United States Patent 8,969,254 (OLIGONUCLEOTIDE ARRAY FOR TISSUE TYPING) - sequence listing, part 7

SEQ ID NO: 144339 - DNA, 36 bp, Artificial Sequence
  Description of Artificial Sequence: Synthetic oligonucleotide
aacacttgttacgagatatcaaagacacgacggtgg

SEQ ID NO: 144340 - DNA, 35 bp, Artificial Sequence
  Description of Artificial Sequence: Synthetic oligonucleotide
acacttgttacgagatatcaaagacacgacggtgg

SEQ ID NO: 144341 - DNA, 34 bp, Artificial Sequence
  Description of Artificial Sequence: Synthetic oligonucleotide
cacttgttacgagatatcaaagacacgacggtgg

SEQ ID NO: 144342 - DNA, 34 bp, Artificial Sequence
  Description of Artificial Sequence: Synthetic oligonucleotide
acttgttacgagatatcaaagacacgacggtggg

SEQ ID NO: 144343 - DNA, 33 bp, Artificial Sequence
  Description of Artificial Sequence: Synthetic oligonucleotide
cttgttacgagatatcaaagacacgacggtggg

SEQ ID NO: 144344 - DNA, 33 bp, Artificial Sequence
  Description of Artificial Sequence: Synthetic oligonucleotide
ttgttacgagatatcaaagacacgacggtgggc

SEQ ID NO: 144345 - DNA, 32 bp, Artificial Sequence
  Description of Artificial Sequence: Synthetic oligonucleotide
tgttacgagatatcaaagacacgacggtgggc

SEQ ID NO: 144346 - DNA, 31 bp, Artificial Sequence
  Description of Artificial Sequence: Synthetic oligonucleotide
gttacgagatatcaaagacacgacggtgggc

SEQ ID NO: 144347 - DNA, 32 bp, Artificial Sequence
  Description of Artificial Sequence: Synthetic oligonucleotide
ttacgagatatcaaagacacgacggtgggcac

SEQ ID NO: 144348 - DNA, 31 bp, Artificial Sequence
  Description of Artificial Sequence: Synthetic oligonucleotide
tacgagatatcaaagacacgacggtgggcac

SEQ ID NO: 144349 - DNA, 30 bp, Artificial Sequence
  Description of Artificial Sequence: Synthetic oligonucleotide
acgagatatcaaagacacgacggtgggcac

SEQ ID NO: 144350 - DNA, 29 bp, Artificial Sequence
  Description of Artificial Sequence: Synthetic oligonucleotide
cgagatatcaaagacacgacggtgggcac

SEQ ID NO: 144351 - DNA, 30 bp, Artificial Sequence
  Description of Artificial Sequence: Synthetic oligonucleotide
gagatatcaaagacacgacggtgggcactc

SEQ ID NO: 144352 - DNA, 31 bp, Artificial Sequence
  Description of Artificial Sequence: Synthetic oligonucleotide
agatatcaaagacacgacggtgggcactctg

SEQ ID NO: 144353 - DNA, 30 bp, Artificial Sequence
  Description of Artificial Sequence: Synthetic oligonucleotide
gatatcaaagacacgacggtgggcactctg

SEQ ID NO: 144354 - DNA, 31 bp, Artificial Sequence
  Description of Artificial Sequence: Synthetic oligonucleotide
atatcaaagacacgacggtgggcactctgtc

SEQ ID NO: 144355 - DNA, 30 bp, Artificial Sequence
  Description of Artificial Sequence: Synthetic oligonucleotide
tatcaaagacacgacggtgggcactctgtc

SEQ ID NO: 144356 - DNA, 29 bp, Artificial Sequence
  Description of Artificial Sequence: Synthetic oligonucleotide
atcaaagacacgacggtgggcactctgtc

SEQ ID NO: 144357 - DNA, 28 bp, Artificial Sequence
  Description of Artificial Sequence: Synthetic oligonucleotide
tcaaagacacgacggtgggcactctgtc

SEQ ID NO: 144358 - DNA, 27 bp, Artificial Sequence
  Description of Artificial Sequence: Synthetic oligonucleotide
caaagacacgacggtgggcactctgtc

SEQ ID NO: 144359 - DNA, 27 bp, Artificial Sequence
  Description of Artificial Sequence: Synthetic oligonucleotide
aaagacacgacggtgggcactctgtcc

SEQ ID NO: 144360 - DNA, 26 bp, Artificial Sequence
  Description of Artificial Sequence: Synthetic oligonucleotide
aagacacgacggtgggcactctgtcc

SEQ ID NO: 144361 - DNA, 25 bp, Artificial Sequence
  Description of Artificial Sequence: Synthetic oligonucleotide
agacacgacggtgggcactctgtcc

SEQ ID NO: 144362 - DNA, 24 bp, Artificial Sequence
  Description of Artificial Sequence: Synthetic oligonucleotide
gacacgacggtgggcactctgtcc

SEQ ID NO: 144363 - DNA, 25 bp, Artificial Sequence
  Description of Artificial Sequence: Synthetic oligonucleotide
acacgacggtgggcactctgtccca

SEQ ID NO: 144364 - DNA, 24 bp, Artificial Sequence
  Description of Artificial Sequence: Synthetic oligonucleotide
cacgacggtgggcactctgtccca

SEQ ID NO: 144365 - DNA, 24 bp, Artificial Sequence
  Description of Artificial Sequence: Synthetic oligonucleotide
acgacggtgggcactctgtcccag

SEQ ID NO: 144366 - DNA, 23 bp, Artificial Sequence
  Description of Artificial Sequence: Synthetic oligonucleotide
cgacggtgggcactctgtcccag

SEQ ID NO: 144367 - DNA, 23 bp, Artificial Sequence
  Description of Artificial Sequence: Synthetic oligonucleotide
gacggtgggcactctgtcccagc

SEQ ID NO: 144368 - DNA, 23 bp, Artificial Sequence
  Description of Artificial Sequence: Synthetic oligonucleotide
acggtgggcactctgtcccagcg

SEQ ID NO: 144369 - DNA, 22 bp, Artificial Sequence
  Description of Artificial Sequence: Synthetic oligonucleotide
cggtgggcactctgtcccagcg

SEQ ID NO: 144370 - DNA, 24 bp, Artificial Sequence
  Description of Artificial Sequence: Synthetic oligonucleotide
ggtgggcactctgtcccagcggat

SEQ ID NO: 144371 - DNA, 25 bp, Artificial Sequence
  Description of Artificial Sequence: Synthetic oligonucleotide
gtgggcactctgtcccagcggatca

SEQ ID NO: 144372 - DNA, 27 bp, Artificial Sequence
  Description of Artificial Sequence: Synthetic oligonucleotide
tgggcactctgtcccagcggatcacaa

SEQ ID NO: 144373 - DNA, 27 bp, Artificial Sequence
  Description of Artificial Sequence: Synthetic oligonucleotide
gggcactctgtcccagcggatcacaaa

SEQ ID NO: 144374 - DNA, 27 bp, Artificial Sequence
  Description of Artificial Sequence: Synthetic oligonucleotide
ggcactctgtcccagcggatcacaaac

SEQ ID NO: 144375 - DNA, 27 bp, Artificial Sequence
  Description of Artificial Sequence: Synthetic oligonucleotide
gcactctgtcccagcggatcacaaacc

SEQ ID NO: 144376 - DNA, 28 bp, Artificial Sequence
  Description of Artificial Sequence: Synthetic oligonucleotide
cactctgtcccagcggatcacaaaccag

SEQ ID NO: 144377 - DNA, 28 bp, Artificial Sequence
  Description of Artificial Sequence: Synthetic oligonucleotide
actctgtcccagcggatcacaaaccagg

SEQ ID NO: 144378 - DNA, 27 bp, Artificial Sequence
  Description of Artificial Sequence: Synthetic oligonucleotide
ctctgtcccagcggatcacaaaccagg

SEQ ID NO: 144379 - DNA, 28 bp, Artificial Sequence
  Description of Artificial Sequence: Synthetic oligonucleotide
tctgtcccagcggatcacaaaccaggtc

SEQ ID NO: 144380 - DNA, 27 bp, Artificial Sequence
  Description of Artificial Sequence: Synthetic oligonucleotide
ctgtcccagcggatcacaaaccaggtc

SEQ ID NO: 144381 - DNA, 27 bp, Artificial Sequence
  Description of Artificial Sequence: Synthetic oligonucleotide
tgtcccagcggatcacaaaccaggtcc

SEQ ID NO: 144382 - DNA, 27 bp, Artificial Sequence
  Description of Artificial Sequence: Synthetic oligonucleotide
gtcccagcggatcacaaaccaggtcca

SEQ ID NO: 144383 - DNA, 28 bp, Artificial Sequence
  Description of Artificial Sequence: Synthetic oligonucleotide
tcccagcggatcacaaaccaggtccatg

SEQ ID NO: 144384 - DNA, 27 bp, Artificial Sequence
  Description of Artificial Sequence: Synthetic oligonucleotide
cccagcggatcacaaaccaggtccatg

SEQ ID NO: 144385 - DNA, 27 bp, Artificial Sequence
  Description of Artificial Sequence: Synthetic oligonucleotide
ccagcggatcacaaaccaggtccatgg

SEQ ID NO: 144386 - DNA, 30 bp, Artificial Sequence
  Description of Artificial Sequence: Synthetic oligonucleotide
cagcggatcacaaaccaggtccatggtttg

SEQ ID NO: 144387 - DNA, 32 bp, Artificial Sequence
  Description of Artificial Sequence: Synthetic oligonucleotide
agcggatcacaaaccaggtccatggtttgaag

SEQ ID NO: 144388 - DNA, 31 bp, Artificial Sequence
  Description of Artificial Sequence: Synthetic oligonucleotide
gcggatcacaaaccaggtccatggtttgaag

SEQ ID NO: 144389 - DNA, 31 bp, Artificial Sequence
  Description of Artificial Sequence: Synthetic oligonucleotide
cggatcacaaaccaggtccatggtttgaagg

SEQ ID NO: 144390 - DNA, 31 bp, Artificial Sequence
  Description of Artificial Sequence: Synthetic oligonucleotide
ggatcacaaaccaggtccatggtttgaaggg

SEQ ID NO: 144391 - DNA, 32 bp, Artificial Sequence
  Description of Artificial Sequence: Synthetic oligonucleotide
gatcacaaaccaggtccatggtttgaagggac

SEQ ID NO: 144392 - DNA, 33 bp, Artificial Sequence
  Description of Artificial Sequence: Synthetic oligonucleotide
atcacaaaccaggtccatggtttgaagggactg

SEQ ID NO: 144393 - DNA, 32 bp, Artificial Sequence
  Description of Artificial Sequence: Synthetic oligonucleotide
tcacaaaccaggtccatggtttgaagggactg

SEQ ID NO: 144394 - DNA, 31 bp, Artificial Sequence
  Description of Artificial Sequence: Synthetic oligonucleotide
cacaaaccaggtccatggtttgaagggactg

SEQ ID NO: 144395 - DNA, 33 bp, Artificial Sequence
  Description of Artificial Sequence: Synthetic oligonucleotide
acaaaccaggtccatggtttgaagggactgaac

SEQ ID NO: 144396 - DNA, 32 bp, Artificial Sequence
  Description of Artificial Sequence: Synthetic oligonucleotide
caaaccaggtccatggtttgaagggactgaac

SEQ ID NO: 144397 - DNA, 33 bp, Artificial Sequence
  Description of Artificial Sequence: Synthetic oligonucleotide
aaaccaggtccatggtttgaagggactgaactc

SEQ ID NO: 144398 - DNA, 32 bp, Artificial Sequence
  Description of Artificial Sequence: Synthetic oligonucleotide
aaccaggtccatggtttgaagggactgaactc

SEQ ID NO: 144399 - DNA, 31 bp, Artificial Sequence
  Description of Artificial Sequence: Synthetic oligonucleotide
accaggtccatggtttgaagggactgaactc

SEQ ID NO: 144400 - DNA, 30 bp, Artificial Sequence
  Description of Artificial Sequence: Synthetic oligonucleotide
ccaggtccatggtttgaagggactgaactc

SEQ ID NO: 144401 - DNA, 30 bp, Artificial Sequence
  Description of Artificial Sequence: Synthetic oligonucleotide
caggtccatggtttgaagggactgaactcc

SEQ ID NO: 144402 - DNA, 32 bp, Artificial Sequence
  Description of Artificial Sequence: Synthetic oligonucleotide
aggtccatggtttgaagggactgaactccaag

SEQ ID NO: 144403 - DNA, 31 bp, Artificial Sequence
  Description of Artificial Sequence: Synthetic oligonucleotide
ggtccatggtttgaagggactgaactccaag

SEQ ID NO: 144404 - DNA, 31 bp, Artificial Sequence
  Description of Artificial Sequence: Synthetic oligonucleotide
gtccatggtttgaagggactgaactccaagc

SEQ ID NO: 144405 - DNA, 33 bp, Artificial Sequence
  Description of Artificial Sequence: Synthetic oligonucleotide
tccatggtttgaagggactgaactccaagcttc

SEQ ID NO: 144406 - DNA, 32 bp, Artificial Sequence
  Description of Artificial Sequence: Synthetic oligonucleotide
ccatggtttgaagggactgaactccaagcttc

SEQ ID NO: 144407 - DNA, 33 bp, Artificial Sequence
  Description of Artificial Sequence: Synthetic oligonucleotide
catggtttgaagggactgaactccaagcttctg

SEQ ID NO: 144408 - DNA, 33 bp, Artificial Sequence
  Description of Artificial Sequence: Synthetic oligonucleotide
atggtttgaagggactgaactccaagcttctgg

SEQ ID NO: 144409 - DNA, 32 bp, Artificial Sequence
  Description of Artificial Sequence: Synthetic oligonucleotide
tggtttgaagggactgaactccaagcttctgg

SEQ ID NO: 144410 - DNA, 31 bp, Artificial Sequence
  Description of Artificial Sequence: Synthetic oligonucleotide
ggtttgaagggactgaactccaagcttctgg

SEQ ID NO: 144411 - DNA, 35 bp, Artificial Sequence
  Description of Artificial Sequence: Synthetic oligonucleotide
gtttgaagggactgaactccaagcttctggatatc

SEQ ID NO: 144412 - DNA, 36 bp, Artificial Sequence
  Description of Artificial Sequence: Synthetic oligonucleotide
tttgaagggactgaactccaagcttctggatatcag

SEQ ID NO: 144413 - DNA, 35 bp, Artificial Sequence
  Description of Artificial Sequence: Synthetic oligonucleotide
ttgaagggactgaactccaagcttctggatatcag

SEQ ID NO: 144414 - DNA, 34 bp, Artificial Sequence
  Description of Artificial Sequence: Synthetic oligonucleotide
tgaagggactgaactccaagcttctggatatcag

SEQ ID NO: 144415 - DNA, 33 bp, Artificial Sequence
  Description of Artificial Sequence: Synthetic oligonucleotide
gaagggactgaactccaagcttctggatatcag

SEQ ID NO: 144416 - DNA, 33 bp, Artificial Sequence
  Description of Artificial Sequence: Synthetic oligonucleotide
aagggactgaactccaagcttctggatatcagg

SEQ ID NO: 144417 - DNA, 32 bp, Artificial Sequence
  Description of Artificial Sequence: Synthetic oligonucleotide
agggactgaactccaagcttctggatatcagg

SEQ ID NO: 144418 - DNA, 31 bp, Artificial Sequence
  Description of Artificial Sequence: Synthetic oligonucleotide
gggactgaactccaagcttctggatatcagg

SEQ ID NO: 144419 - DNA, 32 bp, Artificial Sequence
  Description of Artificial Sequence: Synthetic oligonucleotide
ggactgaactccaagcttctggatatcaggag

SEQ ID NO: 144420 - DNA, 32 bp, Artificial Sequence
  Description of Artificial Sequence: Synthetic oligonucleotide
gactgaactccaagcttctggatatcaggagc

SEQ ID NO: 144421 - DNA, 34 bp, Artificial Sequence
  Description of Artificial Sequence: Synthetic oligonucleotide
actgaactccaagcttctggatatcaggagctac

SEQ ID NO: 144422 - DNA, 33 bp, Artificial Sequence
  Description of Artificial Sequence: Synthetic oligonucleotide
ctgaactccaagcttctggatatcaggagctac

SEQ ID NO: 144423 - DNA, 33 bp, Artificial Sequence
  Description of Artificial Sequence: Synthetic oligonucleotide
tgaactccaagcttctggatatcaggagctacc

SEQ ID NO: 144424 - DNA, 32 bp, Artificial Sequence
  Description of Artificial Sequence: Synthetic oligonucleotide
gaactccaagcttctggatatcaggagctacc

SEQ ID NO: 144425 - DNA, 33 bp, Artificial Sequence
  Description of Artificial Sequence: Synthetic oligonucleotide
aactccaagcttctggatatcaggagctacctg

SEQ ID NO: 144426 - DNA, 32 bp, Artificial Sequence
  Description of Artificial Sequence: Synthetic oligonucleotide
actccaagcttctggatatcaggagctacctg

SEQ ID NO: 144427 - DNA, 31 bp, Artificial Sequence
  Description of Artificial Sequence: Synthetic oligonucleotide
ctccaagcttctggatatcaggagctacctg

SEQ ID NO: 144428 - DNA, 31 bp, Artificial Sequence
  Description of Artificial Sequence: Synthetic oligonucleotide
tccaagcttctggatatcaggagctacctgg

SEQ ID NO: 144429 - DNA, 30 bp, Artificial Sequence
  Description of Artificial Sequence: Synthetic oligonucleotide
ccaagcttctggatatcaggagctacctgg

SEQ ID NO: 144430 - DNA, 35 bp, Artificial Sequence
  Description of Artificial Sequence: Synthetic oligonucleotide
caagcttctggatatcaggagctacctggaaaaag

SEQ ID NO: 144431 - DNA, 36 bp, Artificial Sequence
  Description of Artificial Sequence: Synthetic oligonucleotide
aagcttctggatatcaggagctacctggaaaaagtc

SEQ ID NO: 144432 - DNA, 35 bp, Artificial Sequence
  Description of Artificial Sequence: Synthetic oligonucleotide
agcttctggatatcaggagctacctggaaaaagtc

SEQ ID NO: 144433 - DNA, 34 bp, Artificial Sequence
  Description of Artificial Sequence: Synthetic oligonucleotide
gcttctggatatcaggagctacctggaaaaagtc

SEQ ID NO: 144434 - DNA, 34 bp, Artificial Sequence
  Description of Artificial Sequence: Synthetic oligonucleotide
cttctggatatcaggagctacctggaaaaagtcg

SEQ ID NO: 144435 - DNA, 34 bp, Artificial Sequence
  Description of Artificial Sequence: Synthetic oligonucleotide
ttctggatatcaggagctacctggaaaaagtcgc

SEQ ID NO: 144436 - DNA, 33 bp, Artificial Sequence
  Description of Artificial Sequence: Synthetic oligonucleotide
tctggatatcaggagctacctggaaaaagtcgc

SEQ ID NO: 144437 - DNA, 32 bp, Artificial Sequence
  Description of Artificial Sequence: Synthetic oligonucleotide
ctggatatcaggagctacctggaaaaagtcgc

SEQ ID NO: 144438 - DNA, 32 bp, Artificial Sequence
  Description of Artificial Sequence: Synthetic oligonucleotide
tggatatcaggagctacctggaaaaagtcgcc

SEQ ID NO: 144439 - DNA, 31 bp, Artificial Sequence
  Description of Artificial Sequence: Synthetic oligonucleotide
ggatatcaggagctacctggaaaaagtcgcc

SEQ ID NO: 144440 - DNA, 32 bp, Artificial Sequence
  Description of Artificial Sequence: Synthetic oligonucleotide
gatatcaggagctacctggaaaaagtcgccac

SEQ ID NO: 144441 - DNA, 33 bp, Artificial Sequence
  Description of Artificial Sequence: Synthetic oligonucleotide
atatcaggagctacctggaaaaagtcgccacag

SEQ ID NO: 144442 - DNA, 32 bp, Artificial Sequence
  Description of Artificial Sequence: Synthetic oligonucleotide
tatcaggagctacctggaaaaagtcgccacag

SEQ ID NO: 144443 - DNA, 31 bp, Artificial Sequence
  Description of Artificial Sequence: Synthetic oligonucleotide
atcaggagctacctggaaaaagtcgccacag

SEQ ID NO: 144444 - DNA, 30 bp, Artificial Sequence
  Description of Artificial Sequence: Synthetic oligonucleotide
tcaggagctacctggaaaaagtcgccacag

SEQ ID NO: 144445 - DNA, 29 bp, Artificial Sequence
  Description of Artificial Sequence: Synthetic oligonucleotide
caggagctacctggaaaaagtcgccacag

SEQ ID NO: 144446 - DNA, 29 bp, Artificial Sequence
  Description of Artificial Sequence: Synthetic oligonucleotide
aggagctacctggaaaaagtcgccacagg

SEQ ID NO: 144447 - DNA, 28 bp, Artificial Sequence
  Description of Artificial Sequence: Synthetic oligonucleotide
ggagctacctggaaaaagtcgccacagg

SEQ ID NO: 144448 - DNA, 28 bp, Artificial Sequence
  Description of Artificial Sequence: Synthetic oligonucleotide
gagctacctggaaaaagtcgccacaggc

SEQ ID NO: 144449 - DNA, 30 bp, Artificial Sequence
  Description of Artificial Sequence: Synthetic oligonucleotide
agctacctggaaaaagtcgccacaggcaag

SEQ ID NO: 144450 - DNA, 29 bp, Artificial Sequence
  Description of Artificial Sequence: Synthetic oligonucleotide
gctacctggaaaaagtcgccacaggcaag

SEQ ID NO: 144451 - DNA, 29 bp, Artificial Sequence
  Description of Artificial Sequence: Synthetic oligonucleotide
ctacctggaaaaagtcgccacaggcaagc

SEQ ID NO: 144452 - DNA, 30 bp, Artificial Sequence
  Description of Artificial Sequence: Synthetic oligonucleotide
tacctggaaaaagtcgccacaggcaagctg

SEQ ID NO: 144453 - DNA, 29 bp, Artificial Sequence
  Description of Artificial Sequence: Synthetic oligonucleotide
acctggaaaaagtcgccacaggcaagctg

SEQ ID NO: 144454 - DNA, 28 bp, Artificial Sequence
  Description of Artificial Sequence: Synthetic oligonucleotide
cctggaaaaagtcgccacaggcaagctg

SEQ ID NO: 144455 - DNA, 28 bp, Artificial Sequence
  Description of Artificial Sequence: Synthetic oligonucleotide
ctggaaaaagtcgccacaggcaagctgc

SEQ ID NO: 144456 - DNA, 28 bp, Artificial Sequence
  Description of Artificial Sequence: Synthetic oligonucleotide
tggaaaaagtcgccacaggcaagctgcc

SEQ ID NO: 144457 - DNA, 27 bp, Artificial Sequence
  Description of Artificial Sequence: Synthetic oligonucleotide
ggaaaaagtcgccacaggcaagctgcc

SEQ ID NO: 144458 - DNA, 27 bp, Artificial Sequence
  Description of Artificial Sequence: Synthetic oligonucleotide
gaaaaagtcgccacaggcaagctgccc

SEQ ID NO: 144459 - DNA, 29 bp, Artificial Sequence
  Description of Artificial Sequence: Synthetic oligonucleotide
aaaaagtcgccacaggcaagctgcccatc

SEQ ID NO: 144460 - DNA, 28 bp, Artificial Sequence
  Description of Artificial Sequence: Synthetic oligonucleotide
aaaagtcgccacaggcaagctgcccatc

SEQ ID NO: 144461 - DNA, 27 bp, Artificial Sequence
  Description of Artificial Sequence: Synthetic oligonucleotide
aaagtcgccacaggcaagctgcccatc

SEQ ID NO: 144462 - DNA, 27 bp, Artificial Sequence
  Description of Artificial Sequence: Synthetic oligonucleotide
aagtcgccacaggcaagctgcccatca

SEQ ID NO: 144463 - DNA, 27 bp, Artificial Sequence
  Description of Artificial Sequence: Synthetic oligonucleotide
agtcgccacaggcaagctgcccatcaa

SEQ ID NO: 144464 - DNA, 26 bp, Artificial Sequence
  Description of Artificial Sequence: Synthetic oligonucleotide
gtcgccacaggcaagctgcccatcaa

SEQ ID NO: 144465 - DNA, 26 bp, Artificial Sequence
  Description of Artificial Sequence: Synthetic oligonucleotide
tcgccacaggcaagctgcccatcaac

SEQ ID NO: 144466 - DNA, 25 bp, Artificial Sequence
  Description of Artificial Sequence: Synthetic oligonucleotide
cgccacaggcaagctgcccatcaac

SEQ ID NO: 144467 - DNA, 26 bp, Artificial Sequence
  Description of Artificial Sequence: Synthetic oligonucleotide
gccacaggcaagctgcccatcaacca

SEQ ID NO: 144468 - DNA, 26 bp, Artificial Sequence
  Description of Artificial Sequence: Synthetic oligonucleotide
ccacaggcaagctgcccatcaaccac

SEQ ID NO: 144469 - DNA, 27 bp, Artificial Sequence
  Description of Artificial Sequence: Synthetic oligonucleotide
cacaggcaagctgcccatcaaccacca

SEQ ID NO: 144470 - DNA, 27 bp, Artificial Sequence
  Description of Artificial Sequence: Synthetic oligonucleotide
acaggcaagctgcccatcaaccaccag

SEQ ID NO: 144471 - DNA, 27 bp, Artificial Sequence
  Description of Artificial Sequence: Synthetic oligonucleotide
caggcaagctgcccatcaaccaccaga

SEQ ID NO: 144472 - DNA, 28 bp, Artificial Sequence
  Description of Artificial Sequence: Synthetic oligonucleotide
aggcaagctgcccatcaaccaccagatc

SEQ ID NO: 144473 - DNA, 27 bp, Artificial Sequence
  Description of Artificial Sequence: Synthetic oligonucleotide
ggcaagctgcccatcaaccaccagatc

SEQ ID NO: 144474 - DNA, 29 bp, Artificial Sequence
  Description of Artificial Sequence: Synthetic oligonucleotide
gcaagctgcccatcaaccaccagatcatc

SEQ ID NO: 144475 - DNA, 31 bp, Artificial Sequence
  Description of Artificial Sequence: Synthetic oligonucleotide
caagctgcccatcaaccaccagatcatctac

SEQ ID NO: 144476 - DNA, 31 bp, Artificial Sequence
  Description of Artificial Sequence: Synthetic oligonucleotide
aagctgcccatcaaccaccagatcatctacc

SEQ ID NO: 144477 - DNA, 30 bp, Artificial Sequence
  Description of Artificial Sequence: Synthetic oligonucleotide
agctgcccatcaaccaccagatcatctacc

SEQ ID NO: 144478 - DNA, 29 bp, Artificial Sequence
  Description of Artificial Sequence: Synthetic oligonucleotide
gctgcccatcaaccaccagatcatctacc

SEQ ID NO: 144479 - DNA, 30 bp, Artificial Sequence
  Description of Artificial Sequence: Synthetic oligonucleotide
ctgcccatcaaccaccagatcatctaccag

SEQ ID NO: 144480 - DNA, 30 bp, Artificial Sequence
  Description of Artificial Sequence: Synthetic oligonucleotide
tgcccatcaaccaccagatcatctaccagc

SEQ ID NO: 144481 - DNA, 29 bp, Artificial Sequence
  Description of Artificial Sequence: Synthetic oligonucleotide
gcccatcaaccaccagatcatctaccagc

SEQ ID NO: 144482 - DNA, 30 bp, Artificial Sequence
  Description of Artificial Sequence: Synthetic oligonucleotide
cccatcaaccaccagatcatctaccagctg

SEQ ID NO: 144483 - DNA, 30 bp, Artificial Sequence
  Description of Artificial Sequence: Synthetic oligonucleotide
ccatcaaccaccagatcatctaccagctgc

SEQ ID NO: 144484 - DNA, 31 bp, Artificial Sequence
  Description of Artificial Sequence: Synthetic oligonucleotide
catcaaccaccagatcatctaccagctgcag

SEQ ID NO: 144485 - DNA, 31 bp, Artificial Sequence
  Description of Artificial Sequence: Synthetic oligonucleotide
atcaaccaccagatcatctaccagctgcagg

SEQ ID NO: 144486 - DNA, 30 bp, Artificial Sequence
  Description of Artificial Sequence: Synthetic oligonucleotide
tcaaccaccagatcatctaccagctgcagg

SEQ ID NO: 144487 - DNA, 29 bp, Artificial Sequence
  Description of Artificial Sequence: Synthetic oligonucleotide
caaccaccagatcatctaccagctgcagg

SEQ ID NO: 144488 - DNA, 30 bp, Artificial Sequence
  Description of Artificial Sequence: Synthetic oligonucleotide
aaccaccagatcatctaccagctgcaggac

SEQ ID NO: 144489 - DNA, 29 bp, Artificial Sequence
  Description of Artificial Sequence: Synthetic oligonucleotide
accaccagatcatctaccagctgcaggac

SEQ ID NO: 144490 - DNA, 28 bp, Artificial Sequence
  Description of Artificial Sequence: Synthetic oligonucleotide
ccaccagatcatctaccagctgcaggac

SEQ ID NO: 144491 - DNA, 28 bp, Artificial Sequence
  Description of Artificial Sequence: Synthetic oligonucleotide
caccagatcatctaccagctgcaggacg

SEQ ID NO: 144492 - DNA, 29 bp, Artificial Sequence
  Description of Artificial Sequence: Synthetic oligonucleotide
accagatcatctaccagctgcaggacgtc

SEQ ID NO: 144493 - DNA, 28 bp, Artificial Sequence
  Description of Artificial Sequence: Synthetic oligonucleotide
ccagatcatctaccagctgcaggacgtc

SEQ ID NO: 144494 - DNA, 30 bp, Artificial Sequence
  Description of Artificial Sequence: Synthetic oligonucleotide
cagatcatctaccagctgcaggacgtcttc

SEQ ID NO: 144495 - DNA, 32 bp, Artificial Sequence
  Description of Artificial Sequence: Synthetic oligonucleotide
agatcatctaccagctgcaggacgtcttcaac

SEQ ID NO: 144496 - DNA, 31 bp, Artificial Sequence
  Description of Artificial Sequence: Synthetic oligonucleotide
gatcatctaccagctgcaggacgtcttcaac

SEQ ID NO: 144497 - DNA, 31 bp, Artificial Sequence
  Description of Artificial Sequence: Synthetic oligonucleotide
atcatctaccagctgcaggacgtcttcaacc

SEQ ID NO: 144498 - DNA, 30 bp, Artificial Sequence
  Description of Artificial Sequence: Synthetic oligonucleotide
tcatctaccagctgcaggacgtcttcaacc

SEQ ID NO: 144499 - DNA, 29 bp, Artificial Sequence
  Description of Artificial Sequence: Synthetic oligonucleotide
catctaccagctgcaggacgtcttcaacc

SEQ ID NO: 144500 - DNA, 30 bp, Artificial Sequence
  Description of Artificial Sequence: Synthetic oligonucleotide
atctaccagctgcaggacgtcttcaacctg

SEQ ID NO: 144501 - DNA, 29 bp, Artificial Sequence
  Description of Artificial Sequence: Synthetic oligonucleotide
tctaccagctgcaggacgtcttcaacctg

SEQ ID NO: 144502 - DNA, 28 bp, Artificial Sequence
  Description of Artificial Sequence: Synthetic oligonucleotide
ctaccagctgcaggacgtcttcaacctg

SEQ ID NO: 144503 - DNA, 28 bp, Artificial Sequence
  Description of Artificial Sequence: Synthetic oligonucleotide
taccagctgcaggacgtcttcaacctgc

SEQ ID NO: 144504 - DNA, 27 bp, Artificial Sequence
  Description of Artificial Sequence: Synthetic oligonucleotide
accagctgcaggacgtcttcaacctgc

SEQ ID NO: 144505 - DNA, 27 bp, Artificial Sequence
  Description of Artificial Sequence: Synthetic oligonucleotide
ccagctgcaggacgtcttcaacctgct

SEQ ID NO: 144506 - DNA, 27 bp, Artificial Sequence
  Description of Artificial Sequence: Synthetic oligonucleotide
cagctgcaggacgtcttcaacctgctg

SEQ ID NO: 144507 - DNA, 27 bp, Artificial Sequence
  Description of Artificial Sequence: Synthetic oligonucleotide
agctgcaggacgtcttcaacctgctgc

SEQ ID NO: 144508 - DNA, 26 bp, Artificial Sequence
  Description of Artificial Sequence: Synthetic oligonucleotide
gctgcaggacgtcttcaacctgctgc

SEQ ID NO: 144509 - DNA, 27 bp, Artificial Sequence
  Description of Artificial Sequence: Synthetic oligonucleotide
ctgcaggacgtcttcaacctgctgcca

SEQ ID NO: 144510 - DNA, 27 bp, Artificial Sequence
  Description of Artificial Sequence: Synthetic oligonucleotide
tgcaggacgtcttcaacctgctgccag

SEQ ID NO: 144511 - DNA, 27 bp, Artificial Sequence
  Description of Artificial Sequence: Synthetic oligonucleotide
gcaggacgtcttcaacctgctgccaga

SEQ ID NO: 144512 - DNA, 28 bp, Artificial Sequence
  Description of Artificial Sequence: Synthetic oligonucleotide
caggacgtcttcaacctgctgccagatg

SEQ ID NO: 144513 - DNA, 29 bp, Artificial Sequence
  Description of Artificial Sequence: Synthetic oligonucleotide
aggacgtcttcaacctgctgccagatgtc

SEQ ID NO: 144514 - DNA, 28 bp, Artificial Sequence
  Description of Artificial Sequence: Synthetic oligonucleotide
ggacgtcttcaacctgctgccagatgtc

SEQ ID NO: 144515 - DNA, 29 bp, Artificial Sequence
  Description of Artificial Sequence: Synthetic oligonucleotide
gacgtcttcaacctgctgccagatgtcag

SEQ ID NO: 144516 - DNA, 29 bp, Artificial Sequence
  Description of Artificial Sequence: Synthetic oligonucleotide
acgtcttcaacctgctgccagatgtcagc

SEQ ID NO: 144517 - DNA, 28 bp, Artificial Sequence
  Description of Artificial Sequence: Synthetic oligonucleotide
cgtcttcaacctgctgccagatgtcagc

SEQ ID NO: 144518 - DNA, 28 bp, Artificial Sequence
  Description of Artificial Sequence: Synthetic oligonucleotide
gtcttcaacctgctgccagatgtcagcc

SEQ ID NO: 144519 - DNA, 29 bp, Artificial Sequence
  Description of Artificial Sequence: Synthetic oligonucleotide
tcttcaacctgctgccagatgtcagcctg

SEQ ID NO: 144520 - DNA, 28 bp, Artificial Sequence
  Description of Artificial Sequence: Synthetic oligonucleotide
cttcaacctgctgccagatgtcagcctg

SEQ ID NO: 144521 - DNA, 28 bp, Artificial Sequence
  Description of Artificial Sequence: Synthetic oligonucleotide
ttcaacctgctgccagatgtcagcctgc

SEQ ID NO: 144522 - DNA, 27 bp, Artificial Sequence
  Description of Artificial Sequence: Synthetic oligonucleotide
tcaacctgctgccagatgtcagcctgc

SEQ ID NO: 144523 - DNA, 27 bp, Artificial Sequence
  Description of Artificial Sequence: Synthetic oligonucleotide
caacctgctgccagatgtcagcctgca

SEQ ID NO: 144524 - DNA, 27 bp, Artificial Sequence
  Description of Artificial Sequence: Synthetic oligonucleotide
aacctgctgccagatgtcagcctgcag

SEQ ID NO: 144525 - DNA, 26 bp, Artificial Sequence
  Description of Artificial Sequence: Synthetic oligonucleotide
acctgctgccagatgtcagcctgcag

SEQ ID NO: 144526 - DNA, 25 bp, Artificial Sequence
  Description of Artificial Sequence: Synthetic oligonucleotide
cctgctgccagatgtcagcctgcag

SEQ ID NO: 144527 - DNA, 26 bp, Artificial Sequence
  Description of Artificial Sequence: Synthetic oligonucleotide
ctgctgccagatgtcagcctgcagga

SEQ ID NO: 144528 - DNA, 27 bp, Artificial Sequence
  Description of Artificial Sequence: Synthetic oligonucleotide
tgctgccagatgtcagcctgcaggagt

SEQ ID NO: 144529 - DNA, 27 bp, Artificial Sequence
  Description of Artificial Sequence: Synthetic oligonucleotide
gctgccagatgtcagcctgcaggagtt

SEQ ID NO: 144530 - DNA, 27 bp, Artificial Sequence
  Description of Artificial Sequence: Synthetic oligonucleotide
ctgccagatgtcagcctgcaggagttc

SEQ ID NO: 144531 - DNA, 27 bp, Artificial Sequence
  Description of Artificial Sequence: Synthetic oligonucleotide
tgccagatgtcagcctgcaggagttcg

SEQ ID NO: 144532 - DNA, 27 bp, Artificial Sequence
  Description of Artificial Sequence: Synthetic oligonucleotide
gccagatgtcagcctgcaggagttcgt

SEQ ID NO: 144533 - DNA, 27 bp, Artificial Sequence
  Description of Artificial Sequence: Synthetic oligonucleotide
ccagatgtcagcctgcaggagttcgtc

SEQ ID NO: 144534 - DNA, 29 bp, Artificial Sequence
  Description of Artificial Sequence: Synthetic oligonucleotide
cagatgtcagcctgcaggagttcgtcaag

SEQ ID NO: 144535 - DNA, 29 bp, Artificial Sequence
  Description of Artificial Sequence: Synthetic oligonucleotide
agatgtcagcctgcaggagttcgtcaagg

SEQ ID NO: 144536 - DNA, 28 bp, Artificial Sequence
  Description of Artificial Sequence: Synthetic oligonucleotide
gatgtcagcctgcaggagttcgtcaagg

SEQ ID NO: 144537 - DNA, 28 bp, Artificial Sequence
  Description of Artificial Sequence: Synthetic oligonucleotide
atgtcagcctgcaggagttcgtcaaggc

SEQ ID NO: 144538 - DNA, 27 bp, Artificial Sequence
  Description of Artificial Sequence: Synthetic oligonucleotide
tgtcagcctgcaggagttcgtcaaggc

SEQ ID NO: 144539 - DNA, 26 bp, Artificial Sequence
  Description of Artificial Sequence: Synthetic oligonucleotide
gtcagcctgcaggagttcgtcaaggc

SEQ ID NO: 144540 - DNA, 27 bp, Artificial Sequence
  Description of Artificial Sequence: Synthetic oligonucleotide
tcagcctgcaggagttcgtcaaggcct

SEQ ID NO: 144541 - DNA, 27 bp, Artificial Sequence
  Description of Artificial Sequence: Synthetic oligonucleotide
cagcctgcaggagttcgtcaaggcctt

SEQ ID NO: 144542 - DNA, 30 bp, Artificial Sequence
  Description of Artificial Sequence: Synthetic oligonucleotide
agcctgcaggagttcgtcaaggccttttac

SEQ ID NO: 144543 - DNA, 29 bp, Artificial Sequence
  Description of Artificial Sequence: Synthetic oligonucleotide
gcctgcaggagttcgtcaaggccttttac

SEQ ID NO: 144544 - DNA, 29 bp, Artificial Sequence
  Description of Artificial Sequence: Synthetic oligonucleotide
cctgcaggagttcgtcaaggccttttacc

SEQ ID NO: 144545 - DNA, 30 bp, Artificial Sequence
  Description of Artificial Sequence: Synthetic oligonucleotide
ctgcaggagttcgtcaaggccttttacctg

SEQ ID NO: 144546 - DNA, 32 bp, Artificial Sequence
  Description of Artificial Sequence: Synthetic oligonucleotide
tgcaggagttcgtcaaggccttttacctgaag

SEQ ID NO: 144547 - DNA, 31 bp, Artificial Sequence
  Description of Artificial Sequence: Synthetic oligonucleotide
gcaggagttcgtcaaggccttttacctgaag

SEQ ID NO: 144548 - DNA, 32 bp, Artificial Sequence
  Description of Artificial Sequence: Synthetic oligonucleotide
caggagttcgtcaaggccttttacctgaagac

SEQ ID NO: 144549 - DNA, 32 bp, Artificial Sequence
  Description of Artificial Sequence: Synthetic oligonucleotide
aggagttcgtcaaggccttttacctgaagacc

SEQ ID NO: 144550 - DNA, 31 bp, Artificial Sequence
  Description of Artificial Sequence: Synthetic oligonucleotide
ggagttcgtcaaggccttttacctgaagacc

SEQ ID NO: 144551 - DNA, 34 bp, Artificial Sequence
  Description of Artificial Sequence: Synthetic oligonucleotide
gagttcgtcaaggccttttacctgaagaccaatg

SEQ ID NO: 144552 - DNA, 35 bp, Artificial Sequence
  Description of Artificial Sequence: Synthetic oligonucleotide
agttcgtcaaggccttttacctgaagaccaatgac

SEQ ID NO: 144553 - DNA, 34 bp, Artificial Sequence
  Description of Artificial Sequence: Synthetic oligonucleotide
gttcgtcaaggccttttacctgaagaccaatgac

SEQ ID NO: 144554 - DNA, 34 bp, Artificial Sequence
  Description of Artificial Sequence: Synthetic oligonucleotide
ttcgtcaaggccttttacctgaagaccaatgacc

SEQ ID NO: 144555 - DNA, 33 bp, Artificial Sequence
  Description of Artificial Sequence: Synthetic oligonucleotide
tcgtcaaggccttttacctgaagaccaatgacc

SEQ ID NO: 144556 - DNA, 32 bp, Artificial Sequence
  Description of Artificial Sequence: Synthetic oligonucleotide
cgtcaaggccttttacctgaagaccaatgacc

SEQ ID NO: 144557 - DNA, 33 bp, Artificial Sequence
  Description of Artificial Sequence: Synthetic oligonucleotide
gtcaaggccttttacctgaagaccaatgaccag

SEQ ID NO: 144558 - DNA, 35 bp, Artificial Sequence
  Description of Artificial Sequence: Synthetic oligonucleotide
tcaaggccttttacctgaagaccaatgaccagatg

SEQ ID NO: 144559 - DNA, 34 bp, Artificial Sequence
  Description of Artificial Sequence: Synthetic oligonucleotide
caaggccttttacctgaagaccaatgaccagatg

SEQ ID NO: 144560 - DNA, 34 bp, Artificial Sequence
  Description of Artificial Sequence: Synthetic oligonucleotide
aaggccttttacctgaagaccaatgaccagatgg

SEQ ID NO: 144561 - DNA, 33 bp, Artificial Sequence
  Description of Artificial Sequence: Synthetic oligonucleotide
aggccttttacctgaagaccaatgaccagatgg

SEQ ID NO: 144562 - DNA, 32 bp, Artificial Sequence
  Description of Artificial Sequence: Synthetic oligonucleotide
ggccttttacctgaagaccaatgaccagatgg

SEQ ID NO: 144563 - DNA, 33 bp, Artificial Sequence
  Description of Artificial Sequence: Synthetic oligonucleotide
gccttttacctgaagaccaatgaccagatggtg

SEQ ID NO: 144564 - DNA, 33 bp, Artificial Sequence
  Description of Artificial Sequence: Synthetic oligonucleotide
ccttttacctgaagaccaatgaccagatggtgg

SEQ ID NO: 144565 - DNA, 35 bp, Artificial Sequence
  Description of Artificial Sequence: Synthetic oligonucleotide
cttttacctgaagaccaatgaccagatggtggtag

SEQ ID NO: 144566 - DNA, 36 bp, Artificial Sequence
  Description of Artificial Sequence: Synthetic oligonucleotide
ttttacctgaagaccaatgaccagatggtggtagtg

SEQ ID NO: 144567 - DNA, 35 bp, Artificial Sequence
  Description of Artificial Sequence: Synthetic oligonucleotide
tttacctgaagaccaatgaccagatggtggtagtg

SEQ ID NO: 144568 - DNA, 34 bp, Artificial Sequence
  Description of Artificial Sequence: Synthetic oligonucleotide
ttacctgaagaccaatgaccagatggtggtagtg

SEQ ID NO: 144569 - DNA, 33 bp, Artificial Sequence
  Description of Artificial Sequence: Synthetic oligonucleotide
tacctgaagaccaatgaccagatggtggtagtg

SEQ ID NO: 144570 - DNA, 32 bp, Artificial Sequence
  Description of Artificial Sequence: Synthetic oligonucleotide
acctgaagaccaatgaccagatggtggtagtg

SEQ ID NO: 144571 - DNA, 31 bp, Artificial Sequence
  Description of Artificial Sequence: Synthetic oligonucleotide
cctgaagaccaatgaccagatggtggtagtg

SEQ ID NO: 144572 - DNA, 33 bp, Artificial Sequence
  Description of Artificial Sequence: Synthetic oligonucleotide
ctgaagaccaatgaccagatggtggtagtgtac

SEQ ID NO: 144573 - DNA, 35 bp, Artificial Sequence
  Description of Artificial Sequence: Synthetic oligonucleotide
tgaagaccaatgaccagatggtggtagtgtacttg

SEQ ID NO: 144574 - DNA, 34 bp, Artificial Sequence
  Description of Artificial Sequence: Synthetic oligonucleotide
gaagaccaatgaccagatggtggtagtgtacttg

SEQ ID NO: 144575 - DNA, 34 bp, Artificial Sequence
  Description of Artificial Sequence: Synthetic oligonucleotide
aagaccaatgaccagatggtggtagtgtacttgg

SEQ ID NO: 144576 - DNA, 33 bp, Artificial Sequence
  Description of Artificial Sequence: Synthetic oligonucleotide
agaccaatgaccagatggtggtagtgtacttgg

SEQ ID NO: 144577 - DNA, 32 bp, Artificial Sequence
  Description of Artificial Sequence: Synthetic oligonucleotide
gaccaatgaccagatggtggtagtgtacttgg

SEQ ID NO: 144578 - DNA, 32 bp, Artificial Sequence
  Description of Artificial Sequence: Synthetic oligonucleotide
accaatgaccagatggtggtagtgtacttggc

SEQ ID NO: 144579 - DNA, 31 bp, Artificial Sequence
  Description of Artificial Sequence: Synthetic oligonucleotide
ccaatgaccagatggtggtagtgtacttggc

SEQ ID NO: 144580 - DNA, 31 bp, Artificial Sequence
  Description of Artificial Sequence: Synthetic oligonucleotide
caatgaccagatggtggtagtgtacttggcc

SEQ ID NO: 144581 - DNA, 32 bp, Artificial Sequence
  Description of Artificial Sequence: Synthetic oligonucleotide
aatgaccagatggtggtagtgtacttggcctc

SEQ ID NO: 144582 - DNA, 31 bp, Artificial Sequence
  Description of Artificial Sequence: Synthetic oligonucleotide
atgaccagatggtggtagtgtacttggcctc

SEQ ID NO: 144583 - DNA, 30 bp, Artificial Sequence
  Description of Artificial Sequence: Synthetic oligonucleotide
tgaccagatggtggtagtgtacttggcctc

SEQ ID NO: 144584 - DNA, 29 bp, Artificial Sequence
  Description of Artificial Sequence: Synthetic oligonucleotide
gaccagatggtggtagtgtacttggcctc

SEQ ID NO: 144585 - DNA, 29 bp, Artificial Sequence
  Description of Artificial Sequence: Synthetic oligonucleotide
accagatggtggtagtgtacttggcctcg

SEQ ID NO: 144586 - DNA, 28 bp, Artificial Sequence
  Description of Artificial Sequence: Synthetic oligonucleotide
ccagatggtggtagtgtacttggcctcg

SEQ ID NO: 144587 - DNA, 28 bp, Artificial Sequence
  Description of Artificial Sequence: Synthetic oligonucleotide
cagatggtggtagtgtacttggcctcgc

SEQ ID NO: 144588 - DNA, 29 bp, Artificial Sequence
  Description of Artificial Sequence: Synthetic oligonucleotide
agatggtggtagtgtacttggcctcgctg

SEQ ID NO: 144589 - DNA, 28 bp, Artificial Sequence
  Description of Artificial Sequence: Synthetic oligonucleotide
gatggtggtagtgtacttggcctcgctg

SEQ ID NO: 144590 - DNA, 30 bp, Artificial Sequence
  Description of Artificial Sequence: Synthetic oligonucleotide
atggtggtagtgtacttggcctcgctgatc

SEQ ID NO: 144591 - DNA, 29 bp, Artificial Sequence
  Description of Artificial Sequence: Synthetic oligonucleotide
tggtggtagtgtacttggcctcgctgatc

SEQ ID NO: 144592 - DNA, 28 bp, Artificial Sequence
  Description of Artificial Sequence: Synthetic oligonucleotide
ggtggtagtgtacttggcctcgctgatc

SEQ ID NO: 144593 - DNA, 28 bp, Artificial Sequence
  Description of Artificial Sequence: Synthetic oligonucleotide
gtggtagtgtacttggcctcgctgatcc

SEQ ID NO: 144594 - DNA, 28 bp, Artificial Sequence
  Description of Artificial Sequence: Synthetic oligonucleotide
tggtagtgtacttggcctcgctgatccg

SEQ ID NO: 144595 - DNA, 27 bp, Artificial Sequence
  Description of Artificial Sequence: Synthetic oligonucleotide
ggtagtgtacttggcctcgctgatccg

SEQ ID NO: 144596 - DNA, 29 bp, Artificial Sequence
  Description of Artificial Sequence: Synthetic oligonucleotide
gtagtgtacttggcctcgctgatccgttc

SEQ ID NO: 144597 - DNA, 29 bp, Artificial Sequence
  Description of Artificial Sequence: Synthetic oligonucleotide
tagtgtacttggcctcgctgatccgttcc

SEQ ID NO: 144598 - DNA, 28 bp, Artificial Sequence
  Description of Artificial Sequence: Synthetic oligonucleotide
agtgtacttggcctcgctgatccgttcc

SEQ ID NO: 144599 - DNA, 27 bp, Artificial Sequence
  Description of Artificial Sequence: Synthetic oligonucleotide
gtgtacttggcctcgctgatccgttcc

SEQ ID NO: 144600 - DNA, 27 bp, Artificial Sequence
  Description of Artificial Sequence: Synthetic oligonucleotide
tgtacttggcctcgctgatccgttccg

SEQ ID NO: 144601 - DNA, 27 bp, Artificial Sequence
  Description of Artificial Sequence: Synthetic oligonucleotide
gtacttggcctcgctgatccgttccgt

SEQ ID NO: 144602 - DNA, 27 bp, Artificial Sequence
  Description of Artificial Sequence: Synthetic oligonucleotide
tacttggcctcgctgatccgttccgtg

SEQ ID NO: 144603 - DNA, 26 bp, Artificial Sequence
  Description of Artificial Sequence: Synthetic oligonucleotide
acttggcctcgctgatccgttccgtg

SEQ ID NO: 144604 - DNA, 25 bp, Artificial Sequence
  Description of Artificial Sequence: Synthetic oligonucleotide
cttggcctcgctgatccgttccgtg

SEQ ID NO: 144605 - DNA, 26 bp, Artificial Sequence
  Description of Artificial Sequence: Synthetic oligonucleotide
ttggcctcgctgatccgttccgtggt

SEQ ID NO: 144606 - DNA, 25 bp, Artificial Sequence
  Description of Artificial Sequence: Synthetic oligonucleotide
tggcctcgctgatccgttccgtggt

SEQ ID NO: 144607 - DNA, 24 bp, Artificial Sequence
  Description of Artificial Sequence: Synthetic oligonucleotide
ggcctcgctgatccgttccgtggt

SEQ ID NO: 144608 - DNA, 24 bp, Artificial Sequence
  Description of Artificial Sequence: Synthetic oligonucleotide
gcctcgctgatccgttccgtggtc

SEQ ID NO: 144609 - DNA, 24 bp, Artificial Sequence
  Description of Artificial Sequence: Synthetic oligonucleotide
cctcgctgatccgttccgtggtcg

SEQ ID NO: 144610 - DNA, 24 bp, Artificial Sequence
  Description of Artificial Sequence: Synthetic oligonucleotide
ctcgctgatccgttccgtggtcgc

SEQ ID NO: 144611 - DNA, 24 bp, Artificial Sequence
  Description of Artificial Sequence: Synthetic oligonucleotide
tcgctgatccgttccgtggtcgcc

SEQ ID NO: 144612 - DNA, 23 bp, Artificial Sequence
  Description of Artificial Sequence: Synthetic oligonucleotide
cgctgatccgttccgtggtcgcc

SEQ ID NO: 144613 - DNA, 24 bp, Artificial Sequence
  Description of Artificial Sequence: Synthetic oligonucleotide
gctgatccgttccgtggtcgccct

SEQ ID NO: 144614 - DNA, 24 bp, Artificial Sequence
  Description of Artificial Sequence: Synthetic oligonucleotide
ctgatccgttccgtggtcgccctg

SEQ ID NO: 144615 - DNA, 25 bp, Artificial Sequence
  Description of Artificial Sequence: Synthetic oligonucleotide
tgatccgttccgtggtcgccctgca

SEQ ID NO: 144616 - DNA, 24 bp, Artificial Sequence
  Description of Artificial Sequence: Synthetic oligonucleotide
gatccgttccgtggtcgccctgca

SEQ ID NO: 144617 - DNA, 26 bp, Artificial Sequence
  Description of Artificial Sequence: Synthetic oligonucleotide
atccgttccgtggtcgccctgcacaa

SEQ ID NO: 144618 - DNA, 25 bp, Artificial Sequence
  Description of Artificial Sequence: Synthetic oligonucleotide
tccgttccgtggtcgccctgcacaa

SEQ ID NO: 144619 - DNA, 24 bp, Artificial Sequence
  Description of Artificial Sequence: Synthetic oligonucleotide
ccgttccgtggtcgccctgcacaa

SEQ ID NO: 144620 - DNA, 24 bp, Artificial Sequence
  Description of Artificial Sequence: Synthetic oligonucleotide
cgttccgtggtcgccctgcacaac

SEQ ID NO: 144621 - DNA, 25 bp, Artificial Sequence
  Description of Artificial Sequence: Synthetic oligonucleotide
gttccgtggtcgccctgcacaacct

SEQ ID NO: 144622 - DNA, 27 bp, Artificial Sequence
  Description of Artificial Sequence: Synthetic oligonucleotide
ttccgtggtcgccctgcacaacctcat

SEQ ID NO: 144623 - DNA, 26 bp, Artificial Sequence
  Description of Artificial Sequence: Synthetic oligonucleotide
tccgtggtcgccctgcacaacctcat

SEQ ID NO: 144624 - DNA, 25 bp, Artificial Sequence
  Description of Artificial Sequence: Synthetic oligonucleotide
ccgtggtcgccctgcacaacctcat

SEQ ID NO: 144625 - DNA, 27 bp, Artificial Sequence
  Description of Artificial Sequence: Synthetic oligonucleotide
cgtggtcgccctgcacaacctcatcaa

SEQ ID NO: 144626 - DNA, 27 bp, Artificial Sequence
  Description of Artificial Sequence: Synthetic oligonucleotide
gtggtcgccctgcacaacctcatcaac

SEQ ID NO: 144627 - DNA, 29 bp, Artificial Sequence
  Description of Artificial Sequence: Synthetic oligonucleotide
tggtcgccctgcacaacctcatcaacaac

SEQ ID NO: 144628 - DNA, 28 bp, Artificial Sequence
  Description of Artificial Sequence: Synthetic oligonucleotide
ggtcgccctgcacaacctcatcaacaac

SEQ ID NO: 144629 - DNA, 30 bp, Artificial Sequence
  Description of Artificial Sequence: Synthetic oligonucleotide
gtcgccctgcacaacctcatcaacaacaag

SEQ ID NO: 144630 - DNA, 33 bp, Artificial Sequence
  Description of Artificial Sequence: Synthetic oligonucleotide
tcgccctgcacaacctcatcaacaacaagattg

SEQ ID NO: 144631 - DNA, 32 bp, Artificial Sequence
  Description of Artificial Sequence: Synthetic oligonucleotide
cgccctgcacaacctcatcaacaacaagattg

SEQ ID NO: 144632 - DNA, 32 bp, Artificial Sequence
  Description of Artificial Sequence: Synthetic oligonucleotide
gccctgcacaacctcatcaacaacaagattgc

SEQ ID NO: 144633 - DNA, 32 bp, Artificial Sequence
  Description of Artificial Sequence: Synthetic oligonucleotide
ccctgcacaacctcatcaacaacaagattgcc

SEQ ID NO: 144634 - DNA, 34 bp, Artificial Sequence
  Description of Artificial Sequence: Synthetic oligonucleotide
cctgcacaacctcatcaacaacaagattgccaac

SEQ ID NO: 144635 - DNA, 34 bp, Artificial Sequence
  Description of Artificial Sequence: Synthetic oligonucleotide
ctgcacaacctcatcaacaacaagattgccaacc

SEQ ID NO: 144636 - DNA, 34 bp, Artificial Sequence
  Description of Artificial Sequence: Synthetic oligonucleotide
tgcacaacctcatcaacaacaagattgccaaccg

SEQ ID NO: 144637 - DNA, 33 bp, Artificial Sequence
  Description of Artificial Sequence: Synthetic oligonucleotide
gcacaacctcatcaacaacaagattgccaaccg

SEQ ID NO: 144638 - DNA, 33 bp, Artificial Sequence
  Description of Artificial Sequence: Synthetic oligonucleotide
cacaacctcatcaacaacaagattgccaaccgg

SEQ ID NO: 144639 - DNA, 33 bp, Artificial Sequence
  Description of Artificial Sequence: Synthetic oligonucleotide
acaacctcatcaacaacaagattgccaaccggg

SEQ ID NO: 144640 - DNA, 32 bp, Artificial Sequence
  Description of Artificial Sequence: Synthetic oligonucleotide
caacctcatcaacaacaagattgccaaccggg

SEQ ID NO: 144641 - DNA, 34 bp, Artificial Sequence
  Description of Artificial Sequence: Synthetic oligonucleotide
aacctcatcaacaacaagattgccaaccgggatg

SEQ ID NO: 144642 - DNA, 33 bp, Artificial Sequence
  Description of Artificial Sequence: Synthetic oligonucleotide
acctcatcaacaacaagattgccaaccgggatg

SEQ ID NO: 144643 - DNA, 32 bp, Artificial Sequence
  Description of Artificial Sequence: Synthetic oligonucleotide
cctcatcaacaacaagattgccaaccgggatg

SEQ ID NO: 144644 - DNA, 32 bp, Artificial Sequence
  Description of Artificial Sequence: Synthetic oligonucleotide
ctcatcaacaacaagattgccaaccgggatgc

SEQ ID NO: 144645 - DNA, 33 bp, Artificial Sequence
  Description of Artificial Sequence: Synthetic oligonucleotide
tcatcaacaacaagattgccaaccgggatgcag

SEQ ID NO: 144646 - DNA, 32 bp, Artificial Sequence
  Description of Artificial Sequence: Synthetic oligonucleotide
catcaacaacaagattgccaaccgggatgcag

SEQ ID NO: 144647 - DNA, 33 bp, Artificial Sequence
  Description of Artificial Sequence: Synthetic oligonucleotide
atcaacaacaagattgccaaccgggatgcagag

SEQ ID NO: 144648 - DNA, 32 bp, Artificial Sequence
  Description of Artificial Sequence: Synthetic oligonucleotide
tcaacaacaagattgccaaccgggatgcagag

SEQ ID NO: 144649 - DNA, 31 bp, Artificial Sequence
  Description of Artificial Sequence: Synthetic oligonucleotide
caacaacaagattgccaaccgggatgcagag

SEQ ID NO: 144650 - DNA, 33 bp, Artificial Sequence
  Description of Artificial Sequence: Synthetic oligonucleotide
aacaacaagattgccaaccgggatgcagagaag

SEQ ID NO: 144651 - DNA, 32 bp, Artificial Sequence
  Description of Artificial Sequence: Synthetic oligonucleotide
acaacaagattgccaaccgggatgcagagaag

SEQ ID NO: 144652 - DNA, 31 bp, Artificial Sequence
  Description of Artificial Sequence: Synthetic oligonucleotide
caacaagattgccaaccgggatgcagagaag

SEQ ID NO: 144653 - DNA, 34 bp, Artificial Sequence
  Description of Artificial Sequence: Synthetic oligonucleotide
aacaagattgccaaccgggatgcagagaagaaag

SEQ ID NO: 144654 - DNA, 33 bp, Artificial Sequence
  Description of Artificial Sequence: Synthetic oligonucleotide
acaagattgccaaccgggatgcagagaagaaag

SEQ ID NO: 144655 - DNA, 32 bp, Artificial Sequence
  Description of Artificial Sequence: Synthetic oligonucleotide
caagattgccaaccgggatgcagagaagaaag

SEQ ID NO: 144656 - DNA, 34 bp, Artificial Sequence
  Description of Artificial Sequence: Synthetic oligonucleotide
aagattgccaaccgggatgcagagaagaaagaag

SEQ ID NO: 144657 - DNA, 33 bp, Artificial Sequence
  Description of Artificial Sequence: Synthetic oligonucleotide
agattgccaaccgggatgcagagaagaaagaag

SEQ ID NO: 144658 - DNA, 32 bp, Artificial Sequence
  Description of Artificial Sequence: Synthetic oligonucleotide
gattgccaaccgggatgcagagaagaaagaag

SEQ ID NO: 144659 - DNA, 32 bp, Artificial Sequence
  Description of Artificial Sequence: Synthetic oligonucleotide
attgccaaccgggatgcagagaagaaagaagg

SEQ ID NO: 144660 - DNA, 31 bp, Artificial Sequence
  Description of Artificial Sequence: Synthetic oligonucleotide
ttgccaaccgggatgcagagaagaaagaagg

SEQ ID NO: 144661 - DNA, 30 bp, Artificial Sequence
  Description of Artificial Sequence: Synthetic oligonucleotide
tgccaaccgggatgcagagaagaaagaagg

SEQ ID NO: 144662 - DNA, 29 bp, Artificial Sequence
  Description of Artificial Sequence: Synthetic oligonucleotide
gccaaccgggatgcagagaagaaagaagg

SEQ ID NO: 144663 - DNA, 29 bp, Artificial Sequence
  Description of Artificial Sequence: Synthetic oligonucleotide
ccaaccgggatgcagagaagaaagaaggg

SEQ ID NO: 144664 - DNA, 29 bp, Artificial Sequence
  Description of Artificial Sequence: Synthetic oligonucleotide
caaccgggatgcagagaagaaagaagggc

SEQ ID NO: 144665 - DNA, 30 bp, Artificial Sequence
  Description of Artificial Sequence: Synthetic oligonucleotide
aaccgggatgcagagaagaaagaagggcag

SEQ ID NO: 144666 - DNA, 29 bp, Artificial Sequence
  Description of Artificial Sequence: Synthetic oligonucleotide
accgggatgcagagaagaaagaagggcag

SEQ ID NO: 144667 - DNA, 28 bp, Artificial Sequence
  Description of Artificial Sequence: Synthetic oligonucleotide
ccgggatgcagagaagaaagaagggcag

SEQ ID NO: 144668 - DNA, 28 bp, Artificial Sequence
  Description of Artificial Sequence: Synthetic oligonucleotide
cgggatgcagagaagaaagaagggcagg

SEQ ID NO: 144669 - DNA, 29 bp, Artificial Sequence
  Description of Artificial Sequence: Synthetic oligonucleotide
gggatgcagagaagaaagaagggcaggag

SEQ ID NO: 144670 - DNA, 32 bp, Artificial Sequence
  Description of Artificial Sequence: Synthetic oligonucleotide
ggatgcagagaagaaagaagggcaggagaaag

SEQ ID NO: 144671 - DNA, 34 bp, Artificial Sequence
  Description of Artificial Sequence: Synthetic oligonucleotide
gatgcagagaagaaagaagggcaggagaaagaag

SEQ ID NO: 144672 - DNA, 35 bp, Artificial Sequence
  Description of Artificial Sequence: Synthetic oligonucleotide
atgcagagaagaaagaagggcaggagaaagaagag

SEQ ID NO: 144673 - DNA, 34 bp, Artificial Sequence
  Description of Artificial Sequence: Synthetic oligonucleotide
tgcagagaagaaagaagggcaggagaaagaagag

SEQ ID NO: 144674 - DNA, 33 bp, Artificial Sequence
  Description of Artificial Sequence: Synthetic oligonucleotide
gcagagaagaaagaagggcaggagaaagaagag

SEQ ID NO: 144675 - DNA, 34 bp, Artificial Sequence
  Description of Artificial Sequence: Synthetic oligonucleotide
cagagaagaaagaagggcaggagaaagaagagag

SEQ ID NO: 144676 - DNA, 34 bp, Artificial Sequence
  Description of Artificial Sequence: Synthetic oligonucleotide
agagaagaaagaagggcaggagaaagaagagagc

SEQ ID NO: 144677 - DNA, 33 bp, Artificial Sequence
  Description of Artificial Sequence: Synthetic oligonucleotide
gagaagaaagaagggcaggagaaagaagagagc

SEQ ID NO: 144678 - DNA, 38 bp, Artificial Sequence
  Description of Artificial Sequence: Synthetic oligonucleotide
agaagaaagaagggcaggagaaagaagagagcaaaaag

SEQ ID NO: 144679 - DNA, 37 bp, Artificial Sequence
  Description of Artificial Sequence: Synthetic oligonucleotide
gaagaaagaagggcaggagaaagaagagagcaaaaag

SEQ ID NO: 144680 - DNA, 37 bp, Artificial Sequence
  Description of Artificial Sequence: Synthetic oligonucleotide
aagaaagaagggcaggagaaagaagagagcaaaaagg

SEQ ID NO: 144681 - DNA, 36 bp, Artificial Sequence
  Description of Artificial Sequence: Synthetic oligonucleotide
agaaagaagggcaggagaaagaagagagcaaaaagg

SEQ ID NO: 144682 - DNA, 35 bp, Artificial Sequence
  Description of Artificial Sequence: Synthetic oligonucleotide
gaaagaagggcaggagaaagaagagagcaaaaagg

SEQ ID NO: 144683 - DNA, 38 bp, Artificial Sequence
  Description of Artificial Sequence: Synthetic oligonucleotide
aaagaagggcaggagaaagaagagagcaaaaaggatag

SEQ ID NO: 144684 - DNA, 37 bp, Artificial Sequence
  Description of Artificial Sequence: Synthetic oligonucleotide
aagaagggcaggagaaagaagagagcaaaaaggatag

SEQ ID NO: 144685 - DNA, 36 bp, Artificial Sequence
  Description of Artificial Sequence: Synthetic oligonucleotide
agaagggcaggagaaagaagagagcaaaaaggatag

SEQ ID NO: 144686 - DNA, 35 bp, Artificial Sequence
  Description of Artificial Sequence: Synthetic oligonucleotide
gaagggcaggagaaagaagagagcaaaaaggatag

SEQ ID NO: 144687 - DNA, 35 bp, Artificial Sequence
  Description of Artificial Sequence: Synthetic oligonucleotide
aagggcaggagaaagaagagagcaaaaaggatagg

SEQ ID NO: 144688 - DNA, 34 bp, Artificial Sequence
  Description of Artificial Sequence: Synthetic oligonucleotide
agggcaggagaaagaagagagcaaaaaggatagg

SEQ ID NO: 144689 - DNA, 33 bp, Artificial Sequence
  Description of Artificial Sequence: Synthetic oligonucleotide
gggcaggagaaagaagagagcaaaaaggatagg

SEQ ID NO: 144690 - DNA, 36 bp, Artificial Sequence
  Description of Artificial Sequence: Synthetic oligonucleotide
ggcaggagaaagaagagagcaaaaaggataggaaag

SEQ ID NO: 144691 - DNA, 37 bp, Artificial Sequence
  Description of Artificial Sequence: Synthetic oligonucleotide
gcaggagaaagaagagagcaaaaaggataggaaagag

SEQ ID NO: 144692 - DNA, 37 bp, Artificial Sequence
  Description of Artificial Sequence: Synthetic oligonucleotide
caggagaaagaagagagcaaaaaggataggaaagagg

SEQ ID NO: 144693 - DNA, 38 bp, Artificial Sequence
  Description of Artificial Sequence: Synthetic oligonucleotide
aggagaaagaagagagcaaaaaggataggaaagaggac

SEQ ID NO: 144694 - DNA, 37 bp, Artificial Sequence
  Description of Artificial Sequence: Synthetic oligonucleotide
ggagaaagaagagagcaaaaaggataggaaagaggac

SEQ ID NO: 144695 - DNA, 39 bp, Artificial Sequence
  Description of Artificial Sequence: Synthetic oligonucleotide
gagaaagaagagagcaaaaaggataggaaagaggacaag

SEQ ID NO: 144696 - DNA, 39 bp, Artificial Sequence
  Description of Artificial Sequence: Synthetic oligonucleotide
agaaagaagagagcaaaaaggataggaaagaggacaagg

SEQ ID NO: 144697 - DNA, 38 bp, Artificial Sequence
  Description of Artificial Sequence: Synthetic oligonucleotide
gaaagaagagagcaaaaaggataggaaagaggacaagg

SEQ ID NO: 144698 - DNA, 39 bp, Artificial Sequence
  Description of Artificial Sequence: Synthetic oligonucleotide
aaagaagagagcaaaaaggataggaaagaggacaaggag

SEQ ID NO: 144699 - DNA, 38 bp, Artificial Sequence
  Description of Artificial Sequence: Synthetic oligonucleotide
aagaagagagcaaaaaggataggaaagaggacaaggag

SEQ ID NO: 144700 - DNA, 37 bp, Artificial Sequence
  Description of Artificial Sequence: Synthetic oligonucleotide
agaagagagcaaaaaggataggaaagaggacaaggag

SEQ ID NO: 144701 - DNA, 36 bp, Artificial Sequence
  Description of Artificial Sequence: Synthetic oligonucleotide
gaagagagcaaaaaggataggaaagaggacaaggag

SEQ ID NO: 144702 - DNA, 39 bp, Artificial Sequence
  Description of Artificial Sequence: Synthetic oligonucleotide
aagagagcaaaaaggataggaaagaggacaaggagaaag

SEQ ID NO: 144703 - DNA, 38 bp, Artificial Sequence
  Description of Artificial Sequence: Synthetic oligonucleotide
agagagcaaaaaggataggaaagaggacaaggagaaag

SEQ ID NO: 144704 - DNA, 37 bp, Artificial Sequence
  Description of Artificial Sequence: Synthetic oligonucleotide
gagagcaaaaaggataggaaagaggacaaggagaaag

SEQ ID NO: 144705 - DNA, 42 bp, Artificial Sequence
  Description of Artificial Sequence: Synthetic oligonucleotide
agagcaaaaaggataggaaagaggacaaggagaaagataaag

SEQ ID NO: 144706 - DNA, 41 bp, Artificial Sequence
  Description of Artificial Sequence: Synthetic oligonucleotide
gagcaaaaaggataggaaagaggacaaggagaaagataaag

SEQ ID NO: 144707 - DNA, 45 bp, Artificial Sequence
  Description of Artificial Sequence: Synthetic oligonucleotide
agcaaaaaggataggaaagaggacaaggagaaagataaagataag

SEQ ID NO: 144708 - DNA, 44 bp, Artificial Sequence
  Description of Artificial Sequence: Synthetic oligonucleotide
gcaaaaaggataggaaagaggacaaggagaaagataaagataag

SEQ ID NO: 144709 - DNA, 44 bp, Artificial Sequence
  Description of Artificial Sequence: Synthetic oligonucleotide
caaaaaggataggaaagaggacaaggagaaagataaagataagg

SEQ ID NO: 144710 - DNA, 48 bp, Artificial Sequence
  Description of Artificial Sequence: Synthetic oligonucleotide
aaaaaggataggaaagaggacaaggagaaagataaagataaggaaaag

SEQ ID NO: 144711 - DNA, 47 bp, Artificial Sequence
  Description of Artificial Sequence: Synthetic oligonucleotide
aaaaggataggaaagaggacaaggagaaagataaagataaggaaaag

SEQ ID NO: 144712 - DNA, 46 bp, Artificial Sequence
  Description of Artificial Sequence: Synthetic oligonucleotide
aaaggataggaaagaggacaaggagaaagataaagataaggaaaag

SEQ ID NO: 144713 - DNA, 45 bp, Artificial Sequence
  Description of Artificial Sequence: Synthetic oligonucleotide
aaggataggaaagaggacaaggagaaagataaagataaggaaaag

SEQ ID NO: 144714 - DNA, 44 bp, Artificial Sequence
  Description of Artificial Sequence: Synthetic oligonucleotide
aggataggaaagaggacaaggagaaagataaagataaggaaaag

SEQ ID NO: 144715 - DNA, 43 bp, Artificial Sequence
  Description of Artificial Sequence: Synthetic oligonucleotide
ggataggaaagaggacaaggagaaagataaagataaggaaaag

SEQ ID NO: 144716 - DNA, 44 bp, Artificial Sequence
  Description of Artificial Sequence: Synthetic oligonucleotide
gataggaaagaggacaaggagaaagataaagataaggaaaagag

SEQ ID NO: 144717 - DNA, 45 bp, Artificial Sequence
  Description of Artificial Sequence: Synthetic oligonucleotide
ataggaaagaggacaaggagaaagataaagataaggaaaagagtg

SEQ ID NO: 144718 - DNA, 44 bp, Artificial Sequence
  Description of Artificial Sequence: Synthetic oligonucleotide
taggaaagaggacaaggagaaagataaagataaggaaaagagtg

SEQ ID NO: 144719 - DNA, 43 bp, Artificial Sequence
  Description of Artificial Sequence: Synthetic oligonucleotide
aggaaagaggacaaggagaaagataaagataaggaaaagagtg

SEQ ID NO: 144720 - DNA, 42 bp, Artificial Sequence
  Description of Artificial Sequence: Synthetic oligonucleotide
ggaaagaggacaaggagaaagataaagataaggaaaagagtg

SEQ ID NO: 144721 - DNA, 44 bp, Artificial Sequence
  Description of Artificial Sequence: Synthetic oligonucleotide
gaaagaggacaaggagaaagataaagataaggaaaagagtgatg

SEQ ID NO: 144722 - DNA, 48 bp, Artificial Sequence
  Description of Artificial Sequence: Synthetic oligonucleotide
aaagaggacaaggagaaagataaagataaggaaaagagtgatgtaaag

SEQ ID NO: 144723 - DNA, 47 bp, Artificial Sequence
  Description of Artificial Sequence: Synthetic oligonucleotide
aagaggacaaggagaaagataaagataaggaaaagagtgatgtaaag

SEQ ID NO: 144724 - DNA, 46 bp, Artificial Sequence
  Description of Artificial Sequence: Synthetic oligonucleotide
agaggacaaggagaaagataaagataaggaaaagagtgatgtaaag

SEQ ID NO: 144725 - DNA, 45 bp, Artificial Sequence
  Description of Artificial Sequence: Synthetic oligonucleotide
gaggacaaggagaaagataaagataaggaaaagagtgatgtaaag

SEQ ID NO: 144726 - DNA, 48 bp, Artificial Sequence
  Description of Artificial Sequence: Synthetic oligonucleotide
aggacaaggagaaagataaagataaggaaaagagtgatgtaaagaaag

SEQ ID NO: 144727 - DNA, 47 bp, Artificial Sequence
  Description of Artificial Sequence: Synthetic oligonucleotide
ggacaaggagaaagataaagataaggaaaagagtgatgtaaagaaag

SEQ ID NO: 144728 - DNA, 48 bp, Artificial Sequence
  Description of Artificial Sequence: Synthetic oligonucleotide
gacaaggagaaagataaagataaggaaaagagtgatgtaaagaaagag

SEQ ID NO: 144729 - DNA, 48 bp, Artificial Sequence
  Description of Artificial Sequence: Synthetic oligonucleotide
acaaggagaaagataaagataaggaaaagagtgatgtaaagaaagagg

SEQ ID NO: 144730 - DNA, 47 bp, Artificial Sequence
  Description of Artificial Sequence: Synthetic oligonucleotide
caaggagaaagataaagataaggaaaagagtgatgtaaagaaagagg

SEQ ID NO: 144731 - DNA, 48 bp, Artificial Sequence
  Description of Artificial Sequence: Synthetic oligonucleotide
aaggagaaagataaagataaggaaaagagtgatgtaaagaaagaggag

SEQ ID NO: 144732 - DNA, 47 bp, Artificial Sequence
  Description of Artificial Sequence: Synthetic oligonucleotide
aggagaaagataaagataaggaaaagagtgatgtaaagaaagaggag

SEQ ID NO: 144733 - DNA, 46 bp, Artificial Sequence
  Description of Artificial Sequence: Synthetic oligonucleotide
ggagaaagataaagataaggaaaagagtgatgtaaagaaagaggag

SEQ ID NO: 144734 - DNA, 51 bp, Artificial Sequence
  Description of Artificial Sequence: Synthetic oligonucleotide
gagaaagataaagataaggaaaagagtgatgtaaagaaagaggagaaaaag

SEQ ID NO: 144735 - DNA, 51 bp, Artificial Sequence
  Description of Artificial Sequence: Synthetic oligonucleotide
agaaagataaagataaggaaaagagtgatgtaaagaaagaggagaaaaagg

SEQ ID NO: 144736 - DNA, 50 bp, Artificial Sequence
  Description of Artificial Sequence: Synthetic oligonucleotide
gaaagataaagataaggaaaagagtgatgtaaagaaagaggagaaaaagg

SEQ ID NO: 144737 - DNA, 51 bp, Artificial Sequence
  Description of Artificial Sequence: Synthetic oligonucleotide
aaagataaagataaggaaaagagtgatgtaaagaaagaggagaaaaaggag

SEQ ID NO: 144738 - DNA, 50 bp, Artificial Sequence
  Description of Artificial Sequence: Synthetic oligonucleotide
aagataaagataaggaaaagagtgatgtaaagaaagaggagaaaaaggag

SEQ ID NO: 144739 - DNA, 49 bp, Artificial Sequence
  Description of Artificial Sequence: Synthetic oligonucleotide
agataaagataaggaaaagagtgatgtaaagaaagaggagaaaaaggag

SEQ ID NO: 144740 - DNA, 48 bp, Artificial Sequence
  Description of Artificial Sequence: Synthetic oligonucleotide
gataaagataaggaaaagagtgatgtaaagaaagaggagaaaaaggag

SEQ ID NO: 144741 - DNA, 53 bp, Artificial Sequence
  Description of Artificial Sequence: Synthetic oligonucleotide
ataaagataaggaaaagagtgatgtaaagaaagaggagaaaaaggagaaaaag

SEQ ID NO: 144742 - DNA, 52 bp, Artificial Sequence
  Description of Artificial Sequence: Synthetic oligonucleotide
taaagataaggaaaagagtgatgtaaagaaagaggagaaaaaggagaaaaag

SEQ ID NO: 144743 - DNA, 51 bp, Artificial Sequence
  Description of Artificial Sequence: Synthetic oligonucleotide
aaagataaggaaaagagtgatgtaaagaaagaggagaaaaaggagaaaaag

SEQ ID NO: 144744 - DNA, 50 bp, Artificial Sequence
  Description of Artificial Sequence: Synthetic oligonucleotide
aagataaggaaaagagtgatgtaaagaaagaggagaaaaaggagaaaaag

SEQ ID NO: 144745 - DNA, 49 bp, Artificial Sequence
  Description of Artificial Sequence: Synthetic oligonucleotide
agataaggaaaagagtgatgtaaagaaagaggagaaaaaggagaaaaag

SEQ ID NO: 144746 - DNA, 48 bp, Artificial Sequence
  Description of Artificial Sequence: Synthetic oligonucleotide
gataaggaaaagagtgatgtaaagaaagaggagaaaaaggagaaaaag

SEQ ID NO: 144747 - DNA, 28 bp, Artificial Sequence
  Description of Artificial Sequence: Synthetic oligonucleotide
atgttcattaagggcagggctccgaggg

SEQ ID NO: 144748 - DNA, 27 bp, Artificial Sequence
  Description of Artificial Sequence: Synthetic oligonucleotide
tgttcattaagggcagggctccgaggg

SEQ ID NO: 144749 - DNA, 26 bp, Artificial Sequence
  Description of Artificial Sequence: Synthetic oligonucleotide
gttcattaagggcagggctccgaggg

SEQ ID NO: 144750 - DNA, 26 bp, Artificial Sequence
  Description of Artificial Sequence: Synthetic oligonucleotide
ttcattaagggcagggctccgagggc

SEQ ID NO: 144751 - DNA, 25 bp, Artificial Sequence
  Description of Artificial Sequence: Synthetic oligonucleotide
tcattaagggcagggctccgagggc

SEQ ID NO: 144752 - DNA, 24 bp, Artificial Sequence
  Description of Artificial Sequence: Synthetic oligonucleotide
cattaagggcagggctccgagggc

SEQ ID NO: 144753 - DNA, 24 bp, Artificial Sequence
  Description of Artificial Sequence: Synthetic oligonucleotide
attaagggcagggctccgagggcg

SEQ ID NO: 144754 - DNA, 23 bp, Artificial Sequence
  Description of Artificial Sequence: Synthetic oligonucleotide
ttaagggcagggctccgagggcg

SEQ ID NO: 144755 - DNA, 22 bp, Artificial Sequence
  Description of Artificial Sequence: Synthetic oligonucleotide
taagggcagggctccgagggcg

SEQ ID NO: 144756 - DNA, 21 bp, Artificial Sequence
  Description of Artificial Sequence: Synthetic oligonucleotide
aagggcagggctccgagggcg

SEQ ID NO: 144757 - DNA, 20 bp, Artificial Sequence
  Description of Artificial Sequence: Synthetic oligonucleotide
agggcagggctccgagggcg

SEQ ID NO: 144758 - DNA, 20 bp, Artificial Sequence
  Description of Artificial Sequence: Synthetic oligonucleotide
gggcagggctccgagggcgt

SEQ ID NO: 144759 - DNA, 20 bp, Artificial Sequence
  Description of Artificial Sequence: Synthetic oligonucleotide
ggcagggctccgagggcgct

SEQ ID NO: 144760 - DNA, 20 bp, Artificial Sequence
  Description of Artificial Sequence: Synthetic oligonucleotide
gcagggctccgagggcgcca

SEQ ID NO: 144761 - DNA, 20 bp, Artificial Sequence
  Description of Artificial Sequence: Synthetic oligonucleotide
cagggctccgagggcgccac

SEQ ID NO: 144762 - DNA, 21 bp, Artificial Sequence
  Description of Artificial Sequence: Synthetic oligonucleotide
agggctccgagggcgccacct

SEQ ID NO: 144763 - DNA, 20 bp, Artificial Sequence
  Description of Artificial Sequence: Synthetic oligonucleotide
gggctccgagggcgccacct

SEQ ID NO: 144764 - DNA, 20 bp, Artificial Sequence
  Description of Artificial Sequence: Synthetic oligonucleotide
ggctccgagggcgccacctc

SEQ ID NO: 144765 - DNA, 21 bp, Artificial Sequence
  Description of Artificial Sequence: Synthetic oligonucleotide
gctccgagggcgccacctcga

SEQ ID NO: 144766 - DNA, 22 bp, Artificial Sequence
  Description of Artificial Sequence: Synthetic oligonucleotide
ctccgagggcgccacctcgaga

SEQ ID NO: 144767 - DNA, 22 bp, Artificial Sequence
  Description of Artificial Sequence: Synthetic oligonucleotide
tccgagggcgccacctcgagag

SEQ ID NO: 144768 - DNA, 21 bp, Artificial Sequence
  Description of Artificial Sequence: Synthetic oligonucleotide
ccgagggcgccacctcgagag

SEQ ID NO: 144769 - DNA, 21 bp, Artificial Sequence
  Description of Artificial Sequence: Synthetic oligonucleotide
cgagggcgccacctcgagagc

SEQ ID NO: 144770 - DNA, 22 bp, Artificial Sequence
  Description of Artificial Sequence: Synthetic oligonucleotide
gagggcgccacctcgagagcga

SEQ ID NO: 144771 - DNA, 22 bp, Artificial Sequence
  Description of Artificial Sequence: Synthetic oligonucleotide
agggcgccacctcgagagcgac

SEQ ID NO: 144772 - DNA, 21 bp, Artificial Sequence
  Description of Artificial Sequence: Synthetic oligonucleotide
gggcgccacctcgagagcgac

SEQ ID NO: 144773 - DNA, 21 bp, Artificial Sequence
  Description of Artificial Sequence: Synthetic oligonucleotide
ggcgccacctcgagagcgacg

SEQ ID NO: 144774 - DNA, 21 bp, Artificial Sequence
  Description of Artificial Sequence: Synthetic oligonucleotide
gcgccacctcgagagcgacgg

SEQ ID NO: 144775 - DNA, 21 bp, Artificial Sequence
  Description of Artificial Sequence: Synthetic oligonucleotide
cgccacctcgagagcgacggc

SEQ ID NO: 144776 - DNA, 21 bp, Artificial Sequence
  Description of Artificial Sequence: Synthetic oligonucleotide
gccacctcgagagcgacggcg

SEQ ID NO: 144777 - DNA, 21 bp, Artificial Sequence
  Description of Artificial Sequence: Synthetic oligonucleotide
ccacctcgagagcgacggcgg

SEQ ID NO: 144778 - DNA, 21 bp, Artificial Sequence
  Description of Artificial Sequence: Synthetic oligonucleotide
cacctcgagagcgacggcggg

SEQ ID NO: 144779 - DNA, 23 bp, Artificial Sequence
  Description of Artificial Sequence: Synthetic oligonucleotide
acctcgagagcgacggcgggcta

SEQ ID NO: 144780 - DNA, 22 bp, Artificial Sequence
  Description of Artificial Sequence: Synthetic oligonucleotide
cctcgagagcgacggcgggcta

SEQ ID NO: 144781 - DNA, 22 bp, Artificial Sequence
  Description of Artificial Sequence: Synthetic oligonucleotide
ctcgagagcgacggcgggctac

SEQ ID NO: 144782 - DNA, 22 bp, Artificial Sequence
  Description of Artificial Sequence: Synthetic oligonucleotide
tcgagagcgacggcgggctacc

SEQ ID NO: 144783 - DNA, 21 bp, Artificial Sequence
  Description of Artificial Sequence: Synthetic oligonucleotide
cgagagcgacggcgggctacc

SEQ ID NO: 144784 - DNA, 21 bp, Artificial Sequence
  Description of Artificial Sequence: Synthetic oligonucleotide
gagagcgacggcgggctaccc

SEQ ID NO: 144785 - DNA, 21 bp, Artificial Sequence
  Description of Artificial Sequence: Synthetic oligonucleotide
agagcgacggcgggctacccg

SEQ ID NO: 144786 - DNA, 20 bp, Artificial Sequence
  Description of Artificial Sequence: Synthetic oligonucleotide
gagcgacggcgggctacccg

SEQ ID NO: 144787 - DNA, 20 bp, Artificial Sequence
  Description of Artificial Sequence: Synthetic oligonucleotide
agcgacggcgggctacccgg

SEQ ID NO: 144788 - DNA, 20 bp, Artificial Sequence
  Description of Artificial Sequence: Synthetic oligonucleotide
gcgacggcgggctacccggt

SEQ ID NO: 144789 - DNA, 20 bp, Artificial Sequence
  Description of Artificial Sequence: Synthetic oligonucleotide
cgacggcgggctacccgggt

SEQ ID NO: 144790 - DNA, 20 bp, Artificial Sequence
  Description of Artificial Sequence: Synthetic oligonucleotide
gacggcgggctacccggggt

SEQ ID NO: 144791 - DNA, 20 bp, Artificial Sequence
  Description of Artificial Sequence: Synthetic oligonucleotide
acggcgggctacccggggct

SEQ ID NO: 144792 - DNA, 20 bp, Artificial Sequence
  Description of Artificial Sequence: Synthetic oligonucleotide
cggcgggctacccggggctt

SEQ ID NO: 144793 - DNA, 20 bp, Artificial Sequence
  Description of Artificial Sequence: Synthetic oligonucleotide
ggcgggctacccggggcgtt

SEQ ID NO: 144794 - DNA, 20 bp, Artificial Sequence
  Description of Artificial Sequence: Synthetic oligonucleotide
gcgggctacccggggcggtt

SEQ ID NO: 144795 - DNA, 20 bp, Artificial Sequence
  Description of Artificial Sequence: Synthetic oligonucleotide
cgggctacccggggcgggtt

SEQ ID NO: 144796 - DNA, 20 bp, Artificial Sequence
  Description of Artificial Sequence: Synthetic oligonucleotide
gggctacccggggcgggctt

SEQ ID NO: 144797 - DNA, 20 bp, Artificial Sequence
  Description of Artificial Sequence: Synthetic oligonucleotide
ggctacccggggcgggctga

SEQ ID NO: 144798 - DNA, 20 bp, Artificial Sequence
  Description of Artificial Sequence: Synthetic oligonucleotide
gctacccggggcgggctgag

SEQ ID NO: 144799 - DNA, 20 bp, Artificial Sequence
  Description of Artificial Sequence: Synthetic oligonucleotide
ctacccggggcgggctgagg

SEQ ID NO: 144800 - DNA, 21 bp, Artificial Sequence
  Description of Artificial Sequence: Synthetic oligonucleotide
tacccggggcgggctgaggca

SEQ ID NO: 144801 - DNA, 20 bp, Artificial Sequence
  Description of Artificial Sequence: Synthetic oligonucleotide
acccggggcgggctgaggca

SEQ ID NO: 144802 - DNA, 20 bp, Artificial Sequence
  Description of Artificial Sequence: Synthetic oligonucleotide
cccggggcgggctgaggcat

SEQ ID NO: 144803 - DNA, 20 bp, Artificial Sequence
  Description of Artificial Sequence: Synthetic oligonucleotide
ccggggcgggctgaggcagt

SEQ ID NO: 144804 - DNA, 21 bp, Artificial Sequence
  Description of Artificial Sequence: Synthetic oligonucleotide
cggggcgggctgaggcaggtt

SEQ ID NO: 144805 - DNA, 23 bp, Artificial Sequence
  Description of Artificial Sequence: Synthetic oligonucleotide
ggggcgggctgaggcaggttgta

SEQ ID NO: 144806 - DNA, 23 bp, Artificial Sequence
  Description of Artificial Sequence: Synthetic oligonucleotide
gggcgggctgaggcaggttgtag

SEQ ID NO: 144807 - DNA, 23 bp, Artificial Sequence
  Description of Artificial Sequence: Synthetic oligonucleotide
ggcgggctgaggcaggttgtagc

SEQ ID NO: 144808 - DNA, 23 bp, Artificial Sequence
  Description of Artificial Sequence: Synthetic oligonucleotide
gcgggctgaggcaggttgtagcc

SEQ ID NO: 144809 - DNA, 23 bp, Artificial Sequence
  Description of Artificial Sequence: Synthetic oligonucleotide
cgggctgaggcaggttgtagccc

SEQ ID NO: 144810 - DNA, 23 bp, Artificial Sequence
  Description of Artificial Sequence: Synthetic oligonucleotide
gggctgaggcaggttgtagcccc

SEQ ID NO: 144811 - DNA, 23 bp, Artificial Sequence
  Description of Artificial Sequence: Synthetic oligonucleotide
ggctgaggcaggttgtagccccg

SEQ ID NO: 144812 - DNA, 23 bp, Artificial Sequence
  Description of Artificial Sequence: Synthetic oligonucleotide
gctgaggcaggttgtagccccgc

SEQ ID NO: 144813 - DNA, 23 bp, Artificial Sequence
  Description of Artificial Sequence: Synthetic oligonucleotide
ctgaggcaggttgtagccccgcc

SEQ ID NO: 144814 - DNA, 23 bp, Artificial Sequence
  Description of Artificial Sequence: Synthetic oligonucleotide
tgaggcaggttgtagccccgccc

SEQ ID NO: 144815 - DNA, 22 bp, Artificial Sequence
  Description of Artificial Sequence: Synthetic oligonucleotide
gaggcaggttgtagccccgccc

SEQ ID NO: 144816 - DNA, 22 bp, Artificial Sequence
  Description of Artificial Sequence: Synthetic oligonucleotide
aggcaggttgtagccccgcccc

SEQ ID NO: 144817 - DNA, 21 bp, Artificial Sequence
  Description of Artificial Sequence: Synthetic oligonucleotide
ggcaggttgtagccccgcccc

SEQ ID NO: 144818 - DNA, 21 bp, Artificial Sequence
  Description of Artificial Sequence: Synthetic oligonucleotide
gcaggttgtagccccgccccg

SEQ ID NO: 144819 - DNA, 21 bp, Artificial Sequence
  Description of Artificial Sequence: Synthetic oligonucleotide
caggttgtagccccgccccgg

SEQ ID NO: 144820 - DNA, 21 bp, Artificial Sequence
  Description of Artificial Sequence: Synthetic oligonucleotide
aggttgtagccccgccccggg

SEQ ID NO: 144821 - DNA, 20 bp, Artificial Sequence
  Description of Artificial Sequence: Synthetic oligonucleotide
ggttgtagccccgccccggg

SEQ ID NO: 144822 - DNA, 20 bp, Artificial Sequence
  Description of Artificial Sequence: Synthetic oligonucleotide
gttgtagccccgccccgggc

SEQ ID NO: 144823 - DNA, 22 bp, Artificial Sequence
  Description of Artificial Sequence: Synthetic oligonucleotide
ttgtagccccgccccgggcctt

SEQ ID NO: 144824 - DNA, 21 bp, Artificial Sequence
  Description of Artificial Sequence: Synthetic oligonucleotide
tgtagccccgccccgggcctt

SEQ ID NO: 144825 - DNA, 20 bp, Artificial Sequence
  Description of Artificial Sequence: Synthetic oligonucleotide
gtagccccgccccgggcctt

SEQ ID NO: 144826 - DNA, 20 bp, Artificial Sequence
  Description of Artificial Sequence: Synthetic oligonucleotide
tagccccgccccgggccttg

SEQ ID NO: 144827 - DNA, 20 bp, Artificial Sequence
  Description of Artificial Sequence: Synthetic oligonucleotide
agccccgccccgggccttgt

SEQ ID NO: 144828 - DNA, 20 bp, Artificial Sequence
  Description of Artificial Sequence: Synthetic oligonucleotide
gccccgccccgggccttgtt

SEQ ID NO: 144829 - DNA, 20 bp, Artificial Sequence
  Description of Artificial Sequence: Synthetic oligonucleotide
ccccgccccgggccttggtt

SEQ ID NO: 144830 - DNA, 20 bp, Artificial Sequence
  Description of Artificial Sequence: Synthetic oligonucleotide
cccgccccgggccttgggtt

SEQ ID NO: 144831 - DNA, 20 bp, Artificial Sequence
  Description of Artificial Sequence: Synthetic oligonucleotide
ccgccccgggccttgggctt

SEQ ID NO: 144832 - DNA, 20 bp, Artificial Sequence
  Description of Artificial Sequence: Synthetic oligonucleotide
cgccccgggccttgggctct

SEQ ID NO: 144833 - DNA, 20 bp, Artificial Sequence
  Description of Artificial Sequence: Synthetic oligonucleotide
gccccgggccttgggctcca

SEQ ID NO: 144834 - DNA, 20 bp, Artificial Sequence
  Description of Artificial Sequence: Synthetic oligonucleotide
ccccgggccttgggctccac

SEQ ID NO: 144835 - DNA, 21 bp, Artificial Sequence
  Description of Artificial Sequence: Synthetic oligonucleotide
cccgggccttgggctccacct

SEQ ID NO: 144836 - DNA, 22 bp, Artificial Sequence
  Description of Artificial Sequence: Synthetic oligonucleotide
ccgggccttgggctccacctct

SEQ ID NO: 144837 - DNA, 22 bp, Artificial Sequence
  Description of Artificial Sequence: Synthetic oligonucleotide
cgggccttgggctccacctctc

SEQ ID NO: 144838 - DNA, 22 bp, Artificial Sequence
  Description of Artificial Sequence: Synthetic oligonucleotide
gggccttgggctccacctctcg

SEQ ID NO: 144839 - DNA, 22 bp, Artificial Sequence
  Description of Artificial Sequence: Synthetic oligonucleotide
ggccttgggctccacctctcgg

SEQ ID NO: 144840 - DNA, 22 bp, Artificial Sequence
  Description of Artificial Sequence: Synthetic oligonucleotide
gccttgggctccacctctcggc

SEQ ID NO: 144841 - DNA, 22 bp, Artificial Sequence
  Description of Artificial Sequence: Synthetic oligonucleotide
ccttgggctccacctctcggcc

SEQ ID NO: 144842 - DNA, 22 bp, Artificial Sequence
  Description of Artificial Sequence: Synthetic oligonucleotide
cttgggctccacctctcggccc

SEQ ID NO: 144843 - DNA, 23 bp, Artificial Sequence
  Description of Artificial Sequence: Synthetic oligonucleotide
ttgggctccacctctcggcccca

SEQ ID NO: 144844 - DNA, 22 bp, Artificial Sequence
  Description of Artificial Sequence: Synthetic oligonucleotide
tgggctccacctctcggcccca

SEQ ID NO: 144845 - DNA, 21 bp, Artificial Sequence
  Description of Artificial Sequence: Synthetic oligonucleotide
gggctccacctctcggcccca

SEQ ID NO: 144846 - DNA, 23 bp, Artificial Sequence
  Description of Artificial Sequence: Synthetic oligonucleotide
ggctccacctctcggccccactt

SEQ ID NO: 144847 - DNA, 23 bp, Artificial Sequence
  Description of Artificial Sequence: Synthetic oligonucleotide
gctccacctctcggccccacttc

SEQ ID NO: 144848 - DNA, 23 bp, Artificial Sequence
  Description of Artificial Sequence: Synthetic oligonucleotide
ctccacctctcggccccacttcc

SEQ ID NO: 144849 - DNA, 23 bp, Artificial Sequence
  Description of Artificial Sequence: Synthetic oligonucleotide
tccacctctcggccccacttccg

SEQ ID NO: 144850 - DNA, 22 bp, Artificial Sequence
  Description of Artificial Sequence: Synthetic oligonucleotide
ccacctctcggccccacttccg

SEQ ID NO: 144851 - DNA, 22 bp, Artificial Sequence
  Description of Artificial Sequence: Synthetic oligonucleotide
cacctctcggccccacttccgc

SEQ ID NO: 144852 - DNA, 22 bp, Artificial Sequence
  Description of Artificial Sequence: Synthetic oligonucleotide
acctctcggccccacttccgcc

SEQ ID NO: 144853 - DNA, 21 bp, Artificial Sequence
  Description of Artificial Sequence: Synthetic oligonucleotide
cctctcggccccacttccgcc

SEQ ID NO: 144854 - DNA, 21 bp, Artificial Sequence
  Description of Artificial Sequence: Synthetic oligonucleotide
ctctcggccccacttccgccg

SEQ ID NO: 144855 - DNA, 21 bp, Artificial Sequence
  Description of Artificial Sequence: Synthetic oligonucleotide
tctcggccccacttccgccgg

SEQ ID NO: 144856 - DNA, 20 bp, Artificial Sequence
  Description of Artificial Sequence: Synthetic oligonucleotide
ctcggccccacttccgccgg

SEQ ID NO: 144857 - DNA, 20 bp, Artificial Sequence
  Description of Artificial Sequence: Synthetic oligonucleotide
tcggccccacttccgccggg

SEQ ID NO: 144858 - DNA, 20 bp, Artificial Sequence
  Description of Artificial Sequence: Synthetic oligonucleotide
cggccccacttccgccgggt

SEQ ID NO: 144859 - DNA, 21 bp, Artificial Sequence
  Description of Artificial Sequence: Synthetic oligonucleotide
ggccccacttccgccgggcaa

SEQ ID NO: 144860 - DNA, 21 bp, Artificial Sequence
  Description of Artificial Sequence: Synthetic oligonucleotide
gccccacttccgccgggcaag

SEQ ID NO: 144861 - DNA, 21 bp, Artificial Sequence
  Description of Artificial Sequence: Synthetic oligonucleotide
ccccacttccgccgggcaagc

SEQ ID NO: 144862 - DNA, 24 bp, Artificial Sequence
  Description of Artificial Sequence: Synthetic oligonucleotide
cccacttccgccgggcaagcgttt

SEQ ID NO: 144863 - DNA, 26 bp, Artificial Sequence
  Description of Artificial Sequence: Synthetic oligonucleotide
ccacttccgccgggcaagcgtttgta

SEQ ID NO: 144864 - DNA, 26 bp, Artificial Sequence
  Description of Artificial Sequence: Synthetic oligonucleotide
cacttccgccgggcaagcgtttgtag

SEQ ID NO: 144865 - DNA, 26 bp, Artificial Sequence
  Description of Artificial Sequence: Synthetic oligonucleotide
acttccgccgggcaagcgtttgtagg

SEQ ID NO: 144866 - DNA, 25 bp, Artificial Sequence
  Description of Artificial Sequence: Synthetic oligonucleotide
cttccgccgggcaagcgtttgtagg

SEQ ID NO: 144867 - DNA, 25 bp, Artificial Sequence
  Description of Artificial Sequence: Synthetic oligonucleotide
ttccgccgggcaagcgtttgtaggc

SEQ ID NO: 144868 - DNA, 24 bp, Artificial Sequence
  Description of Artificial Sequence: Synthetic oligonucleotide
tccgccgggcaagcgtttgtaggc

SEQ ID NO: 144869 - DNA, 23 bp, Artificial Sequence
  Description of Artificial Sequence: Synthetic oligonucleotide
ccgccgggcaagcgtttgtaggc

SEQ ID NO: 144870 - DNA, 23 bp, Artificial Sequence
  Description of Artificial Sequence: Synthetic oligonucleotide
cgccgggcaagcgtttgtaggcg

SEQ ID NO: 144871 - DNA, 23 bp, Artificial Sequence
  Description of Artificial Sequence: Synthetic oligonucleotide
gccgggcaagcgtttgtaggcgg

SEQ ID NO: 144872 - DNA, 23 bp, Artificial Sequence
  Description of Artificial Sequence: Synthetic oligonucleotide
ccgggcaagcgtttgtaggcggc

SEQ ID NO: 144873 - DNA, 23 bp, Artificial Sequence
  Description of Artificial Sequence: Synthetic oligonucleotide
cgggcaagcgtttgtaggcggcg

SEQ ID NO: 144874 - DNA, 24 bp, Artificial Sequence
  Description of Artificial Sequence: Synthetic oligonucleotide
gggcaagcgtttgtaggcggcgct

SEQ ID NO: 144875 - DNA, 24 bp, Artificial Sequence
  Description of Artificial Sequence: Synthetic oligonucleotide
ggcaagcgtttgtaggcggcgctg

SEQ ID NO: 144876 - DNA, 24 bp, Artificial Sequence
  Description of Artificial Sequence: Synthetic oligonucleotide
gcaagcgtttgtaggcggcgctgc

SEQ ID NO: 144877 - DNA, 24 bp, Artificial Sequence
  Description of Artificial Sequence: Synthetic oligonucleotide
caagcgtttgtaggcggcgctgcc

SEQ ID NO: 144878 - DNA, 27 bp, Artificial Sequence
  Description of Artificial Sequence: Synthetic oligonucleotide
aagcgtttgtaggcggcgctgccgtaa

SEQ ID NO: 144879 - DNA, 27 bp, Artificial Sequence
  Description of Artificial Sequence: Synthetic oligonucleotide
agcgtttgtaggcggcgctgccgtaaa

SEQ ID NO: 144880 - DNA, 27 bp, Artificial Sequence
  Description of Artificial Sequence: Synthetic oligonucleotide
gcgtttgtaggcggcgctgccgtaaat

SEQ ID NO: 144881 - DNA, 27 bp, Artificial Sequence
  Description of Artificial Sequence: Synthetic oligonucleotide
cgtttgtaggcggcgctgccgtaaatc

SEQ ID NO: 144882 - DNA, 28 bp, Artificial Sequence
  Description of Artificial Sequence: Synthetic oligonucleotide
gtttgtaggcggcgctgccgtaaatcag

SEQ ID NO: 144883 - DNA, 28 bp, Artificial Sequence
  Description of Artificial Sequence: Synthetic oligonucleotide
tttgtaggcggcgctgccgtaaatcagg

SEQ ID NO: 144884 - DNA, 27 bp, Artificial Sequence
  Description of Artificial Sequence: Synthetic oligonucleotide
ttgtaggcggcgctgccgtaaatcagg

SEQ ID NO: 144885 - DNA, 26 bp, Artificial Sequence
  Description of Artificial Sequence: Synthetic oligonucleotide
tgtaggcggcgctgccgtaaatcagg

SEQ ID NO: 144886 - DNA, 25 bp, Artificial Sequence
  Description of Artificial Sequence: Synthetic oligonucleotide
gtaggcggcgctgccgtaaatcagg

SEQ ID NO: 144887 - DNA, 25 bp, Artificial Sequence
  Description of Artificial Sequence: Synthetic oligonucleotide
taggcggcgctgccgtaaatcaggc

SEQ ID NO: 144888 - DNA, 24 bp, Artificial Sequence
  Description of Artificial Sequence: Synthetic oligonucleotide
aggcggcgctgccgtaaatcaggc

SEQ ID NO: 144889 - DNA, 23 bp, Artificial Sequence
  Description of Artificial Sequence: Synthetic oligonucleotide
ggcggcgctgccgtaaatcaggc

SEQ ID NO: 144890 - DNA, 23 bp, Artificial Sequence
  Description of Artificial Sequence: Synthetic oligonucleotide
gcggcgctgccgtaaatcaggcg

SEQ ID NO: 144891 - DNA, 24 bp, Artificial Sequence
  Description of Artificial Sequence: Synthetic oligonucleotide
cggcgctgccgtaaatcaggcggt

SEQ ID NO: 144892 - DNA, 25 bp, Artificial Sequence
  Description of Artificial Sequence: Synthetic oligonucleotide
ggcgctgccgtaaatcaggcggtct

SEQ ID NO: 144893 - DNA, 25 bp, Artificial Sequence
  Description of Artificial Sequence: Synthetic oligonucleotide
gcgctgccgtaaatcaggcggtctg

SEQ ID NO: 144894 - DNA, 27 bp, Artificial Sequence
  Description of Artificial Sequence: Synthetic oligonucleotide
cgctgccgtaaatcaggcggtctgctt

SEQ ID NO: 144895 - DNA, 27 bp, Artificial Sequence
  Description of Artificial Sequence: Synthetic oligonucleotide
gctgccgtaaatcaggcggtctgcttg

SEQ ID NO: 144896 - DNA, 27 bp, Artificial Sequence
  Description of Artificial Sequence: Synthetic oligonucleotide
ctgccgtaaatcaggcggtctgcttgc

SEQ ID NO: 144897 - DNA, 27 bp, Artificial Sequence
  Description of Artificial Sequence: Synthetic oligonucleotide
tgccgtaaatcaggcggtctgcttgcc

SEQ ID NO: 144898 - DNA, 26 bp, Artificial Sequence
  Description of Artificial Sequence: Synthetic oligonucleotide
gccgtaaatcaggcggtctgcttgcc

SEQ ID NO: 144899 - DNA, 26 bp, Artificial Sequence
  Description of Artificial Sequence: Synthetic oligonucleotide
ccgtaaatcaggcggtctgcttgccg

SEQ ID NO: 144900 - DNA, 27 bp, Artificial Sequence
  Description of Artificial Sequence: Synthetic oligonucleotide
cgtaaatcaggcggtctgcttgccgca

SEQ ID NO: 144901 - DNA, 28 bp, Artificial Sequence
  Description of Artificial Sequence: Synthetic oligonucleotide
gtaaatcaggcggtctgcttgccgcatc

SEQ ID NO: 144902 - DNA, 29 bp, Artificial Sequence
  Description of Artificial Sequence: Synthetic oligonucleotide
taaatcaggcggtctgcttgccgcatcac

SEQ ID NO: 144903 - DNA, 28 bp, Artificial Sequence
  Description of Artificial Sequence: Synthetic oligonucleotide
aaatcaggcggtctgcttgccgcatcac

SEQ ID NO: 144904 - DNA, 27 bp, Artificial Sequence
  Description of Artificial Sequence: Synthetic oligonucleotide
aatcaggcggtctgcttgccgcatcac

SEQ ID NO: 144905 - DNA, 26 bp, Artificial Sequence
  Description of Artificial Sequence: Synthetic oligonucleotide
atcaggcggtctgcttgccgcatcac

SEQ ID NO: 144906 - DNA, 25 bp, Artificial Sequence
  Description of Artificial Sequence: Synthetic oligonucleotide
tcaggcggtctgcttgccgcatcac

SEQ ID NO: 144907 - DNA, 24 bp, Artificial Sequence
  Description of Artificial Sequence: Synthetic oligonucleotide
caggcggtctgcttgccgcatcac

SEQ ID NO: 144908 - DNA, 24 bp, Artificial Sequence
  Description of Artificial Sequence: Synthetic oligonucleotide
aggcggtctgcttgccgcatcacg

SEQ ID NO: 144909 - DNA, 23 bp, Artificial Sequence
  Description of Artificial Sequence: Synthetic oligonucleotide
ggcggtctgcttgccgcatcacg

SEQ ID NO: 144910 - DNA, 25 bp, Artificial Sequence
  Description of Artificial Sequence: Synthetic oligonucleotide
gcggtctgcttgccgcatcacgcaa

SEQ ID NO: 144911 - DNA, 27 bp, Artificial Sequence
  Description of Artificial Sequence: Synthetic oligonucleotide
cggtctgcttgccgcatcacgcaagat

SEQ ID NO: 144912 - DNA, 27 bp, Artificial Sequence
  Description of Artificial Sequence: Synthetic oligonucleotide
ggtctgcttgccgcatcacgcaagatg

SEQ ID NO: 144913 - DNA, 27 bp, Artificial Sequence
  Description of Artificial Sequence: Synthetic oligonucleotide
gtctgcttgccgcatcacgcaagatgg

SEQ ID NO: 144914 - DNA, 27 bp, Artificial Sequence
  Description of Artificial Sequence: Synthetic oligonucleotide
tctgcttgccgcatcacgcaagatggc

SEQ ID NO: 144915 - DNA, 26 bp, Artificial Sequence
  Description of Artificial Sequence: Synthetic oligonucleotide
ctgcttgccgcatcacgcaagatggc

SEQ ID NO: 144916 - DNA, 26 bp, Artificial Sequence
  Description of Artificial Sequence: Synthetic oligonucleotide
tgcttgccgcatcacgcaagatggcg

SEQ ID NO: 144917 - DNA, 25 bp, Artificial Sequence
  Description of Artificial Sequence: Synthetic oligonucleotide
gcttgccgcatcacgcaagatggcg

SEQ ID NO: 144918 - DNA, 25 bp, Artificial Sequence
  Description of Artificial Sequence: Synthetic oligonucleotide
cttgccgcatcacgcaagatggcgg

SEQ ID NO: 144919 - DNA, 25 bp, Artificial Sequence
  Description of Artificial Sequence: Synthetic oligonucleotide
ttgccgcatcacgcaagatggcggc

SEQ ID NO: 144920 - DNA, 24 bp, Artificial Sequence
  Description of Artificial Sequence: Synthetic oligonucleotide
tgccgcatcacgcaagatggcggc

SEQ ID NO: 144921 - DNA, 23 bp, Artificial Sequence
  Description of Artificial Sequence: Synthetic oligonucleotide
gccgcatcacgcaagatggcggc

SEQ ID NO: 144922 - DNA, 23 bp, Artificial Sequence
  Description of Artificial Sequence: Synthetic oligonucleotide
ccgcatcacgcaagatggcggcc

SEQ ID NO: 144923 - DNA, 23 bp, Artificial Sequence
  Description of Artificial Sequence: Synthetic oligonucleotide
cgcatcacgcaagatggcggccg

SEQ ID NO: 144924 - DNA, 23 bp, Artificial Sequence
  Description of Artificial Sequence: Synthetic oligonucleotide
gcatcacgcaagatggcggccgc

SEQ ID NO: 144925 - DNA, 23 bp, Artificial Sequence
  Description of Artificial Sequence: Synthetic oligonucleotide
catcacgcaagatggcggccgcg

SEQ ID NO: 144926 - DNA, 23 bp, Artificial Sequence
  Description of Artificial Sequence: Synthetic oligonucleotide
atcacgcaagatggcggccgcgg

SEQ ID NO: 144927 - DNA, 22 bp, Artificial Sequence
  Description of Artificial Sequence: Synthetic oligonucleotide
tcacgcaagatggcggccgcgg

SEQ ID NO: 144928 - DNA, 21 bp, Artificial Sequence
  Description of Artificial Sequence: Synthetic oligonucleotide
cacgcaagatggcggccgcgg

SEQ ID NO: 144929 - DNA, 21 bp, Artificial Sequence
  Description of Artificial Sequence: Synthetic oligonucleotide
acgcaagatggcggccgcggc

SEQ ID NO: 144930 - DNA, 20 bp, Artificial Sequence
  Description of Artificial Sequence: Synthetic oligonucleotide
cgcaagatggcggccgcggc

SEQ ID NO: 144931 - DNA, 20 bp, Artificial Sequence
  Description of Artificial Sequence: Synthetic oligonucleotide
gcaagatggcggccgcggcg

SEQ ID NO: 144932 - DNA, 21 bp, Artificial Sequence
  Description of Artificial Sequence: Synthetic oligonucleotide
caagatggcggccgcggcggt

SEQ ID NO: 144933 - DNA, 23 bp, Artificial Sequence
  Description of Artificial Sequence: Synthetic oligonucleotide
aagatggcggccgcggcggtgaa

SEQ ID NO: 144934 - DNA, 22 bp, Artificial Sequence
  Description of Artificial Sequence: Synthetic oligonucleotide
agatggcggccgcggcggtgaa

SEQ ID NO: 144935 - DNA, 21 bp, Artificial Sequence
  Description of Artificial Sequence: Synthetic oligonucleotide
gatggcggccgcggcggtgaa

SEQ ID NO: 144936 - DNA, 21 bp, Artificial Sequence
  Description of Artificial Sequence: Synthetic oligonucleotide
atggcggccgcggcggtgaac

SEQ ID NO: 144937 - DNA, 20 bp, Artificial Sequence
  Description of Artificial Sequence: Synthetic oligonucleotide
tggcggccgcggcggtgaac

SEQ ID NO: 144938 - DNA, 20 bp, Artificial Sequence
  Description of Artificial Sequence: Synthetic oligonucleotide
ggcggccgcggcggtgaact

SEQ ID NO: 144939 - DNA, 20 bp, Artificial Sequence
  Description of Artificial Sequence: Synthetic oligonucleotide
gcggccgcggcggtgaacgt

SEQ ID NO: 144940 - DNA, 20 bp, Artificial Sequence
  Description of Artificial Sequence: Synthetic oligonucleotide
cggccgcggcggtgaacggt

SEQ ID NO: 144941 - DNA, 20 bp, Artificial Sequence
  Description of Artificial Sequence: Synthetic oligonucleotide
ggccgcggcggtgaacgggt

SEQ ID NO: 144942 - DNA, 20 bp, Artificial Sequence
  Description of Artificial Sequence: Synthetic oligonucleotide
gccgcggcggtgaacggggt

SEQ ID NO: 144943 - DNA, 20 bp, Artificial Sequence
  Description of Artificial Sequence: Synthetic oligonucleotide
ccgcggcggtgaacggggct

SEQ ID NO: 144944 - DNA, 20 bp, Artificial Sequence
  Description of Artificial Sequence: Synthetic oligonucleotide
cgcggcggtgaacggggcgt

SEQ ID NO: 144945 - DNA, 20 bp, Artificial Sequence
  Description of Artificial Sequence: Synthetic oligonucleotide
gcggcggtgaacggggcggt

SEQ ID NO: 144946 - DNA, 20 bp, Artificial Sequence
  Description of Artificial Sequence: Synthetic oligonucleotide
cggcggtgaacggggcggca

SEQ ID NO: 144947 - DNA, 20 bp, Artificial Sequence
  Description of Artificial Sequence: Synthetic oligonucleotide
ggcggtgaacggggcggcag

SEQ ID NO: 144948 - DNA, 20 bp, Artificial Sequence
  Description of Artificial Sequence: Synthetic oligonucleotide
gcggtgaacggggcggcagg

SEQ ID NO: 144949 - DNA, 22 bp, Artificial Sequence
  Description of Artificial Sequence: Synthetic oligonucleotide
cggtgaacggggcggcaggctt

SEQ ID NO: 144950 - DNA, 23 bp, Artificial Sequence
  Description of Artificial Sequence: Synthetic oligonucleotide
ggtgaacggggcggcaggcttct

SEQ ID NO: 144951 - DNA, 23 bp, Artificial Sequence
  Description of Artificial Sequence: Synthetic oligonucleotide
gtgaacggggcggcaggcttctc

SEQ ID NO: 144952 - DNA, 24 bp, Artificial Sequence
  Description of Artificial Sequence: Synthetic oligonucleotide
tgaacggggcggcaggcttctcga

SEQ ID NO: 144953 - DNA, 23 bp, Artificial Sequence
  Description of Artificial Sequence: Synthetic oligonucleotide
gaacggggcggcaggcttctcga

SEQ ID NO: 144954 - DNA, 23 bp, Artificial Sequence
  Description of Artificial Sequence: Synthetic oligonucleotide
aacggggcggcaggcttctcgag

SEQ ID NO: 144955 - DNA, 22 bp, Artificial Sequence
  Description of Artificial Sequence: Synthetic oligonucleotide
acggggcggcaggcttctcgag

SEQ ID NO: 144956 - DNA, 21 bp, Artificial Sequence
  Description of Artificial Sequence: Synthetic oligonucleotide
cggggcggcaggcttctcgag

SEQ ID NO: 144957 - DNA, 22 bp, Artificial Sequence
  Description of Artificial Sequence: Synthetic oligonucleotide
ggggcggcaggcttctcgagct

SEQ ID NO: 144958 - DNA, 22 bp, Artificial Sequence
  Description of Artificial Sequence: Synthetic oligonucleotide
gggcggcaggcttctcgagctc

SEQ ID NO: 144959 - DNA, 22 bp, Artificial Sequence
  Description of Artificial Sequence: Synthetic oligonucleotide
ggcggcaggcttctcgagctcc

SEQ ID NO: 144960 - DNA, 22 bp, Artificial Sequence
  Description of Artificial Sequence: Synthetic oligonucleotide
gcggcaggcttctcgagctccg

SEQ ID NO: 144961 - DNA, 22 bp, Artificial Sequence
  Description of Artificial Sequence: Synthetic oligonucleotide
cggcaggcttctcgagctccgg

SEQ ID NO: 144962 - DNA, 22 bp, Artificial Sequence
  Description of Artificial Sequence: Synthetic oligonucleotide
ggcaggcttctcgagctccggg

SEQ ID NO: 144963 - DNA, 22 bp, Artificial Sequence
  Description of Artificial Sequence: Synthetic oligonucleotide
gcaggcttctcgagctccgggc

SEQ ID NO: 144964 - DNA, 22 bp, Artificial Sequence
  Description of Artificial Sequence: Synthetic oligonucleotide
caggcttctcgagctccgggcc

SEQ ID NO: 144965 - DNA, 22 bp, Artificial Sequence
  Description of Artificial Sequence: Synthetic oligonucleotide
aggcttctcgagctccgggccc

SEQ ID NO: 144966 - DNA, 21 bp, Artificial Sequence
  Description of Artificial Sequence: Synthetic oligonucleotide
ggcttctcgagctccgggccc

SEQ ID NO: 144967 - DNA, 21 bp, Artificial Sequence
  Description of Artificial Sequence: Synthetic oligonucleotide
gcttctcgagctccgggcccg

SEQ ID NO: 144968 - DNA, 21 bp, Artificial Sequence
  Description of Artificial Sequence: Synthetic oligonucleotide
cttctcgagctccgggcccgc

SEQ ID NO: 144969 - DNA, 21 bp, Artificial Sequence
  Description of Artificial Sequence: Synthetic oligonucleotide
ttctcgagctccgggcccgcg

SEQ ID NO: 144970 - DNA, 20 bp, Artificial Sequence
  Description of Artificial Sequence: Synthetic oligonucleotide
tctcgagctccgggcccgcg

SEQ ID NO: 144971 - DNA, 20 bp, Artificial Sequence
  Description of Artificial Sequence: Synthetic oligonucleotide
ctcgagctccgggcccgcgt

SEQ ID NO: 144972 - DNA, 20 bp, Artificial Sequence
  Description of Artificial Sequence: Synthetic oligonucleotide
tcgagctccgggcccgcggt

SEQ ID NO: 144973 - DNA, 20 bp, Artificial Sequence
  Description of Artificial Sequence: Synthetic oligonucleotide
cgagctccgggcccgcggtt

SEQ ID NO: 144974 - DNA, 20 bp, Artificial Sequence
  Description of Artificial Sequence: Synthetic oligonucleotide
gagctccgggcccgcggcaa

SEQ ID NO: 144975 - DNA, 20 bp, Artificial Sequence
  Description of Artificial Sequence: Synthetic oligonucleotide
agctccgggcccgcggcaac

SEQ ID NO: 144976 - DNA, 20 bp, Artificial Sequence
  Description of Artificial Sequence: Synthetic oligonucleotide
gctccgggcccgcggcaact

SEQ ID NO: 144977 - DNA, 20 bp, Artificial Sequence
  Description of Artificial Sequence: Synthetic oligonucleotide
ctccgggcccgcggcaacct

SEQ ID NO: 144978 - DNA, 20 bp, Artificial Sequence
  Description of Artificial Sequence: Synthetic oligonucleotide
tccgggcccgcggcaacctc

SEQ ID NO: 144979 - DNA, 20 bp, Artificial Sequence
  Description of Artificial Sequence: Synthetic oligonucleotide
ccgggcccgcggcaacctct

SEQ ID NO: 144980 - DNA, 20 bp, Artificial Sequence
  Description of Artificial Sequence: Synthetic oligonucleotide
cgggcccgcggcaacctcgt

SEQ ID NO: 144981 - DNA, 20 bp, Artificial Sequence
  Description of Artificial Sequence: Synthetic oligonucleotide
gggcccgcggcaacctcggt

SEQ ID NO: 144982 - DNA, 20 bp, Artificial Sequence
  Description of Artificial Sequence: Synthetic oligonucleotide
ggcccgcggcaacctcgggt

SEQ ID NO: 144983 - DNA, 20 bp, Artificial Sequence
  Description of Artificial Sequence: Synthetic oligonucleotide
gcccgcggcaacctcgggct

SEQ ID NO: 144984 - DNA, 20 bp, Artificial Sequence
  Description of Artificial Sequence: Synthetic oligonucleotide
cccgcggcaacctcgggcgt

SEQ ID NO: 144985 - DNA, 20 bp, Artificial Sequence
  Description of Artificial Sequence: Synthetic oligonucleotide
ccgcggcaacctcgggcgct

SEQ ID NO: 144986 - DNA, 22 bp, Artificial Sequence
  Description of Artificial Sequence: Synthetic oligonucleotide
cgcggcaacctcgggcgctgtt

SEQ ID NO: 144987 - DNA, 23 bp, Artificial Sequence
  Description of Artificial Sequence: Synthetic oligonucleotide
gcggcaacctcgggcgctgttct

SEQ ID NO: 144988 - DNA, 23 bp, Artificial Sequence
  Description of Artificial Sequence: Synthetic oligonucleotide
cggcaacctcgggcgctgttctg

SEQ ID NO: 144989 - DNA, 24 bp, Artificial Sequence
  Description of Artificial Sequence: Synthetic oligonucleotide
ggcaacctcgggcgctgttctgca

SEQ ID NO: 144990 - DNA, 24 bp, Artificial Sequence
  Description of Artificial Sequence: Synthetic oligonucleotide
gcaacctcgggcgctgttctgcag

SEQ ID NO: 144991 - DNA, 24 bp, Artificial Sequence
  Description of Artificial Sequence: Synthetic oligonucleotide
caacctcgggcgctgttctgcagg

SEQ ID NO: 144992 - DNA, 24 bp, Artificial Sequence
  Description of Artificial Sequence: Synthetic oligonucleotide
aacctcgggcgctgttctgcaggc

SEQ ID NO: 144993 - DNA, 23 bp, Artificial Sequence
  Description of Artificial Sequence: Synthetic oligonucleotide
acctcgggcgctgttctgcaggc

SEQ ID NO: 144994 - DNA, 22 bp, Artificial Sequence
  Description of Artificial Sequence: Synthetic oligonucleotide
cctcgggcgctgttctgcaggc

SEQ ID NO: 144995 - DNA, 22 bp, Artificial Sequence
  Description of Artificial Sequence: Synthetic oligonucleotide
ctcgggcgctgttctgcaggcc

SEQ ID NO: 144996 - DNA, 22 bp, Artificial Sequence
  Description of Artificial Sequence: Synthetic oligonucleotide
tcgggcgctgttctgcaggccg

SEQ ID NO: 144997 - DNA, 21 bp, Artificial Sequence
  Description of Artificial Sequence: Synthetic oligonucleotide
cgggcgctgttctgcaggccg

SEQ ID NO: 144998 - DNA, 21 bp, Artificial Sequence
  Description of Artificial Sequence: Synthetic oligonucleotide
gggcgctgttctgcaggccgc

SEQ ID NO: 144999 - DNA, 22 bp, Artificial Sequence
  Description of Artificial Sequence: Synthetic oligonucleotide
ggcgctgttctgcaggccgcga

SEQ ID NO: 145000 - DNA, 22 bp, Artificial Sequence
  Description of Artificial Sequence: Synthetic oligonucleotide
gcgctgttctgcaggccgcgac

SEQ ID NO: 145001 - DNA, 22 bp, Artificial Sequence
  Description of Artificial Sequence: Synthetic oligonucleotide
cgctgttctgcaggccgcgacc

SEQ ID NO: 145002 - DNA, 22 bp, Artificial Sequence
  Description of Artificial Sequence: Synthetic oligonucleotide
gctgttctgcaggccgcgaccg

SEQ ID NO: 145003 - DNA, 22 bp, Artificial Sequence
  Description of Artificial Sequence: Synthetic oligonucleotide
ctgttctgcaggccgcgaccgg

SEQ ID NO: 145004 - DNA, 24 bp, Artificial Sequence
  Description of Artificial Sequence: Synthetic oligonucleotide
tgttctgcaggccgcgaccggcat

SEQ ID NO: 145005 - DNA, 23 bp, Artificial Sequence
  Description of Artificial Sequence: Synthetic oligonucleotide
gttctgcaggccgcgaccggcat

SEQ ID NO: 145006 - DNA, 25 bp, Artificial Sequence
  Description of Artificial Sequence: Synthetic oligonucleotide
ttctgcaggccgcgaccggcatgta

SEQ ID NO: 145007 - DNA, 24 bp, Artificial Sequence
  Description of Artificial Sequence: Synthetic oligonucleotide
tctgcaggccgcgaccggcatgta

SEQ ID NO: 145008 - DNA, 23 bp, Artificial Sequence
  Description of Artificial Sequence: Synthetic oligonucleotide
ctgcaggccgcgaccggcatgta

SEQ ID NO: 145009 - DNA, 23 bp, Artificial Sequence
  Description of Artificial Sequence: Synthetic oligonucleotide
tgcaggccgcgaccggcatgtac

SEQ ID NO: 145010 - DNA, 22 bp, Artificial Sequence
  Description of Artificial Sequence: Synthetic oligonucleotide
gcaggccgcgaccggcatgtac

SEQ ID NO: 145011 - DNA, 23 bp, Artificial Sequence
  Description of Artificial Sequence: Synthetic oligonucleotide
caggccgcgaccggcatgtacga

SEQ ID NO: 145012 - DNA, 23 bp, Artificial Sequence
  Description of Artificial Sequence: Synthetic oligonucleotide
aggccgcgaccggcatgtacgag

SEQ ID NO: 145013 - DNA, 22 bp, Artificial Sequence
  Description of Artificial Sequence: Synthetic oligonucleotide
ggccgcgaccggcatgtacgag

SEQ ID NO: 145014 - DNA, 24 bp, Artificial Sequence
  Description of Artificial Sequence: Synthetic oligonucleotide
gccgcgaccggcatgtacgagcaa

SEQ ID NO: 145015 - DNA, 25 bp, Artificial Sequence
  Description of Artificial Sequence: Synthetic oligonucleotide
ccgcgaccggcatgtacgagcaact

SEQ ID NO: 145016 - DNA, 27 bp, Artificial Sequence
  Description of Artificial Sequence: Synthetic oligonucleotide
cgcgaccggcatgtacgagcaactcaa

SEQ ID NO: 145017 - DNA, 27 bp, Artificial Sequence
  Description of Artificial Sequence: Synthetic oligonucleotide
gcgaccggcatgtacgagcaactcaag

SEQ ID NO: 145018 - DNA, 27 bp, Artificial Sequence
  Description of Artificial Sequence: Synthetic oligonucleotide
cgaccggcatgtacgagcaactcaagg

SEQ ID NO: 145019 - DNA, 27 bp, Artificial Sequence
  Description of Artificial Sequence: Synthetic oligonucleotide
gaccggcatgtacgagcaactcaaggg

SEQ ID NO: 145020 - DNA, 27 bp, Artificial Sequence
  Description of Artificial Sequence: Synthetic oligonucleotide
accggcatgtacgagcaactcaagggc

SEQ ID NO: 145021 - DNA, 26 bp, Artificial Sequence
  Description of Artificial Sequence: Synthetic oligonucleotide
ccggcatgtacgagcaactcaagggc

SEQ ID NO: 145022 - DNA, 27 bp, Artificial Sequence
  Description of Artificial Sequence: Synthetic oligonucleotide
cggcatgtacgagcaactcaagggcga

SEQ ID NO: 145023 - DNA, 27 bp, Artificial Sequence
  Description of Artificial Sequence: Synthetic oligonucleotide
ggcatgtacgagcaactcaagggcgag

SEQ ID NO: 145024 - DNA, 28 bp, Artificial Sequence
  Description of Artificial Sequence: Synthetic oligonucleotide
gcatgtacgagcaactcaagggcgagtg

SEQ ID NO: 145025 - DNA, 28 bp, Artificial Sequence
  Description of Artificial Sequence: Synthetic oligonucleotide
catgtacgagcaactcaagggcgagtgg

SEQ ID NO: 145026 - DNA, 30 bp, Artificial Sequence
  Description of Artificial Sequence: Synthetic oligonucleotide
atgtacgagcaactcaagggcgagtggaac

SEQ ID NO: 145027 - DNA, 29 bp, Artificial Sequence
  Description of Artificial Sequence: Synthetic oligonucleotide
tgtacgagcaactcaagggcgagtggaac

SEQ ID NO: 145028 - DNA, 28 bp, Artificial Sequence
  Description of Artificial Sequence: Synthetic oligonucleotide
gtacgagcaactcaagggcgagtggaac

SEQ ID NO: 145029 - DNA, 28 bp, Artificial Sequence
  Description of Artificial Sequence: Synthetic oligonucleotide
tacgagcaactcaagggcgagtggaacc

SEQ ID NO: 145030 - DNA, 27 bp, Artificial Sequence
  Description of Artificial Sequence: Synthetic oligonucleotide
acgagcaactcaagggcgagtggaacc

SEQ ID NO: 145031 - DNA, 26 bp, Artificial Sequence
  Description of Artificial Sequence: Synthetic oligonucleotide
cgagcaactcaagggcgagtggaacc

SEQ ID NO: 145032 - DNA, 27 bp, Artificial Sequence
  Description of Artificial Sequence: Synthetic oligonucleotide
gagcaactcaagggcgagtggaaccgt

SEQ ID NO: 145033 - DNA, 31 bp, Artificial Sequence
  Description of Artificial Sequence: Synthetic oligonucleotide
agcaactcaagggcgagtggaaccgtaaaag

SEQ ID NO: 145034 - DNA, 30 bp, Artificial Sequence
  Description of Artificial Sequence: Synthetic oligonucleotide
gcaactcaagggcgagtggaaccgtaaaag

SEQ ID NO: 145035 - DNA, 30 bp, Artificial Sequence
  Description of Artificial Sequence: Synthetic oligonucleotide
caactcaagggcgagtggaaccgtaaaagc

SEQ ID NO: 145036 - DNA, 30 bp, Artificial Sequence
  Description of Artificial Sequence: Synthetic oligonucleotide
aactcaagggcgagtggaaccgtaaaagcc

SEQ ID NO: 145037 - DNA, 29 bp, Artificial Sequence
  Description of Artificial Sequence: Synthetic oligonucleotide
actcaagggcgagtggaaccgtaaaagcc

SEQ ID NO: 145038 - DNA, 28 bp, Artificial Sequence
  Description of Artificial Sequence: Synthetic oligonucleotide
ctcaagggcgagtggaaccgtaaaagcc

SEQ ID NO: 145039 - DNA, 28 bp, Artificial Sequence
  Description of Artificial Sequence: Synthetic oligonucleotide
tcaagggcgagtggaaccgtaaaagccc

SEQ ID NO: 145040 - DNA, 27 bp, Artificial Sequence
  Description of Artificial Sequence: Synthetic oligonucleotide
caagggcgagtggaaccgtaaaagccc

SEQ ID NO: 145041 - DNA, 27 bp, Artificial Sequence
  Description of Artificial Sequence: Synthetic oligonucleotide
aagggcgagtggaaccgtaaaagcccc

SEQ ID NO: 145042 - DNA, 27 bp, Artificial Sequence
  Description of Artificial Sequence: Synthetic oligonucleotide
agggcgagtggaaccgtaaaagcccca

SEQ ID NO: 145043 - DNA, 27 bp, Artificial Sequence
  Description of Artificial Sequence: Synthetic oligonucleotide
gggcgagtggaaccgtaaaagccccaa

SEQ ID NO: 145044 - DNA, 28 bp, Artificial Sequence
  Description of Artificial Sequence: Synthetic oligonucleotide
ggcgagtggaaccgtaaaagccccaatc

SEQ ID NO: 145045 - DNA, 31 bp, Artificial Sequence
  Description of Artificial Sequence: Synthetic oligonucleotide
gcgagtggaaccgtaaaagccccaatcttag

SEQ ID NO: 145046 - DNA, 31 bp, Artificial Sequence
  Description of Artificial Sequence: Synthetic oligonucleotide
cgagtggaaccgtaaaagccccaatcttagc

SEQ ID NO: 145047 - DNA, 33 bp, Artificial Sequence
  Description of Artificial Sequence: Synthetic oligonucleotide
gagtggaaccgtaaaagccccaatcttagcaag

SEQ ID NO: 145048 - DNA, 34 bp, Artificial Sequence
  Description of Artificial Sequence: Synthetic oligonucleotide
agtggaaccgtaaaagccccaatcttagcaagtg

SEQ ID NO: 145049 - DNA, 33 bp, Artificial Sequence
  Description of Artificial Sequence: Synthetic oligonucleotide
gtggaaccgtaaaagccccaatcttagcaagtg

SEQ ID NO: 145050 - DNA, 33 bp, Artificial Sequence
  Description of Artificial Sequence: Synthetic oligonucleotide
tggaaccgtaaaagccccaatcttagcaagtgc

SEQ ID NO: 145051 - DNA, 32 bp, Artificial Sequence
  Description of Artificial Sequence: Synthetic oligonucleotide
ggaaccgtaaaagccccaatcttagcaagtgc

SEQ ID NO: 145052 - DNA, 32 bp, Artificial Sequence
  Description of Artificial Sequence: Synthetic oligonucleotide
gaaccgtaaaagccccaatcttagcaagtgcg

SEQ ID NO: 145053 - DNA, 32 bp, Artificial Sequence
  Description of Artificial Sequence: Synthetic oligonucleotide
aaccgtaaaagccccaatcttagcaagtgcgg

SEQ ID NO: 145054 - DNA, 31 bp, Artificial Sequence
  Description of Artificial Sequence: Synthetic oligonucleotide
accgtaaaagccccaatcttagcaagtgcgg

SEQ ID NO: 145055 - DNA, 30 bp, Artificial Sequence
  Description of Artificial Sequence: Synthetic oligonucleotide
ccgtaaaagccccaatcttagcaagtgcgg

SEQ ID NO: 145056 - DNA, 30 bp, Artificial Sequence
  Description of Artificial Sequence: Synthetic oligonucleotide
cgtaaaagccccaatcttagcaagtgcggg

SEQ ID NO: 145057 - DNA, 30 bp, Artificial Sequence
  Description of Artificial Sequence: Synthetic oligonucleotide
gtaaaagccccaatcttagcaagtgcgggg

SEQ ID NO: 145058 - DNA, 32 bp, Artificial Sequence
  Description of Artificial Sequence: Synthetic oligonucleotide
taaaagccccaatcttagcaagtgcggggaag

SEQ ID NO: 145059 - DNA, 31 bp, Artificial Sequence
  Description of Artificial Sequence: Synthetic oligonucleotide
aaaagccccaatcttagcaagtgcggggaag

SEQ ID NO: 145060 - DNA, 30 bp, Artificial Sequence
  Description of Artificial Sequence: Synthetic oligonucleotide
aaagccccaatcttagcaagtgcggggaag

SEQ ID NO: 145061 - DNA, 29 bp, Artificial Sequence
  Description of Artificial Sequence: Synthetic oligonucleotide
aagccccaatcttagcaagtgcggggaag

SEQ ID NO: 145062 - DNA, 28 bp, Artificial Sequence
  Description of Artificial Sequence: Synthetic oligonucleotide
agccccaatcttagcaagtgcggggaag

SEQ ID NO: 145063 - DNA, 27 bp, Artificial Sequence
  Description of Artificial Sequence: Synthetic oligonucleotide
gccccaatcttagcaagtgcggggaag

SEQ ID NO: 145064 - DNA, 28 bp, Artificial Sequence
  Description of Artificial Sequence: Synthetic oligonucleotide
ccccaatcttagcaagtgcggggaagag

SEQ ID NO: 145065 - DNA, 28 bp, Artificial Sequence
  Description of Artificial Sequence: Synthetic oligonucleotide
cccaatcttagcaagtgcggggaagagc

SEQ ID NO: 145066 - DNA, 29 bp, Artificial Sequence
  Description of Artificial Sequence: Synthetic oligonucleotide
ccaatcttagcaagtgcggggaagagctg

SEQ ID NO: 145067 - DNA, 29 bp, Artificial Sequence
  Description of Artificial Sequence: Synthetic oligonucleotide
caatcttagcaagtgcggggaagagctgg

SEQ ID NO: 145068 - DNA, 29 bp, Artificial Sequence
  Description of Artificial Sequence: Synthetic oligonucleotide
aatcttagcaagtgcggggaagagctggg

SEQ ID NO: 145069 - DNA, 28 bp, Artificial Sequence
  Description of Artificial Sequence: Synthetic oligonucleotide
atcttagcaagtgcggggaagagctggg

SEQ ID NO: 145070 - DNA, 27 bp, Artificial Sequence
  Description of Artificial Sequence: Synthetic oligonucleotide
tcttagcaagtgcggggaagagctggg

SEQ ID NO: 145071 - DNA, 27 bp, Artificial Sequence
  Description of Artificial Sequence: Synthetic oligonucleotide
cttagcaagtgcggggaagagctgggt

SEQ ID NO: 145072 - DNA, 27 bp, Artificial Sequence
  Description of Artificial Sequence: Synthetic oligonucleotide
ttagcaagtgcggggaagagctgggtc

SEQ ID NO: 145073 - DNA, 26 bp, Artificial Sequence
  Description of Artificial Sequence: Synthetic oligonucleotide
tagcaagtgcggggaagagctgggtc

SEQ ID NO: 145074 - DNA, 25 bp, Artificial Sequence
  Description of Artificial Sequence: Synthetic oligonucleotide
agcaagtgcggggaagagctgggtc

SEQ ID NO: 145075 - DNA, 24 bp, Artificial Sequence
  Description of Artificial Sequence: Synthetic oligonucleotide
gcaagtgcggggaagagctgggtc

SEQ ID NO: 145076 - DNA, 25 bp, Artificial Sequence
  Description of Artificial Sequence: Synthetic oligonucleotide
caagtgcggggaagagctgggtcga

SEQ ID NO: 145077 - DNA, 26 bp, Artificial Sequence
  Description of Artificial Sequence: Synthetic oligonucleotide
aagtgcggggaagagctgggtcgact

SEQ ID NO: 145078 - DNA, 25 bp, Artificial Sequence
  Description of Artificial Sequence: Synthetic oligonucleotide
agtgcggggaagagctgggtcgact

SEQ ID NO: 145079 - DNA, 24 bp, Artificial Sequence
  Description of Artificial Sequence: Synthetic oligonucleotide
gtgcggggaagagctgggtcgact

SEQ ID NO: 145080 - DNA, 26 bp, Artificial Sequence
  Description of Artificial Sequence: Synthetic oligonucleotide
tgcggggaagagctgggtcgactcaa

SEQ ID NO: 145081 - DNA, 25 bp, Artificial Sequence
  Description of Artificial Sequence: Synthetic oligonucleotide
gcggggaagagctgggtcgactcaa

SEQ ID NO: 145082 - DNA, 25 bp, Artificial Sequence
  Description of Artificial Sequence: Synthetic oligonucleotide
cggggaagagctgggtcgactcaag

SEQ ID NO: 145083 - DNA, 27 bp, Artificial Sequence
  Description of Artificial Sequence: Synthetic oligonucleotide
ggggaagagctgggtcgactcaagcta

SEQ ID NO: 145084 - DNA, 27 bp, Artificial Sequence
  Description of Artificial Sequence: Synthetic oligonucleotide
gggaagagctgggtcgactcaagctag

SEQ ID NO: 145085 - DNA, 29 bp, Artificial Sequence
  Description of Artificial Sequence: Synthetic oligonucleotide
ggaagagctgggtcgactcaagctagttc

SEQ ID NO: 145086 - DNA, 31 bp, Artificial Sequence
  Description of Artificial Sequence: Synthetic oligonucleotide
gaagagctgggtcgactcaagctagttcttc

SEQ ID NO: 145087 - DNA, 32 bp, Artificial Sequence
  Description of Artificial Sequence: Synthetic oligonucleotide
aagagctgggtcgactcaagctagttcttctg

SEQ ID NO: 145088 - DNA, 31 bp, Artificial Sequence
  Description of Artificial Sequence: Synthetic oligonucleotide
agagctgggtcgactcaagctagttcttctg

SEQ ID NO: 145089 - DNA, 30 bp, Artificial Sequence
  Description of Artificial Sequence: Synthetic oligonucleotide
gagctgggtcgactcaagctagttcttctg

SEQ ID NO: 145090 - DNA, 30 bp, Artificial Sequence
  Description of Artificial Sequence: Synthetic oligonucleotide
agctgggtcgactcaagctagttcttctgg

SEQ ID NO: 145091 - DNA, 29 bp, Artificial Sequence
  Description of Artificial Sequence: Synthetic oligonucleotide
gctgggtcgactcaagctagttcttctgg

SEQ ID NO: 145092 - DNA, 30 bp, Artificial Sequence
  Description of Artificial Sequence: Synthetic oligonucleotide
ctgggtcgactcaagctagttcttctggag

SEQ ID NO: 145093 - DNA, 30 bp, Artificial Sequence
  Description of Artificial Sequence: Synthetic oligonucleotide
tgggtcgactcaagctagttcttctggagc

SEQ ID NO: 145094 - DNA, 29 bp, Artificial Sequence
  Description of Artificial Sequence: Synthetic oligonucleotide
gggtcgactcaagctagttcttctggagc

SEQ ID NO: 145095 - DNA, 30 bp, Artificial Sequence
  Description of Artificial Sequence: Synthetic oligonucleotide
ggtcgactcaagctagttcttctggagctc

SEQ ID NO: 145096 - DNA, 32 bp, Artificial Sequence
  Description of Artificial Sequence: Synthetic oligonucleotide
gtcgactcaagctagttcttctggagctcaac

SEQ ID NO: 145097 - DNA, 34 bp, Artificial Sequence
  Description of Artificial Sequence: Synthetic oligonucleotide
tcgactcaagctagttcttctggagctcaacttc

SEQ ID NO: 145098 - DNA, 33 bp, Artificial Sequence
  Description of Artificial Sequence: Synthetic oligonucleotide
cgactcaagctagttcttctggagctcaacttc

SEQ ID NO: 145099 - DNA, 35 bp, Artificial Sequence
  Description of Artificial Sequence: Synthetic oligonucleotide
gactcaagctagttcttctggagctcaacttcttg

SEQ ID NO: 145100 - DNA, 35 bp, Artificial Sequence
  Description of Artificial Sequence: Synthetic oligonucleotide
actcaagctagttcttctggagctcaacttcttgc

SEQ ID NO: 145101 - DNA, 34 bp, Artificial Sequence
  Description of Artificial Sequence: Synthetic oligonucleotide
ctcaagctagttcttctggagctcaacttcttgc

SEQ ID NO: 145102 - DNA, 34 bp, Artificial Sequence
  Description of Artificial Sequence: Synthetic oligonucleotide
tcaagctagttcttctggagctcaacttcttgcc

SEQ ID NO: 145103 - DNA, 33 bp, Artificial Sequence
  Description of Artificial Sequence: Synthetic oligonucleotide
caagctagttcttctggagctcaacttcttgcc

SEQ ID NO: 145104 - DNA, 35 bp, Artificial Sequence
  Description of Artificial Sequence: Synthetic oligonucleotide
aagctagttcttctggagctcaacttcttgccaac

SEQ ID NO: 145105 - DNA, 34 bp, Artificial Sequence
  Description of Artificial Sequence: Synthetic oligonucleotide
agctagttcttctggagctcaacttcttgccaac

SEQ ID NO: 145106 - DNA, 33 bp, Artificial Sequence
  Description of Artificial Sequence: Synthetic oligonucleotide
gctagttcttctggagctcaacttcttgccaac

SEQ ID NO: 145107 - DNA, 33 bp, Artificial Sequence
  Description of Artificial Sequence: Synthetic oligonucleotide
ctagttcttctggagctcaacttcttgccaacc

SEQ ID NO: 145108 - DNA, 34 bp, Artificial Sequence
  Description of Artificial Sequence: Synthetic oligonucleotide
tagttcttctggagctcaacttcttgccaaccac

SEQ ID NO: 145109 - DNA, 33 bp, Artificial Sequence
  Description of Artificial Sequence: Synthetic oligonucleotide
agttcttctggagctcaacttcttgccaaccac

SEQ ID NO: 145110 - DNA, 32 bp, Artificial Sequence
  Description of Artificial Sequence: Synthetic oligonucleotide
gttcttctggagctcaacttcttgccaaccac

SEQ ID NO: 145111 - DNA, 33 bp, Artificial Sequence
  Description of Artificial Sequence: Synthetic oligonucleotide
ttcttctggagctcaacttcttgccaaccacag

SEQ ID NO: 145112 - DNA, 32 bp, Artificial Sequence
  Description of Artificial Sequence: Synthetic oligonucleotide
tcttctggagctcaacttcttgccaaccacag

SEQ ID NO: 145113 - DNA, 31 bp, Artificial Sequence
  Description of Artificial Sequence: Synthetic oligonucleotide
cttctggagctcaacttcttgccaaccacag

SEQ ID NO: 145114 - DNA, 31 bp, Artificial Sequence
  Description of Artificial Sequence: Synthetic oligonucleotide
ttctggagctcaacttcttgccaaccacagg

SEQ ID NO: 145115 - DNA, 30 bp, Artificial Sequence
  Description of Artificial Sequence: Synthetic oligonucleotide
tctggagctcaacttcttgccaaccacagg

SEQ ID NO: 145116 - DNA, 29 bp, Artificial Sequence
  Description of Artificial Sequence: Synthetic oligonucleotide
ctggagctcaacttcttgccaaccacagg

SEQ ID NO: 145117 - DNA, 29 bp, Artificial Sequence
  Description of Artificial Sequence: Synthetic oligonucleotide
tggagctcaacttcttgccaaccacaggg

SEQ ID NO: 145118 - DNA, 28 bp, Artificial Sequence
  Description of Artificial Sequence: Synthetic oligonucleotide
ggagctcaacttcttgccaaccacaggg

SEQ ID NO: 145119 - DNA, 29 bp, Artificial Sequence
  Description of Artificial Sequence: Synthetic oligonucleotide
gagctcaacttcttgccaaccacagggac

SEQ ID NO: 145120 - DNA, 29 bp, Artificial Sequence
  Description of Artificial Sequence: Synthetic oligonucleotide
agctcaacttcttgccaaccacagggacc

SEQ ID NO: 145121 - DNA, 28 bp, Artificial Sequence
  Description of Artificial Sequence: Synthetic oligonucleotide
gctcaacttcttgccaaccacagggacc

SEQ ID NO: 145122 - DNA, 30 bp, Artificial Sequence
  Description of Artificial Sequence: Synthetic oligonucleotide
ctcaacttcttgccaaccacagggaccaag

SEQ ID NO: 145123 - DNA, 30 bp, Artificial Sequence
  Description of Artificial Sequence: Synthetic oligonucleotide
tcaacttcttgccaaccacagggaccaagc

SEQ ID NO: 145124 - DNA, 29 bp, Artificial Sequence
  Description of Artificial Sequence: Synthetic oligonucleotide
caacttcttgccaaccacagggaccaagc

SEQ ID NO: 145125 - DNA, 30 bp, Artificial Sequence
  Description of Artificial Sequence: Synthetic oligonucleotide
aacttcttgccaaccacagggaccaagctg

SEQ ID NO: 145126 - DNA, 29 bp, Artificial Sequence
  Description of Artificial Sequence: Synthetic oligonucleotide
acttcttgccaaccacagggaccaagctg

SEQ ID NO: 145127 - DNA, 28 bp, Artificial Sequence
  Description of Artificial Sequence: Synthetic oligonucleotide
cttcttgccaaccacagggaccaagctg

SEQ ID NO: 145128 - DNA, 29 bp, Artificial Sequence
  Description of Artificial Sequence: Synthetic oligonucleotide
ttcttgccaaccacagggaccaagctgac

SEQ ID NO: 145129 - DNA, 28 bp, Artificial Sequence
  Description of Artificial Sequence: Synthetic oligonucleotide
tcttgccaaccacagggaccaagctgac

SEQ ID NO: 145130 - DNA, 27 bp, Artificial Sequence
  Description of Artificial Sequence: Synthetic oligonucleotide
cttgccaaccacagggaccaagctgac

SEQ ID NO: 145131 - DNA, 27 bp, Artificial Sequence
  Description of Artificial Sequence: Synthetic oligonucleotide
ttgccaaccacagggaccaagctgacc

SEQ ID NO: 145132 - DNA, 27 bp, Artificial Sequence
  Description of Artificial Sequence: Synthetic oligonucleotide
tgccaaccacagggaccaagctgacca

SEQ ID NO: 145133 - DNA, 27 bp, Artificial Sequence
  Description of Artificial Sequence: Synthetic oligonucleotide
gccaaccacagggaccaagctgaccaa

SEQ ID NO: 145134 - DNA, 28 bp, Artificial Sequence
  Description of Artificial Sequence: Synthetic oligonucleotide
ccaaccacagggaccaagctgaccaaac

SEQ ID NO: 145135 - DNA, 29 bp, Artificial Sequence
  Description of Artificial Sequence: Synthetic oligonucleotide
caaccacagggaccaagctgaccaaacag

SEQ ID NO: 145136 - DNA, 29 bp, Artificial Sequence
  Description of Artificial Sequence: Synthetic oligonucleotide
aaccacagggaccaagctgaccaaacagc

SEQ ID NO: 145137 - DNA, 28 bp, Artificial Sequence
  Description of Artificial Sequence: Synthetic oligonucleotide
accacagggaccaagctgaccaaacagc

SEQ ID NO: 145138 - DNA, 27 bp, Artificial Sequence
  Description of Artificial Sequence: Synthetic oligonucleotide
ccacagggaccaagctgaccaaacagc

SEQ ID NO: 145139 - DNA, 28 bp, Artificial Sequence
  Description of Artificial Sequence: Synthetic oligonucleotide
cacagggaccaagctgaccaaacagcag

SEQ ID NO: 145140 - DNA, 28 bp, Artificial Sequence
  Description of Artificial Sequence: Synthetic oligonucleotide
acagggaccaagctgaccaaacagcagc

SEQ ID NO: 145141 - DNA, 27 bp, Artificial Sequence
  Description of Artificial Sequence: Synthetic oligonucleotide
cagggaccaagctgaccaaacagcagc

SEQ ID NO: 145142 - DNA, 32 bp, Artificial Sequence
  Description of Artificial Sequence: Synthetic oligonucleotide
agggaccaagctgaccaaacagcagctaattc

SEQ ID NO: 145143 - DNA, 31 bp, Artificial Sequence
  Description of Artificial Sequence: Synthetic oligonucleotide
gggaccaagctgaccaaacagcagctaattc

SEQ ID NO: 145144 - DNA, 32 bp, Artificial Sequence
  Description of Artificial Sequence: Synthetic oligonucleotide
ggaccaagctgaccaaacagcagctaattctg

SEQ ID NO: 145145 - DNA, 32 bp, Artificial Sequence
  Description of Artificial Sequence: Synthetic oligonucleotide
gaccaagctgaccaaacagcagctaattctgg

SEQ ID NO: 145146 - DNA, 32 bp, Artificial Sequence
  Description of Artificial Sequence: Synthetic oligonucleotide
accaagctgaccaaacagcagctaattctggc

SEQ ID NO: 145147 - DNA, 31 bp, Artificial Sequence
  Description of Artificial Sequence: Synthetic oligonucleotide
ccaagctgaccaaacagcagctaattctggc

SEQ ID NO: 145148 - DNA, 31 bp, Artificial Sequence
  Description of Artificial Sequence: Synthetic oligonucleotide
caagctgaccaaacagcagctaattctggcc

SEQ ID NO: 145149 - DNA, 31 bp, Artificial Sequence
  Description of Artificial Sequence: Synthetic oligonucleotide
aagctgaccaaacagcagctaattctggccc

SEQ ID NO: 145150 - DNA, 30 bp, Artificial Sequence
  Description of Artificial Sequence: Synthetic oligonucleotide
agctgaccaaacagcagctaattctggccc

SEQ ID NO: 145151 - DNA, 29 bp, Artificial Sequence
  Description of Artificial Sequence: Synthetic oligonucleotide
gctgaccaaacagcagctaattctggccc

SEQ ID NO: 145152 - DNA, 29 bp, Artificial Sequence
  Description of Artificial Sequence: Synthetic oligonucleotide
ctgaccaaacagcagctaattctggcccg

SEQ ID NO: 145153 - DNA, 30 bp, Artificial Sequence
  Description of Artificial Sequence: Synthetic oligonucleotide
tgaccaaacagcagctaattctggcccgtg

SEQ ID NO: 145154 - DNA, 29 bp, Artificial Sequence
  Description of Artificial Sequence: Synthetic oligonucleotide
gaccaaacagcagctaattctggcccgtg

SEQ ID NO: 145155 - DNA, 30 bp, Artificial Sequence
  Description of Artificial Sequence: Synthetic oligonucleotide
accaaacagcagctaattctggcccgtgac

SEQ ID NO: 145156 - DNA, 29 bp, Artificial Sequence
  Description of Artificial Sequence: Synthetic oligonucleotide
ccaaacagcagctaattctggcccgtgac

SEQ ID NO: 145157 - DNA, 32 bp, Artificial Sequence
  Description of Artificial Sequence: Synthetic oligonucleotide
caaacagcagctaattctggcccgtgacatac

SEQ ID NO: 145158 - DNA, 33 bp, Artificial Sequence
  Description of Artificial Sequence: Synthetic oligonucleotide
aaacagcagctaattctggcccgtgacatactg

SEQ ID NO: 145159 - DNA, 32 bp, Artificial Sequence
  Description of Artificial Sequence: Synthetic oligonucleotide
aacagcagctaattctggcccgtgacatactg

SEQ ID NO: 145160 - DNA, 31 bp, Artificial Sequence
  Description of Artificial Sequence: Synthetic oligonucleotide
acagcagctaattctggcccgtgacatactg

SEQ ID NO: 145161 - DNA, 30 bp, Artificial Sequence
  Description of Artificial Sequence: Synthetic oligonucleotide
cagcagctaattctggcccgtgacatactg

SEQ ID NO: 145162 - DNA, 30 bp, Artificial Sequence
  Description of Artificial Sequence: Synthetic oligonucleotide
agcagctaattctggcccgtgacatactgg

SEQ ID NO: 145163 - DNA, 29 bp, Artificial Sequence
  Description of Artificial Sequence: Synthetic oligonucleotide
gcagctaattctggcccgtgacatactgg

SEQ ID NO: 145164 - DNA, 30 bp, Artificial Sequence
  Description of Artificial Sequence: Synthetic oligonucleotide
cagctaattctggcccgtgacatactggag

SEQ ID NO: 145165 - DNA, 32 bp, Artificial Sequence
  Description of Artificial Sequence: Synthetic oligonucleotide
agctaattctggcccgtgacatactggagatc

SEQ ID NO: 145166 - DNA, 31 bp, Artificial Sequence
  Description of Artificial Sequence: Synthetic oligonucleotide
gctaattctggcccgtgacatactggagatc

SEQ ID NO: 145167 - DNA, 31 bp, Artificial Sequence
  Description of Artificial Sequence: Synthetic oligonucleotide
ctaattctggcccgtgacatactggagatcg

SEQ ID NO: 145168 - DNA, 31 bp, Artificial Sequence
  Description of Artificial Sequence: Synthetic oligonucleotide
taattctggcccgtgacatactggagatcgg

SEQ ID NO: 145169 - DNA, 30 bp, Artificial Sequence
  Description of Artificial Sequence: Synthetic oligonucleotide
aattctggcccgtgacatactggagatcgg

SEQ ID NO: 145170 - DNA, 29 bp, Artificial Sequence
  Description of Artificial Sequence: Synthetic oligonucleotide
attctggcccgtgacatactggagatcgg

SEQ ID NO: 145171 - DNA, 28 bp, Artificial Sequence
  Description of Artificial Sequence: Synthetic oligonucleotide
ttctggcccgtgacatactggagatcgg

SEQ ID NO: 145172 - DNA, 27 bp, Artificial Sequence
  Description of Artificial Sequence: Synthetic oligonucleotide
tctggcccgtgacatactggagatcgg

SEQ ID NO: 145173 - DNA, 26 bp, Artificial Sequence
  Description of Artificial Sequence: Synthetic oligonucleotide
ctggcccgtgacatactggagatcgg

SEQ ID NO: 145174 - DNA, 26 bp, Artificial Sequence
  Description of Artificial Sequence: Synthetic oligonucleotide
tggcccgtgacatactggagatcggg

SEQ ID NO: 145175 - DNA, 25 bp, Artificial Sequence
  Description of Artificial Sequence: Synthetic oligonucleotide
ggcccgtgacatactggagatcggg

SEQ ID NO: 145176 - DNA, 25 bp, Artificial Sequence
  Description of Artificial Sequence: Synthetic oligonucleotide
gcccgtgacatactggagatcgggg

SEQ ID NO: 145177 - DNA, 25 bp, Artificial Sequence
  Description of Artificial Sequence: Synthetic oligonucleotide
cccgtgacatactggagatcggggc

SEQ ID NO: 145178 - DNA, 25 bp, Artificial Sequence
  Description of Artificial Sequence: Synthetic oligonucleotide
ccgtgacatactggagatcggggcc

SEQ ID NO: 145179 - DNA, 27 bp, Artificial Sequence
  Description of Artificial Sequence: Synthetic oligonucleotide
cgtgacatactggagatcggggcccaa

SEQ ID NO: 145180 - DNA, 28 bp, Artificial Sequence
  Description of Artificial Sequence: Synthetic oligonucleotide
gtgacatactggagatcggggcccaatg

SEQ ID NO: 145181 - DNA, 28 bp, Artificial Sequence
  Description of Artificial Sequence: Synthetic oligonucleotide
tgacatactggagatcggggcccaatgg

SEQ ID NO: 145182 - DNA, 27 bp, Artificial Sequence
  Description of Artificial Sequence: Synthetic oligonucleotide
gacatactggagatcggggcccaatgg

SEQ ID NO: 145183 - DNA, 28 bp, Artificial Sequence
  Description of Artificial Sequence: Synthetic oligonucleotide
acatactggagatcggggcccaatggag

SEQ ID NO: 145184 - DNA, 27 bp, Artificial Sequence
  Description of Artificial Sequence: Synthetic oligonucleotide
catactggagatcggggcccaatggag

SEQ ID NO: 145185 - DNA, 27 bp, Artificial Sequence
  Description of Artificial Sequence: Synthetic oligonucleotide
atactggagatcggggcccaatggagc

SEQ ID NO: 145186 - DNA, 27 bp, Artificial Sequence
  Description of Artificial Sequence: Synthetic oligonucleotide
tactggagatcggggcccaatggagca

SEQ ID NO: 145187 - DNA, 27 bp, Artificial Sequence
  Description of Artificial Sequence: Synthetic oligonucleotide
actggagatcggggcccaatggagcat

SEQ ID NO: 145188 - DNA, 26 bp, Artificial Sequence
  Description of Artificial Sequence: Synthetic oligonucleotide
ctggagatcggggcccaatggagcat

SEQ ID NO: 145189 - DNA, 26 bp, Artificial Sequence
  Description of Artificial Sequence: Synthetic oligonucleotide
tggagatcggggcccaatggagcatc

SEQ ID NO: 145190 - DNA, 25 bp, Artificial Sequence
  Description of Artificial Sequence: Synthetic oligonucleotide
ggagatcggggcccaatggagcatc

SEQ ID NO: 145191 - DNA, 27 bp, Artificial Sequence
  Description of Artificial Sequence: Synthetic oligonucleotide
gagatcggggcccaatggagcatccta

SEQ ID NO: 145192 - DNA, 27 bp, Artificial Sequence
  Description of Artificial Sequence: Synthetic oligonucleotide
agatcggggcccaatggagcatcctac

SEQ ID NO: 145193 - DNA, 26 bp, Artificial Sequence
  Description of Artificial Sequence: Synthetic oligonucleotide
gatcggggcccaatggagcatcctac

SEQ ID NO: 145194 - DNA, 26 bp, Artificial Sequence
  Description of Artificial Sequence: Synthetic oligonucleotide
atcggggcccaatggagcatcctacg

SEQ ID NO: 145195 - DNA, 25 bp, Artificial Sequence
  Description of Artificial Sequence: Synthetic oligonucleotide
tcggggcccaatggagcatcctacg

SEQ ID NO: 145196 - DNA, 24 bp, Artificial Sequence
  Description of Artificial Sequence: Synthetic oligonucleotide
cggggcccaatggagcatcctacg

SEQ ID NO: 145197 - DNA, 26 bp, Artificial Sequence
  Description of Artificial Sequence: Synthetic oligonucleotide
ggggcccaatggagcatcctacgcaa

SEQ ID NO: 145198 - DNA, 26 bp, Artificial Sequence
  Description of Artificial Sequence: Synthetic oligonucleotide
gggcccaatggagcatcctacgcaag

SEQ ID NO: 145199 - DNA, 27 bp, Artificial Sequence
  Description of Artificial Sequence: Synthetic oligonucleotide
ggcccaatggagcatcctacgcaagga

SEQ ID NO: 145200 - DNA, 27 bp, Artificial Sequence
  Description of Artificial Sequence: Synthetic oligonucleotide
gcccaatggagcatcctacgcaaggac

SEQ ID NO: 145201 - DNA, 29 bp, Artificial Sequence
  Description of Artificial Sequence: Synthetic oligonucleotide
cccaatggagcatcctacgcaaggacatc

SEQ ID NO: 145202 - DNA, 29 bp, Artificial Sequence
  Description of Artificial Sequence: Synthetic oligonucleotide
ccaatggagcatcctacgcaaggacatcc

SEQ ID NO: 145203 - DNA, 29 bp, Artificial Sequence
  Description of Artificial Sequence: Synthetic oligonucleotide
caatggagcatcctacgcaaggacatccc

SEQ ID NO: 145204 - DNA, 29 bp, Artificial Sequence
  Description of Artificial Sequence: Synthetic oligonucleotide
aatggagcatcctacgcaaggacatcccc

SEQ ID NO: 145205 - DNA, 28 bp, Artificial Sequence
  Description of Artificial Sequence: Synthetic oligonucleotide
atggagcatcctacgcaaggacatcccc

SEQ ID NO: 145206 - DNA, 27 bp, Artificial Sequence
  Description of Artificial Sequence: Synthetic oligonucleotide
tggagcatcctacgcaaggacatcccc

SEQ ID NO: 145207 - DNA, 27 bp, Artificial Sequence
  Description of Artificial Sequence: Synthetic oligonucleotide
ggagcatcctacgcaaggacatcccct

SEQ ID NO: 145208 - DNA, 27 bp, Artificial Sequence
  Description of Artificial Sequence: Synthetic oligonucleotide
gagcatcctacgcaaggacatcccctc

SEQ ID NO: 145209 - DNA, 27 bp, Artificial Sequence
  Description of Artificial Sequence: Synthetic oligonucleotide
agcatcctacgcaaggacatcccctcc

SEQ ID NO: 145210 - DNA, 27 bp, Artificial Sequence
  Description of Artificial Sequence: Synthetic oligonucleotide
gcatcctacgcaaggacatcccctcct

SEQ ID NO: 145211 - DNA, 28 bp, Artificial Sequence
  Description of Artificial Sequence: Synthetic oligonucleotide
catcctacgcaaggacatcccctccttc

SEQ ID NO: 145212 - DNA, 28 bp, Artificial Sequence
  Description of Artificial Sequence: Synthetic oligonucleotide
atcctacgcaaggacatcccctccttcg

SEQ ID NO: 145213 - DNA, 27 bp, Artificial Sequence
  Description of Artificial Sequence: Synthetic oligonucleotide
tcctacgcaaggacatcccctccttcg

SEQ ID NO: 145214 - DNA, 27 bp, Artificial Sequence
  Description of Artificial Sequence: Synthetic oligonucleotide
cctacgcaaggacatcccctccttcga

SEQ ID NO: 145215 - DNA, 27 bp, Artificial Sequence
  Description of Artificial Sequence: Synthetic oligonucleotide
ctacgcaaggacatcccctccttcgag

SEQ ID NO: 145216 - DNA, 27 bp, Artificial Sequence
  Description of Artificial Sequence: Synthetic oligonucleotide
tacgcaaggacatcccctccttcgagc

SEQ ID NO: 145217 - DNA, 26 bp, Artificial Sequence
  Description of Artificial Sequence: Synthetic oligonucleotide
acgcaaggacatcccctccttcgagc

SEQ ID NO: 145218 - DNA, 25 bp, Artificial Sequence
  Description of Artificial Sequence: Synthetic oligonucleotide
cgcaaggacatcccctccttcgagc

SEQ ID NO: 145219 - DNA, 25 bp, Artificial Sequence
  Description of Artificial Sequence: Synthetic oligonucleotide
gcaaggacatcccctccttcgagcg

SEQ ID NO: 145220 - DNA, 27 bp, Artificial Sequence
  Description of Artificial Sequence: Synthetic oligonucleotide
caaggacatcccctccttcgagcgcta

SEQ ID NO: 145221 - DNA, 27 bp, Artificial Sequence
  Description of Artificial Sequence: Synthetic oligonucleotide
aaggacatcccctccttcgagcgctac

SEQ ID NO: 145222 - DNA, 27 bp, Artificial Sequence
  Description of Artificial Sequence: Synthetic oligonucleotide
aggacatcccctccttcgagcgctaca

SEQ ID NO: 145223 - DNA, 27 bp, Artificial Sequence
  Description of Artificial Sequence: Synthetic oligonucleotide
ggacatcccctccttcgagcgctacat

SEQ ID NO: 145224 - DNA, 27 bp, Artificial Sequence
  Description of Artificial Sequence: Synthetic oligonucleotide
gacatcccctccttcgagcgctacatg

SEQ ID NO: 145225 - DNA, 27 bp, Artificial Sequence
  Description of Artificial Sequence: Synthetic oligonucleotide
acatcccctccttcgagcgctacatgg

SEQ ID NO: 145226 - DNA, 26 bp, Artificial Sequence
  Description of Artificial Sequence: Synthetic oligonucleotide
catcccctccttcgagcgctacatgg

SEQ ID NO: 145227 - DNA, 26 bp, Artificial Sequence
  Description of Artificial Sequence: Synthetic oligonucleotide
atcccctccttcgagcgctacatggc

SEQ ID NO: 145228 - DNA, 25 bp, Artificial Sequence
  Description of Artificial Sequence: Synthetic oligonucleotide
tcccctccttcgagcgctacatggc

SEQ ID NO: 145229 - DNA, 24 bp, Artificial Sequence
  Description of Artificial Sequence: Synthetic oligonucleotide
cccctccttcgagcgctacatggc

SEQ ID NO: 145230 - DNA, 24 bp, Artificial Sequence
  Description of Artificial Sequence: Synthetic oligonucleotide
ccctccttcgagcgctacatggcc

SEQ ID NO: 145231 - DNA, 25 bp, Artificial Sequence
  Description of Artificial Sequence: Synthetic oligonucleotide
cctccttcgagcgctacatggccca

SEQ ID NO: 145232 - DNA, 25 bp, Artificial Sequence
  Description of Artificial Sequence: Synthetic oligonucleotide
ctccttcgagcgctacatggcccag

SEQ ID NO: 145233 - DNA, 26 bp, Artificial Sequence
  Description of Artificial Sequence: Synthetic oligonucleotide
tccttcgagcgctacatggcccagct

SEQ ID NO: 145234 - DNA, 25 bp, Artificial Sequence
  Description of Artificial Sequence: Synthetic oligonucleotide
ccttcgagcgctacatggcccagct

SEQ ID NO: 145235 - DNA, 27 bp, Artificial Sequence
  Description of Artificial Sequence: Synthetic oligonucleotide
cttcgagcgctacatggcccagctcaa

SEQ ID NO: 145236 - DNA, 29 bp, Artificial Sequence
  Description of Artificial Sequence: Synthetic oligonucleotide
ttcgagcgctacatggcccagctcaaatg

SEQ ID NO: 145237 - DNA, 28 bp, Artificial Sequence
  Description of Artificial Sequence: Synthetic oligonucleotide
tcgagcgctacatggcccagctcaaatg

SEQ ID NO: 145238 - DNA, 27 bp, Artificial Sequence
  Description of Artificial Sequence: Synthetic oligonucleotide
cgagcgctacatggcccagctcaaatg

SEQ ID NO: 145239 - DNA, 27 bp, Artificial Sequence
  Description of Artificial Sequence: Synthetic oligonucleotide
gagcgctacatggcccagctcaaatgc

SEQ ID NO: 145240 - DNA, 29 bp, Artificial Sequence
  Description of Artificial Sequence: Synthetic oligonucleotide
agcgctacatggcccagctcaaatgctac

SEQ ID NO: 145241 - DNA, 28 bp, Artificial Sequence
  Description of Artificial Sequence: Synthetic oligonucleotide
gcgctacatggcccagctcaaatgctac

SEQ ID NO: 145242 - DNA, 30 bp, Artificial Sequence
  Description of Artificial Sequence: Synthetic oligonucleotide
cgctacatggcccagctcaaatgctactac

SEQ ID NO: 145243 - DNA, 33 bp, Artificial Sequence
  Description of Artificial Sequence: Synthetic oligonucleotide
gctacatggcccagctcaaatgctactactttg

SEQ ID NO: 145244 - DNA, 37 bp, Artificial Sequence
  Description of Artificial Sequence: Synthetic oligonucleotide
ctacatggcccagctcaaatgctactactttgattac

SEQ ID NO: 145245 - DNA, 39 bp, Artificial Sequence
  Description of Artificial Sequence: Synthetic oligonucleotide
tacatggcccagctcaaatgctactactttgattacaag

SEQ ID NO: 145246 - DNA, 38 bp, Artificial Sequence
  Description of Artificial Sequence: Synthetic oligonucleotide
acatggcccagctcaaatgctactactttgattacaag

SEQ ID NO: 145247 - DNA, 37 bp, Artificial Sequence
  Description of Artificial Sequence: Synthetic oligonucleotide
catggcccagctcaaatgctactactttgattacaag

SEQ ID NO: 145248 - DNA, 37 bp, Artificial Sequence
  Description of Artificial Sequence: Synthetic oligonucleotide
atggcccagctcaaatgctactactttgattacaagg

SEQ ID NO: 145249 - DNA, 36 bp, Artificial Sequence
  Description of Artificial Sequence: Synthetic oligonucleotide
tggcccagctcaaatgctactactttgattacaagg

SEQ ID NO: 145250 - DNA, 35 bp, Artificial Sequence
  Description of Artificial Sequence: Synthetic oligonucleotide
ggcccagctcaaatgctactactttgattacaagg

SEQ ID NO: 145251 - DNA, 36 bp, Artificial Sequence
  Description of Artificial Sequence: Synthetic oligonucleotide
gcccagctcaaatgctactactttgattacaaggag

SEQ ID NO: 145252 - DNA, 36 bp, Artificial Sequence
  Description of Artificial Sequence: Synthetic oligonucleotide
cccagctcaaatgctactactttgattacaaggagc

SEQ ID NO: 145253 - DNA, 37 bp, Artificial Sequence
  Description of Artificial Sequence: Synthetic oligonucleotide
ccagctcaaatgctactactttgattacaaggagcag

SEQ ID NO: 145254 - DNA, 37 bp, Artificial Sequence
  Description of Artificial Sequence: Synthetic oligonucleotide
cagctcaaatgctactactttgattacaaggagcagc

SEQ ID NO: 145255 - DNA, 38 bp, Artificial Sequence
  Description of Artificial Sequence: Synthetic oligonucleotide
agctcaaatgctactactttgattacaaggagcagctc

SEQ ID NO: 145256 - DNA, 37 bp, Artificial Sequence
  Description of Artificial Sequence: Synthetic oligonucleotide
gctcaaatgctactactttgattacaaggagcagctc

SEQ ID NO: 145257 - DNA, 37 bp, Artificial Sequence
  Description of Artificial Sequence: Synthetic oligonucleotide
ctcaaatgctactactttgattacaaggagcagctcc

SEQ ID NO: 145258 - DNA, 37 bp, Artificial Sequence
  Description of Artificial Sequence: Synthetic oligonucleotide
tcaaatgctactactttgattacaaggagcagctccc

SEQ ID NO: 145259 - DNA, 36 bp, Artificial Sequence
  Description of Artificial Sequence: Synthetic oligonucleotide
caaatgctactactttgattacaaggagcagctccc

SEQ ID NO: 145260 - DNA, 36 bp, Artificial Sequence
  Description of Artificial Sequence: Synthetic oligonucleotide
aaatgctactactttgattacaaggagcagctcccc

SEQ ID NO: 145261 - DNA, 35 bp, Artificial Sequence
  Description of Artificial Sequence: Synthetic oligonucleotide
aatgctactactttgattacaaggagcagctcccc

SEQ ID NO: 145262 - DNA, 34 bp, Artificial Sequence
  Description of Artificial Sequence: Synthetic oligonucleotide
atgctactactttgattacaaggagcagctcccc

SEQ ID NO: 145263 - DNA, 33 bp, Artificial Sequence
  Description of Artificial Sequence: Synthetic oligonucleotide
tgctactactttgattacaaggagcagctcccc

SEQ ID NO: 145264 - DNA, 32 bp, Artificial Sequence
  Description of Artificial Sequence: Synthetic oligonucleotide
gctactactttgattacaaggagcagctcccc

SEQ ID NO: 145265 - DNA, 32 bp, Artificial Sequence
  Description of Artificial Sequence: Synthetic oligonucleotide
ctactactttgattacaaggagcagctccccg

SEQ ID NO: 145266 - DNA, 33 bp, Artificial Sequence
  Description of Artificial Sequence: Synthetic oligonucleotide
tactactttgattacaaggagcagctccccgag

SEQ ID NO: 145267 - DNA, 32 bp, Artificial Sequence
  Description of Artificial Sequence: Synthetic oligonucleotide
actactttgattacaaggagcagctccccgag

SEQ ID NO: 145268 - DNA, 31 bp, Artificial Sequence
  Description of Artificial Sequence: Synthetic oligonucleotide
ctactttgattacaaggagcagctccccgag

SEQ ID NO: 145269 - DNA, 32 bp, Artificial Sequence
  Description of Artificial Sequence: Synthetic oligonucleotide
tactttgattacaaggagcagctccccgagtc

SEQ ID NO: 145270 - DNA, 31 bp, Artificial Sequence
  Description of Artificial Sequence: Synthetic oligonucleotide
actttgattacaaggagcagctccccgagtc

SEQ ID NO: 145271 - DNA, 30 bp, Artificial Sequence
  Description of Artificial Sequence: Synthetic oligonucleotide
ctttgattacaaggagcagctccccgagtc

SEQ ID NO: 145272 - DNA, 31 bp, Artificial Sequence
  Description of Artificial Sequence: Synthetic oligonucleotide
tttgattacaaggagcagctccccgagtcag

SEQ ID NO: 145273 - DNA, 30 bp, Artificial Sequence
  Description of Artificial Sequence: Synthetic oligonucleotide
ttgattacaaggagcagctccccgagtcag

SEQ ID NO: 145274 - DNA, 29 bp, Artificial Sequence
  Description of Artificial Sequence: Synthetic oligonucleotide
tgattacaaggagcagctccccgagtcag

SEQ ID NO: 145275 - DNA, 28 bp, Artificial Sequence
  Description of Artificial Sequence: Synthetic oligonucleotide
gattacaaggagcagctccccgagtcag

SEQ ID NO: 145276 - DNA, 28 bp, Artificial Sequence
  Description of Artificial Sequence: Synthetic oligonucleotide
attacaaggagcagctccccgagtcagc

SEQ ID NO: 145277 - DNA, 27 bp, Artificial Sequence
  Description of Artificial Sequence: Synthetic oligonucleotide
ttacaaggagcagctccccgagtcagc

SEQ ID NO: 145278 - DNA, 26 bp, Artificial Sequence
  Description of Artificial Sequence: Synthetic oligonucleotide
tacaaggagcagctccccgagtcagc

SEQ ID NO: 145279 - DNA, 25 bp, Artificial Sequence
  Description of Artificial Sequence: Synthetic oligonucleotide
acaaggagcagctccccgagtcagc

SEQ ID NO: 145280 - DNA, 24 bp, Artificial Sequence
  Description of Artificial Sequence: Synthetic oligonucleotide
caaggagcagctccccgagtcagc

SEQ ID NO: 145281 - DNA, 27 bp, Artificial Sequence
  Description of Artificial Sequence: Synthetic oligonucleotide
aaggagcagctccccgagtcagcctat

SEQ ID NO: 145282 - DNA, 27 bp, Artificial Sequence
  Description of Artificial Sequence: Synthetic oligonucleotide
aggagcagctccccgagtcagcctata

SEQ ID NO: 145283 - DNA, 27 bp, Artificial Sequence
  Description of Artificial Sequence: Synthetic oligonucleotide
ggagcagctccccgagtcagcctatat

SEQ ID NO: 145284 - DNA, 27 bp, Artificial Sequence
  Description of Artificial Sequence: Synthetic oligonucleotide
gagcagctccccgagtcagcctatatg

SEQ ID NO: 145285 - DNA, 27 bp, Artificial Sequence
  Description of Artificial Sequence: Synthetic oligonucleotide
agcagctccccgagtcagcctatatgc

SEQ ID NO: 145286 - DNA, 27 bp, Artificial Sequence
  Description of Artificial Sequence: Synthetic oligonucleotide
gcagctccccgagtcagcctatatgca

SEQ ID NO: 145287 - DNA, 27 bp, Artificial Sequence
  Description of Artificial Sequence: Synthetic oligonucleotide
cagctccccgagtcagcctatatgcac

SEQ ID NO: 145288 - DNA, 27 bp, Artificial Sequence
  Description of Artificial Sequence: Synthetic oligonucleotide
agctccccgagtcagcctatatgcacc

SEQ ID NO: 145289 - DNA, 27 bp, Artificial Sequence
  Description of Artificial Sequence: Synthetic oligonucleotide
gctccccgagtcagcctatatgcacca

SEQ ID NO: 145290 - DNA, 27 bp, Artificial Sequence
  Description of Artificial Sequence: Synthetic oligonucleotide
ctccccgagtcagcctatatgcaccag

SEQ ID NO: 145291 - DNA, 27 bp, Artificial Sequence
  Description of Artificial Sequence: Synthetic oligonucleotide
tccccgagtcagcctatatgcaccagc

SEQ ID NO: 145292 - DNA, 27 bp, Artificial Sequence
  Description of Artificial Sequence: Synthetic oligonucleotide
ccccgagtcagcctatatgcaccagct

SEQ ID NO: 145293 - DNA, 27 bp, Artificial Sequence
  Description of Artificial Sequence: Synthetic oligonucleotide
cccgagtcagcctatatgcaccagctc

SEQ ID NO: 145294 - DNA, 29 bp, Artificial Sequence
  Description of Artificial Sequence: Synthetic oligonucleotide
ccgagtcagcctatatgcaccagctcttg

SEQ ID NO: 145295 - DNA, 29 bp, Artificial Sequence
  Description of Artificial Sequence: Synthetic oligonucleotide
cgagtcagcctatatgcaccagctcttgg

SEQ ID NO: 145296 - DNA, 29 bp, Artificial Sequence
  Description of Artificial Sequence: Synthetic oligonucleotide
gagtcagcctatatgcaccagctcttggg

SEQ ID NO: 145297 - DNA, 29 bp, Artificial Sequence
  Description of Artificial Sequence: Synthetic oligonucleotide
agtcagcctatatgcaccagctcttgggc

SEQ ID NO: 145298 - DNA, 28 bp, Artificial Sequence
  Description of Artificial Sequence: Synthetic oligonucleotide
gtcagcctatatgcaccagctcttgggc

SEQ ID NO: 145299 - DNA, 28 bp, Artificial Sequence
  Description of Artificial Sequence: Synthetic oligonucleotide
tcagcctatatgcaccagctcttgggcc

SEQ ID NO: 145300 - DNA, 27 bp, Artificial Sequence
  Description of Artificial Sequence: Synthetic oligonucleotide
cagcctatatgcaccagctcttgggcc

SEQ ID NO: 145301 - DNA, 28 bp, Artificial Sequence
  Description of Artificial Sequence: Synthetic oligonucleotide
agcctatatgcaccagctcttgggcctc

SEQ ID NO: 145302 - DNA, 27 bp, Artificial Sequence
  Description of Artificial Sequence: Synthetic oligonucleotide
gcctatatgcaccagctcttgggcctc

SEQ ID NO: 145303 - DNA, 29 bp, Artificial Sequence
  Description of Artificial Sequence: Synthetic oligonucleotide
cctatatgcaccagctcttgggcctcaac

SEQ ID NO: 145304 - DNA, 29 bp, Artificial Sequence
  Description of Artificial Sequence: Synthetic oligonucleotide
ctatatgcaccagctcttgggcctcaacc

SEQ ID NO: 145305 - DNA, 30 bp, Artificial Sequence
  Description of Artificial Sequence: Synthetic oligonucleotide
tatatgcaccagctcttgggcctcaacctc

SEQ ID NO: 145306 - DNA, 29 bp, Artificial Sequence
  Description of Artificial Sequence: Synthetic oligonucleotide
atatgcaccagctcttgggcctcaacctc

SEQ ID NO: 145307 - DNA, 28 bp, Artificial Sequence
  Description of Artificial Sequence: Synthetic oligonucleotide
tatgcaccagctcttgggcctcaacctc

SEQ ID NO: 145308 - DNA, 27 bp, Artificial Sequence
  Description of Artificial Sequence: Synthetic oligonucleotide
atgcaccagctcttgggcctcaacctc

SEQ ID NO: 145309 - DNA, 26 bp, Artificial Sequence
  Description of Artificial Sequence: Synthetic oligonucleotide
tgcaccagctcttgggcctcaacctc

SEQ ID NO: 145310 - DNA, 25 bp, Artificial Sequence
  Description of Artificial Sequence: Synthetic oligonucleotide
gcaccagctcttgggcctcaacctc

SEQ ID NO: 145311 - DNA, 26 bp, Artificial Sequence
  Description of Artificial Sequence: Synthetic oligonucleotide
caccagctcttgggcctcaacctcct

SEQ ID NO: 145312 - DNA, 27 bp, Artificial Sequence
  Description of Artificial Sequence: Synthetic oligonucleotide
accagctcttgggcctcaacctcctct

SEQ ID NO: 145313 - DNA, 27 bp, Artificial Sequence
  Description of Artificial Sequence: Synthetic oligonucleotide
ccagctcttgggcctcaacctcctctt

SEQ ID NO: 145314 - DNA, 27 bp, Artificial Sequence
  Description of Artificial Sequence: Synthetic oligonucleotide
cagctcttgggcctcaacctcctcttc

SEQ ID NO: 145315 - DNA, 27 bp, Artificial Sequence
  Description of Artificial Sequence: Synthetic oligonucleotide
agctcttgggcctcaacctcctcttcc

SEQ ID NO: 145316 - DNA, 27 bp, Artificial Sequence
  Description of Artificial Sequence: Synthetic oligonucleotide
gctcttgggcctcaacctcctcttcct

SEQ ID NO: 145317 - DNA, 27 bp, Artificial Sequence
  Description of Artificial Sequence: Synthetic oligonucleotide
ctcttgggcctcaacctcctcttcctg

SEQ ID NO: 145318 - DNA, 27 bp, Artificial Sequence
  Description of Artificial Sequence: Synthetic oligonucleotide
tcttgggcctcaacctcctcttcctgc

SEQ ID NO: 145319 - DNA, 27 bp, Artificial Sequence
  Description of Artificial Sequence: Synthetic oligonucleotide
cttgggcctcaacctcctcttcctgct

SEQ ID NO: 145320 - DNA, 27 bp, Artificial Sequence
  Description of Artificial Sequence: Synthetic oligonucleotide
ttgggcctcaacctcctcttcctgctg

SEQ ID NO: 145321 - DNA, 27 bp, Artificial Sequence
  Description of Artificial Sequence: Synthetic oligonucleotide
tgggcctcaacctcctcttcctgctgt

SEQ ID NO: 145322 - DNA, 26 bp, Artificial Sequence
  Description of Artificial Sequence: Synthetic oligonucleotide
gggcctcaacctcctcttcctgctgt

SEQ ID NO: 145323 - DNA, 26 bp, Artificial Sequence
  Description of Artificial Sequence: Synthetic oligonucleotide
ggcctcaacctcctcttcctgctgtc

SEQ ID NO: 145324 - DNA, 26 bp, Artificial Sequence
  Description of Artificial Sequence: Synthetic oligonucleotide
gcctcaacctcctcttcctgctgtcc

SEQ ID NO: 145325 - DNA, 27 bp, Artificial Sequence
  Description of Artificial Sequence: Synthetic oligonucleotide
cctcaacctcctcttcctgctgtccca

SEQ ID NO: 145326 - DNA, 27 bp, Artificial Sequence
  Description of Artificial Sequence: Synthetic oligonucleotide
ctcaacctcctcttcctgctgtcccag

SEQ ID NO: 145327 - DNA, 29 bp, Artificial Sequence
  Description of Artificial Sequence: Synthetic oligonucleotide
tcaacctcctcttcctgctgtcccagaac

SEQ ID NO: 145328 - DNA, 28 bp, Artificial Sequence
  Description of Artificial Sequence: Synthetic oligonucleotide
caacctcctcttcctgctgtcccagaac

SEQ ID NO: 145329 - DNA, 28 bp, Artificial Sequence
  Description of Artificial Sequence: Synthetic oligonucleotide
aacctcctcttcctgctgtcccagaacc

SEQ ID NO: 145330 - DNA, 27 bp, Artificial Sequence
  Description of Artificial Sequence: Synthetic oligonucleotide
acctcctcttcctgctgtcccagaacc

SEQ ID NO: 145331 - DNA, 26 bp, Artificial Sequence
  Description of Artificial Sequence: Synthetic oligonucleotide
cctcctcttcctgctgtcccagaacc

SEQ ID NO: 145332 - DNA, 26 bp, Artificial Sequence
  Description of Artificial Sequence: Synthetic oligonucleotide
ctcctcttcctgctgtcccagaaccg

SEQ ID NO: 145333 - DNA, 26 bp, Artificial Sequence
  Description of Artificial Sequence: Synthetic oligonucleotide
tcctcttcctgctgtcccagaaccgg

SEQ ID NO: 145334 - DNA, 25 bp, Artificial Sequence
  Description of Artificial Sequence: Synthetic oligonucleotide
cctcttcctgctgtcccagaaccgg

SEQ ID NO: 145335 - DNA, 26 bp, Artificial Sequence
  Description of Artificial Sequence: Synthetic oligonucleotide
ctcttcctgctgtcccagaaccgggt

SEQ ID NO: 145336 - DNA, 26 bp, Artificial Sequence
  Description of Artificial Sequence: Synthetic oligonucleotide
tcttcctgctgtcccagaaccgggtg

SEQ ID NO: 145337 - DNA, 25 bp, Artificial Sequence
  Description of Artificial Sequence: Synthetic oligonucleotide
cttcctgctgtcccagaaccgggtg

SEQ ID NO: 145338 - DNA, 25 bp, Artificial Sequence
  Description of Artificial Sequence: Synthetic oligonucleotide
ttcctgctgtcccagaaccgggtgg

SEQ ID NO: 145339 - DNA, 24 bp, Artificial Sequence
  Description of Artificial Sequence: Synthetic oligonucleotide
tcctgctgtcccagaaccgggtgg

SEQ ID NO: 145340 - DNA, 23 bp, Artificial Sequence
  Description of Artificial Sequence: Synthetic oligonucleotide
cctgctgtcccagaaccgggtgg

SEQ ID NO: 145341 - DNA, 24 bp, Artificial Sequence
  Description of Artificial Sequence: Synthetic oligonucleotide
ctgctgtcccagaaccgggtggct

SEQ ID NO: 145342 - DNA, 25 bp, Artificial Sequence
  Description of Artificial Sequence: Synthetic oligonucleotide
tgctgtcccagaaccgggtggctga

SEQ ID NO: 145343 - DNA, 24 bp, Artificial Sequence
  Description of Artificial Sequence: Synthetic oligonucleotide
gctgtcccagaaccgggtggctga

SEQ ID NO: 145344 - DNA, 26 bp, Artificial Sequence
  Description of Artificial Sequence: Synthetic oligonucleotide
ctgtcccagaaccgggtggctgagtt

SEQ ID NO: 145345 - DNA, 26 bp, Artificial Sequence
  Description of Artificial Sequence: Synthetic oligonucleotide
tgtcccagaaccgggtggctgagttc

SEQ ID NO: 145346 - DNA, 25 bp, Artificial Sequence
  Description of Artificial Sequence: Synthetic oligonucleotide
gtcccagaaccgggtggctgagttc

SEQ ID NO: 145347 - DNA, 26 bp, Artificial Sequence
  Description of Artificial Sequence: Synthetic oligonucleotide
tcccagaaccgggtggctgagttcca

SEQ ID NO: 145348 - DNA, 25 bp, Artificial Sequence
  Description of Artificial Sequence: Synthetic oligonucleotide
cccagaaccgggtggctgagttcca

SEQ ID NO: 145349 - DNA, 26 bp, Artificial Sequence
  Description of Artificial Sequence: Synthetic oligonucleotide
ccagaaccgggtggctgagttccaca

SEQ ID NO: 145350 - DNA, 26 bp, Artificial Sequence
  Description of Artificial Sequence: Synthetic oligonucleotide
cagaaccgggtggctgagttccacac

SEQ ID NO: 145351 - DNA, 26 bp, Artificial Sequence
  Description of Artificial Sequence: Synthetic oligonucleotide
agaaccgggtggctgagttccacacg

SEQ ID NO: 145352 - DNA, 25 bp, Artificial Sequence
  Description of Artificial Sequence: Synthetic oligonucleotide
gaaccgggtggctgagttccacacg

SEQ ID NO: 145353 - DNA, 26 bp, Artificial Sequence
  Description of Artificial Sequence: Synthetic oligonucleotide
aaccgggtggctgagttccacacgga

SEQ ID NO: 145354 - DNA, 25 bp, Artificial Sequence
  Description of Artificial Sequence: Synthetic oligonucleotide
accgggtggctgagttccacacgga

SEQ ID NO: 145355 - DNA, 24 bp, Artificial Sequence
  Description of Artificial Sequence: Synthetic oligonucleotide
ccgggtggctgagttccacacgga

SEQ ID NO: 145356 - DNA, 26 bp, Artificial Sequence
  Description of Artificial Sequence: Synthetic oligonucleotide
cgggtggctgagttccacacggagtt

SEQ ID NO: 145357 - DNA, 26 bp, Artificial Sequence
  Description of Artificial Sequence: Synthetic oligonucleotide
gggtggctgagttccacacggagttg

SEQ ID NO: 145358 - DNA, 27 bp, Artificial Sequence
  Description of Artificial Sequence: Synthetic oligonucleotide
ggtggctgagttccacacggagttgga

SEQ ID NO: 145359 - DNA, 27 bp, Artificial Sequence
  Description of Artificial Sequence: Synthetic oligonucleotide
gtggctgagttccacacggagttggag

SEQ ID NO: 145360 - DNA, 27 bp, Artificial Sequence
  Description of Artificial Sequence: Synthetic oligonucleotide
tggctgagttccacacggagttggagc

SEQ ID NO: 145361 - DNA, 26 bp, Artificial Sequence
  Description of Artificial Sequence: Synthetic oligonucleotide
ggctgagttccacacggagttggagc

SEQ ID NO: 145362 - DNA, 26 bp, Artificial Sequence
  Description of Artificial Sequence: Synthetic oligonucleotide
gctgagttccacacggagttggagcg

SEQ ID NO: 145363 - DNA, 26 bp, Artificial Sequence
  Description of Artificial Sequence: Synthetic oligonucleotide
ctgagttccacacggagttggagcgg

SEQ ID NO: 145364 - DNA, 27 bp, Artificial Sequence
  Description of Artificial Sequence: Synthetic oligonucleotide
tgagttccacacggagttggagcggct

SEQ ID NO: 145365 - DNA, 26 bp, Artificial Sequence
  Description of Artificial Sequence: Synthetic oligonucleotide
gagttccacacggagttggagcggct

SEQ ID NO: 145366 - DNA, 26 bp, Artificial Sequence
  Description of Artificial Sequence: Synthetic oligonucleotide
agttccacacggagttggagcggctg

SEQ ID NO: 145367 - DNA, 25 bp, Artificial Sequence
  Description of Artificial Sequence: Synthetic oligonucleotide
gttccacacggagttggagcggctg

SEQ ID NO: 145368 - DNA, 25 bp, Artificial Sequence
  Description of Artificial Sequence: Synthetic oligonucleotide
ttccacacggagttggagcggctgc

SEQ ID NO: 145369 - DNA, 24 bp, Artificial Sequence
  Description of Artificial Sequence: Synthetic oligonucleotide
tccacacggagttggagcggctgc

SEQ ID NO: 145370 - DNA, 23 bp, Artificial Sequence
  Description of Artificial Sequence: Synthetic oligonucleotide
ccacacggagttggagcggctgc

SEQ ID NO: 145371 - DNA, 24 bp, Artificial Sequence
  Description of Artificial Sequence: Synthetic oligonucleotide
cacacggagttggagcggctgcct

SEQ ID NO: 145372 - DNA, 24 bp, Artificial Sequence
  Description of Artificial Sequence: Synthetic oligonucleotide
acacggagttggagcggctgcctg

SEQ ID NO: 145373 - DNA, 23 bp, Artificial Sequence
  Description of Artificial Sequence: Synthetic oligonucleotide
cacggagttggagcggctgcctg

SEQ ID NO: 145374 - DNA, 23 bp, Artificial Sequence
  Description of Artificial Sequence: Synthetic oligonucleotide
acggagttggagcggctgcctgc

SEQ ID NO: 145375 - DNA, 22 bp, Artificial Sequence
  Description of Artificial Sequence: Synthetic oligonucleotide
cggagttggagcggctgcctgc

SEQ ID NO: 145376 - DNA, 24 bp, Artificial Sequence
  Description of Artificial Sequence: Synthetic oligonucleotide
ggagttggagcggctgcctgccaa

SEQ ID NO: 145377 - DNA, 24 bp, Artificial Sequence
  Description of Artificial Sequence: Synthetic oligonucleotide
gagttggagcggctgcctgccaag

SEQ ID NO: 145378 - DNA, 25 bp, Artificial Sequence
  Description of Artificial Sequence: Synthetic oligonucleotide
agttggagcggctgcctgccaagga

SEQ ID NO: 145379 - DNA, 24 bp, Artificial Sequence
  Description of Artificial Sequence: Synthetic oligonucleotide
gttggagcggctgcctgccaagga

SEQ ID NO: 145380 - DNA, 27 bp, Artificial Sequence
  Description of Artificial Sequence: Synthetic oligonucleotide
ttggagcggctgcctgccaaggacata

SEQ ID NO: 145381 - DNA, 26 bp, Artificial Sequence
  Description of Artificial Sequence: Synthetic oligonucleotide
tggagcggctgcctgccaaggacata

SEQ ID NO: 145382 - DNA, 25 bp, Artificial Sequence
  Description of Artificial Sequence: Synthetic oligonucleotide
ggagcggctgcctgccaaggacata

SEQ ID NO: 145383 - DNA, 26 bp, Artificial Sequence
  Description of Artificial Sequence: Synthetic oligonucleotide
gagcggctgcctgccaaggacataca

SEQ ID NO: 145384 - DNA, 27 bp, Artificial Sequence
  Description of Artificial Sequence: Synthetic oligonucleotide
agcggctgcctgccaaggacatacaga

SEQ ID NO: 145385 - DNA, 26 bp, Artificial Sequence
  Description of Artificial Sequence: Synthetic oligonucleotide
gcggctgcctgccaaggacatacaga

SEQ ID NO: 145386 - DNA, 26 bp, Artificial Sequence
  Description of Artificial Sequence: Synthetic oligonucleotide
cggctgcctgccaaggacatacagac

SEQ ID NO: 145387 - DNA, 27 bp, Artificial Sequence
  Description of Artificial Sequence: Synthetic oligonucleotide
ggctgcctgccaaggacatacagacca

SEQ ID NO: 145388 - DNA, 29 bp, Artificial Sequence
  Description of Artificial Sequence: Synthetic oligonucleotide
gctgcctgccaaggacatacagaccaatg

SEQ ID NO: 145389 - DNA, 30 bp, Artificial Sequence
  Description of Artificial Sequence: Synthetic oligonucleotide
ctgcctgccaaggacatacagaccaatgtc

SEQ ID NO: 145390 - DNA, 32 bp, Artificial Sequence
  Description of Artificial Sequence: Synthetic oligonucleotide
tgcctgccaaggacatacagaccaatgtctac

SEQ ID NO: 145391 - DNA, 31 bp, Artificial Sequence
  Description of Artificial Sequence: Synthetic oligonucleotide
gcctgccaaggacatacagaccaatgtctac

SEQ ID NO: 145392 - DNA, 33 bp, Artificial Sequence
  Description of Artificial Sequence: Synthetic oligonucleotide
cctgccaaggacatacagaccaatgtctacatc

SEQ ID NO: 145393 - DNA, 35 bp, Artificial Sequence
  Description of Artificial Sequence: Synthetic oligonucleotide
ctgccaaggacatacagaccaatgtctacatcaag

SEQ ID NO: 145394 - DNA, 35 bp, Artificial Sequence
  Description of Artificial Sequence: Synthetic oligonucleotide
tgccaaggacatacagaccaatgtctacatcaagc

SEQ ID NO: 145395 - DNA, 34 bp, Artificial Sequence
  Description of Artificial Sequence: Synthetic oligonucleotide
gccaaggacatacagaccaatgtctacatcaagc

SEQ ID NO: 145396 - DNA, 35 bp, Artificial Sequence
  Description of Artificial Sequence: Synthetic oligonucleotide
ccaaggacatacagaccaatgtctacatcaagcac

SEQ ID NO: 145397 - DNA, 35 bp, Artificial Sequence
  Description of Artificial Sequence: Synthetic oligonucleotide
caaggacatacagaccaatgtctacatcaagcacc

SEQ ID NO: 145398 - DNA, 35 bp, Artificial Sequence
  Description of Artificial Sequence: Synthetic oligonucleotide
aaggacatacagaccaatgtctacatcaagcaccc

SEQ ID NO: 145399 - DNA, 34 bp, Artificial Sequence
  Description of Artificial Sequence: Synthetic oligonucleotide
aggacatacagaccaatgtctacatcaagcaccc

SEQ ID NO: 145400 - DNA, 33 bp, Artificial Sequence
  Description of Artificial Sequence: Synthetic oligonucleotide
ggacatacagaccaatgtctacatcaagcaccc

SEQ ID NO: 145401 - DNA, 34 bp, Artificial Sequence
  Description of Artificial Sequence: Synthetic oligonucleotide
gacatacagaccaatgtctacatcaagcacccag

SEQ ID NO: 145402 - DNA, 35 bp, Artificial Sequence
  Description of Artificial Sequence: Synthetic oligonucleotide
acatacagaccaatgtctacatcaagcacccagtg

SEQ ID NO: 145403 - DNA, 34 bp, Artificial Sequence
  Description of Artificial Sequence: Synthetic oligonucleotide
catacagaccaatgtctacatcaagcacccagtg

SEQ ID NO: 145404 - DNA, 35 bp, Artificial Sequence
  Description of Artificial Sequence: Synthetic oligonucleotide
atacagaccaatgtctacatcaagcacccagtgtc

SEQ ID NO: 145405 - DNA, 34 bp, Artificial Sequence
  Description of Artificial Sequence: Synthetic oligonucleotide
tacagaccaatgtctacatcaagcacccagtgtc

SEQ ID NO: 145406 - DNA, 33 bp, Artificial Sequence
  Description of Artificial Sequence: Synthetic oligonucleotide
acagaccaatgtctacatcaagcacccagtgtc

SEQ ID NO: 145407 - DNA, 32 bp, Artificial Sequence
  Description of Artificial Sequence: Synthetic oligonucleotide
cagaccaatgtctacatcaagcacccagtgtc

SEQ ID NO: 145408 - DNA, 32 bp, Artificial Sequence
  Description of Artificial Sequence: Synthetic oligonucleotide
agaccaatgtctacatcaagcacccagtgtcc

SEQ ID NO: 145409 - DNA, 31 bp, Artificial Sequence
  Description of Artificial Sequence: Synthetic oligonucleotide
gaccaatgtctacatcaagcacccagtgtcc

SEQ ID NO: 145410 - DNA, 31 bp, Artificial Sequence
  Description of Artificial Sequence: Synthetic oligonucleotide
accaatgtctacatcaagcacccagtgtccc

SEQ ID NO: 145411 - DNA, 30 bp, Artificial Sequence
  Description of Artificial Sequence: Synthetic oligonucleotide
ccaatgtctacatcaagcacccagtgtccc

SEQ ID NO: 145412 - DNA, 31 bp, Artificial Sequence
  Description of Artificial Sequence: Synthetic oligonucleotide
caatgtctacatcaagcacccagtgtccctg

SEQ ID NO: 145413 - DNA, 31 bp, Artificial Sequence
  Description of Artificial Sequence: Synthetic oligonucleotide
aatgtctacatcaagcacccagtgtccctgg

SEQ ID NO: 145414 - DNA, 30 bp, Artificial Sequence
  Description of Artificial Sequence: Synthetic oligonucleotide
atgtctacatcaagcacccagtgtccctgg

SEQ ID NO: 145415 - DNA, 29 bp, Artificial Sequence
  Description of Artificial Sequence: Synthetic oligonucleotide
tgtctacatcaagcacccagtgtccctgg

SEQ ID NO: 145416 - DNA, 28 bp, Artificial Sequence
  Description of Artificial Sequence: Synthetic oligonucleotide
gtctacatcaagcacccagtgtccctgg

SEQ ID NO: 145417 - DNA, 29 bp, Artificial Sequence
  Description of Artificial Sequence: Synthetic oligonucleotide
tctacatcaagcacccagtgtccctggag

SEQ ID NO: 145418 - DNA, 28 bp, Artificial Sequence
  Description of Artificial Sequence: Synthetic oligonucleotide
ctacatcaagcacccagtgtccctggag

SEQ ID NO: 145419 - DNA, 28 bp, Artificial Sequence
  Description of Artificial Sequence: Synthetic oligonucleotide
tacatcaagcacccagtgtccctggagc

SEQ ID NO: 145420 - DNA, 27 bp, Artificial Sequence
  Description of Artificial Sequence: Synthetic oligonucleotide
acatcaagcacccagtgtccctggagc

SEQ ID NO: 145421 - DNA, 27 bp, Artificial Sequence
  Description of Artificial Sequence: Synthetic oligonucleotide
catcaagcacccagtgtccctggagca

SEQ ID NO: 145422 - DNA, 30 bp, Artificial Sequence
  Description of Artificial Sequence: Synthetic oligonucleotide
atcaagcacccagtgtccctggagcaatac

SEQ ID NO: 145423 - DNA, 29 bp, Artificial Sequence
  Description of Artificial Sequence: Synthetic oligonucleotide
tcaagcacccagtgtccctggagcaatac

SEQ ID NO: 145424 - DNA, 28 bp, Artificial Sequence
  Description of Artificial Sequence: Synthetic oligonucleotide
caagcacccagtgtccctggagcaatac

SEQ ID NO: 145425 - DNA, 28 bp, Artificial Sequence
  Description of Artificial Sequence: Synthetic oligonucleotide
aagcacccagtgtccctggagcaatacc

SEQ ID NO: 145426 - DNA, 27 bp, Artificial Sequence
  Description of Artificial Sequence: Synthetic oligonucleotide
agcacccagtgtccctggagcaatacc

SEQ ID NO: 145427 - DNA, 27 bp, Artificial Sequence
  Description of Artificial Sequence: Synthetic oligonucleotide
gcacccagtgtccctggagcaatacct

SEQ ID NO: 145428 - DNA, 27 bp, Artificial Sequence
  Description of Artificial Sequence: Synthetic oligonucleotide
cacccagtgtccctggagcaatacctg

SEQ ID NO: 145429 - DNA, 29 bp, Artificial Sequence
  Description of Artificial Sequence: Synthetic oligonucleotide
acccagtgtccctggagcaatacctgatg

SEQ ID NO: 145430 - DNA, 28 bp, Artificial Sequence
  Description of Artificial Sequence: Synthetic oligonucleotide
cccagtgtccctggagcaatacctgatg

SEQ ID NO: 145431 - DNA, 28 bp, Artificial Sequence
  Description of Artificial Sequence: Synthetic oligonucleotide
ccagtgtccctggagcaatacctgatgg

SEQ ID NO: 145432 - DNA, 29 bp, Artificial Sequence
  Description of Artificial Sequence: Synthetic oligonucleotide
cagtgtccctggagcaatacctgatggag

SEQ ID NO: 145433 - DNA, 29 bp, Artificial Sequence
  Description of Artificial Sequence: Synthetic oligonucleotide
agtgtccctggagcaatacctgatggagg

SEQ ID NO: 145434 - DNA, 28 bp, Artificial Sequence
  Description of Artificial Sequence: Synthetic oligonucleotide
gtgtccctggagcaatacctgatggagg

SEQ ID NO: 145435 - DNA, 28 bp, Artificial Sequence
  Description of Artificial Sequence: Synthetic oligonucleotide
tgtccctggagcaatacctgatggaggg

SEQ ID NO: 145436 - DNA, 27 bp, Artificial Sequence
  Description of Artificial Sequence: Synthetic oligonucleotide
gtccctggagcaatacctgatggaggg

SEQ ID NO: 145437 - DNA, 27 bp, Artificial Sequence
  Description of Artificial Sequence: Synthetic oligonucleotide
tccctggagcaatacctgatggagggc

SEQ ID NO: 145438 - DNA, 27 bp, Artificial Sequence
  Description of Artificial Sequence: Synthetic oligonucleotide
ccctggagcaatacctgatggagggca

SEQ ID NO: 145439 - DNA, 27 bp, Artificial Sequence
  Description of Artificial Sequence: Synthetic oligonucleotide
cctggagcaatacctgatggagggcag

SEQ ID NO: 145440 - DNA, 27 bp, Artificial Sequence
  Description of Artificial Sequence: Synthetic oligonucleotide
ctggagcaatacctgatggagggcagc

SEQ ID NO: 145441 - DNA, 29 bp, Artificial Sequence
  Description of Artificial Sequence: Synthetic oligonucleotide
tggagcaatacctgatggagggcagctac

SEQ ID NO: 145442 - DNA, 28 bp, Artificial Sequence
  Description of Artificial Sequence: Synthetic oligonucleotide
ggagcaatacctgatggagggcagctac

SEQ ID NO: 145443 - DNA, 30 bp, Artificial Sequence
  Description of Artificial Sequence: Synthetic oligonucleotide
gagcaatacctgatggagggcagctacaac

SEQ ID NO: 145444 - DNA, 33 bp, Artificial Sequence
  Description of Artificial Sequence: Synthetic oligonucleotide
agcaatacctgatggagggcagctacaacaaag

SEQ ID NO: 145445 - DNA, 32 bp, Artificial Sequence
  Description of Artificial Sequence: Synthetic oligonucleotide
gcaatacctgatggagggcagctacaacaaag

SEQ ID NO: 145446 - DNA, 33 bp, Artificial Sequence
  Description of Artificial Sequence: Synthetic oligonucleotide
caatacctgatggagggcagctacaacaaagtg

SEQ ID NO: 145447 - DNA, 35 bp, Artificial Sequence
  Description of Artificial Sequence: Synthetic oligonucleotide
aatacctgatggagggcagctacaacaaagtgttc

SEQ ID NO: 145448 - DNA, 34 bp, Artificial Sequence
  Description of Artificial Sequence: Synthetic oligonucleotide
atacctgatggagggcagctacaacaaagtgttc

SEQ ID NO: 145449 - DNA, 33 bp, Artificial Sequence
  Description of Artificial Sequence: Synthetic oligonucleotide
tacctgatggagggcagctacaacaaagtgttc

SEQ ID NO: 145450 - DNA, 32 bp, Artificial Sequence
  Description of Artificial Sequence: Synthetic oligonucleotide
acctgatggagggcagctacaacaaagtgttc

SEQ ID NO: 145451 - DNA, 31 bp, Artificial Sequence
  Description of Artificial Sequence: Synthetic oligonucleotide
cctgatggagggcagctacaacaaagtgttc

SEQ ID NO: 145452 - DNA, 31 bp, Artificial Sequence
  Description of Artificial Sequence: Synthetic oligonucleotide
ctgatggagggcagctacaacaaagtgttcc

SEQ ID NO: 145453 - DNA, 32 bp, Artificial Sequence
  Description of Artificial Sequence: Synthetic oligonucleotide
tgatggagggcagctacaacaaagtgttcctg

SEQ ID NO: 145454 - DNA, 31 bp, Artificial Sequence
  Description of Artificial Sequence: Synthetic oligonucleotide
gatggagggcagctacaacaaagtgttcctg

SEQ ID NO: 145455 - DNA, 31 bp, Artificial Sequence
  Description of Artificial Sequence: Synthetic oligonucleotide
atggagggcagctacaacaaagtgttcctgg

SEQ ID NO: 145456 - DNA, 30 bp, Artificial Sequence
  Description of Artificial Sequence: Synthetic oligonucleotide
tggagggcagctacaacaaagtgttcctgg

SEQ ID NO: 145457 - DNA, 29 bp, Artificial Sequence
  Description of Artificial Sequence: Synthetic oligonucleotide
ggagggcagctacaacaaagtgttcctgg

SEQ ID NO: 145458 - DNA, 29 bp, Artificial Sequence
  Description of Artificial Sequence: Synthetic oligonucleotide
gagggcagctacaacaaagtgttcctggc

SEQ ID NO: 145459 - DNA, 29 bp, Artificial Sequence
  Description of Artificial Sequence: Synthetic oligonucleotide
agggcagctacaacaaagtgttcctggcc

SEQ ID NO: 145460 - DNA, 28 bp, Artificial Sequence
  Description of Artificial Sequence: Synthetic oligonucleotide
gggcagctacaacaaagtgttcctggcc

SEQ ID NO: 145461 - DNA, 30 bp, Artificial Sequence
  Description of Artificial Sequence: Synthetic oligonucleotide
ggcagctacaacaaagtgttcctggccaag

SEQ ID NO: 145462 - DNA, 30 bp, Artificial Sequence
  Description of Artificial Sequence: Synthetic oligonucleotide
gcagctacaacaaagtgttcctggccaagg

SEQ ID NO: 145463 - DNA, 30 bp, Artificial Sequence
  Description of Artificial Sequence: Synthetic oligonucleotide
cagctacaacaaagtgttcctggccaaggg

SEQ ID NO: 145464 - DNA, 33 bp, Artificial Sequence
  Description of Artificial Sequence: Synthetic oligonucleotide
agctacaacaaagtgttcctggccaagggtaac

SEQ ID NO: 145465 - DNA, 32 bp, Artificial Sequence
  Description of Artificial Sequence: Synthetic oligonucleotide
gctacaacaaagtgttcctggccaagggtaac

SEQ ID NO: 145466 - DNA, 34 bp, Artificial Sequence
  Description of Artificial Sequence: Synthetic oligonucleotide
ctacaacaaagtgttcctggccaagggtaacatc

SEQ ID NO: 145467 - DNA, 34 bp, Artificial Sequence
  Description of Artificial Sequence: Synthetic oligonucleotide
tacaacaaagtgttcctggccaagggtaacatcc

SEQ ID NO: 145468 - DNA, 33 bp, Artificial Sequence
  Description of Artificial Sequence: Synthetic oligonucleotide
acaacaaagtgttcctggccaagggtaacatcc

SEQ ID NO: 145469 - DNA, 32 bp, Artificial Sequence
  Description of Artificial Sequence: Synthetic oligonucleotide
caacaaagtgttcctggccaagggtaacatcc

SEQ ID NO: 145470 - DNA, 32 bp, Artificial Sequence
  Description of Artificial Sequence: Synthetic oligonucleotide
aacaaagtgttcctggccaagggtaacatccc

SEQ ID NO: 145471 - DNA, 31 bp, Artificial Sequence
  Description of Artificial Sequence: Synthetic oligonucleotide
acaaagtgttcctggccaagggtaacatccc

SEQ ID NO: 145472 - DNA, 30 bp, Artificial Sequence
  Description of Artificial Sequence: Synthetic oligonucleotide
caaagtgttcctggccaagggtaacatccc

SEQ ID NO: 145473 - DNA, 30 bp, Artificial Sequence
  Description of Artificial Sequence: Synthetic oligonucleotide
aaagtgttcctggccaagggtaacatcccc

SEQ ID NO: 145474 - DNA, 29 bp, Artificial Sequence
  Description of Artificial Sequence: Synthetic oligonucleotide
aagtgttcctggccaagggtaacatcccc

SEQ ID NO: 145475 - DNA, 28 bp, Artificial Sequence
  Description of Artificial Sequence: Synthetic oligonucleotide
agtgttcctggccaagggtaacatcccc

SEQ ID NO: 145476 - DNA, 27 bp, Artificial Sequence
  Description of Artificial Sequence: Synthetic oligonucleotide
gtgttcctggccaagggtaacatcccc

SEQ ID NO: 145477 - DNA, 27 bp, Artificial Sequence
  Description of Artificial Sequence: Synthetic oligonucleotide
tgttcctggccaagggtaacatccccg

SEQ ID NO: 145478 - DNA, 26 bp, Artificial Sequence
  Description of Artificial Sequence: Synthetic oligonucleotide
gttcctggccaagggtaacatccccg

SEQ ID NO: 145479 - DNA, 26 bp, Artificial Sequence
  Description of Artificial Sequence: Synthetic oligonucleotide
ttcctggccaagggtaacatccccgc

SEQ ID NO: 145480 - DNA, 25 bp, Artificial Sequence
  Description of Artificial Sequence: Synthetic oligonucleotide
tcctggccaagggtaacatccccgc

SEQ ID NO: 145481 - DNA, 24 bp, Artificial Sequence
  Description of Artificial Sequence: Synthetic oligonucleotide
cctggccaagggtaacatccccgc

SEQ ID NO: 145482 - DNA, 24 bp, Artificial Sequence
  Description of Artificial Sequence: Synthetic oligonucleotide
ctggccaagggtaacatccccgcc

SEQ ID NO: 145483 - DNA, 25 bp, Artificial Sequence
  Description of Artificial Sequence: Synthetic oligonucleotide
tggccaagggtaacatccccgccga

SEQ ID NO: 145484 - DNA, 24 bp, Artificial Sequence
  Description of Artificial Sequence: Synthetic oligonucleotide
ggccaagggtaacatccccgccga

SEQ ID NO: 145485 - DNA, 25 bp, Artificial Sequence
  Description of Artificial Sequence: Synthetic oligonucleotide
gccaagggtaacatccccgccgaga

SEQ ID NO: 145486 - DNA, 25 bp, Artificial Sequence
  Description of Artificial Sequence: Synthetic oligonucleotide
ccaagggtaacatccccgccgagag

SEQ ID NO: 145487 - DNA, 27 bp, Artificial Sequence
  Description of Artificial Sequence: Synthetic oligonucleotide
caagggtaacatccccgccgagagcta

SEQ ID NO: 145488 - DNA, 27 bp, Artificial Sequence
  Description of Artificial Sequence: Synthetic oligonucleotide
aagggtaacatccccgccgagagctac

SEQ ID NO: 145489 - DNA, 27 bp, Artificial Sequence
  Description of Artificial Sequence: Synthetic oligonucleotide
agggtaacatccccgccgagagctaca

SEQ ID NO: 145490 - DNA, 26 bp, Artificial Sequence
  Description of Artificial Sequence: Synthetic oligonucleotide
gggtaacatccccgccgagagctaca

SEQ ID NO: 145491 - DNA, 26 bp, Artificial Sequence
  Description of Artificial Sequence: Synthetic oligonucleotide
ggtaacatccccgccgagagctacac

SEQ ID NO: 145492 - DNA, 27 bp, Artificial Sequence
  Description of Artificial Sequence: Synthetic oligonucleotide
gtaacatccccgccgagagctacacct

SEQ ID NO: 145493 - DNA, 28 bp, Artificial Sequence
  Description of Artificial Sequence: Synthetic oligonucleotide
taacatccccgccgagagctacaccttc

SEQ ID NO: 145494 - DNA, 27 bp, Artificial Sequence
  Description of Artificial Sequence: Synthetic oligonucleotide
aacatccccgccgagagctacaccttc

SEQ ID NO: 145495 - DNA, 27 bp, Artificial Sequence
  Description of Artificial Sequence: Synthetic oligonucleotide
acatccccgccgagagctacaccttct

SEQ ID NO: 145496 - DNA, 27 bp, Artificial Sequence
  Description of Artificial Sequence: Synthetic oligonucleotide
catccccgccgagagctacaccttctt

SEQ ID NO: 145497 - DNA, 27 bp, Artificial Sequence
  Description of Artificial Sequence: Synthetic oligonucleotide
atccccgccgagagctacaccttcttc

SEQ ID NO: 145498 - DNA, 27 bp, Artificial Sequence
  Description of Artificial Sequence: Synthetic oligonucleotide
tccccgccgagagctacaccttcttca

SEQ ID NO: 145499 - DNA, 27 bp, Artificial Sequence
  Description of Artificial Sequence: Synthetic oligonucleotide
ccccgccgagagctacaccttcttcat

SEQ ID NO: 145500 - DNA, 28 bp, Artificial Sequence
  Description of Artificial Sequence: Synthetic oligonucleotide
cccgccgagagctacaccttcttcattg

SEQ ID NO: 145501 - DNA, 29 bp, Artificial Sequence
  Description of Artificial Sequence: Synthetic oligonucleotide
ccgccgagagctacaccttcttcattgac

SEQ ID NO: 145502 - DNA, 31 bp, Artificial Sequence
  Description of Artificial Sequence: Synthetic oligonucleotide
cgccgagagctacaccttcttcattgacatc

SEQ ID NO: 145503 - DNA, 31 bp, Artificial Sequence
  Description of Artificial Sequence: Synthetic oligonucleotide
gccgagagctacaccttcttcattgacatcc

SEQ ID NO: 145504 - DNA, 32 bp, Artificial Sequence
  Description of Artificial Sequence: Synthetic oligonucleotide
ccgagagctacaccttcttcattgacatcctg

SEQ ID NO: 145505 - DNA, 32 bp, Artificial Sequence
  Description of Artificial Sequence: Synthetic oligonucleotide
cgagagctacaccttcttcattgacatcctgc

SEQ ID NO: 145506 - DNA, 33 bp, Artificial Sequence
  Description of Artificial Sequence: Synthetic oligonucleotide
gagagctacaccttcttcattgacatcctgctc

SEQ ID NO: 145507 - DNA, 33 bp, Artificial Sequence
  Description of Artificial Sequence: Synthetic oligonucleotide
agagctacaccttcttcattgacatcctgctcg

SEQ ID NO: 145508 - DNA, 32 bp, Artificial Sequence
  Description of Artificial Sequence: Synthetic oligonucleotide
gagctacaccttcttcattgacatcctgctcg

SEQ ID NO: 145509 - DNA, 33 bp, Artificial Sequence
  Description of Artificial Sequence: Synthetic oligonucleotide
agctacaccttcttcattgacatcctgctcgac

SEQ ID NO: 145510 - DNA, 32 bp, Artificial Sequence
  Description of Artificial Sequence: Synthetic oligonucleotide
gctacaccttcttcattgacatcctgctcgac

SEQ ID NO: 145511 - DNA, 33 bp, Artificial Sequence
  Description of Artificial Sequence: Synthetic oligonucleotide
ctacaccttcttcattgacatcctgctcgacac

SEQ ID NO: 145512 - DNA, 36 bp, Artificial Sequence
  Description of Artificial Sequence: Synthetic oligonucleotide
tacaccttcttcattgacatcctgctcgacactatc

SEQ ID NO: 145513 - DNA, 35 bp, Artificial Sequence
  Description of Artificial Sequence: Synthetic oligonucleotide
acaccttcttcattgacatcctgctcgacactatc

SEQ ID NO: 145514 - DNA, 34 bp, Artificial Sequence
  Description of Artificial Sequence: Synthetic oligonucleotide
caccttcttcattgacatcctgctcgacactatc

SEQ ID NO: 145515 - DNA, 35 bp, Artificial Sequence
  Description of Artificial Sequence: Synthetic oligonucleotide
accttcttcattgacatcctgctcgacactatcag

SEQ ID NO: 145516 - DNA, 34 bp, Artificial Sequence
  Description of Artificial Sequence: Synthetic oligonucleotide
ccttcttcattgacatcctgctcgacactatcag

SEQ ID NO: 145517 - DNA, 34 bp, Artificial Sequence
  Description of Artificial Sequence: Synthetic oligonucleotide
cttcttcattgacatcctgctcgacactatcagg

SEQ ID NO: 145518 - DNA, 34 bp, Artificial Sequence
  Description of Artificial Sequence: Synthetic oligonucleotide
ttcttcattgacatcctgctcgacactatcaggg

SEQ ID NO: 145519 - DNA, 33 bp, Artificial Sequence
  Description of Artificial Sequence: Synthetic oligonucleotide
tcttcattgacatcctgctcgacactatcaggg

SEQ ID NO: 145520 - DNA, 32 bp, Artificial Sequence
  Description of Artificial Sequence: Synthetic oligonucleotide
cttcattgacatcctgctcgacactatcaggg

SEQ ID NO: 145521 - DNA, 34 bp, Artificial Sequence
  Description of Artificial Sequence: Synthetic oligonucleotide
ttcattgacatcctgctcgacactatcagggatg

SEQ ID NO: 145522 - DNA, 33 bp, Artificial Sequence
  Description of Artificial Sequence: Synthetic oligonucleotide
tcattgacatcctgctcgacactatcagggatg

SEQ ID NO: 145523 - DNA, 32 bp, Artificial Sequence
  Description of Artificial Sequence: Synthetic oligonucleotide
cattgacatcctgctcgacactatcagggatg

SEQ ID NO: 145524 - DNA, 33 bp, Artificial Sequence
  Description of Artificial Sequence: Synthetic oligonucleotide
attgacatcctgctcgacactatcagggatgag

SEQ ID NO: 145525 - DNA, 32 bp, Artificial Sequence
  Description of Artificial Sequence: Synthetic oligonucleotide
ttgacatcctgctcgacactatcagggatgag

SEQ ID NO: 145526 - DNA, 31 bp, Artificial Sequence
  Description of Artificial Sequence: Synthetic oligonucleotide
tgacatcctgctcgacactatcagggatgag

SEQ ID NO: 145527 - DNA, 30 bp, Artificial Sequence
  Description of Artificial Sequence: Synthetic oligonucleotide
gacatcctgctcgacactatcagggatgag

SEQ ID NO: 145528 - DNA, 32 bp, Artificial Sequence
  Description of Artificial Sequence: Synthetic oligonucleotide
acatcctgctcgacactatcagggatgagatc

SEQ ID NO: 145529 - DNA, 31 bp, Artificial Sequence
  Description of Artificial Sequence: Synthetic oligonucleotide
catcctgctcgacactatcagggatgagatc

SEQ ID NO: 145530 - DNA, 31 bp, Artificial Sequence
  Description of Artificial Sequence: Synthetic oligonucleotide
atcctgctcgacactatcagggatgagatcg

SEQ ID NO: 145531 - DNA, 30 bp, Artificial Sequence
  Description of Artificial Sequence: Synthetic oligonucleotide
tcctgctcgacactatcagggatgagatcg

SEQ ID NO: 145532 - DNA, 29 bp, Artificial Sequence
  Description of Artificial Sequence: Synthetic oligonucleotide
cctgctcgacactatcagggatgagatcg

SEQ ID NO: 145533 - DNA, 29 bp, Artificial Sequence
  Description of Artificial Sequence: Synthetic oligonucleotide
ctgctcgacactatcagggatgagatcgc

SEQ ID NO: 145534 - DNA, 30 bp, Artificial Sequence
  Description of Artificial Sequence: Synthetic oligonucleotide
tgctcgacactatcagggatgagatcgctg

SEQ ID NO: 145535 - DNA, 29 bp, Artificial Sequence
  Description of Artificial Sequence: Synthetic oligonucleotide
gctcgacactatcagggatgagatcgctg

SEQ ID NO: 145536 - DNA, 29 bp, Artificial Sequence
  Description of Artificial Sequence: Synthetic oligonucleotide
ctcgacactatcagggatgagatcgctgg

SEQ ID NO: 145537 - DNA, 29 bp, Artificial Sequence
  Description of Artificial Sequence: Synthetic oligonucleotide
tcgacactatcagggatgagatcgctggg

SEQ ID NO: 145538 - DNA, 28 bp, Artificial Sequence
  Description of Artificial Sequence: Synthetic oligonucleotide
cgacactatcagggatgagatcgctggg

SEQ ID NO: 145539 - DNA, 29 bp, Artificial Sequence
  Description of Artificial Sequence: Synthetic oligonucleotide
gacactatcagggatgagatcgctgggtg

SEQ ID NO: 145540 - DNA, 29 bp, Artificial Sequence
  Description of Artificial Sequence: Synthetic oligonucleotide
acactatcagggatgagatcgctgggtgc

SEQ ID NO: 145541 - DNA, 28 bp, Artificial Sequence
  Description of Artificial Sequence: Synthetic oligonucleotide
cactatcagggatgagatcgctgggtgc

SEQ ID NO: 145542 - DNA, 30 bp, Artificial Sequence
  Description of Artificial Sequence: Synthetic oligonucleotide
actatcagggatgagatcgctgggtgcatc

SEQ ID NO: 145543 - DNA, 29 bp, Artificial Sequence
  Description of Artificial Sequence: Synthetic oligonucleotide
ctatcagggatgagatcgctgggtgcatc

SEQ ID NO: 145544 - DNA, 29 bp, Artificial Sequence
  Description of Artificial Sequence: Synthetic oligonucleotide
tatcagggatgagatcgctgggtgcatcg

SEQ ID NO: 145545 - DNA, 28 bp, Artificial Sequence
  Description of Artificial Sequence: Synthetic oligonucleotide
atcagggatgagatcgctgggtgcatcg

SEQ ID NO: 145546 - DNA, 27 bp, Artificial Sequence
  Description of Artificial Sequence: Synthetic oligonucleotide
tcagggatgagatcgctgggtgcatcg

SEQ ID NO: 145547 - DNA, 27 bp, Artificial Sequence
  Description of Artificial Sequence: Synthetic oligonucleotide
cagggatgagatcgctgggtgcatcga

SEQ ID NO: 145548 - DNA, 27 bp, Artificial Sequence
  Description of Artificial Sequence: Synthetic oligonucleotide
agggatgagatcgctgggtgcatcgag

SEQ ID NO: 145549 - DNA, 27 bp, Artificial Sequence
  Description of Artificial Sequence: Synthetic oligonucleotide
gggatgagatcgctgggtgcatcgaga

SEQ ID NO: 145550 - DNA, 28 bp, Artificial Sequence
  Description of Artificial Sequence: Synthetic oligonucleotide
ggatgagatcgctgggtgcatcgagaag

SEQ ID NO: 145551 - DNA, 28 bp, Artificial Sequence
  Description of Artificial Sequence: Synthetic oligonucleotide
gatgagatcgctgggtgcatcgagaagg

SEQ ID NO: 145552 - DNA, 28 bp, Artificial Sequence
  Description of Artificial Sequence: Synthetic oligonucleotide
atgagatcgctgggtgcatcgagaaggc

SEQ ID NO: 145553 - DNA, 27 bp, Artificial Sequence
  Description of Artificial Sequence: Synthetic oligonucleotide
tgagatcgctgggtgcatcgagaaggc

SEQ ID NO: 145554 - DNA, 26 bp, Artificial Sequence
  Description of Artificial Sequence: Synthetic oligonucleotide
gagatcgctgggtgcatcgagaaggc

SEQ ID NO: 145555 - DNA, 27 bp, Artificial Sequence
  Description of Artificial Sequence: Synthetic oligonucleotide
agatcgctgggtgcatcgagaaggcct

SEQ ID NO: 145556 - DNA, 27 bp, Artificial Sequence
  Description of Artificial Sequence: Synthetic oligonucleotide
gatcgctgggtgcatcgagaaggccta

SEQ ID NO: 145557 - DNA, 27 bp, Artificial Sequence
  Description of Artificial Sequence: Synthetic oligonucleotide
atcgctgggtgcatcgagaaggcctac

SEQ ID NO: 145558 - DNA, 26 bp, Artificial Sequence
  Description of Artificial Sequence: Synthetic oligonucleotide
tcgctgggtgcatcgagaaggcctac

SEQ ID NO: 145559 - DNA, 25 bp, Artificial Sequence
  Description of Artificial Sequence: Synthetic oligonucleotide
cgctgggtgcatcgagaaggcctac

SEQ ID NO: 145560 - DNA, 26 bp, Artificial Sequence
  Description of Artificial Sequence: Synthetic oligonucleotide
gctgggtgcatcgagaaggcctacga

SEQ ID NO: 145561 - DNA, 27 bp, Artificial Sequence
  Description of Artificial Sequence: Synthetic oligonucleotide
ctgggtgcatcgagaaggcctacgaga

SEQ ID NO: 145562 - DNA, 31 bp, Artificial Sequence
  Description of Artificial Sequence: Synthetic oligonucleotide
tgggtgcatcgagaaggcctacgagaaaatc

SEQ ID NO: 145563 - DNA, 30 bp, Artificial Sequence
  Description of Artificial Sequence: Synthetic oligonucleotide
gggtgcatcgagaaggcctacgagaaaatc

SEQ ID NO: 145564 - DNA, 30 bp, Artificial Sequence
  Description of Artificial Sequence: Synthetic oligonucleotide
ggtgcatcgagaaggcctacgagaaaatcc

SEQ ID NO: 145565 - DNA, 34 bp, Artificial Sequence
  Description of Artificial Sequence: Synthetic oligonucleotide
gtgcatcgagaaggcctacgagaaaatccttttc

SEQ ID NO: 145566 - DNA, 35 bp, Artificial Sequence
  Description of Artificial Sequence: Synthetic oligonucleotide
tgcatcgagaaggcctacgagaaaatccttttcac

SEQ ID NO: 145567 - DNA, 34 bp, Artificial Sequence
  Description of Artificial Sequence: Synthetic oligonucleotide
gcatcgagaaggcctacgagaaaatccttttcac

SEQ ID NO: 145568 - DNA, 35 bp, Artificial Sequence
  Description of Artificial Sequence: Synthetic oligonucleotide
catcgagaaggcctacgagaaaatccttttcactg

SEQ ID NO: 145569 - DNA, 36 bp, Artificial Sequence
  Description of Artificial Sequence: Synthetic oligonucleotide
atcgagaaggcctacgagaaaatccttttcactgag

SEQ ID NO: 145570 - DNA, 35 bp, Artificial Sequence
  Description of Artificial Sequence: Synthetic oligonucleotide
tcgagaaggcctacgagaaaatccttttcactgag

SEQ ID NO: 145571 - DNA, 34 bp, Artificial Sequence
  Description of Artificial Sequence: Synthetic oligonucleotide
cgagaaggcctacgagaaaatccttttcactgag

SEQ ID NO: 145572 - DNA, 34 bp, Artificial Sequence
  Description of Artificial Sequence: Synthetic oligonucleotide
gagaaggcctacgagaaaatccttttcactgagg

SEQ ID NO: 145573 - DNA, 34 bp, Artificial Sequence
  Description of Artificial Sequence: Synthetic oligonucleotide
agaaggcctacgagaaaatccttttcactgaggc

SEQ ID NO: 145574 - DNA, 33 bp, Artificial Sequence
  Description of Artificial Sequence: Synthetic oligonucleotide
gaaggcctacgagaaaatccttttcactgaggc

SEQ ID NO: 145575 - DNA, 33 bp, Artificial Sequence
  Description of Artificial Sequence: Synthetic oligonucleotide
aaggcctacgagaaaatccttttcactgaggcc

SEQ ID NO: 145576 - DNA, 32 bp, Artificial Sequence
  Description of Artificial Sequence: Synthetic oligonucleotide
aggcctacgagaaaatccttttcactgaggcc

SEQ ID NO: 145577 - DNA, 31 bp, Artificial Sequence
  Description of Artificial Sequence: Synthetic oligonucleotide
ggcctacgagaaaatccttttcactgaggcc

SEQ ID NO: 145578 - DNA, 32 bp, Artificial Sequence
  Description of Artificial Sequence: Synthetic oligonucleotide
gcctacgagaaaatccttttcactgaggccac

SEQ ID NO: 145579 - DNA, 32 bp, Artificial Sequence
  Description of Artificial Sequence: Synthetic oligonucleotide
cctacgagaaaatccttttcactgaggccacc

SEQ ID NO: 145580 - DNA, 32 bp, Artificial Sequence
  Description of Artificial Sequence: Synthetic oligonucleotide
ctacgagaaaatccttttcactgaggccaccc

SEQ ID NO: 145581 - DNA, 32 bp, Artificial Sequence
  Description of Artificial Sequence: Synthetic oligonucleotide
tacgagaaaatccttttcactgaggccacccg

SEQ ID NO: 145582 - DNA, 31 bp, Artificial Sequence
  Description of Artificial Sequence: Synthetic oligonucleotide
acgagaaaatccttttcactgaggccacccg

SEQ ID NO: 145583 - DNA, 30 bp, Artificial Sequence
  Description of Artificial Sequence: Synthetic oligonucleotide
cgagaaaatccttttcactgaggccacccg

SEQ ID NO: 145584 - DNA, 30 bp, Artificial Sequence
  Description of Artificial Sequence: Synthetic oligonucleotide
gagaaaatccttttcactgaggccacccgg

SEQ ID NO: 145585 - DNA, 32 bp, Artificial Sequence
  Description of Artificial Sequence: Synthetic oligonucleotide
agaaaatccttttcactgaggccacccggatc

SEQ ID NO: 145586 - DNA, 31 bp, Artificial Sequence
  Description of Artificial Sequence: Synthetic oligonucleotide
gaaaatccttttcactgaggccacccggatc

SEQ ID NO: 145587 - DNA, 31 bp, Artificial Sequence
  Description of Artificial Sequence: Synthetic oligonucleotide
aaaatccttttcactgaggccacccggatcc

SEQ ID NO: 145588 - DNA, 30 bp, Artificial Sequence
  Description of Artificial Sequence: Synthetic oligonucleotide
aaatccttttcactgaggccacccggatcc

SEQ ID NO: 145589 - DNA, 29 bp, Artificial Sequence
  Description of Artificial Sequence: Synthetic oligonucleotide
aatccttttcactgaggccacccggatcc

SEQ ID NO: 145590 - DNA, 28 bp, Artificial Sequence
  Description of Artificial Sequence: Synthetic oligonucleotide
atccttttcactgaggccacccggatcc

SEQ ID NO: 145591 - DNA, 27 bp, Artificial Sequence
  Description of Artificial Sequence: Synthetic oligonucleotide
tccttttcactgaggccacccggatcc

SEQ ID NO: 145592 - DNA, 27 bp, Artificial Sequence
  Description of Artificial Sequence: Synthetic oligonucleotide
ccttttcactgaggccacccggatcct

SEQ ID NO: 145593 - DNA, 27 bp, Artificial Sequence
  Description of Artificial Sequence: Synthetic oligonucleotide
cttttcactgaggccacccggatcctc

SEQ ID NO: 145594 - DNA, 29 bp, Artificial Sequence
  Description of Artificial Sequence: Synthetic oligonucleotide
ttttcactgaggccacccggatcctcttc

SEQ ID NO: 145595 - DNA, 28 bp, Artificial Sequence
  Description of Artificial Sequence: Synthetic oligonucleotide
tttcactgaggccacccggatcctcttc

SEQ ID NO: 145596 - DNA, 27 bp, Artificial Sequence
  Description of Artificial Sequence: Synthetic oligonucleotide
ttcactgaggccacccggatcctcttc

SEQ ID NO: 145597 - DNA, 27 bp, Artificial Sequence
  Description of Artificial Sequence: Synthetic oligonucleotide
tcactgaggccacccggatcctcttct

SEQ ID NO: 145598 - DNA, 27 bp, Artificial Sequence
  Description of Artificial Sequence: Synthetic oligonucleotide
cactgaggccacccggatcctcttctt

SEQ ID NO: 145599 - DNA, 27 bp, Artificial Sequence
  Description of Artificial Sequence: Synthetic oligonucleotide
actgaggccacccggatcctcttcttc

SEQ ID NO: 145600 - DNA, 27 bp, Artificial Sequence
  Description of Artificial Sequence: Synthetic oligonucleotide
ctgaggccacccggatcctcttcttca

SEQ ID NO: 145601 - DNA, 28 bp, Artificial Sequence
  Description of Artificial Sequence: Synthetic oligonucleotide
tgaggccacccggatcctcttcttcaac

SEQ ID NO: 145602 - DNA, 27 bp, Artificial Sequence
  Description of Artificial Sequence: Synthetic oligonucleotide
gaggccacccggatcctcttcttcaac

SEQ ID NO: 145603 - DNA, 28 bp, Artificial Sequence
  Description of Artificial Sequence: Synthetic oligonucleotide
aggccacccggatcctcttcttcaacac

SEQ ID NO: 145604 - DNA, 27 bp, Artificial Sequence
  Description of Artificial Sequence: Synthetic oligonucleotide
ggccacccggatcctcttcttcaacac

SEQ ID NO: 145605 - DNA, 28 bp, Artificial Sequence
  Description of Artificial Sequence: Synthetic oligonucleotide
gccacccggatcctcttcttcaacacac

SEQ ID NO: 145606 - DNA, 28 bp, Artificial Sequence
  Description of Artificial Sequence: Synthetic oligonucleotide
ccacccggatcctcttcttcaacacacc

SEQ ID NO: 145607 - DNA, 28 bp, Artificial Sequence
  Description of Artificial Sequence: Synthetic oligonucleotide
cacccggatcctcttcttcaacacaccc

SEQ ID NO: 145608 - DNA, 33 bp, Artificial Sequence
  Description of Artificial Sequence: Synthetic oligonucleotide
acccggatcctcttcttcaacacacccaaaaag

SEQ ID NO: 145609 - DNA, 32 bp, Artificial Sequence
  Description of Artificial Sequence: Synthetic oligonucleotide
cccggatcctcttcttcaacacacccaaaaag

SEQ ID NO: 145610 - DNA, 34 bp, Artificial Sequence
  Description of Artificial Sequence: Synthetic oligonucleotide
ccggatcctcttcttcaacacacccaaaaagatg

SEQ ID NO: 145611 - DNA, 35 bp, Artificial Sequence
  Description of Artificial Sequence: Synthetic oligonucleotide
cggatcctcttcttcaacacacccaaaaagatgac

SEQ ID NO: 145612 - DNA, 36 bp, Artificial Sequence
  Description of Artificial Sequence: Synthetic oligonucleotide
ggatcctcttcttcaacacacccaaaaagatgacag

SEQ ID NO: 145613 - DNA, 37 bp, Artificial Sequence
  Description of Artificial Sequence: Synthetic oligonucleotide
gatcctcttcttcaacacacccaaaaagatgacagac

SEQ ID NO: 145614 - DNA, 39 bp, Artificial Sequence
  Description of Artificial Sequence: Synthetic oligonucleotide
atcctcttcttcaacacacccaaaaagatgacagactac

SEQ ID NO: 145615 - DNA, 38 bp, Artificial Sequence
  Description of Artificial Sequence: Synthetic oligonucleotide
tcctcttcttcaacacacccaaaaagatgacagactac

SEQ ID NO: 145616 - DNA, 37 bp, Artificial Sequence
  Description of Artificial Sequence: Synthetic oligonucleotide
cctcttcttcaacacacccaaaaagatgacagactac

SEQ ID NO: 145617 - DNA, 37 bp, Artificial Sequence
  Description of Artificial Sequence: Synthetic oligonucleotide
ctcttcttcaacacacccaaaaagatgacagactacg

SEQ ID NO: 145618 - DNA, 37 bp, Artificial Sequence
  Description of Artificial Sequence: Synthetic oligonucleotide
tcttcttcaacacacccaaaaagatgacagactacgc

SEQ ID NO: 145619 - DNA, 36 bp, Artificial Sequence
  Description of Artificial Sequence: Synthetic oligonucleotide
cttcttcaacacacccaaaaagatgacagactacgc

SEQ ID NO: 145620 - DNA, 36 bp, Artificial Sequence
  Description of Artificial Sequence: Synthetic oligonucleotide
ttcttcaacacacccaaaaagatgacagactacgcc

SEQ ID NO: 145621 - DNA, 35 bp, Artificial Sequence
  Description of Artificial Sequence: Synthetic oligonucleotide
tcttcaacacacccaaaaagatgacagactacgcc

SEQ ID NO: 145622 - DNA, 34 bp, Artificial Sequence
  Description of Artificial Sequence: Synthetic oligonucleotide
cttcaacacacccaaaaagatgacagactacgcc

SEQ ID NO: 145623 - DNA, 36 bp, Artificial Sequence
  Description of Artificial Sequence: Synthetic oligonucleotide
ttcaacacacccaaaaagatgacagactacgccaag

SEQ ID NO: 145624 - DNA, 35 bp, Artificial Sequence
  Description of Artificial Sequence: Synthetic oligonucleotide
tcaacacacccaaaaagatgacagactacgccaag

SEQ ID NO: 145625 - DNA, 34 bp, Artificial Sequence
  Description of Artificial Sequence: Synthetic oligonucleotide
caacacacccaaaaagatgacagactacgccaag

SEQ ID NO: 145626 - DNA, 36 bp, Artificial Sequence
  Description of Artificial Sequence: Synthetic oligonucleotide
aacacacccaaaaagatgacagactacgccaagaag

SEQ ID NO: 145627 - DNA, 35 bp, Artificial Sequence
  Description of Artificial Sequence: Synthetic oligonucleotide
acacacccaaaaagatgacagactacgccaagaag

SEQ ID NO: 145628 - DNA, 34 bp, Artificial Sequence
  Description of Artificial Sequence: Synthetic oligonucleotide
cacacccaaaaagatgacagactacgccaagaag

SEQ ID NO: 145629 - DNA, 34 bp, Artificial Sequence
  Description of Artificial Sequence: Synthetic oligonucleotide
acacccaaaaagatgacagactacgccaagaagc

SEQ ID NO: 145630 - DNA, 33 bp, Artificial Sequence
  Description of Artificial Sequence: Synthetic oligonucleotide
cacccaaaaagatgacagactacgccaagaagc

SEQ ID NO: 145631 - DNA, 33 bp, Artificial Sequence
  Description of Artificial Sequence: Synthetic oligonucleotide
acccaaaaagatgacagactacgccaagaagcg

SEQ ID NO: 145632 - DNA, 32 bp, Artificial Sequence
  Description of Artificial Sequence: Synthetic oligonucleotide
cccaaaaagatgacagactacgccaagaagcg

SEQ ID NO: 145633 - DNA, 33 bp, Artificial Sequence
  Description of Artificial Sequence: Synthetic oligonucleotide
ccaaaaagatgacagactacgccaagaagcgag

SEQ ID NO: 145634 - DNA, 33 bp, Artificial Sequence
  Description of Artificial Sequence: Synthetic oligonucleotide
caaaaagatgacagactacgccaagaagcgagg

SEQ ID NO: 145635 - DNA, 33 bp, Artificial Sequence
  Description of Artificial Sequence: Synthetic oligonucleotide
aaaaagatgacagactacgccaagaagcgaggg

SEQ ID NO: 145636 - DNA, 32 bp, Artificial Sequence
  Description of Artificial Sequence: Synthetic oligonucleotide
aaaagatgacagactacgccaagaagcgaggg

SEQ ID NO: 145637 - DNA, 31 bp, Artificial Sequence
  Description of Artificial Sequence: Synthetic oligonucleotide
aaagatgacagactacgccaagaagcgaggg

SEQ ID NO: 145638 - DNA, 30 bp, Artificial Sequence
  Description of Artificial Sequence: Synthetic oligonucleotide
aagatgacagactacgccaagaagcgaggg

SEQ ID NO: 145639 - DNA, 29 bp, Artificial Sequence
  Description of Artificial Sequence: Synthetic oligonucleotide
agatgacagactacgccaagaagcgaggg

SEQ ID NO: 145640 - DNA, 28 bp, Artificial Sequence
  Description of Artificial Sequence: Synthetic oligonucleotide
gatgacagactacgccaagaagcgaggg

SEQ ID NO: 145641 - DNA, 29 bp, Artificial Sequence
  Description of Artificial Sequence: Synthetic oligonucleotide
atgacagactacgccaagaagcgagggtg

SEQ ID NO: 145642 - DNA, 28 bp, Artificial Sequence
  Description of Artificial Sequence: Synthetic oligonucleotide
tgacagactacgccaagaagcgagggtg

SEQ ID NO: 145643 - DNA, 27 bp, Artificial Sequence
  Description of Artificial Sequence: Synthetic oligonucleotide
gacagactacgccaagaagcgagggtg

SEQ ID NO: 145644 - DNA, 27 bp, Artificial Sequence
  Description of Artificial Sequence: Synthetic oligonucleotide
acagactacgccaagaagcgagggtgg

SEQ ID NO: 145645 - DNA, 26 bp, Artificial Sequence
  Description of Artificial Sequence: Synthetic oligonucleotide
cagactacgccaagaagcgagggtgg

SEQ ID NO: 145646 - DNA, 27 bp, Artificial Sequence
  Description of Artificial Sequence: Synthetic oligonucleotide
agactacgccaagaagcgagggtgggt

SEQ ID NO: 145647 - DNA, 26 bp, Artificial Sequence
  Description of Artificial Sequence: Synthetic oligonucleotide
gactacgccaagaagcgagggtgggt

SEQ ID NO: 145648 - DNA, 26 bp, Artificial Sequence
  Description of Artificial Sequence: Synthetic oligonucleotide
actacgccaagaagcgagggtgggtc

SEQ ID NO: 145649 - DNA, 25 bp, Artificial Sequence
  Description of Artificial Sequence: Synthetic oligonucleotide
ctacgccaagaagcgagggtgggtc

SEQ ID NO: 145650 - DNA, 26 bp, Artificial Sequence
  Description of Artificial Sequence: Synthetic oligonucleotide
tacgccaagaagcgagggtgggtcct

SEQ ID NO: 145651 - DNA, 25 bp, Artificial Sequence
  Description of Artificial Sequence: Synthetic oligonucleotide
acgccaagaagcgagggtgggtcct

SEQ ID NO: 145652 - DNA, 24 bp, Artificial Sequence
  Description of Artificial Sequence: Synthetic oligonucleotide
cgccaagaagcgagggtgggtcct

SEQ ID NO: 145653 - DNA, 24 bp, Artificial Sequence
  Description of Artificial Sequence: Synthetic oligonucleotide
gccaagaagcgagggtgggtcctg

SEQ ID NO: 145654 - DNA, 24 bp, Artificial Sequence
  Description of Artificial Sequence: Synthetic oligonucleotide
ccaagaagcgagggtgggtcctgg

SEQ ID NO: 145655 - DNA, 24 bp, Artificial Sequence
  Description of Artificial Sequence: Synthetic oligonucleotide
caagaagcgagggtgggtcctggg

SEQ ID NO: 145656 - DNA, 24 bp, Artificial Sequence
  Description of Artificial Sequence: Synthetic oligonucleotide
aagaagcgagggtgggtcctgggc

SEQ ID NO: 145657 - DNA, 23 bp, Artificial Sequence
  Description of Artificial Sequence: Synthetic oligonucleotide
agaagcgagggtgggtcctgggc

SEQ ID NO: 145658 - DNA, 22 bp, Artificial Sequence
  Description of Artificial Sequence: Synthetic oligonucleotide
gaagcgagggtgggtcctgggc

SEQ ID NO: 145659 - DNA, 22 bp, Artificial Sequence
  Description of Artificial Sequence: Synthetic oligonucleotide
aagcgagggtgggtcctgggcc

SEQ ID NO: 145660 - DNA, 21 bp, Artificial Sequence
  Description of Artificial Sequence: Synthetic oligonucleotide
agcgagggtgggtcctgggcc

SEQ ID NO: 145661 - DNA, 20 bp, Artificial Sequence
  Description of Artificial Sequence: Synthetic oligonucleotide
gcgagggtgggtcctgggcc

SEQ ID NO: 145662 - DNA, 20 bp, Artificial Sequence
  Description of Artificial Sequence: Synthetic oligonucleotide
cgagggtgggtcctgggccc

SEQ ID NO: 145663 - DNA, 22 bp, Artificial Sequence
  Description of Artificial Sequence: Synthetic oligonucleotide
gagggtgggtcctgggccccaa

SEQ ID NO: 145664 - DNA, 24 bp, Artificial Sequence
  Description of Artificial Sequence: Synthetic oligonucleotide
agggtgggtcctgggccccaacaa

SEQ ID NO: 145665 - DNA, 23 bp, Artificial Sequence
  Description of Artificial Sequence: Synthetic oligonucleotide
gggtgggtcctgggccccaacaa

SEQ ID NO: 145666 - DNA, 25 bp, Artificial Sequence
  Description of Artificial Sequence: Synthetic oligonucleotide
ggtgggtcctgggccccaacaacta

SEQ ID NO: 145667 - DNA, 27 bp, Artificial Sequence
  Description of Artificial Sequence: Synthetic oligonucleotide
gtgggtcctgggccccaacaactacta

SEQ ID NO: 145668 - DNA, 27 bp, Artificial Sequence
  Description of Artificial Sequence: Synthetic oligonucleotide
tgggtcctgggccccaacaactactac

SEQ ID NO: 145669 - DNA, 27 bp, Artificial Sequence
  Description of Artificial Sequence: Synthetic oligonucleotide
gggtcctgggccccaacaactactaca

SEQ ID NO: 145670 - DNA, 27 bp, Artificial Sequence
  Description of Artificial Sequence: Synthetic oligonucleotide
ggtcctgggccccaacaactactacag

SEQ ID NO: 145671 - DNA, 31 bp, Artificial Sequence
  Description of Artificial Sequence: Synthetic oligonucleotide
gtcctgggccccaacaactactacagttttg

SEQ ID NO: 145672 - DNA, 31 bp, Artificial Sequence
  Description of Artificial Sequence: Synthetic oligonucleotide
tcctgggccccaacaactactacagttttgc

SEQ ID NO: 145673 - DNA, 30 bp, Artificial Sequence
  Description of Artificial Sequence: Synthetic oligonucleotide
cctgggccccaacaactactacagttttgc

SEQ ID NO: 145674 - DNA, 30 bp, Artificial Sequence
  Description of Artificial Sequence: Synthetic oligonucleotide
ctgggccccaacaactactacagttttgcc

SEQ ID NO: 145675 - DNA, 31 bp, Artificial Sequence
  Description of Artificial Sequence: Synthetic oligonucleotide
tgggccccaacaactactacagttttgccag

SEQ ID NO: 145676 - DNA, 30 bp, Artificial Sequence
  Description of Artificial Sequence: Synthetic oligonucleotide
gggccccaacaactactacagttttgccag

SEQ ID NO: 145677 - DNA, 30 bp, Artificial Sequence
  Description of Artificial Sequence: Synthetic oligonucleotide
ggccccaacaactactacagttttgccagc

SEQ ID NO: 145678 - DNA, 30 bp, Artificial Sequence
  Description of Artificial Sequence: Synthetic oligonucleotide
gccccaacaactactacagttttgccagcc

SEQ ID NO: 145679 - DNA, 31 bp, Artificial Sequence
  Description of Artificial Sequence: Synthetic oligonucleotide
ccccaacaactactacagttttgccagccag

SEQ ID NO: 145680 - DNA, 31 bp, Artificial Sequence
  Description of Artificial Sequence: Synthetic oligonucleotide
cccaacaactactacagttttgccagccagc

SEQ ID NO: 145681 - DNA, 32 bp, Artificial Sequence
  Description of Artificial Sequence: Synthetic oligonucleotide
ccaacaactactacagttttgccagccagcag

SEQ ID NO: 145682 - DNA, 32 bp, Artificial Sequence
  Description of Artificial Sequence: Synthetic oligonucleotide
caacaactactacagttttgccagccagcagc

SEQ ID NO: 145683 - DNA, 33 bp, Artificial Sequence
  Description of Artificial Sequence: Synthetic oligonucleotide
aacaactactacagttttgccagccagcagcag

SEQ ID NO: 145684 - DNA, 32 bp, Artificial Sequence
  Description of Artificial Sequence: Synthetic oligonucleotide
acaactactacagttttgccagccagcagcag

SEQ ID NO: 145685 - DNA, 31 bp, Artificial Sequence
  Description of Artificial Sequence: Synthetic oligonucleotide
caactactacagttttgccagccagcagcag

SEQ ID NO: 145686 - DNA, 33 bp, Artificial Sequence
  Description of Artificial Sequence: Synthetic oligonucleotide
aactactacagttttgccagccagcagcagaag

SEQ ID NO: 145687 - DNA, 32 bp, Artificial Sequence
  Description of Artificial Sequence: Synthetic oligonucleotide
actactacagttttgccagccagcagcagaag

SEQ ID NO: 145688 - DNA, 31 bp, Artificial Sequence
  Description of Artificial Sequence: Synthetic oligonucleotide
ctactacagttttgccagccagcagcagaag

SEQ ID NO: 145689 - DNA, 31 bp, Artificial Sequence
  Description of Artificial Sequence: Synthetic oligonucleotide
tactacagttttgccagccagcagcagaagc

SEQ ID NO: 145690 - DNA, 30 bp, Artificial Sequence
  Description of Artificial Sequence: Synthetic oligonucleotide
actacagttttgccagccagcagcagaagc

SEQ ID NO: 145691 - DNA, 29 bp, Artificial Sequence
  Description of Artificial Sequence: Synthetic oligonucleotide
ctacagttttgccagccagcagcagaagc

SEQ ID NO: 145692 - DNA, 29 bp, Artificial Sequence
  Description of Artificial Sequence: Synthetic oligonucleotide
tacagttttgccagccagcagcagaagcc

SEQ ID NO: 145693 - DNA, 28 bp, Artificial Sequence
  Description of Artificial Sequence: Synthetic oligonucleotide
acagttttgccagccagcagcagaagcc

SEQ ID NO: 145694 - DNA, 27 bp, Artificial Sequence
  Description of Artificial Sequence: Synthetic oligonucleotide
cagttttgccagccagcagcagaagcc

SEQ ID NO: 145695 - DNA, 27 bp, Artificial Sequence
  Description of Artificial Sequence: Synthetic oligonucleotide
agttttgccagccagcagcagaagccg

SEQ ID NO: 145696 - DNA, 26 bp, Artificial Sequence
  Description of Artificial Sequence: Synthetic oligonucleotide
gttttgccagccagcagcagaagccg

SEQ ID NO: 145697 - DNA, 27 bp, Artificial Sequence
  Description of Artificial Sequence: Synthetic oligonucleotide
ttttgccagccagcagcagaagccgga

SEQ ID NO: 145698 - DNA, 27 bp, Artificial Sequence
  Description of Artificial Sequence: Synthetic oligonucleotide
tttgccagccagcagcagaagccggaa

SEQ ID NO: 145699 - DNA, 26 bp, Artificial Sequence
  Description of Artificial Sequence: Synthetic oligonucleotide
ttgccagccagcagcagaagccggaa

SEQ ID NO: 145700 - DNA, 25 bp, Artificial Sequence
  Description of Artificial Sequence: Synthetic oligonucleotide
tgccagccagcagcagaagccggaa

SEQ ID NO: 145701 - DNA, 24 bp, Artificial Sequence
  Description of Artificial Sequence: Synthetic oligonucleotide
gccagccagcagcagaagccggaa

SEQ ID NO: 145702 - DNA, 25 bp, Artificial Sequence
  Description of Artificial Sequence: Synthetic oligonucleotide
ccagccagcagcagaagccggaaga

SEQ ID NO: 145703 - DNA, 26 bp, Artificial Sequence
  Description of Artificial Sequence: Synthetic oligonucleotide
cagccagcagcagaagccggaagaca

SEQ ID NO: 145704 - DNA, 26 bp, Artificial Sequence
  Description of Artificial Sequence: Synthetic oligonucleotide
agccagcagcagaagccggaagacac

SEQ ID NO: 145705 - DNA, 25 bp, Artificial Sequence
  Description of Artificial Sequence: Synthetic oligonucleotide
gccagcagcagaagccggaagacac

SEQ ID NO: 145706 - DNA, 26 bp, Artificial Sequence
  Description of Artificial Sequence: Synthetic oligonucleotide
ccagcagcagaagccggaagacacca

SEQ ID NO: 145707 - DNA, 26 bp, Artificial Sequence
  Description of Artificial Sequence: Synthetic oligonucleotide
cagcagcagaagccggaagacaccac

SEQ ID NO: 145708 - DNA, 27 bp, Artificial Sequence
  Description of Artificial Sequence: Synthetic oligonucleotide
agcagcagaagccggaagacaccacca

SEQ ID NO: 145709 - DNA, 27 bp, Artificial Sequence
  Description of Artificial Sequence: Synthetic oligonucleotide
gcagcagaagccggaagacaccaccat

SEQ ID NO: 145710 - DNA, 28 bp, Artificial Sequence
  Description of Artificial Sequence: Synthetic oligonucleotide
cagcagaagccggaagacaccaccattc

SEQ ID NO: 145711 - DNA, 28 bp, Artificial Sequence
  Description of Artificial Sequence: Synthetic oligonucleotide
agcagaagccggaagacaccaccattcc

SEQ ID NO: 145712 - DNA, 27 bp, Artificial Sequence
  Description of Artificial Sequence: Synthetic oligonucleotide
gcagaagccggaagacaccaccattcc

SEQ ID NO: 145713 - DNA, 27 bp, Artificial Sequence
  Description of Artificial Sequence: Synthetic oligonucleotide
cagaagccggaagacaccaccattccc

SEQ ID NO: 145714 - DNA, 28 bp, Artificial Sequence
  Description of Artificial Sequence: Synthetic oligonucleotide
agaagccggaagacaccaccattccctc

SEQ ID NO: 145715 - DNA, 27 bp, Artificial Sequence
  Description of Artificial Sequence: Synthetic oligonucleotide
gaagccggaagacaccaccattccctc

SEQ ID NO: 145716 - DNA, 27 bp, Artificial Sequence
  Description of Artificial Sequence: Synthetic oligonucleotide
aagccggaagacaccaccattccctcc

SEQ ID NO: 145717 - DNA, 27 bp, Artificial Sequence
  Description of Artificial Sequence: Synthetic oligonucleotide
agccggaagacaccaccattccctcca

SEQ ID NO: 145718 - DNA, 26 bp, Artificial Sequence
  Description of Artificial Sequence: Synthetic oligonucleotide
gccggaagacaccaccattccctcca

SEQ ID NO: 145719 - DNA, 27 bp, Artificial Sequence
  Description of Artificial Sequence: Synthetic oligonucleotide
ccggaagacaccaccattccctccaca

SEQ ID NO: 145720 - DNA, 27 bp, Artificial Sequence
  Description of Artificial Sequence: Synthetic oligonucleotide
cggaagacaccaccattccctccacag

SEQ ID NO: 145721 - DNA, 29 bp, Artificial Sequence
  Description of Artificial Sequence: Synthetic oligonucleotide
ggaagacaccaccattccctccacagaac

SEQ ID NO: 145722 - DNA, 30 bp, Artificial Sequence
  Description of Artificial Sequence: Synthetic oligonucleotide
gaagacaccaccattccctccacagaactg

SEQ ID NO: 145723 - DNA, 30 bp, Artificial Sequence
  Description of Artificial Sequence: Synthetic oligonucleotide
aagacaccaccattccctccacagaactgg

SEQ ID NO: 145724 - DNA, 29 bp, Artificial Sequence
  Description of Artificial Sequence: Synthetic oligonucleotide
agacaccaccattccctccacagaactgg

SEQ ID NO: 145725 - DNA, 28 bp, Artificial Sequence
  Description of Artificial Sequence: Synthetic oligonucleotide
gacaccaccattccctccacagaactgg

SEQ ID NO: 145726 - DNA, 28 bp, Artificial Sequence
  Description of Artificial Sequence: Synthetic oligonucleotide
acaccaccattccctccacagaactggc

SEQ ID NO: 145727 - DNA, 27 bp, Artificial Sequence
  Description of Artificial Sequence: Synthetic oligonucleotide
caccaccattccctccacagaactggc

SEQ ID NO: 145728 - DNA, 27 bp, Artificial Sequence
  Description of Artificial Sequence: Synthetic oligonucleotide
accaccattccctccacagaactggcc

SEQ ID NO: 145729 - DNA, 27 bp, Artificial Sequence
  Description of Artificial Sequence: Synthetic oligonucleotide
ccaccattccctccacagaactggcca

SEQ ID NO: 145730 - DNA, 29 bp, Artificial Sequence
  Description of Artificial Sequence: Synthetic oligonucleotide
caccattccctccacagaactggccaaac

SEQ ID NO: 145731 - DNA, 30 bp, Artificial Sequence
  Description of Artificial Sequence: Synthetic oligonucleotide
accattccctccacagaactggccaaacag

SEQ ID NO: 145732 - DNA, 29 bp, Artificial Sequence
  Description of Artificial Sequence: Synthetic oligonucleotide
ccattccctccacagaactggccaaacag

SEQ ID NO: 145733 - DNA, 29 bp, Artificial Sequence
  Description of Artificial Sequence: Synthetic oligonucleotide
cattccctccacagaactggccaaacagg

SEQ ID NO: 145734 - DNA, 30 bp, Artificial Sequence
  Description of Artificial Sequence: Synthetic oligonucleotide
attccctccacagaactggccaaacaggtc

SEQ ID NO: 145735 - DNA, 29 bp, Artificial Sequence
  Description of Artificial Sequence: Synthetic oligonucleotide
ttccctccacagaactggccaaacaggtc

SEQ ID NO: 145736 - DNA, 28 bp, Artificial Sequence
  Description of Artificial Sequence: Synthetic oligonucleotide
tccctccacagaactggccaaacaggtc

SEQ ID NO: 145737 - DNA, 27 bp, Artificial Sequence
  Description of Artificial Sequence: Synthetic oligonucleotide
ccctccacagaactggccaaacaggtc

SEQ ID NO: 145738 - DNA, 29 bp, Artificial Sequence
  Description of Artificial Sequence: Synthetic oligonucleotide
cctccacagaactggccaaacaggtcatc

SEQ ID NO: 145739 - DNA, 29 bp, Artificial Sequence
  Description of Artificial Sequence: Synthetic oligonucleotide
ctccacagaactggccaaacaggtcatcg

SEQ ID NO: 145740 - DNA, 30 bp, Artificial Sequence
  Description of Artificial Sequence: Synthetic oligonucleotide
tccacagaactggccaaacaggtcatcgag

SEQ ID NO: 145741 - DNA, 29 bp, Artificial Sequence
  Description of Artificial Sequence: Synthetic oligonucleotide
ccacagaactggccaaacaggtcatcgag

SEQ ID NO: 145742 - DNA, 32 bp, Artificial Sequence
  Description of Artificial Sequence: Synthetic oligonucleotide
cacagaactggccaaacaggtcatcgagtatg

SEQ ID NO: 145743 - DNA, 32 bp, Artificial Sequence
  Description of Artificial Sequence: Synthetic oligonucleotide
acagaactggccaaacaggtcatcgagtatgc

SEQ ID NO: 145744 - DNA, 31 bp, Artificial Sequence
  Description of Artificial Sequence: Synthetic oligonucleotide
cagaactggccaaacaggtcatcgagtatgc

SEQ ID NO: 145745 - DNA, 31 bp, Artificial Sequence
  Description of Artificial Sequence: Synthetic oligonucleotide
agaactggccaaacaggtcatcgagtatgcc

SEQ ID NO: 145746 - DNA, 30 bp, Artificial Sequence
  Description of Artificial Sequence: Synthetic oligonucleotide
gaactggccaaacaggtcatcgagtatgcc

SEQ ID NO: 145747 - DNA, 30 bp, Artificial Sequence
  Description of Artificial Sequence: Synthetic oligonucleotide
aactggccaaacaggtcatcgagtatgccc

SEQ ID NO: 145748 - DNA, 29 bp, Artificial Sequence
  Description of Artificial Sequence: Synthetic oligonucleotide
actggccaaacaggtcatcgagtatgccc

SEQ ID NO: 145749 - DNA, 28 bp, Artificial Sequence
  Description of Artificial Sequence: Synthetic oligonucleotide
ctggccaaacaggtcatcgagtatgccc

SEQ ID NO: 145750 - DNA, 28 bp, Artificial Sequence
  Description of Artificial Sequence: Synthetic oligonucleotide
tggccaaacaggtcatcgagtatgcccg

SEQ ID NO: 145751 - DNA, 27 bp, Artificial Sequence
  Description of Artificial Sequence: Synthetic oligonucleotide
ggccaaacaggtcatcgagtatgcccg

SEQ ID NO: 145752 - DNA, 27 bp, Artificial Sequence
  Description of Artificial Sequence: Synthetic oligonucleotide
gccaaacaggtcatcgagtatgcccgg

SEQ ID NO: 145753 - DNA, 27 bp, Artificial Sequence
  Description of Artificial Sequence: Synthetic oligonucleotide
ccaaacaggtcatcgagtatgcccggc

SEQ ID NO: 145754 - DNA, 28 bp, Artificial Sequence
  Description of Artificial Sequence: Synthetic oligonucleotide
caaacaggtcatcgagtatgcccggcag

SEQ ID NO: 145755 - DNA, 28 bp, Artificial Sequence
  Description of Artificial Sequence: Synthetic oligonucleotide
aaacaggtcatcgagtatgcccggcagc

SEQ ID NO: 145756 - DNA, 27 bp, Artificial Sequence
  Description of Artificial Sequence: Synthetic oligonucleotide
aacaggtcatcgagtatgcccggcagc

SEQ ID NO: 145757 - DNA, 27 bp, Artificial Sequence
  Description of Artificial Sequence: Synthetic oligonucleotide
acaggtcatcgagtatgcccggcagct

SEQ ID NO: 145758 - DNA, 26 bp, Artificial Sequence
  Description of Artificial Sequence: Synthetic oligonucleotide
caggtcatcgagtatgcccggcagct

SEQ ID NO: 145759 - DNA, 26 bp, Artificial Sequence
  Description of Artificial Sequence: Synthetic oligonucleotide
aggtcatcgagtatgcccggcagctg

SEQ ID NO: 145760 - DNA, 25 bp, Artificial Sequence
  Description of Artificial Sequence: Synthetic oligonucleotide
ggtcatcgagtatgcccggcagctg

SEQ ID NO: 145761 - DNA, 26 bp, Artificial Sequence
  Description of Artificial Sequence: Synthetic oligonucleotide
gtcatcgagtatgcccggcagctgga

SEQ ID NO: 145762 - DNA, 27 bp, Artificial Sequence
  Description of Artificial Sequence: Synthetic oligonucleotide
tcatcgagtatgcccggcagctggaga

SEQ ID NO: 145763 - DNA, 27 bp, Artificial Sequence
  Description of Artificial Sequence: Synthetic oligonucleotide
catcgagtatgcccggcagctggagat

SEQ ID NO: 145764 - DNA, 27 bp, Artificial Sequence
  Description of Artificial Sequence: Synthetic oligonucleotide
atcgagtatgcccggcagctggagatg

SEQ ID NO: 145765 - DNA, 27 bp, Artificial Sequence
  Description of Artificial Sequence: Synthetic oligonucleotide
tcgagtatgcccggcagctggagatga

SEQ ID NO: 145766 - DNA, 27 bp, Artificial Sequence
  Description of Artificial Sequence: Synthetic oligonucleotide
cgagtatgcccggcagctggagatgat

SEQ ID NO: 145767 - DNA, 27 bp, Artificial Sequence
  Description of Artificial Sequence: Synthetic oligonucleotide
gagtatgcccggcagctggagatgatc

SEQ ID NO: 145768 - DNA, 27 bp, Artificial Sequence
  Description of Artificial Sequence: Synthetic oligonucleotide
agtatgcccggcagctggagatgatcg

SEQ ID NO: 145769 - DNA, 27 bp, Artificial Sequence
  Description of Artificial Sequence: Synthetic oligonucleotide
gtatgcccggcagctggagatgatcgt

SEQ ID NO: 145770 - DNA, 27 bp, Artificial Sequence
  Description of Artificial Sequence: Synthetic oligonucleotide
tatgcccggcagctggagatgatcgtc

SEQ ID NO: 145771 - DNA, 27 bp, Artificial Sequence
  Description of Artificial Sequence: Synthetic oligonucleotide
atgcccggcagctggagatgatcgtct

SEQ ID NO: 145772 - DNA, 26 bp, Artificial Sequence
  Description of Artificial Sequence: Synthetic oligonucleotide
tgcccggcagctggagatgatcgtct

SEQ ID NO: 145773 - DNA, 25 bp, Artificial Sequence
  Description of Artificial Sequence: Synthetic oligonucleotide
gcccggcagctggagatgatcgtct

SEQ ID NO: 145774 - DNA, 26 bp, Artificial Sequence
  Description of Artificial Sequence: Synthetic oligonucleotide
cccggcagctggagatgatcgtctga

SEQ ID NO: 145775 - DNA, 26 bp, Artificial Sequence
  Description of Artificial Sequence: Synthetic oligonucleotide
atgtccgacgaggaagcgaggcagag

SEQ ID NO: 145776 - DNA, 25 bp, Artificial Sequence
  Description of Artificial Sequence: Synthetic oligonucleotide
tgtccgacgaggaagcgaggcagag

SEQ ID NO: 145777 - DNA, 24 bp, Artificial Sequence
  Description of Artificial Sequence: Synthetic oligonucleotide
gtccgacgaggaagcgaggcagag

SEQ ID NO: 145778 - DNA, 24 bp, Artificial Sequence
  Description of Artificial Sequence: Synthetic oligonucleotide
tccgacgaggaagcgaggcagagc

SEQ ID NO: 145779 - DNA, 23 bp, Artificial Sequence
  Description of Artificial Sequence: Synthetic oligonucleotide
ccgacgaggaagcgaggcagagc

SEQ ID NO: 145780 - DNA, 23 bp, Artificial Sequence
  Description of Artificial Sequence: Synthetic oligonucleotide
cgacgaggaagcgaggcagagcg

SEQ ID NO: 145781 - DNA, 24 bp, Artificial Sequence
  Description of Artificial Sequence: Synthetic oligonucleotide
gacgaggaagcgaggcagagcgga

SEQ ID NO: 145782 - DNA, 24 bp, Artificial Sequence
  Description of Artificial Sequence: Synthetic oligonucleotide
acgaggaagcgaggcagagcggag

SEQ ID NO: 145783 - DNA, 23 bp, Artificial Sequence
  Description of Artificial Sequence: Synthetic oligonucleotide
cgaggaagcgaggcagagcggag

SEQ ID NO: 145784 - DNA, 23 bp, Artificial Sequence
  Description of Artificial Sequence: Synthetic oligonucleotide
gaggaagcgaggcagagcggagg

SEQ ID NO: 145785 - DNA, 24 bp, Artificial Sequence
  Description of Artificial Sequence: Synthetic oligonucleotide
aggaagcgaggcagagcggaggct

SEQ ID NO: 145786 - DNA, 23 bp, Artificial Sequence
  Description of Artificial Sequence: Synthetic oligonucleotide
ggaagcgaggcagagcggaggct

SEQ ID NO: 145787 - DNA, 23 bp, Artificial Sequence
  Description of Artificial Sequence: Synthetic oligonucleotide
gaagcgaggcagagcggaggctc

SEQ ID NO: 145788 - DNA, 24 bp, Artificial Sequence
  Description of Artificial Sequence: Synthetic oligonucleotide
aagcgaggcagagcggaggctcct

SEQ ID NO: 145789 - DNA, 23 bp, Artificial Sequence
  Description of Artificial Sequence: Synthetic oligonucleotide
agcgaggcagagcggaggctcct

SEQ ID NO: 145790 - DNA, 22 bp, Artificial Sequence
  Description of Artificial Sequence: Synthetic oligonucleotide
gcgaggcagagcggaggctcct

SEQ ID NO: 145791 - DNA, 22 bp, Artificial Sequence
  Description of Artificial Sequence: Synthetic oligonucleotide
cgaggcagagcggaggctcctc

SEQ ID NO: 145792 - DNA, 22 bp, Artificial Sequence
  Description of Artificial Sequence: Synthetic oligonucleotide
gaggcagagcggaggctcctcg

SEQ ID NO: 145793 - DNA, 23 bp, Artificial Sequence
  Description of Artificial Sequence: Synthetic oligonucleotide
aggcagagcggaggctcctcgca

SEQ ID NO: 145794 - DNA, 22 bp, Artificial Sequence
  Description of Artificial Sequence: Synthetic oligonucleotide
ggcagagcggaggctcctcgca

SEQ ID NO: 145795 - DNA, 22 bp, Artificial Sequence
  Description of Artificial Sequence: Synthetic oligonucleotide
gcagagcggaggctcctcgcag

SEQ ID NO: 145796 - DNA, 22 bp, Artificial Sequence
  Description of Artificial Sequence: Synthetic oligonucleotide
cagagcggaggctcctcgcagg

SEQ ID NO: 145797 - DNA, 22 bp, Artificial Sequence
  Description of Artificial Sequence: Synthetic oligonucleotide
agagcggaggctcctcgcaggc

SEQ ID NO: 145798 - DNA, 21 bp, Artificial Sequence
  Description of Artificial Sequence: Synthetic oligonucleotide
gagcggaggctcctcgcaggc

SEQ ID NO: 145799 - DNA, 21 bp, Artificial Sequence
  Description of Artificial Sequence: Synthetic oligonucleotide
agcggaggctcctcgcaggcc

SEQ ID NO: 145800 - DNA, 20 bp, Artificial Sequence
  Description of Artificial Sequence: Synthetic oligonucleotide
gcggaggctcctcgcaggcc

SEQ ID NO: 145801 - DNA, 20 bp, Artificial Sequence
  Description of Artificial Sequence: Synthetic oligonucleotide
cggaggctcctcgcaggccg

SEQ ID NO: 145802 - DNA, 20 bp, Artificial Sequence
  Description of Artificial Sequence: Synthetic oligonucleotide
ggaggctcctcgcaggccgg

SEQ ID NO: 145803 - DNA, 20 bp, Artificial Sequence
  Description of Artificial Sequence: Synthetic oligonucleotide
gaggctcctcgcaggccggc

SEQ ID NO: 145804 - DNA, 21 bp, Artificial Sequence
  Description of Artificial Sequence: Synthetic oligonucleotide
aggctcctcgcaggccggcgt

SEQ ID NO: 145805 - DNA, 20 bp, Artificial Sequence
  Description of Artificial Sequence: Synthetic oligonucleotide
ggctcctcgcaggccggcgt

SEQ ID NO: 145806 - DNA, 20 bp, Artificial Sequence
  Description of Artificial Sequence: Synthetic oligonucleotide
gctcctcgcaggccggcgtc

SEQ ID NO: 145807 - DNA, 21 bp, Artificial Sequence
  Description of Artificial Sequence: Synthetic oligonucleotide
ctcctcgcaggccggcgtcgt

SEQ ID NO: 145808 - DNA, 22 bp, Artificial Sequence
  Description of Artificial Sequence: Synthetic oligonucleotide
tcctcgcaggccggcgtcgtga

SEQ ID NO: 145809 - DNA, 21 bp, Artificial Sequence
  Description of Artificial Sequence: Synthetic oligonucleotide
cctcgcaggccggcgtcgtga

SEQ ID NO: 145810 - DNA, 22 bp, Artificial Sequence
  Description of Artificial Sequence: Synthetic oligonucleotide
ctcgcaggccggcgtcgtgact

SEQ ID NO: 145811 - DNA, 23 bp, Artificial Sequence
  Description of Artificial Sequence: Synthetic oligonucleotide
tcgcaggccggcgtcgtgactgt

SEQ ID NO: 145812 - DNA, 22 bp, Artificial Sequence
  Description of Artificial Sequence: Synthetic oligonucleotide
cgcaggccggcgtcgtgactgt

SEQ ID NO: 145813 - DNA, 23 bp, Artificial Sequence
  Description of Artificial Sequence: Synthetic oligonucleotide
gcaggccggcgtcgtgactgtca

SEQ ID NO: 145814 - DNA, 23 bp, Artificial Sequence
  Description of Artificial Sequence: Synthetic oligonucleotide
caggccggcgtcgtgactgtcag

SEQ ID NO: 145815 - DNA, 23 bp, Artificial Sequence
  Description of Artificial Sequence: Synthetic oligonucleotide
aggccggcgtcgtgactgtcagc

SEQ ID NO: 145816 - DNA, 22 bp, Artificial Sequence
  Description of Artificial Sequence: Synthetic oligonucleotide
ggccggcgtcgtgactgtcagc

SEQ ID NO: 145817 - DNA, 23 bp, Artificial Sequence
  Description of Artificial Sequence: Synthetic oligonucleotide
gccggcgtcgtgactgtcagcga

SEQ ID NO: 145818 - DNA, 23 bp, Artificial Sequence
  Description of Artificial Sequence: Synthetic oligonucleotide
ccggcgtcgtgactgtcagcgac

SEQ ID NO: 145819 - DNA, 24 bp, Artificial Sequence
  Description of Artificial Sequence: Synthetic oligonucleotide
cggcgtcgtgactgtcagcgacgt

SEQ ID NO: 145820 - DNA, 24 bp, Artificial Sequence
  Description of Artificial Sequence: Synthetic oligonucleotide
ggcgtcgtgactgtcagcgacgtc

SEQ ID NO: 145821 - DNA, 25 bp, Artificial Sequence
  Description of Artificial Sequence: Synthetic oligonucleotide
gcgtcgtgactgtcagcgacgtcca

SEQ ID NO: 145822 - DNA, 25 bp, Artificial Sequence
  Description of Artificial Sequence: Synthetic oligonucleotide
cgtcgtgactgtcagcgacgtccag

SEQ ID NO: 145823 - DNA, 26 bp, Artificial Sequence
  Description of Artificial Sequence: Synthetic oligonucleotide
gtcgtgactgtcagcgacgtccagga

SEQ ID NO: 145824 - DNA, 26 bp, Artificial Sequence
  Description of Artificial Sequence: Synthetic oligonucleotide
tcgtgactgtcagcgacgtccaggag

SEQ ID NO: 145825 - DNA, 25 bp, Artificial Sequence
  Description of Artificial Sequence: Synthetic oligonucleotide
cgtgactgtcagcgacgtccaggag

SEQ ID NO: 145826 - DNA, 26 bp, Artificial Sequence
  Description of Artificial Sequence: Synthetic oligonucleotide
gtgactgtcagcgacgtccaggagct

SEQ ID NO: 145827 - DNA, 27 bp, Artificial Sequence
  Description of Artificial Sequence: Synthetic oligonucleotide
tgactgtcagcgacgtccaggagctga

SEQ ID NO: 145828 - DNA, 27 bp, Artificial Sequence
  Description of Artificial Sequence: Synthetic oligonucleotide
gactgtcagcgacgtccaggagctgat

SEQ ID NO: 145829 - DNA, 27 bp, Artificial Sequence
  Description of Artificial Sequence: Synthetic oligonucleotide
actgtcagcgacgtccaggagctgatg

SEQ ID NO: 145830 - DNA, 26 bp, Artificial Sequence
  Description of Artificial Sequence: Synthetic oligonucleotide
ctgtcagcgacgtccaggagctgatg

SEQ ID NO: 145831 - DNA, 26 bp, Artificial Sequence
  Description of Artificial Sequence: Synthetic oligonucleotide
tgtcagcgacgtccaggagctgatgc

SEQ ID NO: 145832 - DNA, 25 bp, Artificial Sequence
  Description of Artificial Sequence: Synthetic oligonucleotide
gtcagcgacgtccaggagctgatgc

SEQ ID NO: 145833 - DNA, 25 bp, Artificial Sequence
  Description of Artificial Sequence: Synthetic oligonucleotide
tcagcgacgtccaggagctgatgcg

SEQ ID NO: 145834 - DNA, 24 bp, Artificial Sequence
  Description of Artificial Sequence: Synthetic oligonucleotide
cagcgacgtccaggagctgatgcg

SEQ ID NO: 145835 - DNA, 24 bp, Artificial Sequence
  Description of Artificial Sequence: Synthetic oligonucleotide
agcgacgtccaggagctgatgcgg

SEQ ID NO: 145836 - DNA, 23 bp, Artificial Sequence
  Description of Artificial Sequence: Synthetic oligonucleotide
gcgacgtccaggagctgatgcgg

SEQ ID NO: 145837 - DNA, 23 bp, Artificial Sequence
  Description of Artificial Sequence: Synthetic oligonucleotide
cgacgtccaggagctgatgcggc

SEQ ID NO: 145838 - DNA, 23 bp, Artificial Sequence
  Description of Artificial Sequence: Synthetic oligonucleotide
gacgtccaggagctgatgcggcg

SEQ ID NO: 145839 - DNA, 25 bp, Artificial Sequence
  Description of Artificial Sequence: Synthetic oligonucleotide
acgtccaggagctgatgcggcgcaa

SEQ ID NO: 145840 - DNA, 24 bp, Artificial Sequence
  Description of Artificial Sequence: Synthetic oligonucleotide
cgtccaggagctgatgcggcgcaa

SEQ ID NO: 145841 - DNA, 24 bp, Artificial Sequence
  Description of Artificial Sequence: Synthetic oligonucleotide
gtccaggagctgatgcggcgcaag

SEQ ID NO: 145842 - DNA, 25 bp, Artificial Sequence
  Description of Artificial Sequence: Synthetic oligonucleotide
tccaggagctgatgcggcgcaagga

SEQ ID NO: 145843 - DNA, 24 bp, Artificial Sequence
  Description of Artificial Sequence: Synthetic oligonucleotide
ccaggagctgatgcggcgcaagga

SEQ ID NO: 145844 - DNA, 24 bp, Artificial Sequence
  Description of Artificial Sequence: Synthetic oligonucleotide
caggagctgatgcggcgcaaggag

SEQ ID NO: 145845 - DNA, 25 bp, Artificial Sequence
  Description of Artificial Sequence: Synthetic oligonucleotide
aggagctgatgcggcgcaaggagga

SEQ ID NO: 145846 - DNA, 24 bp, Artificial Sequence
  Description of Artificial Sequence: Synthetic oligonucleotide
ggagctgatgcggcgcaaggagga

SEQ ID NO: 145847 - DNA, 27 bp, Artificial Sequence
  Description of Artificial Sequence: Synthetic oligonucleotide
gagctgatgcggcgcaaggaggagata

SEQ ID NO: 145848 - DNA, 27 bp, Artificial Sequence
  Description of Artificial Sequence: Synthetic oligonucleotide
agctgatgcggcgcaaggaggagatag

SEQ ID NO: 145849 - DNA, 27 bp, Artificial Sequence
  Description of Artificial Sequence: Synthetic oligonucleotide
gctgatgcggcgcaaggaggagataga

SEQ ID NO: 145850 - DNA, 28 bp, Artificial Sequence
  Description of Artificial Sequence: Synthetic oligonucleotide
ctgatgcggcgcaaggaggagatagaag

SEQ ID NO: 145851 - DNA, 28 bp, Artificial Sequence
  Description of Artificial Sequence: Synthetic oligonucleotide
tgatgcggcgcaaggaggagatagaagc

SEQ ID NO: 145852 - DNA, 27 bp, Artificial Sequence
  Description of Artificial Sequence: Synthetic oligonucleotide
gatgcggcgcaaggaggagatagaagc

SEQ ID NO: 145853 - DNA, 27 bp, Artificial Sequence
  Description of Artificial Sequence: Synthetic oligonucleotide
atgcggcgcaaggaggagatagaagcg

SEQ ID NO: 145854 - DNA, 26 bp, Artificial Sequence
  Description of Artificial Sequence: Synthetic oligonucleotide
tgcggcgcaaggaggagatagaagcg

SEQ ID NO: 145855 - DNA, 25 bp, Artificial Sequence
  Description of Artificial Sequence: Synthetic oligonucleotide
gcggcgcaaggaggagatagaagcg

SEQ ID NO: 145856 - DNA, 26 bp, Artificial Sequence
  Description of Artificial Sequence: Synthetic oligonucleotide
cggcgcaaggaggagatagaagcgca

SEQ ID NO: 145857 - DNA, 27 bp, Artificial Sequence
  Description of Artificial Sequence: Synthetic oligonucleotide
ggcgcaaggaggagatagaagcgcaga

SEQ ID NO: 145858 - DNA, 28 bp, Artificial Sequence
  Description of Artificial Sequence: Synthetic oligonucleotide
gcgcaaggaggagatagaagcgcagatc

SEQ ID NO: 145859 - DNA, 30 bp, Artificial Sequence
  Description of Artificial Sequence: Synthetic oligonucleotide
cgcaaggaggagatagaagcgcagatcaag

SEQ ID NO: 145860 - DNA, 30 bp, Artificial Sequence
  Description of Artificial Sequence: Synthetic oligonucleotide
gcaaggaggagatagaagcgcagatcaagg

SEQ ID NO: 145861 - DNA, 30 bp, Artificial Sequence
  Description of Artificial Sequence: Synthetic oligonucleotide
caaggaggagatagaagcgcagatcaaggc

SEQ ID NO: 145862 - DNA, 30 bp, Artificial Sequence
  Description of Artificial Sequence: Synthetic oligonucleotide
aaggaggagatagaagcgcagatcaaggcc

SEQ ID NO: 145863 - DNA, 29 bp, Artificial Sequence
  Description of Artificial Sequence: Synthetic oligonucleotide
aggaggagatagaagcgcagatcaaggcc

SEQ ID NO: 145864 - DNA, 28 bp, Artificial Sequence
  Description of Artificial Sequence: Synthetic oligonucleotide
ggaggagatagaagcgcagatcaaggcc

SEQ ID NO: 145865 - DNA, 30 bp, Artificial Sequence
  Description of Artificial Sequence: Synthetic oligonucleotide
gaggagatagaagcgcagatcaaggccaac

SEQ ID NO: 145866 - DNA, 33 bp, Artificial Sequence
  Description of Artificial Sequence: Synthetic oligonucleotide
aggagatagaagcgcagatcaaggccaactatg

SEQ ID NO: 145867 - DNA, 32 bp, Artificial Sequence
  Description of Artificial Sequence: Synthetic oligonucleotide
ggagatagaagcgcagatcaaggccaactatg

SEQ ID NO: 145868 - DNA, 33 bp, Artificial Sequence
  Description of Artificial Sequence: Synthetic oligonucleotide
gagatagaagcgcagatcaaggccaactatgac

SEQ ID NO: 145869 - DNA, 33 bp, Artificial Sequence
  Description of Artificial Sequence: Synthetic oligonucleotide
agatagaagcgcagatcaaggccaactatgacg

SEQ ID NO: 145870 - DNA, 32 bp, Artificial Sequence
  Description of Artificial Sequence: Synthetic oligonucleotide
gatagaagcgcagatcaaggccaactatgacg

SEQ ID NO: 145871 - DNA, 33 bp, Artificial Sequence
  Description of Artificial Sequence: Synthetic oligonucleotide
atagaagcgcagatcaaggccaactatgacgtg

SEQ ID NO: 145872 - DNA, 32 bp, Artificial Sequence
  Description of Artificial Sequence: Synthetic oligonucleotide
tagaagcgcagatcaaggccaactatgacgtg

SEQ ID NO: 145873 - DNA, 31 bp, Artificial Sequence
  Description of Artificial Sequence: Synthetic oligonucleotide
agaagcgcagatcaaggccaactatgacgtg

SEQ ID NO: 145874 - DNA, 30 bp, Artificial Sequence
  Description of Artificial Sequence: Synthetic oligonucleotide
gaagcgcagatcaaggccaactatgacgtg

SEQ ID NO: 145875 - DNA, 30 bp, Artificial Sequence
  Description of Artificial Sequence: Synthetic oligonucleotide
aagcgcagatcaaggccaactatgacgtgc

SEQ ID NO: 145876 - DNA, 29 bp, Artificial Sequence
  Description of Artificial Sequence: Synthetic oligonucleotide
agcgcagatcaaggccaactatgacgtgc

SEQ ID NO: 145877 - DNA, 28 bp, Artificial Sequence
  Description of Artificial Sequence: Synthetic oligonucleotide
gcgcagatcaaggccaactatgacgtgc

SEQ ID NO: 145878 - DNA, 29 bp, Artificial Sequence
  Description of Artificial Sequence: Synthetic oligonucleotide
cgcagatcaaggccaactatgacgtgctg

SEQ ID NO: 145879 - DNA, 29 bp, Artificial Sequence
  Description of Artificial Sequence: Synthetic oligonucleotide
gcagatcaaggccaactatgacgtgctgg

SEQ ID NO: 145880 - DNA, 32 bp, Artificial Sequence
  Description of Artificial Sequence: Synthetic oligonucleotide
cagatcaaggccaactatgacgtgctggaaag

SEQ ID NO: 145881 - DNA, 32 bp, Artificial Sequence
  Description of Artificial Sequence: Synthetic oligonucleotide
agatcaaggccaactatgacgtgctggaaagc

SEQ ID NO: 145882 - DNA, 31 bp, Artificial Sequence
  Description of Artificial Sequence: Synthetic oligonucleotide
gatcaaggccaactatgacgtgctggaaagc

SEQ ID NO: 145883 - DNA, 31 bp, Artificial Sequence
  Description of Artificial Sequence: Synthetic oligonucleotide
atcaaggccaactatgacgtgctggaaagcc

SEQ ID NO: 145884 - DNA, 30 bp, Artificial Sequence
  Description of Artificial Sequence: Synthetic oligonucleotide
tcaaggccaactatgacgtgctggaaagcc

SEQ ID NO: 145885 - DNA, 29 bp, Artificial Sequence
  Description of Artificial Sequence: Synthetic oligonucleotide
caaggccaactatgacgtgctggaaagcc

SEQ ID NO: 145886 - DNA, 34 bp, Artificial Sequence
  Description of Artificial Sequence: Synthetic oligonucleotide
aaggccaactatgacgtgctggaaagccaaaaag

SEQ ID NO: 145887 - DNA, 33 bp, Artificial Sequence
  Description of Artificial Sequence: Synthetic oligonucleotide
aggccaactatgacgtgctggaaagccaaaaag

SEQ ID NO: 145888 - DNA, 32 bp, Artificial Sequence
  Description of Artificial Sequence: Synthetic oligonucleotide
ggccaactatgacgtgctggaaagccaaaaag

SEQ ID NO: 145889 - DNA, 32 bp, Artificial Sequence
  Description of Artificial Sequence: Synthetic oligonucleotide
gccaactatgacgtgctggaaagccaaaaagg

SEQ ID NO: 145890 - DNA, 32 bp, Artificial Sequence
  Description of Artificial Sequence: Synthetic oligonucleotide
ccaactatgacgtgctggaaagccaaaaaggc

SEQ ID NO: 145891 - DNA, 35 bp, Artificial Sequence
  Description of Artificial Sequence: Synthetic oligonucleotide
caactatgacgtgctggaaagccaaaaaggcattg

SEQ ID NO: 145892 - DNA, 35 bp, Artificial Sequence
  Description of Artificial Sequence: Synthetic oligonucleotide
aactatgacgtgctggaaagccaaaaaggcattgg

SEQ ID NO: 145893 - DNA, 34 bp, Artificial Sequence
  Description of Artificial Sequence: Synthetic oligonucleotide
actatgacgtgctggaaagccaaaaaggcattgg

SEQ ID NO: 145894 - DNA, 33 bp, Artificial Sequence
  Description of Artificial Sequence: Synthetic oligonucleotide
ctatgacgtgctggaaagccaaaaaggcattgg

SEQ ID NO: 145895 - DNA, 33 bp, Artificial Sequence
  Description of Artificial Sequence: Synthetic oligonucleotide
tatgacgtgctggaaagccaaaaaggcattggg

SEQ ID NO: 145896 - DNA, 32 bp, Artificial Sequence
  Description of Artificial Sequence: Synthetic oligonucleotide
atgacgtgctggaaagccaaaaaggcattggg

SEQ ID NO: 145897 - DNA, 31 bp, Artificial Sequence
  Description of Artificial Sequence: Synthetic oligonucleotide
tgacgtgctggaaagccaaaaaggcattggg

SEQ ID NO: 145898 - DNA, 30 bp, Artificial Sequence
  Description of Artificial Sequence: Synthetic oligonucleotide
gacgtgctggaaagccaaaaaggcattggg

SEQ ID NO: 145899 - DNA, 32 bp, Artificial Sequence
  Description of Artificial Sequence: Synthetic oligonucleotide
acgtgctggaaagccaaaaaggcattgggatg

SEQ ID NO: 145900 - DNA, 31 bp, Artificial Sequence
  Description of Artificial Sequence: Synthetic oligonucleotide
cgtgctggaaagccaaaaaggcattgggatg

SEQ ID NO: 145901 - DNA, 33 bp, Artificial Sequence
  Description of Artificial Sequence: Synthetic oligonucleotide
gtgctggaaagccaaaaaggcattgggatgaac

SEQ ID NO: 145902 - DNA, 33 bp, Artificial Sequence
  Description of Artificial Sequence: Synthetic oligonucleotide
tgctggaaagccaaaaaggcattgggatgaacg

SEQ ID NO: 145903 - DNA, 32 bp, Artificial Sequence
  Description of Artificial Sequence: Synthetic oligonucleotide
gctggaaagccaaaaaggcattgggatgaacg

SEQ ID NO: 145904 - DNA, 33 bp, Artificial Sequence
  Description of Artificial Sequence: Synthetic oligonucleotide
ctggaaagccaaaaaggcattgggatgaacgag

SEQ ID NO: 145905 - DNA, 33 bp, Artificial Sequence
  Description of Artificial Sequence: Synthetic oligonucleotide
tggaaagccaaaaaggcattgggatgaacgagc

SEQ ID NO: 145906 - DNA, 32 bp, Artificial Sequence
  Description of Artificial Sequence: Synthetic oligonucleotide
ggaaagccaaaaaggcattgggatgaacgagc

SEQ ID NO: 145907 - DNA, 32 bp, Artificial Sequence
  Description of Artificial Sequence: Synthetic oligonucleotide
gaaagccaaaaaggcattgggatgaacgagcc

SEQ ID NO: 145908 - DNA, 32 bp, Artificial Sequence
  Description of Artificial Sequence: Synthetic oligonucleotide
aaagccaaaaaggcattgggatgaacgagccg

SEQ ID NO: 145909 - DNA, 31 bp, Artificial Sequence
  Description of Artificial Sequence: Synthetic oligonucleotide
aagccaaaaaggcattgggatgaacgagccg

SEQ ID NO: 145910 - DNA, 30 bp, Artificial Sequence
  Description of Artificial Sequence: Synthetic oligonucleotide
agccaaaaaggcattgggatgaacgagccg

SEQ ID NO: 145911 - DNA, 29 bp, Artificial Sequence
  Description of Artificial Sequence: Synthetic oligonucleotide
gccaaaaaggcattgggatgaacgagccg

SEQ ID NO: 145912 - DNA, 29 bp, Artificial Sequence
  Description of Artificial Sequence: Synthetic oligonucleotide
ccaaaaaggcattgggatgaacgagccgc

SEQ ID NO: 145913 - DNA, 30 bp, Artificial Sequence
  Description of Artificial Sequence: Synthetic oligonucleotide
caaaaaggcattgggatgaacgagccgctg

SEQ ID NO: 145914 - DNA, 30 bp, Artificial Sequence
  Description of Artificial Sequence: Synthetic oligonucleotide
aaaaaggcattgggatgaacgagccgctgg

SEQ ID NO: 145915 - DNA, 29 bp, Artificial Sequence
  Description of Artificial Sequence: Synthetic oligonucleotide
aaaaggcattgggatgaacgagccgctgg

SEQ ID NO: 145916 - DNA, 28 bp, Artificial Sequence
  Description of Artificial Sequence: Synthetic oligonucleotide
aaaggcattgggatgaacgagccgctgg

SEQ ID NO: 145917 - DNA, 27 bp, Artificial Sequence
  Description of Artificial Sequence: Synthetic oligonucleotide
aaggcattgggatgaacgagccgctgg

SEQ ID NO: 145918 - DNA, 27 bp, Artificial Sequence
  Description of Artificial Sequence: Synthetic oligonucleotide
aggcattgggatgaacgagccgctggt

SEQ ID NO: 145919 - DNA, 26 bp, Artificial Sequence
  Description of Artificial Sequence: Synthetic oligonucleotide
ggcattgggatgaacgagccgctggt

SEQ ID NO: 145920 - DNA, 26 bp, Artificial Sequence
  Description of Artificial Sequence: Synthetic oligonucleotide
gcattgggatgaacgagccgctggtg

SEQ ID NO: 145921 - DNA, 27 bp, Artificial Sequence
  Description of Artificial Sequence: Synthetic oligonucleotide
cattgggatgaacgagccgctggtgga

SEQ ID NO: 145922 - DNA, 27 bp, Artificial Sequence
  Description of Artificial Sequence: Synthetic oligonucleotide
attgggatgaacgagccgctggtggac

SEQ ID NO: 145923 - DNA, 27 bp, Artificial Sequence
  Description of Artificial Sequence: Synthetic oligonucleotide
ttgggatgaacgagccgctggtggact

SEQ ID NO: 145924 - DNA, 26 bp, Artificial Sequence
  Description of Artificial Sequence: Synthetic oligonucleotide
tgggatgaacgagccgctggtggact

SEQ ID NO: 145925 - DNA, 25 bp, Artificial Sequence
  Description of Artificial Sequence: Synthetic oligonucleotide
gggatgaacgagccgctggtggact

SEQ ID NO: 145926 - DNA, 26 bp, Artificial Sequence
  Description of Artificial Sequence: Synthetic oligonucleotide
ggatgaacgagccgctggtggactgt

SEQ ID NO: 145927 - DNA, 27 bp, Artificial Sequence
  Description of Artificial Sequence: Synthetic oligonucleotide
gatgaacgagccgctggtggactgtga

SEQ ID NO: 145928 - DNA, 27 bp, Artificial Sequence
  Description of Artificial Sequence: Synthetic oligonucleotide
atgaacgagccgctggtggactgtgag

SEQ ID NO: 145929 - DNA, 26 bp, Artificial Sequence
  Description of Artificial Sequence: Synthetic oligonucleotide
tgaacgagccgctggtggactgtgag

SEQ ID NO: 145930 - DNA, 25 bp, Artificial Sequence
  Description of Artificial Sequence: Synthetic oligonucleotide
gaacgagccgctggtggactgtgag

SEQ ID NO: 145931 - DNA, 25 bp, Artificial Sequence
  Description of Artificial Sequence: Synthetic oligonucleotide
aacgagccgctggtggactgtgagg

SEQ ID NO: 145932 - DNA, 24 bp, Artificial Sequence
  Description of Artificial Sequence: Synthetic oligonucleotide
acgagccgctggtggactgtgagg

SEQ ID NO: 145933 - DNA, 23 bp, Artificial Sequence
  Description of Artificial Sequence: Synthetic oligonucleotide
cgagccgctggtggactgtgagg

SEQ ID NO: 145934 - DNA, 23 bp, Artificial Sequence
  Description of Artificial Sequence: Synthetic oligonucleotide
gagccgctggtggactgtgaggg

SEQ ID NO: 145935 - DNA, 25 bp, Artificial Sequence
  Description of Artificial Sequence: Synthetic oligonucleotide
agccgctggtggactgtgagggcta

SEQ ID NO: 145936 - DNA, 24 bp, Artificial Sequence
  Description of Artificial Sequence: Synthetic oligonucleotide
gccgctggtggactgtgagggcta

SEQ ID NO: 145937 - DNA, 24 bp, Artificial Sequence
  Description of Artificial Sequence: Synthetic oligonucleotide
ccgctggtggactgtgagggctac

SEQ ID NO: 145938 - DNA, 24 bp, Artificial Sequence
  Description of Artificial Sequence: Synthetic oligonucleotide
cgctggtggactgtgagggctacc

SEQ ID NO: 145939 - DNA, 24 bp, Artificial Sequence
  Description of Artificial Sequence: Synthetic oligonucleotide
gctggtggactgtgagggctaccc

SEQ ID NO: 145940 - DNA, 24 bp, Artificial Sequence
  Description of Artificial Sequence: Synthetic oligonucleotide
ctggtggactgtgagggctacccc

SEQ ID NO: 145941 - DNA, 24 bp, Artificial Sequence
  Description of Artificial Sequence: Synthetic oligonucleotide
tggtggactgtgagggctaccccc

SEQ ID NO: 145942 - DNA, 23 bp, Artificial Sequence
  Description of Artificial Sequence: Synthetic oligonucleotide
ggtggactgtgagggctaccccc

SEQ ID NO: 145943 - DNA, 23 bp, Artificial Sequence
  Description of Artificial Sequence: Synthetic oligonucleotide
gtggactgtgagggctacccccg

SEQ ID NO: 145944 - DNA, 24 bp, Artificial Sequence
  Description of Artificial Sequence: Synthetic oligonucleotide
tggactgtgagggctacccccggt

SEQ ID NO: 145945 - DNA, 23 bp, Artificial Sequence
  Description of Artificial Sequence: Synthetic oligonucleotide
ggactgtgagggctacccccggt

SEQ ID NO: 145946 - DNA, 24 bp, Artificial Sequence
  Description of Artificial Sequence: Synthetic oligonucleotide
gactgtgagggctacccccggtca

SEQ ID NO: 145947 - DNA, 25 bp, Artificial Sequence
  Description of Artificial Sequence: Synthetic oligonucleotide
actgtgagggctacccccggtcaga

SEQ ID NO: 145948 - DNA, 24 bp, Artificial Sequence
  Description of Artificial Sequence: Synthetic oligonucleotide
ctgtgagggctacccccggtcaga

SEQ ID NO: 145949 - DNA, 24 bp, Artificial Sequence
  Description of Artificial Sequence: Synthetic oligonucleotide
tgtgagggctacccccggtcagac

SEQ ID NO: 145950 - DNA, 23 bp, Artificial Sequence
  Description of Artificial Sequence: Synthetic oligonucleotide
gtgagggctacccccggtcagac

SEQ ID NO: 145951 - DNA, 24 bp, Artificial Sequence
  Description of Artificial Sequence: Synthetic oligonucleotide
tgagggctacccccggtcagacgt

SEQ ID NO: 145952 - DNA, 23 bp, Artificial Sequence
  Description of Artificial Sequence: Synthetic oligonucleotide
gagggctacccccggtcagacgt

SEQ ID NO: 145953 - DNA, 23 bp, Artificial Sequence
  Description of Artificial Sequence: Synthetic oligonucleotide
agggctacccccggtcagacgtg

SEQ ID NO: 145954 - DNA, 22 bp, Artificial Sequence
  Description of Artificial Sequence: Synthetic oligonucleotide
gggctacccccggtcagacgtg

SEQ ID NO: 145955 - DNA, 23 bp, Artificial Sequence
  Description of Artificial Sequence: Synthetic oligonucleotide
ggctacccccggtcagacgtgga

SEQ ID NO: 145956 - DNA, 23 bp, Artificial Sequence
  Description of Artificial Sequence: Synthetic oligonucleotide
gctacccccggtcagacgtggac

SEQ ID NO: 145957 - DNA, 24 bp, Artificial Sequence
  Description of Artificial Sequence: Synthetic oligonucleotide
ctacccccggtcagacgtggacct

SEQ ID NO: 145958 - DNA, 26 bp, Artificial Sequence
  Description of Artificial Sequence: Synthetic oligonucleotide
tacccccggtcagacgtggacctgta

SEQ ID NO: 145959 - DNA, 25 bp, Artificial Sequence
  Description of Artificial Sequence: Synthetic oligonucleotide
acccccggtcagacgtggacctgta

SEQ ID NO: 145960 - DNA, 24 bp, Artificial Sequence
  Description of Artificial Sequence: Synthetic oligonucleotide
cccccggtcagacgtggacctgta

SEQ ID NO: 145961 - DNA, 24 bp, Artificial Sequence
  Description of Artificial Sequence: Synthetic oligonucleotide
ccccggtcagacgtggacctgtac

SEQ ID NO: 145962 - DNA, 26 bp, Artificial Sequence
  Description of Artificial Sequence: Synthetic oligonucleotide
cccggtcagacgtggacctgtaccaa

SEQ ID NO: 145963 - DNA, 27 bp, Artificial Sequence
  Description of Artificial Sequence: Synthetic oligonucleotide
ccggtcagacgtggacctgtaccaagt

SEQ ID NO: 145964 - DNA, 27 bp, Artificial Sequence
  Description of Artificial Sequence: Synthetic oligonucleotide
cggtcagacgtggacctgtaccaagtc

SEQ ID NO: 145965 - DNA, 27 bp, Artificial Sequence
  Description of Artificial Sequence: Synthetic oligonucleotide
ggtcagacgtggacctgtaccaagtcc

SEQ ID NO: 145966 - DNA, 27 bp, Artificial Sequence
  Description of Artificial Sequence: Synthetic oligonucleotide
gtcagacgtggacctgtaccaagtccg

SEQ ID NO: 145967 - DNA, 27 bp, Artificial Sequence
  Description of Artificial Sequence: Synthetic oligonucleotide
tcagacgtggacctgtaccaagtccgc

SEQ ID NO: 145968 - DNA, 27 bp, Artificial Sequence
  Description of Artificial Sequence: Synthetic oligonucleotide
cagacgtggacctgtaccaagtccgca

SEQ ID NO: 145969 - DNA, 27 bp, Artificial Sequence
  Description of Artificial Sequence: Synthetic oligonucleotide
agacgtggacctgtaccaagtccgcac

SEQ ID NO: 145970 - DNA, 26 bp, Artificial Sequence
  Description of Artificial Sequence: Synthetic oligonucleotide
gacgtggacctgtaccaagtccgcac

SEQ ID NO: 145971 - DNA, 26 bp, Artificial Sequence
  Description of Artificial Sequence: Synthetic oligonucleotide
acgtggacctgtaccaagtccgcacc

SEQ ID NO: 145972 - DNA, 25 bp, Artificial Sequence
  Description of Artificial Sequence: Synthetic oligonucleotide
cgtggacctgtaccaagtccgcacc

SEQ ID NO: 145973 - DNA, 25 bp, Artificial Sequence
  Description of Artificial Sequence: Synthetic oligonucleotide
gtggacctgtaccaagtccgcaccg

SEQ ID NO: 145974 - DNA, 25 bp, Artificial Sequence
  Description of Artificial Sequence: Synthetic oligonucleotide
tggacctgtaccaagtccgcaccgc

SEQ ID NO: 145975 - DNA, 24 bp, Artificial Sequence
  Description of Artificial Sequence: Synthetic oligonucleotide
ggacctgtaccaagtccgcaccgc

SEQ ID NO: 145976 - DNA, 25 bp, Artificial Sequence
  Description of Artificial Sequence: Synthetic oligonucleotide
gacctgtaccaagtccgcaccgcca

SEQ ID NO: 145977 - DNA, 25 bp, Artificial Sequence
  Description of Artificial Sequence: Synthetic oligonucleotide
acctgtaccaagtccgcaccgccag

SEQ ID NO: 145978 - DNA, 24 bp, Artificial Sequence
  Description of Artificial Sequence: Synthetic oligonucleotide
cctgtaccaagtccgcaccgccag

SEQ ID NO: 145979 - DNA, 24 bp, Artificial Sequence
  Description of Artificial Sequence: Synthetic oligonucleotide
ctgtaccaagtccgcaccgccagg

SEQ ID NO: 145980 - DNA, 25 bp, Artificial Sequence
  Description of Artificial Sequence: Synthetic oligonucleotide
tgtaccaagtccgcaccgccaggca

SEQ ID NO: 145981 - DNA, 24 bp, Artificial Sequence
  Description of Artificial Sequence: Synthetic oligonucleotide
gtaccaagtccgcaccgccaggca

SEQ ID NO: 145982 - DNA, 26 bp, Artificial Sequence
  Description of Artificial Sequence: Synthetic oligonucleotide
taccaagtccgcaccgccaggcacaa

SEQ ID NO: 145983 - DNA, 25 bp, Artificial Sequence
  Description of Artificial Sequence: Synthetic oligonucleotide
accaagtccgcaccgccaggcacaa

SEQ ID NO: 145984 - DNA, 24 bp, Artificial Sequence
  Description of Artificial Sequence: Synthetic oligonucleotide
ccaagtccgcaccgccaggcacaa

SEQ ID NO: 145985 - DNA, 26 bp, Artificial Sequence
  Description of Artificial Sequence: Synthetic oligonucleotide
caagtccgcaccgccaggcacaacat

SEQ ID NO: 145986 - DNA, 27 bp, Artificial Sequence
  Description of Artificial Sequence: Synthetic oligonucleotide
aagtccgcaccgccaggcacaacatca

SEQ ID NO: 145987 - DNA, 27 bp, Artificial Sequence
  Description of Artificial Sequence: Synthetic oligonucleotide
agtccgcaccgccaggcacaacatcat

SEQ ID NO: 145988 - DNA, 27 bp, Artificial Sequence
  Description of Artificial Sequence: Synthetic oligonucleotide
gtccgcaccgccaggcacaacatcata

SEQ ID NO: 145989 - DNA, 28 bp, Artificial Sequence
  Description of Artificial Sequence: Synthetic oligonucleotide
tccgcaccgccaggcacaacatcatatg

SEQ ID NO: 145990 - DNA, 27 bp, Artificial Sequence
  Description of Artificial Sequence: Synthetic oligonucleotide
ccgcaccgccaggcacaacatcatatg

SEQ ID NO: 145991 - DNA, 27 bp, Artificial Sequence
  Description of Artificial Sequence: Synthetic oligonucleotide
cgcaccgccaggcacaacatcatatgc

SEQ ID NO: 145992 - DNA, 27 bp, Artificial Sequence
  Description of Artificial Sequence: Synthetic oligonucleotide
gcaccgccaggcacaacatcatatgcc

SEQ ID NO: 145993 - DNA, 28 bp, Artificial Sequence
  Description of Artificial Sequence: Synthetic oligonucleotide
caccgccaggcacaacatcatatgcctg

SEQ ID NO: 145994 - DNA, 28 bp, Artificial Sequence
  Description of Artificial Sequence: Synthetic oligonucleotide
accgccaggcacaacatcatatgcctgc

SEQ ID NO: 145995 - DNA, 27 bp, Artificial Sequence
  Description of Artificial Sequence: Synthetic oligonucleotide
ccgccaggcacaacatcatatgcctgc

SEQ ID NO: 145996 - DNA, 28 bp, Artificial Sequence
  Description of Artificial Sequence: Synthetic oligonucleotide
cgccaggcacaacatcatatgcctgcag

SEQ ID NO: 145997 - DNA, 31 bp, Artificial Sequence
  Description of Artificial Sequence: Synthetic oligonucleotide
gccaggcacaacatcatatgcctgcagaatg

SEQ ID NO: 145998 - DNA, 33 bp, Artificial Sequence
  Description of Artificial Sequence: Synthetic oligonucleotide
ccaggcacaacatcatatgcctgcagaatgatc

SEQ ID NO: 145999 - DNA, 34 bp, Artificial Sequence
  Description of Artificial Sequence: Synthetic oligonucleotide
caggcacaacatcatatgcctgcagaatgatcac

SEQ ID NO: 146000 - DNA, 36 bp, Artificial Sequence
  Description of Artificial Sequence: Synthetic oligonucleotide
aggcacaacatcatatgcctgcagaatgatcacaag

SEQ ID NO: 146001 - DNA, 35 bp, Artificial Sequence
  Description of Artificial Sequence: Synthetic oligonucleotide
ggcacaacatcatatgcctgcagaatgatcacaag

SEQ ID NO: 146002 - DNA, 35 bp, Artificial Sequence
  Description of Artificial Sequence: Synthetic oligonucleotide
gcacaacatcatatgcctgcagaatgatcacaagg

SEQ ID NO: 146003 - DNA, 35 bp, Artificial Sequence
  Description of Artificial Sequence: Synthetic oligonucleotide
cacaacatcatatgcctgcagaatgatcacaaggc

SEQ ID NO: 146004 - DNA, 36 bp, Artificial Sequence
  Description of Artificial Sequence: Synthetic oligonucleotide
acaacatcatatgcctgcagaatgatcacaaggcag

SEQ ID NO: 146005 - DNA, 35 bp, Artificial Sequence
  Description of Artificial Sequence: Synthetic oligonucleotide
caacatcatatgcctgcagaatgatcacaaggcag

SEQ ID NO: 146006 - DNA, 36 bp, Artificial Sequence
  Description of Artificial Sequence: Synthetic oligonucleotide
aacatcatatgcctgcagaatgatcacaaggcagtg

SEQ ID NO: 146007 - DNA, 35 bp, Artificial Sequence
  Description of Artificial Sequence: Synthetic oligonucleotide
acatcatatgcctgcagaatgatcacaaggcagtg

SEQ ID NO: 146008 - DNA, 34 bp, Artificial Sequence
  Description of Artificial Sequence: Synthetic oligonucleotide
catcatatgcctgcagaatgatcacaaggcagtg

SEQ ID NO: 146009 - DNA, 36 bp, Artificial Sequence
  Description of Artificial Sequence: Synthetic oligonucleotide
atcatatgcctgcagaatgatcacaaggcagtgatg

SEQ ID NO: 146010 - DNA, 35 bp, Artificial Sequence
  Description of Artificial Sequence: Synthetic oligonucleotide
tcatatgcctgcagaatgatcacaaggcagtgatg

SEQ ID NO: 146011 - DNA, 34 bp, Artificial Sequence
  Description of Artificial Sequence: Synthetic oligonucleotide
catatgcctgcagaatgatcacaaggcagtgatg

SEQ ID NO: 146012 - DNA, 36 bp, Artificial Sequence
  Description of Artificial Sequence: Synthetic oligonucleotide
atatgcctgcagaatgatcacaaggcagtgatgaag

SEQ ID NO: 146013 - DNA, 35 bp, Artificial Sequence
  Description of Artificial Sequence: Synthetic oligonucleotide
tatgcctgcagaatgatcacaaggcagtgatgaag

SEQ ID NO: 146014 - DNA, 34 bp, Artificial Sequence
  Description of Artificial Sequence: Synthetic oligonucleotide
atgcctgcagaatgatcacaaggcagtgatgaag

SEQ ID NO: 146015 - DNA, 33 bp, Artificial Sequence
  Description of Artificial Sequence: Synthetic oligonucleotide
tgcctgcagaatgatcacaaggcagtgatgaag

SEQ ID NO: 146016 - DNA, 32 bp, Artificial Sequence
  Description of Artificial Sequence: Synthetic oligonucleotide
gcctgcagaatgatcacaaggcagtgatgaag

SEQ ID NO: 146017 - DNA, 32 bp, Artificial Sequence
  Description of Artificial Sequence: Synthetic oligonucleotide
cctgcagaatgatcacaaggcagtgatgaagc

SEQ ID NO: 146018 - DNA, 33 bp, Artificial Sequence
  Description of Artificial Sequence: Synthetic oligonucleotide
ctgcagaatgatcacaaggcagtgatgaagcag

SEQ ID NO: 146019 - DNA, 33 bp, Artificial Sequence
  Description of Artificial Sequence: Synthetic oligonucleotide
tgcagaatgatcacaaggcagtgatgaagcagg

SEQ ID NO: 146020 - DNA, 32 bp, Artificial Sequence
  Description of Artificial Sequence: Synthetic oligonucleotide
gcagaatgatcacaaggcagtgatgaagcagg

SEQ ID NO: 146021 - DNA, 33 bp, Artificial Sequence
  Description of Artificial Sequence: Synthetic oligonucleotide
cagaatgatcacaaggcagtgatgaagcaggtg

SEQ ID NO: 146022 - DNA, 33 bp, Artificial Sequence
  Description of Artificial Sequence: Synthetic oligonucleotide
agaatgatcacaaggcagtgatgaagcaggtgg

SEQ ID NO: 146023 - DNA, 32 bp, Artificial Sequence
  Description of Artificial Sequence: Synthetic oligonucleotide
gaatgatcacaaggcagtgatgaagcaggtgg

SEQ ID NO: 146024 - DNA, 33 bp, Artificial Sequence
  Description of Artificial Sequence: Synthetic oligonucleotide
aatgatcacaaggcagtgatgaagcaggtggag

SEQ ID NO: 146025 - DNA, 32 bp, Artificial Sequence
  Description of Artificial Sequence: Synthetic oligonucleotide
atgatcacaaggcagtgatgaagcaggtggag

SEQ ID NO: 146026 - DNA, 31 bp, Artificial Sequence
  Description of Artificial Sequence: Synthetic oligonucleotide
tgatcacaaggcagtgatgaagcaggtggag

SEQ ID NO: 146027 - DNA, 30 bp, Artificial Sequence
  Description of Artificial Sequence: Synthetic oligonucleotide
gatcacaaggcagtgatgaagcaggtggag

SEQ ID NO: 146028 - DNA, 30 bp, Artificial Sequence
  Description of Artificial Sequence: Synthetic oligonucleotide
atcacaaggcagtgatgaagcaggtggagg

SEQ ID NO: 146029 - DNA, 29 bp, Artificial Sequence
  Description of Artificial Sequence: Synthetic oligonucleotide
tcacaaggcagtgatgaagcaggtggagg

SEQ ID NO: 146030 - DNA, 28 bp, Artificial Sequence
  Description of Artificial Sequence: Synthetic oligonucleotide
cacaaggcagtgatgaagcaggtggagg

SEQ ID NO: 146031 - DNA, 29 bp, Artificial Sequence
  Description of Artificial Sequence: Synthetic oligonucleotide
acaaggcagtgatgaagcaggtggaggag

SEQ ID NO: 146032 - DNA, 28 bp, Artificial Sequence
  Description of Artificial Sequence: Synthetic oligonucleotide
caaggcagtgatgaagcaggtggaggag

SEQ ID NO: 146033 - DNA, 28 bp, Artificial Sequence
  Description of Artificial Sequence: Synthetic oligonucleotide
aaggcagtgatgaagcaggtggaggagg

SEQ ID NO: 146034 - DNA, 27 bp, Artificial Sequence
  Description of Artificial Sequence: Synthetic oligonucleotide
aggcagtgatgaagcaggtggaggagg

SEQ ID NO: 146035 - DNA, 26 bp, Artificial Sequence
  Description of Artificial Sequence: Synthetic oligonucleotide
ggcagtgatgaagcaggtggaggagg

SEQ ID NO: 146036 - DNA, 26 bp, Artificial Sequence
  Description of Artificial Sequence: Synthetic oligonucleotide
gcagtgatgaagcaggtggaggaggc

SEQ ID NO: 146037 - DNA, 26 bp, Artificial Sequence
  Description of Artificial Sequence: Synthetic oligonucleotide
cagtgatgaagcaggtggaggaggcc

SEQ ID NO: 146038 - DNA, 27 bp, Artificial Sequence
  Description of Artificial Sequence: Synthetic oligonucleotide
agtgatgaagcaggtggaggaggccct

SEQ ID NO: 146039 - DNA, 26 bp, Artificial Sequence
  Description of Artificial Sequence: Synthetic oligonucleotide
gtgatgaagcaggtggaggaggccct

SEQ ID NO: 146040 - DNA, 26 bp, Artificial Sequence
  Description of Artificial Sequence: Synthetic oligonucleotide
tgatgaagcaggtggaggaggccctg

SEQ ID NO: 146041 - DNA, 25 bp, Artificial Sequence
  Description of Artificial Sequence: Synthetic oligonucleotide
gatgaagcaggtggaggaggccctg

SEQ ID NO: 146042 - DNA, 26 bp, Artificial Sequence
  Description of Artificial Sequence: Synthetic oligonucleotide
atgaagcaggtggaggaggccctgca

SEQ ID NO: 146043 - DNA, 25 bp, Artificial Sequence
  Description of Artificial Sequence: Synthetic oligonucleotide
tgaagcaggtggaggaggccctgca

SEQ ID NO: 146044 - DNA, 24 bp, Artificial Sequence
  Description of Artificial Sequence: Synthetic oligonucleotide
gaagcaggtggaggaggccctgca

SEQ ID NO: 146045 - DNA, 24 bp, Artificial Sequence
  Description of Artificial Sequence: Synthetic oligonucleotide
aagcaggtggaggaggccctgcac

SEQ ID NO: 146046 - DNA, 23 bp, Artificial Sequence
  Description of Artificial Sequence: Synthetic oligonucleotide
agcaggtggaggaggccctgcac

SEQ ID NO: 146047 - DNA, 22 bp, Artificial Sequence
  Description of Artificial Sequence: Synthetic oligonucleotide
gcaggtggaggaggccctgcac

SEQ ID NO: 146048 - DNA, 23 bp, Artificial Sequence
  Description of Artificial Sequence: Synthetic oligonucleotide
caggtggaggaggccctgcacca

SEQ ID NO: 146049 - DNA, 23 bp, Artificial Sequence
  Description of Artificial Sequence: Synthetic oligonucleotide
aggtggaggaggccctgcaccag

SEQ ID NO: 146050 - DNA, 22 bp, Artificial Sequence
  Description of Artificial Sequence: Synthetic oligonucleotide
ggtggaggaggccctgcaccag

SEQ ID NO: 146051 - DNA, 23 bp, Artificial Sequence
  Description of Artificial Sequence: Synthetic oligonucleotide
gtggaggaggccctgcaccagct

SEQ ID NO: 146052 - DNA, 23 bp, Artificial Sequence
  Description of Artificial Sequence: Synthetic oligonucleotide
tggaggaggccctgcaccagctg

SEQ ID NO: 146053 - DNA, 22 bp, Artificial Sequence
  Description of Artificial Sequence: Synthetic oligonucleotide
ggaggaggccctgcaccagctg

SEQ ID NO: 146054 - DNA, 23 bp, Artificial Sequence
  Description of Artificial Sequence: Synthetic oligonucleotide
gaggaggccctgcaccagctgca

SEQ ID NO: 146055 - DNA, 23 bp, Artificial Sequence
  Description of Artificial Sequence: Synthetic oligonucleotide
aggaggccctgcaccagctgcac

SEQ ID NO: 146056 - DNA, 22 bp, Artificial Sequence
  Description of Artificial Sequence: Synthetic oligonucleotide
ggaggccctgcaccagctgcac

SEQ ID NO: 146057 - DNA, 22 bp, Artificial Sequence
  Description of Artificial Sequence: Synthetic oligonucleotide
gaggccctgcaccagctgcacg

SEQ ID NO: 146058 - DNA, 23 bp, Artificial Sequence
  Description of Artificial Sequence: Synthetic oligonucleotide
aggccctgcaccagctgcacgct

SEQ ID NO: 146059 - DNA, 22 bp, Artificial Sequence
  Description of Artificial Sequence: Synthetic oligonucleotide
ggccctgcaccagctgcacgct

SEQ ID NO: 146060 - DNA, 22 bp, Artificial Sequence
  Description of Artificial Sequence: Synthetic oligonucleotide
gccctgcaccagctgcacgctc

SEQ ID NO: 146061 - DNA, 22 bp, Artificial Sequence
  Description of Artificial Sequence: Synthetic oligonucleotide
ccctgcaccagctgcacgctcg

SEQ ID NO: 146062 - DNA, 22 bp, Artificial Sequence
  Description of Artificial Sequence: Synthetic oligonucleotide
cctgcaccagctgcacgctcgc

SEQ ID NO: 146063 - DNA, 23 bp, Artificial Sequence
  Description of Artificial Sequence: Synthetic oligonucleotide
ctgcaccagctgcacgctcgcga

SEQ ID NO: 146064 - DNA, 25 bp, Artificial Sequence
  Description of Artificial Sequence: Synthetic oligonucleotide
tgcaccagctgcacgctcgcgacaa

SEQ ID NO: 146065 - DNA, 24 bp, Artificial Sequence
  Description of Artificial Sequence: Synthetic oligonucleotide
gcaccagctgcacgctcgcgacaa

SEQ ID NO: 146066 - DNA, 24 bp, Artificial Sequence
  Description of Artificial Sequence: Synthetic oligonucleotide
caccagctgcacgctcgcgacaag

SEQ ID NO: 146067 - DNA, 25 bp, Artificial Sequence
  Description of Artificial Sequence: Synthetic oligonucleotide
accagctgcacgctcgcgacaagga

SEQ ID NO: 146068 - DNA, 24 bp, Artificial Sequence
  Description of Artificial Sequence: Synthetic oligonucleotide
ccagctgcacgctcgcgacaagga

SEQ ID NO: 146069 - DNA, 26 bp, Artificial Sequence
  Description of Artificial Sequence: Synthetic oligonucleotide
cagctgcacgctcgcgacaaggagaa

SEQ ID NO: 146070 - DNA, 26 bp, Artificial Sequence
  Description of Artificial Sequence: Synthetic oligonucleotide
agctgcacgctcgcgacaaggagaag

SEQ ID NO: 146071 - DNA, 25 bp, Artificial Sequence
  Description of Artificial Sequence: Synthetic oligonucleotide
gctgcacgctcgcgacaaggagaag

SEQ ID NO: 146072 - DNA, 26 bp, Artificial Sequence
  Description of Artificial Sequence: Synthetic oligonucleotide
ctgcacgctcgcgacaaggagaagca

SEQ ID NO: 146073 - DNA, 26 bp, Artificial Sequence
  Description of Artificial Sequence: Synthetic oligonucleotide
tgcacgctcgcgacaaggagaagcag

SEQ ID NO: 146074 - DNA, 25 bp, Artificial Sequence
  Description of Artificial Sequence: Synthetic oligonucleotide
gcacgctcgcgacaaggagaagcag

SEQ ID NO: 146075 - DNA, 25 bp, Artificial Sequence
  Description of Artificial Sequence: Synthetic oligonucleotide
cacgctcgcgacaaggagaagcagg

SEQ ID NO: 146076 - DNA, 25 bp, Artificial Sequence
  Description of Artificial Sequence: Synthetic oligonucleotide
acgctcgcgacaaggagaagcaggc

SEQ ID NO: 146077 - DNA, 24 bp, Artificial Sequence
  Description of Artificial Sequence: Synthetic oligonucleotide
cgctcgcgacaaggagaagcaggc

SEQ ID NO: 146078 - DNA, 24 bp, Artificial Sequence
  Description of Artificial Sequence: Synthetic oligonucleotide
gctcgcgacaaggagaagcaggcc

SEQ ID NO: 146079 - DNA, 24 bp, Artificial Sequence
  Description of Artificial Sequence: Synthetic oligonucleotide
ctcgcgacaaggagaagcaggccc

SEQ ID NO: 146080 - DNA, 24 bp, Artificial Sequence
  Description of Artificial Sequence: Synthetic oligonucleotide
tcgcgacaaggagaagcaggcccg

SEQ ID NO: 146081 - DNA, 23 bp, Artificial Sequence
  Description of Artificial Sequence: Synthetic oligonucleotide
cgcgacaaggagaagcaggcccg

SEQ ID NO: 146082 - DNA, 23 bp, Artificial Sequence
  Description of Artificial Sequence: Synthetic oligonucleotide
gcgacaaggagaagcaggcccgg

SEQ ID NO: 146083 - DNA, 24 bp, Artificial Sequence
  Description of Artificial Sequence: Synthetic oligonucleotide
cgacaaggagaagcaggcccggga

SEQ ID NO: 146084 - DNA, 26 bp, Artificial Sequence
  Description of Artificial Sequence: Synthetic oligonucleotide
gacaaggagaagcaggcccgggacat

SEQ ID NO: 146085 - DNA, 26 bp, Artificial Sequence
  Description of Artificial Sequence: Synthetic oligonucleotide
acaaggagaagcaggcccgggacatg

SEQ ID NO: 146086 - DNA, 25 bp, Artificial Sequence
  Description of Artificial Sequence: Synthetic oligonucleotide
caaggagaagcaggcccgggacatg

SEQ ID NO: 146087 - DNA, 25 bp, Artificial Sequence
  Description of Artificial Sequence: Synthetic oligonucleotide
aaggagaagcaggcccgggacatgg

SEQ ID NO: 146088 - DNA, 24 bp, Artificial Sequence
  Description of Artificial Sequence: Synthetic oligonucleotide
aggagaagcaggcccgggacatgg

SEQ ID NO: 146089 - DNA, 23 bp, Artificial Sequence
  Description of Artificial Sequence: Synthetic oligonucleotide
ggagaagcaggcccgggacatgg

SEQ ID NO: 146090 - DNA, 24 bp, Artificial Sequence
  Description of Artificial Sequence: Synthetic oligonucleotide
gagaagcaggcccgggacatggct

SEQ ID NO: 146091 - DNA, 25 bp, Artificial Sequence
  Description of Artificial Sequence: Synthetic oligonucleotide
agaagcaggcccgggacatggctga

SEQ ID NO: 146092 - DNA, 24 bp, Artificial Sequence
  Description of Artificial Sequence: Synthetic oligonucleotide
gaagcaggcccgggacatggctga

SEQ ID NO: 146093 - DNA, 24 bp, Artificial Sequence
  Description of Artificial Sequence: Synthetic oligonucleotide
aagcaggcccgggacatggctgag

SEQ ID NO: 146094 - DNA, 23 bp, Artificial Sequence
  Description of Artificial Sequence: Synthetic oligonucleotide
agcaggcccgggacatggctgag

SEQ ID NO: 146095 - DNA, 22 bp, Artificial Sequence
  Description of Artificial Sequence: Synthetic oligonucleotide
gcaggcccgggacatggctgag

SEQ ID NO: 146096 - DNA, 22 bp, Artificial Sequence
  Description of Artificial Sequence: Synthetic oligonucleotide
caggcccgggacatggctgagg

SEQ ID NO: 146097 - DNA, 22 bp, Artificial Sequence
  Description of Artificial Sequence: Synthetic oligonucleotide
aggcccgggacatggctgaggc

SEQ ID NO: 146098 - DNA, 21 bp, Artificial Sequence
  Description of Artificial Sequence: Synthetic oligonucleotide
ggcccgggacatggctgaggc

SEQ ID NO: 146099 - DNA, 21 bp, Artificial Sequence
  Description of Artificial Sequence: Synthetic oligonucleotide
gcccgggacatggctgaggcc

SEQ ID NO: 146100 - DNA, 22 bp, Artificial Sequence
  Description of Artificial Sequence: Synthetic oligonucleotide
cccgggacatggctgaggccca

SEQ ID NO: 146101 - DNA, 25 bp, Artificial Sequence
  Description of Artificial Sequence: Synthetic oligonucleotide
ccgggacatggctgaggcccacaaa

SEQ ID NO: 146102 - DNA, 26 bp, Artificial Sequence
  Description of Artificial Sequence: Synthetic oligonucleotide
cgggacatggctgaggcccacaaaga

SEQ ID NO: 146103 - DNA, 26 bp, Artificial Sequence
  Description of Artificial Sequence: Synthetic oligonucleotide
gggacatggctgaggcccacaaagag

SEQ ID NO: 146104 - DNA, 26 bp, Artificial Sequence
  Description of Artificial Sequence: Synthetic oligonucleotide
ggacatggctgaggcccacaaagagg

SEQ ID NO: 146105 - DNA, 26 bp, Artificial Sequence
  Description of Artificial Sequence: Synthetic oligonucleotide
gacatggctgaggcccacaaagaggc

SEQ ID NO: 146106 - DNA, 27 bp, Artificial Sequence
  Description of Artificial Sequence: Synthetic oligonucleotide
acatggctgaggcccacaaagaggcca

SEQ ID NO: 146107 - DNA, 27 bp, Artificial Sequence
  Description of Artificial Sequence: Synthetic oligonucleotide
catggctgaggcccacaaagaggccat

SEQ ID NO: 146108 - DNA, 27 bp, Artificial Sequence
  Description of Artificial Sequence: Synthetic oligonucleotide
atggctgaggcccacaaagaggccatg

SEQ ID NO: 146109 - DNA, 27 bp, Artificial Sequence
  Description of Artificial Sequence: Synthetic oligonucleotide
tggctgaggcccacaaagaggccatga

SEQ ID NO: 146110 - DNA, 26 bp, Artificial Sequence
  Description of Artificial Sequence: Synthetic oligonucleotide
ggctgaggcccacaaagaggccatga

SEQ ID NO: 146111 - DNA, 26 bp, Artificial Sequence
  Description of Artificial Sequence: Synthetic oligonucleotide
gctgaggcccacaaagaggccatgag

SEQ ID NO: 146112 - DNA, 26 bp, Artificial Sequence
  Description of Artificial Sequence: Synthetic oligonucleotide
ctgaggcccacaaagaggccatgagc

SEQ ID NO: 146113 - DNA, 26 bp, Artificial Sequence
  Description of Artificial Sequence: Synthetic oligonucleotide
tgaggcccacaaagaggccatgagcc

SEQ ID NO: 146114 - DNA, 25 bp, Artificial Sequence
  Description of Artificial Sequence: Synthetic oligonucleotide
gaggcccacaaagaggccatgagcc

SEQ ID NO: 146115 - DNA, 25 bp, Artificial Sequence
  Description of Artificial Sequence: Synthetic oligonucleotide
aggcccacaaagaggccatgagccg

SEQ ID NO: 146116 - DNA, 24 bp, Artificial Sequence
  Description of Artificial Sequence: Synthetic oligonucleotide
ggcccacaaagaggccatgagccg

SEQ ID NO: 146117 - DNA, 27 bp, Artificial Sequence
  Description of Artificial Sequence: Synthetic oligonucleotide
gcccacaaagaggccatgagccgcaaa

SEQ ID NO: 146118 - DNA, 27 bp, Artificial Sequence
  Description of Artificial Sequence: Synthetic oligonucleotide
cccacaaagaggccatgagccgcaaac

SEQ ID NO: 146119 - DNA, 28 bp, Artificial Sequence
  Description of Artificial Sequence: Synthetic oligonucleotide
ccacaaagaggccatgagccgcaaactg

SEQ ID NO: 146120 - DNA, 28 bp, Artificial Sequence
  Description of Artificial Sequence: Synthetic oligonucleotide
cacaaagaggccatgagccgcaaactgg

SEQ ID NO: 146121 - DNA, 28 bp, Artificial Sequence
  Description of Artificial Sequence: Synthetic oligonucleotide
acaaagaggccatgagccgcaaactggg

SEQ ID NO: 146122 - DNA, 27 bp, Artificial Sequence
  Description of Artificial Sequence: Synthetic oligonucleotide
caaagaggccatgagccgcaaactggg

SEQ ID NO: 146123 - DNA, 28 bp, Artificial Sequence
  Description of Artificial Sequence: Synthetic oligonucleotide
aaagaggccatgagccgcaaactgggtc

SEQ ID NO: 146124 - DNA, 27 bp, Artificial Sequence
  Description of Artificial Sequence: Synthetic oligonucleotide
aagaggccatgagccgcaaactgggtc

SEQ ID NO: 146125 - DNA, 27 bp, Artificial Sequence
  Description of Artificial Sequence: Synthetic oligonucleotide
agaggccatgagccgcaaactgggtca

SEQ ID NO: 146126 - DNA, 26 bp, Artificial Sequence
  Description of Artificial Sequence: Synthetic oligonucleotide
gaggccatgagccgcaaactgggtca

SEQ ID NO: 146127 - DNA, 27 bp, Artificial Sequence
  Description of Artificial Sequence: Synthetic oligonucleotide
aggccatgagccgcaaactgggtcaga

SEQ ID NO: 146128 - DNA, 26 bp, Artificial Sequence
  Description of Artificial Sequence: Synthetic oligonucleotide
ggccatgagccgcaaactgggtcaga

SEQ ID NO: 146129 - DNA, 27 bp, Artificial Sequence
  Description of Artificial Sequence: Synthetic oligonucleotide
gccatgagccgcaaactgggtcagagt

SEQ ID NO: 146130 - DNA, 27 bp, Artificial Sequence
  Description of Artificial Sequence: Synthetic oligonucleotide
ccatgagccgcaaactgggtcagagtg

SEQ ID NO: 146131 - DNA, 28 bp, Artificial Sequence
  Description of Artificial Sequence: Synthetic oligonucleotide
catgagccgcaaactgggtcagagtgag

SEQ ID NO: 146132 - DNA, 29 bp, Artificial Sequence
  Description of Artificial Sequence: Synthetic oligonucleotide
atgagccgcaaactgggtcagagtgagag

SEQ ID NO: 146133 - DNA, 28 bp, Artificial Sequence
  Description of Artificial Sequence: Synthetic oligonucleotide
tgagccgcaaactgggtcagagtgagag

SEQ ID NO: 146134 - DNA, 27 bp, Artificial Sequence
  Description of Artificial Sequence: Synthetic oligonucleotide
gagccgcaaactgggtcagagtgagag

SEQ ID NO: 146135 - DNA, 27 bp, Artificial Sequence
  Description of Artificial Sequence: Synthetic oligonucleotide
agccgcaaactgggtcagagtgagagc

SEQ ID NO: 146136 - DNA, 26 bp, Artificial Sequence
  Description of Artificial Sequence: Synthetic oligonucleotide
gccgcaaactgggtcagagtgagagc

SEQ ID NO: 146137 - DNA, 27 bp, Artificial Sequence
  Description of Artificial Sequence: Synthetic oligonucleotide
ccgcaaactgggtcagagtgagagcca

SEQ ID NO: 146138 - DNA, 27 bp, Artificial Sequence
  Description of Artificial Sequence: Synthetic oligonucleotide
cgcaaactgggtcagagtgagagccag

SEQ ID NO: 146139 - DNA, 27 bp, Artificial Sequence
  Description of Artificial Sequence: Synthetic oligonucleotide
gcaaactgggtcagagtgagagccagg

SEQ ID NO: 146140 - DNA, 27 bp, Artificial Sequence
  Description of Artificial Sequence: Synthetic oligonucleotide
caaactgggtcagagtgagagccaggg

SEQ ID NO: 146141 - DNA, 27 bp, Artificial Sequence
  Description of Artificial Sequence: Synthetic oligonucleotide
aaactgggtcagagtgagagccagggc

SEQ ID NO: 146142 - DNA, 26 bp, Artificial Sequence
  Description of Artificial Sequence: Synthetic oligonucleotide
aactgggtcagagtgagagccagggc

SEQ ID NO: 146143 - DNA, 25 bp, Artificial Sequence
  Description of Artificial Sequence: Synthetic oligonucleotide
actgggtcagagtgagagccagggc

SEQ ID NO: 146144 - DNA, 24 bp, Artificial Sequence
  Description of Artificial Sequence: Synthetic oligonucleotide
ctgggtcagagtgagagccagggc

SEQ ID NO: 146145 - DNA, 24 bp, Artificial Sequence
  Description of Artificial Sequence: Synthetic oligonucleotide
tgggtcagagtgagagccagggcc

SEQ ID NO: 146146 - DNA, 23 bp, Artificial Sequence
  Description of Artificial Sequence: Synthetic oligonucleotide
gggtcagagtgagagccagggcc

SEQ ID NO: 146147 - DNA, 24 bp, Artificial Sequence
  Description of Artificial Sequence: Synthetic oligonucleotide
ggtcagagtgagagccagggccct

SEQ ID NO: 146148 - DNA, 24 bp, Artificial Sequence
  Description of Artificial Sequence: Synthetic oligonucleotide
gtcagagtgagagccagggccctc

SEQ ID NO: 146149 - DNA, 25 bp, Artificial Sequence
  Description of Artificial Sequence: Synthetic oligonucleotide
tcagagtgagagccagggccctcca

SEQ ID NO: 146150 - DNA, 24 bp, Artificial Sequence
  Description of Artificial Sequence: Synthetic oligonucleotide
cagagtgagagccagggccctcca

SEQ ID NO: 146151 - DNA, 24 bp, Artificial Sequence
  Description of Artificial Sequence: Synthetic oligonucleotide
agagtgagagccagggccctccac

SEQ ID NO: 146152 - DNA, 23 bp, Artificial Sequence
  Description of Artificial Sequence: Synthetic oligonucleotide
gagtgagagccagggccctccac

SEQ ID NO: 146153 - DNA, 23 bp, Artificial Sequence
  Description of Artificial Sequence: Synthetic oligonucleotide
agtgagagccagggccctccacg

SEQ ID NO: 146154 - DNA, 22 bp, Artificial Sequence
  Description of Artificial Sequence: Synthetic oligonucleotide
gtgagagccagggccctccacg

SEQ ID NO: 146155 - DNA, 22 bp, Artificial Sequence
  Description of Artificial Sequence: Synthetic oligonucleotide
tgagagccagggccctccacgg

SEQ ID NO: 146156 - DNA, 21 bp, Artificial Sequence
  Description of Artificial Sequence: Synthetic oligonucleotide
gagagccagggccctccacgg

SEQ ID NO: 146157 - DNA, 21 bp, Artificial Sequence
  Description of Artificial Sequence: Synthetic oligonucleotide
agagccagggccctccacggg

SEQ ID NO: 146158 - DNA, 20 bp, Artificial Sequence
  Description of Artificial Sequence: Synthetic oligonucleotide
gagccagggccctccacggg

SEQ ID NO: 146159 - DNA, 20 bp, Artificial Sequence
  Description of Artificial Sequence: Synthetic oligonucleotide
agccagggccctccacgggc

SEQ ID NO: 146160 - DNA, 20 bp, Artificial Sequence
  Description of Artificial Sequence: Synthetic oligonucleotide
gccagggccctccacgggct

SEQ ID NO: 146161 - DNA, 21 bp, Artificial Sequence
  Description of Artificial Sequence: Synthetic oligonucleotide
ccagggccctccacgggcctt

SEQ ID NO: 146162 - DNA, 21 bp, Artificial Sequence
  Description of Artificial Sequence: Synthetic oligonucleotide
cagggccctccacgggccttc

SEQ ID NO: 146163 - DNA, 21 bp, Artificial Sequence
  Description of Artificial Sequence: Synthetic oligonucleotide
agggccctccacgggccttcg

SEQ ID NO: 146164 - DNA, 20 bp, Artificial Sequence
  Description of Artificial Sequence: Synthetic oligonucleotide
gggccctccacgggccttcg

SEQ ID NO: 146165 - DNA, 20 bp, Artificial Sequence
  Description of Artificial Sequence: Synthetic oligonucleotide
ggccctccacgggccttcgc

SEQ ID NO: 146166 - DNA, 23 bp, Artificial Sequence
  Description of Artificial Sequence: Synthetic oligonucleotide
gccctccacgggccttcgccaaa

SEQ ID NO: 146167 - DNA, 24 bp, Artificial Sequence
  Description of Artificial Sequence: Synthetic oligonucleotide
ccctccacgggccttcgccaaagt

SEQ ID NO: 146168 - DNA, 26 bp, Artificial Sequence
  Description of Artificial Sequence: Synthetic oligonucleotide
cctccacgggccttcgccaaagtgaa

SEQ ID NO: 146169 - DNA, 27 bp, Artificial Sequence
  Description of Artificial Sequence: Synthetic oligonucleotide
ctccacgggccttcgccaaagtgaaca

SEQ ID NO: 146170 - DNA, 27 bp, Artificial Sequence
  Description of Artificial Sequence: Synthetic oligonucleotide
tccacgggccttcgccaaagtgaacag

SEQ ID NO: 146171 - DNA, 26 bp, Artificial Sequence
  Description of Artificial Sequence: Synthetic oligonucleotide
ccacgggccttcgccaaagtgaacag

SEQ ID NO: 146172 - DNA, 27 bp, Artificial Sequence
  Description of Artificial Sequence: Synthetic oligonucleotide
cacgggccttcgccaaagtgaacagca

SEQ ID NO: 146173 - DNA, 28 bp, Artificial Sequence
  Description of Artificial Sequence: Synthetic oligonucleotide
acgggccttcgccaaagtgaacagcatc

SEQ ID NO: 146174 - DNA, 27 bp, Artificial Sequence
  Description of Artificial Sequence: Synthetic oligonucleotide
cgggccttcgccaaagtgaacagcatc

SEQ ID NO: 146175 - DNA, 28 bp, Artificial Sequence
  Description of Artificial Sequence: Synthetic oligonucleotide
gggccttcgccaaagtgaacagcatcag

SEQ ID NO: 146176 - DNA, 28 bp, Artificial Sequence
  Description of Artificial Sequence: Synthetic oligonucleotide
ggccttcgccaaagtgaacagcatcagc

SEQ ID NO: 146177 - DNA, 28 bp, Artificial Sequence
  Description of Artificial Sequence: Synthetic oligonucleotide
gccttcgccaaagtgaacagcatcagcc

SEQ ID NO: 146178 - DNA, 28 bp, Artificial Sequence
  Description of Artificial Sequence: Synthetic oligonucleotide
ccttcgccaaagtgaacagcatcagccc

SEQ ID NO: 146179 - DNA, 28 bp, Artificial Sequence
  Description of Artificial Sequence: Synthetic oligonucleotide
cttcgccaaagtgaacagcatcagcccc

SEQ ID NO: 146180 - DNA, 28 bp, Artificial Sequence
  Description of Artificial Sequence: Synthetic oligonucleotide
ttcgccaaagtgaacagcatcagccccg

SEQ ID NO: 146181 - DNA, 27 bp, Artificial Sequence
  Description of Artificial Sequence: Synthetic oligonucleotide
tcgccaaagtgaacagcatcagccccg

SEQ ID NO: 146182 - DNA, 26 bp, Artificial Sequence
  Description of Artificial Sequence: Synthetic oligonucleotide
cgccaaagtgaacagcatcagccccg

SEQ ID NO: 146183 - DNA, 26 bp, Artificial Sequence
  Description of Artificial Sequence: Synthetic oligonucleotide
gccaaagtgaacagcatcagccccgg

SEQ ID NO: 146184 - DNA, 27 bp, Artificial Sequence
  Description of Artificial Sequence: Synthetic oligonucleotide
ccaaagtgaacagcatcagccccggct

SEQ ID NO: 146185 - DNA, 27 bp, Artificial Sequence
  Description of Artificial Sequence: Synthetic oligonucleotide
caaagtgaacagcatcagccccggctc

SEQ ID NO: 146186 - DNA, 27 bp, Artificial Sequence
  Description of Artificial Sequence: Synthetic oligonucleotide
aaagtgaacagcatcagccccggctcc

SEQ ID NO: 146187 - DNA, 26 bp, Artificial Sequence
  Description of Artificial Sequence: Synthetic oligonucleotide
aagtgaacagcatcagccccggctcc

SEQ ID NO: 146188 - DNA, 25 bp, Artificial Sequence
  Description of Artificial Sequence: Synthetic oligonucleotide
agtgaacagcatcagccccggctcc

SEQ ID NO: 146189 - DNA, 24 bp, Artificial Sequence
  Description of Artificial Sequence: Synthetic oligonucleotide
gtgaacagcatcagccccggctcc

SEQ ID NO: 146190 - DNA, 24 bp, Artificial Sequence
  Description of Artificial Sequence: Synthetic oligonucleotide
tgaacagcatcagccccggctccc

SEQ ID NO: 146191 - DNA, 23 bp, Artificial Sequence
  Description of Artificial Sequence: Synthetic oligonucleotide
gaacagcatcagccccggctccc

SEQ ID NO: 146192 - DNA, 24 bp, Artificial Sequence
  Description of Artificial Sequence: Synthetic oligonucleotide
aacagcatcagccccggctcccca

SEQ ID NO: 146193 - DNA, 23 bp, Artificial Sequence
  Description of Artificial Sequence: Synthetic oligonucleotide
acagcatcagccccggctcccca

SEQ ID NO: 146194 - DNA, 22 bp, Artificial Sequence
  Description of Artificial Sequence: Synthetic oligonucleotide
cagcatcagccccggctcccca

SEQ ID NO: 146195 - DNA, 22 bp, Artificial Sequence
  Description of Artificial Sequence: Synthetic oligonucleotide
agcatcagccccggctccccag

SEQ ID NO: 146196 - DNA, 21 bp, Artificial Sequence
  Description of Artificial Sequence: Synthetic oligonucleotide
gcatcagccccggctccccag

SEQ ID NO: 146197 - DNA, 21 bp, Artificial Sequence
  Description of Artificial Sequence: Synthetic oligonucleotide
catcagccccggctccccagc

SEQ ID NO: 146198 - DNA, 22 bp, Artificial Sequence
  Description of Artificial Sequence: Synthetic oligonucleotide
atcagccccggctccccagcca

SEQ ID NO: 146199 - DNA, 21 bp, Artificial Sequence
  Description of Artificial Sequence: Synthetic oligonucleotide
tcagccccggctccccagcca

SEQ ID NO: 146200 - DNA, 20 bp, Artificial Sequence
  Description of Artificial Sequence: Synthetic oligonucleotide
cagccccggctccccagcca

SEQ ID NO: 146201 - DNA, 20 bp, Artificial Sequence
  Description of Artificial Sequence: Synthetic oligonucleotide
agccccggctccccagccag

SEQ ID NO: 146202 - DNA, 20 bp, Artificial Sequence
  Description of Artificial Sequence: Synthetic oligonucleotide
gccccggctccccagccagt

SEQ ID NO: 146203 - DNA, 21 bp, Artificial Sequence
  Description of Artificial Sequence: Synthetic oligonucleotide
ccccggctccccagccagcat

SEQ ID NO: 146204 - DNA, 21 bp, Artificial Sequence
  Description of Artificial Sequence: Synthetic oligonucleotide
cccggctccccagccagcatc

SEQ ID NO: 146205 - DNA, 21 bp, Artificial Sequence
  Description of Artificial Sequence: Synthetic oligonucleotide
ccggctccccagccagcatcg

SEQ ID NO: 146206 - DNA, 21 bp, Artificial Sequence
  Description of Artificial Sequence: Synthetic oligonucleotide
cggctccccagccagcatcgc

SEQ ID NO: 146207 - DNA, 21 bp, Artificial Sequence
  Description of Artificial Sequence: Synthetic oligonucleotide
ggctccccagccagcatcgcg

SEQ ID NO: 146208 - DNA, 21 bp, Artificial Sequence
  Description of Artificial Sequence: Synthetic oligonucleotide
gctccccagccagcatcgcgg

SEQ ID NO: 146209 - DNA, 22 bp, Artificial Sequence
  Description of Artificial Sequence: Synthetic oligonucleotide
ctccccagccagcatcgcgggt

SEQ ID NO: 146210 - DNA, 23 bp, Artificial Sequence
  Description of Artificial Sequence: Synthetic oligonucleotide
tccccagccagcatcgcgggtct

SEQ ID NO: 146211 - DNA, 22 bp, Artificial Sequence
  Description of Artificial Sequence: Synthetic oligonucleotide
ccccagccagcatcgcgggtct

SEQ ID NO: 146212 - DNA, 22 bp, Artificial Sequence
  Description of Artificial Sequence: Synthetic oligonucleotide
cccagccagcatcgcgggtctg

SEQ ID NO: 146213 - DNA, 24 bp, Artificial Sequence
  Description of Artificial Sequence: Synthetic oligonucleotide
ccagccagcatcgcgggtctgcaa

SEQ ID NO: 146214 - DNA, 25 bp, Artificial Sequence
  Description of Artificial Sequence: Synthetic oligonucleotide
cagccagcatcgcgggtctgcaagt

SEQ ID NO: 146215 - DNA, 25 bp, Artificial Sequence
  Description of Artificial Sequence: Synthetic oligonucleotide
agccagcatcgcgggtctgcaagtg

SEQ ID NO: 146216 - DNA, 24 bp, Artificial Sequence
  Description of Artificial Sequence: Synthetic oligonucleotide
gccagcatcgcgggtctgcaagtg

SEQ ID NO: 146217 - DNA, 26 bp, Artificial Sequence
  Description of Artificial Sequence: Synthetic oligonucleotide
ccagcatcgcgggtctgcaagtggat

SEQ ID NO: 146218 - DNA, 27 bp, Artificial Sequence
  Description of Artificial Sequence: Synthetic oligonucleotide
cagcatcgcgggtctgcaagtggatga

SEQ ID NO: 146219 - DNA, 28 bp, Artificial Sequence
  Description of Artificial Sequence: Synthetic oligonucleotide
agcatcgcgggtctgcaagtggatgatg

SEQ ID NO: 146220 - DNA, 27 bp, Artificial Sequence
  Description of Artificial Sequence: Synthetic oligonucleotide
gcatcgcgggtctgcaagtggatgatg

SEQ ID NO: 146221 - DNA, 28 bp, Artificial Sequence
  Description of Artificial Sequence: Synthetic oligonucleotide
catcgcgggtctgcaagtggatgatgag

SEQ ID NO: 146222 - DNA, 31 bp, Artificial Sequence
  Description of Artificial Sequence: Synthetic oligonucleotide
atcgcgggtctgcaagtggatgatgagattg

SEQ ID NO: 146223 - DNA, 30 bp, Artificial Sequence
  Description of Artificial Sequence: Synthetic oligonucleotide
tcgcgggtctgcaagtggatgatgagattg

SEQ ID NO: 146224 - DNA, 29 bp, Artificial Sequence
  Description of Artificial Sequence: Synthetic oligonucleotide
cgcgggtctgcaagtggatgatgagattg

SEQ ID NO: 146225 - DNA, 30 bp, Artificial Sequence
  Description of Artificial Sequence: Synthetic oligonucleotide
gcgggtctgcaagtggatgatgagattgtg

SEQ ID NO: 146226 - DNA, 30 bp, Artificial Sequence
  Description of Artificial Sequence: Synthetic oligonucleotide
cgggtctgcaagtggatgatgagattgtgg

SEQ ID NO: 146227 - DNA, 31 bp, Artificial Sequence
  Description of Artificial Sequence: Synthetic oligonucleotide
gggtctgcaagtggatgatgagattgtggag

SEQ ID NO: 146228 - DNA, 33 bp, Artificial Sequence
  Description of Artificial Sequence: Synthetic oligonucleotide
ggtctgcaagtggatgatgagattgtggagttc

SEQ ID NO: 146229 - DNA, 33 bp, Artificial Sequence
  Description of Artificial Sequence: Synthetic oligonucleotide
gtctgcaagtggatgatgagattgtggagttcg

SEQ ID NO: 146230 - DNA, 33 bp, Artificial Sequence
  Description of Artificial Sequence: Synthetic oligonucleotide
tctgcaagtggatgatgagattgtggagttcgg

SEQ ID NO: 146231 - DNA, 32 bp, Artificial Sequence
  Description of Artificial Sequence: Synthetic oligonucleotide
ctgcaagtggatgatgagattgtggagttcgg

SEQ ID NO: 146232 - DNA, 32 bp, Artificial Sequence
  Description of Artificial Sequence: Synthetic oligonucleotide
tgcaagtggatgatgagattgtggagttcggc

SEQ ID NO: 146233 - DNA, 31 bp, Artificial Sequence
  Description of Artificial Sequence: Synthetic oligonucleotide
gcaagtggatgatgagattgtggagttcggc

SEQ ID NO: 146234 - DNA, 32 bp, Artificial Sequence
  Description of Artificial Sequence: Synthetic oligonucleotide
caagtggatgatgagattgtggagttcggctc

SEQ ID NO: 146235 - DNA, 33 bp, Artificial Sequence
  Description of Artificial Sequence: Synthetic oligonucleotide
aagtggatgatgagattgtggagttcggctctg

SEQ ID NO: 146236 - DNA, 32 bp, Artificial Sequence
  Description of Artificial Sequence: Synthetic oligonucleotide
agtggatgatgagattgtggagttcggctctg

SEQ ID NO: 146237 - DNA, 31 bp, Artificial Sequence
  Description of Artificial Sequence: Synthetic oligonucleotide
gtggatgatgagattgtggagttcggctctg

SEQ ID NO: 146238 - DNA, 32 bp, Artificial Sequence
  Description of Artificial Sequence: Synthetic oligonucleotide
tggatgatgagattgtggagttcggctctgtg

SEQ ID NO: 146239 - DNA, 31 bp, Artificial Sequence
  Description of Artificial Sequence: Synthetic oligonucleotide
ggatgatgagattgtggagttcggctctgtg

SEQ ID NO: 146240 - DNA, 33 bp, Artificial Sequence
  Description of Artificial Sequence: Synthetic oligonucleotide
gatgatgagattgtggagttcggctctgtgaac

SEQ ID NO: 146241 - DNA, 34 bp, Artificial Sequence
  Description of Artificial Sequence: Synthetic oligonucleotide
atgatgagattgtggagttcggctctgtgaacac

SEQ ID NO: 146242 - DNA, 33 bp, Artificial Sequence
  Description of Artificial Sequence: Synthetic oligonucleotide
tgatgagattgtggagttcggctctgtgaacac

SEQ ID NO: 146243 - DNA, 32 bp, Artificial Sequence
  Description of Artificial Sequence: Synthetic oligonucleotide
gatgagattgtggagttcggctctgtgaacac

SEQ ID NO: 146244 - DNA, 32 bp, Artificial Sequence
  Description of Artificial Sequence: Synthetic oligonucleotide
atgagattgtggagttcggctctgtgaacacc

SEQ ID NO: 146245 - DNA, 31 bp, Artificial Sequence
  Description of Artificial Sequence: Synthetic oligonucleotide
tgagattgtggagttcggctctgtgaacacc

SEQ ID NO: 146246 - DNA, 30 bp, Artificial Sequence
  Description of Artificial Sequence: Synthetic oligonucleotide
gagattgtggagttcggctctgtgaacacc

SEQ ID NO: 146247 - DNA, 30 bp, Artificial Sequence
  Description of Artificial Sequence: Synthetic oligonucleotide
agattgtggagttcggctctgtgaacaccc

SEQ ID NO: 146248 - DNA, 29 bp, Artificial Sequence
  Description of Artificial Sequence: Synthetic oligonucleotide
gattgtggagttcggctctgtgaacaccc

SEQ ID NO: 146249 - DNA, 30 bp, Artificial Sequence
  Description of Artificial Sequence: Synthetic oligonucleotide
attgtggagttcggctctgtgaacacccag

SEQ ID NO: 146250 - DNA, 29 bp, Artificial Sequence
  Description of Artificial Sequence: Synthetic oligonucleotide
ttgtggagttcggctctgtgaacacccag

SEQ ID NO: 146251 - DNA, 28 bp, Artificial Sequence
  Description of Artificial Sequence: Synthetic oligonucleotide
tgtggagttcggctctgtgaacacccag

SEQ ID NO: 146252 - DNA, 27 bp, Artificial Sequence
  Description of Artificial Sequence: Synthetic oligonucleotide
gtggagttcggctctgtgaacacccag

SEQ ID NO: 146253 - DNA, 29 bp, Artificial Sequence
  Description of Artificial Sequence: Synthetic oligonucleotide
tggagttcggctctgtgaacacccagaac

SEQ ID NO: 146254 - DNA, 28 bp, Artificial Sequence
  Description of Artificial Sequence: Synthetic oligonucleotide
ggagttcggctctgtgaacacccagaac

SEQ ID NO: 146255 - DNA, 30 bp, Artificial Sequence
  Description of Artificial Sequence: Synthetic oligonucleotide
gagttcggctctgtgaacacccagaacttc

SEQ ID NO: 146256 - DNA, 30 bp, Artificial Sequence
  Description of Artificial Sequence: Synthetic oligonucleotide
agttcggctctgtgaacacccagaacttcc

SEQ ID NO: 146257 - DNA, 29 bp, Artificial Sequence
  Description of Artificial Sequence: Synthetic oligonucleotide
gttcggctctgtgaacacccagaacttcc

SEQ ID NO: 146258 - DNA, 30 bp, Artificial Sequence
  Description of Artificial Sequence: Synthetic oligonucleotide
ttcggctctgtgaacacccagaacttccag

SEQ ID NO: 146259 - DNA, 29 bp, Artificial Sequence
  Description of Artificial Sequence: Synthetic oligonucleotide
tcggctctgtgaacacccagaacttccag

SEQ ID NO: 146260 - DNA, 28 bp, Artificial Sequence
  Description of Artificial Sequence: Synthetic oligonucleotide
cggctctgtgaacacccagaacttccag

SEQ ID NO: 146261 - DNA, 29 bp, Artificial Sequence
  Description of Artificial Sequence: Synthetic oligonucleotide
ggctctgtgaacacccagaacttccagtc

SEQ ID NO: 146262 - DNA, 30 bp, Artificial Sequence
  Description of Artificial Sequence: Synthetic oligonucleotide
gctctgtgaacacccagaacttccagtcac

SEQ ID NO: 146263 - DNA, 31 bp, Artificial Sequence
  Description of Artificial Sequence: Synthetic oligonucleotide
ctctgtgaacacccagaacttccagtcactg

SEQ ID NO: 146264 - DNA, 31 bp, Artificial Sequence
  Description of Artificial Sequence: Synthetic oligonucleotide
tctgtgaacacccagaacttccagtcactgc

SEQ ID NO: 146265 - DNA, 30 bp, Artificial Sequence
  Description of Artificial Sequence: Synthetic oligonucleotide
ctgtgaacacccagaacttccagtcactgc

SEQ ID NO: 146266 - DNA, 34 bp, Artificial Sequence
  Description of Artificial Sequence: Synthetic oligonucleotide
tgtgaacacccagaacttccagtcactgcataac

SEQ ID NO: 146267 - DNA, 33 bp, Artificial Sequence
  Description of Artificial Sequence: Synthetic oligonucleotide
gtgaacacccagaacttccagtcactgcataac

SEQ ID NO: 146268 - DNA, 36 bp, Artificial Sequence
  Description of Artificial Sequence: Synthetic oligonucleotide
tgaacacccagaacttccagtcactgcataacattg

SEQ ID NO: 146269 - DNA, 35 bp, Artificial Sequence
  Description of Artificial Sequence: Synthetic oligonucleotide
gaacacccagaacttccagtcactgcataacattg

SEQ ID NO: 146270 - DNA, 35 bp, Artificial Sequence
  Description of Artificial Sequence: Synthetic oligonucleotide
aacacccagaacttccagtcactgcataacattgg

SEQ ID NO: 146271 - DNA, 34 bp, Artificial Sequence
  Description of Artificial Sequence: Synthetic oligonucleotide
acacccagaacttccagtcactgcataacattgg

SEQ ID NO: 146272 - DNA, 33 bp, Artificial Sequence
  Description of Artificial Sequence: Synthetic oligonucleotide
cacccagaacttccagtcactgcataacattgg

SEQ ID NO: 146273 - DNA, 33 bp, Artificial Sequence
  Description of Artificial Sequence: Synthetic oligonucleotide
acccagaacttccagtcactgcataacattggc

SEQ ID NO: 146274 - DNA, 32 bp, Artificial Sequence
  Description of Artificial Sequence: Synthetic oligonucleotide
cccagaacttccagtcactgcataacattggc

SEQ ID NO: 146275 - DNA, 33 bp, Artificial Sequence
  Description of Artificial Sequence: Synthetic oligonucleotide
ccagaacttccagtcactgcataacattggcag

SEQ ID NO: 146276 - DNA, 34 bp, Artificial Sequence
  Description of Artificial Sequence: Synthetic oligonucleotide
cagaacttccagtcactgcataacattggcagtg

SEQ ID NO: 146277 - DNA, 35 bp, Artificial Sequence
  Description of Artificial Sequence: Synthetic oligonucleotide
agaacttccagtcactgcataacattggcagtgtg

SEQ ID NO: 146278 - DNA, 34 bp, Artificial Sequence
  Description of Artificial Sequence: Synthetic oligonucleotide
gaacttccagtcactgcataacattggcagtgtg

SEQ ID NO: 146279 - DNA, 34 bp, Artificial Sequence
  Description of Artificial Sequence: Synthetic oligonucleotide
aacttccagtcactgcataacattggcagtgtgg

SEQ ID NO: 146280 - DNA, 33 bp, Artificial Sequence
  Description of Artificial Sequence: Synthetic oligonucleotide
acttccagtcactgcataacattggcagtgtgg

SEQ ID NO: 146281 - DNA, 32 bp, Artificial Sequence
  Description of Artificial Sequence: Synthetic oligonucleotide
cttccagtcactgcataacattggcagtgtgg

SEQ ID NO: 146282 - DNA, 33 bp, Artificial Sequence
  Description of Artificial Sequence: Synthetic oligonucleotide
ttccagtcactgcataacattggcagtgtggtg

SEQ ID NO: 146283 - DNA, 32 bp, Artificial Sequence
  Description of Artificial Sequence: Synthetic oligonucleotide
tccagtcactgcataacattggcagtgtggtg

SEQ ID NO: 146284 - DNA, 31 bp, Artificial Sequence
  Description of Artificial Sequence: Synthetic oligonucleotide
ccagtcactgcataacattggcagtgtggtg

SEQ ID NO: 146285 - DNA, 31 bp, Artificial Sequence
  Description of Artificial Sequence: Synthetic oligonucleotide
cagtcactgcataacattggcagtgtggtgc

SEQ ID NO: 146286 - DNA, 32 bp, Artificial Sequence
  Description of Artificial Sequence: Synthetic oligonucleotide
agtcactgcataacattggcagtgtggtgcag

SEQ ID NO: 146287 - DNA, 31 bp, Artificial Sequence
  Description of Artificial Sequence: Synthetic oligonucleotide
gtcactgcataacattggcagtgtggtgcag

SEQ ID NO: 146288 - DNA, 31 bp, Artificial Sequence
  Description of Artificial Sequence: Synthetic oligonucleotide
tcactgcataacattggcagtgtggtgcagc

SEQ ID NO: 146289 - DNA, 30 bp, Artificial Sequence
  Description of Artificial Sequence: Synthetic oligonucleotide
cactgcataacattggcagtgtggtgcagc

SEQ ID NO: 146290 - DNA, 31 bp, Artificial Sequence
  Description of Artificial Sequence: Synthetic oligonucleotide
actgcataacattggcagtgtggtgcagcac

SEQ ID NO: 146291 - DNA, 30 bp, Artificial Sequence
  Description of Artificial Sequence: Synthetic oligonucleotide
ctgcataacattggcagtgtggtgcagcac

SEQ ID NO: 146292 - DNA, 31 bp, Artificial Sequence
  Description of Artificial Sequence: Synthetic oligonucleotide
tgcataacattggcagtgtggtgcagcacag

SEQ ID NO: 146293 - DNA, 30 bp, Artificial Sequence
  Description of Artificial Sequence: Synthetic oligonucleotide
gcataacattggcagtgtggtgcagcacag

SEQ ID NO: 146294 - DNA, 31 bp, Artificial Sequence
  Description of Artificial Sequence: Synthetic oligonucleotide
cataacattggcagtgtggtgcagcacagtg

SEQ ID NO: 146295 - DNA, 32 bp, Artificial Sequence
  Description of Artificial Sequence: Synthetic oligonucleotide
ataacattggcagtgtggtgcagcacagtgag

SEQ ID NO: 146296 - DNA, 31 bp, Artificial Sequence
  Description of Artificial Sequence: Synthetic oligonucleotide
taacattggcagtgtggtgcagcacagtgag

SEQ ID NO: 146297 - DNA, 30 bp, Artificial Sequence
  Description of Artificial Sequence: Synthetic oligonucleotide
aacattggcagtgtggtgcagcacagtgag

SEQ ID NO: 146298 - DNA, 29 bp, Artificial Sequence
  Description of Artificial Sequence: Synthetic oligonucleotide
acattggcagtgtggtgcagcacagtgag

SEQ ID NO: 146299 - DNA, 28 bp, Artificial Sequence
  Description of Artificial Sequence: Synthetic oligonucleotide
cattggcagtgtggtgcagcacagtgag

SEQ ID NO: 146300 - DNA, 28 bp, Artificial Sequence
  Description of Artificial Sequence: Synthetic oligonucleotide
attggcagtgtggtgcagcacagtgagg

SEQ ID NO: 146301 - DNA, 27 bp, Artificial Sequence
  Description of Artificial Sequence: Synthetic oligonucleotide
ttggcagtgtggtgcagcacagtgagg

SEQ ID NO: 146302 - DNA, 26 bp, Artificial Sequence
  Description of Artificial Sequence: Synthetic oligonucleotide
tggcagtgtggtgcagcacagtgagg

SEQ ID NO: 146303 - DNA, 25 bp, Artificial Sequence
  Description of Artificial Sequence: Synthetic oligonucleotide
ggcagtgtggtgcagcacagtgagg

SEQ ID NO: 146304 - DNA, 25 bp, Artificial Sequence
  Description of Artificial Sequence: Synthetic oligonucleotide
gcagtgtggtgcagcacagtgaggg

SEQ ID NO: 146305 - DNA, 27 bp, Artificial Sequence
  Description of Artificial Sequence: Synthetic oligonucleotide
cagtgtggtgcagcacagtgaggggaa

SEQ ID NO: 146306 - DNA, 27 bp, Artificial Sequence
  Description of Artificial Sequence: Synthetic oligonucleotide
agtgtggtgcagcacagtgaggggaag

SEQ ID NO: 146307 - DNA, 26 bp, Artificial Sequence
  Description of Artificial Sequence: Synthetic oligonucleotide
gtgtggtgcagcacagtgaggggaag

SEQ ID NO: 146308 - DNA, 26 bp, Artificial Sequence
  Description of Artificial Sequence: Synthetic oligonucleotide
tgtggtgcagcacagtgaggggaagc

SEQ ID NO: 146309 - DNA, 25 bp, Artificial Sequence
  Description of Artificial Sequence: Synthetic oligonucleotide
gtggtgcagcacagtgaggggaagc

SEQ ID NO: 146310 - DNA, 25 bp, Artificial Sequence
  Description of Artificial Sequence: Synthetic oligonucleotide
tggtgcagcacagtgaggggaagcc

SEQ ID NO: 146311 - DNA, 24 bp, Artificial Sequence
  Description of Artificial Sequence: Synthetic oligonucleotide
ggtgcagcacagtgaggggaagcc

SEQ ID NO: 146312 - DNA, 24 bp, Artificial Sequence
  Description of Artificial Sequence: Synthetic oligonucleotide
gtgcagcacagtgaggggaagccc

SEQ ID NO: 146313 - DNA, 25 bp, Artificial Sequence
  Description of Artificial Sequence: Synthetic oligonucleotide
tgcagcacagtgaggggaagcccct

SEQ ID NO: 146314 - DNA, 24 bp, Artificial Sequence
  Description of Artificial Sequence: Synthetic oligonucleotide
gcagcacagtgaggggaagcccct

SEQ ID NO: 146315 - DNA, 27 bp, Artificial Sequence
  Description of Artificial Sequence: Synthetic oligonucleotide
cagcacagtgaggggaagcccctgaat

SEQ ID NO: 146316 - DNA, 27 bp, Artificial Sequence
  Description of Artificial Sequence: Synthetic oligonucleotide
agcacagtgaggggaagcccctgaatg

SEQ ID NO: 146317 - DNA, 27 bp, Artificial Sequence
  Description of Artificial Sequence: Synthetic oligonucleotide
gcacagtgaggggaagcccctgaatgt

SEQ ID NO: 146318 - DNA, 27 bp, Artificial Sequence
  Description of Artificial Sequence: Synthetic oligonucleotide
cacagtgaggggaagcccctgaatgtg

SEQ ID NO: 146319 - DNA, 28 bp, Artificial Sequence
  Description of Artificial Sequence: Synthetic oligonucleotide
acagtgaggggaagcccctgaatgtgac

SEQ ID NO: 146320 - DNA, 27 bp, Artificial Sequence
  Description of Artificial Sequence: Synthetic oligonucleotide
cagtgaggggaagcccctgaatgtgac

SEQ ID NO: 146321 - DNA, 28 bp, Artificial Sequence
  Description of Artificial Sequence: Synthetic oligonucleotide
agtgaggggaagcccctgaatgtgacag

SEQ ID NO: 146322 - DNA, 27 bp, Artificial Sequence
  Description of Artificial Sequence: Synthetic oligonucleotide
gtgaggggaagcccctgaatgtgacag

SEQ ID NO: 146323 - DNA, 28 bp, Artificial Sequence
  Description of Artificial Sequence: Synthetic oligonucleotide
tgaggggaagcccctgaatgtgacagtg

SEQ ID NO: 146324 - DNA, 27 bp, Artificial Sequence
  Description of Artificial Sequence: Synthetic oligonucleotide
gaggggaagcccctgaatgtgacagtg

SEQ ID NO: 146325 - DNA, 29 bp, Artificial Sequence
  Description of Artificial Sequence: Synthetic oligonucleotide
aggggaagcccctgaatgtgacagtgatc

SEQ ID NO: 146326 - DNA, 28 bp, Artificial Sequence
  Description of Artificial Sequence: Synthetic oligonucleotide
ggggaagcccctgaatgtgacagtgatc

SEQ ID NO: 146327 - DNA, 28 bp, Artificial Sequence
  Description of Artificial Sequence: Synthetic oligonucleotide
gggaagcccctgaatgtgacagtgatcc

SEQ ID NO: 146328 - DNA, 28 bp, Artificial Sequence
  Description of Artificial Sequence: Synthetic oligonucleotide
ggaagcccctgaatgtgacagtgatccg

SEQ ID NO: 146329 - DNA, 28 bp, Artificial Sequence
  Description of Artificial Sequence: Synthetic oligonucleotide
gaagcccctgaatgtgacagtgatccgc

SEQ ID NO: 146330 - DNA, 29 bp, Artificial Sequence
  Description of Artificial Sequence: Synthetic oligonucleotide
aagcccctgaatgtgacagtgatccgcag

SEQ ID NO: 146331 - DNA, 28 bp, Artificial Sequence
  Description of Artificial Sequence: Synthetic oligonucleotide
agcccctgaatgtgacagtgatccgcag

SEQ ID NO: 146332 - DNA, 27 bp, Artificial Sequence
  Description of Artificial Sequence: Synthetic oligonucleotide
gcccctgaatgtgacagtgatccgcag

SEQ ID NO: 146333 - DNA, 27 bp, Artificial Sequence
  Description of Artificial Sequence: Synthetic oligonucleotide
cccctgaatgtgacagtgatccgcagg

SEQ ID NO: 146334 - DNA, 27 bp, Artificial Sequence
  Description of Artificial Sequence: Synthetic oligonucleotide
ccctgaatgtgacagtgatccgcaggg

SEQ ID NO: 146335 - DNA, 27 bp, Artificial Sequence
  Description of Artificial Sequence: Synthetic oligonucleotide
cctgaatgtgacagtgatccgcagggg

SEQ ID NO: 146336 - DNA, 27 bp, Artificial Sequence
  Description of Artificial Sequence: Synthetic oligonucleotide
ctgaatgtgacagtgatccgcaggggg

SEQ ID NO: 146337 - DNA, 27 bp, Artificial Sequence
  Description of Artificial Sequence: Synthetic oligonucleotide
tgaatgtgacagtgatccgcagggggg

SEQ ID NO: 146338 - DNA, 27 bp, Artificial Sequence
  Description of Artificial Sequence: Synthetic oligonucleotide
gaatgtgacagtgatccgcagggggga

SEQ ID NO: 146339 - DNA, 31 bp, Artificial Sequence
  Description of Artificial Sequence: Synthetic oligonucleotide
aatgtgacagtgatccgcaggggggaaaaac

SEQ ID NO: 146340 - DNA, 30 bp, Artificial Sequence
  Description of Artificial Sequence: Synthetic oligonucleotide
atgtgacagtgatccgcaggggggaaaaac

SEQ ID NO: 146341 - DNA, 29 bp, Artificial Sequence
  Description of Artificial Sequence: Synthetic oligonucleotide
tgtgacagtgatccgcaggggggaaaaac

SEQ ID NO: 146342 - DNA, 28 bp, Artificial Sequence
  Description of Artificial Sequence: Synthetic oligonucleotide
gtgacagtgatccgcaggggggaaaaac

SEQ ID NO: 146343 - DNA, 29 bp, Artificial Sequence
  Description of Artificial Sequence: Synthetic oligonucleotide
tgacagtgatccgcaggggggaaaaacac

SEQ ID NO: 146344 - DNA, 28 bp, Artificial Sequence
  Description of Artificial Sequence: Synthetic oligonucleotide
gacagtgatccgcaggggggaaaaacac

SEQ ID NO: 146345 - DNA, 28 bp, Artificial Sequence
  Description of Artificial Sequence: Synthetic oligonucleotide
acagtgatccgcaggggggaaaaacacc

SEQ ID NO: 146346 - DNA, 27 bp, Artificial Sequence
  Description of Artificial Sequence: Synthetic oligonucleotide
cagtgatccgcaggggggaaaaacacc

SEQ ID NO: 146347 - DNA, 28 bp, Artificial Sequence
  Description of Artificial Sequence: Synthetic oligonucleotide
agtgatccgcaggggggaaaaacaccag

SEQ ID NO: 146348 - DNA, 27 bp, Artificial Sequence
  Description of Artificial Sequence: Synthetic oligonucleotide
gtgatccgcaggggggaaaaacaccag

SEQ ID NO: 146349 - DNA, 27 bp, Artificial Sequence
  Description of Artificial Sequence: Synthetic oligonucleotide
tgatccgcaggggggaaaaacaccagc

SEQ ID NO: 146350 - DNA, 27 bp, Artificial Sequence
  Description of Artificial Sequence: Synthetic oligonucleotide
gatccgcaggggggaaaaacaccagct

SEQ ID NO: 146351 - DNA, 29 bp, Artificial Sequence
  Description of Artificial Sequence: Synthetic oligonucleotide
atccgcaggggggaaaaacaccagcttag

SEQ ID NO: 146352 - DNA, 28 bp, Artificial Sequence
  Description of Artificial Sequence: Synthetic oligonucleotide
tccgcaggggggaaaaacaccagcttag

SEQ ID NO: 146353 - DNA, 27 bp, Artificial Sequence
  Description of Artificial Sequence: Synthetic oligonucleotide
ccgcaggggggaaaaacaccagcttag

SEQ ID NO: 146354 - DNA, 28 bp, Artificial Sequence
  Description of Artificial Sequence: Synthetic oligonucleotide
cgcaggggggaaaaacaccagcttagac

SEQ ID NO: 146355 - DNA, 30 bp, Artificial Sequence
  Description of Artificial Sequence: Synthetic oligonucleotide
gcaggggggaaaaacaccagcttagacttg

SEQ ID NO: 146356 - DNA, 32 bp, Artificial Sequence
  Description of Artificial Sequence: Synthetic oligonucleotide
caggggggaaaaacaccagcttagacttgttc

SEQ ID NO: 146357 - DNA, 32 bp, Artificial Sequence
  Description of Artificial Sequence: Synthetic oligonucleotide
aggggggaaaaacaccagcttagacttgttcc

SEQ ID NO: 146358 - DNA, 31 bp, Artificial Sequence
  Description of Artificial Sequence: Synthetic oligonucleotide
ggggggaaaaacaccagcttagacttgttcc

SEQ ID NO: 146359 - DNA, 33 bp, Artificial Sequence
  Description of Artificial Sequence: Synthetic oligonucleotide
gggggaaaaacaccagcttagacttgttccaac

SEQ ID NO: 146360 - DNA, 34 bp, Artificial Sequence
  Description of Artificial Sequence: Synthetic oligonucleotide
ggggaaaaacaccagcttagacttgttccaacac

SEQ ID NO: 146361 - DNA, 34 bp, Artificial Sequence
  Description of Artificial Sequence: Synthetic oligonucleotide
gggaaaaacaccagcttagacttgttccaacacg

SEQ ID NO: 146362 - DNA, 34 bp, Artificial Sequence
  Description of Artificial Sequence: Synthetic oligonucleotide
ggaaaaacaccagcttagacttgttccaacacgc

SEQ ID NO: 146363 - DNA, 35 bp, Artificial Sequence
  Description of Artificial Sequence: Synthetic oligonucleotide
gaaaaacaccagcttagacttgttccaacacgctg

SEQ ID NO: 146364 - DNA, 35 bp, Artificial Sequence
  Description of Artificial Sequence: Synthetic oligonucleotide
aaaaacaccagcttagacttgttccaacacgctgg

SEQ ID NO: 146365 - DNA, 34 bp, Artificial Sequence
  Description of Artificial Sequence: Synthetic oligonucleotide
aaaacaccagcttagacttgttccaacacgctgg

SEQ ID NO: 146366 - DNA, 33 bp, Artificial Sequence
  Description of Artificial Sequence: Synthetic oligonucleotide
aaacaccagcttagacttgttccaacacgctgg

SEQ ID NO: 146367 - DNA, 32 bp, Artificial Sequence
  Description of Artificial Sequence: Synthetic oligonucleotide
aacaccagcttagacttgttccaacacgctgg

SEQ ID NO: 146368 - DNA, 31 bp, Artificial Sequence
  Description of Artificial Sequence: Synthetic oligonucleotide
acaccagcttagacttgttccaacacgctgg

SEQ ID NO: 146369 - DNA, 30 bp, Artificial Sequence
  Description of Artificial Sequence: Synthetic oligonucleotide
caccagcttagacttgttccaacacgctgg

SEQ ID NO: 146370 - DNA, 30 bp, Artificial Sequence
  Description of Artificial Sequence: Synthetic oligonucleotide
accagcttagacttgttccaacacgctggg

SEQ ID NO: 146371 - DNA, 29 bp, Artificial Sequence
  Description of Artificial Sequence: Synthetic oligonucleotide
ccagcttagacttgttccaacacgctggg

SEQ ID NO: 146372 - DNA, 29 bp, Artificial Sequence
  Description of Artificial Sequence: Synthetic oligonucleotide
cagcttagacttgttccaacacgctgggc

SEQ ID NO: 146373 - DNA, 30 bp, Artificial Sequence
  Description of Artificial Sequence: Synthetic oligonucleotide
agcttagacttgttccaacacgctgggcag

SEQ ID NO: 146374 - DNA, 29 bp, Artificial Sequence
  Description of Artificial Sequence: Synthetic oligonucleotide
gcttagacttgttccaacacgctgggcag

SEQ ID NO: 146375 - DNA, 29 bp, Artificial Sequence
  Description of Artificial Sequence: Synthetic oligonucleotide
cttagacttgttccaacacgctgggcagg

SEQ ID NO: 146376 - DNA, 33 bp, Artificial Sequence
  Description of Artificial Sequence: Synthetic oligonucleotide
ttagacttgttccaacacgctgggcaggaaaag

SEQ ID NO: 146377 - DNA, 32 bp, Artificial Sequence
  Description of Artificial Sequence: Synthetic oligonucleotide
tagacttgttccaacacgctgggcaggaaaag

SEQ ID NO: 146378 - DNA, 31 bp, Artificial Sequence
  Description of Artificial Sequence: Synthetic oligonucleotide
agacttgttccaacacgctgggcaggaaaag

SEQ ID NO: 146379 - DNA, 30 bp, Artificial Sequence
  Description of Artificial Sequence: Synthetic oligonucleotide
gacttgttccaacacgctgggcaggaaaag

SEQ ID NO: 146380 - DNA, 30 bp, Artificial Sequence
  Description of Artificial Sequence: Synthetic oligonucleotide
acttgttccaacacgctgggcaggaaaagg

SEQ ID NO: 146381 - DNA, 29 bp, Artificial Sequence
  Description of Artificial Sequence: Synthetic oligonucleotide
cttgttccaacacgctgggcaggaaaagg

SEQ ID NO: 146382 - DNA, 30 bp, Artificial Sequence
  Description of Artificial Sequence: Synthetic oligonucleotide
ttgttccaacacgctgggcaggaaaaggac

SEQ ID NO: 146383 - DNA, 29 bp, Artificial Sequence
  Description of Artificial Sequence: Synthetic oligonucleotide
tgttccaacacgctgggcaggaaaaggac

SEQ ID NO: 146384 - DNA, 28 bp, Artificial Sequence
  Description of Artificial Sequence: Synthetic oligonucleotide
gttccaacacgctgggcaggaaaaggac

SEQ ID NO: 146385 - DNA, 29 bp, Artificial Sequence
  Description of Artificial Sequence: Synthetic oligonucleotide
ttccaacacgctgggcaggaaaaggactg

SEQ ID NO: 146386 - DNA, 28 bp, Artificial Sequence
  Description of Artificial Sequence: Synthetic oligonucleotide
tccaacacgctgggcaggaaaaggactg

SEQ ID NO: 146387 - DNA, 27 bp, Artificial Sequence
  Description of Artificial Sequence: Synthetic oligonucleotide
ccaacacgctgggcaggaaaaggactg

SEQ ID NO: 146388 - DNA, 27 bp, Artificial Sequence
  Description of Artificial Sequence: Synthetic oligonucleotide
caacacgctgggcaggaaaaggactgc

SEQ ID NO: 146389 - DNA, 28 bp, Artificial Sequence
  Description of Artificial Sequence: Synthetic oligonucleotide
aacacgctgggcaggaaaaggactgctg

SEQ ID NO: 146390 - DNA, 27 bp, Artificial Sequence
  Description of Artificial Sequence: Synthetic oligonucleotide
acacgctgggcaggaaaaggactgctg

SEQ ID NO: 146391 - DNA, 26 bp, Artificial Sequence
  Description of Artificial Sequence: Synthetic oligonucleotide
cacgctgggcaggaaaaggactgctg

SEQ ID NO: 146392 - DNA, 26 bp, Artificial Sequence
  Description of Artificial Sequence: Synthetic oligonucleotide
acgctgggcaggaaaaggactgctgg

SEQ ID NO: 146393 - DNA, 25 bp, Artificial Sequence
  Description of Artificial Sequence: Synthetic oligonucleotide
cgctgggcaggaaaaggactgctgg

SEQ ID NO: 146394 - DNA, 25 bp, Artificial Sequence
  Description of Artificial Sequence: Synthetic oligonucleotide
gctgggcaggaaaaggactgctggg

SEQ ID NO: 146395 - DNA, 26 bp, Artificial Sequence
  Description of Artificial Sequence: Synthetic oligonucleotide
ctgggcaggaaaaggactgctgggct

SEQ ID NO: 146396 - DNA, 26 bp, Artificial Sequence
  Description of Artificial Sequence: Synthetic oligonucleotide
tgggcaggaaaaggactgctgggctg

SEQ ID NO: 146397 - DNA, 25 bp, Artificial Sequence
  Description of Artificial Sequence: Synthetic oligonucleotide
gggcaggaaaaggactgctgggctg

SEQ ID NO: 146398 - DNA, 27 bp, Artificial Sequence
  Description of Artificial Sequence: Synthetic oligonucleotide
ggcaggaaaaggactgctgggctgcaa

SEQ ID NO: 146399 - DNA, 27 bp, Artificial Sequence
  Description of Artificial Sequence: Synthetic oligonucleotide
gcaggaaaaggactgctgggctgcaac

SEQ ID NO: 146400 - DNA, 33 bp, Artificial Sequence
  Description of Artificial Sequence: Synthetic oligonucleotide
caggaaaaggactgctgggctgcaacattattc

SEQ ID NO: 146401 - DNA, 33 bp, Artificial Sequence
  Description of Artificial Sequence: Synthetic oligonucleotide
aggaaaaggactgctgggctgcaacattattcc

SEQ ID NO: 146402 - DNA, 32 bp, Artificial Sequence
  Description of Artificial Sequence: Synthetic oligonucleotide
ggaaaaggactgctgggctgcaacattattcc

SEQ ID NO: 146403 - DNA, 33 bp, Artificial Sequence
  Description of Artificial Sequence: Synthetic oligonucleotide
gaaaaggactgctgggctgcaacattattcctc

SEQ ID NO: 146404 - DNA, 34 bp, Artificial Sequence
  Description of Artificial Sequence: Synthetic oligonucleotide
aaaaggactgctgggctgcaacattattcctctg

SEQ ID NO: 146405 - DNA, 33 bp, Artificial Sequence
  Description of Artificial Sequence: Synthetic oligonucleotide
aaaggactgctgggctgcaacattattcctctg

SEQ ID NO: 146406 - DNA, 32 bp, Artificial Sequence
  Description of Artificial Sequence: Synthetic oligonucleotide
aaggactgctgggctgcaacattattcctctg

SEQ ID NO: 146407 - DNA, 31 bp, Artificial Sequence
  Description of Artificial Sequence: Synthetic oligonucleotide
aggactgctgggctgcaacattattcctctg

SEQ ID NO: 146408 - DNA, 30 bp, Artificial Sequence
  Description of Artificial Sequence: Synthetic oligonucleotide
ggactgctgggctgcaacattattcctctg

SEQ ID NO: 146409 - DNA, 30 bp, Artificial Sequence
  Description of Artificial Sequence: Synthetic oligonucleotide
gactgctgggctgcaacattattcctctgc

SEQ ID NO: 146410 - DNA, 33 bp, Artificial Sequence
  Description of Artificial Sequence: Synthetic oligonucleotide
actgctgggctgcaacattattcctctgcaaag

SEQ ID NO: 146411 - DNA, 32 bp, Artificial Sequence
  Description of Artificial Sequence: Synthetic oligonucleotide
ctgctgggctgcaacattattcctctgcaaag

SEQ ID NO: 146412 - DNA, 34 bp, Artificial Sequence
  Description of Artificial Sequence: Synthetic oligonucleotide
tgctgggctgcaacattattcctctgcaaagatg

SEQ ID NO: 146413 - DNA, 33 bp, Artificial Sequence
  Description of Artificial Sequence: Synthetic oligonucleotide
gctgggctgcaacattattcctctgcaaagatg

SEQ ID NO: 146414 - DNA, 20 bp, Artificial Sequence
  Description of Artificial Sequence: Synthetic oligonucleotide
atggcggcggcggcggtggt

SEQ ID NO: 146415 - DNA, 20 bp, Artificial Sequence
  Description of Artificial Sequence: Synthetic oligonucleotide
tggcggcggcggcggtggtt

SEQ ID NO: 146416 - DNA, 20 bp, Artificial Sequence
  Description of Artificial Sequence: Synthetic oligonucleotide
ggcggcggcggcggtggttt

SEQ ID NO: 146417 - DNA, 20 bp, Artificial Sequence
  Description of Artificial Sequence: Synthetic oligonucleotide
gcggcggcggcggtggtgtt

SEQ ID NO: 146418 - DNA, 20 bp, Artificial Sequence
  Description of Artificial Sequence: Synthetic oligonucleotide
cggcggcggcggtggtggat

SEQ ID NO: 146419 - DNA, 21 bp, Artificial Sequence
  Description of Artificial Sequence: Synthetic oligonucleotide
ggcggcggcggtggtggagtt

SEQ ID NO: 146420 - DNA, 21 bp, Artificial Sequence
  Description of Artificial Sequence: Synthetic oligonucleotide
gcggcggcggtggtggagttc

SEQ ID NO: 146421 - DNA, 22 bp, Artificial Sequence
  Description of Artificial Sequence: Synthetic oligonucleotide
cggcggcggtggtggagttcca

SEQ ID NO: 146422 - DNA, 23 bp, Artificial Sequence
  Description of Artificial Sequence: Synthetic oligonucleotide
ggcggcggtggtggagttccaga

SEQ ID NO: 146423 - DNA, 24 bp, Artificial Sequence
  Description of Artificial Sequence: Synthetic oligonucleotide
gcggcggtggtggagttccagaga

SEQ ID NO: 146424 - DNA, 24 bp, Artificial Sequence
  Description of Artificial Sequence: Synthetic oligonucleotide
cggcggtggtggagttccagagag

SEQ ID NO: 146425 - DNA, 24 bp, Artificial Sequence
  Description of Artificial Sequence: Synthetic oligonucleotide
ggcggtggtggagttccagagagc

SEQ ID NO: 146426 - DNA, 24 bp, Artificial Sequence
  Description of Artificial Sequence: Synthetic oligonucleotide
gcggtggtggagttccagagagcc

SEQ ID NO: 146427 - DNA, 25 bp, Artificial Sequence
  Description of Artificial Sequence: Synthetic oligonucleotide
cggtggtggagttccagagagccca

SEQ ID NO: 146428 - DNA, 26 bp, Artificial Sequence
  Description of Artificial Sequence: Synthetic oligonucleotide
ggtggtggagttccagagagcccagt

SEQ ID NO: 146429 - DNA, 27 bp, Artificial Sequence
  Description of Artificial Sequence: Synthetic oligonucleotide
gtggtggagttccagagagcccagtct

SEQ ID NO: 146430 - DNA, 27 bp, Artificial Sequence
  Description of Artificial Sequence: Synthetic oligonucleotide
tggtggagttccagagagcccagtctc

SEQ ID NO: 146431 - DNA, 27 bp, Artificial Sequence
  Description of Artificial Sequence: Synthetic oligonucleotide
ggtggagttccagagagcccagtctct

SEQ ID NO: 146432 - DNA, 28 bp, Artificial Sequence
  Description of Artificial Sequence: Synthetic oligonucleotide
gtggagttccagagagcccagtctctac

SEQ ID NO: 146433 - DNA, 29 bp, Artificial Sequence
  Description of Artificial Sequence: Synthetic oligonucleotide
tggagttccagagagcccagtctctactc

SEQ ID NO: 146434 - DNA, 28 bp, Artificial Sequence
  Description of Artificial Sequence: Synthetic oligonucleotide
ggagttccagagagcccagtctctactc

SEQ ID NO: 146435 - DNA, 29 bp, Artificial Sequence
  Description of Artificial Sequence: Synthetic oligonucleotide
gagttccagagagcccagtctctactcag

SEQ ID NO: 146436 - DNA, 29 bp, Artificial Sequence
  Description of Artificial Sequence: Synthetic oligonucleotide
agttccagagagcccagtctctactcagc

SEQ ID NO: 146437 - DNA, 28 bp, Artificial Sequence
  Description of Artificial Sequence: Synthetic oligonucleotide
gttccagagagcccagtctctactcagc

SEQ ID NO: 146438 - DNA, 29 bp, Artificial Sequence
  Description of Artificial Sequence: Synthetic oligonucleotide
ttccagagagcccagtctctactcagcac

SEQ ID NO: 146439 - DNA, 28 bp, Artificial Sequence
  Description of Artificial Sequence: Synthetic oligonucleotide
tccagagagcccagtctctactcagcac

SEQ ID NO: 146440 - DNA, 27 bp, Artificial Sequence
  Description of Artificial Sequence: Synthetic oligonucleotide
ccagagagcccagtctctactcagcac

SEQ ID NO: 146441 - DNA, 27 bp, Artificial Sequence
  Description of Artificial Sequence: Synthetic oligonucleotide
cagagagcccagtctctactcagcacc

SEQ ID NO: 146442 - DNA, 27 bp, Artificial Sequence
  Description of Artificial Sequence: Synthetic oligonucleotide
agagagcccagtctctactcagcaccg

SEQ ID NO: 146443 - DNA, 27 bp, Artificial Sequence
  Description of Artificial Sequence: Synthetic oligonucleotide
gagagcccagtctctactcagcaccga

SEQ ID NO: 146444 - DNA, 27 bp, Artificial Sequence
  Description of Artificial Sequence: Synthetic oligonucleotide
agagcccagtctctactcagcaccgac

SEQ ID NO: 146445 - DNA, 26 bp, Artificial Sequence
  Description of Artificial Sequence: Synthetic oligonucleotide
gagcccagtctctactcagcaccgac

SEQ ID NO: 146446 - DNA, 26 bp, Artificial Sequence
  Description of Artificial Sequence: Synthetic oligonucleotide
agcccagtctctactcagcaccgacc

SEQ ID NO: 146447 - DNA, 25 bp, Artificial Sequence
  Description of Artificial Sequence: Synthetic oligonucleotide
gcccagtctctactcagcaccgacc

SEQ ID NO: 146448 - DNA, 25 bp, Artificial Sequence
  Description of Artificial Sequence: Synthetic oligonucleotide
cccagtctctactcagcaccgaccg

SEQ ID NO: 146449 - DNA, 25 bp, Artificial Sequence
  Description of Artificial Sequence: Synthetic oligonucleotide
ccagtctctactcagcaccgaccgg

SEQ ID NO: 146450 - DNA, 26 bp, Artificial Sequence
  Description of Artificial Sequence: Synthetic oligonucleotide
cagtctctactcagcaccgaccggga

SEQ ID NO: 146451 - DNA, 26 bp, Artificial Sequence
  Description of Artificial Sequence: Synthetic oligonucleotide
agtctctactcagcaccgaccgggag

SEQ ID NO: 146452 - DNA, 25 bp, Artificial Sequence
  Description of Artificial Sequence: Synthetic oligonucleotide
gtctctactcagcaccgaccgggag

SEQ ID NO: 146453 - DNA, 25 bp, Artificial Sequence
  Description of Artificial Sequence: Synthetic oligonucleotide
tctctactcagcaccgaccgggagg

SEQ ID NO: 146454 - DNA, 24 bp, Artificial Sequence
  Description of Artificial Sequence: Synthetic oligonucleotide
ctctactcagcaccgaccgggagg

SEQ ID NO: 146455 - DNA, 24 bp, Artificial Sequence
  Description of Artificial Sequence: Synthetic oligonucleotide
tctactcagcaccgaccgggaggc

SEQ ID NO: 146456 - DNA, 23 bp, Artificial Sequence
  Description of Artificial Sequence: Synthetic oligonucleotide
ctactcagcaccgaccgggaggc

SEQ ID NO: 146457 - DNA, 24 bp, Artificial Sequence
  Description of Artificial Sequence: Synthetic oligonucleotide
tactcagcaccgaccgggaggcct

SEQ ID NO: 146458 - DNA, 23 bp, Artificial Sequence
  Description of Artificial Sequence: Synthetic oligonucleotide
actcagcaccgaccgggaggcct

SEQ ID NO: 146459 - DNA, 22 bp, Artificial Sequence
  Description of Artificial Sequence: Synthetic oligonucleotide
ctcagcaccgaccgggaggcct

SEQ ID NO: 146460 - DNA, 22 bp, Artificial Sequence
  Description of Artificial Sequence: Synthetic oligonucleotide
tcagcaccgaccgggaggcctc

SEQ ID NO: 146461 - DNA, 21 bp, Artificial Sequence
  Description of Artificial Sequence: Synthetic oligonucleotide
cagcaccgaccgggaggcctc

SEQ ID NO: 146462 - DNA, 23 bp, Artificial Sequence
  Description of Artificial Sequence: Synthetic oligonucleotide
agcaccgaccgggaggcctccat

SEQ ID NO: 146463 - DNA, 22 bp, Artificial Sequence
  Description of Artificial Sequence: Synthetic oligonucleotide
gcaccgaccgggaggcctccat

SEQ ID NO: 146464 - DNA, 22 bp, Artificial Sequence
  Description of Artificial Sequence: Synthetic oligonucleotide
caccgaccgggaggcctccatc

SEQ ID NO: 146465 - DNA, 23 bp, Artificial Sequence
  Description of Artificial Sequence: Synthetic oligonucleotide
accgaccgggaggcctccatcga

SEQ ID NO: 146466 - DNA, 22 bp, Artificial Sequence
  Description of Artificial Sequence: Synthetic oligonucleotide
ccgaccgggaggcctccatcga

SEQ ID NO: 146467 - DNA, 24 bp, Artificial Sequence
  Description of Artificial Sequence: Synthetic oligonucleotide
cgaccgggaggcctccatcgacat

SEQ ID NO: 146468 - DNA, 24 bp, Artificial Sequence
  Description of Artificial Sequence: Synthetic oligonucleotide
gaccgggaggcctccatcgacatc

SEQ ID NO: 146469 - DNA, 25 bp, Artificial Sequence
  Description of Artificial Sequence: Synthetic oligonucleotide
accgggaggcctccatcgacatcct

SEQ ID NO: 146470 - DNA, 24 bp, Artificial Sequence
  Description of Artificial Sequence: Synthetic oligonucleotide
ccgggaggcctccatcgacatcct

SEQ ID NO: 146471 - DNA, 24 bp, Artificial Sequence
  Description of Artificial Sequence: Synthetic oligonucleotide
cgggaggcctccatcgacatcctc

SEQ ID NO: 146472 - DNA, 25 bp, Artificial Sequence
  Description of Artificial Sequence: Synthetic oligonucleotide
gggaggcctccatcgacatcctcca

SEQ ID NO: 146473 - DNA, 26 bp, Artificial Sequence
  Description of Artificial Sequence: Synthetic oligonucleotide
ggaggcctccatcgacatcctccact

SEQ ID NO: 146474 - DNA, 26 bp, Artificial Sequence
  Description of Artificial Sequence: Synthetic oligonucleotide
gaggcctccatcgacatcctccactc

SEQ ID NO: 146475 - DNA, 27 bp, Artificial Sequence
  Description of Artificial Sequence: Synthetic oligonucleotide
aggcctccatcgacatcctccactcca

SEQ ID NO: 146476 - DNA, 27 bp, Artificial Sequence
  Description of Artificial Sequence: Synthetic oligonucleotide
ggcctccatcgacatcctccactccat

SEQ ID NO: 146477 - DNA, 27 bp, Artificial Sequence
  Description of Artificial Sequence: Synthetic oligonucleotide
gcctccatcgacatcctccactccatc

SEQ ID NO: 146478 - DNA, 27 bp, Artificial Sequence
  Description of Artificial Sequence: Synthetic oligonucleotide
cctccatcgacatcctccactccatcg

SEQ ID NO: 146479 - DNA, 28 bp, Artificial Sequence
  Description of Artificial Sequence: Synthetic oligonucleotide
ctccatcgacatcctccactccatcgtg

SEQ ID NO: 146480 - DNA, 30 bp, Artificial Sequence
  Description of Artificial Sequence: Synthetic oligonucleotide
tccatcgacatcctccactccatcgtgaag

SEQ ID NO: 146481 - DNA, 29 bp, Artificial Sequence
  Description of Artificial Sequence: Synthetic oligonucleotide
ccatcgacatcctccactccatcgtgaag

SEQ ID NO: 146482 - DNA, 29 bp, Artificial Sequence
  Description of Artificial Sequence: Synthetic oligonucleotide
catcgacatcctccactccatcgtgaagc

SEQ ID NO: 146483 - DNA, 29 bp, Artificial Sequence
  Description of Artificial Sequence: Synthetic oligonucleotide
atcgacatcctccactccatcgtgaagcg

SEQ ID NO: 146484 - DNA, 28 bp, Artificial Sequence
  Description of Artificial Sequence: Synthetic oligonucleotide
tcgacatcctccactccatcgtgaagcg

SEQ ID NO: 146485 - DNA, 27 bp, Artificial Sequence
  Description of Artificial Sequence: Synthetic oligonucleotide
cgacatcctccactccatcgtgaagcg

SEQ ID NO: 146486 - DNA, 28 bp, Artificial Sequence
  Description of Artificial Sequence: Synthetic oligonucleotide
gacatcctccactccatcgtgaagcgtg

SEQ ID NO: 146487 - DNA, 29 bp, Artificial Sequence
  Description of Artificial Sequence: Synthetic oligonucleotide
acatcctccactccatcgtgaagcgtgac

SEQ ID NO: 146488 - DNA, 28 bp, Artificial Sequence
  Description of Artificial Sequence: Synthetic oligonucleotide
catcctccactccatcgtgaagcgtgac

SEQ ID NO: 146489 - DNA, 31 bp, Artificial Sequence
  Description of Artificial Sequence: Synthetic oligonucleotide
atcctccactccatcgtgaagcgtgacattc

SEQ ID NO: 146490 - DNA, 30 bp, Artificial Sequence
  Description of Artificial Sequence: Synthetic oligonucleotide
tcctccactccatcgtgaagcgtgacattc

SEQ ID NO: 146491 - DNA, 29 bp, Artificial Sequence
  Description of Artificial Sequence: Synthetic oligonucleotide
cctccactccatcgtgaagcgtgacattc

SEQ ID NO: 146492 - DNA, 30 bp, Artificial Sequence
  Description of Artificial Sequence: Synthetic oligonucleotide
ctccactccatcgtgaagcgtgacattcag

SEQ ID NO: 146493 - DNA, 30 bp, Artificial Sequence
  Description of Artificial Sequence: Synthetic oligonucleotide
tccactccatcgtgaagcgtgacattcagg

SEQ ID NO: 146494 - DNA, 29 bp, Artificial Sequence
  Description of Artificial Sequence: Synthetic oligonucleotide
ccactccatcgtgaagcgtgacattcagg

SEQ ID NO: 146495 - DNA, 33 bp, Artificial Sequence
  Description of Artificial Sequence: Synthetic oligonucleotide
cactccatcgtgaagcgtgacattcaggaaaac

SEQ ID NO: 146496 - DNA, 33 bp, Artificial Sequence
  Description of Artificial Sequence: Synthetic oligonucleotide
actccatcgtgaagcgtgacattcaggaaaacg

SEQ ID NO: 146497 - DNA, 32 bp, Artificial Sequence
  Description of Artificial Sequence: Synthetic oligonucleotide
ctccatcgtgaagcgtgacattcaggaaaacg

SEQ ID NO: 146498 - DNA, 34 bp, Artificial Sequence
  Description of Artificial Sequence: Synthetic oligonucleotide
tccatcgtgaagcgtgacattcaggaaaacgatg

SEQ ID NO: 146499 - DNA, 33 bp, Artificial Sequence
  Description of Artificial Sequence: Synthetic oligonucleotide
ccatcgtgaagcgtgacattcaggaaaacgatg

SEQ ID NO: 146500 - DNA, 35 bp, Artificial Sequence
  Description of Artificial Sequence: Synthetic oligonucleotide
catcgtgaagcgtgacattcaggaaaacgatgaag

SEQ ID NO: 146501 - DNA, 36 bp, Artificial Sequence
  Description of Artificial Sequence: Synthetic oligonucleotide
atcgtgaagcgtgacattcaggaaaacgatgaagag

SEQ ID NO: 146502 - DNA, 35 bp, Artificial Sequence
  Description of Artificial Sequence: Synthetic oligonucleotide
tcgtgaagcgtgacattcaggaaaacgatgaagag

SEQ ID NO: 146503 - DNA, 34 bp, Artificial Sequence
  Description of Artificial Sequence: Synthetic oligonucleotide
cgtgaagcgtgacattcaggaaaacgatgaagag

SEQ ID NO: 146504 - DNA, 34 bp, Artificial Sequence
  Description of Artificial Sequence: Synthetic oligonucleotide
gtgaagcgtgacattcaggaaaacgatgaagagg

SEQ ID NO: 146505 - DNA, 34 bp, Artificial Sequence
  Description of Artificial Sequence: Synthetic oligonucleotide
tgaagcgtgacattcaggaaaacgatgaagaggc

SEQ ID NO: 146506 - DNA, 33 bp, Artificial Sequence
  Description of Artificial Sequence: Synthetic oligonucleotide
gaagcgtgacattcaggaaaacgatgaagaggc

SEQ ID NO: 146507 - DNA, 34 bp, Artificial Sequence
  Description of Artificial Sequence: Synthetic oligonucleotide
aagcgtgacattcaggaaaacgatgaagaggcag

SEQ ID NO: 146508 - DNA, 33 bp, Artificial Sequence
  Description of Artificial Sequence: Synthetic oligonucleotide
agcgtgacattcaggaaaacgatgaagaggcag

SEQ ID NO: 146509 - DNA, 32 bp, Artificial Sequence
  Description of Artificial Sequence: Synthetic oligonucleotide
gcgtgacattcaggaaaacgatgaagaggcag

SEQ ID NO: 146510 - DNA, 33 bp, Artificial Sequence
  Description of Artificial Sequence: Synthetic oligonucleotide
cgtgacattcaggaaaacgatgaagaggcagtg

SEQ ID NO: 146511 - DNA, 33 bp, Artificial Sequence
  Description of Artificial Sequence: Synthetic oligonucleotide
gtgacattcaggaaaacgatgaagaggcagtgc

SEQ ID NO: 146512 - DNA, 35 bp, Artificial Sequence
  Description of Artificial Sequence: Synthetic oligonucleotide
tgacattcaggaaaacgatgaagaggcagtgcaag

SEQ ID NO: 146513 - DNA, 34 bp, Artificial Sequence
  Description of Artificial Sequence: Synthetic oligonucleotide
gacattcaggaaaacgatgaagaggcagtgcaag

SEQ ID NO: 146514 - DNA, 35 bp, Artificial Sequence
  Description of Artificial Sequence: Synthetic oligonucleotide
acattcaggaaaacgatgaagaggcagtgcaagtc

SEQ ID NO: 146515 - DNA, 34 bp, Artificial Sequence
  Description of Artificial Sequence: Synthetic oligonucleotide
cattcaggaaaacgatgaagaggcagtgcaagtc

SEQ ID NO: 146516 - DNA, 37 bp, Artificial Sequence
  Description of Artificial Sequence: Synthetic oligonucleotide
attcaggaaaacgatgaagaggcagtgcaagtcaaag

SEQ ID NO: 146517 - DNA, 36 bp, Artificial Sequence
  Description of Artificial Sequence: Synthetic oligonucleotide
ttcaggaaaacgatgaagaggcagtgcaagtcaaag

SEQ ID NO: 146518 - DNA, 35 bp, Artificial Sequence
  Description of Artificial Sequence: Synthetic oligonucleotide
tcaggaaaacgatgaagaggcagtgcaagtcaaag

SEQ ID NO: 146519 - DNA, 34 bp, Artificial Sequence
  Description of Artificial Sequence: Synthetic oligonucleotide
caggaaaacgatgaagaggcagtgcaagtcaaag

SEQ ID NO: 146520 - DNA, 35 bp, Artificial Sequence
  Description of Artificial Sequence: Synthetic oligonucleotide
aggaaaacgatgaagaggcagtgcaagtcaaagag

SEQ ID NO: 146521 - DNA, 34 bp, Artificial Sequence
  Description of Artificial Sequence: Synthetic oligonucleotide
ggaaaacgatgaagaggcagtgcaagtcaaagag

SEQ ID NO: 146522 - DNA, 34 bp, Artificial Sequence
  Description of Artificial Sequence: Synthetic oligonucleotide
gaaaacgatgaagaggcagtgcaagtcaaagagc

SEQ ID NO: 146523 - DNA, 35 bp, Artificial Sequence
  Description of Artificial Sequence: Synthetic oligonucleotide
aaaacgatgaagaggcagtgcaagtcaaagagcag

SEQ ID NO: 146524 - DNA, 34 bp, Artificial Sequence
  Description of Artificial Sequence: Synthetic oligonucleotide
aaacgatgaagaggcagtgcaagtcaaagagcag

SEQ ID NO: 146525 - DNA, 33 bp, Artificial Sequence
  Description of Artificial Sequence: Synthetic oligonucleotide
aacgatgaagaggcagtgcaagtcaaagagcag

SEQ ID NO: 146526 - DNA, 32 bp, Artificial Sequence
  Description of Artificial Sequence: Synthetic oligonucleotide
acgatgaagaggcagtgcaagtcaaagagcag

SEQ ID NO: 146527 - DNA, 31 bp, Artificial Sequence
  Description of Artificial Sequence: Synthetic oligonucleotide
cgatgaagaggcagtgcaagtcaaagagcag

SEQ ID NO: 146528 - DNA, 32 bp, Artificial Sequence
  Description of Artificial Sequence: Synthetic oligonucleotide
gatgaagaggcagtgcaagtcaaagagcagag

SEQ ID NO: 146529 - DNA, 32 bp, Artificial Sequence
  Description of Artificial Sequence: Synthetic oligonucleotide
atgaagaggcagtgcaagtcaaagagcagagc

SEQ ID NO: 146530 - DNA, 31 bp, Artificial Sequence
  Description of Artificial Sequence: Synthetic oligonucleotide
tgaagaggcagtgcaagtcaaagagcagagc

SEQ ID NO: 146531 - DNA, 30 bp, Artificial Sequence
  Description of Artificial Sequence: Synthetic oligonucleotide
gaagaggcagtgcaagtcaaagagcagagc

SEQ ID NO: 146532 - DNA, 32 bp, Artificial Sequence
  Description of Artificial Sequence: Synthetic oligonucleotide
aagaggcagtgcaagtcaaagagcagagcatc

SEQ ID NO: 146533 - DNA, 31 bp, Artificial Sequence
  Description of Artificial Sequence: Synthetic oligonucleotide
agaggcagtgcaagtcaaagagcagagcatc

SEQ ID NO: 146534 - DNA, 30 bp, Artificial Sequence
  Description of Artificial Sequence: Synthetic oligonucleotide
gaggcagtgcaagtcaaagagcagagcatc

SEQ ID NO: 146535 - DNA, 30 bp, Artificial Sequence
  Description of Artificial Sequence: Synthetic oligonucleotide
aggcagtgcaagtcaaagagcagagcatcc

SEQ ID NO: 146536 - DNA, 29 bp, Artificial Sequence
  Description of Artificial Sequence: Synthetic oligonucleotide
ggcagtgcaagtcaaagagcagagcatcc

SEQ ID NO: 146537 - DNA, 30 bp, Artificial Sequence
  Description of Artificial Sequence: Synthetic oligonucleotide
gcagtgcaagtcaaagagcagagcatcctg

SEQ ID NO: 146538 - DNA, 30 bp, Artificial Sequence
  Description of Artificial Sequence: Synthetic oligonucleotide
cagtgcaagtcaaagagcagagcatcctgg

SEQ ID NO: 146539 - DNA, 32 bp, Artificial Sequence
  Description of Artificial Sequence: Synthetic oligonucleotide
agtgcaagtcaaagagcagagcatcctggaac

SEQ ID NO: 146540 - DNA, 31 bp, Artificial Sequence
  Description of Artificial Sequence: Synthetic oligonucleotide
gtgcaagtcaaagagcagagcatcctggaac

SEQ ID NO: 146541 - DNA, 32 bp, Artificial Sequence
  Description of Artificial Sequence: Synthetic oligonucleotide
tgcaagtcaaagagcagagcatcctggaactg

SEQ ID NO: 146542 - DNA, 31 bp, Artificial Sequence
  Description of Artificial Sequence: Synthetic oligonucleotide
gcaagtcaaagagcagagcatcctggaactg

SEQ ID NO: 146543 - DNA, 31 bp, Artificial Sequence
  Description of Artificial Sequence: Synthetic oligonucleotide
caagtcaaagagcagagcatcctggaactgg

SEQ ID NO: 146544 - DNA, 31 bp, Artificial Sequence
  Description of Artificial Sequence: Synthetic oligonucleotide
aagtcaaagagcagagcatcctggaactggg

SEQ ID NO: 146545 - DNA, 30 bp, Artificial Sequence
  Description of Artificial Sequence: Synthetic oligonucleotide
agtcaaagagcagagcatcctggaactggg

SEQ ID NO: 146546 - DNA, 29 bp, Artificial Sequence
  Description of Artificial Sequence: Synthetic oligonucleotide
gtcaaagagcagagcatcctggaactggg

SEQ ID NO: 146547 - DNA, 31 bp, Artificial Sequence
  Description of Artificial Sequence: Synthetic oligonucleotide
tcaaagagcagagcatcctggaactgggatc

SEQ ID NO: 146548 - DNA, 30 bp, Artificial Sequence
  Description of Artificial Sequence: Synthetic oligonucleotide
caaagagcagagcatcctggaactgggatc

SEQ ID NO: 146549 - DNA, 31 bp, Artificial Sequence
  Description of Artificial Sequence: Synthetic oligonucleotide
aaagagcagagcatcctggaactgggatctc

SEQ ID NO: 146550 - DNA, 30 bp, Artificial Sequence
  Description of Artificial Sequence: Synthetic oligonucleotide
aagagcagagcatcctggaactgggatctc

SEQ ID NO: 146551 - DNA, 29 bp, Artificial Sequence
  Description of Artificial Sequence: Synthetic oligonucleotide
agagcagagcatcctggaactgggatctc

SEQ ID NO: 146552 - DNA, 28 bp, Artificial Sequence
  Description of Artificial Sequence: Synthetic oligonucleotide
gagcagagcatcctggaactgggatctc

SEQ ID NO: 146553 - DNA, 29 bp, Artificial Sequence
  Description of Artificial Sequence: Synthetic oligonucleotide
agcagagcatcctggaactgggatctctc

SEQ ID NO: 146554 - DNA, 28 bp, Artificial Sequence
  Description of Artificial Sequence: Synthetic oligonucleotide
gcagagcatcctggaactgggatctctc

SEQ ID NO: 146555 - DNA, 28 bp, Artificial Sequence
  Description of Artificial Sequence: Synthetic oligonucleotide
cagagcatcctggaactgggatctctcc

SEQ ID NO: 146556 - DNA, 29 bp, Artificial Sequence
  Description of Artificial Sequence: Synthetic oligonucleotide
agagcatcctggaactgggatctctcctg

SEQ ID NO: 146557 - DNA, 28 bp, Artificial Sequence
  Description of Artificial Sequence: Synthetic oligonucleotide
gagcatcctggaactgggatctctcctg

SEQ ID NO: 146558 - DNA, 28 bp, Artificial Sequence
  Description of Artificial Sequence: Synthetic oligonucleotide
agcatcctggaactgggatctctcctgg

SEQ ID NO: 146559 - DNA, 27 bp, Artificial Sequence
  Description of Artificial Sequence: Synthetic oligonucleotide
gcatcctggaactgggatctctcctgg

SEQ ID NO: 146560 - DNA, 27 bp, Artificial Sequence
  Description of Artificial Sequence: Synthetic oligonucleotide
catcctggaactgggatctctcctggc

SEQ ID NO: 146561 - DNA, 30 bp, Artificial Sequence
  Description of Artificial Sequence: Synthetic oligonucleotide
atcctggaactgggatctctcctggcaaag

SEQ ID NO: 146562 - DNA, 29 bp, Artificial Sequence
  Description of Artificial Sequence: Synthetic oligonucleotide
tcctggaactgggatctctcctggcaaag

SEQ ID NO: 146563 - DNA, 28 bp, Artificial Sequence
  Description of Artificial Sequence: Synthetic oligonucleotide
cctggaactgggatctctcctggcaaag

SEQ ID NO: 146564 - DNA, 29 bp, Artificial Sequence
  Description of Artificial Sequence: Synthetic oligonucleotide
ctggaactgggatctctcctggcaaagac

SEQ ID NO: 146565 - DNA, 30 bp, Artificial Sequence
  Description of Artificial Sequence: Synthetic oligonucleotide
tggaactgggatctctcctggcaaagactg

SEQ ID NO: 146566 - DNA, 29 bp, Artificial Sequence
  Description of Artificial Sequence: Synthetic oligonucleotide
ggaactgggatctctcctggcaaagactg

SEQ ID NO: 146567 - DNA, 29 bp, Artificial Sequence
  Description of Artificial Sequence: Synthetic oligonucleotide
gaactgggatctctcctggcaaagactgg

SEQ ID NO: 146568 - DNA, 30 bp, Artificial Sequence
  Description of Artificial Sequence: Synthetic oligonucleotide
aactgggatctctcctggcaaagactggac

SEQ ID NO: 146569 - DNA, 29 bp, Artificial Sequence
  Description of Artificial Sequence: Synthetic oligonucleotide
actgggatctctcctggcaaagactggac

SEQ ID NO: 146570 - DNA, 28 bp, Artificial Sequence
  Description of Artificial Sequence: Synthetic oligonucleotide
ctgggatctctcctggcaaagactggac

SEQ ID NO: 146571 - DNA, 30 bp, Artificial Sequence
  Description of Artificial Sequence: Synthetic oligonucleotide
tgggatctctcctggcaaagactggacaag

SEQ ID NO: 146572 - DNA, 29 bp, Artificial Sequence
  Description of Artificial Sequence: Synthetic oligonucleotide
gggatctctcctggcaaagactggacaag

SEQ ID NO: 146573 - DNA, 29 bp, Artificial Sequence
  Description of Artificial Sequence: Synthetic oligonucleotide
ggatctctcctggcaaagactggacaagc

SEQ ID NO: 146574 - DNA, 30 bp, Artificial Sequence
  Description of Artificial Sequence: Synthetic oligonucleotide
gatctctcctggcaaagactggacaagctg

SEQ ID NO: 146575 - DNA, 30 bp, Artificial Sequence
  Description of Artificial Sequence: Synthetic oligonucleotide
atctctcctggcaaagactggacaagctgc

SEQ ID NO: 146576 - DNA, 29 bp, Artificial Sequence
  Description of Artificial Sequence: Synthetic oligonucleotide
tctctcctggcaaagactggacaagctgc

SEQ ID NO: 146577 - DNA, 28 bp, Artificial Sequence
  Description of Artificial Sequence: Synthetic oligonucleotide
ctctcctggcaaagactggacaagctgc

SEQ ID NO: 146578 - DNA, 29 bp, Artificial Sequence
  Description of Artificial Sequence: Synthetic oligonucleotide
tctcctggcaaagactggacaagctgcag

SEQ ID NO: 146579 - DNA, 28 bp, Artificial Sequence
  Description of Artificial Sequence: Synthetic oligonucleotide
ctcctggcaaagactggacaagctgcag

SEQ ID NO: 146580 - DNA, 29 bp, Artificial Sequence
  Description of Artificial Sequence: Synthetic oligonucleotide
tcctggcaaagactggacaagctgcagag

SEQ ID NO: 146581 - DNA, 28 bp, Artificial Sequence
  Description of Artificial Sequence: Synthetic oligonucleotide
cctggcaaagactggacaagctgcagag

SEQ ID NO: 146582 - DNA, 28 bp, Artificial Sequence
  Description of Artificial Sequence: Synthetic oligonucleotide
ctggcaaagactggacaagctgcagagc

SEQ ID NO: 146583 - DNA, 30 bp, Artificial Sequence
  Description of Artificial Sequence: Synthetic oligonucleotide
tggcaaagactggacaagctgcagagcttg

SEQ ID NO: 146584 - DNA, 29 bp, Artificial Sequence
  Description of Artificial Sequence: Synthetic oligonucleotide
ggcaaagactggacaagctgcagagcttg

SEQ ID NO: 146585 - DNA, 29 bp, Artificial Sequence
  Description of Artificial Sequence: Synthetic oligonucleotide
gcaaagactggacaagctgcagagcttgg

SEQ ID NO: 146586 - DNA, 30 bp, Artificial Sequence
  Description of Artificial Sequence: Synthetic oligonucleotide
caaagactggacaagctgcagagcttggag

SEQ ID NO: 146587 - DNA, 30 bp, Artificial Sequence
  Description of Artificial Sequence: Synthetic oligonucleotide
aaagactggacaagctgcagagcttggagg

SEQ ID NO: 146588 - DNA, 29 bp, Artificial Sequence
  Description of Artificial Sequence: Synthetic oligonucleotide
aagactggacaagctgcagagcttggagg

SEQ ID NO: 146589 - DNA, 28 bp, Artificial Sequence
  Description of Artificial Sequence: Synthetic oligonucleotide
agactggacaagctgcagagcttggagg

SEQ ID NO: 146590 - DNA, 27 bp, Artificial Sequence
  Description of Artificial Sequence: Synthetic oligonucleotide
gactggacaagctgcagagcttggagg

SEQ ID NO: 146591 - DNA, 28 bp, Artificial Sequence
  Description of Artificial Sequence: Synthetic oligonucleotide
actggacaagctgcagagcttggaggac

SEQ ID NO: 146592 - DNA, 27 bp, Artificial Sequence
  Description of Artificial Sequence: Synthetic oligonucleotide
ctggacaagctgcagagcttggaggac

SEQ ID NO: 146593 - DNA, 28 bp, Artificial Sequence
  Description of Artificial Sequence: Synthetic oligonucleotide
tggacaagctgcagagcttggaggactc

SEQ ID NO: 146594 - DNA, 27 bp, Artificial Sequence
  Description of Artificial Sequence: Synthetic oligonucleotide
ggacaagctgcagagcttggaggactc

SEQ ID NO: 146595 - DNA, 27 bp, Artificial Sequence
  Description of Artificial Sequence: Synthetic oligonucleotide
gacaagctgcagagcttggaggactcc

SEQ ID NO: 146596 - DNA, 28 bp, Artificial Sequence
  Description of Artificial Sequence: Synthetic oligonucleotide
acaagctgcagagcttggaggactcctg

SEQ ID NO: 146597 - DNA, 27 bp, Artificial Sequence
  Description of Artificial Sequence: Synthetic oligonucleotide
caagctgcagagcttggaggactcctg

SEQ ID NO: 146598 - DNA, 29 bp, Artificial Sequence
  Description of Artificial Sequence: Synthetic oligonucleotide
aagctgcagagcttggaggactcctgaag

SEQ ID NO: 146599 - DNA, 28 bp, Artificial Sequence
  Description of Artificial Sequence: Synthetic oligonucleotide
agctgcagagcttggaggactcctgaag

SEQ ID NO: 146600 - DNA, 27 bp, Artificial Sequence
  Description of Artificial Sequence: Synthetic oligonucleotide
gctgcagagcttggaggactcctgaag

SEQ ID NO: 146601 - DNA, 30 bp, Artificial Sequence
  Description of Artificial Sequence: Synthetic oligonucleotide
ctgcagagcttggaggactcctgaagtatg

SEQ ID NO: 146602 - DNA, 32 bp, Artificial Sequence
  Description of Artificial Sequence: Synthetic oligonucleotide
tgcagagcttggaggactcctgaagtatgtac

SEQ ID NO: 146603 - DNA, 31 bp, Artificial Sequence
  Description of Artificial Sequence: Synthetic oligonucleotide
gcagagcttggaggactcctgaagtatgtac

SEQ ID NO: 146604 - DNA, 31 bp, Artificial Sequence
  Description of Artificial Sequence: Synthetic oligonucleotide
cagagcttggaggactcctgaagtatgtacg

SEQ ID NO: 146605 - DNA, 32 bp, Artificial Sequence
  Description of Artificial Sequence: Synthetic oligonucleotide
agagcttggaggactcctgaagtatgtacgac

SEQ ID NO: 146606 - DNA, 31 bp, Artificial Sequence
  Description of Artificial Sequence: Synthetic oligonucleotide
gagcttggaggactcctgaagtatgtacgac

SEQ ID NO: 146607 - DNA, 31 bp, Artificial Sequence
  Description of Artificial Sequence: Synthetic oligonucleotide
agcttggaggactcctgaagtatgtacgacc

SEQ ID NO: 146608 - DNA, 30 bp, Artificial Sequence
  Description of Artificial Sequence: Synthetic oligonucleotide
gcttggaggactcctgaagtatgtacgacc

SEQ ID NO: 146609 - DNA, 30 bp, Artificial Sequence
  Description of Artificial Sequence: Synthetic oligonucleotide
cttggaggactcctgaagtatgtacgaccc

SEQ ID NO: 146610 - DNA, 32 bp, Artificial Sequence
  Description of Artificial Sequence: Synthetic oligonucleotide
ttggaggactcctgaagtatgtacgacccttc

SEQ ID NO: 146611 - DNA, 31 bp, Artificial Sequence
  Description of Artificial Sequence: Synthetic oligonucleotide
tggaggactcctgaagtatgtacgacccttc

SEQ ID NO: 146612 - DNA, 30 bp, Artificial Sequence
  Description of Artificial Sequence: Synthetic oligonucleotide
ggaggactcctgaagtatgtacgacccttc

SEQ ID NO: 146613 - DNA, 32 bp, Artificial Sequence
  Description of Artificial Sequence: Synthetic oligonucleotide
gaggactcctgaagtatgtacgacccttcttg

SEQ ID NO: 146614 - DNA, 36 bp, Artificial Sequence
  Description of Artificial Sequence: Synthetic oligonucleotide
aggactcctgaagtatgtacgacccttcttgaattc

SEQ ID NO: 146615 - DNA, 35 bp, Artificial Sequence
  Description of Artificial Sequence: Synthetic oligonucleotide
ggactcctgaagtatgtacgacccttcttgaattc

SEQ ID NO: 146616 - DNA, 35 bp, Artificial Sequence
  Description of Artificial Sequence: Synthetic oligonucleotide
gactcctgaagtatgtacgacccttcttgaattcc

SEQ ID NO: 146617 - DNA, 37 bp, Artificial Sequence
  Description of Artificial Sequence: Synthetic oligonucleotide
actcctgaagtatgtacgacccttcttgaattccatc

SEQ ID NO: 146618 - DNA, 36 bp, Artificial Sequence
  Description of Artificial Sequence: Synthetic oligonucleotide
ctcctgaagtatgtacgacccttcttgaattccatc

SEQ ID NO: 146619 - DNA, 37 bp, Artificial Sequence
  Description of Artificial Sequence: Synthetic oligonucleotide
tcctgaagtatgtacgacccttcttgaattccatcag

SEQ ID NO: 146620 - DNA, 36 bp, Artificial Sequence
  Description of Artificial Sequence: Synthetic oligonucleotide
cctgaagtatgtacgacccttcttgaattccatcag

SEQ ID NO: 146621 - DNA, 36 bp, Artificial Sequence
  Description of Artificial Sequence: Synthetic oligonucleotide
ctgaagtatgtacgacccttcttgaattccatcagc

SEQ ID NO: 146622 - DNA, 38 bp, Artificial Sequence
  Description of Artificial Sequence: Synthetic oligonucleotide
tgaagtatgtacgacccttcttgaattccatcagcaag

SEQ ID NO: 146623 - DNA, 37 bp, Artificial Sequence
  Description of Artificial Sequence: Synthetic oligonucleotide
gaagtatgtacgacccttcttgaattccatcagcaag

SEQ ID NO: 146624 - DNA, 37 bp, Artificial Sequence
  Description of Artificial Sequence: Synthetic oligonucleotide
aagtatgtacgacccttcttgaattccatcagcaagg

SEQ ID NO: 146625 - DNA, 36 bp, Artificial Sequence
  Description of Artificial Sequence: Synthetic oligonucleotide
agtatgtacgacccttcttgaattccatcagcaagg

SEQ ID NO: 146626 - DNA, 35 bp, Artificial Sequence
  Description of Artificial Sequence: Synthetic oligonucleotide
gtatgtacgacccttcttgaattccatcagcaagg

SEQ ID NO: 146627 - DNA, 35 bp, Artificial Sequence
  Description of Artificial Sequence: Synthetic oligonucleotide
tatgtacgacccttcttgaattccatcagcaaggc

SEQ ID NO: 146628 - DNA, 34 bp, Artificial Sequence
  Description of Artificial Sequence: Synthetic oligonucleotide
atgtacgacccttcttgaattccatcagcaaggc

SEQ ID NO: 146629 - DNA, 33 bp, Artificial Sequence
  Description of Artificial Sequence: Synthetic oligonucleotide
tgtacgacccttcttgaattccatcagcaaggc

SEQ ID NO: 146630 - DNA, 32 bp, Artificial Sequence
  Description of Artificial Sequence: Synthetic oligonucleotide
gtacgacccttcttgaattccatcagcaaggc

SEQ ID NO: 146631 - DNA, 36 bp, Artificial Sequence
  Description of Artificial Sequence: Synthetic oligonucleotide
tacgacccttcttgaattccatcagcaaggctaaag

SEQ ID NO: 146632 - DNA, 35 bp, Artificial Sequence
  Description of Artificial Sequence: Synthetic oligonucleotide
acgacccttcttgaattccatcagcaaggctaaag

SEQ ID NO: 146633 - DNA, 34 bp, Artificial Sequence
  Description of Artificial Sequence: Synthetic oligonucleotide
cgacccttcttgaattccatcagcaaggctaaag

SEQ ID NO: 146634 - DNA, 34 bp, Artificial Sequence
  Description of Artificial Sequence: Synthetic oligonucleotide
gacccttcttgaattccatcagcaaggctaaagc

SEQ ID NO: 146635 - DNA, 35 bp, Artificial Sequence
  Description of Artificial Sequence: Synthetic oligonucleotide
acccttcttgaattccatcagcaaggctaaagcag

SEQ ID NO: 146636 - DNA, 34 bp, Artificial Sequence
  Description of Artificial Sequence: Synthetic oligonucleotide
cccttcttgaattccatcagcaaggctaaagcag

SEQ ID NO: 146637 - DNA, 34 bp, Artificial Sequence
  Description of Artificial Sequence: Synthetic oligonucleotide
ccttcttgaattccatcagcaaggctaaagcagc

SEQ ID NO: 146638 - DNA, 35 bp, Artificial Sequence
  Description of Artificial Sequence: Synthetic oligonucleotide
cttcttgaattccatcagcaaggctaaagcagctc

SEQ ID NO: 146639 - DNA, 35 bp, Artificial Sequence
  Description of Artificial Sequence: Synthetic oligonucleotide
ttcttgaattccatcagcaaggctaaagcagctcg

SEQ ID NO: 146640 - DNA, 34 bp, Artificial Sequence
  Description of Artificial Sequence: Synthetic oligonucleotide
tcttgaattccatcagcaaggctaaagcagctcg

SEQ ID NO: 146641 - DNA, 33 bp, Artificial Sequence
  Description of Artificial Sequence: Synthetic oligonucleotide
cttgaattccatcagcaaggctaaagcagctcg

SEQ ID NO: 146642 - DNA, 33 bp, Artificial Sequence
  Description of Artificial Sequence: Synthetic oligonucleotide
ttgaattccatcagcaaggctaaagcagctcgc

SEQ ID NO: 146643 - DNA, 32 bp, Artificial Sequence
  Description of Artificial Sequence: Synthetic oligonucleotide
tgaattccatcagcaaggctaaagcagctcgc

SEQ ID NO: 146644 - DNA, 31 bp, Artificial Sequence
  Description of Artificial Sequence: Synthetic oligonucleotide
gaattccatcagcaaggctaaagcagctcgc

SEQ ID NO: 146645 - DNA, 31 bp, Artificial Sequence
  Description of Artificial Sequence: Synthetic oligonucleotide
aattccatcagcaaggctaaagcagctcgcc

SEQ ID NO: 146646 - DNA, 30 bp, Artificial Sequence
  Description of Artificial Sequence: Synthetic oligonucleotide
attccatcagcaaggctaaagcagctcgcc

SEQ ID NO: 146647 - DNA, 29 bp, Artificial Sequence
  Description of Artificial Sequence: Synthetic oligonucleotide
ttccatcagcaaggctaaagcagctcgcc

SEQ ID NO: 146648 - DNA, 28 bp, Artificial Sequence
  Description of Artificial Sequence: Synthetic oligonucleotide
tccatcagcaaggctaaagcagctcgcc

SEQ ID NO: 146649 - DNA, 27 bp, Artificial Sequence
  Description of Artificial Sequence: Synthetic oligonucleotide
ccatcagcaaggctaaagcagctcgcc

SEQ ID NO: 146650 - DNA, 28 bp, Artificial Sequence
  Description of Artificial Sequence: Synthetic oligonucleotide
catcagcaaggctaaagcagctcgcctg

SEQ ID NO: 146651 - DNA, 28 bp, Artificial Sequence
  Description of Artificial Sequence: Synthetic oligonucleotide
atcagcaaggctaaagcagctcgcctgg

SEQ ID NO: 146652 - DNA, 27 bp, Artificial Sequence
  Description of Artificial Sequence: Synthetic oligonucleotide
tcagcaaggctaaagcagctcgcctgg

SEQ ID NO: 146653 - DNA, 27 bp, Artificial Sequence
  Description of Artificial Sequence: Synthetic oligonucleotide
cagcaaggctaaagcagctcgcctggt

SEQ ID NO: 146654 - DNA, 27 bp, Artificial Sequence
  Description of Artificial Sequence: Synthetic oligonucleotide
agcaaggctaaagcagctcgcctggtc

SEQ ID NO: 146655 - DNA, 26 bp, Artificial Sequence
  Description of Artificial Sequence: Synthetic oligonucleotide
gcaaggctaaagcagctcgcctggtc

SEQ ID NO: 146656 - DNA, 26 bp, Artificial Sequence
  Description of Artificial Sequence: Synthetic oligonucleotide
caaggctaaagcagctcgcctggtcc

SEQ ID NO: 146657 - DNA, 27 bp, Artificial Sequence
  Description of Artificial Sequence: Synthetic oligonucleotide
aaggctaaagcagctcgcctggtccga

SEQ ID NO: 146658 - DNA, 27 bp, Artificial Sequence
  Description of Artificial Sequence: Synthetic oligonucleotide
aggctaaagcagctcgcctggtccgat

SEQ ID NO: 146659 - DNA, 26 bp, Artificial Sequence
  Description of Artificial Sequence: Synthetic oligonucleotide
ggctaaagcagctcgcctggtccgat

SEQ ID NO: 146660 - DNA, 27 bp, Artificial Sequence
  Description of Artificial Sequence: Synthetic oligonucleotide
gctaaagcagctcgcctggtccgatct

SEQ ID NO: 146661 - DNA, 27 bp, Artificial Sequence
  Description of Artificial Sequence: Synthetic oligonucleotide
ctaaagcagctcgcctggtccgatctc

SEQ ID NO: 146662 - DNA, 29 bp, Artificial Sequence
  Description of Artificial Sequence: Synthetic oligonucleotide
taaagcagctcgcctggtccgatctcttc

SEQ ID NO: 146663 - DNA, 28 bp, Artificial Sequence
  Description of Artificial Sequence: Synthetic oligonucleotide
aaagcagctcgcctggtccgatctcttc

SEQ ID NO: 146664 - DNA, 27 bp, Artificial Sequence
  Description of Artificial Sequence: Synthetic oligonucleotide
aagcagctcgcctggtccgatctcttc

SEQ ID NO: 146665 - DNA, 27 bp, Artificial Sequence
  Description of Artificial Sequence: Synthetic oligonucleotide
agcagctcgcctggtccgatctcttct

SEQ ID NO: 146666 - DNA, 27 bp, Artificial Sequence
  Description of Artificial Sequence: Synthetic oligonucleotide
gcagctcgcctggtccgatctcttctt

SEQ ID NO: 146667 - DNA, 27 bp, Artificial Sequence
  Description of Artificial Sequence: Synthetic oligonucleotide
cagctcgcctggtccgatctcttcttg

SEQ ID NO: 146668 - DNA, 29 bp, Artificial Sequence
  Description of Artificial Sequence: Synthetic oligonucleotide
agctcgcctggtccgatctcttcttgatc

SEQ ID NO: 146669 - DNA, 28 bp, Artificial Sequence
  Description of Artificial Sequence: Synthetic oligonucleotide
gctcgcctggtccgatctcttcttgatc

SEQ ID NO: 146670 - DNA, 29 bp, Artificial Sequence
  Description of Artificial Sequence: Synthetic oligonucleotide
ctcgcctggtccgatctcttcttgatctg

SEQ ID NO: 146671 - DNA, 32 bp, Artificial Sequence
  Description of Artificial Sequence: Synthetic oligonucleotide
tcgcctggtccgatctcttcttgatctgtttc

SEQ ID NO: 146672 - DNA, 31 bp, Artificial Sequence
  Description of Artificial Sequence: Synthetic oligonucleotide
cgcctggtccgatctcttcttgatctgtttc

SEQ ID NO: 146673 - DNA, 33 bp, Artificial Sequence
  Description of Artificial Sequence: Synthetic oligonucleotide
gcctggtccgatctcttcttgatctgtttcttg

SEQ ID NO: 146674 - DNA, 37 bp, Artificial Sequence
  Description of Artificial Sequence: Synthetic oligonucleotide
cctggtccgatctcttcttgatctgtttcttgatatg

SEQ ID NO: 146675 - DNA, 37 bp, Artificial Sequence
  Description of Artificial Sequence: Synthetic oligonucleotide
ctggtccgatctcttcttgatctgtttcttgatatgg

SEQ ID NO: 146676 - DNA, 39 bp, Artificial Sequence
  Description of Artificial Sequence: Synthetic oligonucleotide
tggtccgatctcttcttgatctgtttcttgatatggaag

SEQ ID NO: 146677 - DNA, 38 bp, Artificial Sequence
  Description of Artificial Sequence: Synthetic oligonucleotide
ggtccgatctcttcttgatctgtttcttgatatggaag

SEQ ID NO: 146678 - DNA, 38 bp, Artificial Sequence
  Description of Artificial Sequence: Synthetic oligonucleotide
gtccgatctcttcttgatctgtttcttgatatggaagc

SEQ ID NO: 146679 - DNA, 39 bp, Artificial Sequence
  Description of Artificial Sequence: Synthetic oligonucleotide
tccgatctcttcttgatctgtttcttgatatggaagcag

SEQ ID NO: 146680 - DNA, 38 bp, Artificial Sequence
  Description of Artificial Sequence: Synthetic oligonucleotide
ccgatctcttcttgatctgtttcttgatatggaagcag

SEQ ID NO: 146681 - DNA, 38 bp, Artificial Sequence
  Description of Artificial Sequence: Synthetic oligonucleotide
cgatctcttcttgatctgtttcttgatatggaagcagc

SEQ ID NO: 146682 - DNA, 40 bp, Artificial Sequence
  Description of Artificial Sequence: Synthetic oligonucleotide
gatctcttcttgatctgtttcttgatatggaagcagctac

SEQ ID NO: 146683 - DNA, 41 bp, Artificial Sequence
  Description of Artificial Sequence: Synthetic oligonucleotide
atctcttcttgatctgtttcttgatatggaagcagctacag

SEQ ID NO: 146684 - DNA, 40 bp, Artificial Sequence
  Description of Artificial Sequence: Synthetic oligonucleotide
tctcttcttgatctgtttcttgatatggaagcagctacag

SEQ ID NO: 146685 - DNA, 39 bp, Artificial Sequence
  Description of Artificial Sequence: Synthetic oligonucleotide
ctcttcttgatctgtttcttgatatggaagcagctacag

SEQ ID NO: 146686 - DNA, 39 bp, Artificial Sequence
  Description of Artificial Sequence: Synthetic oligonucleotide
tcttcttgatctgtttcttgatatggaagcagctacagg

SEQ ID NO: 146687 - DNA, 38 bp, Artificial Sequence
  Description of Artificial Sequence: Synthetic oligonucleotide
cttcttgatctgtttcttgatatggaagcagctacagg

SEQ ID NO: 146688 - DNA, 38 bp, Artificial Sequence
  Description of Artificial Sequence: Synthetic oligonucleotide
ttcttgatctgtttcttgatatggaagcagctacaggg

SEQ ID NO: 146689 - DNA, 37 bp, Artificial Sequence
  Description of Artificial Sequence: Synthetic oligonucleotide
tcttgatctgtttcttgatatggaagcagctacaggg

SEQ ID NO: 146690 - DNA, 36 bp, Artificial Sequence
  Description of Artificial Sequence: Synthetic oligonucleotide
cttgatctgtttcttgatatggaagcagctacaggg

SEQ ID NO: 146691 - DNA, 36 bp, Artificial Sequence
  Description of Artificial Sequence: Synthetic oligonucleotide
ttgatctgtttcttgatatggaagcagctacagggc

SEQ ID NO: 146692 - DNA, 35 bp, Artificial Sequence
  Description of Artificial Sequence: Synthetic oligonucleotide
tgatctgtttcttgatatggaagcagctacagggc

SEQ ID NO: 146693 - DNA, 34 bp, Artificial Sequence
  Description of Artificial Sequence: Synthetic oligonucleotide
gatctgtttcttgatatggaagcagctacagggc

SEQ ID NO: 146694 - DNA, 35 bp, Artificial Sequence
  Description of Artificial Sequence: Synthetic oligonucleotide
atctgtttcttgatatggaagcagctacagggcag

SEQ ID NO: 146695 - DNA, 34 bp, Artificial Sequence
  Description of Artificial Sequence: Synthetic oligonucleotide
tctgtttcttgatatggaagcagctacagggcag

SEQ ID NO: 146696 - DNA, 33 bp, Artificial Sequence
  Description of Artificial Sequence: Synthetic oligonucleotide
ctgtttcttgatatggaagcagctacagggcag

SEQ ID NO: 146697 - DNA, 33 bp, Artificial Sequence
  Description of Artificial Sequence: Synthetic oligonucleotide
tgtttcttgatatggaagcagctacagggcagg

SEQ ID NO: 146698 - DNA, 32 bp, Artificial Sequence
  Description of Artificial Sequence: Synthetic oligonucleotide
gtttcttgatatggaagcagctacagggcagg

SEQ ID NO: 146699 - DNA, 33 bp, Artificial Sequence
  Description of Artificial Sequence: Synthetic oligonucleotide
tttcttgatatggaagcagctacagggcaggag

SEQ ID NO: 146700 - DNA, 32 bp, Artificial Sequence
  Description of Artificial Sequence: Synthetic oligonucleotide
ttcttgatatggaagcagctacagggcaggag

SEQ ID NO: 146701 - DNA, 31 bp, Artificial Sequence
  Description of Artificial Sequence: Synthetic oligonucleotide
tcttgatatggaagcagctacagggcaggag

SEQ ID NO: 146702 - DNA, 30 bp, Artificial Sequence
  Description of Artificial Sequence: Synthetic oligonucleotide
cttgatatggaagcagctacagggcaggag

SEQ ID NO: 146703 - DNA, 30 bp, Artificial Sequence
  Description of Artificial Sequence: Synthetic oligonucleotide
ttgatatggaagcagctacagggcaggagg

SEQ ID NO: 146704 - DNA, 29 bp, Artificial Sequence
  Description of Artificial Sequence: Synthetic oligonucleotide
tgatatggaagcagctacagggcaggagg

SEQ ID NO: 146705 - DNA, 28 bp, Artificial Sequence
  Description of Artificial Sequence: Synthetic oligonucleotide
gatatggaagcagctacagggcaggagg

SEQ ID NO: 146706 - DNA, 29 bp, Artificial Sequence
  Description of Artificial Sequence: Synthetic oligonucleotide
atatggaagcagctacagggcaggaggtc

SEQ ID NO: 146707 - DNA, 28 bp, Artificial Sequence
  Description of Artificial Sequence: Synthetic oligonucleotide
tatggaagcagctacagggcaggaggtc

SEQ ID NO: 146708 - DNA, 27 bp, Artificial Sequence
  Description of Artificial Sequence: Synthetic oligonucleotide
atggaagcagctacagggcaggaggtc

SEQ ID NO: 146709 - DNA, 26 bp, Artificial Sequence
  Description of Artificial Sequence: Synthetic oligonucleotide
tggaagcagctacagggcaggaggtc

SEQ ID NO: 146710 - DNA, 25 bp, Artificial Sequence
  Description of Artificial Sequence: Synthetic oligonucleotide
ggaagcagctacagggcaggaggtc

SEQ ID NO: 146711 - DNA, 26 bp, Artificial Sequence
  Description of Artificial Sequence: Synthetic oligonucleotide
gaagcagctacagggcaggaggtcga

SEQ ID NO: 146712 - DNA, 26 bp, Artificial Sequence
  Description of Artificial Sequence: Synthetic oligonucleotide
aagcagctacagggcaggaggtcgag

SEQ ID NO: 146713 - DNA, 25 bp, Artificial Sequence
  Description of Artificial Sequence: Synthetic oligonucleotide
agcagctacagggcaggaggtcgag

SEQ ID NO: 146714 - DNA, 24 bp, Artificial Sequence
  Description of Artificial Sequence: Synthetic oligonucleotide
gcagctacagggcaggaggtcgag

SEQ ID NO: 146715 - DNA, 25 bp, Artificial Sequence
  Description of Artificial Sequence: Synthetic oligonucleotide
cagctacagggcaggaggtcgagct

SEQ ID NO: 146716 - DNA, 26 bp, Artificial Sequence
  Description of Artificial Sequence: Synthetic oligonucleotide
agctacagggcaggaggtcgagctgt

SEQ ID NO: 146717 - DNA, 25 bp, Artificial Sequence
  Description of Artificial Sequence: Synthetic oligonucleotide
gctacagggcaggaggtcgagctgt

SEQ ID NO: 146718 - DNA, 27 bp, Artificial Sequence
  Description of Artificial Sequence: Synthetic oligonucleotide
ctacagggcaggaggtcgagctgtgtt

SEQ ID NO: 146719 - DNA, 29 bp, Artificial Sequence
  Description of Artificial Sequence: Synthetic oligonucleotide
tacagggcaggaggtcgagctgtgtttag

SEQ ID NO: 146720 - DNA, 28 bp, Artificial Sequence
  Description of Artificial Sequence: Synthetic oligonucleotide
acagggcaggaggtcgagctgtgtttag

SEQ ID NO: 146721 - DNA, 27 bp, Artificial Sequence
  Description of Artificial Sequence: Synthetic oligonucleotide
cagggcaggaggtcgagctgtgtttag

SEQ ID NO: 146722 - DNA, 28 bp, Artificial Sequence
  Description of Artificial Sequence: Synthetic oligonucleotide
agggcaggaggtcgagctgtgtttagag

SEQ ID NO: 146723 - DNA, 27 bp, Artificial Sequence
  Description of Artificial Sequence: Synthetic oligonucleotide
gggcaggaggtcgagctgtgtttagag

SEQ ID NO: 146724 - DNA, 28 bp, Artificial Sequence
  Description of Artificial Sequence: Synthetic oligonucleotide
ggcaggaggtcgagctgtgtttagagtg

SEQ ID NO: 146725 - DNA, 28 bp, Artificial Sequence
  Description of Artificial Sequence: Synthetic oligonucleotide
gcaggaggtcgagctgtgtttagagtgc

SEQ ID NO: 146726 - DNA, 30 bp, Artificial Sequence
  Description of Artificial Sequence: Synthetic oligonucleotide
caggaggtcgagctgtgtttagagtgcatc

SEQ ID NO: 146727 - DNA, 30 bp, Artificial Sequence
  Description of Artificial Sequence: Synthetic oligonucleotide
aggaggtcgagctgtgtttagagtgcatcg

SEQ ID NO: 146728 - DNA, 29 bp, Artificial Sequence
  Description of Artificial Sequence: Synthetic oligonucleotide
ggaggtcgagctgtgtttagagtgcatcg

SEQ ID NO: 146729 - DNA, 32 bp, Artificial Sequence
  Description of Artificial Sequence: Synthetic oligonucleotide
gaggtcgagctgtgtttagagtgcatcgaatg

SEQ ID NO: 146730 - DNA, 32 bp, Artificial Sequence
  Description of Artificial Sequence: Synthetic oligonucleotide
aggtcgagctgtgtttagagtgcatcgaatgg

SEQ ID NO: 146731 - DNA, 31 bp, Artificial Sequence
  Description of Artificial Sequence: Synthetic oligonucleotide
ggtcgagctgtgtttagagtgcatcgaatgg

SEQ ID NO: 146732 - DNA, 31 bp, Artificial Sequence
  Description of Artificial Sequence: Synthetic oligonucleotide
gtcgagctgtgtttagagtgcatcgaatggg

SEQ ID NO: 146733 - DNA, 31 bp, Artificial Sequence
  Description of Artificial Sequence: Synthetic oligonucleotide
tcgagctgtgtttagagtgcatcgaatgggc

SEQ ID NO: 146734 - DNA, 30 bp, Artificial Sequence
  Description of Artificial Sequence: Synthetic oligonucleotide
cgagctgtgtttagagtgcatcgaatgggc

SEQ ID NO: 146735 - DNA, 30 bp, Artificial Sequence
  Description of Artificial Sequence: Synthetic oligonucleotide
gagctgtgtttagagtgcatcgaatgggcc

SEQ ID NO: 146736 - DNA, 32 bp, Artificial Sequence
  Description of Artificial Sequence: Synthetic oligonucleotide
agctgtgtttagagtgcatcgaatgggccaag

SEQ ID NO: 146737 - DNA, 31 bp, Artificial Sequence
  Description of Artificial Sequence: Synthetic oligonucleotide
gctgtgtttagagtgcatcgaatgggccaag

SEQ ID NO: 146738 - DNA, 32 bp, Artificial Sequence
  Description of Artificial Sequence: Synthetic oligonucleotide
ctgtgtttagagtgcatcgaatgggccaagtc

SEQ ID NO: 146739 - DNA, 33 bp, Artificial Sequence
  Description of Artificial Sequence: Synthetic oligonucleotide
tgtgtttagagtgcatcgaatgggccaagtcag

SEQ ID NO: 146740 - DNA, 32 bp, Artificial Sequence
  Description of Artificial Sequence: Synthetic oligonucleotide
gtgtttagagtgcatcgaatgggccaagtcag

SEQ ID NO: 146741 - DNA, 33 bp, Artificial Sequence
  Description of Artificial Sequence: Synthetic oligonucleotide
tgtttagagtgcatcgaatgggccaagtcagag

SEQ ID NO: 146742 - DNA, 32 bp, Artificial Sequence
  Description of Artificial Sequence: Synthetic oligonucleotide
gtttagagtgcatcgaatgggccaagtcagag

SEQ ID NO: 146743 - DNA, 36 bp, Artificial Sequence
  Description of Artificial Sequence: Synthetic oligonucleotide
tttagagtgcatcgaatgggccaagtcagagaaaag

SEQ ID NO: 146744 - DNA, 35 bp, Artificial Sequence
  Description of Artificial Sequence: Synthetic oligonucleotide
ttagagtgcatcgaatgggccaagtcagagaaaag

SEQ ID NO: 146745 - DNA, 34 bp, Artificial Sequence
  Description of Artificial Sequence: Synthetic oligonucleotide
tagagtgcatcgaatgggccaagtcagagaaaag

SEQ ID NO: 146746 - DNA, 33 bp, Artificial Sequence
  Description of Artificial Sequence: Synthetic oligonucleotide
agagtgcatcgaatgggccaagtcagagaaaag

SEQ ID NO: 146747 - DNA, 32 bp, Artificial Sequence
  Description of Artificial Sequence: Synthetic oligonucleotide
gagtgcatcgaatgggccaagtcagagaaaag

SEQ ID NO: 146748 - DNA, 34 bp, Artificial Sequence
  Description of Artificial Sequence: Synthetic oligonucleotide
agtgcatcgaatgggccaagtcagagaaaagaac

SEQ ID NO: 146749 - DNA, 33 bp, Artificial Sequence
  Description of Artificial Sequence: Synthetic oligonucleotide
gtgcatcgaatgggccaagtcagagaaaagaac

SEQ ID NO: 146750 - DNA, 36 bp, Artificial Sequence
  Description of Artificial Sequence: Synthetic oligonucleotide
tgcatcgaatgggccaagtcagagaaaagaactttc

SEQ ID NO: 146751 - DNA, 35 bp, Artificial Sequence
  Description of Artificial Sequence: Synthetic oligonucleotide
gcatcgaatgggccaagtcagagaaaagaactttc

SEQ ID NO: 146752 - DNA, 38 bp, Artificial Sequence
  Description of Artificial Sequence: Synthetic oligonucleotide
catcgaatgggccaagtcagagaaaagaactttcttac

SEQ ID NO: 146753 - DNA, 38 bp, Artificial Sequence
  Description of Artificial Sequence: Synthetic oligonucleotide
atcgaatgggccaagtcagagaaaagaactttcttacg

SEQ ID NO: 146754 - DNA, 37 bp, Artificial Sequence
  Description of Artificial Sequence: Synthetic oligonucleotide
tcgaatgggccaagtcagagaaaagaactttcttacg

SEQ ID NO: 146755 - DNA, 36 bp, Artificial Sequence
  Description of Artificial Sequence: Synthetic oligonucleotide
cgaatgggccaagtcagagaaaagaactttcttacg

SEQ ID NO: 146756 - DNA, 36 bp, Artificial Sequence
  Description of Artificial Sequence: Synthetic oligonucleotide
gaatgggccaagtcagagaaaagaactttcttacgc

SEQ ID NO: 146757 - DNA, 36 bp, Artificial Sequence
  Description of Artificial Sequence: Synthetic oligonucleotide
aatgggccaagtcagagaaaagaactttcttacgcc

SEQ ID NO: 146758 - DNA, 35 bp, Artificial Sequence
  Description of Artificial Sequence: Synthetic oligonucleotide
atgggccaagtcagagaaaagaactttcttacgcc

SEQ ID NO: 146759 - DNA, 34 bp, Artificial Sequence
  Description of Artificial Sequence: Synthetic oligonucleotide
tgggccaagtcagagaaaagaactttcttacgcc

SEQ ID NO: 146760 - DNA, 33 bp, Artificial Sequence
  Description of Artificial Sequence: Synthetic oligonucleotide
gggccaagtcagagaaaagaactttcttacgcc

SEQ ID NO: 146761 - DNA, 35 bp, Artificial Sequence
  Description of Artificial Sequence: Synthetic oligonucleotide
ggccaagtcagagaaaagaactttcttacgccaag

SEQ ID NO: 146762 - DNA, 35 bp, Artificial Sequence
  Description of Artificial Sequence: Synthetic oligonucleotide
gccaagtcagagaaaagaactttcttacgccaagc

SEQ ID NO: 146763 - DNA, 38 bp, Artificial Sequence
  Description of Artificial Sequence: Synthetic oligonucleotide
ccaagtcagagaaaagaactttcttacgccaagctttg

SEQ ID NO: 146764 - DNA, 38 bp, Artificial Sequence
  Description of Artificial Sequence: Synthetic oligonucleotide
caagtcagagaaaagaactttcttacgccaagctttgg

SEQ ID NO: 146765 - DNA, 39 bp, Artificial Sequence
  Description of Artificial Sequence: Synthetic oligonucleotide
aagtcagagaaaagaactttcttacgccaagctttggag

SEQ ID NO: 146766 - DNA, 38 bp, Artificial Sequence
  Description of Artificial Sequence: Synthetic oligonucleotide
agtcagagaaaagaactttcttacgccaagctttggag

SEQ ID NO: 146767 - DNA, 37 bp, Artificial Sequence
  Description of Artificial Sequence: Synthetic oligonucleotide
gtcagagaaaagaactttcttacgccaagctttggag

SEQ ID NO: 146768 - DNA, 37 bp, Artificial Sequence
  Description of Artificial Sequence: Synthetic oligonucleotide
tcagagaaaagaactttcttacgccaagctttggagg

SEQ ID NO: 146769 - DNA, 36 bp, Artificial Sequence
  Description of Artificial Sequence: Synthetic oligonucleotide
cagagaaaagaactttcttacgccaagctttggagg

SEQ ID NO: 146770 - DNA, 36 bp, Artificial Sequence
  Description of Artificial Sequence: Synthetic oligonucleotide
agagaaaagaactttcttacgccaagctttggaggc

SEQ ID NO: 146771 - DNA, 35 bp, Artificial Sequence
  Description of Artificial Sequence: Synthetic oligonucleotide
gagaaaagaactttcttacgccaagctttggaggc

SEQ ID NO: 146772 - DNA, 37 bp, Artificial Sequence
  Description of Artificial Sequence: Synthetic oligonucleotide
agaaaagaactttcttacgccaagctttggaggcaag

SEQ ID NO: 146773 - DNA, 36 bp, Artificial Sequence
  Description of Artificial Sequence: Synthetic oligonucleotide
gaaaagaactttcttacgccaagctttggaggcaag

SEQ ID NO: 146774 - DNA, 37 bp, Artificial Sequence
  Description of Artificial Sequence: Synthetic oligonucleotide
aaaagaactttcttacgccaagctttggaggcaagac

SEQ ID NO: 146775 - DNA, 36 bp, Artificial Sequence
  Description of Artificial Sequence: Synthetic oligonucleotide
aaagaactttcttacgccaagctttggaggcaagac

SEQ ID NO: 146776 - DNA, 35 bp, Artificial Sequence
  Description of Artificial Sequence: Synthetic oligonucleotide
aagaactttcttacgccaagctttggaggcaagac

SEQ ID NO: 146777 - DNA, 34 bp, Artificial Sequence
  Description of Artificial Sequence: Synthetic oligonucleotide
agaactttcttacgccaagctttggaggcaagac

SEQ ID NO: 146778 - DNA, 33 bp, Artificial Sequence
  Description of Artificial Sequence: Synthetic oligonucleotide
gaactttcttacgccaagctttggaggcaagac

SEQ ID NO: 146779 - DNA, 34 bp, Artificial Sequence
  Description of Artificial Sequence: Synthetic oligonucleotide
aactttcttacgccaagctttggaggcaagactg

SEQ ID NO: 146780 - DNA, 33 bp, Artificial Sequence
  Description of Artificial Sequence: Synthetic oligonucleotide
actttcttacgccaagctttggaggcaagactg

SEQ ID NO: 146781 - DNA, 32 bp, Artificial Sequence
  Description of Artificial Sequence: Synthetic oligonucleotide
ctttcttacgccaagctttggaggcaagactg

SEQ ID NO: 146782 - DNA, 32 bp, Artificial Sequence
  Description of Artificial Sequence: Synthetic oligonucleotide
tttcttacgccaagctttggaggcaagactgg

SEQ ID NO: 146783 - DNA, 31 bp, Artificial Sequence
  Description of Artificial Sequence: Synthetic oligonucleotide
ttcttacgccaagctttggaggcaagactgg

SEQ ID NO: 146784 - DNA, 30 bp, Artificial Sequence
  Description of Artificial Sequence: Synthetic oligonucleotide
tcttacgccaagctttggaggcaagactgg

SEQ ID NO: 146785 - DNA, 29 bp, Artificial Sequence
  Description of Artificial Sequence: Synthetic oligonucleotide
cttacgccaagctttggaggcaagactgg

SEQ ID NO: 146786 - DNA, 30 bp, Artificial Sequence
  Description of Artificial Sequence: Synthetic oligonucleotide
ttacgccaagctttggaggcaagactggtg

SEQ ID NO: 146787 - DNA, 29 bp, Artificial Sequence
  Description of Artificial Sequence: Synthetic oligonucleotide
tacgccaagctttggaggcaagactggtg

SEQ ID NO: 146788 - DNA, 28 bp, Artificial Sequence
  Description of Artificial Sequence: Synthetic oligonucleotide
acgccaagctttggaggcaagactggtg

SEQ ID NO: 146789 - DNA, 27 bp, Artificial Sequence
  Description of Artificial Sequence: Synthetic oligonucleotide
cgccaagctttggaggcaagactggtg

SEQ ID NO: 146790 - DNA, 28 bp, Artificial Sequence
  Description of Artificial Sequence: Synthetic oligonucleotide
gccaagctttggaggcaagactggtgtc

SEQ ID NO: 146791 - DNA, 31 bp, Artificial Sequence
  Description of Artificial Sequence: Synthetic oligonucleotide
ccaagctttggaggcaagactggtgtctttg

SEQ ID NO: 146792 - DNA, 33 bp, Artificial Sequence
  Description of Artificial Sequence: Synthetic oligonucleotide
caagctttggaggcaagactggtgtctttgtac

SEQ ID NO: 146793 - DNA, 36 bp, Artificial Sequence
  Description of Artificial Sequence: Synthetic oligonucleotide
aagctttggaggcaagactggtgtctttgtactttg

SEQ ID NO: 146794 - DNA, 35 bp, Artificial Sequence
  Description of Artificial Sequence: Synthetic oligonucleotide
agctttggaggcaagactggtgtctttgtactttg

SEQ ID NO: 146795 - DNA, 34 bp, Artificial Sequence
  Description of Artificial Sequence: Synthetic oligonucleotide
gctttggaggcaagactggtgtctttgtactttg

SEQ ID NO: 146796 - DNA, 37 bp, Artificial Sequence
  Description of Artificial Sequence: Synthetic oligonucleotide
ctttggaggcaagactggtgtctttgtactttgatac

SEQ ID NO: 146797 - DNA, 37 bp, Artificial Sequence
  Description of Artificial Sequence: Synthetic oligonucleotide
tttggaggcaagactggtgtctttgtactttgatacc

SEQ ID NO: 146798 - DNA, 36 bp, Artificial Sequence
  Description of Artificial Sequence: Synthetic oligonucleotide
ttggaggcaagactggtgtctttgtactttgatacc

SEQ ID NO: 146799 - DNA, 35 bp, Artificial Sequence
  Description of Artificial Sequence: Synthetic oligonucleotide
tggaggcaagactggtgtctttgtactttgatacc

SEQ ID NO: 146800 - DNA, 34 bp, Artificial Sequence
  Description of Artificial Sequence: Synthetic oligonucleotide
ggaggcaagactggtgtctttgtactttgatacc

SEQ ID NO: 146801 - DNA, 36 bp, Artificial Sequence
  Description of Artificial Sequence: Synthetic oligonucleotide
gaggcaagactggtgtctttgtactttgataccaag

SEQ ID NO: 146802 - DNA, 37 bp, Artificial Sequence
  Description of Artificial Sequence: Synthetic oligonucleotide
aggcaagactggtgtctttgtactttgataccaagag

SEQ ID NO: 146803 - DNA, 36 bp, Artificial Sequence
  Description of Artificial Sequence: Synthetic oligonucleotide
ggcaagactggtgtctttgtactttgataccaagag

SEQ ID NO: 146804 - DNA, 36 bp, Artificial Sequence
  Description of Artificial Sequence: Synthetic oligonucleotide
gcaagactggtgtctttgtactttgataccaagagg

SEQ ID NO: 146805 - DNA, 38 bp, Artificial Sequence
  Description of Artificial Sequence: Synthetic oligonucleotide
caagactggtgtctttgtactttgataccaagaggtac

SEQ ID NO: 146806 - DNA, 38 bp, Artificial Sequence
  Description of Artificial Sequence: Synthetic oligonucleotide
aagactggtgtctttgtactttgataccaagaggtacc

SEQ ID NO: 146807 - DNA, 37 bp, Artificial Sequence
  Description of Artificial Sequence: Synthetic oligonucleotide
agactggtgtctttgtactttgataccaagaggtacc

SEQ ID NO: 146808 - DNA, 36 bp, Artificial Sequence
  Description of Artificial Sequence: Synthetic oligonucleotide
gactggtgtctttgtactttgataccaagaggtacc

SEQ ID NO: 146809 - DNA, 37 bp, Artificial Sequence
  Description of Artificial Sequence: Synthetic oligonucleotide
actggtgtctttgtactttgataccaagaggtaccag

SEQ ID NO: 146810 - DNA, 36 bp, Artificial Sequence
  Description of Artificial Sequence: Synthetic oligonucleotide
ctggtgtctttgtactttgataccaagaggtaccag

SEQ ID NO: 146811 - DNA, 36 bp, Artificial Sequence
  Description of Artificial Sequence: Synthetic oligonucleotide
tggtgtctttgtactttgataccaagaggtaccagg

SEQ ID NO: 146812 - DNA, 35 bp, Artificial Sequence
  Description of Artificial Sequence: Synthetic oligonucleotide
ggtgtctttgtactttgataccaagaggtaccagg

SEQ ID NO: 146813 - DNA, 37 bp, Artificial Sequence
  Description of Artificial Sequence: Synthetic oligonucleotide
gtgtctttgtactttgataccaagaggtaccaggaag

SEQ ID NO: 146814 - DNA, 37 bp, Artificial Sequence
  Description of Artificial Sequence: Synthetic oligonucleotide
tgtctttgtactttgataccaagaggtaccaggaagc

SEQ ID NO: 146815 - DNA, 36 bp, Artificial Sequence
  Description of Artificial Sequence: Synthetic oligonucleotide
gtctttgtactttgataccaagaggtaccaggaagc

SEQ ID NO: 146816 - DNA, 39 bp, Artificial Sequence
  Description of Artificial Sequence: Synthetic oligonucleotide
tctttgtactttgataccaagaggtaccaggaagcattg

SEQ ID NO: 146817 - DNA, 38 bp, Artificial Sequence
  Description of Artificial Sequence: Synthetic oligonucleotide
ctttgtactttgataccaagaggtaccaggaagcattg

SEQ ID NO: 146818 - DNA, 38 bp, Artificial Sequence
  Description of Artificial Sequence: Synthetic oligonucleotide
tttgtactttgataccaagaggtaccaggaagcattgc

SEQ ID NO: 146819 - DNA, 37 bp, Artificial Sequence
  Description of Artificial Sequence: Synthetic oligonucleotide
ttgtactttgataccaagaggtaccaggaagcattgc

SEQ ID NO: 146820 - DNA, 36 bp, Artificial Sequence
  Description of Artificial Sequence: Synthetic oligonucleotide
tgtactttgataccaagaggtaccaggaagcattgc

SEQ ID NO: 146821 - DNA, 35 bp, Artificial Sequence
  Description of Artificial Sequence: Synthetic oligonucleotide
gtactttgataccaagaggtaccaggaagcattgc

SEQ ID NO: 146822 - DNA, 39 bp, Artificial Sequence
  Description of Artificial Sequence: Synthetic oligonucleotide
tactttgataccaagaggtaccaggaagcattgcatttg

SEQ ID NO: 146823 - DNA, 38 bp, Artificial Sequence
  Description of Artificial Sequence: Synthetic oligonucleotide
actttgataccaagaggtaccaggaagcattgcatttg

SEQ ID NO: 146824 - DNA, 37 bp, Artificial Sequence
  Description of Artificial Sequence: Synthetic oligonucleotide
ctttgataccaagaggtaccaggaagcattgcatttg

SEQ ID NO: 146825 - DNA, 37 bp, Artificial Sequence
  Description of Artificial Sequence: Synthetic oligonucleotide
tttgataccaagaggtaccaggaagcattgcatttgg

SEQ ID NO: 146826 - DNA, 36 bp, Artificial Sequence
  Description of Artificial Sequence: Synthetic oligonucleotide
ttgataccaagaggtaccaggaagcattgcatttgg

SEQ ID NO: 146827 - DNA, 35 bp, Artificial Sequence
  Description of Artificial Sequence: Synthetic oligonucleotide
tgataccaagaggtaccaggaagcattgcatttgg

SEQ ID NO: 146828 - DNA, 34 bp, Artificial Sequence
  Description of Artificial Sequence: Synthetic oligonucleotide
gataccaagaggtaccaggaagcattgcatttgg

SEQ ID NO: 146829 - DNA, 34 bp, Artificial Sequence
  Description of Artificial Sequence: Synthetic oligonucleotide
ataccaagaggtaccaggaagcattgcatttggg

SEQ ID NO: 146830 - DNA, 33 bp, Artificial Sequence
  Description of Artificial Sequence: Synthetic oligonucleotide
taccaagaggtaccaggaagcattgcatttggg

SEQ ID NO: 146831 - DNA, 32 bp, Artificial Sequence
  Description of Artificial Sequence: Synthetic oligonucleotide
accaagaggtaccaggaagcattgcatttggg

SEQ ID NO: 146832 - DNA, 31 bp, Artificial Sequence
  Description of Artificial Sequence: Synthetic oligonucleotide
ccaagaggtaccaggaagcattgcatttggg

SEQ ID NO: 146833 - DNA, 33 bp, Artificial Sequence
  Description of Artificial Sequence: Synthetic oligonucleotide
caagaggtaccaggaagcattgcatttgggttc

SEQ ID NO: 146834 - DNA, 34 bp, Artificial Sequence
  Description of Artificial Sequence: Synthetic oligonucleotide
aagaggtaccaggaagcattgcatttgggttctc

SEQ ID NO: 146835 - DNA, 33 bp, Artificial Sequence
  Description of Artificial Sequence: Synthetic oligonucleotide
agaggtaccaggaagcattgcatttgggttctc

SEQ ID NO: 146836 - DNA, 32 bp, Artificial Sequence
  Description of Artificial Sequence: Synthetic oligonucleotide
gaggtaccaggaagcattgcatttgggttctc

SEQ ID NO: 146837 - DNA, 33 bp, Artificial Sequence
  Description of Artificial Sequence: Synthetic oligonucleotide
aggtaccaggaagcattgcatttgggttctcag

SEQ ID NO: 146838 - DNA, 32 bp, Artificial Sequence
  Description of Artificial Sequence: Synthetic oligonucleotide
ggtaccaggaagcattgcatttgggttctcag

SEQ ID NO: 146839 - DNA, 32 bp, Artificial Sequence
  Description of Artificial Sequence: Synthetic oligonucleotide
gtaccaggaagcattgcatttgggttctcagc

SEQ ID NO: 146840 - DNA, 33 bp, Artificial Sequence
  Description of Artificial Sequence: Synthetic oligonucleotide
taccaggaagcattgcatttgggttctcagctg

SEQ ID NO: 146841 - DNA, 32 bp, Artificial Sequence
  Description of Artificial Sequence: Synthetic oligonucleotide
accaggaagcattgcatttgggttctcagctg

SEQ ID NO: 146842 - DNA, 31 bp, Artificial Sequence
  Description of Artificial Sequence: Synthetic oligonucleotide
ccaggaagcattgcatttgggttctcagctg

SEQ ID NO: 146843 - DNA, 31 bp, Artificial Sequence
  Description of Artificial Sequence: Synthetic oligonucleotide
caggaagcattgcatttgggttctcagctgc

SEQ ID NO: 146844 - DNA, 32 bp, Artificial Sequence
  Description of Artificial Sequence: Synthetic oligonucleotide
aggaagcattgcatttgggttctcagctgctg

SEQ ID NO: 146845 - DNA, 31 bp, Artificial Sequence
  Description of Artificial Sequence: Synthetic oligonucleotide
ggaagcattgcatttgggttctcagctgctg

SEQ ID NO: 146846 - DNA, 31 bp, Artificial Sequence
  Description of Artificial Sequence: Synthetic oligonucleotide
gaagcattgcatttgggttctcagctgctgc

SEQ ID NO: 146847 - DNA, 31 bp, Artificial Sequence
  Description of Artificial Sequence: Synthetic oligonucleotide
aagcattgcatttgggttctcagctgctgcg

SEQ ID NO: 146848 - DNA, 30 bp, Artificial Sequence
  Description of Artificial Sequence: Synthetic oligonucleotide
agcattgcatttgggttctcagctgctgcg

SEQ ID NO: 146849 - DNA, 29 bp, Artificial Sequence
  Description of Artificial Sequence: Synthetic oligonucleotide
gcattgcatttgggttctcagctgctgcg

SEQ ID NO: 146850 - DNA, 29 bp, Artificial Sequence
  Description of Artificial Sequence: Synthetic oligonucleotide
cattgcatttgggttctcagctgctgcgg

SEQ ID NO: 146851 - DNA, 29 bp, Artificial Sequence
  Description of Artificial Sequence: Synthetic oligonucleotide
attgcatttgggttctcagctgctgcggg

SEQ ID NO: 146852 - DNA, 28 bp, Artificial Sequence
  Description of Artificial Sequence: Synthetic oligonucleotide
ttgcatttgggttctcagctgctgcggg

SEQ ID NO: 146853 - DNA, 27 bp, Artificial Sequence
  Description of Artificial Sequence: Synthetic oligonucleotide
tgcatttgggttctcagctgctgcggg

SEQ ID NO: 146854 - DNA, 27 bp, Artificial Sequence
  Description of Artificial Sequence: Synthetic oligonucleotide
gcatttgggttctcagctgctgcggga

SEQ ID NO: 146855 - DNA, 27 bp, Artificial Sequence
  Description of Artificial Sequence: Synthetic oligonucleotide
catttgggttctcagctgctgcgggag

SEQ ID NO: 146856 - DNA, 29 bp, Artificial Sequence
  Description of Artificial Sequence: Synthetic oligonucleotide
atttgggttctcagctgctgcgggagttg

SEQ ID NO: 146857 - DNA, 28 bp, Artificial Sequence
  Description of Artificial Sequence: Synthetic oligonucleotide
tttgggttctcagctgctgcgggagttg

SEQ ID NO: 146858 - DNA, 27 bp, Artificial Sequence
  Description of Artificial Sequence: Synthetic oligonucleotide
ttgggttctcagctgctgcgggagttg

SEQ ID NO: 146859 - DNA, 27 bp, Artificial Sequence
  Description of Artificial Sequence: Synthetic oligonucleotide
tgggttctcagctgctgcgggagttga

SEQ ID NO: 146860 - DNA, 27 bp, Artificial Sequence
  Description of Artificial Sequence: Synthetic oligonucleotide
gggttctcagctgctgcgggagttgaa

SEQ ID NO: 146861 - DNA, 30 bp, Artificial Sequence
  Description of Artificial Sequence: Synthetic oligonucleotide
ggttctcagctgctgcgggagttgaaaaag

SEQ ID NO: 146862 - DNA, 32 bp, Artificial Sequence
  Description of Artificial Sequence: Synthetic oligonucleotide
gttctcagctgctgcgggagttgaaaaagatg

SEQ ID NO: 146863 - DNA, 32 bp, Artificial Sequence
  Description of Artificial Sequence: Synthetic oligonucleotide
ttctcagctgctgcgggagttgaaaaagatgg

SEQ ID NO: 146864 - DNA, 31 bp, Artificial Sequence
  Description of Artificial Sequence: Synthetic oligonucleotide
tctcagctgctgcgggagttgaaaaagatgg

SEQ ID NO: 146865 - DNA, 30 bp, Artificial Sequence
  Description of Artificial Sequence: Synthetic oligonucleotide
ctcagctgctgcgggagttgaaaaagatgg

SEQ ID NO: 146866 - DNA, 31 bp, Artificial Sequence
  Description of Artificial Sequence: Synthetic oligonucleotide
tcagctgctgcgggagttgaaaaagatggac

SEQ ID NO: 146867 - DNA, 30 bp, Artificial Sequence
  Description of Artificial Sequence: Synthetic oligonucleotide
cagctgctgcgggagttgaaaaagatggac

SEQ ID NO: 146868 - DNA, 30 bp, Artificial Sequence
  Description of Artificial Sequence: Synthetic oligonucleotide
agctgctgcgggagttgaaaaagatggacg

SEQ ID NO: 146869 - DNA, 29 bp, Artificial Sequence
  Description of Artificial Sequence: Synthetic oligonucleotide
gctgctgcgggagttgaaaaagatggacg

SEQ ID NO: 146870 - DNA, 30 bp, Artificial Sequence
  Description of Artificial Sequence: Synthetic oligonucleotide
ctgctgcgggagttgaaaaagatggacgac

SEQ ID NO: 146871 - DNA, 33 bp, Artificial Sequence
  Description of Artificial Sequence: Synthetic oligonucleotide
tgctgcgggagttgaaaaagatggacgacaaag

SEQ ID NO: 146872 - DNA, 32 bp, Artificial Sequence
  Description of Artificial Sequence: Synthetic oligonucleotide
gctgcgggagttgaaaaagatggacgacaaag

SEQ ID NO: 146873 - DNA, 32 bp, Artificial Sequence
  Description of Artificial Sequence: Synthetic oligonucleotide
ctgcgggagttgaaaaagatggacgacaaagc

SEQ ID NO: 146874 - DNA, 33 bp, Artificial Sequence
  Description of Artificial Sequence: Synthetic oligonucleotide
tgcgggagttgaaaaagatggacgacaaagctc

SEQ ID NO: 146875 - DNA, 32 bp, Artificial Sequence
  Description of Artificial Sequence: Synthetic oligonucleotide
gcgggagttgaaaaagatggacgacaaagctc

SEQ ID NO: 146876 - DNA, 36 bp, Artificial Sequence
  Description of Artificial Sequence: Synthetic oligonucleotide
cgggagttgaaaaagatggacgacaaagctcttttg

SEQ ID NO: 146877 - DNA, 36 bp, Artificial Sequence
  Description of Artificial Sequence: Synthetic oligonucleotide
gggagttgaaaaagatggacgacaaagctcttttgg

SEQ ID NO: 146878 - DNA, 37 bp, Artificial Sequence
  Description of Artificial Sequence: Synthetic oligonucleotide
ggagttgaaaaagatggacgacaaagctcttttggtg

SEQ ID NO: 146879 - DNA, 37 bp, Artificial Sequence
  Description of Artificial Sequence: Synthetic oligonucleotide
gagttgaaaaagatggacgacaaagctcttttggtgg

SEQ ID NO: 146880 - DNA, 39 bp, Artificial Sequence
  Description of Artificial Sequence: Synthetic oligonucleotide
agttgaaaaagatggacgacaaagctcttttggtggaag

SEQ ID NO: 146881 - DNA, 38 bp, Artificial Sequence
  Description of Artificial Sequence: Synthetic oligonucleotide
gttgaaaaagatggacgacaaagctcttttggtggaag

SEQ ID NO: 146882 - DNA, 40 bp, Artificial Sequence
  Description of Artificial Sequence: Synthetic oligonucleotide
ttgaaaaagatggacgacaaagctcttttggtggaagtac

SEQ ID NO: 146883 - DNA, 39 bp, Artificial Sequence
  Description of Artificial Sequence: Synthetic oligonucleotide
tgaaaaagatggacgacaaagctcttttggtggaagtac

SEQ ID NO: 146884 - DNA, 38 bp, Artificial Sequence
  Description of Artificial Sequence: Synthetic oligonucleotide
gaaaaagatggacgacaaagctcttttggtggaagtac

SEQ ID NO: 146885 - DNA, 39 bp, Artificial Sequence
  Description of Artificial Sequence: Synthetic oligonucleotide
aaaaagatggacgacaaagctcttttggtggaagtacag

SEQ ID NO: 146886 - DNA, 38 bp, Artificial Sequence
  Description of Artificial Sequence: Synthetic oligonucleotide
aaaagatggacgacaaagctcttttggtggaagtacag

SEQ ID NO: 146887 - DNA, 37 bp, Artificial Sequence
  Description of Artificial Sequence: Synthetic oligonucleotide
aaagatggacgacaaagctcttttggtggaagtacag

SEQ ID NO: 146888 - DNA, 36 bp, Artificial Sequence
  Description of Artificial Sequence: Synthetic oligonucleotide
aagatggacgacaaagctcttttggtggaagtacag

SEQ ID NO: 146889 - DNA, 35 bp, Artificial Sequence
  Description of Artificial Sequence: Synthetic oligonucleotide
agatggacgacaaagctcttttggtggaagtacag

SEQ ID NO: 146890 - DNA, 34 bp, Artificial Sequence
  Description of Artificial Sequence: Synthetic oligonucleotide
gatggacgacaaagctcttttggtggaagtacag

SEQ ID NO: 146891 - DNA, 34 bp, Artificial Sequence
  Description of Artificial Sequence: Synthetic oligonucleotide
atggacgacaaagctcttttggtggaagtacagc

SEQ ID NO: 146892 - DNA, 33 bp, Artificial Sequence
  Description of Artificial Sequence: Synthetic oligonucleotide
tggacgacaaagctcttttggtggaagtacagc

SEQ ID NO: 146893 - DNA, 32 bp, Artificial Sequence
  Description of Artificial Sequence: Synthetic oligonucleotide
ggacgacaaagctcttttggtggaagtacagc

SEQ ID NO: 146894 - DNA, 37 bp, Artificial Sequence
  Description of Artificial Sequence: Synthetic oligonucleotide
gacgacaaagctcttttggtggaagtacagcttttag

SEQ ID NO: 146895 - DNA, 40 bp, Artificial Sequence
  Description of Artificial Sequence: Synthetic oligonucleotide
acgacaaagctcttttggtggaagtacagcttttagaaag

SEQ ID NO: 146896 - DNA, 39 bp, Artificial Sequence
  Description of Artificial Sequence: Synthetic oligonucleotide
cgacaaagctcttttggtggaagtacagcttttagaaag

SEQ ID NO: 146897 - DNA, 39 bp, Artificial Sequence
  Description of Artificial Sequence: Synthetic oligonucleotide
gacaaagctcttttggtggaagtacagcttttagaaagc

SEQ ID NO: 146898 - DNA, 43 bp, Artificial Sequence
  Description of Artificial Sequence: Synthetic oligonucleotide
acaaagctcttttggtggaagtacagcttttagaaagcaaaac

SEQ ID NO: 146899 - DNA, 42 bp, Artificial Sequence
  Description of Artificial Sequence: Synthetic oligonucleotide
caaagctcttttggtggaagtacagcttttagaaagcaaaac

SEQ ID NO: 146900 - DNA, 45 bp, Artificial Sequence
  Description of Artificial Sequence: Synthetic oligonucleotide
aaagctcttttggtggaagtacagcttttagaaagcaaaacatac

SEQ ID NO: 146901 - DNA, 44 bp, Artificial Sequence
  Description of Artificial Sequence: Synthetic oligonucleotide
aagctcttttggtggaagtacagcttttagaaagcaaaacatac

SEQ ID NO: 146902 - DNA, 43 bp, Artificial Sequence
  Description of Artificial Sequence: Synthetic oligonucleotide
agctcttttggtggaagtacagcttttagaaagcaaaacatac

SEQ ID NO: 146903 - DNA, 42 bp, Artificial Sequence
  Description of Artificial Sequence: Synthetic oligonucleotide
gctcttttggtggaagtacagcttttagaaagcaaaacatac

SEQ ID NO: 146904 - DNA, 42 bp, Artificial Sequence
  Description of Artificial Sequence: Synthetic oligonucleotide
ctcttttggtggaagtacagcttttagaaagcaaaacatacc

SEQ ID NO: 146905 - DNA, 44 bp, Artificial Sequence
  Description of Artificial Sequence: Synthetic oligonucleotide
tcttttggtggaagtacagcttttagaaagcaaaacataccatg

SEQ ID NO: 146906 - DNA, 43 bp, Artificial Sequence
  Description of Artificial Sequence: Synthetic oligonucleotide
cttttggtggaagtacagcttttagaaagcaaaacataccatg

SEQ ID NO: 146907 - DNA, 43 bp, Artificial Sequence
  Description of Artificial Sequence: Synthetic oligonucleotide
ttttggtggaagtacagcttttagaaagcaaaacataccatgc

SEQ ID NO: 146908 - DNA, 42 bp, Artificial Sequence
  Description of Artificial Sequence: Synthetic oligonucleotide
tttggtggaagtacagcttttagaaagcaaaacataccatgc

SEQ ID NO: 146909 - DNA, 41 bp, Artificial Sequence
  Description of Artificial Sequence: Synthetic oligonucleotide
ttggtggaagtacagcttttagaaagcaaaacataccatgc

SEQ ID NO: 146910 - DNA, 40 bp, Artificial Sequence
  Description of Artificial Sequence: Synthetic oligonucleotide
tggtggaagtacagcttttagaaagcaaaacataccatgc

SEQ ID NO: 146911 - DNA, 39 bp, Artificial Sequence
  Description of Artificial Sequence: Synthetic oligonucleotide
ggtggaagtacagcttttagaaagcaaaacataccatgc

SEQ ID NO: 146912 - DNA, 39 bp, Artificial Sequence
  Description of Artificial Sequence: Synthetic oligonucleotide
gtggaagtacagcttttagaaagcaaaacataccatgcc

SEQ ID NO: 146913 - DNA, 39 bp, Artificial Sequence
  Description of Artificial Sequence: Synthetic oligonucleotide
tggaagtacagcttttagaaagcaaaacataccatgccc

SEQ ID NO: 146914 - DNA, 38 bp, Artificial Sequence
  Description of Artificial Sequence: Synthetic oligonucleotide
ggaagtacagcttttagaaagcaaaacataccatgccc

SEQ ID NO: 146915 - DNA, 39 bp, Artificial Sequence
  Description of Artificial Sequence: Synthetic oligonucleotide
gaagtacagcttttagaaagcaaaacataccatgccctg

SEQ ID NO: 146916 - DNA, 40 bp, Artificial Sequence
  Description of Artificial Sequence: Synthetic oligonucleotide
aagtacagcttttagaaagcaaaacataccatgccctgag

SEQ ID NO: 146917 - DNA, 39 bp, Artificial Sequence
  Description of Artificial Sequence: Synthetic oligonucleotide
agtacagcttttagaaagcaaaacataccatgccctgag

SEQ ID NO: 146918 - DNA, 38 bp, Artificial Sequence
  Description of Artificial Sequence: Synthetic oligonucleotide
gtacagcttttagaaagcaaaacataccatgccctgag

SEQ ID NO: 146919 - DNA, 38 bp, Artificial Sequence
  Description of Artificial Sequence: Synthetic oligonucleotide
tacagcttttagaaagcaaaacataccatgccctgagc

SEQ ID NO: 146920 - DNA, 37 bp, Artificial Sequence
  Description of Artificial Sequence: Synthetic oligonucleotide
acagcttttagaaagcaaaacataccatgccctgagc

SEQ ID NO: 146921 - DNA, 36 bp, Artificial Sequence
  Description of Artificial Sequence: Synthetic oligonucleotide
cagcttttagaaagcaaaacataccatgccctgagc

SEQ ID NO: 146922 - DNA, 38 bp, Artificial Sequence
  Description of Artificial Sequence: Synthetic oligonucleotide
agcttttagaaagcaaaacataccatgccctgagcaac

SEQ ID NO: 146923 - DNA, 37 bp, Artificial Sequence
  Description of Artificial Sequence: Synthetic oligonucleotide
gcttttagaaagcaaaacataccatgccctgagcaac

SEQ ID NO: 146924 - DNA, 37 bp, Artificial Sequence
  Description of Artificial Sequence: Synthetic oligonucleotide
cttttagaaagcaaaacataccatgccctgagcaacc

SEQ ID NO: 146925 - DNA, 38 bp, Artificial Sequence
  Description of Artificial Sequence: Synthetic oligonucleotide
ttttagaaagcaaaacataccatgccctgagcaacctg

SEQ ID NO: 146926 - DNA, 37 bp, Artificial Sequence
  Description of Artificial Sequence: Synthetic oligonucleotide
tttagaaagcaaaacataccatgccctgagcaacctg

SEQ ID NO: 146927 - DNA, 36 bp, Artificial Sequence
  Description of Artificial Sequence: Synthetic oligonucleotide
ttagaaagcaaaacataccatgccctgagcaacctg

SEQ ID NO: 146928 - DNA, 35 bp, Artificial Sequence
  Description of Artificial Sequence: Synthetic oligonucleotide
tagaaagcaaaacataccatgccctgagcaacctg

SEQ ID NO: 146929 - DNA, 34 bp, Artificial Sequence
  Description of Artificial Sequence: Synthetic oligonucleotide
agaaagcaaaacataccatgccctgagcaacctg

SEQ ID NO: 146930 - DNA, 33 bp, Artificial Sequence
  Description of Artificial Sequence: Synthetic oligonucleotide
gaaagcaaaacataccatgccctgagcaacctg

SEQ ID NO: 146931 - DNA, 33 bp, Artificial Sequence
  Description of Artificial Sequence: Synthetic oligonucleotide
aaagcaaaacataccatgccctgagcaacctgc

SEQ ID NO: 146932 - DNA, 32 bp, Artificial Sequence
  Description of Artificial Sequence: Synthetic oligonucleotide
aagcaaaacataccatgccctgagcaacctgc

SEQ ID NO: 146933 - DNA, 31 bp, Artificial Sequence
  Description of Artificial Sequence: Synthetic oligonucleotide
agcaaaacataccatgccctgagcaacctgc

SEQ ID NO: 146934 - DNA, 30 bp, Artificial Sequence
  Description of Artificial Sequence: Synthetic oligonucleotide
gcaaaacataccatgccctgagcaacctgc

SEQ ID NO: 146935 - DNA, 30 bp, Artificial Sequence
  Description of Artificial Sequence: Synthetic oligonucleotide
caaaacataccatgccctgagcaacctgcc

SEQ ID NO: 146936 - DNA, 30 bp, Artificial Sequence
  Description of Artificial Sequence: Synthetic oligonucleotide
aaaacataccatgccctgagcaacctgccg

SEQ ID NO: 146937 - DNA, 29 bp, Artificial Sequence
  Description of Artificial Sequence: Synthetic oligonucleotide
aaacataccatgccctgagcaacctgccg

SEQ ID NO: 146938 - DNA, 28 bp, Artificial Sequence
  Description of Artificial Sequence: Synthetic oligonucleotide
aacataccatgccctgagcaacctgccg

SEQ ID NO: 146939 - DNA, 27 bp, Artificial Sequence
  Description of Artificial Sequence: Synthetic oligonucleotide
acataccatgccctgagcaacctgccg

SEQ ID NO: 146940 - DNA, 27 bp, Artificial Sequence
  Description of Artificial Sequence: Synthetic oligonucleotide
cataccatgccctgagcaacctgccga

SEQ ID NO: 146941 - DNA, 29 bp, Artificial Sequence
  Description of Artificial Sequence: Synthetic oligonucleotide
ataccatgccctgagcaacctgccgaaag

SEQ ID NO: 146942 - DNA, 28 bp, Artificial Sequence
  Description of Artificial Sequence: Synthetic oligonucleotide
taccatgccctgagcaacctgccgaaag

SEQ ID NO: 146943 - DNA, 27 bp, Artificial Sequence
  Description of Artificial Sequence: Synthetic oligonucleotide
accatgccctgagcaacctgccgaaag

SEQ ID NO: 146944 - DNA, 26 bp, Artificial Sequence
  Description of Artificial Sequence: Synthetic oligonucleotide
ccatgccctgagcaacctgccgaaag

SEQ ID NO: 146945 - DNA, 26 bp, Artificial Sequence
  Description of Artificial Sequence: Synthetic oligonucleotide
catgccctgagcaacctgccgaaagc

SEQ ID NO: 146946 - DNA, 26 bp, Artificial Sequence
  Description of Artificial Sequence: Synthetic oligonucleotide
atgccctgagcaacctgccgaaagcc

SEQ ID NO: 146947 - DNA, 25 bp, Artificial Sequence
  Description of Artificial Sequence: Synthetic oligonucleotide
tgccctgagcaacctgccgaaagcc

SEQ ID NO: 146948 - DNA, 24 bp, Artificial Sequence
  Description of Artificial Sequence: Synthetic oligonucleotide
gccctgagcaacctgccgaaagcc

SEQ ID NO: 146949 - DNA, 24 bp, Artificial Sequence
  Description of Artificial Sequence: Synthetic oligonucleotide
ccctgagcaacctgccgaaagccc

SEQ ID NO: 146950 - DNA, 25 bp, Artificial Sequence
  Description of Artificial Sequence: Synthetic oligonucleotide
cctgagcaacctgccgaaagcccga

SEQ ID NO: 146951 - DNA, 25 bp, Artificial Sequence
  Description of Artificial Sequence: Synthetic oligonucleotide
ctgagcaacctgccgaaagcccgag

SEQ ID NO: 146952 - DNA, 26 bp, Artificial Sequence
  Description of Artificial Sequence: Synthetic oligonucleotide
tgagcaacctgccgaaagcccgagct

SEQ ID NO: 146953 - DNA, 25 bp, Artificial Sequence
  Description of Artificial Sequence: Synthetic oligonucleotide
gagcaacctgccgaaagcccgagct

SEQ ID NO: 146954 - DNA, 25 bp, Artificial Sequence
  Description of Artificial Sequence: Synthetic oligonucleotide
agcaacctgccgaaagcccgagctg

SEQ ID NO: 146955 - DNA, 24 bp, Artificial Sequence
  Description of Artificial Sequence: Synthetic oligonucleotide
gcaacctgccgaaagcccgagctg

SEQ ID NO: 146956 - DNA, 24 bp, Artificial Sequence
  Description of Artificial Sequence: Synthetic oligonucleotide
caacctgccgaaagcccgagctgc

SEQ ID NO: 146957 - DNA, 27 bp, Artificial Sequence
  Description of Artificial Sequence: Synthetic oligonucleotide
aacctgccgaaagcccgagctgcctta

SEQ ID NO: 146958 - DNA, 27 bp, Artificial Sequence
  Description of Artificial Sequence: Synthetic oligonucleotide
acctgccgaaagcccgagctgccttaa

SEQ ID NO: 146959 - DNA, 26 bp, Artificial Sequence
  Description of Artificial Sequence: Synthetic oligonucleotide
cctgccgaaagcccgagctgccttaa

SEQ ID NO: 146960 - DNA, 27 bp, Artificial Sequence
  Description of Artificial Sequence: Synthetic oligonucleotide
ctgccgaaagcccgagctgccttaact

SEQ ID NO: 146961 - DNA, 28 bp, Artificial Sequence
  Description of Artificial Sequence: Synthetic oligonucleotide
tgccgaaagcccgagctgccttaacttc

SEQ ID NO: 146962 - DNA, 27 bp, Artificial Sequence
  Description of Artificial Sequence: Synthetic oligonucleotide
gccgaaagcccgagctgccttaacttc

SEQ ID NO: 146963 - DNA, 28 bp, Artificial Sequence
  Description of Artificial Sequence: Synthetic oligonucleotide
ccgaaagcccgagctgccttaacttctg

SEQ ID NO: 146964 - DNA, 28 bp, Artificial Sequence
  Description of Artificial Sequence: Synthetic oligonucleotide
cgaaagcccgagctgccttaacttctgc

SEQ ID NO: 146965 - DNA, 29 bp, Artificial Sequence
  Description of Artificial Sequence: Synthetic oligonucleotide
gaaagcccgagctgccttaacttctgctc

SEQ ID NO: 146966 - DNA, 29 bp, Artificial Sequence
  Description of Artificial Sequence: Synthetic oligonucleotide
aaagcccgagctgccttaacttctgctcg

SEQ ID NO: 146967 - DNA, 28 bp, Artificial Sequence
  Description of Artificial Sequence: Synthetic oligonucleotide
aagcccgagctgccttaacttctgctcg

SEQ ID NO: 146968 - DNA, 27 bp, Artificial Sequence
  Description of Artificial Sequence: Synthetic oligonucleotide
agcccgagctgccttaacttctgctcg

SEQ ID NO: 146969 - DNA, 27 bp, Artificial Sequence
  Description of Artificial Sequence: Synthetic oligonucleotide
gcccgagctgccttaacttctgctcga

SEQ ID NO: 146970 - DNA, 28 bp, Artificial Sequence
  Description of Artificial Sequence: Synthetic oligonucleotide
cccgagctgccttaacttctgctcgaac

SEQ ID NO: 146971 - DNA, 28 bp, Artificial Sequence
  Description of Artificial Sequence: Synthetic oligonucleotide
ccgagctgccttaacttctgctcgaacc

SEQ ID NO: 146972 - DNA, 29 bp, Artificial Sequence
  Description of Artificial Sequence: Synthetic oligonucleotide
cgagctgccttaacttctgctcgaaccac

SEQ ID NO: 146973 - DNA, 30 bp, Artificial Sequence
  Description of Artificial Sequence: Synthetic oligonucleotide
gagctgccttaacttctgctcgaaccacag

SEQ ID NO: 146974 - DNA, 30 bp, Artificial Sequence
  Description of Artificial Sequence: Synthetic oligonucleotide
agctgccttaacttctgctcgaaccacagc

SEQ ID NO: 146975 - DNA, 29 bp, Artificial Sequence
  Description of Artificial Sequence: Synthetic oligonucleotide
gctgccttaacttctgctcgaaccacagc

SEQ ID NO: 146976 - DNA, 33 bp, Artificial Sequence
  Description of Artificial Sequence: Synthetic oligonucleotide
ctgccttaacttctgctcgaaccacagcaaatg

SEQ ID NO: 146977 - DNA, 33 bp, Artificial Sequence
  Description of Artificial Sequence: Synthetic oligonucleotide
tgccttaacttctgctcgaaccacagcaaatgc

SEQ ID NO: 146978 - DNA, 32 bp, Artificial Sequence
  Description of Artificial Sequence: Synthetic oligonucleotide
gccttaacttctgctcgaaccacagcaaatgc

SEQ ID NO: 146979 - DNA, 32 bp, Artificial Sequence
  Description of Artificial Sequence: Synthetic oligonucleotide
ccttaacttctgctcgaaccacagcaaatgcc

SEQ ID NO: 146980 - DNA, 34 bp, Artificial Sequence
  Description of Artificial Sequence: Synthetic oligonucleotide
cttaacttctgctcgaaccacagcaaatgccatc

SEQ ID NO: 146981 - DNA, 36 bp, Artificial Sequence
  Description of Artificial Sequence: Synthetic oligonucleotide
ttaacttctgctcgaaccacagcaaatgccatctac

SEQ ID NO: 146982 - DNA, 35 bp, Artificial Sequence
  Description of Artificial Sequence: Synthetic oligonucleotide
taacttctgctcgaaccacagcaaatgccatctac

SEQ ID NO: 146983 - DNA, 34 bp, Artificial Sequence
  Description of Artificial Sequence: Synthetic oligonucleotide
aacttctgctcgaaccacagcaaatgccatctac

SEQ ID NO: 146984 - DNA, 33 bp, Artificial Sequence
  Description of Artificial Sequence: Synthetic oligonucleotide
acttctgctcgaaccacagcaaatgccatctac

SEQ ID NO: 146985 - DNA, 32 bp, Artificial Sequence
  Description of Artificial Sequence: Synthetic oligonucleotide
cttctgctcgaaccacagcaaatgccatctac

SEQ ID NO: 146986 - DNA, 33 bp, Artificial Sequence
  Description of Artificial Sequence: Synthetic oligonucleotide
ttctgctcgaaccacagcaaatgccatctactg

SEQ ID NO: 146987 - DNA, 32 bp, Artificial Sequence
  Description of Artificial Sequence: Synthetic oligonucleotide
tctgctcgaaccacagcaaatgccatctactg

SEQ ID NO: 146988 - DNA, 31 bp, Artificial Sequence
  Description of Artificial Sequence: Synthetic oligonucleotide
ctgctcgaaccacagcaaatgccatctactg

SEQ ID NO: 146989 - DNA, 31 bp, Artificial Sequence
  Description of Artificial Sequence: Synthetic oligonucleotide
tgctcgaaccacagcaaatgccatctactgc

SEQ ID NO: 146990 - DNA, 30 bp, Artificial Sequence
  Description of Artificial Sequence: Synthetic oligonucleotide
gctcgaaccacagcaaatgccatctactgc

SEQ ID NO: 146991 - DNA, 30 bp, Artificial Sequence
  Description of Artificial Sequence: Synthetic oligonucleotide
ctcgaaccacagcaaatgccatctactgcc

SEQ ID NO: 146992 - DNA, 30 bp, Artificial Sequence
  Description of Artificial Sequence: Synthetic oligonucleotide
tcgaaccacagcaaatgccatctactgccc

SEQ ID NO: 146993 - DNA, 29 bp, Artificial Sequence
  Description of Artificial Sequence: Synthetic oligonucleotide
cgaaccacagcaaatgccatctactgccc

SEQ ID NO: 146994 - DNA, 29 bp, Artificial Sequence
  Description of Artificial Sequence: Synthetic oligonucleotide
gaaccacagcaaatgccatctactgcccc

SEQ ID NO: 146995 - DNA, 29 bp, Artificial Sequence
  Description of Artificial Sequence: Synthetic oligonucleotide
aaccacagcaaatgccatctactgccccc

SEQ ID NO: 146996 - DNA, 28 bp, Artificial Sequence
  Description of Artificial Sequence: Synthetic oligonucleotide
accacagcaaatgccatctactgccccc

SEQ ID NO: 146997 - DNA, 27 bp, Artificial Sequence
  Description of Artificial Sequence: Synthetic oligonucleotide
ccacagcaaatgccatctactgccccc

SEQ ID NO: 146998 - DNA, 27 bp, Artificial Sequence
  Description of Artificial Sequence: Synthetic oligonucleotide
cacagcaaatgccatctactgcccccc

SEQ ID NO: 146999 - DNA, 33 bp, Artificial Sequence
  Description of Artificial Sequence: Synthetic oligonucleotide
acagcaaatgccatctactgcccccctaaattg

SEQ ID NO: 147000 - DNA, 32 bp, Artificial Sequence
  Description of Artificial Sequence: Synthetic oligonucleotide
cagcaaatgccatctactgcccccctaaattg

SEQ ID NO: 147001 - DNA, 32 bp, Artificial Sequence
  Description of Artificial Sequence: Synthetic oligonucleotide
agcaaatgccatctactgcccccctaaattgc

SEQ ID NO: 147002 - DNA, 31 bp, Artificial Sequence
  Description of Artificial Sequence: Synthetic oligonucleotide
gcaaatgccatctactgcccccctaaattgc

SEQ ID NO: 147003 - DNA, 32 bp, Artificial Sequence
  Description of Artificial Sequence: Synthetic oligonucleotide
caaatgccatctactgcccccctaaattgcag

SEQ ID NO: 147004 - DNA, 32 bp, Artificial Sequence
  Description of Artificial Sequence: Synthetic oligonucleotide
aaatgccatctactgcccccctaaattgcagg

SEQ ID NO: 147005 - DNA, 31 bp, Artificial Sequence
  Description of Artificial Sequence: Synthetic oligonucleotide
aatgccatctactgcccccctaaattgcagg

SEQ ID NO: 147006 - DNA, 30 bp, Artificial Sequence
  Description of Artificial Sequence: Synthetic oligonucleotide
atgccatctactgcccccctaaattgcagg

SEQ ID NO: 147007 - DNA, 29 bp, Artificial Sequence
  Description of Artificial Sequence: Synthetic oligonucleotide
tgccatctactgcccccctaaattgcagg

SEQ ID NO: 147008 - DNA, 28 bp, Artificial Sequence
  Description of Artificial Sequence: Synthetic oligonucleotide
gccatctactgcccccctaaattgcagg

SEQ ID NO: 147009 - DNA, 28 bp, Artificial Sequence
  Description of Artificial Sequence: Synthetic oligonucleotide
ccatctactgcccccctaaattgcaggc

SEQ ID NO: 147010 - DNA, 28 bp, Artificial Sequence
  Description of Artificial Sequence: Synthetic oligonucleotide
catctactgcccccctaaattgcaggcc

SEQ ID NO: 147011 - DNA, 29 bp, Artificial Sequence
  Description of Artificial Sequence: Synthetic oligonucleotide
atctactgcccccctaaattgcaggccac

SEQ ID NO: 147012 - DNA, 28 bp, Artificial Sequence
  Description of Artificial Sequence: Synthetic oligonucleotide
tctactgcccccctaaattgcaggccac

SEQ ID NO: 147013 - DNA, 27 bp, Artificial Sequence
  Description of Artificial Sequence: Synthetic oligonucleotide
ctactgcccccctaaattgcaggccac

SEQ ID NO: 147014 - DNA, 27 bp, Artificial Sequence
  Description of Artificial Sequence: Synthetic oligonucleotide
tactgcccccctaaattgcaggccacc

SEQ ID NO: 147015 - DNA, 27 bp, Artificial Sequence
  Description of Artificial Sequence: Synthetic oligonucleotide
actgcccccctaaattgcaggccacct

SEQ ID NO: 147016 - DNA, 27 bp, Artificial Sequence
  Description of Artificial Sequence: Synthetic oligonucleotide
ctgcccccctaaattgcaggccacctt

SEQ ID NO: 147017 - DNA, 27 bp, Artificial Sequence
  Description of Artificial Sequence: Synthetic oligonucleotide
tgcccccctaaattgcaggccaccttg

SEQ ID NO: 147018 - DNA, 26 bp, Artificial Sequence
  Description of Artificial Sequence: Synthetic oligonucleotide
gcccccctaaattgcaggccaccttg

SEQ ID NO: 147019 - DNA, 27 bp, Artificial Sequence
  Description of Artificial Sequence: Synthetic oligonucleotide
cccccctaaattgcaggccaccttgga

SEQ ID NO: 147020 - DNA, 27 bp, Artificial Sequence
  Description of Artificial Sequence: Synthetic oligonucleotide
ccccctaaattgcaggccaccttggac

SEQ ID NO: 147021 - DNA, 29 bp, Artificial Sequence
  Description of Artificial Sequence: Synthetic oligonucleotide
cccctaaattgcaggccaccttggacatg

SEQ ID NO: 147022 - DNA, 29 bp, Artificial Sequence
  Description of Artificial Sequence: Synthetic oligonucleotide
ccctaaattgcaggccaccttggacatgc

SEQ ID NO: 147023 - DNA, 30 bp, Artificial Sequence
  Description of Artificial Sequence: Synthetic oligonucleotide
cctaaattgcaggccaccttggacatgcag

SEQ ID NO: 147024 - DNA, 31 bp, Artificial Sequence
  Description of Artificial Sequence: Synthetic oligonucleotide
ctaaattgcaggccaccttggacatgcagtc

SEQ ID NO: 147025 - DNA, 31 bp, Artificial Sequence
  Description of Artificial Sequence: Synthetic oligonucleotide
taaattgcaggccaccttggacatgcagtcg

SEQ ID NO: 147026 - DNA, 30 bp, Artificial Sequence
  Description of Artificial Sequence: Synthetic oligonucleotide
aaattgcaggccaccttggacatgcagtcg

SEQ ID NO: 147027 - DNA, 29 bp, Artificial Sequence
  Description of Artificial Sequence: Synthetic oligonucleotide
aattgcaggccaccttggacatgcagtcg

SEQ ID NO: 147028 - DNA, 28 bp, Artificial Sequence
  Description of Artificial Sequence: Synthetic oligonucleotide
attgcaggccaccttggacatgcagtcg

SEQ ID NO: 147029 - DNA, 27 bp, Artificial Sequence
  Description of Artificial Sequence: Synthetic oligonucleotide
ttgcaggccaccttggacatgcagtcg

SEQ ID NO: 147030 - DNA, 26 bp, Artificial Sequence
  Description of Artificial Sequence: Synthetic oligonucleotide
tgcaggccaccttggacatgcagtcg

SEQ ID NO: 147031 - DNA, 25 bp, Artificial Sequence
  Description of Artificial Sequence: Synthetic oligonucleotide
gcaggccaccttggacatgcagtcg

SEQ ID NO: 147032 - DNA, 25 bp, Artificial Sequence
  Description of Artificial Sequence: Synthetic oligonucleotide
caggccaccttggacatgcagtcgg

SEQ ID NO: 147033 - DNA, 27 bp, Artificial Sequence
  Description of Artificial Sequence: Synthetic oligonucleotide
aggccaccttggacatgcagtcgggta

SEQ ID NO: 147034 - DNA, 27 bp, Artificial Sequence
  Description of Artificial Sequence: Synthetic oligonucleotide
ggccaccttggacatgcagtcgggtat

SEQ ID NO: 147035 - DNA, 30 bp, Artificial Sequence
  Description of Artificial Sequence: Synthetic oligonucleotide
gccaccttggacatgcagtcgggtattatc

SEQ ID NO: 147036 - DNA, 30 bp, Artificial Sequence
  Description of Artificial Sequence: Synthetic oligonucleotide
ccaccttggacatgcagtcgggtattatcc

SEQ ID NO: 147037 - DNA, 32 bp, Artificial Sequence
  Description of Artificial Sequence: Synthetic oligonucleotide
caccttggacatgcagtcgggtattatccatg

SEQ ID NO: 147038 - DNA, 32 bp, Artificial Sequence
  Description of Artificial Sequence: Synthetic oligonucleotide
accttggacatgcagtcgggtattatccatgc

SEQ ID NO: 147039 - DNA, 31 bp, Artificial Sequence
  Description of Artificial Sequence: Synthetic oligonucleotide
ccttggacatgcagtcgggtattatccatgc

SEQ ID NO: 147040 - DNA, 32 bp, Artificial Sequence
  Description of Artificial Sequence: Synthetic oligonucleotide
cttggacatgcagtcgggtattatccatgcag

SEQ ID NO: 147041 - DNA, 32 bp, Artificial Sequence
  Description of Artificial Sequence: Synthetic oligonucleotide
ttggacatgcagtcgggtattatccatgcagc

SEQ ID NO: 147042 - DNA, 31 bp, Artificial Sequence
  Description of Artificial Sequence: Synthetic oligonucleotide
tggacatgcagtcgggtattatccatgcagc

SEQ ID NO: 147043 - DNA, 30 bp, Artificial Sequence
  Description of Artificial Sequence: Synthetic oligonucleotide
ggacatgcagtcgggtattatccatgcagc

SEQ ID NO: 147044 - DNA, 31 bp, Artificial Sequence
  Description of Artificial Sequence: Synthetic oligonucleotide
gacatgcagtcgggtattatccatgcagcag

SEQ ID NO: 147045 - DNA, 33 bp, Artificial Sequence
  Description of Artificial Sequence: Synthetic oligonucleotide
acatgcagtcgggtattatccatgcagcagaag

SEQ ID NO: 147046 - DNA, 32 bp, Artificial Sequence
  Description of Artificial Sequence: Synthetic oligonucleotide
catgcagtcgggtattatccatgcagcagaag

SEQ ID NO: 147047 - DNA, 33 bp, Artificial Sequence
  Description of Artificial Sequence: Synthetic oligonucleotide
atgcagtcgggtattatccatgcagcagaagag

SEQ ID NO: 147048 - DNA, 32 bp, Artificial Sequence
  Description of Artificial Sequence: Synthetic oligonucleotide
tgcagtcgggtattatccatgcagcagaagag

SEQ ID NO: 147049 - DNA, 31 bp, Artificial Sequence
  Description of Artificial Sequence: Synthetic oligonucleotide
gcagtcgggtattatccatgcagcagaagag

SEQ ID NO: 147050 - DNA, 33 bp, Artificial Sequence
  Description of Artificial Sequence: Synthetic oligonucleotide
cagtcgggtattatccatgcagcagaagagaag

SEQ ID NO: 147051 - DNA, 33 bp, Artificial Sequence
  Description of Artificial Sequence: Synthetic oligonucleotide
agtcgggtattatccatgcagcagaagagaagg

SEQ ID NO: 147052 - DNA, 32 bp, Artificial Sequence
  Description of Artificial Sequence: Synthetic oligonucleotide
gtcgggtattatccatgcagcagaagagaagg

SEQ ID NO: 147053 - DNA, 33 bp, Artificial Sequence
  Description of Artificial Sequence: Synthetic oligonucleotide
tcgggtattatccatgcagcagaagagaaggac

SEQ ID NO: 147054 - DNA, 32 bp, Artificial Sequence
  Description of Artificial Sequence: Synthetic oligonucleotide
cgggtattatccatgcagcagaagagaaggac

SEQ ID NO: 147055 - DNA, 33 bp, Artificial Sequence
  Description of Artificial Sequence: Synthetic oligonucleotide
gggtattatccatgcagcagaagagaaggactg

SEQ ID NO: 147056 - DNA, 33 bp, Artificial Sequence
  Description of Artificial Sequence: Synthetic oligonucleotide
ggtattatccatgcagcagaagagaaggactgg

SEQ ID NO: 147057 - DNA, 37 bp, Artificial Sequence
  Description of Artificial Sequence: Synthetic oligonucleotide
gtattatccatgcagcagaagagaaggactggaaaac

SEQ ID NO: 147058 - DNA, 38 bp, Artificial Sequence
  Description of Artificial Sequence: Synthetic oligonucleotide
tattatccatgcagcagaagagaaggactggaaaactg

SEQ ID NO: 147059 - DNA, 37 bp, Artificial Sequence
  Description of Artificial Sequence: Synthetic oligonucleotide
attatccatgcagcagaagagaaggactggaaaactg

SEQ ID NO: 147060 - DNA, 36 bp, Artificial Sequence
  Description of Artificial Sequence: Synthetic oligonucleotide
ttatccatgcagcagaagagaaggactggaaaactg

SEQ ID NO: 147061 - DNA, 35 bp, Artificial Sequence
  Description of Artificial Sequence: Synthetic oligonucleotide
tatccatgcagcagaagagaaggactggaaaactg

SEQ ID NO: 147062 - DNA, 34 bp, Artificial Sequence
  Description of Artificial Sequence: Synthetic oligonucleotide
atccatgcagcagaagagaaggactggaaaactg

SEQ ID NO: 147063 - DNA, 33 bp, Artificial Sequence
  Description of Artificial Sequence: Synthetic oligonucleotide
tccatgcagcagaagagaaggactggaaaactg

SEQ ID NO: 147064 - DNA, 32 bp, Artificial Sequence
  Description of Artificial Sequence: Synthetic oligonucleotide
ccatgcagcagaagagaaggactggaaaactg

SEQ ID NO: 147065 - DNA, 32 bp, Artificial Sequence
  Description of Artificial Sequence: Synthetic oligonucleotide
catgcagcagaagagaaggactggaaaactgc

SEQ ID NO: 147066 - DNA, 32 bp, Artificial Sequence
  Description of Artificial Sequence: Synthetic oligonucleotide
atgcagcagaagagaaggactggaaaactgcg

SEQ ID NO: 147067 - DNA, 31 bp, Artificial Sequence
  Description of Artificial Sequence: Synthetic oligonucleotide
tgcagcagaagagaaggactggaaaactgcg

SEQ ID NO: 147068 - DNA, 30 bp, Artificial Sequence
  Description of Artificial Sequence: Synthetic oligonucleotide
gcagcagaagagaaggactggaaaactgcg

SEQ ID NO: 147069 - DNA, 32 bp, Artificial Sequence
  Description of Artificial Sequence: Synthetic oligonucleotide
cagcagaagagaaggactggaaaactgcgtac

SEQ ID NO: 147070 - DNA, 33 bp, Artificial Sequence
  Description of Artificial Sequence: Synthetic oligonucleotide
agcagaagagaaggactggaaaactgcgtactc

SEQ ID NO: 147071 - DNA, 32 bp, Artificial Sequence
  Description of Artificial Sequence: Synthetic oligonucleotide
gcagaagagaaggactggaaaactgcgtactc

SEQ ID NO: 147072 - DNA, 35 bp, Artificial Sequence
  Description of Artificial Sequence: Synthetic oligonucleotide
cagaagagaaggactggaaaactgcgtactcatac

SEQ ID NO: 147073 - DNA, 37 bp, Artificial Sequence
  Description of Artificial Sequence: Synthetic oligonucleotide
agaagagaaggactggaaaactgcgtactcatacttc

SEQ ID NO: 147074 - DNA, 36 bp, Artificial Sequence
  Description of Artificial Sequence: Synthetic oligonucleotide
gaagagaaggactggaaaactgcgtactcatacttc

SEQ ID NO: 147075 - DNA, 39 bp, Artificial Sequence
  Description of Artificial Sequence: Synthetic oligonucleotide
aagagaaggactggaaaactgcgtactcatacttctatg

SEQ ID NO: 147076 - DNA, 38 bp, Artificial Sequence
  Description of Artificial Sequence: Synthetic oligonucleotide
agagaaggactggaaaactgcgtactcatacttctatg

SEQ ID NO: 147077 - DNA, 37 bp, Artificial Sequence
  Description of Artificial Sequence: Synthetic oligonucleotide
gagaaggactggaaaactgcgtactcatacttctatg

SEQ ID NO: 147078 - DNA, 38 bp, Artificial Sequence
  Description of Artificial Sequence: Synthetic oligonucleotide
agaaggactggaaaactgcgtactcatacttctatgag

SEQ ID NO: 147079 - DNA, 37 bp, Artificial Sequence
  Description of Artificial Sequence: Synthetic oligonucleotide
gaaggactggaaaactgcgtactcatacttctatgag

SEQ ID NO: 147080 - DNA, 37 bp, Artificial Sequence
  Description of Artificial Sequence: Synthetic oligonucleotide
aaggactggaaaactgcgtactcatacttctatgagg

SEQ ID NO: 147081 - DNA, 36 bp, Artificial Sequence
  Description of Artificial Sequence: Synthetic oligonucleotide
aggactggaaaactgcgtactcatacttctatgagg

SEQ ID NO: 147082 - DNA, 35 bp, Artificial Sequence
  Description of Artificial Sequence: Synthetic oligonucleotide
ggactggaaaactgcgtactcatacttctatgagg

SEQ ID NO: 147083 - DNA, 35 bp, Artificial Sequence
  Description of Artificial Sequence: Synthetic oligonucleotide
gactggaaaactgcgtactcatacttctatgaggc

SEQ ID NO: 147084 - DNA, 39 bp, Artificial Sequence
  Description of Artificial Sequence: Synthetic oligonucleotide
actggaaaactgcgtactcatacttctatgaggcatttg

SEQ ID NO: 147085 - DNA, 38 bp, Artificial Sequence
  Description of Artificial Sequence: Synthetic oligonucleotide
ctggaaaactgcgtactcatacttctatgaggcatttg

SEQ ID NO: 147086 - DNA, 39 bp, Artificial Sequence
  Description of Artificial Sequence: Synthetic oligonucleotide
tggaaaactgcgtactcatacttctatgaggcatttgag

SEQ ID NO: 147087 - DNA, 38 bp, Artificial Sequence
  Description of Artificial Sequence: Synthetic oligonucleotide
ggaaaactgcgtactcatacttctatgaggcatttgag

SEQ ID NO: 147088 - DNA, 38 bp, Artificial Sequence
  Description of Artificial Sequence: Synthetic oligonucleotide
gaaaactgcgtactcatacttctatgaggcatttgagg

SEQ ID NO: 147089 - DNA, 38 bp, Artificial Sequence
  Description of Artificial Sequence: Synthetic oligonucleotide
aaaactgcgtactcatacttctatgaggcatttgaggg

SEQ ID NO: 147090 - DNA, 37 bp, Artificial Sequence
  Description of Artificial Sequence: Synthetic oligonucleotide
aaactgcgtactcatacttctatgaggcatttgaggg

SEQ ID NO: 147091 - DNA, 36 bp, Artificial Sequence
  Description of Artificial Sequence: Synthetic oligonucleotide
aactgcgtactcatacttctatgaggcatttgaggg

SEQ ID NO: 147092 - DNA, 35 bp, Artificial Sequence
  Description of Artificial Sequence: Synthetic oligonucleotide
actgcgtactcatacttctatgaggcatttgaggg

SEQ ID NO: 147093 - DNA, 34 bp, Artificial Sequence
  Description of Artificial Sequence: Synthetic oligonucleotide
ctgcgtactcatacttctatgaggcatttgaggg

SEQ ID NO: 147094 - DNA, 38 bp, Artificial Sequence
  Description of Artificial Sequence: Synthetic oligonucleotide
tgcgtactcatacttctatgaggcatttgagggttatg

SEQ ID NO: 147095 - DNA, 37 bp, Artificial Sequence
  Description of Artificial Sequence: Synthetic oligonucleotide
gcgtactcatacttctatgaggcatttgagggttatg

SEQ ID NO: 147096 - DNA, 38 bp, Artificial Sequence
  Description of Artificial Sequence: Synthetic oligonucleotide
cgtactcatacttctatgaggcatttgagggttatgac

SEQ ID NO: 147097 - DNA, 39 bp, Artificial Sequence
  Description of Artificial Sequence: Synthetic oligonucleotide
gtactcatacttctatgaggcatttgagggttatgactc

SEQ ID NO: 147098 - DNA, 39 bp, Artificial Sequence
  Description of Artificial Sequence: Synthetic oligonucleotide
tactcatacttctatgaggcatttgagggttatgactcc

SEQ ID NO: 147099 - DNA, 38 bp, Artificial Sequence
  Description of Artificial Sequence: Synthetic oligonucleotide
actcatacttctatgaggcatttgagggttatgactcc

SEQ ID NO: 147100 - DNA, 37 bp, Artificial Sequence
  Description of Artificial Sequence: Synthetic oligonucleotide
ctcatacttctatgaggcatttgagggttatgactcc

SEQ ID NO: 147101 - DNA, 39 bp, Artificial Sequence
  Description of Artificial Sequence: Synthetic oligonucleotide
tcatacttctatgaggcatttgagggttatgactccatc

SEQ ID NO: 147102 - DNA, 38 bp, Artificial Sequence
  Description of Artificial Sequence: Synthetic oligonucleotide
catacttctatgaggcatttgagggttatgactccatc

SEQ ID NO: 147103 - DNA, 38 bp, Artificial Sequence
  Description of Artificial Sequence: Synthetic oligonucleotide
atacttctatgaggcatttgagggttatgactccatcg

SEQ ID NO: 147104 - DNA, 37 bp, Artificial Sequence
  Description of Artificial Sequence: Synthetic oligonucleotide
tacttctatgaggcatttgagggttatgactccatcg

SEQ ID NO: 147105 - DNA, 36 bp, Artificial Sequence
  Description of Artificial Sequence: Synthetic oligonucleotide
acttctatgaggcatttgagggttatgactccatcg

SEQ ID NO: 147106 - DNA, 35 bp, Artificial Sequence
  Description of Artificial Sequence: Synthetic oligonucleotide
cttctatgaggcatttgagggttatgactccatcg

SEQ ID NO: 147107 - DNA, 36 bp, Artificial Sequence
  Description of Artificial Sequence: Synthetic oligonucleotide
ttctatgaggcatttgagggttatgactccatcgac

SEQ ID NO: 147108 - DNA, 35 bp, Artificial Sequence
  Description of Artificial Sequence: Synthetic oligonucleotide
tctatgaggcatttgagggttatgactccatcgac

SEQ ID NO: 147109 - DNA, 34 bp, Artificial Sequence
  Description of Artificial Sequence: Synthetic oligonucleotide
ctatgaggcatttgagggttatgactccatcgac

SEQ ID NO: 147110 - DNA, 35 bp, Artificial Sequence
  Description of Artificial Sequence: Synthetic oligonucleotide
tatgaggcatttgagggttatgactccatcgacag

SEQ ID NO: 147111 - DNA, 34 bp, Artificial Sequence
  Description of Artificial Sequence: Synthetic oligonucleotide
atgaggcatttgagggttatgactccatcgacag

SEQ ID NO: 147112 - DNA, 33 bp, Artificial Sequence
  Description of Artificial Sequence: Synthetic oligonucleotide
tgaggcatttgagggttatgactccatcgacag

SEQ ID NO: 147113 - DNA, 32 bp, Artificial Sequence
  Description of Artificial Sequence: Synthetic oligonucleotide
gaggcatttgagggttatgactccatcgacag

SEQ ID NO: 147114 - DNA, 32 bp, Artificial Sequence
  Description of Artificial Sequence: Synthetic oligonucleotide
aggcatttgagggttatgactccatcgacagc

SEQ ID NO: 147115 - DNA, 31 bp, Artificial Sequence
  Description of Artificial Sequence: Synthetic oligonucleotide
ggcatttgagggttatgactccatcgacagc

SEQ ID NO: 147116 - DNA, 31 bp, Artificial Sequence
  Description of Artificial Sequence: Synthetic oligonucleotide
gcatttgagggttatgactccatcgacagcc

SEQ ID NO: 147117 - DNA, 31 bp, Artificial Sequence
  Description of Artificial Sequence: Synthetic oligonucleotide
catttgagggttatgactccatcgacagccc

SEQ ID NO: 147118 - DNA, 31 bp, Artificial Sequence
  Description of Artificial Sequence: Synthetic oligonucleotide
atttgagggttatgactccatcgacagcccc

SEQ ID NO: 147119 - DNA, 30 bp, Artificial Sequence
  Description of Artificial Sequence: Synthetic oligonucleotide
tttgagggttatgactccatcgacagcccc

SEQ ID NO: 147120 - DNA, 29 bp, Artificial Sequence
  Description of Artificial Sequence: Synthetic oligonucleotide
ttgagggttatgactccatcgacagcccc

SEQ ID NO: 147121 - DNA, 28 bp, Artificial Sequence
  Description of Artificial Sequence: Synthetic oligonucleotide
tgagggttatgactccatcgacagcccc

SEQ ID NO: 147122 - DNA, 27 bp, Artificial Sequence
  Description of Artificial Sequence: Synthetic oligonucleotide
gagggttatgactccatcgacagcccc

SEQ ID NO: 147123 - DNA, 29 bp, Artificial Sequence
  Description of Artificial Sequence: Synthetic oligonucleotide
agggttatgactccatcgacagccccaag

SEQ ID NO: 147124 - DNA, 28 bp, Artificial Sequence
  Description of Artificial Sequence: Synthetic oligonucleotide
gggttatgactccatcgacagccccaag

SEQ ID NO: 147125 - DNA, 28 bp, Artificial Sequence
  Description of Artificial Sequence: Synthetic oligonucleotide
ggttatgactccatcgacagccccaagg

SEQ ID NO: 147126 - DNA, 28 bp, Artificial Sequence
  Description of Artificial Sequence: Synthetic oligonucleotide
gttatgactccatcgacagccccaaggc

SEQ ID NO: 147127 - DNA, 28 bp, Artificial Sequence
  Description of Artificial Sequence: Synthetic oligonucleotide
ttatgactccatcgacagccccaaggcc

SEQ ID NO: 147128 - DNA, 27 bp, Artificial Sequence
  Description of Artificial Sequence: Synthetic oligonucleotide
tatgactccatcgacagccccaaggcc

SEQ ID NO: 147129 - DNA, 27 bp, Artificial Sequence
  Description of Artificial Sequence: Synthetic oligonucleotide
atgactccatcgacagccccaaggcca

SEQ ID NO: 147130 - DNA, 27 bp, Artificial Sequence
  Description of Artificial Sequence: Synthetic oligonucleotide
tgactccatcgacagccccaaggccat

SEQ ID NO: 147131 - DNA, 26 bp, Artificial Sequence
  Description of Artificial Sequence: Synthetic oligonucleotide
gactccatcgacagccccaaggccat

SEQ ID NO: 147132 - DNA, 27 bp, Artificial Sequence
  Description of Artificial Sequence: Synthetic oligonucleotide
actccatcgacagccccaaggccatca

SEQ ID NO: 147133 - DNA, 26 bp, Artificial Sequence
  Description of Artificial Sequence: Synthetic oligonucleotide
ctccatcgacagccccaaggccatca

SEQ ID NO: 147134 - DNA, 27 bp, Artificial Sequence
  Description of Artificial Sequence: Synthetic oligonucleotide
tccatcgacagccccaaggccatcaca

SEQ ID NO: 147135 - DNA, 27 bp, Artificial Sequence
  Description of Artificial Sequence: Synthetic oligonucleotide
ccatcgacagccccaaggccatcacat

SEQ ID NO: 147136 - DNA, 27 bp, Artificial Sequence
  Description of Artificial Sequence: Synthetic oligonucleotide
catcgacagccccaaggccatcacatc

SEQ ID NO: 147137 - DNA, 28 bp, Artificial Sequence
  Description of Artificial Sequence: Synthetic oligonucleotide
atcgacagccccaaggccatcacatctc

SEQ ID NO: 147138 - DNA, 27 bp, Artificial Sequence
  Description of Artificial Sequence: Synthetic oligonucleotide
tcgacagccccaaggccatcacatctc

SEQ ID NO: 147139 - DNA, 27 bp, Artificial Sequence
  Description of Artificial Sequence: Synthetic oligonucleotide
cgacagccccaaggccatcacatctct

SEQ ID NO: 147140 - DNA, 27 bp, Artificial Sequence
  Description of Artificial Sequence: Synthetic oligonucleotide
gacagccccaaggccatcacatctctg

SEQ ID NO: 147141 - DNA, 29 bp, Artificial Sequence
  Description of Artificial Sequence: Synthetic oligonucleotide
acagccccaaggccatcacatctctgaag

SEQ ID NO: 147142 - DNA, 28 bp, Artificial Sequence
  Description of Artificial Sequence: Synthetic oligonucleotide
cagccccaaggccatcacatctctgaag

SEQ ID NO: 147143 - DNA, 30 bp, Artificial Sequence
  Description of Artificial Sequence: Synthetic oligonucleotide
agccccaaggccatcacatctctgaagtac

SEQ ID NO: 147144 - DNA, 29 bp, Artificial Sequence
  Description of Artificial Sequence: Synthetic oligonucleotide
gccccaaggccatcacatctctgaagtac

SEQ ID NO: 147145 - DNA, 31 bp, Artificial Sequence
  Description of Artificial Sequence: Synthetic oligonucleotide
ccccaaggccatcacatctctgaagtacatg

SEQ ID NO: 147146 - DNA, 33 bp, Artificial Sequence
  Description of Artificial Sequence: Synthetic oligonucleotide
cccaaggccatcacatctctgaagtacatgttg

SEQ ID NO: 147147 - DNA, 33 bp, Artificial Sequence
  Description of Artificial Sequence: Synthetic oligonucleotide
ccaaggccatcacatctctgaagtacatgttgc

SEQ ID NO: 147148 - DNA, 34 bp, Artificial Sequence
  Description of Artificial Sequence: Synthetic oligonucleotide
caaggccatcacatctctgaagtacatgttgctg

SEQ ID NO: 147149 - DNA, 35 bp, Artificial Sequence
  Description of Artificial Sequence: Synthetic oligonucleotide
aaggccatcacatctctgaagtacatgttgctgtg

SEQ ID NO: 147150 - DNA, 34 bp, Artificial Sequence
  Description of Artificial Sequence: Synthetic oligonucleotide
aggccatcacatctctgaagtacatgttgctgtg

SEQ ID NO: 147151 - DNA, 33 bp, Artificial Sequence
  Description of Artificial Sequence: Synthetic oligonucleotide
ggccatcacatctctgaagtacatgttgctgtg

SEQ ID NO: 147152 - DNA, 33 bp, Artificial Sequence
  Description of Artificial Sequence: Synthetic oligonucleotide
gccatcacatctctgaagtacatgttgctgtgc

SEQ ID NO: 147153 - DNA, 38 bp, Artificial Sequence
  Description of Artificial Sequence: Synthetic oligonucleotide
ccatcacatctctgaagtacatgttgctgtgcaaaatc

SEQ ID NO: 147154 - DNA, 40 bp, Artificial Sequence
  Description of Artificial Sequence: Synthetic oligonucleotide
catcacatctctgaagtacatgttgctgtgcaaaatcatg

SEQ ID NO: 147155 - DNA, 40 bp, Artificial Sequence
  Description of Artificial Sequence: Synthetic oligonucleotide
atcacatctctgaagtacatgttgctgtgcaaaatcatgc

SEQ ID NO: 147156 - DNA, 39 bp, Artificial Sequence
  Description of Artificial Sequence: Synthetic oligonucleotide
tcacatctctgaagtacatgttgctgtgcaaaatcatgc

SEQ ID NO: 147157 - DNA, 38 bp, Artificial Sequence
  Description of Artificial Sequence: Synthetic oligonucleotide
cacatctctgaagtacatgttgctgtgcaaaatcatgc

SEQ ID NO: 147158 - DNA, 39 bp, Artificial Sequence
  Description of Artificial Sequence: Synthetic oligonucleotide
acatctctgaagtacatgttgctgtgcaaaatcatgctc

SEQ ID NO: 147159 - DNA, 38 bp, Artificial Sequence
  Description of Artificial Sequence: Synthetic oligonucleotide
catctctgaagtacatgttgctgtgcaaaatcatgctc

SEQ ID NO: 147160 - DNA, 40 bp, Artificial Sequence
  Description of Artificial Sequence: Synthetic oligonucleotide
atctctgaagtacatgttgctgtgcaaaatcatgctcaac

SEQ ID NO: 147161 - DNA, 39 bp, Artificial Sequence
  Description of Artificial Sequence: Synthetic oligonucleotide
tctctgaagtacatgttgctgtgcaaaatcatgctcaac

SEQ ID NO: 147162 - DNA, 38 bp, Artificial Sequence
  Description of Artificial Sequence: Synthetic oligonucleotide
ctctgaagtacatgttgctgtgcaaaatcatgctcaac

SEQ ID NO: 147163 - DNA, 39 bp, Artificial Sequence
  Description of Artificial Sequence: Synthetic oligonucleotide
tctgaagtacatgttgctgtgcaaaatcatgctcaacac

SEQ ID NO: 147164 - DNA, 38 bp, Artificial Sequence
  Description of Artificial Sequence: Synthetic oligonucleotide
ctgaagtacatgttgctgtgcaaaatcatgctcaacac

SEQ ID NO: 147165 - DNA, 38 bp, Artificial Sequence
  Description of Artificial Sequence: Synthetic oligonucleotide
tgaagtacatgttgctgtgcaaaatcatgctcaacacc

SEQ ID NO: 147166 - DNA, 37 bp, Artificial Sequence
  Description of Artificial Sequence: Synthetic oligonucleotide
gaagtacatgttgctgtgcaaaatcatgctcaacacc

SEQ ID NO: 147167 - DNA, 37 bp, Artificial Sequence
  Description of Artificial Sequence: Synthetic oligonucleotide
aagtacatgttgctgtgcaaaatcatgctcaacaccc

SEQ ID NO: 147168 - DNA, 36 bp, Artificial Sequence
  Description of Artificial Sequence: Synthetic oligonucleotide
agtacatgttgctgtgcaaaatcatgctcaacaccc

SEQ ID NO: 147169 - DNA, 35 bp, Artificial Sequence
  Description of Artificial Sequence: Synthetic oligonucleotide
gtacatgttgctgtgcaaaatcatgctcaacaccc

SEQ ID NO: 147170 - DNA, 35 bp, Artificial Sequence
  Description of Artificial Sequence: Synthetic oligonucleotide
tacatgttgctgtgcaaaatcatgctcaacacccc

SEQ ID NO: 147171 - DNA, 34 bp, Artificial Sequence
  Description of Artificial Sequence: Synthetic oligonucleotide
acatgttgctgtgcaaaatcatgctcaacacccc

SEQ ID NO: 147172 - DNA, 33 bp, Artificial Sequence
  Description of Artificial Sequence: Synthetic oligonucleotide
catgttgctgtgcaaaatcatgctcaacacccc

SEQ ID NO: 147173 - DNA, 34 bp, Artificial Sequence
  Description of Artificial Sequence: Synthetic oligonucleotide
atgttgctgtgcaaaatcatgctcaacaccccag

SEQ ID NO: 147174 - DNA, 33 bp, Artificial Sequence
  Description of Artificial Sequence: Synthetic oligonucleotide
tgttgctgtgcaaaatcatgctcaacaccccag

SEQ ID NO: 147175 - DNA, 32 bp, Artificial Sequence
  Description of Artificial Sequence: Synthetic oligonucleotide
gttgctgtgcaaaatcatgctcaacaccccag

SEQ ID NO: 147176 - DNA, 34 bp, Artificial Sequence
  Description of Artificial Sequence: Synthetic oligonucleotide
ttgctgtgcaaaatcatgctcaacaccccagaag

SEQ ID NO: 147177 - DNA, 33 bp, Artificial Sequence
  Description of Artificial Sequence: Synthetic oligonucleotide
tgctgtgcaaaatcatgctcaacaccccagaag

SEQ ID NO: 147178 - DNA, 32 bp, Artificial Sequence
  Description of Artificial Sequence: Synthetic oligonucleotide
gctgtgcaaaatcatgctcaacaccccagaag

SEQ ID NO: 147179 - DNA, 34 bp, Artificial Sequence
  Description of Artificial Sequence: Synthetic oligonucleotide
ctgtgcaaaatcatgctcaacaccccagaagatg

SEQ ID NO: 147180 - DNA, 35 bp, Artificial Sequence
  Description of Artificial Sequence: Synthetic oligonucleotide
tgtgcaaaatcatgctcaacaccccagaagatgtc

SEQ ID NO: 147181 - DNA, 34 bp, Artificial Sequence
  Description of Artificial Sequence: Synthetic oligonucleotide
gtgcaaaatcatgctcaacaccccagaagatgtc

SEQ ID NO: 147182 - DNA, 34 bp, Artificial Sequence
  Description of Artificial Sequence: Synthetic oligonucleotide
tgcaaaatcatgctcaacaccccagaagatgtcc

SEQ ID NO: 147183 - DNA, 33 bp, Artificial Sequence
  Description of Artificial Sequence: Synthetic oligonucleotide
gcaaaatcatgctcaacaccccagaagatgtcc

SEQ ID NO: 147184 - DNA, 34 bp, Artificial Sequence
  Description of Artificial Sequence: Synthetic oligonucleotide
caaaatcatgctcaacaccccagaagatgtccag

SEQ ID NO: 147185 - DNA, 34 bp, Artificial Sequence
  Description of Artificial Sequence: Synthetic oligonucleotide
aaaatcatgctcaacaccccagaagatgtccagg

SEQ ID NO: 147186 - DNA, 33 bp, Artificial Sequence
  Description of Artificial Sequence: Synthetic oligonucleotide
aaatcatgctcaacaccccagaagatgtccagg

SEQ ID NO: 147187 - DNA, 32 bp, Artificial Sequence
  Description of Artificial Sequence: Synthetic oligonucleotide
aatcatgctcaacaccccagaagatgtccagg

SEQ ID NO: 147188 - DNA, 31 bp, Artificial Sequence
  Description of Artificial Sequence: Synthetic oligonucleotide
atcatgctcaacaccccagaagatgtccagg

SEQ ID NO: 147189 - DNA, 30 bp, Artificial Sequence
  Description of Artificial Sequence: Synthetic oligonucleotide
tcatgctcaacaccccagaagatgtccagg

SEQ ID NO: 147190 - DNA, 29 bp, Artificial Sequence
  Description of Artificial Sequence: Synthetic oligonucleotide
catgctcaacaccccagaagatgtccagg

SEQ ID NO: 147191 - DNA, 29 bp, Artificial Sequence
  Description of Artificial Sequence: Synthetic oligonucleotide
atgctcaacaccccagaagatgtccaggc

SEQ ID NO: 147192 - DNA, 28 bp, Artificial Sequence
  Description of Artificial Sequence: Synthetic oligonucleotide
tgctcaacaccccagaagatgtccaggc

SEQ ID NO: 147193 - DNA, 27 bp, Artificial Sequence
  Description of Artificial Sequence: Synthetic oligonucleotide
gctcaacaccccagaagatgtccaggc

SEQ ID NO: 147194 - DNA, 30 bp, Artificial Sequence
  Description of Artificial Sequence: Synthetic oligonucleotide
ctcaacaccccagaagatgtccaggctttg

SEQ ID NO: 147195 - DNA, 30 bp, Artificial Sequence
  Description of Artificial Sequence: Synthetic oligonucleotide
tcaacaccccagaagatgtccaggctttgg

SEQ ID NO: 147196 - DNA, 29 bp, Artificial Sequence
  Description of Artificial Sequence: Synthetic oligonucleotide
caacaccccagaagatgtccaggctttgg

SEQ ID NO: 147197 - DNA, 30 bp, Artificial Sequence
  Description of Artificial Sequence: Synthetic oligonucleotide
aacaccccagaagatgtccaggctttggtg

SEQ ID NO: 147198 - DNA, 29 bp, Artificial Sequence
  Description of Artificial Sequence: Synthetic oligonucleotide
acaccccagaagatgtccaggctttggtg

SEQ ID NO: 147199 - DNA, 28 bp, Artificial Sequence
  Description of Artificial Sequence: Synthetic oligonucleotide
caccccagaagatgtccaggctttggtg

SEQ ID NO: 147200 - DNA, 29 bp, Artificial Sequence
  Description of Artificial Sequence: Synthetic oligonucleotide
accccagaagatgtccaggctttggtgag

SEQ ID NO: 147201 - DNA, 28 bp, Artificial Sequence
  Description of Artificial Sequence: Synthetic oligonucleotide
ccccagaagatgtccaggctttggtgag

SEQ ID NO: 147202 - DNA, 28 bp, Artificial Sequence
  Description of Artificial Sequence: Synthetic oligonucleotide
cccagaagatgtccaggctttggtgagc

SEQ ID NO: 147203 - DNA, 28 bp, Artificial Sequence
  Description of Artificial Sequence: Synthetic oligonucleotide
ccagaagatgtccaggctttggtgagcg

SEQ ID NO: 147204 - DNA, 28 bp, Artificial Sequence
  Description of Artificial Sequence: Synthetic oligonucleotide
cagaagatgtccaggctttggtgagcgg

SEQ ID NO: 147205 - DNA, 28 bp, Artificial Sequence
  Description of Artificial Sequence: Synthetic oligonucleotide
agaagatgtccaggctttggtgagcggg

SEQ ID NO: 147206 - DNA, 27 bp, Artificial Sequence
  Description of Artificial Sequence: Synthetic oligonucleotide
gaagatgtccaggctttggtgagcggg

SEQ ID NO: 147207 - DNA, 29 bp, Artificial Sequence
  Description of Artificial Sequence: Synthetic oligonucleotide
aagatgtccaggctttggtgagcgggaag

SEQ ID NO: 147208 - DNA, 28 bp, Artificial Sequence
  Description of Artificial Sequence: Synthetic oligonucleotide
agatgtccaggctttggtgagcgggaag

SEQ ID NO: 147209 - DNA, 27 bp, Artificial Sequence
  Description of Artificial Sequence: Synthetic oligonucleotide
gatgtccaggctttggtgagcgggaag

SEQ ID NO: 147210 - DNA, 27 bp, Artificial Sequence
  Description of Artificial Sequence: Synthetic oligonucleotide
atgtccaggctttggtgagcgggaagc

SEQ ID NO: 147211 - DNA, 27 bp, Artificial Sequence
  Description of Artificial Sequence: Synthetic oligonucleotide
tgtccaggctttggtgagcgggaagct

SEQ ID NO: 147212 - DNA, 27 bp, Artificial Sequence
  Description of Artificial Sequence: Synthetic oligonucleotide
gtccaggctttggtgagcgggaagctt

SEQ ID NO: 147213 - DNA, 27 bp, Artificial Sequence
  Description of Artificial Sequence: Synthetic oligonucleotide
tccaggctttggtgagcgggaagcttg

SEQ ID NO: 147214 - DNA, 26 bp, Artificial Sequence
  Description of Artificial Sequence: Synthetic oligonucleotide
ccaggctttggtgagcgggaagcttg

SEQ ID NO: 147215 - DNA, 27 bp, Artificial Sequence
  Description of Artificial Sequence: Synthetic oligonucleotide
caggctttggtgagcgggaagcttgca

SEQ ID NO: 147216 - DNA, 27 bp, Artificial Sequence
  Description of Artificial Sequence: Synthetic oligonucleotide
aggctttggtgagcgggaagcttgcac

SEQ ID NO: 147217 - DNA, 27 bp, Artificial Sequence
  Description of Artificial Sequence: Synthetic oligonucleotide
ggctttggtgagcgggaagcttgcact

SEQ ID NO: 147218 - DNA, 28 bp, Artificial Sequence
  Description of Artificial Sequence: Synthetic oligonucleotide
gctttggtgagcgggaagcttgcacttc

SEQ ID NO: 147219 - DNA, 28 bp, Artificial Sequence
  Description of Artificial Sequence: Synthetic oligonucleotide
ctttggtgagcgggaagcttgcacttcg

SEQ ID NO: 147220 - DNA, 28 bp, Artificial Sequence
  Description of Artificial Sequence: Synthetic oligonucleotide
tttggtgagcgggaagcttgcacttcgg

SEQ ID NO: 147221 - DNA, 27 bp, Artificial Sequence
  Description of Artificial Sequence: Synthetic oligonucleotide
ttggtgagcgggaagcttgcacttcgg

SEQ ID NO: 147222 - DNA, 27 bp, Artificial Sequence
  Description of Artificial Sequence: Synthetic oligonucleotide
tggtgagcgggaagcttgcacttcggt

SEQ ID NO: 147223 - DNA, 27 bp, Artificial Sequence
  Description of Artificial Sequence: Synthetic oligonucleotide
ggtgagcgggaagcttgcacttcggta

SEQ ID NO: 147224 - DNA, 28 bp, Artificial Sequence
  Description of Artificial Sequence: Synthetic oligonucleotide
gtgagcgggaagcttgcacttcggtatg

SEQ ID NO: 147225 - DNA, 28 bp, Artificial Sequence
  Description of Artificial Sequence: Synthetic oligonucleotide
tgagcgggaagcttgcacttcggtatgc

SEQ ID NO: 147226 - DNA, 27 bp, Artificial Sequence
  Description of Artificial Sequence: Synthetic oligonucleotide
gagcgggaagcttgcacttcggtatgc

SEQ ID NO: 147227 - DNA, 28 bp, Artificial Sequence
  Description of Artificial Sequence: Synthetic oligonucleotide
agcgggaagcttgcacttcggtatgcag

SEQ ID NO: 147228 - DNA, 27 bp, Artificial Sequence
  Description of Artificial Sequence: Synthetic oligonucleotide
gcgggaagcttgcacttcggtatgcag

SEQ ID NO: 147229 - DNA, 27 bp, Artificial Sequence
  Description of Artificial Sequence: Synthetic oligonucleotide
cgggaagcttgcacttcggtatgcagg

SEQ ID NO: 147230 - DNA, 27 bp, Artificial Sequence
  Description of Artificial Sequence: Synthetic oligonucleotide
gggaagcttgcacttcggtatgcaggg

SEQ ID NO: 147231 - DNA, 28 bp, Artificial Sequence
  Description of Artificial Sequence: Synthetic oligonucleotide
ggaagcttgcacttcggtatgcagggag

SEQ ID NO: 147232 - DNA, 28 bp, Artificial Sequence
  Description of Artificial Sequence: Synthetic oligonucleotide
gaagcttgcacttcggtatgcagggagg

SEQ ID NO: 147233 - DNA, 28 bp, Artificial Sequence
  Description of Artificial Sequence: Synthetic oligonucleotide
aagcttgcacttcggtatgcagggaggc

SEQ ID NO: 147234 - DNA, 27 bp, Artificial Sequence
  Description of Artificial Sequence: Synthetic oligonucleotide
agcttgcacttcggtatgcagggaggc

SEQ ID NO: 147235 - DNA, 27 bp, Artificial Sequence
  Description of Artificial Sequence: Synthetic oligonucleotide
gcttgcacttcggtatgcagggaggca

SEQ ID NO: 147236 - DNA, 27 bp, Artificial Sequence
  Description of Artificial Sequence: Synthetic oligonucleotide
cttgcacttcggtatgcagggaggcag

SEQ ID NO: 147237 - DNA, 28 bp, Artificial Sequence
  Description of Artificial Sequence: Synthetic oligonucleotide
ttgcacttcggtatgcagggaggcagac

SEQ ID NO: 147238 - DNA, 27 bp, Artificial Sequence
  Description of Artificial Sequence: Synthetic oligonucleotide
tgcacttcggtatgcagggaggcagac

SEQ ID NO: 147239 - DNA, 27 bp, Artificial Sequence
  Description of Artificial Sequence: Synthetic oligonucleotide
gcacttcggtatgcagggaggcagaca

SEQ ID NO: 147240 - DNA, 27 bp, Artificial Sequence
  Description of Artificial Sequence: Synthetic oligonucleotide
cacttcggtatgcagggaggcagacag

SEQ ID NO: 147241 - DNA, 29 bp, Artificial Sequence
  Description of Artificial Sequence: Synthetic oligonucleotide
acttcggtatgcagggaggcagacagaag

SEQ ID NO: 147242 - DNA, 28 bp, Artificial Sequence
  Description of Artificial Sequence: Synthetic oligonucleotide
cttcggtatgcagggaggcagacagaag

SEQ ID NO: 147243 - DNA, 28 bp, Artificial Sequence
  Description of Artificial Sequence: Synthetic oligonucleotide
ttcggtatgcagggaggcagacagaagc

SEQ ID NO: 147244 - DNA, 27 bp, Artificial Sequence
  Description of Artificial Sequence: Synthetic oligonucleotide
tcggtatgcagggaggcagacagaagc

SEQ ID NO: 147245 - DNA, 27 bp, Artificial Sequence
  Description of Artificial Sequence: Synthetic oligonucleotide
cggtatgcagggaggcagacagaagca

SEQ ID NO: 147246 - DNA, 34 bp, Artificial Sequence
  Description of Artificial Sequence: Synthetic oligonucleotide
ggtatgcagggaggcagacagaagcattaaaatg

SEQ ID NO: 147247 - DNA, 34 bp, Artificial Sequence
  Description of Artificial Sequence: Synthetic oligonucleotide
gtatgcagggaggcagacagaagcattaaaatgc

SEQ ID NO: 147248 - DNA, 34 bp, Artificial Sequence
  Description of Artificial Sequence: Synthetic oligonucleotide
tatgcagggaggcagacagaagcattaaaatgcg

SEQ ID NO: 147249 - DNA, 33 bp, Artificial Sequence
  Description of Artificial Sequence: Synthetic oligonucleotide
atgcagggaggcagacagaagcattaaaatgcg

SEQ ID NO: 147250 - DNA, 32 bp, Artificial Sequence
  Description of Artificial Sequence: Synthetic oligonucleotide
tgcagggaggcagacagaagcattaaaatgcg

SEQ ID NO: 147251 - DNA, 31 bp, Artificial Sequence
  Description of Artificial Sequence: Synthetic oligonucleotide
gcagggaggcagacagaagcattaaaatgcg

SEQ ID NO: 147252 - DNA, 32 bp, Artificial Sequence
  Description of Artificial Sequence: Synthetic oligonucleotide
cagggaggcagacagaagcattaaaatgcgtg

SEQ ID NO: 147253 - DNA, 32 bp, Artificial Sequence
  Description of Artificial Sequence: Synthetic oligonucleotide
agggaggcagacagaagcattaaaatgcgtgg

SEQ ID NO: 147254 - DNA, 31 bp, Artificial Sequence
  Description of Artificial Sequence: Synthetic oligonucleotide
gggaggcagacagaagcattaaaatgcgtgg

SEQ ID NO: 147255 - DNA, 31 bp, Artificial Sequence
  Description of Artificial Sequence: Synthetic oligonucleotide
ggaggcagacagaagcattaaaatgcgtggc

SEQ ID NO: 147256 - DNA, 32 bp, Artificial Sequence
  Description of Artificial Sequence: Synthetic oligonucleotide
gaggcagacagaagcattaaaatgcgtggctc

SEQ ID NO: 147257 - DNA, 33 bp, Artificial Sequence
  Description of Artificial Sequence: Synthetic oligonucleotide
aggcagacagaagcattaaaatgcgtggctcag

SEQ ID NO: 147258 - DNA, 32 bp, Artificial Sequence
  Description of Artificial Sequence: Synthetic oligonucleotide
ggcagacagaagcattaaaatgcgtggctcag

SEQ ID NO: 147259 - DNA, 32 bp, Artificial Sequence
  Description of Artificial Sequence: Synthetic oligonucleotide
gcagacagaagcattaaaatgcgtggctcagg

SEQ ID NO: 147260 - DNA, 32 bp, Artificial Sequence
  Description of Artificial Sequence: Synthetic oligonucleotide
cagacagaagcattaaaatgcgtggctcaggc

SEQ ID NO: 147261 - DNA, 34 bp, Artificial Sequence
  Description of Artificial Sequence: Synthetic oligonucleotide
agacagaagcattaaaatgcgtggctcaggctag

SEQ ID NO: 147262 - DNA, 33 bp, Artificial Sequence
  Description of Artificial Sequence: Synthetic oligonucleotide
gacagaagcattaaaatgcgtggctcaggctag

SEQ ID NO: 147263 - DNA, 33 bp, Artificial Sequence
  Description of Artificial Sequence: Synthetic oligonucleotide
acagaagcattaaaatgcgtggctcaggctagc

SEQ ID NO: 147264 - DNA, 32 bp, Artificial Sequence
  Description of Artificial Sequence: Synthetic oligonucleotide
cagaagcattaaaatgcgtggctcaggctagc

SEQ ID NO: 147265 - DNA, 34 bp, Artificial Sequence
  Description of Artificial Sequence: Synthetic oligonucleotide
agaagcattaaaatgcgtggctcaggctagcaag

SEQ ID NO: 147266 - DNA, 33 bp, Artificial Sequence
  Description of Artificial Sequence: Synthetic oligonucleotide
gaagcattaaaatgcgtggctcaggctagcaag

SEQ ID NO: 147267 - DNA, 35 bp, Artificial Sequence
  Description of Artificial Sequence: Synthetic oligonucleotide
aagcattaaaatgcgtggctcaggctagcaagaac

SEQ ID NO: 147268 - DNA, 34 bp, Artificial Sequence
  Description of Artificial Sequence: Synthetic oligonucleotide
agcattaaaatgcgtggctcaggctagcaagaac

SEQ ID NO: 147269 - DNA, 33 bp, Artificial Sequence
  Description of Artificial Sequence: Synthetic oligonucleotide
gcattaaaatgcgtggctcaggctagcaagaac

SEQ ID NO: 147270 - DNA, 34 bp, Artificial Sequence
  Description of Artificial Sequence: Synthetic oligonucleotide
cattaaaatgcgtggctcaggctagcaagaacag

SEQ ID NO: 147271 - DNA, 36 bp, Artificial Sequence
  Description of Artificial Sequence: Synthetic oligonucleotide
attaaaatgcgtggctcaggctagcaagaacagatc

SEQ ID NO: 147272 - DNA, 35 bp, Artificial Sequence
  Description of Artificial Sequence: Synthetic oligonucleotide
ttaaaatgcgtggctcaggctagcaagaacagatc

SEQ ID NO: 147273 - DNA, 34 bp, Artificial Sequence
  Description of Artificial Sequence: Synthetic oligonucleotide
taaaatgcgtggctcaggctagcaagaacagatc

SEQ ID NO: 147274 - DNA, 33 bp, Artificial Sequence
  Description of Artificial Sequence: Synthetic oligonucleotide
aaaatgcgtggctcaggctagcaagaacagatc

SEQ ID NO: 147275 - DNA, 32 bp, Artificial Sequence
  Description of Artificial Sequence: Synthetic oligonucleotide
aaatgcgtggctcaggctagcaagaacagatc

SEQ ID NO: 147276 - DNA, 31 bp, Artificial Sequence
  Description of Artificial Sequence: Synthetic oligonucleotide
aatgcgtggctcaggctagcaagaacagatc

SEQ ID NO: 147277 - DNA, 30 bp, Artificial Sequence
  Description of Artificial Sequence: Synthetic oligonucleotide
atgcgtggctcaggctagcaagaacagatc

SEQ ID NO: 147278 - DNA, 29 bp, Artificial Sequence
  Description of Artificial Sequence: Synthetic oligonucleotide
tgcgtggctcaggctagcaagaacagatc

SEQ ID NO: 147279 - DNA, 28 bp, Artificial Sequence
  Description of Artificial Sequence: Synthetic oligonucleotide
gcgtggctcaggctagcaagaacagatc

SEQ ID NO: 147280 - DNA, 29 bp, Artificial Sequence
  Description of Artificial Sequence: Synthetic oligonucleotide
cgtggctcaggctagcaagaacagatcac

SEQ ID NO: 147281 - DNA, 30 bp, Artificial Sequence
  Description of Artificial Sequence: Synthetic oligonucleotide
gtggctcaggctagcaagaacagatcactg

SEQ ID NO: 147282 - DNA, 30 bp, Artificial Sequence
  Description of Artificial Sequence: Synthetic oligonucleotide
tggctcaggctagcaagaacagatcactgg

SEQ ID NO: 147283 - DNA, 29 bp, Artificial Sequence
  Description of Artificial Sequence: Synthetic oligonucleotide
ggctcaggctagcaagaacagatcactgg

SEQ ID NO: 147284 - DNA, 29 bp, Artificial Sequence
  Description of Artificial Sequence: Synthetic oligonucleotide
gctcaggctagcaagaacagatcactggc

SEQ ID NO: 147285 - DNA, 30 bp, Artificial Sequence
  Description of Artificial Sequence: Synthetic oligonucleotide
ctcaggctagcaagaacagatcactggcag

SEQ ID NO: 147286 - DNA, 35 bp, Artificial Sequence
  Description of Artificial Sequence: Synthetic oligonucleotide
tcaggctagcaagaacagatcactggcagattttg

SEQ ID NO: 147287 - DNA, 34 bp, Artificial Sequence
  Description of Artificial Sequence: Synthetic oligonucleotide
caggctagcaagaacagatcactggcagattttg

SEQ ID NO: 147288 - DNA, 38 bp, Artificial Sequence
  Description of Artificial Sequence: Synthetic oligonucleotide
aggctagcaagaacagatcactggcagattttgaaaag

SEQ ID NO: 147289 - DNA, 37 bp, Artificial Sequence
  Description of Artificial Sequence: Synthetic oligonucleotide
ggctagcaagaacagatcactggcagattttgaaaag

SEQ ID NO: 147290 - DNA, 37 bp, Artificial Sequence
  Description of Artificial Sequence: Synthetic oligonucleotide
gctagcaagaacagatcactggcagattttgaaaagg

SEQ ID NO: 147291 - DNA, 37 bp, Artificial Sequence
  Description of Artificial Sequence: Synthetic oligonucleotide
ctagcaagaacagatcactggcagattttgaaaaggc

SEQ ID NO: 147292 - DNA, 38 bp, Artificial Sequence
  Description of Artificial Sequence: Synthetic oligonucleotide
tagcaagaacagatcactggcagattttgaaaaggctc

SEQ ID NO: 147293 - DNA, 37 bp, Artificial Sequence
  Description of Artificial Sequence: Synthetic oligonucleotide
agcaagaacagatcactggcagattttgaaaaggctc

SEQ ID NO: 147294 - DNA, 36 bp, Artificial Sequence
  Description of Artificial Sequence: Synthetic oligonucleotide
gcaagaacagatcactggcagattttgaaaaggctc

SEQ ID NO: 147295 - DNA, 37 bp, Artificial Sequence
  Description of Artificial Sequence: Synthetic oligonucleotide
caagaacagatcactggcagattttgaaaaggctctg

SEQ ID NO: 147296 - DNA, 38 bp, Artificial Sequence
  Description of Artificial Sequence: Synthetic oligonucleotide
aagaacagatcactggcagattttgaaaaggctctgac

SEQ ID NO: 147297 - DNA, 37 bp, Artificial Sequence
  Description of Artificial Sequence: Synthetic oligonucleotide
agaacagatcactggcagattttgaaaaggctctgac

SEQ ID NO: 147298 - DNA, 36 bp, Artificial Sequence
  Description of Artificial Sequence: Synthetic oligonucleotide
gaacagatcactggcagattttgaaaaggctctgac

SEQ ID NO: 147299 - DNA, 37 bp, Artificial Sequence
  Description of Artificial Sequence: Synthetic oligonucleotide
aacagatcactggcagattttgaaaaggctctgacag

SEQ ID NO: 147300 - DNA, 36 bp, Artificial Sequence
  Description of Artificial Sequence: Synthetic oligonucleotide
acagatcactggcagattttgaaaaggctctgacag

SEQ ID NO: 147301 - DNA, 35 bp, Artificial Sequence
  Description of Artificial Sequence: Synthetic oligonucleotide
cagatcactggcagattttgaaaaggctctgacag

SEQ ID NO: 147302 - DNA, 39 bp, Artificial Sequence
  Description of Artificial Sequence: Synthetic oligonucleotide
agatcactggcagattttgaaaaggctctgacagattac

SEQ ID NO: 147303 - DNA, 38 bp, Artificial Sequence
  Description of Artificial Sequence: Synthetic oligonucleotide
gatcactggcagattttgaaaaggctctgacagattac

SEQ ID NO: 147304 - DNA, 38 bp, Artificial Sequence
  Description of Artificial Sequence: Synthetic oligonucleotide
atcactggcagattttgaaaaggctctgacagattacc

SEQ ID NO: 147305 - DNA, 37 bp, Artificial Sequence
  Description of Artificial Sequence: Synthetic oligonucleotide
tcactggcagattttgaaaaggctctgacagattacc

SEQ ID NO: 147306 - DNA, 36 bp, Artificial Sequence
  Description of Artificial Sequence: Synthetic oligonucleotide
cactggcagattttgaaaaggctctgacagattacc

SEQ ID NO: 147307 - DNA, 36 bp, Artificial Sequence
  Description of Artificial Sequence: Synthetic oligonucleotide
actggcagattttgaaaaggctctgacagattaccg

SEQ ID NO: 147308 - DNA, 35 bp, Artificial Sequence
  Description of Artificial Sequence: Synthetic oligonucleotide
ctggcagattttgaaaaggctctgacagattaccg

SEQ ID NO: 147309 - DNA, 35 bp, Artificial Sequence
  Description of Artificial Sequence: Synthetic oligonucleotide
tggcagattttgaaaaggctctgacagattaccgg

SEQ ID NO: 147310 - DNA, 34 bp, Artificial Sequence
  Description of Artificial Sequence: Synthetic oligonucleotide
ggcagattttgaaaaggctctgacagattaccgg

SEQ ID NO: 147311 - DNA, 34 bp, Artificial Sequence
  Description of Artificial Sequence: Synthetic oligonucleotide
gcagattttgaaaaggctctgacagattaccggg

SEQ ID NO: 147312 - DNA, 34 bp, Artificial Sequence
  Description of Artificial Sequence: Synthetic oligonucleotide
cagattttgaaaaggctctgacagattaccgggc

SEQ ID NO: 147313 - DNA, 35 bp, Artificial Sequence
  Description of Artificial Sequence: Synthetic oligonucleotide
agattttgaaaaggctctgacagattaccgggcag

SEQ ID NO: 147314 - DNA, 34 bp, Artificial Sequence
  Description of Artificial Sequence: Synthetic oligonucleotide
gattttgaaaaggctctgacagattaccgggcag

SEQ ID NO: 147315 - DNA, 35 bp, Artificial Sequence
  Description of Artificial Sequence: Synthetic oligonucleotide
attttgaaaaggctctgacagattaccgggcagag

SEQ ID NO: 147316 - DNA, 34 bp, Artificial Sequence
  Description of Artificial Sequence: Synthetic oligonucleotide
ttttgaaaaggctctgacagattaccgggcagag

SEQ ID NO: 147317 - DNA, 33 bp, Artificial Sequence
  Description of Artificial Sequence: Synthetic oligonucleotide
tttgaaaaggctctgacagattaccgggcagag

SEQ ID NO: 147318 - DNA, 32 bp, Artificial Sequence
  Description of Artificial Sequence: Synthetic oligonucleotide
ttgaaaaggctctgacagattaccgggcagag

SEQ ID NO: 147319 - DNA, 31 bp, Artificial Sequence
  Description of Artificial Sequence: Synthetic oligonucleotide
tgaaaaggctctgacagattaccgggcagag

SEQ ID NO: 147320 - DNA, 30 bp, Artificial Sequence
  Description of Artificial Sequence: Synthetic oligonucleotide
gaaaaggctctgacagattaccgggcagag

SEQ ID NO: 147321 - DNA, 30 bp, Artificial Sequence
  Description of Artificial Sequence: Synthetic oligonucleotide
aaaaggctctgacagattaccgggcagagc

SEQ ID NO: 147322 - DNA, 29 bp, Artificial Sequence
  Description of Artificial Sequence: Synthetic oligonucleotide
aaaggctctgacagattaccgggcagagc

SEQ ID NO: 147323 - DNA, 28 bp, Artificial Sequence
  Description of Artificial Sequence: Synthetic oligonucleotide
aaggctctgacagattaccgggcagagc

SEQ ID NO: 147324 - DNA, 27 bp, Artificial Sequence
  Description of Artificial Sequence: Synthetic oligonucleotide
aggctctgacagattaccgggcagagc

SEQ ID NO: 147325 - DNA, 27 bp, Artificial Sequence
  Description of Artificial Sequence: Synthetic oligonucleotide
ggctctgacagattaccgggcagagct

SEQ ID NO: 147326 - DNA, 27 bp, Artificial Sequence
  Description of Artificial Sequence: Synthetic oligonucleotide
gctctgacagattaccgggcagagctc

SEQ ID NO: 147327 - DNA, 27 bp, Artificial Sequence
  Description of Artificial Sequence: Synthetic oligonucleotide
ctctgacagattaccgggcagagctcc

SEQ ID NO: 147328 - DNA, 27 bp, Artificial Sequence
  Description of Artificial Sequence: Synthetic oligonucleotide
tctgacagattaccgggcagagctccg

SEQ ID NO: 147329 - DNA, 26 bp, Artificial Sequence
  Description of Artificial Sequence: Synthetic oligonucleotide
ctgacagattaccgggcagagctccg

SEQ ID NO: 147330 - DNA, 26 bp, Artificial Sequence
  Description of Artificial Sequence: Synthetic oligonucleotide
tgacagattaccgggcagagctccgg

SEQ ID NO: 147331 - DNA, 25 bp, Artificial Sequence
  Description of Artificial Sequence: Synthetic oligonucleotide
gacagattaccgggcagagctccgg

SEQ ID NO: 147332 - DNA, 27 bp, Artificial Sequence
  Description of Artificial Sequence: Synthetic oligonucleotide
acagattaccgggcagagctccgggat

SEQ ID NO: 147333 - DNA, 26 bp, Artificial Sequence
  Description of Artificial Sequence: Synthetic oligonucleotide
cagattaccgggcagagctccgggat

SEQ ID NO: 147334 - DNA, 27 bp, Artificial Sequence
  Description of Artificial Sequence: Synthetic oligonucleotide
agattaccgggcagagctccgggatga

SEQ ID NO: 147335 - DNA, 26 bp, Artificial Sequence
  Description of Artificial Sequence: Synthetic oligonucleotide
gattaccgggcagagctccgggatga

SEQ ID NO: 147336 - DNA, 26 bp, Artificial Sequence
  Description of Artificial Sequence: Synthetic oligonucleotide
attaccgggcagagctccgggatgac

SEQ ID NO: 147337 - DNA, 25 bp, Artificial Sequence
  Description of Artificial Sequence: Synthetic oligonucleotide
ttaccgggcagagctccgggatgac

SEQ ID NO: 147338 - DNA, 24 bp, Artificial Sequence
  Description of Artificial Sequence: Synthetic oligonucleotide
taccgggcagagctccgggatgac

SEQ ID NO: 147339 - DNA, 23 bp, Artificial Sequence
  Description of Artificial Sequence: Synthetic oligonucleotide
accgggcagagctccgggatgac

SEQ ID NO: 147340 - DNA, 22 bp, Artificial Sequence
  Description of Artificial Sequence: Synthetic oligonucleotide
ccgggcagagctccgggatgac

SEQ ID NO: 147341 - DNA, 22 bp, Artificial Sequence
  Description of Artificial Sequence: Synthetic oligonucleotide
cgggcagagctccgggatgacc

SEQ ID NO: 147342 - DNA, 25 bp, Artificial Sequence
  Description of Artificial Sequence: Synthetic oligonucleotide
gggcagagctccgggatgacccaat

SEQ ID NO: 147343 - DNA, 27 bp, Artificial Sequence
  Description of Artificial Sequence: Synthetic oligonucleotide
ggcagagctccgggatgacccaatcat

SEQ ID NO: 147344 - DNA, 27 bp, Artificial Sequence
  Description of Artificial Sequence: Synthetic oligonucleotide
gcagagctccgggatgacccaatcatc

SEQ ID NO: 147345 - DNA, 28 bp, Artificial Sequence
  Description of Artificial Sequence: Synthetic oligonucleotide
cagagctccgggatgacccaatcatcag

SEQ ID NO: 147346 - DNA, 28 bp, Artificial Sequence
  Description of Artificial Sequence: Synthetic oligonucleotide
agagctccgggatgacccaatcatcagc

SEQ ID NO: 147347 - DNA, 27 bp, Artificial Sequence
  Description of Artificial Sequence: Synthetic oligonucleotide
gagctccgggatgacccaatcatcagc

SEQ ID NO: 147348 - DNA, 28 bp, Artificial Sequence
  Description of Artificial Sequence: Synthetic oligonucleotide
agctccgggatgacccaatcatcagcac

SEQ ID NO: 147349 - DNA, 27 bp, Artificial Sequence
  Description of Artificial Sequence: Synthetic oligonucleotide
gctccgggatgacccaatcatcagcac

SEQ ID NO: 147350 - DNA, 28 bp, Artificial Sequence
  Description of Artificial Sequence: Synthetic oligonucleotide
ctccgggatgacccaatcatcagcacac

SEQ ID NO: 147351 - DNA, 29 bp, Artificial Sequence
  Description of Artificial Sequence: Synthetic oligonucleotide
tccgggatgacccaatcatcagcacacac

SEQ ID NO: 147352 - DNA, 28 bp, Artificial Sequence
  Description of Artificial Sequence: Synthetic oligonucleotide
ccgggatgacccaatcatcagcacacac

SEQ ID NO: 147353 - DNA, 30 bp, Artificial Sequence
  Description of Artificial Sequence: Synthetic oligonucleotide
cgggatgacccaatcatcagcacacacttg

SEQ ID NO: 147354 - DNA, 30 bp, Artificial Sequence
  Description of Artificial Sequence: Synthetic oligonucleotide
gggatgacccaatcatcagcacacacttgg

SEQ ID NO: 147355 - DNA, 30 bp, Artificial Sequence
  Description of Artificial Sequence: Synthetic oligonucleotide
ggatgacccaatcatcagcacacacttggc

SEQ ID NO: 147356 - DNA, 30 bp, Artificial Sequence
  Description of Artificial Sequence: Synthetic oligonucleotide
gatgacccaatcatcagcacacacttggcc

SEQ ID NO: 147357 - DNA, 32 bp, Artificial Sequence
  Description of Artificial Sequence: Synthetic oligonucleotide
atgacccaatcatcagcacacacttggccaag

SEQ ID NO: 147358 - DNA, 31 bp, Artificial Sequence
  Description of Artificial Sequence: Synthetic oligonucleotide
tgacccaatcatcagcacacacttggccaag

SEQ ID NO: 147359 - DNA, 30 bp, Artificial Sequence
  Description of Artificial Sequence: Synthetic oligonucleotide
gacccaatcatcagcacacacttggccaag

SEQ ID NO: 147360 - DNA, 32 bp, Artificial Sequence
  Description of Artificial Sequence: Synthetic oligonucleotide
acccaatcatcagcacacacttggccaagttg

SEQ ID NO: 147361 - DNA, 31 bp, Artificial Sequence
  Description of Artificial Sequence: Synthetic oligonucleotide
cccaatcatcagcacacacttggccaagttg

SEQ ID NO: 147362 - DNA, 34 bp, Artificial Sequence
  Description of Artificial Sequence: Synthetic oligonucleotide
ccaatcatcagcacacacttggccaagttgtatg

SEQ ID NO: 147363 - DNA, 38 bp, Artificial Sequence
  Description of Artificial Sequence: Synthetic oligonucleotide
caatcatcagcacacacttggccaagttgtatgataac

SEQ ID NO: 147364 - DNA, 41 bp, Artificial Sequence
  Description of Artificial Sequence: Synthetic oligonucleotide
aatcatcagcacacacttggccaagttgtatgataacttac

SEQ ID NO: 147365 - DNA, 40 bp, Artificial Sequence
  Description of Artificial Sequence: Synthetic oligonucleotide
atcatcagcacacacttggccaagttgtatgataacttac

SEQ ID NO: 147366 - DNA, 39 bp, Artificial Sequence
  Description of Artificial Sequence: Synthetic oligonucleotide
tcatcagcacacacttggccaagttgtatgataacttac

SEQ ID NO: 147367 - DNA, 38 bp, Artificial Sequence
  Description of Artificial Sequence: Synthetic oligonucleotide
catcagcacacacttggccaagttgtatgataacttac

SEQ ID NO: 147368 - DNA, 40 bp, Artificial Sequence
  Description of Artificial Sequence: Synthetic oligonucleotide
atcagcacacacttggccaagttgtatgataacttactag

SEQ ID NO: 147369 - DNA, 39 bp, Artificial Sequence
  Description of Artificial Sequence: Synthetic oligonucleotide
tcagcacacacttggccaagttgtatgataacttactag

SEQ ID NO: 147370 - DNA, 38 bp, Artificial Sequence
  Description of Artificial Sequence: Synthetic oligonucleotide
cagcacacacttggccaagttgtatgataacttactag

SEQ ID NO: 147371 - DNA, 40 bp, Artificial Sequence
  Description of Artificial Sequence: Synthetic oligonucleotide
agcacacacttggccaagttgtatgataacttactagaac

SEQ ID NO: 147372 - DNA, 39 bp, Artificial Sequence
  Description of Artificial Sequence: Synthetic oligonucleotide
gcacacacttggccaagttgtatgataacttactagaac

SEQ ID NO: 147373 - DNA, 40 bp, Artificial Sequence
  Description of Artificial Sequence: Synthetic oligonucleotide
cacacacttggccaagttgtatgataacttactagaacag

SEQ ID NO: 147374 - DNA, 43 bp, Artificial Sequence
  Description of Artificial Sequence: Synthetic oligonucleotide
acacacttggccaagttgtatgataacttactagaacagaatc

SEQ ID NO: 147375 - DNA, 42 bp, Artificial Sequence
  Description of Artificial Sequence: Synthetic oligonucleotide
cacacttggccaagttgtatgataacttactagaacagaatc

SEQ ID NO: 147376 - DNA, 43 bp, Artificial Sequence
  Description of Artificial Sequence: Synthetic oligonucleotide
acacttggccaagttgtatgataacttactagaacagaatctg

SEQ ID NO: 147377 - DNA, 42 bp, Artificial Sequence
  Description of Artificial Sequence: Synthetic oligonucleotide
cacttggccaagttgtatgataacttactagaacagaatctg

SEQ ID NO: 147378 - DNA, 44 bp, Artificial Sequence
  Description of Artificial Sequence: Synthetic oligonucleotide
acttggccaagttgtatgataacttactagaacagaatctgatc

SEQ ID NO: 147379 - DNA, 43 bp, Artificial Sequence
  Description of Artificial Sequence: Synthetic oligonucleotide
cttggccaagttgtatgataacttactagaacagaatctgatc

SEQ ID NO: 147380 - DNA, 43 bp, Artificial Sequence
  Description of Artificial Sequence: Synthetic oligonucleotide
ttggccaagttgtatgataacttactagaacagaatctgatcc

SEQ ID NO: 147381 - DNA, 42 bp, Artificial Sequence
  Description of Artificial Sequence: Synthetic oligonucleotide
tggccaagttgtatgataacttactagaacagaatctgatcc

SEQ ID NO: 147382 - DNA, 41 bp, Artificial Sequence
  Description of Artificial Sequence: Synthetic oligonucleotide
ggccaagttgtatgataacttactagaacagaatctgatcc

SEQ ID NO: 147383 - DNA, 41 bp, Artificial Sequence
  Description of Artificial Sequence: Synthetic oligonucleotide
gccaagttgtatgataacttactagaacagaatctgatccg

SEQ ID NO: 147384 - DNA, 42 bp, Artificial Sequence
  Description of Artificial Sequence: Synthetic oligonucleotide
ccaagttgtatgataacttactagaacagaatctgatccgag

SEQ ID NO: 147385 - DNA, 43 bp, Artificial Sequence
  Description of Artificial Sequence: Synthetic oligonucleotide
caagttgtatgataacttactagaacagaatctgatccgagtc

SEQ ID NO: 147386 - DNA, 46 bp, Artificial Sequence
  Description of Artificial Sequence: Synthetic oligonucleotide
aagttgtatgataacttactagaacagaatctgatccgagtcattg

SEQ ID NO: 147387 - DNA, 45 bp, Artificial Sequence
  Description of Artificial Sequence: Synthetic oligonucleotide
agttgtatgataacttactagaacagaatctgatccgagtcattg

SEQ ID NO: 147388 - DNA, 44 bp, Artificial Sequence
  Description of Artificial Sequence: Synthetic oligonucleotide
gttgtatgataacttactagaacagaatctgatccgagtcattg

SEQ ID NO: 147389 - DNA, 45 bp, Artificial Sequence
  Description of Artificial Sequence: Synthetic oligonucleotide
ttgtatgataacttactagaacagaatctgatccgagtcattgag

SEQ ID NO: 147390 - DNA, 44 bp, Artificial Sequence
  Description of Artificial Sequence: Synthetic oligonucleotide
tgtatgataacttactagaacagaatctgatccgagtcattgag

SEQ ID NO: 147391 - DNA, 43 bp, Artificial Sequence
  Description of Artificial Sequence: Synthetic oligonucleotide
gtatgataacttactagaacagaatctgatccgagtcattgag

SEQ ID NO: 147392 - DNA, 43 bp, Artificial Sequence
  Description of Artificial Sequence: Synthetic oligonucleotide
tatgataacttactagaacagaatctgatccgagtcattgagc

SEQ ID NO: 147393 - DNA, 42 bp, Artificial Sequence
  Description of Artificial Sequence: Synthetic oligonucleotide
atgataacttactagaacagaatctgatccgagtcattgagc

SEQ ID NO: 147394 - DNA, 41 bp, Artificial Sequence
  Description of Artificial Sequence: Synthetic oligonucleotide
tgataacttactagaacagaatctgatccgagtcattgagc

SEQ ID NO: 147395 - DNA, 40 bp, Artificial Sequence
  Description of Artificial Sequence: Synthetic oligonucleotide
gataacttactagaacagaatctgatccgagtcattgagc

SEQ ID NO: 147396 - DNA, 40 bp, Artificial Sequence
  Description of Artificial Sequence: Synthetic oligonucleotide
ataacttactagaacagaatctgatccgagtcattgagcc

SEQ ID NO: 147397 - DNA, 39 bp, Artificial Sequence
  Description of Artificial Sequence: Synthetic oligonucleotide
taacttactagaacagaatctgatccgagtcattgagcc

SEQ ID NO: 147398 - DNA, 38 bp, Artificial Sequence
  Description of Artificial Sequence: Synthetic oligonucleotide
aacttactagaacagaatctgatccgagtcattgagcc

SEQ ID NO: 147399 - DNA, 37 bp, Artificial Sequence
  Description of Artificial Sequence: Synthetic oligonucleotide
acttactagaacagaatctgatccgagtcattgagcc

SEQ ID NO: 147400 - DNA, 36 bp, Artificial Sequence
  Description of Artificial Sequence: Synthetic oligonucleotide
cttactagaacagaatctgatccgagtcattgagcc

SEQ ID NO: 147401 - DNA, 41 bp, Artificial Sequence
  Description of Artificial Sequence: Synthetic oligonucleotide
ttactagaacagaatctgatccgagtcattgagcctttttc

SEQ ID NO: 147402 - DNA, 40 bp, Artificial Sequence
  Description of Artificial Sequence: Synthetic oligonucleotide
tactagaacagaatctgatccgagtcattgagcctttttc

SEQ ID NO: 147403 - DNA, 39 bp, Artificial Sequence
  Description of Artificial Sequence: Synthetic oligonucleotide
actagaacagaatctgatccgagtcattgagcctttttc

SEQ ID NO: 147404 - DNA, 38 bp, Artificial Sequence
  Description of Artificial Sequence: Synthetic oligonucleotide
ctagaacagaatctgatccgagtcattgagcctttttc

SEQ ID NO: 147405 - DNA, 38 bp, Artificial Sequence
  Description of Artificial Sequence: Synthetic oligonucleotide
tagaacagaatctgatccgagtcattgagcctttttcc

SEQ ID NO: 147406 - DNA, 37 bp, Artificial Sequence
  Description of Artificial Sequence: Synthetic oligonucleotide
agaacagaatctgatccgagtcattgagcctttttcc

SEQ ID NO: 147407 - DNA, 36 bp, Artificial Sequence
  Description of Artificial Sequence: Synthetic oligonucleotide
gaacagaatctgatccgagtcattgagcctttttcc

SEQ ID NO: 147408 - DNA, 37 bp, Artificial Sequence
  Description of Artificial Sequence: Synthetic oligonucleotide
aacagaatctgatccgagtcattgagcctttttccag

SEQ ID NO: 147409 - DNA, 36 bp, Artificial Sequence
  Description of Artificial Sequence: Synthetic oligonucleotide
acagaatctgatccgagtcattgagcctttttccag

SEQ ID NO: 147410 - DNA, 35 bp, Artificial Sequence
  Description of Artificial Sequence: Synthetic oligonucleotide
cagaatctgatccgagtcattgagcctttttccag

SEQ ID NO: 147411 - DNA, 36 bp, Artificial Sequence
  Description of Artificial Sequence: Synthetic oligonucleotide
agaatctgatccgagtcattgagcctttttccagag

SEQ ID NO: 147412 - DNA, 35 bp, Artificial Sequence
  Description of Artificial Sequence: Synthetic oligonucleotide
gaatctgatccgagtcattgagcctttttccagag

SEQ ID NO: 147413 - DNA, 37 bp, Artificial Sequence
  Description of Artificial Sequence: Synthetic oligonucleotide
aatctgatccgagtcattgagcctttttccagagtac

SEQ ID NO: 147414 - DNA, 36 bp, Artificial Sequence
  Description of Artificial Sequence: Synthetic oligonucleotide
atctgatccgagtcattgagcctttttccagagtac

SEQ ID NO: 147415 - DNA, 35 bp, Artificial Sequence
  Description of Artificial Sequence: Synthetic oligonucleotide
tctgatccgagtcattgagcctttttccagagtac

SEQ ID NO: 147416 - DNA, 34 bp, Artificial Sequence
  Description of Artificial Sequence: Synthetic oligonucleotide
ctgatccgagtcattgagcctttttccagagtac

SEQ ID NO: 147417 - DNA, 35 bp, Artificial Sequence
  Description of Artificial Sequence: Synthetic oligonucleotide
tgatccgagtcattgagcctttttccagagtacag

SEQ ID NO: 147418 - DNA, 34 bp, Artificial Sequence
  Description of Artificial Sequence: Synthetic oligonucleotide
gatccgagtcattgagcctttttccagagtacag

SEQ ID NO: 147419 - DNA, 37 bp, Artificial Sequence
  Description of Artificial Sequence: Synthetic oligonucleotide
atccgagtcattgagcctttttccagagtacagattg

SEQ ID NO: 147420 - DNA, 36 bp, Artificial Sequence
  Description of Artificial Sequence: Synthetic oligonucleotide
tccgagtcattgagcctttttccagagtacagattg

SEQ ID NO: 147421 - DNA, 35 bp, Artificial Sequence
  Description of Artificial Sequence: Synthetic oligonucleotide
ccgagtcattgagcctttttccagagtacagattg

SEQ ID NO: 147422 - DNA, 37 bp, Artificial Sequence
  Description of Artificial Sequence: Synthetic oligonucleotide
cgagtcattgagcctttttccagagtacagattgaac

SEQ ID NO: 147423 - DNA, 38 bp, Artificial Sequence
  Description of Artificial Sequence: Synthetic oligonucleotide
gagtcattgagcctttttccagagtacagattgaacac

SEQ ID NO: 147424 - DNA, 42 bp, Artificial Sequence
  Description of Artificial Sequence: Synthetic oligonucleotide
agtcattgagcctttttccagagtacagattgaacacatatc

SEQ ID NO: 147425 - DNA, 41 bp, Artificial Sequence
  Description of Artificial Sequence: Synthetic oligonucleotide
gtcattgagcctttttccagagtacagattgaacacatatc

SEQ ID NO: 147426 - DNA, 43 bp, Artificial Sequence
  Description of Artificial Sequence: Synthetic oligonucleotide
tcattgagcctttttccagagtacagattgaacacatatctag

SEQ ID NO: 147427 - DNA, 42 bp, Artificial Sequence
  Description of Artificial Sequence: Synthetic oligonucleotide
cattgagcctttttccagagtacagattgaacacatatctag

SEQ ID NO: 147428 - DNA, 43 bp, Artificial Sequence
  Description of Artificial Sequence: Synthetic oligonucleotide
attgagcctttttccagagtacagattgaacacatatctagtc

SEQ ID NO: 147429 - DNA, 42 bp, Artificial Sequence
  Description of Artificial Sequence: Synthetic oligonucleotide
ttgagcctttttccagagtacagattgaacacatatctagtc

SEQ ID NO: 147430 - DNA, 41 bp, Artificial Sequence
  Description of Artificial Sequence: Synthetic oligonucleotide
tgagcctttttccagagtacagattgaacacatatctagtc

SEQ ID NO: 147431 - DNA, 40 bp, Artificial Sequence
  Description of Artificial Sequence: Synthetic oligonucleotide
gagcctttttccagagtacagattgaacacatatctagtc

SEQ ID NO: 147432 - DNA, 41 bp, Artificial Sequence
  Description of Artificial Sequence: Synthetic oligonucleotide
agcctttttccagagtacagattgaacacatatctagtctc

SEQ ID NO: 147433 - DNA, 40 bp, Artificial Sequence
  Description of Artificial Sequence: Synthetic oligonucleotide
gcctttttccagagtacagattgaacacatatctagtctc

SEQ ID NO: 147434 - DNA, 42 bp, Artificial Sequence
  Description of Artificial Sequence: Synthetic oligonucleotide
cctttttccagagtacagattgaacacatatctagtctcatc

SEQ ID NO: 147435 - DNA, 45 bp, Artificial Sequence
  Description of Artificial Sequence: Synthetic oligonucleotide
ctttttccagagtacagattgaacacatatctagtctcatcaaac

SEQ ID NO: 147436 - DNA, 46 bp, Artificial Sequence
  Description of Artificial Sequence: Synthetic oligonucleotide
tttttccagagtacagattgaacacatatctagtctcatcaaactc

SEQ ID NO: 147437 - DNA, 45 bp, Artificial Sequence
  Description of Artificial Sequence: Synthetic oligonucleotide
ttttccagagtacagattgaacacatatctagtctcatcaaactc

SEQ ID NO: 147438 - DNA, 44 bp, Artificial Sequence
  Description of Artificial Sequence: Synthetic oligonucleotide
tttccagagtacagattgaacacatatctagtctcatcaaactc

SEQ ID NO: 147439 - DNA, 43 bp, Artificial Sequence
  Description of Artificial Sequence: Synthetic oligonucleotide
ttccagagtacagattgaacacatatctagtctcatcaaactc

SEQ ID NO: 147440 - DNA, 42 bp, Artificial Sequence
  Description of Artificial Sequence: Synthetic oligonucleotide
tccagagtacagattgaacacatatctagtctcatcaaactc

SEQ ID NO: 147441 - DNA, 41 bp, Artificial Sequence
  Description of Artificial Sequence: Synthetic oligonucleotide
ccagagtacagattgaacacatatctagtctcatcaaactc

SEQ ID NO: 147442 - DNA, 42 bp, Artificial Sequence
  Description of Artificial Sequence: Synthetic oligonucleotide
cagagtacagattgaacacatatctagtctcatcaaactctc

SEQ ID NO: 147443 - DNA, 42 bp, Artificial Sequence
  Description of Artificial Sequence: Synthetic oligonucleotide
agagtacagattgaacacatatctagtctcatcaaactctcc

SEQ ID NO: 147444 - DNA, 41 bp, Artificial Sequence
  Description of Artificial Sequence: Synthetic oligonucleotide
gagtacagattgaacacatatctagtctcatcaaactctcc

SEQ ID NO: 147445 - DNA, 43 bp, Artificial Sequence
  Description of Artificial Sequence: Synthetic oligonucleotide
agtacagattgaacacatatctagtctcatcaaactctccaag

SEQ ID NO: 147446 - DNA, 42 bp, Artificial Sequence
  Description of Artificial Sequence: Synthetic oligonucleotide
gtacagattgaacacatatctagtctcatcaaactctccaag

SEQ ID NO: 147447 - DNA, 42 bp, Artificial Sequence
  Description of Artificial Sequence: Synthetic oligonucleotide
tacagattgaacacatatctagtctcatcaaactctccaagg

SEQ ID NO: 147448 - DNA, 41 bp, Artificial Sequence
  Description of Artificial Sequence: Synthetic oligonucleotide
acagattgaacacatatctagtctcatcaaactctccaagg

SEQ ID NO: 147449 - DNA, 40 bp, Artificial Sequence
  Description of Artificial Sequence: Synthetic oligonucleotide
cagattgaacacatatctagtctcatcaaactctccaagg

SEQ ID NO: 147450 - DNA, 40 bp, Artificial Sequence
  Description of Artificial Sequence: Synthetic oligonucleotide
agattgaacacatatctagtctcatcaaactctccaaggc

SEQ ID NO: 147451 - DNA, 39 bp, Artificial Sequence
  Description of Artificial Sequence: Synthetic oligonucleotide
gattgaacacatatctagtctcatcaaactctccaaggc

SEQ ID NO: 147452 - DNA, 39 bp, Artificial Sequence
  Description of Artificial Sequence: Synthetic oligonucleotide
attgaacacatatctagtctcatcaaactctccaaggcc

SEQ ID NO: 147453 - DNA, 38 bp, Artificial Sequence
  Description of Artificial Sequence: Synthetic oligonucleotide
ttgaacacatatctagtctcatcaaactctccaaggcc

SEQ ID NO: 147454 - DNA, 37 bp, Artificial Sequence
  Description of Artificial Sequence: Synthetic oligonucleotide
tgaacacatatctagtctcatcaaactctccaaggcc

SEQ ID NO: 147455 - DNA, 36 bp, Artificial Sequence
  Description of Artificial Sequence: Synthetic oligonucleotide
gaacacatatctagtctcatcaaactctccaaggcc

SEQ ID NO: 147456 - DNA, 36 bp, Artificial Sequence
  Description of Artificial Sequence: Synthetic oligonucleotide
aacacatatctagtctcatcaaactctccaaggccg

SEQ ID NO: 147457 - DNA, 35 bp, Artificial Sequence
  Description of Artificial Sequence: Synthetic oligonucleotide
acacatatctagtctcatcaaactctccaaggccg

SEQ ID NO: 147458 - DNA, 34 bp, Artificial Sequence
  Description of Artificial Sequence: Synthetic oligonucleotide
cacatatctagtctcatcaaactctccaaggccg

SEQ ID NO: 147459 - DNA, 35 bp, Artificial Sequence
  Description of Artificial Sequence: Synthetic oligonucleotide
acatatctagtctcatcaaactctccaaggccgac

SEQ ID NO: 147460 - DNA, 34 bp, Artificial Sequence
  Description of Artificial Sequence: Synthetic oligonucleotide
catatctagtctcatcaaactctccaaggccgac

SEQ ID NO: 147461 - DNA, 34 bp, Artificial Sequence
  Description of Artificial Sequence: Synthetic oligonucleotide
atatctagtctcatcaaactctccaaggccgacg

SEQ ID NO: 147462 - DNA, 33 bp, Artificial Sequence
  Description of Artificial Sequence: Synthetic oligonucleotide
tatctagtctcatcaaactctccaaggccgacg

SEQ ID NO: 147463 - DNA, 32 bp, Artificial Sequence
  Description of Artificial Sequence: Synthetic oligonucleotide
atctagtctcatcaaactctccaaggccgacg

SEQ ID NO: 147464 - DNA, 31 bp, Artificial Sequence
  Description of Artificial Sequence: Synthetic oligonucleotide
tctagtctcatcaaactctccaaggccgacg

SEQ ID NO: 147465 - DNA, 30 bp, Artificial Sequence
  Description of Artificial Sequence: Synthetic oligonucleotide
ctagtctcatcaaactctccaaggccgacg

SEQ ID NO: 147466 - DNA, 31 bp, Artificial Sequence
  Description of Artificial Sequence: Synthetic oligonucleotide
tagtctcatcaaactctccaaggccgacgtg

SEQ ID NO: 147467 - DNA, 30 bp, Artificial Sequence
  Description of Artificial Sequence: Synthetic oligonucleotide
agtctcatcaaactctccaaggccgacgtg

SEQ ID NO: 147468 - DNA, 29 bp, Artificial Sequence
  Description of Artificial Sequence: Synthetic oligonucleotide
gtctcatcaaactctccaaggccgacgtg

SEQ ID NO: 147469 - DNA, 29 bp, Artificial Sequence
  Description of Artificial Sequence: Synthetic oligonucleotide
tctcatcaaactctccaaggccgacgtgg

SEQ ID NO: 147470 - DNA, 28 bp, Artificial Sequence
  Description of Artificial Sequence: Synthetic oligonucleotide
ctcatcaaactctccaaggccgacgtgg

SEQ ID NO: 147471 - DNA, 31 bp, Artificial Sequence
  Description of Artificial Sequence: Synthetic oligonucleotide
tcatcaaactctccaaggccgacgtggaaag

SEQ ID NO: 147472 - DNA, 30 bp, Artificial Sequence
  Description of Artificial Sequence: Synthetic oligonucleotide
catcaaactctccaaggccgacgtggaaag

SEQ ID NO: 147473 - DNA, 30 bp, Artificial Sequence
  Description of Artificial Sequence: Synthetic oligonucleotide
atcaaactctccaaggccgacgtggaaagg

SEQ ID NO: 147474 - DNA, 29 bp, Artificial Sequence
  Description of Artificial Sequence: Synthetic oligonucleotide
tcaaactctccaaggccgacgtggaaagg

SEQ ID NO: 147475 - DNA, 28 bp, Artificial Sequence
  Description of Artificial Sequence: Synthetic oligonucleotide
caaactctccaaggccgacgtggaaagg

SEQ ID NO: 147476 - DNA, 35 bp, Artificial Sequence
  Description of Artificial Sequence: Synthetic oligonucleotide
aaactctccaaggccgacgtggaaaggaaattatc

SEQ ID NO: 147477 - DNA, 34 bp, Artificial Sequence
  Description of Artificial Sequence: Synthetic oligonucleotide
aactctccaaggccgacgtggaaaggaaattatc

SEQ ID NO: 147478 - DNA, 33 bp, Artificial Sequence
  Description of Artificial Sequence: Synthetic oligonucleotide
actctccaaggccgacgtggaaaggaaattatc

SEQ ID NO: 147479 - DNA, 32 bp, Artificial Sequence
  Description of Artificial Sequence: Synthetic oligonucleotide
ctctccaaggccgacgtggaaaggaaattatc

SEQ ID NO: 147480 - DNA, 33 bp, Artificial Sequence
  Description of Artificial Sequence: Synthetic oligonucleotide
tctccaaggccgacgtggaaaggaaattatcac

SEQ ID NO: 147481 - DNA, 32 bp, Artificial Sequence
  Description of Artificial Sequence: Synthetic oligonucleotide
ctccaaggccgacgtggaaaggaaattatcac

SEQ ID NO: 147482 - DNA, 33 bp, Artificial Sequence
  Description of Artificial Sequence: Synthetic oligonucleotide
tccaaggccgacgtggaaaggaaattatcacag

SEQ ID NO: 147483 - DNA, 32 bp, Artificial Sequence
  Description of Artificial Sequence: Synthetic oligonucleotide
ccaaggccgacgtggaaaggaaattatcacag

SEQ ID NO: 147484 - DNA, 34 bp, Artificial Sequence
  Description of Artificial Sequence: Synthetic oligonucleotide
caaggccgacgtggaaaggaaattatcacagatg

SEQ ID NO: 147485 - DNA, 37 bp, Artificial Sequence
  Description of Artificial Sequence: Synthetic oligonucleotide
aaggccgacgtggaaaggaaattatcacagatgattc

SEQ ID NO: 147486 - DNA, 36 bp, Artificial Sequence
  Description of Artificial Sequence: Synthetic oligonucleotide
aggccgacgtggaaaggaaattatcacagatgattc

SEQ ID NO: 147487 - DNA, 35 bp, Artificial Sequence
  Description of Artificial Sequence: Synthetic oligonucleotide
ggccgacgtggaaaggaaattatcacagatgattc

SEQ ID NO: 147488 - DNA, 37 bp, Artificial Sequence
  Description of Artificial Sequence: Synthetic oligonucleotide
gccgacgtggaaaggaaattatcacagatgattcttg

SEQ ID NO: 147489 - DNA, 38 bp, Artificial Sequence
  Description of Artificial Sequence: Synthetic oligonucleotide
ccgacgtggaaaggaaattatcacagatgattcttgac

SEQ ID NO: 147490 - DNA, 40 bp, Artificial Sequence
  Description of Artificial Sequence: Synthetic oligonucleotide
cgacgtggaaaggaaattatcacagatgattcttgacaag

SEQ ID NO: 147491 - DNA, 46 bp, Artificial Sequence
  Description of Artificial Sequence: Synthetic oligonucleotide
gacgtggaaaggaaattatcacagatgattcttgacaagaaatttc

SEQ ID NO: 147492 - DNA, 48 bp, Artificial Sequence
  Description of Artificial Sequence: Synthetic oligonucleotide
acgtggaaaggaaattatcacagatgattcttgacaagaaatttcatg

SEQ ID NO: 147493 - DNA, 47 bp, Artificial Sequence
  Description of Artificial Sequence: Synthetic oligonucleotide
cgtggaaaggaaattatcacagatgattcttgacaagaaatttcatg

SEQ ID NO: 147494 - DNA, 47 bp, Artificial Sequence
  Description of Artificial Sequence: Synthetic oligonucleotide
gtggaaaggaaattatcacagatgattcttgacaagaaatttcatgg

SEQ ID NO: 147495 - DNA, 47 bp, Artificial Sequence
  Description of Artificial Sequence: Synthetic oligonucleotide
tggaaaggaaattatcacagatgattcttgacaagaaatttcatggg

SEQ ID NO: 147496 - DNA, 46 bp, Artificial Sequence
  Description of Artificial Sequence: Synthetic oligonucleotide
ggaaaggaaattatcacagatgattcttgacaagaaatttcatggg

SEQ ID NO: 147497 - DNA, 51 bp, Artificial Sequence
  Description of Artificial Sequence: Synthetic oligonucleotide
gaaaggaaattatcacagatgattcttgacaagaaatttcatgggattttg

SEQ ID NO: 147498 - DNA, 51 bp, Artificial Sequence
  Description of Artificial Sequence: Synthetic oligonucleotide
aaaggaaattatcacagatgattcttgacaagaaatttcatgggattttgg

SEQ ID NO: 147499 - DNA, 50 bp, Artificial Sequence
  Description of Artificial Sequence: Synthetic oligonucleotide
aaggaaattatcacagatgattcttgacaagaaatttcatgggattttgg

SEQ ID NO: 147500 - DNA, 49 bp, Artificial Sequence
  Description of Artificial Sequence: Synthetic oligonucleotide
aggaaattatcacagatgattcttgacaagaaatttcatgggattttgg

SEQ ID NO: 147501 - DNA, 48 bp, Artificial Sequence
  Description of Artificial Sequence: Synthetic oligonucleotide
ggaaattatcacagatgattcttgacaagaaatttcatgggattttgg

SEQ ID NO: 147502 - DNA, 49 bp, Artificial Sequence
  Description of Artificial Sequence: Synthetic oligonucleotide
gaaattatcacagatgattcttgacaagaaatttcatgggattttggac

SEQ ID NO: 147503 - DNA, 49 bp, Artificial Sequence
  Description of Artificial Sequence: Synthetic oligonucleotide
aaattatcacagatgattcttgacaagaaatttcatgggattttggacc

SEQ ID NO: 147504 - DNA, 48 bp, Artificial Sequence
  Description of Artificial Sequence: Synthetic oligonucleotide
aattatcacagatgattcttgacaagaaatttcatgggattttggacc

SEQ ID NO: 147505 - DNA, 47 bp, Artificial Sequence
  Description of Artificial Sequence: Synthetic oligonucleotide
attatcacagatgattcttgacaagaaatttcatgggattttggacc

SEQ ID NO: 147506 - DNA, 46 bp, Artificial Sequence
  Description of Artificial Sequence: Synthetic oligonucleotide
ttatcacagatgattcttgacaagaaatttcatgggattttggacc

SEQ ID NO: 147507 - DNA, 45 bp, Artificial Sequence
  Description of Artificial Sequence: Synthetic oligonucleotide
tatcacagatgattcttgacaagaaatttcatgggattttggacc

SEQ ID NO: 147508 - DNA, 44 bp, Artificial Sequence
  Description of Artificial Sequence: Synthetic oligonucleotide
atcacagatgattcttgacaagaaatttcatgggattttggacc

SEQ ID NO: 147509 - DNA, 43 bp, Artificial Sequence
  Description of Artificial Sequence: Synthetic oligonucleotide
tcacagatgattcttgacaagaaatttcatgggattttggacc

SEQ ID NO: 147510 - DNA, 42 bp, Artificial Sequence
  Description of Artificial Sequence: Synthetic oligonucleotide
cacagatgattcttgacaagaaatttcatgggattttggacc

SEQ ID NO: 147511 - DNA, 43 bp, Artificial Sequence
  Description of Artificial Sequence: Synthetic oligonucleotide
acagatgattcttgacaagaaatttcatgggattttggaccag

SEQ ID NO: 147512 - DNA, 42 bp, Artificial Sequence
  Description of Artificial Sequence: Synthetic oligonucleotide
cagatgattcttgacaagaaatttcatgggattttggaccag

SEQ ID NO: 147513 - DNA, 42 bp, Artificial Sequence
  Description of Artificial Sequence: Synthetic oligonucleotide
agatgattcttgacaagaaatttcatgggattttggaccagg

SEQ ID NO: 147514 - DNA, 41 bp, Artificial Sequence
  Description of Artificial Sequence: Synthetic oligonucleotide
gatgattcttgacaagaaatttcatgggattttggaccagg

SEQ ID NO: 147515 - DNA, 41 bp, Artificial Sequence
  Description of Artificial Sequence: Synthetic oligonucleotide
atgattcttgacaagaaatttcatgggattttggaccaggg

SEQ ID NO: 147516 - DNA, 40 bp, Artificial Sequence
  Description of Artificial Sequence: Synthetic oligonucleotide
tgattcttgacaagaaatttcatgggattttggaccaggg

SEQ ID NO: 147517 - DNA, 39 bp, Artificial Sequence
  Description of Artificial Sequence: Synthetic oligonucleotide
gattcttgacaagaaatttcatgggattttggaccaggg

SEQ ID NO: 147518 - DNA, 39 bp, Artificial Sequence
  Description of Artificial Sequence: Synthetic oligonucleotide
attcttgacaagaaatttcatgggattttggaccagggg

SEQ ID NO: 147519 - DNA, 38 bp, Artificial Sequence
  Description of Artificial Sequence: Synthetic oligonucleotide
ttcttgacaagaaatttcatgggattttggaccagggg

SEQ ID NO: 147520 - DNA, 37 bp, Artificial Sequence
  Description of Artificial Sequence: Synthetic oligonucleotide
tcttgacaagaaatttcatgggattttggaccagggg

SEQ ID NO: 147521 - DNA, 36 bp, Artificial Sequence
  Description of Artificial Sequence: Synthetic oligonucleotide
cttgacaagaaatttcatgggattttggaccagggg

SEQ ID NO: 147522 - DNA, 36 bp, Artificial Sequence
  Description of Artificial Sequence: Synthetic oligonucleotide
ttgacaagaaatttcatgggattttggaccaggggg

SEQ ID NO: 147523 - DNA, 35 bp, Artificial Sequence
  Description of Artificial Sequence: Synthetic oligonucleotide
tgacaagaaatttcatgggattttggaccaggggg

SEQ ID NO: 147524 - DNA, 34 bp, Artificial Sequence
  Description of Artificial Sequence: Synthetic oligonucleotide
gacaagaaatttcatgggattttggaccaggggg

SEQ ID NO: 147525 - DNA, 35 bp, Artificial Sequence
  Description of Artificial Sequence: Synthetic oligonucleotide
acaagaaatttcatgggattttggaccagggggag

SEQ ID NO: 147526 - DNA, 34 bp, Artificial Sequence
  Description of Artificial Sequence: Synthetic oligonucleotide
caagaaatttcatgggattttggaccagggggag

SEQ ID NO: 147527 - DNA, 34 bp, Artificial Sequence
  Description of Artificial Sequence: Synthetic oligonucleotide
aagaaatttcatgggattttggaccagggggagg

SEQ ID NO: 147528 - DNA, 33 bp, Artificial Sequence
  Description of Artificial Sequence: Synthetic oligonucleotide
agaaatttcatgggattttggaccagggggagg

SEQ ID NO: 147529 - DNA, 32 bp, Artificial Sequence
  Description of Artificial Sequence: Synthetic oligonucleotide
gaaatttcatgggattttggaccagggggagg

SEQ ID NO: 147530 - DNA, 32 bp, Artificial Sequence
  Description of Artificial Sequence: Synthetic oligonucleotide
aaatttcatgggattttggaccagggggaggg

SEQ ID NO: 147531 - DNA, 31 bp, Artificial Sequence
  Description of Artificial Sequence: Synthetic oligonucleotide
aatttcatgggattttggaccagggggaggg

SEQ ID NO: 147532 - DNA, 30 bp, Artificial Sequence
  Description of Artificial Sequence: Synthetic oligonucleotide
atttcatgggattttggaccagggggaggg

SEQ ID NO: 147533 - DNA, 29 bp, Artificial Sequence
  Description of Artificial Sequence: Synthetic oligonucleotide
tttcatgggattttggaccagggggaggg

SEQ ID NO: 147534 - DNA, 28 bp, Artificial Sequence
  Description of Artificial Sequence: Synthetic oligonucleotide
ttcatgggattttggaccagggggaggg

SEQ ID NO: 147535 - DNA, 27 bp, Artificial Sequence
  Description of Artificial Sequence: Synthetic oligonucleotide
tcatgggattttggaccagggggaggg

SEQ ID NO: 147536 - DNA, 27 bp, Artificial Sequence
  Description of Artificial Sequence: Synthetic oligonucleotide
catgggattttggaccagggggagggt

SEQ ID NO: 147537 - DNA, 27 bp, Artificial Sequence
  Description of Artificial Sequence: Synthetic oligonucleotide
atgggattttggaccagggggagggtg

SEQ ID NO: 147538 - DNA, 27 bp, Artificial Sequence
  Description of Artificial Sequence: Synthetic oligonucleotide
tgggattttggaccagggggagggtgt

SEQ ID NO: 147539 - DNA, 26 bp, Artificial Sequence
  Description of Artificial Sequence: Synthetic oligonucleotide
gggattttggaccagggggagggtgt

SEQ ID NO: 147540 - DNA, 26 bp, Artificial Sequence
  Description of Artificial Sequence: Synthetic oligonucleotide
ggattttggaccagggggagggtgtc

SEQ ID NO: 147541 - DNA, 27 bp, Artificial Sequence
  Description of Artificial Sequence: Synthetic oligonucleotide
gattttggaccagggggagggtgtcct

SEQ ID NO: 147542 - DNA, 27 bp, Artificial Sequence
  Description of Artificial Sequence: Synthetic oligonucleotide
attttggaccagggggagggtgtcctg

SEQ ID NO: 147543 - DNA, 27 bp, Artificial Sequence
  Description of Artificial Sequence: Synthetic oligonucleotide
ttttggaccagggggagggtgtcctga

SEQ ID NO: 147544 - DNA, 27 bp, Artificial Sequence
  Description of Artificial Sequence: Synthetic oligonucleotide
tttggaccagggggagggtgtcctgat

SEQ ID NO: 147545 - DNA, 27 bp, Artificial Sequence
  Description of Artificial Sequence: Synthetic oligonucleotide
ttggaccagggggagggtgtcctgatt

SEQ ID NO: 147546 - DNA, 27 bp, Artificial Sequence
  Description of Artificial Sequence: Synthetic oligonucleotide
tggaccagggggagggtgtcctgatta

SEQ ID NO: 147547 - DNA, 27 bp, Artificial Sequence
  Description of Artificial Sequence: Synthetic oligonucleotide
ggaccagggggagggtgtcctgattat

SEQ ID NO: 147548 - DNA, 30 bp, Artificial Sequence
  Description of Artificial Sequence: Synthetic oligonucleotide
gaccagggggagggtgtcctgattattttc

SEQ ID NO: 147549 - DNA, 30 bp, Artificial Sequence
  Description of Artificial Sequence: Synthetic oligonucleotide
accagggggagggtgtcctgattattttcg

SEQ ID NO: 147550 - DNA, 29 bp, Artificial Sequence
  Description of Artificial Sequence: Synthetic oligonucleotide
ccagggggagggtgtcctgattattttcg

SEQ ID NO: 147551 - DNA, 31 bp, Artificial Sequence
  Description of Artificial Sequence: Synthetic oligonucleotide
cagggggagggtgtcctgattattttcgatg

SEQ ID NO: 147552 - DNA, 33 bp, Artificial Sequence
  Description of Artificial Sequence: Synthetic oligonucleotide
agggggagggtgtcctgattattttcgatgaac

SEQ ID NO: 147553 - DNA, 32 bp, Artificial Sequence
  Description of Artificial Sequence: Synthetic oligonucleotide
gggggagggtgtcctgattattttcgatgaac

SEQ ID NO: 147554 - DNA, 32 bp, Artificial Sequence
  Description of Artificial Sequence: Synthetic oligonucleotide
ggggagggtgtcctgattattttcgatgaacc

SEQ ID NO: 147555 - DNA, 32 bp, Artificial Sequence
  Description of Artificial Sequence: Synthetic oligonucleotide
gggagggtgtcctgattattttcgatgaaccc

SEQ ID NO: 147556 - DNA, 32 bp, Artificial Sequence
  Description of Artificial Sequence: Synthetic oligonucleotide
ggagggtgtcctgattattttcgatgaacccc

SEQ ID NO: 147557 - DNA, 32 bp, Artificial Sequence
  Description of Artificial Sequence: Synthetic oligonucleotide
gagggtgtcctgattattttcgatgaaccccc

SEQ ID NO: 147558 - DNA, 33 bp, Artificial Sequence
  Description of Artificial Sequence: Synthetic oligonucleotide
agggtgtcctgattattttcgatgaacccccag

SEQ ID NO: 147559 - DNA, 32 bp, Artificial Sequence
  Description of Artificial Sequence: Synthetic oligonucleotide
gggtgtcctgattattttcgatgaacccccag

SEQ ID NO: 147560 - DNA, 34 bp, Artificial Sequence
  Description of Artificial Sequence: Synthetic oligonucleotide
ggtgtcctgattattttcgatgaacccccagtag

SEQ ID NO: 147561 - DNA, 40 bp, Artificial Sequence
  Description of Artificial Sequence: Synthetic oligonucleotide
gtgtcctgattattttcgatgaacccccagtagataaaac

SEQ ID NO: 147562 - DNA, 43 bp, Artificial Sequence
  Description of Artificial Sequence: Synthetic oligonucleotide
tgtcctgattattttcgatgaacccccagtagataaaacttac

SEQ ID NO: 147563 - DNA, 42 bp, Artificial Sequence
  Description of Artificial Sequence: Synthetic oligonucleotide
gtcctgattattttcgatgaacccccagtagataaaacttac

SEQ ID NO: 147564 - DNA, 42 bp, Artificial Sequence
  Description of Artificial Sequence: Synthetic oligonucleotide
tcctgattattttcgatgaacccccagtagataaaacttacg

SEQ ID NO: 147565 - DNA, 41 bp, Artificial Sequence
  Description of Artificial Sequence: Synthetic oligonucleotide
cctgattattttcgatgaacccccagtagataaaacttacg

SEQ ID NO: 147566 - DNA, 43 bp, Artificial Sequence
  Description of Artificial Sequence: Synthetic oligonucleotide
ctgattattttcgatgaacccccagtagataaaacttacgaag

SEQ ID NO: 147567 - DNA, 43 bp, Artificial Sequence
  Description of Artificial Sequence: Synthetic oligonucleotide
tgattattttcgatgaacccccagtagataaaacttacgaagc

SEQ ID NO: 147568 - DNA, 42 bp, Artificial Sequence
  Description of Artificial Sequence: Synthetic oligonucleotide
gattattttcgatgaacccccagtagataaaacttacgaagc

SEQ ID NO: 147569 - DNA, 43 bp, Artificial Sequence
  Description of Artificial Sequence: Synthetic oligonucleotide
attattttcgatgaacccccagtagataaaacttacgaagctg

SEQ ID NO: 147570 - DNA, 42 bp, Artificial Sequence
  Description of Artificial Sequence: Synthetic oligonucleotide
ttattttcgatgaacccccagtagataaaacttacgaagctg

SEQ ID NO: 147571 - DNA, 41 bp, Artificial Sequence
  Description of Artificial Sequence: Synthetic oligonucleotide
tattttcgatgaacccccagtagataaaacttacgaagctg

SEQ ID NO: 147572 - DNA, 40 bp, Artificial Sequence
  Description of Artificial Sequence: Synthetic oligonucleotide
attttcgatgaacccccagtagataaaacttacgaagctg

SEQ ID NO: 147573 - DNA, 39 bp, Artificial Sequence
  Description of Artificial Sequence: Synthetic oligonucleotide
ttttcgatgaacccccagtagataaaacttacgaagctg

SEQ ID NO: 147574 - DNA, 38 bp, Artificial Sequence
  Description of Artificial Sequence: Synthetic oligonucleotide
tttcgatgaacccccagtagataaaacttacgaagctg

SEQ ID NO: 147575 - DNA, 37 bp, Artificial Sequence
  Description of Artificial Sequence: Synthetic oligonucleotide
ttcgatgaacccccagtagataaaacttacgaagctg

SEQ ID NO: 147576 - DNA, 36 bp, Artificial Sequence
  Description of Artificial Sequence: Synthetic oligonucleotide
tcgatgaacccccagtagataaaacttacgaagctg

SEQ ID NO: 147577 - DNA, 35 bp, Artificial Sequence
  Description of Artificial Sequence: Synthetic oligonucleotide
cgatgaacccccagtagataaaacttacgaagctg

SEQ ID NO: 147578 - DNA, 35 bp, Artificial Sequence
  Description of Artificial Sequence: Synthetic oligonucleotide
gatgaacccccagtagataaaacttacgaagctgc

SEQ ID NO: 147579 - DNA, 36 bp, Artificial Sequence
  Description of Artificial Sequence: Synthetic oligonucleotide
atgaacccccagtagataaaacttacgaagctgctc

SEQ ID NO: 147580 - DNA, 35 bp, Artificial Sequence
  Description of Artificial Sequence: Synthetic oligonucleotide
tgaacccccagtagataaaacttacgaagctgctc

SEQ ID NO: 147581 - DNA, 34 bp, Artificial Sequence
  Description of Artificial Sequence: Synthetic oligonucleotide
gaacccccagtagataaaacttacgaagctgctc

SEQ ID NO: 147582 - DNA, 35 bp, Artificial Sequence
  Description of Artificial Sequence: Synthetic oligonucleotide
aacccccagtagataaaacttacgaagctgctctg

SEQ ID NO: 147583 - DNA, 34 bp, Artificial Sequence
  Description of Artificial Sequence: Synthetic oligonucleotide
acccccagtagataaaacttacgaagctgctctg

SEQ ID NO: 147584 - DNA, 33 bp, Artificial Sequence
  Description of Artificial Sequence: Synthetic oligonucleotide
cccccagtagataaaacttacgaagctgctctg

SEQ ID NO: 147585 - DNA, 33 bp, Artificial Sequence
  Description of Artificial Sequence: Synthetic oligonucleotide
ccccagtagataaaacttacgaagctgctctgg

SEQ ID NO: 147586 - DNA, 36 bp, Artificial Sequence
  Description of Artificial Sequence: Synthetic oligonucleotide
cccagtagataaaacttacgaagctgctctggaaac

SEQ ID NO: 147587 - DNA, 40 bp, Artificial Sequence
  Description of Artificial Sequence: Synthetic oligonucleotide
ccagtagataaaacttacgaagctgctctggaaacaattc

SEQ ID NO: 147588 - DNA, 41 bp, Artificial Sequence
  Description of Artificial Sequence: Synthetic oligonucleotide
cagtagataaaacttacgaagctgctctggaaacaattcag

SEQ ID NO: 147589 - DNA, 43 bp, Artificial Sequence
  Description of Artificial Sequence: Synthetic oligonucleotide
agtagataaaacttacgaagctgctctggaaacaattcagaac

SEQ ID NO: 147590 - DNA, 42 bp, Artificial Sequence
  Description of Artificial Sequence: Synthetic oligonucleotide
gtagataaaacttacgaagctgctctggaaacaattcagaac

SEQ ID NO: 147591 - DNA, 44 bp, Artificial Sequence
  Description of Artificial Sequence: Synthetic oligonucleotide
tagataaaacttacgaagctgctctggaaacaattcagaacatg

SEQ ID NO: 147592 - DNA, 43 bp, Artificial Sequence
  Description of Artificial Sequence: Synthetic oligonucleotide
agataaaacttacgaagctgctctggaaacaattcagaacatg

SEQ ID NO: 147593 - DNA, 42 bp, Artificial Sequence
  Description of Artificial Sequence: Synthetic oligonucleotide
gataaaacttacgaagctgctctggaaacaattcagaacatg

SEQ ID NO: 147594 - DNA, 43 bp, Artificial Sequence
  Description of Artificial Sequence: Synthetic oligonucleotide
ataaaacttacgaagctgctctggaaacaattcagaacatgag

SEQ ID NO: 147595 - DNA, 42 bp, Artificial Sequence
  Description of Artificial Sequence: Synthetic oligonucleotide
taaaacttacgaagctgctctggaaacaattcagaacatgag

SEQ ID NO: 147596 - DNA, 41 bp, Artificial Sequence
  Description of Artificial Sequence: Synthetic oligonucleotide
aaaacttacgaagctgctctggaaacaattcagaacatgag

SEQ ID NO: 147597 - DNA, 40 bp, Artificial Sequence
  Description of Artificial Sequence: Synthetic oligonucleotide
aaacttacgaagctgctctggaaacaattcagaacatgag

SEQ ID NO: 147598 - DNA, 39 bp, Artificial Sequence
  Description of Artificial Sequence: Synthetic oligonucleotide
aacttacgaagctgctctggaaacaattcagaacatgag

SEQ ID NO: 147599 - DNA, 38 bp, Artificial Sequence
  Description of Artificial Sequence: Synthetic oligonucleotide
acttacgaagctgctctggaaacaattcagaacatgag

SEQ ID NO: 147600 - DNA, 37 bp, Artificial Sequence
  Description of Artificial Sequence: Synthetic oligonucleotide
cttacgaagctgctctggaaacaattcagaacatgag

SEQ ID NO: 147601 - DNA, 37 bp, Artificial Sequence
  Description of Artificial Sequence: Synthetic oligonucleotide
ttacgaagctgctctggaaacaattcagaacatgagc

SEQ ID NO: 147602 - DNA, 36 bp, Artificial Sequence
  Description of Artificial Sequence: Synthetic oligonucleotide
tacgaagctgctctggaaacaattcagaacatgagc

SEQ ID NO: 147603 - DNA, 35 bp, Artificial Sequence
  Description of Artificial Sequence: Synthetic oligonucleotide
acgaagctgctctggaaacaattcagaacatgagc

SEQ ID NO: 147604 - DNA, 34 bp, Artificial Sequence
  Description of Artificial Sequence: Synthetic oligonucleotide
cgaagctgctctggaaacaattcagaacatgagc

SEQ ID NO: 147605 - DNA, 37 bp, Artificial Sequence
  Description of Artificial Sequence: Synthetic oligonucleotide
gaagctgctctggaaacaattcagaacatgagcaaag

SEQ ID NO: 147606 - DNA, 39 bp, Artificial Sequence
  Description of Artificial Sequence: Synthetic oligonucleotide
aagctgctctggaaacaattcagaacatgagcaaagtag

SEQ ID NO: 147607 - DNA, 38 bp, Artificial Sequence
  Description of Artificial Sequence: Synthetic oligonucleotide
agctgctctggaaacaattcagaacatgagcaaagtag

SEQ ID NO: 147608 - DNA, 37 bp, Artificial Sequence
  Description of Artificial Sequence: Synthetic oligonucleotide
gctgctctggaaacaattcagaacatgagcaaagtag

SEQ ID NO: 147609 - DNA, 38 bp, Artificial Sequence
  Description of Artificial Sequence: Synthetic oligonucleotide
ctgctctggaaacaattcagaacatgagcaaagtagtg

SEQ ID NO: 147610 - DNA, 38 bp, Artificial Sequence
  Description of Artificial Sequence: Synthetic oligonucleotide
tgctctggaaacaattcagaacatgagcaaagtagtgg

SEQ ID NO: 147611 - DNA, 37 bp, Artificial Sequence
  Description of Artificial Sequence: Synthetic oligonucleotide
gctctggaaacaattcagaacatgagcaaagtagtgg

SEQ ID NO: 147612 - DNA, 40 bp, Artificial Sequence
  Description of Artificial Sequence: Synthetic oligonucleotide
ctctggaaacaattcagaacatgagcaaagtagtggattc

SEQ ID NO: 147613 - DNA, 40 bp, Artificial Sequence
  Description of Artificial Sequence: Synthetic oligonucleotide
tctggaaacaattcagaacatgagcaaagtagtggattcc

SEQ ID NO: 147614 - DNA, 39 bp, Artificial Sequence
  Description of Artificial Sequence: Synthetic oligonucleotide
ctggaaacaattcagaacatgagcaaagtagtggattcc

SEQ ID NO: 147615 - DNA, 39 bp, Artificial Sequence
  Description of Artificial Sequence: Synthetic oligonucleotide
tggaaacaattcagaacatgagcaaagtagtggattccc

SEQ ID NO: 147616 - DNA, 38 bp, Artificial Sequence
  Description of Artificial Sequence: Synthetic oligonucleotide
ggaaacaattcagaacatgagcaaagtagtggattccc

SEQ ID NO: 147617 - DNA, 39 bp, Artificial Sequence
  Description of Artificial Sequence: Synthetic oligonucleotide
gaaacaattcagaacatgagcaaagtagtggattccctc

SEQ ID NO: 147618 - DNA, 41 bp, Artificial Sequence
  Description of Artificial Sequence: Synthetic oligonucleotide
aaacaattcagaacatgagcaaagtagtggattccctctac

SEQ ID NO: 147619 - DNA, 40 bp, Artificial Sequence
  Description of Artificial Sequence: Synthetic oligonucleotide
aacaattcagaacatgagcaaagtagtggattccctctac

SEQ ID NO: 147620 - DNA, 39 bp, Artificial Sequence
  Description of Artificial Sequence: Synthetic oligonucleotide
acaattcagaacatgagcaaagtagtggattccctctac

SEQ ID NO: 147621 - DNA, 38 bp, Artificial Sequence
  Description of Artificial Sequence: Synthetic oligonucleotide
caattcagaacatgagcaaagtagtggattccctctac

SEQ ID NO: 147622 - DNA, 40 bp, Artificial Sequence
  Description of Artificial Sequence: Synthetic oligonucleotide
aattcagaacatgagcaaagtagtggattccctctacaac

SEQ ID NO: 147623 - DNA, 39 bp, Artificial Sequence
  Description of Artificial Sequence: Synthetic oligonucleotide
attcagaacatgagcaaagtagtggattccctctacaac

SEQ ID NO: 147624 - DNA, 38 bp, Artificial Sequence
  Description of Artificial Sequence: Synthetic oligonucleotide
ttcagaacatgagcaaagtagtggattccctctacaac

SEQ ID NO: 147625 - DNA, 37 bp, Artificial Sequence
  Description of Artificial Sequence: Synthetic oligonucleotide
tcagaacatgagcaaagtagtggattccctctacaac

SEQ ID NO: 147626 - DNA, 36 bp, Artificial Sequence
  Description of Artificial Sequence: Synthetic oligonucleotide
cagaacatgagcaaagtagtggattccctctacaac

SEQ ID NO: 147627 - DNA, 39 bp, Artificial Sequence
  Description of Artificial Sequence: Synthetic oligonucleotide
agaacatgagcaaagtagtggattccctctacaacaaag

SEQ ID NO: 147628 - DNA, 38 bp, Artificial Sequence
  Description of Artificial Sequence: Synthetic oligonucleotide
gaacatgagcaaagtagtggattccctctacaacaaag

SEQ ID NO: 147629 - DNA, 38 bp, Artificial Sequence
  Description of Artificial Sequence: Synthetic oligonucleotide
aacatgagcaaagtagtggattccctctacaacaaagc

SEQ ID NO: 147630 - DNA, 37 bp, Artificial Sequence
  Description of Artificial Sequence: Synthetic oligonucleotide
acatgagcaaagtagtggattccctctacaacaaagc

SEQ ID NO: 147631 - DNA, 36 bp, Artificial Sequence
  Description of Artificial Sequence: Synthetic oligonucleotide
catgagcaaagtagtggattccctctacaacaaagc

SEQ ID NO: 147632 - DNA, 36 bp, Artificial Sequence
  Description of Artificial Sequence: Synthetic oligonucleotide
atgagcaaagtagtggattccctctacaacaaagcc

SEQ ID NO: 147633 - DNA, 35 bp, Artificial Sequence
  Description of Artificial Sequence: Synthetic oligonucleotide
tgagcaaagtagtggattccctctacaacaaagcc

SEQ ID NO: 147634 - DNA, 34 bp, Artificial Sequence
  Description of Artificial Sequence: Synthetic oligonucleotide
gagcaaagtagtggattccctctacaacaaagcc

SEQ ID NO: 147635 - DNA, 36 bp, Artificial Sequence
  Description of Artificial Sequence: Synthetic oligonucleotide
agcaaagtagtggattccctctacaacaaagccaag

SEQ ID NO: 147636 - DNA, 35 bp, Artificial Sequence
  Description of Artificial Sequence: Synthetic oligonucleotide
gcaaagtagtggattccctctacaacaaagccaag

SEQ ID NO: 147637 - DNA, 38 bp, Artificial Sequence
  Description of Artificial Sequence: Synthetic oligonucleotide
caaagtagtggattccctctacaacaaagccaagaaac

SEQ ID NO: 147638 - DNA, 39 bp, Artificial Sequence
  Description of Artificial Sequence: Synthetic oligonucleotide
aaagtagtggattccctctacaacaaagccaagaaactg

SEQ ID NO: 147639 - DNA, 38 bp, Artificial Sequence
  Description of Artificial Sequence: Synthetic oligonucleotide
aagtagtggattccctctacaacaaagccaagaaactg

SEQ ID NO: 147640 - DNA, 37 bp, Artificial Sequence
  Description of Artificial Sequence: Synthetic oligonucleotide
agtagtggattccctctacaacaaagccaagaaactg

SEQ ID NO: 147641 - DNA, 36 bp, Artificial Sequence
  Description of Artificial Sequence: Synthetic oligonucleotide
gtagtggattccctctacaacaaagccaagaaactg

SEQ ID NO: 147642 - DNA, 37 bp, Artificial Sequence
  Description of Artificial Sequence: Synthetic oligonucleotide
tagtggattccctctacaacaaagccaagaaactgac

SEQ ID NO: 147643 - DNA, 36 bp, Artificial Sequence
  Description of Artificial Sequence: Synthetic oligonucleotide
agtggattccctctacaacaaagccaagaaactgac

SEQ ID NO: 147644 - DNA, 35 bp, Artificial Sequence
  Description of Artificial Sequence: Synthetic oligonucleotide
gtggattccctctacaacaaagccaagaaactgac

SEQ ID NO: 147645 - DNA, 38 bp, Artificial Sequence
  Description of Artificial Sequence: Synthetic oligonucleotide
tggattccctctacaacaaagccaagaaactgacatag

SEQ ID NO: 147646 - DNA, 34 bp, Artificial Sequence
  Description of Artificial Sequence: Synthetic oligonucleotide
atggacagacttcttagacttggaggaggtatgc

SEQ ID NO: 147647 - DNA, 33 bp, Artificial Sequence
  Description of Artificial Sequence: Synthetic oligonucleotide
tggacagacttcttagacttggaggaggtatgc

SEQ ID NO: 147648 - DNA, 32 bp, Artificial Sequence
  Description of Artificial Sequence: Synthetic oligonucleotide
ggacagacttcttagacttggaggaggtatgc

SEQ ID NO: 147649 - DNA, 32 bp, Artificial Sequence
  Description of Artificial Sequence: Synthetic oligonucleotide
gacagacttcttagacttggaggaggtatgcc

SEQ ID NO: 147650 - DNA, 33 bp, Artificial Sequence
  Description of Artificial Sequence: Synthetic oligonucleotide
acagacttcttagacttggaggaggtatgcctg

SEQ ID NO: 147651 - DNA, 32 bp, Artificial Sequence
  Description of Artificial Sequence: Synthetic oligonucleotide
cagacttcttagacttggaggaggtatgcctg

SEQ ID NO: 147652 - DNA, 32 bp, Artificial Sequence
  Description of Artificial Sequence: Synthetic oligonucleotide
agacttcttagacttggaggaggtatgcctgg

SEQ ID NO: 147653 - DNA, 31 bp, Artificial Sequence
  Description of Artificial Sequence: Synthetic oligonucleotide
gacttcttagacttggaggaggtatgcctgg

SEQ ID NO: 147654 - DNA, 32 bp, Artificial Sequence
  Description of Artificial Sequence: Synthetic oligonucleotide
acttcttagacttggaggaggtatgcctggac

SEQ ID NO: 147655 - DNA, 31 bp, Artificial Sequence
  Description of Artificial Sequence: Synthetic oligonucleotide
cttcttagacttggaggaggtatgcctggac

SEQ ID NO: 147656 - DNA, 32 bp, Artificial Sequence
  Description of Artificial Sequence: Synthetic oligonucleotide
ttcttagacttggaggaggtatgcctggactg

SEQ ID NO: 147657 - DNA, 31 bp, Artificial Sequence
  Description of Artificial Sequence: Synthetic oligonucleotide
tcttagacttggaggaggtatgcctggactg

SEQ ID NO: 147658 - DNA, 30 bp, Artificial Sequence
  Description of Artificial Sequence: Synthetic oligonucleotide
cttagacttggaggaggtatgcctggactg

SEQ ID NO: 147659 - DNA, 30 bp, Artificial Sequence
  Description of Artificial Sequence: Synthetic oligonucleotide
ttagacttggaggaggtatgcctggactgg

SEQ ID NO: 147660 - DNA, 29 bp, Artificial Sequence
  Description of Artificial Sequence: Synthetic oligonucleotide
tagacttggaggaggtatgcctggactgg

SEQ ID NO: 147661 - DNA, 28 bp, Artificial Sequence
  Description of Artificial Sequence: Synthetic oligonucleotide
agacttggaggaggtatgcctggactgg

SEQ ID NO: 147662 - DNA, 27 bp, Artificial Sequence
  Description of Artificial Sequence: Synthetic oligonucleotide
gacttggaggaggtatgcctggactgg

SEQ ID NO: 147663 - DNA, 27 bp, Artificial Sequence
  Description of Artificial Sequence: Synthetic oligonucleotide
acttggaggaggtatgcctggactggg

SEQ ID NO: 147664 - DNA, 26 bp, Artificial Sequence
  Description of Artificial Sequence: Synthetic oligonucleotide
cttggaggaggtatgcctggactggg

SEQ ID NO: 147665 - DNA, 26 bp, Artificial Sequence
  Description of Artificial Sequence: Synthetic oligonucleotide
ttggaggaggtatgcctggactgggc

SEQ ID NO: 147666 - DNA, 25 bp, Artificial Sequence
  Description of Artificial Sequence: Synthetic oligonucleotide
tggaggaggtatgcctggactgggc

SEQ ID NO: 147667 - DNA, 24 bp, Artificial Sequence
  Description of Artificial Sequence: Synthetic oligonucleotide
ggaggaggtatgcctggactgggc

SEQ ID NO: 147668 - DNA, 25 bp, Artificial Sequence
  Description of Artificial Sequence: Synthetic oligonucleotide
gaggaggtatgcctggactgggcca

SEQ ID NO: 147669 - DNA, 25 bp, Artificial Sequence
  Description of Artificial Sequence: Synthetic oligonucleotide
aggaggtatgcctggactgggccag

SEQ ID NO: 147670 - DNA, 24 bp, Artificial Sequence
  Description of Artificial Sequence: Synthetic oligonucleotide
ggaggtatgcctggactgggccag

SEQ ID NO: 147671 - DNA, 24 bp, Artificial Sequence
  Description of Artificial Sequence: Synthetic oligonucleotide
gaggtatgcctggactgggccagg

SEQ ID NO: 147672 - DNA, 24 bp, Artificial Sequence
  Description of Artificial Sequence: Synthetic oligonucleotide
aggtatgcctggactgggccaggg

SEQ ID NO: 147673 - DNA, 23 bp, Artificial Sequence
  Description of Artificial Sequence: Synthetic oligonucleotide
ggtatgcctggactgggccaggg

SEQ ID NO: 147674 - DNA, 23 bp, Artificial Sequence
  Description of Artificial Sequence: Synthetic oligonucleotide
gtatgcctggactgggccagggg

SEQ ID NO: 147675 - DNA, 23 bp, Artificial Sequence
  Description of Artificial Sequence: Synthetic oligonucleotide
tatgcctggactgggccaggggc

SEQ ID NO: 147676 - DNA, 22 bp, Artificial Sequence
  Description of Artificial Sequence: Synthetic oligonucleotide
atgcctggactgggccaggggc

SEQ ID NO: 147677 - DNA, 21 bp, Artificial Sequence
  Description of Artificial Sequence: Synthetic oligonucleotide
tgcctggactgggccaggggc

SEQ ID NO: 147678 - DNA, 20 bp, Artificial Sequence
  Description of Artificial Sequence: Synthetic oligonucleotide
gcctggactgggccaggggc

SEQ ID NO: 147679 - DNA, 21 bp, Artificial Sequence
  Description of Artificial Sequence: Synthetic oligonucleotide
cctggactgggccaggggcca

SEQ ID NO: 147680 - DNA, 21 bp, Artificial Sequence
  Description of Artificial Sequence: Synthetic oligonucleotide
ctggactgggccaggggccac

SEQ ID NO: 147681 - DNA, 23 bp, Artificial Sequence
  Description of Artificial Sequence: Synthetic oligonucleotide
tggactgggccaggggccaccta

SEQ ID NO: 147682 - DNA, 22 bp, Artificial Sequence
  Description of Artificial Sequence: Synthetic oligonucleotide
ggactgggccaggggccaccta

SEQ ID NO: 147683 - DNA, 23 bp, Artificial Sequence
  Description of Artificial Sequence: Synthetic oligonucleotide
gactgggccaggggccacctaca

SEQ ID NO: 147684 - DNA, 25 bp, Artificial Sequence
  Description of Artificial Sequence: Synthetic oligonucleotide
actgggccaggggccacctacagat

SEQ ID NO: 147685 - DNA, 24 bp, Artificial Sequence
  Description of Artificial Sequence: Synthetic oligonucleotide
ctgggccaggggccacctacagat

SEQ ID NO: 147686 - DNA, 24 bp, Artificial Sequence
  Description of Artificial Sequence: Synthetic oligonucleotide
tgggccaggggccacctacagatg

SEQ ID NO: 147687 - DNA, 23 bp, Artificial Sequence
  Description of Artificial Sequence: Synthetic oligonucleotide
gggccaggggccacctacagatg

SEQ ID NO: 147688 - DNA, 24 bp, Artificial Sequence
  Description of Artificial Sequence: Synthetic oligonucleotide
ggccaggggccacctacagatgct

SEQ ID NO: 147689 - DNA, 24 bp, Artificial Sequence
  Description of Artificial Sequence: Synthetic oligonucleotide
gccaggggccacctacagatgctc

SEQ ID NO: 147690 - DNA, 25 bp, Artificial Sequence
  Description of Artificial Sequence: Synthetic oligonucleotide
ccaggggccacctacagatgctcct

SEQ ID NO: 147691 - DNA, 25 bp, Artificial Sequence
  Description of Artificial Sequence: Synthetic oligonucleotide
caggggccacctacagatgctcctg

SEQ ID NO: 147692 - DNA, 26 bp, Artificial Sequence
  Description of Artificial Sequence: Synthetic oligonucleotide
aggggccacctacagatgctcctgca

SEQ ID NO: 147693 - DNA, 25 bp, Artificial Sequence
  Description of Artificial Sequence: Synthetic oligonucleotide
ggggccacctacagatgctcctgca

SEQ ID NO: 147694 - DNA, 26 bp, Artificial Sequence
  Description of Artificial Sequence: Synthetic oligonucleotide
gggccacctacagatgctcctgcagt

SEQ ID NO: 147695 - DNA, 26 bp, Artificial Sequence
  Description of Artificial Sequence: Synthetic oligonucleotide
ggccacctacagatgctcctgcagtg

SEQ ID NO: 147696 - DNA, 27 bp, Artificial Sequence
  Description of Artificial Sequence: Synthetic oligonucleotide
gccacctacagatgctcctgcagtgga

SEQ ID NO: 147697 - DNA, 27 bp, Artificial Sequence
  Description of Artificial Sequence: Synthetic oligonucleotide
ccacctacagatgctcctgcagtggac

SEQ ID NO: 147698 - DNA, 28 bp, Artificial Sequence
  Description of Artificial Sequence: Synthetic oligonucleotide
cacctacagatgctcctgcagtggacac

SEQ ID NO: 147699 - DNA, 29 bp, Artificial Sequence
  Description of Artificial Sequence: Synthetic oligonucleotide
acctacagatgctcctgcagtggacacag

SEQ ID NO: 147700 - DNA, 28 bp, Artificial Sequence
  Description of Artificial Sequence: Synthetic oligonucleotide
cctacagatgctcctgcagtggacacag

SEQ ID NO: 147701 - DNA, 28 bp, Artificial Sequence
  Description of Artificial Sequence: Synthetic oligonucleotide
ctacagatgctcctgcagtggacacagc

SEQ ID NO: 147702 - DNA, 29 bp, Artificial Sequence
  Description of Artificial Sequence: Synthetic oligonucleotide
tacagatgctcctgcagtggacacagcag

SEQ ID NO: 147703 - DNA, 28 bp, Artificial Sequence
  Description of Artificial Sequence: Synthetic oligonucleotide
acagatgctcctgcagtggacacagcag

SEQ ID NO: 147704 - DNA, 27 bp, Artificial Sequence
  Description of Artificial Sequence: Synthetic oligonucleotide
cagatgctcctgcagtggacacagcag

SEQ ID NO: 147705 - DNA, 29 bp, Artificial Sequence
  Description of Artificial Sequence: Synthetic oligonucleotide
agatgctcctgcagtggacacagcagaac

SEQ ID NO: 147706 - DNA, 28 bp, Artificial Sequence
  Description of Artificial Sequence: Synthetic oligonucleotide
gatgctcctgcagtggacacagcagaac

SEQ ID NO: 147707 - DNA, 30 bp, Artificial Sequence
  Description of Artificial Sequence: Synthetic oligonucleotide
atgctcctgcagtggacacagcagaacaag

SEQ ID NO: 147708 - DNA, 29 bp, Artificial Sequence
  Description of Artificial Sequence: Synthetic oligonucleotide
tgctcctgcagtggacacagcagaacaag

SEQ ID NO: 147709 - DNA, 28 bp, Artificial Sequence
  Description of Artificial Sequence: Synthetic oligonucleotide
gctcctgcagtggacacagcagaacaag

SEQ ID NO: 147710 - DNA, 29 bp, Artificial Sequence
  Description of Artificial Sequence: Synthetic oligonucleotide
ctcctgcagtggacacagcagaacaagtc

SEQ ID NO: 147711 - DNA, 34 bp, Artificial Sequence
  Description of Artificial Sequence: Synthetic oligonucleotide
tcctgcagtggacacagcagaacaagtctatatc

SEQ ID NO: 147712 - DNA, 33 bp, Artificial Sequence
  Description of Artificial Sequence: Synthetic oligonucleotide
cctgcagtggacacagcagaacaagtctatatc

SEQ ID NO: 147713 - DNA, 34 bp, Artificial Sequence
  Description of Artificial Sequence: Synthetic oligonucleotide
ctgcagtggacacagcagaacaagtctatatctc

SEQ ID NO: 147714 - DNA, 36 bp, Artificial Sequence
  Description of Artificial Sequence: Synthetic oligonucleotide
tgcagtggacacagcagaacaagtctatatctcttc

SEQ ID NO: 147715 - DNA, 35 bp, Artificial Sequence
  Description of Artificial Sequence: Synthetic oligonucleotide
gcagtggacacagcagaacaagtctatatctcttc

SEQ ID NO: 147716 - DNA, 35 bp, Artificial Sequence
  Description of Artificial Sequence: Synthetic oligonucleotide
cagtggacacagcagaacaagtctatatctcttcc

SEQ ID NO: 147717 - DNA, 35 bp, Artificial Sequence
  Description of Artificial Sequence: Synthetic oligonucleotide
agtggacacagcagaacaagtctatatctcttccc

SEQ ID NO: 147718 - DNA, 34 bp, Artificial Sequence
  Description of Artificial Sequence: Synthetic oligonucleotide
gtggacacagcagaacaagtctatatctcttccc

SEQ ID NO: 147719 - DNA, 35 bp, Artificial Sequence
  Description of Artificial Sequence: Synthetic oligonucleotide
tggacacagcagaacaagtctatatctcttccctg

SEQ ID NO: 147720 - DNA, 34 bp, Artificial Sequence
  Description of Artificial Sequence: Synthetic oligonucleotide
ggacacagcagaacaagtctatatctcttccctg

SEQ ID NO: 147721 - DNA, 34 bp, Artificial Sequence
  Description of Artificial Sequence: Synthetic oligonucleotide
gacacagcagaacaagtctatatctcttccctgg

SEQ ID NO: 147722 - DNA, 34 bp, Artificial Sequence
  Description of Artificial Sequence: Synthetic oligonucleotide
acacagcagaacaagtctatatctcttccctggc

SEQ ID NO: 147723 - DNA, 33 bp, Artificial Sequence
  Description of Artificial Sequence: Synthetic oligonucleotide
cacagcagaacaagtctatatctcttccctggc

SEQ ID NO: 147724 - DNA, 34 bp, Artificial Sequence
  Description of Artificial Sequence: Synthetic oligonucleotide
acagcagaacaagtctatatctcttccctggcac

SEQ ID NO: 147725 - DNA, 33 bp, Artificial Sequence
  Description of Artificial Sequence: Synthetic oligonucleotide
cagcagaacaagtctatatctcttccctggcac

SEQ ID NO: 147726 - DNA, 34 bp, Artificial Sequence
  Description of Artificial Sequence: Synthetic oligonucleotide
agcagaacaagtctatatctcttccctggcactg

SEQ ID NO: 147727 - DNA, 33 bp, Artificial Sequence
  Description of Artificial Sequence: Synthetic oligonucleotide
gcagaacaagtctatatctcttccctggcactg

SEQ ID NO: 147728 - DNA, 41 bp, Artificial Sequence
  Description of Artificial Sequence: Synthetic oligonucleotide
cagaacaagtctatatctcttccctggcactgttaaaaatg

SEQ ID NO: 147729 - DNA, 47 bp, Artificial Sequence
  Description of Artificial Sequence: Synthetic oligonucleotide
agaacaagtctatatctcttccctggcactgttaaaaatgttaaaac

SEQ ID NO: 147730 - DNA, 46 bp, Artificial Sequence
  Description of Artificial Sequence: Synthetic oligonucleotide
gaacaagtctatatctcttccctggcactgttaaaaatgttaaaac

SEQ ID NO: 147731 - DNA, 48 bp, Artificial Sequence
  Description of Artificial Sequence: Synthetic oligonucleotide
aacaagtctatatctcttccctggcactgttaaaaatgttaaaacatg

SEQ ID NO: 147732 - DNA, 47 bp, Artificial Sequence
  Description of Artificial Sequence: Synthetic oligonucleotide
acaagtctatatctcttccctggcactgttaaaaatgttaaaacatg

SEQ ID NO: 147733 - DNA, 46 bp, Artificial Sequence
  Description of Artificial Sequence: Synthetic oligonucleotide
caagtctatatctcttccctggcactgttaaaaatgttaaaacatg

SEQ ID NO: 147734 - DNA, 46 bp, Artificial Sequence
  Description of Artificial Sequence: Synthetic oligonucleotide
aagtctatatctcttccctggcactgttaaaaatgttaaaacatgg

SEQ ID NO: 147735 - DNA, 45 bp, Artificial Sequence
  Description of Artificial Sequence: Synthetic oligonucleotide
agtctatatctcttccctggcactgttaaaaatgttaaaacatgg

SEQ ID NO: 147736 - DNA, 44 bp, Artificial Sequence
  Description of Artificial Sequence: Synthetic oligonucleotide
gtctatatctcttccctggcactgttaaaaatgttaaaacatgg

SEQ ID NO: 147737 - DNA, 44 bp, Artificial Sequence
  Description of Artificial Sequence: Synthetic oligonucleotide
tctatatctcttccctggcactgttaaaaatgttaaaacatggc

SEQ ID NO: 147738 - DNA, 43 bp, Artificial Sequence
  Description of Artificial Sequence: Synthetic oligonucleotide
ctatatctcttccctggcactgttaaaaatgttaaaacatggc

SEQ ID NO: 147739 - DNA, 43 bp, Artificial Sequence
  Description of Artificial Sequence: Synthetic oligonucleotide
tatatctcttccctggcactgttaaaaatgttaaaacatggcc

SEQ ID NO: 147740 - DNA, 42 bp, Artificial Sequence
  Description of Artificial Sequence: Synthetic oligonucleotide
atatctcttccctggcactgttaaaaatgttaaaacatggcc

SEQ ID NO: 147741 - DNA, 41 bp, Artificial Sequence
  Description of Artificial Sequence: Synthetic oligonucleotide
tatctcttccctggcactgttaaaaatgttaaaacatggcc

SEQ ID NO: 147742 - DNA, 40 bp, Artificial Sequence
  Description of Artificial Sequence: Synthetic oligonucleotide
atctcttccctggcactgttaaaaatgttaaaacatggcc

SEQ ID NO: 147743 - DNA, 39 bp, Artificial Sequence
  Description of Artificial Sequence: Synthetic oligonucleotide
tctcttccctggcactgttaaaaatgttaaaacatggcc

SEQ ID NO: 147744 - DNA, 38 bp, Artificial Sequence
  Description of Artificial Sequence: Synthetic oligonucleotide
ctcttccctggcactgttaaaaatgttaaaacatggcc

SEQ ID NO: 147745 - DNA, 38 bp, Artificial Sequence
  Description of Artificial Sequence: Synthetic oligonucleotide
tcttccctggcactgttaaaaatgttaaaacatggccg

SEQ ID NO: 147746 - DNA, 37 bp, Artificial Sequence
  Description of Artificial Sequence: Synthetic oligonucleotide
cttccctggcactgttaaaaatgttaaaacatggccg

SEQ ID NO: 147747 - DNA, 38 bp, Artificial Sequence
  Description of Artificial Sequence: Synthetic oligonucleotide
ttccctggcactgttaaaaatgttaaaacatggccgtg

SEQ ID NO: 147748 - DNA, 37 bp, Artificial Sequence
  Description of Artificial Sequence: Synthetic oligonucleotide
tccctggcactgttaaaaatgttaaaacatggccgtg

SEQ ID NO: 147749 - DNA, 36 bp, Artificial Sequence
  Description of Artificial Sequence: Synthetic oligonucleotide
ccctggcactgttaaaaatgttaaaacatggccgtg

SEQ ID NO: 147750 - DNA, 36 bp, Artificial Sequence
  Description of Artificial Sequence: Synthetic oligonucleotide
cctggcactgttaaaaatgttaaaacatggccgtgc

SEQ ID NO: 147751 - DNA, 37 bp, Artificial Sequence
  Description of Artificial Sequence: Synthetic oligonucleotide
ctggcactgttaaaaatgttaaaacatggccgtgctg

SEQ ID NO: 147752 - DNA, 37 bp, Artificial Sequence
  Description of Artificial Sequence: Synthetic oligonucleotide
tggcactgttaaaaatgttaaaacatggccgtgctgg

SEQ ID NO: 147753 - DNA, 36 bp, Artificial Sequence
  Description of Artificial Sequence: Synthetic oligonucleotide
ggcactgttaaaaatgttaaaacatggccgtgctgg

SEQ ID NO: 147754 - DNA, 37 bp, Artificial Sequence
  Description of Artificial Sequence: Synthetic oligonucleotide
gcactgttaaaaatgttaaaacatggccgtgctggag

SEQ ID NO: 147755 - DNA, 39 bp, Artificial Sequence
  Description of Artificial Sequence: Synthetic oligonucleotide
cactgttaaaaatgttaaaacatggccgtgctggagttc

SEQ ID NO: 147756 - DNA, 39 bp, Artificial Sequence
  Description of Artificial Sequence: Synthetic oligonucleotide
actgttaaaaatgttaaaacatggccgtgctggagttcc

SEQ ID NO: 147757 - DNA, 38 bp, Artificial Sequence
  Description of Artificial Sequence: Synthetic oligonucleotide
ctgttaaaaatgttaaaacatggccgtgctggagttcc

SEQ ID NO: 147758 - DNA, 41 bp, Artificial Sequence
  Description of Artificial Sequence: Synthetic oligonucleotide
tgttaaaaatgttaaaacatggccgtgctggagttccaatg

SEQ ID NO: 147759 - DNA, 40 bp, Artificial Sequence
  Description of Artificial Sequence: Synthetic oligonucleotide
gttaaaaatgttaaaacatggccgtgctggagttccaatg

SEQ ID NO: 147760 - DNA, 40 bp, Artificial Sequence
  Description of Artificial Sequence: Synthetic oligonucleotide
ttaaaaatgttaaaacatggccgtgctggagttccaatgg

SEQ ID NO: 147761 - DNA, 39 bp, Artificial Sequence
  Description of Artificial Sequence: Synthetic oligonucleotide
taaaaatgttaaaacatggccgtgctggagttccaatgg

SEQ ID NO: 147762 - DNA, 38 bp, Artificial Sequence
  Description of Artificial Sequence: Synthetic oligonucleotide
aaaaatgttaaaacatggccgtgctggagttccaatgg

SEQ ID NO: 147763 - DNA, 37 bp, Artificial Sequence
  Description of Artificial Sequence: Synthetic oligonucleotide
aaaatgttaaaacatggccgtgctggagttccaatgg

SEQ ID NO: 147764 - DNA, 36 bp, Artificial Sequence
  Description of Artificial Sequence: Synthetic oligonucleotide
aaatgttaaaacatggccgtgctggagttccaatgg

SEQ ID NO: 147765 - DNA, 35 bp, Artificial Sequence
  Description of Artificial Sequence: Synthetic oligonucleotide
aatgttaaaacatggccgtgctggagttccaatgg

SEQ ID NO: 147766 - DNA, 34 bp, Artificial Sequence
  Description of Artificial Sequence: Synthetic oligonucleotide
atgttaaaacatggccgtgctggagttccaatgg

SEQ ID NO: 147767 - DNA, 33 bp, Artificial Sequence
  Description of Artificial Sequence: Synthetic oligonucleotide
tgttaaaacatggccgtgctggagttccaatgg

SEQ ID NO: 147768 - DNA, 32 bp, Artificial Sequence
  Description of Artificial Sequence: Synthetic oligonucleotide
gttaaaacatggccgtgctggagttccaatgg

SEQ ID NO: 147769 - DNA, 34 bp, Artificial Sequence
  Description of Artificial Sequence: Synthetic oligonucleotide
ttaaaacatggccgtgctggagttccaatggaag

SEQ ID NO: 147770 - DNA, 33 bp, Artificial Sequence
  Description of Artificial Sequence: Synthetic oligonucleotide
taaaacatggccgtgctggagttccaatggaag

SEQ ID NO: 147771 - DNA, 32 bp, Artificial Sequence
  Description of Artificial Sequence: Synthetic oligonucleotide
aaaacatggccgtgctggagttccaatggaag

SEQ ID NO: 147772 - DNA, 31 bp, Artificial Sequence
  Description of Artificial Sequence: Synthetic oligonucleotide
aaacatggccgtgctggagttccaatggaag

SEQ ID NO: 147773 - DNA, 30 bp, Artificial Sequence
  Description of Artificial Sequence: Synthetic oligonucleotide
aacatggccgtgctggagttccaatggaag

SEQ ID NO: 147774 - DNA, 29 bp, Artificial Sequence
  Description of Artificial Sequence: Synthetic oligonucleotide
acatggccgtgctggagttccaatggaag

SEQ ID NO: 147775 - DNA, 28 bp, Artificial Sequence
  Description of Artificial Sequence: Synthetic oligonucleotide
catggccgtgctggagttccaatggaag

SEQ ID NO: 147776 - DNA, 32 bp, Artificial Sequence
  Description of Artificial Sequence: Synthetic oligonucleotide
atggccgtgctggagttccaatggaagttatg

SEQ ID NO: 147777 - DNA, 31 bp, Artificial Sequence
  Description of Artificial Sequence: Synthetic oligonucleotide
tggccgtgctggagttccaatggaagttatg

SEQ ID NO: 147778 - DNA, 30 bp, Artificial Sequence
  Description of Artificial Sequence: Synthetic oligonucleotide
ggccgtgctggagttccaatggaagttatg

SEQ ID NO: 147779 - DNA, 30 bp, Artificial Sequence
  Description of Artificial Sequence: Synthetic oligonucleotide
gccgtgctggagttccaatggaagttatgg

SEQ ID NO: 147780 - DNA, 30 bp, Artificial Sequence
  Description of Artificial Sequence: Synthetic oligonucleotide
ccgtgctggagttccaatggaagttatggg

SEQ ID NO: 147781 - DNA, 33 bp, Artificial Sequence
  Description of Artificial Sequence: Synthetic oligonucleotide
cgtgctggagttccaatggaagttatgggtttg

SEQ ID NO: 147782 - DNA, 35 bp, Artificial Sequence
  Description of Artificial Sequence: Synthetic oligonucleotide
gtgctggagttccaatggaagttatgggtttgatg

SEQ ID NO: 147783 - DNA, 35 bp, Artificial Sequence
  Description of Artificial Sequence: Synthetic oligonucleotide
tgctggagttccaatggaagttatgggtttgatgc

SEQ ID NO: 147784 - DNA, 34 bp, Artificial Sequence
  Description of Artificial Sequence: Synthetic oligonucleotide
gctggagttccaatggaagttatgggtttgatgc

SEQ ID NO: 147785 - DNA, 36 bp, Artificial Sequence
  Description of Artificial Sequence: Synthetic oligonucleotide
ctggagttccaatggaagttatgggtttgatgcttg

SEQ ID NO: 147786 - DNA, 36 bp, Artificial Sequence
  Description of Artificial Sequence: Synthetic oligonucleotide
tggagttccaatggaagttatgggtttgatgcttgg

SEQ ID NO: 147787 - DNA, 35 bp, Artificial Sequence
  Description of Artificial Sequence: Synthetic oligonucleotide
ggagttccaatggaagttatgggtttgatgcttgg

SEQ ID NO: 147788 - DNA, 36 bp, Artificial Sequence
  Description of Artificial Sequence: Synthetic oligonucleotide
gagttccaatggaagttatgggtttgatgcttggag

SEQ ID NO: 147789 - DNA, 41 bp, Artificial Sequence
  Description of Artificial Sequence: Synthetic oligonucleotide
agttccaatggaagttatgggtttgatgcttggagaatttg

SEQ ID NO: 147790 - DNA, 40 bp, Artificial Sequence
  Description of Artificial Sequence: Synthetic oligonucleotide
gttccaatggaagttatgggtttgatgcttggagaatttg

SEQ ID NO: 147791 - DNA, 42 bp, Artificial Sequence
  Description of Artificial Sequence: Synthetic oligonucleotide
ttccaatggaagttatgggtttgatgcttggagaatttgttg

SEQ ID NO: 147792 - DNA, 41 bp, Artificial Sequence
  Description of Artificial Sequence: Synthetic oligonucleotide
tccaatggaagttatgggtttgatgcttggagaatttgttg

SEQ ID NO: 147793 - DNA, 40 bp, Artificial Sequence
  Description of Artificial Sequence: Synthetic oligonucleotide
ccaatggaagttatgggtttgatgcttggagaatttgttg

SEQ ID NO: 147794 - DNA, 42 bp, Artificial Sequence
  Description of Artificial Sequence: Synthetic oligonucleotide
caatggaagttatgggtttgatgcttggagaatttgttgatg

SEQ ID NO: 147795 - DNA, 48 bp, Artificial Sequence
  Description of Artificial Sequence: Synthetic oligonucleotide
aatggaagttatgggtttgatgcttggagaatttgttgatgattatac

SEQ ID NO: 147796 - DNA, 47 bp, Artificial Sequence
  Description of Artificial Sequence: Synthetic oligonucleotide
atggaagttatgggtttgatgcttggagaatttgttgatgattatac

SEQ ID NO: 147797 - DNA, 46 bp, Artificial Sequence
  Description of Artificial Sequence: Synthetic oligonucleotide
tggaagttatgggtttgatgcttggagaatttgttgatgattatac

SEQ ID NO: 147798 - DNA, 45 bp, Artificial Sequence
  Description of Artificial Sequence: Synthetic oligonucleotide
ggaagttatgggtttgatgcttggagaatttgttgatgattatac

SEQ ID NO: 147799 - DNA, 45 bp, Artificial Sequence
  Description of Artificial Sequence: Synthetic oligonucleotide
gaagttatgggtttgatgcttggagaatttgttgatgattatacc

SEQ ID NO: 147800 - DNA, 45 bp, Artificial Sequence
  Description of Artificial Sequence: Synthetic oligonucleotide
aagttatgggtttgatgcttggagaatttgttgatgattataccg

SEQ ID NO: 147801 - DNA, 44 bp, Artificial Sequence
  Description of Artificial Sequence: Synthetic oligonucleotide
agttatgggtttgatgcttggagaatttgttgatgattataccg

SEQ ID NO: 147802 - DNA, 43 bp, Artificial Sequence
  Description of Artificial Sequence: Synthetic oligonucleotide
gttatgggtttgatgcttggagaatttgttgatgattataccg

SEQ ID NO: 147803 - DNA, 44 bp, Artificial Sequence
  Description of Artificial Sequence: Synthetic oligonucleotide
ttatgggtttgatgcttggagaatttgttgatgattataccgtc

SEQ ID NO: 147804 - DNA, 43 bp, Artificial Sequence
  Description of Artificial Sequence: Synthetic oligonucleotide
tatgggtttgatgcttggagaatttgttgatgattataccgtc

SEQ ID NO: 147805 - DNA, 42 bp, Artificial Sequence
  Description of Artificial Sequence: Synthetic oligonucleotide
atgggtttgatgcttggagaatttgttgatgattataccgtc

SEQ ID NO: 147806 - DNA, 41 bp, Artificial Sequence
  Description of Artificial Sequence: Synthetic oligonucleotide
tgggtttgatgcttggagaatttgttgatgattataccgtc

SEQ ID NO: 147807 - DNA, 40 bp, Artificial Sequence
  Description of Artificial Sequence: Synthetic oligonucleotide
gggtttgatgcttggagaatttgttgatgattataccgtc

SEQ ID NO: 147808 - DNA, 41 bp, Artificial Sequence
  Description of Artificial Sequence: Synthetic oligonucleotide
ggtttgatgcttggagaatttgttgatgattataccgtcag

SEQ ID NO: 147809 - DNA, 42 bp, Artificial Sequence
  Description of Artificial Sequence: Synthetic oligonucleotide
gtttgatgcttggagaatttgttgatgattataccgtcagag

SEQ ID NO: 147810 - DNA, 43 bp, Artificial Sequence
  Description of Artificial Sequence: Synthetic oligonucleotide
tttgatgcttggagaatttgttgatgattataccgtcagagtg

SEQ ID NO: 147811 - DNA, 42 bp, Artificial Sequence
  Description of Artificial Sequence: Synthetic oligonucleotide
ttgatgcttggagaatttgttgatgattataccgtcagagtg

SEQ ID NO: 147812 - DNA, 41 bp, Artificial Sequence
  Description of Artificial Sequence: Synthetic oligonucleotide
tgatgcttggagaatttgttgatgattataccgtcagagtg

SEQ ID NO: 147813 - DNA, 40 bp, Artificial Sequence
  Description of Artificial Sequence: Synthetic oligonucleotide
gatgcttggagaatttgttgatgattataccgtcagagtg

SEQ ID NO: 147814 - DNA, 43 bp, Artificial Sequence
  Description of Artificial Sequence: Synthetic oligonucleotide
atgcttggagaatttgttgatgattataccgtcagagtgattg

SEQ ID NO: 147815 - DNA, 42 bp, Artificial Sequence
  Description of Artificial Sequence: Synthetic oligonucleotide
tgcttggagaatttgttgatgattataccgtcagagtgattg

SEQ ID NO: 147816 - DNA, 41 bp, Artificial Sequence
  Description of Artificial Sequence: Synthetic oligonucleotide
gcttggagaatttgttgatgattataccgtcagagtgattg

SEQ ID NO: 147817 - DNA, 43 bp, Artificial Sequence
  Description of Artificial Sequence: Synthetic oligonucleotide
cttggagaatttgttgatgattataccgtcagagtgattgatg

SEQ ID NO: 147818 - DNA, 44 bp, Artificial Sequence
  Description of Artificial Sequence: Synthetic oligonucleotide
ttggagaatttgttgatgattataccgtcagagtgattgatgtg

SEQ ID NO: 147819 - DNA, 43 bp, Artificial Sequence
  Description of Artificial Sequence: Synthetic oligonucleotide
tggagaatttgttgatgattataccgtcagagtgattgatgtg

SEQ ID NO: 147820 - DNA, 42 bp, Artificial Sequence
  Description of Artificial Sequence: Synthetic oligonucleotide
ggagaatttgttgatgattataccgtcagagtgattgatgtg

SEQ ID NO: 147821 - DNA, 45 bp, Artificial Sequence
  Description of Artificial Sequence: Synthetic oligonucleotide
gagaatttgttgatgattataccgtcagagtgattgatgtgtttg

SEQ ID NO: 147822 - DNA, 45 bp, Artificial Sequence
  Description of Artificial Sequence: Synthetic oligonucleotide
agaatttgttgatgattataccgtcagagtgattgatgtgtttgc

SEQ ID NO: 147823 - DNA, 44 bp, Artificial Sequence
  Description of Artificial Sequence: Synthetic oligonucleotide
gaatttgttgatgattataccgtcagagtgattgatgtgtttgc

SEQ ID NO: 147824 - DNA, 47 bp, Artificial Sequence
  Description of Artificial Sequence: Synthetic oligonucleotide
aatttgttgatgattataccgtcagagtgattgatgtgtttgctatg

SEQ ID NO: 147825 - DNA, 46 bp, Artificial Sequence
  Description of Artificial Sequence: Synthetic oligonucleotide
atttgttgatgattataccgtcagagtgattgatgtgtttgctatg

SEQ ID NO: 147826 - DNA, 45 bp, Artificial Sequence
  Description of Artificial Sequence: Synthetic oligonucleotide
tttgttgatgattataccgtcagagtgattgatgtgtttgctatg

SEQ ID NO: 147827 - DNA, 44 bp, Artificial Sequence
  Description of Artificial Sequence: Synthetic oligonucleotide
ttgttgatgattataccgtcagagtgattgatgtgtttgctatg

SEQ ID NO: 147828 - DNA, 43 bp, Artificial Sequence
  Description of Artificial Sequence: Synthetic oligonucleotide
tgttgatgattataccgtcagagtgattgatgtgtttgctatg

SEQ ID NO: 147829 - DNA, 42 bp, Artificial Sequence
  Description of Artificial Sequence: Synthetic oligonucleotide
gttgatgattataccgtcagagtgattgatgtgtttgctatg

SEQ ID NO: 147830 - DNA, 42 bp, Artificial Sequence
  Description of Artificial Sequence: Synthetic oligonucleotide
ttgatgattataccgtcagagtgattgatgtgtttgctatgc

SEQ ID NO: 147831 - DNA, 41 bp, Artificial Sequence
  Description of Artificial Sequence: Synthetic oligonucleotide
tgatgattataccgtcagagtgattgatgtgtttgctatgc

SEQ ID NO: 147832 - DNA, 40 bp, Artificial Sequence
  Description of Artificial Sequence: Synthetic oligonucleotide
gatgattataccgtcagagtgattgatgtgtttgctatgc

SEQ ID NO: 147833 - DNA, 40 bp, Artificial Sequence
  Description of Artificial Sequence: Synthetic oligonucleotide
atgattataccgtcagagtgattgatgtgtttgctatgcc

SEQ ID NO: 147834 - DNA, 39 bp, Artificial Sequence
  Description of Artificial Sequence: Synthetic oligonucleotide
tgattataccgtcagagtgattgatgtgtttgctatgcc

SEQ ID NO: 147835 - DNA, 38 bp, Artificial Sequence
  Description of Artificial Sequence: Synthetic oligonucleotide
gattataccgtcagagtgattgatgtgtttgctatgcc

SEQ ID NO: 147836 - DNA, 39 bp, Artificial Sequence
  Description of Artificial Sequence: Synthetic oligonucleotide
attataccgtcagagtgattgatgtgtttgctatgccac

SEQ ID NO: 147837 - DNA, 38 bp, Artificial Sequence
  Description of Artificial Sequence: Synthetic oligonucleotide
ttataccgtcagagtgattgatgtgtttgctatgccac

SEQ ID NO: 147838 - DNA, 37 bp, Artificial Sequence
  Description of Artificial Sequence: Synthetic oligonucleotide
tataccgtcagagtgattgatgtgtttgctatgccac

SEQ ID NO: 147839 - DNA, 36 bp, Artificial Sequence
  Description of Artificial Sequence: Synthetic oligonucleotide
ataccgtcagagtgattgatgtgtttgctatgccac

SEQ ID NO: 147840 - DNA, 35 bp, Artificial Sequence
  Description of Artificial Sequence: Synthetic oligonucleotide
taccgtcagagtgattgatgtgtttgctatgccac

SEQ ID NO: 147841 - DNA, 34 bp, Artificial Sequence
  Description of Artificial Sequence: Synthetic oligonucleotide
accgtcagagtgattgatgtgtttgctatgccac

SEQ ID NO: 147842 - DNA, 33 bp, Artificial Sequence
  Description of Artificial Sequence: Synthetic oligonucleotide
ccgtcagagtgattgatgtgtttgctatgccac

SEQ ID NO: 147843 - DNA, 34 bp, Artificial Sequence
  Description of Artificial Sequence: Synthetic oligonucleotide
cgtcagagtgattgatgtgtttgctatgccacag

SEQ ID NO: 147844 - DNA, 35 bp, Artificial Sequence
  Description of Artificial Sequence: Synthetic oligonucleotide
gtcagagtgattgatgtgtttgctatgccacagtc

SEQ ID NO: 147845 - DNA, 36 bp, Artificial Sequence
  Description of Artificial Sequence: Synthetic oligonucleotide
tcagagtgattgatgtgtttgctatgccacagtcag

SEQ ID NO: 147846 - DNA, 35 bp, Artificial Sequence
  Description of Artificial Sequence: Synthetic oligonucleotide
cagagtgattgatgtgtttgctatgccacagtcag

SEQ ID NO: 147847 - DNA, 35 bp, Artificial Sequence
  Description of Artificial Sequence: Synthetic oligonucleotide
agagtgattgatgtgtttgctatgccacagtcagg

SEQ ID NO: 147848 - DNA, 34 bp, Artificial Sequence
  Description of Artificial Sequence: Synthetic oligonucleotide
gagtgattgatgtgtttgctatgccacagtcagg

SEQ ID NO: 147849 - DNA, 36 bp, Artificial Sequence
  Description of Artificial Sequence: Synthetic oligonucleotide
agtgattgatgtgtttgctatgccacagtcaggaac

SEQ ID NO: 147850 - DNA, 35 bp, Artificial Sequence
  Description of Artificial Sequence: Synthetic oligonucleotide
gtgattgatgtgtttgctatgccacagtcaggaac

SEQ ID NO: 147851 - DNA, 36 bp, Artificial Sequence
  Description of Artificial Sequence: Synthetic oligonucleotide
tgattgatgtgtttgctatgccacagtcaggaacag

SEQ ID NO: 147852 - DNA, 35 bp, Artificial Sequence
  Description of Artificial Sequence: Synthetic oligonucleotide
gattgatgtgtttgctatgccacagtcaggaacag

SEQ ID NO: 147853 - DNA, 35 bp, Artificial Sequence
  Description of Artificial Sequence: Synthetic oligonucleotide
attgatgtgtttgctatgccacagtcaggaacagg

SEQ ID NO: 147854 - DNA, 34 bp, Artificial Sequence
  Description of Artificial Sequence: Synthetic oligonucleotide
ttgatgtgtttgctatgccacagtcaggaacagg

SEQ ID NO: 147855 - DNA, 33 bp, Artificial Sequence
  Description of Artificial Sequence: Synthetic oligonucleotide
tgatgtgtttgctatgccacagtcaggaacagg

SEQ ID NO: 147856 - DNA, 32 bp, Artificial Sequence
  Description of Artificial Sequence: Synthetic oligonucleotide
gatgtgtttgctatgccacagtcaggaacagg

SEQ ID NO: 147857 - DNA, 33 bp, Artificial Sequence
  Description of Artificial Sequence: Synthetic oligonucleotide
atgtgtttgctatgccacagtcaggaacaggtg

SEQ ID NO: 147858 - DNA, 32 bp, Artificial Sequence
  Description of Artificial Sequence: Synthetic oligonucleotide
tgtgtttgctatgccacagtcaggaacaggtg

SEQ ID NO: 147859 - DNA, 31 bp, Artificial Sequence
  Description of Artificial Sequence: Synthetic oligonucleotide
gtgtttgctatgccacagtcaggaacaggtg

SEQ ID NO: 147860 - DNA, 32 bp, Artificial Sequence
  Description of Artificial Sequence: Synthetic oligonucleotide
tgtttgctatgccacagtcaggaacaggtgtc

SEQ ID NO: 147861 - DNA, 31 bp, Artificial Sequence
  Description of Artificial Sequence: Synthetic oligonucleotide
gtttgctatgccacagtcaggaacaggtgtc

SEQ ID NO: 147862 - DNA, 32 bp, Artificial Sequence
  Description of Artificial Sequence: Synthetic oligonucleotide
tttgctatgccacagtcaggaacaggtgtcag

SEQ ID NO: 147863 - DNA, 31 bp, Artificial Sequence
  Description of Artificial Sequence: Synthetic oligonucleotide
ttgctatgccacagtcaggaacaggtgtcag

SEQ ID NO: 147864 - DNA, 30 bp, Artificial Sequence
  Description of Artificial Sequence: Synthetic oligonucleotide
tgctatgccacagtcaggaacaggtgtcag

SEQ ID NO: 147865 - DNA, 29 bp, Artificial Sequence
  Description of Artificial Sequence: Synthetic oligonucleotide
gctatgccacagtcaggaacaggtgtcag

SEQ ID NO: 147866 - DNA, 30 bp, Artificial Sequence
  Description of Artificial Sequence: Synthetic oligonucleotide
ctatgccacagtcaggaacaggtgtcagtg

SEQ ID NO: 147867 - DNA, 31 bp, Artificial Sequence
  Description of Artificial Sequence: Synthetic oligonucleotide
tatgccacagtcaggaacaggtgtcagtgtg

SEQ ID NO: 147868 - DNA, 30 bp, Artificial Sequence
  Description of Artificial Sequence: Synthetic oligonucleotide
atgccacagtcaggaacaggtgtcagtgtg

SEQ ID NO: 147869 - DNA, 29 bp, Artificial Sequence
  Description of Artificial Sequence: Synthetic oligonucleotide
tgccacagtcaggaacaggtgtcagtgtg

SEQ ID NO: 147870 - DNA, 28 bp, Artificial Sequence
  Description of Artificial Sequence: Synthetic oligonucleotide
gccacagtcaggaacaggtgtcagtgtg

SEQ ID NO: 147871 - DNA, 28 bp, Artificial Sequence
  Description of Artificial Sequence: Synthetic oligonucleotide
ccacagtcaggaacaggtgtcagtgtgg

SEQ ID NO: 147872 - DNA, 29 bp, Artificial Sequence
  Description of Artificial Sequence: Synthetic oligonucleotide
cacagtcaggaacaggtgtcagtgtggag

SEQ ID NO: 147873 - DNA, 29 bp, Artificial Sequence
  Description of Artificial Sequence: Synthetic oligonucleotide
acagtcaggaacaggtgtcagtgtggagg

SEQ ID NO: 147874 - DNA, 28 bp, Artificial Sequence
  Description of Artificial Sequence: Synthetic oligonucleotide
cagtcaggaacaggtgtcagtgtggagg

SEQ ID NO: 147875 - DNA, 28 bp, Artificial Sequence
  Description of Artificial Sequence: Synthetic oligonucleotide
agtcaggaacaggtgtcagtgtggaggc

SEQ ID NO: 147876 - DNA, 27 bp, Artificial Sequence
  Description of Artificial Sequence: Synthetic oligonucleotide
gtcaggaacaggtgtcagtgtggaggc

SEQ ID NO: 147877 - DNA, 28 bp, Artificial Sequence
  Description of Artificial Sequence: Synthetic oligonucleotide
tcaggaacaggtgtcagtgtggaggcag

SEQ ID NO: 147878 - DNA, 27 bp, Artificial Sequence
  Description of Artificial Sequence: Synthetic oligonucleotide
caggaacaggtgtcagtgtggaggcag

SEQ ID NO: 147879 - DNA, 29 bp, Artificial Sequence
  Description of Artificial Sequence: Synthetic oligonucleotide
aggaacaggtgtcagtgtggaggcagttg

SEQ ID NO: 147880 - DNA, 28 bp, Artificial Sequence
  Description of Artificial Sequence: Synthetic oligonucleotide
ggaacaggtgtcagtgtggaggcagttg

SEQ ID NO: 147881 - DNA, 30 bp, Artificial Sequence
  Description of Artificial Sequence: Synthetic oligonucleotide
gaacaggtgtcagtgtggaggcagttgatc

SEQ ID NO: 147882 - DNA, 30 bp, Artificial Sequence
  Description of Artificial Sequence: Synthetic oligonucleotide
aacaggtgtcagtgtggaggcagttgatcc

SEQ ID NO: 147883 - DNA, 29 bp, Artificial Sequence
  Description of Artificial Sequence: Synthetic oligonucleotide
acaggtgtcagtgtggaggcagttgatcc

SEQ ID NO: 147884 - DNA, 28 bp, Artificial Sequence
  Description of Artificial Sequence: Synthetic oligonucleotide
caggtgtcagtgtggaggcagttgatcc

SEQ ID NO: 147885 - DNA, 29 bp, Artificial Sequence
  Description of Artificial Sequence: Synthetic oligonucleotide
aggtgtcagtgtggaggcagttgatccag

SEQ ID NO: 147886 - DNA, 28 bp, Artificial Sequence
  Description of Artificial Sequence: Synthetic oligonucleotide
ggtgtcagtgtggaggcagttgatccag

SEQ ID NO: 147887 - DNA, 29 bp, Artificial Sequence
  Description of Artificial Sequence: Synthetic oligonucleotide
gtgtcagtgtggaggcagttgatccagtg

SEQ ID NO: 147888 - DNA, 31 bp, Artificial Sequence
  Description of Artificial Sequence: Synthetic oligonucleotide
tgtcagtgtggaggcagttgatccagtgttc

SEQ ID NO: 147889 - DNA, 30 bp, Artificial Sequence
  Description of Artificial Sequence: Synthetic oligonucleotide
gtcagtgtggaggcagttgatccagtgttc

SEQ ID NO: 147890 - DNA, 30 bp, Artificial Sequence
  Description of Artificial Sequence: Synthetic oligonucleotide
tcagtgtggaggcagttgatccagtgttcc

SEQ ID NO: 147891 - DNA, 29 bp, Artificial Sequence
  Description of Artificial Sequence: Synthetic oligonucleotide
cagtgtggaggcagttgatccagtgttcc

SEQ ID NO: 147892 - DNA, 31 bp, Artificial Sequence
  Description of Artificial Sequence: Synthetic oligonucleotide
agtgtggaggcagttgatccagtgttccaag

SEQ ID NO: 147893 - DNA, 30 bp, Artificial Sequence
  Description of Artificial Sequence: Synthetic oligonucleotide
gtgtggaggcagttgatccagtgttccaag

SEQ ID NO: 147894 - DNA, 30 bp, Artificial Sequence
  Description of Artificial Sequence: Synthetic oligonucleotide
tgtggaggcagttgatccagtgttccaagc

SEQ ID NO: 147895 - DNA, 29 bp, Artificial Sequence
  Description of Artificial Sequence: Synthetic oligonucleotide
gtggaggcagttgatccagtgttccaagc

SEQ ID NO: 147896 - DNA, 35 bp, Artificial Sequence
  Description of Artificial Sequence: Synthetic oligonucleotide
tggaggcagttgatccagtgttccaagctaaaatg

SEQ ID NO: 147897 - DNA, 34 bp, Artificial Sequence
  Description of Artificial Sequence: Synthetic oligonucleotide
ggaggcagttgatccagtgttccaagctaaaatg

SEQ ID NO: 147898 - DNA, 36 bp, Artificial Sequence
  Description of Artificial Sequence: Synthetic oligonucleotide
gaggcagttgatccagtgttccaagctaaaatgttg

SEQ ID NO: 147899 - DNA, 36 bp, Artificial Sequence
  Description of Artificial Sequence: Synthetic oligonucleotide
aggcagttgatccagtgttccaagctaaaatgttgg

SEQ ID NO: 147900 - DNA, 35 bp, Artificial Sequence
  Description of Artificial Sequence: Synthetic oligonucleotide
ggcagttgatccagtgttccaagctaaaatgttgg

SEQ ID NO: 147901 - DNA, 39 bp, Artificial Sequence
  Description of Artificial Sequence: Synthetic oligonucleotide
gcagttgatccagtgttccaagctaaaatgttggatatg

SEQ ID NO: 147902 - DNA, 41 bp, Artificial Sequence
  Description of Artificial Sequence: Synthetic oligonucleotide
cagttgatccagtgttccaagctaaaatgttggatatgttg

SEQ ID NO: 147903 - DNA, 43 bp, Artificial Sequence
  Description of Artificial Sequence: Synthetic oligonucleotide
agttgatccagtgttccaagctaaaatgttggatatgttgaag

SEQ ID NO: 147904 - DNA, 42 bp, Artificial Sequence
  Description of Artificial Sequence: Synthetic oligonucleotide
gttgatccagtgttccaagctaaaatgttggatatgttgaag

SEQ ID NO: 147905 - DNA, 42 bp, Artificial Sequence
  Description of Artificial Sequence: Synthetic oligonucleotide
ttgatccagtgttccaagctaaaatgttggatatgttgaagc

SEQ ID NO: 147906 - DNA, 41 bp, Artificial Sequence
  Description of Artificial Sequence: Synthetic oligonucleotide
tgatccagtgttccaagctaaaatgttggatatgttgaagc

SEQ ID NO: 147907 - DNA, 40 bp, Artificial Sequence
  Description of Artificial Sequence: Synthetic oligonucleotide
gatccagtgttccaagctaaaatgttggatatgttgaagc

SEQ ID NO: 147908 - DNA, 41 bp, Artificial Sequence
  Description of Artificial Sequence: Synthetic oligonucleotide
atccagtgttccaagctaaaatgttggatatgttgaagcag

SEQ ID NO: 147909 - DNA, 40 bp, Artificial Sequence
  Description of Artificial Sequence: Synthetic oligonucleotide
tccagtgttccaagctaaaatgttggatatgttgaagcag

SEQ ID NO: 147910 - DNA, 39 bp, Artificial Sequence
  Description of Artificial Sequence: Synthetic oligonucleotide
ccagtgttccaagctaaaatgttggatatgttgaagcag

SEQ ID NO: 147911 - DNA, 40 bp, Artificial Sequence
  Description of Artificial Sequence: Synthetic oligonucleotide
cagtgttccaagctaaaatgttggatatgttgaagcagac

SEQ ID NO: 147912 - DNA, 41 bp, Artificial Sequence
  Description of Artificial Sequence: Synthetic oligonucleotide
agtgttccaagctaaaatgttggatatgttgaagcagacag

SEQ ID NO: 147913 - DNA, 40 bp, Artificial Sequence
  Description of Artificial Sequence: Synthetic oligonucleotide
gtgttccaagctaaaatgttggatatgttgaagcagacag

SEQ ID NO: 147914 - DNA, 40 bp, Artificial Sequence
  Description of Artificial Sequence: Synthetic oligonucleotide
tgttccaagctaaaatgttggatatgttgaagcagacagg

SEQ ID NO: 147915 - DNA, 39 bp, Artificial Sequence
  Description of Artificial Sequence: Synthetic oligonucleotide
gttccaagctaaaatgttggatatgttgaagcagacagg

SEQ ID NO: 147916 - DNA, 41 bp, Artificial Sequence
  Description of Artificial Sequence: Synthetic oligonucleotide
ttccaagctaaaatgttggatatgttgaagcagacaggaag

SEQ ID NO: 147917 - DNA, 40 bp, Artificial Sequence
  Description of Artificial Sequence: Synthetic oligonucleotide
tccaagctaaaatgttggatatgttgaagcagacaggaag

SEQ ID NO: 147918 - DNA, 39 bp, Artificial Sequence
  Description of Artificial Sequence: Synthetic oligonucleotide
ccaagctaaaatgttggatatgttgaagcagacaggaag

SEQ ID NO: 147919 - DNA, 39 bp, Artificial Sequence
  Description of Artificial Sequence: Synthetic oligonucleotide
caagctaaaatgttggatatgttgaagcagacaggaagg

SEQ ID NO: 147920 - DNA, 39 bp, Artificial Sequence
  Description of Artificial Sequence: Synthetic oligonucleotide
aagctaaaatgttggatatgttgaagcagacaggaaggc

SEQ ID NO: 147921 - DNA, 38 bp, Artificial Sequence
  Description of Artificial Sequence: Synthetic oligonucleotide
agctaaaatgttggatatgttgaagcagacaggaaggc

SEQ ID NO: 147922 - DNA, 37 bp, Artificial Sequence
  Description of Artificial Sequence: Synthetic oligonucleotide
gctaaaatgttggatatgttgaagcagacaggaaggc

SEQ ID NO: 147923 - DNA, 37 bp, Artificial Sequence
  Description of Artificial Sequence: Synthetic oligonucleotide
ctaaaatgttggatatgttgaagcagacaggaaggcc

SEQ ID NO: 147924 - DNA, 37 bp, Artificial Sequence
  Description of Artificial Sequence: Synthetic oligonucleotide
taaaatgttggatatgttgaagcagacaggaaggccg

SEQ ID NO: 147925 - DNA, 36 bp, Artificial Sequence
  Description of Artificial Sequence: Synthetic oligonucleotide
aaaatgttggatatgttgaagcagacaggaaggccg

SEQ ID NO: 147926 - DNA, 35 bp, Artificial Sequence
  Description of Artificial Sequence: Synthetic oligonucleotide
aaatgttggatatgttgaagcagacaggaaggccg

SEQ ID NO: 147927 - DNA, 34 bp, Artificial Sequence
  Description of Artificial Sequence: Synthetic oligonucleotide
aatgttggatatgttgaagcagacaggaaggccg

SEQ ID NO: 147928 - DNA, 33 bp, Artificial Sequence
  Description of Artificial Sequence: Synthetic oligonucleotide
atgttggatatgttgaagcagacaggaaggccg

SEQ ID NO: 147929 - DNA, 32 bp, Artificial Sequence
  Description of Artificial Sequence: Synthetic oligonucleotide
tgttggatatgttgaagcagacaggaaggccg

SEQ ID NO: 147930 - DNA, 31 bp, Artificial Sequence
  Description of Artificial Sequence: Synthetic oligonucleotide
gttggatatgttgaagcagacaggaaggccg

SEQ ID NO: 147931 - DNA, 31 bp, Artificial Sequence
  Description of Artificial Sequence: Synthetic oligonucleotide
ttggatatgttgaagcagacaggaaggccgg

SEQ ID NO: 147932 - DNA, 30 bp, Artificial Sequence
  Description of Artificial Sequence: Synthetic oligonucleotide
tggatatgttgaagcagacaggaaggccgg

SEQ ID NO: 147933 - DNA, 29 bp, Artificial Sequence
  Description of Artificial Sequence: Synthetic oligonucleotide
ggatatgttgaagcagacaggaaggccgg

SEQ ID NO: 147934 - DNA, 30 bp, Artificial Sequence
  Description of Artificial Sequence: Synthetic oligonucleotide
gatatgttgaagcagacaggaaggccggag

SEQ ID NO: 147935 - DNA, 32 bp, Artificial Sequence
  Description of Artificial Sequence: Synthetic oligonucleotide
atatgttgaagcagacaggaaggccggagatg

SEQ ID NO: 147936 - DNA, 31 bp, Artificial Sequence
  Description of Artificial Sequence: Synthetic oligonucleotide
tatgttgaagcagacaggaaggccggagatg

SEQ ID NO: 147937 - DNA, 30 bp, Artificial Sequence
  Description of Artificial Sequence: Synthetic oligonucleotide
atgttgaagcagacaggaaggccggagatg

SEQ ID NO: 147938 - DNA, 29 bp, Artificial Sequence
  Description of Artificial Sequence: Synthetic oligonucleotide
tgttgaagcagacaggaaggccggagatg

SEQ ID NO: 147939 - DNA, 28 bp, Artificial Sequence
  Description of Artificial Sequence: Synthetic oligonucleotide
gttgaagcagacaggaaggccggagatg

SEQ ID NO: 147940 - DNA, 28 bp, Artificial Sequence
  Description of Artificial Sequence: Synthetic oligonucleotide
ttgaagcagacaggaaggccggagatgg

SEQ ID NO: 147941 - DNA, 27 bp, Artificial Sequence
  Description of Artificial Sequence: Synthetic oligonucleotide
tgaagcagacaggaaggccggagatgg

SEQ ID NO: 147942 - DNA, 27 bp, Artificial Sequence
  Description of Artificial Sequence: Synthetic oligonucleotide
gaagcagacaggaaggccggagatggt

SEQ ID NO: 147943 - DNA, 28 bp, Artificial Sequence
  Description of Artificial Sequence: Synthetic oligonucleotide
aagcagacaggaaggccggagatggttg

SEQ ID NO: 147944 - DNA, 27 bp, Artificial Sequence
  Description of Artificial Sequence: Synthetic oligonucleotide
agcagacaggaaggccggagatggttg

SEQ ID NO: 147945 - DNA, 27 bp, Artificial Sequence
  Description of Artificial Sequence: Synthetic oligonucleotide
gcagacaggaaggccggagatggttgt

SEQ ID NO: 147946 - DNA, 28 bp, Artificial Sequence
  Description of Artificial Sequence: Synthetic oligonucleotide
cagacaggaaggccggagatggttgttg

SEQ ID NO: 147947 - DNA, 28 bp, Artificial Sequence
  Description of Artificial Sequence: Synthetic oligonucleotide
agacaggaaggccggagatggttgttgg

SEQ ID NO: 147948 - DNA, 27 bp, Artificial Sequence
  Description of Artificial Sequence: Synthetic oligonucleotide
gacaggaaggccggagatggttgttgg

SEQ ID NO: 147949 - DNA, 29 bp, Artificial Sequence
  Description of Artificial Sequence: Synthetic oligonucleotide
acaggaaggccggagatggttgttggttg

SEQ ID NO: 147950 - DNA, 28 bp, Artificial Sequence
  Description of Artificial Sequence: Synthetic oligonucleotide
caggaaggccggagatggttgttggttg

SEQ ID NO: 147951 - DNA, 28 bp, Artificial Sequence
  Description of Artificial Sequence: Synthetic oligonucleotide
aggaaggccggagatggttgttggttgg

SEQ ID NO: 147952 - DNA, 27 bp, Artificial Sequence
  Description of Artificial Sequence: Synthetic oligonucleotide
ggaaggccggagatggttgttggttgg

SEQ ID NO: 147953 - DNA, 30 bp, Artificial Sequence
  Description of Artificial Sequence: Synthetic oligonucleotide
gaaggccggagatggttgttggttggtatc

SEQ ID NO: 147954 - DNA, 31 bp, Artificial Sequence
  Description of Artificial Sequence: Synthetic oligonucleotide
aaggccggagatggttgttggttggtatcac

SEQ ID NO: 147955 - DNA, 30 bp, Artificial Sequence
  Description of Artificial Sequence: Synthetic oligonucleotide
aggccggagatggttgttggttggtatcac

SEQ ID NO: 147956 - DNA, 29 bp, Artificial Sequence
  Description of Artificial Sequence: Synthetic oligonucleotide
ggccggagatggttgttggttggtatcac

SEQ ID NO: 147957 - DNA, 30 bp, Artificial Sequence
  Description of Artificial Sequence: Synthetic oligonucleotide
gccggagatggttgttggttggtatcacag

SEQ ID NO: 147958 - DNA, 31 bp, Artificial Sequence
  Description of Artificial Sequence: Synthetic oligonucleotide
ccggagatggttgttggttggtatcacagtc

SEQ ID NO: 147959 - DNA, 32 bp, Artificial Sequence
  Description of Artificial Sequence: Synthetic oligonucleotide
cggagatggttgttggttggtatcacagtcac

SEQ ID NO: 147960 - DNA, 32 bp, Artificial Sequence
  Description of Artificial Sequence: Synthetic oligonucleotide
ggagatggttgttggttggtatcacagtcacc

SEQ ID NO: 147961 - DNA, 32 bp, Artificial Sequence
  Description of Artificial Sequence: Synthetic oligonucleotide
gagatggttgttggttggtatcacagtcaccc

SEQ ID NO: 147962 - DNA, 33 bp, Artificial Sequence
  Description of Artificial Sequence: Synthetic oligonucleotide
agatggttgttggttggtatcacagtcaccctg

SEQ ID NO: 147963 - DNA, 32 bp, Artificial Sequence
  Description of Artificial Sequence: Synthetic oligonucleotide
gatggttgttggttggtatcacagtcaccctg

SEQ ID NO: 147964 - DNA, 32 bp, Artificial Sequence
  Description of Artificial Sequence: Synthetic oligonucleotide
atggttgttggttggtatcacagtcaccctgg

SEQ ID NO: 147965 - DNA, 31 bp, Artificial Sequence
  Description of Artificial Sequence: Synthetic oligonucleotide
tggttgttggttggtatcacagtcaccctgg

SEQ ID NO: 147966 - DNA, 30 bp, Artificial Sequence
  Description of Artificial Sequence: Synthetic oligonucleotide
ggttgttggttggtatcacagtcaccctgg

SEQ ID NO: 147967 - DNA, 30 bp, Artificial Sequence
  Description of Artificial Sequence: Synthetic oligonucleotide
gttgttggttggtatcacagtcaccctggc

SEQ ID NO: 147968 - DNA, 33 bp, Artificial Sequence
  Description of Artificial Sequence: Synthetic oligonucleotide
ttgttggttggtatcacagtcaccctggctttg

SEQ ID NO: 147969 - DNA, 32 bp, Artificial Sequence
  Description of Artificial Sequence: Synthetic oligonucleotide
tgttggttggtatcacagtcaccctggctttg

SEQ ID NO: 147970 - DNA, 31 bp, Artificial Sequence
  Description of Artificial Sequence: Synthetic oligonucleotide
gttggttggtatcacagtcaccctggctttg

SEQ ID NO: 147971 - DNA, 31 bp, Artificial Sequence
  Description of Artificial Sequence: Synthetic oligonucleotide
ttggttggtatcacagtcaccctggctttgg

SEQ ID NO: 147972 - DNA, 30 bp, Artificial Sequence
  Description of Artificial Sequence: Synthetic oligonucleotide
tggttggtatcacagtcaccctggctttgg

SEQ ID NO: 147973 - DNA, 29 bp, Artificial Sequence
  Description of Artificial Sequence: Synthetic oligonucleotide
ggttggtatcacagtcaccctggctttgg

SEQ ID NO: 147974 - DNA, 31 bp, Artificial Sequence
  Description of Artificial Sequence: Synthetic oligonucleotide
gttggtatcacagtcaccctggctttggttg

SEQ ID NO: 147975 - DNA, 33 bp, Artificial Sequence
  Description of Artificial Sequence: Synthetic oligonucleotide
ttggtatcacagtcaccctggctttggttgttg

SEQ ID NO: 147976 - DNA, 32 bp, Artificial Sequence
  Description of Artificial Sequence: Synthetic oligonucleotide
tggtatcacagtcaccctggctttggttgttg

SEQ ID NO: 147977 - DNA, 31 bp, Artificial Sequence
  Description of Artificial Sequence: Synthetic oligonucleotide
ggtatcacagtcaccctggctttggttgttg

SEQ ID NO: 147978 - DNA, 31 bp, Artificial Sequence
  Description of Artificial Sequence: Synthetic oligonucleotide
gtatcacagtcaccctggctttggttgttgg

SEQ ID NO: 147979 - DNA, 31 bp, Artificial Sequence
  Description of Artificial Sequence: Synthetic oligonucleotide
tatcacagtcaccctggctttggttgttggc

SEQ ID NO: 147980 - DNA, 30 bp, Artificial Sequence
  Description of Artificial Sequence: Synthetic oligonucleotide
atcacagtcaccctggctttggttgttggc

SEQ ID NO: 147981 - DNA, 29 bp, Artificial Sequence
  Description of Artificial Sequence: Synthetic oligonucleotide
tcacagtcaccctggctttggttgttggc

SEQ ID NO: 147982 - DNA, 28 bp, Artificial Sequence
  Description of Artificial Sequence: Synthetic oligonucleotide
cacagtcaccctggctttggttgttggc

SEQ ID NO: 147983 - DNA, 31 bp, Artificial Sequence
  Description of Artificial Sequence: Synthetic oligonucleotide
acagtcaccctggctttggttgttggctttc

SEQ ID NO: 147984 - DNA, 30 bp, Artificial Sequence
  Description of Artificial Sequence: Synthetic oligonucleotide
cagtcaccctggctttggttgttggctttc

SEQ ID NO: 147985 - DNA, 31 bp, Artificial Sequence
  Description of Artificial Sequence: Synthetic oligonucleotide
agtcaccctggctttggttgttggctttctg

SEQ ID NO: 147986 - DNA, 30 bp, Artificial Sequence
  Description of Artificial Sequence: Synthetic oligonucleotide
gtcaccctggctttggttgttggctttctg

SEQ ID NO: 147987 - DNA, 30 bp, Artificial Sequence
  Description of Artificial Sequence: Synthetic oligonucleotide
tcaccctggctttggttgttggctttctgg

SEQ ID NO: 147988 - DNA, 29 bp, Artificial Sequence
  Description of Artificial Sequence: Synthetic oligonucleotide
caccctggctttggttgttggctttctgg

SEQ ID NO: 147989 - DNA, 30 bp, Artificial Sequence
  Description of Artificial Sequence: Synthetic oligonucleotide
accctggctttggttgttggctttctggtg

SEQ ID NO: 147990 - DNA, 29 bp, Artificial Sequence
  Description of Artificial Sequence: Synthetic oligonucleotide
ccctggctttggttgttggctttctggtg

SEQ ID NO: 147991 - DNA, 30 bp, Artificial Sequence
  Description of Artificial Sequence: Synthetic oligonucleotide
cctggctttggttgttggctttctggtgtg

SEQ ID NO: 147992 - DNA, 30 bp, Artificial Sequence
  Description of Artificial Sequence: Synthetic oligonucleotide
ctggctttggttgttggctttctggtgtgg

SEQ ID NO: 147993 - DNA, 34 bp, Artificial Sequence
  Description of Artificial Sequence: Synthetic oligonucleotide
tggctttggttgttggctttctggtgtggatatc

SEQ ID NO: 147994 - DNA, 33 bp, Artificial Sequence
  Description of Artificial Sequence: Synthetic oligonucleotide
ggctttggttgttggctttctggtgtggatatc

SEQ ID NO: 147995 - DNA, 35 bp, Artificial Sequence
  Description of Artificial Sequence: Synthetic oligonucleotide
gctttggttgttggctttctggtgtggatatcaac

SEQ ID NO: 147996 - DNA, 36 bp, Artificial Sequence
  Description of Artificial Sequence: Synthetic oligonucleotide
ctttggttgttggctttctggtgtggatatcaacac

SEQ ID NO: 147997 - DNA, 37 bp, Artificial Sequence
  Description of Artificial Sequence: Synthetic oligonucleotide
tttggttgttggctttctggtgtggatatcaacactc

SEQ ID NO: 147998 - DNA, 36 bp, Artificial Sequence
  Description of Artificial Sequence: Synthetic oligonucleotide
ttggttgttggctttctggtgtggatatcaacactc

SEQ ID NO: 147999 - DNA, 35 bp, Artificial Sequence
  Description of Artificial Sequence: Synthetic oligonucleotide
tggttgttggctttctggtgtggatatcaacactc

SEQ ID NO: 148000 - DNA, 34 bp, Artificial Sequence
  Description of Artificial Sequence: Synthetic oligonucleotide
ggttgttggctttctggtgtggatatcaacactc

SEQ ID NO: 148001 - DNA, 35 bp, Artificial Sequence
  Description of Artificial Sequence: Synthetic oligonucleotide
gttgttggctttctggtgtggatatcaacactcag

SEQ ID NO: 148002 - DNA, 35 bp, Artificial Sequence
  Description of Artificial Sequence: Synthetic oligonucleotide
ttgttggctttctggtgtggatatcaacactcagc

SEQ ID NO: 148003 - DNA, 34 bp, Artificial Sequence
  Description of Artificial Sequence: Synthetic oligonucleotide
tgttggctttctggtgtggatatcaacactcagc

SEQ ID NO: 148004 - DNA, 33 bp, Artificial Sequence
  Description of Artificial Sequence: Synthetic oligonucleotide
gttggctttctggtgtggatatcaacactcagc

SEQ ID NO: 148005 - DNA, 34 bp, Artificial Sequence
  Description of Artificial Sequence: Synthetic oligonucleotide
ttggctttctggtgtggatatcaacactcagcag

SEQ ID NO: 148006 - DNA, 33 bp, Artificial Sequence
  Description of Artificial Sequence: Synthetic oligonucleotide
tggctttctggtgtggatatcaacactcagcag

SEQ ID NO: 148007 - DNA, 32 bp, Artificial Sequence
  Description of Artificial Sequence: Synthetic oligonucleotide
ggctttctggtgtggatatcaacactcagcag

SEQ ID NO: 148008 - DNA, 33 bp, Artificial Sequence
  Description of Artificial Sequence: Synthetic oligonucleotide
gctttctggtgtggatatcaacactcagcagag

SEQ ID NO: 148009 - DNA, 33 bp, Artificial Sequence
  Description of Artificial Sequence: Synthetic oligonucleotide
ctttctggtgtggatatcaacactcagcagagc

SEQ ID NO: 148010 - DNA, 36 bp, Artificial Sequence
  Description of Artificial Sequence: Synthetic oligonucleotide
tttctggtgtggatatcaacactcagcagagctttg

SEQ ID NO: 148011 - DNA, 35 bp, Artificial Sequence
  Description of Artificial Sequence: Synthetic oligonucleotide
ttctggtgtggatatcaacactcagcagagctttg

SEQ ID NO: 148012 - DNA, 34 bp, Artificial Sequence
  Description of Artificial Sequence: Synthetic oligonucleotide
tctggtgtggatatcaacactcagcagagctttg

SEQ ID NO: 148013 - DNA, 33 bp, Artificial Sequence
  Description of Artificial Sequence: Synthetic oligonucleotide
ctggtgtggatatcaacactcagcagagctttg

SEQ ID NO: 148014 - DNA, 35 bp, Artificial Sequence
  Description of Artificial Sequence: Synthetic oligonucleotide
tggtgtggatatcaacactcagcagagctttgaag

SEQ ID NO: 148015 - DNA, 34 bp, Artificial Sequence
  Description of Artificial Sequence: Synthetic oligonucleotide
ggtgtggatatcaacactcagcagagctttgaag

SEQ ID NO: 148016 - DNA, 34 bp, Artificial Sequence
  Description of Artificial Sequence: Synthetic oligonucleotide
gtgtggatatcaacactcagcagagctttgaagc

SEQ ID NO: 148017 - DNA, 34 bp, Artificial Sequence
  Description of Artificial Sequence: Synthetic oligonucleotide
tgtggatatcaacactcagcagagctttgaagcc

SEQ ID NO: 148018 - DNA, 33 bp, Artificial Sequence
  Description of Artificial Sequence: Synthetic oligonucleotide
gtggatatcaacactcagcagagctttgaagcc

SEQ ID NO: 148019 - DNA, 35 bp, Artificial Sequence
  Description of Artificial Sequence: Synthetic oligonucleotide
tggatatcaacactcagcagagctttgaagccttg

SEQ ID NO: 148020 - DNA, 34 bp, Artificial Sequence
  Description of Artificial Sequence: Synthetic oligonucleotide
ggatatcaacactcagcagagctttgaagccttg

SEQ ID NO: 148021 - DNA, 35 bp, Artificial Sequence
  Description of Artificial Sequence: Synthetic oligonucleotide
gatatcaacactcagcagagctttgaagccttgtc

SEQ ID NO: 148022 - DNA, 35 bp, Artificial Sequence
  Description of Artificial Sequence: Synthetic oligonucleotide
atatcaacactcagcagagctttgaagccttgtcg

SEQ ID NO: 148023 - DNA, 34 bp, Artificial Sequence
  Description of Artificial Sequence: Synthetic oligonucleotide
tatcaacactcagcagagctttgaagccttgtcg

SEQ ID NO: 148024 - DNA, 33 bp, Artificial Sequence
  Description of Artificial Sequence: Synthetic oligonucleotide
atcaacactcagcagagctttgaagccttgtcg

SEQ ID NO: 148025 - DNA, 32 bp, Artificial Sequence
  Description of Artificial Sequence: Synthetic oligonucleotide
tcaacactcagcagagctttgaagccttgtcg

SEQ ID NO: 148026 - DNA, 31 bp, Artificial Sequence
  Description of Artificial Sequence: Synthetic oligonucleotide
caacactcagcagagctttgaagccttgtcg

SEQ ID NO: 148027 - DNA, 31 bp, Artificial Sequence
  Description of Artificial Sequence: Synthetic oligonucleotide
aacactcagcagagctttgaagccttgtcgg

SEQ ID NO: 148028 - DNA, 30 bp, Artificial Sequence
  Description of Artificial Sequence: Synthetic oligonucleotide
acactcagcagagctttgaagccttgtcgg

SEQ ID NO: 148029 - DNA, 29 bp, Artificial Sequence
  Description of Artificial Sequence: Synthetic oligonucleotide
cactcagcagagctttgaagccttgtcgg

SEQ ID NO: 148030 - DNA, 30 bp, Artificial Sequence
  Description of Artificial Sequence: Synthetic oligonucleotide
actcagcagagctttgaagccttgtcggag

SEQ ID NO: 148031 - DNA, 29 bp, Artificial Sequence
  Description of Artificial Sequence: Synthetic oligonucleotide
ctcagcagagctttgaagccttgtcggag

SEQ ID NO: 148032 - DNA, 30 bp, Artificial Sequence
  Description of Artificial Sequence: Synthetic oligonucleotide
tcagcagagctttgaagccttgtcggagag

SEQ ID NO: 148033 - DNA, 29 bp, Artificial Sequence
  Description of Artificial Sequence: Synthetic oligonucleotide
cagcagagctttgaagccttgtcggagag

SEQ ID NO: 148034 - DNA, 30 bp, Artificial Sequence
  Description of Artificial Sequence: Synthetic oligonucleotide
agcagagctttgaagccttgtcggagagag

SEQ ID NO: 148035 - DNA, 29 bp, Artificial Sequence
  Description of Artificial Sequence: Synthetic oligonucleotide
gcagagctttgaagccttgtcggagagag

SEQ ID NO: 148036 - DNA, 29 bp, Artificial Sequence
  Description of Artificial Sequence: Synthetic oligonucleotide
cagagctttgaagccttgtcggagagagc

SEQ ID NO: 148037 - DNA, 30 bp, Artificial Sequence
  Description of Artificial Sequence: Synthetic oligonucleotide
agagctttgaagccttgtcggagagagctg

SEQ ID NO: 148038 - DNA, 29 bp, Artificial Sequence
  Description of Artificial Sequence: Synthetic oligonucleotide
gagctttgaagccttgtcggagagagctg

SEQ ID NO: 148039 - DNA, 30 bp, Artificial Sequence
  Description of Artificial Sequence: Synthetic oligonucleotide
agctttgaagccttgtcggagagagctgtg

SEQ ID NO: 148040 - DNA, 29 bp, Artificial Sequence
  Description of Artificial Sequence: Synthetic oligonucleotide
gctttgaagccttgtcggagagagctgtg

SEQ ID NO: 148041 - DNA, 29 bp, Artificial Sequence
  Description of Artificial Sequence: Synthetic oligonucleotide
ctttgaagccttgtcggagagagctgtgg

SEQ ID NO: 148042 - DNA, 29 bp, Artificial Sequence
  Description of Artificial Sequence: Synthetic oligonucleotide
tttgaagccttgtcggagagagctgtggc

SEQ ID NO: 148043 - DNA, 28 bp, Artificial Sequence
  Description of Artificial Sequence: Synthetic oligonucleotide
ttgaagccttgtcggagagagctgtggc

SEQ ID NO: 148044 - DNA, 27 bp, Artificial Sequence
  Description of Artificial Sequence: Synthetic oligonucleotide
tgaagccttgtcggagagagctgtggc

SEQ ID NO: 148045 - DNA, 27 bp, Artificial Sequence
  Description of Artificial Sequence: Synthetic oligonucleotide
gaagccttgtcggagagagctgtggca

SEQ ID NO: 148046 - DNA, 27 bp, Artificial Sequence
  Description of Artificial Sequence: Synthetic oligonucleotide
aagccttgtcggagagagctgtggcag

SEQ ID NO: 148047 - DNA, 27 bp, Artificial Sequence
  Description of Artificial Sequence: Synthetic oligonucleotide
agccttgtcggagagagctgtggcagt

SEQ ID NO: 148048 - DNA, 26 bp, Artificial Sequence
  Description of Artificial Sequence: Synthetic oligonucleotide
gccttgtcggagagagctgtggcagt

SEQ ID NO: 148049 - DNA, 26 bp, Artificial Sequence
  Description of Artificial Sequence: Synthetic oligonucleotide
ccttgtcggagagagctgtggcagtg

SEQ ID NO: 148050 - DNA, 27 bp, Artificial Sequence
  Description of Artificial Sequence: Synthetic oligonucleotide
cttgtcggagagagctgtggcagtggt

SEQ ID NO: 148051 - DNA, 28 bp, Artificial Sequence
  Description of Artificial Sequence: Synthetic oligonucleotide
ttgtcggagagagctgtggcagtggttg

SEQ ID NO: 148052 - DNA, 27 bp, Artificial Sequence
  Description of Artificial Sequence: Synthetic oligonucleotide
tgtcggagagagctgtggcagtggttg

SEQ ID NO: 148053 - DNA, 27 bp, Artificial Sequence
  Description of Artificial Sequence: Synthetic oligonucleotide
gtcggagagagctgtggcagtggttgt

SEQ ID NO: 148054 - DNA, 27 bp, Artificial Sequence
  Description of Artificial Sequence: Synthetic oligonucleotide
tcggagagagctgtggcagtggttgtg

SEQ ID NO: 148055 - DNA, 26 bp, Artificial Sequence
  Description of Artificial Sequence: Synthetic oligonucleotide
cggagagagctgtggcagtggttgtg

SEQ ID NO: 148056 - DNA, 27 bp, Artificial Sequence
  Description of Artificial Sequence: Synthetic oligonucleotide
ggagagagctgtggcagtggttgtgga

SEQ ID NO: 148057 - DNA, 28 bp, Artificial Sequence
  Description of Artificial Sequence: Synthetic oligonucleotide
gagagagctgtggcagtggttgtggatc

SEQ ID NO: 148058 - DNA, 28 bp, Artificial Sequence
  Description of Artificial Sequence: Synthetic oligonucleotide
agagagctgtggcagtggttgtggatcc

SEQ ID NO: 148059 - DNA, 27 bp, Artificial Sequence
  Description of Artificial Sequence: Synthetic oligonucleotide
gagagctgtggcagtggttgtggatcc

SEQ ID NO: 148060 - DNA, 27 bp, Artificial Sequence
  Description of Artificial Sequence: Synthetic oligonucleotide
agagctgtggcagtggttgtggatccc

SEQ ID NO: 148061 - DNA, 27 bp, Artificial Sequence
  Description of Artificial Sequence: Synthetic oligonucleotide
gagctgtggcagtggttgtggatccca

SEQ ID NO: 148062 - DNA, 29 bp, Artificial Sequence
  Description of Artificial Sequence: Synthetic oligonucleotide
agctgtggcagtggttgtggatcccattc

SEQ ID NO: 148063 - DNA, 28 bp, Artificial Sequence
  Description of Artificial Sequence: Synthetic oligonucleotide
gctgtggcagtggttgtggatcccattc

SEQ ID NO: 148064 - DNA, 29 bp, Artificial Sequence
  Description of Artificial Sequence: Synthetic oligonucleotide
ctgtggcagtggttgtggatcccattcag

SEQ ID NO: 148065 - DNA, 30 bp, Artificial Sequence
  Description of Artificial Sequence: Synthetic oligonucleotide
tgtggcagtggttgtggatcccattcagag

SEQ ID NO: 148066 - DNA, 29 bp, Artificial Sequence
  Description of Artificial Sequence: Synthetic oligonucleotide
gtggcagtggttgtggatcccattcagag

SEQ ID NO: 148067 - DNA, 30 bp, Artificial Sequence
  Description of Artificial Sequence: Synthetic oligonucleotide
tggcagtggttgtggatcccattcagagtg

SEQ ID NO: 148068 - DNA, 29 bp, Artificial Sequence
  Description of Artificial Sequence: Synthetic oligonucleotide
ggcagtggttgtggatcccattcagagtg

SEQ ID NO: 148069 - DNA, 34 bp, Artificial Sequence
  Description of Artificial Sequence: Synthetic oligonucleotide
gcagtggttgtggatcccattcagagtgtaaaag

SEQ ID NO: 148070 - DNA, 34 bp, Artificial Sequence
  Description of Artificial Sequence: Synthetic oligonucleotide
cagtggttgtggatcccattcagagtgtaaaagg

SEQ ID NO: 148071 - DNA, 37 bp, Artificial Sequence
  Description of Artificial Sequence: Synthetic oligonucleotide
agtggttgtggatcccattcagagtgtaaaaggaaag

SEQ ID NO: 148072 - DNA, 36 bp, Artificial Sequence
  Description of Artificial Sequence: Synthetic oligonucleotide
gtggttgtggatcccattcagagtgtaaaaggaaag

SEQ ID NO: 148073 - DNA, 36 bp, Artificial Sequence
  Description of Artificial Sequence: Synthetic oligonucleotide
tggttgtggatcccattcagagtgtaaaaggaaagg

SEQ ID NO: 148074 - DNA, 35 bp, Artificial Sequence
  Description of Artificial Sequence: Synthetic oligonucleotide
ggttgtggatcccattcagagtgtaaaaggaaagg

SEQ ID NO: 148075 - DNA, 37 bp, Artificial Sequence
  Description of Artificial Sequence: Synthetic oligonucleotide
gttgtggatcccattcagagtgtaaaaggaaaggttg

SEQ ID NO: 148076 - DNA, 42 bp, Artificial Sequence
  Description of Artificial Sequence: Synthetic oligonucleotide
ttgtggatcccattcagagtgtaaaaggaaaggttgttattg

SEQ ID NO: 148077 - DNA, 41 bp, Artificial Sequence
  Description of Artificial Sequence: Synthetic oligonucleotide
tgtggatcccattcagagtgtaaaaggaaaggttgttattg

SEQ ID NO: 148078 - DNA, 40 bp, Artificial Sequence
  Description of Artificial Sequence: Synthetic oligonucleotide
gtggatcccattcagagtgtaaaaggaaaggttgttattg

SEQ ID NO: 148079 - DNA, 42 bp, Artificial Sequence
  Description of Artificial Sequence: Synthetic oligonucleotide
tggatcccattcagagtgtaaaaggaaaggttgttattgatg

SEQ ID NO: 148080 - DNA, 41 bp, Artificial Sequence
  Description of Artificial Sequence: Synthetic oligonucleotide
ggatcccattcagagtgtaaaaggaaaggttgttattgatg

SEQ ID NO: 148081 - DNA, 41 bp, Artificial Sequence
  Description of Artificial Sequence: Synthetic oligonucleotide
gatcccattcagagtgtaaaaggaaaggttgttattgatgc

SEQ ID NO: 148082 - DNA, 41 bp, Artificial Sequence
  Description of Artificial Sequence: Synthetic oligonucleotide
atcccattcagagtgtaaaaggaaaggttgttattgatgcc

SEQ ID NO: 148083 - DNA, 40 bp, Artificial Sequence
  Description of Artificial Sequence: Synthetic oligonucleotide
tcccattcagagtgtaaaaggaaaggttgttattgatgcc

SEQ ID NO: 148084 - DNA, 39 bp, Artificial Sequence
  Description of Artificial Sequence: Synthetic oligonucleotide
cccattcagagtgtaaaaggaaaggttgttattgatgcc

SEQ ID NO: 148085 - DNA, 41 bp, Artificial Sequence
  Description of Artificial Sequence: Synthetic oligonucleotide
ccattcagagtgtaaaaggaaaggttgttattgatgccttc

SEQ ID NO: 148086 - DNA, 42 bp, Artificial Sequence
  Description of Artificial Sequence: Synthetic oligonucleotide
cattcagagtgtaaaaggaaaggttgttattgatgccttcag

SEQ ID NO: 148087 - DNA, 45 bp, Artificial Sequence
  Description of Artificial Sequence: Synthetic oligonucleotide
attcagagtgtaaaaggaaaggttgttattgatgccttcagattg

SEQ ID NO: 148088 - DNA, 44 bp, Artificial Sequence
  Description of Artificial Sequence: Synthetic oligonucleotide
ttcagagtgtaaaaggaaaggttgttattgatgccttcagattg

SEQ ID NO: 148089 - DNA, 43 bp, Artificial Sequence
  Description of Artificial Sequence: Synthetic oligonucleotide
tcagagtgtaaaaggaaaggttgttattgatgccttcagattg

SEQ ID NO: 148090 - DNA, 42 bp, Artificial Sequence
  Description of Artificial Sequence: Synthetic oligonucleotide
cagagtgtaaaaggaaaggttgttattgatgccttcagattg

SEQ ID NO: 148091 - DNA, 44 bp, Artificial Sequence
  Description of Artificial Sequence: Synthetic oligonucleotide
agagtgtaaaaggaaaggttgttattgatgccttcagattgatc

SEQ ID NO: 148092 - DNA, 43 bp, Artificial Sequence
  Description of Artificial Sequence: Synthetic oligonucleotide
gagtgtaaaaggaaaggttgttattgatgccttcagattgatc

SEQ ID NO: 148093 - DNA, 46 bp, Artificial Sequence
  Description of Artificial Sequence: Synthetic oligonucleotide
agtgtaaaaggaaaggttgttattgatgccttcagattgatcaatg

SEQ ID NO: 148094 - DNA, 45 bp, Artificial Sequence
  Description of Artificial Sequence: Synthetic oligonucleotide
gtgtaaaaggaaaggttgttattgatgccttcagattgatcaatg

SEQ ID NO: 148095 - DNA, 45 bp, Artificial Sequence
  Description of Artificial Sequence: Synthetic oligonucleotide
tgtaaaaggaaaggttgttattgatgccttcagattgatcaatgc

SEQ ID NO: 148096 - DNA, 44 bp, Artificial Sequence
  Description of Artificial Sequence: Synthetic oligonucleotide
gtaaaaggaaaggttgttattgatgccttcagattgatcaatgc

SEQ ID NO: 148097 - DNA, 50 bp, Artificial Sequence
  Description of Artificial Sequence: Synthetic oligonucleotide
taaaaggaaaggttgttattgatgccttcagattgatcaatgctaatatg

SEQ ID NO: 148098 - DNA, 49 bp, Artificial Sequence
  Description of Artificial Sequence: Synthetic oligonucleotide
aaaaggaaaggttgttattgatgccttcagattgatcaatgctaatatg

SEQ ID NO: 148099 - DNA, 48 bp, Artificial Sequence
  Description of Artificial Sequence: Synthetic oligonucleotide
aaaggaaaggttgttattgatgccttcagattgatcaatgctaatatg

SEQ ID NO: 148100 - DNA, 47 bp, Artificial Sequence
  Description of Artificial Sequence: Synthetic oligonucleotide
aaggaaaggttgttattgatgccttcagattgatcaatgctaatatg

SEQ ID NO: 148101 - DNA, 46 bp, Artificial Sequence
  Description of Artificial Sequence: Synthetic oligonucleotide
aggaaaggttgttattgatgccttcagattgatcaatgctaatatg

SEQ ID NO: 148102 - DNA, 45 bp, Artificial Sequence
  Description of Artificial Sequence: Synthetic oligonucleotide
ggaaaggttgttattgatgccttcagattgatcaatgctaatatg

SEQ ID NO: 148103 - DNA, 47 bp, Artificial Sequence
  Description of Artificial Sequence: Synthetic oligonucleotide
gaaaggttgttattgatgccttcagattgatcaatgctaatatgatg

SEQ ID NO: 148104 - DNA, 47 bp, Artificial Sequence
  Description of Artificial Sequence: Synthetic oligonucleotide
aaaggttgttattgatgccttcagattgatcaatgctaatatgatgg

SEQ ID NO: 148105 - DNA, 46 bp, Artificial Sequence
  Description of Artificial Sequence: Synthetic oligonucleotide
aaggttgttattgatgccttcagattgatcaatgctaatatgatgg

SEQ ID NO: 148106 - DNA, 45 bp, Artificial Sequence
  Description of Artificial Sequence: Synthetic oligonucleotide
aggttgttattgatgccttcagattgatcaatgctaatatgatgg

SEQ ID NO: 148107 - DNA, 44 bp, Artificial Sequence
  Description of Artificial Sequence: Synthetic oligonucleotide
ggttgttattgatgccttcagattgatcaatgctaatatgatgg

SEQ ID NO: 148108 - DNA, 45 bp, Artificial Sequence
  Description of Artificial Sequence: Synthetic oligonucleotide
gttgttattgatgccttcagattgatcaatgctaatatgatggtc

SEQ ID NO: 148109 - DNA, 48 bp, Artificial Sequence
  Description of Artificial Sequence: Synthetic oligonucleotide
ttgttattgatgccttcagattgatcaatgctaatatgatggtcttag

SEQ ID NO: 148110 - DNA, 47 bp, Artificial Sequence
  Description of Artificial Sequence: Synthetic oligonucleotide
tgttattgatgccttcagattgatcaatgctaatatgatggtcttag

SEQ ID NO: 148111 - DNA, 46 bp, Artificial Sequence
  Description of Artificial Sequence: Synthetic oligonucleotide
gttattgatgccttcagattgatcaatgctaatatgatggtcttag

SEQ ID NO: 148112 - DNA, 46 bp, Artificial Sequence
  Description of Artificial Sequence: Synthetic oligonucleotide
ttattgatgccttcagattgatcaatgctaatatgatggtcttagg

SEQ ID NO: 148113 - DNA, 45 bp, Artificial Sequence
  Description of Artificial Sequence: Synthetic oligonucleotide
tattgatgccttcagattgatcaatgctaatatgatggtcttagg

SEQ ID NO: 148114 - DNA, 44 bp, Artificial Sequence
  Description of Artificial Sequence: Synthetic oligonucleotide
attgatgccttcagattgatcaatgctaatatgatggtcttagg

SEQ ID NO: 148115 - DNA, 43 bp, Artificial Sequence
  Description of Artificial Sequence: Synthetic oligonucleotide
ttgatgccttcagattgatcaatgctaatatgatggtcttagg

SEQ ID NO: 148116 - DNA, 42 bp, Artificial Sequence
  Description of Artificial Sequence: Synthetic oligonucleotide
tgatgccttcagattgatcaatgctaatatgatggtcttagg

SEQ ID NO: 148117 - DNA, 41 bp, Artificial Sequence
  Description of Artificial Sequence: Synthetic oligonucleotide
gatgccttcagattgatcaatgctaatatgatggtcttagg

SEQ ID NO: 148118 - DNA, 42 bp, Artificial Sequence
  Description of Artificial Sequence: Synthetic oligonucleotide
atgccttcagattgatcaatgctaatatgatggtcttaggac

SEQ ID NO: 148119 - DNA, 41 bp, Artificial Sequence
  Description of Artificial Sequence: Synthetic oligonucleotide
tgccttcagattgatcaatgctaatatgatggtcttaggac

SEQ ID NO: 148120 - DNA, 40 bp, Artificial Sequence
  Description of Artificial Sequence: Synthetic oligonucleotide
gccttcagattgatcaatgctaatatgatggtcttaggac

SEQ ID NO: 148121 - DNA, 42 bp, Artificial Sequence
  Description of Artificial Sequence: Synthetic oligonucleotide
ccttcagattgatcaatgctaatatgatggtcttaggacatg

SEQ ID NO: 148122 - DNA, 44 bp, Artificial Sequence
  Description of Artificial Sequence: Synthetic oligonucleotide
cttcagattgatcaatgctaatatgatggtcttaggacatgaac

SEQ ID NO: 148123 - DNA, 44 bp, Artificial Sequence
  Description of Artificial Sequence: Synthetic oligonucleotide
ttcagattgatcaatgctaatatgatggtcttaggacatgaacc

SEQ ID NO: 148124 - DNA, 43 bp, Artificial Sequence
  Description of Artificial Sequence: Synthetic oligonucleotide
tcagattgatcaatgctaatatgatggtcttaggacatgaacc

SEQ ID NO: 148125 - DNA, 42 bp, Artificial Sequence
  Description of Artificial Sequence: Synthetic oligonucleotide
cagattgatcaatgctaatatgatggtcttaggacatgaacc

SEQ ID NO: 148126 - DNA, 44 bp, Artificial Sequence
  Description of Artificial Sequence: Synthetic oligonucleotide
agattgatcaatgctaatatgatggtcttaggacatgaaccaag

SEQ ID NO: 148127 - DNA, 43 bp, Artificial Sequence
  Description of Artificial Sequence: Synthetic oligonucleotide
gattgatcaatgctaatatgatggtcttaggacatgaaccaag

SEQ ID NO: 148128 - DNA, 44 bp, Artificial Sequence
  Description of Artificial Sequence: Synthetic oligonucleotide
attgatcaatgctaatatgatggtcttaggacatgaaccaagac

SEQ ID NO: 148129 - DNA, 43 bp, Artificial Sequence
  Description of Artificial Sequence: Synthetic oligonucleotide
ttgatcaatgctaatatgatggtcttaggacatgaaccaagac

SEQ ID NO: 148130 - DNA, 42 bp, Artificial Sequence
  Description of Artificial Sequence: Synthetic oligonucleotide
tgatcaatgctaatatgatggtcttaggacatgaaccaagac

SEQ ID NO: 148131 - DNA, 41 bp, Artificial Sequence
  Description of Artificial Sequence: Synthetic oligonucleotide
gatcaatgctaatatgatggtcttaggacatgaaccaagac

SEQ ID NO: 148132 - DNA, 44 bp, Artificial Sequence
  Description of Artificial Sequence: Synthetic oligonucleotide
atcaatgctaatatgatggtcttaggacatgaaccaagacaaac

SEQ ID NO: 148133 - DNA, 43 bp, Artificial Sequence
  Description of Artificial Sequence: Synthetic oligonucleotide
tcaatgctaatatgatggtcttaggacatgaaccaagacaaac

SEQ ID NO: 148134 - DNA, 42 bp, Artificial Sequence
  Description of Artificial Sequence: Synthetic oligonucleotide
caatgctaatatgatggtcttaggacatgaaccaagacaaac

SEQ ID NO: 148135 - DNA, 44 bp, Artificial Sequence
  Description of Artificial Sequence: Synthetic oligonucleotide
aatgctaatatgatggtcttaggacatgaaccaagacaaacaac

SEQ ID NO: 148136 - DNA, 43 bp, Artificial Sequence
  Description of Artificial Sequence: Synthetic oligonucleotide
atgctaatatgatggtcttaggacatgaaccaagacaaacaac

SEQ ID NO: 148137 - DNA, 42 bp, Artificial Sequence
  Description of Artificial Sequence: Synthetic oligonucleotide
tgctaatatgatggtcttaggacatgaaccaagacaaacaac

SEQ ID NO: 148138 - DNA, 41 bp, Artificial Sequence
  Description of Artificial Sequence: Synthetic oligonucleotide
gctaatatgatggtcttaggacatgaaccaagacaaacaac

SEQ ID NO: 148139 - DNA, 43 bp, Artificial Sequence
  Description of Artificial Sequence: Synthetic oligonucleotide
ctaatatgatggtcttaggacatgaaccaagacaaacaacttc

SEQ ID NO: 148140 - DNA, 43 bp, Artificial Sequence
  Description of Artificial Sequence: Synthetic oligonucleotide
taatatgatggtcttaggacatgaaccaagacaaacaacttcg

SEQ ID NO: 148141 - DNA, 42 bp, Artificial Sequence
  Description of Artificial Sequence: Synthetic oligonucleotide
aatatgatggtcttaggacatgaaccaagacaaacaacttcg

SEQ ID NO: 148142 - DNA, 41 bp, Artificial Sequence
  Description of Artificial Sequence: Synthetic oligonucleotide
atatgatggtcttaggacatgaaccaagacaaacaacttcg

SEQ ID NO: 148143 - DNA, 40 bp, Artificial Sequence
  Description of Artificial Sequence: Synthetic oligonucleotide
tatgatggtcttaggacatgaaccaagacaaacaacttcg

SEQ ID NO: 148144 - DNA, 39 bp, Artificial Sequence
  Description of Artificial Sequence: Synthetic oligonucleotide
atgatggtcttaggacatgaaccaagacaaacaacttcg

SEQ ID NO: 148145 - DNA, 38 bp, Artificial Sequence
  Description of Artificial Sequence: Synthetic oligonucleotide
tgatggtcttaggacatgaaccaagacaaacaacttcg

SEQ ID NO: 148146 - DNA, 37 bp, Artificial Sequence
  Description of Artificial Sequence: Synthetic oligonucleotide
gatggtcttaggacatgaaccaagacaaacaacttcg

SEQ ID NO: 148147 - DNA, 40 bp, Artificial Sequence
  Description of Artificial Sequence: Synthetic oligonucleotide
atggtcttaggacatgaaccaagacaaacaacttcgaatc

SEQ ID NO: 148148 - DNA, 39 bp, Artificial Sequence
  Description of Artificial Sequence: Synthetic oligonucleotide
tggtcttaggacatgaaccaagacaaacaacttcgaatc

SEQ ID NO: 148149 - DNA, 38 bp, Artificial Sequence
  Description of Artificial Sequence: Synthetic oligonucleotide
ggtcttaggacatgaaccaagacaaacaacttcgaatc

SEQ ID NO: 148150 - DNA, 39 bp, Artificial Sequence
  Description of Artificial Sequence: Synthetic oligonucleotide
gtcttaggacatgaaccaagacaaacaacttcgaatctg

SEQ ID NO: 148151 - DNA, 39 bp, Artificial Sequence
  Description of Artificial Sequence: Synthetic oligonucleotide
tcttaggacatgaaccaagacaaacaacttcgaatctgg

SEQ ID NO: 148152 - DNA, 38 bp, Artificial Sequence
  Description of Artificial Sequence: Synthetic oligonucleotide
cttaggacatgaaccaagacaaacaacttcgaatctgg

SEQ ID NO: 148153 - DNA, 38 bp, Artificial Sequence
  Description of Artificial Sequence: Synthetic oligonucleotide
ttaggacatgaaccaagacaaacaacttcgaatctggg

SEQ ID NO: 148154 - DNA, 37 bp, Artificial Sequence
  Description of Artificial Sequence: Synthetic oligonucleotide
taggacatgaaccaagacaaacaacttcgaatctggg

SEQ ID NO: 148155 - DNA, 36 bp, Artificial Sequence
  Description of Artificial Sequence: Synthetic oligonucleotide
aggacatgaaccaagacaaacaacttcgaatctggg

SEQ ID NO: 148156 - DNA, 35 bp, Artificial Sequence
  Description of Artificial Sequence: Synthetic oligonucleotide
ggacatgaaccaagacaaacaacttcgaatctggg

SEQ ID NO: 148157 - DNA, 36 bp, Artificial Sequence
  Description of Artificial Sequence: Synthetic oligonucleotide
gacatgaaccaagacaaacaacttcgaatctgggtc

SEQ ID NO: 148158 - DNA, 37 bp, Artificial Sequence
  Description of Artificial Sequence: Synthetic oligonucleotide
acatgaaccaagacaaacaacttcgaatctgggtcac

SEQ ID NO: 148159 - DNA, 36 bp, Artificial Sequence
  Description of Artificial Sequence: Synthetic oligonucleotide
catgaaccaagacaaacaacttcgaatctgggtcac

SEQ ID NO: 148160 - DNA, 41 bp, Artificial Sequence
  Description of Artificial Sequence: Synthetic oligonucleotide
atgaaccaagacaaacaacttcgaatctgggtcacttaaac

SEQ ID NO: 148161 - DNA, 40 bp, Artificial Sequence
  Description of Artificial Sequence: Synthetic oligonucleotide
tgaaccaagacaaacaacttcgaatctgggtcacttaaac

SEQ ID NO: 148162 - DNA, 39 bp, Artificial Sequence
  Description of Artificial Sequence: Synthetic oligonucleotide
gaaccaagacaaacaacttcgaatctgggtcacttaaac

SEQ ID NO: 148163 - DNA, 41 bp, Artificial Sequence
  Description of Artificial Sequence: Synthetic oligonucleotide
aaccaagacaaacaacttcgaatctgggtcacttaaacaag

SEQ ID NO: 148164 - DNA, 40 bp, Artificial Sequence
  Description of Artificial Sequence: Synthetic oligonucleotide
accaagacaaacaacttcgaatctgggtcacttaaacaag

SEQ ID NO: 148165 - DNA, 39 bp, Artificial Sequence
  Description of Artificial Sequence: Synthetic oligonucleotide
ccaagacaaacaacttcgaatctgggtcacttaaacaag

SEQ ID NO: 148166 - DNA, 39 bp, Artificial Sequence
  Description of Artificial Sequence: Synthetic oligonucleotide
caagacaaacaacttcgaatctgggtcacttaaacaagc

SEQ ID NO: 148167 - DNA, 39 bp, Artificial Sequence
  Description of Artificial Sequence: Synthetic oligonucleotide
aagacaaacaacttcgaatctgggtcacttaaacaagcc

SEQ ID NO: 148168 - DNA, 38 bp, Artificial Sequence
  Description of Artificial Sequence: Synthetic oligonucleotide
agacaaacaacttcgaatctgggtcacttaaacaagcc

SEQ ID NO: 148169 - DNA, 37 bp, Artificial Sequence
  Description of Artificial Sequence: Synthetic oligonucleotide
gacaaacaacttcgaatctgggtcacttaaacaagcc

SEQ ID NO: 148170 - DNA, 39 bp, Artificial Sequence
  Description of Artificial Sequence: Synthetic oligonucleotide
acaaacaacttcgaatctgggtcacttaaacaagccatc

SEQ ID NO: 148171 - DNA, 38 bp, Artificial Sequence
  Description of Artificial Sequence: Synthetic oligonucleotide
caaacaacttcgaatctgggtcacttaaacaagccatc

SEQ ID NO: 148172 - DNA, 41 bp, Artificial Sequence
  Description of Artificial Sequence: Synthetic oligonucleotide
aaacaacttcgaatctgggtcacttaaacaagccatctatc

SEQ ID NO: 148173 - DNA, 40 bp, Artificial Sequence
  Description of Artificial Sequence: Synthetic oligonucleotide
aacaacttcgaatctgggtcacttaaacaagccatctatc

SEQ ID NO: 148174 - DNA, 39 bp, Artificial Sequence
  Description of Artificial Sequence: Synthetic oligonucleotide
acaacttcgaatctgggtcacttaaacaagccatctatc

SEQ ID NO: 148175 - DNA, 38 bp, Artificial Sequence
  Description of Artificial Sequence: Synthetic oligonucleotide
caacttcgaatctgggtcacttaaacaagccatctatc

SEQ ID NO: 148176 - DNA, 38 bp, Artificial Sequence
  Description of Artificial Sequence: Synthetic oligonucleotide
aacttcgaatctgggtcacttaaacaagccatctatcc

SEQ ID NO: 148177 - DNA, 37 bp, Artificial Sequence
  Description of Artificial Sequence: Synthetic oligonucleotide
acttcgaatctgggtcacttaaacaagccatctatcc

SEQ ID NO: 148178 - DNA, 36 bp, Artificial Sequence
  Description of Artificial Sequence: Synthetic oligonucleotide
cttcgaatctgggtcacttaaacaagccatctatcc

SEQ ID NO: 148179 - DNA, 37 bp, Artificial Sequence
  Description of Artificial Sequence: Synthetic oligonucleotide
ttcgaatctgggtcacttaaacaagccatctatccag

SEQ ID NO: 148180 - DNA, 36 bp, Artificial Sequence
  Description of Artificial Sequence: Synthetic oligonucleotide
tcgaatctgggtcacttaaacaagccatctatccag

SEQ ID NO: 148181 - DNA, 35 bp, Artificial Sequence
  Description of Artificial Sequence: Synthetic oligonucleotide
cgaatctgggtcacttaaacaagccatctatccag

SEQ ID NO: 148182 - DNA, 35 bp, Artificial Sequence
  Description of Artificial Sequence: Synthetic oligonucleotide
gaatctgggtcacttaaacaagccatctatccagg

SEQ ID NO: 148183 - DNA, 35 bp, Artificial Sequence
  Description of Artificial Sequence: Synthetic oligonucleotide
aatctgggtcacttaaacaagccatctatccaggc

SEQ ID NO: 148184 - DNA, 34 bp, Artificial Sequence
  Description of Artificial Sequence: Synthetic oligonucleotide
atctgggtcacttaaacaagccatctatccaggc

SEQ ID NO: 148185 - DNA, 33 bp, Artificial Sequence
  Description of Artificial Sequence: Synthetic oligonucleotide
tctgggtcacttaaacaagccatctatccaggc

SEQ ID NO: 148186 - DNA, 32 bp, Artificial Sequence
  Description of Artificial Sequence: Synthetic oligonucleotide
ctgggtcacttaaacaagccatctatccaggc

SEQ ID NO: 148187 - DNA, 39 bp, Artificial Sequence
  Description of Artificial Sequence: Synthetic oligonucleotide
tgggtcacttaaacaagccatctatccaggcattaattc

SEQ ID NO: 148188 - DNA, 38 bp, Artificial Sequence
  Description of Artificial Sequence: Synthetic oligonucleotide
gggtcacttaaacaagccatctatccaggcattaattc

SEQ ID NO: 148189 - DNA, 40 bp, Artificial Sequence
  Description of Artificial Sequence: Synthetic oligonucleotide
ggtcacttaaacaagccatctatccaggcattaattcatg

SEQ ID NO: 148190 - DNA, 40 bp, Artificial Sequence
  Description of Artificial Sequence: Synthetic oligonucleotide
gtcacttaaacaagccatctatccaggcattaattcatgg

SEQ ID NO: 148191 - DNA, 41 bp, Artificial Sequence
  Description of Artificial Sequence: Synthetic oligonucleotide
tcacttaaacaagccatctatccaggcattaattcatggac

SEQ ID NO: 148192 - DNA, 40 bp, Artificial Sequence
  Description of Artificial Sequence: Synthetic oligonucleotide
cacttaaacaagccatctatccaggcattaattcatggac

SEQ ID NO: 148193 - DNA, 44 bp, Artificial Sequence
  Description of Artificial Sequence: Synthetic oligonucleotide
acttaaacaagccatctatccaggcattaattcatggactaaac

SEQ ID NO: 148194 - DNA, 43 bp, Artificial Sequence
  Description of Artificial Sequence: Synthetic oligonucleotide
cttaaacaagccatctatccaggcattaattcatggactaaac

SEQ ID NO: 148195 - DNA, 44 bp, Artificial Sequence
  Description of Artificial Sequence: Synthetic oligonucleotide
ttaaacaagccatctatccaggcattaattcatggactaaacag

SEQ ID NO: 148196 - DNA, 43 bp, Artificial Sequence
  Description of Artificial Sequence: Synthetic oligonucleotide
taaacaagccatctatccaggcattaattcatggactaaacag

SEQ ID NO: 148197 - DNA, 42 bp, Artificial Sequence
  Description of Artificial Sequence: Synthetic oligonucleotide
aaacaagccatctatccaggcattaattcatggactaaacag

SEQ ID NO: 148198 - DNA, 41 bp, Artificial Sequence
  Description of Artificial Sequence: Synthetic oligonucleotide
aacaagccatctatccaggcattaattcatggactaaacag

SEQ ID NO: 148199 - DNA, 40 bp, Artificial Sequence
  Description of Artificial Sequence: Synthetic oligonucleotide
acaagccatctatccaggcattaattcatggactaaacag

SEQ ID NO: 148200 - DNA, 39 bp, Artificial Sequence
  Description of Artificial Sequence: Synthetic oligonucleotide
caagccatctatccaggcattaattcatggactaaacag

SEQ ID NO: 148201 - DNA, 40 bp, Artificial Sequence
  Description of Artificial Sequence: Synthetic oligonucleotide
aagccatctatccaggcattaattcatggactaaacagac

SEQ ID NO: 148202 - DNA, 39 bp, Artificial Sequence
  Description of Artificial Sequence: Synthetic oligonucleotide
agccatctatccaggcattaattcatggactaaacagac

SEQ ID NO: 148203 - DNA, 38 bp, Artificial Sequence
  Description of Artificial Sequence: Synthetic oligonucleotide
gccatctatccaggcattaattcatggactaaacagac

SEQ ID NO: 148204 - DNA, 45 bp, Artificial Sequence
  Description of Artificial Sequence: Synthetic oligonucleotide
ccatctatccaggcattaattcatggactaaacagacattattac

SEQ ID NO: 148205 - DNA, 46 bp, Artificial Sequence
  Description of Artificial Sequence: Synthetic oligonucleotide
catctatccaggcattaattcatggactaaacagacattattactc

SEQ ID NO: 148206 - DNA, 46 bp, Artificial Sequence
  Description of Artificial Sequence: Synthetic oligonucleotide
atctatccaggcattaattcatggactaaacagacattattactcc

SEQ ID NO: 148207 - DNA, 45 bp, Artificial Sequence
  Description of Artificial Sequence: Synthetic oligonucleotide
tctatccaggcattaattcatggactaaacagacattattactcc

SEQ ID NO: 148208 - DNA, 44 bp, Artificial Sequence
  Description of Artificial Sequence: Synthetic oligonucleotide
ctatccaggcattaattcatggactaaacagacattattactcc

SEQ ID NO: 148209 - DNA, 48 bp, Artificial Sequence
  Description of Artificial Sequence: Synthetic oligonucleotide
tatccaggcattaattcatggactaaacagacattattactccattac

SEQ ID NO: 148210 - DNA, 47 bp, Artificial Sequence
  Description of Artificial Sequence: Synthetic oligonucleotide
atccaggcattaattcatggactaaacagacattattactccattac

SEQ ID NO: 148211 - DNA, 46 bp, Artificial Sequence
  Description of Artificial Sequence: Synthetic oligonucleotide
tccaggcattaattcatggactaaacagacattattactccattac

SEQ ID NO: 148212 - DNA, 45 bp, Artificial Sequence
  Description of Artificial Sequence: Synthetic oligonucleotide
ccaggcattaattcatggactaaacagacattattactccattac

SEQ ID NO: 148213 - DNA, 51 bp, Artificial Sequence
  Description of Artificial Sequence: Synthetic oligonucleotide
caggcattaattcatggactaaacagacattattactccattactattaac

SEQ ID NO: 148214 - DNA, 54 bp, Artificial Sequence
  Description of Artificial Sequence: Synthetic oligonucleotide
aggcattaattcatggactaaacagacattattactccattactattaactatc

SEQ ID NO: 148215 - DNA, 53 bp, Artificial Sequence
  Description of Artificial Sequence: Synthetic oligonucleotide
ggcattaattcatggactaaacagacattattactccattactattaactatc

SEQ ID NO: 148216 - DNA, 53 bp, Artificial Sequence
  Description of Artificial Sequence: Synthetic oligonucleotide
gcattaattcatggactaaacagacattattactccattactattaactatcg

SEQ ID NO: 148217 - DNA, 53 bp, Artificial Sequence
  Description of Artificial Sequence: Synthetic oligonucleotide
cattaattcatggactaaacagacattattactccattactattaactatcgg

SEQ ID NO: 148218 - DNA, 59 bp, Artificial Sequence
  Description of Artificial Sequence: Synthetic oligonucleotide
attaattcatggactaaacagacattattactccattactattaactatcggaaaaatg

SEQ ID NO: 148219 - DNA, 58 bp, Artificial Sequence
  Description of Artificial Sequence: Synthetic oligonucleotide
ttaattcatggactaaacagacattattactccattactattaactatcggaaaaatg

SEQ ID NO: 148220 - DNA, 57 bp, Artificial Sequence
  Description of Artificial Sequence: Synthetic oligonucleotide
taattcatggactaaacagacattattactccattactattaactatcggaaaaatg

SEQ ID NO: 148221 - DNA, 56 bp, Artificial Sequence
  Description of Artificial Sequence: Synthetic oligonucleotide
aattcatggactaaacagacattattactccattactattaactatcggaaaaatg

SEQ ID NO: 148222 - DNA, 55 bp, Artificial Sequence
  Description of Artificial Sequence: Synthetic oligonucleotide
attcatggactaaacagacattattactccattactattaactatcggaaaaatg

SEQ ID NO: 148223 - DNA, 54 bp, Artificial Sequence
  Description of Artificial Sequence: Synthetic oligonucleotide
ttcatggactaaacagacattattactccattactattaactatcggaaaaatg

SEQ ID NO: 148224 - DNA, 53 bp, Artificial Sequence
  Description of Artificial Sequence: Synthetic oligonucleotide
tcatggactaaacagacattattactccattactattaactatcggaaaaatg

SEQ ID NO: 148225 - DNA, 52 bp, Artificial Sequence
  Description of Artificial Sequence: Synthetic oligonucleotide
catggactaaacagacattattactccattactattaactatcggaaaaatg

SEQ ID NO: 148226 - DNA, 54 bp, Artificial Sequence
  Description of Artificial Sequence: Synthetic oligonucleotide
atggactaaacagacattattactccattactattaactatcggaaaaatgaac

SEQ ID NO: 148227 - DNA, 53 bp, Artificial Sequence
  Description of Artificial Sequence: Synthetic oligonucleotide
tggactaaacagacattattactccattactattaactatcggaaaaatgaac

SEQ ID NO: 148228 - DNA, 52 bp, Artificial Sequence
  Description of Artificial Sequence: Synthetic oligonucleotide
ggactaaacagacattattactccattactattaactatcggaaaaatgaac

SEQ ID NO: 148229 - DNA, 53 bp, Artificial Sequence
  Description of Artificial Sequence: Synthetic oligonucleotide
gactaaacagacattattactccattactattaactatcggaaaaatgaactg

SEQ ID NO: 148230 - DNA, 53 bp, Artificial Sequence
  Description of Artificial Sequence: Synthetic oligonucleotide
actaaacagacattattactccattactattaactatcggaaaaatgaactgg

SEQ ID NO: 148231 - DNA, 52 bp, Artificial Sequence
  Description of Artificial Sequence: Synthetic oligonucleotide
ctaaacagacattattactccattactattaactatcggaaaaatgaactgg

SEQ ID NO: 148232 - DNA, 54 bp, Artificial Sequence
  Description of Artificial Sequence: Synthetic oligonucleotide
taaacagacattattactccattactattaactatcggaaaaatgaactggaac

SEQ ID NO: 148233 - DNA, 53 bp, Artificial Sequence
  Description of Artificial Sequence: Synthetic oligonucleotide
aaacagacattattactccattactattaactatcggaaaaatgaactggaac

SEQ ID NO: 148234 - DNA, 52 bp, Artificial Sequence
  Description of Artificial Sequence: Synthetic oligonucleotide
aacagacattattactccattactattaactatcggaaaaatgaactggaac

SEQ ID NO: 148235 - DNA, 51 bp, Artificial Sequence
  Description of Artificial Sequence: Synthetic oligonucleotide
acagacattattactccattactattaactatcggaaaaatgaactggaac

SEQ ID NO: 148236 - DNA, 50 bp, Artificial Sequence
  Description of Artificial Sequence: Synthetic oligonucleotide
cagacattattactccattactattaactatcggaaaaatgaactggaac

SEQ ID NO: 148237 - DNA, 51 bp, Artificial Sequence
  Description of Artificial Sequence: Synthetic oligonucleotide
agacattattactccattactattaactatcggaaaaatgaactggaacag

SEQ ID NO: 148238 - DNA, 50 bp, Artificial Sequence
  Description of Artificial Sequence: Synthetic oligonucleotide
gacattattactccattactattaactatcggaaaaatgaactggaacag

SEQ ID NO: 148239 - DNA, 52 bp, Artificial Sequence
  Description of Artificial Sequence: Synthetic oligonucleotide
acattattactccattactattaactatcggaaaaatgaactggaacagaag

SEQ ID NO: 148240 - DNA, 51 bp, Artificial Sequence
  Description of Artificial Sequence: Synthetic oligonucleotide
cattattactccattactattaactatcggaaaaatgaactggaacagaag

SEQ ID NO: 148241 - DNA, 53 bp, Artificial Sequence
  Description of Artificial Sequence: Synthetic oligonucleotide
attattactccattactattaactatcggaaaaatgaactggaacagaagatg

SEQ ID NO: 148242 - DNA, 52 bp, Artificial Sequence
  Description of Artificial Sequence: Synthetic oligonucleotide
ttattactccattactattaactatcggaaaaatgaactggaacagaagatg

SEQ ID NO: 148243 - DNA, 51 bp, Artificial Sequence
  Description of Artificial Sequence: Synthetic oligonucleotide
tattactccattactattaactatcggaaaaatgaactggaacagaagatg

SEQ ID NO: 148244 - DNA, 50 bp, Artificial Sequence
  Description of Artificial Sequence: Synthetic oligonucleotide
attactccattactattaactatcggaaaaatgaactggaacagaagatg

SEQ ID NO: 148245 - DNA, 49 bp, Artificial Sequence
  Description of Artificial Sequence: Synthetic oligonucleotide
ttactccattactattaactatcggaaaaatgaactggaacagaagatg

SEQ ID NO: 148246 - DNA, 48 bp, Artificial Sequence
  Description of Artificial Sequence: Synthetic oligonucleotide
tactccattactattaactatcggaaaaatgaactggaacagaagatg

SEQ ID NO: 148247 - DNA, 47 bp, Artificial Sequence
  Description of Artificial Sequence: Synthetic oligonucleotide
actccattactattaactatcggaaaaatgaactggaacagaagatg

SEQ ID NO: 148248 - DNA, 46 bp, Artificial Sequence
  Description of Artificial Sequence: Synthetic oligonucleotide
ctccattactattaactatcggaaaaatgaactggaacagaagatg

SEQ ID NO: 148249 - DNA, 48 bp, Artificial Sequence
  Description of Artificial Sequence: Synthetic oligonucleotide
tccattactattaactatcggaaaaatgaactggaacagaagatgttg

SEQ ID NO: 148250 - DNA, 47 bp, Artificial Sequence
  Description of Artificial Sequence: Synthetic oligonucleotide
ccattactattaactatcggaaaaatgaactggaacagaagatgttg

SEQ ID NO: 148251 - DNA, 47 bp, Artificial Sequence
  Description of Artificial Sequence: Synthetic oligonucleotide
cattactattaactatcggaaaaatgaactggaacagaagatgttgc

SEQ ID NO: 148252 - DNA, 54 bp, Artificial Sequence
  Description of Artificial Sequence: Synthetic oligonucleotide
attactattaactatcggaaaaatgaactggaacagaagatgttgctaaatttg

SEQ ID NO: 148253 - DNA, 53 bp, Artificial Sequence
  Description of Artificial Sequence: Synthetic oligonucleotide
ttactattaactatcggaaaaatgaactggaacagaagatgttgctaaatttg

SEQ ID NO: 148254 - DNA, 52 bp, Artificial Sequence
  Description of Artificial Sequence: Synthetic oligonucleotide
tactattaactatcggaaaaatgaactggaacagaagatgttgctaaatttg

SEQ ID NO: 148255 - DNA, 51 bp, Artificial Sequence
  Description of Artificial Sequence: Synthetic oligonucleotide
actattaactatcggaaaaatgaactggaacagaagatgttgctaaatttg

SEQ ID NO: 148256 - DNA, 50 bp, Artificial Sequence
  Description of Artificial Sequence: Synthetic oligonucleotide
ctattaactatcggaaaaatgaactggaacagaagatgttgctaaatttg

SEQ ID NO: 148257 - DNA, 50 bp, Artificial Sequence
  Description of Artificial Sequence: Synthetic oligonucleotide
tattaactatcggaaaaatgaactggaacagaagatgttgctaaatttgc

SEQ ID NO: 148258 - DNA, 49 bp, Artificial Sequence
  Description of Artificial Sequence: Synthetic oligonucleotide
attaactatcggaaaaatgaactggaacagaagatgttgctaaatttgc

SEQ ID NO: 148259 - DNA, 48 bp, Artificial Sequence
  Description of Artificial Sequence: Synthetic oligonucleotide
ttaactatcggaaaaatgaactggaacagaagatgttgctaaatttgc

SEQ ID NO: 148260 - DNA, 47 bp, Artificial Sequence
  Description of Artificial Sequence: Synthetic oligonucleotide
taactatcggaaaaatgaactggaacagaagatgttgctaaatttgc

SEQ ID NO: 148261 - DNA, 46 bp, Artificial Sequence
  Description of Artificial Sequence: Synthetic oligonucleotide
aactatcggaaaaatgaactggaacagaagatgttgctaaatttgc

SEQ ID NO: 148262 - DNA, 45 bp, Artificial Sequence
  Description of Artificial Sequence: Synthetic oligonucleotide
actatcggaaaaatgaactggaacagaagatgttgctaaatttgc

SEQ ID NO: 148263 - DNA, 44 bp, Artificial Sequence
  Description of Artificial Sequence: Synthetic oligonucleotide
ctatcggaaaaatgaactggaacagaagatgttgctaaatttgc

SEQ ID NO: 148264 - DNA, 48 bp, Artificial Sequence
  Description of Artificial Sequence: Synthetic oligonucleotide
tatcggaaaaatgaactggaacagaagatgttgctaaatttgcataag

SEQ ID NO: 148265 - DNA, 47 bp, Artificial Sequence
  Description of Artificial Sequence: Synthetic oligonucleotide
atcggaaaaatgaactggaacagaagatgttgctaaatttgcataag

SEQ ID NO: 148266 - DNA, 46 bp, Artificial Sequence
  Description of Artificial Sequence: Synthetic oligonucleotide
tcggaaaaatgaactggaacagaagatgttgctaaatttgcataag

SEQ ID NO: 148267 - DNA, 45 bp, Artificial Sequence
  Description of Artificial Sequence: Synthetic oligonucleotide
cggaaaaatgaactggaacagaagatgttgctaaatttgcataag

SEQ ID NO: 148268 - DNA, 47 bp, Artificial Sequence
  Description of Artificial Sequence: Synthetic oligonucleotide
ggaaaaatgaactggaacagaagatgttgctaaatttgcataagaag

SEQ ID NO: 148269 - DNA, 48 bp, Artificial Sequence
  Description of Artificial Sequence: Synthetic oligonucleotide
gaaaaatgaactggaacagaagatgttgctaaatttgcataagaagag

SEQ ID NO: 148270 - DNA, 50 bp, Artificial Sequence
  Description of Artificial Sequence: Synthetic oligonucleotide
aaaaatgaactggaacagaagatgttgctaaatttgcataagaagagttg

SEQ ID NO: 148271 - DNA, 49 bp, Artificial Sequence
  Description of Artificial Sequence: Synthetic oligonucleotide
aaaatgaactggaacagaagatgttgctaaatttgcataagaagagttg

SEQ ID NO: 148272 - DNA, 48 bp, Artificial Sequence
  Description of Artificial Sequence: Synthetic oligonucleotide
aaatgaactggaacagaagatgttgctaaatttgcataagaagagttg

SEQ ID NO: 148273 - DNA, 47 bp, Artificial Sequence
  Description of Artificial Sequence: Synthetic oligonucleotide
aatgaactggaacagaagatgttgctaaatttgcataagaagagttg

SEQ ID NO: 148274 - DNA, 46 bp, Artificial Sequence
  Description of Artificial Sequence: Synthetic oligonucleotide
atgaactggaacagaagatgttgctaaatttgcataagaagagttg

SEQ ID NO: 148275 - DNA, 45 bp, Artificial Sequence
  Description of Artificial Sequence: Synthetic oligonucleotide
tgaactggaacagaagatgttgctaaatttgcataagaagagttg

SEQ ID NO: 148276 - DNA, 44 bp, Artificial Sequence
  Description of Artificial Sequence: Synthetic oligonucleotide
gaactggaacagaagatgttgctaaatttgcataagaagagttg

SEQ ID NO: 148277 - DNA, 44 bp, Artificial Sequence
  Description of Artificial Sequence: Synthetic oligonucleotide
aactggaacagaagatgttgctaaatttgcataagaagagttgg

SEQ ID NO: 148278 - DNA, 43 bp, Artificial Sequence
  Description of Artificial Sequence: Synthetic oligonucleotide
actggaacagaagatgttgctaaatttgcataagaagagttgg

SEQ ID NO: 148279 - DNA, 42 bp, Artificial Sequence
  Description of Artificial Sequence: Synthetic oligonucleotide
ctggaacagaagatgttgctaaatttgcataagaagagttgg

SEQ ID NO: 148280 - DNA, 44 bp, Artificial Sequence
  Description of Artificial Sequence: Synthetic oligonucleotide
tggaacagaagatgttgctaaatttgcataagaagagttggatg

SEQ ID NO: 148281 - DNA, 43 bp, Artificial Sequence
  Description of Artificial Sequence: Synthetic oligonucleotide
ggaacagaagatgttgctaaatttgcataagaagagttggatg

SEQ ID NO: 148282 - DNA, 43 bp, Artificial Sequence
  Description of Artificial Sequence: Synthetic oligonucleotide
gaacagaagatgttgctaaatttgcataagaagagttggatgg

SEQ ID NO: 148283 - DNA, 45 bp, Artificial Sequence
  Description of Artificial Sequence: Synthetic oligonucleotide
aacagaagatgttgctaaatttgcataagaagagttggatggaag

SEQ ID NO: 148284 - DNA, 44 bp, Artificial Sequence
  Description of Artificial Sequence: Synthetic oligonucleotide
acagaagatgttgctaaatttgcataagaagagttggatggaag

SEQ ID NO: 148285 - DNA, 43 bp, Artificial Sequence
  Description of Artificial Sequence: Synthetic oligonucleotide
cagaagatgttgctaaatttgcataagaagagttggatggaag

SEQ ID NO: 148286 - DNA, 43 bp, Artificial Sequence
  Description of Artificial Sequence: Synthetic oligonucleotide
agaagatgttgctaaatttgcataagaagagttggatggaagg

SEQ ID NO: 148287 - DNA, 42 bp, Artificial Sequence
  Description of Artificial Sequence: Synthetic oligonucleotide
gaagatgttgctaaatttgcataagaagagttggatggaagg

SEQ ID NO: 148288 - DNA, 45 bp, Artificial Sequence
  Description of Artificial Sequence: Synthetic oligonucleotide
aagatgttgctaaatttgcataagaagagttggatggaaggtttg

SEQ ID NO: 148289 - DNA, 44 bp, Artificial Sequence
  Description of Artificial Sequence: Synthetic oligonucleotide
agatgttgctaaatttgcataagaagagttggatggaaggtttg

SEQ ID NO: 148290 - DNA, 43 bp, Artificial Sequence
  Description of Artificial Sequence: Synthetic oligonucleotide
gatgttgctaaatttgcataagaagagttggatggaaggtttg

SEQ ID NO: 148291 - DNA, 44 bp, Artificial Sequence
  Description of Artificial Sequence: Synthetic oligonucleotide
atgttgctaaatttgcataagaagagttggatggaaggtttgac

SEQ ID NO: 148292 - DNA, 43 bp, Artificial Sequence
  Description of Artificial Sequence: Synthetic oligonucleotide
tgttgctaaatttgcataagaagagttggatggaaggtttgac

SEQ ID NO: 148293 - DNA, 42 bp, Artificial Sequence
  Description of Artificial Sequence: Synthetic oligonucleotide
gttgctaaatttgcataagaagagttggatggaaggtttgac

SEQ ID NO: 148294 - DNA, 43 bp, Artificial Sequence
  Description of Artificial Sequence: Synthetic oligonucleotide
ttgctaaatttgcataagaagagttggatggaaggtttgacac

SEQ ID NO: 148295 - DNA, 42 bp, Artificial Sequence
  Description of Artificial Sequence: Synthetic oligonucleotide
tgctaaatttgcataagaagagttggatggaaggtttgacac

SEQ ID NO: 148296 - DNA, 41 bp, Artificial Sequence
  Description of Artificial Sequence: Synthetic oligonucleotide
gctaaatttgcataagaagagttggatggaaggtttgacac

SEQ ID NO: 148297 - DNA, 43 bp, Artificial Sequence
  Description of Artificial Sequence: Synthetic oligonucleotide
ctaaatttgcataagaagagttggatggaaggtttgacacttc

SEQ ID NO: 148298 - DNA, 44 bp, Artificial Sequence
  Description of Artificial Sequence: Synthetic oligonucleotide
taaatttgcataagaagagttggatggaaggtttgacacttcag

SEQ ID NO: 148299 - DNA, 43 bp, Artificial Sequence
  Description of Artificial Sequence: Synthetic oligonucleotide
aaatttgcataagaagagttggatggaaggtttgacacttcag

SEQ ID NO: 148300 - DNA, 42 bp, Artificial Sequence
  Description of Artificial Sequence: Synthetic oligonucleotide
aatttgcataagaagagttggatggaaggtttgacacttcag

SEQ ID NO: 148301 - DNA, 41 bp, Artificial Sequence
  Description of Artificial Sequence: Synthetic oligonucleotide
atttgcataagaagagttggatggaaggtttgacacttcag

SEQ ID NO: 148302 - DNA, 40 bp, Artificial Sequence
  Description of Artificial Sequence: Synthetic oligonucleotide
tttgcataagaagagttggatggaaggtttgacacttcag

SEQ ID NO: 148303 - DNA, 39 bp, Artificial Sequence
  Description of Artificial Sequence: Synthetic oligonucleotide
ttgcataagaagagttggatggaaggtttgacacttcag

SEQ ID NO: 148304 - DNA, 38 bp, Artificial Sequence
  Description of Artificial Sequence: Synthetic oligonucleotide
tgcataagaagagttggatggaaggtttgacacttcag

SEQ ID NO: 148305 - DNA, 37 bp, Artificial Sequence
  Description of Artificial Sequence: Synthetic oligonucleotide
gcataagaagagttggatggaaggtttgacacttcag

SEQ ID NO: 148306 - DNA, 37 bp, Artificial Sequence
  Description of Artificial Sequence: Synthetic oligonucleotide
cataagaagagttggatggaaggtttgacacttcagg

SEQ ID NO: 148307 - DNA, 38 bp, Artificial Sequence
  Description of Artificial Sequence: Synthetic oligonucleotide
ataagaagagttggatggaaggtttgacacttcaggac

SEQ ID NO: 148308 - DNA, 37 bp, Artificial Sequence
  Description of Artificial Sequence: Synthetic oligonucleotide
taagaagagttggatggaaggtttgacacttcaggac

SEQ ID NO: 148309 - DNA, 36 bp, Artificial Sequence
  Description of Artificial Sequence: Synthetic oligonucleotide
aagaagagttggatggaaggtttgacacttcaggac

SEQ ID NO: 148310 - DNA, 35 bp, Artificial Sequence
  Description of Artificial Sequence: Synthetic oligonucleotide
agaagagttggatggaaggtttgacacttcaggac

SEQ ID NO: 148311 - DNA, 34 bp, Artificial Sequence
  Description of Artificial Sequence: Synthetic oligonucleotide
gaagagttggatggaaggtttgacacttcaggac

SEQ ID NO: 148312 - DNA, 36 bp, Artificial Sequence
  Description of Artificial Sequence: Synthetic oligonucleotide
aagagttggatggaaggtttgacacttcaggactac

SEQ ID NO: 148313 - DNA, 35 bp, Artificial Sequence
  Description of Artificial Sequence: Synthetic oligonucleotide
agagttggatggaaggtttgacacttcaggactac

SEQ ID NO: 148314 - DNA, 34 bp, Artificial Sequence
  Description of Artificial Sequence: Synthetic oligonucleotide
gagttggatggaaggtttgacacttcaggactac

SEQ ID NO: 148315 - DNA, 35 bp, Artificial Sequence
  Description of Artificial Sequence: Synthetic oligonucleotide
agttggatggaaggtttgacacttcaggactacag

SEQ ID NO: 148316 - DNA, 34 bp, Artificial Sequence
  Description of Artificial Sequence: Synthetic oligonucleotide
gttggatggaaggtttgacacttcaggactacag

SEQ ID NO: 148317 - DNA, 35 bp, Artificial Sequence
  Description of Artificial Sequence: Synthetic oligonucleotide
ttggatggaaggtttgacacttcaggactacagtg

SEQ ID NO: 148318 - DNA, 34 bp, Artificial Sequence
  Description of Artificial Sequence: Synthetic oligonucleotide
tggatggaaggtttgacacttcaggactacagtg

SEQ ID NO: 148319 - DNA, 33 bp, Artificial Sequence
  Description of Artificial Sequence: Synthetic oligonucleotide
ggatggaaggtttgacacttcaggactacagtg

SEQ ID NO: 148320 - DNA, 35 bp, Artificial Sequence
  Description of Artificial Sequence: Synthetic oligonucleotide
gatggaaggtttgacacttcaggactacagtgaac

SEQ ID NO: 148321 - DNA, 38 bp, Artificial Sequence
  Description of Artificial Sequence: Synthetic oligonucleotide
atggaaggtttgacacttcaggactacagtgaacattg

SEQ ID NO: 148322 - DNA, 37 bp, Artificial Sequence
  Description of Artificial Sequence: Synthetic oligonucleotide
tggaaggtttgacacttcaggactacagtgaacattg

SEQ ID NO: 148323 - DNA, 36 bp, Artificial Sequence
  Description of Artificial Sequence: Synthetic oligonucleotide
ggaaggtttgacacttcaggactacagtgaacattg

SEQ ID NO: 148324 - DNA, 40 bp, Artificial Sequence
  Description of Artificial Sequence: Synthetic oligonucleotide
gaaggtttgacacttcaggactacagtgaacattgtaaac

SEQ ID NO: 148325 - DNA, 41 bp, Artificial Sequence
  Description of Artificial Sequence: Synthetic oligonucleotide
aaggtttgacacttcaggactacagtgaacattgtaaacac

SEQ ID NO: 148326 - DNA, 40 bp, Artificial Sequence
  Description of Artificial Sequence: Synthetic oligonucleotide
aggtttgacacttcaggactacagtgaacattgtaaacac

SEQ ID NO: 148327 - DNA, 39 bp, Artificial Sequence
  Description of Artificial Sequence: Synthetic oligonucleotide
ggtttgacacttcaggactacagtgaacattgtaaacac

SEQ ID NO: 148328 - DNA, 42 bp, Artificial Sequence
  Description of Artificial Sequence: Synthetic oligonucleotide
gtttgacacttcaggactacagtgaacattgtaaacacaatg

SEQ ID NO: 148329 - DNA, 45 bp, Artificial Sequence
  Description of Artificial Sequence: Synthetic oligonucleotide
tttgacacttcaggactacagtgaacattgtaaacacaatgaatc

SEQ ID NO: 148330 - DNA, 44 bp, Artificial Sequence
  Description of Artificial Sequence: Synthetic oligonucleotide
ttgacacttcaggactacagtgaacattgtaaacacaatgaatc

SEQ ID NO: 148331 - DNA, 43 bp, Artificial Sequence
  Description of Artificial Sequence: Synthetic oligonucleotide
tgacacttcaggactacagtgaacattgtaaacacaatgaatc

SEQ ID NO: 148332 - DNA, 42 bp, Artificial Sequence
  Description of Artificial Sequence: Synthetic oligonucleotide
gacacttcaggactacagtgaacattgtaaacacaatgaatc

SEQ ID NO: 148333 - DNA, 43 bp, Artificial Sequence
  Description of Artificial Sequence: Synthetic oligonucleotide
acacttcaggactacagtgaacattgtaaacacaatgaatcag

SEQ ID NO: 148334 - DNA, 42 bp, Artificial Sequence
  Description of Artificial Sequence: Synthetic oligonucleotide
cacttcaggactacagtgaacattgtaaacacaatgaatcag

SEQ ID NO: 148335 - DNA, 43 bp, Artificial Sequence
  Description of Artificial Sequence: Synthetic oligonucleotide
acttcaggactacagtgaacattgtaaacacaatgaatcagtg

SEQ ID NO: 148336 - DNA, 42 bp, Artificial Sequence
  Description of Artificial Sequence: Synthetic oligonucleotide
cttcaggactacagtgaacattgtaaacacaatgaatcagtg

SEQ ID NO: 148337 - DNA, 42 bp, Artificial Sequence
  Description of Artificial Sequence: Synthetic oligonucleotide
ttcaggactacagtgaacattgtaaacacaatgaatcagtgg

SEQ ID NO: 148338 - DNA, 41 bp, Artificial Sequence
  Description of Artificial Sequence: Synthetic oligonucleotide
tcaggactacagtgaacattgtaaacacaatgaatcagtgg

SEQ ID NO: 148339 - DNA, 40 bp, Artificial Sequence
  Description of Artificial Sequence: Synthetic oligonucleotide
caggactacagtgaacattgtaaacacaatgaatcagtgg

SEQ ID NO: 148340 - DNA, 45 bp, Artificial Sequence
  Description of Artificial Sequence: Synthetic oligonucleotide
aggactacagtgaacattgtaaacacaatgaatcagtggtaaaag

SEQ ID NO: 148341 - DNA, 44 bp, Artificial Sequence
  Description of Artificial Sequence: Synthetic oligonucleotide
ggactacagtgaacattgtaaacacaatgaatcagtggtaaaag

SEQ ID NO: 148342 - DNA, 45 bp, Artificial Sequence
  Description of Artificial Sequence: Synthetic oligonucleotide
gactacagtgaacattgtaaacacaatgaatcagtggtaaaagag

SEQ ID NO: 148343 - DNA, 47 bp, Artificial Sequence
  Description of Artificial Sequence: Synthetic oligonucleotide
actacagtgaacattgtaaacacaatgaatcagtggtaaaagagatg

SEQ ID NO: 148344 - DNA, 46 bp, Artificial Sequence
  Description of Artificial Sequence: Synthetic oligonucleotide
ctacagtgaacattgtaaacacaatgaatcagtggtaaaagagatg

SEQ ID NO: 148345 - DNA, 48 bp, Artificial Sequence
  Description of Artificial Sequence: Synthetic oligonucleotide
tacagtgaacattgtaaacacaatgaatcagtggtaaaagagatgttg

SEQ ID NO: 148346 - DNA, 47 bp, Artificial Sequence
  Description of Artificial Sequence: Synthetic oligonucleotide
acagtgaacattgtaaacacaatgaatcagtggtaaaagagatgttg

SEQ ID NO: 148347 - DNA, 46 bp, Artificial Sequence
  Description of Artificial Sequence: Synthetic oligonucleotide
cagtgaacattgtaaacacaatgaatcagtggtaaaagagatgttg

SEQ ID NO: 148348 - DNA, 46 bp, Artificial Sequence
  Description of Artificial Sequence: Synthetic oligonucleotide
agtgaacattgtaaacacaatgaatcagtggtaaaagagatgttgg

SEQ ID NO: 148349 - DNA, 45 bp, Artificial Sequence
  Description of Artificial Sequence: Synthetic oligonucleotide
gtgaacattgtaaacacaatgaatcagtggtaaaagagatgttgg

SEQ ID NO: 148350 - DNA, 50 bp, Artificial Sequence
  Description of Artificial Sequence: Synthetic oligonucleotide
tgaacattgtaaacacaatgaatcagtggtaaaagagatgttggaattag

SEQ ID NO: 148351 - DNA, 49 bp, Artificial Sequence
  Description of Artificial Sequence: Synthetic oligonucleotide
gaacattgtaaacacaatgaatcagtggtaaaagagatgttggaattag

SEQ ID NO: 148352 - DNA, 49 bp, Artificial Sequence
  Description of Artificial Sequence: Synthetic oligonucleotide
aacattgtaaacacaatgaatcagtggtaaaagagatgttggaattagc

SEQ ID NO: 148353 - DNA, 48 bp, Artificial Sequence
  Description of Artificial Sequence: Synthetic oligonucleotide
acattgtaaacacaatgaatcagtggtaaaagagatgttggaattagc

SEQ ID NO: 148354 - DNA, 47 bp, Artificial Sequence
  Description of Artificial Sequence: Synthetic oligonucleotide
cattgtaaacacaatgaatcagtggtaaaagagatgttggaattagc

SEQ ID NO: 148355 - DNA, 47 bp, Artificial Sequence
  Description of Artificial Sequence: Synthetic oligonucleotide
attgtaaacacaatgaatcagtggtaaaagagatgttggaattagcc

SEQ ID NO: 148356 - DNA, 46 bp, Artificial Sequence
  Description of Artificial Sequence: Synthetic oligonucleotide
ttgtaaacacaatgaatcagtggtaaaagagatgttggaattagcc

SEQ ID NO: 148357 - DNA, 45 bp, Artificial Sequence
  Description of Artificial Sequence: Synthetic oligonucleotide
tgtaaacacaatgaatcagtggtaaaagagatgttggaattagcc

SEQ ID NO: 148358 - DNA, 44 bp, Artificial Sequence
  Description of Artificial Sequence: Synthetic oligonucleotide
gtaaacacaatgaatcagtggtaaaagagatgttggaattagcc

SEQ ID NO: 148359 - DNA, 46 bp, Artificial Sequence
  Description of Artificial Sequence: Synthetic oligonucleotide
taaacacaatgaatcagtggtaaaagagatgttggaattagccaag

SEQ ID NO: 148360 - DNA, 45 bp, Artificial Sequence
  Description of Artificial Sequence: Synthetic oligonucleotide
aaacacaatgaatcagtggtaaaagagatgttggaattagccaag

SEQ ID NO: 148361 - DNA, 44 bp, Artificial Sequence
  Description of Artificial Sequence: Synthetic oligonucleotide
aacacaatgaatcagtggtaaaagagatgttggaattagccaag

SEQ ID NO: 148362 - DNA, 43 bp, Artificial Sequence
  Description of Artificial Sequence: Synthetic oligonucleotide
acacaatgaatcagtggtaaaagagatgttggaattagccaag

SEQ ID NO: 148363 - DNA, 42 bp, Artificial Sequence
  Description of Artificial Sequence: Synthetic oligonucleotide
cacaatgaatcagtggtaaaagagatgttggaattagccaag

SEQ ID NO: 148364 - DNA, 47 bp, Artificial Sequence
  Description of Artificial Sequence: Synthetic oligonucleotide
acaatgaatcagtggtaaaagagatgttggaattagccaagaattac

SEQ ID NO: 148365 - DNA, 46 bp, Artificial Sequence
  Description of Artificial Sequence: Synthetic oligonucleotide
caatgaatcagtggtaaaagagatgttggaattagccaagaattac

SEQ ID NO: 148366 - DNA, 51 bp, Artificial Sequence
  Description of Artificial Sequence: Synthetic oligonucleotide
aatgaatcagtggtaaaagagatgttggaattagccaagaattacaataag

SEQ ID NO: 148367 - DNA, 50 bp, Artificial Sequence
  Description of Artificial Sequence: Synthetic oligonucleotide
atgaatcagtggtaaaagagatgttggaattagccaagaattacaataag

SEQ ID NO: 148368 - DNA, 49 bp, Artificial Sequence
  Description of Artificial Sequence: Synthetic oligonucleotide
tgaatcagtggtaaaagagatgttggaattagccaagaattacaataag

SEQ ID NO: 148369 - DNA, 48 bp, Artificial Sequence
  Description of Artificial Sequence: Synthetic oligonucleotide
gaatcagtggtaaaagagatgttggaattagccaagaattacaataag

SEQ ID NO: 148370 - DNA, 48 bp, Artificial Sequence
  Description of Artificial Sequence: Synthetic oligonucleotide
aatcagtggtaaaagagatgttggaattagccaagaattacaataagg

SEQ ID NO: 148371 - DNA, 47 bp, Artificial Sequence
  Description of Artificial Sequence: Synthetic oligonucleotide
atcagtggtaaaagagatgttggaattagccaagaattacaataagg

SEQ ID NO: 148372 - DNA, 46 bp, Artificial Sequence
  Description of Artificial Sequence: Synthetic oligonucleotide
tcagtggtaaaagagatgttggaattagccaagaattacaataagg

SEQ ID NO: 148373 - DNA, 45 bp, Artificial Sequence
  Description of Artificial Sequence: Synthetic oligonucleotide
cagtggtaaaagagatgttggaattagccaagaattacaataagg

SEQ ID NO: 148374 - DNA, 45 bp, Artificial Sequence
  Description of Artificial Sequence: Synthetic oligonucleotide
agtggtaaaagagatgttggaattagccaagaattacaataaggc

SEQ ID NO: 148375 - DNA, 44 bp, Artificial Sequence
  Description of Artificial Sequence: Synthetic oligonucleotide
gtggtaaaagagatgttggaattagccaagaattacaataaggc

SEQ ID NO: 148376 - DNA, 45 bp, Artificial Sequence
  Description of Artificial Sequence: Synthetic oligonucleotide
tggtaaaagagatgttggaattagccaagaattacaataaggctg

SEQ ID NO: 148377 - DNA, 44 bp, Artificial Sequence
  Description of Artificial Sequence: Synthetic oligonucleotide
ggtaaaagagatgttggaattagccaagaattacaataaggctg

SEQ ID NO: 148378 - DNA, 46 bp, Artificial Sequence
  Description of Artificial Sequence: Synthetic oligonucleotide
gtaaaagagatgttggaattagccaagaattacaataaggctgtag

SEQ ID NO: 148379 - DNA, 48 bp, Artificial Sequence
  Description of Artificial Sequence: Synthetic oligonucleotide
taaaagagatgttggaattagccaagaattacaataaggctgtagaag

SEQ ID NO: 148380 - DNA, 47 bp, Artificial Sequence
  Description of Artificial Sequence: Synthetic oligonucleotide
aaaagagatgttggaattagccaagaattacaataaggctgtagaag

SEQ ID NO: 148381 - DNA, 46 bp, Artificial Sequence
  Description of Artificial Sequence: Synthetic oligonucleotide
aaagagatgttggaattagccaagaattacaataaggctgtagaag

SEQ ID NO: 148382 - DNA, 45 bp, Artificial Sequence
  Description of Artificial Sequence: Synthetic oligonucleotide
aagagatgttggaattagccaagaattacaataaggctgtagaag

SEQ ID NO: 148383 - DNA, 44 bp, Artificial Sequence
  Description of Artificial Sequence: Synthetic oligonucleotide
agagatgttggaattagccaagaattacaataaggctgtagaag

SEQ ID NO: 148384 - DNA, 43 bp, Artificial Sequence
  Description of Artificial Sequence: Synthetic oligonucleotide
gagatgttggaattagccaagaattacaataaggctgtagaag

SEQ ID NO: 148385 - DNA, 45 bp, Artificial Sequence
  Description of Artificial Sequence: Synthetic oligonucleotide
agatgttggaattagccaagaattacaataaggctgtagaagaag

SEQ ID NO: 148386 - DNA, 44 bp, Artificial Sequence
  Description of Artificial Sequence: Synthetic oligonucleotide
gatgttggaattagccaagaattacaataaggctgtagaagaag

SEQ ID NO: 148387 - DNA, 46 bp, Artificial Sequence
  Description of Artificial Sequence: Synthetic oligonucleotide
atgttggaattagccaagaattacaataaggctgtagaagaagaag

SEQ ID NO: 148388 - DNA, 45 bp, Artificial Sequence
  Description of Artificial Sequence: Synthetic oligonucleotide
tgttggaattagccaagaattacaataaggctgtagaagaagaag

SEQ ID NO: 148389 - DNA, 44 bp, Artificial Sequence
  Description of Artificial Sequence: Synthetic oligonucleotide
gttggaattagccaagaattacaataaggctgtagaagaagaag

SEQ ID NO: 148390 - DNA, 48 bp, Artificial Sequence
  Description of Artificial Sequence: Synthetic oligonucleotide
ttggaattagccaagaattacaataaggctgtagaagaagaagataag

SEQ ID NO: 148391 - DNA, 47 bp, Artificial Sequence
  Description of Artificial Sequence: Synthetic oligonucleotide
tggaattagccaagaattacaataaggctgtagaagaagaagataag

SEQ ID NO: 148392 - DNA, 46 bp, Artificial Sequence
  Description of Artificial Sequence: Synthetic oligonucleotide
ggaattagccaagaattacaataaggctgtagaagaagaagataag

SEQ ID NO: 148393 - DNA, 48 bp, Artificial Sequence
  Description of Artificial Sequence: Synthetic oligonucleotide
gaattagccaagaattacaataaggctgtagaagaagaagataagatg

SEQ ID NO: 148394 - DNA, 49 bp, Artificial Sequence
  Description of Artificial Sequence: Synthetic oligonucleotide
aattagccaagaattacaataaggctgtagaagaagaagataagatgac

SEQ ID NO: 148395 - DNA, 48 bp, Artificial Sequence
  Description of Artificial Sequence: Synthetic oligonucleotide
attagccaagaattacaataaggctgtagaagaagaagataagatgac

SEQ ID NO: 148396 - DNA, 47 bp, Artificial Sequence
  Description of Artificial Sequence: Synthetic oligonucleotide
ttagccaagaattacaataaggctgtagaagaagaagataagatgac

SEQ ID NO: 148397 - DNA, 46 bp, Artificial Sequence
  Description of Artificial Sequence: Synthetic oligonucleotide
tagccaagaattacaataaggctgtagaagaagaagataagatgac

SEQ ID NO: 148398 - DNA, 45 bp, Artificial Sequence
  Description of Artificial Sequence: Synthetic oligonucleotide
agccaagaattacaataaggctgtagaagaagaagataagatgac

SEQ ID NO: 148399 - DNA, 44 bp, Artificial Sequence
  Description of Artificial Sequence: Synthetic oligonucleotide
gccaagaattacaataaggctgtagaagaagaagataagatgac

SEQ ID NO: 148400 - DNA, 45 bp, Artificial Sequence
  Description of Artificial Sequence: Synthetic oligonucleotide
ccaagaattacaataaggctgtagaagaagaagataagatgacac

SEQ ID NO: 148401 - DNA, 45 bp, Artificial Sequence
  Description of Artificial Sequence: Synthetic oligonucleotide
caagaattacaataaggctgtagaagaagaagataagatgacacc

SEQ ID NO: 148402 - DNA, 46 bp, Artificial Sequence
  Description of Artificial Sequence: Synthetic oligonucleotide
aagaattacaataaggctgtagaagaagaagataagatgacacctg

SEQ ID NO: 148403 - DNA, 45 bp, Artificial Sequence
  Description of Artificial Sequence: Synthetic oligonucleotide
agaattacaataaggctgtagaagaagaagataagatgacacctg

SEQ ID NO: 148404 - DNA, 44 bp, Artificial Sequence
  Description of Artificial Sequence: Synthetic oligonucleotide
gaattacaataaggctgtagaagaagaagataagatgacacctg

SEQ ID NO: 148405 - DNA, 46 bp, Artificial Sequence
  Description of Artificial Sequence: Synthetic oligonucleotide
aattacaataaggctgtagaagaagaagataagatgacacctgaac

SEQ ID NO: 148406 - DNA, 45 bp, Artificial Sequence
  Description of Artificial Sequence: Synthetic oligonucleotide
attacaataaggctgtagaagaagaagataagatgacacctgaac

SEQ ID NO: 148407 - DNA, 44 bp, Artificial Sequence
  Description of Artificial Sequence: Synthetic oligonucleotide
ttacaataaggctgtagaagaagaagataagatgacacctgaac

SEQ ID NO: 148408 - DNA, 43 bp, Artificial Sequence
  Description of Artificial Sequence: Synthetic oligonucleotide
tacaataaggctgtagaagaagaagataagatgacacctgaac

SEQ ID NO: 148409 - DNA, 42 bp, Artificial Sequence
  Description of Artificial Sequence: Synthetic oligonucleotide
acaataaggctgtagaagaagaagataagatgacacctgaac

SEQ ID NO: 148410 - DNA, 41 bp, Artificial Sequence
  Description of Artificial Sequence: Synthetic oligonucleotide
caataaggctgtagaagaagaagataagatgacacctgaac

SEQ ID NO: 148411 - DNA, 42 bp, Artificial Sequence
  Description of Artificial Sequence: Synthetic oligonucleotide
aataaggctgtagaagaagaagataagatgacacctgaacag

SEQ ID NO: 148412 - DNA, 41 bp, Artificial Sequence
  Description of Artificial Sequence: Synthetic oligonucleotide
ataaggctgtagaagaagaagataagatgacacctgaacag

SEQ ID NO: 148413 - DNA, 40 bp, Artificial Sequence
  Description of Artificial Sequence: Synthetic oligonucleotide
taaggctgtagaagaagaagataagatgacacctgaacag

SEQ ID NO: 148414 - DNA, 39 bp, Artificial Sequence
  Description of Artificial Sequence: Synthetic oligonucleotide
aaggctgtagaagaagaagataagatgacacctgaacag

SEQ ID NO: 148415 - DNA, 38 bp, Artificial Sequence
  Description of Artificial Sequence: Synthetic oligonucleotide
aggctgtagaagaagaagataagatgacacctgaacag

SEQ ID NO: 148416 - DNA, 37 bp, Artificial Sequence
  Description of Artificial Sequence: Synthetic oligonucleotide
ggctgtagaagaagaagataagatgacacctgaacag

SEQ ID NO: 148417 - DNA, 37 bp, Artificial Sequence
  Description of Artificial Sequence: Synthetic oligonucleotide
gctgtagaagaagaagataagatgacacctgaacagc

SEQ ID NO: 148418 - DNA, 38 bp, Artificial Sequence
  Description of Artificial Sequence: Synthetic oligonucleotide
ctgtagaagaagaagataagatgacacctgaacagctg

SEQ ID NO: 148419 - DNA, 38 bp, Artificial Sequence
  Description of Artificial Sequence: Synthetic oligonucleotide
tgtagaagaagaagataagatgacacctgaacagctgg

SEQ ID NO: 148420 - DNA, 37 bp, Artificial Sequence
  Description of Artificial Sequence: Synthetic oligonucleotide
gtagaagaagaagataagatgacacctgaacagctgg

SEQ ID NO: 148421 - DNA, 37 bp, Artificial Sequence
  Description of Artificial Sequence: Synthetic oligonucleotide
tagaagaagaagataagatgacacctgaacagctggc

SEQ ID NO: 148422 - DNA, 36 bp, Artificial Sequence
  Description of Artificial Sequence: Synthetic oligonucleotide
agaagaagaagataagatgacacctgaacagctggc

SEQ ID NO: 148423 - DNA, 35 bp, Artificial Sequence
  Description of Artificial Sequence: Synthetic oligonucleotide
gaagaagaagataagatgacacctgaacagctggc

SEQ ID NO: 148424 - DNA, 41 bp, Artificial Sequence
  Description of Artificial Sequence: Synthetic oligonucleotide
aagaagaagataagatgacacctgaacagctggcaataaag

SEQ ID NO: 148425 - DNA, 40 bp, Artificial Sequence
  Description of Artificial Sequence: Synthetic oligonucleotide
agaagaagataagatgacacctgaacagctggcaataaag

SEQ ID NO: 148426 - DNA, 39 bp, Artificial Sequence
  Description of Artificial Sequence: Synthetic oligonucleotide
gaagaagataagatgacacctgaacagctggcaataaag

SEQ ID NO: 148427 - DNA, 42 bp, Artificial Sequence
  Description of Artificial Sequence: Synthetic oligonucleotide
aagaagataagatgacacctgaacagctggcaataaagaatg

SEQ ID NO: 148428 - DNA, 41 bp, Artificial Sequence
  Description of Artificial Sequence: Synthetic oligonucleotide
agaagataagatgacacctgaacagctggcaataaagaatg

SEQ ID NO: 148429 - DNA, 40 bp, Artificial Sequence
  Description of Artificial Sequence: Synthetic oligonucleotide
gaagataagatgacacctgaacagctggcaataaagaatg

SEQ ID NO: 148430 - DNA, 42 bp, Artificial Sequence
  Description of Artificial Sequence: Synthetic oligonucleotide
aagataagatgacacctgaacagctggcaataaagaatgttg

SEQ ID NO: 148431 - DNA, 41 bp, Artificial Sequence
  Description of Artificial Sequence: Synthetic oligonucleotide
agataagatgacacctgaacagctggcaataaagaatgttg

SEQ ID NO: 148432 - DNA, 40 bp, Artificial Sequence
  Description of Artificial Sequence: Synthetic oligonucleotide
gataagatgacacctgaacagctggcaataaagaatgttg

SEQ ID NO: 148433 - DNA, 40 bp, Artificial Sequence
  Description of Artificial Sequence: Synthetic oligonucleotide
ataagatgacacctgaacagctggcaataaagaatgttgg

SEQ ID NO: 148434 - DNA, 39 bp, Artificial Sequence
  Description of Artificial Sequence: Synthetic oligonucleotide
taagatgacacctgaacagctggcaataaagaatgttgg

SEQ ID NO: 148435 - DNA, 38 bp, Artificial Sequence
  Description of Artificial Sequence: Synthetic oligonucleotide
aagatgacacctgaacagctggcaataaagaatgttgg

SEQ ID NO: 148436 - DNA, 37 bp, Artificial Sequence
  Description of Artificial Sequence: Synthetic oligonucleotide
agatgacacctgaacagctggcaataaagaatgttgg

SEQ ID NO: 148437 - DNA, 36 bp, Artificial Sequence
  Description of Artificial Sequence: Synthetic oligonucleotide
gatgacacctgaacagctggcaataaagaatgttgg

SEQ ID NO: 148438 - DNA, 36 bp, Artificial Sequence
  Description of Artificial Sequence: Synthetic oligonucleotide
atgacacctgaacagctggcaataaagaatgttggc

SEQ ID NO: 148439 - DNA, 35 bp, Artificial Sequence
  Description of Artificial Sequence: Synthetic oligonucleotide
tgacacctgaacagctggcaataaagaatgttggc

SEQ ID NO: 148440 - DNA, 34 bp, Artificial Sequence
  Description of Artificial Sequence: Synthetic oligonucleotide
gacacctgaacagctggcaataaagaatgttggc

SEQ ID NO: 148441 - DNA, 36 bp, Artificial Sequence
  Description of Artificial Sequence: Synthetic oligonucleotide
acacctgaacagctggcaataaagaatgttggcaag

SEQ ID NO: 148442 - DNA, 35 bp, Artificial Sequence
  Description of Artificial Sequence: Synthetic oligonucleotide
cacctgaacagctggcaataaagaatgttggcaag

SEQ ID NO: 148443 - DNA, 35 bp, Artificial Sequence
  Description of Artificial Sequence: Synthetic oligonucleotide
acctgaacagctggcaataaagaatgttggcaagc

SEQ ID NO: 148444 - DNA, 34 bp, Artificial Sequence
  Description of Artificial Sequence: Synthetic oligonucleotide
cctgaacagctggcaataaagaatgttggcaagc

SEQ ID NO: 148445 - DNA, 35 bp, Artificial Sequence
  Description of Artificial Sequence: Synthetic oligonucleotide
ctgaacagctggcaataaagaatgttggcaagcag

SEQ ID NO: 148446 - DNA, 35 bp, Artificial Sequence
  Description of Artificial Sequence: Synthetic oligonucleotide
tgaacagctggcaataaagaatgttggcaagcagg

SEQ ID NO: 148447 - DNA, 34 bp, Artificial Sequence
  Description of Artificial Sequence: Synthetic oligonucleotide
gaacagctggcaataaagaatgttggcaagcagg

SEQ ID NO: 148448 - DNA, 35 bp, Artificial Sequence
  Description of Artificial Sequence: Synthetic oligonucleotide
aacagctggcaataaagaatgttggcaagcaggac

SEQ ID NO: 148449 - DNA, 34 bp, Artificial Sequence
  Description of Artificial Sequence: Synthetic oligonucleotide
acagctggcaataaagaatgttggcaagcaggac

SEQ ID NO: 148450 - DNA, 33 bp, Artificial Sequence
  Description of Artificial Sequence: Synthetic oligonucleotide
cagctggcaataaagaatgttggcaagcaggac

SEQ ID NO: 148451 - DNA, 33 bp, Artificial Sequence
  Description of Artificial Sequence: Synthetic oligonucleotide
agctggcaataaagaatgttggcaagcaggacc

SEQ ID NO: 148452 - DNA, 32 bp, Artificial Sequence
  Description of Artificial Sequence: Synthetic oligonucleotide
gctggcaataaagaatgttggcaagcaggacc

SEQ ID NO: 148453 - DNA, 32 bp, Artificial Sequence
  Description of Artificial Sequence: Synthetic oligonucleotide
ctggcaataaagaatgttggcaagcaggaccc

SEQ ID NO: 148454 - DNA, 32 bp, Artificial Sequence
  Description of Artificial Sequence: Synthetic oligonucleotide
tggcaataaagaatgttggcaagcaggacccc

SEQ ID NO: 148455 - DNA, 31 bp, Artificial Sequence
  Description of Artificial Sequence: Synthetic oligonucleotide
ggcaataaagaatgttggcaagcaggacccc

SEQ ID NO: 148456 - DNA, 34 bp, Artificial Sequence
  Description of Artificial Sequence: Synthetic oligonucleotide
gcaataaagaatgttggcaagcaggaccccaaac

SEQ ID NO: 148457 - DNA, 34 bp, Artificial Sequence
  Description of Artificial Sequence: Synthetic oligonucleotide
caataaagaatgttggcaagcaggaccccaaacg

SEQ ID NO: 148458 - DNA, 35 bp, Artificial Sequence
  Description of Artificial Sequence: Synthetic oligonucleotide
aataaagaatgttggcaagcaggaccccaaacgtc

SEQ ID NO: 148459 - DNA, 34 bp, Artificial Sequence
  Description of Artificial Sequence: Synthetic oligonucleotide
ataaagaatgttggcaagcaggaccccaaacgtc

SEQ ID NO: 148460 - DNA, 33 bp, Artificial Sequence
  Description of Artificial Sequence: Synthetic oligonucleotide
taaagaatgttggcaagcaggaccccaaacgtc

SEQ ID NO: 148461 - DNA, 32 bp, Artificial Sequence
  Description of Artificial Sequence: Synthetic oligonucleotide
aaagaatgttggcaagcaggaccccaaacgtc

SEQ ID NO: 148462 - DNA, 31 bp, Artificial Sequence
  Description of Artificial Sequence: Synthetic oligonucleotide
aagaatgttggcaagcaggaccccaaacgtc

SEQ ID NO: 148463 - DNA, 30 bp, Artificial Sequence
  Description of Artificial Sequence: Synthetic oligonucleotide
agaatgttggcaagcaggaccccaaacgtc

SEQ ID NO: 148464 - DNA, 29 bp, Artificial Sequence
  Description of Artificial Sequence: Synthetic oligonucleotide
gaatgttggcaagcaggaccccaaacgtc

SEQ ID NO: 148465 - DNA, 33 bp, Artificial Sequence
  Description of Artificial Sequence: Synthetic oligonucleotide
aatgttggcaagcaggaccccaaacgtcatttg

SEQ ID NO: 148466 - DNA, 32 bp, Artificial Sequence
  Description of Artificial Sequence: Synthetic oligonucleotide
atgttggcaagcaggaccccaaacgtcatttg

SEQ ID NO: 148467 - DNA, 31 bp, Artificial Sequence
  Description of Artificial Sequence: Synthetic oligonucleotide
tgttggcaagcaggaccccaaacgtcatttg

SEQ ID NO: 148468 - DNA, 30 bp, Artificial Sequence
  Description of Artificial Sequence: Synthetic oligonucleotide
gttggcaagcaggaccccaaacgtcatttg

SEQ ID NO: 148469 - DNA, 30 bp, Artificial Sequence
  Description of Artificial Sequence: Synthetic oligonucleotide
ttggcaagcaggaccccaaacgtcatttgg

SEQ ID NO: 148470 - DNA, 29 bp, Artificial Sequence
  Description of Artificial Sequence: Synthetic oligonucleotide
tggcaagcaggaccccaaacgtcatttgg

SEQ ID NO: 148471 - DNA, 28 bp, Artificial Sequence
  Description of Artificial Sequence: Synthetic oligonucleotide
ggcaagcaggaccccaaacgtcatttgg

SEQ ID NO: 148472 - DNA, 29 bp, Artificial Sequence
  Description of Artificial Sequence: Synthetic oligonucleotide
gcaagcaggaccccaaacgtcatttggag

SEQ ID NO: 148473 - DNA, 29 bp, Artificial Sequence
  Description of Artificial Sequence: Synthetic oligonucleotide
caagcaggaccccaaacgtcatttggagg

SEQ ID NO: 148474 - DNA, 31 bp, Artificial Sequence
  Description of Artificial Sequence: Synthetic oligonucleotide
aagcaggaccccaaacgtcatttggaggaac

SEQ ID NO: 148475 - DNA, 30 bp, Artificial Sequence
  Description of Artificial Sequence: Synthetic oligonucleotide
agcaggaccccaaacgtcatttggaggaac

SEQ ID NO: 148476 - DNA, 29 bp, Artificial Sequence
  Description of Artificial Sequence: Synthetic oligonucleotide
gcaggaccccaaacgtcatttggaggaac

SEQ ID NO: 148477 - DNA, 31 bp, Artificial Sequence
  Description of Artificial Sequence: Synthetic oligonucleotide
caggaccccaaacgtcatttggaggaacatg

SEQ ID NO: 148478 - DNA, 32 bp, Artificial Sequence
  Description of Artificial Sequence: Synthetic oligonucleotide
aggaccccaaacgtcatttggaggaacatgtg

SEQ ID NO: 148479 - DNA, 31 bp, Artificial Sequence
  Description of Artificial Sequence: Synthetic oligonucleotide
ggaccccaaacgtcatttggaggaacatgtg

SEQ ID NO: 148480 - DNA, 31 bp, Artificial Sequence
  Description of Artificial Sequence: Synthetic oligonucleotide
gaccccaaacgtcatttggaggaacatgtgg

SEQ ID NO: 148481 - DNA, 33 bp, Artificial Sequence
  Description of Artificial Sequence: Synthetic oligonucleotide
accccaaacgtcatttggaggaacatgtggatg

SEQ ID NO: 148482 - DNA, 32 bp, Artificial Sequence
  Description of Artificial Sequence: Synthetic oligonucleotide
ccccaaacgtcatttggaggaacatgtggatg

SEQ ID NO: 148483 - DNA, 34 bp, Artificial Sequence
  Description of Artificial Sequence: Synthetic oligonucleotide
cccaaacgtcatttggaggaacatgtggatgtac

SEQ ID NO: 148484 - DNA, 38 bp, Artificial Sequence
  Description of Artificial Sequence: Synthetic oligonucleotide
ccaaacgtcatttggaggaacatgtggatgtacttatg

SEQ ID NO: 148485 - DNA, 39 bp, Artificial Sequence
  Description of Artificial Sequence: Synthetic oligonucleotide
caaacgtcatttggaggaacatgtggatgtacttatgac

SEQ ID NO: 148486 - DNA, 39 bp, Artificial Sequence
  Description of Artificial Sequence: Synthetic oligonucleotide
aaacgtcatttggaggaacatgtggatgtacttatgacc

SEQ ID NO: 148487 - DNA, 38 bp, Artificial Sequence
  Description of Artificial Sequence: Synthetic oligonucleotide
aacgtcatttggaggaacatgtggatgtacttatgacc

SEQ ID NO: 148488 - DNA, 37 bp, Artificial Sequence
  Description of Artificial Sequence: Synthetic oligonucleotide
acgtcatttggaggaacatgtggatgtacttatgacc

SEQ ID NO: 148489 - DNA, 36 bp, Artificial Sequence
  Description of Artificial Sequence: Synthetic oligonucleotide
cgtcatttggaggaacatgtggatgtacttatgacc

SEQ ID NO: 148490 - DNA, 37 bp, Artificial Sequence
  Description of Artificial Sequence: Synthetic oligonucleotide
gtcatttggaggaacatgtggatgtacttatgacctc

SEQ ID NO: 148491 - DNA, 44 bp, Artificial Sequence
  Description of Artificial Sequence: Synthetic oligonucleotide
tcatttggaggaacatgtggatgtacttatgacctcaaatattg

SEQ ID NO: 148492 - DNA, 43 bp, Artificial Sequence
  Description of Artificial Sequence: Synthetic oligonucleotide
catttggaggaacatgtggatgtacttatgacctcaaatattg

SEQ ID NO: 148493 - DNA, 44 bp, Artificial Sequence
  Description of Artificial Sequence: Synthetic oligonucleotide
atttggaggaacatgtggatgtacttatgacctcaaatattgtc

SEQ ID NO: 148494 - DNA, 43 bp, Artificial Sequence
  Description of Artificial Sequence: Synthetic oligonucleotide
tttggaggaacatgtggatgtacttatgacctcaaatattgtc

SEQ ID NO: 148495 - DNA, 42 bp, Artificial Sequence
  Description of Artificial Sequence: Synthetic oligonucleotide
ttggaggaacatgtggatgtacttatgacctcaaatattgtc

SEQ ID NO: 148496 - DNA, 41 bp, Artificial Sequence
  Description of Artificial Sequence: Synthetic oligonucleotide
tggaggaacatgtggatgtacttatgacctcaaatattgtc

SEQ ID NO: 148497 - DNA, 40 bp, Artificial Sequence
  Description of Artificial Sequence: Synthetic oligonucleotide
ggaggaacatgtggatgtacttatgacctcaaatattgtc

SEQ ID NO: 148498 - DNA, 40 bp, Artificial Sequence
  Description of Artificial Sequence: Synthetic oligonucleotide
gaggaacatgtggatgtacttatgacctcaaatattgtcc

SEQ ID NO: 148499 - DNA, 41 bp, Artificial Sequence
  Description of Artificial Sequence: Synthetic oligonucleotide
aggaacatgtggatgtacttatgacctcaaatattgtccag

SEQ ID NO: 148500 - DNA, 40 bp, Artificial Sequence
  Description of Artificial Sequence: Synthetic oligonucleotide
ggaacatgtggatgtacttatgacctcaaatattgtccag

SEQ ID NO: 148501 - DNA, 41 bp, Artificial Sequence
  Description of Artificial Sequence: Synthetic oligonucleotide
gaacatgtggatgtacttatgacctcaaatattgtccagtg

SEQ ID NO: 148502 - DNA, 45 bp, Artificial Sequence
  Description of Artificial Sequence: Synthetic oligonucleotide
aacatgtggatgtacttatgacctcaaatattgtccagtgtttag

SEQ ID NO: 148503 - DNA, 44 bp, Artificial Sequence
  Description of Artificial Sequence: Synthetic oligonucleotide
acatgtggatgtacttatgacctcaaatattgtccagtgtttag

SEQ ID NO: 148504 - DNA, 43 bp, Artificial Sequence
  Description of Artificial Sequence: Synthetic oligonucleotide
catgtggatgtacttatgacctcaaatattgtccagtgtttag

SEQ ID NO: 148505 - DNA, 43 bp, Artificial Sequence
  Description of Artificial Sequence: Synthetic oligonucleotide
atgtggatgtacttatgacctcaaatattgtccagtgtttagc

SEQ ID NO: 148506 - DNA, 42 bp, Artificial Sequence
  Description of Artificial Sequence: Synthetic oligonucleotide
tgtggatgtacttatgacctcaaatattgtccagtgtttagc

SEQ ID NO: 148507 - DNA, 41 bp, Artificial Sequence
  Description of Artificial Sequence: Synthetic oligonucleotide
gtggatgtacttatgacctcaaatattgtccagtgtttagc

SEQ ID NO: 148508 - DNA, 42 bp, Artificial Sequence
  Description of Artificial Sequence: Synthetic oligonucleotide
tggatgtacttatgacctcaaatattgtccagtgtttagcag

SEQ ID NO: 148509 - DNA, 41 bp, Artificial Sequence
  Description of Artificial Sequence: Synthetic oligonucleotide
ggatgtacttatgacctcaaatattgtccagtgtttagcag

SEQ ID NO: 148510 - DNA, 41 bp, Artificial Sequence
  Description of Artificial Sequence: Synthetic oligonucleotide
gatgtacttatgacctcaaatattgtccagtgtttagcagc

SEQ ID NO: 148511 - DNA, 44 bp, Artificial Sequence
  Description of Artificial Sequence: Synthetic oligonucleotide
atgtacttatgacctcaaatattgtccagtgtttagcagctatg

SEQ ID NO: 148512 - DNA, 43 bp, Artificial Sequence
  Description of Artificial Sequence: Synthetic oligonucleotide
tgtacttatgacctcaaatattgtccagtgtttagcagctatg

SEQ ID NO: 148513 - DNA, 42 bp, Artificial Sequence
  Description of Artificial Sequence: Synthetic oligonucleotide
gtacttatgacctcaaatattgtccagtgtttagcagctatg

SEQ ID NO: 148514 - DNA, 44 bp, Artificial Sequence
  Description of Artificial Sequence: Synthetic oligonucleotide
tacttatgacctcaaatattgtccagtgtttagcagctatgttg

SEQ ID NO: 148515 - DNA, 43 bp, Artificial Sequence
  Description of Artificial Sequence: Synthetic oligonucleotide
acttatgacctcaaatattgtccagtgtttagcagctatgttg

SEQ ID NO: 148516 - DNA, 42 bp, Artificial Sequence
  Description of Artificial Sequence: Synthetic oligonucleotide
cttatgacctcaaatattgtccagtgtttagcagctatgttg

SEQ ID NO: 148517 - DNA, 42 bp, Artificial Sequence
  Description of Artificial Sequence: Synthetic oligonucleotide
ttatgacctcaaatattgtccagtgtttagcagctatgttgg

SEQ ID NO: 148518 - DNA, 41 bp, Artificial Sequence
  Description of Artificial Sequence: Synthetic oligonucleotide
tatgacctcaaatattgtccagtgtttagcagctatgttgg

SEQ ID NO: 148519 - DNA, 40 bp, Artificial Sequence
  Description of Artificial Sequence: Synthetic oligonucleotide
atgacctcaaatattgtccagtgtttagcagctatgttgg

SEQ ID NO: 148520 - DNA, 39 bp, Artificial Sequence
  Description of Artificial Sequence: Synthetic oligonucleotide
tgacctcaaatattgtccagtgtttagcagctatgttgg

SEQ ID NO: 148521 - DNA, 38 bp, Artificial Sequence
  Description of Artificial Sequence: Synthetic oligonucleotide
gacctcaaatattgtccagtgtttagcagctatgttgg

SEQ ID NO: 148522 - DNA, 41 bp, Artificial Sequence
  Description of Artificial Sequence: Synthetic oligonucleotide
acctcaaatattgtccagtgtttagcagctatgttggatac

SEQ ID NO: 148523 - DNA, 40 bp, Artificial Sequence
  Description of Artificial Sequence: Synthetic oligonucleotide
cctcaaatattgtccagtgtttagcagctatgttggatac

SEQ ID NO: 148524 - DNA, 41 bp, Artificial Sequence
  Description of Artificial Sequence: Synthetic oligonucleotide
ctcaaatattgtccagtgtttagcagctatgttggatactg

SEQ ID NO: 148525 - DNA, 42 bp, Artificial Sequence
  Description of Artificial Sequence: Synthetic oligonucleotide
tcaaatattgtccagtgtttagcagctatgttggatactgtc

SEQ ID NO: 148526 - DNA, 41 bp, Artificial Sequence
  Description of Artificial Sequence: Synthetic oligonucleotide
caaatattgtccagtgtttagcagctatgttggatactgtc

SEQ ID NO: 148527 - DNA, 41 bp, Artificial Sequence
  Description of Artificial Sequence: Synthetic oligonucleotide
aaatattgtccagtgtttagcagctatgttggatactgtcg

SEQ ID NO: 148528 - DNA, 40 bp, Artificial Sequence
  Description of Artificial Sequence: Synthetic oligonucleotide
aatattgtccagtgtttagcagctatgttggatactgtcg

SEQ ID NO: 148529 - DNA, 39 bp, Artificial Sequence
  Description of Artificial Sequence: Synthetic oligonucleotide
atattgtccagtgtttagcagctatgttggatactgtcg

SEQ ID NO: 148530 - DNA, 38 bp, Artificial Sequence
  Description of Artificial Sequence: Synthetic oligonucleotide
tattgtccagtgtttagcagctatgttggatactgtcg

SEQ ID NO: 148531 - DNA, 37 bp, Artificial Sequence
  Description of Artificial Sequence: Synthetic oligonucleotide
attgtccagtgtttagcagctatgttggatactgtcg

SEQ ID NO: 148532 - DNA, 36 bp, Artificial Sequence
  Description of Artificial Sequence: Synthetic oligonucleotide
ttgtccagtgtttagcagctatgttggatactgtcg

SEQ ID NO: 148533 - DNA, 35 bp, Artificial Sequence
  Description of Artificial Sequence: Synthetic oligonucleotide
tgtccagtgtttagcagctatgttggatactgtcg

SEQ ID NO: 148534 - DNA, 34 bp, Artificial Sequence
  Description of Artificial Sequence: Synthetic oligonucleotide
gtccagtgtttagcagctatgttggatactgtcg

SEQ ID NO: 148535 - DNA, 23 bp, Artificial Sequence
  Description of Artificial Sequence: Synthetic oligonucleotide
atggggctgggcccggtcttcct

SEQ ID NO: 148536 - DNA, 22 bp, Artificial Sequence
  Description of Artificial Sequence: Synthetic oligonucleotide
tggggctgggcccggtcttcct

SEQ ID NO: 148537 - DNA, 21 bp, Artificial Sequence
  Description of Artificial Sequence: Synthetic oligonucleotide
ggggctgggcccggtcttcct

SEQ ID NO: 148538 - DNA, 21 bp, Artificial Sequence
  Description of Artificial Sequence: Synthetic oligonucleotide
gggctgggcccggtcttcctg

SEQ ID NO: 148539 - DNA, 23 bp, Artificial Sequence
  Description of Artificial Sequence: Synthetic oligonucleotide
ggctgggcccggtcttcctgctt

SEQ ID NO: 148540 - DNA, 24 bp, Artificial Sequence
  Description of Artificial Sequence: Synthetic oligonucleotide
gctgggcccggtcttcctgcttct

SEQ ID NO: 148541 - DNA, 24 bp, Artificial Sequence
  Description of Artificial Sequence: Synthetic oligonucleotide
ctgggcccggtcttcctgcttctg

SEQ ID NO: 148542 - DNA, 24 bp, Artificial Sequence
  Description of Artificial Sequence: Synthetic oligonucleotide
tgggcccggtcttcctgcttctgg

SEQ ID NO: 148543 - DNA, 23 bp, Artificial Sequence
  Description of Artificial Sequence: Synthetic oligonucleotide
gggcccggtcttcctgcttctgg

SEQ ID NO: 148544 - DNA, 24 bp, Artificial Sequence
  Description of Artificial Sequence: Synthetic oligonucleotide
ggcccggtcttcctgcttctggct

SEQ ID NO: 148545 - DNA, 24 bp, Artificial Sequence
  Description of Artificial Sequence: Synthetic oligonucleotide
gcccggtcttcctgcttctggctg

SEQ ID NO: 148546 - DNA, 24 bp, Artificial Sequence
  Description of Artificial Sequence: Synthetic oligonucleotide
cccggtcttcctgcttctggctgg

SEQ ID NO: 148547 - DNA, 26 bp, Artificial Sequence
  Description of Artificial Sequence: Synthetic oligonucleotide
ccggtcttcctgcttctggctggcat

SEQ ID NO: 148548 - DNA, 27 bp, Artificial Sequence
  Description of Artificial Sequence: Synthetic oligonucleotide
cggtcttcctgcttctggctggcatct

SEQ ID NO: 148549 - DNA, 28 bp, Artificial Sequence
  Description of Artificial Sequence: Synthetic oligonucleotide
ggtcttcctgcttctggctggcatcttc

SEQ ID NO: 148550 - DNA, 28 bp, Artificial Sequence
  Description of Artificial Sequence: Synthetic oligonucleotide
gtcttcctgcttctggctggcatcttcc

SEQ ID NO: 148551 - DNA, 28 bp, Artificial Sequence
  Description of Artificial Sequence: Synthetic oligonucleotide
tcttcctgcttctggctggcatcttccc

SEQ ID NO: 148552 - DNA, 27 bp, Artificial Sequence
  Description of Artificial Sequence: Synthetic oligonucleotide
cttcctgcttctggctggcatcttccc

SEQ ID NO: 148553 - DNA, 31 bp, Artificial Sequence
  Description of Artificial Sequence: Synthetic oligonucleotide
ttcctgcttctggctggcatcttcccttttg

SEQ ID NO: 148554 - DNA, 30 bp, Artificial Sequence
  Description of Artificial Sequence: Synthetic oligonucleotide
tcctgcttctggctggcatcttcccttttg

SEQ ID NO: 148555 - DNA, 29 bp, Artificial Sequence
  Description of Artificial Sequence: Synthetic oligonucleotide
cctgcttctggctggcatcttcccttttg

SEQ ID NO: 148556 - DNA, 29 bp, Artificial Sequence
  Description of Artificial Sequence: Synthetic oligonucleotide
ctgcttctggctggcatcttcccttttgc

SEQ ID NO: 148557 - DNA, 30 bp, Artificial Sequence
  Description of Artificial Sequence: Synthetic oligonucleotide
tgcttctggctggcatcttcccttttgcac

SEQ ID NO: 148558 - DNA, 29 bp, Artificial Sequence
  Description of Artificial Sequence: Synthetic oligonucleotide
gcttctggctggcatcttcccttttgcac

SEQ ID NO: 148559 - DNA, 29 bp, Artificial Sequence
  Description of Artificial Sequence: Synthetic oligonucleotide
cttctggctggcatcttcccttttgcacc

SEQ ID NO: 148560 - DNA, 30 bp, Artificial Sequence
  Description of Artificial Sequence: Synthetic oligonucleotide
ttctggctggcatcttcccttttgcacctc

SEQ ID NO: 148561 - DNA, 29 bp, Artificial Sequence
  Description of Artificial Sequence: Synthetic oligonucleotide
tctggctggcatcttcccttttgcacctc

SEQ ID NO: 148562 - DNA, 28 bp, Artificial Sequence
  Description of Artificial Sequence: Synthetic oligonucleotide
ctggctggcatcttcccttttgcacctc

SEQ ID NO: 148563 - DNA, 28 bp, Artificial Sequence
  Description of Artificial Sequence: Synthetic oligonucleotide
tggctggcatcttcccttttgcacctcc

SEQ ID NO: 148564 - DNA, 27 bp, Artificial Sequence
  Description of Artificial Sequence: Synthetic oligonucleotide
ggctggcatcttcccttttgcacctcc

SEQ ID NO: 148565 - DNA, 27 bp, Artificial Sequence
  Description of Artificial Sequence: Synthetic oligonucleotide
gctggcatcttcccttttgcacctccg

SEQ ID NO: 148566 - DNA, 27 bp, Artificial Sequence
  Description of Artificial Sequence: Synthetic oligonucleotide
ctggcatcttcccttttgcacctccgg

SEQ ID NO: 148567 - DNA, 27 bp, Artificial Sequence
  Description of Artificial Sequence: Synthetic oligonucleotide
tggcatcttcccttttgcacctccggg

SEQ ID NO: 148568 - DNA, 27 bp, Artificial Sequence
  Description of Artificial Sequence: Synthetic oligonucleotide
ggcatcttcccttttgcacctccggga

SEQ ID NO: 148569 - DNA, 27 bp, Artificial Sequence
  Description of Artificial Sequence: Synthetic oligonucleotide
gcatcttcccttttgcacctccgggag

SEQ ID NO: 148570 - DNA, 27 bp, Artificial Sequence
  Description of Artificial Sequence: Synthetic oligonucleotide
catcttcccttttgcacctccgggagc

SEQ ID NO: 148571 - DNA, 28 bp, Artificial Sequence
  Description of Artificial Sequence: Synthetic oligonucleotide
atcttcccttttgcacctccgggagctg

SEQ ID NO: 148572 - DNA, 27 bp, Artificial Sequence
  Description of Artificial Sequence: Synthetic oligonucleotide
tcttcccttttgcacctccgggagctg

SEQ ID NO: 148573 - DNA, 26 bp, Artificial Sequence
  Description of Artificial Sequence: Synthetic oligonucleotide
cttcccttttgcacctccgggagctg

SEQ ID NO: 148574 - DNA, 27 bp, Artificial Sequence
  Description of Artificial Sequence: Synthetic oligonucleotide
ttcccttttgcacctccgggagctgct

SEQ ID NO: 148575 - DNA, 26 bp, Artificial Sequence
  Description of Artificial Sequence: Synthetic oligonucleotide
tcccttttgcacctccgggagctgct

SEQ ID NO: 148576 - DNA, 25 bp, Artificial Sequence
  Description of Artificial Sequence: Synthetic oligonucleotide
cccttttgcacctccgggagctgct

SEQ ID NO: 148577 - DNA, 25 bp, Artificial Sequence
  Description of Artificial Sequence: Synthetic oligonucleotide
ccttttgcacctccgggagctgctg

SEQ ID NO: 148578 - DNA, 26 bp, Artificial Sequence
  Description of Artificial Sequence: Synthetic oligonucleotide
cttttgcacctccgggagctgctgct

SEQ ID NO: 148579 - DNA, 27 bp, Artificial Sequence
  Description of Artificial Sequence: Synthetic oligonucleotide
ttttgcacctccgggagctgctgctga

SEQ ID NO: 148580 - DNA, 26 bp, Artificial Sequence
  Description of Artificial Sequence: Synthetic oligonucleotide
tttgcacctccgggagctgctgctga

SEQ ID NO: 148581 - DNA, 25 bp, Artificial Sequence
  Description of Artificial Sequence: Synthetic oligonucleotide
ttgcacctccgggagctgctgctga

SEQ ID NO: 148582 - DNA, 24 bp, Artificial Sequence
  Description of Artificial Sequence: Synthetic oligonucleotide
tgcacctccgggagctgctgctga

SEQ ID NO: 148583 - DNA, 23 bp, Artificial Sequence
  Description of Artificial Sequence: Synthetic oligonucleotide
gcacctccgggagctgctgctga

SEQ ID NO: 148584 - DNA, 23 bp, Artificial Sequence
  Description of Artificial Sequence: Synthetic oligonucleotide
cacctccgggagctgctgctgag

SEQ ID NO: 148585 - DNA, 23 bp, Artificial Sequence
  Description of Artificial Sequence: Synthetic oligonucleotide
acctccgggagctgctgctgagc

SEQ ID NO: 148586 - DNA, 22 bp, Artificial Sequence
  Description of Artificial Sequence: Synthetic oligonucleotide
cctccgggagctgctgctgagc

SEQ ID NO: 148587 - DNA, 22 bp, Artificial Sequence
  Description of Artificial Sequence: Synthetic oligonucleotide
ctccgggagctgctgctgagcc

SEQ ID NO: 148588 - DNA, 22 bp, Artificial Sequence
  Description of Artificial Sequence: Synthetic oligonucleotide
tccgggagctgctgctgagccc

SEQ ID NO: 148589 - DNA, 21 bp, Artificial Sequence
  Description of Artificial Sequence: Synthetic oligonucleotide
ccgggagctgctgctgagccc

SEQ ID NO: 148590 - DNA, 22 bp, Artificial Sequence
  Description of Artificial Sequence: Synthetic oligonucleotide
cgggagctgctgctgagcccca

SEQ ID NO: 148591 - DNA, 23 bp, Artificial Sequence
  Description of Artificial Sequence: Synthetic oligonucleotide
gggagctgctgctgagccccaca

SEQ ID NO: 148592 - DNA, 24 bp, Artificial Sequence
  Description of Artificial Sequence: Synthetic oligonucleotide
ggagctgctgctgagccccacagt

SEQ ID NO: 148593 - DNA, 26 bp, Artificial Sequence
  Description of Artificial Sequence: Synthetic oligonucleotide
gagctgctgctgagccccacagtctt

SEQ ID NO: 148594 - DNA, 26 bp, Artificial Sequence
  Description of Artificial Sequence: Synthetic oligonucleotide
agctgctgctgagccccacagtcttc

SEQ ID NO: 148595 - DNA, 25 bp, Artificial Sequence
  Description of Artificial Sequence: Synthetic oligonucleotide
gctgctgctgagccccacagtcttc

SEQ ID NO: 148596 - DNA, 27 bp, Artificial Sequence
  Description of Artificial Sequence: Synthetic oligonucleotide
ctgctgctgagccccacagtcttcgtt

SEQ ID NO: 148597 - DNA, 31 bp, Artificial Sequence
  Description of Artificial Sequence: Synthetic oligonucleotide
tgctgctgagccccacagtcttcgttataac

SEQ ID NO: 148598 - DNA, 30 bp, Artificial Sequence
  Description of Artificial Sequence: Synthetic oligonucleotide
gctgctgagccccacagtcttcgttataac

SEQ ID NO: 148599 - DNA, 30 bp, Artificial Sequence
  Description of Artificial Sequence: Synthetic oligonucleotide
ctgctgagccccacagtcttcgttataacc

SEQ ID NO: 148600 - DNA, 31 bp, Artificial Sequence
  Description of Artificial Sequence: Synthetic oligonucleotide
tgctgagccccacagtcttcgttataacctc

SEQ ID NO: 148601 - DNA, 30 bp, Artificial Sequence
  Description of Artificial Sequence: Synthetic oligonucleotide
gctgagccccacagtcttcgttataacctc

SEQ ID NO: 148602 - DNA, 31 bp, Artificial Sequence
  Description of Artificial Sequence: Synthetic oligonucleotide
ctgagccccacagtcttcgttataacctcac

SEQ ID NO: 148603 - DNA, 31 bp, Artificial Sequence
  Description of Artificial Sequence: Synthetic oligonucleotide
tgagccccacagtcttcgttataacctcacg

SEQ ID NO: 148604 - DNA, 30 bp, Artificial Sequence
  Description of Artificial Sequence: Synthetic oligonucleotide
gagccccacagtcttcgttataacctcacg

SEQ ID NO: 148605 - DNA, 30 bp, Artificial Sequence
  Description of Artificial Sequence: Synthetic oligonucleotide
agccccacagtcttcgttataacctcacgg

SEQ ID NO: 148606 - DNA, 29 bp, Artificial Sequence
  Description of Artificial Sequence: Synthetic oligonucleotide
gccccacagtcttcgttataacctcacgg

SEQ ID NO: 148607 - DNA, 30 bp, Artificial Sequence
  Description of Artificial Sequence: Synthetic oligonucleotide
ccccacagtcttcgttataacctcacggtg

SEQ ID NO: 148608 - DNA, 30 bp, Artificial Sequence
  Description of Artificial Sequence: Synthetic oligonucleotide
cccacagtcttcgttataacctcacggtgc

SEQ ID NO: 148609 - DNA, 31 bp, Artificial Sequence
  Description of Artificial Sequence: Synthetic oligonucleotide
ccacagtcttcgttataacctcacggtgctg

SEQ ID NO: 148610 - DNA, 32 bp, Artificial Sequence
  Description of Artificial Sequence: Synthetic oligonucleotide
cacagtcttcgttataacctcacggtgctgtc

SEQ ID NO: 148611 - DNA, 32 bp, Artificial Sequence
  Description of Artificial Sequence: Synthetic oligonucleotide
acagtcttcgttataacctcacggtgctgtcc

SEQ ID NO: 148612 - DNA, 31 bp, Artificial Sequence
  Description of Artificial Sequence: Synthetic oligonucleotide
cagtcttcgttataacctcacggtgctgtcc

SEQ ID NO: 148613 - DNA, 32 bp, Artificial Sequence
  Description of Artificial Sequence: Synthetic oligonucleotide
agtcttcgttataacctcacggtgctgtcctg

SEQ ID NO: 148614 - DNA, 31 bp, Artificial Sequence
  Description of Artificial Sequence: Synthetic oligonucleotide
gtcttcgttataacctcacggtgctgtcctg

SEQ ID NO: 148615 - DNA, 31 bp, Artificial Sequence
  Description of Artificial Sequence: Synthetic oligonucleotide
tcttcgttataacctcacggtgctgtcctgg

SEQ ID NO: 148616 - DNA, 30 bp, Artificial Sequence
  Description of Artificial Sequence: Synthetic oligonucleotide
cttcgttataacctcacggtgctgtcctgg

SEQ ID NO: 148617 - DNA, 30 bp, Artificial Sequence
  Description of Artificial Sequence: Synthetic oligonucleotide
ttcgttataacctcacggtgctgtcctggg

SEQ ID NO: 148618 - DNA, 29 bp, Artificial Sequence
  Description of Artificial Sequence: Synthetic oligonucleotide
tcgttataacctcacggtgctgtcctggg

SEQ ID NO: 148619 - DNA, 28 bp, Artificial Sequence
  Description of Artificial Sequence: Synthetic oligonucleotide
cgttataacctcacggtgctgtcctggg

SEQ ID NO: 148620 - DNA, 30 bp, Artificial Sequence
  Description of Artificial Sequence: Synthetic oligonucleotide
gttataacctcacggtgctgtcctgggatg

SEQ ID NO: 148621 - DNA, 30 bp, Artificial Sequence
  Description of Artificial Sequence: Synthetic oligonucleotide
ttataacctcacggtgctgtcctgggatgg

SEQ ID NO: 148622 - DNA, 29 bp, Artificial Sequence
  Description of Artificial Sequence: Synthetic oligonucleotide
tataacctcacggtgctgtcctgggatgg

SEQ ID NO: 148623 - DNA, 28 bp, Artificial Sequence
  Description of Artificial Sequence: Synthetic oligonucleotide
ataacctcacggtgctgtcctgggatgg

SEQ ID NO: 148624 - DNA, 27 bp, Artificial Sequence
  Description of Artificial Sequence: Synthetic oligonucleotide
taacctcacggtgctgtcctgggatgg

SEQ ID NO: 148625 - DNA, 27 bp, Artificial Sequence
  Description of Artificial Sequence: Synthetic oligonucleotide
aacctcacggtgctgtcctgggatgga

SEQ ID NO: 148626 - DNA, 27 bp, Artificial Sequence
  Description of Artificial Sequence: Synthetic oligonucleotide
acctcacggtgctgtcctgggatggat

SEQ ID NO: 148627 - DNA, 26 bp, Artificial Sequence
  Description of Artificial Sequence: Synthetic oligonucleotide
cctcacggtgctgtcctgggatggat

SEQ ID NO: 148628 - DNA, 27 bp, Artificial Sequence
  Description of Artificial Sequence: Synthetic oligonucleotide
ctcacggtgctgtcctgggatggatct

SEQ ID NO: 148629 - DNA, 27 bp, Artificial Sequence
  Description of Artificial Sequence: Synthetic oligonucleotide
tcacggtgctgtcctgggatggatctg

SEQ ID NO: 148630 - DNA, 27 bp, Artificial Sequence
  Description of Artificial Sequence: Synthetic oligonucleotide
cacggtgctgtcctgggatggatctgt

SEQ ID NO: 148631 - DNA, 27 bp, Artificial Sequence
  Description of Artificial Sequence: Synthetic oligonucleotide
acggtgctgtcctgggatggatctgtg

SEQ ID NO: 148632 - DNA, 26 bp, Artificial Sequence
  Description of Artificial Sequence: Synthetic oligonucleotide
cggtgctgtcctgggatggatctgtg

SEQ ID NO: 148633 - DNA, 27 bp, Artificial Sequence
  Description of Artificial Sequence: Synthetic oligonucleotide
ggtgctgtcctgggatggatctgtgca

SEQ ID NO: 148634 - DNA, 27 bp, Artificial Sequence
  Description of Artificial Sequence: Synthetic oligonucleotide
gtgctgtcctgggatggatctgtgcag

SEQ ID NO: 148635 - DNA, 28 bp, Artificial Sequence
  Description of Artificial Sequence: Synthetic oligonucleotide
tgctgtcctgggatggatctgtgcagtc

SEQ ID NO: 148636 - DNA, 27 bp, Artificial Sequence
  Description of Artificial Sequence: Synthetic oligonucleotide
gctgtcctgggatggatctgtgcagtc

SEQ ID NO: 148637 - DNA, 28 bp, Artificial Sequence
  Description of Artificial Sequence: Synthetic oligonucleotide
ctgtcctgggatggatctgtgcagtcag

SEQ ID NO: 148638 - DNA, 28 bp, Artificial Sequence
  Description of Artificial Sequence: Synthetic oligonucleotide
tgtcctgggatggatctgtgcagtcagg

SEQ ID NO: 148639 - DNA, 27 bp, Artificial Sequence
  Description of Artificial Sequence: Synthetic oligonucleotide
gtcctgggatggatctgtgcagtcagg

SEQ ID NO: 148640 - DNA, 27 bp, Artificial Sequence
  Description of Artificial Sequence: Synthetic oligonucleotide
tcctgggatggatctgtgcagtcaggg

SEQ ID NO: 148641 - DNA, 27 bp, Artificial Sequence
  Description of Artificial Sequence: Synthetic oligonucleotide
cctgggatggatctgtgcagtcagggt

SEQ ID NO: 148642 - DNA, 29 bp, Artificial Sequence
  Description of Artificial Sequence: Synthetic oligonucleotide
ctgggatggatctgtgcagtcagggtttc

SEQ ID NO: 148643 - DNA, 30 bp, Artificial Sequence
  Description of Artificial Sequence: Synthetic oligonucleotide
tgggatggatctgtgcagtcagggtttctc

SEQ ID NO: 148644 - DNA, 29 bp, Artificial Sequence
  Description of Artificial Sequence: Synthetic oligonucleotide
gggatggatctgtgcagtcagggtttctc

SEQ ID NO: 148645 - DNA, 30 bp, Artificial Sequence
  Description of Artificial Sequence: Synthetic oligonucleotide
ggatggatctgtgcagtcagggtttctcac

SEQ ID NO: 148646 - DNA, 31 bp, Artificial Sequence
  Description of Artificial Sequence: Synthetic oligonucleotide
gatggatctgtgcagtcagggtttctcactg

SEQ ID NO: 148647 - DNA, 32 bp, Artificial Sequence
  Description of Artificial Sequence: Synthetic oligonucleotide
atggatctgtgcagtcagggtttctcactgag

SEQ ID NO: 148648 - DNA, 31 bp, Artificial Sequence
  Description of Artificial Sequence: Synthetic oligonucleotide
tggatctgtgcagtcagggtttctcactgag

SEQ ID NO: 148649 - DNA, 30 bp, Artificial Sequence
  Description of Artificial Sequence: Synthetic oligonucleotide
ggatctgtgcagtcagggtttctcactgag

SEQ ID NO: 148650 - DNA, 30 bp, Artificial Sequence
  Description of Artificial Sequence: Synthetic oligonucleotide
gatctgtgcagtcagggtttctcactgagg

SEQ ID NO: 148651 - DNA, 32 bp, Artificial Sequence
  Description of Artificial Sequence: Synthetic oligonucleotide
atctgtgcagtcagggtttctcactgaggtac

SEQ ID NO: 148652 - DNA, 31 bp, Artificial Sequence
  Description of Artificial Sequence: Synthetic oligonucleotide
tctgtgcagtcagggtttctcactgaggtac

SEQ ID NO: 148653 - DNA, 30 bp, Artificial Sequence
  Description of Artificial Sequence: Synthetic oligonucleotide
ctgtgcagtcagggtttctcactgaggtac

SEQ ID NO: 148654 - DNA, 32 bp, Artificial Sequence
  Description of Artificial Sequence: Synthetic oligonucleotide
tgtgcagtcagggtttctcactgaggtacatc

SEQ ID NO: 148655 - DNA, 31 bp, Artificial Sequence
  Description of Artificial Sequence: Synthetic oligonucleotide
gtgcagtcagggtttctcactgaggtacatc

SEQ ID NO: 148656 - DNA, 32 bp, Artificial Sequence
  Description of Artificial Sequence: Synthetic oligonucleotide
tgcagtcagggtttctcactgaggtacatctg

SEQ ID NO: 148657 - DNA, 31 bp, Artificial Sequence
  Description of Artificial Sequence: Synthetic oligonucleotide
gcagtcagggtttctcactgaggtacatctg

SEQ ID NO: 148658 - DNA, 31 bp, Artificial Sequence
  Description of Artificial Sequence: Synthetic oligonucleotide
cagtcagggtttctcactgaggtacatctgg

SEQ ID NO: 148659 - DNA, 33 bp, Artificial Sequence
  Description of Artificial Sequence: Synthetic oligonucleotide
agtcagggtttctcactgaggtacatctggatg

SEQ ID NO: 148660 - DNA, 32 bp, Artificial Sequence
  Description of Artificial Sequence: Synthetic oligonucleotide
gtcagggtttctcactgaggtacatctggatg

SEQ ID NO: 148661 - DNA, 32 bp, Artificial Sequence
  Description of Artificial Sequence: Synthetic oligonucleotide
tcagggtttctcactgaggtacatctggatgg

SEQ ID NO: 148662 - DNA, 31 bp, Artificial Sequence
  Description of Artificial Sequence: Synthetic oligonucleotide
cagggtttctcactgaggtacatctggatgg

SEQ ID NO: 148663 - DNA, 32 bp, Artificial Sequence
  Description of Artificial Sequence: Synthetic oligonucleotide
agggtttctcactgaggtacatctggatggtc

SEQ ID NO: 148664 - DNA, 31 bp, Artificial Sequence
  Description of Artificial Sequence: Synthetic oligonucleotide
gggtttctcactgaggtacatctggatggtc

SEQ ID NO: 148665 - DNA, 32 bp, Artificial Sequence
  Description of Artificial Sequence: Synthetic oligonucleotide
ggtttctcactgaggtacatctggatggtcag

SEQ ID NO: 148666 - DNA, 32 bp, Artificial Sequence
  Description of Artificial Sequence: Synthetic oligonucleotide
gtttctcactgaggtacatctggatggtcagc

SEQ ID NO: 148667 - DNA, 32 bp, Artificial Sequence
  Description of Artificial Sequence: Synthetic oligonucleotide
tttctcactgaggtacatctggatggtcagcc

SEQ ID NO: 148668 - DNA, 31 bp, Artificial Sequence
  Description of Artificial Sequence: Synthetic oligonucleotide
ttctcactgaggtacatctggatggtcagcc

SEQ ID NO: 148669 - DNA, 30 bp, Artificial Sequence
  Description of Artificial Sequence: Synthetic oligonucleotide
tctcactgaggtacatctggatggtcagcc

SEQ ID NO: 148670 - DNA, 29 bp, Artificial Sequence
  Description of Artificial Sequence: Synthetic oligonucleotide
ctcactgaggtacatctggatggtcagcc

SEQ ID NO: 148671 - DNA, 29 bp, Artificial Sequence
  Description of Artificial Sequence: Synthetic oligonucleotide
tcactgaggtacatctggatggtcagccc

SEQ ID NO: 148672 - DNA, 28 bp, Artificial Sequence
  Description of Artificial Sequence: Synthetic oligonucleotide
cactgaggtacatctggatggtcagccc

SEQ ID NO: 148673 - DNA, 30 bp, Artificial Sequence
  Description of Artificial Sequence: Synthetic oligonucleotide
actgaggtacatctggatggtcagcccttc

SEQ ID NO: 148674 - DNA, 29 bp, Artificial Sequence
  Description of Artificial Sequence: Synthetic oligonucleotide
ctgaggtacatctggatggtcagcccttc

SEQ ID NO: 148675 - DNA, 29 bp, Artificial Sequence
  Description of Artificial Sequence: Synthetic oligonucleotide
tgaggtacatctggatggtcagcccttcc

SEQ ID NO: 148676 - DNA, 28 bp, Artificial Sequence
  Description of Artificial Sequence: Synthetic oligonucleotide
gaggtacatctggatggtcagcccttcc

SEQ ID NO: 148677 - DNA, 29 bp, Artificial Sequence
  Description of Artificial Sequence: Synthetic oligonucleotide
aggtacatctggatggtcagcccttcctg

SEQ ID NO: 148678 - DNA, 28 bp, Artificial Sequence
  Description of Artificial Sequence: Synthetic oligonucleotide
ggtacatctggatggtcagcccttcctg

SEQ ID NO: 148679 - DNA, 28 bp, Artificial Sequence
  Description of Artificial Sequence: Synthetic oligonucleotide
gtacatctggatggtcagcccttcctgc

SEQ ID NO: 148680 - DNA, 28 bp, Artificial Sequence
  Description of Artificial Sequence: Synthetic oligonucleotide
tacatctggatggtcagcccttcctgcg

SEQ ID NO: 148681 - DNA, 27 bp, Artificial Sequence
  Description of Artificial Sequence: Synthetic oligonucleotide
acatctggatggtcagcccttcctgcg

SEQ ID NO: 148682 - DNA, 26 bp, Artificial Sequence
  Description of Artificial Sequence: Synthetic oligonucleotide
catctggatggtcagcccttcctgcg

SEQ ID NO: 148683 - DNA, 27 bp, Artificial Sequence
  Description of Artificial Sequence: Synthetic oligonucleotide
atctggatggtcagcccttcctgcgct

SEQ ID NO: 148684 - DNA, 26 bp, Artificial Sequence
  Description of Artificial Sequence: Synthetic oligonucleotide
tctggatggtcagcccttcctgcgct

SEQ ID NO: 148685 - DNA, 25 bp, Artificial Sequence
  Description of Artificial Sequence: Synthetic oligonucleotide
ctggatggtcagcccttcctgcgct

SEQ ID NO: 148686 - DNA, 26 bp, Artificial Sequence
  Description of Artificial Sequence: Synthetic oligonucleotide
tggatggtcagcccttcctgcgctgt

SEQ ID NO: 148687 - DNA, 25 bp, Artificial Sequence
  Description of Artificial Sequence: Synthetic oligonucleotide
ggatggtcagcccttcctgcgctgt

SEQ ID NO: 148688 - DNA, 26 bp, Artificial Sequence
  Description of Artificial Sequence: Synthetic oligonucleotide
gatggtcagcccttcctgcgctgtga

SEQ ID NO: 148689 - DNA, 27 bp, Artificial Sequence
  Description of Artificial Sequence: Synthetic oligonucleotide
atggtcagcccttcctgcgctgtgaca

SEQ ID NO: 148690 - DNA, 26 bp, Artificial Sequence
  Description of Artificial Sequence: Synthetic oligonucleotide
tggtcagcccttcctgcgctgtgaca

SEQ ID NO: 148691 - DNA, 25 bp, Artificial Sequence
  Description of Artificial Sequence: Synthetic oligonucleotide
ggtcagcccttcctgcgctgtgaca

SEQ ID NO: 148692 - DNA, 25 bp, Artificial Sequence
  Description of Artificial Sequence: Synthetic oligonucleotide
gtcagcccttcctgcgctgtgacag

SEQ ID NO: 148693 - DNA, 25 bp, Artificial Sequence
  Description of Artificial Sequence: Synthetic oligonucleotide
tcagcccttcctgcgctgtgacagg

SEQ ID NO: 148694 - DNA, 24 bp, Artificial Sequence
  Description of Artificial Sequence: Synthetic oligonucleotide
cagcccttcctgcgctgtgacagg

SEQ ID NO: 148695 - DNA, 25 bp, Artificial Sequence
  Description of Artificial Sequence: Synthetic oligonucleotide
agcccttcctgcgctgtgacaggca

SEQ ID NO: 148696 - DNA, 24 bp, Artificial Sequence
  Description of Artificial Sequence: Synthetic oligonucleotide
gcccttcctgcgctgtgacaggca

SEQ ID NO: 148697 - DNA, 27 bp, Artificial Sequence
  Description of Artificial Sequence: Synthetic oligonucleotide
cccttcctgcgctgtgacaggcagaaa

SEQ ID NO: 148698 - DNA, 28 bp, Artificial Sequence
  Description of Artificial Sequence: Synthetic oligonucleotide
ccttcctgcgctgtgacaggcagaaatg

SEQ ID NO: 148699 - DNA, 28 bp, Artificial Sequence
  Description of Artificial Sequence: Synthetic oligonucleotide
cttcctgcgctgtgacaggcagaaatgc

SEQ ID NO: 148700 - DNA, 29 bp, Artificial Sequence
  Description of Artificial Sequence: Synthetic oligonucleotide
ttcctgcgctgtgacaggcagaaatgcag

SEQ ID NO: 148701 - DNA, 28 bp, Artificial Sequence
  Description of Artificial Sequence: Synthetic oligonucleotide
tcctgcgctgtgacaggcagaaatgcag

SEQ ID NO: 148702 - DNA, 27 bp, Artificial Sequence
  Description of Artificial Sequence: Synthetic oligonucleotide
cctgcgctgtgacaggcagaaatgcag

SEQ ID NO: 148703 - DNA, 27 bp, Artificial Sequence
  Description of Artificial Sequence: Synthetic oligonucleotide
ctgcgctgtgacaggcagaaatgcagg

SEQ ID NO: 148704 - DNA, 27 bp, Artificial Sequence
  Description of Artificial Sequence: Synthetic oligonucleotide
tgcgctgtgacaggcagaaatgcaggg

SEQ ID NO: 148705 - DNA, 26 bp, Artificial Sequence
  Description of Artificial Sequence: Synthetic oligonucleotide
gcgctgtgacaggcagaaatgcaggg

SEQ ID NO: 148706 - DNA, 27 bp, Artificial Sequence
  Description of Artificial Sequence: Synthetic oligonucleotide
cgctgtgacaggcagaaatgcagggca

SEQ ID NO: 148707 - DNA, 29 bp, Artificial Sequence
  Description of Artificial Sequence: Synthetic oligonucleotide
gctgtgacaggcagaaatgcagggcaaag

SEQ ID NO: 148708 - DNA, 29 bp, Artificial Sequence
  Description of Artificial Sequence: Synthetic oligonucleotide
ctgtgacaggcagaaatgcagggcaaagc

SEQ ID NO: 148709 - DNA, 29 bp, Artificial Sequence
  Description of Artificial Sequence: Synthetic oligonucleotide
tgtgacaggcagaaatgcagggcaaagcc

SEQ ID NO: 148710 - DNA, 28 bp, Artificial Sequence
  Description of Artificial Sequence: Synthetic oligonucleotide
gtgacaggcagaaatgcagggcaaagcc

SEQ ID NO: 148711 - DNA, 28 bp, Artificial Sequence
  Description of Artificial Sequence: Synthetic oligonucleotide
tgacaggcagaaatgcagggcaaagccc

SEQ ID NO: 148712 - DNA, 27 bp, Artificial Sequence
  Description of Artificial Sequence: Synthetic oligonucleotide
gacaggcagaaatgcagggcaaagccc

SEQ ID NO: 148713 - DNA, 27 bp, Artificial Sequence
  Description of Artificial Sequence: Synthetic oligonucleotide
acaggcagaaatgcagggcaaagcccc

SEQ ID NO: 148714 - DNA, 27 bp, Artificial Sequence
  Description of Artificial Sequence: Synthetic oligonucleotide
caggcagaaatgcagggcaaagcccca

SEQ ID NO: 148715 - DNA, 27 bp, Artificial Sequence
  Description of Artificial Sequence: Synthetic oligonucleotide
aggcagaaatgcagggcaaagccccag

SEQ ID NO: 148716 - DNA, 26 bp, Artificial Sequence
  Description of Artificial Sequence: Synthetic oligonucleotide
ggcagaaatgcagggcaaagccccag

SEQ ID NO: 148717 - DNA, 26 bp, Artificial Sequence
  Description of Artificial Sequence: Synthetic oligonucleotide
gcagaaatgcagggcaaagccccagg

SEQ ID NO: 148718 - DNA, 27 bp, Artificial Sequence
  Description of Artificial Sequence: Synthetic oligonucleotide
cagaaatgcagggcaaagccccaggga

SEQ ID NO: 148719 - DNA, 27 bp, Artificial Sequence
  Description of Artificial Sequence: Synthetic oligonucleotide
agaaatgcagggcaaagccccagggac

SEQ ID NO: 148720 - DNA, 27 bp, Artificial Sequence
  Description of Artificial Sequence: Synthetic oligonucleotide
gaaatgcagggcaaagccccagggaca

SEQ ID NO: 148721 - DNA, 27 bp, Artificial Sequence
  Description of Artificial Sequence: Synthetic oligonucleotide
aaatgcagggcaaagccccagggacag

SEQ ID NO: 148722 - DNA, 27 bp, Artificial Sequence
  Description of Artificial Sequence: Synthetic oligonucleotide
aatgcagggcaaagccccagggacagt

SEQ ID NO: 148723 - DNA, 26 bp, Artificial Sequence
  Description of Artificial Sequence: Synthetic oligonucleotide
atgcagggcaaagccccagggacagt

SEQ ID NO: 148724 - DNA, 25 bp, Artificial Sequence
  Description of Artificial Sequence: Synthetic oligonucleotide
tgcagggcaaagccccagggacagt

SEQ ID NO: 148725 - DNA, 24 bp, Artificial Sequence
  Description of Artificial Sequence: Synthetic oligonucleotide
gcagggcaaagccccagggacagt

SEQ ID NO: 148726 - DNA, 24 bp, Artificial Sequence
  Description of Artificial Sequence: Synthetic oligonucleotide
cagggcaaagccccagggacagtg

SEQ ID NO: 148727 - DNA, 24 bp, Artificial Sequence
  Description of Artificial Sequence: Synthetic oligonucleotide
agggcaaagccccagggacagtgg

SEQ ID NO: 148728 - DNA, 23 bp, Artificial Sequence
  Description of Artificial Sequence: Synthetic oligonucleotide
gggcaaagccccagggacagtgg

SEQ ID NO: 148729 - DNA, 23 bp, Artificial Sequence
  Description of Artificial Sequence: Synthetic oligonucleotide
ggcaaagccccagggacagtggg

SEQ ID NO: 148730 - DNA, 24 bp, Artificial Sequence
  Description of Artificial Sequence: Synthetic oligonucleotide
gcaaagccccagggacagtgggca

SEQ ID NO: 148731 - DNA, 26 bp, Artificial Sequence
  Description of Artificial Sequence: Synthetic oligonucleotide
caaagccccagggacagtgggcagaa

SEQ ID NO: 148732 - DNA, 27 bp, Artificial Sequence
  Description of Artificial Sequence: Synthetic oligonucleotide
aaagccccagggacagtgggcagaaga

SEQ ID NO: 148733 - DNA, 27 bp, Artificial Sequence
  Description of Artificial Sequence: Synthetic oligonucleotide
aagccccagggacagtgggcagaagat

SEQ ID NO: 148734 - DNA, 26 bp, Artificial Sequence
  Description of Artificial Sequence: Synthetic oligonucleotide
agccccagggacagtgggcagaagat

SEQ ID NO: 148735 - DNA, 25 bp, Artificial Sequence
  Description of Artificial Sequence: Synthetic oligonucleotide
gccccagggacagtgggcagaagat

SEQ ID NO: 148736 - DNA, 26 bp, Artificial Sequence
  Description of Artificial Sequence: Synthetic oligonucleotide
ccccagggacagtgggcagaagatgt

SEQ ID NO: 148737 - DNA, 26 bp, Artificial Sequence
  Description of Artificial Sequence: Synthetic oligonucleotide
cccagggacagtgggcagaagatgtc

SEQ ID NO: 148738 - DNA, 27 bp, Artificial Sequence
  Description of Artificial Sequence: Synthetic oligonucleotide
ccagggacagtgggcagaagatgtcct

SEQ ID NO: 148739 - DNA, 27 bp, Artificial Sequence
  Description of Artificial Sequence: Synthetic oligonucleotide
cagggacagtgggcagaagatgtcctg

SEQ ID NO: 148740 - DNA, 27 bp, Artificial Sequence
  Description of Artificial Sequence: Synthetic oligonucleotide
agggacagtgggcagaagatgtcctgg

SEQ ID NO: 148741 - DNA, 26 bp, Artificial Sequence
  Description of Artificial Sequence: Synthetic oligonucleotide
gggacagtgggcagaagatgtcctgg

SEQ ID NO: 148742 - DNA, 27 bp, Artificial Sequence
  Description of Artificial Sequence: Synthetic oligonucleotide
ggacagtgggcagaagatgtcctggga

SEQ ID NO: 148743 - DNA, 32 bp, Artificial Sequence
  Description of Artificial Sequence: Synthetic oligonucleotide
gacagtgggcagaagatgtcctgggaaataag

SEQ ID NO: 148744 - DNA, 33 bp, Artificial Sequence
  Description of Artificial Sequence: Synthetic oligonucleotide
acagtgggcagaagatgtcctgggaaataagac

SEQ ID NO: 148745 - DNA, 32 bp, Artificial Sequence
  Description of Artificial Sequence: Synthetic oligonucleotide
cagtgggcagaagatgtcctgggaaataagac

SEQ ID NO: 148746 - DNA, 34 bp, Artificial Sequence
  Description of Artificial Sequence: Synthetic oligonucleotide
agtgggcagaagatgtcctgggaaataagacatg

SEQ ID NO: 148747 - DNA, 33 bp, Artificial Sequence
  Description of Artificial Sequence: Synthetic oligonucleotide
gtgggcagaagatgtcctgggaaataagacatg

SEQ ID NO: 148748 - DNA, 33 bp, Artificial Sequence
  Description of Artificial Sequence: Synthetic oligonucleotide
tgggcagaagatgtcctgggaaataagacatgg

SEQ ID NO: 148749 - DNA, 32 bp, Artificial Sequence
  Description of Artificial Sequence: Synthetic oligonucleotide
gggcagaagatgtcctgggaaataagacatgg

SEQ ID NO: 148750 - DNA, 32 bp, Artificial Sequence
  Description of Artificial Sequence: Synthetic oligonucleotide
ggcagaagatgtcctgggaaataagacatggg

SEQ ID NO: 148751 - DNA, 33 bp, Artificial Sequence
  Description of Artificial Sequence: Synthetic oligonucleotide
gcagaagatgtcctgggaaataagacatgggac

SEQ ID NO: 148752 - DNA, 34 bp, Artificial Sequence
  Description of Artificial Sequence: Synthetic oligonucleotide
cagaagatgtcctgggaaataagacatgggacag

SEQ ID NO: 148753 - DNA, 35 bp, Artificial Sequence
  Description of Artificial Sequence: Synthetic oligonucleotide
agaagatgtcctgggaaataagacatgggacagag

SEQ ID NO: 148754 - DNA, 34 bp, Artificial Sequence
  Description of Artificial Sequence: Synthetic oligonucleotide
gaagatgtcctgggaaataagacatgggacagag

SEQ ID NO: 148755 - DNA, 35 bp, Artificial Sequence
  Description of Artificial Sequence: Synthetic oligonucleotide
aagatgtcctgggaaataagacatgggacagagag

SEQ ID NO: 148756 - DNA, 34 bp, Artificial Sequence
  Description of Artificial Sequence: Synthetic oligonucleotide
agatgtcctgggaaataagacatgggacagagag

SEQ ID NO: 148757 - DNA, 33 bp, Artificial Sequence
  Description of Artificial Sequence: Synthetic oligonucleotide
gatgtcctgggaaataagacatgggacagagag

SEQ ID NO: 148758 - DNA, 34 bp, Artificial Sequence
  Description of Artificial Sequence: Synthetic oligonucleotide
atgtcctgggaaataagacatgggacagagagac

SEQ ID NO: 148759 - DNA, 33 bp, Artificial Sequence
  Description of Artificial Sequence: Synthetic oligonucleotide
tgtcctgggaaataagacatgggacagagagac

SEQ ID NO: 148760 - DNA, 32 bp, Artificial Sequence
  Description of Artificial Sequence: Synthetic oligonucleotide
gtcctgggaaataagacatgggacagagagac

SEQ ID NO: 148761 - DNA, 32 bp, Artificial Sequence
  Description of Artificial Sequence: Synthetic oligonucleotide
tcctgggaaataagacatgggacagagagacc

SEQ ID NO: 148762 - DNA, 31 bp, Artificial Sequence
  Description of Artificial Sequence: Synthetic oligonucleotide
cctgggaaataagacatgggacagagagacc

SEQ ID NO: 148763 - DNA, 32 bp, Artificial Sequence
  Description of Artificial Sequence: Synthetic oligonucleotide
ctgggaaataagacatgggacagagagaccag

SEQ ID NO: 148764 - DNA, 33 bp, Artificial Sequence
  Description of Artificial Sequence: Synthetic oligonucleotide
tgggaaataagacatgggacagagagaccagag

SEQ ID NO: 148765 - DNA, 32 bp, Artificial Sequence
  Description of Artificial Sequence: Synthetic oligonucleotide
gggaaataagacatgggacagagagaccagag

SEQ ID NO: 148766 - DNA, 33 bp, Artificial Sequence
  Description of Artificial Sequence: Synthetic oligonucleotide
ggaaataagacatgggacagagagaccagagac

SEQ ID NO: 148767 - DNA, 35 bp, Artificial Sequence
  Description of Artificial Sequence: Synthetic oligonucleotide
gaaataagacatgggacagagagaccagagacttg

SEQ ID NO: 148768 - DNA, 36 bp, Artificial Sequence
  Description of Artificial Sequence: Synthetic oligonucleotide
aaataagacatgggacagagagaccagagacttgac

SEQ ID NO: 148769 - DNA, 35 bp, Artificial Sequence
  Description of Artificial Sequence: Synthetic oligonucleotide
aataagacatgggacagagagaccagagacttgac

SEQ ID NO: 148770 - DNA, 34 bp, Artificial Sequence
  Description of Artificial Sequence: Synthetic oligonucleotide
ataagacatgggacagagagaccagagacttgac

SEQ ID NO: 148771 - DNA, 33 bp, Artificial Sequence
  Description of Artificial Sequence: Synthetic oligonucleotide
taagacatgggacagagagaccagagacttgac

SEQ ID NO: 148772 - DNA, 32 bp, Artificial Sequence
  Description of Artificial Sequence: Synthetic oligonucleotide
aagacatgggacagagagaccagagacttgac

SEQ ID NO: 148773 - DNA, 31 bp, Artificial Sequence
  Description of Artificial Sequence: Synthetic oligonucleotide
agacatgggacagagagaccagagacttgac

SEQ ID NO: 148774 - DNA, 30 bp, Artificial Sequence
  Description of Artificial Sequence: Synthetic oligonucleotide
gacatgggacagagagaccagagacttgac

SEQ ID NO: 148775 - DNA, 31 bp, Artificial Sequence
  Description of Artificial Sequence: Synthetic oligonucleotide
acatgggacagagagaccagagacttgacag

SEQ ID NO: 148776 - DNA, 30 bp, Artificial Sequence
  Description of Artificial Sequence: Synthetic oligonucleotide
catgggacagagagaccagagacttgacag

SEQ ID NO: 148777 - DNA, 30 bp, Artificial Sequence
  Description of Artificial Sequence: Synthetic oligonucleotide
atgggacagagagaccagagacttgacagg

SEQ ID NO: 148778 - DNA, 29 bp, Artificial Sequence
  Description of Artificial Sequence: Synthetic oligonucleotide
tgggacagagagaccagagacttgacagg

SEQ ID NO: 148779 - DNA, 28 bp, Artificial Sequence
  Description of Artificial Sequence: Synthetic oligonucleotide
gggacagagagaccagagacttgacagg

SEQ ID NO: 148780 - DNA, 28 bp, Artificial Sequence
  Description of Artificial Sequence: Synthetic oligonucleotide
ggacagagagaccagagacttgacaggg

SEQ ID NO: 148781 - DNA, 30 bp, Artificial Sequence
  Description of Artificial Sequence: Synthetic oligonucleotide
gacagagagaccagagacttgacagggaac

SEQ ID NO: 148782 - DNA, 30 bp, Artificial Sequence
  Description of Artificial Sequence: Synthetic oligonucleotide
acagagagaccagagacttgacagggaacg

SEQ ID NO: 148783 - DNA, 29 bp, Artificial Sequence
  Description of Artificial Sequence: Synthetic oligonucleotide
cagagagaccagagacttgacagggaacg

SEQ ID NO: 148784 - DNA, 29 bp, Artificial Sequence
  Description of Artificial Sequence: Synthetic oligonucleotide
agagagaccagagacttgacagggaacgg

SEQ ID NO: 148785 - DNA, 28 bp, Artificial Sequence
  Description of Artificial Sequence: Synthetic oligonucleotide
gagagaccagagacttgacagggaacgg

SEQ ID NO: 148786 - DNA, 31 bp, Artificial Sequence
  Description of Artificial Sequence: Synthetic oligonucleotide
agagaccagagacttgacagggaacggaaag

SEQ ID NO: 148787 - DNA, 30 bp, Artificial Sequence
  Description of Artificial Sequence: Synthetic oligonucleotide
gagaccagagacttgacagggaacggaaag

SEQ ID NO: 148788 - DNA, 30 bp, Artificial Sequence
  Description of Artificial Sequence: Synthetic oligonucleotide
agaccagagacttgacagggaacggaaagg

SEQ ID NO: 148789 - DNA, 29 bp, Artificial Sequence
  Description of Artificial Sequence: Synthetic oligonucleotide
gaccagagacttgacagggaacggaaagg

SEQ ID NO: 148790 - DNA, 30 bp, Artificial Sequence
  Description of Artificial Sequence: Synthetic oligonucleotide
accagagacttgacagggaacggaaaggac

SEQ ID NO: 148791 - DNA, 29 bp, Artificial Sequence
  Description of Artificial Sequence: Synthetic oligonucleotide
ccagagacttgacagggaacggaaaggac

SEQ ID NO: 148792 - DNA, 29 bp, Artificial Sequence
  Description of Artificial Sequence: Synthetic oligonucleotide
cagagacttgacagggaacggaaaggacc

SEQ ID NO: 148793 - DNA, 30 bp, Artificial Sequence
  Description of Artificial Sequence: Synthetic oligonucleotide
agagacttgacagggaacggaaaggacctc

SEQ ID NO: 148794 - DNA, 29 bp, Artificial Sequence
  Description of Artificial Sequence: Synthetic oligonucleotide
gagacttgacagggaacggaaaggacctc

SEQ ID NO: 148795 - DNA, 30 bp, Artificial Sequence
  Description of Artificial Sequence: Synthetic oligonucleotide
agacttgacagggaacggaaaggacctcag

SEQ ID NO: 148796 - DNA, 29 bp, Artificial Sequence
  Description of Artificial Sequence: Synthetic oligonucleotide
gacttgacagggaacggaaaggacctcag

SEQ ID NO: 148797 - DNA, 29 bp, Artificial Sequence
  Description of Artificial Sequence: Synthetic oligonucleotide
acttgacagggaacggaaaggacctcagg

SEQ ID NO: 148798 - DNA, 28 bp, Artificial Sequence
  Description of Artificial Sequence: Synthetic oligonucleotide
cttgacagggaacggaaaggacctcagg

SEQ ID NO: 148799 - DNA, 30 bp, Artificial Sequence
  Description of Artificial Sequence: Synthetic oligonucleotide
ttgacagggaacggaaaggacctcaggatg

SEQ ID NO: 148800 - DNA, 29 bp, Artificial Sequence
  Description of Artificial Sequence: Synthetic oligonucleotide
tgacagggaacggaaaggacctcaggatg

SEQ ID NO: 148801 - DNA, 28 bp, Artificial Sequence
  Description of Artificial Sequence: Synthetic oligonucleotide
gacagggaacggaaaggacctcaggatg

SEQ ID NO: 148802 - DNA, 29 bp, Artificial Sequence
  Description of Artificial Sequence: Synthetic oligonucleotide
acagggaacggaaaggacctcaggatgac

SEQ ID NO: 148803 - DNA, 28 bp, Artificial Sequence
  Description of Artificial Sequence: Synthetic oligonucleotide
cagggaacggaaaggacctcaggatgac

SEQ ID NO: 148804 - DNA, 28 bp, Artificial Sequence
  Description of Artificial Sequence: Synthetic oligonucleotide
agggaacggaaaggacctcaggatgacc

SEQ ID NO: 148805 - DNA, 27 bp, Artificial Sequence
  Description of Artificial Sequence: Synthetic oligonucleotide
gggaacggaaaggacctcaggatgacc

SEQ ID NO: 148806 - DNA, 27 bp, Artificial Sequence
  Description of Artificial Sequence: Synthetic oligonucleotide
ggaacggaaaggacctcaggatgaccc

SEQ ID NO: 148807 - DNA, 28 bp, Artificial Sequence
  Description of Artificial Sequence: Synthetic oligonucleotide
gaacggaaaggacctcaggatgaccctg

SEQ ID NO: 148808 - DNA, 28 bp, Artificial Sequence
  Description of Artificial Sequence: Synthetic oligonucleotide
aacggaaaggacctcaggatgaccctgg

SEQ ID NO: 148809 - DNA, 27 bp, Artificial Sequence
  Description of Artificial Sequence: Synthetic oligonucleotide
acggaaaggacctcaggatgaccctgg

SEQ ID NO: 148810 - DNA, 26 bp, Artificial Sequence
  Description of Artificial Sequence: Synthetic oligonucleotide
cggaaaggacctcaggatgaccctgg

SEQ ID NO: 148811 - DNA, 27 bp, Artificial Sequence
  Description of Artificial Sequence: Synthetic oligonucleotide
ggaaaggacctcaggatgaccctggct

SEQ ID NO: 148812 - DNA, 27 bp, Artificial Sequence
  Description of Artificial Sequence: Synthetic oligonucleotide
gaaaggacctcaggatgaccctggctc

SEQ ID NO: 148813 - DNA, 31 bp, Artificial Sequence
  Description of Artificial Sequence: Synthetic oligonucleotide
aaaggacctcaggatgaccctggctcatatc

SEQ ID NO: 148814 - DNA, 30 bp, Artificial Sequence
  Description of Artificial Sequence: Synthetic oligonucleotide
aaggacctcaggatgaccctggctcatatc

SEQ ID NO: 148815 - DNA, 29 bp, Artificial Sequence
  Description of Artificial Sequence: Synthetic oligonucleotide
aggacctcaggatgaccctggctcatatc

SEQ ID NO: 148816 - DNA, 28 bp, Artificial Sequence
  Description of Artificial Sequence: Synthetic oligonucleotide
ggacctcaggatgaccctggctcatatc

SEQ ID NO: 148817 - DNA, 30 bp, Artificial Sequence
  Description of Artificial Sequence: Synthetic oligonucleotide
gacctcaggatgaccctggctcatatcaag

SEQ ID NO: 148818 - DNA, 30 bp, Artificial Sequence
  Description of Artificial Sequence: Synthetic oligonucleotide
acctcaggatgaccctggctcatatcaagg

SEQ ID NO: 148819 - DNA, 29 bp, Artificial Sequence
  Description of Artificial Sequence: Synthetic oligonucleotide
cctcaggatgaccctggctcatatcaagg

SEQ ID NO: 148820 - DNA, 30 bp, Artificial Sequence
  Description of Artificial Sequence: Synthetic oligonucleotide
ctcaggatgaccctggctcatatcaaggac

SEQ ID NO: 148821 - DNA, 30 bp, Artificial Sequence
  Description of Artificial Sequence: Synthetic oligonucleotide
tcaggatgaccctggctcatatcaaggacc

SEQ ID NO: 148822 - DNA, 29 bp, Artificial Sequence
  Description of Artificial Sequence: Synthetic oligonucleotide
caggatgaccctggctcatatcaaggacc

SEQ ID NO: 148823 - DNA, 30 bp, Artificial Sequence
  Description of Artificial Sequence: Synthetic oligonucleotide
aggatgaccctggctcatatcaaggaccag

SEQ ID NO: 148824 - DNA, 29 bp, Artificial Sequence
  Description of Artificial Sequence: Synthetic oligonucleotide
ggatgaccctggctcatatcaaggaccag

SEQ ID NO: 148825 - DNA, 32 bp, Artificial Sequence
  Description of Artificial Sequence: Synthetic oligonucleotide
gatgaccctggctcatatcaaggaccagaaag

SEQ ID NO: 148826 - DNA, 34 bp, Artificial Sequence
  Description of Artificial Sequence: Synthetic oligonucleotide
atgaccctggctcatatcaaggaccagaaagaag

SEQ ID NO: 148827 - DNA, 33 bp, Artificial Sequence
  Description of Artificial Sequence: Synthetic oligonucleotide
tgaccctggctcatatcaaggaccagaaagaag

SEQ ID NO: 148828 - DNA, 32 bp, Artificial Sequence
  Description of Artificial Sequence: Synthetic oligonucleotide
gaccctggctcatatcaaggaccagaaagaag

SEQ ID NO: 148829 - DNA, 32 bp, Artificial Sequence
  Description of Artificial Sequence: Synthetic oligonucleotide
accctggctcatatcaaggaccagaaagaagg

SEQ ID NO: 148830 - DNA, 31 bp, Artificial Sequence
  Description of Artificial Sequence: Synthetic oligonucleotide
ccctggctcatatcaaggaccagaaagaagg

SEQ ID NO: 148831 - DNA, 31 bp, Artificial Sequence
  Description of Artificial Sequence: Synthetic oligonucleotide
cctggctcatatcaaggaccagaaagaaggc

SEQ ID NO: 148832 - DNA, 33 bp, Artificial Sequence
  Description of Artificial Sequence: Synthetic oligonucleotide
ctggctcatatcaaggaccagaaagaaggcttg

SEQ ID NO: 148833 - DNA, 33 bp, Artificial Sequence
  Description of Artificial Sequence: Synthetic oligonucleotide
tggctcatatcaaggaccagaaagaaggcttgc

SEQ ID NO: 148834 - DNA, 32 bp, Artificial Sequence
  Description of Artificial Sequence: Synthetic oligonucleotide
ggctcatatcaaggaccagaaagaaggcttgc

SEQ ID NO: 148835 - DNA, 35 bp, Artificial Sequence
  Description of Artificial Sequence: Synthetic oligonucleotide
gctcatatcaaggaccagaaagaaggcttgcattc

SEQ ID NO: 148836 - DNA, 35 bp, Artificial Sequence
  Description of Artificial Sequence: Synthetic oligonucleotide
ctcatatcaaggaccagaaagaaggcttgcattcc

SEQ ID NO: 148837 - DNA, 35 bp, Artificial Sequence
  Description of Artificial Sequence: Synthetic oligonucleotide
tcatatcaaggaccagaaagaaggcttgcattccc

SEQ ID NO: 148838 - DNA, 34 bp, Artificial Sequence
  Description of Artificial Sequence: Synthetic oligonucleotide
catatcaaggaccagaaagaaggcttgcattccc

SEQ ID NO: 148839 - DNA, 35 bp, Artificial Sequence
  Description of Artificial Sequence: Synthetic oligonucleotide
atatcaaggaccagaaagaaggcttgcattccctc

SEQ ID NO: 148840 - DNA, 34 bp, Artificial Sequence
  Description of Artificial Sequence: Synthetic oligonucleotide
tatcaaggaccagaaagaaggcttgcattccctc

SEQ ID NO: 148841 - DNA, 33 bp, Artificial Sequence
  Description of Artificial Sequence: Synthetic oligonucleotide
atcaaggaccagaaagaaggcttgcattccctc

SEQ ID NO: 148842 - DNA, 32 bp, Artificial Sequence
  Description of Artificial Sequence: Synthetic oligonucleotide
tcaaggaccagaaagaaggcttgcattccctc

SEQ ID NO: 148843 - DNA, 31 bp, Artificial Sequence
  Description of Artificial Sequence: Synthetic oligonucleotide
caaggaccagaaagaaggcttgcattccctc

SEQ ID NO: 148844 - DNA, 31 bp, Artificial Sequence
  Description of Artificial Sequence: Synthetic oligonucleotide
aaggaccagaaagaaggcttgcattccctcc

SEQ ID NO: 148845 - DNA, 30 bp, Artificial Sequence
  Description of Artificial Sequence: Synthetic oligonucleotide
aggaccagaaagaaggcttgcattccctcc

SEQ ID NO: 148846 - DNA, 29 bp, Artificial Sequence
  Description of Artificial Sequence: Synthetic oligonucleotide
ggaccagaaagaaggcttgcattccctcc

SEQ ID NO: 148847 - DNA, 30 bp, Artificial Sequence
  Description of Artificial Sequence: Synthetic oligonucleotide
gaccagaaagaaggcttgcattccctccag

SEQ ID NO: 148848 - DNA, 30 bp, Artificial Sequence
  Description of Artificial Sequence: Synthetic oligonucleotide
accagaaagaaggcttgcattccctccagg

SEQ ID NO: 148849 - DNA, 29 bp, Artificial Sequence
  Description of Artificial Sequence: Synthetic oligonucleotide
ccagaaagaaggcttgcattccctccagg

SEQ ID NO: 148850 - DNA, 30 bp, Artificial Sequence
  Description of Artificial Sequence: Synthetic oligonucleotide
cagaaagaaggcttgcattccctccaggag

SEQ ID NO: 148851 - DNA, 34 bp, Artificial Sequence
  Description of Artificial Sequence: Synthetic oligonucleotide
agaaagaaggcttgcattccctccaggagattag

SEQ ID NO: 148852 - DNA, 33 bp, Artificial Sequence
  Description of Artificial Sequence: Synthetic oligonucleotide
gaaagaaggcttgcattccctccaggagattag

SEQ ID NO: 148853 - DNA, 33 bp, Artificial Sequence
  Description of Artificial Sequence: Synthetic oligonucleotide
aaagaaggcttgcattccctccaggagattagg

SEQ ID NO: 148854 - DNA, 32 bp, Artificial Sequence
  Description of Artificial Sequence: Synthetic oligonucleotide
aagaaggcttgcattccctccaggagattagg

SEQ ID NO: 148855 - DNA, 31 bp, Artificial Sequence
  Description of Artificial Sequence: Synthetic oligonucleotide
agaaggcttgcattccctccaggagattagg

SEQ ID NO: 148856 - DNA, 30 bp, Artificial Sequence
  Description of Artificial Sequence: Synthetic oligonucleotide
gaaggcttgcattccctccaggagattagg

SEQ ID NO: 148857 - DNA, 30 bp, Artificial Sequence
  Description of Artificial Sequence: Synthetic oligonucleotide
aaggcttgcattccctccaggagattaggg

SEQ ID NO: 148858 - DNA, 29 bp, Artificial Sequence
  Description of Artificial Sequence: Synthetic oligonucleotide
aggcttgcattccctccaggagattaggg

SEQ ID NO: 148859 - DNA, 28 bp, Artificial Sequence
  Description of Artificial Sequence: Synthetic oligonucleotide
ggcttgcattccctccaggagattaggg

SEQ ID NO: 148860 - DNA, 29 bp, Artificial Sequence
  Description of Artificial Sequence: Synthetic oligonucleotide
gcttgcattccctccaggagattagggtc

SEQ ID NO: 148861 - DNA, 30 bp, Artificial Sequence
  Description of Artificial Sequence: Synthetic oligonucleotide
cttgcattccctccaggagattagggtctg

SEQ ID NO: 148862 - DNA, 31 bp, Artificial Sequence
  Description of Artificial Sequence: Synthetic oligonucleotide
ttgcattccctccaggagattagggtctgtg

SEQ ID NO: 148863 - DNA, 30 bp, Artificial Sequence
  Description of Artificial Sequence: Synthetic oligonucleotide
tgcattccctccaggagattagggtctgtg

SEQ ID NO: 148864 - DNA, 29 bp, Artificial Sequence
  Description of Artificial Sequence: Synthetic oligonucleotide
gcattccctccaggagattagggtctgtg

SEQ ID NO: 148865 - DNA, 30 bp, Artificial Sequence
  Description of Artificial Sequence: Synthetic oligonucleotide
cattccctccaggagattagggtctgtgag

SEQ ID NO: 148866 - DNA, 32 bp, Artificial Sequence
  Description of Artificial Sequence: Synthetic oligonucleotide
attccctccaggagattagggtctgtgagatc

SEQ ID NO: 148867 - DNA, 31 bp, Artificial Sequence
  Description of Artificial Sequence: Synthetic oligonucleotide
ttccctccaggagattagggtctgtgagatc

SEQ ID NO: 148868 - DNA, 30 bp, Artificial Sequence
  Description of Artificial Sequence: Synthetic oligonucleotide
tccctccaggagattagggtctgtgagatc

SEQ ID NO: 148869 - DNA, 29 bp, Artificial Sequence
  Description of Artificial Sequence: Synthetic oligonucleotide
ccctccaggagattagggtctgtgagatc

SEQ ID NO: 148870 - DNA, 29 bp, Artificial Sequence
  Description of Artificial Sequence: Synthetic oligonucleotide
cctccaggagattagggtctgtgagatcc

SEQ ID NO: 148871 - DNA, 31 bp, Artificial Sequence
  Description of Artificial Sequence: Synthetic oligonucleotide
ctccaggagattagggtctgtgagatccatg

SEQ ID NO: 148872 - DNA, 33 bp, Artificial Sequence
  Description of Artificial Sequence: Synthetic oligonucleotide
tccaggagattagggtctgtgagatccatgaag

SEQ ID NO: 148873 - DNA, 32 bp, Artificial Sequence
  Description of Artificial Sequence: Synthetic oligonucleotide
ccaggagattagggtctgtgagatccatgaag

SEQ ID NO: 148874 - DNA, 33 bp, Artificial Sequence
  Description of Artificial Sequence: Synthetic oligonucleotide
caggagattagggtctgtgagatccatgaagac

SEQ ID NO: 148875 - DNA, 35 bp, Artificial Sequence
  Description of Artificial Sequence: Synthetic oligonucleotide
aggagattagggtctgtgagatccatgaagacaac

SEQ ID NO: 148876 - DNA, 34 bp, Artificial Sequence
  Description of Artificial Sequence: Synthetic oligonucleotide
ggagattagggtctgtgagatccatgaagacaac

SEQ ID NO: 148877 - DNA, 35 bp, Artificial Sequence
  Description of Artificial Sequence: Synthetic oligonucleotide
gagattagggtctgtgagatccatgaagacaacag

SEQ ID NO: 148878 - DNA, 35 bp, Artificial Sequence
  Description of Artificial Sequence: Synthetic oligonucleotide
agattagggtctgtgagatccatgaagacaacagc

SEQ ID NO: 148879 - DNA, 34 bp, Artificial Sequence
  Description of Artificial Sequence: Synthetic oligonucleotide
gattagggtctgtgagatccatgaagacaacagc

SEQ ID NO: 148880 - DNA, 35 bp, Artificial Sequence
  Description of Artificial Sequence: Synthetic oligonucleotide
attagggtctgtgagatccatgaagacaacagcac

SEQ ID NO: 148881 - DNA, 34 bp, Artificial Sequence
  Description of Artificial Sequence: Synthetic oligonucleotide
ttagggtctgtgagatccatgaagacaacagcac

SEQ ID NO: 148882 - DNA, 33 bp, Artificial Sequence
  Description of Artificial Sequence: Synthetic oligonucleotide
tagggtctgtgagatccatgaagacaacagcac

SEQ ID NO: 148883 - DNA, 32 bp, Artificial Sequence
  Description of Artificial Sequence: Synthetic oligonucleotide
agggtctgtgagatccatgaagacaacagcac

SEQ ID NO: 148884 - DNA, 31 bp, Artificial Sequence
  Description of Artificial Sequence: Synthetic oligonucleotide
gggtctgtgagatccatgaagacaacagcac

SEQ ID NO: 148885 - DNA, 31 bp, Artificial Sequence
  Description of Artificial Sequence: Synthetic oligonucleotide
ggtctgtgagatccatgaagacaacagcacc

SEQ ID NO: 148886 - DNA, 32 bp, Artificial Sequence
  Description of Artificial Sequence: Synthetic oligonucleotide
gtctgtgagatccatgaagacaacagcaccag

SEQ ID NO: 148887 - DNA, 32 bp, Artificial Sequence
  Description of Artificial Sequence: Synthetic oligonucleotide
tctgtgagatccatgaagacaacagcaccagg

SEQ ID NO: 148888 - DNA, 31 bp, Artificial Sequence
  Description of Artificial Sequence: Synthetic oligonucleotide
ctgtgagatccatgaagacaacagcaccagg

SEQ ID NO: 148889 - DNA, 32 bp, Artificial Sequence
  Description of Artificial Sequence: Synthetic oligonucleotide
tgtgagatccatgaagacaacagcaccaggag

SEQ ID NO: 148890 - DNA, 31 bp, Artificial Sequence
  Description of Artificial Sequence: Synthetic oligonucleotide
gtgagatccatgaagacaacagcaccaggag

SEQ ID NO: 148891 - DNA, 31 bp, Artificial Sequence
  Description of Artificial Sequence: Synthetic oligonucleotide
tgagatccatgaagacaacagcaccaggagc

SEQ ID NO: 148892 - DNA, 30 bp, Artificial Sequence
  Description of Artificial Sequence: Synthetic oligonucleotide
gagatccatgaagacaacagcaccaggagc

SEQ ID NO: 148893 - DNA, 31 bp, Artificial Sequence
  Description of Artificial Sequence: Synthetic oligonucleotide
agatccatgaagacaacagcaccaggagctc

SEQ ID NO: 148894 - DNA, 30 bp, Artificial Sequence
  Description of Artificial Sequence: Synthetic oligonucleotide
gatccatgaagacaacagcaccaggagctc

SEQ ID NO: 148895 - DNA, 30 bp, Artificial Sequence
  Description of Artificial Sequence: Synthetic oligonucleotide
atccatgaagacaacagcaccaggagctcc

SEQ ID NO: 148896 - DNA, 29 bp, Artificial Sequence
  Description of Artificial Sequence: Synthetic oligonucleotide
tccatgaagacaacagcaccaggagctcc

SEQ ID NO: 148897 - DNA, 28 bp, Artificial Sequence
  Description of Artificial Sequence: Synthetic oligonucleotide
ccatgaagacaacagcaccaggagctcc

SEQ ID NO: 148898 - DNA, 28 bp, Artificial Sequence
  Description of Artificial Sequence: Synthetic oligonucleotide
catgaagacaacagcaccaggagctccc

SEQ ID NO: 148899 - DNA, 29 bp, Artificial Sequence
  Description of Artificial Sequence: Synthetic oligonucleotide
atgaagacaacagcaccaggagctcccag

SEQ ID NO: 148900 - DNA, 28 bp, Artificial Sequence
  Description of Artificial Sequence: Synthetic oligonucleotide
tgaagacaacagcaccaggagctcccag

SEQ ID NO: 148901 - DNA, 27 bp, Artificial Sequence
  Description of Artificial Sequence: Synthetic oligonucleotide
gaagacaacagcaccaggagctcccag

SEQ ID NO: 148902 - DNA, 27 bp, Artificial Sequence
  Description of Artificial Sequence: Synthetic oligonucleotide
aagacaacagcaccaggagctcccagc

SEQ ID NO: 148903 - DNA, 27 bp, Artificial Sequence
  Description of Artificial Sequence: Synthetic oligonucleotide
agacaacagcaccaggagctcccagca

SEQ ID NO: 148904 - DNA, 27 bp, Artificial Sequence
  Description of Artificial Sequence: Synthetic oligonucleotide
gacaacagcaccaggagctcccagcat

SEQ ID NO: 148905 - DNA, 29 bp, Artificial Sequence
  Description of Artificial Sequence: Synthetic oligonucleotide
acaacagcaccaggagctcccagcatttc

SEQ ID NO: 148906 - DNA, 28 bp, Artificial Sequence
  Description of Artificial Sequence: Synthetic oligonucleotide
caacagcaccaggagctcccagcatttc

SEQ ID NO: 148907 - DNA, 30 bp, Artificial Sequence
  Description of Artificial Sequence: Synthetic oligonucleotide
aacagcaccaggagctcccagcatttctac

SEQ ID NO: 148908 - DNA, 29 bp, Artificial Sequence
  Description of Artificial Sequence: Synthetic oligonucleotide
acagcaccaggagctcccagcatttctac

SEQ ID NO: 148909 - DNA, 28 bp, Artificial Sequence
  Description of Artificial Sequence: Synthetic oligonucleotide
cagcaccaggagctcccagcatttctac

SEQ ID NO: 148910 - DNA, 30 bp, Artificial Sequence
  Description of Artificial Sequence: Synthetic oligonucleotide
agcaccaggagctcccagcatttctactac

SEQ ID NO: 148911 - DNA, 29 bp, Artificial Sequence
  Description of Artificial Sequence: Synthetic oligonucleotide
gcaccaggagctcccagcatttctactac

SEQ ID NO: 148912 - DNA, 29 bp, Artificial Sequence
  Description of Artificial Sequence: Synthetic oligonucleotide
caccaggagctcccagcatttctactacg

SEQ ID NO: 148913 - DNA, 31 bp, Artificial Sequence
  Description of Artificial Sequence: Synthetic oligonucleotide
accaggagctcccagcatttctactacgatg

SEQ ID NO: 148914 - DNA, 30 bp, Artificial Sequence
  Description of Artificial Sequence: Synthetic oligonucleotide
ccaggagctcccagcatttctactacgatg

SEQ ID NO: 148915 - DNA, 30 bp, Artificial Sequence
  Description of Artificial Sequence: Synthetic oligonucleotide
caggagctcccagcatttctactacgatgg

SEQ ID NO: 148916 - DNA, 30 bp, Artificial Sequence
  Description of Artificial Sequence: Synthetic oligonucleotide
aggagctcccagcatttctactacgatggg

SEQ ID NO: 148917 - DNA, 29 bp, Artificial Sequence
  Description of Artificial Sequence: Synthetic oligonucleotide
ggagctcccagcatttctactacgatggg

SEQ ID NO: 148918 - DNA, 29 bp, Artificial Sequence
  Description of Artificial Sequence: Synthetic oligonucleotide
gagctcccagcatttctactacgatgggg

SEQ ID NO: 148919 - DNA, 30 bp, Artificial Sequence
  Description of Artificial Sequence: Synthetic oligonucleotide
agctcccagcatttctactacgatggggag

SEQ ID NO: 148920 - DNA, 29 bp, Artificial Sequence
  Description of Artificial Sequence: Synthetic oligonucleotide
gctcccagcatttctactacgatggggag

SEQ ID NO: 148921 - DNA, 29 bp, Artificial Sequence
  Description of Artificial Sequence: Synthetic oligonucleotide
ctcccagcatttctactacgatggggagc

SEQ ID NO: 148922 - DNA, 30 bp, Artificial Sequence
  Description of Artificial Sequence: Synthetic oligonucleotide
tcccagcatttctactacgatggggagctc

SEQ ID NO: 148923 - DNA, 29 bp, Artificial Sequence
  Description of Artificial Sequence: Synthetic oligonucleotide
cccagcatttctactacgatggggagctc

SEQ ID NO: 148924 - DNA, 31 bp, Artificial Sequence
  Description of Artificial Sequence: Synthetic oligonucleotide
ccagcatttctactacgatggggagctcttc

SEQ ID NO: 148925 - DNA, 31 bp, Artificial Sequence
  Description of Artificial Sequence: Synthetic oligonucleotide
cagcatttctactacgatggggagctcttcc

SEQ ID NO: 148926 - DNA, 32 bp, Artificial Sequence
  Description of Artificial Sequence: Synthetic oligonucleotide
agcatttctactacgatggggagctcttcctc

SEQ ID NO: 148927 - DNA, 31 bp, Artificial Sequence
  Description of Artificial Sequence: Synthetic oligonucleotide
gcatttctactacgatggggagctcttcctc

SEQ ID NO: 148928 - DNA, 32 bp, Artificial Sequence
  Description of Artificial Sequence: Synthetic oligonucleotide
catttctactacgatggggagctcttcctctc

SEQ ID NO: 148929 - DNA, 32 bp, Artificial Sequence
  Description of Artificial Sequence: Synthetic oligonucleotide
atttctactacgatggggagctcttcctctcc

SEQ ID NO: 148930 - DNA, 31 bp, Artificial Sequence
  Description of Artificial Sequence: Synthetic oligonucleotide
tttctactacgatggggagctcttcctctcc

SEQ ID NO: 148931 - DNA, 30 bp, Artificial Sequence
  Description of Artificial Sequence: Synthetic oligonucleotide
ttctactacgatggggagctcttcctctcc

SEQ ID NO: 148932 - DNA, 29 bp, Artificial Sequence
  Description of Artificial Sequence: Synthetic oligonucleotide
tctactacgatggggagctcttcctctcc

SEQ ID NO: 148933 - DNA, 28 bp, Artificial Sequence
  Description of Artificial Sequence: Synthetic oligonucleotide
ctactacgatggggagctcttcctctcc

SEQ ID NO: 148934 - DNA, 28 bp, Artificial Sequence
  Description of Artificial Sequence: Synthetic oligonucleotide
tactacgatggggagctcttcctctccc

SEQ ID NO: 148935 - DNA, 27 bp, Artificial Sequence
  Description of Artificial Sequence: Synthetic oligonucleotide
actacgatggggagctcttcctctccc

SEQ ID NO: 148936 - DNA, 27 bp, Artificial Sequence
  Description of Artificial Sequence: Synthetic oligonucleotide
ctacgatggggagctcttcctctccca

SEQ ID NO: 148937 - DNA, 30 bp, Artificial Sequence
  Description of Artificial Sequence: Synthetic oligonucleotide
tacgatggggagctcttcctctcccaaaac

SEQ ID NO: 148938 - DNA, 29 bp, Artificial Sequence
  Description of Artificial Sequence: Synthetic oligonucleotide
acgatggggagctcttcctctcccaaaac

SEQ ID NO: 148939 - DNA, 28 bp, Artificial Sequence
  Description of Artificial Sequence: Synthetic oligonucleotide
cgatggggagctcttcctctcccaaaac

SEQ ID NO: 148940 - DNA, 28 bp, Artificial Sequence
  Description of Artificial Sequence: Synthetic oligonucleotide
gatggggagctcttcctctcccaaaacc

SEQ ID NO: 148941 - DNA, 29 bp, Artificial Sequence
  Description of Artificial Sequence: Synthetic oligonucleotide
atggggagctcttcctctcccaaaacctg

SEQ ID NO: 148942 - DNA, 28 bp, Artificial Sequence
  Description of Artificial Sequence: Synthetic oligonucleotide
tggggagctcttcctctcccaaaacctg

SEQ ID NO: 148943 - DNA, 27 bp, Artificial Sequence
  Description of Artificial Sequence: Synthetic oligonucleotide
ggggagctcttcctctcccaaaacctg

SEQ ID NO: 148944 - DNA, 27 bp, Artificial Sequence
  Description of Artificial Sequence: Synthetic oligonucleotide
gggagctcttcctctcccaaaacctgg

SEQ ID NO: 148945 - DNA, 28 bp, Artificial Sequence
  Description of Artificial Sequence: Synthetic oligonucleotide
ggagctcttcctctcccaaaacctggag

SEQ ID NO: 148946 - DNA, 29 bp, Artificial Sequence
  Description of Artificial Sequence: Synthetic oligonucleotide
gagctcttcctctcccaaaacctggagac

SEQ ID NO: 148947 - DNA, 32 bp, Artificial Sequence
  Description of Artificial Sequence: Synthetic oligonucleotide
agctcttcctctcccaaaacctggagactaag

SEQ ID NO: 148948 - DNA, 31 bp, Artificial Sequence
  Description of Artificial Sequence: Synthetic oligonucleotide
gctcttcctctcccaaaacctggagactaag

SEQ ID NO: 148949 - DNA, 31 bp, Artificial Sequence
  Description of Artificial Sequence: Synthetic oligonucleotide
ctcttcctctcccaaaacctggagactaagg

SEQ ID NO: 148950 - DNA, 34 bp, Artificial Sequence
  Description of Artificial Sequence: Synthetic oligonucleotide
tcttcctctcccaaaacctggagactaaggaatg

SEQ ID NO: 148951 - DNA, 33 bp, Artificial Sequence
  Description of Artificial Sequence: Synthetic oligonucleotide
cttcctctcccaaaacctggagactaaggaatg

SEQ ID NO: 148952 - DNA, 33 bp, Artificial Sequence
  Description of Artificial Sequence: Synthetic oligonucleotide
ttcctctcccaaaacctggagactaaggaatgg

SEQ ID NO: 148953 - DNA, 32 bp, Artificial Sequence
  Description of Artificial Sequence: Synthetic oligonucleotide
tcctctcccaaaacctggagactaaggaatgg

SEQ ID NO: 148954 - DNA, 31 bp, Artificial Sequence
  Description of Artificial Sequence: Synthetic oligonucleotide
cctctcccaaaacctggagactaaggaatgg

SEQ ID NO: 148955 - DNA, 32 bp, Artificial Sequence
  Description of Artificial Sequence: Synthetic oligonucleotide
ctctcccaaaacctggagactaaggaatggac

SEQ ID NO: 148956 - DNA, 35 bp, Artificial Sequence
  Description of Artificial Sequence: Synthetic oligonucleotide
tctcccaaaacctggagactaaggaatggacaatg

SEQ ID NO: 148957 - DNA, 34 bp, Artificial Sequence
  Description of Artificial Sequence: Synthetic oligonucleotide
ctcccaaaacctggagactaaggaatggacaatg

SEQ ID NO: 148958 - DNA, 34 bp, Artificial Sequence
  Description of Artificial Sequence: Synthetic oligonucleotide
tcccaaaacctggagactaaggaatggacaatgc

SEQ ID NO: 148959 - DNA, 33 bp, Artificial Sequence
  Description of Artificial Sequence: Synthetic oligonucleotide
cccaaaacctggagactaaggaatggacaatgc

SEQ ID NO: 148960 - DNA, 33 bp, Artificial Sequence
  Description of Artificial Sequence: Synthetic oligonucleotide
ccaaaacctggagactaaggaatggacaatgcc

SEQ ID NO: 148961 - DNA, 33 bp, Artificial Sequence
  Description of Artificial Sequence: Synthetic oligonucleotide
caaaacctggagactaaggaatggacaatgccc

SEQ ID NO: 148962 - DNA, 33 bp, Artificial Sequence
  Description of Artificial Sequence: Synthetic oligonucleotide
aaaacctggagactaaggaatggacaatgcccc

SEQ ID NO: 148963 - DNA, 32 bp, Artificial Sequence
  Description of Artificial Sequence: Synthetic oligonucleotide
aaacctggagactaaggaatggacaatgcccc

SEQ ID NO: 148964 - DNA, 31 bp, Artificial Sequence
  Description of Artificial Sequence: Synthetic oligonucleotide
aacctggagactaaggaatggacaatgcccc

SEQ ID NO: 148965 - DNA, 30 bp, Artificial Sequence
  Description of Artificial Sequence: Synthetic oligonucleotide
acctggagactaaggaatggacaatgcccc

SEQ ID NO: 148966 - DNA, 29 bp, Artificial Sequence
  Description of Artificial Sequence: Synthetic oligonucleotide
cctggagactaaggaatggacaatgcccc

SEQ ID NO: 148967 - DNA, 30 bp, Artificial Sequence
  Description of Artificial Sequence: Synthetic oligonucleotide
ctggagactaaggaatggacaatgccccag

SEQ ID NO: 148968 - DNA, 31 bp, Artificial Sequence
  Description of Artificial Sequence: Synthetic oligonucleotide
tggagactaaggaatggacaatgccccagtc

SEQ ID NO: 148969 - DNA, 30 bp, Artificial Sequence
  Description of Artificial Sequence: Synthetic oligonucleotide
ggagactaaggaatggacaatgccccagtc

SEQ ID NO: 148970 - DNA, 30 bp, Artificial Sequence
  Description of Artificial Sequence: Synthetic oligonucleotide
gagactaaggaatggacaatgccccagtcc

SEQ ID NO: 148971 - DNA, 31 bp, Artificial Sequence
  Description of Artificial Sequence: Synthetic oligonucleotide
agactaaggaatggacaatgccccagtcctc

SEQ ID NO: 148972 - DNA, 30 bp, Artificial Sequence
  Description of Artificial Sequence: Synthetic oligonucleotide
gactaaggaatggacaatgccccagtcctc

SEQ ID NO: 148973 - DNA, 30 bp, Artificial Sequence
  Description of Artificial Sequence: Synthetic oligonucleotide
actaaggaatggacaatgccccagtcctcc

SEQ ID NO: 148974 - DNA, 29 bp, Artificial Sequence
  Description of Artificial Sequence: Synthetic oligonucleotide
ctaaggaatggacaatgccccagtcctcc

SEQ ID NO: 148975 - DNA, 30 bp, Artificial Sequence
  Description of Artificial Sequence: Synthetic oligonucleotide
taaggaatggacaatgccccagtcctccag

SEQ ID NO: 148976 - DNA, 29 bp, Artificial Sequence
  Description of Artificial Sequence: Synthetic oligonucleotide
aaggaatggacaatgccccagtcctccag

SEQ ID NO: 148977 - DNA, 28 bp, Artificial Sequence
  Description of Artificial Sequence: Synthetic oligonucleotide
aggaatggacaatgccccagtcctccag

SEQ ID NO: 148978 - DNA, 27 bp, Artificial Sequence
  Description of Artificial Sequence: Synthetic oligonucleotide
ggaatggacaatgccccagtcctccag

SEQ ID NO: 148979 - DNA, 28 bp, Artificial Sequence
  Description of Artificial Sequence: Synthetic oligonucleotide
gaatggacaatgccccagtcctccagag

SEQ ID NO: 148980 - DNA, 28 bp, Artificial Sequence
  Description of Artificial Sequence: Synthetic oligonucleotide
aatggacaatgccccagtcctccagagc

SEQ ID NO: 148981 - DNA, 27 bp, Artificial Sequence
  Description of Artificial Sequence: Synthetic oligonucleotide
atggacaatgccccagtcctccagagc

SEQ ID NO: 148982 - DNA, 27 bp, Artificial Sequence
  Description of Artificial Sequence: Synthetic oligonucleotide
tggacaatgccccagtcctccagagct

SEQ ID NO: 148983 - DNA, 26 bp, Artificial Sequence
  Description of Artificial Sequence: Synthetic oligonucleotide
ggacaatgccccagtcctccagagct

SEQ ID NO: 148984 - DNA, 27 bp, Artificial Sequence
  Description of Artificial Sequence: Synthetic oligonucleotide
gacaatgccccagtcctccagagctca

SEQ ID NO: 148985 - DNA, 27 bp, Artificial Sequence
  Description of Artificial Sequence: Synthetic oligonucleotide
acaatgccccagtcctccagagctcag

SEQ ID NO: 148986 - DNA, 27 bp, Artificial Sequence
  Description of Artificial Sequence: Synthetic oligonucleotide
caatgccccagtcctccagagctcaga

SEQ ID NO: 148987 - DNA, 27 bp, Artificial Sequence
  Description of Artificial Sequence: Synthetic oligonucleotide
aatgccccagtcctccagagctcagac

SEQ ID NO: 148988 - DNA, 26 bp, Artificial Sequence
  Description of Artificial Sequence: Synthetic oligonucleotide
atgccccagtcctccagagctcagac

SEQ ID NO: 148989 - DNA, 25 bp, Artificial Sequence
  Description of Artificial Sequence: Synthetic oligonucleotide
tgccccagtcctccagagctcagac

SEQ ID NO: 148990 - DNA, 24 bp, Artificial Sequence
  Description of Artificial Sequence: Synthetic oligonucleotide
gccccagtcctccagagctcagac

SEQ ID NO: 148991 - DNA, 26 bp, Artificial Sequence
  Description of Artificial Sequence: Synthetic oligonucleotide
ccccagtcctccagagctcagacctt

SEQ ID NO: 148992 - DNA, 26 bp, Artificial Sequence
  Description of Artificial Sequence: Synthetic oligonucleotide
cccagtcctccagagctcagaccttg

SEQ ID NO: 148993 - DNA, 26 bp, Artificial Sequence
  Description of Artificial Sequence: Synthetic oligonucleotide
ccagtcctccagagctcagaccttgg

SEQ ID NO: 148994 - DNA, 26 bp, Artificial Sequence
  Description of Artificial Sequence: Synthetic oligonucleotide
cagtcctccagagctcagaccttggc

SEQ ID NO: 148995 - DNA, 27 bp, Artificial Sequence
  Description of Artificial Sequence: Synthetic oligonucleotide
agtcctccagagctcagaccttggcca

SEQ ID NO: 148996 - DNA, 27 bp, Artificial Sequence
  Description of Artificial Sequence: Synthetic oligonucleotide
gtcctccagagctcagaccttggccat

SEQ ID NO: 148997 - DNA, 27 bp, Artificial Sequence
  Description of Artificial Sequence: Synthetic oligonucleotide
tcctccagagctcagaccttggccatg

SEQ ID NO: 148998 - DNA, 27 bp, Artificial Sequence
  Description of Artificial Sequence: Synthetic oligonucleotide
cctccagagctcagaccttggccatga

SEQ ID NO: 148999 - DNA, 28 bp, Artificial Sequence
  Description of Artificial Sequence: Synthetic oligonucleotide
ctccagagctcagaccttggccatgaac

SEQ ID NO: 149000 - DNA, 28 bp, Artificial Sequence
  Description of Artificial Sequence: Synthetic oligonucleotide
tccagagctcagaccttggccatgaacg

SEQ ID NO: 149001 - DNA, 27 bp, Artificial Sequence
  Description of Artificial Sequence: Synthetic oligonucleotide
ccagagctcagaccttggccatgaacg

SEQ ID NO: 149002 - DNA, 28 bp, Artificial Sequence
  Description of Artificial Sequence: Synthetic oligonucleotide
cagagctcagaccttggccatgaacgtc

SEQ ID NO: 149003 - DNA, 29 bp, Artificial Sequence
  Description of Artificial Sequence: Synthetic oligonucleotide
agagctcagaccttggccatgaacgtcag

SEQ ID NO: 149004 - DNA, 28 bp, Artificial Sequence
  Description of Artificial Sequence: Synthetic oligonucleotide
gagctcagaccttggccatgaacgtcag

SEQ ID NO: 149005 - DNA, 28 bp, Artificial Sequence
  Description of Artificial Sequence: Synthetic oligonucleotide
agctcagaccttggccatgaacgtcagg

SEQ ID NO: 149006 - DNA, 27 bp, Artificial Sequence
  Description of Artificial Sequence: Synthetic oligonucleotide
gctcagaccttggccatgaacgtcagg

SEQ ID NO: 149007 - DNA, 32 bp, Artificial Sequence
  Description of Artificial Sequence: Synthetic oligonucleotide
ctcagaccttggccatgaacgtcaggaatttc

SEQ ID NO: 149008 - DNA, 34 bp, Artificial Sequence
  Description of Artificial Sequence: Synthetic oligonucleotide
tcagaccttggccatgaacgtcaggaatttcttg

SEQ ID NO: 149009 - DNA, 33 bp, Artificial Sequence
  Description of Artificial Sequence: Synthetic oligonucleotide
cagaccttggccatgaacgtcaggaatttcttg

SEQ ID NO: 149010 - DNA, 35 bp, Artificial Sequence
  Description of Artificial Sequence: Synthetic oligonucleotide
agaccttggccatgaacgtcaggaatttcttgaag

SEQ ID NO: 149011 - DNA, 34 bp, Artificial Sequence
  Description of Artificial Sequence: Synthetic oligonucleotide
gaccttggccatgaacgtcaggaatttcttgaag

SEQ ID NO: 149012 - DNA, 34 bp, Artificial Sequence
  Description of Artificial Sequence: Synthetic oligonucleotide
accttggccatgaacgtcaggaatttcttgaagg

SEQ ID NO: 149013 - DNA, 33 bp, Artificial Sequence
  Description of Artificial Sequence: Synthetic oligonucleotide
ccttggccatgaacgtcaggaatttcttgaagg

SEQ ID NO: 149014 - DNA, 35 bp, Artificial Sequence
  Description of Artificial Sequence: Synthetic oligonucleotide
cttggccatgaacgtcaggaatttcttgaaggaag

SEQ ID NO: 149015 - DNA, 37 bp, Artificial Sequence
  Description of Artificial Sequence: Synthetic oligonucleotide
ttggccatgaacgtcaggaatttcttgaaggaagatg

SEQ ID NO: 149016 - DNA, 36 bp, Artificial Sequence
  Description of Artificial Sequence: Synthetic oligonucleotide
tggccatgaacgtcaggaatttcttgaaggaagatg

SEQ ID NO: 149017 - DNA, 35 bp, Artificial Sequence
  Description of Artificial Sequence: Synthetic oligonucleotide
ggccatgaacgtcaggaatttcttgaaggaagatg

SEQ ID NO: 149018 - DNA, 35 bp, Artificial Sequence
  Description of Artificial Sequence: Synthetic oligonucleotide
gccatgaacgtcaggaatttcttgaaggaagatgc

SEQ ID NO: 149019 - DNA, 35 bp, Artificial Sequence
  Description of Artificial Sequence: Synthetic oligonucleotide
ccatgaacgtcaggaatttcttgaaggaagatgcc

SEQ ID NO: 149020 - DNA, 37 bp, Artificial Sequence
  Description of Artificial Sequence: Synthetic oligonucleotide
catgaacgtcaggaatttcttgaaggaagatgccatg

SEQ ID NO: 149021 - DNA, 39 bp, Artificial Sequence
  Description of Artificial Sequence: Synthetic oligonucleotide
atgaacgtcaggaatttcttgaaggaagatgccatgaag

SEQ ID NO: 149022 - DNA, 38 bp, Artificial Sequence
  Description of Artificial Sequence: Synthetic oligonucleotide
tgaacgtcaggaatttcttgaaggaagatgccatgaag

SEQ ID NO: 149023 - DNA, 37 bp, Artificial Sequence
  Description of Artificial Sequence: Synthetic oligonucleotide
gaacgtcaggaatttcttgaaggaagatgccatgaag

SEQ ID NO: 149024 - DNA, 38 bp, Artificial Sequence
  Description of Artificial Sequence: Synthetic oligonucleotide
aacgtcaggaatttcttgaaggaagatgccatgaagac

SEQ ID NO: 149025 - DNA, 37 bp, Artificial Sequence
  Description of Artificial Sequence: Synthetic oligonucleotide
acgtcaggaatttcttgaaggaagatgccatgaagac

SEQ ID NO: 149026 - DNA, 36 bp, Artificial Sequence
  Description of Artificial Sequence: Synthetic oligonucleotide
cgtcaggaatttcttgaaggaagatgccatgaagac

SEQ ID NO: 149027 - DNA, 36 bp, Artificial Sequence
  Description of Artificial Sequence: Synthetic oligonucleotide
gtcaggaatttcttgaaggaagatgccatgaagacc

SEQ ID NO: 149028 - DNA, 38 bp, Artificial Sequence
  Description of Artificial Sequence: Synthetic oligonucleotide
tcaggaatttcttgaaggaagatgccatgaagaccaag

SEQ ID NO: 149029 - DNA, 37 bp, Artificial Sequence
  Description of Artificial Sequence: Synthetic oligonucleotide
caggaatttcttgaaggaagatgccatgaagaccaag

SEQ ID NO: 149030 - DNA, 38 bp, Artificial Sequence
  Description of Artificial Sequence: Synthetic oligonucleotide
aggaatttcttgaaggaagatgccatgaagaccaagac

SEQ ID NO: 149031 - DNA, 37 bp, Artificial Sequence
  Description of Artificial Sequence: Synthetic oligonucleotide
ggaatttcttgaaggaagatgccatgaagaccaagac

SEQ ID NO: 149032 - DNA, 38 bp, Artificial Sequence
  Description of Artificial Sequence: Synthetic oligonucleotide
gaatttcttgaaggaagatgccatgaagaccaagacac

SEQ ID NO: 149033 - DNA, 39 bp, Artificial Sequence
  Description of Artificial Sequence: Synthetic oligonucleotide
aatttcttgaaggaagatgccatgaagaccaagacacac

SEQ ID NO: 149034 - DNA, 38 bp, Artificial Sequence
  Description of Artificial Sequence: Synthetic oligonucleotide
atttcttgaaggaagatgccatgaagaccaagacacac

SEQ ID NO: 149035 - DNA, 37 bp, Artificial Sequence
  Description of Artificial Sequence: Synthetic oligonucleotide
tttcttgaaggaagatgccatgaagaccaagacacac

SEQ ID NO: 149036 - DNA, 36 bp, Artificial Sequence
  Description of Artificial Sequence: Synthetic oligonucleotide
ttcttgaaggaagatgccatgaagaccaagacacac

SEQ ID NO: 149037 - DNA, 35 bp, Artificial Sequence
  Description of Artificial Sequence: Synthetic oligonucleotide
tcttgaaggaagatgccatgaagaccaagacacac

SEQ ID NO: 149038 - DNA, 34 bp, Artificial Sequence
  Description of Artificial Sequence: Synthetic oligonucleotide
cttgaaggaagatgccatgaagaccaagacacac

SEQ ID NO: 149039 - DNA, 37 bp, Artificial Sequence
  Description of Artificial Sequence: Synthetic oligonucleotide
ttgaaggaagatgccatgaagaccaagacacactatc

SEQ ID NO: 149040 - DNA, 36 bp, Artificial Sequence
  Description of Artificial Sequence: Synthetic oligonucleotide
tgaaggaagatgccatgaagaccaagacacactatc

SEQ ID NO: 149041 - DNA, 35 bp, Artificial Sequence
  Description of Artificial Sequence: Synthetic oligonucleotide
gaaggaagatgccatgaagaccaagacacactatc

SEQ ID NO: 149042 - DNA, 36 bp, Artificial Sequence
  Description of Artificial Sequence: Synthetic oligonucleotide
aaggaagatgccatgaagaccaagacacactatcac

SEQ ID NO: 149043 - DNA, 35 bp, Artificial Sequence
  Description of Artificial Sequence: Synthetic oligonucleotide
aggaagatgccatgaagaccaagacacactatcac

SEQ ID NO: 149044 - DNA, 34 bp, Artificial Sequence
  Description of Artificial Sequence: Synthetic oligonucleotide
ggaagatgccatgaagaccaagacacactatcac

SEQ ID NO: 149045 - DNA, 34 bp, Artificial Sequence
  Description of Artificial Sequence: Synthetic oligonucleotide
gaagatgccatgaagaccaagacacactatcacg

SEQ ID NO: 149046 - DNA, 34 bp, Artificial Sequence
  Description of Artificial Sequence: Synthetic oligonucleotide
aagatgccatgaagaccaagacacactatcacgc

SEQ ID NO: 149047 - DNA, 33 bp, Artificial Sequence
  Description of Artificial Sequence: Synthetic oligonucleotide
agatgccatgaagaccaagacacactatcacgc

SEQ ID NO: 149048 - DNA, 32 bp, Artificial Sequence
  Description of Artificial Sequence: Synthetic oligonucleotide
gatgccatgaagaccaagacacactatcacgc

SEQ ID NO: 149049 - DNA, 35 bp, Artificial Sequence
  Description of Artificial Sequence: Synthetic oligonucleotide
atgccatgaagaccaagacacactatcacgctatg

SEQ ID NO: 149050 - DNA, 34 bp, Artificial Sequence
  Description of Artificial Sequence: Synthetic oligonucleotide
tgccatgaagaccaagacacactatcacgctatg

SEQ ID NO: 149051 - DNA, 33 bp, Artificial Sequence
  Description of Artificial Sequence: Synthetic oligonucleotide
gccatgaagaccaagacacactatcacgctatg

SEQ ID NO: 149052 - DNA, 33 bp, Artificial Sequence
  Description of Artificial Sequence: Synthetic oligonucleotide
ccatgaagaccaagacacactatcacgctatgc

SEQ ID NO: 149053 - DNA, 35 bp, Artificial Sequence
  Description of Artificial Sequence: Synthetic oligonucleotide
catgaagaccaagacacactatcacgctatgcatg

SEQ ID NO: 149054 - DNA, 35 bp, Artificial Sequence
  Description of Artificial Sequence: Synthetic oligonucleotide
atgaagaccaagacacactatcacgctatgcatgc

SEQ ID NO: 149055 - DNA, 34 bp, Artificial Sequence
  Description of Artificial Sequence: Synthetic oligonucleotide
tgaagaccaagacacactatcacgctatgcatgc

SEQ ID NO: 149056 - DNA, 33 bp, Artificial Sequence
  Description of Artificial Sequence: Synthetic oligonucleotide
gaagaccaagacacactatcacgctatgcatgc

SEQ ID NO: 149057 - DNA, 34 bp, Artificial Sequence
  Description of Artificial Sequence: Synthetic oligonucleotide
aagaccaagacacactatcacgctatgcatgcag

SEQ ID NO: 149058 - DNA, 33 bp, Artificial Sequence
  Description of Artificial Sequence: Synthetic oligonucleotide
agaccaagacacactatcacgctatgcatgcag

SEQ ID NO: 149059 - DNA, 32 bp, Artificial Sequence
  Description of Artificial Sequence: Synthetic oligonucleotide
gaccaagacacactatcacgctatgcatgcag

SEQ ID NO: 149060 - DNA, 33 bp, Artificial Sequence
  Description of Artificial Sequence: Synthetic oligonucleotide
accaagacacactatcacgctatgcatgcagac

SEQ ID NO: 149061 - DNA, 32 bp, Artificial Sequence
  Description of Artificial Sequence: Synthetic oligonucleotide
ccaagacacactatcacgctatgcatgcagac

SEQ ID NO: 149062 - DNA, 33 bp, Artificial Sequence
  Description of Artificial Sequence: Synthetic oligonucleotide
caagacacactatcacgctatgcatgcagactg

SEQ ID NO: 149063 - DNA, 33 bp, Artificial Sequence
  Description of Artificial Sequence: Synthetic oligonucleotide
aagacacactatcacgctatgcatgcagactgc

SEQ ID NO: 149064 - DNA, 32 bp, Artificial Sequence
  Description of Artificial Sequence: Synthetic oligonucleotide
agacacactatcacgctatgcatgcagactgc

SEQ ID NO: 149065 - DNA, 31 bp, Artificial Sequence
  Description of Artificial Sequence: Synthetic oligonucleotide
gacacactatcacgctatgcatgcagactgc

SEQ ID NO: 149066 - DNA, 31 bp, Artificial Sequence
  Description of Artificial Sequence: Synthetic oligonucleotide
acacactatcacgctatgcatgcagactgcc

SEQ ID NO: 149067 - DNA, 30 bp, Artificial Sequence
  Description of Artificial Sequence: Synthetic oligonucleotide
cacactatcacgctatgcatgcagactgcc

SEQ ID NO: 149068 - DNA, 31 bp, Artificial Sequence
  Description of Artificial Sequence: Synthetic oligonucleotide
acactatcacgctatgcatgcagactgcctg

SEQ ID NO: 149069 - DNA, 30 bp, Artificial Sequence
  Description of Artificial Sequence: Synthetic oligonucleotide
cactatcacgctatgcatgcagactgcctg

SEQ ID NO: 149070 - DNA, 30 bp, Artificial Sequence
  Description of Artificial Sequence: Synthetic oligonucleotide
actatcacgctatgcatgcagactgcctgc

SEQ ID NO: 149071 - DNA, 29 bp, Artificial Sequence
  Description of Artificial Sequence: Synthetic oligonucleotide
ctatcacgctatgcatgcagactgcctgc

SEQ ID NO: 149072 - DNA, 30 bp, Artificial Sequence
  Description of Artificial Sequence: Synthetic oligonucleotide
tatcacgctatgcatgcagactgcctgcag

SEQ ID NO: 149073 - DNA, 29 bp, Artificial Sequence
  Description of Artificial Sequence: Synthetic oligonucleotide
atcacgctatgcatgcagactgcctgcag

SEQ ID NO: 149074 - DNA, 28 bp, Artificial Sequence
  Description of Artificial Sequence: Synthetic oligonucleotide
tcacgctatgcatgcagactgcctgcag

SEQ ID NO: 149075 - DNA, 27 bp, Artificial Sequence
  Description of Artificial Sequence: Synthetic oligonucleotide
cacgctatgcatgcagactgcctgcag

SEQ ID NO: 149076 - DNA, 27 bp, Artificial Sequence
  Description of Artificial Sequence: Synthetic oligonucleotide
acgctatgcatgcagactgcctgcagg

SEQ ID NO: 149077 - DNA, 27 bp, Artificial Sequence
  Description of Artificial Sequence: Synthetic oligonucleotide
cgctatgcatgcagactgcctgcagga

SEQ ID NO: 149078 - DNA, 28 bp, Artificial Sequence
  Description of Artificial Sequence: Synthetic oligonucleotide
gctatgcatgcagactgcctgcaggaac

SEQ ID NO: 149079 - DNA, 30 bp, Artificial Sequence
  Description of Artificial Sequence: Synthetic oligonucleotide
ctatgcatgcagactgcctgcaggaactac

SEQ ID NO: 149080 - DNA, 30 bp, Artificial Sequence
  Description of Artificial Sequence: Synthetic oligonucleotide
tatgcatgcagactgcctgcaggaactacg

SEQ ID NO: 149081 - DNA, 29 bp, Artificial Sequence
  Description of Artificial Sequence: Synthetic oligonucleotide
atgcatgcagactgcctgcaggaactacg

SEQ ID NO: 149082 - DNA, 28 bp, Artificial Sequence
  Description of Artificial Sequence: Synthetic oligonucleotide
tgcatgcagactgcctgcaggaactacg

SEQ ID NO: 149083 - DNA, 27 bp, Artificial Sequence
  Description of Artificial Sequence: Synthetic oligonucleotide
gcatgcagactgcctgcaggaactacg

SEQ ID NO: 149084 - DNA, 27 bp, Artificial Sequence
  Description of Artificial Sequence: Synthetic oligonucleotide
catgcagactgcctgcaggaactacgg

SEQ ID NO: 149085 - DNA, 27 bp, Artificial Sequence
  Description of Artificial Sequence: Synthetic oligonucleotide
atgcagactgcctgcaggaactacggc

SEQ ID NO: 149086 - DNA, 26 bp, Artificial Sequence
  Description of Artificial Sequence: Synthetic oligonucleotide
tgcagactgcctgcaggaactacggc

SEQ ID NO: 149087 - DNA, 25 bp, Artificial Sequence
  Description of Artificial Sequence: Synthetic oligonucleotide
gcagactgcctgcaggaactacggc

SEQ ID NO: 149088 - DNA, 27 bp, Artificial Sequence
  Description of Artificial Sequence: Synthetic oligonucleotide
cagactgcctgcaggaactacggcgat

SEQ ID NO: 149089 - DNA, 29 bp, Artificial Sequence
  Description of Artificial Sequence: Synthetic oligonucleotide
agactgcctgcaggaactacggcgatatc

SEQ ID NO: 149090 - DNA, 28 bp, Artificial Sequence
  Description of Artificial Sequence: Synthetic oligonucleotide
gactgcctgcaggaactacggcgatatc

SEQ ID NO: 149091 - DNA, 34 bp, Artificial Sequence
  Description of Artificial Sequence: Synthetic oligonucleotide
actgcctgcaggaactacggcgatatctaaaatc

SEQ ID NO: 149092 - DNA, 33 bp, Artificial Sequence
  Description of Artificial Sequence: Synthetic oligonucleotide
ctgcctgcaggaactacggcgatatctaaaatc

SEQ ID NO: 149093 - DNA, 33 bp, Artificial Sequence
  Description of Artificial Sequence: Synthetic oligonucleotide
tgcctgcaggaactacggcgatatctaaaatcc

SEQ ID NO: 149094 - DNA, 32 bp, Artificial Sequence
  Description of Artificial Sequence: Synthetic oligonucleotide
gcctgcaggaactacggcgatatctaaaatcc

SEQ ID NO: 149095 - DNA, 32 bp, Artificial Sequence
  Description of Artificial Sequence: Synthetic oligonucleotide
cctgcaggaactacggcgatatctaaaatccg

SEQ ID NO: 149096 - DNA, 32 bp, Artificial Sequence
  Description of Artificial Sequence: Synthetic oligonucleotide
ctgcaggaactacggcgatatctaaaatccgg

SEQ ID NO: 149097 - DNA, 32 bp, Artificial Sequence
  Description of Artificial Sequence: Synthetic oligonucleotide
tgcaggaactacggcgatatctaaaatccggc

SEQ ID NO: 149098 - DNA, 31 bp, Artificial Sequence
  Description of Artificial Sequence: Synthetic oligonucleotide
gcaggaactacggcgatatctaaaatccggc

SEQ ID NO: 149099 - DNA, 31 bp, Artificial Sequence
  Description of Artificial Sequence: Synthetic oligonucleotide
caggaactacggcgatatctaaaatccggcg

SEQ ID NO: 149100 - DNA, 33 bp, Artificial Sequence
  Description of Artificial Sequence: Synthetic oligonucleotide
aggaactacggcgatatctaaaatccggcgtag

SEQ ID NO: 149101 - DNA, 32 bp, Artificial Sequence
  Description of Artificial Sequence: Synthetic oligonucleotide
ggaactacggcgatatctaaaatccggcgtag

SEQ ID NO: 149102 - DNA, 33 bp, Artificial Sequence
  Description of Artificial Sequence: Synthetic oligonucleotide
gaactacggcgatatctaaaatccggcgtagtc

SEQ ID NO: 149103 - DNA, 33 bp, Artificial Sequence
  Description of Artificial Sequence: Synthetic oligonucleotide
aactacggcgatatctaaaatccggcgtagtcc

SEQ ID NO: 149104 - DNA, 32 bp, Artificial Sequence
  Description of Artificial Sequence: Synthetic oligonucleotide
actacggcgatatctaaaatccggcgtagtcc

SEQ ID NO: 149105 - DNA, 31 bp, Artificial Sequence
  Description of Artificial Sequence: Synthetic oligonucleotide
ctacggcgatatctaaaatccggcgtagtcc

SEQ ID NO: 149106 - DNA, 32 bp, Artificial Sequence
  Description of Artificial Sequence: Synthetic oligonucleotide
tacggcgatatctaaaatccggcgtagtcctg

SEQ ID NO: 149107 - DNA, 31 bp, Artificial Sequence
  Description of Artificial Sequence: Synthetic oligonucleotide
acggcgatatctaaaatccggcgtagtcctg

SEQ ID NO: 149108 - DNA, 30 bp, Artificial Sequence
  Description of Artificial Sequence: Synthetic oligonucleotide
cggcgatatctaaaatccggcgtagtcctg

SEQ ID NO: 149109 - DNA, 31 bp, Artificial Sequence
  Description of Artificial Sequence: Synthetic oligonucleotide
ggcgatatctaaaatccggcgtagtcctgag

SEQ ID NO: 149110 - DNA, 31 bp, Artificial Sequence
  Description of Artificial Sequence: Synthetic oligonucleotide
gcgatatctaaaatccggcgtagtcctgagg

SEQ ID NO: 149111 - DNA, 32 bp, Artificial Sequence
  Description of Artificial Sequence: Synthetic oligonucleotide
cgatatctaaaatccggcgtagtcctgaggag

SEQ ID NO: 149112 - DNA, 34 bp, Artificial Sequence
  Description of Artificial Sequence: Synthetic oligonucleotide
gatatctaaaatccggcgtagtcctgaggagaac

SEQ ID NO: 149113 - DNA, 35 bp, Artificial Sequence
  Description of Artificial Sequence: Synthetic oligonucleotide
atatctaaaatccggcgtagtcctgaggagaacag

SEQ ID NO: 149114 - DNA, 34 bp, Artificial Sequence
  Description of Artificial Sequence: Synthetic oligonucleotide
tatctaaaatccggcgtagtcctgaggagaacag

SEQ ID NO: 149115 - DNA, 33 bp, Artificial Sequence
  Description of Artificial Sequence: Synthetic oligonucleotide
atctaaaatccggcgtagtcctgaggagaacag

SEQ ID NO: 149116 - DNA, 32 bp, Artificial Sequence
  Description of Artificial Sequence: Synthetic oligonucleotide
tctaaaatccggcgtagtcctgaggagaacag

SEQ ID NO: 149117 - DNA, 31 bp, Artificial Sequence
  Description of Artificial Sequence: Synthetic oligonucleotide
ctaaaatccggcgtagtcctgaggagaacag

SEQ ID NO: 149118 - DNA, 32 bp, Artificial Sequence
  Description of Artificial Sequence: Synthetic oligonucleotide
taaaatccggcgtagtcctgaggagaacagtg

SEQ ID NO: 149119 - DNA, 31 bp, Artificial Sequence
  Description of Artificial Sequence: Synthetic oligonucleotide
aaaatccggcgtagtcctgaggagaacagtg

SEQ ID NO: 149120 - DNA, 30 bp, Artificial Sequence
  Description of Artificial Sequence: Synthetic oligonucleotide
aaatccggcgtagtcctgaggagaacagtg

SEQ ID NO: 149121 - DNA, 29 bp, Artificial Sequence
  Description of Artificial Sequence: Synthetic oligonucleotide
aatccggcgtagtcctgaggagaacagtg

SEQ ID NO: 149122 - DNA, 28 bp, Artificial Sequence
  Description of Artificial Sequence: Synthetic oligonucleotide
atccggcgtagtcctgaggagaacagtg

SEQ ID NO: 149123 - DNA, 27 bp, Artificial Sequence
  Description of Artificial Sequence: Synthetic oligonucleotide
tccggcgtagtcctgaggagaacagtg

SEQ ID NO: 149124 - DNA, 26 bp, Artificial Sequence
  Description of Artificial Sequence: Synthetic oligonucleotide
ccggcgtagtcctgaggagaacagtg

SEQ ID NO: 149125 - DNA, 26 bp, Artificial Sequence
  Description of Artificial Sequence: Synthetic oligonucleotide
cggcgtagtcctgaggagaacagtgc

SEQ ID NO: 149126 - DNA, 26 bp, Artificial Sequence
  Description of Artificial Sequence: Synthetic oligonucleotide
ggcgtagtcctgaggagaacagtgcc

SEQ ID NO: 149127 - DNA, 26 bp, Artificial Sequence
  Description of Artificial Sequence: Synthetic oligonucleotide
gcgtagtcctgaggagaacagtgccc

SEQ ID NO: 149128 - DNA, 26 bp, Artificial Sequence
  Description of Artificial Sequence: Synthetic oligonucleotide
cgtagtcctgaggagaacagtgcccc

SEQ ID NO: 149129 - DNA, 26 bp, Artificial Sequence
  Description of Artificial Sequence: Synthetic oligonucleotide
gtagtcctgaggagaacagtgccccc

SEQ ID NO: 149130 - DNA, 27 bp, Artificial Sequence
  Description of Artificial Sequence: Synthetic oligonucleotide
tagtcctgaggagaacagtgcccccca

SEQ ID NO: 149131 - DNA, 27 bp, Artificial Sequence
  Description of Artificial Sequence: Synthetic oligonucleotide
agtcctgaggagaacagtgccccccat

SEQ ID NO: 149132 - DNA, 26 bp, Artificial Sequence
  Description of Artificial Sequence: Synthetic oligonucleotide
gtcctgaggagaacagtgccccccat

SEQ ID NO: 149133 - DNA, 26 bp, Artificial Sequence
  Description of Artificial Sequence: Synthetic oligonucleotide
tcctgaggagaacagtgccccccatg

SEQ ID NO: 149134 - DNA, 25 bp, Artificial Sequence
  Description of Artificial Sequence: Synthetic oligonucleotide
cctgaggagaacagtgccccccatg

SEQ ID NO: 149135 - DNA, 26 bp, Artificial Sequence
  Description of Artificial Sequence: Synthetic oligonucleotide
ctgaggagaacagtgccccccatggt

SEQ ID NO: 149136 - DNA, 27 bp, Artificial Sequence
  Description of Artificial Sequence: Synthetic oligonucleotide
tgaggagaacagtgccccccatggtga

SEQ ID NO: 149137 - DNA, 27 bp, Artificial Sequence
  Description of Artificial Sequence: Synthetic oligonucleotide
gaggagaacagtgccccccatggtgaa

SEQ ID NO: 149138 - DNA, 28 bp, Artificial Sequence
  Description of Artificial Sequence: Synthetic oligonucleotide
aggagaacagtgccccccatggtgaatg

SEQ ID NO: 149139 - DNA, 27 bp, Artificial Sequence
  Description of Artificial Sequence: Synthetic oligonucleotide
ggagaacagtgccccccatggtgaatg

SEQ ID NO: 149140 - DNA, 28 bp, Artificial Sequence
  Description of Artificial Sequence: Synthetic oligonucleotide
gagaacagtgccccccatggtgaatgtc

SEQ ID NO: 149141 - DNA, 29 bp, Artificial Sequence
  Description of Artificial Sequence: Synthetic oligonucleotide
agaacagtgccccccatggtgaatgtcac

SEQ ID NO: 149142 - DNA, 28 bp, Artificial Sequence
  Description of Artificial Sequence: Synthetic oligonucleotide
gaacagtgccccccatggtgaatgtcac

SEQ ID NO: 149143 - DNA, 28 bp, Artificial Sequence
  Description of Artificial Sequence: Synthetic oligonucleotide
aacagtgccccccatggtgaatgtcacc

SEQ ID NO: 149144 - DNA, 27 bp, Artificial Sequence
  Description of Artificial Sequence: Synthetic oligonucleotide
acagtgccccccatggtgaatgtcacc

SEQ ID NO: 149145 - DNA, 26 bp, Artificial Sequence
  Description of Artificial Sequence: Synthetic oligonucleotide
cagtgccccccatggtgaatgtcacc

SEQ ID NO: 149146 - DNA, 26 bp, Artificial Sequence
  Description of Artificial Sequence: Synthetic oligonucleotide
agtgccccccatggtgaatgtcaccc

SEQ ID NO: 149147 - DNA, 25 bp, Artificial Sequence
  Description of Artificial Sequence: Synthetic oligonucleotide
gtgccccccatggtgaatgtcaccc

SEQ ID NO: 149148 - DNA, 25 bp, Artificial Sequence
  Description of Artificial Sequence: Synthetic oligonucleotide
tgccccccatggtgaatgtcacccg

SEQ ID NO: 149149 - DNA, 24 bp, Artificial Sequence
  Description of Artificial Sequence: Synthetic oligonucleotide
gccccccatggtgaatgtcacccg

SEQ ID NO: 149150 - DNA, 25 bp, Artificial Sequence
  Description of Artificial Sequence: Synthetic oligonucleotide
ccccccatggtgaatgtcacccgca

SEQ ID NO: 149151 - DNA, 25 bp, Artificial Sequence
  Description of Artificial Sequence: Synthetic oligonucleotide
cccccatggtgaatgtcacccgcag

SEQ ID NO: 149152 - DNA, 25 bp, Artificial Sequence
  Description of Artificial Sequence: Synthetic oligonucleotide
ccccatggtgaatgtcacccgcagc

SEQ ID NO: 149153 - DNA, 26 bp, Artificial Sequence
  Description of Artificial Sequence: Synthetic oligonucleotide
cccatggtgaatgtcacccgcagcga

SEQ ID NO: 149154 - DNA, 26 bp, Artificial Sequence
  Description of Artificial Sequence: Synthetic oligonucleotide
ccatggtgaatgtcacccgcagcgag

SEQ ID NO: 149155 - DNA, 26 bp, Artificial Sequence
  Description of Artificial Sequence: Synthetic oligonucleotide
catggtgaatgtcacccgcagcgagg

SEQ ID NO: 149156 - DNA, 26 bp, Artificial Sequence
  Description of Artificial Sequence: Synthetic oligonucleotide
atggtgaatgtcacccgcagcgaggc

SEQ ID NO: 149157 - DNA, 25 bp, Artificial Sequence
  Description of Artificial Sequence: Synthetic oligonucleotide
tggtgaatgtcacccgcagcgaggc

SEQ ID NO: 149158 - DNA, 24 bp, Artificial Sequence
  Description of Artificial Sequence: Synthetic oligonucleotide
ggtgaatgtcacccgcagcgaggc

SEQ ID NO: 149159 - DNA, 25 bp, Artificial Sequence
  Description of Artificial Sequence: Synthetic oligonucleotide
gtgaatgtcacccgcagcgaggcct

SEQ ID NO: 149160 - DNA, 26 bp, Artificial Sequence
  Description of Artificial Sequence: Synthetic oligonucleotide
tgaatgtcacccgcagcgaggcctca

SEQ ID NO: 149161 - DNA, 25 bp, Artificial Sequence
  Description of Artificial Sequence: Synthetic oligonucleotide
gaatgtcacccgcagcgaggcctca

SEQ ID NO: 149162 - DNA, 26 bp, Artificial Sequence
  Description of Artificial Sequence: Synthetic oligonucleotide
aatgtcacccgcagcgaggcctcaga

SEQ ID NO: 149163 - DNA, 25 bp, Artificial Sequence
  Description of Artificial Sequence: Synthetic oligonucleotide
atgtcacccgcagcgaggcctcaga

SEQ ID NO: 149164 - DNA, 24 bp, Artificial Sequence
  Description of Artificial Sequence: Synthetic oligonucleotide
tgtcacccgcagcgaggcctcaga

SEQ ID NO: 149165 - DNA, 23 bp, Artificial Sequence
  Description of Artificial Sequence: Synthetic oligonucleotide
gtcacccgcagcgaggcctcaga

SEQ ID NO: 149166 - DNA, 23 bp, Artificial Sequence
  Description of Artificial Sequence: Synthetic oligonucleotide
tcacccgcagcgaggcctcagag

SEQ ID NO: 149167 - DNA, 22 bp, Artificial Sequence
  Description of Artificial Sequence: Synthetic oligonucleotide
cacccgcagcgaggcctcagag

SEQ ID NO: 149168 - DNA, 22 bp, Artificial Sequence
  Description of Artificial Sequence: Synthetic oligonucleotide
acccgcagcgaggcctcagagg

SEQ ID NO: 149169 - DNA, 21 bp, Artificial Sequence
  Description of Artificial Sequence: Synthetic oligonucleotide
cccgcagcgaggcctcagagg

SEQ ID NO: 149170 - DNA, 21 bp, Artificial Sequence
  Description of Artificial Sequence: Synthetic oligonucleotide
ccgcagcgaggcctcagaggg

SEQ ID NO: 149171 - DNA, 23 bp, Artificial Sequence
  Description of Artificial Sequence: Synthetic oligonucleotide
cgcagcgaggcctcagagggcaa

SEQ ID NO: 149172 - DNA, 27 bp, Artificial Sequence
  Description of Artificial Sequence: Synthetic oligonucleotide
gcagcgaggcctcagagggcaacatta

SEQ ID NO: 149173 - DNA, 27 bp, Artificial Sequence
  Description of Artificial Sequence: Synthetic oligonucleotide
cagcgaggcctcagagggcaacattac

SEQ ID NO: 149174 - DNA, 27 bp, Artificial Sequence
  Description of Artificial Sequence: Synthetic oligonucleotide
agcgaggcctcagagggcaacattacc

SEQ ID NO: 149175 - DNA, 26 bp, Artificial Sequence
  Description of Artificial Sequence: Synthetic oligonucleotide
gcgaggcctcagagggcaacattacc

SEQ ID NO: 149176 - DNA, 27 bp, Artificial Sequence
  Description of Artificial Sequence: Synthetic oligonucleotide
cgaggcctcagagggcaacattaccgt

SEQ ID NO: 149177 - DNA, 27 bp, Artificial Sequence
  Description of Artificial Sequence: Synthetic oligonucleotide
gaggcctcagagggcaacattaccgtg

SEQ ID NO: 149178 - DNA, 28 bp, Artificial Sequence
  Description of Artificial Sequence: Synthetic oligonucleotide
aggcctcagagggcaacattaccgtgac

SEQ ID NO: 149179 - DNA, 27 bp, Artificial Sequence
  Description of Artificial Sequence: Synthetic oligonucleotide
ggcctcagagggcaacattaccgtgac

SEQ ID NO: 149180 - DNA, 29 bp, Artificial Sequence
  Description of Artificial Sequence: Synthetic oligonucleotide
gcctcagagggcaacattaccgtgacatg

SEQ ID NO: 149181 - DNA, 29 bp, Artificial Sequence
  Description of Artificial Sequence: Synthetic oligonucleotide
cctcagagggcaacattaccgtgacatgc

SEQ ID NO: 149182 - DNA, 30 bp, Artificial Sequence
  Description of Artificial Sequence: Synthetic oligonucleotide
ctcagagggcaacattaccgtgacatgcag

SEQ ID NO: 149183 - DNA, 30 bp, Artificial Sequence
  Description of Artificial Sequence: Synthetic oligonucleotide
tcagagggcaacattaccgtgacatgcagg

SEQ ID NO: 149184 - DNA, 29 bp, Artificial Sequence
  Description of Artificial Sequence: Synthetic oligonucleotide
cagagggcaacattaccgtgacatgcagg

SEQ ID NO: 149185 - DNA, 29 bp, Artificial Sequence
  Description of Artificial Sequence: Synthetic oligonucleotide
agagggcaacattaccgtgacatgcaggg

SEQ ID NO: 149186 - DNA, 28 bp, Artificial Sequence
  Description of Artificial Sequence: Synthetic oligonucleotide
gagggcaacattaccgtgacatgcaggg

SEQ ID NO: 149187 - DNA, 28 bp, Artificial Sequence
  Description of Artificial Sequence: Synthetic oligonucleotide
agggcaacattaccgtgacatgcagggc

SEQ ID NO: 149188 - DNA, 27 bp, Artificial Sequence
  Description of Artificial Sequence: Synthetic oligonucleotide
gggcaacattaccgtgacatgcagggc

SEQ ID NO: 149189 - DNA, 29 bp, Artificial Sequence
  Description of Artificial Sequence: Synthetic oligonucleotide
ggcaacattaccgtgacatgcagggcttc

SEQ ID NO: 149190 - DNA, 30 bp, Artificial Sequence
  Description of Artificial Sequence: Synthetic oligonucleotide
gcaacattaccgtgacatgcagggcttctg

SEQ ID NO: 149191 - DNA, 30 bp, Artificial Sequence
  Description of Artificial Sequence: Synthetic oligonucleotide
caacattaccgtgacatgcagggcttctgg

SEQ ID NO: 149192 - DNA, 30 bp, Artificial Sequence
  Description of Artificial Sequence: Synthetic oligonucleotide
aacattaccgtgacatgcagggcttctggc

SEQ ID NO: 149193 - DNA, 29 bp, Artificial Sequence
  Description of Artificial Sequence: Synthetic oligonucleotide
acattaccgtgacatgcagggcttctggc

SEQ ID NO: 149194 - DNA, 28 bp, Artificial Sequence
  Description of Artificial Sequence: Synthetic oligonucleotide
cattaccgtgacatgcagggcttctggc

SEQ ID NO: 149195 - DNA, 30 bp, Artificial Sequence
  Description of Artificial Sequence: Synthetic oligonucleotide
attaccgtgacatgcagggcttctggcttc

SEQ ID NO: 149196 - DNA, 29 bp, Artificial Sequence
  Description of Artificial Sequence: Synthetic oligonucleotide
ttaccgtgacatgcagggcttctggcttc

SEQ ID NO: 149197 - DNA, 28 bp, Artificial Sequence
  Description of Artificial Sequence: Synthetic oligonucleotide
taccgtgacatgcagggcttctggcttc

SEQ ID NO: 149198 - DNA, 27 bp, Artificial Sequence
  Description of Artificial Sequence: Synthetic oligonucleotide
accgtgacatgcagggcttctggcttc

SEQ ID NO: 149199 - DNA, 27 bp, Artificial Sequence
  Description of Artificial Sequence: Synthetic oligonucleotide
ccgtgacatgcagggcttctggcttct

SEQ ID NO: 149200 - DNA, 29 bp, Artificial Sequence
  Description of Artificial Sequence: Synthetic oligonucleotide
cgtgacatgcagggcttctggcttctatc

SEQ ID NO: 149201 - DNA, 29 bp, Artificial Sequence
  Description of Artificial Sequence: Synthetic oligonucleotide
gtgacatgcagggcttctggcttctatcc

SEQ ID NO: 149202 - DNA, 29 bp, Artificial Sequence
  Description of Artificial Sequence: Synthetic oligonucleotide
tgacatgcagggcttctggcttctatccc

SEQ ID NO: 149203 - DNA, 28 bp, Artificial Sequence
  Description of Artificial Sequence: Synthetic oligonucleotide
gacatgcagggcttctggcttctatccc

SEQ ID NO: 149204 - DNA, 29 bp, Artificial Sequence
  Description of Artificial Sequence: Synthetic oligonucleotide
acatgcagggcttctggcttctatccctg

SEQ ID NO: 149205 - DNA, 28 bp, Artificial Sequence
  Description of Artificial Sequence: Synthetic oligonucleotide
catgcagggcttctggcttctatccctg

SEQ ID NO: 149206 - DNA, 28 bp, Artificial Sequence
  Description of Artificial Sequence: Synthetic oligonucleotide
atgcagggcttctggcttctatccctgg

SEQ ID NO: 149207 - DNA, 27 bp, Artificial Sequence
  Description of Artificial Sequence: Synthetic oligonucleotide
tgcagggcttctggcttctatccctgg

SEQ ID NO: 149208 - DNA, 27 bp, Artificial Sequence
  Description of Artificial Sequence: Synthetic oligonucleotide
gcagggcttctggcttctatccctgga

SEQ ID NO: 149209 - DNA, 31 bp, Artificial Sequence
  Description of Artificial Sequence: Synthetic oligonucleotide
cagggcttctggcttctatccctggaatatc

SEQ ID NO: 149210 - DNA, 32 bp, Artificial Sequence
  Description of Artificial Sequence: Synthetic oligonucleotide
agggcttctggcttctatccctggaatatcac

SEQ ID NO: 149211 - DNA, 31 bp, Artificial Sequence
  Description of Artificial Sequence: Synthetic oligonucleotide
gggcttctggcttctatccctggaatatcac

SEQ ID NO: 149212 - DNA, 32 bp, Artificial Sequence
  Description of Artificial Sequence: Synthetic oligonucleotide
ggcttctggcttctatccctggaatatcacac

SEQ ID NO: 149213 - DNA, 33 bp, Artificial Sequence
  Description of Artificial Sequence: Synthetic oligonucleotide
gcttctggcttctatccctggaatatcacactg

SEQ ID NO: 149214 - DNA, 34 bp, Artificial Sequence
  Description of Artificial Sequence: Synthetic oligonucleotide
cttctggcttctatccctggaatatcacactgag

SEQ ID NO: 149215 - DNA, 34 bp, Artificial Sequence
  Description of Artificial Sequence: Synthetic oligonucleotide
ttctggcttctatccctggaatatcacactgagc

SEQ ID NO: 149216 - DNA, 33 bp, Artificial Sequence
  Description of Artificial Sequence: Synthetic oligonucleotide
tctggcttctatccctggaatatcacactgagc

SEQ ID NO: 149217 - DNA, 32 bp, Artificial Sequence
  Description of Artificial Sequence: Synthetic oligonucleotide
ctggcttctatccctggaatatcacactgagc

SEQ ID NO: 149218 - DNA, 33 bp, Artificial Sequence
  Description of Artificial Sequence: Synthetic oligonucleotide
tggcttctatccctggaatatcacactgagctg

SEQ ID NO: 149219 - DNA, 32 bp, Artificial Sequence
  Description of Artificial Sequence: Synthetic oligonucleotide
ggcttctatccctggaatatcacactgagctg

SEQ ID NO: 149220 - DNA, 32 bp, Artificial Sequence
  Description of Artificial Sequence: Synthetic oligonucleotide
gcttctatccctggaatatcacactgagctgg

SEQ ID NO: 149221 - DNA, 32 bp, Artificial Sequence
  Description of Artificial Sequence: Synthetic oligonucleotide
cttctatccctggaatatcacactgagctggc

SEQ ID NO: 149222 - DNA, 32 bp, Artificial Sequence
  Description of Artificial Sequence: Synthetic oligonucleotide
ttctatccctggaatatcacactgagctggcg

SEQ ID NO: 149223 - DNA, 31 bp, Artificial Sequence
  Description of Artificial Sequence: Synthetic oligonucleotide
tctatccctggaatatcacactgagctggcg

SEQ ID NO: 149224 - DNA, 30 bp, Artificial Sequence
  Description of Artificial Sequence: Synthetic oligonucleotide
ctatccctggaatatcacactgagctggcg

SEQ ID NO: 149225 - DNA, 31 bp, Artificial Sequence
  Description of Artificial Sequence: Synthetic oligonucleotide
tatccctggaatatcacactgagctggcgtc

SEQ ID NO: 149226 - DNA, 30 bp, Artificial Sequence
  Description of Artificial Sequence: Synthetic oligonucleotide
atccctggaatatcacactgagctggcgtc

SEQ ID NO: 149227 - DNA, 29 bp, Artificial Sequence
  Description of Artificial Sequence: Synthetic oligonucleotide
tccctggaatatcacactgagctggcgtc

SEQ ID NO: 149228 - DNA, 28 bp, Artificial Sequence
  Description of Artificial Sequence: Synthetic oligonucleotide
ccctggaatatcacactgagctggcgtc

SEQ ID NO: 149229 - DNA, 29 bp, Artificial Sequence
  Description of Artificial Sequence: Synthetic oligonucleotide
cctggaatatcacactgagctggcgtcag

SEQ ID NO: 149230 - DNA, 29 bp, Artificial Sequence
  Description of Artificial Sequence: Synthetic oligonucleotide
ctggaatatcacactgagctggcgtcagg

SEQ ID NO: 149231 - DNA, 31 bp, Artificial Sequence
  Description of Artificial Sequence: Synthetic oligonucleotide
tggaatatcacactgagctggcgtcaggatg

SEQ ID NO: 149232 - DNA, 30 bp, Artificial Sequence
  Description of Artificial Sequence: Synthetic oligonucleotide
ggaatatcacactgagctggcgtcaggatg

SEQ ID NO: 149233 - DNA, 30 bp, Artificial Sequence
  Description of Artificial Sequence: Synthetic oligonucleotide
gaatatcacactgagctggcgtcaggatgg

SEQ ID NO: 149234 - DNA, 30 bp, Artificial Sequence
  Description of Artificial Sequence: Synthetic oligonucleotide
aatatcacactgagctggcgtcaggatggg

SEQ ID NO: 149235 - DNA, 29 bp, Artificial Sequence
  Description of Artificial Sequence: Synthetic oligonucleotide
atatcacactgagctggcgtcaggatggg

SEQ ID NO: 149236 - DNA, 28 bp, Artificial Sequence
  Description of Artificial Sequence: Synthetic oligonucleotide
tatcacactgagctggcgtcaggatggg

SEQ ID NO: 149237 - DNA, 27 bp, Artificial Sequence
  Description of Artificial Sequence: Synthetic oligonucleotide
atcacactgagctggcgtcaggatggg

SEQ ID NO: 149238 - DNA, 26 bp, Artificial Sequence
  Description of Artificial Sequence: Synthetic oligonucleotide
tcacactgagctggcgtcaggatggg

SEQ ID NO: 149239 - DNA, 25 bp, Artificial Sequence
  Description of Artificial Sequence: Synthetic oligonucleotide
cacactgagctggcgtcaggatggg

SEQ ID NO: 149240 - DNA, 27 bp, Artificial Sequence
  Description of Artificial Sequence: Synthetic oligonucleotide
acactgagctggcgtcaggatggggta

SEQ ID NO: 149241 - DNA, 27 bp, Artificial Sequence
  Description of Artificial Sequence: Synthetic oligonucleotide
cactgagctggcgtcaggatggggtat

SEQ ID NO: 149242 - DNA, 27 bp, Artificial Sequence
  Description of Artificial Sequence: Synthetic oligonucleotide
actgagctggcgtcaggatggggtatc

SEQ ID NO: 149243 - DNA, 27 bp, Artificial Sequence
  Description of Artificial Sequence: Synthetic oligonucleotide
ctgagctggcgtcaggatggggtatct

SEQ ID NO: 149244 - DNA, 29 bp, Artificial Sequence
  Description of Artificial Sequence: Synthetic oligonucleotide
tgagctggcgtcaggatggggtatctttg

SEQ ID NO: 149245 - DNA, 28 bp, Artificial Sequence
  Description of Artificial Sequence: Synthetic oligonucleotide
gagctggcgtcaggatggggtatctttg

SEQ ID NO: 149246 - DNA, 29 bp, Artificial Sequence
  Description of Artificial Sequence: Synthetic oligonucleotide
agctggcgtcaggatggggtatctttgag

SEQ ID NO: 149247 - DNA, 28 bp, Artificial Sequence
  Description of Artificial Sequence: Synthetic oligonucleotide
gctggcgtcaggatggggtatctttgag

SEQ ID NO: 149248 - DNA, 28 bp, Artificial Sequence
  Description of Artificial Sequence: Synthetic oligonucleotide
ctggcgtcaggatggggtatctttgagc

SEQ ID NO: 149249 - DNA, 28 bp, Artificial Sequence
  Description of Artificial Sequence: Synthetic oligonucleotide
tggcgtcaggatggggtatctttgagcc

SEQ ID NO: 149250 - DNA, 27 bp, Artificial Sequence
  Description of Artificial Sequence: Synthetic oligonucleotide
ggcgtcaggatggggtatctttgagcc

SEQ ID NO: 149251 - DNA, 28 bp, Artificial Sequence
  Description of Artificial Sequence: Synthetic oligonucleotide
gcgtcaggatggggtatctttgagccac

SEQ ID NO: 149252 - DNA, 28 bp, Artificial Sequence
  Description of Artificial Sequence: Synthetic oligonucleotide
cgtcaggatggggtatctttgagccacg

SEQ ID NO: 149253 - DNA, 29 bp, Artificial Sequence
  Description of Artificial Sequence: Synthetic oligonucleotide
gtcaggatggggtatctttgagccacgac

SEQ ID NO: 149254 - DNA, 30 bp, Artificial Sequence
  Description of Artificial Sequence: Synthetic oligonucleotide
tcaggatggggtatctttgagccacgacac

SEQ ID NO: 149255 - DNA, 29 bp, Artificial Sequence
  Description of Artificial Sequence: Synthetic oligonucleotide
caggatggggtatctttgagccacgacac

SEQ ID NO: 149256 - DNA, 29 bp, Artificial Sequence
  Description of Artificial Sequence: Synthetic oligonucleotide
aggatggggtatctttgagccacgacacc

SEQ ID NO: 149257 - DNA, 28 bp, Artificial Sequence
  Description of Artificial Sequence: Synthetic oligonucleotide
ggatggggtatctttgagccacgacacc

SEQ ID NO: 149258 - DNA, 28 bp, Artificial Sequence
  Description of Artificial Sequence: Synthetic oligonucleotide
gatggggtatctttgagccacgacaccc

SEQ ID NO: 149259 - DNA, 29 bp, Artificial Sequence
  Description of Artificial Sequence: Synthetic oligonucleotide
atggggtatctttgagccacgacacccag

SEQ ID NO: 149260 - DNA, 28 bp, Artificial Sequence
  Description of Artificial Sequence: Synthetic oligonucleotide
tggggtatctttgagccacgacacccag

SEQ ID NO: 149261 - DNA, 27 bp, Artificial Sequence
  Description of Artificial Sequence: Synthetic oligonucleotide
ggggtatctttgagccacgacacccag

SEQ ID NO: 149262 - DNA, 27 bp, Artificial Sequence
  Description of Artificial Sequence: Synthetic oligonucleotide
gggtatctttgagccacgacacccagc

SEQ ID NO: 149263 - DNA, 28 bp, Artificial Sequence
  Description of Artificial Sequence: Synthetic oligonucleotide
ggtatctttgagccacgacacccagcag

SEQ ID NO: 149264 - DNA, 29 bp, Artificial Sequence
  Description of Artificial Sequence: Synthetic oligonucleotide
gtatctttgagccacgacacccagcagtg

SEQ ID NO: 149265 - DNA, 29 bp, Artificial Sequence
  Description of Artificial Sequence: Synthetic oligonucleotide
tatctttgagccacgacacccagcagtgg

SEQ ID NO: 149266 - DNA, 28 bp, Artificial Sequence
  Description of Artificial Sequence: Synthetic oligonucleotide
atctttgagccacgacacccagcagtgg

SEQ ID NO: 149267 - DNA, 27 bp, Artificial Sequence
  Description of Artificial Sequence: Synthetic oligonucleotide
tctttgagccacgacacccagcagtgg

SEQ ID NO: 149268 - DNA, 26 bp, Artificial Sequence
  Description of Artificial Sequence: Synthetic oligonucleotide
ctttgagccacgacacccagcagtgg

SEQ ID NO: 149269 - DNA, 26 bp, Artificial Sequence
  Description of Artificial Sequence: Synthetic oligonucleotide
tttgagccacgacacccagcagtggg

SEQ ID NO: 149270 - DNA, 25 bp, Artificial Sequence
  Description of Artificial Sequence: Synthetic oligonucleotide
ttgagccacgacacccagcagtggg

SEQ ID NO: 149271 - DNA, 24 bp, Artificial Sequence
  Description of Artificial Sequence: Synthetic oligonucleotide
tgagccacgacacccagcagtggg

SEQ ID NO: 149272 - DNA, 23 bp, Artificial Sequence
  Description of Artificial Sequence: Synthetic oligonucleotide
gagccacgacacccagcagtggg

SEQ ID NO: 149273 - DNA, 23 bp, Artificial Sequence
  Description of Artificial Sequence: Synthetic oligonucleotide
agccacgacacccagcagtgggg

SEQ ID NO: 149274 - DNA, 22 bp, Artificial Sequence
  Description of Artificial Sequence: Synthetic oligonucleotide
gccacgacacccagcagtgggg

SEQ ID NO: 149275 - DNA, 22 bp, Artificial Sequence
  Description of Artificial Sequence: Synthetic oligonucleotide
ccacgacacccagcagtggggg

SEQ ID NO: 149276 - DNA, 24 bp, Artificial Sequence
  Description of Artificial Sequence: Synthetic oligonucleotide
cacgacacccagcagtggggggat

SEQ ID NO: 149277 - DNA, 25 bp, Artificial Sequence
  Description of Artificial Sequence: Synthetic oligonucleotide
acgacacccagcagtggggggatgt

SEQ ID NO: 149278 - DNA, 24 bp, Artificial Sequence
  Description of Artificial Sequence: Synthetic oligonucleotide
cgacacccagcagtggggggatgt

SEQ ID NO: 149279 - DNA, 24 bp, Artificial Sequence
  Description of Artificial Sequence: Synthetic oligonucleotide
gacacccagcagtggggggatgtc

SEQ ID NO: 149280 - DNA, 25 bp, Artificial Sequence
  Description of Artificial Sequence: Synthetic oligonucleotide
acacccagcagtggggggatgtcct

SEQ ID NO: 149281 - DNA, 24 bp, Artificial Sequence
  Description of Artificial Sequence: Synthetic oligonucleotide
cacccagcagtggggggatgtcct

SEQ ID NO: 149282 - DNA, 24 bp, Artificial Sequence
  Description of Artificial Sequence: Synthetic oligonucleotide
acccagcagtggggggatgtcctg

SEQ ID NO: 149283 - DNA, 23 bp, Artificial Sequence
  Description of Artificial Sequence: Synthetic oligonucleotide
cccagcagtggggggatgtcctg

SEQ ID NO: 149284 - DNA, 23 bp, Artificial Sequence
  Description of Artificial Sequence: Synthetic oligonucleotide
ccagcagtggggggatgtcctgc

SEQ ID NO: 149285 - DNA, 24 bp, Artificial Sequence
  Description of Artificial Sequence: Synthetic oligonucleotide
cagcagtggggggatgtcctgcct

SEQ ID NO: 149286 - DNA, 26 bp, Artificial Sequence
  Description of Artificial Sequence: Synthetic oligonucleotide
agcagtggggggatgtcctgcctgat

SEQ ID NO: 149287 - DNA, 25 bp, Artificial Sequence
  Description of Artificial Sequence: Synthetic oligonucleotide
gcagtggggggatgtcctgcctgat

SEQ ID NO: 149288 - DNA, 25 bp, Artificial Sequence
  Description of Artificial Sequence: Synthetic oligonucleotide
cagtggggggatgtcctgcctgatg

SEQ ID NO: 149289 - DNA, 25 bp, Artificial Sequence
  Description of Artificial Sequence: Synthetic oligonucleotide
agtggggggatgtcctgcctgatgg

SEQ ID NO: 149290 - DNA, 24 bp, Artificial Sequence
  Description of Artificial Sequence: Synthetic oligonucleotide
gtggggggatgtcctgcctgatgg

SEQ ID NO: 149291 - DNA, 27 bp, Artificial Sequence
  Description of Artificial Sequence: Synthetic oligonucleotide
tggggggatgtcctgcctgatgggaat

SEQ ID NO: 149292 - DNA, 26 bp, Artificial Sequence
  Description of Artificial Sequence: Synthetic oligonucleotide
ggggggatgtcctgcctgatgggaat

SEQ ID NO: 149293 - DNA, 26 bp, Artificial Sequence
  Description of Artificial Sequence: Synthetic oligonucleotide
gggggatgtcctgcctgatgggaatg

SEQ ID NO: 149294 - DNA, 27 bp, Artificial Sequence
  Description of Artificial Sequence: Synthetic oligonucleotide
ggggatgtcctgcctgatgggaatgga

SEQ ID NO: 149295 - DNA, 28 bp, Artificial Sequence
  Description of Artificial Sequence: Synthetic oligonucleotide
gggatgtcctgcctgatgggaatggaac

SEQ ID NO: 149296 - DNA, 28 bp, Artificial Sequence
  Description of Artificial Sequence: Synthetic oligonucleotide
ggatgtcctgcctgatgggaatggaacc

SEQ ID NO: 149297 - DNA, 30 bp, Artificial Sequence
  Description of Artificial Sequence: Synthetic oligonucleotide
gatgtcctgcctgatgggaatggaacctac

SEQ ID NO: 149298 - DNA, 30 bp, Artificial Sequence
  Description of Artificial Sequence: Synthetic oligonucleotide
atgtcctgcctgatgggaatggaacctacc

SEQ ID NO: 149299 - DNA, 29 bp, Artificial Sequence
  Description of Artificial Sequence: Synthetic oligonucleotide
tgtcctgcctgatgggaatggaacctacc

SEQ ID NO: 149300 - DNA, 28 bp, Artificial Sequence
  Description of Artificial Sequence: Synthetic oligonucleotide
gtcctgcctgatgggaatggaacctacc

SEQ ID NO: 149301 - DNA, 29 bp, Artificial Sequence
  Description of Artificial Sequence: Synthetic oligonucleotide
tcctgcctgatgggaatggaacctaccag

SEQ ID NO: 149302 - DNA, 28 bp, Artificial Sequence
  Description of Artificial Sequence: Synthetic oligonucleotide
cctgcctgatgggaatggaacctaccag

SEQ ID NO: 149303 - DNA, 29 bp, Artificial Sequence
  Description of Artificial Sequence: Synthetic oligonucleotide
ctgcctgatgggaatggaacctaccagac

SEQ ID NO: 149304 - DNA, 29 bp, Artificial Sequence
  Description of Artificial Sequence: Synthetic oligonucleotide
tgcctgatgggaatggaacctaccagacc

SEQ ID NO: 149305 - DNA, 28 bp, Artificial Sequence
  Description of Artificial Sequence: Synthetic oligonucleotide
gcctgatgggaatggaacctaccagacc

SEQ ID NO: 149306 - DNA, 29 bp, Artificial Sequence
  Description of Artificial Sequence: Synthetic oligonucleotide
cctgatgggaatggaacctaccagacctg

SEQ ID NO: 149307 - DNA, 29 bp, Artificial Sequence
  Description of Artificial Sequence: Synthetic oligonucleotide
ctgatgggaatggaacctaccagacctgg

SEQ ID NO: 149308 - DNA, 29 bp, Artificial Sequence
  Description of Artificial Sequence: Synthetic oligonucleotide
tgatgggaatggaacctaccagacctggg

SEQ ID NO: 149309 - DNA, 28 bp, Artificial Sequence
  Description of Artificial Sequence: Synthetic oligonucleotide
gatgggaatggaacctaccagacctggg

SEQ ID NO: 149310 - DNA, 29 bp, Artificial Sequence
  Description of Artificial Sequence: Synthetic oligonucleotide
atgggaatggaacctaccagacctgggtg

SEQ ID NO: 149311 - DNA, 28 bp, Artificial Sequence
  Description of Artificial Sequence: Synthetic oligonucleotide
tgggaatggaacctaccagacctgggtg

SEQ ID NO: 149312 - DNA, 27 bp, Artificial Sequence
  Description of Artificial Sequence: Synthetic oligonucleotide
gggaatggaacctaccagacctgggtg

SEQ ID NO: 149313 - DNA, 27 bp, Artificial Sequence
  Description of Artificial Sequence: Synthetic oligonucleotide
ggaatggaacctaccagacctgggtgg

SEQ ID NO: 149314 - DNA, 27 bp, Artificial Sequence
  Description of Artificial Sequence: Synthetic oligonucleotide
gaatggaacctaccagacctgggtggc

SEQ ID NO: 149315 - DNA, 27 bp, Artificial Sequence
  Description of Artificial Sequence: Synthetic oligonucleotide
aatggaacctaccagacctgggtggcc

SEQ ID NO: 149316 - DNA, 27 bp, Artificial Sequence
  Description of Artificial Sequence: Synthetic oligonucleotide
atggaacctaccagacctgggtggcca

SEQ ID NO: 149317 - DNA, 26 bp, Artificial Sequence
  Description of Artificial Sequence: Synthetic oligonucleotide
tggaacctaccagacctgggtggcca

SEQ ID NO: 149318 - DNA, 25 bp, Artificial Sequence
  Description of Artificial Sequence: Synthetic oligonucleotide
ggaacctaccagacctgggtggcca

SEQ ID NO: 149319 - DNA, 25 bp, Artificial Sequence
  Description of Artificial Sequence: Synthetic oligonucleotide
gaacctaccagacctgggtggccac

SEQ ID NO: 149320 - DNA, 26 bp, Artificial Sequence
  Description of Artificial Sequence: Synthetic oligonucleotide
aacctaccagacctgggtggccacca

SEQ ID NO: 149321 - DNA, 25 bp, Artificial Sequence
  Description of Artificial Sequence: Synthetic oligonucleotide
acctaccagacctgggtggccacca

SEQ ID NO: 149322 - DNA, 24 bp, Artificial Sequence
  Description of Artificial Sequence: Synthetic oligonucleotide
cctaccagacctgggtggccacca

SEQ ID NO: 149323 - DNA, 24 bp, Artificial Sequence
  Description of Artificial Sequence: Synthetic oligonucleotide
ctaccagacctgggtggccaccag

SEQ ID NO: 149324 - DNA, 27 bp, Artificial Sequence
  Description of Artificial Sequence: Synthetic oligonucleotide
taccagacctgggtggccaccaggatt

SEQ ID NO: 149325 - DNA, 27 bp, Artificial Sequence
  Description of Artificial Sequence: Synthetic oligonucleotide
accagacctgggtggccaccaggattt

SEQ ID NO: 149326 - DNA, 26 bp, Artificial Sequence
  Description of Artificial Sequence: Synthetic oligonucleotide
ccagacctgggtggccaccaggattt

SEQ ID NO: 149327 - DNA, 26 bp, Artificial Sequence
  Description of Artificial Sequence: Synthetic oligonucleotide
cagacctgggtggccaccaggatttg

SEQ ID NO: 149328 - DNA, 26 bp, Artificial Sequence
  Description of Artificial Sequence: Synthetic oligonucleotide
agacctgggtggccaccaggatttgc

SEQ ID NO: 149329 - DNA, 25 bp, Artificial Sequence
  Description of Artificial Sequence: Synthetic oligonucleotide
gacctgggtggccaccaggatttgc

SEQ ID NO: 149330 - DNA, 27 bp, Artificial Sequence
  Description of Artificial Sequence: Synthetic oligonucleotide
acctgggtggccaccaggatttgccaa

SEQ ID NO: 149331 - DNA, 26 bp, Artificial Sequence
  Description of Artificial Sequence: Synthetic oligonucleotide
cctgggtggccaccaggatttgccaa

SEQ ID NO: 149332 - DNA, 26 bp, Artificial Sequence
  Description of Artificial Sequence: Synthetic oligonucleotide
ctgggtggccaccaggatttgccaag

SEQ ID NO: 149333 - DNA, 27 bp, Artificial Sequence
  Description of Artificial Sequence: Synthetic oligonucleotide
tgggtggccaccaggatttgccaagga

SEQ ID NO: 149334 - DNA, 26 bp, Artificial Sequence
  Description of Artificial Sequence: Synthetic oligonucleotide
gggtggccaccaggatttgccaagga

SEQ ID NO: 149335 - DNA, 27 bp, Artificial Sequence
  Description of Artificial Sequence: Synthetic oligonucleotide
ggtggccaccaggatttgccaaggaga

SEQ ID NO: 149336 - DNA, 27 bp, Artificial Sequence
  Description of Artificial Sequence: Synthetic oligonucleotide
gtggccaccaggatttgccaaggagag

SEQ ID NO: 149337 - DNA, 27 bp, Artificial Sequence
  Description of Artificial Sequence: Synthetic oligonucleotide
tggccaccaggatttgccaaggagagg

SEQ ID NO: 149338 - DNA, 27 bp, Artificial Sequence
  Description of Artificial Sequence: Synthetic oligonucleotide
ggccaccaggatttgccaaggagagga

SEQ ID NO: 149339 - DNA, 27 bp, Artificial Sequence
  Description of Artificial Sequence: Synthetic oligonucleotide
gccaccaggatttgccaaggagaggag

SEQ ID NO: 149340 - DNA, 27 bp, Artificial Sequence
  Description of Artificial Sequence: Synthetic oligonucleotide
ccaccaggatttgccaaggagaggagc

SEQ ID NO: 149341 - DNA, 28 bp, Artificial Sequence
  Description of Artificial Sequence: Synthetic oligonucleotide
caccaggatttgccaaggagaggagcag

SEQ ID NO: 149342 - DNA, 29 bp, Artificial Sequence
  Description of Artificial Sequence: Synthetic oligonucleotide
accaggatttgccaaggagaggagcagag

SEQ ID NO: 149343 - DNA, 28 bp, Artificial Sequence
  Description of Artificial Sequence: Synthetic oligonucleotide
ccaggatttgccaaggagaggagcagag

SEQ ID NO: 149344 - DNA, 28 bp, Artificial Sequence
  Description of Artificial Sequence: Synthetic oligonucleotide
caggatttgccaaggagaggagcagagg

SEQ ID NO: 149345 - DNA, 30 bp, Artificial Sequence
  Description of Artificial Sequence: Synthetic oligonucleotide
aggatttgccaaggagaggagcagaggttc

SEQ ID NO: 149346 - DNA, 29 bp, Artificial Sequence
  Description of Artificial Sequence: Synthetic oligonucleotide
ggatttgccaaggagaggagcagaggttc

SEQ ID NO: 149347 - DNA, 30 bp, Artificial Sequence
  Description of Artificial Sequence: Synthetic oligonucleotide
gatttgccaaggagaggagcagaggttcac

SEQ ID NO: 149348 - DNA, 30 bp, Artificial Sequence
  Description of Artificial Sequence: Synthetic oligonucleotide
atttgccaaggagaggagcagaggttcacc

SEQ ID NO: 149349 - DNA, 29 bp, Artificial Sequence
  Description of Artificial Sequence: Synthetic oligonucleotide
tttgccaaggagaggagcagaggttcacc

SEQ ID NO: 149350 - DNA, 28 bp, Artificial Sequence
  Description of Artificial Sequence: Synthetic oligonucleotide
ttgccaaggagaggagcagaggttcacc

SEQ ID NO: 149351 - DNA, 27 bp, Artificial Sequence
  Description of Artificial Sequence: Synthetic oligonucleotide
tgccaaggagaggagcagaggttcacc

SEQ ID NO: 149352 - DNA, 27 bp, Artificial Sequence
  Description of Artificial Sequence: Synthetic oligonucleotide
gccaaggagaggagcagaggttcacct

SEQ ID NO: 149353 - DNA, 27 bp, Artificial Sequence
  Description of Artificial Sequence: Synthetic oligonucleotide
ccaaggagaggagcagaggttcacctg

SEQ ID NO: 149354 - DNA, 27 bp, Artificial Sequence
  Description of Artificial Sequence: Synthetic oligonucleotide
caaggagaggagcagaggttcacctgc

SEQ ID NO: 149355 - DNA, 29 bp, Artificial Sequence
  Description of Artificial Sequence: Synthetic oligonucleotide
aaggagaggagcagaggttcacctgctac

SEQ ID NO: 149356 - DNA, 28 bp, Artificial Sequence
  Description of Artificial Sequence: Synthetic oligonucleotide
aggagaggagcagaggttcacctgctac

SEQ ID NO: 149357 - DNA, 27 bp, Artificial Sequence
  Description of Artificial Sequence: Synthetic oligonucleotide
ggagaggagcagaggttcacctgctac

SEQ ID NO: 149358 - DNA, 29 bp, Artificial Sequence
  Description of Artificial Sequence: Synthetic oligonucleotide
gagaggagcagaggttcacctgctacatg

SEQ ID NO: 149359 - DNA, 29 bp, Artificial Sequence
  Description of Artificial Sequence: Synthetic oligonucleotide
agaggagcagaggttcacctgctacatgg

SEQ ID NO: 149360 - DNA, 28 bp, Artificial Sequence
  Description of Artificial Sequence: Synthetic oligonucleotide
gaggagcagaggttcacctgctacatgg

SEQ ID NO: 149361 - DNA, 30 bp, Artificial Sequence
  Description of Artificial Sequence: Synthetic oligonucleotide
aggagcagaggttcacctgctacatggaac

SEQ ID NO: 149362 - DNA, 29 bp, Artificial Sequence
  Description of Artificial Sequence: Synthetic oligonucleotide
ggagcagaggttcacctgctacatggaac

SEQ ID NO: 149363 - DNA, 30 bp, Artificial Sequence
  Description of Artificial Sequence: Synthetic oligonucleotide
gagcagaggttcacctgctacatggaacac

SEQ ID NO: 149364 - DNA, 31 bp, Artificial Sequence
  Description of Artificial Sequence: Synthetic oligonucleotide
agcagaggttcacctgctacatggaacacag

SEQ ID NO: 149365 - DNA, 30 bp, Artificial Sequence
  Description of Artificial Sequence: Synthetic oligonucleotide
gcagaggttcacctgctacatggaacacag

SEQ ID NO: 149366 - DNA, 30 bp, Artificial Sequence
  Description of Artificial Sequence: Synthetic oligonucleotide
cagaggttcacctgctacatggaacacagc

SEQ ID NO: 149367 - DNA, 30 bp, Artificial Sequence
  Description of Artificial Sequence: Synthetic oligonucleotide
agaggttcacctgctacatggaacacagcg

SEQ ID NO: 149368 - DNA, 29 bp, Artificial Sequence
  Description of Artificial Sequence: Synthetic oligonucleotide
gaggttcacctgctacatggaacacagcg

SEQ ID NO: 149369 - DNA, 29 bp, Artificial Sequence
  Description of Artificial Sequence: Synthetic oligonucleotide
aggttcacctgctacatggaacacagcgg

SEQ ID NO: 149370 - DNA, 28 bp, Artificial Sequence
  Description of Artificial Sequence: Synthetic oligonucleotide
ggttcacctgctacatggaacacagcgg

SEQ ID NO: 149371 - DNA, 28 bp, Artificial Sequence
  Description of Artificial Sequence: Synthetic oligonucleotide
gttcacctgctacatggaacacagcggg

SEQ ID NO: 149372 - DNA, 31 bp, Artificial Sequence
  Description of Artificial Sequence: Synthetic oligonucleotide
ttcacctgctacatggaacacagcgggaatc

SEQ ID NO: 149373 - DNA, 30 bp, Artificial Sequence
  Description of Artificial Sequence: Synthetic oligonucleotide
tcacctgctacatggaacacagcgggaatc

SEQ ID NO: 149374 - DNA, 29 bp, Artificial Sequence
  Description of Artificial Sequence: Synthetic oligonucleotide
cacctgctacatggaacacagcgggaatc

SEQ ID NO: 149375 - DNA, 30 bp, Artificial Sequence
  Description of Artificial Sequence: Synthetic oligonucleotide
acctgctacatggaacacagcgggaatcac

SEQ ID NO: 149376 - DNA, 29 bp, Artificial Sequence
  Description of Artificial Sequence: Synthetic oligonucleotide
cctgctacatggaacacagcgggaatcac

SEQ ID NO: 149377 - DNA, 30 bp, Artificial Sequence
  Description of Artificial Sequence: Synthetic oligonucleotide
ctgctacatggaacacagcgggaatcacag

SEQ ID NO: 149378 - DNA, 30 bp, Artificial Sequence
  Description of Artificial Sequence: Synthetic oligonucleotide
tgctacatggaacacagcgggaatcacagc

SEQ ID NO: 149379 - DNA, 29 bp, Artificial Sequence
  Description of Artificial Sequence: Synthetic oligonucleotide
gctacatggaacacagcgggaatcacagc

SEQ ID NO: 149380 - DNA, 30 bp, Artificial Sequence
  Description of Artificial Sequence: Synthetic oligonucleotide
ctacatggaacacagcgggaatcacagcac

SEQ ID NO: 149381 - DNA, 31 bp, Artificial Sequence
  Description of Artificial Sequence: Synthetic oligonucleotide
tacatggaacacagcgggaatcacagcactc

SEQ ID NO: 149382 - DNA, 30 bp, Artificial Sequence
  Description of Artificial Sequence: Synthetic oligonucleotide
acatggaacacagcgggaatcacagcactc

SEQ ID NO: 149383 - DNA, 29 bp, Artificial Sequence
  Description of Artificial Sequence: Synthetic oligonucleotide
catggaacacagcgggaatcacagcactc

SEQ ID NO: 149384 - DNA, 30 bp, Artificial Sequence
  Description of Artificial Sequence: Synthetic oligonucleotide
atggaacacagcgggaatcacagcactcac

SEQ ID NO: 149385 - DNA, 29 bp, Artificial Sequence
  Description of Artificial Sequence: Synthetic oligonucleotide
tggaacacagcgggaatcacagcactcac

SEQ ID NO: 149386 - DNA, 28 bp, Artificial Sequence
  Description of Artificial Sequence: Synthetic oligonucleotide
ggaacacagcgggaatcacagcactcac

SEQ ID NO: 149387 - DNA, 28 bp, Artificial Sequence
  Description of Artificial Sequence: Synthetic oligonucleotide
gaacacagcgggaatcacagcactcacc

SEQ ID NO: 149388 - DNA, 28 bp, Artificial Sequence
  Description of Artificial Sequence: Synthetic oligonucleotide
aacacagcgggaatcacagcactcaccc

SEQ ID NO: 149389 - DNA, 27 bp, Artificial Sequence
  Description of Artificial Sequence: Synthetic oligonucleotide
acacagcgggaatcacagcactcaccc

SEQ ID NO: 149390 - DNA, 27 bp, Artificial Sequence
  Description of Artificial Sequence: Synthetic oligonucleotide
cacagcgggaatcacagcactcaccct

SEQ ID NO: 149391 - DNA, 27 bp, Artificial Sequence
  Description of Artificial Sequence: Synthetic oligonucleotide
acagcgggaatcacagcactcaccctg

SEQ ID NO: 149392 - DNA, 27 bp, Artificial Sequence
  Description of Artificial Sequence: Synthetic oligonucleotide
cagcgggaatcacagcactcaccctgt

SEQ ID NO: 149393 - DNA, 27 bp, Artificial Sequence
  Description of Artificial Sequence: Synthetic oligonucleotide
agcgggaatcacagcactcaccctgtg

SEQ ID NO: 149394 - DNA, 26 bp, Artificial Sequence
  Description of Artificial Sequence: Synthetic oligonucleotide
gcgggaatcacagcactcaccctgtg

SEQ ID NO: 149395 - DNA, 26 bp, Artificial Sequence
  Description of Artificial Sequence: Synthetic oligonucleotide
cgggaatcacagcactcaccctgtgc

SEQ ID NO: 149396 - DNA, 26 bp, Artificial Sequence
  Description of Artificial Sequence: Synthetic oligonucleotide
gggaatcacagcactcaccctgtgcc

SEQ ID NO: 149397 - DNA, 27 bp, Artificial Sequence
  Description of Artificial Sequence: Synthetic oligonucleotide
ggaatcacagcactcaccctgtgccct

SEQ ID NO: 149398 - DNA, 27 bp, Artificial Sequence
  Description of Artificial Sequence: Synthetic oligonucleotide
gaatcacagcactcaccctgtgccctc

SEQ ID NO: 149399 - DNA, 28 bp, Artificial Sequence
  Description of Artificial Sequence: Synthetic oligonucleotide
aatcacagcactcaccctgtgccctctg

SEQ ID NO: 149400 - DNA, 27 bp, Artificial Sequence
  Description of Artificial Sequence: Synthetic oligonucleotide
atcacagcactcaccctgtgccctctg

SEQ ID NO: 149401 - DNA, 26 bp, Artificial Sequence
  Description of Artificial Sequence: Synthetic oligonucleotide
tcacagcactcaccctgtgccctctg

SEQ ID NO: 149402 - DNA, 25 bp, Artificial Sequence
  Description of Artificial Sequence: Synthetic oligonucleotide
cacagcactcaccctgtgccctctg

SEQ ID NO: 149403 - DNA, 25 bp, Artificial Sequence
  Description of Artificial Sequence: Synthetic oligonucleotide
acagcactcaccctgtgccctctgg

SEQ ID NO: 149404 - DNA, 24 bp, Artificial Sequence
  Description of Artificial Sequence: Synthetic oligonucleotide
cagcactcaccctgtgccctctgg

SEQ ID NO: 149405 - DNA, 27 bp, Artificial Sequence
  Description of Artificial Sequence: Synthetic oligonucleotide
agcactcaccctgtgccctctgggaaa

SEQ ID NO: 149406 - DNA, 26 bp, Artificial Sequence
  Description of Artificial Sequence: Synthetic oligonucleotide
gcactcaccctgtgccctctgggaaa

SEQ ID NO: 149407 - DNA, 27 bp, Artificial Sequence
  Description of Artificial Sequence: Synthetic oligonucleotide
cactcaccctgtgccctctgggaaagt

SEQ ID NO: 149408 - DNA, 27 bp, Artificial Sequence
  Description of Artificial Sequence: Synthetic oligonucleotide
actcaccctgtgccctctgggaaagtg

SEQ ID NO: 149409 - DNA, 26 bp, Artificial Sequence
  Description of Artificial Sequence: Synthetic oligonucleotide
ctcaccctgtgccctctgggaaagtg

SEQ ID NO: 149410 - DNA, 27 bp, Artificial Sequence
  Description of Artificial Sequence: Synthetic oligonucleotide
tcaccctgtgccctctgggaaagtgct

SEQ ID NO: 149411 - DNA, 26 bp, Artificial Sequence
  Description of Artificial Sequence: Synthetic oligonucleotide
caccctgtgccctctgggaaagtgct

SEQ ID NO: 149412 - DNA, 26 bp, Artificial Sequence
  Description of Artificial Sequence: Synthetic oligonucleotide
accctgtgccctctgggaaagtgctg

SEQ ID NO: 149413 - DNA, 25 bp, Artificial Sequence
  Description of Artificial Sequence: Synthetic oligonucleotide
ccctgtgccctctgggaaagtgctg

SEQ ID NO: 149414 - DNA, 26 bp, Artificial Sequence
  Description of Artificial Sequence: Synthetic oligonucleotide
cctgtgccctctgggaaagtgctggt

SEQ ID NO: 149415 - DNA, 26 bp, Artificial Sequence
  Description of Artificial Sequence: Synthetic oligonucleotide
ctgtgccctctgggaaagtgctggtg

SEQ ID NO: 149416 - DNA, 27 bp, Artificial Sequence
  Description of Artificial Sequence: Synthetic oligonucleotide
tgtgccctctgggaaagtgctggtgct

SEQ ID NO: 149417 - DNA, 27 bp, Artificial Sequence
  Description of Artificial Sequence: Synthetic oligonucleotide
gtgccctctgggaaagtgctggtgctt

SEQ ID NO: 149418 - DNA, 27 bp, Artificial Sequence
  Description of Artificial Sequence: Synthetic oligonucleotide
tgccctctgggaaagtgctggtgcttc

SEQ ID NO: 149419 - DNA, 27 bp, Artificial Sequence
  Description of Artificial Sequence: Synthetic oligonucleotide
gccctctgggaaagtgctggtgcttca

SEQ ID NO: 149420 - DNA, 27 bp, Artificial Sequence
  Description of Artificial Sequence: Synthetic oligonucleotide
ccctctgggaaagtgctggtgcttcag

SEQ ID NO: 149421 - DNA, 28 bp, Artificial Sequence
  Description of Artificial Sequence: Synthetic oligonucleotide
cctctgggaaagtgctggtgcttcagag

SEQ ID NO: 149422 - DNA, 29 bp, Artificial Sequence
  Description of Artificial Sequence: Synthetic oligonucleotide
ctctgggaaagtgctggtgcttcagagtc

SEQ ID NO: 149423 - DNA, 32 bp, Artificial Sequence
  Description of Artificial Sequence: Synthetic oligonucleotide
tctgggaaagtgctggtgcttcagagtcattg

SEQ ID NO: 149424 - DNA, 31 bp, Artificial Sequence
  Description of Artificial Sequence: Synthetic oligonucleotide
ctgggaaagtgctggtgcttcagagtcattg

SEQ ID NO: 149425 - DNA, 31 bp, Artificial Sequence
  Description of Artificial Sequence: Synthetic oligonucleotide
tgggaaagtgctggtgcttcagagtcattgg

SEQ ID NO: 149426 - DNA, 30 bp, Artificial Sequence
  Description of Artificial Sequence: Synthetic oligonucleotide
gggaaagtgctggtgcttcagagtcattgg

SEQ ID NO: 149427 - DNA, 30 bp, Artificial Sequence
  Description of Artificial Sequence: Synthetic oligonucleotide
ggaaagtgctggtgcttcagagtcattggc

SEQ ID NO: 149428 - DNA, 31 bp, Artificial Sequence
  Description of Artificial Sequence: Synthetic oligonucleotide
gaaagtgctggtgcttcagagtcattggcag

SEQ ID NO: 149429 - DNA, 32 bp, Artificial Sequence
  Description of Artificial Sequence: Synthetic oligonucleotide
aaagtgctggtgcttcagagtcattggcagac

SEQ ID NO: 149430 - DNA, 31 bp, Artificial Sequence
  Description of Artificial Sequence: Synthetic oligonucleotide
aagtgctggtgcttcagagtcattggcagac

SEQ ID NO: 149431 - DNA, 30 bp, Artificial Sequence
  Description of Artificial Sequence: Synthetic oligonucleotide
agtgctggtgcttcagagtcattggcagac

SEQ ID NO: 149432 - DNA, 29 bp, Artificial Sequence
  Description of Artificial Sequence: Synthetic oligonucleotide
gtgctggtgcttcagagtcattggcagac

SEQ ID NO: 149433 - DNA, 32 bp, Artificial Sequence
  Description of Artificial Sequence: Synthetic oligonucleotide
tgctggtgcttcagagtcattggcagacattc

SEQ ID NO: 149434 - DNA, 31 bp, Artificial Sequence
  Description of Artificial Sequence: Synthetic oligonucleotide
gctggtgcttcagagtcattggcagacattc

SEQ ID NO: 149435 - DNA, 31 bp, Artificial Sequence
  Description of Artificial Sequence: Synthetic oligonucleotide
ctggtgcttcagagtcattggcagacattcc

SEQ ID NO: 149436 - DNA, 33 bp, Artificial Sequence
  Description of Artificial Sequence: Synthetic oligonucleotide
tggtgcttcagagtcattggcagacattccatg

SEQ ID NO: 149437 - DNA, 32 bp, Artificial Sequence
  Description of Artificial Sequence: Synthetic oligonucleotide
ggtgcttcagagtcattggcagacattccatg

SEQ ID NO: 149438 - DNA, 35 bp, Artificial Sequence
  Description of Artificial Sequence: Synthetic oligonucleotide
gtgcttcagagtcattggcagacattccatgtttc

SEQ ID NO: 149439 - DNA, 36 bp, Artificial Sequence
  Description of Artificial Sequence: Synthetic oligonucleotide
tgcttcagagtcattggcagacattccatgtttctg

SEQ ID NO: 149440 - DNA, 35 bp, Artificial Sequence
  Description of Artificial Sequence: Synthetic oligonucleotide
gcttcagagtcattggcagacattccatgtttctg

SEQ ID NO: 149441 - DNA, 35 bp, Artificial Sequence
  Description of Artificial Sequence: Synthetic oligonucleotide
cttcagagtcattggcagacattccatgtttctgc

SEQ ID NO: 149442 - DNA, 36 bp, Artificial Sequence
  Description of Artificial Sequence: Synthetic oligonucleotide
ttcagagtcattggcagacattccatgtttctgctg

SEQ ID NO: 149443 - DNA, 35 bp, Artificial Sequence
  Description of Artificial Sequence: Synthetic oligonucleotide
tcagagtcattggcagacattccatgtttctgctg

SEQ ID NO: 149444 - DNA, 34 bp, Artificial Sequence
  Description of Artificial Sequence: Synthetic oligonucleotide
cagagtcattggcagacattccatgtttctgctg

SEQ ID NO: 149445 - DNA, 36 bp, Artificial Sequence
  Description of Artificial Sequence: Synthetic oligonucleotide
agagtcattggcagacattccatgtttctgctgttg

SEQ ID NO: 149446 - DNA, 35 bp, Artificial Sequence
  Description of Artificial Sequence: Synthetic oligonucleotide
gagtcattggcagacattccatgtttctgctgttg

SEQ ID NO: 149447 - DNA, 35 bp, Artificial Sequence
  Description of Artificial Sequence: Synthetic oligonucleotide
agtcattggcagacattccatgtttctgctgttgc

SEQ ID NO: 149448 - DNA, 34 bp, Artificial Sequence
  Description of Artificial Sequence: Synthetic oligonucleotide
gtcattggcagacattccatgtttctgctgttgc

SEQ ID NO: 149449 - DNA, 35 bp, Artificial Sequence
  Description of Artificial Sequence: Synthetic oligonucleotide
tcattggcagacattccatgtttctgctgttgctg

SEQ ID NO: 149450 - DNA, 34 bp, Artificial Sequence
  Description of Artificial Sequence: Synthetic oligonucleotide
cattggcagacattccatgtttctgctgttgctg

SEQ ID NO: 149451 - DNA, 34 bp, Artificial Sequence
  Description of Artificial Sequence: Synthetic oligonucleotide
attggcagacattccatgtttctgctgttgctgc

SEQ ID NO: 149452 - DNA, 33 bp, Artificial Sequence
  Description of Artificial Sequence: Synthetic oligonucleotide
ttggcagacattccatgtttctgctgttgctgc

SEQ ID NO: 149453 - DNA, 32 bp, Artificial Sequence
  Description of Artificial Sequence: Synthetic oligonucleotide
tggcagacattccatgtttctgctgttgctgc

SEQ ID NO: 149454 - DNA, 31 bp, Artificial Sequence
  Description of Artificial Sequence: Synthetic oligonucleotide
ggcagacattccatgtttctgctgttgctgc

SEQ ID NO: 149455 - DNA, 32 bp, Artificial Sequence
  Description of Artificial Sequence: Synthetic oligonucleotide
gcagacattccatgtttctgctgttgctgctg

SEQ ID NO: 149456 - DNA, 32 bp, Artificial Sequence
  Description of Artificial Sequence: Synthetic oligonucleotide
cagacattccatgtttctgctgttgctgctgc

SEQ ID NO: 149457 - DNA, 33 bp, Artificial Sequence
  Description of Artificial Sequence: Synthetic oligonucleotide
agacattccatgtttctgctgttgctgctgctg

SEQ ID NO: 149458 - DNA, 32 bp, Artificial Sequence
  Description of Artificial Sequence: Synthetic oligonucleotide
gacattccatgtttctgctgttgctgctgctg

SEQ ID NO: 149459 - DNA, 32 bp, Artificial Sequence
  Description of Artificial Sequence: Synthetic oligonucleotide
acattccatgtttctgctgttgctgctgctgc

SEQ ID NO: 149460 - DNA, 31 bp, Artificial Sequence
  Description of Artificial Sequence: Synthetic oligonucleotide
cattccatgtttctgctgttgctgctgctgc

SEQ ID NO: 149461 - DNA, 38 bp, Artificial Sequence
  Description of Artificial Sequence: Synthetic oligonucleotide
attccatgtttctgctgttgctgctgctgctatttttg

SEQ ID NO: 149462 - DNA, 37 bp, Artificial Sequence
  Description of Artificial Sequence: Synthetic oligonucleotide
ttccatgtttctgctgttgctgctgctgctatttttg

SEQ ID NO: 149463 - DNA, 36 bp, Artificial Sequence
  Description of Artificial Sequence: Synthetic oligonucleotide
tccatgtttctgctgttgctgctgctgctatttttg

SEQ ID NO: 149464 - DNA, 35 bp, Artificial Sequence
  Description of Artificial Sequence: Synthetic oligonucleotide
ccatgtttctgctgttgctgctgctgctatttttg

SEQ ID NO: 149465 - DNA, 48 bp, Artificial Sequence
  Description of Artificial Sequence: Synthetic oligonucleotide
catgtttctgctgttgctgctgctgctatttttgttattattattttc

SEQ ID NO: 149466 - DNA, 51 bp, Artificial Sequence
  Description of Artificial Sequence: Synthetic oligonucleotide
atgtttctgctgttgctgctgctgctatttttgttattattattttctatg

SEQ ID NO: 149467 - DNA, 50 bp, Artificial Sequence
  Description of Artificial Sequence: Synthetic oligonucleotide
tgtttctgctgttgctgctgctgctatttttgttattattattttctatg

SEQ ID NO: 149468 - DNA, 49 bp, Artificial Sequence
  Description of Artificial Sequence: Synthetic oligonucleotide
gtttctgctgttgctgctgctgctatttttgttattattattttctatg

SEQ ID NO: 149469 - DNA, 50 bp, Artificial Sequence
  Description of Artificial Sequence: Synthetic oligonucleotide
tttctgctgttgctgctgctgctatttttgttattattattttctatgtc

SEQ ID NO: 149470 - DNA, 49 bp, Artificial Sequence
  Description of Artificial Sequence: Synthetic oligonucleotide
ttctgctgttgctgctgctgctatttttgttattattattttctatgtc

SEQ ID NO: 149471 - DNA, 48 bp, Artificial Sequence
  Description of Artificial Sequence: Synthetic oligonucleotide
tctgctgttgctgctgctgctatttttgttattattattttctatgtc

SEQ ID NO: 149472 - DNA, 47 bp, Artificial Sequence
  Description of Artificial Sequence: Synthetic oligonucleotide
ctgctgttgctgctgctgctatttttgttattattattttctatgtc

SEQ ID NO: 149473 - DNA, 47 bp, Artificial Sequence
  Description of Artificial Sequence: Synthetic oligonucleotide
tgctgttgctgctgctgctatttttgttattattattttctatgtcc

SEQ ID NO: 149474 - DNA, 46 bp, Artificial Sequence
  Description of Artificial Sequence: Synthetic oligonucleotide
gctgttgctgctgctgctatttttgttattattattttctatgtcc

SEQ ID NO: 149475 - DNA, 46 bp, Artificial Sequence
  Description of Artificial Sequence: Synthetic oligonucleotide
ctgttgctgctgctgctatttttgttattattattttctatgtccg

SEQ ID NO: 149476 - DNA, 48 bp, Artificial Sequence
  Description of Artificial Sequence: Synthetic oligonucleotide
tgttgctgctgctgctatttttgttattattattttctatgtccgttg

SEQ ID NO: 149477 - DNA, 47 bp, Artificial Sequence
  Description of Artificial Sequence: Synthetic oligonucleotide
gttgctgctgctgctatttttgttattattattttctatgtccgttg

SEQ ID NO: 149478 - DNA, 49 bp, Artificial Sequence
  Description of Artificial Sequence: Synthetic oligonucleotide
ttgctgctgctgctatttttgttattattattttctatgtccgttgttg

SEQ ID NO: 149479 - DNA, 48 bp, Artificial Sequence
  Description of Artificial Sequence: Synthetic oligonucleotide
tgctgctgctgctatttttgttattattattttctatgtccgttgttg

SEQ ID NO: 149480 - DNA, 47 bp, Artificial Sequence
  Description of Artificial Sequence: Synthetic oligonucleotide
gctgctgctgctatttttgttattattattttctatgtccgttgttg

SEQ ID NO: 149481 - DNA, 50 bp, Artificial Sequence
  Description of Artificial Sequence: Synthetic oligonucleotide
ctgctgctgctatttttgttattattattttctatgtccgttgttgtaag

SEQ ID NO: 149482 - DNA, 52 bp, Artificial Sequence
  Description of Artificial Sequence: Synthetic oligonucleotide
tgctgctgctatttttgttattattattttctatgtccgttgttgtaagaag

SEQ ID NO: 149483 - DNA, 51 bp, Artificial Sequence
  Description of Artificial Sequence: Synthetic oligonucleotide
gctgctgctatttttgttattattattttctatgtccgttgttgtaagaag

SEQ ID NO: 149484 - DNA, 55 bp, Artificial Sequence
  Description of Artificial Sequence: Synthetic oligonucleotide
ctgctgctatttttgttattattattttctatgtccgttgttgtaagaagaaaac

SEQ ID NO: 149485 - DNA, 57 bp, Artificial Sequence
  Description of Artificial Sequence: Synthetic oligonucleotide
tgctgctatttttgttattattattttctatgtccgttgttgtaagaagaaaacatc

SEQ ID NO: 149486 - DNA, 56 bp, Artificial Sequence
  Description of Artificial Sequence: Synthetic oligonucleotide
gctgctatttttgttattattattttctatgtccgttgttgtaagaagaaaacatc

SEQ ID NO: 149487 - DNA, 57 bp, Artificial Sequence
  Description of Artificial Sequence: Synthetic oligonucleotide
ctgctatttttgttattattattttctatgtccgttgttgtaagaagaaaacatcag

SEQ ID NO: 149488 - DNA, 57 bp, Artificial Sequence
  Description of Artificial Sequence: Synthetic oligonucleotide
tgctatttttgttattattattttctatgtccgttgttgtaagaagaaaacatcagc

SEQ ID NO: 149489 - DNA, 56 bp, Artificial Sequence
  Description of Artificial Sequence: Synthetic oligonucleotide
gctatttttgttattattattttctatgtccgttgttgtaagaagaaaacatcagc

SEQ ID NO: 149490 - DNA, 57 bp, Artificial Sequence
  Description of Artificial Sequence: Synthetic oligonucleotide
ctatttttgttattattattttctatgtccgttgttgtaagaagaaaacatcagctg

SEQ ID NO: 149491 - DNA, 57 bp, Artificial Sequence
  Description of Artificial Sequence: Synthetic oligonucleotide
tatttttgttattattattttctatgtccgttgttgtaagaagaaaacatcagctgc

SEQ ID NO: 149492 - DNA, 56 bp, Artificial Sequence
  Description of Artificial Sequence: Synthetic oligonucleotide
atttttgttattattattttctatgtccgttgttgtaagaagaaaacatcagctgc

SEQ ID NO: 149493 - DNA, 55 bp, Artificial Sequence
  Description of Artificial Sequence: Synthetic oligonucleotide
tttttgttattattattttctatgtccgttgttgtaagaagaaaacatcagctgc

SEQ ID NO: 149494 - DNA, 54 bp, Artificial Sequence
  Description of Artificial Sequence: Synthetic oligonucleotide
ttttgttattattattttctatgtccgttgttgtaagaagaaaacatcagctgc

SEQ ID NO: 149495 - DNA, 53 bp, Artificial Sequence
  Description of Artificial Sequence: Synthetic oligonucleotide
tttgttattattattttctatgtccgttgttgtaagaagaaaacatcagctgc

SEQ ID NO: 149496 - DNA, 52 bp, Artificial Sequence
  Description of Artificial Sequence: Synthetic oligonucleotide
ttgttattattattttctatgtccgttgttgtaagaagaaaacatcagctgc

SEQ ID NO: 149497 - DNA, 51 bp, Artificial Sequence
  Description of Artificial Sequence: Synthetic oligonucleotide
tgttattattattttctatgtccgttgttgtaagaagaaaacatcagctgc

SEQ ID NO: 149498 - DNA, 50 bp, Artificial Sequence
  Description of Artificial Sequence: Synthetic oligonucleotide
gttattattattttctatgtccgttgttgtaagaagaaaacatcagctgc

SEQ ID NO: 149499 - DNA, 51 bp, Artificial Sequence
  Description of Artificial Sequence: Synthetic oligonucleotide
ttattattattttctatgtccgttgttgtaagaagaaaacatcagctgcag

SEQ ID NO: 149500 - DNA, 50 bp, Artificial Sequence
  Description of Artificial Sequence: Synthetic oligonucleotide
tattattattttctatgtccgttgttgtaagaagaaaacatcagctgcag

SEQ ID NO: 149501 - DNA, 49 bp, Artificial Sequence
  Description of Artificial Sequence: Synthetic oligonucleotide
attattattttctatgtccgttgttgtaagaagaaaacatcagctgcag

SEQ ID NO: 149502 - DNA, 48 bp, Artificial Sequence
  Description of Artificial Sequence: Synthetic oligonucleotide
ttattattttctatgtccgttgttgtaagaagaaaacatcagctgcag

SEQ ID NO: 149503 - DNA, 47 bp, Artificial Sequence
  Description of Artificial Sequence: Synthetic oligonucleotide
tattattttctatgtccgttgttgtaagaagaaaacatcagctgcag

SEQ ID NO: 149504 - DNA, 46 bp, Artificial Sequence
  Description of Artificial Sequence: Synthetic oligonucleotide
attattttctatgtccgttgttgtaagaagaaaacatcagctgcag

SEQ ID NO: 149505 - DNA, 45 bp, Artificial Sequence
  Description of Artificial Sequence: Synthetic oligonucleotide
ttattttctatgtccgttgttgtaagaagaaaacatcagctgcag

SEQ ID NO: 149506 - DNA, 44 bp, Artificial Sequence
  Description of Artificial Sequence: Synthetic oligonucleotide
tattttctatgtccgttgttgtaagaagaaaacatcagctgcag

SEQ ID NO: 149507 - DNA, 43 bp, Artificial Sequence
  Description of Artificial Sequence: Synthetic oligonucleotide
attttctatgtccgttgttgtaagaagaaaacatcagctgcag

SEQ ID NO: 149508 - DNA, 42 bp, Artificial Sequence
  Description of Artificial Sequence: Synthetic oligonucleotide
ttttctatgtccgttgttgtaagaagaaaacatcagctgcag

SEQ ID NO: 149509 - DNA, 41 bp, Artificial Sequence
  Description of Artificial Sequence: Synthetic oligonucleotide
tttctatgtccgttgttgtaagaagaaaacatcagctgcag

SEQ ID NO: 149510 - DNA, 40 bp, Artificial Sequence
  Description of Artificial Sequence: Synthetic oligonucleotide
ttctatgtccgttgttgtaagaagaaaacatcagctgcag

SEQ ID NO: 149511 - DNA, 39 bp, Artificial Sequence
  Description of Artificial Sequence: Synthetic oligonucleotide
tctatgtccgttgttgtaagaagaaaacatcagctgcag

SEQ ID NO: 149512 - DNA, 38 bp, Artificial Sequence
  Description of Artificial Sequence: Synthetic oligonucleotide
ctatgtccgttgttgtaagaagaaaacatcagctgcag

SEQ ID NO: 149513 - DNA, 39 bp, Artificial Sequence
  Description of Artificial Sequence: Synthetic oligonucleotide
tatgtccgttgttgtaagaagaaaacatcagctgcagag

SEQ ID NO: 149514 - DNA, 38 bp, Artificial Sequence
  Description of Artificial Sequence: Synthetic oligonucleotide
atgtccgttgttgtaagaagaaaacatcagctgcagag

SEQ ID NO: 149515 - DNA, 37 bp, Artificial Sequence
  Description of Artificial Sequence: Synthetic oligonucleotide
tgtccgttgttgtaagaagaaaacatcagctgcagag

SEQ ID NO: 149516 - DNA, 36 bp, Artificial Sequence
  Description of Artificial Sequence: Synthetic oligonucleotide
gtccgttgttgtaagaagaaaacatcagctgcagag

SEQ ID NO: 149517 - DNA, 36 bp, Artificial Sequence
  Description of Artificial Sequence: Synthetic oligonucleotide
tccgttgttgtaagaagaaaacatcagctgcagagg

SEQ ID NO: 149518 - DNA, 35 bp, Artificial Sequence
  Description of Artificial Sequence: Synthetic oligonucleotide
ccgttgttgtaagaagaaaacatcagctgcagagg

SEQ ID NO: 149519 - DNA, 35 bp, Artificial Sequence
  Description of Artificial Sequence: Synthetic oligonucleotide
cgttgttgtaagaagaaaacatcagctgcagaggg

SEQ ID NO: 149520 - DNA, 36 bp, Artificial Sequence
  Description of Artificial Sequence: Synthetic oligonucleotide
gttgttgtaagaagaaaacatcagctgcagagggtc

SEQ ID NO: 149521 - DNA, 36 bp, Artificial Sequence
  Description of Artificial Sequence: Synthetic oligonucleotide
ttgttgtaagaagaaaacatcagctgcagagggtcc

SEQ ID NO: 149522 - DNA, 35 bp, Artificial Sequence
  Description of Artificial Sequence: Synthetic oligonucleotide
tgttgtaagaagaaaacatcagctgcagagggtcc

SEQ ID NO: 149523 - DNA, 34 bp, Artificial Sequence
  Description of Artificial Sequence: Synthetic oligonucleotide
gttgtaagaagaaaacatcagctgcagagggtcc

SEQ ID NO: 149524 - DNA, 35 bp, Artificial Sequence
  Description of Artificial Sequence: Synthetic oligonucleotide
ttgtaagaagaaaacatcagctgcagagggtccag

SEQ ID NO: 149525 - DNA, 34 bp, Artificial Sequence
  Description of Artificial Sequence: Synthetic oligonucleotide
tgtaagaagaaaacatcagctgcagagggtccag

SEQ ID NO: 149526 - DNA, 33 bp, Artificial Sequence
  Description of Artificial Sequence: Synthetic oligonucleotide
gtaagaagaaaacatcagctgcagagggtccag

SEQ ID NO: 149527 - DNA, 34 bp, Artificial Sequence
  Description of Artificial Sequence: Synthetic oligonucleotide
taagaagaaaacatcagctgcagagggtccagag

SEQ ID NO: 149528 - DNA, 33 bp, Artificial Sequence
  Description of Artificial Sequence: Synthetic oligonucleotide
aagaagaaaacatcagctgcagagggtccagag

SEQ ID NO: 149529 - DNA, 32 bp, Artificial Sequence
  Description of Artificial Sequence: Synthetic oligonucleotide
agaagaaaacatcagctgcagagggtccagag

SEQ ID NO: 149530 - DNA, 31 bp, Artificial Sequence
  Description of Artificial Sequence: Synthetic oligonucleotide
gaagaaaacatcagctgcagagggtccagag

SEQ ID NO: 149531 - DNA, 31 bp, Artificial Sequence
  Description of Artificial Sequence: Synthetic oligonucleotide
aagaaaacatcagctgcagagggtccagagc

SEQ ID NO: 149532 - DNA, 30 bp, Artificial Sequence
  Description of Artificial Sequence: Synthetic oligonucleotide
agaaaacatcagctgcagagggtccagagc

SEQ ID NO: 149533 - DNA, 29 bp, Artificial Sequence
  Description of Artificial Sequence: Synthetic oligonucleotide
gaaaacatcagctgcagagggtccagagc

SEQ ID NO: 149534 - DNA, 30 bp, Artificial Sequence
  Description of Artificial Sequence: Synthetic oligonucleotide
aaaacatcagctgcagagggtccagagctc

SEQ ID NO: 149535 - DNA, 29 bp, Artificial Sequence
  Description of Artificial Sequence: Synthetic oligonucleotide
aaacatcagctgcagagggtccagagctc

SEQ ID NO: 149536 - DNA, 28 bp, Artificial Sequence
  Description of Artificial Sequence: Synthetic oligonucleotide
aacatcagctgcagagggtccagagctc

SEQ ID NO: 149537 - DNA, 27 bp, Artificial Sequence
  Description of Artificial Sequence: Synthetic oligonucleotide
acatcagctgcagagggtccagagctc

SEQ ID NO: 149538 - DNA, 26 bp, Artificial Sequence
  Description of Artificial Sequence: Synthetic oligonucleotide
catcagctgcagagggtccagagctc

SEQ ID NO: 149539 - DNA, 27 bp, Artificial Sequence
  Description of Artificial Sequence: Synthetic oligonucleotide
atcagctgcagagggtccagagctcgt

SEQ ID NO: 149540 - DNA, 26 bp, Artificial Sequence
  Description of Artificial Sequence: Synthetic oligonucleotide
tcagctgcagagggtccagagctcgt

SEQ ID NO: 149541 - DNA, 25 bp, Artificial Sequence
  Description of Artificial Sequence: Synthetic oligonucleotide
cagctgcagagggtccagagctcgt

SEQ ID NO: 149542 - DNA, 26 bp, Artificial Sequence
  Description of Artificial Sequence: Synthetic oligonucleotide
agctgcagagggtccagagctcgtga

SEQ ID NO: 149543 - DNA, 25 bp, Artificial Sequence
  Description of Artificial Sequence: Synthetic oligonucleotide
gctgcagagggtccagagctcgtga

SEQ ID NO: 149544 - DNA, 25 bp, Artificial Sequence
  Description of Artificial Sequence: Synthetic oligonucleotide
ctgcagagggtccagagctcgtgag

SEQ ID NO: 149545 - DNA, 25 bp, Artificial Sequence
  Description of Artificial Sequence: Synthetic oligonucleotide
tgcagagggtccagagctcgtgagc

SEQ ID NO: 149546 - DNA, 24 bp, Artificial Sequence
  Description of Artificial Sequence: Synthetic oligonucleotide
gcagagggtccagagctcgtgagc

SEQ ID NO: 149547 - DNA, 25 bp, Artificial Sequence
  Description of Artificial Sequence: Synthetic oligonucleotide
cagagggtccagagctcgtgagcct

SEQ ID NO: 149548 - DNA, 25 bp, Artificial Sequence
  Description of Artificial Sequence: Synthetic oligonucleotide
agagggtccagagctcgtgagcctg

SEQ ID NO: 149549 - DNA, 24 bp, Artificial Sequence
  Description of Artificial Sequence: Synthetic oligonucleotide
gagggtccagagctcgtgagcctg

SEQ ID NO: 149550 - DNA, 25 bp, Artificial Sequence
  Description of Artificial Sequence: Synthetic oligonucleotide
agggtccagagctcgtgagcctgca

SEQ ID NO: 149551 - DNA, 24 bp, Artificial Sequence
  Description of Artificial Sequence: Synthetic oligonucleotide
gggtccagagctcgtgagcctgca

SEQ ID NO: 149552 - DNA, 24 bp, Artificial Sequence
  Description of Artificial Sequence: Synthetic oligonucleotide
ggtccagagctcgtgagcctgcag

SEQ ID NO: 149553 - DNA, 25 bp, Artificial Sequence
  Description of Artificial Sequence: Synthetic oligonucleotide
gtccagagctcgtgagcctgcaggt

SEQ ID NO: 149554 - DNA, 25 bp, Artificial Sequence
  Description of Artificial Sequence: Synthetic oligonucleotide
tccagagctcgtgagcctgcaggtc

SEQ ID NO: 149555 - DNA, 24 bp, Artificial Sequence
  Description of Artificial Sequence: Synthetic oligonucleotide
ccagagctcgtgagcctgcaggtc

SEQ ID NO: 149556 - DNA, 25 bp, Artificial Sequence
  Description of Artificial Sequence: Synthetic oligonucleotide
cagagctcgtgagcctgcaggtcct

SEQ ID NO: 149557 - DNA, 25 bp, Artificial Sequence
  Description of Artificial Sequence: Synthetic oligonucleotide
agagctcgtgagcctgcaggtcctg

SEQ ID NO: 149558 - DNA, 24 bp, Artificial Sequence
  Description of Artificial Sequence: Synthetic oligonucleotide
gagctcgtgagcctgcaggtcctg

SEQ ID NO: 149559 - DNA, 26 bp, Artificial Sequence
  Description of Artificial Sequence: Synthetic oligonucleotide
agctcgtgagcctgcaggtcctggat

SEQ ID NO: 149560 - DNA, 25 bp, Artificial Sequence
  Description of Artificial Sequence: Synthetic oligonucleotide
gctcgtgagcctgcaggtcctggat

SEQ ID NO: 149561 - DNA, 27 bp, Artificial Sequence
  Description of Artificial Sequence: Synthetic oligonucleotide
ctcgtgagcctgcaggtcctggatcaa

SEQ ID NO: 149562 - DNA, 27 bp, Artificial Sequence
  Description of Artificial Sequence: Synthetic oligonucleotide
tcgtgagcctgcaggtcctggatcaac

SEQ ID NO: 149563 - DNA, 27 bp, Artificial Sequence
  Description of Artificial Sequence: Synthetic oligonucleotide
cgtgagcctgcaggtcctggatcaaca

SEQ ID NO: 149564 - DNA, 27 bp, Artificial Sequence
  Description of Artificial Sequence: Synthetic oligonucleotide
gtgagcctgcaggtcctggatcaacac

SEQ ID NO: 149565 - DNA, 27 bp, Artificial Sequence
  Description of Artificial Sequence: Synthetic oligonucleotide
tgagcctgcaggtcctggatcaacacc

SEQ ID NO: 149566 - DNA, 26 bp, Artificial Sequence
  Description of Artificial Sequence: Synthetic oligonucleotide
gagcctgcaggtcctggatcaacacc

SEQ ID NO: 149567 - DNA, 27 bp, Artificial Sequence
  Description of Artificial Sequence: Synthetic oligonucleotide
agcctgcaggtcctggatcaacaccca

SEQ ID NO: 149568 - DNA, 26 bp, Artificial Sequence
  Description of Artificial Sequence: Synthetic oligonucleotide
gcctgcaggtcctggatcaacaccca

SEQ ID NO: 149569 - DNA, 27 bp, Artificial Sequence
  Description of Artificial Sequence: Synthetic oligonucleotide
cctgcaggtcctggatcaacacccagt

SEQ ID NO: 149570 - DNA, 28 bp, Artificial Sequence
  Description of Artificial Sequence: Synthetic oligonucleotide
ctgcaggtcctggatcaacacccagttg

SEQ ID NO: 149571 - DNA, 28 bp, Artificial Sequence
  Description of Artificial Sequence: Synthetic oligonucleotide
tgcaggtcctggatcaacacccagttgg

SEQ ID NO: 149572 - DNA, 27 bp, Artificial Sequence
  Description of Artificial Sequence: Synthetic oligonucleotide
gcaggtcctggatcaacacccagttgg

SEQ ID NO: 149573 - DNA, 27 bp, Artificial Sequence
  Description of Artificial Sequence: Synthetic oligonucleotide
caggtcctggatcaacacccagttggg

SEQ ID NO: 149574 - DNA, 28 bp, Artificial Sequence
  Description of Artificial Sequence: Synthetic oligonucleotide
aggtcctggatcaacacccagttgggac

SEQ ID NO: 149575 - DNA, 27 bp, Artificial Sequence
  Description of Artificial Sequence: Synthetic oligonucleotide
ggtcctggatcaacacccagttgggac

SEQ ID NO: 149576 - DNA, 27 bp, Artificial Sequence
  Description of Artificial Sequence: Synthetic oligonucleotide
gtcctggatcaacacccagttgggacg

SEQ ID NO: 149577 - DNA, 28 bp, Artificial Sequence
  Description of Artificial Sequence: Synthetic oligonucleotide
tcctggatcaacacccagttgggacgag

SEQ ID NO: 149578 - DNA, 27 bp, Artificial Sequence
  Description of Artificial Sequence: Synthetic oligonucleotide
cctggatcaacacccagttgggacgag

SEQ ID NO: 149579 - DNA, 28 bp, Artificial Sequence
  Description of Artificial Sequence: Synthetic oligonucleotide
ctggatcaacacccagttgggacgagtg

SEQ ID NO: 149580 - DNA, 29 bp, Artificial Sequence
  Description of Artificial Sequence: Synthetic oligonucleotide
tggatcaacacccagttgggacgagtgac

SEQ ID NO: 149581 - DNA, 28 bp, Artificial Sequence
  Description of Artificial Sequence: Synthetic oligonucleotide
ggatcaacacccagttgggacgagtgac

SEQ ID NO: 149582 - DNA, 28 bp, Artificial Sequence
  Description of Artificial Sequence: Synthetic oligonucleotide
gatcaacacccagttgggacgagtgacc

SEQ ID NO: 149583 - DNA, 29 bp, Artificial Sequence
  Description of Artificial Sequence: Synthetic oligonucleotide
atcaacacccagttgggacgagtgaccac

SEQ ID NO: 149584 - DNA, 28 bp, Artificial Sequence
  Description of Artificial Sequence: Synthetic oligonucleotide
tcaacacccagttgggacgagtgaccac

SEQ ID NO: 149585 - DNA, 27 bp, Artificial Sequence
  Description of Artificial Sequence: Synthetic oligonucleotide
caacacccagttgggacgagtgaccac

SEQ ID NO: 149586 - DNA, 28 bp, Artificial Sequence
  Description of Artificial Sequence: Synthetic oligonucleotide
aacacccagttgggacgagtgaccacag

SEQ ID NO: 149587 - DNA, 27 bp, Artificial Sequence
  Description of Artificial Sequence: Synthetic oligonucleotide
acacccagttgggacgagtgaccacag

SEQ ID NO: 149588 - DNA, 26 bp, Artificial Sequence
  Description of Artificial Sequence: Synthetic oligonucleotide
cacccagttgggacgagtgaccacag

SEQ ID NO: 149589 - DNA, 26 bp, Artificial Sequence
  Description of Artificial Sequence: Synthetic oligonucleotide
acccagttgggacgagtgaccacagg

SEQ ID NO: 149590 - DNA, 25 bp, Artificial Sequence
  Description of Artificial Sequence: Synthetic oligonucleotide
cccagttgggacgagtgaccacagg

SEQ ID NO: 149591 - DNA, 27 bp, Artificial Sequence
  Description of Artificial Sequence: Synthetic oligonucleotide
ccagttgggacgagtgaccacagggat

SEQ ID NO: 149592 - DNA, 27 bp, Artificial Sequence
  Description of Artificial Sequence: Synthetic oligonucleotide
cagttgggacgagtgaccacagggatg

SEQ ID NO: 149593 - DNA, 27 bp, Artificial Sequence
  Description of Artificial Sequence: Synthetic oligonucleotide
agttgggacgagtgaccacagggatgc

SEQ ID NO: 149594 - DNA, 26 bp, Artificial Sequence
  Description of Artificial Sequence: Synthetic oligonucleotide
gttgggacgagtgaccacagggatgc

SEQ ID NO: 149595 - DNA, 27 bp, Artificial Sequence
  Description of Artificial Sequence: Synthetic oligonucleotide
ttgggacgagtgaccacagggatgcca

SEQ ID NO: 149596 - DNA, 26 bp, Artificial Sequence
  Description of Artificial Sequence: Synthetic oligonucleotide
tgggacgagtgaccacagggatgcca

SEQ ID NO: 149597 - DNA, 25 bp, Artificial Sequence
  Description of Artificial Sequence: Synthetic oligonucleotide
gggacgagtgaccacagggatgcca

SEQ ID NO: 149598 - DNA, 26 bp, Artificial Sequence
  Description of Artificial Sequence: Synthetic oligonucleotide
ggacgagtgaccacagggatgccaca

SEQ ID NO: 149599 - DNA, 27 bp, Artificial Sequence
  Description of Artificial Sequence: Synthetic oligonucleotide
gacgagtgaccacagggatgccacaca

SEQ ID NO: 149600 - DNA, 27 bp, Artificial Sequence
  Description of Artificial Sequence: Synthetic oligonucleotide
acgagtgaccacagggatgccacacag

SEQ ID NO: 149601 - DNA, 26 bp, Artificial Sequence
  Description of Artificial Sequence: Synthetic oligonucleotide
cgagtgaccacagggatgccacacag

SEQ ID NO: 149602 - DNA, 27 bp, Artificial Sequence
  Description of Artificial Sequence: Synthetic oligonucleotide
gagtgaccacagggatgccacacagct

SEQ ID NO: 149603 - DNA, 27 bp, Artificial Sequence
  Description of Artificial Sequence: Synthetic oligonucleotide
agtgaccacagggatgccacacagctc

SEQ ID NO: 149604 - DNA, 26 bp, Artificial Sequence
  Description of Artificial Sequence: Synthetic oligonucleotide
gtgaccacagggatgccacacagctc

SEQ ID NO: 149605 - DNA, 26 bp, Artificial Sequence
  Description of Artificial Sequence: Synthetic oligonucleotide
tgaccacagggatgccacacagctcg

SEQ ID NO: 149606 - DNA, 25 bp, Artificial Sequence
  Description of Artificial Sequence: Synthetic oligonucleotide
gaccacagggatgccacacagctcg

SEQ ID NO: 149607 - DNA, 27 bp, Artificial Sequence
  Description of Artificial Sequence: Synthetic oligonucleotide
accacagggatgccacacagctcggat

SEQ ID NO: 149608 - DNA, 27 bp, Artificial Sequence
  Description of Artificial Sequence: Synthetic oligonucleotide
ccacagggatgccacacagctcggatt

SEQ ID NO: 149609 - DNA, 28 bp, Artificial Sequence
  Description of Artificial Sequence: Synthetic oligonucleotide
cacagggatgccacacagctcggatttc

SEQ ID NO: 149610 - DNA, 29 bp, Artificial Sequence
  Description of Artificial Sequence: Synthetic oligonucleotide
acagggatgccacacagctcggatttcag

SEQ ID NO: 149611 - DNA, 28 bp, Artificial Sequence
  Description of Artificial Sequence: Synthetic oligonucleotide
cagggatgccacacagctcggatttcag

SEQ ID NO: 149612 - DNA, 28 bp, Artificial Sequence
  Description of Artificial Sequence: Synthetic oligonucleotide
agggatgccacacagctcggatttcagc

SEQ ID NO: 149613 - DNA, 27 bp, Artificial Sequence
  Description of Artificial Sequence: Synthetic oligonucleotide
gggatgccacacagctcggatttcagc

SEQ ID NO: 149614 - DNA, 27 bp, Artificial Sequence
  Description of Artificial Sequence: Synthetic oligonucleotide
ggatgccacacagctcggatttcagcc

SEQ ID NO: 149615 - DNA, 28 bp, Artificial Sequence
  Description of Artificial Sequence: Synthetic oligonucleotide
gatgccacacagctcggatttcagcctc

SEQ ID NO: 149616 - DNA, 29 bp, Artificial Sequence
  Description of Artificial Sequence: Synthetic oligonucleotide
atgccacacagctcggatttcagcctctg

SEQ ID NO: 149617 - DNA, 28 bp, Artificial Sequence
  Description of Artificial Sequence: Synthetic oligonucleotide
tgccacacagctcggatttcagcctctg

SEQ ID NO: 149618 - DNA, 27 bp, Artificial Sequence
  Description of Artificial Sequence: Synthetic oligonucleotide
gccacacagctcggatttcagcctctg

SEQ ID NO: 149619 - DNA, 29 bp, Artificial Sequence
  Description of Artificial Sequence: Synthetic oligonucleotide
ccacacagctcggatttcagcctctgatg

SEQ ID NO: 149620 - DNA, 30 bp, Artificial Sequence
  Description of Artificial Sequence: Synthetic oligonucleotide
cacacagctcggatttcagcctctgatgtc

SEQ ID NO: 149621 - DNA, 31 bp, Artificial Sequence
  Description of Artificial Sequence: Synthetic oligonucleotide
acacagctcggatttcagcctctgatgtcag

SEQ ID NO: 149622 - DNA, 30 bp, Artificial Sequence
  Description of Artificial Sequence: Synthetic oligonucleotide
cacagctcggatttcagcctctgatgtcag

SEQ ID NO: 149623 - DNA, 32 bp, Artificial Sequence
  Description of Artificial Sequence: Synthetic oligonucleotide
acagctcggatttcagcctctgatgtcagatc

SEQ ID NO: 149624 - DNA, 31 bp, Artificial Sequence
  Description of Artificial Sequence: Synthetic oligonucleotide
cagctcggatttcagcctctgatgtcagatc

SEQ ID NO: 149625 - DNA, 33 bp, Artificial Sequence
  Description of Artificial Sequence: Synthetic oligonucleotide
agctcggatttcagcctctgatgtcagatcttg

SEQ ID NO: 149626 - DNA, 32 bp, Artificial Sequence
  Description of Artificial Sequence: Synthetic oligonucleotide
gctcggatttcagcctctgatgtcagatcttg

SEQ ID NO: 149627 - DNA, 32 bp, Artificial Sequence
  Description of Artificial Sequence: Synthetic oligonucleotide
ctcggatttcagcctctgatgtcagatcttgg

SEQ ID NO: 149628 - DNA, 32 bp, Artificial Sequence
  Description of Artificial Sequence: Synthetic oligonucleotide
tcggatttcagcctctgatgtcagatcttggg

SEQ ID NO: 149629 - DNA, 31 bp, Artificial Sequence
  Description of Artificial Sequence: Synthetic oligonucleotide
cggatttcagcctctgatgtcagatcttggg

SEQ ID NO: 149630 - DNA, 32 bp, Artificial Sequence
  Description of Artificial Sequence: Synthetic oligonucleotide
ggatttcagcctctgatgtcagatcttgggtc

SEQ ID NO: 149631 - DNA, 32 bp, Artificial Sequence
  Description of Artificial Sequence: Synthetic oligonucleotide
gatttcagcctctgatgtcagatcttgggtcc

SEQ ID NO: 149632 - DNA, 33 bp, Artificial Sequence
  Description of Artificial Sequence: Synthetic oligonucleotide
atttcagcctctgatgtcagatcttgggtccac

SEQ ID NO: 149633 - DNA, 32 bp, Artificial Sequence
  Description of Artificial Sequence: Synthetic oligonucleotide
tttcagcctctgatgtcagatcttgggtccac

SEQ ID NO: 149634 - DNA, 31 bp, Artificial Sequence
  Description of Artificial Sequence: Synthetic oligonucleotide
ttcagcctctgatgtcagatcttgggtccac

SEQ ID NO: 149635 - DNA, 30 bp, Artificial Sequence
  Description of Artificial Sequence: Synthetic oligonucleotide
tcagcctctgatgtcagatcttgggtccac

SEQ ID NO: 149636 - DNA, 29 bp, Artificial Sequence
  Description of Artificial Sequence: Synthetic oligonucleotide
cagcctctgatgtcagatcttgggtccac

SEQ ID NO: 149637 - DNA, 30 bp, Artificial Sequence
  Description of Artificial Sequence: Synthetic oligonucleotide
agcctctgatgtcagatcttgggtccactg

SEQ ID NO: 149638 - DNA, 29 bp, Artificial Sequence
  Description of Artificial Sequence: Synthetic oligonucleotide
gcctctgatgtcagatcttgggtccactg

SEQ ID NO: 149639 - DNA, 29 bp, Artificial Sequence
  Description of Artificial Sequence: Synthetic oligonucleotide
cctctgatgtcagatcttgggtccactgg

SEQ ID NO: 149640 - DNA, 29 bp, Artificial Sequence
  Description of Artificial Sequence: Synthetic oligonucleotide
ctctgatgtcagatcttgggtccactggc

SEQ ID NO: 149641 - DNA, 30 bp, Artificial Sequence
  Description of Artificial Sequence: Synthetic oligonucleotide
tctgatgtcagatcttgggtccactggctc

SEQ ID NO: 149642 - DNA, 29 bp, Artificial Sequence
  Description of Artificial Sequence: Synthetic oligonucleotide
ctgatgtcagatcttgggtccactggctc

SEQ ID NO: 149643 - DNA, 29 bp, Artificial Sequence
  Description of Artificial Sequence: Synthetic oligonucleotide
tgatgtcagatcttgggtccactggctcc

SEQ ID NO: 149644 - DNA, 28 bp, Artificial Sequence
  Description of Artificial Sequence: Synthetic oligonucleotide
gatgtcagatcttgggtccactggctcc

SEQ ID NO: 149645 - DNA, 29 bp, Artificial Sequence
  Description of Artificial Sequence: Synthetic oligonucleotide
atgtcagatcttgggtccactggctccac

SEQ ID NO: 149646 - DNA, 28 bp, Artificial Sequence
  Description of Artificial Sequence: Synthetic oligonucleotide
tgtcagatcttgggtccactggctccac

SEQ ID NO: 149647 - DNA, 27 bp, Artificial Sequence
  Description of Artificial Sequence: Synthetic oligonucleotide
gtcagatcttgggtccactggctccac

SEQ ID NO: 149648 - DNA, 28 bp, Artificial Sequence
  Description of Artificial Sequence: Synthetic oligonucleotide
tcagatcttgggtccactggctccactg

SEQ ID NO: 149649 - DNA, 27 bp, Artificial Sequence
  Description of Artificial Sequence: Synthetic oligonucleotide
cagatcttgggtccactggctccactg

SEQ ID NO: 149650 - DNA, 28 bp, Artificial Sequence
  Description of Artificial Sequence: Synthetic oligonucleotide
agatcttgggtccactggctccactgag

SEQ ID NO: 149651 - DNA, 27 bp, Artificial Sequence
  Description of Artificial Sequence: Synthetic oligonucleotide
gatcttgggtccactggctccactgag

SEQ ID NO: 149652 - DNA, 27 bp, Artificial Sequence
  Description of Artificial Sequence: Synthetic oligonucleotide
atcttgggtccactggctccactgagg

SEQ ID NO: 149653 - DNA, 26 bp, Artificial Sequence
  Description of Artificial Sequence: Synthetic oligonucleotide
tcttgggtccactggctccactgagg

SEQ ID NO: 149654 - DNA, 25 bp, Artificial Sequence
  Description of Artificial Sequence: Synthetic oligonucleotide
cttgggtccactggctccactgagg

SEQ ID NO: 149655 - DNA, 25 bp, Artificial Sequence
  Description of Artificial Sequence: Synthetic oligonucleotide
ttgggtccactggctccactgaggg

SEQ ID NO: 149656 - DNA, 24 bp, Artificial Sequence
  Description of Artificial Sequence: Synthetic oligonucleotide
tgggtccactggctccactgaggg

SEQ ID NO: 149657 - DNA, 23 bp, Artificial Sequence
  Description of Artificial Sequence: Synthetic oligonucleotide
gggtccactggctccactgaggg

SEQ ID NO: 149658 - DNA, 23 bp, Artificial Sequence
  Description of Artificial Sequence: Synthetic oligonucleotide
ggtccactggctccactgagggc

SEQ ID NO: 149659 - DNA, 23 bp, Artificial Sequence
  Description of Artificial Sequence: Synthetic oligonucleotide
gtccactggctccactgagggcg

SEQ ID NO: 149660 - DNA, 23 bp, Artificial Sequence
  Description of Artificial Sequence: Synthetic oligonucleotide
tccactggctccactgagggcgc

SEQ ID NO: 149661 - DNA, 22 bp, Artificial Sequence
  Description of Artificial Sequence: Synthetic oligonucleotide
ccactggctccactgagggcgc

SEQ ID NO: 149662 - DNA, 24 bp, Artificial Sequence
  Description of Artificial Sequence: Synthetic oligonucleotide
cactggctccactgagggcgccta

SEQ ID NO: 149663 - DNA, 24 bp, Artificial Sequence
  Description of Artificial Sequence: Synthetic oligonucleotide
actggctccactgagggcgcctag

SEQ ID NO: 149664 - DNA, 31 bp, Artificial Sequence
  Description of Artificial Sequence: Synthetic oligonucleotide
agtcttcgttataacctcacggtgctgtccg

SEQ ID NO: 149665 - DNA, 30 bp, Artificial Sequence
  Description of Artificial Sequence: Synthetic oligonucleotide
gtcttcgttataacctcacggtgctgtccg

SEQ ID NO: 149666 - DNA, 30 bp, Artificial Sequence
  Description of Artificial Sequence: Synthetic oligonucleotide
tcttcgttataacctcacggtgctgtccgg

SEQ ID NO: 149667 - DNA, 29 bp, Artificial Sequence
  Description of Artificial Sequence: Synthetic oligonucleotide
cttcgttataacctcacggtgctgtccgg

SEQ ID NO: 149668 - DNA, 29 bp, Artificial Sequence
  Description of Artificial Sequence: Synthetic oligonucleotide
ttcgttataacctcacggtgctgtccggg

SEQ ID NO: 149669 - DNA, 28 bp, Artificial Sequence
  Description of Artificial Sequence: Synthetic oligonucleotide
tcgttataacctcacggtgctgtccggg

SEQ ID NO: 149670 - DNA, 27 bp, Artificial Sequence
  Description of Artificial Sequence: Synthetic oligonucleotide
cgttataacctcacggtgctgtccggg

SEQ ID NO: 149671 - DNA, 27 bp, Artificial Sequence
  Description of Artificial Sequence: Synthetic oligonucleotide
gttataacctcacggtgctgtccgggg

SEQ ID NO: 149672 - DNA, 29 bp, Artificial Sequence
  Description of Artificial Sequence: Synthetic oligonucleotide
ttataacctcacggtgctgtccggggatg

SEQ ID NO: 149673 - DNA, 28 bp, Artificial Sequence
  Description of Artificial Sequence: Synthetic oligonucleotide
tataacctcacggtgctgtccggggatg

SEQ ID NO: 149674 - DNA, 27 bp, Artificial Sequence
  Description of Artificial Sequence: Synthetic oligonucleotide
ataacctcacggtgctgtccggggatg

SEQ ID NO: 149675 - DNA, 26 bp, Artificial Sequence
  Description of Artificial Sequence: Synthetic oligonucleotide
taacctcacggtgctgtccggggatg

SEQ ID NO: 149676 - DNA, 25 bp, Artificial Sequence
  Description of Artificial Sequence: Synthetic oligonucleotide
aacctcacggtgctgtccggggatg

SEQ ID NO: 149677 - DNA, 24 bp, Artificial Sequence
  Description of Artificial Sequence: Synthetic oligonucleotide
acctcacggtgctgtccggggatg

SEQ ID NO: 149678 - DNA, 23 bp, Artificial Sequence
  Description of Artificial Sequence: Synthetic oligonucleotide
cctcacggtgctgtccggggatg

SEQ ID NO: 149679 - DNA, 25 bp, Artificial Sequence
  Description of Artificial Sequence: Synthetic oligonucleotide
ctcacggtgctgtccggggatggat

SEQ ID NO: 149680 - DNA, 26 bp, Artificial Sequence
  Description of Artificial Sequence: Synthetic oligonucleotide
tcacggtgctgtccggggatggatct

SEQ ID NO: 149681 - DNA, 25 bp, Artificial Sequence
  Description of Artificial Sequence: Synthetic oligonucleotide
cacggtgctgtccggggatggatct

SEQ ID NO: 149682 - DNA, 26 bp, Artificial Sequence
  Description of Artificial Sequence: Synthetic oligonucleotide
acggtgctgtccggggatggatctgt

SEQ ID NO: 149683 - DNA, 25 bp, Artificial Sequence
  Description of Artificial Sequence: Synthetic oligonucleotide
cggtgctgtccggggatggatctgt

SEQ ID NO: 149684 - DNA, 25 bp, Artificial Sequence
  Description of Artificial Sequence: Synthetic oligonucleotide
ggtgctgtccggggatggatctgtg

SEQ ID NO: 149685 - DNA, 26 bp, Artificial Sequence
  Description of Artificial Sequence: Synthetic oligonucleotide
gtgctgtccggggatggatctgtgca

SEQ ID NO: 149686 - DNA, 27 bp, Artificial Sequence
  Description of Artificial Sequence: Synthetic oligonucleotide
tgctgtccggggatggatctgtgcagt

SEQ ID NO: 149687 - DNA, 26 bp, Artificial Sequence
  Description of Artificial Sequence: Synthetic oligonucleotide
gctgtccggggatggatctgtgcagt

SEQ ID NO: 149688 - DNA, 27 bp, Artificial Sequence
  Description of Artificial Sequence: Synthetic oligonucleotide
ctgtccggggatggatctgtgcagtca

SEQ ID NO: 149689 - DNA, 27 bp, Artificial Sequence
  Description of Artificial Sequence: Synthetic oligonucleotide
tgtccggggatggatctgtgcagtcag

SEQ ID NO: 149690 - DNA, 26 bp, Artificial Sequence
  Description of Artificial Sequence: Synthetic oligonucleotide
gtccggggatggatctgtgcagtcag

SEQ ID NO: 149691 - DNA, 26 bp, Artificial Sequence
  Description of Artificial Sequence: Synthetic oligonucleotide
tccggggatggatctgtgcagtcagg

SEQ ID NO: 149692 - DNA, 25 bp, Artificial Sequence
  Description of Artificial Sequence: Synthetic oligonucleotide
ccggggatggatctgtgcagtcagg

SEQ ID NO: 149693 - DNA, 27 bp, Artificial Sequence
  Description of Artificial Sequence: Synthetic oligonucleotide
cggggatggatctgtgcagtcagggtt

SEQ ID NO: 149694 - DNA, 28 bp, Artificial Sequence
  Description of Artificial Sequence: Synthetic oligonucleotide
ggggatggatctgtgcagtcagggtttc

SEQ ID NO: 149695 - DNA, 29 bp, Artificial Sequence
  Description of Artificial Sequence: Synthetic oligonucleotide
ggatggatctgtgcagtcagggtttctcg

SEQ ID NO: 149696 - DNA, 29 bp, Artificial Sequence
  Description of Artificial Sequence: Synthetic oligonucleotide
gatggatctgtgcagtcagggtttctcgc

SEQ ID NO: 149697 - DNA, 30 bp, Artificial Sequence
  Description of Artificial Sequence: Synthetic oligonucleotide
atggatctgtgcagtcagggtttctcgctg

SEQ ID NO: 149698 - DNA, 29 bp, Artificial Sequence
  Description of Artificial Sequence: Synthetic oligonucleotide
tggatctgtgcagtcagggtttctcgctg

SEQ ID NO: 149699 - DNA, 28 bp, Artificial Sequence
  Description of Artificial Sequence: Synthetic oligonucleotide
ggatctgtgcagtcagggtttctcgctg

SEQ ID NO: 149700 - DNA, 29 bp, Artificial Sequence
  Description of Artificial Sequence: Synthetic oligonucleotide
gatctgtgcagtcagggtttctcgctgag

SEQ ID NO: 149701 - DNA, 29 bp, Artificial Sequence
  Description of Artificial Sequence: Synthetic oligonucleotide
atctgtgcagtcagggtttctcgctgagg

SEQ ID NO: 149702 - DNA, 28 bp, Artificial Sequence
  Description of Artificial Sequence: Synthetic oligonucleotide
tctgtgcagtcagggtttctcgctgagg

SEQ ID NO: 149703 - DNA, 27 bp, Artificial Sequence
  Description of Artificial Sequence: Synthetic oligonucleotide
ctgtgcagtcagggtttctcgctgagg

SEQ ID NO: 149704 - DNA, 29 bp, Artificial Sequence
  Description of Artificial Sequence: Synthetic oligonucleotide
tgtgcagtcagggtttctcgctgaggtac

SEQ ID NO: 149705 - DNA, 28 bp, Artificial Sequence
  Description of Artificial Sequence: Synthetic oligonucleotide
gtgcagtcagggtttctcgctgaggtac

SEQ ID NO: 149706 - DNA, 30 bp, Artificial Sequence
  Description of Artificial Sequence: Synthetic oligonucleotide
tgcagtcagggtttctcgctgaggtacatc

SEQ ID NO: 149707 - DNA, 29 bp, Artificial Sequence
  Description of Artificial Sequence: Synthetic oligonucleotide
gcagtcagggtttctcgctgaggtacatc

SEQ ID NO: 149708 - DNA, 30 bp, Artificial Sequence
  Description of Artificial Sequence: Synthetic oligonucleotide
cagtcagggtttctcgctgaggtacatctg

SEQ ID NO: 149709 - DNA, 30 bp, Artificial Sequence
  Description of Artificial Sequence: Synthetic oligonucleotide
agtcagggtttctcgctgaggtacatctgg

SEQ ID NO: 149710 - DNA, 29 bp, Artificial Sequence
  Description of Artificial Sequence: Synthetic oligonucleotide
gtcagggtttctcgctgaggtacatctgg

SEQ ID NO: 149711 - DNA, 31 bp, Artificial Sequence
  Description of Artificial Sequence: Synthetic oligonucleotide
tcagggtttctcgctgaggtacatctggatg

SEQ ID NO: 149712 - DNA, 30 bp, Artificial Sequence
  Description of Artificial Sequence: Synthetic oligonucleotide
cagggtttctcgctgaggtacatctggatg

SEQ ID NO: 149713 - DNA, 30 bp, Artificial Sequence
  Description of Artificial Sequence: Synthetic oligonucleotide
agggtttctcgctgaggtacatctggatgg

SEQ ID NO: 149714 - DNA, 29 bp, Artificial Sequence
  Description of Artificial Sequence: Synthetic oligonucleotide
gggtttctcgctgaggtacatctggatgg

SEQ ID NO: 149715 - DNA, 30 bp, Artificial Sequence
  Description of Artificial Sequence: Synthetic oligonucleotide
ggtttctcgctgaggtacatctggatggtc

SEQ ID NO: 149716 - DNA, 31 bp, Artificial Sequence
  Description of Artificial Sequence: Synthetic oligonucleotide
gtttctcgctgaggtacatctggatggtcag

SEQ ID NO: 149717 - DNA, 31 bp, Artificial Sequence
  Description of Artificial Sequence: Synthetic oligonucleotide
tttctcgctgaggtacatctggatggtcagc

SEQ ID NO: 149718 - DNA, 30 bp, Artificial Sequence
  Description of Artificial Sequence: Synthetic oligonucleotide
ttctcgctgaggtacatctggatggtcagc

SEQ ID NO: 149719 - DNA, 29 bp, Artificial Sequence
  Description of Artificial Sequence: Synthetic oligonucleotide
tctcgctgaggtacatctggatggtcagc

SEQ ID NO: 149720 - DNA, 28 bp, Artificial Sequence
  Description of Artificial Sequence: Synthetic oligonucleotide
ctcgctgaggtacatctggatggtcagc

SEQ ID NO: 149721 - DNA, 28 bp, Artificial Sequence
  Description of Artificial Sequence: Synthetic oligonucleotide
tcgctgaggtacatctggatggtcagcc

SEQ ID NO: 149722 - DNA, 27 bp, Artificial Sequence
  Description of Artificial Sequence: Synthetic oligonucleotide
cgctgaggtacatctggatggtcagcc

SEQ ID NO: 149723 - DNA, 27 bp, Artificial Sequence
  Description of Artificial Sequence: Synthetic oligonucleotide
gctgaggtacatctggatggtcagccc

SEQ ID NO: 149724 - DNA, 32 bp, Artificial Sequence
  Description of Artificial Sequence: Synthetic oligonucleotide
tgggaaataagacatgggacagagagaccagg

SEQ ID NO: 149725 - DNA, 31 bp, Artificial Sequence
  Description of Artificial Sequence: Synthetic oligonucleotide
gggaaataagacatgggacagagagaccagg

SEQ ID NO: 149726 - DNA, 31 bp, Artificial Sequence
  Description of Artificial Sequence: Synthetic oligonucleotide
ggaaataagacatgggacagagagaccaggg

SEQ ID NO: 149727 - DNA, 32 bp, Artificial Sequence
  Description of Artificial Sequence: Synthetic oligonucleotide
gaaataagacatgggacagagagaccagggac

SEQ ID NO: 149728 - DNA, 34 bp, Artificial Sequence
  Description of Artificial Sequence: Synthetic oligonucleotide
aaataagacatgggacagagagaccagggacttg

SEQ ID NO: 149729 - DNA, 33 bp, Artificial Sequence
  Description of Artificial Sequence: Synthetic oligonucleotide
aataagacatgggacagagagaccagggacttg

SEQ ID NO: 149730 - DNA, 32 bp, Artificial Sequence
  Description of Artificial Sequence: Synthetic oligonucleotide
ataagacatgggacagagagaccagggacttg

SEQ ID NO: 149731 - DNA, 31 bp, Artificial Sequence
  Description of Artificial Sequence: Synthetic oligonucleotide
taagacatgggacagagagaccagggacttg

SEQ ID NO: 149732 - DNA, 30 bp, Artificial Sequence
  Description of Artificial Sequence: Synthetic oligonucleotide
aagacatgggacagagagaccagggacttg

SEQ ID NO: 149733 - DNA, 29 bp, Artificial Sequence
  Description of Artificial Sequence: Synthetic oligonucleotide
agacatgggacagagagaccagggacttg

SEQ ID NO: 149734 - DNA, 28 bp, Artificial Sequence
  Description of Artificial Sequence: Synthetic oligonucleotide
gacatgggacagagagaccagggacttg

SEQ ID NO: 149735 - DNA, 29 bp, Artificial Sequence
  Description of Artificial Sequence: Synthetic oligonucleotide
acatgggacagagagaccagggacttgac

SEQ ID NO: 149736 - DNA, 28 bp, Artificial Sequence
  Description of Artificial Sequence: Synthetic oligonucleotide
catgggacagagagaccagggacttgac

SEQ ID NO: 149737 - DNA, 29 bp, Artificial Sequence
  Description of Artificial Sequence: Synthetic oligonucleotide
atgggacagagagaccagggacttgacag

SEQ ID NO: 149738 - DNA, 28 bp, Artificial Sequence
  Description of Artificial Sequence: Synthetic oligonucleotide
tgggacagagagaccagggacttgacag

SEQ ID NO: 149739 - DNA, 27 bp, Artificial Sequence
  Description of Artificial Sequence: Synthetic oligonucleotide
gggacagagagaccagggacttgacag

SEQ ID NO: 149740 - DNA, 27 bp, Artificial Sequence
  Description of Artificial Sequence: Synthetic oligonucleotide
ggacagagagaccagggacttgacagg

SEQ ID NO: 149741 - DNA, 27 bp, Artificial Sequence
  Description of Artificial Sequence: Synthetic oligonucleotide
gacagagagaccagggacttgacaggg

SEQ ID NO: 149742 - DNA, 29 bp, Artificial Sequence
  Description of Artificial Sequence: Synthetic oligonucleotide
acagagagaccagggacttgacagggaac

SEQ ID NO: 149743 - DNA, 28 bp, Artificial Sequence
  Description of Artificial Sequence: Synthetic oligonucleotide
cagagagaccagggacttgacagggaac

SEQ ID NO: 149744 - DNA, 28 bp, Artificial Sequence
  Description of Artificial Sequence: Synthetic oligonucleotide
agagagaccagggacttgacagggaacg

SEQ ID NO: 149745 - DNA, 27 bp, Artificial Sequence
  Description of Artificial Sequence: Synthetic oligonucleotide
gagagaccagggacttgacagggaacg

SEQ ID NO: 149746 - DNA, 27 bp, Artificial Sequence
  Description of Artificial Sequence: Synthetic oligonucleotide
agagaccagggacttgacagggaacgg

SEQ ID NO: 149747 - DNA, 27 bp, Artificial Sequence
  Description of Artificial Sequence: Synthetic oligonucleotide
gagaccagggacttgacagggaacgga

SEQ ID NO: 149748 - DNA, 29 bp, Artificial Sequence
  Description of Artificial Sequence: Synthetic oligonucleotide
agaccagggacttgacagggaacggaaag

SEQ ID NO: 149749 - DNA, 28 bp, Artificial Sequence
  Description of Artificial Sequence: Synthetic oligonucleotide
gaccagggacttgacagggaacggaaag

SEQ ID NO: 149750 - DNA, 28 bp, Artificial Sequence
  Description of Artificial Sequence: Synthetic oligonucleotide
accagggacttgacagggaacggaaagg

SEQ ID NO: 149751 - DNA, 27 bp, Artificial Sequence
  Description of Artificial Sequence: Synthetic oligonucleotide
ccagggacttgacagggaacggaaagg

SEQ ID NO: 149752 - DNA, 28 bp, Artificial Sequence
  Description of Artificial Sequence: Synthetic oligonucleotide
cagggacttgacagggaacggaaaggac

SEQ ID NO: 149753 - DNA, 28 bp, Artificial Sequence
  Description of Artificial Sequence: Synthetic oligonucleotide
agggacttgacagggaacggaaaggacc

SEQ ID NO: 149754 - DNA, 27 bp, Artificial Sequence
  Description of Artificial Sequence: Synthetic oligonucleotide
gggacttgacagggaacggaaaggacc

SEQ ID NO: 149755 - DNA, 28 bp, Artificial Sequence
  Description of Artificial Sequence: Synthetic oligonucleotide
ggacttgacagggaacggaaaggacctc

SEQ ID NO: 149756 - DNA, 30 bp, Artificial Sequence
  Description of Artificial Sequence: Synthetic oligonucleotide
agctcttcctctcccaaaacctggagactg

SEQ ID NO: 149757 - DNA, 29 bp, Artificial Sequence
  Description of Artificial Sequence: Synthetic oligonucleotide
gctcttcctctcccaaaacctggagactg

SEQ ID NO: 149758 - DNA, 30 bp, Artificial Sequence
  Description of Artificial Sequence: Synthetic oligonucleotide
ctcttcctctcccaaaacctggagactgag

SEQ ID NO: 149759 - DNA, 30 bp, Artificial Sequence
  Description of Artificial Sequence: Synthetic oligonucleotide
tcttcctctcccaaaacctggagactgagg

SEQ ID NO: 149760 - DNA, 29 bp, Artificial Sequence
  Description of Artificial Sequence: Synthetic oligonucleotide
cttcctctcccaaaacctggagactgagg

SEQ ID NO: 149761 - DNA, 32 bp, Artificial Sequence
  Description of Artificial Sequence: Synthetic oligonucleotide
ttcctctcccaaaacctggagactgaggaatg

SEQ ID NO: 149762 - DNA, 31 bp, Artificial Sequence
  Description of Artificial Sequence: Synthetic oligonucleotide
tcctctcccaaaacctggagactgaggaatg

SEQ ID NO: 149763 - DNA, 30 bp, Artificial Sequence
  Description of Artificial Sequence: Synthetic oligonucleotide
cctctcccaaaacctggagactgaggaatg

SEQ ID NO: 149764 - DNA, 30 bp, Artificial Sequence
  Description of Artificial Sequence: Synthetic oligonucleotide
ctctcccaaaacctggagactgaggaatgg

SEQ ID NO: 149765 - DNA, 31 bp, Artificial Sequence
  Description of Artificial Sequence: Synthetic oligonucleotide
tctcccaaaacctggagactgaggaatggac

SEQ ID NO: 149766 - DNA, 30 bp, Artificial Sequence
  Description of Artificial Sequence: Synthetic oligonucleotide
ctcccaaaacctggagactgaggaatggac

SEQ ID NO: 149767 - DNA, 33 bp, Artificial Sequence
  Description of Artificial Sequence: Synthetic oligonucleotide
tcccaaaacctggagactgaggaatggacaatg

SEQ ID NO: 149768 - DNA, 32 bp, Artificial Sequence
  Description of Artificial Sequence: Synthetic oligonucleotide
cccaaaacctggagactgaggaatggacaatg

SEQ ID NO: 149769 - DNA, 32 bp, Artificial Sequence
  Description of Artificial Sequence: Synthetic oligonucleotide
ccaaaacctggagactgaggaatggacaatgc

SEQ ID NO: 149770 - DNA, 32 bp, Artificial Sequence
  Description of Artificial Sequence: Synthetic oligonucleotide
caaaacctggagactgaggaatggacaatgcc

SEQ ID NO: 149771 - DNA, 32 bp, Artificial Sequence
  Description of Artificial Sequence: Synthetic oligonucleotide
aaaacctggagactgaggaatggacaatgccc

SEQ ID NO: 149772 - DNA, 31 bp, Artificial Sequence
  Description of Artificial Sequence: Synthetic oligonucleotide
aaacctggagactgaggaatggacaatgccc

SEQ ID NO: 149773 - DNA, 30 bp, Artificial Sequence
  Description of Artificial Sequence: Synthetic oligonucleotide
aacctggagactgaggaatggacaatgccc

SEQ ID NO: 149774 - DNA, 29 bp, Artificial Sequence
  Description of Artificial Sequence: Synthetic oligonucleotide
acctggagactgaggaatggacaatgccc

SEQ ID NO: 149775 - DNA, 28 bp, Artificial Sequence
  Description of Artificial Sequence: Synthetic oligonucleotide
cctggagactgaggaatggacaatgccc

SEQ ID NO: 149776 - DNA, 28 bp, Artificial Sequence
  Description of Artificial Sequence: Synthetic oligonucleotide
ctggagactgaggaatggacaatgcccc

SEQ ID NO: 149777 - DNA, 29 bp, Artificial Sequence
  Description of Artificial Sequence: Synthetic oligonucleotide
tggagactgaggaatggacaatgccccag

SEQ ID NO: 149778 - DNA, 28 bp, Artificial Sequence
  Description of Artificial Sequence: Synthetic oligonucleotide
ggagactgaggaatggacaatgccccag

SEQ ID NO: 149779 - DNA, 29 bp, Artificial Sequence
  Description of Artificial Sequence: Synthetic oligonucleotide
gagactgaggaatggacaatgccccagtc

SEQ ID NO: 149780 - DNA, 29 bp, Artificial Sequence
  Description of Artificial Sequence: Synthetic oligonucleotide
agactgaggaatggacaatgccccagtcc

SEQ ID NO: 149781 - DNA, 28 bp, Artificial Sequence
  Description of Artificial Sequence: Synthetic oligonucleotide
gactgaggaatggacaatgccccagtcc

SEQ ID NO: 149782 - DNA, 29 bp, Artificial Sequence
  Description of Artificial Sequence: Synthetic oligonucleotide
actgaggaatggacaatgccccagtcctc

SEQ ID NO: 149783 - DNA, 28 bp, Artificial Sequence
  Description of Artificial Sequence: Synthetic oligonucleotide
ctgaggaatggacaatgccccagtcctc

SEQ ID NO: 149784 - DNA, 28 bp, Artificial Sequence
  Description of Artificial Sequence: Synthetic oligonucleotide
tgaggaatggacaatgccccagtcctcc

SEQ ID NO: 149785 - DNA, 27 bp, Artificial Sequence
  Description of Artificial Sequence: Synthetic oligonucleotide
gaggaatggacaatgccccagtcctcc

SEQ ID NO: 149786 - DNA, 32 bp, Artificial Sequence
  Description of Artificial Sequence: Synthetic oligonucleotide
attccatgtttctgctgttgctgctgctgctg

SEQ ID NO: 149787 - DNA, 31 bp, Artificial Sequence
  Description of Artificial Sequence: Synthetic oligonucleotide
ttccatgtttctgctgttgctgctgctgctg

SEQ ID NO: 149788 - DNA, 30 bp, Artificial Sequence
  Description of Artificial Sequence: Synthetic oligonucleotide
tccatgtttctgctgttgctgctgctgctg

SEQ ID NO: 149789 - DNA, 29 bp, Artificial Sequence
  Description of Artificial Sequence: Synthetic oligonucleotide
ccatgtttctgctgttgctgctgctgctg

SEQ ID NO: 149790 - DNA, 29 bp, Artificial Sequence
  Description of Artificial Sequence: Synthetic oligonucleotide
catgtttctgctgttgctgctgctgctgc

SEQ ID NO: 149791 - DNA, 30 bp, Artificial Sequence
  Description of Artificial Sequence: Synthetic oligonucleotide
atgtttctgctgttgctgctgctgctgctg

SEQ ID NO: 149792 - DNA, 29 bp, Artificial Sequence
  Description of Artificial Sequence: Synthetic oligonucleotide
tgtttctgctgttgctgctgctgctgctg

SEQ ID NO: 149793 - DNA, 28 bp, Artificial Sequence
  Description of Artificial Sequence: Synthetic oligonucleotide
gtttctgctgttgctgctgctgctgctg

SEQ ID NO: 149794 - DNA, 28 bp, Artificial Sequence
  Description of Artificial Sequence: Synthetic oligonucleotide
tttctgctgttgctgctgctgctgctgc

SEQ ID NO: 149795 - DNA, 27 bp, Artificial Sequence
  Description of Artificial Sequence: Synthetic oligonucleotide
ttctgctgttgctgctgctgctgctgc

SEQ ID NO: 149796 - DNA, 27 bp, Artificial Sequence
  Description of Artificial Sequence: Synthetic oligonucleotide
tctgctgttgctgctgctgctgctgct

SEQ ID NO: 149797 - DNA, 26 bp, Artificial Sequence
  Description of Artificial Sequence: Synthetic oligonucleotide
ctgctgttgctgctgctgctgctgct

SEQ ID NO: 149798 - DNA, 26 bp, Artificial Sequence
  Description of Artificial Sequence: Synthetic oligonucleotide
tgctgttgctgctgctgctgctgctg

SEQ ID NO: 149799 - DNA, 25 bp, Artificial Sequence
  Description of Artificial Sequence: Synthetic oligonucleotide
gctgttgctgctgctgctgctgctg

SEQ ID NO: 149800 - DNA, 26 bp, Artificial Sequence
  Description of Artificial Sequence: Synthetic oligonucleotide
ctgttgctgctgctgctgctgctgct

SEQ ID NO: 149801 - DNA, 26 bp, Artificial Sequence
  Description of Artificial Sequence: Synthetic oligonucleotide
tgttgctgctgctgctgctgctgctg

SEQ ID NO: 149802 - DNA, 25 bp, Artificial Sequence
  Description of Artificial Sequence: Synthetic oligonucleotide
gttgctgctgctgctgctgctgctg

SEQ ID NO: 149803 - DNA, 26 bp, Artificial Sequence
  Description of Artificial Sequence: Synthetic oligonucleotide
ttgctgctgctgctgctgctgctgct

SEQ ID NO: 149804 - DNA, 25 bp, Artificial Sequence
  Description of Artificial Sequence: Synthetic oligonucleotide
tgctgctgctgctgctgctgctgct

SEQ ID NO: 149805 - DNA, 24 bp, Artificial Sequence
  Description of Artificial Sequence: Synthetic oligonucleotide
gctgctgctgctgctgctgctgct

SEQ ID NO: 149806 - DNA, 24 bp, Artificial Sequence
  Description of Artificial Sequence: Synthetic oligonucleotide
ctgctgctgctgctgctgctgctg

SEQ ID NO: 149807 - DNA, 27 bp, Artificial Sequence
  Description of Artificial Sequence: Synthetic oligonucleotide
tgctgctgctgctgctgctgctgctat

SEQ ID NO: 149808 - DNA, 27 bp, Artificial Sequence
  Description of Artificial Sequence: Synthetic oligonucleotide
gctgctgctgctgctgctgctgctatt

SEQ ID NO: 149809 - DNA, 30 bp, Artificial Sequence
  Description of Artificial Sequence: Synthetic oligonucleotide
ctgctgctgctgctgctgctgctatttttg

SEQ ID NO: 149810 - DNA, 43 bp, Artificial Sequence
  Description of Artificial Sequence: Synthetic oligonucleotide
tgctgctgctgctgctgctgctatttttgttattattattttc

SEQ ID NO: 149811 - DNA, 42 bp, Artificial Sequence
  Description of Artificial Sequence: Synthetic oligonucleotide
gctgctgctgctgctgctgctatttttgttattattattttc

SEQ ID NO: 149812 - DNA, 44 bp, Artificial Sequence
  Description of Artificial Sequence: Synthetic oligonucleotide
ctgctgctgctgctgctgctatttttgttattattattttctac

SEQ ID NO: 149813 - DNA, 44 bp, Artificial Sequence
  Description of Artificial Sequence: Synthetic oligonucleotide
tgctgctgctgctgctgctatttttgttattattattttctacg

SEQ ID NO: 149814 - DNA, 43 bp, Artificial Sequence
  Description of Artificial Sequence: Synthetic oligonucleotide
gctgctgctgctgctgctatttttgttattattattttctacg

SEQ ID NO: 149815 - DNA, 44 bp, Artificial Sequence
  Description of Artificial Sequence: Synthetic oligonucleotide
ctgctgctgctgctgctatttttgttattattattttctacgtc

SEQ ID NO: 149816 - DNA, 45 bp, Artificial Sequence
  Description of Artificial Sequence: Synthetic oligonucleotide
tgctgctgctgctgctatttttgttattattattttctacgtctg

SEQ ID NO: 149817 - DNA, 44 bp, Artificial Sequence
  Description of Artificial Sequence: Synthetic oligonucleotide
gctgctgctgctgctatttttgttattattattttctacgtctg

SEQ ID NO: 149818 - DNA, 46 bp, Artificial Sequence
  Description of Artificial Sequence: Synthetic oligonucleotide
ctgctgctgctgctatttttgttattattattttctacgtctgttg

SEQ ID NO: 149819 - DNA, 48 bp, Artificial Sequence
  Description of Artificial Sequence: Synthetic oligonucleotide
tgctgctgctgctatttttgttattattattttctacgtctgttgttg

SEQ ID NO: 149820 - DNA, 47 bp, Artificial Sequence
  Description of Artificial Sequence: Synthetic oligonucleotide
gctgctgctgctatttttgttattattattttctacgtctgttgttg

SEQ ID NO: 149821 - DNA, 50 bp, Artificial Sequence
  Description of Artificial Sequence: Synthetic oligonucleotide
ctgctgctgctatttttgttattattattttctacgtctgttgttgtaag

SEQ ID NO: 149822 - DNA, 52 bp, Artificial Sequence
  Description of Artificial Sequence: Synthetic oligonucleotide
tgctgctgctatttttgttattattattttctacgtctgttgttgtaagaag

SEQ ID NO: 149823 - DNA, 51 bp, Artificial Sequence
  Description of Artificial Sequence: Synthetic oligonucleotide
gctgctgctatttttgttattattattttctacgtctgttgttgtaagaag

SEQ ID NO: 149824 - DNA, 55 bp, Artificial Sequence
  Description of Artificial Sequence: Synthetic oligonucleotide
ctgctgctatttttgttattattattttctacgtctgttgttgtaagaagaaaac

SEQ ID NO: 149825 - DNA, 57 bp, Artificial Sequence
  Description of Artificial Sequence: Synthetic oligonucleotide
tgctgctatttttgttattattattttctacgtctgttgttgtaagaagaaaacatc

SEQ ID NO: 149826 - DNA, 56 bp, Artificial Sequence
  Description of Artificial Sequence: Synthetic oligonucleotide
gctgctatttttgttattattattttctacgtctgttgttgtaagaagaaaacatc

SEQ ID NO: 149827 - DNA, 57 bp, Artificial Sequence
  Description of Artificial Sequence: Synthetic oligonucleotide
ctgctatttttgttattattattttctacgtctgttgttgtaagaagaaaacatcag

SEQ ID NO: 149828 - DNA, 57 bp, Artificial Sequence
  Description of Artificial Sequence: Synthetic oligonucleotide
tgctatttttgttattattattttctacgtctgttgttgtaagaagaaaacatcagc

SEQ ID NO: 149829 - DNA, 56 bp, Artificial Sequence
  Description of Artificial Sequence: Synthetic oligonucleotide
gctatttttgttattattattttctacgtctgttgttgtaagaagaaaacatcagc

SEQ ID NO: 149830 - DNA, 57 bp, Artificial Sequence
  Description of Artificial Sequence: Synthetic oligonucleotide
ctatttttgttattattattttctacgtctgttgttgtaagaagaaaacatcagctg

SEQ ID NO: 149831 - DNA, 57 bp, Artificial Sequence
  Description of Artificial Sequence: Synthetic oligonucleotide
tatttttgttattattattttctacgtctgttgttgtaagaagaaaacatcagctgc

SEQ ID NO: 149832 - DNA, 56 bp, Artificial Sequence
  Description of Artificial Sequence: Synthetic oligonucleotide
atttttgttattattattttctacgtctgttgttgtaagaagaaaacatcagctgc

SEQ ID NO: 149833 - DNA, 55 bp, Artificial Sequence
  Description of Artificial Sequence: Synthetic oligonucleotide
tttttgttattattattttctacgtctgttgttgtaagaagaaaacatcagctgc

SEQ ID NO: 149834 - DNA, 54 bp, Artificial Sequence
  Description of Artificial Sequence: Synthetic oligonucleotide
ttttgttattattattttctacgtctgttgttgtaagaagaaaacatcagctgc

SEQ ID NO: 149835 - DNA, 53 bp, Artificial Sequence
  Description of Artificial Sequence: Synthetic oligonucleotide
tttgttattattattttctacgtctgttgttgtaagaagaaaacatcagctgc

SEQ ID NO: 149836 - DNA, 52 bp, Artificial Sequence
  Description of Artificial Sequence: Synthetic oligonucleotide
ttgttattattattttctacgtctgttgttgtaagaagaaaacatcagctgc

SEQ ID NO: 149837 - DNA, 51 bp, Artificial Sequence
  Description of Artificial Sequence: Synthetic oligonucleotide
tgttattattattttctacgtctgttgttgtaagaagaaaacatcagctgc

SEQ ID NO: 149838 - DNA, 50 bp, Artificial Sequence
  Description of Artificial Sequence: Synthetic oligonucleotide
gttattattattttctacgtctgttgttgtaagaagaaaacatcagctgc

SEQ ID NO: 149839 - DNA, 51 bp, Artificial Sequence
  Description of Artificial Sequence: Synthetic oligonucleotide
ttattattattttctacgtctgttgttgtaagaagaaaacatcagctgcag

SEQ ID NO: 149840 - DNA, 50 bp, Artificial Sequence
  Description of Artificial Sequence: Synthetic oligonucleotide
tattattattttctacgtctgttgttgtaagaagaaaacatcagctgcag

SEQ ID NO: 149841 - DNA, 49 bp, Artificial Sequence
  Description of Artificial Sequence: Synthetic oligonucleotide
attattattttctacgtctgttgttgtaagaagaaaacatcagctgcag

SEQ ID NO: 149842 - DNA, 48 bp, Artificial Sequence
  Description of Artificial Sequence: Synthetic oligonucleotide
ttattattttctacgtctgttgttgtaagaagaaaacatcagctgcag

SEQ ID NO: 149843 - DNA, 47 bp, Artificial Sequence
  Description of Artificial Sequence: Synthetic oligonucleotide
tattattttctacgtctgttgttgtaagaagaaaacatcagctgcag

SEQ ID NO: 149844 - DNA, 46 bp, Artificial Sequence
  Description of Artificial Sequence: Synthetic oligonucleotide
attattttctacgtctgttgttgtaagaagaaaacatcagctgcag

SEQ ID NO: 149845 - DNA, 45 bp, Artificial Sequence
  Description of Artificial Sequence: Synthetic oligonucleotide
ttattttctacgtctgttgttgtaagaagaaaacatcagctgcag

SEQ ID NO: 149846 - DNA, 44 bp, Artificial Sequence
  Description of Artificial Sequence: Synthetic oligonucleotide
tattttctacgtctgttgttgtaagaagaaaacatcagctgcag

SEQ ID NO: 149847 - DNA, 43 bp, Artificial Sequence
  Description of Artificial Sequence: Synthetic oligonucleotide
attttctacgtctgttgttgtaagaagaaaacatcagctgcag

SEQ ID NO: 149848 - DNA, 42 bp, Artificial Sequence
  Description of Artificial Sequence: Synthetic oligonucleotide
ttttctacgtctgttgttgtaagaagaaaacatcagctgcag

SEQ ID NO: 149849 - DNA, 41 bp, Artificial Sequence
  Description of Artificial Sequence: Synthetic oligonucleotide
tttctacgtctgttgttgtaagaagaaaacatcagctgcag

SEQ ID NO: 149850 - DNA, 40 bp, Artificial Sequence
  Description of Artificial Sequence: Synthetic oligonucleotide
ttctacgtctgttgttgtaagaagaaaacatcagctgcag

SEQ ID NO: 149851 - DNA, 39 bp, Artificial Sequence
  Description of Artificial Sequence: Synthetic oligonucleotide
tctacgtctgttgttgtaagaagaaaacatcagctgcag

SEQ ID NO: 149852 - DNA, 38 bp, Artificial Sequence
  Description of Artificial Sequence: Synthetic oligonucleotide
ctacgtctgttgttgtaagaagaaaacatcagctgcag

SEQ ID NO: 149853 - DNA, 39 bp, Artificial Sequence
  Description of Artificial Sequence: Synthetic oligonucleotide
tacgtctgttgttgtaagaagaaaacatcagctgcagag

SEQ ID NO: 149854 - DNA, 38 bp, Artificial Sequence
  Description of Artificial Sequence: Synthetic oligonucleotide
acgtctgttgttgtaagaagaaaacatcagctgcagag

SEQ ID NO: 149855 - DNA, 37 bp, Artificial Sequence
  Description of Artificial Sequence: Synthetic oligonucleotide
cgtctgttgttgtaagaagaaaacatcagctgcagag

SEQ ID NO: 149856 - DNA, 37 bp, Artificial Sequence
  Description of Artificial Sequence: Synthetic oligonucleotide
gtctgttgttgtaagaagaaaacatcagctgcagagg

SEQ ID NO: 149857 - DNA, 37 bp, Artificial Sequence
  Description of Artificial Sequence: Synthetic oligonucleotide
tctgttgttgtaagaagaaaacatcagctgcagaggg

SEQ ID NO: 149858 - DNA, 36 bp, Artificial Sequence
  Description of Artificial Sequence: Synthetic oligonucleotide
ctgttgttgtaagaagaaaacatcagctgcagaggg

SEQ ID NO: 149859 - DNA, 37 bp, Artificial Sequence
  Description of Artificial Sequence: Synthetic oligonucleotide
tgttgttgtaagaagaaaacatcagctgcagagggtc

SEQ ID NO: 149860 - DNA, 26 bp, Artificial Sequence
  Description of Artificial Sequence: Synthetic oligonucleotide
cccccatggtgaatgtcacccgcagt

SEQ ID NO: 149861 - DNA, 27 bp, Artificial Sequence
  Description of Artificial Sequence: Synthetic oligonucleotide
ccccatggtgaatgtcacccgcagtga

SEQ ID NO: 149862 - DNA, 27 bp, Artificial Sequence
  Description of Artificial Sequence: Synthetic oligonucleotide
cccatggtgaatgtcacccgcagtgag

SEQ ID NO: 149863 - DNA, 27 bp, Artificial Sequence
  Description of Artificial Sequence: Synthetic oligonucleotide
ccatggtgaatgtcacccgcagtgagg

SEQ ID NO: 149864 - DNA, 27 bp, Artificial Sequence
  Description of Artificial Sequence: Synthetic oligonucleotide
catggtgaatgtcacccgcagtgaggc

SEQ ID NO: 149865 - DNA, 27 bp, Artificial Sequence
  Description of Artificial Sequence: Synthetic oligonucleotide
atggtgaatgtcacccgcagtgaggcc

SEQ ID NO: 149866 - DNA, 27 bp, Artificial Sequence
  Description of Artificial Sequence: Synthetic oligonucleotide
tggtgaatgtcacccgcagtgaggcct

SEQ ID NO: 149867 - DNA, 26 bp, Artificial Sequence
  Description of Artificial Sequence: Synthetic oligonucleotide
ggtgaatgtcacccgcagtgaggcct

SEQ ID NO: 149868 - DNA, 27 bp, Artificial Sequence
  Description of Artificial Sequence: Synthetic oligonucleotide
gtgaatgtcacccgcagtgaggcctca

SEQ ID NO: 149869 - DNA, 27 bp, Artificial Sequence
  Description of Artificial Sequence: Synthetic oligonucleotide
tgaatgtcacccgcagtgaggcctcag

SEQ ID NO: 149870 - DNA, 27 bp, Artificial Sequence
  Description of Artificial Sequence: Synthetic oligonucleotide
gaatgtcacccgcagtgaggcctcaga

SEQ ID NO: 149871 - DNA, 27 bp, Artificial Sequence
  Description of Artificial Sequence: Synthetic oligonucleotide
aatgtcacccgcagtgaggcctcagag

SEQ ID NO: 149872 - DNA, 26 bp, Artificial Sequence
  Description of Artificial Sequence: Synthetic oligonucleotide
atgtcacccgcagtgaggcctcagag

SEQ ID NO: 149873 - DNA, 25 bp, Artificial Sequence
  Description of Artificial Sequence: Synthetic oligonucleotide
tgtcacccgcagtgaggcctcagag

SEQ ID NO: 149874 - DNA, 24 bp, Artificial Sequence
  Description of Artificial Sequence: Synthetic oligonucleotide
gtcacccgcagtgaggcctcagag

SEQ ID NO: 149875 - DNA, 24 bp, Artificial Sequence
  Description of Artificial Sequence: Synthetic oligonucleotide
tcacccgcagtgaggcctcagagg

SEQ ID NO: 149876 - DNA, 23 bp, Artificial Sequence
  Description of Artificial Sequence: Synthetic oligonucleotide
cacccgcagtgaggcctcagagg

SEQ ID NO: 149877 - DNA, 23 bp, Artificial Sequence
  Description of Artificial Sequence: Synthetic oligonucleotide
acccgcagtgaggcctcagaggg

SEQ ID NO: 149878 - DNA, 22 bp, Artificial Sequence
  Description of Artificial Sequence: Synthetic oligonucleotide
cccgcagtgaggcctcagaggg

SEQ ID NO: 149879 - DNA, 24 bp, Artificial Sequence
  Description of Artificial Sequence: Synthetic oligonucleotide
ccgcagtgaggcctcagagggcaa

SEQ ID NO: 149880 - DNA, 27 bp, Artificial Sequence
  Description of Artificial Sequence: Synthetic oligonucleotide
cgcagtgaggcctcagagggcaacatt

SEQ ID NO: 149881 - DNA, 28 bp, Artificial Sequence
  Description of Artificial Sequence: Synthetic oligonucleotide
gcagtgaggcctcagagggcaacattac

SEQ ID NO: 149882 - DNA, 28 bp, Artificial Sequence
  Description of Artificial Sequence: Synthetic oligonucleotide
cagtgaggcctcagagggcaacattacc

SEQ ID NO: 149883 - DNA, 28 bp, Artificial Sequence
  Description of Artificial Sequence: Synthetic oligonucleotide
agtgaggcctcagagggcaacattaccg

SEQ ID NO: 149884 - DNA, 27 bp, Artificial Sequence
  Description of Artificial Sequence: Synthetic oligonucleotide
gtgaggcctcagagggcaacattaccg

SEQ ID NO: 149885 - DNA, 28 bp, Artificial Sequence
  Description of Artificial Sequence: Synthetic oligonucleotide
tgaggcctcagagggcaacattaccgtg

SEQ ID NO: 149886 - DNA, 29 bp, Artificial Sequence
  Description of Artificial Sequence: Synthetic oligonucleotide
agccccacagtcttcgctataacctcacg

SEQ ID NO: 149887 - DNA, 28 bp, Artificial Sequence
  Description of Artificial Sequence: Synthetic oligonucleotide
gccccacagtcttcgctataacctcacg

SEQ ID NO: 149888 - DNA, 28 bp, Artificial Sequence
  Description of Artificial Sequence: Synthetic oligonucleotide
ccccacagtcttcgctataacctcacgg

SEQ ID NO: 149889 - DNA, 29 bp, Artificial Sequence
  Description of Artificial Sequence: Synthetic oligonucleotide
cccacagtcttcgctataacctcacggtg

SEQ ID NO: 149890 - DNA, 29 bp, Artificial Sequence
  Description of Artificial Sequence: Synthetic oligonucleotide
ccacagtcttcgctataacctcacggtgc

SEQ ID NO: 149891 - DNA, 30 bp, Artificial Sequence
  Description of Artificial Sequence: Synthetic oligonucleotide
cacagtcttcgctataacctcacggtgctg

SEQ ID NO: 149892 - DNA, 31 bp, Artificial Sequence
  Description of Artificial Sequence: Synthetic oligonucleotide
acagtcttcgctataacctcacggtgctgtc

SEQ ID NO: 149893 - DNA, 30 bp, Artificial Sequence
  Description of Artificial Sequence: Synthetic oligonucleotide
cagtcttcgctataacctcacggtgctgtc

SEQ ID NO: 149894 - DNA, 30 bp, Artificial Sequence
  Description of Artificial Sequence: Synthetic oligonucleotide
agtcttcgctataacctcacggtgctgtcc

SEQ ID NO: 149895 - DNA, 29 bp, Artificial Sequence
  Description of Artificial Sequence: Synthetic oligonucleotide
gtcttcgctataacctcacggtgctgtcc

SEQ ID NO: 149896 - DNA, 29 bp, Artificial Sequence
  Description of Artificial Sequence: Synthetic oligonucleotide
tcttcgctataacctcacggtgctgtccg

SEQ ID NO: 149897 - DNA, 28 bp, Artificial Sequence
  Description of Artificial Sequence: Synthetic oligonucleotide
cttcgctataacctcacggtgctgtccg

SEQ ID NO: 149898 - DNA, 28 bp, Artificial Sequence
  Description of Artificial Sequence: Synthetic oligonucleotide
ttcgctataacctcacggtgctgtccgg

SEQ ID NO: 149899 - DNA, 27 bp, Artificial Sequence
  Description of Artificial Sequence: Synthetic oligonucleotide
tcgctataacctcacggtgctgtccgg

SEQ ID NO: 149900 - DNA, 26 bp, Artificial Sequence
  Description of Artificial Sequence: Synthetic oligonucleotide
cgctataacctcacggtgctgtccgg

SEQ ID NO: 149901 - DNA, 26 bp, Artificial Sequence
  Description of Artificial Sequence: Synthetic oligonucleotide
gctataacctcacggtgctgtccggg

SEQ ID NO: 149902 - DNA, 27 bp, Artificial Sequence
  Description of Artificial Sequence: Synthetic oligonucleotide
ctataacctcacggtgctgtccgggga

SEQ ID NO: 149903 - DNA, 31 bp, Artificial Sequence
  Description of Artificial Sequence: Synthetic oligonucleotide
tgggatggatctgtgcagtcagggtttcttg

SEQ ID NO: 149904 - DNA, 30 bp, Artificial Sequence
  Description of Artificial Sequence: Synthetic oligonucleotide
gggatggatctgtgcagtcagggtttcttg

SEQ ID NO: 149905 - DNA, 30 bp, Artificial Sequence
  Description of Artificial Sequence: Synthetic oligonucleotide
ggatggatctgtgcagtcagggtttcttgc

SEQ ID NO: 149906 - DNA, 31 bp, Artificial Sequence
  Description of Artificial Sequence: Synthetic oligonucleotide
gatggatctgtgcagtcagggtttcttgctg

SEQ ID NO: 149907 - DNA, 32 bp, Artificial Sequence
  Description of Artificial Sequence: Synthetic oligonucleotide
atggatctgtgcagtcagggtttcttgctgag

SEQ ID NO: 149908 - DNA, 31 bp, Artificial Sequence
  Description of Artificial Sequence: Synthetic oligonucleotide
tggatctgtgcagtcagggtttcttgctgag

SEQ ID NO: 149909 - DNA, 30 bp, Artificial Sequence
  Description of Artificial Sequence: Synthetic oligonucleotide
ggatctgtgcagtcagggtttcttgctgag

SEQ ID NO: 149910 - DNA, 30 bp, Artificial Sequence
  Description of Artificial Sequence: Synthetic oligonucleotide
gatctgtgcagtcagggtttcttgctgagg

SEQ ID NO: 149911 - DNA, 32 bp, Artificial Sequence
  Description of Artificial Sequence: Synthetic oligonucleotide
atctgtgcagtcagggtttcttgctgaggtac

SEQ ID NO: 149912 - DNA, 31 bp, Artificial Sequence
  Description of Artificial Sequence: Synthetic oligonucleotide
tctgtgcagtcagggtttcttgctgaggtac

SEQ ID NO: 149913 - DNA, 30 bp, Artificial Sequence
  Description of Artificial Sequence: Synthetic oligonucleotide
ctgtgcagtcagggtttcttgctgaggtac

SEQ ID NO: 149914 - DNA, 32 bp, Artificial Sequence
  Description of Artificial Sequence: Synthetic oligonucleotide
tgtgcagtcagggtttcttgctgaggtacatc

SEQ ID NO: 149915 - DNA, 31 bp, Artificial Sequence
  Description of Artificial Sequence: Synthetic oligonucleotide
gtgcagtcagggtttcttgctgaggtacatc

SEQ ID NO: 149916 - DNA, 32 bp, Artificial Sequence
  Description of Artificial Sequence: Synthetic oligonucleotide
tgcagtcagggtttcttgctgaggtacatctg

SEQ ID NO: 149917 - DNA, 31 bp, Artificial Sequence
  Description of Artificial Sequence: Synthetic oligonucleotide
gcagtcagggtttcttgctgaggtacatctg

SEQ ID NO: 149918 - DNA, 31 bp, Artificial Sequence
  Description of Artificial Sequence: Synthetic oligonucleotide
cagtcagggtttcttgctgaggtacatctgg

SEQ ID NO: 149919 - DNA, 33 bp, Artificial Sequence
  Description of Artificial Sequence: Synthetic oligonucleotide
agtcagggtttcttgctgaggtacatctggatg

SEQ ID NO: 149920 - DNA, 32 bp, Artificial Sequence
  Description of Artificial Sequence: Synthetic oligonucleotide
gtcagggtttcttgctgaggtacatctggatg

SEQ ID NO: 149921 - DNA, 32 bp, Artificial Sequence
  Description of Artificial Sequence: Synthetic oligonucleotide
tcagggtttcttgctgaggtacatctggatgg

SEQ ID NO: 149922 - DNA, 31 bp, Artificial Sequence
  Description of Artificial Sequence: Synthetic oligonucleotide
cagggtttcttgctgaggtacatctggatgg

SEQ ID NO: 149923 - DNA, 32 bp, Artificial Sequence
  Description of Artificial Sequence: Synthetic oligonucleotide
agggtttcttgctgaggtacatctggatggtc

SEQ ID NO: 149924 - DNA, 31 bp, Artificial Sequence
  Description of Artificial Sequence: Synthetic oligonucleotide
gggtttcttgctgaggtacatctggatggtc

SEQ ID NO: 149925 - DNA, 32 bp, Artificial Sequence
  Description of Artificial Sequence: Synthetic oligonucleotide
ggtttcttgctgaggtacatctggatggtcag

SEQ ID NO: 149926 - DNA, 32 bp, Artificial Sequence
  Description of Artificial Sequence: Synthetic oligonucleotide
gtttcttgctgaggtacatctggatggtcagc

SEQ ID NO: 149927 - DNA, 32 bp, Artificial Sequence
  Description of Artificial Sequence: Synthetic oligonucleotide
tttcttgctgaggtacatctggatggtcagcc

SEQ ID NO: 149928 - DNA, 31 bp, Artificial Sequence
  Description of Artificial Sequence: Synthetic oligonucleotide
ttcttgctgaggtacatctggatggtcagcc

SEQ ID NO: 149929 - DNA, 30 bp, Artificial Sequence
  Description of Artificial Sequence: Synthetic oligonucleotide
tcttgctgaggtacatctggatggtcagcc

SEQ ID NO: 149930 - DNA, 29 bp, Artificial Sequence
  Description of Artificial Sequence: Synthetic oligonucleotide
cttgctgaggtacatctggatggtcagcc

SEQ ID NO: 149931 - DNA, 29 bp, Artificial Sequence
  Description of Artificial Sequence: Synthetic oligonucleotide
ttgctgaggtacatctggatggtcagccc

SEQ ID NO: 149932 - DNA, 28 bp, Artificial Sequence
  Description of Artificial Sequence: Synthetic oligonucleotide
tgctgaggtacatctggatggtcagccc

SEQ ID NO: 149933 - DNA, 27 bp, Artificial Sequence
  Description of Artificial Sequence: Synthetic oligonucleotide
tctggatggtcagcccttcctgcgcta

SEQ ID NO: 149934 - DNA, 27 bp, Artificial Sequence
  Description of Artificial Sequence: Synthetic oligonucleotide
ctggatggtcagcccttcctgcgctat

SEQ ID NO: 149935 - DNA, 27 bp, Artificial Sequence
  Description of Artificial Sequence: Synthetic oligonucleotide
tggatggtcagcccttcctgcgctatg

SEQ ID NO: 149936 - DNA, 27 bp, Artificial Sequence
  Description of Artificial Sequence: Synthetic oligonucleotide
ggatggtcagcccttcctgcgctatga

SEQ ID NO: 149937 - DNA, 27 bp, Artificial Sequence
  Description of Artificial Sequence: Synthetic oligonucleotide
gatggtcagcccttcctgcgctatgac

SEQ ID NO: 149938 - DNA, 28 bp, Artificial Sequence
  Description of Artificial Sequence: Synthetic oligonucleotide
atggtcagcccttcctgcgctatgacag

SEQ ID NO: 149939 - DNA, 27 bp, Artificial Sequence
  Description of Artificial Sequence: Synthetic oligonucleotide
tggtcagcccttcctgcgctatgacag

SEQ ID NO: 149940 - DNA, 26 bp, Artificial Sequence
  Description of Artificial Sequence: Synthetic oligonucleotide
ggtcagcccttcctgcgctatgacag

SEQ ID NO: 149941 - DNA, 26 bp, Artificial Sequence
  Description of Artificial Sequence: Synthetic oligonucleotide
gtcagcccttcctgcgctatgacagg

SEQ ID NO: 149942 - DNA, 27 bp, Artificial Sequence
  Description of Artificial Sequence: Synthetic oligonucleotide
tcagcccttcctgcgctatgacaggca

SEQ ID NO: 149943 - DNA, 26 bp, Artificial Sequence
  Description of Artificial Sequence: Synthetic oligonucleotide
cagcccttcctgcgctatgacaggca

SEQ ID NO: 149944 - DNA, 27 bp, Artificial Sequence
  Description of Artificial Sequence: Synthetic oligonucleotide
agcccttcctgcgctatgacaggcaga

SEQ ID NO: 149945 - DNA, 27 bp, Artificial Sequence
  Description of Artificial Sequence: Synthetic oligonucleotide
gcccttcctgcgctatgacaggcagaa

SEQ ID NO: 149946 - DNA, 29 bp, Artificial Sequence
  Description of Artificial Sequence: Synthetic oligonucleotide
cccttcctgcgctatgacaggcagaaatg

SEQ ID NO: 149947 - DNA, 29 bp, Artificial Sequence
  Description of Artificial Sequence: Synthetic oligonucleotide
ccttcctgcgctatgacaggcagaaatgc

SEQ ID NO: 149948 - DNA, 30 bp, Artificial Sequence
  Description of Artificial Sequence: Synthetic oligonucleotide
cttcctgcgctatgacaggcagaaatgcag

SEQ ID NO: 149949 - DNA, 30 bp, Artificial Sequence
  Description of Artificial Sequence: Synthetic oligonucleotide
ttcctgcgctatgacaggcagaaatgcagg

SEQ ID NO: 149950 - DNA, 29 bp, Artificial Sequence
  Description of Artificial Sequence: Synthetic oligonucleotide
tcctgcgctatgacaggcagaaatgcagg

SEQ ID NO: 149951 - DNA, 28 bp, Artificial Sequence
  Description of Artificial Sequence: Synthetic oligonucleotide
cctgcgctatgacaggcagaaatgcagg

SEQ ID NO: 149952 - DNA, 28 bp, Artificial Sequence
  Description of Artificial Sequence: Synthetic oligonucleotide
ctgcgctatgacaggcagaaatgcaggg

SEQ ID NO: 149953 - DNA, 28 bp, Artificial Sequence
  Description of Artificial Sequence: Synthetic oligonucleotide
tgcgctatgacaggcagaaatgcagggc

SEQ ID NO: 149954 - DNA, 27 bp, Artificial Sequence
  Description of Artificial Sequence: Synthetic oligonucleotide
gcgctatgacaggcagaaatgcagggc

SEQ ID NO: 149955 - DNA, 30 bp, Artificial Sequence
  Description of Artificial Sequence: Synthetic oligonucleotide
cgctatgacaggcagaaatgcagggcaaag

SEQ ID NO: 149956 - DNA, 30 bp, Artificial Sequence
  Description of Artificial Sequence: Synthetic oligonucleotide
gctatgacaggcagaaatgcagggcaaagc

SEQ ID NO: 149957 - DNA, 30 bp, Artificial Sequence
  Description of Artificial Sequence: Synthetic oligonucleotide
ctatgacaggcagaaatgcagggcaaagcc

SEQ ID NO: 149958 - DNA, 30 bp, Artificial Sequence
  Description of Artificial Sequence: Synthetic oligonucleotide
tatgacaggcagaaatgcagggcaaagccc

SEQ ID NO: 149959 - DNA, 29 bp, Artificial Sequence
  Description of Artificial Sequence: Synthetic oligonucleotide
atgacaggcagaaatgcagggcaaagccc

SEQ ID NO: 149960 - DNA, 28 bp, Artificial Sequence
  Description of Artificial Sequence: Synthetic oligonucleotide
gatggggagctcttcctctcccaaaacg

SEQ ID NO: 149961 - DNA, 29 bp, Artificial Sequence
  Description of Artificial Sequence: Synthetic oligonucleotide
atggggagctcttcctctcccaaaacgtg

SEQ ID NO: 149962 - DNA, 28 bp, Artificial Sequence
  Description of Artificial Sequence: Synthetic oligonucleotide
tggggagctcttcctctcccaaaacgtg

SEQ ID NO: 149963 - DNA, 27 bp, Artificial Sequence
  Description of Artificial Sequence: Synthetic oligonucleotide
ggggagctcttcctctcccaaaacgtg

SEQ ID NO: 149964 - DNA, 27 bp, Artificial Sequence
  Description of Artificial Sequence: Synthetic oligonucleotide
gggagctcttcctctcccaaaacgtgg

SEQ ID NO: 149965 - DNA, 28 bp, Artificial Sequence
  Description of Artificial Sequence: Synthetic oligonucleotide
ggagctcttcctctcccaaaacgtggag

SEQ ID NO: 149966 - DNA, 29 bp, Artificial Sequence
  Description of Artificial Sequence: Synthetic oligonucleotide
gagctcttcctctcccaaaacgtggagac

SEQ ID NO: 149967 - DNA, 30 bp, Artificial Sequence
  Description of Artificial Sequence: Synthetic oligonucleotide
agctcttcctctcccaaaacgtggagactg

SEQ ID NO: 149968 - DNA, 29 bp, Artificial Sequence
  Description of Artificial Sequence: Synthetic oligonucleotide
gctcttcctctcccaaaacgtggagactg

SEQ ID NO: 149969 - DNA, 30 bp, Artificial Sequence
  Description of Artificial Sequence: Synthetic oligonucleotide
ctcttcctctcccaaaacgtggagactgag

SEQ ID NO: 149970 - DNA, 30 bp, Artificial Sequence
  Description of Artificial Sequence: Synthetic oligonucleotide
tcttcctctcccaaaacgtggagactgagg

SEQ ID NO: 149971 - DNA, 29 bp, Artificial Sequence
  Description of Artificial Sequence: Synthetic oligonucleotide
cttcctctcccaaaacgtggagactgagg

SEQ ID NO: 149972 - DNA, 32 bp, Artificial Sequence
  Description of Artificial Sequence: Synthetic oligonucleotide
ttcctctcccaaaacgtggagactgaggaatg

SEQ ID NO: 149973 - DNA, 31 bp, Artificial Sequence
  Description of Artificial Sequence: Synthetic oligonucleotide
tcctctcccaaaacgtggagactgaggaatg

SEQ ID NO: 149974 - DNA, 30 bp, Artificial Sequence
  Description of Artificial Sequence: Synthetic oligonucleotide
cctctcccaaaacgtggagactgaggaatg

SEQ ID NO: 149975 - DNA, 30 bp, Artificial Sequence
  Description of Artificial Sequence: Synthetic oligonucleotide
ctctcccaaaacgtggagactgaggaatgg

SEQ ID NO: 149976 - DNA, 31 bp, Artificial Sequence
  Description of Artificial Sequence: Synthetic oligonucleotide
tctcccaaaacgtggagactgaggaatggac

SEQ ID NO: 149977 - DNA, 30 bp, Artificial Sequence
  Description of Artificial Sequence: Synthetic oligonucleotide
ctcccaaaacgtggagactgaggaatggac

SEQ ID NO: 149978 - DNA, 31 bp, Artificial Sequence
  Description of Artificial Sequence: Synthetic oligonucleotide
tcccaaaacgtggagactgaggaatggacag

SEQ ID NO: 149979 - DNA, 30 bp, Artificial Sequence
  Description of Artificial Sequence: Synthetic oligonucleotide
cccaaaacgtggagactgaggaatggacag

SEQ ID NO: 149980 - DNA, 31 bp, Artificial Sequence
  Description of Artificial Sequence: Synthetic oligonucleotide
ccaaaacgtggagactgaggaatggacagtg

SEQ ID NO: 149981 - DNA, 31 bp, Artificial Sequence
  Description of Artificial Sequence: Synthetic oligonucleotide
caaaacgtggagactgaggaatggacagtgc

SEQ ID NO: 149982 - DNA, 31 bp, Artificial Sequence
  Description of Artificial Sequence: Synthetic oligonucleotide
aaaacgtggagactgaggaatggacagtgcc

SEQ ID NO: 149983 - DNA, 30 bp, Artificial Sequence
  Description of Artificial Sequence: Synthetic oligonucleotide
aaacgtggagactgaggaatggacagtgcc

SEQ ID NO: 149984 - DNA, 29 bp, Artificial Sequence
  Description of Artificial Sequence: Synthetic oligonucleotide
aacgtggagactgaggaatggacagtgcc

SEQ ID NO: 149985 - DNA, 28 bp, Artificial Sequence
  Description of Artificial Sequence: Synthetic oligonucleotide
acgtggagactgaggaatggacagtgcc

SEQ ID NO: 149986 - DNA, 27 bp, Artificial Sequence
  Description of Artificial Sequence: Synthetic oligonucleotide
cgtggagactgaggaatggacagtgcc

SEQ ID NO: 149987 - DNA, 27 bp, Artificial Sequence
  Description of Artificial Sequence: Synthetic oligonucleotide
gtggagactgaggaatggacagtgccc

SEQ ID NO: 149988 - DNA, 27 bp, Artificial Sequence
  Description of Artificial Sequence: Synthetic oligonucleotide
tggagactgaggaatggacagtgcccc

SEQ ID NO: 149989 - DNA, 27 bp, Artificial Sequence
  Description of Artificial Sequence: Synthetic oligonucleotide
ggagactgaggaatggacagtgcccca

SEQ ID NO: 149990 - DNA, 27 bp, Artificial Sequence
  Description of Artificial Sequence: Synthetic oligonucleotide
gagactgaggaatggacagtgccccag

SEQ ID NO: 149991 - DNA, 28 bp, Artificial Sequence
  Description of Artificial Sequence: Synthetic oligonucleotide
agactgaggaatggacagtgccccagtc

SEQ ID NO: 149992 - DNA, 27 bp, Artificial Sequence
  Description of Artificial Sequence: Synthetic oligonucleotide
gactgaggaatggacagtgccccagtc

SEQ ID NO: 149993 - DNA, 27 bp, Artificial Sequence
  Description of Artificial Sequence: Synthetic oligonucleotide
actgaggaatggacagtgccccagtcc

SEQ ID NO: 149994 - DNA, 27 bp, Artificial Sequence
  Description of Artificial Sequence: Synthetic oligonucleotide
ctgaggaatggacagtgccccagtcct

SEQ ID NO: 149995 - DNA, 27 bp, Artificial Sequence
  Description of Artificial Sequence: Synthetic oligonucleotide
tgaggaatggacagtgccccagtcctc

SEQ ID NO: 149996 - DNA, 26 bp, Artificial Sequence
  Description of Artificial Sequence: Synthetic oligonucleotide
gaggaatggacagtgccccagtcctc

SEQ ID NO: 149997 - DNA, 27 bp, Artificial Sequence
  Description of Artificial Sequence: Synthetic oligonucleotide
aggaatggacagtgccccagtcctcca

SEQ ID NO: 149998 - DNA, 26 bp, Artificial Sequence
  Description of Artificial Sequence: Synthetic oligonucleotide
ggaatggacagtgccccagtcctcca

SEQ ID NO: 149999 - DNA, 27 bp, Artificial Sequence
  Description of Artificial Sequence: Synthetic oligonucleotide
gaatggacagtgccccagtcctccaga

SEQ ID NO: 150000 - DNA, 27 bp, Artificial Sequence
  Description of Artificial Sequence: Synthetic oligonucleotide
aatggacagtgccccagtcctccagag

SEQ ID NO: 150001 - DNA, 26 bp, Artificial Sequence
  Description of Artificial Sequence: Synthetic oligonucleotide
atggacagtgccccagtcctccagag

SEQ ID NO: 150002 - DNA, 25 bp, Artificial Sequence
  Description of Artificial Sequence: Synthetic oligonucleotide
tggacagtgccccagtcctccagag

SEQ ID NO: 150003 - DNA, 24 bp, Artificial Sequence
  Description of Artificial Sequence: Synthetic oligonucleotide
ggacagtgccccagtcctccagag

SEQ ID NO: 150004 - DNA, 25 bp, Artificial Sequence
  Description of Artificial Sequence: Synthetic oligonucleotide
gacagtgccccagtcctccagagct

SEQ ID NO: 150005 - DNA, 26 bp, Artificial Sequence
  Description of Artificial Sequence: Synthetic oligonucleotide
acagtgccccagtcctccagagctca

SEQ ID NO: 150006 - DNA, 25 bp, Artificial Sequence
  Description of Artificial Sequence: Synthetic oligonucleotide
cagtgccccagtcctccagagctca

SEQ ID NO: 150007 - DNA, 26 bp, Artificial Sequence
  Description of Artificial Sequence: Synthetic oligonucleotide
agtgccccagtcctccagagctcaga

SEQ ID NO: 150008 - DNA, 25 bp, Artificial Sequence
  Description of Artificial Sequence: Synthetic oligonucleotide
gtgccccagtcctccagagctcaga

SEQ ID NO: 150009 - DNA, 30 bp, Artificial Sequence
  Description of Artificial Sequence: Synthetic oligonucleotide
actgcctgcaggaactacggcgatatctag

SEQ ID NO: 150010 - DNA, 29 bp, Artificial Sequence
  Description of Artificial Sequence: Synthetic oligonucleotide
ctgcctgcaggaactacggcgatatctag

SEQ ID NO: 150011 - DNA, 32 bp, Artificial Sequence
  Description of Artificial Sequence: Synthetic oligonucleotide
tgcctgcaggaactacggcgatatctagaatc

SEQ ID NO: 150012 - DNA, 31 bp, Artificial Sequence
  Description of Artificial Sequence: Synthetic oligonucleotide
gcctgcaggaactacggcgatatctagaatc

SEQ ID NO: 150013 - DNA, 31 bp, Artificial Sequence
  Description of Artificial Sequence: Synthetic oligonucleotide
cctgcaggaactacggcgatatctagaatcc

SEQ ID NO: 150014 - DNA, 32 bp, Artificial Sequence
  Description of Artificial Sequence: Synthetic oligonucleotide
ctgcaggaactacggcgatatctagaatccag

SEQ ID NO: 150015 - DNA, 32 bp, Artificial Sequence
  Description of Artificial Sequence: Synthetic oligonucleotide
tgcaggaactacggcgatatctagaatccagc

SEQ ID NO: 150016 - DNA, 31 bp, Artificial Sequence
  Description of Artificial Sequence: Synthetic oligonucleotide
gcaggaactacggcgatatctagaatccagc

SEQ ID NO: 150017 - DNA, 31 bp, Artificial Sequence
  Description of Artificial Sequence: Synthetic oligonucleotide
caggaactacggcgatatctagaatccagcg

SEQ ID NO: 150018 - DNA, 33 bp, Artificial Sequence
  Description of Artificial Sequence: Synthetic oligonucleotide
aggaactacggcgatatctagaatccagcgtag

SEQ ID NO: 150019 - DNA, 32 bp, Artificial Sequence
  Description of Artificial Sequence: Synthetic oligonucleotide
ggaactacggcgatatctagaatccagcgtag

SEQ ID NO: 150020 - DNA, 33 bp, Artificial Sequence
  Description of Artificial Sequence: Synthetic oligonucleotide
gaactacggcgatatctagaatccagcgtagtc

SEQ ID NO: 150021 - DNA, 33 bp, Artificial Sequence
  Description of Artificial Sequence: Synthetic oligonucleotide
aactacggcgatatctagaatccagcgtagtcc

SEQ ID NO: 150022 - DNA, 32 bp, Artificial Sequence
  Description of Artificial Sequence: Synthetic oligonucleotide
actacggcgatatctagaatccagcgtagtcc

SEQ ID NO: 150023 - DNA, 31 bp, Artificial Sequence
  Description of Artificial Sequence: Synthetic oligonucleotide
ctacggcgatatctagaatccagcgtagtcc

SEQ ID NO: 150024 - DNA, 32 bp, Artificial Sequence
  Description of Artificial Sequence: Synthetic oligonucleotide
tacggcgatatctagaatccagcgtagtcctg

SEQ ID NO: 150025 - DNA, 31 bp, Artificial Sequence
  Description of Artificial Sequence: Synthetic oligonucleotide
acggcgatatctagaatccagcgtagtcctg

SEQ ID NO: 150026 - DNA, 30 bp, Artificial Sequence
  Description of Artificial Sequence: Synthetic oligonucleotide
cggcgatatctagaatccagcgtagtcctg

SEQ ID NO: 150027 - DNA, 31 bp, Artificial Sequence
  Description of Artificial Sequence: Synthetic oligonucleotide
ggcgatatctagaatccagcgtagtcctgag

SEQ ID NO: 150028 - DNA, 31 bp, Artificial Sequence
  Description of Artificial Sequence: Synthetic oligonucleotide
gcgatatctagaatccagcgtagtcctgagg

SEQ ID NO: 150029 - DNA, 32 bp, Artificial Sequence
  Description of Artificial Sequence: Synthetic oligonucleotide
cgatatctagaatccagcgtagtcctgaggag

SEQ ID NO: 150030 - DNA, 34 bp, Artificial Sequence
  Description of Artificial Sequence: Synthetic oligonucleotide
gatatctagaatccagcgtagtcctgaggagaag

SEQ ID NO: 150031 - DNA, 35 bp, Artificial Sequence
  Description of Artificial Sequence: Synthetic oligonucleotide
atatctagaatccagcgtagtcctgaggagaagag

SEQ ID NO: 150032 - DNA, 34 bp, Artificial Sequence
  Description of Artificial Sequence: Synthetic oligonucleotide
tatctagaatccagcgtagtcctgaggagaagag

SEQ ID NO: 150033 - DNA, 33 bp, Artificial Sequence
  Description of Artificial Sequence: Synthetic oligonucleotide
atctagaatccagcgtagtcctgaggagaagag

SEQ ID NO: 150034 - DNA, 32 bp, Artificial Sequence
  Description of Artificial Sequence: Synthetic oligonucleotide
tctagaatccagcgtagtcctgaggagaagag

SEQ ID NO: 150035 - DNA, 31 bp, Artificial Sequence
  Description of Artificial Sequence: Synthetic oligonucleotide
ctagaatccagcgtagtcctgaggagaagag

SEQ ID NO: 150036 - DNA, 32 bp, Artificial Sequence
  Description of Artificial Sequence: Synthetic oligonucleotide
tagaatccagcgtagtcctgaggagaagagtg

SEQ ID NO: 150037 - DNA, 31 bp, Artificial Sequence
  Description of Artificial Sequence: Synthetic oligonucleotide
agaatccagcgtagtcctgaggagaagagtg

SEQ ID NO: 150038 - DNA, 30 bp, Artificial Sequence
  Description of Artificial Sequence: Synthetic oligonucleotide
gaatccagcgtagtcctgaggagaagagtg

SEQ ID NO: 150039 - DNA, 30 bp, Artificial Sequence
  Description of Artificial Sequence: Synthetic oligonucleotide
aatccagcgtagtcctgaggagaagagtgc

SEQ ID NO: 150040 - DNA, 29 bp, Artificial Sequence
  Description of Artificial Sequence: Synthetic oligonucleotide
atccagcgtagtcctgaggagaagagtgc

SEQ ID NO: 150041 - DNA, 28 bp, Artificial Sequence
  Description of Artificial Sequence: Synthetic oligonucleotide
tccagcgtagtcctgaggagaagagtgc

SEQ ID NO: 150042 - DNA, 27 bp, Artificial Sequence
  Description of Artificial Sequence: Synthetic oligonucleotide
ccagcgtagtcctgaggagaagagtgc

SEQ ID NO: 150043 - DNA, 27 bp, Artificial Sequence
  Description of Artificial Sequence: Synthetic oligonucleotide
cagcgtagtcctgaggagaagagtgcc

SEQ ID NO: 150044 - DNA, 27 bp, Artificial Sequence
  Description of Artificial Sequence: Synthetic oligonucleotide
agcgtagtcctgaggagaagagtgccc

SEQ ID NO: 150045 - DNA, 26 bp, Artificial Sequence
  Description of Artificial Sequence: Synthetic oligonucleotide
gcgtagtcctgaggagaagagtgccc

SEQ ID NO: 150046 - DNA, 26 bp, Artificial Sequence
  Description of Artificial Sequence: Synthetic oligonucleotide
cgtagtcctgaggagaagagtgcccc

SEQ ID NO: 150047 - DNA, 26 bp, Artificial Sequence
  Description of Artificial Sequence: Synthetic oligonucleotide
gtagtcctgaggagaagagtgccccc

SEQ ID NO: 150048 - DNA, 27 bp, Artificial Sequence
  Description of Artificial Sequence: Synthetic oligonucleotide
tagtcctgaggagaagagtgcccccca

SEQ ID NO: 150049 - DNA, 27 bp, Artificial Sequence
  Description of Artificial Sequence: Synthetic oligonucleotide
agtcctgaggagaagagtgccccccat

SEQ ID NO: 150050 - DNA, 26 bp, Artificial Sequence
  Description of Artificial Sequence: Synthetic oligonucleotide
gtcctgaggagaagagtgccccccat

SEQ ID NO: 150051 - DNA, 26 bp, Artificial Sequence
  Description of Artificial Sequence: Synthetic oligonucleotide
tcctgaggagaagagtgccccccatg

SEQ ID NO: 150052 - DNA, 25 bp, Artificial Sequence
  Description of Artificial Sequence: Synthetic oligonucleotide
cctgaggagaagagtgccccccatg

SEQ ID NO: 150053 - DNA, 26 bp, Artificial Sequence
  Description of Artificial Sequence: Synthetic oligonucleotide
ctgaggagaagagtgccccccatggt

SEQ ID NO: 150054 - DNA, 27 bp, Artificial Sequence
  Description of Artificial Sequence: Synthetic oligonucleotide
tgaggagaagagtgccccccatggtga

SEQ ID NO: 150055 - DNA, 27 bp, Artificial Sequence
  Description of Artificial Sequence: Synthetic oligonucleotide
gaggagaagagtgccccccatggtgaa

SEQ ID NO: 150056 - DNA, 28 bp, Artificial Sequence
  Description of Artificial Sequence: Synthetic oligonucleotide
aggagaagagtgccccccatggtgaatg

SEQ ID NO: 150057 - DNA, 27 bp, Artificial Sequence
  Description of Artificial Sequence: Synthetic oligonucleotide
ggagaagagtgccccccatggtgaatg

SEQ ID NO: 150058 - DNA, 28 bp, Artificial Sequence
  Description of Artificial Sequence: Synthetic oligonucleotide
gagaagagtgccccccatggtgaatgtc

SEQ ID NO: 150059 - DNA, 29 bp, Artificial Sequence
  Description of Artificial Sequence: Synthetic oligonucleotide
agaagagtgccccccatggtgaatgtcac

SEQ ID NO: 150060 - DNA, 28 bp, Artificial Sequence
  Description of Artificial Sequence: Synthetic oligonucleotide
gaagagtgccccccatggtgaatgtcac

SEQ ID NO: 150061 - DNA, 28 bp, Artificial Sequence
  Description of Artificial Sequence: Synthetic oligonucleotide
aagagtgccccccatggtgaatgtcacc

SEQ ID NO: 150062 - DNA, 27 bp, Artificial Sequence
  Description of Artificial Sequence: Synthetic oligonucleotide
agagtgccccccatggtgaatgtcacc

SEQ ID NO: 150063 - DNA, 26 bp, Artificial Sequence
  Description of Artificial Sequence: Synthetic oligonucleotide
gagtgccccccatggtgaatgtcacc

SEQ ID NO: 150064 - DNA, 25 bp, Artificial Sequence
  Description of Artificial Sequence: Synthetic oligonucleotide
gcagcgaggcctcagagggcaacat

SEQ ID NO: 150065 - DNA, 26 bp, Artificial Sequence
  Description of Artificial Sequence: Synthetic oligonucleotide
cagcgaggcctcagagggcaacatca

SEQ ID NO: 150066 - DNA, 26 bp, Artificial Sequence
  Description of Artificial Sequence: Synthetic oligonucleotide
agcgaggcctcagagggcaacatcac

SEQ ID NO: 150067 - DNA, 25 bp, Artificial Sequence
  Description of Artificial Sequence: Synthetic oligonucleotide
gcgaggcctcagagggcaacatcac

SEQ ID NO: 150068 - DNA, 25 bp, Artificial Sequence
  Description of Artificial Sequence: Synthetic oligonucleotide
cgaggcctcagagggcaacatcacc

SEQ ID NO: 150069 - DNA, 26 bp, Artificial Sequence
  Description of Artificial Sequence: Synthetic oligonucleotide
gaggcctcagagggcaacatcaccgt

SEQ ID NO: 150070 - DNA, 27 bp, Artificial Sequence
  Description of Artificial Sequence: Synthetic oligonucleotide
aggcctcagagggcaacatcaccgtga

SEQ ID NO: 150071 - DNA, 26 bp, Artificial Sequence
  Description of Artificial Sequence: Synthetic oligonucleotide
ggcctcagagggcaacatcaccgtga

SEQ ID NO: 150072 - DNA, 27 bp, Artificial Sequence
  Description of Artificial Sequence: Synthetic oligonucleotide
gcctcagagggcaacatcaccgtgaca

SEQ ID NO: 150073 - DNA, 28 bp, Artificial Sequence
  Description of Artificial Sequence: Synthetic oligonucleotide
cctcagagggcaacatcaccgtgacatg

SEQ ID NO: 150074 - DNA, 28 bp, Artificial Sequence
  Description of Artificial Sequence: Synthetic oligonucleotide
ctcagagggcaacatcaccgtgacatgc

SEQ ID NO: 150075 - DNA, 29 bp, Artificial Sequence
  Description of Artificial Sequence: Synthetic oligonucleotide
tcagagggcaacatcaccgtgacatgcag

SEQ ID NO: 150076 - DNA, 28 bp, Artificial Sequence
  Description of Artificial Sequence: Synthetic oligonucleotide
cagagggcaacatcaccgtgacatgcag

SEQ ID NO: 150077 - DNA, 28 bp, Artificial Sequence
  Description of Artificial Sequence: Synthetic oligonucleotide
agagggcaacatcaccgtgacatgcagg

SEQ ID NO: 150078 - DNA, 27 bp, Artificial Sequence
  Description of Artificial Sequence: Synthetic oligonucleotide
gagggcaacatcaccgtgacatgcagg

SEQ ID NO: 150079 - DNA, 27 bp, Artificial Sequence
  Description of Artificial Sequence: Synthetic oligonucleotide
agggcaacatcaccgtgacatgcaggg

SEQ ID NO: 150080 - DNA, 26 bp, Artificial Sequence
  Description of Artificial Sequence: Synthetic oligonucleotide
gggcaacatcaccgtgacatgcaggg

SEQ ID NO: 150081 - DNA, 27 bp, Artificial Sequence
  Description of Artificial Sequence: Synthetic oligonucleotide
ggcaacatcaccgtgacatgcagggct

SEQ ID NO: 150082 - DNA, 28 bp, Artificial Sequence
  Description of Artificial Sequence: Synthetic oligonucleotide
gcaacatcaccgtgacatgcagggcttc

SEQ ID NO: 150083 - DNA, 28 bp, Artificial Sequence
  Description of Artificial Sequence: Synthetic oligonucleotide
caacatcaccgtgacatgcagggcttcc

SEQ ID NO: 150084 - DNA, 29 bp, Artificial Sequence
  Description of Artificial Sequence: Synthetic oligonucleotide
aacatcaccgtgacatgcagggcttccag

SEQ ID NO: 150085 - DNA, 28 bp, Artificial Sequence
  Description of Artificial Sequence: Synthetic oligonucleotide
acatcaccgtgacatgcagggcttccag

SEQ ID NO: 150086 - DNA, 27 bp, Artificial Sequence
  Description of Artificial Sequence: Synthetic oligonucleotide
catcaccgtgacatgcagggcttccag

SEQ ID NO: 150087 - DNA, 27 bp, Artificial Sequence
  Description of Artificial Sequence: Synthetic oligonucleotide
atcaccgtgacatgcagggcttccagc

SEQ ID NO: 150088 - DNA, 27 bp, Artificial Sequence
  Description of Artificial Sequence: Synthetic oligonucleotide
tcaccgtgacatgcagggcttccagct

SEQ ID NO: 150089 - DNA, 27 bp, Artificial Sequence
  Description of Artificial Sequence: Synthetic oligonucleotide
caccgtgacatgcagggcttccagctt

SEQ ID NO: 150090 - DNA, 27 bp, Artificial Sequence
  Description of Artificial Sequence: Synthetic oligonucleotide
accgtgacatgcagggcttccagcttc

SEQ ID NO: 150091 - DNA, 27 bp, Artificial Sequence
  Description of Artificial Sequence: Synthetic oligonucleotide
ccgtgacatgcagggcttccagcttct

SEQ ID NO: 150092 - DNA, 29 bp, Artificial Sequence
  Description of Artificial Sequence: Synthetic oligonucleotide
cgtgacatgcagggcttccagcttctatc

SEQ ID NO: 150093 - DNA, 29 bp, Artificial Sequence
  Description of Artificial Sequence: Synthetic oligonucleotide
gtgacatgcagggcttccagcttctatcc

SEQ ID NO: 150094 - DNA, 29 bp, Artificial Sequence
  Description of Artificial Sequence: Synthetic oligonucleotide
tgacatgcagggcttccagcttctatccc

SEQ ID NO: 150095 - DNA, 28 bp, Artificial Sequence
  Description of Artificial Sequence: Synthetic oligonucleotide
gacatgcagggcttccagcttctatccc

SEQ ID NO: 150096 - DNA, 28 bp, Artificial Sequence
  Description of Artificial Sequence: Synthetic oligonucleotide
acatgcagggcttccagcttctatcccc

SEQ ID NO: 150097 - DNA, 27 bp, Artificial Sequence
  Description of Artificial Sequence: Synthetic oligonucleotide
catgcagggcttccagcttctatcccc

SEQ ID NO: 150098 - DNA, 27 bp, Artificial Sequence
  Description of Artificial Sequence: Synthetic oligonucleotide
atgcagggcttccagcttctatccccg

SEQ ID NO: 150099 - DNA, 26 bp, Artificial Sequence
  Description of Artificial Sequence: Synthetic oligonucleotide
tgcagggcttccagcttctatccccg

SEQ ID NO: 150100 - DNA, 25 bp, Artificial Sequence
  Description of Artificial Sequence: Synthetic oligonucleotide
gcagggcttccagcttctatccccg

SEQ ID NO: 150101 - DNA, 27 bp, Artificial Sequence
  Description of Artificial Sequence: Synthetic oligonucleotide
cagggcttccagcttctatccccggaa

SEQ ID NO: 150102 - DNA, 30 bp, Artificial Sequence
  Description of Artificial Sequence: Synthetic oligonucleotide
agggcttccagcttctatccccggaatatc

SEQ ID NO: 150103 - DNA, 29 bp, Artificial Sequence
  Description of Artificial Sequence: Synthetic oligonucleotide
gggcttccagcttctatccccggaatatc

SEQ ID NO: 150104 - DNA, 30 bp, Artificial Sequence
  Description of Artificial Sequence: Synthetic oligonucleotide
ggcttccagcttctatccccggaatatcac

SEQ ID NO: 150105 - DNA, 31 bp, Artificial Sequence
  Description of Artificial Sequence: Synthetic oligonucleotide
gcttccagcttctatccccggaatatcacac

SEQ ID NO: 150106 - DNA, 32 bp, Artificial Sequence
  Description of Artificial Sequence: Synthetic oligonucleotide
cttccagcttctatccccggaatatcacactg

SEQ ID NO: 150107 - DNA, 33 bp, Artificial Sequence
  Description of Artificial Sequence: Synthetic oligonucleotide
ttccagcttctatccccggaatatcacactgac

SEQ ID NO: 150108 - DNA, 32 bp, Artificial Sequence
  Description of Artificial Sequence: Synthetic oligonucleotide
tccagcttctatccccggaatatcacactgac

SEQ ID NO: 150109 - DNA, 31 bp, Artificial Sequence
  Description of Artificial Sequence: Synthetic oligonucleotide
ccagcttctatccccggaatatcacactgac

SEQ ID NO: 150110 - DNA, 31 bp, Artificial Sequence
  Description of Artificial Sequence: Synthetic oligonucleotide
cagcttctatccccggaatatcacactgacc

SEQ ID NO: 150111 - DNA, 32 bp, Artificial Sequence
  Description of Artificial Sequence: Synthetic oligonucleotide
agcttctatccccggaatatcacactgacctg

SEQ ID NO: 150112 - DNA, 31 bp, Artificial Sequence
  Description of Artificial Sequence: Synthetic oligonucleotide
gcttctatccccggaatatcacactgacctg

SEQ ID NO: 150113 - DNA, 31 bp, Artificial Sequence
  Description of Artificial Sequence: Synthetic oligonucleotide
cttctatccccggaatatcacactgacctgg

SEQ ID NO: 150114 - DNA, 31 bp, Artificial Sequence
  Description of Artificial Sequence: Synthetic oligonucleotide
ttctatccccggaatatcacactgacctggc

SEQ ID NO: 150115 - DNA, 30 bp, Artificial Sequence
  Description of Artificial Sequence: Synthetic oligonucleotide
tctatccccggaatatcacactgacctggc

SEQ ID NO: 150116 - DNA, 29 bp, Artificial Sequence
  Description of Artificial Sequence: Synthetic oligonucleotide
ctatccccggaatatcacactgacctggc

SEQ ID NO: 150117 - DNA, 29 bp, Artificial Sequence
  Description of Artificial Sequence: Synthetic oligonucleotide
tatccccggaatatcacactgacctggcg

SEQ ID NO: 150118 - DNA, 28 bp, Artificial Sequence
  Description of Artificial Sequence: Synthetic oligonucleotide
atccccggaatatcacactgacctggcg

SEQ ID NO: 150119 - DNA, 27 bp, Artificial Sequence
  Description of Artificial Sequence: Synthetic oligonucleotide
tccccggaatatcacactgacctggcg

SEQ ID NO: 150120 - DNA, 27 bp, Artificial Sequence
  Description of Artificial Sequence: Synthetic oligonucleotide
ccccggaatatcacactgacctggcgt

SEQ ID NO: 150121 - DNA, 27 bp, Artificial Sequence
  Description of Artificial Sequence: Synthetic oligonucleotide
cccggaatatcacactgacctggcgtc

SEQ ID NO: 150122 - DNA, 28 bp, Artificial Sequence
  Description of Artificial Sequence: Synthetic oligonucleotide
ccggaatatcacactgacctggcgtcag

SEQ ID NO: 150123 - DNA, 28 bp, Artificial Sequence
  Description of Artificial Sequence: Synthetic oligonucleotide
cggaatatcacactgacctggcgtcagg

SEQ ID NO: 150124 - DNA, 30 bp, Artificial Sequence
  Description of Artificial Sequence: Synthetic oligonucleotide
ggaatatcacactgacctggcgtcaggatg

SEQ ID NO: 150125 - DNA, 30 bp, Artificial Sequence
  Description of Artificial Sequence: Synthetic oligonucleotide
gaatatcacactgacctggcgtcaggatgg

SEQ ID NO: 150126 - DNA, 30 bp, Artificial Sequence
  Description of Artificial Sequence: Synthetic oligonucleotide
aatatcacactgacctggcgtcaggatggg

SEQ ID NO: 150127 - DNA, 29 bp, Artificial Sequence
  Description of Artificial Sequence: Synthetic oligonucleotide
atatcacactgacctggcgtcaggatggg

SEQ ID NO: 150128 - DNA, 28 bp, Artificial Sequence
  Description of Artificial Sequence: Synthetic oligonucleotide
tatcacactgacctggcgtcaggatggg

SEQ ID NO: 150129 - DNA, 27 bp, Artificial Sequence
  Description of Artificial Sequence: Synthetic oligonucleotide
atcacactgacctggcgtcaggatggg

SEQ ID NO: 150130 - DNA, 26 bp, Artificial Sequence
  Description of Artificial Sequence: Synthetic oligonucleotide
tcacactgacctggcgtcaggatggg

SEQ ID NO: 150131 - DNA, 25 bp, Artificial Sequence
  Description of Artificial Sequence: Synthetic oligonucleotide
cacactgacctggcgtcaggatggg

SEQ ID NO: 150132 - DNA, 27 bp, Artificial Sequence
  Description of Artificial Sequence: Synthetic oligonucleotide
acactgacctggcgtcaggatggggta

SEQ ID NO: 150133 - DNA, 27 bp, Artificial Sequence
  Description of Artificial Sequence: Synthetic oligonucleotide
cactgacctggcgtcaggatggggtat

SEQ ID NO: 150134 - DNA, 27 bp, Artificial Sequence
  Description of Artificial Sequence: Synthetic oligonucleotide
actgacctggcgtcaggatggggtatc

SEQ ID NO: 150135 - DNA, 27 bp, Artificial Sequence
  Description of Artificial Sequence: Synthetic oligonucleotide
ctgacctggcgtcaggatggggtatct

SEQ ID NO: 150136 - DNA, 29 bp, Artificial Sequence
  Description of Artificial Sequence: Synthetic oligonucleotide
tgacctggcgtcaggatggggtatctttg

SEQ ID NO: 150137 - DNA, 28 bp, Artificial Sequence
  Description of Artificial Sequence: Synthetic oligonucleotide
gacctggcgtcaggatggggtatctttg

SEQ ID NO: 150138 - DNA, 29 bp, Artificial Sequence
  Description of Artificial Sequence: Synthetic oligonucleotide
acctggcgtcaggatggggtatctttgag

SEQ ID NO: 150139 - DNA, 28 bp, Artificial Sequence
  Description of Artificial Sequence: Synthetic oligonucleotide
cctggcgtcaggatggggtatctttgag

SEQ ID NO: 150140 - DNA, 27 bp, Artificial Sequence
  Description of Artificial Sequence: Synthetic oligonucleotide
ctgctgttgctgctgctgctgctgcta

SEQ ID NO: 150141 - DNA, 32 bp, Artificial Sequence
  Description of Artificial Sequence: Synthetic oligonucleotide
tgctgttgctgctgctgctgctgctatttttg

SEQ ID NO: 150142 - DNA, 31 bp, Artificial Sequence
  Description of Artificial Sequence: Synthetic oligonucleotide
gctgttgctgctgctgctgctgctatttttg

SEQ ID NO: 150143 - DNA, 44 bp, Artificial Sequence
  Description of Artificial Sequence: Synthetic oligonucleotide
ctgttgctgctgctgctgctgctatttttgttattattattttc

SEQ ID NO: 150144 - DNA, 47 bp, Artificial Sequence
  Description of Artificial Sequence: Synthetic oligonucleotide
tgttgctgctgctgctgctgctatttttgttattattattttctatg

SEQ ID NO: 150145 - DNA, 46 bp, Artificial Sequence
  Description of Artificial Sequence: Synthetic oligonucleotide
gttgctgctgctgctgctgctatttttgttattattattttctatg

SEQ ID NO: 150146 - DNA, 47 bp, Artificial Sequence
  Description of Artificial Sequence: Synthetic oligonucleotide
ttgctgctgctgctgctgctatttttgttattattattttctatgtc

SEQ ID NO: 150147 - DNA, 46 bp, Artificial Sequence
  Description of Artificial Sequence: Synthetic oligonucleotide
tgctgctgctgctgctgctatttttgttattattattttctatgtc

SEQ ID NO: 150148 - DNA, 45 bp, Artificial Sequence
  Description of Artificial Sequence: Synthetic oligonucleotide
gctgctgctgctgctgctatttttgttattattattttctatgtc

SEQ ID NO: 150149 - DNA, 45 bp, Artificial Sequence
  Description of Artificial Sequence: Synthetic oligonucleotide
ctgctgctgctgctgctatttttgttattattattttctatgtcc

SEQ ID NO: 150150 - DNA, 45 bp, Artificial Sequence
  Description of Artificial Sequence: Synthetic oligonucleotide
tgctgctgctgctgctatttttgttattattattttctatgtccg

SEQ ID NO: 150151 - DNA, 44 bp, Artificial Sequence
  Description of Artificial Sequence: Synthetic oligonucleotide
gctgctgctgctgctatttttgttattattattttctatgtccg

SEQ ID NO: 150152 - DNA, 46 bp, Artificial Sequence
  Description of Artificial Sequence: Synthetic oligonucleotide
ctgctgctgctgctatttttgttattattattttctatgtccgttg

SEQ ID NO: 150153 - DNA, 30 bp, Artificial Sequence
  Description of Artificial Sequence: Synthetic oligonucleotide
acagctcggatttcagcctctgatgtcagc

SEQ ID NO: 150154 - DNA, 29 bp, Artificial Sequence
  Description of Artificial Sequence: Synthetic oligonucleotide
cagctcggatttcagcctctgatgtcagc

SEQ ID NO: 150155 - DNA, 30 bp, Artificial Sequence
  Description of Artificial Sequence: Synthetic oligonucleotide
agctcggatttcagcctctgatgtcagctc

SEQ ID NO: 150156 - DNA, 29 bp, Artificial Sequence
  Description of Artificial Sequence: Synthetic oligonucleotide
gctcggatttcagcctctgatgtcagctc

SEQ ID NO: 150157 - DNA, 31 bp, Artificial Sequence
  Description of Artificial Sequence: Synthetic oligonucleotide
ctcggatttcagcctctgatgtcagctcttg

SEQ ID NO: 150158 - DNA, 31 bp, Artificial Sequence
  Description of Artificial Sequence: Synthetic oligonucleotide
tcggatttcagcctctgatgtcagctcttgg

SEQ ID NO: 150159 - DNA, 30 bp, Artificial Sequence
  Description of Artificial Sequence: Synthetic oligonucleotide
cggatttcagcctctgatgtcagctcttgg

SEQ ID NO: 150160 - DNA, 30 bp, Artificial Sequence
  Description of Artificial Sequence: Synthetic oligonucleotide
ggatttcagcctctgatgtcagctcttggg

SEQ ID NO: 150161 - DNA, 31 bp, Artificial Sequence
  Description of Artificial Sequence: Synthetic oligonucleotide
gatttcagcctctgatgtcagctcttgggtc

SEQ ID NO: 150162 - DNA, 31 bp, Artificial Sequence
  Description of Artificial Sequence: Synthetic oligonucleotide
atttcagcctctgatgtcagctcttgggtcc

SEQ ID NO: 150163 - DNA, 30 bp, Artificial Sequence
  Description of Artificial Sequence: Synthetic oligonucleotide
tttcagcctctgatgtcagctcttgggtcc

SEQ ID NO: 150164 - DNA, 29 bp, Artificial Sequence
  Description of Artificial Sequence: Synthetic oligonucleotide
ttcagcctctgatgtcagctcttgggtcc

SEQ ID NO: 150165 - DNA, 28 bp, Artificial Sequence
  Description of Artificial Sequence: Synthetic oligonucleotide
tcagcctctgatgtcagctcttgggtcc

SEQ ID NO: 150166 - DNA, 27 bp, Artificial Sequence
  Description of Artificial Sequence: Synthetic oligonucleotide
cagcctctgatgtcagctcttgggtcc

SEQ ID NO: 150167 - DNA, 28 bp, Artificial Sequence
  Description of Artificial Sequence: Synthetic oligonucleotide
agcctctgatgtcagctcttgggtccac

SEQ ID NO: 150168 - DNA, 27 bp, Artificial Sequence
  Description of Artificial Sequence: Synthetic oligonucleotide
gcctctgatgtcagctcttgggtccac

SEQ ID NO: 150169 - DNA, 28 bp, Artificial Sequence
  Description of Artificial Sequence: Synthetic oligonucleotide
cctctgatgtcagctcttgggtccactg

SEQ ID NO: 150170 - DNA, 28 bp, Artificial Sequence
  Description of Artificial Sequence: Synthetic oligonucleotide
ctctgatgtcagctcttgggtccactgg

SEQ ID NO: 150171 - DNA, 28 bp, Artificial Sequence
  Description of Artificial Sequence: Synthetic oligonucleotide
tctgatgtcagctcttgggtccactggc

SEQ ID NO: 150172 - DNA, 27 bp, Artificial Sequence
  Description of Artificial Sequence: Synthetic oligonucleotide
ctgatgtcagctcttgggtccactggc

SEQ ID NO: 150173 - DNA, 28 bp, Artificial Sequence
  Description of Artificial Sequence: Synthetic oligonucleotide
tgatgtcagctcttgggtccactggctc

SEQ ID NO: 150174 - DNA, 27 bp, Artificial Sequence
  Description of Artificial Sequence: Synthetic oligonucleotide
gatgtcagctcttgggtccactggctc

SEQ ID NO: 150175 - DNA, 27 bp, Artificial Sequence
  Description of Artificial Sequence: Synthetic oligonucleotide
atgtcagctcttgggtccactggctcc

SEQ ID NO: 150176 - DNA, 27 bp, Artificial Sequence
  Description of Artificial Sequence: Synthetic oligonucleotide
tgtcagctcttgggtccactggctcca

SEQ ID NO: 150177 - DNA, 26 bp, Artificial Sequence
  Description of Artificial Sequence: Synthetic oligonucleotide
gtcagctcttgggtccactggctcca

SEQ ID NO: 150178 - DNA, 27 bp, Artificial Sequence
  Description of Artificial Sequence: Synthetic oligonucleotide
tcagctcttgggtccactggctccact

SEQ ID NO: 150179 - DNA, 26 bp, Artificial Sequence
  Description of Artificial Sequence: Synthetic oligonucleotide
cagctcttgggtccactggctccact

SEQ ID NO: 150180 - DNA, 27 bp, Artificial Sequence
  Description of Artificial Sequence: Synthetic oligonucleotide
agctcttgggtccactggctccactga

SEQ ID NO: 150181 - DNA, 26 bp, Artificial Sequence
  Description of Artificial Sequence: Synthetic oligonucleotide
gctcttgggtccactggctccactga

SEQ ID NO: 150182 - DNA, 26 bp, Artificial Sequence
  Description of Artificial Sequence: Synthetic oligonucleotide
ctcttgggtccactggctccactgag

SEQ ID NO: 150183 - DNA, 31 bp, Artificial Sequence
  Description of Artificial Sequence: Synthetic oligonucleotide
tcccaaaacctggagactgaggaatggacag

SEQ ID NO: 150184 - DNA, 30 bp, Artificial Sequence
  Description of Artificial Sequence: Synthetic oligonucleotide
cccaaaacctggagactgaggaatggacag

SEQ ID NO: 150185 - DNA, 31 bp, Artificial Sequence
  Description of Artificial Sequence: Synthetic oligonucleotide
ccaaaacctggagactgaggaatggacagtg

SEQ ID NO: 150186 - DNA, 31 bp, Artificial Sequence
  Description of Artificial Sequence: Synthetic oligonucleotide
caaaacctggagactgaggaatggacagtgc

SEQ ID NO: 150187 - DNA, 31 bp, Artificial Sequence
  Description of Artificial Sequence: Synthetic oligonucleotide
aaaacctggagactgaggaatggacagtgcc

SEQ ID NO: 150188 - DNA, 30 bp, Artificial Sequence
  Description of Artificial Sequence: Synthetic oligonucleotide
aaacctggagactgaggaatggacagtgcc

SEQ ID NO: 150189 - DNA, 29 bp, Artificial Sequence
  Description of Artificial Sequence: Synthetic oligonucleotide
aacctggagactgaggaatggacagtgcc

SEQ ID NO: 150190 - DNA, 28 bp, Artificial Sequence
  Description of Artificial Sequence: Synthetic oligonucleotide
acctggagactgaggaatggacagtgcc

SEQ ID NO: 150191 - DNA, 27 bp, Artificial Sequence
  Description of Artificial Sequence: Synthetic oligonucleotide
cctggagactgaggaatggacagtgcc

SEQ ID NO: 150192 - DNA, 27 bp, Artificial Sequence
  Description of Artificial Sequence: Synthetic oligonucleotide
ctggagactgaggaatggacagtgccc

SEQ ID NO: 150193 - DNA, 29 bp, Artificial Sequence
  Description of Artificial Sequence: Synthetic oligonucleotide
gcaacattaccgtgacatgcagggcttcc

SEQ ID NO: 150194 - DNA, 30 bp, Artificial Sequence
  Description of Artificial Sequence: Synthetic oligonucleotide
caacattaccgtgacatgcagggcttccag

SEQ ID NO: 150195 - DNA, 30 bp, Artificial Sequence
  Description of Artificial Sequence: Synthetic oligonucleotide
aacattaccgtgacatgcagggcttccagc

SEQ ID NO: 150196 - DNA, 29 bp, Artificial Sequence
  Description of Artificial Sequence: Synthetic oligonucleotide
acattaccgtgacatgcagggcttccagc

SEQ ID NO: 150197 - DNA, 28 bp, Artificial Sequence
  Description of Artificial Sequence: Synthetic oligonucleotide
cattaccgtgacatgcagggcttccagc

SEQ ID NO: 150198 - DNA, 30 bp, Artificial Sequence
  Description of Artificial Sequence: Synthetic oligonucleotide
attaccgtgacatgcagggcttccagcttc

SEQ ID NO: 150199 - DNA, 29 bp, Artificial Sequence
  Description of Artificial Sequence: Synthetic oligonucleotide
ttaccgtgacatgcagggcttccagcttc

SEQ ID NO: 150200 - DNA, 28 bp, Artificial Sequence
  Description of Artificial Sequence: Synthetic oligonucleotide
taccgtgacatgcagggcttccagcttc

SEQ ID NO: 150201 - DNA, 25 bp, Artificial Sequence
  Description of Artificial Sequence: Synthetic oligonucleotide
acctgggtggccaccaggatttgcc

SEQ ID NO: 150202 - DNA, 24 bp, Artificial Sequence
  Description of Artificial Sequence: Synthetic oligonucleotide
cctgggtggccaccaggatttgcc

SEQ ID NO: 150203 - DNA, 25 bp, Artificial Sequence
  Description of Artificial Sequence: Synthetic oligonucleotide
ctgggtggccaccaggatttgccga

SEQ ID NO: 150204 - DNA, 25 bp, Artificial Sequence
  Description of Artificial Sequence: Synthetic oligonucleotide
tgggtggccaccaggatttgccgag

SEQ ID NO: 150205 - DNA, 24 bp, Artificial Sequence
  Description of Artificial Sequence: Synthetic oligonucleotide
gggtggccaccaggatttgccgag

SEQ ID NO: 150206 - DNA, 25 bp, Artificial Sequence
  Description of Artificial Sequence: Synthetic oligonucleotide
ggtggccaccaggatttgccgagga

SEQ ID NO: 150207 - DNA, 26 bp, Artificial Sequence
  Description of Artificial Sequence: Synthetic oligonucleotide
gtggccaccaggatttgccgaggaga

SEQ ID NO: 150208 - DNA, 26 bp, Artificial Sequence
  Description of Artificial Sequence: Synthetic oligonucleotide
tggccaccaggatttgccgaggagag

SEQ ID NO: 150209 - DNA, 25 bp, Artificial Sequence
  Description of Artificial Sequence: Synthetic oligonucleotide
ggccaccaggatttgccgaggagag

SEQ ID NO: 150210 - DNA, 26 bp, Artificial Sequence
  Description of Artificial Sequence: Synthetic oligonucleotide
gccaccaggatttgccgaggagagga

SEQ ID NO: 150211 - DNA, 26 bp, Artificial Sequence
  Description of Artificial Sequence: Synthetic oligonucleotide
ccaccaggatttgccgaggagaggag

SEQ ID NO: 150212 - DNA, 27 bp, Artificial Sequence
  Description of Artificial Sequence: Synthetic oligonucleotide
caccaggatttgccgaggagaggagca

SEQ ID NO: 150213 - DNA, 27 bp, Artificial Sequence
  Description of Artificial Sequence: Synthetic oligonucleotide
accaggatttgccgaggagaggagcag

SEQ ID NO: 150214 - DNA, 27 bp, Artificial Sequence
  Description of Artificial Sequence: Synthetic oligonucleotide
ccaggatttgccgaggagaggagcaga

SEQ ID NO: 150215 - DNA, 27 bp, Artificial Sequence
  Description of Artificial Sequence: Synthetic oligonucleotide
caggatttgccgaggagaggagcagag

SEQ ID NO: 150216 - DNA, 27 bp, Artificial Sequence
  Description of Artificial Sequence: Synthetic oligonucleotide
aggatttgccgaggagaggagcagagg

SEQ ID NO: 150217 - DNA, 27 bp, Artificial Sequence
  Description of Artificial Sequence: Synthetic oligonucleotide
ggatttgccgaggagaggagcagaggt

SEQ ID NO: 150218 - DNA, 28 bp, Artificial Sequence
  Description of Artificial Sequence: Synthetic oligonucleotide
gatttgccgaggagaggagcagaggttc

SEQ ID NO: 150219 - DNA, 29 bp, Artificial Sequence
  Description of Artificial Sequence: Synthetic oligonucleotide
atttgccgaggagaggagcagaggttcac

SEQ ID NO: 150220 - DNA, 28 bp, Artificial Sequence
  Description of Artificial Sequence: Synthetic oligonucleotide
tttgccgaggagaggagcagaggttcac

SEQ ID NO: 150221 - DNA, 27 bp, Artificial Sequence
  Description of Artificial Sequence: Synthetic oligonucleotide
ttgccgaggagaggagcagaggttcac

SEQ ID NO: 150222 - DNA, 26 bp, Artificial Sequence
  Description of Artificial Sequence: Synthetic oligonucleotide
tgccgaggagaggagcagaggttcac

SEQ ID NO: 150223 - DNA, 25 bp, Artificial Sequence
  Description of Artificial Sequence: Synthetic oligonucleotide
gccgaggagaggagcagaggttcac

SEQ ID NO: 150224 - DNA, 26 bp, Artificial Sequence
  Description of Artificial Sequence: Synthetic oligonucleotide
ccgaggagaggagcagaggttcacct

SEQ ID NO: 150225 - DNA, 26 bp, Artificial Sequence
  Description of Artificial Sequence: Synthetic oligonucleotide
cgaggagaggagcagaggttcacctg

SEQ ID NO: 150226 - DNA, 27 bp, Artificial Sequence
  Description of Artificial Sequence: Synthetic oligonucleotide
gaggagaggagcagaggttcacctgct

SEQ ID NO: 150227 - DNA, 34 bp, Artificial Sequence
  Description of Artificial Sequence: Synthetic oligonucleotide
caggaactacggcgatatctagaatccagcatag

SEQ ID NO: 150228 - DNA, 35 bp, Artificial Sequence
  Description of Artificial Sequence: Synthetic oligonucleotide
aggaactacggcgatatctagaatccagcatagtc

SEQ ID NO: 150229 - DNA, 34 bp, Artificial Sequence
  Description of Artificial Sequence: Synthetic oligonucleotide
ggaactacggcgatatctagaatccagcatagtc

SEQ ID NO: 150230 - DNA, 34 bp, Artificial Sequence
  Description of Artificial Sequence: Synthetic oligonucleotide
gaactacggcgatatctagaatccagcatagtcc

SEQ ID NO: 150231 - DNA, 35 bp, Artificial Sequence
  Description of Artificial Sequence: Synthetic oligonucleotide
aactacggcgatatctagaatccagcatagtcctg

SEQ ID NO: 150232 - DNA, 34 bp, Artificial Sequence
  Description of Artificial Sequence: Synthetic oligonucleotide
actacggcgatatctagaatccagcatagtcctg

SEQ ID NO: 150233 - DNA, 33 bp, Artificial Sequence
  Description of Artificial Sequence: Synthetic oligonucleotide
ctacggcgatatctagaatccagcatagtcctg

SEQ ID NO: 150234 - DNA, 34 bp, Artificial Sequence
  Description of Artificial Sequence: Synthetic oligonucleotide
tacggcgatatctagaatccagcatagtcctgag

SEQ ID NO: 150235 - DNA, 33 bp, Artificial Sequence
  Description of Artificial Sequence: Synthetic oligonucleotide
acggcgatatctagaatccagcatagtcctgag

SEQ ID NO: 150236 - DNA, 32 bp, Artificial Sequence
  Description of Artificial Sequence: Synthetic oligonucleotide
cggcgatatctagaatccagcatagtcctgag

SEQ ID NO: 150237 - DNA, 32 bp, Artificial Sequence
  Description of Artificial Sequence: Synthetic oligonucleotide
ggcgatatctagaatccagcatagtcctgagg

SEQ ID NO: 150238 - DNA, 33 bp, Artificial Sequence
  Description of Artificial Sequence: Synthetic oligonucleotide
gcgatatctagaatccagcatagtcctgaggag

SEQ ID NO: 150239 - DNA, 35 bp, Artificial Sequence
  Description of Artificial Sequence: Synthetic oligonucleotide
cgatatctagaatccagcatagtcctgaggagaac

SEQ ID NO: 150240 - DNA, 36 bp, Artificial Sequence
  Description of Artificial Sequence: Synthetic oligonucleotide
gatatctagaatccagcatagtcctgaggagaacag

SEQ ID NO: 150241 - DNA, 37 bp, Artificial Sequence
  Description of Artificial Sequence: Synthetic oligonucleotide
atatctagaatccagcatagtcctgaggagaacagtg

SEQ ID NO: 150242 - DNA, 36 bp, Artificial Sequence
  Description of Artificial Sequence: Synthetic oligonucleotide
tatctagaatccagcatagtcctgaggagaacagtg

SEQ ID NO: 150243 - DNA, 35 bp, Artificial Sequence
  Description of Artificial Sequence: Synthetic oligonucleotide
atctagaatccagcatagtcctgaggagaacagtg

SEQ ID NO: 150244 - DNA, 34 bp, Artificial Sequence
  Description of Artificial Sequence: Synthetic oligonucleotide
tctagaatccagcatagtcctgaggagaacagtg

SEQ ID NO: 150245 - DNA, 33 bp, Artificial Sequence
  Description of Artificial Sequence: Synthetic oligonucleotide
ctagaatccagcatagtcctgaggagaacagtg

SEQ ID NO: 150246 - DNA, 33 bp, Artificial Sequence
  Description of Artificial Sequence: Synthetic oligonucleotide
tagaatccagcatagtcctgaggagaacagtgc

SEQ ID NO: 150247 - DNA, 32 bp, Artificial Sequence
  Description of Artificial Sequence: Synthetic oligonucleotide
agaatccagcatagtcctgaggagaacagtgc

SEQ ID NO: 150248 - DNA, 31 bp, Artificial Sequence
  Description of Artificial Sequence: Synthetic oligonucleotide
gaatccagcatagtcctgaggagaacagtgc

SEQ ID NO: 150249 - DNA, 31 bp, Artificial Sequence
  Description of Artificial Sequence: Synthetic oligonucleotide
aatccagcatagtcctgaggagaacagtgcc

SEQ ID NO: 150250 - DNA, 30 bp, Artificial Sequence
  Description of Artificial Sequence: Synthetic oligonucleotide
atccagcatagtcctgaggagaacagtgcc

SEQ ID NO: 150251 - DNA, 29 bp, Artificial Sequence
  Description of Artificial Sequence: Synthetic oligonucleotide
tccagcatagtcctgaggagaacagtgcc

SEQ ID NO: 150252 - DNA, 28 bp, Artificial Sequence
  Description of Artificial Sequence: Synthetic oligonucleotide
ccagcatagtcctgaggagaacagtgcc

SEQ ID NO: 150253 - DNA, 28 bp, Artificial Sequence
  Description of Artificial Sequence: Synthetic oligonucleotide
cagcatagtcctgaggagaacagtgccc

SEQ ID NO: 150254 - DNA, 28 bp, Artificial Sequence
  Description of Artificial Sequence: Synthetic oligonucleotide
agcatagtcctgaggagaacagtgcccc

SEQ ID NO: 150255 - DNA, 27 bp, Artificial Sequence
  Description of Artificial Sequence: Synthetic oligonucleotide
gcatagtcctgaggagaacagtgcccc

SEQ ID NO: 150256 - DNA, 27 bp, Artificial Sequence
  Description of Artificial Sequence: Synthetic oligonucleotide
catagtcctgaggagaacagtgccccc

SEQ ID NO: 150257 - DNA, 27 bp, Artificial Sequence
  Description of Artificial Sequence: Synthetic oligonucleotide
atagtcctgaggagaacagtgcccccc

SEQ ID NO: 150258 - DNA, 31 bp, Artificial Sequence
  Description of Artificial Sequence: Synthetic oligonucleotide
agcaccaggagctcccagcatttctactatg

SEQ ID NO: 150259 - DNA, 30 bp, Artificial Sequence
  Description of Artificial Sequence: Synthetic oligonucleotide
gcaccaggagctcccagcatttctactatg

SEQ ID NO: 150260 - DNA, 32 bp, Artificial Sequence
  Description of Artificial Sequence: Synthetic oligonucleotide
caccaggagctcccagcatttctactatgatg

SEQ ID NO: 150261 - DNA, 32 bp, Artificial Sequence
  Description of Artificial Sequence: Synthetic oligonucleotide
accaggagctcccagcatttctactatgatgg

SEQ ID NO: 150262 - DNA, 31 bp, Artificial Sequence
  Description of Artificial Sequence: Synthetic oligonucleotide
ccaggagctcccagcatttctactatgatgg

SEQ ID NO: 150263 - DNA, 31 bp, Artificial Sequence
  Description of Artificial Sequence: Synthetic oligonucleotide
caggagctcccagcatttctactatgatggg

SEQ ID NO: 150264 - DNA, 31 bp, Artificial Sequence
  Description of Artificial Sequence: Synthetic oligonucleotide
aggagctcccagcatttctactatgatgggg

SEQ ID NO: 150265 - DNA, 30 bp, Artificial Sequence
  Description of Artificial Sequence: Synthetic oligonucleotide
ggagctcccagcatttctactatgatgggg

SEQ ID NO: 150266 - DNA, 31 bp, Artificial Sequence
  Description of Artificial Sequence: Synthetic oligonucleotide
gagctcccagcatttctactatgatggggag

SEQ ID NO: 150267 - DNA, 31 bp, Artificial Sequence
  Description of Artificial Sequence: Synthetic oligonucleotide
agctcccagcatttctactatgatggggagc

SEQ ID NO: 150268 - DNA, 30 bp, Artificial Sequence
  Description of Artificial Sequence: Synthetic oligonucleotide
gctcccagcatttctactatgatggggagc

SEQ ID NO: 150269 - DNA, 31 bp, Artificial Sequence
  Description of Artificial Sequence: Synthetic oligonucleotide
ctcccagcatttctactatgatggggagctc

SEQ ID NO: 150270 - DNA, 33 bp, Artificial Sequence
  Description of Artificial Sequence: Synthetic oligonucleotide
tcccagcatttctactatgatggggagctcttc

SEQ ID NO: 150271 - DNA, 32 bp, Artificial Sequence
  Description of Artificial Sequence: Synthetic oligonucleotide
cccagcatttctactatgatggggagctcttc

SEQ ID NO: 150272 - DNA, 32 bp, Artificial Sequence
  Description of Artificial Sequence: Synthetic oligonucleotide
ccagcatttctactatgatggggagctcttcc

SEQ ID NO: 150273 - DNA, 33 bp, Artificial Sequence
  Description of Artificial Sequence: Synthetic oligonucleotide
cagcatttctactatgatggggagctcttcctc

SEQ ID NO: 150274 - DNA, 34 bp, Artificial Sequence
  Description of Artificial Sequence: Synthetic oligonucleotide
agcatttctactatgatggggagctcttcctctc

SEQ ID NO: 150275 - DNA, 33 bp, Artificial Sequence
  Description of Artificial Sequence: Synthetic oligonucleotide
gcatttctactatgatggggagctcttcctctc

SEQ ID NO: 150276 - DNA, 33 bp, Artificial Sequence
  Description of Artificial Sequence: Synthetic oligonucleotide
catttctactatgatggggagctcttcctctcc

SEQ ID NO: 150277 - DNA, 33 bp, Artificial Sequence
  Description of Artificial Sequence: Synthetic oligonucleotide
atttctactatgatggggagctcttcctctccc

SEQ ID NO: 150278 - DNA, 32 bp, Artificial Sequence
  Description of Artificial Sequence: Synthetic oligonucleotide
tttctactatgatggggagctcttcctctccc

SEQ ID NO: 150279 - DNA, 31 bp, Artificial Sequence
  Description of Artificial Sequence: Synthetic oligonucleotide
ttctactatgatggggagctcttcctctccc

SEQ ID NO: 150280 - DNA, 30 bp, Artificial Sequence
  Description of Artificial Sequence: Synthetic oligonucleotide
tctactatgatggggagctcttcctctccc

SEQ ID NO: 150281 - DNA, 29 bp, Artificial Sequence
  Description of Artificial Sequence: Synthetic oligonucleotide
ctactatgatggggagctcttcctctccc

SEQ ID NO: 150282 - DNA, 33 bp, Artificial Sequence
  Description of Artificial Sequence: Synthetic oligonucleotide
tactatgatggggagctcttcctctcccaaaac

SEQ ID NO: 150283 - DNA, 32 bp, Artificial Sequence
  Description of Artificial Sequence: Synthetic oligonucleotide
actatgatggggagctcttcctctcccaaaac

SEQ ID NO: 150284 - DNA, 31 bp, Artificial Sequence
  Description of Artificial Sequence: Synthetic oligonucleotide
ctatgatggggagctcttcctctcccaaaac

SEQ ID NO: 150285 - DNA, 31 bp, Artificial Sequence
  Description of Artificial Sequence: Synthetic oligonucleotide
tatgatggggagctcttcctctcccaaaacc

SEQ ID NO: 150286 - DNA, 30 bp, Artificial Sequence
  Description of Artificial Sequence: Synthetic oligonucleotide
atgatggggagctcttcctctcccaaaacc

SEQ ID NO: 150287 - DNA, 29 bp, Artificial Sequence
  Description of Artificial Sequence: Synthetic oligonucleotide
tgatggggagctcttcctctcccaaaacc

SEQ ID NO: 150288 - DNA, 31 bp, Artificial Sequence
  Description of Artificial Sequence: Synthetic oligonucleotide
ctgcaggaactacggcgatatctagaatccg

SEQ ID NO: 150289 - DNA, 31 bp, Artificial Sequence
  Description of Artificial Sequence: Synthetic oligonucleotide
tgcaggaactacggcgatatctagaatccgg

SEQ ID NO: 150290 - DNA, 30 bp, Artificial Sequence
  Description of Artificial Sequence: Synthetic oligonucleotide
gcaggaactacggcgatatctagaatccgg

SEQ ID NO: 150291 - DNA, 30 bp, Artificial Sequence
  Description of Artificial Sequence: Synthetic oligonucleotide
caggaactacggcgatatctagaatccggc

SEQ ID NO: 150292 - DNA, 30 bp, Artificial Sequence
  Description of Artificial Sequence: Synthetic oligonucleotide
aggaactacggcgatatctagaatccggcg

SEQ ID NO: 150293 - DNA, 29 bp, Artificial Sequence
  Description of Artificial Sequence: Synthetic oligonucleotide
ggaactacggcgatatctagaatccggcg

SEQ ID NO: 150294 - DNA, 31 bp, Artificial Sequence
  Description of Artificial Sequence: Synthetic oligonucleotide
gaactacggcgatatctagaatccggcgtag

SEQ ID NO: 150295 - DNA, 32 bp, Artificial Sequence
  Description of Artificial Sequence: Synthetic oligonucleotide
aactacggcgatatctagaatccggcgtagtc

SEQ ID NO: 150296 - DNA, 31 bp, Artificial Sequence
  Description of Artificial Sequence: Synthetic oligonucleotide
actacggcgatatctagaatccggcgtagtc

SEQ ID NO: 150297 - DNA, 30 bp, Artificial Sequence
  Description of Artificial Sequence: Synthetic oligonucleotide
ctacggcgatatctagaatccggcgtagtc

SEQ ID NO: 150298 - DNA, 30 bp, Artificial Sequence
  Description of Artificial Sequence: Synthetic oligonucleotide
tacggcgatatctagaatccggcgtagtcc

SEQ ID NO: 150299 - DNA, 29 bp, Artificial Sequence
  Description of Artificial Sequence: Synthetic oligonucleotide
acggcgatatctagaatccggcgtagtcc

SEQ ID NO: 150300 - DNA, 28 bp, Artificial Sequence
  Description of Artificial Sequence: Synthetic oligonucleotide
cggcgatatctagaatccggcgtagtcc

SEQ ID NO: 150301 - DNA, 29 bp, Artificial Sequence
  Description of Artificial Sequence: Synthetic oligonucleotide
ggcgatatctagaatccggcgtagtcctg

SEQ ID NO: 150302 - DNA, 30 bp, Artificial Sequence
  Description of Artificial Sequence: Synthetic oligonucleotide
gcgatatctagaatccggcgtagtcctgag

SEQ ID NO: 150303 - DNA, 30 bp, Artificial Sequence
  Description of Artificial Sequence: Synthetic oligonucleotide
cgatatctagaatccggcgtagtcctgagg

SEQ ID NO: 150304 - DNA, 31 bp, Artificial Sequence
  Description of Artificial Sequence: Synthetic oligonucleotide
gatatctagaatccggcgtagtcctgaggag

SEQ ID NO: 150305 - DNA, 33 bp, Artificial Sequence
  Description of Artificial Sequence: Synthetic oligonucleotide
atatctagaatccggcgtagtcctgaggagaac

SEQ ID NO: 150306 - DNA, 32 bp, Artificial Sequence
  Description of Artificial Sequence: Synthetic oligonucleotide
tatctagaatccggcgtagtcctgaggagaac

SEQ ID NO: 150307 - DNA, 31 bp, Artificial Sequence
  Description of Artificial Sequence: Synthetic oligonucleotide
atctagaatccggcgtagtcctgaggagaac

SEQ ID NO: 150308 - DNA, 30 bp, Artificial Sequence
  Description of Artificial Sequence: Synthetic oligonucleotide
tctagaatccggcgtagtcctgaggagaac

SEQ ID NO: 150309 - DNA, 29 bp, Artificial Sequence
  Description of Artificial Sequence: Synthetic oligonucleotide
ctagaatccggcgtagtcctgaggagaac

SEQ ID NO: 150310 - DNA, 30 bp, Artificial Sequence
  Description of Artificial Sequence: Synthetic oligonucleotide
tagaatccggcgtagtcctgaggagaacag

SEQ ID NO: 150311 - DNA, 29 bp, Artificial Sequence
  Description of Artificial Sequence: Synthetic oligonucleotide
agaatccggcgtagtcctgaggagaacag

SEQ ID NO: 150312 - DNA, 28 bp, Artificial Sequence
  Description of Artificial Sequence: Synthetic oligonucleotide
gaatccggcgtagtcctgaggagaacag

SEQ ID NO: 150313 - DNA, 32 bp, Artificial Sequence
  Description of Artificial Sequence: Synthetic oligonucleotide
ggcttccagcttctatccccggaatatcatac

SEQ ID NO: 150314 - DNA, 33 bp, Artificial Sequence
  Description of Artificial Sequence: Synthetic oligonucleotide
gcttccagcttctatccccggaatatcatactg

SEQ ID NO: 150315 - DNA, 34 bp, Artificial Sequence
  Description of Artificial Sequence: Synthetic oligonucleotide
cttccagcttctatccccggaatatcatactgac

SEQ ID NO: 150316 - DNA, 34 bp, Artificial Sequence
  Description of Artificial Sequence: Synthetic oligonucleotide
ttccagcttctatccccggaatatcatactgacc

SEQ ID NO: 150317 - DNA, 33 bp, Artificial Sequence
  Description of Artificial Sequence: Synthetic oligonucleotide
tccagcttctatccccggaatatcatactgacc

SEQ ID NO: 150318 - DNA, 32 bp, Artificial Sequence
  Description of Artificial Sequence: Synthetic oligonucleotide
ccagcttctatccccggaatatcatactgacc

SEQ ID NO: 150319 - DNA, 33 bp, Artificial Sequence
  Description of Artificial Sequence: Synthetic oligonucleotide
cagcttctatccccggaatatcatactgacctg

SEQ ID NO: 150320 - DNA, 33 bp, Artificial Sequence
  Description of Artificial Sequence: Synthetic oligonucleotide
agcttctatccccggaatatcatactgacctgg

SEQ ID NO: 150321 - DNA, 32 bp, Artificial Sequence
  Description of Artificial Sequence: Synthetic oligonucleotide
gcttctatccccggaatatcatactgacctgg

SEQ ID NO: 150322 - DNA, 32 bp, Artificial Sequence
  Description of Artificial Sequence: Synthetic oligonucleotide
cttctatccccggaatatcatactgacctggc

SEQ ID NO: 150323 - DNA, 32 bp, Artificial Sequence
  Description of Artificial Sequence: Synthetic oligonucleotide
ttctatccccggaatatcatactgacctggcg

SEQ ID NO: 150324 - DNA, 31 bp, Artificial Sequence
  Description of Artificial Sequence: Synthetic oligonucleotide
tctatccccggaatatcatactgacctggcg

SEQ ID NO: 150325 - DNA, 30 bp, Artificial Sequence
  Description of Artificial Sequence: Synthetic oligonucleotide
ctatccccggaatatcatactgacctggcg

SEQ ID NO: 150326 - DNA, 31 bp, Artificial Sequence
  Description of Artificial Sequence: Synthetic oligonucleotide
tatccccggaatatcatactgacctggcgtc

SEQ ID NO: 150327 - DNA, 30 bp, Artificial Sequence
  Description of Artificial Sequence: Synthetic oligonucleotide
atccccggaatatcatactgacctggcgtc

SEQ ID NO: 150328 - DNA, 29 bp, Artificial Sequence
  Description of Artificial Sequence: Synthetic oligonucleotide
tccccggaatatcatactgacctggcgtc

SEQ ID NO: 150329 - DNA, 28 bp, Artificial Sequence
  Description of Artificial Sequence: Synthetic oligonucleotide
ccccggaatatcatactgacctggcgtc

SEQ ID NO: 150330 - DNA, 29 bp, Artificial Sequence
  Description of Artificial Sequence: Synthetic oligonucleotide
cccggaatatcatactgacctggcgtcag

SEQ ID NO: 150331 - DNA, 29 bp, Artificial Sequence
  Description of Artificial Sequence: Synthetic oligonucleotide
ccggaatatcatactgacctggcgtcagg

SEQ ID NO: 150332 - DNA, 31 bp, Artificial Sequence
  Description of Artificial Sequence: Synthetic oligonucleotide
cggaatatcatactgacctggcgtcaggatg

SEQ ID NO: 150333 - DNA, 31 bp, Artificial Sequence
  Description of Artificial Sequence: Synthetic oligonucleotide
ggaatatcatactgacctggcgtcaggatgg

SEQ ID NO: 150334 - DNA, 31 bp, Artificial Sequence
  Description of Artificial Sequence: Synthetic oligonucleotide
gaatatcatactgacctggcgtcaggatggg

SEQ ID NO: 150335 - DNA, 31 bp, Artificial Sequence
  Description of Artificial Sequence: Synthetic oligonucleotide
aatatcatactgacctggcgtcaggatgggg

SEQ ID NO: 150336 - DNA, 30 bp, Artificial Sequence
  Description of Artificial Sequence: Synthetic oligonucleotide
atatcatactgacctggcgtcaggatgggg

SEQ ID NO: 150337 - DNA, 29 bp, Artificial Sequence
  Description of Artificial Sequence: Synthetic oligonucleotide
tatcatactgacctggcgtcaggatgggg

SEQ ID NO: 150338 - DNA, 28 bp, Artificial Sequence
  Description of Artificial Sequence: Synthetic oligonucleotide
atcatactgacctggcgtcaggatgggg

SEQ ID NO: 150339 - DNA, 27 bp, Artificial Sequence
  Description of Artificial Sequence: Synthetic oligonucleotide
tcatactgacctggcgtcaggatgggg

SEQ ID NO: 150340 - DNA, 27 bp, Artificial Sequence
  Description of Artificial Sequence: Synthetic oligonucleotide
catactgacctggcgtcaggatggggt

SEQ ID NO: 150341 - DNA, 29 bp, Artificial Sequence
  Description of Artificial Sequence: Synthetic oligonucleotide
atactgacctggcgtcaggatggggtatc

SEQ ID NO: 150342 - DNA, 28 bp, Artificial Sequence
  Description of Artificial Sequence: Synthetic oligonucleotide
tactgacctggcgtcaggatggggtatc

SEQ ID NO: 150343 - DNA, 32 bp, Artificial Sequence
  Description of Artificial Sequence: Synthetic oligonucleotide
cagacattccatgtttctgctgttgctgctgg

SEQ ID NO: 150344 - DNA, 32 bp, Artificial Sequence
  Description of Artificial Sequence: Synthetic oligonucleotide
agacattccatgtttctgctgttgctgctggc

SEQ ID NO: 150345 - DNA, 31 bp, Artificial Sequence
  Description of Artificial Sequence: Synthetic oligonucleotide
gacattccatgtttctgctgttgctgctggc

SEQ ID NO: 150346 - DNA, 32 bp, Artificial Sequence
  Description of Artificial Sequence: Synthetic oligonucleotide
acattccatgtttctgctgttgctgctggctg

SEQ ID NO: 150347 - DNA, 31 bp, Artificial Sequence
  Description of Artificial Sequence: Synthetic oligonucleotide
cattccatgtttctgctgttgctgctggctg

SEQ ID NO: 150348 - DNA, 31 bp, Artificial Sequence
  Description of Artificial Sequence: Synthetic oligonucleotide
attccatgtttctgctgttgctgctggctgc

SEQ ID NO: 150349 - DNA, 30 bp, Artificial Sequence
  Description of Artificial Sequence: Synthetic oligonucleotide
ttccatgtttctgctgttgctgctggctgc

SEQ ID NO: 150350 - DNA, 29 bp, Artificial Sequence
  Description of Artificial Sequence: Synthetic oligonucleotide
tccatgtttctgctgttgctgctggctgc

SEQ ID NO: 150351 - DNA, 28 bp, Artificial Sequence
  Description of Artificial Sequence: Synthetic oligonucleotide
ccatgtttctgctgttgctgctggctgc

SEQ ID NO: 150352 - DNA, 29 bp, Artificial Sequence
  Description of Artificial Sequence: Synthetic oligonucleotide
catgtttctgctgttgctgctggctgctg

SEQ ID NO: 150353 - DNA, 29 bp, Artificial Sequence
  Description of Artificial Sequence: Synthetic oligonucleotide
atgtttctgctgttgctgctggctgctgc

SEQ ID NO: 150354 - DNA, 28 bp, Artificial Sequence
  Description of Artificial Sequence: Synthetic oligonucleotide
tgtttctgctgttgctgctggctgctgc

SEQ ID NO: 150355 - DNA, 27 bp, Artificial Sequence
  Description of Artificial Sequence: Synthetic oligonucleotide
gtttctgctgttgctgctggctgctgc

SEQ ID NO: 150356 - DNA, 34 bp, Artificial Sequence
  Description of Artificial Sequence: Synthetic oligonucleotide
tttctgctgttgctgctggctgctgctatttttg

SEQ ID NO: 150357 - DNA, 33 bp, Artificial Sequence
  Description of Artificial Sequence: Synthetic oligonucleotide
ttctgctgttgctgctggctgctgctatttttg

SEQ ID NO: 150358 - DNA, 32 bp, Artificial Sequence
  Description of Artificial Sequence: Synthetic oligonucleotide
tctgctgttgctgctggctgctgctatttttg

SEQ ID NO: 150359 - DNA, 31 bp, Artificial Sequence
  Description of Artificial Sequence: Synthetic oligonucleotide
ctgctgttgctgctggctgctgctatttttg

SEQ ID NO: 150360 - DNA, 44 bp, Artificial Sequence
  Description of Artificial Sequence: Synthetic oligonucleotide
tgctgttgctgctggctgctgctatttttgttattattattttc

SEQ ID NO: 150361 - DNA, 43 bp, Artificial Sequence
  Description of Artificial Sequence: Synthetic oligonucleotide
gctgttgctgctggctgctgctatttttgttattattattttc

SEQ ID NO: 150362 - DNA, 46 bp, Artificial Sequence
  Description of Artificial Sequence: Synthetic oligonucleotide
ctgttgctgctggctgctgctatttttgttattattattttctatg

SEQ ID NO: 150363 - DNA, 47 bp, Artificial Sequence
  Description of Artificial Sequence: Synthetic oligonucleotide
tgttgctgctggctgctgctatttttgttattattattttctatgtc

SEQ ID NO: 150364 - DNA, 46 bp, Artificial Sequence
  Description of Artificial Sequence: Synthetic oligonucleotide
gttgctgctggctgctgctatttttgttattattattttctatgtc

SEQ ID NO: 150365 - DNA, 46 bp, Artificial Sequence
  Description of Artificial Sequence: Synthetic oligonucleotide
ttgctgctggctgctgctatttttgttattattattttctatgtcc

SEQ ID NO: 150366 - DNA, 45 bp, Artificial Sequence
  Description of Artificial Sequence: Synthetic oligonucleotide
tgctgctggctgctgctatttttgttattattattttctatgtcc

SEQ ID NO: 150367 - DNA, 44 bp, Artificial Sequence
  Description of Artificial Sequence: Synthetic oligonucleotide
gctgctggctgctgctatttttgttattattattttctatgtcc

SEQ ID NO: 150368 - DNA, 44 bp, Artificial Sequence
  Description of Artificial Sequence: Synthetic oligonucleotide
ctgctggctgctgctatttttgttattattattttctatgtccg

SEQ ID NO: 150369 - DNA, 46 bp, Artificial Sequence
  Description of Artificial Sequence: Synthetic oligonucleotide
tgctggctgctgctatttttgttattattattttctatgtccgttg

SEQ ID NO: 150370 - DNA, 45 bp, Artificial Sequence
  Description of Artificial Sequence: Synthetic oligonucleotide
gctggctgctgctatttttgttattattattttctatgtccgttg

SEQ ID NO: 150371 - DNA, 47 bp, Artificial Sequence
  Description of Artificial Sequence: Synthetic oligonucleotide
ctggctgctgctatttttgttattattattttctatgtccgttgttg

SEQ ID NO: 150372 - DNA, 50 bp, Artificial Sequence
  Description of Artificial Sequence: Synthetic oligonucleotide
tggctgctgctatttttgttattattattttctatgtccgttgttgtaag

SEQ ID NO: 150373 - DNA, 49 bp, Artificial Sequence
  Description of Artificial Sequence: Synthetic oligonucleotide
ggctgctgctatttttgttattattattttctatgtccgttgttgtaag

SEQ ID NO: 150374 - DNA, 24 bp, Artificial Sequence
  Description of Artificial Sequence: Synthetic oligonucleotide
ggtccactggctccactgagggca

SEQ ID NO: 150375 - DNA, 24 bp, Artificial Sequence
  Description of Artificial Sequence: Synthetic oligonucleotide
gtccactggctccactgagggcac

SEQ ID NO: 150376 - DNA, 26 bp, Artificial Sequence
  Description of Artificial Sequence: Synthetic oligonucleotide
tccactggctccactgagggcaccta

SEQ ID NO: 150377 - DNA, 25 bp, Artificial Sequence
  Description of Artificial Sequence: Synthetic oligonucleotide
ccactggctccactgagggcaccta

SEQ ID NO: 150378 - DNA, 25 bp, Artificial Sequence
  Description of Artificial Sequence: Synthetic oligonucleotide
cactggctccactgagggcacctag

SEQ ID NO: 150379 - DNA, 27 bp, Artificial Sequence
  Description of Artificial Sequence: Synthetic oligonucleotide
gaacctaccagacctgggtggccacta

SEQ ID NO: 150380 - DNA, 27 bp, Artificial Sequence
  Description of Artificial Sequence: Synthetic oligonucleotide
aacctaccagacctgggtggccactag

SEQ ID NO: 150381 - DNA, 26 bp, Artificial Sequence
  Description of Artificial Sequence: Synthetic oligonucleotide
acctaccagacctgggtggccactag

SEQ ID NO: 150382 - DNA, 25 bp, Artificial Sequence
  Description of Artificial Sequence: Synthetic oligonucleotide
cctaccagacctgggtggccactag

SEQ ID NO: 150383 - DNA, 27 bp, Artificial Sequence
  Description of Artificial Sequence: Synthetic oligonucleotide
ctaccagacctgggtggccactaggat

SEQ ID NO: 150384 - DNA, 29 bp, Artificial Sequence
  Description of Artificial Sequence: Synthetic oligonucleotide
taccagacctgggtggccactaggatttg

SEQ ID NO: 150385 - DNA, 28 bp, Artificial Sequence
  Description of Artificial Sequence: Synthetic oligonucleotide
accagacctgggtggccactaggatttg

SEQ ID NO: 150386 - DNA, 27 bp, Artificial Sequence
  Description of Artificial Sequence: Synthetic oligonucleotide
ccagacctgggtggccactaggatttg

SEQ ID NO: 150387 - DNA, 27 bp, Artificial Sequence
  Description of Artificial Sequence: Synthetic oligonucleotide
cagacctgggtggccactaggatttgc

SEQ ID NO: 150388 - DNA, 27 bp, Artificial Sequence
  Description of Artificial Sequence: Synthetic oligonucleotide
agacctgggtggccactaggatttgcc

SEQ ID NO: 150389 - DNA, 26 bp, Artificial Sequence
  Description of Artificial Sequence: Synthetic oligonucleotide
gacctgggtggccactaggatttgcc

SEQ ID NO: 150390 - DNA, 27 bp, Artificial Sequence
  Description of Artificial Sequence: Synthetic oligonucleotide
acctgggtggccactaggatttgccga

SEQ ID NO: 150391 - DNA, 26 bp, Artificial Sequence
  Description of Artificial Sequence: Synthetic oligonucleotide
cctgggtggccactaggatttgccga

SEQ ID NO: 150392 - DNA, 26 bp, Artificial Sequence
  Description of Artificial Sequence: Synthetic oligonucleotide
ctgggtggccactaggatttgccgag

SEQ ID NO: 150393 - DNA, 27 bp, Artificial Sequence
  Description of Artificial Sequence: Synthetic oligonucleotide
tgggtggccactaggatttgccgagga

SEQ ID NO: 150394 - DNA, 26 bp, Artificial Sequence
  Description of Artificial Sequence: Synthetic oligonucleotide
gggtggccactaggatttgccgagga

SEQ ID NO: 150395 - DNA, 27 bp, Artificial Sequence
  Description of Artificial Sequence: Synthetic oligonucleotide
ggtggccactaggatttgccgaggaga

SEQ ID NO: 150396 - DNA, 27 bp, Artificial Sequence
  Description of Artificial Sequence: Synthetic oligonucleotide
gtggccactaggatttgccgaggagag

SEQ ID NO: 150397 - DNA, 27 bp, Artificial Sequence
  Description of Artificial Sequence: Synthetic oligonucleotide
tggccactaggatttgccgaggagagg

SEQ ID NO: 150398 - DNA, 27 bp, Artificial Sequence
  Description of Artificial Sequence: Synthetic oligonucleotide
ggccactaggatttgccgaggagagga

SEQ ID NO: 150399 - DNA, 27 bp, Artificial Sequence
  Description of Artificial Sequence: Synthetic oligonucleotide
gccactaggatttgccgaggagaggag

SEQ ID NO: 150400 - DNA, 27 bp, Artificial Sequence
  Description of Artificial Sequence: Synthetic oligonucleotide
ccactaggatttgccgaggagaggagc

SEQ ID NO: 150401 - DNA, 28 bp, Artificial Sequence
  Description of Artificial Sequence: Synthetic oligonucleotide
cactaggatttgccgaggagaggagcag

SEQ ID NO: 150402 - DNA, 29 bp, Artificial Sequence
  Description of Artificial Sequence: Synthetic oligonucleotide
actaggatttgccgaggagaggagcagag

SEQ ID NO: 150403 - DNA, 28 bp, Artificial Sequence
  Description of Artificial Sequence: Synthetic oligonucleotide
ctaggatttgccgaggagaggagcagag

SEQ ID NO: 150404 - DNA, 28 bp, Artificial Sequence
  Description of Artificial Sequence: Synthetic oligonucleotide
taggatttgccgaggagaggagcagagg

SEQ ID NO: 150405 - DNA, 27 bp, Artificial Sequence
  Description of Artificial Sequence: Synthetic oligonucleotide
atggtgaatgtcacccgcagcgaggca

SEQ ID NO: 150406 - DNA, 27 bp, Artificial Sequence
  Description of Artificial Sequence: Synthetic oligonucleotide
tggtgaatgtcacccgcagcgaggcat

SEQ ID NO: 150407 - DNA, 26 bp, Artificial Sequence
  Description of Artificial Sequence: Synthetic oligonucleotide
ggtgaatgtcacccgcagcgaggcat

SEQ ID NO: 150408 - DNA, 27 bp, Artificial Sequence
  Description of Artificial Sequence: Synthetic oligonucleotide
gtgaatgtcacccgcagcgaggcatca

SEQ ID NO: 150409 - DNA, 27 bp, Artificial Sequence
  Description of Artificial Sequence: Synthetic oligonucleotide
tgaatgtcacccgcagcgaggcatcag

SEQ ID NO: 150410 - DNA, 27 bp, Artificial Sequence
  Description of Artificial Sequence: Synthetic oligonucleotide
gaatgtcacccgcagcgaggcatcaga

SEQ ID NO: 150411 - DNA, 27 bp, Artificial Sequence
  Description of Artificial Sequence: Synthetic oligonucleotide
aatgtcacccgcagcgaggcatcagag

SEQ ID NO: 150412 - DNA, 26 bp, Artificial Sequence
  Description of Artificial Sequence: Synthetic oligonucleotide
atgtcacccgcagcgaggcatcagag

SEQ ID NO: 150413 - DNA, 25 bp, Artificial Sequence
  Description of Artificial Sequence: Synthetic oligonucleotide
tgtcacccgcagcgaggcatcagag

SEQ ID NO: 150414 - DNA, 24 bp, Artificial Sequence
  Description of Artificial Sequence: Synthetic oligonucleotide
gtcacccgcagcgaggcatcagag

SEQ ID NO: 150415 - DNA, 24 bp, Artificial Sequence
  Description of Artificial Sequence: Synthetic oligonucleotide
tcacccgcagcgaggcatcagagg

SEQ ID NO: 150416 - DNA, 23 bp, Artificial Sequence
  Description of Artificial Sequence: Synthetic oligonucleotide
cacccgcagcgaggcatcagagg

SEQ ID NO: 150417 - DNA, 23 bp, Artificial Sequence
  Description of Artificial Sequence: Synthetic oligonucleotide
acccgcagcgaggcatcagaggg

SEQ ID NO: 150418 - DNA, 22 bp, Artificial Sequence
  Description of Artificial Sequence: Synthetic oligonucleotide
cccgcagcgaggcatcagaggg

SEQ ID NO: 150419 - DNA, 24 bp, Artificial Sequence
  Description of Artificial Sequence: Synthetic oligonucleotide
ccgcagcgaggcatcagagggcaa

SEQ ID NO: 150420 - DNA, 26 bp, Artificial Sequence
  Description of Artificial Sequence: Synthetic oligonucleotide
cgcagcgaggcatcagagggcaacat

SEQ ID NO: 150421 - DNA, 27 bp, Artificial Sequence
  Description of Artificial Sequence: Synthetic oligonucleotide
gcagcgaggcatcagagggcaacatca

SEQ ID NO: 150422 - DNA, 27 bp, Artificial Sequence
  Description of Artificial Sequence: Synthetic oligonucleotide
cagcgaggcatcagagggcaacatcac

SEQ ID NO: 150423 - DNA, 27 bp, Artificial Sequence
  Description of Artificial Sequence: Synthetic oligonucleotide
agcgaggcatcagagggcaacatcacc

SEQ ID NO: 150424 - DNA, 26 bp, Artificial Sequence
  Description of Artificial Sequence: Synthetic oligonucleotide
gcgaggcatcagagggcaacatcacc

SEQ ID NO: 150425 - DNA, 27 bp, Artificial Sequence
  Description of Artificial Sequence: Synthetic oligonucleotide
cgaggcatcagagggcaacatcaccgt

SEQ ID NO: 150426 - DNA, 27 bp, Artificial Sequence
  Description of Artificial Sequence: Synthetic oligonucleotide
gaggcatcagagggcaacatcaccgtg

SEQ ID NO: 150427 - DNA, 28 bp, Artificial Sequence
  Description of Artificial Sequence: Synthetic oligonucleotide
aggcatcagagggcaacatcaccgtgac

SEQ ID NO: 150428 - DNA, 27 bp, Artificial Sequence
  Description of Artificial Sequence: Synthetic oligonucleotide
ggcatcagagggcaacatcaccgtgac

SEQ ID NO: 150429 - DNA, 29 bp, Artificial Sequence
  Description of Artificial Sequence: Synthetic oligonucleotide
gcatcagagggcaacatcaccgtgacatg

SEQ ID NO: 150430 - DNA, 29 bp, Artificial Sequence
  Description of Artificial Sequence: Synthetic oligonucleotide
catcagagggcaacatcaccgtgacatgc

SEQ ID NO: 150431 - DNA, 30 bp, Artificial Sequence
  Description of Artificial Sequence: Synthetic oligonucleotide
atcagagggcaacatcaccgtgacatgcag

SEQ ID NO: 150432 - DNA, 24 bp, Artificial Sequence
  Description of Artificial Sequence: Synthetic oligonucleotide
atggggctgggcccggtctttctg

SEQ ID NO: 150433 - DNA, 23 bp, Artificial Sequence
  Description of Artificial Sequence: Synthetic oligonucleotide
tggggctgggcccggtctttctg

SEQ ID NO: 150434 - DNA, 22 bp, Artificial Sequence
  Description of Artificial Sequence: Synthetic oligonucleotide
ggggctgggcccggtctttctg

SEQ ID NO: 150435 - DNA, 24 bp, Artificial Sequence
  Description of Artificial Sequence: Synthetic oligonucleotide
gggctgggcccggtctttctgctt

SEQ ID NO: 150436 - DNA, 25 bp, Artificial Sequence
  Description of Artificial Sequence: Synthetic oligonucleotide
ggctgggcccggtctttctgcttct

SEQ ID NO: 150437 - DNA, 25 bp, Artificial Sequence
  Description of Artificial Sequence: Synthetic oligonucleotide
gctgggcccggtctttctgcttctg

SEQ ID NO: 150438 - DNA, 25 bp, Artificial Sequence
  Description of Artificial Sequence: Synthetic oligonucleotide
ctgggcccggtctttctgcttctgg

SEQ ID NO: 150439 - DNA, 26 bp, Artificial Sequence
  Description of Artificial Sequence: Synthetic oligonucleotide
tgggcccggtctttctgcttctggct

SEQ ID NO: 150440 - DNA, 25 bp, Artificial Sequence
  Description of Artificial Sequence: Synthetic oligonucleotide
gggcccggtctttctgcttctggct

SEQ ID NO: 150441 - DNA, 25 bp, Artificial Sequence
  Description of Artificial Sequence: Synthetic oligonucleotide
ggcccggtctttctgcttctggctg

SEQ ID NO: 150442 - DNA, 25 bp, Artificial Sequence
  Description of Artificial Sequence: Synthetic oligonucleotide
gcccggtctttctgcttctggctgg

SEQ ID NO: 150443 - DNA, 27 bp, Artificial Sequence
  Description of Artificial Sequence: Synthetic oligonucleotide
cccggtctttctgcttctggctggcat

SEQ ID NO: 150444 - DNA, 27 bp, Artificial Sequence
  Description of Artificial Sequence: Synthetic oligonucleotide
ccggtctttctgcttctggctggcatc

SEQ ID NO: 150445 - DNA, 29 bp, Artificial Sequence
  Description of Artificial Sequence: Synthetic oligonucleotide
cggtctttctgcttctggctggcatcttc

SEQ ID NO: 150446 - DNA, 29 bp, Artificial Sequence
  Description of Artificial Sequence: Synthetic oligonucleotide
ggtctttctgcttctggctggcatcttcc

SEQ ID NO: 150447 - DNA, 29 bp, Artificial Sequence
  Description of Artificial Sequence: Synthetic oligonucleotide
gtctttctgcttctggctggcatcttccc

SEQ ID NO: 150448 - DNA, 33 bp, Artificial Sequence
  Description of Artificial Sequence: Synthetic oligonucleotide
tctttctgcttctggctggcatcttcccttttg

SEQ ID NO: 150449 - DNA, 32 bp, Artificial Sequence
  Description of Artificial Sequence: Synthetic oligonucleotide
ctttctgcttctggctggcatcttcccttttg

SEQ ID NO: 150450 - DNA, 32 bp, Artificial Sequence
  Description of Artificial Sequence: Synthetic oligonucleotide
tttctgcttctggctggcatcttcccttttgc

SEQ ID NO: 150451 - DNA, 31 bp, Artificial Sequence
  Description of Artificial Sequence: Synthetic oligonucleotide
ttctgcttctggctggcatcttcccttttgc

SEQ ID NO: 150452 - DNA, 30 bp, Artificial Sequence
  Description of Artificial Sequence: Synthetic oligonucleotide
tctgcttctggctggcatcttcccttttgc

SEQ ID NO: 150453 - DNA, 34 bp, Artificial Sequence
  Description of Artificial Sequence: Synthetic oligonucleotide
gatatctagaatccagcgtagtcctgaggagaac

SEQ ID NO: 150454 - DNA, 35 bp, Artificial Sequence
  Description of Artificial Sequence: Synthetic oligonucleotide
atatctagaatccagcgtagtcctgaggagaacag

SEQ ID NO: 150455 - DNA, 34 bp, Artificial Sequence
  Description of Artificial Sequence: Synthetic oligonucleotide
tatctagaatccagcgtagtcctgaggagaacag

SEQ ID NO: 150456 - DNA, 33 bp, Artificial Sequence
  Description of Artificial Sequence: Synthetic oligonucleotide
atctagaatccagcgtagtcctgaggagaacag

SEQ ID NO: 150457 - DNA, 32 bp, Artificial Sequence
  Description of Artificial Sequence: Synthetic oligonucleotide
tctagaatccagcgtagtcctgaggagaacag

SEQ ID NO: 150458 - DNA, 31 bp, Artificial Sequence
  Description of Artificial Sequence: Synthetic oligonucleotide
ctagaatccagcgtagtcctgaggagaacag

SEQ ID NO: 150459 - DNA, 32 bp, Artificial Sequence
  Description of Artificial Sequence: Synthetic oligonucleotide
tagaatccagcgtagtcctgaggagaacagtg

SEQ ID NO: 150460 - DNA, 31 bp, Artificial Sequence
  Description of Artificial Sequence: Synthetic oligonucleotide
agaatccagcgtagtcctgaggagaacagtg

SEQ ID NO: 150461 - DNA, 30 bp, Artificial Sequence
  Description of Artificial Sequence: Synthetic oligonucleotide
gaatccagcgtagtcctgaggagaacagtg

SEQ ID NO: 150462 - DNA, 30 bp, Artificial Sequence
  Description of Artificial Sequence: Synthetic oligonucleotide
aatccagcgtagtcctgaggagaacagtgc

SEQ ID NO: 150463 - DNA, 29 bp, Artificial Sequence
  Description of Artificial Sequence: Synthetic oligonucleotide
atccagcgtagtcctgaggagaacagtgc

SEQ ID NO: 150464 - DNA, 28 bp, Artificial Sequence
  Description of Artificial Sequence: Synthetic oligonucleotide
tccagcgtagtcctgaggagaacagtgc

SEQ ID NO: 150465 - DNA, 27 bp, Artificial Sequence
  Description of Artificial Sequence: Synthetic oligonucleotide
ccagcgtagtcctgaggagaacagtgc

SEQ ID NO: 150466 - DNA, 27 bp, Artificial Sequence
  Description of Artificial Sequence: Synthetic oligonucleotide
cagcgtagtcctgaggagaacagtgcc

SEQ ID NO: 150467 - DNA, 27 bp, Artificial Sequence
  Description of Artificial Sequence: Synthetic oligonucleotide
agcgtagtcctgaggagaacagtgccc

SEQ ID NO: 150468 - DNA, 31 bp, Artificial Sequence
  Description of Artificial Sequence: Synthetic oligonucleotide
tatgatggggagctcttcctctcccaaaacg

SEQ ID NO: 150469 - DNA, 30 bp, Artificial Sequence
  Description of Artificial Sequence: Synthetic oligonucleotide
atgatggggagctcttcctctcccaaaacg

SEQ ID NO: 150470 - DNA, 29 bp, Artificial Sequence
  Description of Artificial Sequence: Synthetic oligonucleotide
tgatggggagctcttcctctcccaaaacg

SEQ ID NO: 150471 - DNA, 30 bp, Artificial Sequence
  Description of Artificial Sequence: Synthetic oligonucleotide
agccccacagtcttccttataacctcacgg

SEQ ID NO: 150472 - DNA, 29 bp, Artificial Sequence
  Description of Artificial Sequence: Synthetic oligonucleotide
gccccacagtcttccttataacctcacgg

SEQ ID NO: 150473 - DNA, 30 bp, Artificial Sequence
  Description of Artificial Sequence: Synthetic oligonucleotide
ccccacagtcttccttataacctcacggtg

SEQ ID NO: 150474 - DNA, 30 bp, Artificial Sequence
  Description of Artificial Sequence: Synthetic oligonucleotide
cccacagtcttccttataacctcacggtgc

SEQ ID NO: 150475 - DNA, 31 bp, Artificial Sequence
  Description of Artificial Sequence: Synthetic oligonucleotide
ccacagtcttccttataacctcacggtgctg

SEQ ID NO: 150476 - DNA, 32 bp, Artificial Sequence
  Description of Artificial Sequence: Synthetic oligonucleotide
cacagtcttccttataacctcacggtgctgtc

SEQ ID NO: 150477 - DNA, 32 bp, Artificial Sequence
  Description of Artificial Sequence: Synthetic oligonucleotide
acagtcttccttataacctcacggtgctgtcc

SEQ ID NO: 150478 - DNA, 31 bp, Artificial Sequence
  Description of Artificial Sequence: Synthetic oligonucleotide
cagtcttccttataacctcacggtgctgtcc

SEQ ID NO: 150479 - DNA, 32 bp, Artificial Sequence
  Description of Artificial Sequence: Synthetic oligonucleotide
agtcttccttataacctcacggtgctgtcctg

SEQ ID NO: 150480 - DNA, 31 bp, Artificial Sequence
  Description of Artificial Sequence: Synthetic oligonucleotide
gtcttccttataacctcacggtgctgtcctg

SEQ ID NO: 150481 - DNA, 31 bp, Artificial Sequence
  Description of Artificial Sequence: Synthetic oligonucleotide
tcttccttataacctcacggtgctgtcctgg

SEQ ID NO: 150482 - DNA, 30 bp, Artificial Sequence
  Description of Artificial Sequence: Synthetic oligonucleotide
cttccttataacctcacggtgctgtcctgg

SEQ ID NO: 150483 - DNA, 30 bp, Artificial Sequence
  Description of Artificial Sequence: Synthetic oligonucleotide
ttccttataacctcacggtgctgtcctggg

SEQ ID NO: 150484 - DNA, 29 bp, Artificial Sequence
  Description of Artificial Sequence: Synthetic oligonucleotide
tccttataacctcacggtgctgtcctggg

SEQ ID NO: 150485 - DNA, 28 bp, Artificial Sequence
  Description of Artificial Sequence: Synthetic oligonucleotide
ccttataacctcacggtgctgtcctggg

SEQ ID NO: 150486 - DNA, 30 bp, Artificial Sequence
  Description of Artificial Sequence: Synthetic oligonucleotide
cttataacctcacggtgctgtcctgggatg

SEQ ID NO: 150487 - DNA, 36 bp, Artificial Sequence
  Description of Artificial Sequence: Synthetic oligonucleotide
atgtttctgctgttgctgctgctgctgctatttttg

SEQ ID NO: 150488 - DNA, 35 bp, Artificial Sequence
  Description of Artificial Sequence: Synthetic oligonucleotide
tgtttctgctgttgctgctgctgctgctatttttg

SEQ ID NO: 150489 - DNA, 34 bp, Artificial Sequence
  Description of Artificial Sequence: Synthetic oligonucleotide
gtttctgctgttgctgctgctgctgctatttttg

SEQ ID NO: 150490 - DNA, 47 bp, Artificial Sequence
  Description of Artificial Sequence: Synthetic oligonucleotide
tttctgctgttgctgctgctgctgctatttttgttattattattttc

SEQ ID NO: 150491 - DNA, 46 bp, Artificial Sequence
  Description of Artificial Sequence: Synthetic oligonucleotide
ttctgctgttgctgctgctgctgctatttttgttattattattttc

SEQ ID NO: 150492 - DNA, 45 bp, Artificial Sequence
  Description of Artificial Sequence: Synthetic oligonucleotide
tctgctgttgctgctgctgctgctatttttgttattattattttc

SEQ ID NO: 150493 - DNA, 44 bp, Artificial Sequence
  Description of Artificial Sequence: Synthetic oligonucleotide
ctgctgttgctgctgctgctgctatttttgttattattattttc

SEQ ID NO: 150494 - DNA, 47 bp, Artificial Sequence
  Description of Artificial Sequence: Synthetic oligonucleotide
tgctgttgctgctgctgctgctatttttgttattattattttctatg

SEQ ID NO: 150495 - DNA, 46 bp, Artificial Sequence
  Description of Artificial Sequence: Synthetic oligonucleotide
gctgttgctgctgctgctgctatttttgttattattattttctatg

SEQ ID NO: 150496 - DNA, 47 bp, Artificial Sequence
  Description of Artificial Sequence: Synthetic oligonucleotide
ctgttgctgctgctgctgctatttttgttattattattttctatgtc

SEQ ID NO: 150497 - DNA, 47 bp, Artificial Sequence
  Description of Artificial Sequence: Synthetic oligonucleotide
tgttgctgctgctgctgctatttttgttattattattttctatgtcc

SEQ ID NO: 150498 - DNA, 46 bp, Artificial Sequence
  Description of Artificial Sequence: Synthetic oligonucleotide
gttgctgctgctgctgctatttttgttattattattttctatgtcc

SEQ ID NO: 150499 - DNA, 46 bp, Artificial Sequence
  Description of Artificial Sequence: Synthetic oligonucleotide
ttgctgctgctgctgctatttttgttattattattttctatgtccg

SEQ ID NO: 150500 - DNA, 35 bp, Artificial Sequence
  Description of Artificial Sequence: Synthetic oligonucleotide
catgaacgtcaggaatttcttgaaggaagatgccg

SEQ ID NO: 150501 - DNA, 36 bp, Artificial Sequence
  Description of Artificial Sequence: Synthetic oligonucleotide
atgaacgtcaggaatttcttgaaggaagatgccgtg

SEQ ID NO: 150502 - DNA, 35 bp, Artificial Sequence
  Description of Artificial Sequence: Synthetic oligonucleotide
tgaacgtcaggaatttcttgaaggaagatgccgtg

SEQ ID NO: 150503 - DNA, 34 bp, Artificial Sequence
  Description of Artificial Sequence: Synthetic oligonucleotide
gaacgtcaggaatttcttgaaggaagatgccgtg

SEQ ID NO: 150504 - DNA, 36 bp, Artificial Sequence
  Description of Artificial Sequence: Synthetic oligonucleotide
aacgtcaggaatttcttgaaggaagatgccgtgaag

SEQ ID NO: 150505 - DNA, 35 bp, Artificial Sequence
  Description of Artificial Sequence: Synthetic oligonucleotide
acgtcaggaatttcttgaaggaagatgccgtgaag

SEQ ID NO: 150506 - DNA, 34 bp, Artificial Sequence
  Description of Artificial Sequence: Synthetic oligonucleotide
cgtcaggaatttcttgaaggaagatgccgtgaag

SEQ ID NO: 150507 - DNA, 35 bp, Artificial Sequence
  Description of Artificial Sequence: Synthetic oligonucleotide
gtcaggaatttcttgaaggaagatgccgtgaagac

SEQ ID NO: 150508 - DNA, 35 bp, Artificial Sequence
  Description of Artificial Sequence: Synthetic oligonucleotide
tcaggaatttcttgaaggaagatgccgtgaagacc

SEQ ID NO: 150509 - DNA, 34 bp, Artificial Sequence
  Description of Artificial Sequence: Synthetic oligonucleotide
caggaatttcttgaaggaagatgccgtgaagacc

SEQ ID NO: 150510 - DNA, 36 bp, Artificial Sequence
  Description of Artificial Sequence: Synthetic oligonucleotide
aggaatttcttgaaggaagatgccgtgaagaccaag

SEQ ID NO: 150511 - DNA, 35 bp, Artificial Sequence
  Description of Artificial Sequence: Synthetic oligonucleotide
ggaatttcttgaaggaagatgccgtgaagaccaag

SEQ ID NO: 150512 - DNA, 36 bp, Artificial Sequence
  Description of Artificial Sequence: Synthetic oligonucleotide
gaatttcttgaaggaagatgccgtgaagaccaagac

SEQ ID NO: 150513 - DNA, 37 bp, Artificial Sequence
  Description of Artificial Sequence: Synthetic oligonucleotide
aatttcttgaaggaagatgccgtgaagaccaagacac

SEQ ID NO: 150514 - DNA, 36 bp, Artificial Sequence
  Description of Artificial Sequence: Synthetic oligonucleotide
atttcttgaaggaagatgccgtgaagaccaagacac

SEQ ID NO: 150515 - DNA, 35 bp, Artificial Sequence
  Description of Artificial Sequence: Synthetic oligonucleotide
tttcttgaaggaagatgccgtgaagaccaagacac

SEQ ID NO: 150516 - DNA, 34 bp, Artificial Sequence
  Description of Artificial Sequence: Synthetic oligonucleotide
ttcttgaaggaagatgccgtgaagaccaagacac

SEQ ID NO: 150517 - DNA, 33 bp, Artificial Sequence
  Description of Artificial Sequence: Synthetic oligonucleotide
tcttgaaggaagatgccgtgaagaccaagacac

SEQ ID NO: 150518 - DNA, 32 bp, Artificial Sequence
  Description of Artificial Sequence: Synthetic oligonucleotide
cttgaaggaagatgccgtgaagaccaagacac

SEQ ID NO: 150519 - DNA, 33 bp, Artificial Sequence
  Description of Artificial Sequence: Synthetic oligonucleotide
ttgaaggaagatgccgtgaagaccaagacacac

SEQ ID NO: 150520 - DNA, 32 bp, Artificial Sequence
  Description of Artificial Sequence: Synthetic oligonucleotide
tgaaggaagatgccgtgaagaccaagacacac

SEQ ID NO: 150521 - DNA, 31 bp, Artificial Sequence
  Description of Artificial Sequence: Synthetic oligonucleotide
gaaggaagatgccgtgaagaccaagacacac

SEQ ID NO: 150522 - DNA, 34 bp, Artificial Sequence
  Description of Artificial Sequence: Synthetic oligonucleotide
aaggaagatgccgtgaagaccaagacacactatc

SEQ ID NO: 150523 - DNA, 33 bp, Artificial Sequence
  Description of Artificial Sequence: Synthetic oligonucleotide
aggaagatgccgtgaagaccaagacacactatc

SEQ ID NO: 150524 - DNA, 32 bp, Artificial Sequence
  Description of Artificial Sequence: Synthetic oligonucleotide
ggaagatgccgtgaagaccaagacacactatc

SEQ ID NO: 150525 - DNA, 33 bp, Artificial Sequence
  Description of Artificial Sequence: Synthetic oligonucleotide
gaagatgccgtgaagaccaagacacactatcac

SEQ ID NO: 150526 - DNA, 33 bp, Artificial Sequence
  Description of Artificial Sequence: Synthetic oligonucleotide
aagatgccgtgaagaccaagacacactatcacg

SEQ ID NO: 150527 - DNA, 32 bp, Artificial Sequence
  Description of Artificial Sequence: Synthetic oligonucleotide
agatgccgtgaagaccaagacacactatcacg

SEQ ID NO: 150528 - DNA, 31 bp, Artificial Sequence
  Description of Artificial Sequence: Synthetic oligonucleotide
gatgccgtgaagaccaagacacactatcacg

SEQ ID NO: 150529 - DNA, 31 bp, Artificial Sequence
  Description of Artificial Sequence: Synthetic oligonucleotide
atgccgtgaagaccaagacacactatcacgc

SEQ ID NO: 150530 - DNA, 30 bp, Artificial Sequence
  Description of Artificial Sequence: Synthetic oligonucleotide
tgccgtgaagaccaagacacactatcacgc

SEQ ID NO: 150531 - DNA, 29 bp, Artificial Sequence
  Description of Artificial Sequence: Synthetic oligonucleotide
gccgtgaagaccaagacacactatcacgc

SEQ ID NO: 150532 - DNA, 32 bp, Artificial Sequence
  Description of Artificial Sequence: Synthetic oligonucleotide
ccgtgaagaccaagacacactatcacgctatg

SEQ ID NO: 150533 - DNA, 32 bp, Artificial Sequence
  Description of Artificial Sequence: Synthetic oligonucleotide
cgtgaagaccaagacacactatcacgctatgc

SEQ ID NO: 150534 - DNA, 34 bp, Artificial Sequence
  Description of Artificial Sequence: Synthetic oligonucleotide
gtgaagaccaagacacactatcacgctatgcatg

SEQ ID NO: 150535 - DNA, 28 bp, Artificial Sequence
  Description of Artificial Sequence: Synthetic oligonucleotide
gaacacagcgggaatcacagcactcacg

SEQ ID NO: 150536 - DNA, 28 bp, Artificial Sequence
  Description of Artificial Sequence: Synthetic oligonucleotide
aacacagcgggaatcacagcactcacgc

SEQ ID NO: 150537 - DNA, 27 bp, Artificial Sequence
  Description of Artificial Sequence: Synthetic oligonucleotide
acacagcgggaatcacagcactcacgc

SEQ ID NO: 150538 - DNA, 27 bp, Artificial Sequence
  Description of Artificial Sequence: Synthetic oligonucleotide
cacagcgggaatcacagcactcacgct

SEQ ID NO: 150539 - DNA, 27 bp, Artificial Sequence
  Description of Artificial Sequence: Synthetic oligonucleotide
acagcgggaatcacagcactcacgctg

SEQ ID NO: 150540 - DNA, 27 bp, Artificial Sequence
  Description of Artificial Sequence: Synthetic oligonucleotide
cagcgggaatcacagcactcacgctgt

SEQ ID NO: 150541 - DNA, 27 bp, Artificial Sequence
  Description of Artificial Sequence: Synthetic oligonucleotide
agcgggaatcacagcactcacgctgtg

SEQ ID NO: 150542 - DNA, 26 bp, Artificial Sequence
  Description of Artificial Sequence: Synthetic oligonucleotide
gcgggaatcacagcactcacgctgtg

SEQ ID NO: 150543 - DNA, 26 bp, Artificial Sequence
  Description of Artificial Sequence: Synthetic oligonucleotide
cgggaatcacagcactcacgctgtgc

SEQ ID NO: 150544 - DNA, 26 bp, Artificial Sequence
  Description of Artificial Sequence: Synthetic oligonucleotide
gggaatcacagcactcacgctgtgcc

SEQ ID NO: 150545 - DNA, 27 bp, Artificial Sequence
  Description of Artificial Sequence: Synthetic oligonucleotide
ggaatcacagcactcacgctgtgccct

SEQ ID NO: 150546 - DNA, 27 bp, Artificial Sequence
  Description of Artificial Sequence: Synthetic oligonucleotide
gaatcacagcactcacgctgtgccctc

SEQ ID NO: 150547 - DNA, 28 bp, Artificial Sequence
  Description of Artificial Sequence: Synthetic oligonucleotide
aatcacagcactcacgctgtgccctctg

SEQ ID NO: 150548 - DNA, 27 bp, Artificial Sequence
  Description of Artificial Sequence: Synthetic oligonucleotide
atcacagcactcacgctgtgccctctg

SEQ ID NO: 150549 - DNA, 26 bp, Artificial Sequence
  Description of Artificial Sequence: Synthetic oligonucleotide
tcacagcactcacgctgtgccctctg

SEQ ID NO: 150550 - DNA, 25 bp, Artificial Sequence
  Description of Artificial Sequence: Synthetic oligonucleotide
cacagcactcacgctgtgccctctg

SEQ ID NO: 150551 - DNA, 25 bp, Artificial Sequence
  Description of Artificial Sequence: Synthetic oligonucleotide
acagcactcacgctgtgccctctgg

SEQ ID NO: 150552 - DNA, 24 bp, Artificial Sequence
  Description of Artificial Sequence: Synthetic oligonucleotide
cagcactcacgctgtgccctctgg

SEQ ID NO: 150553 - DNA, 27 bp, Artificial Sequence
  Description of Artificial Sequence: Synthetic oligonucleotide
agcactcacgctgtgccctctgggaaa

SEQ ID NO: 150554 - DNA, 26 bp, Artificial Sequence
  Description of Artificial Sequence: Synthetic oligonucleotide
gcactcacgctgtgccctctgggaaa

SEQ ID NO: 150555 - DNA, 27 bp, Artificial Sequence
  Description of Artificial Sequence: Synthetic oligonucleotide
cactcacgctgtgccctctgggaaagt

SEQ ID NO: 150556 - DNA, 27 bp, Artificial Sequence
  Description of Artificial Sequence: Synthetic oligonucleotide
actcacgctgtgccctctgggaaagtg

SEQ ID NO: 150557 - DNA, 26 bp, Artificial Sequence
  Description of Artificial Sequence: Synthetic oligonucleotide
ctcacgctgtgccctctgggaaagtg

SEQ ID NO: 150558 - DNA, 27 bp, Artificial Sequence
  Description of Artificial Sequence: Synthetic oligonucleotide
tcacgctgtgccctctgggaaagtgct

SEQ ID NO: 150559 - DNA, 26 bp, Artificial Sequence
  Description of Artificial Sequence: Synthetic oligonucleotide
cacgctgtgccctctgggaaagtgct

SEQ ID NO: 150560 - DNA, 26 bp, Artificial Sequence
  Description of Artificial Sequence: Synthetic oligonucleotide
acgctgtgccctctgggaaagtgctg

SEQ ID NO: 150561 - DNA, 25 bp, Artificial Sequence
  Description of Artificial Sequence: Synthetic oligonucleotide
cgctgtgccctctgggaaagtgctg

SEQ ID NO: 150562 - DNA, 26 bp, Artificial Sequence
  Description of Artificial Sequence: Synthetic oligonucleotide
gctgtgccctctgggaaagtgctggt

SEQ ID NO: 150563 - DNA, 46 bp, Artificial Sequence
  Description of Artificial Sequence: Synthetic oligonucleotide
ctgctgctgctgctgctatttttgttattattattttctatgtctg

SEQ ID NO: 150564 - DNA, 48 bp, Artificial Sequence
  Description of Artificial Sequence: Synthetic oligonucleotide
tgctgctgctgctgctatttttgttattattattttctatgtctgttg

SEQ ID NO: 150565 - DNA, 47 bp, Artificial Sequence
  Description of Artificial Sequence: Synthetic oligonucleotide
gctgctgctgctgctatttttgttattattattttctatgtctgttg

SEQ ID NO: 150566 - DNA, 49 bp, Artificial Sequence
  Description of Artificial Sequence: Synthetic oligonucleotide
ctgctgctgctgctatttttgttattattattttctatgtctgttgttg

SEQ ID NO: 150567 - DNA, 52 bp, Artificial Sequence
  Description of Artificial Sequence: Synthetic oligonucleotide
tgctgctgctgctatttttgttattattattttctatgtctgttgttgtaag

SEQ ID NO: 150568 - DNA, 51 bp, Artificial Sequence
  Description of Artificial Sequence: Synthetic oligonucleotide
gctgctgctgctatttttgttattattattttctatgtctgttgttgtaag

SEQ ID NO: 150569 - DNA, 53 bp, Artificial Sequence
  Description of Artificial Sequence: Synthetic oligonucleotide
ctgctgctgctatttttgttattattattttctatgtctgttgttgtaagaag

SEQ ID NO: 150570 - DNA, 57 bp, Artificial Sequence
  Description of Artificial Sequence: Synthetic oligonucleotide
tgctgctgctatttttgttattattattttctatgtctgttgttgtaagaagaaaac

SEQ ID NO: 150571 - DNA, 56 bp, Artificial Sequence
  Description of Artificial Sequence: Synthetic oligonucleotide
gctgctgctatttttgttattattattttctatgtctgttgttgtaagaagaaaac

SEQ ID NO: 150572 - DNA, 58 bp, Artificial Sequence
  Description of Artificial Sequence: Synthetic oligonucleotide
ctgctgctatttttgttattattattttctatgtctgttgttgtaagaagaaaacatc

SEQ ID NO: 150573 - DNA, 59 bp, Artificial Sequence
  Description of Artificial Sequence: Synthetic oligonucleotide
tgctgctatttttgttattattattttctatgtctgttgttgtaagaagaaaacatcag

SEQ ID NO: 150574 - DNA, 58 bp, Artificial Sequence
  Description of Artificial Sequence: Synthetic oligonucleotide
gctgctatttttgttattattattttctatgtctgttgttgtaagaagaaaacatcag

SEQ ID NO: 150575 - DNA, 58 bp, Artificial Sequence
  Description of Artificial Sequence: Synthetic oligonucleotide
ctgctatttttgttattattattttctatgtctgttgttgtaagaagaaaacatcagc

SEQ ID NO: 150576 - DNA, 59 bp, Artificial Sequence
  Description of Artificial Sequence: Synthetic oligonucleotide
tgctatttttgttattattattttctatgtctgttgttgtaagaagaaaacatcagctg

SEQ ID NO: 150577 - DNA, 58 bp, Artificial Sequence
  Description of Artificial Sequence: Synthetic oligonucleotide
gctatttttgttattattattttctatgtctgttgttgtaagaagaaaacatcagctg

SEQ ID NO: 150578 - DNA, 58 bp, Artificial Sequence
  Description of Artificial Sequence: Synthetic oligonucleotide
ctatttttgttattattattttctatgtctgttgttgtaagaagaaaacatcagctgc

SEQ ID NO: 150579 - DNA, 59 bp, Artificial Sequence
  Description of Artificial Sequence: Synthetic oligonucleotide
tatttttgttattattattttctatgtctgttgttgtaagaagaaaacatcagctgcag

SEQ ID NO: 150580 - DNA, 58 bp, Artificial Sequence
  Description of Artificial Sequence: Synthetic oligonucleotide
atttttgttattattattttctatgtctgttgttgtaagaagaaaacatcagctgcag

SEQ ID NO: 150581 - DNA, 57 bp, Artificial Sequence
  Description of Artificial Sequence: Synthetic oligonucleotide
tttttgttattattattttctatgtctgttgttgtaagaagaaaacatcagctgcag

SEQ ID NO: 150582 - DNA, 56 bp, Artificial Sequence
  Description of Artificial Sequence: Synthetic oligonucleotide
ttttgttattattattttctatgtctgttgttgtaagaagaaaacatcagctgcag

SEQ ID NO: 150583 - DNA, 55 bp, Artificial Sequence
  Description of Artificial Sequence: Synthetic oligonucleotide
tttgttattattattttctatgtctgttgttgtaagaagaaaacatcagctgcag

SEQ ID NO: 150584 - DNA, 54 bp, Artificial Sequence
  Description of Artificial Sequence: Synthetic oligonucleotide
ttgttattattattttctatgtctgttgttgtaagaagaaaacatcagctgcag

SEQ ID NO: 150585 - DNA, 53 bp, Artificial Sequence
  Description of Artificial Sequence: Synthetic oligonucleotide
tgttattattattttctatgtctgttgttgtaagaagaaaacatcagctgcag

SEQ ID NO: 150586 - DNA, 52 bp, Artificial Sequence
  Description of Artificial Sequence: Synthetic oligonucleotide
gttattattattttctatgtctgttgttgtaagaagaaaacatcagctgcag

SEQ ID NO: 150587 - DNA, 53 bp, Artificial Sequence
  Description of Artificial Sequence: Synthetic oligonucleotide
ttattattattttctatgtctgttgttgtaagaagaaaacatcagctgcagag

SEQ ID NO: 150588 - DNA, 52 bp, Artificial Sequence
  Description of Artificial Sequence: Synthetic oligonucleotide
tattattattttctatgtctgttgttgtaagaagaaaacatcagctgcagag

SEQ ID NO: 150589 - DNA, 51 bp, Artificial Sequence
  Description of Artificial Sequence: Synthetic oligonucleotide
attattattttctatgtctgttgttgtaagaagaaaacatcagctgcagag

SEQ ID NO: 150590 - DNA, 50 bp, Artificial Sequence
  Description of Artificial Sequence: Synthetic oligonucleotide
ttattattttctatgtctgttgttgtaagaagaaaacatcagctgcagag

SEQ ID NO: 150591 - DNA, 49 bp, Artificial Sequence
  Description of Artificial Sequence: Synthetic oligonucleotide
tattattttctatgtctgttgttgtaagaagaaaacatcagctgcagag

SEQ ID NO: 150592 - DNA, 48 bp, Artificial Sequence
  Description of Artificial Sequence: Synthetic oligonucleotide
attattttctatgtctgttgttgtaagaagaaaacatcagctgcagag

SEQ ID NO: 150593 - DNA, 47 bp, Artificial Sequence
  Description of Artificial Sequence: Synthetic oligonucleotide
ttattttctatgtctgttgttgtaagaagaaaacatcagctgcagag

SEQ ID NO: 150594 - DNA, 46 bp, Artificial Sequence
  Description of Artificial Sequence: Synthetic oligonucleotide
tattttctatgtctgttgttgtaagaagaaaacatcagctgcagag

SEQ ID NO: 150595 - DNA, 45 bp, Artificial Sequence
  Description of Artificial Sequence: Synthetic oligonucleotide
attttctatgtctgttgttgtaagaagaaaacatcagctgcagag

SEQ ID NO: 150596 - DNA, 44 bp, Artificial Sequence
  Description of Artificial Sequence: Synthetic oligonucleotide
ttttctatgtctgttgttgtaagaagaaaacatcagctgcagag

SEQ ID NO: 150597 - DNA, 43 bp, Artificial Sequence
  Description of Artificial Sequence: Synthetic oligonucleotide
tttctatgtctgttgttgtaagaagaaaacatcagctgcagag

SEQ ID NO: 150598 - DNA, 42 bp, Artificial Sequence
  Description of Artificial Sequence: Synthetic oligonucleotide
ttctatgtctgttgttgtaagaagaaaacatcagctgcagag

SEQ ID NO: 150599 - DNA, 41 bp, Artificial Sequence
  Description of Artificial Sequence: Synthetic oligonucleotide
tctatgtctgttgttgtaagaagaaaacatcagctgcagag

SEQ ID NO: 150600 - DNA, 40 bp, Artificial Sequence
  Description of Artificial Sequence: Synthetic oligonucleotide
ctatgtctgttgttgtaagaagaaaacatcagctgcagag

SEQ ID NO: 150601 - DNA, 40 bp, Artificial Sequence
  Description of Artificial Sequence: Synthetic oligonucleotide
tatgtctgttgttgtaagaagaaaacatcagctgcagagg

SEQ ID NO: 150602 - DNA, 39 bp, Artificial Sequence
  Description of Artificial Sequence: Synthetic oligonucleotide
atgtctgttgttgtaagaagaaaacatcagctgcagagg

SEQ ID NO: 150603 - DNA, 38 bp, Artificial Sequence
  Description of Artificial Sequence: Synthetic oligonucleotide
tgtctgttgttgtaagaagaaaacatcagctgcagagg

SEQ ID NO: 150604 - DNA, 27 bp, Artificial Sequence
  Description of Artificial Sequence: Synthetic oligonucleotide
agcctctgatgtcagctcttgggtccg

SEQ ID NO: 150605 - DNA, 26 bp, Artificial Sequence
  Description of Artificial Sequence: Synthetic oligonucleotide
gcctctgatgtcagctcttgggtccg

SEQ ID NO: 150606 - DNA, 27 bp, Artificial Sequence
  Description of Artificial Sequence: Synthetic oligonucleotide
cctctgatgtcagctcttgggtccgct

SEQ ID NO: 150607 - DNA, 27 bp, Artificial Sequence
  Description of Artificial Sequence: Synthetic oligonucleotide
ctctgatgtcagctcttgggtccgctg

SEQ ID NO: 150608 - DNA, 27 bp, Artificial Sequence
  Description of Artificial Sequence: Synthetic oligonucleotide
tctgatgtcagctcttgggtccgctgg

SEQ ID NO: 150609 - DNA, 26 bp, Artificial Sequence
  Description of Artificial Sequence: Synthetic oligonucleotide
ctgatgtcagctcttgggtccgctgg

SEQ ID NO: 150610 - DNA, 27 bp, Artificial Sequence
  Description of Artificial Sequence: Synthetic oligonucleotide
tgatgtcagctcttgggtccgctggct

SEQ ID NO: 150611 - DNA, 26 bp, Artificial Sequence
  Description of Artificial Sequence: Synthetic oligonucleotide
gatgtcagctcttgggtccgctggct

SEQ ID NO: 150612 - DNA, 26 bp, Artificial Sequence
  Description of Artificial Sequence: Synthetic oligonucleotide
atgtcagctcttgggtccgctggctc

SEQ ID NO: 150613 - DNA, 25 bp, Artificial Sequence
  Description of Artificial Sequence: Synthetic oligonucleotide
tgtcagctcttgggtccgctggctc

SEQ ID NO: 150614 - DNA, 24 bp, Artificial Sequence
  Description of Artificial Sequence: Synthetic oligonucleotide
gtcagctcttgggtccgctggctc

SEQ ID NO: 150615 - DNA, 25 bp, Artificial Sequence
  Description of Artificial Sequence: Synthetic oligonucleotide
tcagctcttgggtccgctggctcca

SEQ ID NO: 150616 - DNA, 24 bp, Artificial Sequence
  Description of Artificial Sequence: Synthetic oligonucleotide
cagctcttgggtccgctggctcca

SEQ ID NO: 150617 - DNA, 25 bp, Artificial Sequence
  Description of Artificial Sequence: Synthetic oligonucleotide
agctcttgggtccgctggctccact

SEQ ID NO: 150618 - DNA, 24 bp, Artificial Sequence
  Description of Artificial Sequence: Synthetic oligonucleotide
gctcttgggtccgctggctccact

SEQ ID NO: 150619 - DNA, 25 bp, Artificial Sequence
  Description of Artificial Sequence: Synthetic oligonucleotide
ctcttgggtccgctggctccactga

SEQ ID NO: 150620 - DNA, 25 bp, Artificial Sequence
  Description of Artificial Sequence: Synthetic oligonucleotide
tcttgggtccgctggctccactgag

SEQ ID NO: 150621 - DNA, 24 bp, Artificial Sequence
  Description of Artificial Sequence: Synthetic oligonucleotide
cttgggtccgctggctccactgag

SEQ ID NO: 150622 - DNA, 24 bp, Artificial Sequence
  Description of Artificial Sequence: Synthetic oligonucleotide
ttgggtccgctggctccactgagg

SEQ ID NO: 150623 - DNA, 23 bp, Artificial Sequence
  Description of Artificial Sequence: Synthetic oligonucleotide
tgggtccgctggctccactgagg

SEQ ID NO: 150624 - DNA, 22 bp, Artificial Sequence
  Description of Artificial Sequence: Synthetic oligonucleotide
gggtccgctggctccactgagg

SEQ ID NO: 150625 - DNA, 23 bp, Artificial Sequence
  Description of Artificial Sequence: Synthetic oligonucleotide
ggtccgctggctccactgagggt

SEQ ID NO: 150626 - DNA, 23 bp, Artificial Sequence
  Description of Artificial Sequence: Synthetic oligonucleotide
gtccgctggctccactgagggtg

SEQ ID NO: 150627 - DNA, 23 bp, Artificial Sequence
  Description of Artificial Sequence: Synthetic oligonucleotide
tccgctggctccactgagggtgc

SEQ ID NO: 150628 - DNA, 22 bp, Artificial Sequence
  Description of Artificial Sequence: Synthetic oligonucleotide
ccgctggctccactgagggtgc

SEQ ID NO: 150629 - DNA, 24 bp, Artificial Sequence
  Description of Artificial Sequence: Synthetic oligonucleotide
cgctggctccactgagggtgccta

SEQ ID NO: 150630 - DNA, 24 bp, Artificial Sequence
  Description of Artificial Sequence: Synthetic oligonucleotide
gctggctccactgagggtgcctag

SEQ ID NO: 150631 - DNA, 39 bp, Artificial Sequence
  Description of Artificial Sequence: Synthetic oligonucleotide
aatttcttgaaggaagatgccatgaagaccaagacactc

SEQ ID NO: 150632 - DNA, 38 bp, Artificial Sequence
  Description of Artificial Sequence: Synthetic oligonucleotide
atttcttgaaggaagatgccatgaagaccaagacactc

SEQ ID NO: 150633 - DNA, 37 bp, Artificial Sequence
  Description of Artificial Sequence: Synthetic oligonucleotide
tttcttgaaggaagatgccatgaagaccaagacactc

SEQ ID NO: 150634 - DNA, 36 bp, Artificial Sequence
  Description of Artificial Sequence: Synthetic oligonucleotide
ttcttgaaggaagatgccatgaagaccaagacactc

SEQ ID NO: 150635 - DNA, 35 bp, Artificial Sequence
  Description of Artificial Sequence: Synthetic oligonucleotide
tcttgaaggaagatgccatgaagaccaagacactc

SEQ ID NO: 150636 - DNA, 34 bp, Artificial Sequence
  Description of Artificial Sequence: Synthetic oligonucleotide
cttgaaggaagatgccatgaagaccaagacactc

SEQ ID NO: 150637 - DNA, 37 bp, Artificial Sequence
  Description of Artificial Sequence: Synthetic oligonucleotide
ttgaaggaagatgccatgaagaccaagacactctatc

SEQ ID NO: 150638 - DNA, 36 bp, Artificial Sequence
  Description of Artificial Sequence: Synthetic oligonucleotide
tgaaggaagatgccatgaagaccaagacactctatc

SEQ ID NO: 150639 - DNA, 35 bp, Artificial Sequence
  Description of Artificial Sequence: Synthetic oligonucleotide
gaaggaagatgccatgaagaccaagacactctatc

SEQ ID NO: 150640 - DNA, 36 bp, Artificial Sequence
  Description of Artificial Sequence: Synthetic oligonucleotide
aaggaagatgccatgaagaccaagacactctatcac

SEQ ID NO: 150641 - DNA, 35 bp, Artificial Sequence
  Description of Artificial Sequence: Synthetic oligonucleotide
aggaagatgccatgaagaccaagacactctatcac

SEQ ID NO: 150642 - DNA, 34 bp, Artificial Sequence
  Description of Artificial Sequence: Synthetic oligonucleotide
ggaagatgccatgaagaccaagacactctatcac

SEQ ID NO: 150643 - DNA, 34 bp, Artificial Sequence
  Description of Artificial Sequence: Synthetic oligonucleotide
gaagatgccatgaagaccaagacactctatcacg

SEQ ID NO: 150644 - DNA, 34 bp, Artificial Sequence
  Description of Artificial Sequence: Synthetic oligonucleotide
aagatgccatgaagaccaagacactctatcacgc

SEQ ID NO: 150645 - DNA, 33 bp, Artificial Sequence
  Description of Artificial Sequence: Synthetic oligonucleotide
agatgccatgaagaccaagacactctatcacgc

SEQ ID NO: 150646 - DNA, 32 bp, Artificial Sequence
  Description of Artificial Sequence: Synthetic oligonucleotide
gatgccatgaagaccaagacactctatcacgc

SEQ ID NO: 150647 - DNA, 35 bp, Artificial Sequence
  Description of Artificial Sequence: Synthetic oligonucleotide
atgccatgaagaccaagacactctatcacgctatg

SEQ ID NO: 150648 - DNA, 34 bp, Artificial Sequence
  Description of Artificial Sequence: Synthetic oligonucleotide
tgccatgaagaccaagacactctatcacgctatg

SEQ ID NO: 150649 - DNA, 33 bp, Artificial Sequence
  Description of Artificial Sequence: Synthetic oligonucleotide
gccatgaagaccaagacactctatcacgctatg

SEQ ID NO: 150650 - DNA, 33 bp, Artificial Sequence
  Description of Artificial Sequence: Synthetic oligonucleotide
ccatgaagaccaagacactctatcacgctatgc

SEQ ID NO: 150651 - DNA, 35 bp, Artificial Sequence
  Description of Artificial Sequence: Synthetic oligonucleotide
catgaagaccaagacactctatcacgctatgcatg

SEQ ID NO: 150652 - DNA, 35 bp, Artificial Sequence
  Description of Artificial Sequence: Synthetic oligonucleotide
atgaagaccaagacactctatcacgctatgcatgc

SEQ ID NO: 150653 - DNA, 34 bp, Artificial Sequence
  Description of Artificial Sequence: Synthetic oligonucleotide
tgaagaccaagacactctatcacgctatgcatgc

SEQ ID NO: 150654 - DNA, 33 bp, Artificial Sequence
  Description of Artificial Sequence: Synthetic oligonucleotide
gaagaccaagacactctatcacgctatgcatgc

SEQ ID NO: 150655 - DNA, 34 bp, Artificial Sequence
  Description of Artificial Sequence: Synthetic oligonucleotide
aagaccaagacactctatcacgctatgcatgcag

SEQ ID NO: 150656 - DNA, 33 bp, Artificial Sequence
  Description of Artificial Sequence: Synthetic oligonucleotide
agaccaagacactctatcacgctatgcatgcag

SEQ ID NO: 150657 - DNA, 32 bp, Artificial Sequence
  Description of Artificial Sequence: Synthetic oligonucleotide
gaccaagacactctatcacgctatgcatgcag

SEQ ID NO: 150658 - DNA, 33 bp, Artificial Sequence
  Description of Artificial Sequence: Synthetic oligonucleotide
accaagacactctatcacgctatgcatgcagac

SEQ ID NO: 150659 - DNA, 32 bp, Artificial Sequence
  Description of Artificial Sequence: Synthetic oligonucleotide
ccaagacactctatcacgctatgcatgcagac

SEQ ID NO: 150660 - DNA, 33 bp, Artificial Sequence
  Description of Artificial Sequence: Synthetic oligonucleotide
caagacactctatcacgctatgcatgcagactg

SEQ ID NO: 150661 - DNA, 33 bp, Artificial Sequence
  Description of Artificial Sequence: Synthetic oligonucleotide
aagacactctatcacgctatgcatgcagactgc

SEQ ID NO: 150662 - DNA, 32 bp, Artificial Sequence
  Description of Artificial Sequence: Synthetic oligonucleotide
agacactctatcacgctatgcatgcagactgc

SEQ ID NO: 150663 - DNA, 31 bp, Artificial Sequence
  Description of Artificial Sequence: Synthetic oligonucleotide
gacactctatcacgctatgcatgcagactgc

SEQ ID NO: 150664 - DNA, 31 bp, Artificial Sequence
  Description of Artificial Sequence: Synthetic oligonucleotide
acactctatcacgctatgcatgcagactgcc

SEQ ID NO: 150665 - DNA, 30 bp, Artificial Sequence
  Description of Artificial Sequence: Synthetic oligonucleotide
cactctatcacgctatgcatgcagactgcc

SEQ ID NO: 150666 - DNA, 31 bp, Artificial Sequence
  Description of Artificial Sequence: Synthetic oligonucleotide
actctatcacgctatgcatgcagactgcctg

SEQ ID NO: 150667 - DNA, 30 bp, Artificial Sequence
  Description of Artificial Sequence: Synthetic oligonucleotide
ctctatcacgctatgcatgcagactgcctg

SEQ ID NO: 150668 - DNA, 30 bp, Artificial Sequence
  Description of Artificial Sequence: Synthetic oligonucleotide
tctatcacgctatgcatgcagactgcctgc

SEQ ID NO: 150669 - DNA, 30 bp, Artificial Sequence
  Description of Artificial Sequence: Synthetic oligonucleotide
caccaggatttgccaaggagaggagcaaag

SEQ ID NO: 150670 - DNA, 30 bp, Artificial Sequence
  Description of Artificial Sequence: Synthetic oligonucleotide
accaggatttgccaaggagaggagcaaagg

SEQ ID NO: 150671 - DNA, 29 bp, Artificial Sequence
  Description of Artificial Sequence: Synthetic oligonucleotide
ccaggatttgccaaggagaggagcaaagg

SEQ ID NO: 150672 - DNA, 31 bp, Artificial Sequence
  Description of Artificial Sequence: Synthetic oligonucleotide
caggatttgccaaggagaggagcaaaggttc

SEQ ID NO: 150673 - DNA, 32 bp, Artificial Sequence
  Description of Artificial Sequence: Synthetic oligonucleotide
aggatttgccaaggagaggagcaaaggttcac

SEQ ID NO: 150674 - DNA, 31 bp, Artificial Sequence
  Description of Artificial Sequence: Synthetic oligonucleotide
ggatttgccaaggagaggagcaaaggttcac

SEQ ID NO: 150675 - DNA, 31 bp, Artificial Sequence
  Description of Artificial Sequence: Synthetic oligonucleotide
gatttgccaaggagaggagcaaaggttcacc

SEQ ID NO: 150676 - DNA, 32 bp, Artificial Sequence
  Description of Artificial Sequence: Synthetic oligonucleotide
atttgccaaggagaggagcaaaggttcacctg

SEQ ID NO: 150677 - DNA, 31 bp, Artificial Sequence
  Description of Artificial Sequence: Synthetic oligonucleotide
tttgccaaggagaggagcaaaggttcacctg

SEQ ID NO: 150678 - DNA, 30 bp, Artificial Sequence
  Description of Artificial Sequence: Synthetic oligonucleotide
ttgccaaggagaggagcaaaggttcacctg

SEQ ID NO: 150679 - DNA, 29 bp, Artificial Sequence
  Description of Artificial Sequence: Synthetic oligonucleotide
tgccaaggagaggagcaaaggttcacctg

SEQ ID NO: 150680 - DNA, 28 bp, Artificial Sequence
  Description of Artificial Sequence: Synthetic oligonucleotide
gccaaggagaggagcaaaggttcacctg

SEQ ID NO: 150681 - DNA, 28 bp, Artificial Sequence
  Description of Artificial Sequence: Synthetic oligonucleotide
ccaaggagaggagcaaaggttcacctgc

SEQ ID NO: 150682 - DNA, 30 bp, Artificial Sequence
  Description of Artificial Sequence: Synthetic oligonucleotide
caaggagaggagcaaaggttcacctgctac

SEQ ID NO: 150683 - DNA, 32 bp, Artificial Sequence
  Description of Artificial Sequence: Synthetic oligonucleotide
aaggagaggagcaaaggttcacctgctacatg

SEQ ID NO: 150684 - DNA, 31 bp, Artificial Sequence
  Description of Artificial Sequence: Synthetic oligonucleotide
aggagaggagcaaaggttcacctgctacatg

SEQ ID NO: 150685 - DNA, 30 bp, Artificial Sequence
  Description of Artificial Sequence: Synthetic oligonucleotide
ggagaggagcaaaggttcacctgctacatg

SEQ ID NO: 150686 - DNA, 30 bp, Artificial Sequence
  Description of Artificial Sequence: Synthetic oligonucleotide
gagaggagcaaaggttcacctgctacatgg

SEQ ID NO: 150687 - DNA, 32 bp, Artificial Sequence
  Description of Artificial Sequence: Synthetic oligonucleotide
agaggagcaaaggttcacctgctacatggaac

SEQ ID NO: 150688 - DNA, 31 bp, Artificial Sequence
  Description of Artificial Sequence: Synthetic oligonucleotide
gaggagcaaaggttcacctgctacatggaac

SEQ ID NO: 150689 - DNA, 32 bp, Artificial Sequence
  Description of Artificial Sequence: Synthetic oligonucleotide
aggagcaaaggttcacctgctacatggaacac

SEQ ID NO: 150690 - DNA, 31 bp, Artificial Sequence
  Description of Artificial Sequence: Synthetic oligonucleotide
ggagcaaaggttcacctgctacatggaacac

SEQ ID NO: 150691 - DNA, 32 bp, Artificial Sequence
  Description of Artificial Sequence: Synthetic oligonucleotide
gagcaaaggttcacctgctacatggaacacag

SEQ ID NO: 150692 - DNA, 32 bp, Artificial Sequence
  Description of Artificial Sequence: Synthetic oligonucleotide
agcaaaggttcacctgctacatggaacacagc

SEQ ID NO: 150693 - DNA, 31 bp, Artificial Sequence
  Description of Artificial Sequence: Synthetic oligonucleotide
gcaaaggttcacctgctacatggaacacagc

SEQ ID NO: 150694 - DNA, 31 bp, Artificial Sequence
  Description of Artificial Sequence: Synthetic oligonucleotide
caaaggttcacctgctacatggaacacagcg

SEQ ID NO: 150695 - DNA, 31 bp, Artificial Sequence
  Description of Artificial Sequence: Synthetic oligonucleotide
aaaggttcacctgctacatggaacacagcgg

SEQ ID NO: 150696 - DNA, 30 bp, Artificial Sequence
  Description of Artificial Sequence: Synthetic oligonucleotide
aaggttcacctgctacatggaacacagcgg

SEQ ID NO: 150697 - DNA, 29 bp, Artificial Sequence
  Description of Artificial Sequence: Synthetic oligonucleotide
gacagtgggcagaagatgtcctgggaaac

SEQ ID NO: 150698 - DNA, 31 bp, Artificial Sequence
  Description of Artificial Sequence: Synthetic oligonucleotide
acagtgggcagaagatgtcctgggaaacaag

SEQ ID NO: 150699 - DNA, 30 bp, Artificial Sequence
  Description of Artificial Sequence: Synthetic oligonucleotide
cagtgggcagaagatgtcctgggaaacaag

SEQ ID NO: 150700 - DNA, 31 bp, Artificial Sequence
  Description of Artificial Sequence: Synthetic oligonucleotide
agtgggcagaagatgtcctgggaaacaagac

SEQ ID NO: 150701 - DNA, 30 bp, Artificial Sequence
  Description of Artificial Sequence: Synthetic oligonucleotide
gtgggcagaagatgtcctgggaaacaagac

SEQ ID NO: 150702 - DNA, 32 bp, Artificial Sequence
  Description of Artificial Sequence: Synthetic oligonucleotide
tgggcagaagatgtcctgggaaacaagacatg

SEQ ID NO: 150703 - DNA, 31 bp, Artificial Sequence
  Description of Artificial Sequence: Synthetic oligonucleotide
gggcagaagatgtcctgggaaacaagacatg

SEQ ID NO: 150704 - DNA, 31 bp, Artificial Sequence
  Description of Artificial Sequence: Synthetic oligonucleotide
ggcagaagatgtcctgggaaacaagacatgg

SEQ ID NO: 150705 - DNA, 31 bp, Artificial Sequence
  Description of Artificial Sequence: Synthetic oligonucleotide
gcagaagatgtcctgggaaacaagacatggg

SEQ ID NO: 150706 - DNA, 32 bp, Artificial Sequence
  Description of Artificial Sequence: Synthetic oligonucleotide
cagaagatgtcctgggaaacaagacatgggac

SEQ ID NO: 150707 - DNA, 33 bp, Artificial Sequence
  Description of Artificial Sequence: Synthetic oligonucleotide
agaagatgtcctgggaaacaagacatgggacag

SEQ ID NO: 150708 - DNA, 32 bp, Artificial Sequence
  Description of Artificial Sequence: Synthetic oligonucleotide
gaagatgtcctgggaaacaagacatgggacag

SEQ ID NO: 150709 - DNA, 33 bp, Artificial Sequence
  Description of Artificial Sequence: Synthetic oligonucleotide
aagatgtcctgggaaacaagacatgggacagag

SEQ ID NO: 150710 - DNA, 32 bp, Artificial Sequence
  Description of Artificial Sequence: Synthetic oligonucleotide
agatgtcctgggaaacaagacatgggacagag

SEQ ID NO: 150711 - DNA, 31 bp, Artificial Sequence
  Description of Artificial Sequence: Synthetic oligonucleotide
gatgtcctgggaaacaagacatgggacagag

SEQ ID NO: 150712 - DNA, 32 bp, Artificial Sequence
  Description of Artificial Sequence: Synthetic oligonucleotide
atgtcctgggaaacaagacatgggacagagag

SEQ ID NO: 150713 - DNA, 31 bp, Artificial Sequence
  Description of Artificial Sequence: Synthetic oligonucleotide
tgtcctgggaaacaagacatgggacagagag

SEQ ID NO: 150714 - DNA, 30 bp, Artificial Sequence
  Description of Artificial Sequence: Synthetic oligonucleotide
gtcctgggaaacaagacatgggacagagag

SEQ ID NO: 150715 - DNA, 31 bp, Artificial Sequence
  Description of Artificial Sequence: Synthetic oligonucleotide
tcctgggaaacaagacatgggacagagagac

SEQ ID NO: 150716 - DNA, 30 bp, Artificial Sequence
  Description of Artificial Sequence: Synthetic oligonucleotide
cctgggaaacaagacatgggacagagagac

SEQ ID NO: 150717 - DNA, 30 bp, Artificial Sequence
  Description of Artificial Sequence: Synthetic oligonucleotide
ctgggaaacaagacatgggacagagagacc

SEQ ID NO: 150718 - DNA, 31 bp, Artificial Sequence
  Description of Artificial Sequence: Synthetic oligonucleotide
tgggaaacaagacatgggacagagagaccag

SEQ ID NO: 150719 - DNA, 30 bp, Artificial Sequence
  Description of Artificial Sequence: Synthetic oligonucleotide
gggaaacaagacatgggacagagagaccag

SEQ ID NO: 150720 - DNA, 31 bp, Artificial Sequence
  Description of Artificial Sequence: Synthetic oligonucleotide
ggaaacaagacatgggacagagagaccagag

SEQ ID NO: 150721 - DNA, 32 bp, Artificial Sequence
  Description of Artificial Sequence: Synthetic oligonucleotide
gaaacaagacatgggacagagagaccagagac

SEQ ID NO: 150722 - DNA, 34 bp, Artificial Sequence
  Description of Artificial Sequence: Synthetic oligonucleotide
aaacaagacatgggacagagagaccagagacttg

SEQ ID NO: 150723 - DNA, 33 bp, Artificial Sequence
  Description of Artificial Sequence: Synthetic oligonucleotide
aacaagacatgggacagagagaccagagacttg

SEQ ID NO: 150724 - DNA, 32 bp, Artificial Sequence
  Description of Artificial Sequence: Synthetic oligonucleotide
acaagacatgggacagagagaccagagacttg

SEQ ID NO: 150725 - DNA, 31 bp, Artificial Sequence
  Description of Artificial Sequence: Synthetic oligonucleotide
caagacatgggacagagagaccagagacttg

SEQ ID NO: 150726 - DNA, 32 bp, Artificial Sequence
  Description of Artificial Sequence: Synthetic oligonucleotide
accaggagctcccagcatttctactacgatag

SEQ ID NO: 150727 - DNA, 31 bp, Artificial Sequence
  Description of Artificial Sequence: Synthetic oligonucleotide
ccaggagctcccagcatttctactacgatag

SEQ ID NO: 150728 - DNA, 31 bp, Artificial Sequence
  Description of Artificial Sequence: Synthetic oligonucleotide
caggagctcccagcatttctactacgatagg

SEQ ID NO: 150729 - DNA, 31 bp, Artificial Sequence
  Description of Artificial Sequence: Synthetic oligonucleotide
aggagctcccagcatttctactacgataggg

SEQ ID NO: 150730 - DNA, 30 bp, Artificial Sequence
  Description of Artificial Sequence: Synthetic oligonucleotide
ggagctcccagcatttctactacgataggg

SEQ ID NO: 150731 - DNA, 31 bp, Artificial Sequence
  Description of Artificial Sequence: Synthetic oligonucleotide
gagctcccagcatttctactacgatagggag

SEQ ID NO: 150732 - DNA, 31 bp, Artificial Sequence
  Description of Artificial Sequence: Synthetic oligonucleotide
agctcccagcatttctactacgatagggagc

SEQ ID NO: 150733 - DNA, 30 bp, Artificial Sequence
  Description of Artificial Sequence: Synthetic oligonucleotide
gctcccagcatttctactacgatagggagc

SEQ ID NO: 150734 - DNA, 31 bp, Artificial Sequence
  Description of Artificial Sequence: Synthetic oligonucleotide
ctcccagcatttctactacgatagggagctc

SEQ ID NO: 150735 - DNA, 33 bp, Artificial Sequence
  Description of Artificial Sequence: Synthetic oligonucleotide
tcccagcatttctactacgatagggagctcttc

SEQ ID NO: 150736 - DNA, 32 bp, Artificial Sequence
  Description of Artificial Sequence: Synthetic oligonucleotide
cccagcatttctactacgatagggagctcttc

SEQ ID NO: 150737 - DNA, 32 bp, Artificial Sequence
  Description of Artificial Sequence: Synthetic oligonucleotide
ccagcatttctactacgatagggagctcttcc

SEQ ID NO: 150738 - DNA, 33 bp, Artificial Sequence
  Description of Artificial Sequence: Synthetic oligonucleotide
cagcatttctactacgatagggagctcttcctc

SEQ ID NO: 150739 - DNA, 34 bp, Artificial Sequence
  Description of Artificial Sequence: Synthetic oligonucleotide
agcatttctactacgatagggagctcttcctctc

SEQ ID NO: 150740 - DNA, 33 bp, Artificial Sequence
  Description of Artificial Sequence: Synthetic oligonucleotide
gcatttctactacgatagggagctcttcctctc

SEQ ID NO: 150741 - DNA, 33 bp, Artificial Sequence
  Description of Artificial Sequence: Synthetic oligonucleotide
catttctactacgatagggagctcttcctctcc

SEQ ID NO: 150742 - DNA, 33 bp, Artificial Sequence
  Description of Artificial Sequence: Synthetic oligonucleotide
atttctactacgatagggagctcttcctctccc

SEQ ID NO: 150743 - DNA, 32 bp, Artificial Sequence
  Description of Artificial Sequence: Synthetic oligonucleotide
tttctactacgatagggagctcttcctctccc

SEQ ID NO: 150744 - DNA, 31 bp, Artificial Sequence
  Description of Artificial Sequence: Synthetic oligonucleotide
ttctactacgatagggagctcttcctctccc

SEQ ID NO: 150745 - DNA, 30 bp, Artificial Sequence
  Description of Artificial Sequence: Synthetic oligonucleotide
tctactacgatagggagctcttcctctccc

SEQ ID NO: 150746 - DNA, 29 bp, Artificial Sequence
  Description of Artificial Sequence: Synthetic oligonucleotide
ctactacgatagggagctcttcctctccc

SEQ ID NO: 150747 - DNA, 33 bp, Artificial Sequence
  Description of Artificial Sequence: Synthetic oligonucleotide
tactacgatagggagctcttcctctcccaaaac

SEQ ID NO: 150748 - DNA, 32 bp, Artificial Sequence
  Description of Artificial Sequence: Synthetic oligonucleotide
actacgatagggagctcttcctctcccaaaac

SEQ ID NO: 150749 - DNA, 31 bp, Artificial Sequence
  Description of Artificial Sequence: Synthetic oligonucleotide
ctacgatagggagctcttcctctcccaaaac

SEQ ID NO: 150750 - DNA, 31 bp, Artificial Sequence
  Description of Artificial Sequence: Synthetic oligonucleotide
tacgatagggagctcttcctctcccaaaacc

SEQ ID NO: 150751 - DNA, 30 bp, Artificial Sequence
  Description of Artificial Sequence: Synthetic oligonucleotide
acgatagggagctcttcctctcccaaaacc

SEQ ID NO: 150752 - DNA, 29 bp, Artificial Sequence
  Description of Artificial Sequence: Synthetic oligonucleotide
cgatagggagctcttcctctcccaaaacc

SEQ ID NO: 150753 - DNA, 30 bp, Artificial Sequence
  Description of Artificial Sequence: Synthetic oligonucleotide
gatagggagctcttcctctcccaaaacctg

SEQ ID NO: 150754 - DNA, 30 bp, Artificial Sequence
  Description of Artificial Sequence: Synthetic oligonucleotide
atagggagctcttcctctcccaaaacctgg

SEQ ID NO: 150755 - DNA, 29 bp, Artificial Sequence
  Description of Artificial Sequence: Synthetic oligonucleotide
tagggagctcttcctctcccaaaacctgg

SEQ ID NO: 150756 - DNA, 28 bp, Artificial Sequence
  Description of Artificial Sequence: Synthetic oligonucleotide
agggagctcttcctctcccaaaacctgg

SEQ ID NO: 150757 - DNA, 33 bp, Artificial Sequence
  Description of Artificial Sequence: Synthetic oligonucleotide
atatctagaatccggcgtagtcctgaggagaag

SEQ ID NO: 150758 - DNA, 32 bp, Artificial Sequence
  Description of Artificial Sequence: Synthetic oligonucleotide
tatctagaatccggcgtagtcctgaggagaag

SEQ ID NO: 150759 - DNA, 31 bp, Artificial Sequence
  Description of Artificial Sequence: Synthetic oligonucleotide
atctagaatccggcgtagtcctgaggagaag

SEQ ID NO: 150760 - DNA, 30 bp, Artificial Sequence
  Description of Artificial Sequence: Synthetic oligonucleotide
tctagaatccggcgtagtcctgaggagaag

SEQ ID NO: 150761 - DNA, 29 bp, Artificial Sequence
  Description of Artificial Sequence: Synthetic oligonucleotide
ctagaatccggcgtagtcctgaggagaag

SEQ ID NO: 150762 - DNA, 30 bp, Artificial Sequence
  Description of Artificial Sequence: Synthetic oligonucleotide
tagaatccggcgtagtcctgaggagaagag

SEQ ID NO: 150763 - DNA, 29 bp, Artificial Sequence
  Description of Artificial Sequence: Synthetic oligonucleotide
agaatccggcgtagtcctgaggagaagag

SEQ ID NO: 150764 - DNA, 28 bp, Artificial Sequence
  Description of Artificial Sequence: Synthetic oligonucleotide
gaatccggcgtagtcctgaggagaagag

SEQ ID NO: 150765 - DNA, 29 bp, Artificial Sequence
  Description of Artificial Sequence: Synthetic oligonucleotide
aatccggcgtagtcctgaggagaagagtg

SEQ ID NO: 150766 - DNA, 28 bp, Artificial Sequence
  Description of Artificial Sequence: Synthetic oligonucleotide
atccggcgtagtcctgaggagaagagtg

SEQ ID NO: 150767 - DNA, 27 bp, Artificial Sequence
  Description of Artificial Sequence: Synthetic oligonucleotide
tccggcgtagtcctgaggagaagagtg

SEQ ID NO: 150768 - DNA, 26 bp, Artificial Sequence
  Description of Artificial Sequence: Synthetic oligonucleotide
ccggcgtagtcctgaggagaagagtg

SEQ ID NO: 150769 - DNA, 26 bp, Artificial Sequence
  Description of Artificial Sequence: Synthetic oligonucleotide
cggcgtagtcctgaggagaagagtgc

SEQ ID NO: 150770 - DNA, 26 bp, Artificial Sequence
  Description of Artificial Sequence: Synthetic oligonucleotide
ggcgtagtcctgaggagaagagtgcc

SEQ ID NO: 150771 - DNA, 27 bp, Artificial Sequence
  Description of Artificial Sequence: Synthetic oligonucleotide
acagcactcaccctgtgccctctggaa

SEQ ID NO: 150772 - DNA, 27 bp, Artificial Sequence
  Description of Artificial Sequence: Synthetic oligonucleotide
cagcactcaccctgtgccctctggaaa

SEQ ID NO: 150773 - DNA, 27 bp, Artificial Sequence
  Description of Artificial Sequence: Synthetic oligonucleotide
agcactcaccctgtgccctctggaaag

SEQ ID NO: 150774 - DNA, 27 bp, Artificial Sequence
  Description of Artificial Sequence: Synthetic oligonucleotide
gcactcaccctgtgccctctggaaagt

SEQ ID NO: 150775 - DNA, 27 bp, Artificial Sequence
  Description of Artificial Sequence: Synthetic oligonucleotide
cactcaccctgtgccctctggaaagtg

SEQ ID NO: 150776 - DNA, 27 bp, Artificial Sequence
  Description of Artificial Sequence: Synthetic oligonucleotide
actcaccctgtgccctctggaaagtgc

SEQ ID NO: 150777 - DNA, 27 bp, Artificial Sequence
  Description of Artificial Sequence: Synthetic oligonucleotide
ctcaccctgtgccctctggaaagtgct

SEQ ID NO: 150778 - DNA, 27 bp, Artificial Sequence
  Description of Artificial Sequence: Synthetic oligonucleotide
tcaccctgtgccctctggaaagtgctg

SEQ ID NO: 150779 - DNA, 26 bp, Artificial Sequence
  Description of Artificial Sequence: Synthetic oligonucleotide
caccctgtgccctctggaaagtgctg

SEQ ID NO: 150780 - DNA, 27 bp, Artificial Sequence
  Description of Artificial Sequence: Synthetic oligonucleotide
accctgtgccctctggaaagtgctggt

SEQ ID NO: 150781 - DNA, 26 bp, Artificial Sequence
  Description of Artificial Sequence: Synthetic oligonucleotide
ccctgtgccctctggaaagtgctggt

SEQ ID NO: 150782 - DNA, 26 bp, Artificial Sequence
  Description of Artificial Sequence: Synthetic oligonucleotide
cctgtgccctctggaaagtgctggtg

SEQ ID NO: 150783 - DNA, 27 bp, Artificial Sequence
  Description of Artificial Sequence: Synthetic oligonucleotide
ctgtgccctctggaaagtgctggtgct

SEQ ID NO: 150784 - DNA, 28 bp, Artificial Sequence
  Description of Artificial Sequence: Synthetic oligonucleotide
tgtgccctctggaaagtgctggtgcttc

SEQ ID NO: 150785 - DNA, 27 bp, Artificial Sequence
  Description of Artificial Sequence: Synthetic oligonucleotide
gtgccctctggaaagtgctggtgcttc

SEQ ID NO: 150786 - DNA, 28 bp, Artificial Sequence
  Description of Artificial Sequence: Synthetic oligonucleotide
tgccctctggaaagtgctggtgcttcag

SEQ ID NO: 150787 - DNA, 27 bp, Artificial Sequence
  Description of Artificial Sequence: Synthetic oligonucleotide
gccctctggaaagtgctggtgcttcag

SEQ ID NO: 150788 - DNA, 28 bp, Artificial Sequence
  Description of Artificial Sequence: Synthetic oligonucleotide
ccctctggaaagtgctggtgcttcagag

SEQ ID NO: 150789 - DNA, 29 bp, Artificial Sequence
  Description of Artificial Sequence: Synthetic oligonucleotide
cctctggaaagtgctggtgcttcagagtc

SEQ ID NO: 150790 - DNA, 32 bp, Artificial Sequence
  Description of Artificial Sequence: Synthetic oligonucleotide
ctctggaaagtgctggtgcttcagagtcattg

SEQ ID NO: 150791 - DNA, 32 bp, Artificial Sequence
  Description of Artificial Sequence: Synthetic oligonucleotide
tctggaaagtgctggtgcttcagagtcattgg

SEQ ID NO: 150792 - DNA, 31 bp, Artificial Sequence
  Description of Artificial Sequence: Synthetic oligonucleotide
ctggaaagtgctggtgcttcagagtcattgg

SEQ ID NO: 150793 - DNA, 31 bp, Artificial Sequence
  Description of Artificial Sequence: Synthetic oligonucleotide
tggaaagtgctggtgcttcagagtcattggc

SEQ ID NO: 150794 - DNA, 33 bp, Artificial Sequence
  Description of Artificial Sequence: Synthetic oligonucleotide
taagaagaaaacatcagctgcagagggtccagg

SEQ ID NO: 150795 - DNA, 32 bp, Artificial Sequence
  Description of Artificial Sequence: Synthetic oligonucleotide
aagaagaaaacatcagctgcagagggtccagg

SEQ ID NO: 150796 - DNA, 31 bp, Artificial Sequence
  Description of Artificial Sequence: Synthetic oligonucleotide
agaagaaaacatcagctgcagagggtccagg

SEQ ID NO: 150797 - DNA, 30 bp, Artificial Sequence
  Description of Artificial Sequence: Synthetic oligonucleotide
gaagaaaacatcagctgcagagggtccagg

SEQ ID NO: 150798 - DNA, 30 bp, Artificial Sequence
  Description of Artificial Sequence: Synthetic oligonucleotide
aagaaaacatcagctgcagagggtccaggg

SEQ ID NO: 150799 - DNA, 29 bp, Artificial Sequence
  Description of Artificial Sequence: Synthetic oligonucleotide
agaaaacatcagctgcagagggtccaggg

SEQ ID NO: 150800 - DNA, 28 bp, Artificial Sequence
  Description of Artificial Sequence: Synthetic oligonucleotide
gaaaacatcagctgcagagggtccaggg

SEQ ID NO: 150801 - DNA, 28 bp, Artificial Sequence
  Description of Artificial Sequence: Synthetic oligonucleotide
aaaacatcagctgcagagggtccagggc

SEQ ID NO: 150802 - DNA, 27 bp, Artificial Sequence
  Description of Artificial Sequence: Synthetic oligonucleotide
aaacatcagctgcagagggtccagggc

SEQ ID NO: 150803 - DNA, 27 bp, Artificial Sequence
  Description of Artificial Sequence: Synthetic oligonucleotide
aacatcagctgcagagggtccagggct

SEQ ID NO: 150804 - DNA, 26 bp, Artificial Sequence
  Description of Artificial Sequence: Synthetic oligonucleotide
acatcagctgcagagggtccagggct

SEQ ID NO: 150805 - DNA, 25 bp, Artificial Sequence
  Description of Artificial Sequence: Synthetic oligonucleotide
catcagctgcagagggtccagggct

SEQ ID NO: 150806 - DNA, 25 bp, Artificial Sequence
  Description of Artificial Sequence: Synthetic oligonucleotide
atcagctgcagagggtccagggctc

SEQ ID NO: 150807 - DNA, 24 bp, Artificial Sequence
  Description of Artificial Sequence: Synthetic oligonucleotide
tcagctgcagagggtccagggctc

SEQ ID NO: 150808 - DNA, 23 bp, Artificial Sequence
  Description of Artificial Sequence: Synthetic oligonucleotide
cagctgcagagggtccagggctc

SEQ ID NO: 150809 - DNA, 24 bp, Artificial Sequence
  Description of Artificial Sequence: Synthetic oligonucleotide
agctgcagagggtccagggctcgt

SEQ ID NO: 150810 - DNA, 23 bp, Artificial Sequence
  Description of Artificial Sequence: Synthetic oligonucleotide
gctgcagagggtccagggctcgt

SEQ ID NO: 150811 - DNA, 24 bp, Artificial Sequence
  Description of Artificial Sequence: Synthetic oligonucleotide
ctgcagagggtccagggctcgtga

SEQ ID NO: 150812 - DNA, 24 bp, Artificial Sequence
  Description of Artificial Sequence: Synthetic oligonucleotide
tgcagagggtccagggctcgtgag

SEQ ID NO: 150813 - DNA, 31 bp, Artificial Sequence
  Description of Artificial Sequence: Synthetic oligonucleotide
aatatcatactgacctggcgtcaggatgggc

SEQ ID NO: 150814 - DNA, 30 bp, Artificial Sequence
  Description of Artificial Sequence: Synthetic oligonucleotide
atatcatactgacctggcgtcaggatgggc

SEQ ID NO: 150815 - DNA, 29 bp, Artificial Sequence
  Description of Artificial Sequence: Synthetic oligonucleotide
tatcatactgacctggcgtcaggatgggc

SEQ ID NO: 150816 - DNA, 28 bp, Artificial Sequence
  Description of Artificial Sequence: Synthetic oligonucleotide
atcatactgacctggcgtcaggatgggc

SEQ ID NO: 150817 - DNA, 27 bp, Artificial Sequence
  Description of Artificial Sequence: Synthetic oligonucleotide
tcatactgacctggcgtcaggatgggc

SEQ ID NO: 150818 - DNA, 27 bp, Artificial Sequence
  Description of Artificial Sequence: Synthetic oligonucleotide
catactgacctggcgtcaggatgggct

SEQ ID NO: 150819 - DNA, 29 bp, Artificial Sequence
  Description of Artificial Sequence: Synthetic oligonucleotide
atactgacctggcgtcaggatgggctatc

SEQ ID NO: 150820 - DNA, 28 bp, Artificial Sequence
  Description of Artificial Sequence: Synthetic oligonucleotide
tactgacctggcgtcaggatgggctatc

SEQ ID NO: 150821 - DNA, 27 bp, Artificial Sequence
  Description of Artificial Sequence: Synthetic oligonucleotide
actgacctggcgtcaggatgggctatc

SEQ ID NO: 150822 - DNA, 27 bp, Artificial Sequence
  Description of Artificial Sequence: Synthetic oligonucleotide
ctgacctggcgtcaggatgggctatct

SEQ ID NO: 150823 - DNA, 29 bp, Artificial Sequence
  Description of Artificial Sequence: Synthetic oligonucleotide
tgacctggcgtcaggatgggctatctttg

SEQ ID NO: 150824 - DNA, 28 bp, Artificial Sequence
  Description of Artificial Sequence: Synthetic oligonucleotide
gacctggcgtcaggatgggctatctttg

SEQ ID NO: 150825 - DNA, 29 bp, Artificial Sequence
  Description of Artificial Sequence: Synthetic oligonucleotide
acctggcgtcaggatgggctatctttgag

SEQ ID NO: 150826 - DNA, 28 bp, Artificial Sequence
  Description of Artificial Sequence: Synthetic oligonucleotide
cctggcgtcaggatgggctatctttgag

SEQ ID NO: 150827 - DNA, 28 bp, Artificial Sequence
  Description of Artificial Sequence: Synthetic oligonucleotide
ctggcgtcaggatgggctatctttgagc

SEQ ID NO: 150828 - DNA, 28 bp, Artificial Sequence
  Description of Artificial Sequence: Synthetic oligonucleotide
tggcgtcaggatgggctatctttgagcc

SEQ ID NO: 150829 - DNA, 27 bp, Artificial Sequence
  Description of Artificial Sequence: Synthetic oligonucleotide
ggcgtcaggatgggctatctttgagcc

SEQ ID NO: 150830 - DNA, 28 bp, Artificial Sequence
  Description of Artificial Sequence: Synthetic oligonucleotide
gcgtcaggatgggctatctttgagccac

SEQ ID NO: 150831 - DNA, 28 bp, Artificial Sequence
  Description of Artificial Sequence: Synthetic oligonucleotide
cgtcaggatgggctatctttgagccacg

SEQ ID NO: 150832 - DNA, 29 bp, Artificial Sequence
  Description of Artificial Sequence: Synthetic oligonucleotide
gtcaggatgggctatctttgagccacgac

SEQ ID NO: 150833 - DNA, 30 bp, Artificial Sequence
  Description of Artificial Sequence: Synthetic oligonucleotide
tcaggatgggctatctttgagccacgacac

SEQ ID NO: 150834 - DNA, 29 bp, Artificial Sequence
  Description of Artificial Sequence: Synthetic oligonucleotide
caggatgggctatctttgagccacgacac

SEQ ID NO: 150835 - DNA, 29 bp, Artificial Sequence
  Description of Artificial Sequence: Synthetic oligonucleotide
aggatgggctatctttgagccacgacacc

SEQ ID NO: 150836 - DNA, 28 bp, Artificial Sequence
  Description of Artificial Sequence: Synthetic oligonucleotide
ggatgggctatctttgagccacgacacc

SEQ ID NO: 150837 - DNA, 28 bp, Artificial Sequence
  Description of Artificial Sequence: Synthetic oligonucleotide
gatgggctatctttgagccacgacaccc

SEQ ID NO: 150838 - DNA, 29 bp, Artificial Sequence
  Description of Artificial Sequence: Synthetic oligonucleotide
atgggctatctttgagccacgacacccag

SEQ ID NO: 150839 - DNA, 28 bp, Artificial Sequence
  Description of Artificial Sequence: Synthetic oligonucleotide
tgggctatctttgagccacgacacccag

SEQ ID NO: 150840 - DNA, 27 bp, Artificial Sequence
  Description of Artificial Sequence: Synthetic oligonucleotide
gggctatctttgagccacgacacccag

SEQ ID NO: 150841 - DNA, 27 bp, Artificial Sequence
  Description of Artificial Sequence: Synthetic oligonucleotide
ggctatctttgagccacgacacccagc

SEQ ID NO: 150842 - DNA, 28 bp, Artificial Sequence
  Description of Artificial Sequence: Synthetic oligonucleotide
gctatctttgagccacgacacccagcag

SEQ ID NO: 150843 - DNA, 29 bp, Artificial Sequence
  Description of Artificial Sequence: Synthetic oligonucleotide
ctatctttgagccacgacacccagcagtg

SEQ ID NO: 150844 - DNA, 29 bp, Artificial Sequence
  Description of Artificial Sequence: Synthetic oligonucleotide
gaccagaaagaaggcttgcattccctccg

SEQ ID NO: 150845 - DNA, 29 bp, Artificial Sequence
  Description of Artificial Sequence: Synthetic oligonucleotide
accagaaagaaggcttgcattccctccgg

SEQ ID NO: 150846 - DNA, 28 bp, Artificial Sequence
  Description of Artificial Sequence: Synthetic oligonucleotide
ccagaaagaaggcttgcattccctccgg

SEQ ID NO: 150847 - DNA, 28 bp, Artificial Sequence
  Description of Artificial Sequence: Synthetic oligonucleotide
cagaaagaaggcttgcattccctccggg

SEQ ID NO: 150848 - DNA, 29 bp, Artificial Sequence
  Description of Artificial Sequence: Synthetic oligonucleotide
agaaagaaggcttgcattccctccgggag

SEQ ID NO: 150849 - DNA, 28 bp, Artificial Sequence
  Description of Artificial Sequence: Synthetic oligonucleotide
gaaagaaggcttgcattccctccgggag

SEQ ID NO: 150850 - DNA, 32 bp, Artificial Sequence
  Description of Artificial Sequence: Synthetic oligonucleotide
aaagaaggcttgcattccctccgggagattag

SEQ ID NO: 150851 - DNA, 31 bp, Artificial Sequence
  Description of Artificial Sequence: Synthetic oligonucleotide
aagaaggcttgcattccctccgggagattag

SEQ ID NO: 150852 - DNA, 30 bp, Artificial Sequence
  Description of Artificial Sequence: Synthetic oligonucleotide
agaaggcttgcattccctccgggagattag

SEQ ID NO: 150853 - DNA, 29 bp, Artificial Sequence
  Description of Artificial Sequence: Synthetic oligonucleotide
gaaggcttgcattccctccgggagattag

SEQ ID NO: 150854 - DNA, 29 bp, Artificial Sequence
  Description of Artificial Sequence: Synthetic oligonucleotide
aaggcttgcattccctccgggagattagg

SEQ ID NO: 150855 - DNA, 28 bp, Artificial Sequence
  Description of Artificial Sequence: Synthetic oligonucleotide
aggcttgcattccctccgggagattagg

SEQ ID NO: 150856 - DNA, 27 bp, Artificial Sequence
  Description of Artificial Sequence: Synthetic oligonucleotide
ggcttgcattccctccgggagattagg

SEQ ID NO: 150857 - DNA, 27 bp, Artificial Sequence
  Description of Artificial Sequence: Synthetic oligonucleotide
gcttgcattccctccgggagattaggg

SEQ ID NO: 150858 - DNA, 28 bp, Artificial Sequence
  Description of Artificial Sequence: Synthetic oligonucleotide
cttgcattccctccgggagattagggtc

SEQ ID NO: 150859 - DNA, 29 bp, Artificial Sequence
  Description of Artificial Sequence: Synthetic oligonucleotide
ttgcattccctccgggagattagggtctg

SEQ ID NO: 150860 - DNA, 28 bp, Artificial Sequence
  Description of Artificial Sequence: Synthetic oligonucleotide
tgcattccctccgggagattagggtctg

SEQ ID NO: 150861 - DNA, 27 bp, Artificial Sequence
  Description of Artificial Sequence: Synthetic oligonucleotide
gcattccctccgggagattagggtctg

SEQ ID NO: 150862 - DNA, 28 bp, Artificial Sequence
  Description of Artificial Sequence: Synthetic oligonucleotide
cattccctccgggagattagggtctgtg

SEQ ID NO: 150863 - DNA, 29 bp, Artificial Sequence
  Description of Artificial Sequence: Synthetic oligonucleotide
attccctccgggagattagggtctgtgag

SEQ ID NO: 150864 - DNA, 28 bp, Artificial Sequence
  Description of Artificial Sequence: Synthetic oligonucleotide
ttccctccgggagattagggtctgtgag

SEQ ID NO: 150865 - DNA, 27 bp, Artificial Sequence
  Description of Artificial Sequence: Synthetic oligonucleotide
tccctccgggagattagggtctgtgag

SEQ ID NO: 150866 - DNA, 27 bp, Artificial Sequence
  Description of Artificial Sequence: Synthetic oligonucleotide
ccctccgggagattagggtctgtgaga

SEQ ID NO: 150867 - DNA, 28 bp, Artificial Sequence
  Description of Artificial Sequence: Synthetic oligonucleotide
cctccgggagattagggtctgtgagatc

SEQ ID NO: 150868 - DNA, 28 bp, Artificial Sequence
  Description of Artificial Sequence: Synthetic oligonucleotide
ctccgggagattagggtctgtgagatcc

SEQ ID NO: 150869 - DNA, 30 bp, Artificial Sequence
  Description of Artificial Sequence: Synthetic oligonucleotide
tccgggagattagggtctgtgagatccatg

SEQ ID NO: 150870 - DNA, 29 bp, Artificial Sequence
  Description of Artificial Sequence: Synthetic oligonucleotide
ccgggagattagggtctgtgagatccatg

SEQ ID NO: 150871 - DNA, 31 bp, Artificial Sequence
  Description of Artificial Sequence: Synthetic oligonucleotide
cgggagattagggtctgtgagatccatgaag

SEQ ID NO: 150872 - DNA, 32 bp, Artificial Sequence
  Description of Artificial Sequence: Synthetic oligonucleotide
gggagattagggtctgtgagatccatgaagac

SEQ ID NO: 150873 - DNA, 30 bp, Artificial Sequence
  Description of Artificial Sequence: Synthetic oligonucleotide
tccagagctcagaccttggccatgaacatc

SEQ ID NO: 150874 - DNA, 29 bp, Artificial Sequence
  Description of Artificial Sequence: Synthetic oligonucleotide
ccagagctcagaccttggccatgaacatc

SEQ ID NO: 150875 - DNA, 30 bp, Artificial Sequence
  Description of Artificial Sequence: Synthetic oligonucleotide
cagagctcagaccttggccatgaacatcag

SEQ ID NO: 150876 - DNA, 30 bp, Artificial Sequence
  Description of Artificial Sequence: Synthetic oligonucleotide
agagctcagaccttggccatgaacatcagg

SEQ ID NO: 150877 - DNA, 29 bp, Artificial Sequence
  Description of Artificial Sequence: Synthetic oligonucleotide
gagctcagaccttggccatgaacatcagg

SEQ ID NO: 150878 - DNA, 34 bp, Artificial Sequence
  Description of Artificial Sequence: Synthetic oligonucleotide
agctcagaccttggccatgaacatcaggaatttc

SEQ ID NO: 150879 - DNA, 33 bp, Artificial Sequence
  Description of Artificial Sequence: Synthetic oligonucleotide
gctcagaccttggccatgaacatcaggaatttc

SEQ ID NO: 150880 - DNA, 35 bp, Artificial Sequence
  Description of Artificial Sequence: Synthetic oligonucleotide
ctcagaccttggccatgaacatcaggaatttcttg

SEQ ID NO: 150881 - DNA, 37 bp, Artificial Sequence
  Description of Artificial Sequence: Synthetic oligonucleotide
tcagaccttggccatgaacatcaggaatttcttgaag

SEQ ID NO: 150882 - DNA, 36 bp, Artificial Sequence
  Description of Artificial Sequence: Synthetic oligonucleotide
cagaccttggccatgaacatcaggaatttcttgaag

SEQ ID NO: 150883 - DNA, 36 bp, Artificial Sequence
  Description of Artificial Sequence: Synthetic oligonucleotide
agaccttggccatgaacatcaggaatttcttgaagg

SEQ ID NO: 150884 - DNA, 35 bp, Artificial Sequence
  Description of Artificial Sequence: Synthetic oligonucleotide
gaccttggccatgaacatcaggaatttcttgaagg

SEQ ID NO: 150885 - DNA, 37 bp, Artificial Sequence
  Description of Artificial Sequence: Synthetic oligonucleotide
accttggccatgaacatcaggaatttcttgaaggaag

SEQ ID NO: 150886 - DNA, 36 bp, Artificial Sequence
  Description of Artificial Sequence: Synthetic oligonucleotide
ccttggccatgaacatcaggaatttcttgaaggaag

SEQ ID NO: 150887 - DNA, 38 bp, Artificial Sequence
  Description of Artificial Sequence: Synthetic oligonucleotide
cttggccatgaacatcaggaatttcttgaaggaagatg

SEQ ID NO: 150888 - DNA, 38 bp, Artificial Sequence
  Description of Artificial Sequence: Synthetic oligonucleotide
ttggccatgaacatcaggaatttcttgaaggaagatgc

SEQ ID NO: 150889 - DNA, 37 bp, Artificial Sequence
  Description of Artificial Sequence: Synthetic oligonucleotide
tggccatgaacatcaggaatttcttgaaggaagatgc

SEQ ID NO: 150890 - DNA, 36 bp, Artificial Sequence
  Description of Artificial Sequence: Synthetic oligonucleotide
ggccatgaacatcaggaatttcttgaaggaagatgc

SEQ ID NO: 150891 - DNA, 36 bp, Artificial Sequence
  Description of Artificial Sequence: Synthetic oligonucleotide
gccatgaacatcaggaatttcttgaaggaagatgcc

SEQ ID NO: 150892 - DNA, 38 bp, Artificial Sequence
  Description of Artificial Sequence: Synthetic oligonucleotide
ccatgaacatcaggaatttcttgaaggaagatgccatg

SEQ ID NO: 150893 - DNA, 40 bp, Artificial Sequence
  Description of Artificial Sequence: Synthetic oligonucleotide
catgaacatcaggaatttcttgaaggaagatgccatgaag

SEQ ID NO: 150894 - DNA, 41 bp, Artificial Sequence
  Description of Artificial Sequence: Synthetic oligonucleotide
atgaacatcaggaatttcttgaaggaagatgccatgaagac

SEQ ID NO: 150895 - DNA, 40 bp, Artificial Sequence
  Description of Artificial Sequence: Synthetic oligonucleotide
tgaacatcaggaatttcttgaaggaagatgccatgaagac

SEQ ID NO: 150896 - DNA, 39 bp, Artificial Sequence
  Description of Artificial Sequence: Synthetic oligonucleotide
gaacatcaggaatttcttgaaggaagatgccatgaagac

SEQ ID NO: 150897 - DNA, 39 bp, Artificial Sequence
  Description of Artificial Sequence: Synthetic oligonucleotide
aacatcaggaatttcttgaaggaagatgccatgaagacc

SEQ ID NO: 150898 - DNA, 38 bp, Artificial Sequence
  Description of Artificial Sequence: Synthetic oligonucleotide
acatcaggaatttcttgaaggaagatgccatgaagacc

SEQ ID NO: 150899 - DNA, 37 bp, Artificial Sequence
  Description of Artificial Sequence: Synthetic oligonucleotide
catcaggaatttcttgaaggaagatgccatgaagacc

SEQ ID NO: 150900 - DNA, 39 bp, Artificial Sequence
  Description of Artificial Sequence: Synthetic oligonucleotide
atcaggaatttcttgaaggaagatgccatgaagaccaag

SEQ ID NO: 150901 - DNA, 33 bp, Artificial Sequence
  Description of Artificial Sequence: Synthetic oligonucleotide
cctgcaggaactacggcgatatctaaaatccag

SEQ ID NO: 150902 - DNA, 33 bp, Artificial Sequence
  Description of Artificial Sequence: Synthetic oligonucleotide
ctgcaggaactacggcgatatctaaaatccagc

SEQ ID NO: 150903 - DNA, 33 bp, Artificial Sequence
  Description of Artificial Sequence: Synthetic oligonucleotide
tgcaggaactacggcgatatctaaaatccagcg

SEQ ID NO: 150904 - DNA, 32 bp, Artificial Sequence
  Description of Artificial Sequence: Synthetic oligonucleotide
gcaggaactacggcgatatctaaaatccagcg

SEQ ID NO: 150905 - DNA, 34 bp, Artificial Sequence
  Description of Artificial Sequence: Synthetic oligonucleotide
caggaactacggcgatatctaaaatccagcgtag

SEQ ID NO: 150906 - DNA, 35 bp, Artificial Sequence
  Description of Artificial Sequence: Synthetic oligonucleotide
aggaactacggcgatatctaaaatccagcgtagtc

SEQ ID NO: 150907 - DNA, 34 bp, Artificial Sequence
  Description of Artificial Sequence: Synthetic oligonucleotide
ggaactacggcgatatctaaaatccagcgtagtc

SEQ ID NO: 150908 - DNA, 34 bp, Artificial Sequence
  Description of Artificial Sequence: Synthetic oligonucleotide
gaactacggcgatatctaaaatccagcgtagtcc

SEQ ID NO: 150909 - DNA, 35 bp, Artificial Sequence
  Description of Artificial Sequence: Synthetic oligonucleotide
aactacggcgatatctaaaatccagcgtagtcctg

SEQ ID NO: 150910 - DNA, 34 bp, Artificial Sequence
  Description of Artificial Sequence: Synthetic oligonucleotide
actacggcgatatctaaaatccagcgtagtcctg

SEQ ID NO: 150911 - DNA, 33 bp, Artificial Sequence
  Description of Artificial Sequence: Synthetic oligonucleotide
ctacggcgatatctaaaatccagcgtagtcctg

SEQ ID NO: 150912 - DNA, 34 bp, Artificial Sequence
  Description of Artificial Sequence: Synthetic oligonucleotide
tacggcgatatctaaaatccagcgtagtcctgag

SEQ ID NO: 150913 - DNA, 33 bp, Artificial Sequence
  Description of Artificial Sequence: Synthetic oligonucleotide
acggcgatatctaaaatccagcgtagtcctgag

SEQ ID NO: 150914 - DNA, 32 bp, Artificial Sequence
  Description of Artificial Sequence: Synthetic oligonucleotide
cggcgatatctaaaatccagcgtagtcctgag

SEQ ID NO: 150915 - DNA, 32 bp, Artificial Sequence
  Description of Artificial Sequence: Synthetic oligonucleotide
ggcgatatctaaaatccagcgtagtcctgagg

SEQ ID NO: 150916 - DNA, 33 bp, Artificial Sequence
  Description of Artificial Sequence: Synthetic oligonucleotide
gcgatatctaaaatccagcgtagtcctgaggag

SEQ ID NO: 150917 - DNA, 35 bp, Artificial Sequence
  Description of Artificial Sequence: Synthetic oligonucleotide
cgatatctaaaatccagcgtagtcctgaggagaag

SEQ ID NO: 150918 - DNA, 36 bp, Artificial Sequence
  Description of Artificial Sequence: Synthetic oligonucleotide
gatatctaaaatccagcgtagtcctgaggagaagag

SEQ ID NO: 150919 - DNA, 37 bp, Artificial Sequence
  Description of Artificial Sequence: Synthetic oligonucleotide
atatctaaaatccagcgtagtcctgaggagaagagtg

SEQ ID NO: 150920 - DNA, 36 bp, Artificial Sequence
  Description of Artificial Sequence: Synthetic oligonucleotide
tatctaaaatccagcgtagtcctgaggagaagagtg

SEQ ID NO: 150921 - DNA, 35 bp, Artificial Sequence
  Description of Artificial Sequence: Synthetic oligonucleotide
atctaaaatccagcgtagtcctgaggagaagagtg

SEQ ID NO: 150922 - DNA, 34 bp, Artificial Sequence
  Description of Artificial Sequence: Synthetic oligonucleotide
tctaaaatccagcgtagtcctgaggagaagagtg

SEQ ID NO: 150923 - DNA, 33 bp, Artificial Sequence
  Description of Artificial Sequence: Synthetic oligonucleotide
ctaaaatccagcgtagtcctgaggagaagagtg

SEQ ID NO: 150924 - DNA, 33 bp, Artificial Sequence
  Description of Artificial Sequence: Synthetic oligonucleotide
taaaatccagcgtagtcctgaggagaagagtgc

SEQ ID NO: 150925 - DNA, 32 bp, Artificial Sequence
  Description of Artificial Sequence: Synthetic oligonucleotide
aaaatccagcgtagtcctgaggagaagagtgc

SEQ ID NO: 150926 - DNA, 31 bp, Artificial Sequence
  Description of Artificial Sequence: Synthetic oligonucleotide
aaatccagcgtagtcctgaggagaagagtgc

SEQ ID NO: 150927 - DNA, 29 bp, Artificial Sequence
  Description of Artificial Sequence: Synthetic oligonucleotide
gagctcttcctctcccaaaacctggagtc

SEQ ID NO: 150928 - DNA, 30 bp, Artificial Sequence
  Description of Artificial Sequence: Synthetic oligonucleotide
agctcttcctctcccaaaacctggagtctg

SEQ ID NO: 150929 - DNA, 29 bp, Artificial Sequence
  Description of Artificial Sequence: Synthetic oligonucleotide
gctcttcctctcccaaaacctggagtctg

SEQ ID NO: 150930 - DNA, 30 bp, Artificial Sequence
  Description of Artificial Sequence: Synthetic oligonucleotide
ctcttcctctcccaaaacctggagtctgag

SEQ ID NO: 150931 - DNA, 30 bp, Artificial Sequence
  Description of Artificial Sequence: Synthetic oligonucleotide
tcttcctctcccaaaacctggagtctgagg

SEQ ID NO: 150932 - DNA, 29 bp, Artificial Sequence
  Description of Artificial Sequence: Synthetic oligonucleotide
cttcctctcccaaaacctggagtctgagg

SEQ ID NO: 150933 - DNA, 32 bp, Artificial Sequence
  Description of Artificial Sequence: Synthetic oligonucleotide
ttcctctcccaaaacctggagtctgaggaatg

SEQ ID NO: 150934 - DNA, 31 bp, Artificial Sequence
  Description of Artificial Sequence: Synthetic oligonucleotide
tcctctcccaaaacctggagtctgaggaatg

SEQ ID NO: 150935 - DNA, 30 bp, Artificial Sequence
  Description of Artificial Sequence: Synthetic oligonucleotide
cctctcccaaaacctggagtctgaggaatg

SEQ ID NO: 150936 - DNA, 30 bp, Artificial Sequence
  Description of Artificial Sequence: Synthetic oligonucleotide
ctctcccaaaacctggagtctgaggaatgg

SEQ ID NO: 150937 - DNA, 31 bp, Artificial Sequence
  Description of Artificial Sequence: Synthetic oligonucleotide
tctcccaaaacctggagtctgaggaatggac

SEQ ID NO: 150938 - DNA, 30 bp, Artificial Sequence
  Description of Artificial Sequence: Synthetic oligonucleotide
ctcccaaaacctggagtctgaggaatggac

SEQ ID NO: 150939 - DNA, 31 bp, Artificial Sequence
  Description of Artificial Sequence: Synthetic oligonucleotide
tcccaaaacctggagtctgaggaatggacag

SEQ ID NO: 150940 - DNA, 30 bp, Artificial Sequence
  Description of Artificial Sequence: Synthetic oligonucleotide
cccaaaacctggagtctgaggaatggacag

SEQ ID NO: 150941 - DNA, 31 bp, Artificial Sequence
  Description of Artificial Sequence: Synthetic oligonucleotide
ccaaaacctggagtctgaggaatggacagtg

SEQ ID NO: 150942 - DNA, 31 bp, Artificial Sequence
  Description of Artificial Sequence: Synthetic oligonucleotide
caaaacctggagtctgaggaatggacagtgc

SEQ ID NO: 150943 - DNA, 31 bp, Artificial Sequence
  Description of Artificial Sequence: Synthetic oligonucleotide
aaaacctggagtctgaggaatggacagtgcc

SEQ ID NO: 150944 - DNA, 30 bp, Artificial Sequence
  Description of Artificial Sequence: Synthetic oligonucleotide
aaacctggagtctgaggaatggacagtgcc

SEQ ID NO: 150945 - DNA, 29 bp, Artificial Sequence
  Description of Artificial Sequence: Synthetic oligonucleotide
aacctggagtctgaggaatggacagtgcc

SEQ ID NO: 150946 - DNA, 28 bp, Artificial Sequence
  Description of Artificial Sequence: Synthetic oligonucleotide
acctggagtctgaggaatggacagtgcc

SEQ ID NO: 150947 - DNA, 27 bp, Artificial Sequence
  Description of Artificial Sequence: Synthetic oligonucleotide
cctggagtctgaggaatggacagtgcc

SEQ ID NO: 150948 - DNA, 27 bp, Artificial Sequence
  Description of Artificial Sequence: Synthetic oligonucleotide
ctggagtctgaggaatggacagtgccc

SEQ ID NO: 150949 - DNA, 27 bp, Artificial Sequence
  Description of Artificial Sequence: Synthetic oligonucleotide
tggagtctgaggaatggacagtgcccc

SEQ ID NO: 150950 - DNA, 27 bp, Artificial Sequence
  Description of Artificial Sequence: Synthetic oligonucleotide
ggagtctgaggaatggacagtgcccca

SEQ ID NO: 150951 - DNA, 27 bp, Artificial Sequence
  Description of Artificial Sequence: Synthetic oligonucleotide
gagtctgaggaatggacagtgccccag

SEQ ID NO: 150952 - DNA, 28 bp, Artificial Sequence
  Description of Artificial Sequence: Synthetic oligonucleotide
agtctgaggaatggacagtgccccagtc

SEQ ID NO: 150953 - DNA, 27 bp, Artificial Sequence
  Description of Artificial Sequence: Synthetic oligonucleotide
gtctgaggaatggacagtgccccagtc

SEQ ID NO: 150954 - DNA, 27 bp, Artificial Sequence
  Description of Artificial Sequence: Synthetic oligonucleotide
tctgaggaatggacagtgccccagtcc

SEQ ID NO: 150955 - DNA, 33 bp, Artificial Sequence
  Description of Artificial Sequence: Synthetic oligonucleotide
gtctgtgagatccatgaagacaacagcaccaag

SEQ ID NO: 150956 - DNA, 34 bp, Artificial Sequence
  Description of Artificial Sequence: Synthetic oligonucleotide
tctgtgagatccatgaagacaacagcaccaagag

SEQ ID NO: 150957 - DNA, 33 bp, Artificial Sequence
  Description of Artificial Sequence: Synthetic oligonucleotide
ctgtgagatccatgaagacaacagcaccaagag

SEQ ID NO: 150958 - DNA, 33 bp, Artificial Sequence
  Description of Artificial Sequence: Synthetic oligonucleotide
tgtgagatccatgaagacaacagcaccaagagc

SEQ ID NO: 150959 - DNA, 32 bp, Artificial Sequence
  Description of Artificial Sequence: Synthetic oligonucleotide
gtgagatccatgaagacaacagcaccaagagc

SEQ ID NO: 150960 - DNA, 33 bp, Artificial Sequence
  Description of Artificial Sequence: Synthetic oligonucleotide
tgagatccatgaagacaacagcaccaagagctc

SEQ ID NO: 150961 - DNA, 32 bp, Artificial Sequence
  Description of Artificial Sequence: Synthetic oligonucleotide
gagatccatgaagacaacagcaccaagagctc

SEQ ID NO: 150962 - DNA, 32 bp, Artificial Sequence
  Description of Artificial Sequence: Synthetic oligonucleotide
agatccatgaagacaacagcaccaagagctcc

SEQ ID NO: 150963 - DNA, 31 bp, Artificial Sequence
  Description of Artificial Sequence: Synthetic oligonucleotide
gatccatgaagacaacagcaccaagagctcc

SEQ ID NO: 150964 - DNA, 31 bp, Artificial Sequence
  Description of Artificial Sequence: Synthetic oligonucleotide
atccatgaagacaacagcaccaagagctccc

SEQ ID NO: 150965 - DNA, 30 bp, Artificial Sequence
  Description of Artificial Sequence: Synthetic oligonucleotide
tccatgaagacaacagcaccaagagctccc

SEQ ID NO: 150966 - DNA, 29 bp, Artificial Sequence
  Description of Artificial Sequence: Synthetic oligonucleotide
ccatgaagacaacagcaccaagagctccc

SEQ ID NO: 150967 - DNA, 30 bp, Artificial Sequence
  Description of Artificial Sequence: Synthetic oligonucleotide
catgaagacaacagcaccaagagctcccag

SEQ ID NO: 150968 - DNA, 30 bp, Artificial Sequence
  Description of Artificial Sequence: Synthetic oligonucleotide
atgaagacaacagcaccaagagctcccagc

SEQ ID NO: 150969 - DNA, 29 bp, Artificial Sequence
  Description of Artificial Sequence: Synthetic oligonucleotide
tgaagacaacagcaccaagagctcccagc

SEQ ID NO: 150970 - DNA, 28 bp, Artificial Sequence
  Description of Artificial Sequence: Synthetic oligonucleotide
gaagacaacagcaccaagagctcccagc

SEQ ID NO: 150971 - DNA, 32 bp, Artificial Sequence
  Description of Artificial Sequence: Synthetic oligonucleotide
aagacaacagcaccaagagctcccagcatttc

SEQ ID NO: 150972 - DNA, 31 bp, Artificial Sequence
  Description of Artificial Sequence: Synthetic oligonucleotide
agacaacagcaccaagagctcccagcatttc

SEQ ID NO: 150973 - DNA, 30 bp, Artificial Sequence
  Description of Artificial Sequence: Synthetic oligonucleotide
gacaacagcaccaagagctcccagcatttc

SEQ ID NO: 150974 - DNA, 32 bp, Artificial Sequence
  Description of Artificial Sequence: Synthetic oligonucleotide
acaacagcaccaagagctcccagcatttctac

SEQ ID NO: 150975 - DNA, 31 bp, Artificial Sequence
  Description of Artificial Sequence: Synthetic oligonucleotide
caacagcaccaagagctcccagcatttctac

SEQ ID NO: 150976 - DNA, 33 bp, Artificial Sequence
  Description of Artificial Sequence: Synthetic oligonucleotide
aacagcaccaagagctcccagcatttctactac

SEQ ID NO: 150977 - DNA, 32 bp, Artificial Sequence
  Description of Artificial Sequence: Synthetic oligonucleotide
acagcaccaagagctcccagcatttctactac

SEQ ID NO: 150978 - DNA, 31 bp, Artificial Sequence
  Description of Artificial Sequence: Synthetic oligonucleotide
cagcaccaagagctcccagcatttctactac

SEQ ID NO: 150979 - DNA, 31 bp, Artificial Sequence
  Description of Artificial Sequence: Synthetic oligonucleotide
agcaccaagagctcccagcatttctactacg

SEQ ID NO: 150980 - DNA, 30 bp, Artificial Sequence
  Description of Artificial Sequence: Synthetic oligonucleotide
gcaccaagagctcccagcatttctactacg

SEQ ID NO: 150981 - DNA, 32 bp, Artificial Sequence
  Description of Artificial Sequence: Synthetic oligonucleotide
caccaagagctcccagcatttctactacgatg

SEQ ID NO: 150982 - DNA, 32 bp, Artificial Sequence
  Description of Artificial Sequence: Synthetic oligonucleotide
accaagagctcccagcatttctactacgatgg

SEQ ID NO: 150983 - DNA, 31 bp, Artificial Sequence
  Description of Artificial Sequence: Synthetic oligonucleotide
ccaagagctcccagcatttctactacgatgg

SEQ ID NO: 150984 - DNA, 31 bp, Artificial Sequence
  Description of Artificial Sequence: Synthetic oligonucleotide
caagagctcccagcatttctactacgatggg

SEQ ID NO: 150985 - DNA, 31 bp, Artificial Sequence
  Description of Artificial Sequence: Synthetic oligonucleotide
aagagctcccagcatttctactacgatgggg

SEQ ID NO: 150986 - DNA, 30 bp, Artificial Sequence
  Description of Artificial Sequence: Synthetic oligonucleotide
agagctcccagcatttctactacgatgggg

SEQ ID NO: 150987 - DNA, 27 bp, Artificial Sequence
  Description of Artificial Sequence: Synthetic oligonucleotide
tgtgcagtcagggtttctcgctgaggg

SEQ ID NO: 150988 - DNA, 27 bp, Artificial Sequence
  Description of Artificial Sequence: Synthetic oligonucleotide
gtgcagtcagggtttctcgctgaggga

SEQ ID NO: 150989 - DNA, 27 bp, Artificial Sequence
  Description of Artificial Sequence: Synthetic oligonucleotide
tgcagtcagggtttctcgctgagggac

SEQ ID NO: 150990 - DNA, 27 bp, Artificial Sequence
  Description of Artificial Sequence: Synthetic oligonucleotide
gcagtcagggtttctcgctgagggaca

SEQ ID NO: 150991 - DNA, 28 bp, Artificial Sequence
  Description of Artificial Sequence: Synthetic oligonucleotide
cagtcagggtttctcgctgagggacatc

SEQ ID NO: 150992 - DNA, 29 bp, Artificial Sequence
  Description of Artificial Sequence: Synthetic oligonucleotide
agtcagggtttctcgctgagggacatctg

SEQ ID NO: 150993 - DNA, 28 bp, Artificial Sequence
  Description of Artificial Sequence: Synthetic oligonucleotide
gtcagggtttctcgctgagggacatctg

SEQ ID NO: 150994 - DNA, 28 bp, Artificial Sequence
  Description of Artificial Sequence: Synthetic oligonucleotide
tcagggtttctcgctgagggacatctgg

SEQ ID NO: 150995 - DNA, 27 bp, Artificial Sequence
  Description of Artificial Sequence: Synthetic oligonucleotide
cagggtttctcgctgagggacatctgg

SEQ ID NO: 150996 - DNA, 29 bp, Artificial Sequence
  Description of Artificial Sequence: Synthetic oligonucleotide
agggtttctcgctgagggacatctggatg

SEQ ID NO: 150997 - DNA, 28 bp, Artificial Sequence
  Description of Artificial Sequence: Synthetic oligonucleotide
gggtttctcgctgagggacatctggatg

SEQ ID NO: 150998 - DNA, 28 bp, Artificial Sequence
  Description of Artificial Sequence: Synthetic oligonucleotide
ggtttctcgctgagggacatctggatgg

SEQ ID NO: 150999 - DNA, 29 bp, Artificial Sequence
  Description of Artificial Sequence: Synthetic oligonucleotide
gtttctcgctgagggacatctggatggtc

SEQ ID NO: 151000 - DNA, 30 bp, Artificial Sequence
  Description of Artificial Sequence: Synthetic oligonucleotide
tttctcgctgagggacatctggatggtcag

SEQ ID NO: 151001 - DNA, 29 bp, Artificial Sequence
  Description of Artificial Sequence: Synthetic oligonucleotide
ttctcgctgagggacatctggatggtcag

SEQ ID NO: 151002 - DNA, 28 bp, Artificial Sequence
  Description of Artificial Sequence: Synthetic oligonucleotide
tctcgctgagggacatctggatggtcag

SEQ ID NO: 151003 - DNA, 27 bp, Artificial Sequence
  Description of Artificial Sequence: Synthetic oligonucleotide
ctcgctgagggacatctggatggtcag

SEQ ID NO: 151004 - DNA, 27 bp, Artificial Sequence
  Description of Artificial Sequence: Synthetic oligonucleotide
tcgctgagggacatctggatggtcagc

SEQ ID NO: 151005 - DNA, 26 bp, Artificial Sequence
  Description of Artificial Sequence: Synthetic oligonucleotide
cgctgagggacatctggatggtcagc

SEQ ID NO: 151006 - DNA, 26 bp, Artificial Sequence
  Description of Artificial Sequence: Synthetic oligonucleotide
gctgagggacatctggatggtcagcc

SEQ ID NO: 151007 - DNA, 27 bp, Artificial Sequence
  Description of Artificial Sequence: Synthetic oligonucleotide
ctgagggacatctggatggtcagccct

SEQ ID NO: 151008 - DNA, 28 bp, Artificial Sequence
  Description of Artificial Sequence: Synthetic oligonucleotide
tgagggacatctggatggtcagcccttc

SEQ ID NO: 151009 - DNA, 27 bp, Artificial Sequence
  Description of Artificial Sequence: Synthetic oligonucleotide
gagggacatctggatggtcagcccttc

SEQ ID NO: 151010 - DNA, 27 bp, Artificial Sequence
  Description of Artificial Sequence: Synthetic oligonucleotide
agggacatctggatggtcagcccttcc

SEQ ID NO: 151011 - DNA, 27 bp, Artificial Sequence
  Description of Artificial Sequence: Synthetic oligonucleotide
gggacatctggatggtcagcccttcct

SEQ ID NO: 151012 - DNA, 27 bp, Artificial Sequence
  Description of Artificial Sequence: Synthetic oligonucleotide
ggacatctggatggtcagcccttcctg

SEQ ID NO: 151013 - DNA, 27 bp, Artificial Sequence
  Description of Artificial Sequence: Synthetic oligonucleotide
gacatctggatggtcagcccttcctgc

SEQ ID NO: 151014 - DNA, 38 bp, Artificial Sequence
  Description of Artificial Sequence: Synthetic oligonucleotide
aatttcttgaaggaagatgccatgaagaccaagacacg

SEQ ID NO: 151015 - DNA, 37 bp, Artificial Sequence
  Description of Artificial Sequence: Synthetic oligonucleotide
atttcttgaaggaagatgccatgaagaccaagacacg

SEQ ID NO: 151016 - DNA, 36 bp, Artificial Sequence
  Description of Artificial Sequence: Synthetic oligonucleotide
tttcttgaaggaagatgccatgaagaccaagacacg

SEQ ID NO: 151017 - DNA, 35 bp, Artificial Sequence
  Description of Artificial Sequence: Synthetic oligonucleotide
ttcttgaaggaagatgccatgaagaccaagacacg

SEQ ID NO: 151018 - DNA, 34 bp, Artificial Sequence
  Description of Artificial Sequence: Synthetic oligonucleotide
tcttgaaggaagatgccatgaagaccaagacacg

SEQ ID NO: 151019 - DNA, 33 bp, Artificial Sequence
  Description of Artificial Sequence: Synthetic oligonucleotide
cttgaaggaagatgccatgaagaccaagacacg

SEQ ID NO: 151020 - DNA, 33 bp, Artificial Sequence
  Description of Artificial Sequence: Synthetic oligonucleotide
ttgaaggaagatgccatgaagaccaagacacgc

SEQ ID NO: 151021 - DNA, 32 bp, Artificial Sequence
  Description of Artificial Sequence: Synthetic oligonucleotide
tgaaggaagatgccatgaagaccaagacacgc

SEQ ID NO: 151022 - DNA, 31 bp, Artificial Sequence
  Description of Artificial Sequence: Synthetic oligonucleotide
gaaggaagatgccatgaagaccaagacacgc

SEQ ID NO: 151023 - DNA, 34 bp, Artificial Sequence
  Description of Artificial Sequence: Synthetic oligonucleotide
aaggaagatgccatgaagaccaagacacgctatc

SEQ ID NO: 151024 - DNA, 33 bp, Artificial Sequence
  Description of Artificial Sequence: Synthetic oligonucleotide
aggaagatgccatgaagaccaagacacgctatc

SEQ ID NO: 151025 - DNA, 32 bp, Artificial Sequence
  Description of Artificial Sequence: Synthetic oligonucleotide
ggaagatgccatgaagaccaagacacgctatc

SEQ ID NO: 151026 - DNA, 33 bp, Artificial Sequence
  Description of Artificial Sequence: Synthetic oligonucleotide
gaagatgccatgaagaccaagacacgctatcac

SEQ ID NO: 151027 - DNA, 33 bp, Artificial Sequence
  Description of Artificial Sequence: Synthetic oligonucleotide
aagatgccatgaagaccaagacacgctatcacg

SEQ ID NO: 151028 - DNA, 32 bp, Artificial Sequence
  Description of Artificial Sequence: Synthetic oligonucleotide
agatgccatgaagaccaagacacgctatcacg

SEQ ID NO: 151029 - DNA, 31 bp, Artificial Sequence
  Description of Artificial Sequence: Synthetic oligonucleotide
gatgccatgaagaccaagacacgctatcacg

SEQ ID NO: 151030 - DNA, 31 bp, Artificial Sequence
  Description of Artificial Sequence: Synthetic oligonucleotide
atgccatgaagaccaagacacgctatcacgc

SEQ ID NO: 151031 - DNA, 30 bp, Artificial Sequence
  Description of Artificial Sequence: Synthetic oligonucleotide
tgccatgaagaccaagacacgctatcacgc

SEQ ID NO: 151032 - DNA, 29 bp, Artificial Sequence
  Description of Artificial Sequence: Synthetic oligonucleotide
gccatgaagaccaagacacgctatcacgc

SEQ ID NO: 151033 - DNA, 32 bp, Artificial Sequence
  Description of Artificial Sequence: Synthetic oligonucleotide
ccatgaagaccaagacacgctatcacgctatg

SEQ ID NO: 151034 - DNA, 32 bp, Artificial Sequence
  Description of Artificial Sequence: Synthetic oligonucleotide
catgaagaccaagacacgctatcacgctatgc

SEQ ID NO: 151035 - DNA, 34 bp, Artificial Sequence
  Description of Artificial Sequence: Synthetic oligonucleotide
atgaagaccaagacacgctatcacgctatgcatg

SEQ ID NO: 151036 - DNA, 33 bp, Artificial Sequence
  Description of Artificial Sequence: Synthetic oligonucleotide
tgaagaccaagacacgctatcacgctatgcatg

SEQ ID NO: 151037 - DNA, 32 bp, Artificial Sequence
  Description of Artificial Sequence: Synthetic oligonucleotide
gaagaccaagacacgctatcacgctatgcatg

SEQ ID NO: 151038 - DNA, 32 bp, Artificial Sequence
  Description of Artificial Sequence: Synthetic oligonucleotide
aagaccaagacacgctatcacgctatgcatgc

SEQ ID NO: 151039 - DNA, 31 bp, Artificial Sequence
  Description of Artificial Sequence: Synthetic oligonucleotide
agaccaagacacgctatcacgctatgcatgc

SEQ ID NO: 151040 - DNA, 30 bp, Artificial Sequence
  Description of Artificial Sequence: Synthetic oligonucleotide
gaccaagacacgctatcacgctatgcatgc

SEQ ID NO: 151041 - DNA, 31 bp, Artificial Sequence
  Description of Artificial Sequence: Synthetic oligonucleotide
accaagacacgctatcacgctatgcatgcag

SEQ ID NO: 151042 - DNA, 30 bp, Artificial Sequence
  Description of Artificial Sequence: Synthetic oligonucleotide
ccaagacacgctatcacgctatgcatgcag

SEQ ID NO: 151043 - DNA, 31 bp, Artificial Sequence
  Description of Artificial Sequence: Synthetic oligonucleotide
caagacacgctatcacgctatgcatgcagac

SEQ ID NO: 151044 - DNA, 32 bp, Artificial Sequence
  Description of Artificial Sequence: Synthetic oligonucleotide
aagacacgctatcacgctatgcatgcagactg

SEQ ID NO: 151045 - DNA, 31 bp, Artificial Sequence
  Description of Artificial Sequence: Synthetic oligonucleotide
agacacgctatcacgctatgcatgcagactg

SEQ ID NO: 151046 - DNA, 30 bp, Artificial Sequence
  Description of Artificial Sequence: Synthetic oligonucleotide
gacacgctatcacgctatgcatgcagactg

SEQ ID NO: 151047 - DNA, 30 bp, Artificial Sequence
  Description of Artificial Sequence: Synthetic oligonucleotide
acacgctatcacgctatgcatgcagactgc

SEQ ID NO: 151048 - DNA, 29 bp, Artificial Sequence
  Description of Artificial Sequence: Synthetic oligonucleotide
cacgctatcacgctatgcatgcagactgc

SEQ ID NO: 151049 - DNA, 29 bp, Artificial Sequence
  Description of Artificial Sequence: Synthetic oligonucleotide
acgctatcacgctatgcatgcagactgcc

SEQ ID NO: 151050 - DNA, 28 bp, Artificial Sequence
  Description of Artificial Sequence: Synthetic oligonucleotide
cgctatcacgctatgcatgcagactgcc

SEQ ID NO: 151051 - DNA, 29 bp, Artificial Sequence
  Description of Artificial Sequence: Synthetic oligonucleotide
gctatcacgctatgcatgcagactgcctg

SEQ ID NO: 151052 - DNA, 31 bp, Artificial Sequence
  Description of Artificial Sequence: Synthetic oligonucleotide
caggatttgccaaggagaggagcagagtttc

SEQ ID NO: 151053 - DNA, 32 bp, Artificial Sequence
  Description of Artificial Sequence: Synthetic oligonucleotide
aggatttgccaaggagaggagcagagtttcac

SEQ ID NO: 151054 - DNA, 31 bp, Artificial Sequence
  Description of Artificial Sequence: Synthetic oligonucleotide
ggatttgccaaggagaggagcagagtttcac

SEQ ID NO: 151055 - DNA, 31 bp, Artificial Sequence
  Description of Artificial Sequence: Synthetic oligonucleotide
gatttgccaaggagaggagcagagtttcacc

SEQ ID NO: 151056 - DNA, 32 bp, Artificial Sequence
  Description of Artificial Sequence: Synthetic oligonucleotide
atttgccaaggagaggagcagagtttcacctg

SEQ ID NO: 151057 - DNA, 31 bp, Artificial Sequence
  Description of Artificial Sequence: Synthetic oligonucleotide
tttgccaaggagaggagcagagtttcacctg

SEQ ID NO: 151058 - DNA, 30 bp, Artificial Sequence
  Description of Artificial Sequence: Synthetic oligonucleotide
ttgccaaggagaggagcagagtttcacctg

SEQ ID NO: 151059 - DNA, 29 bp, Artificial Sequence
  Description of Artificial Sequence: Synthetic oligonucleotide
tgccaaggagaggagcagagtttcacctg

SEQ ID NO: 151060 - DNA, 28 bp, Artificial Sequence
  Description of Artificial Sequence: Synthetic oligonucleotide
gccaaggagaggagcagagtttcacctg

SEQ ID NO: 151061 - DNA, 28 bp, Artificial Sequence
  Description of Artificial Sequence: Synthetic oligonucleotide
ccaaggagaggagcagagtttcacctgc

SEQ ID NO: 151062 - DNA, 30 bp, Artificial Sequence
  Description of Artificial Sequence: Synthetic oligonucleotide
caaggagaggagcagagtttcacctgctac

SEQ ID NO: 151063 - DNA, 32 bp, Artificial Sequence
  Description of Artificial Sequence: Synthetic oligonucleotide
aaggagaggagcagagtttcacctgctacatg

SEQ ID NO: 151064 - DNA, 31 bp, Artificial Sequence
  Description of Artificial Sequence: Synthetic oligonucleotide
aggagaggagcagagtttcacctgctacatg

SEQ ID NO: 151065 - DNA, 30 bp, Artificial Sequence
  Description of Artificial Sequence: Synthetic oligonucleotide
ggagaggagcagagtttcacctgctacatg

SEQ ID NO: 151066 - DNA, 30 bp, Artificial Sequence
  Description of Artificial Sequence: Synthetic oligonucleotide
gagaggagcagagtttcacctgctacatgg

SEQ ID NO: 151067 - DNA, 32 bp, Artificial Sequence
  Description of Artificial Sequence: Synthetic oligonucleotide
agaggagcagagtttcacctgctacatggaac

SEQ ID NO: 151068 - DNA, 31 bp, Artificial Sequence
  Description of Artificial Sequence: Synthetic oligonucleotide
gaggagcagagtttcacctgctacatggaac

SEQ ID NO: 151069 - DNA, 32 bp, Artificial Sequence
  Description of Artificial Sequence: Synthetic oligonucleotide
aggagcagagtttcacctgctacatggaacac

SEQ ID NO: 151070 - DNA, 31 bp, Artificial Sequence
  Description of Artificial Sequence: Synthetic oligonucleotide
ggagcagagtttcacctgctacatggaacac

SEQ ID NO: 151071 - DNA, 32 bp, Artificial Sequence
  Description of Artificial Sequence: Synthetic oligonucleotide
gagcagagtttcacctgctacatggaacacag

SEQ ID NO: 151072 - DNA, 32 bp, Artificial Sequence
  Description of Artificial Sequence: Synthetic oligonucleotide
agcagagtttcacctgctacatggaacacagc

SEQ ID NO: 151073 - DNA, 31 bp, Artificial Sequence
  Description of Artificial Sequence: Synthetic oligonucleotide
gcagagtttcacctgctacatggaacacagc

SEQ ID NO: 151074 - DNA, 31 bp, Artificial Sequence
  Description of Artificial Sequence: Synthetic oligonucleotide
cagagtttcacctgctacatggaacacagcg

SEQ ID NO: 151075 - DNA, 31 bp, Artificial Sequence
  Description of Artificial Sequence: Synthetic oligonucleotide
agagtttcacctgctacatggaacacagcgg

SEQ ID NO: 151076 - DNA, 30 bp, Artificial Sequence
  Description of Artificial Sequence: Synthetic oligonucleotide
gagtttcacctgctacatggaacacagcgg

SEQ ID NO: 151077 - DNA, 30 bp, Artificial Sequence
  Description of Artificial Sequence: Synthetic oligonucleotide
agtttcacctgctacatggaacacagcggg

SEQ ID NO: 151078 - DNA, 29 bp, Artificial Sequence
  Description of Artificial Sequence: Synthetic oligonucleotide
gtttcacctgctacatggaacacagcggg

SEQ ID NO: 151079 - DNA, 32 bp, Artificial Sequence
  Description of Artificial Sequence: Synthetic oligonucleotide
tttcacctgctacatggaacacagcgggaatc

SEQ ID NO: 151080 - DNA, 48 bp, Artificial Sequence
  Description of Artificial Sequence: Synthetic oligonucleotide
tgctgttgctgctgctgctatttttgttattattattttctatgtctg

SEQ ID NO: 151081 - DNA, 47 bp, Artificial Sequence
  Description of Artificial Sequence: Synthetic oligonucleotide
gctgttgctgctgctgctatttttgttattattattttctatgtctg

SEQ ID NO: 151082 - DNA, 49 bp, Artificial Sequence
  Description of Artificial Sequence: Synthetic oligonucleotide
ctgttgctgctgctgctatttttgttattattattttctatgtctgttg

SEQ ID NO: 151083 - DNA, 51 bp, Artificial Sequence
  Description of Artificial Sequence: Synthetic oligonucleotide
tgttgctgctgctgctatttttgttattattattttctatgtctgttgttg

SEQ ID NO: 151084 - DNA, 50 bp, Artificial Sequence
  Description of Artificial Sequence: Synthetic oligonucleotide
gttgctgctgctgctatttttgttattattattttctatgtctgttgttg

SEQ ID NO: 151085 - DNA, 53 bp, Artificial Sequence
  Description of Artificial Sequence: Synthetic oligonucleotide
ttgctgctgctgctatttttgttattattattttctatgtctgttgttgtaag

SEQ ID NO: 151086 - DNA, 27 bp, Artificial Sequence
  Description of Artificial Sequence: Synthetic oligonucleotide
acctgggtggccaccaggatttgcgaa

SEQ ID NO: 151087 - DNA, 26 bp, Artificial Sequence
  Description of Artificial Sequence: Synthetic oligonucleotide
cctgggtggccaccaggatttgcgaa

SEQ ID NO: 151088 - DNA, 26 bp, Artificial Sequence
  Description of Artificial Sequence: Synthetic oligonucleotide
ctgggtggccaccaggatttgcgaag

SEQ ID NO: 151089 - DNA, 27 bp, Artificial Sequence
  Description of Artificial Sequence: Synthetic oligonucleotide
tgggtggccaccaggatttgcgaagga

SEQ ID NO: 151090 - DNA, 26 bp, Artificial Sequence
  Description of Artificial Sequence: Synthetic oligonucleotide
gggtggccaccaggatttgcgaagga

SEQ ID NO: 151091 - DNA, 27 bp, Artificial Sequence
  Description of Artificial Sequence: Synthetic oligonucleotide
ggtggccaccaggatttgcgaaggaga

SEQ ID NO: 151092 - DNA, 27 bp, Artificial Sequence
  Description of Artificial Sequence: Synthetic oligonucleotide
gtggccaccaggatttgcgaaggagag

SEQ ID NO: 151093 - DNA, 27 bp, Artificial Sequence
  Description of Artificial Sequence: Synthetic oligonucleotide
tggccaccaggatttgcgaaggagagg

SEQ ID NO: 151094 - DNA, 27 bp, Artificial Sequence
  Description of Artificial Sequence: Synthetic oligonucleotide
ggccaccaggatttgcgaaggagagga

SEQ ID NO: 151095 - DNA, 27 bp, Artificial Sequence
  Description of Artificial Sequence: Synthetic oligonucleotide
gccaccaggatttgcgaaggagaggag

SEQ ID NO: 151096 - DNA, 27 bp, Artificial Sequence
  Description of Artificial Sequence: Synthetic oligonucleotide
ccaccaggatttgcgaaggagaggagc

SEQ ID NO: 151097 - DNA, 28 bp, Artificial Sequence
  Description of Artificial Sequence: Synthetic oligonucleotide
caccaggatttgcgaaggagaggagcag

SEQ ID NO: 151098 - DNA, 29 bp, Artificial Sequence
  Description of Artificial Sequence: Synthetic oligonucleotide
accaggatttgcgaaggagaggagcagag

SEQ ID NO: 151099 - DNA, 28 bp, Artificial Sequence
  Description of Artificial Sequence: Synthetic oligonucleotide
ccaggatttgcgaaggagaggagcagag

SEQ ID NO: 151100 - DNA, 28 bp, Artificial Sequence
  Description of Artificial Sequence: Synthetic oligonucleotide
caggatttgcgaaggagaggagcagagg

SEQ ID NO: 151101 - DNA, 30 bp, Artificial Sequence
  Description of Artificial Sequence: Synthetic oligonucleotide
aggatttgcgaaggagaggagcagaggttc

SEQ ID NO: 151102 - DNA, 29 bp, Artificial Sequence
  Description of Artificial Sequence: Synthetic oligonucleotide
ggatttgcgaaggagaggagcagaggttc

SEQ ID NO: 151103 - DNA, 30 bp, Artificial Sequence
  Description of Artificial Sequence: Synthetic oligonucleotide
gatttgcgaaggagaggagcagaggttcac

SEQ ID NO: 151104 - DNA, 30 bp, Artificial Sequence
  Description of Artificial Sequence: Synthetic oligonucleotide
atttgcgaaggagaggagcagaggttcacc

SEQ ID NO: 151105 - DNA, 29 bp, Artificial Sequence
  Description of Artificial Sequence: Synthetic oligonucleotide
tttgcgaaggagaggagcagaggttcacc

SEQ ID NO: 151106 - DNA, 28 bp, Artificial Sequence
  Description of Artificial Sequence: Synthetic oligonucleotide
ttgcgaaggagaggagcagaggttcacc

SEQ ID NO: 151107 - DNA, 27 bp, Artificial Sequence
  Description of Artificial Sequence: Synthetic oligonucleotide
tgcgaaggagaggagcagaggttcacc

SEQ ID NO: 151108 - DNA, 27 bp, Artificial Sequence
  Description of Artificial Sequence: Synthetic oligonucleotide
gcgaaggagaggagcagaggttcacct

SEQ ID NO: 151109 - DNA, 27 bp, Artificial Sequence
  Description of Artificial Sequence: Synthetic oligonucleotide
cgaaggagaggagcagaggttcacctg

SEQ ID NO: 151110 - DNA, 27 bp, Artificial Sequence
  Description of Artificial Sequence: Synthetic oligonucleotide
gaaggagaggagcagaggttcacctgc

SEQ ID NO: 151111 - DNA, 27 bp, Artificial Sequence
  Description of Artificial Sequence: Synthetic oligonucleotide
cgtgacatgcagggcttctggcttctg

SEQ ID NO: 151112 - DNA, 28 bp, Artificial Sequence
  Description of Artificial Sequence: Synthetic oligonucleotide
gtgacatgcagggcttctggcttctgtc

SEQ ID NO: 151113 - DNA, 28 bp, Artificial Sequence
  Description of Artificial Sequence: Synthetic oligonucleotide
tgacatgcagggcttctggcttctgtcc

SEQ ID NO: 151114 - DNA, 27 bp, Artificial Sequence
  Description of Artificial Sequence: Synthetic oligonucleotide
gacatgcagggcttctggcttctgtcc

SEQ ID NO: 151115 - DNA, 27 bp, Artificial Sequence
  Description of Artificial Sequence: Synthetic oligonucleotide
acatgcagggcttctggcttctgtccc

SEQ ID NO: 151116 - DNA, 27 bp, Artificial Sequence
  Description of Artificial Sequence: Synthetic oligonucleotide
catgcagggcttctggcttctgtccct

SEQ ID NO: 151117 - DNA, 27 bp, Artificial Sequence
  Description of Artificial Sequence: Synthetic oligonucleotide
atgcagggcttctggcttctgtccctg

SEQ ID NO: 151118 - DNA, 26 bp, Artificial Sequence
  Description of Artificial Sequence: Synthetic oligonucleotide
tgcagggcttctggcttctgtccctg

SEQ ID NO: 151119 - DNA, 25 bp, Artificial Sequence
  Description of Artificial Sequence: Synthetic oligonucleotide
gcagggcttctggcttctgtccctg

SEQ ID NO: 151120 - DNA, 27 bp, Artificial Sequence
  Description of Artificial Sequence: Synthetic oligonucleotide
cagggcttctggcttctgtccctggaa

SEQ ID NO: 151121 - DNA, 30 bp, Artificial Sequence
  Description of Artificial Sequence: Synthetic oligonucleotide
agggcttctggcttctgtccctggaatatc

SEQ ID NO: 151122 - DNA, 29 bp, Artificial Sequence
  Description of Artificial Sequence: Synthetic oligonucleotide
gggcttctggcttctgtccctggaatatc

SEQ ID NO: 151123 - DNA, 30 bp, Artificial Sequence
  Description of Artificial Sequence: Synthetic oligonucleotide
ggcttctggcttctgtccctggaatatcac

SEQ ID NO: 151124 - DNA, 31 bp, Artificial Sequence
  Description of Artificial Sequence: Synthetic oligonucleotide
gcttctggcttctgtccctggaatatcacac

SEQ ID NO: 151125 - DNA, 32 bp, Artificial Sequence
  Description of Artificial Sequence: Synthetic oligonucleotide
cttctggcttctgtccctggaatatcacactg

SEQ ID NO: 151126 - DNA, 33 bp, Artificial Sequence
  Description of Artificial Sequence: Synthetic oligonucleotide
ttctggcttctgtccctggaatatcacactgag

SEQ ID NO: 151127 - DNA, 32 bp, Artificial Sequence
  Description of Artificial Sequence: Synthetic oligonucleotide
tctggcttctgtccctggaatatcacactgag

SEQ ID NO: 151128 - DNA, 31 bp, Artificial Sequence
  Description of Artificial Sequence: Synthetic oligonucleotide
ctggcttctgtccctggaatatcacactgag

SEQ ID NO: 151129 - DNA, 31 bp, Artificial Sequence
  Description of Artificial Sequence: Synthetic oligonucleotide
tggcttctgtccctggaatatcacactgagc

SEQ ID NO: 151130 - DNA, 30 bp, Artificial Sequence
  Description of Artificial Sequence: Synthetic oligonucleotide
ggcttctgtccctggaatatcacactgagc

SEQ ID NO: 151131 - DNA, 31 bp, Artificial Sequence
  Description of Artificial Sequence: Synthetic oligonucleotide
gcttctgtccctggaatatcacactgagctg

SEQ ID NO: 151132 - DNA, 31 bp, Artificial Sequence
  Description of Artificial Sequence: Synthetic oligonucleotide
cttctgtccctggaatatcacactgagctgg

SEQ ID NO: 151133 - DNA, 31 bp, Artificial Sequence
  Description of Artificial Sequence: Synthetic oligonucleotide
ttctgtccctggaatatcacactgagctggc

SEQ ID NO: 151134 - DNA, 30 bp, Artificial Sequence
  Description of Artificial Sequence: Synthetic oligonucleotide
tctgtccctggaatatcacactgagctggc

SEQ ID NO: 151135 - DNA, 29 bp, Artificial Sequence
  Description of Artificial Sequence: Synthetic oligonucleotide
ctgtccctggaatatcacactgagctggc

SEQ ID NO: 151136 - DNA, 29 bp, Artificial Sequence
  Description of Artificial Sequence: Synthetic oligonucleotide
tgtccctggaatatcacactgagctggcg

SEQ ID NO: 151137 - DNA, 28 bp, Artificial Sequence
  Description of Artificial Sequence: Synthetic oligonucleotide
gtccctggaatatcacactgagctggcg

SEQ ID NO: 151138 - DNA, 40 bp, Artificial Sequence
  Description of Artificial Sequence: Synthetic oligonucleotide
tatgtccgttgttgtaagaagaaaacatcagctgcagatg

SEQ ID NO: 151139 - DNA, 39 bp, Artificial Sequence
  Description of Artificial Sequence: Synthetic oligonucleotide
atgtccgttgttgtaagaagaaaacatcagctgcagatg

SEQ ID NO: 151140 - DNA, 38 bp, Artificial Sequence
  Description of Artificial Sequence: Synthetic oligonucleotide
tgtccgttgttgtaagaagaaaacatcagctgcagatg

SEQ ID NO: 151141 - DNA, 37 bp, Artificial Sequence
  Description of Artificial Sequence: Synthetic oligonucleotide
gtccgttgttgtaagaagaaaacatcagctgcagatg

SEQ ID NO: 151142 - DNA, 37 bp, Artificial Sequence
  Description of Artificial Sequence: Synthetic oligonucleotide
tccgttgttgtaagaagaaaacatcagctgcagatgg

SEQ ID NO: 151143 - DNA, 36 bp, Artificial Sequence
  Description of Artificial Sequence: Synthetic oligonucleotide
ccgttgttgtaagaagaaaacatcagctgcagatgg

SEQ ID NO: 151144 - DNA, 37 bp, Artificial Sequence
  Description of Artificial Sequence: Synthetic oligonucleotide
cgttgttgtaagaagaaaacatcagctgcagatggtc

SEQ ID NO: 151145 - DNA, 37 bp, Artificial Sequence
  Description of Artificial Sequence: Synthetic oligonucleotide
gttgttgtaagaagaaaacatcagctgcagatggtcc

SEQ ID NO: 151146 - DNA, 38 bp, Artificial Sequence
  Description of Artificial Sequence: Synthetic oligonucleotide
ttgttgtaagaagaaaacatcagctgcagatggtccag

SEQ ID NO: 151147 - DNA, 37 bp, Artificial Sequence
  Description of Artificial Sequence: Synthetic oligonucleotide
tgttgtaagaagaaaacatcagctgcagatggtccag

SEQ ID NO: 151148 - DNA, 36 bp, Artificial Sequence
  Description of Artificial Sequence: Synthetic oligonucleotide
gttgtaagaagaaaacatcagctgcagatggtccag

SEQ ID NO: 151149 - DNA, 37 bp, Artificial Sequence
  Description of Artificial Sequence: Synthetic oligonucleotide
ttgtaagaagaaaacatcagctgcagatggtccagag

SEQ ID NO: 151150 - DNA, 36 bp, Artificial Sequence
  Description of Artificial Sequence: Synthetic oligonucleotide
tgtaagaagaaaacatcagctgcagatggtccagag

SEQ ID NO: 151151 - DNA, 35 bp, Artificial Sequence
  Description of Artificial Sequence: Synthetic oligonucleotide
gtaagaagaaaacatcagctgcagatggtccagag

SEQ ID NO: 151152 - DNA, 35 bp, Artificial Sequence
  Description of Artificial Sequence: Synthetic oligonucleotide
taagaagaaaacatcagctgcagatggtccagagc

SEQ ID NO: 151153 - DNA, 34 bp, Artificial Sequence
  Description of Artificial Sequence: Synthetic oligonucleotide
aagaagaaaacatcagctgcagatggtccagagc

SEQ ID NO: 151154 - DNA, 33 bp, Artificial Sequence
  Description of Artificial Sequence: Synthetic oligonucleotide
agaagaaaacatcagctgcagatggtccagagc

SEQ ID NO: 151155 - DNA, 32 bp, Artificial Sequence
  Description of Artificial Sequence: Synthetic oligonucleotide
gaagaaaacatcagctgcagatggtccagagc

SEQ ID NO: 151156 - DNA, 33 bp, Artificial Sequence
  Description of Artificial Sequence: Synthetic oligonucleotide
aagaaaacatcagctgcagatggtccagagctc

SEQ ID NO: 151157 - DNA, 32 bp, Artificial Sequence
  Description of Artificial Sequence: Synthetic oligonucleotide
agaaaacatcagctgcagatggtccagagctc

SEQ ID NO: 151158 - DNA, 31 bp, Artificial Sequence
  Description of Artificial Sequence: Synthetic oligonucleotide
gaaaacatcagctgcagatggtccagagctc

SEQ ID NO: 151159 - DNA, 31 bp, Artificial Sequence
  Description of Artificial Sequence: Synthetic oligonucleotide
aaaacatcagctgcagatggtccagagctcg

SEQ ID NO: 151160 - DNA, 30 bp, Artificial Sequence
  Description of Artificial Sequence: Synthetic oligonucleotide
aaacatcagctgcagatggtccagagctcg

SEQ ID NO: 151161 - DNA, 29 bp, Artificial Sequence
  Description of Artificial Sequence: Synthetic oligonucleotide
aacatcagctgcagatggtccagagctcg

SEQ ID NO: 151162 - DNA, 28 bp, Artificial Sequence
  Description of Artificial Sequence: Synthetic oligonucleotide
acatcagctgcagatggtccagagctcg

SEQ ID NO: 151163 - DNA, 27 bp, Artificial Sequence
  Description of Artificial Sequence: Synthetic oligonucleotide
catcagctgcagatggtccagagctcg

SEQ ID NO: 151164 - DNA, 28 bp, Artificial Sequence
  Description of Artificial Sequence: Synthetic oligonucleotide
atcagctgcagatggtccagagctcgtg

SEQ ID NO: 151165 - DNA, 27 bp, Artificial Sequence
  Description of Artificial Sequence: Synthetic oligonucleotide
tcagctgcagatggtccagagctcgtg

SEQ ID NO: 151166 - DNA, 27 bp, Artificial Sequence
  Description of Artificial Sequence: Synthetic oligonucleotide
cagctgcagatggtccagagctcgtga

SEQ ID NO: 151167 - DNA, 27 bp, Artificial Sequence
  Description of Artificial Sequence: Synthetic oligonucleotide
agctgcagatggtccagagctcgtgag

SEQ ID NO: 151168 - DNA, 26 bp, Artificial Sequence
  Description of Artificial Sequence: Synthetic oligonucleotide
gctgcagatggtccagagctcgtgag

SEQ ID NO: 151169 - DNA, 26 bp, Artificial Sequence
  Description of Artificial Sequence: Synthetic oligonucleotide
ctgcagatggtccagagctcgtgagc

SEQ ID NO: 151170 - DNA, 27 bp, Artificial Sequence
  Description of Artificial Sequence: Synthetic oligonucleotide
tgcagatggtccagagctcgtgagcct

SEQ ID NO: 151171 - DNA, 26 bp, Artificial Sequence
  Description of Artificial Sequence: Synthetic oligonucleotide
gcagatggtccagagctcgtgagcct

SEQ ID NO: 151172 - DNA, 26 bp, Artificial Sequence
  Description of Artificial Sequence: Synthetic oligonucleotide
cagatggtccagagctcgtgagcctg

SEQ ID NO: 151173 - DNA, 27 bp, Artificial Sequence
  Description of Artificial Sequence: Synthetic oligonucleotide
agatggtccagagctcgtgagcctgca

SEQ ID NO: 151174 - DNA, 26 bp, Artificial Sequence
  Description of Artificial Sequence: Synthetic oligonucleotide
gatggtccagagctcgtgagcctgca

SEQ ID NO: 151175 - DNA, 26 bp, Artificial Sequence
  Description of Artificial Sequence: Synthetic oligonucleotide
atggtccagagctcgtgagcctgcag

SEQ ID NO: 151176 - DNA, 25 bp, Artificial Sequence
  Description of Artificial Sequence: Synthetic oligonucleotide
tggtccagagctcgtgagcctgcag

SEQ ID NO: 151177 - DNA, 29 bp, Artificial Sequence
  Description of Artificial Sequence: Synthetic oligonucleotide
aggtcctggatcaacacccagttgggatg

SEQ ID NO: 151178 - DNA, 28 bp, Artificial Sequence
  Description of Artificial Sequence: Synthetic oligonucleotide
ggtcctggatcaacacccagttgggatg

SEQ ID NO: 151179 - DNA, 29 bp, Artificial Sequence
  Description of Artificial Sequence: Synthetic oligonucleotide
gtcctggatcaacacccagttgggatgag

SEQ ID NO: 151180 - DNA, 30 bp, Artificial Sequence
  Description of Artificial Sequence: Synthetic oligonucleotide
tcctggatcaacacccagttgggatgagtg

SEQ ID NO: 151181 - DNA, 29 bp, Artificial Sequence
  Description of Artificial Sequence: Synthetic oligonucleotide
cctggatcaacacccagttgggatgagtg

SEQ ID NO: 151182 - DNA, 30 bp, Artificial Sequence
  Description of Artificial Sequence: Synthetic oligonucleotide
ctggatcaacacccagttgggatgagtgac

SEQ ID NO: 151183 - DNA, 30 bp, Artificial Sequence
  Description of Artificial Sequence: Synthetic oligonucleotide
tggatcaacacccagttgggatgagtgacc

SEQ ID NO: 151184 - DNA, 29 bp, Artificial Sequence
  Description of Artificial Sequence: Synthetic oligonucleotide
ggatcaacacccagttgggatgagtgacc

SEQ ID NO: 151185 - DNA, 30 bp, Artificial Sequence
  Description of Artificial Sequence: Synthetic oligonucleotide
gatcaacacccagttgggatgagtgaccac

SEQ ID NO: 151186 - DNA, 31 bp, Artificial Sequence
  Description of Artificial Sequence: Synthetic oligonucleotide
atcaacacccagttgggatgagtgaccacag

SEQ ID NO: 151187 - DNA, 30 bp, Artificial Sequence
  Description of Artificial Sequence: Synthetic oligonucleotide
tcaacacccagttgggatgagtgaccacag

SEQ ID NO: 151188 - DNA, 29 bp, Artificial Sequence
  Description of Artificial Sequence: Synthetic oligonucleotide
caacacccagttgggatgagtgaccacag

SEQ ID NO: 151189 - DNA, 29 bp, Artificial Sequence
  Description of Artificial Sequence: Synthetic oligonucleotide
aacacccagttgggatgagtgaccacagg

SEQ ID NO: 151190 - DNA, 28 bp, Artificial Sequence
  Description of Artificial Sequence: Synthetic oligonucleotide
acacccagttgggatgagtgaccacagg

SEQ ID NO: 151191 - DNA, 27 bp, Artificial Sequence
  Description of Artificial Sequence: Synthetic oligonucleotide
cacccagttgggatgagtgaccacagg

SEQ ID NO: 151192 - DNA, 27 bp, Artificial Sequence
  Description of Artificial Sequence: Synthetic oligonucleotide
acccagttgggatgagtgaccacaggg

SEQ ID NO: 151193 - DNA, 27 bp, Artificial Sequence
  Description of Artificial Sequence: Synthetic oligonucleotide
cccagttgggatgagtgaccacaggga

SEQ ID NO: 151194 - DNA, 28 bp, Artificial Sequence
  Description of Artificial Sequence: Synthetic oligonucleotide
ccagttgggatgagtgaccacagggatg

SEQ ID NO: 151195 - DNA, 28 bp, Artificial Sequence
  Description of Artificial Sequence: Synthetic oligonucleotide
cagttgggatgagtgaccacagggatgc

SEQ ID NO: 151196 - DNA, 28 bp, Artificial Sequence
  Description of Artificial Sequence: Synthetic oligonucleotide
agttgggatgagtgaccacagggatgcc

SEQ ID NO: 151197 - DNA, 27 bp, Artificial Sequence
  Description of Artificial Sequence: Synthetic oligonucleotide
gttgggatgagtgaccacagggatgcc

SEQ ID NO: 151198 - DNA, 28 bp, Artificial Sequence
  Description of Artificial Sequence: Synthetic oligonucleotide
ttgggatgagtgaccacagggatgccac

SEQ ID NO: 151199 - DNA, 27 bp, Artificial Sequence
  Description of Artificial Sequence: Synthetic oligonucleotide
tgggatgagtgaccacagggatgccac

SEQ ID NO: 151200 - DNA, 27 bp, Artificial Sequence
  Description of Artificial Sequence: Synthetic oligonucleotide
gggatgagtgaccacagggatgccaca

SEQ ID NO: 151201 - DNA, 27 bp, Artificial Sequence
  Description of Artificial Sequence: Synthetic oligonucleotide
ggatgagtgaccacagggatgccacac

SEQ ID NO: 151202 - DNA, 28 bp, Artificial Sequence
  Description of Artificial Sequence: Synthetic oligonucleotide
gatgagtgaccacagggatgccacacag

SEQ ID NO: 151203 - DNA, 28 bp, Artificial Sequence
  Description of Artificial Sequence: Synthetic oligonucleotide
atgagtgaccacagggatgccacacagc

SEQ ID NO: 151204 - DNA, 27 bp, Artificial Sequence
  Description of Artificial Sequence: Synthetic oligonucleotide
tgagtgaccacagggatgccacacagc

SEQ ID NO: 151205 - DNA, 37 bp, Artificial Sequence
  Description of Artificial Sequence: Synthetic oligonucleotide
tcatatcaaggaccagaaagaaggcttgcattccttc

SEQ ID NO: 151206 - DNA, 36 bp, Artificial Sequence
  Description of Artificial Sequence: Synthetic oligonucleotide
catatcaaggaccagaaagaaggcttgcattccttc

SEQ ID NO: 151207 - DNA, 36 bp, Artificial Sequence
  Description of Artificial Sequence: Synthetic oligonucleotide
atatcaaggaccagaaagaaggcttgcattccttcc

SEQ ID NO: 151208 - DNA, 35 bp, Artificial Sequence
  Description of Artificial Sequence: Synthetic oligonucleotide
tatcaaggaccagaaagaaggcttgcattccttcc

SEQ ID NO: 151209 - DNA, 34 bp, Artificial Sequence
  Description of Artificial Sequence: Synthetic oligonucleotide
atcaaggaccagaaagaaggcttgcattccttcc

SEQ ID NO: 151210 - DNA, 33 bp, Artificial Sequence
  Description of Artificial Sequence: Synthetic oligonucleotide
tcaaggaccagaaagaaggcttgcattccttcc

SEQ ID NO: 151211 - DNA, 32 bp, Artificial Sequence
  Description of Artificial Sequence: Synthetic oligonucleotide
caaggaccagaaagaaggcttgcattccttcc

SEQ ID NO: 151212 - DNA, 33 bp, Artificial Sequence
  Description of Artificial Sequence: Synthetic oligonucleotide
aaggaccagaaagaaggcttgcattccttccag

SEQ ID NO: 151213 - DNA, 32 bp, Artificial Sequence
  Description of Artificial Sequence: Synthetic oligonucleotide
aggaccagaaagaaggcttgcattccttccag

SEQ ID NO: 151214 - DNA, 31 bp, Artificial Sequence
  Description of Artificial Sequence: Synthetic oligonucleotide
ggaccagaaagaaggcttgcattccttccag

SEQ ID NO: 151215 - DNA, 31 bp, Artificial Sequence
  Description of Artificial Sequence: Synthetic oligonucleotide
gaccagaaagaaggcttgcattccttccagg

SEQ ID NO: 151216 - DNA, 32 bp, Artificial Sequence
  Description of Artificial Sequence: Synthetic oligonucleotide
accagaaagaaggcttgcattccttccaggag

SEQ ID NO: 151217 - DNA, 31 bp, Artificial Sequence
  Description of Artificial Sequence: Synthetic oligonucleotide
ccagaaagaaggcttgcattccttccaggag

SEQ ID NO: 151218 - DNA, 35 bp, Artificial Sequence
  Description of Artificial Sequence: Synthetic oligonucleotide
cagaaagaaggcttgcattccttccaggagattag

SEQ ID NO: 151219 - DNA, 35 bp, Artificial Sequence
  Description of Artificial Sequence: Synthetic oligonucleotide
agaaagaaggcttgcattccttccaggagattagg

SEQ ID NO: 151220 - DNA, 34 bp, Artificial Sequence
  Description of Artificial Sequence: Synthetic oligonucleotide
gaaagaaggcttgcattccttccaggagattagg

SEQ ID NO: 151221 - DNA, 34 bp, Artificial Sequence
  Description of Artificial Sequence: Synthetic oligonucleotide
aaagaaggcttgcattccttccaggagattaggg

SEQ ID NO: 151222 - DNA, 33 bp, Artificial Sequence
  Description of Artificial Sequence: Synthetic oligonucleotide
aagaaggcttgcattccttccaggagattaggg

SEQ ID NO: 151223 - DNA, 32 bp, Artificial Sequence
  Description of Artificial Sequence: Synthetic oligonucleotide
agaaggcttgcattccttccaggagattaggg

SEQ ID NO: 151224 - DNA, 31 bp, Artificial Sequence
  Description of Artificial Sequence: Synthetic oligonucleotide
gaaggcttgcattccttccaggagattaggg

SEQ ID NO: 151225 - DNA, 32 bp, Artificial Sequence
  Description of Artificial Sequence: Synthetic oligonucleotide
aaggcttgcattccttccaggagattagggtc

SEQ ID NO: 151226 - DNA, 31 bp, Artificial Sequence
  Description of Artificial Sequence: Synthetic oligonucleotide
aggcttgcattccttccaggagattagggtc

SEQ ID NO: 151227 - DNA, 30 bp, Artificial Sequence
  Description of Artificial Sequence: Synthetic oligonucleotide
ggcttgcattccttccaggagattagggtc

SEQ ID NO: 151228 - DNA, 31 bp, Artificial Sequence
  Description of Artificial Sequence: Synthetic oligonucleotide
gcttgcattccttccaggagattagggtctg

SEQ ID NO: 151229 - DNA, 32 bp, Artificial Sequence
  Description of Artificial Sequence: Synthetic oligonucleotide
cttgcattccttccaggagattagggtctgtg

SEQ ID NO: 151230 - DNA, 33 bp, Artificial Sequence
  Description of Artificial Sequence: Synthetic oligonucleotide
ttgcattccttccaggagattagggtctgtgag

SEQ ID NO: 151231 - DNA, 32 bp, Artificial Sequence
  Description of Artificial Sequence: Synthetic oligonucleotide
tgcattccttccaggagattagggtctgtgag

SEQ ID NO: 151232 - DNA, 31 bp, Artificial Sequence
  Description of Artificial Sequence: Synthetic oligonucleotide
gcattccttccaggagattagggtctgtgag

SEQ ID NO: 151233 - DNA, 33 bp, Artificial Sequence
  Description of Artificial Sequence: Synthetic oligonucleotide
cattccttccaggagattagggtctgtgagatc

SEQ ID NO: 151234 - DNA, 33 bp, Artificial Sequence
  Description of Artificial Sequence: Synthetic oligonucleotide
attccttccaggagattagggtctgtgagatcc

SEQ ID NO: 151235 - DNA, 32 bp, Artificial Sequence
  Description of Artificial Sequence: Synthetic oligonucleotide
ttccttccaggagattagggtctgtgagatcc

SEQ ID NO: 151236 - DNA, 31 bp, Artificial Sequence
  Description of Artificial Sequence: Synthetic oligonucleotide
tccttccaggagattagggtctgtgagatcc

SEQ ID NO: 151237 - DNA, 30 bp, Artificial Sequence
  Description of Artificial Sequence: Synthetic oligonucleotide
ccttccaggagattagggtctgtgagatcc

SEQ ID NO: 151238 - DNA, 32 bp, Artificial Sequence
  Description of Artificial Sequence: Synthetic oligonucleotide
cttccaggagattagggtctgtgagatccatg

SEQ ID NO: 151239 - DNA, 34 bp, Artificial Sequence
  Description of Artificial Sequence: Synthetic oligonucleotide
ttccaggagattagggtctgtgagatccatgaag

SEQ ID NO: 151240 - DNA, 27 bp, Artificial Sequence
  Description of Artificial Sequence: Synthetic oligonucleotide
ctgttgctgctgctgctgctgctgcta

SEQ ID NO: 151241 - DNA, 32 bp, Artificial Sequence
  Description of Artificial Sequence: Synthetic oligonucleotide
tgttgctgctgctgctgctgctgctatttttg

SEQ ID NO: 151242 - DNA, 31 bp, Artificial Sequence
  Description of Artificial Sequence: Synthetic oligonucleotide
gttgctgctgctgctgctgctgctatttttg

SEQ ID NO: 151243 - DNA, 44 bp, Artificial Sequence
  Description of Artificial Sequence: Synthetic oligonucleotide
ttgctgctgctgctgctgctgctatttttgttattattattttc

SEQ ID NO: 151244 - DNA, 46 bp, Artificial Sequence
  Description of Artificial Sequence: Synthetic oligonucleotide
tgctgctgctgctgctgctatttttgttattattattttctacatc

SEQ ID NO: 151245 - DNA, 45 bp, Artificial Sequence
  Description of Artificial Sequence: Synthetic oligonucleotide
gctgctgctgctgctgctatttttgttattattattttctacatc

SEQ ID NO: 151246 - DNA, 46 bp, Artificial Sequence
  Description of Artificial Sequence: Synthetic oligonucleotide
ctgctgctgctgctgctatttttgttattattattttctacatctg

SEQ ID NO: 151247 - DNA, 48 bp, Artificial Sequence
  Description of Artificial Sequence: Synthetic oligonucleotide
tgctgctgctgctgctatttttgttattattattttctacatctgttg

SEQ ID NO: 151248 - DNA, 47 bp, Artificial Sequence
  Description of Artificial Sequence: Synthetic oligonucleotide
gctgctgctgctgctatttttgttattattattttctacatctgttg

SEQ ID NO: 151249 - DNA, 49 bp, Artificial Sequence
  Description of Artificial Sequence: Synthetic oligonucleotide
ctgctgctgctgctatttttgttattattattttctacatctgttgttg

SEQ ID NO: 151250 - DNA, 52 bp, Artificial Sequence
  Description of Artificial Sequence: Synthetic oligonucleotide
tgctgctgctgctatttttgttattattattttctacatctgttgttgtaag

SEQ ID NO: 151251 - DNA, 51 bp, Artificial Sequence
  Description of Artificial Sequence: Synthetic oligonucleotide
gctgctgctgctatttttgttattattattttctacatctgttgttgtaag

SEQ ID NO: 151252 - DNA, 53 bp, Artificial Sequence
  Description of Artificial Sequence: Synthetic oligonucleotide
ctgctgctgctatttttgttattattattttctacatctgttgttgtaagaag

SEQ ID NO: 151253 - DNA, 57 bp, Artificial Sequence
  Description of Artificial Sequence: Synthetic oligonucleotide
tgctgctgctatttttgttattattattttctacatctgttgttgtaagaagaaaac

SEQ ID NO: 151254 - DNA, 56 bp, Artificial Sequence
  Description of Artificial Sequence: Synthetic oligonucleotide
gctgctgctatttttgttattattattttctacatctgttgttgtaagaagaaaac

SEQ ID NO: 151255 - DNA, 58 bp, Artificial Sequence
  Description of Artificial Sequence: Synthetic oligonucleotide
ctgctgctatttttgttattattattttctacatctgttgttgtaagaagaaaacatc

SEQ ID NO: 151256 - DNA, 59 bp, Artificial Sequence
  Description of Artificial Sequence: Synthetic oligonucleotide
tgctgctatttttgttattattattttctacatctgttgttgtaagaagaaaacatcag

SEQ ID NO: 151257 - DNA, 58 bp, Artificial Sequence
  Description of Artificial Sequence: Synthetic oligonucleotide
gctgctatttttgttattattattttctacatctgttgttgtaagaagaaaacatcag

SEQ ID NO: 151258 - DNA, 58 bp, Artificial Sequence
  Description of Artificial Sequence: Synthetic oligonucleotide
ctgctatttttgttattattattttctacatctgttgttgtaagaagaaaacatcagc

SEQ ID NO: 151259 - DNA, 59 bp, Artificial Sequence
  Description of Artificial Sequence: Synthetic oligonucleotide
tgctatttttgttattattattttctacatctgttgttgtaagaagaaaacatcagctg

SEQ ID NO: 151260 - DNA, 58 bp, Artificial Sequence
  Description of Artificial Sequence: Synthetic oligonucleotide
gctatttttgttattattattttctacatctgttgttgtaagaagaaaacatcagctg

SEQ ID NO: 151261 - DNA, 58 bp, Artificial Sequence
  Description of Artificial Sequence: Synthetic oligonucleotide
ctatttttgttattattattttctacatctgttgttgtaagaagaaaacatcagctgc

SEQ ID NO: 151262 - DNA, 59 bp, Artificial Sequence
  Description of Artificial Sequence: Synthetic oligonucleotide
tatttttgttattattattttctacatctgttgttgtaagaagaaaacatcagctgcag

SEQ ID NO: 151263 - DNA, 58 bp, Artificial Sequence
  Description of Artificial Sequence: Synthetic oligonucleotide
atttttgttattattattttctacatctgttgttgtaagaagaaaacatcagctgcag

SEQ ID NO: 151264 - DNA, 57 bp, Artificial Sequence
  Description of Artificial Sequence: Synthetic oligonucleotide
tttttgttattattattttctacatctgttgttgtaagaagaaaacatcagctgcag

SEQ ID NO: 151265 - DNA, 56 bp, Artificial Sequence
  Description of Artificial Sequence: Synthetic oligonucleotide
ttttgttattattattttctacatctgttgttgtaagaagaaaacatcagctgcag

SEQ ID NO: 151266 - DNA, 55 bp, Artificial Sequence
  Description of Artificial Sequence: Synthetic oligonucleotide
tttgttattattattttctacatctgttgttgtaagaagaaaacatcagctgcag

SEQ ID NO: 151267 - DNA, 54 bp, Artificial Sequence
  Description of Artificial Sequence: Synthetic oligonucleotide
ttgttattattattttctacatctgttgttgtaagaagaaaacatcagctgcag

SEQ ID NO: 151268 - DNA, 53 bp, Artificial Sequence
  Description of Artificial Sequence: Synthetic oligonucleotide
tgttattattattttctacatctgttgttgtaagaagaaaacatcagctgcag

SEQ ID NO: 151269 - DNA, 52 bp, Artificial Sequence
  Description of Artificial Sequence: Synthetic oligonucleotide
gttattattattttctacatctgttgttgtaagaagaaaacatcagctgcag

SEQ ID NO: 151270 - DNA, 53 bp, Artificial Sequence
  Description of Artificial Sequence: Synthetic oligonucleotide
ttattattattttctacatctgttgttgtaagaagaaaacatcagctgcagag

SEQ ID NO: 151271 - DNA, 52 bp, Artificial Sequence
  Description of Artificial Sequence: Synthetic oligonucleotide
tattattattttctacatctgttgttgtaagaagaaaacatcagctgcagag

SEQ ID NO: 151272 - DNA, 51 bp, Artificial Sequence
  Description of Artificial Sequence: Synthetic oligonucleotide
attattattttctacatctgttgttgtaagaagaaaacatcagctgcagag

SEQ ID NO: 151273 - DNA, 50 bp, Artificial Sequence
  Description of Artificial Sequence: Synthetic oligonucleotide
ttattattttctacatctgttgttgtaagaagaaaacatcagctgcagag

SEQ ID NO: 151274 - DNA, 49 bp, Artificial Sequence
  Description of Artificial Sequence: Synthetic oligonucleotide
tattattttctacatctgttgttgtaagaagaaaacatcagctgcagag

SEQ ID NO: 151275 - DNA, 48 bp, Artificial Sequence
  Description of Artificial Sequence: Synthetic oligonucleotide
attattttctacatctgttgttgtaagaagaaaacatcagctgcagag

SEQ ID NO: 151276 - DNA, 47 bp, Artificial Sequence
  Description of Artificial Sequence: Synthetic oligonucleotide
ttattttctacatctgttgttgtaagaagaaaacatcagctgcagag

SEQ ID NO: 151277 - DNA, 46 bp, Artificial Sequence
  Description of Artificial Sequence: Synthetic oligonucleotide
tattttctacatctgttgttgtaagaagaaaacatcagctgcagag

SEQ ID NO: 151278 - DNA, 45 bp, Artificial Sequence
  Description of Artificial Sequence: Synthetic oligonucleotide
attttctacatctgttgttgtaagaagaaaacatcagctgcagag

SEQ ID NO: 151279 - DNA, 44 bp, Artificial Sequence
  Description of Artificial Sequence: Synthetic oligonucleotide
ttttctacatctgttgttgtaagaagaaaacatcagctgcagag

SEQ ID NO: 151280 - DNA, 43 bp, Artificial Sequence
  Description of Artificial Sequence: Synthetic oligonucleotide
tttctacatctgttgttgtaagaagaaaacatcagctgcagag

SEQ ID NO: 151281 - DNA, 42 bp, Artificial Sequence
  Description of Artificial Sequence: Synthetic oligonucleotide
ttctacatctgttgttgtaagaagaaaacatcagctgcagag

SEQ ID NO: 151282 - DNA, 41 bp, Artificial Sequence
  Description of Artificial Sequence: Synthetic oligonucleotide
tctacatctgttgttgtaagaagaaaacatcagctgcagag

SEQ ID NO: 151283 - DNA, 40 bp, Artificial Sequence
  Description of Artificial Sequence: Synthetic oligonucleotide
ctacatctgttgttgtaagaagaaaacatcagctgcagag

SEQ ID NO: 151284 - DNA, 40 bp, Artificial Sequence
  Description of Artificial Sequence: Synthetic oligonucleotide
tacatctgttgttgtaagaagaaaacatcagctgcagagg

SEQ ID NO: 151285 - DNA, 39 bp, Artificial Sequence
  Description of Artificial Sequence: Synthetic oligonucleotide
acatctgttgttgtaagaagaaaacatcagctgcagagg

SEQ ID NO: 151286 - DNA, 38 bp, Artificial Sequence
  Description of Artificial Sequence: Synthetic oligonucleotide
catctgttgttgtaagaagaaaacatcagctgcagagg

SEQ ID NO: 151287 - DNA, 38 bp, Artificial Sequence
  Description of Artificial Sequence: Synthetic oligonucleotide
atctgttgttgtaagaagaaaacatcagctgcagaggg

SEQ ID NO: 151288 - DNA, 29 bp, Artificial Sequence
  Description of Artificial Sequence: Synthetic oligonucleotide
ctgctacatggaacacagcgggaatcacg

SEQ ID NO: 151289 - DNA, 29 bp, Artificial Sequence
  Description of Artificial Sequence: Synthetic oligonucleotide
tgctacatggaacacagcgggaatcacgg

SEQ ID NO: 151290 - DNA, 28 bp, Artificial Sequence
  Description of Artificial Sequence: Synthetic oligonucleotide
gctacatggaacacagcgggaatcacgg

SEQ ID NO: 151291 - DNA, 28 bp, Artificial Sequence
  Description of Artificial Sequence: Synthetic oligonucleotide
ctacatggaacacagcgggaatcacggc

SEQ ID NO: 151292 - DNA, 29 bp, Artificial Sequence
  Description of Artificial Sequence: Synthetic oligonucleotide
tacatggaacacagcgggaatcacggcac

SEQ ID NO: 151293 - DNA, 28 bp, Artificial Sequence
  Description of Artificial Sequence: Synthetic oligonucleotide
acatggaacacagcgggaatcacggcac

SEQ ID NO: 151294 - DNA, 27 bp, Artificial Sequence
  Description of Artificial Sequence: Synthetic oligonucleotide
catggaacacagcgggaatcacggcac

SEQ ID NO: 151295 - DNA, 28 bp, Artificial Sequence
  Description of Artificial Sequence: Synthetic oligonucleotide
atggaacacagcgggaatcacggcactc

SEQ ID NO: 151296 - DNA, 27 bp, Artificial Sequence
  Description of Artificial Sequence: Synthetic oligonucleotide
tggaacacagcgggaatcacggcactc

SEQ ID NO: 151297 - DNA, 27 bp, Artificial Sequence
  Description of Artificial Sequence: Synthetic oligonucleotide
ggaacacagcgggaatcacggcactca

SEQ ID NO: 151298 - DNA, 27 bp, Artificial Sequence
  Description of Artificial Sequence: Synthetic oligonucleotide
gaacacagcgggaatcacggcactcac

SEQ ID NO: 151299 - DNA, 27 bp, Artificial Sequence
  Description of Artificial Sequence: Synthetic oligonucleotide
aacacagcgggaatcacggcactcacc

SEQ ID NO: 151300 - DNA, 26 bp, Artificial Sequence
  Description of Artificial Sequence: Synthetic oligonucleotide
acacagcgggaatcacggcactcacc

SEQ ID NO: 151301 - DNA, 25 bp, Artificial Sequence
  Description of Artificial Sequence: Synthetic oligonucleotide
cacagcgggaatcacggcactcacc

SEQ ID NO: 151302 - DNA, 26 bp, Artificial Sequence
  Description of Artificial Sequence: Synthetic oligonucleotide
acagcgggaatcacggcactcaccct

SEQ ID NO: 151303 - DNA, 25 bp, Artificial Sequence
  Description of Artificial Sequence: Synthetic oligonucleotide
cagcgggaatcacggcactcaccct

SEQ ID NO: 151304 - DNA, 26 bp, Artificial Sequence
  Description of Artificial Sequence: Synthetic oligonucleotide
agcgggaatcacggcactcaccctgt

SEQ ID NO: 151305 - DNA, 25 bp, Artificial Sequence
  Description of Artificial Sequence: Synthetic oligonucleotide
gcgggaatcacggcactcaccctgt

SEQ ID NO: 151306 - DNA, 25 bp, Artificial Sequence
  Description of Artificial Sequence: Synthetic oligonucleotide
cgggaatcacggcactcaccctgtg

SEQ ID NO: 151307 - DNA, 25 bp, Artificial Sequence
  Description of Artificial Sequence: Synthetic oligonucleotide
gggaatcacggcactcaccctgtgc

SEQ ID NO: 151308 - DNA, 25 bp, Artificial Sequence
  Description of Artificial Sequence: Synthetic oligonucleotide
ggaatcacggcactcaccctgtgcc

SEQ ID NO: 151309 - DNA, 26 bp, Artificial Sequence
  Description of Artificial Sequence: Synthetic oligonucleotide
gaatcacggcactcaccctgtgccct

SEQ ID NO: 151310 - DNA, 27 bp, Artificial Sequence
  Description of Artificial Sequence: Synthetic oligonucleotide
aatcacggcactcaccctgtgccctct

SEQ ID NO: 151311 - DNA, 26 bp, Artificial Sequence
  Description of Artificial Sequence: Synthetic oligonucleotide
atcacggcactcaccctgtgccctct

SEQ ID NO: 151312 - DNA, 25 bp, Artificial Sequence
  Description of Artificial Sequence: Synthetic oligonucleotide
tcacggcactcaccctgtgccctct

SEQ ID NO: 151313 - DNA, 24 bp, Artificial Sequence
  Description of Artificial Sequence: Synthetic oligonucleotide
cacggcactcaccctgtgccctct

SEQ ID NO: 151314 - DNA, 24 bp, Artificial Sequence
  Description of Artificial Sequence: Synthetic oligonucleotide
acggcactcaccctgtgccctctg

SEQ ID NO: 151315 - DNA, 23 bp, Artificial Sequence
  Description of Artificial Sequence: Synthetic oligonucleotide
cggcactcaccctgtgccctctg

SEQ ID NO: 151316 - DNA, 23 bp, Artificial Sequence
  Description of Artificial Sequence: Synthetic oligonucleotide
ggcactcaccctgtgccctctgg

SEQ ID NO: 151317 - DNA, 27 bp, Artificial Sequence
  Description of Artificial Sequence: Synthetic oligonucleotide
ttgctgctgctgctgctgctgctgcta

SEQ ID NO: 151318 - DNA, 29 bp, Artificial Sequence
  Description of Artificial Sequence: Synthetic oligonucleotide
gtatctttgagccacgacacccagcagtc

SEQ ID NO: 151319 - DNA, 29 bp, Artificial Sequence
  Description of Artificial Sequence: Synthetic oligonucleotide
tatctttgagccacgacacccagcagtcg

SEQ ID NO: 151320 - DNA, 28 bp, Artificial Sequence
  Description of Artificial Sequence: Synthetic oligonucleotide
atctttgagccacgacacccagcagtcg

SEQ ID NO: 151321 - DNA, 27 bp, Artificial Sequence
  Description of Artificial Sequence: Synthetic oligonucleotide
tctttgagccacgacacccagcagtcg

SEQ ID NO: 151322 - DNA, 26 bp, Artificial Sequence
  Description of Artificial Sequence: Synthetic oligonucleotide
ctttgagccacgacacccagcagtcg

SEQ ID NO: 151323 - DNA, 26 bp, Artificial Sequence
  Description of Artificial Sequence: Synthetic oligonucleotide
tttgagccacgacacccagcagtcgg

SEQ ID NO: 151324 - DNA, 25 bp, Artificial Sequence
  Description of Artificial Sequence: Synthetic oligonucleotide
ttgagccacgacacccagcagtcgg

SEQ ID NO: 151325 - DNA, 24 bp, Artificial Sequence
  Description of Artificial Sequence: Synthetic oligonucleotide
tgagccacgacacccagcagtcgg

SEQ ID NO: 151326 - DNA, 23 bp, Artificial Sequence
  Description of Artificial Sequence: Synthetic oligonucleotide
gagccacgacacccagcagtcgg

SEQ ID NO: 151327 - DNA, 23 bp, Artificial Sequence
  Description of Artificial Sequence: Synthetic oligonucleotide
agccacgacacccagcagtcggg

SEQ ID NO: 151328 - DNA, 22 bp, Artificial Sequence
  Description of Artificial Sequence: Synthetic oligonucleotide
gccacgacacccagcagtcggg

SEQ ID NO: 151329 - DNA, 22 bp, Artificial Sequence
  Description of Artificial Sequence: Synthetic oligonucleotide
ccacgacacccagcagtcgggg

SEQ ID NO: 151330 - DNA, 24 bp, Artificial Sequence
  Description of Artificial Sequence: Synthetic oligonucleotide
cacgacacccagcagtcgggggat

SEQ ID NO: 151331 - DNA, 25 bp, Artificial Sequence
  Description of Artificial Sequence: Synthetic oligonucleotide
acgacacccagcagtcgggggatgt

SEQ ID NO: 151332 - DNA, 24 bp, Artificial Sequence
  Description of Artificial Sequence: Synthetic oligonucleotide
cgacacccagcagtcgggggatgt

SEQ ID NO: 151333 - DNA, 24 bp, Artificial Sequence
  Description of Artificial Sequence: Synthetic oligonucleotide
gacacccagcagtcgggggatgtc

SEQ ID NO: 151334 - DNA, 25 bp, Artificial Sequence
  Description of Artificial Sequence: Synthetic oligonucleotide
acacccagcagtcgggggatgtcct

SEQ ID NO: 151335 - DNA, 24 bp, Artificial Sequence
  Description of Artificial Sequence: Synthetic oligonucleotide
cacccagcagtcgggggatgtcct

SEQ ID NO: 151336 - DNA, 24 bp, Artificial Sequence
  Description of Artificial Sequence: Synthetic oligonucleotide
acccagcagtcgggggatgtcctg

SEQ ID NO: 151337 - DNA, 23 bp, Artificial Sequence
  Description of Artificial Sequence: Synthetic oligonucleotide
cccagcagtcgggggatgtcctg

SEQ ID NO: 151338 - DNA, 23 bp, Artificial Sequence
  Description of Artificial Sequence: Synthetic oligonucleotide
ccagcagtcgggggatgtcctgc

SEQ ID NO: 151339 - DNA, 24 bp, Artificial Sequence
  Description of Artificial Sequence: Synthetic oligonucleotide
cagcagtcgggggatgtcctgcct

SEQ ID NO: 151340 - DNA, 26 bp, Artificial Sequence
  Description of Artificial Sequence: Synthetic oligonucleotide
agcagtcgggggatgtcctgcctgat

SEQ ID NO: 151341 - DNA, 25 bp, Artificial Sequence
  Description of Artificial Sequence: Synthetic oligonucleotide
gcagtcgggggatgtcctgcctgat

SEQ ID NO: 151342 - DNA, 25 bp, Artificial Sequence
  Description of Artificial Sequence: Synthetic oligonucleotide
cagtcgggggatgtcctgcctgatg

SEQ ID NO: 151343 - DNA, 25 bp, Artificial Sequence
  Description of Artificial Sequence: Synthetic oligonucleotide
agtcgggggatgtcctgcctgatgg

SEQ ID NO: 151344 - DNA, 24 bp, Artificial Sequence
  Description of Artificial Sequence: Synthetic oligonucleotide
gtcgggggatgtcctgcctgatgg

SEQ ID NO: 151345 - DNA, 27 bp, Artificial Sequence
  Description of Artificial Sequence: Synthetic oligonucleotide
tcgggggatgtcctgcctgatgggaat

SEQ ID NO: 151346 - DNA, 26 bp, Artificial Sequence
  Description of Artificial Sequence: Synthetic oligonucleotide
cgggggatgtcctgcctgatgggaat

SEQ ID NO: 151347 - DNA, 31 bp, Artificial Sequence
  Description of Artificial Sequence: Synthetic oligonucleotide
agaggttcacctgctacatggaacacagcag

SEQ ID NO: 151348 - DNA, 30 bp, Artificial Sequence
  Description of Artificial Sequence: Synthetic oligonucleotide
gaggttcacctgctacatggaacacagcag

SEQ ID NO: 151349 - DNA, 30 bp, Artificial Sequence
  Description of Artificial Sequence: Synthetic oligonucleotide
aggttcacctgctacatggaacacagcagg

SEQ ID NO: 151350 - DNA, 29 bp, Artificial Sequence
  Description of Artificial Sequence: Synthetic oligonucleotide
ggttcacctgctacatggaacacagcagg

SEQ ID NO: 151351 - DNA, 32 bp, Artificial Sequence
  Description of Artificial Sequence: Synthetic oligonucleotide
gttcacctgctacatggaacacagcaggaatc

SEQ ID NO: 151352 - DNA, 33 bp, Artificial Sequence
  Description of Artificial Sequence: Synthetic oligonucleotide
ttcacctgctacatggaacacagcaggaatcac

SEQ ID NO: 151353 - DNA, 32 bp, Artificial Sequence
  Description of Artificial Sequence: Synthetic oligonucleotide
tcacctgctacatggaacacagcaggaatcac

SEQ ID NO: 151354 - DNA, 31 bp, Artificial Sequence
  Description of Artificial Sequence: Synthetic oligonucleotide
cacctgctacatggaacacagcaggaatcac

SEQ ID NO: 151355 - DNA, 32 bp, Artificial Sequence
  Description of Artificial Sequence: Synthetic oligonucleotide
acctgctacatggaacacagcaggaatcacag

SEQ ID NO: 151356 - DNA, 31 bp, Artificial Sequence
  Description of Artificial Sequence: Synthetic oligonucleotide
cctgctacatggaacacagcaggaatcacag

SEQ ID NO: 151357 - DNA, 31 bp, Artificial Sequence
  Description of Artificial Sequence: Synthetic oligonucleotide
ctgctacatggaacacagcaggaatcacagc

SEQ ID NO: 151358 - DNA, 32 bp, Artificial Sequence
  Description of Artificial Sequence: Synthetic oligonucleotide
tgctacatggaacacagcaggaatcacagcac

SEQ ID NO: 151359 - DNA, 31 bp, Artificial Sequence
  Description of Artificial Sequence: Synthetic oligonucleotide
gctacatggaacacagcaggaatcacagcac

SEQ ID NO: 151360 - DNA, 32 bp, Artificial Sequence
  Description of Artificial Sequence: Synthetic oligonucleotide
ctacatggaacacagcaggaatcacagcactc

SEQ ID NO: 151361 - DNA, 33 bp, Artificial Sequence
  Description of Artificial Sequence: Synthetic oligonucleotide
tacatggaacacagcaggaatcacagcactcac

SEQ ID NO: 151362 - DNA, 32 bp, Artificial Sequence
  Description of Artificial Sequence: Synthetic oligonucleotide
acatggaacacagcaggaatcacagcactcac

SEQ ID NO: 151363 - DNA, 31 bp, Artificial Sequence
  Description of Artificial Sequence: Synthetic oligonucleotide
catggaacacagcaggaatcacagcactcac

SEQ ID NO: 151364 - DNA, 31 bp, Artificial Sequence
  Description of Artificial Sequence: Synthetic oligonucleotide
atggaacacagcaggaatcacagcactcacc

SEQ ID NO: 151365 - DNA, 30 bp, Artificial Sequence
  Description of Artificial Sequence: Synthetic oligonucleotide
tggaacacagcaggaatcacagcactcacc

SEQ ID NO: 151366 - DNA, 29 bp, Artificial Sequence
  Description of Artificial Sequence: Synthetic oligonucleotide
ggaacacagcaggaatcacagcactcacc

SEQ ID NO: 151367 - DNA, 29 bp, Artificial Sequence
  Description of Artificial Sequence: Synthetic oligonucleotide
gaacacagcaggaatcacagcactcaccc

SEQ ID NO: 151368 - DNA, 30 bp, Artificial Sequence
  Description of Artificial Sequence: Synthetic oligonucleotide
aacacagcaggaatcacagcactcaccctg

SEQ ID NO: 151369 - DNA, 29 bp, Artificial Sequence
  Description of Artificial Sequence: Synthetic oligonucleotide
acacagcaggaatcacagcactcaccctg

SEQ ID NO: 151370 - DNA, 28 bp, Artificial Sequence
  Description of Artificial Sequence: Synthetic oligonucleotide
cacagcaggaatcacagcactcaccctg

SEQ ID NO: 151371 - DNA, 29 bp, Artificial Sequence
  Description of Artificial Sequence: Synthetic oligonucleotide
acagcaggaatcacagcactcaccctgtg

SEQ ID NO: 151372 - DNA, 28 bp, Artificial Sequence
  Description of Artificial Sequence: Synthetic oligonucleotide
cagcaggaatcacagcactcaccctgtg

SEQ ID NO: 151373 - DNA, 28 bp, Artificial Sequence
  Description of Artificial Sequence: Synthetic oligonucleotide
agcaggaatcacagcactcaccctgtgc

SEQ ID NO: 151374 - DNA, 27 bp, Artificial Sequence
  Description of Artificial Sequence: Synthetic oligonucleotide
gcaggaatcacagcactcaccctgtgc

SEQ ID NO: 151375 - DNA, 27 bp, Artificial Sequence
  Description of Artificial Sequence: Synthetic oligonucleotide
caggaatcacagcactcaccctgtgcc

SEQ ID NO: 151376 - DNA, 27 bp, Artificial Sequence
  Description of Artificial Sequence: Synthetic oligonucleotide
aggaatcacagcactcaccctgtgccc

SEQ ID NO: 151377 - DNA, 27 bp, Artificial Sequence
  Description of Artificial Sequence: Synthetic oligonucleotide
gggtggccaccaggatttgccaaggaa

SEQ ID NO: 151378 - DNA, 28 bp, Artificial Sequence
  Description of Artificial Sequence: Synthetic oligonucleotide
ggtggccaccaggatttgccaaggaaag

SEQ ID NO: 151379 - DNA, 28 bp, Artificial Sequence
  Description of Artificial Sequence: Synthetic oligonucleotide
gtggccaccaggatttgccaaggaaagg

SEQ ID NO: 151380 - DNA, 29 bp, Artificial Sequence
  Description of Artificial Sequence: Synthetic oligonucleotide
tggccaccaggatttgccaaggaaaggag

SEQ ID NO: 151381 - DNA, 28 bp, Artificial Sequence
  Description of Artificial Sequence: Synthetic oligonucleotide
ggccaccaggatttgccaaggaaaggag

SEQ ID NO: 151382 - DNA, 28 bp, Artificial Sequence
  Description of Artificial Sequence: Synthetic oligonucleotide
gccaccaggatttgccaaggaaaggagc

SEQ ID NO: 151383 - DNA, 29 bp, Artificial Sequence
  Description of Artificial Sequence: Synthetic oligonucleotide
ccaccaggatttgccaaggaaaggagcag

SEQ ID NO: 151384 - DNA, 30 bp, Artificial Sequence
  Description of Artificial Sequence: Synthetic oligonucleotide
caccaggatttgccaaggaaaggagcagag

SEQ ID NO: 151385 - DNA, 30 bp, Artificial Sequence
  Description of Artificial Sequence: Synthetic oligonucleotide
accaggatttgccaaggaaaggagcagagg

SEQ ID NO: 151386 - DNA, 29 bp, Artificial Sequence
  Description of Artificial Sequence: Synthetic oligonucleotide
ccaggatttgccaaggaaaggagcagagg

SEQ ID NO: 151387 - DNA, 31 bp, Artificial Sequence
  Description of Artificial Sequence: Synthetic oligonucleotide
caggatttgccaaggaaaggagcagaggttc

SEQ ID NO: 151388 - DNA, 32 bp, Artificial Sequence
  Description of Artificial Sequence: Synthetic oligonucleotide
aggatttgccaaggaaaggagcagaggttcac

SEQ ID NO: 151389 - DNA, 31 bp, Artificial Sequence
  Description of Artificial Sequence: Synthetic oligonucleotide
ggatttgccaaggaaaggagcagaggttcac

SEQ ID NO: 151390 - DNA, 31 bp, Artificial Sequence
  Description of Artificial Sequence: Synthetic oligonucleotide
gatttgccaaggaaaggagcagaggttcacc

SEQ ID NO: 151391 - DNA, 32 bp, Artificial Sequence
  Description of Artificial Sequence: Synthetic oligonucleotide
atttgccaaggaaaggagcagaggttcacctg

SEQ ID NO: 151392 - DNA, 31 bp, Artificial Sequence
  Description of Artificial Sequence: Synthetic oligonucleotide
tttgccaaggaaaggagcagaggttcacctg

SEQ ID NO: 151393 - DNA, 30 bp, Artificial Sequence
  Description of Artificial Sequence: Synthetic oligonucleotide
ttgccaaggaaaggagcagaggttcacctg

SEQ ID NO: 151394 - DNA, 29 bp, Artificial Sequence
  Description of Artificial Sequence: Synthetic oligonucleotide
tgccaaggaaaggagcagaggttcacctg

SEQ ID NO: 151395 - DNA, 28 bp, Artificial Sequence
  Description of Artificial Sequence: Synthetic oligonucleotide
gccaaggaaaggagcagaggttcacctg

SEQ ID NO: 151396 - DNA, 28 bp, Artificial Sequence
  Description of Artificial Sequence: Synthetic oligonucleotide
ccaaggaaaggagcagaggttcacctgc

SEQ ID NO: 151397 - DNA, 30 bp, Artificial Sequence
  Description of Artificial Sequence: Synthetic oligonucleotide
caaggaaaggagcagaggttcacctgctac

SEQ ID NO: 151398 - DNA, 32 bp, Artificial Sequence
  Description of Artificial Sequence: Synthetic oligonucleotide
aaggaaaggagcagaggttcacctgctacatg

SEQ ID NO: 151399 - DNA, 31 bp, Artificial Sequence
  Description of Artificial Sequence: Synthetic oligonucleotide
aggaaaggagcagaggttcacctgctacatg

SEQ ID NO: 151400 - DNA, 30 bp, Artificial Sequence
  Description of Artificial Sequence: Synthetic oligonucleotide
ggaaaggagcagaggttcacctgctacatg

SEQ ID NO: 151401 - DNA, 30 bp, Artificial Sequence
  Description of Artificial Sequence: Synthetic oligonucleotide
gaaaggagcagaggttcacctgctacatgg

SEQ ID NO: 151402 - DNA, 32 bp, Artificial Sequence
  Description of Artificial Sequence: Synthetic oligonucleotide
aaaggagcagaggttcacctgctacatggaac

SEQ ID NO: 151403 - DNA, 31 bp, Artificial Sequence
  Description of Artificial Sequence: Synthetic oligonucleotide
aaggagcagaggttcacctgctacatggaac

SEQ ID NO: 151404 - DNA, 21 bp, Artificial Sequence
  Description of Artificial Sequence: Synthetic oligonucleotide
atggggctgggccgggtcctg

SEQ ID NO: 151405 - DNA, 20 bp, Artificial Sequence
  Description of Artificial Sequence: Synthetic oligonucleotide
tggggctgggccgggtcctg

SEQ ID NO: 151406 - DNA, 20 bp, Artificial Sequence
  Description of Artificial Sequence: Synthetic oligonucleotide
ggggctgggccgggtcctgt

SEQ ID NO: 151407 - DNA, 20 bp, Artificial Sequence
  Description of Artificial Sequence: Synthetic oligonucleotide
gggctgggccgggtcctgct

SEQ ID NO: 151408 - DNA, 23 bp, Artificial Sequence
  Description of Artificial Sequence: Synthetic oligonucleotide
ggctgggccgggtcctgctgttt

SEQ ID NO: 151409 - DNA, 24 bp, Artificial Sequence
  Description of Artificial Sequence: Synthetic oligonucleotide
gctgggccgggtcctgctgtttct

SEQ ID NO: 151410 - DNA, 24 bp, Artificial Sequence
  Description of Artificial Sequence: Synthetic oligonucleotide
ctgggccgggtcctgctgtttctg

SEQ ID NO: 151411 - DNA, 24 bp, Artificial Sequence
  Description of Artificial Sequence: Synthetic oligonucleotide
tgggccgggtcctgctgtttctgg

SEQ ID NO: 151412 - DNA, 23 bp, Artificial Sequence
  Description of Artificial Sequence: Synthetic oligonucleotide
gggccgggtcctgctgtttctgg

SEQ ID NO: 151413 - DNA, 23 bp, Artificial Sequence
  Description of Artificial Sequence: Synthetic oligonucleotide
ggccgggtcctgctgtttctggc

SEQ ID NO: 151414 - DNA, 23 bp, Artificial Sequence
  Description of Artificial Sequence: Synthetic oligonucleotide
gccgggtcctgctgtttctggcc

SEQ ID NO: 151415 - DNA, 24 bp, Artificial Sequence
  Description of Artificial Sequence: Synthetic oligonucleotide
ccgggtcctgctgtttctggccgt

SEQ ID NO: 151416 - DNA, 24 bp, Artificial Sequence
  Description of Artificial Sequence: Synthetic oligonucleotide
cgggtcctgctgtttctggccgtc

SEQ ID NO: 151417 - DNA, 24 bp, Artificial Sequence
  Description of Artificial Sequence: Synthetic oligonucleotide
gggtcctgctgtttctggccgtcg

SEQ ID NO: 151418 - DNA, 24 bp, Artificial Sequence
  Description of Artificial Sequence: Synthetic oligonucleotide
ggtcctgctgtttctggccgtcgc

SEQ ID NO: 151419 - DNA, 26 bp, Artificial Sequence
  Description of Artificial Sequence: Synthetic oligonucleotide
gtcctgctgtttctggccgtcgcctt

SEQ ID NO: 151420 - DNA, 26 bp, Artificial Sequence
  Description of Artificial Sequence: Synthetic oligonucleotide
tcctgctgtttctggccgtcgccttc

SEQ ID NO: 151421 - DNA, 25 bp, Artificial Sequence
  Description of Artificial Sequence: Synthetic oligonucleotide
cctgctgtttctggccgtcgccttc

SEQ ID NO: 151422 - DNA, 25 bp, Artificial Sequence
  Description of Artificial Sequence: Synthetic oligonucleotide
ctgctgtttctggccgtcgccttcc

SEQ ID NO: 151423 - DNA, 27 bp, Artificial Sequence
  Description of Artificial Sequence: Synthetic oligonucleotide
tgctgtttctggccgtcgccttccctt

SEQ ID NO: 151424 - DNA, 27 bp, Artificial Sequence
  Description of Artificial Sequence: Synthetic oligonucleotide
gctgtttctggccgtcgccttcccttt

SEQ ID NO: 151425 - DNA, 28 bp, Artificial Sequence
  Description of Artificial Sequence: Synthetic oligonucleotide
ctgtttctggccgtcgccttcccttttg

SEQ ID NO: 151426 - DNA, 28 bp, Artificial Sequence
  Description of Artificial Sequence: Synthetic oligonucleotide
tgtttctggccgtcgccttcccttttgc

SEQ ID NO: 151427 - DNA, 27 bp, Artificial Sequence
  Description of Artificial Sequence: Synthetic oligonucleotide
gtttctggccgtcgccttcccttttgc

SEQ ID NO: 151428 - DNA, 28 bp, Artificial Sequence
  Description of Artificial Sequence: Synthetic oligonucleotide
tttctggccgtcgccttcccttttgcac

SEQ ID NO: 151429 - DNA, 27 bp, Artificial Sequence
  Description of Artificial Sequence: Synthetic oligonucleotide
ttctggccgtcgccttcccttttgcac

SEQ ID NO: 151430 - DNA, 26 bp, Artificial Sequence
  Description of Artificial Sequence: Synthetic oligonucleotide
tctggccgtcgccttcccttttgcac

SEQ ID NO: 151431 - DNA, 25 bp, Artificial Sequence
  Description of Artificial Sequence: Synthetic oligonucleotide
ctggccgtcgccttcccttttgcac

SEQ ID NO: 151432 - DNA, 25 bp, Artificial Sequence
  Description of Artificial Sequence: Synthetic oligonucleotide
tggccgtcgccttcccttttgcacc

SEQ ID NO: 151433 - DNA, 24 bp, Artificial Sequence
  Description of Artificial Sequence: Synthetic oligonucleotide
ggccgtcgccttcccttttgcacc

SEQ ID NO: 151434 - DNA, 24 bp, Artificial Sequence
  Description of Artificial Sequence: Synthetic oligonucleotide
gccgtcgccttcccttttgcaccc

SEQ ID NO: 151435 - DNA, 24 bp, Artificial Sequence
  Description of Artificial Sequence: Synthetic oligonucleotide
ccgtcgccttcccttttgcacccc

SEQ ID NO: 151436 - DNA, 24 bp, Artificial Sequence
  Description of Artificial Sequence: Synthetic oligonucleotide
cgtcgccttcccttttgcaccccc

SEQ ID NO: 151437 - DNA, 24 bp, Artificial Sequence
  Description of Artificial Sequence: Synthetic oligonucleotide
gtcgccttcccttttgcacccccg

SEQ ID NO: 151438 - DNA, 24 bp, Artificial Sequence
  Description of Artificial Sequence: Synthetic oligonucleotide
tcgccttcccttttgcacccccgg

SEQ ID NO: 151439 - DNA, 23 bp, Artificial Sequence
  Description of Artificial Sequence: Synthetic oligonucleotide
cgccttcccttttgcacccccgg

SEQ ID NO: 151440 - DNA, 24 bp, Artificial Sequence
  Description of Artificial Sequence: Synthetic oligonucleotide
gccttcccttttgcacccccggca

SEQ ID NO: 151441 - DNA, 24 bp, Artificial Sequence
  Description of Artificial Sequence: Synthetic oligonucleotide
ccttcccttttgcacccccggcag

SEQ ID NO: 151442 - DNA, 24 bp, Artificial Sequence
  Description of Artificial Sequence: Synthetic oligonucleotide
cttcccttttgcacccccggcagc

SEQ ID NO: 151443 - DNA, 24 bp, Artificial Sequence
  Description of Artificial Sequence: Synthetic oligonucleotide
ttcccttttgcacccccggcagcc

SEQ ID NO: 151444 - DNA, 23 bp, Artificial Sequence
  Description of Artificial Sequence: Synthetic oligonucleotide
tcccttttgcacccccggcagcc

SEQ ID NO: 151445 - DNA, 22 bp, Artificial Sequence
  Description of Artificial Sequence: Synthetic oligonucleotide
cccttttgcacccccggcagcc

SEQ ID NO: 151446 - DNA, 22 bp, Artificial Sequence
  Description of Artificial Sequence: Synthetic oligonucleotide
ccttttgcacccccggcagccg

SEQ ID NO: 151447 - DNA, 22 bp, Artificial Sequence
  Description of Artificial Sequence: Synthetic oligonucleotide
cttttgcacccccggcagccgc

SEQ ID NO: 151448 - DNA, 22 bp, Artificial Sequence
  Description of Artificial Sequence: Synthetic oligonucleotide
ttttgcacccccggcagccgcc

SEQ ID NO: 151449 - DNA, 21 bp, Artificial Sequence
  Description of Artificial Sequence: Synthetic oligonucleotide
tttgcacccccggcagccgcc

SEQ ID NO: 151450 - DNA, 20 bp, Artificial Sequence
  Description of Artificial Sequence: Synthetic oligonucleotide
ttgcacccccggcagccgcc

SEQ ID NO: 151451 - DNA, 20 bp, Artificial Sequence
  Description of Artificial Sequence: Synthetic oligonucleotide
tgcacccccggcagccgcct

SEQ ID NO: 151452 - DNA, 20 bp, Artificial Sequence
  Description of Artificial Sequence: Synthetic oligonucleotide
gcacccccggcagccgcctt

SEQ ID NO: 151453 - DNA, 20 bp, Artificial Sequence
  Description of Artificial Sequence: Synthetic oligonucleotide
cacccccggcagccgccgtt

SEQ ID NO: 151454 - DNA, 20 bp, Artificial Sequence
  Description of Artificial Sequence: Synthetic oligonucleotide
acccccggcagccgccgctt

SEQ ID NO: 151455 - DNA, 20 bp, Artificial Sequence
  Description of Artificial Sequence: Synthetic oligonucleotide
cccccggcagccgccgcttt

SEQ ID NO: 151456 - DNA, 20 bp, Artificial Sequence
  Description of Artificial Sequence: Synthetic oligonucleotide
ccccggcagccgccgctgat

SEQ ID NO: 151457 - DNA, 20 bp, Artificial Sequence
  Description of Artificial Sequence: Synthetic oligonucleotide
cccggcagccgccgctgagt

SEQ ID NO: 151458 - DNA, 20 bp, Artificial Sequence
  Description of Artificial Sequence: Synthetic oligonucleotide
ccggcagccgccgctgagct

SEQ ID NO: 151459 - DNA, 20 bp, Artificial Sequence
  Description of Artificial Sequence: Synthetic oligonucleotide
cggcagccgccgctgagcct

SEQ ID NO: 151460 - DNA, 20 bp, Artificial Sequence
  Description of Artificial Sequence: Synthetic oligonucleotide
ggcagccgccgctgagccct

SEQ ID NO: 151461 - DNA, 20 bp, Artificial Sequence
  Description of Artificial Sequence: Synthetic oligonucleotide
gcagccgccgctgagcccca

SEQ ID NO: 151462 - DNA, 21 bp, Artificial Sequence
  Description of Artificial Sequence: Synthetic oligonucleotide
cagccgccgctgagccccaca

SEQ ID NO: 151463 - DNA, 22 bp, Artificial Sequence
  Description of Artificial Sequence: Synthetic oligonucleotide
agccgccgctgagccccacagt

SEQ ID NO: 151464 - DNA, 21 bp, Artificial Sequence
  Description of Artificial Sequence: Synthetic oligonucleotide
gccgccgctgagccccacagt

SEQ ID NO: 151465 - DNA, 23 bp, Artificial Sequence
  Description of Artificial Sequence: Synthetic oligonucleotide
ccgccgctgagccccacagtctt

SEQ ID NO: 151466 - DNA, 23 bp, Artificial Sequence
  Description of Artificial Sequence: Synthetic oligonucleotide
cgccgctgagccccacagtcttc

SEQ ID NO: 151467 - DNA, 26 bp, Artificial Sequence
  Description of Artificial Sequence: Synthetic oligonucleotide
gccgctgagccccacagtcttcgtta

SEQ ID NO: 151468 - DNA, 27 bp, Artificial Sequence
  Description of Artificial Sequence: Synthetic oligonucleotide
ccgctgagccccacagtcttcgttaca

SEQ ID NO: 151469 - DNA, 28 bp, Artificial Sequence
  Description of Artificial Sequence: Synthetic oligonucleotide
cgctgagccccacagtcttcgttacaac

SEQ ID NO: 151470 - DNA, 28 bp, Artificial Sequence
  Description of Artificial Sequence: Synthetic oligonucleotide
gctgagccccacagtcttcgttacaacc

SEQ ID NO: 151471 - DNA, 29 bp, Artificial Sequence
  Description of Artificial Sequence: Synthetic oligonucleotide
ctgagccccacagtcttcgttacaacctc

SEQ ID NO: 151472 - DNA, 31 bp, Artificial Sequence
  Description of Artificial Sequence: Synthetic oligonucleotide
tgagccccacagtcttcgttacaacctcatg

SEQ ID NO: 151473 - DNA, 30 bp, Artificial Sequence
  Description of Artificial Sequence: Synthetic oligonucleotide
gagccccacagtcttcgttacaacctcatg

SEQ ID NO: 151474 - DNA, 30 bp, Artificial Sequence
  Description of Artificial Sequence: Synthetic oligonucleotide
agccccacagtcttcgttacaacctcatgg

SEQ ID NO: 151475 - DNA, 29 bp, Artificial Sequence
  Description of Artificial Sequence: Synthetic oligonucleotide
gccccacagtcttcgttacaacctcatgg

SEQ ID NO: 151476 - DNA, 30 bp, Artificial Sequence
  Description of Artificial Sequence: Synthetic oligonucleotide
ccccacagtcttcgttacaacctcatggtg

SEQ ID NO: 151477 - DNA, 30 bp, Artificial Sequence
  Description of Artificial Sequence: Synthetic oligonucleotide
cccacagtcttcgttacaacctcatggtgc

SEQ ID NO: 151478 - DNA, 31 bp, Artificial Sequence
  Description of Artificial Sequence: Synthetic oligonucleotide
ccacagtcttcgttacaacctcatggtgctg

SEQ ID NO: 151479 - DNA, 32 bp, Artificial Sequence
  Description of Artificial Sequence: Synthetic oligonucleotide
cacagtcttcgttacaacctcatggtgctgtc

SEQ ID NO: 151480 - DNA, 32 bp, Artificial Sequence
  Description of Artificial Sequence: Synthetic oligonucleotide
acagtcttcgttacaacctcatggtgctgtcc

SEQ ID NO: 151481 - DNA, 31 bp, Artificial Sequence
  Description of Artificial Sequence: Synthetic oligonucleotide
cagtcttcgttacaacctcatggtgctgtcc

SEQ ID NO: 151482 - DNA, 31 bp, Artificial Sequence
  Description of Artificial Sequence: Synthetic oligonucleotide
agtcttcgttacaacctcatggtgctgtccc

SEQ ID NO: 151483 - DNA, 30 bp, Artificial Sequence
  Description of Artificial Sequence: Synthetic oligonucleotide
gtcttcgttacaacctcatggtgctgtccc

SEQ ID NO: 151484 - DNA, 31 bp, Artificial Sequence
  Description of Artificial Sequence: Synthetic oligonucleotide
tcttcgttacaacctcatggtgctgtcccag

SEQ ID NO: 151485 - DNA, 30 bp, Artificial Sequence
  Description of Artificial Sequence: Synthetic oligonucleotide
cttcgttacaacctcatggtgctgtcccag

SEQ ID NO: 151486 - DNA, 30 bp, Artificial Sequence
  Description of Artificial Sequence: Synthetic oligonucleotide
ttcgttacaacctcatggtgctgtcccagg

SEQ ID NO: 151487 - DNA, 29 bp, Artificial Sequence
  Description of Artificial Sequence: Synthetic oligonucleotide
tcgttacaacctcatggtgctgtcccagg

SEQ ID NO: 151488 - DNA, 28 bp, Artificial Sequence
  Description of Artificial Sequence: Synthetic oligonucleotide
cgttacaacctcatggtgctgtcccagg

SEQ ID NO: 151489 - DNA, 30 bp, Artificial Sequence
  Description of Artificial Sequence: Synthetic oligonucleotide
gttacaacctcatggtgctgtcccaggatg

SEQ ID NO: 151490 - DNA, 33 bp, Artificial Sequence
  Description of Artificial Sequence: Synthetic oligonucleotide
ttacaacctcatggtgctgtcccaggatgaatc

SEQ ID NO: 151491 - DNA, 32 bp, Artificial Sequence
  Description of Artificial Sequence: Synthetic oligonucleotide
tacaacctcatggtgctgtcccaggatgaatc

SEQ ID NO: 151492 - DNA, 31 bp, Artificial Sequence
  Description of Artificial Sequence: Synthetic oligonucleotide
acaacctcatggtgctgtcccaggatgaatc

SEQ ID NO: 151493 - DNA, 30 bp, Artificial Sequence
  Description of Artificial Sequence: Synthetic oligonucleotide
caacctcatggtgctgtcccaggatgaatc

SEQ ID NO: 151494 - DNA, 31 bp, Artificial Sequence
  Description of Artificial Sequence: Synthetic oligonucleotide
aacctcatggtgctgtcccaggatgaatctg

SEQ ID NO: 151495 - DNA, 30 bp, Artificial Sequence
  Description of Artificial Sequence: Synthetic oligonucleotide
acctcatggtgctgtcccaggatgaatctg

SEQ ID NO: 151496 - DNA, 29 bp, Artificial Sequence
  Description of Artificial Sequence: Synthetic oligonucleotide
cctcatggtgctgtcccaggatgaatctg

SEQ ID NO: 151497 - DNA, 30 bp, Artificial Sequence
  Description of Artificial Sequence: Synthetic oligonucleotide
ctcatggtgctgtcccaggatgaatctgtg

SEQ ID NO: 151498 - DNA, 30 bp, Artificial Sequence
  Description of Artificial Sequence: Synthetic oligonucleotide
tcatggtgctgtcccaggatgaatctgtgc

SEQ ID NO: 151499 - DNA, 29 bp, Artificial Sequence
  Description of Artificial Sequence: Synthetic oligonucleotide
catggtgctgtcccaggatgaatctgtgc

SEQ ID NO: 151500 - DNA, 30 bp, Artificial Sequence
  Description of Artificial Sequence: Synthetic oligonucleotide
atggtgctgtcccaggatgaatctgtgcag

SEQ ID NO: 151501 - DNA, 29 bp, Artificial Sequence
  Description of Artificial Sequence: Synthetic oligonucleotide
tggtgctgtcccaggatgaatctgtgcag

SEQ ID NO: 151502 - DNA, 28 bp, Artificial Sequence
  Description of Artificial Sequence: Synthetic oligonucleotide
ggtgctgtcccaggatgaatctgtgcag

SEQ ID NO: 151503 - DNA, 29 bp, Artificial Sequence
  Description of Artificial Sequence: Synthetic oligonucleotide
gtgctgtcccaggatgaatctgtgcagtc

SEQ ID NO: 151504 - DNA, 30 bp, Artificial Sequence
  Description of Artificial Sequence: Synthetic oligonucleotide
tgctgtcccaggatgaatctgtgcagtcag

SEQ ID NO: 151505 - DNA, 29 bp, Artificial Sequence
  Description of Artificial Sequence: Synthetic oligonucleotide
gctgtcccaggatgaatctgtgcagtcag

SEQ ID NO: 151506 - DNA, 29 bp, Artificial Sequence
  Description of Artificial Sequence: Synthetic oligonucleotide
ctgtcccaggatgaatctgtgcagtcagg

SEQ ID NO: 151507 - DNA, 29 bp, Artificial Sequence
  Description of Artificial Sequence: Synthetic oligonucleotide
tgtcccaggatgaatctgtgcagtcaggg

SEQ ID NO: 151508 - DNA, 28 bp, Artificial Sequence
  Description of Artificial Sequence: Synthetic oligonucleotide
gtcccaggatgaatctgtgcagtcaggg

SEQ ID NO: 151509 - DNA, 31 bp, Artificial Sequence
  Description of Artificial Sequence: Synthetic oligonucleotide
tcccaggatgaatctgtgcagtcagggtttc

SEQ ID NO: 151510 - DNA, 30 bp, Artificial Sequence
  Description of Artificial Sequence: Synthetic oligonucleotide
cccaggatgaatctgtgcagtcagggtttc

SEQ ID NO: 151511 - DNA, 31 bp, Artificial Sequence
  Description of Artificial Sequence: Synthetic oligonucleotide
ccaggatgaatctgtgcagtcagggtttctc

SEQ ID NO: 151512 - DNA, 31 bp, Artificial Sequence
  Description of Artificial Sequence: Synthetic oligonucleotide
caggatgaatctgtgcagtcagggtttctcg

SEQ ID NO: 151513 - DNA, 31 bp, Artificial Sequence
  Description of Artificial Sequence: Synthetic oligonucleotide
aggatgaatctgtgcagtcagggtttctcgc

SEQ ID NO: 151514 - DNA, 30 bp, Artificial Sequence
  Description of Artificial Sequence: Synthetic oligonucleotide
ggatgaatctgtgcagtcagggtttctcgc

SEQ ID NO: 151515 - DNA, 31 bp, Artificial Sequence
  Description of Artificial Sequence: Synthetic oligonucleotide
gatgaatctgtgcagtcagggtttctcgctg

SEQ ID NO: 151516 - DNA, 32 bp, Artificial Sequence
  Description of Artificial Sequence: Synthetic oligonucleotide
atgaatctgtgcagtcagggtttctcgctgag

SEQ ID NO: 151517 - DNA, 31 bp, Artificial Sequence
  Description of Artificial Sequence: Synthetic oligonucleotide
tgaatctgtgcagtcagggtttctcgctgag

SEQ ID NO: 151518 - DNA, 30 bp, Artificial Sequence
  Description of Artificial Sequence: Synthetic oligonucleotide
gaatctgtgcagtcagggtttctcgctgag

SEQ ID NO: 151519 - DNA, 30 bp, Artificial Sequence
  Description of Artificial Sequence: Synthetic oligonucleotide
aatctgtgcagtcagggtttctcgctgagg

SEQ ID NO: 151520 - DNA, 28 bp, Artificial Sequence
  Description of Artificial Sequence: Synthetic oligonucleotide
cccttcctgcgctatgacaggcagaaac

SEQ ID NO: 151521 - DNA, 28 bp, Artificial Sequence
  Description of Artificial Sequence: Synthetic oligonucleotide
ccttcctgcgctatgacaggcagaaacg

SEQ ID NO: 151522 - DNA, 28 bp, Artificial Sequence
  Description of Artificial Sequence: Synthetic oligonucleotide
cttcctgcgctatgacaggcagaaacgc

SEQ ID NO: 151523 - DNA, 29 bp, Artificial Sequence
  Description of Artificial Sequence: Synthetic oligonucleotide
ttcctgcgctatgacaggcagaaacgcag

SEQ ID NO: 151524 - DNA, 28 bp, Artificial Sequence
  Description of Artificial Sequence: Synthetic oligonucleotide
tcctgcgctatgacaggcagaaacgcag

SEQ ID NO: 151525 - DNA, 27 bp, Artificial Sequence
  Description of Artificial Sequence: Synthetic oligonucleotide
cctgcgctatgacaggcagaaacgcag

SEQ ID NO: 151526 - DNA, 27 bp, Artificial Sequence
  Description of Artificial Sequence: Synthetic oligonucleotide
ctgcgctatgacaggcagaaacgcagg

SEQ ID NO: 151527 - DNA, 27 bp, Artificial Sequence
  Description of Artificial Sequence: Synthetic oligonucleotide
tgcgctatgacaggcagaaacgcaggg

SEQ ID NO: 151528 - DNA, 26 bp, Artificial Sequence
  Description of Artificial Sequence: Synthetic oligonucleotide
gcgctatgacaggcagaaacgcaggg

SEQ ID NO: 151529 - DNA, 27 bp, Artificial Sequence
  Description of Artificial Sequence: Synthetic oligonucleotide
cgctatgacaggcagaaacgcagggca

SEQ ID NO: 151530 - DNA, 29 bp, Artificial Sequence
  Description of Artificial Sequence: Synthetic oligonucleotide
gctatgacaggcagaaacgcagggcaaag

SEQ ID NO: 151531 - DNA, 29 bp, Artificial Sequence
  Description of Artificial Sequence: Synthetic oligonucleotide
ctatgacaggcagaaacgcagggcaaagc

SEQ ID NO: 151532 - DNA, 29 bp, Artificial Sequence
  Description of Artificial Sequence: Synthetic oligonucleotide
tatgacaggcagaaacgcagggcaaagcc

SEQ ID NO: 151533 - DNA, 28 bp, Artificial Sequence
  Description of Artificial Sequence: Synthetic oligonucleotide
atgacaggcagaaacgcagggcaaagcc

SEQ ID NO: 151534 - DNA, 27 bp, Artificial Sequence
  Description of Artificial Sequence: Synthetic oligonucleotide
tgacaggcagaaacgcagggcaaagcc

SEQ ID NO: 151535 - DNA, 26 bp, Artificial Sequence
  Description of Artificial Sequence: Synthetic oligonucleotide
gacaggcagaaacgcagggcaaagcc

SEQ ID NO: 151536 - DNA, 26 bp, Artificial Sequence
  Description of Artificial Sequence: Synthetic oligonucleotide
acaggcagaaacgcagggcaaagccc

SEQ ID NO: 151537 - DNA, 25 bp, Artificial Sequence
  Description of Artificial Sequence: Synthetic oligonucleotide
caggcagaaacgcagggcaaagccc

SEQ ID NO: 151538 - DNA, 26 bp, Artificial Sequence
  Description of Artificial Sequence: Synthetic oligonucleotide
aggcagaaacgcagggcaaagcccca

SEQ ID NO: 151539 - DNA, 25 bp, Artificial Sequence
  Description of Artificial Sequence: Synthetic oligonucleotide
ggcagaaacgcagggcaaagcccca

SEQ ID NO: 151540 - DNA, 25 bp, Artificial Sequence
  Description of Artificial Sequence: Synthetic oligonucleotide
gcagaaacgcagggcaaagccccag

SEQ ID NO: 151541 - DNA, 25 bp, Artificial Sequence
  Description of Artificial Sequence: Synthetic oligonucleotide
cagaaacgcagggcaaagccccagg

SEQ ID NO: 151542 - DNA, 26 bp, Artificial Sequence
  Description of Artificial Sequence: Synthetic oligonucleotide
agaaacgcagggcaaagccccaggga

SEQ ID NO: 151543 - DNA, 25 bp, Artificial Sequence
  Description of Artificial Sequence: Synthetic oligonucleotide
gaaacgcagggcaaagccccaggga

SEQ ID NO: 151544 - DNA, 26 bp, Artificial Sequence
  Description of Artificial Sequence: Synthetic oligonucleotide
aaacgcagggcaaagccccagggaca

SEQ ID NO: 151545 - DNA, 25 bp, Artificial Sequence
  Description of Artificial Sequence: Synthetic oligonucleotide
aacgcagggcaaagccccagggaca

SEQ ID NO: 151546 - DNA, 24 bp, Artificial Sequence
  Description of Artificial Sequence: Synthetic oligonucleotide
acgcagggcaaagccccagggaca

SEQ ID NO: 151547 - DNA, 23 bp, Artificial Sequence
  Description of Artificial Sequence: Synthetic oligonucleotide
cgcagggcaaagccccagggaca

SEQ ID NO: 151548 - DNA, 27 bp, Artificial Sequence
  Description of Artificial Sequence: Synthetic oligonucleotide
gacagtgggcagaagatgtcctgggag

SEQ ID NO: 151549 - DNA, 27 bp, Artificial Sequence
  Description of Artificial Sequence: Synthetic oligonucleotide
acagtgggcagaagatgtcctgggagc

SEQ ID NO: 151550 - DNA, 27 bp, Artificial Sequence
  Description of Artificial Sequence: Synthetic oligonucleotide
cagtgggcagaagatgtcctgggagct

SEQ ID NO: 151551 - DNA, 29 bp, Artificial Sequence
  Description of Artificial Sequence: Synthetic oligonucleotide
agtgggcagaagatgtcctgggagctaag

SEQ ID NO: 151552 - DNA, 28 bp, Artificial Sequence
  Description of Artificial Sequence: Synthetic oligonucleotide
gtgggcagaagatgtcctgggagctaag

SEQ ID NO: 151553 - DNA, 29 bp, Artificial Sequence
  Description of Artificial Sequence: Synthetic oligonucleotide
tgggcagaagatgtcctgggagctaagac

SEQ ID NO: 151554 - DNA, 28 bp, Artificial Sequence
  Description of Artificial Sequence: Synthetic oligonucleotide
gggcagaagatgtcctgggagctaagac

SEQ ID NO: 151555 - DNA, 28 bp, Artificial Sequence
  Description of Artificial Sequence: Synthetic oligonucleotide
ggcagaagatgtcctgggagctaagacc

SEQ ID NO: 151556 - DNA, 29 bp, Artificial Sequence
  Description of Artificial Sequence: Synthetic oligonucleotide
gcagaagatgtcctgggagctaagacctg

SEQ ID NO: 151557 - DNA, 29 bp, Artificial Sequence
  Description of Artificial Sequence: Synthetic oligonucleotide
cagaagatgtcctgggagctaagacctgg

SEQ ID NO: 151558 - DNA, 29 bp, Artificial Sequence
  Description of Artificial Sequence: Synthetic oligonucleotide
agaagatgtcctgggagctaagacctggg

SEQ ID NO: 151559 - DNA, 28 bp, Artificial Sequence
  Description of Artificial Sequence: Synthetic oligonucleotide
gaagatgtcctgggagctaagacctggg

SEQ ID NO: 151560 - DNA, 29 bp, Artificial Sequence
  Description of Artificial Sequence: Synthetic oligonucleotide
aagatgtcctgggagctaagacctgggac

SEQ ID NO: 151561 - DNA, 28 bp, Artificial Sequence
  Description of Artificial Sequence: Synthetic oligonucleotide
agatgtcctgggagctaagacctgggac

SEQ ID NO: 151562 - DNA, 27 bp, Artificial Sequence
  Description of Artificial Sequence: Synthetic oligonucleotide
gatgtcctgggagctaagacctgggac

SEQ ID NO: 151563 - DNA, 28 bp, Artificial Sequence
  Description of Artificial Sequence: Synthetic oligonucleotide
atgtcctgggagctaagacctgggacac

SEQ ID NO: 151564 - DNA, 27 bp, Artificial Sequence
  Description of Artificial Sequence: Synthetic oligonucleotide
tgtcctgggagctaagacctgggacac

SEQ ID NO: 151565 - DNA, 27 bp, Artificial Sequence
  Description of Artificial Sequence: Synthetic oligonucleotide
gtcctgggagctaagacctgggacaca

SEQ ID NO: 151566 - DNA, 27 bp, Artificial Sequence
  Description of Artificial Sequence: Synthetic oligonucleotide
tcctgggagctaagacctgggacacag

SEQ ID NO: 151567 - DNA, 27 bp, Artificial Sequence
  Description of Artificial Sequence: Synthetic oligonucleotide
cctgggagctaagacctgggacacaga

SEQ ID NO: 151568 - DNA, 27 bp, Artificial Sequence
  Description of Artificial Sequence: Synthetic oligonucleotide
ctgggagctaagacctgggacacagag

SEQ ID NO: 151569 - DNA, 28 bp, Artificial Sequence
  Description of Artificial Sequence: Synthetic oligonucleotide
tgggagctaagacctgggacacagagac

SEQ ID NO: 151570 - DNA, 27 bp, Artificial Sequence
  Description of Artificial Sequence: Synthetic oligonucleotide
gggagctaagacctgggacacagagac

SEQ ID NO: 151571 - DNA, 27 bp, Artificial Sequence
  Description of Artificial Sequence: Synthetic oligonucleotide
ggagctaagacctgggacacagagacc

SEQ ID NO: 151572 - DNA, 27 bp, Artificial Sequence
  Description of Artificial Sequence: Synthetic oligonucleotide
gagctaagacctgggacacagagaccg

SEQ ID NO: 151573 - DNA, 28 bp, Artificial Sequence
  Description of Artificial Sequence: Synthetic oligonucleotide
agctaagacctgggacacagagaccgag

SEQ ID NO: 151574 - DNA, 27 bp, Artificial Sequence
  Description of Artificial Sequence: Synthetic oligonucleotide
gctaagacctgggacacagagaccgag

SEQ ID NO: 151575 - DNA, 27 bp, Artificial Sequence
  Description of Artificial Sequence: Synthetic oligonucleotide
ctaagacctgggacacagagaccgagg

SEQ ID NO: 151576 - DNA, 28 bp, Artificial Sequence
  Description of Artificial Sequence: Synthetic oligonucleotide
taagacctgggacacagagaccgaggac

SEQ ID NO: 151577 - DNA, 27 bp, Artificial Sequence
  Description of Artificial Sequence: Synthetic oligonucleotide
aagacctgggacacagagaccgaggac

SEQ ID NO: 151578 - DNA, 27 bp, Artificial Sequence
  Description of Artificial Sequence: Synthetic oligonucleotide
agacctgggacacagagaccgaggact

SEQ ID NO: 151579 - DNA, 27 bp, Artificial Sequence
  Description of Artificial Sequence: Synthetic oligonucleotide
gacctgggacacagagaccgaggactt

SEQ ID NO: 151580 - DNA, 27 bp, Artificial Sequence
  Description of Artificial Sequence: Synthetic oligonucleotide
acctgggacacagagaccgaggacttg

SEQ ID NO: 151581 - DNA, 27 bp, Artificial Sequence
  Description of Artificial Sequence: Synthetic oligonucleotide
cctgggacacagagaccgaggacttga

SEQ ID NO: 151582 - DNA, 27 bp, Artificial Sequence
  Description of Artificial Sequence: Synthetic oligonucleotide
ctgggacacagagaccgaggacttgac

SEQ ID NO: 151583 - DNA, 28 bp, Artificial Sequence
  Description of Artificial Sequence: Synthetic oligonucleotide
tgggacacagagaccgaggacttgacag

SEQ ID NO: 151584 - DNA, 27 bp, Artificial Sequence
  Description of Artificial Sequence: Synthetic oligonucleotide
gggacacagagaccgaggacttgacag

SEQ ID NO: 151585 - DNA, 28 bp, Artificial Sequence
  Description of Artificial Sequence: Synthetic oligonucleotide
ggacacagagaccgaggacttgacagag

SEQ ID NO: 151586 - DNA, 31 bp, Artificial Sequence
  Description of Artificial Sequence: Synthetic oligonucleotide
gacacagagaccgaggacttgacagagaatg

SEQ ID NO: 151587 - DNA, 31 bp, Artificial Sequence
  Description of Artificial Sequence: Synthetic oligonucleotide
acacagagaccgaggacttgacagagaatgg

SEQ ID NO: 151588 - DNA, 30 bp, Artificial Sequence
  Description of Artificial Sequence: Synthetic oligonucleotide
cacagagaccgaggacttgacagagaatgg

SEQ ID NO: 151589 - DNA, 30 bp, Artificial Sequence
  Description of Artificial Sequence: Synthetic oligonucleotide
acagagaccgaggacttgacagagaatggg

SEQ ID NO: 151590 - DNA, 29 bp, Artificial Sequence
  Description of Artificial Sequence: Synthetic oligonucleotide
cagagaccgaggacttgacagagaatggg

SEQ ID NO: 151591 - DNA, 29 bp, Artificial Sequence
  Description of Artificial Sequence: Synthetic oligonucleotide
agagaccgaggacttgacagagaatgggc

SEQ ID NO: 151592 - DNA, 28 bp, Artificial Sequence
  Description of Artificial Sequence: Synthetic oligonucleotide
gagaccgaggacttgacagagaatgggc

SEQ ID NO: 151593 - DNA, 30 bp, Artificial Sequence
  Description of Artificial Sequence: Synthetic oligonucleotide
agaccgaggacttgacagagaatgggcaag

SEQ ID NO: 151594 - DNA, 29 bp, Artificial Sequence
  Description of Artificial Sequence: Synthetic oligonucleotide
gaccgaggacttgacagagaatgggcaag

SEQ ID NO: 151595 - DNA, 30 bp, Artificial Sequence
  Description of Artificial Sequence: Synthetic oligonucleotide
accgaggacttgacagagaatgggcaagac

SEQ ID NO: 151596 - DNA, 29 bp, Artificial Sequence
  Description of Artificial Sequence: Synthetic oligonucleotide
ccgaggacttgacagagaatgggcaagac

SEQ ID NO: 151597 - DNA, 29 bp, Artificial Sequence
  Description of Artificial Sequence: Synthetic oligonucleotide
cgaggacttgacagagaatgggcaagacc

SEQ ID NO: 151598 - DNA, 30 bp, Artificial Sequence
  Description of Artificial Sequence: Synthetic oligonucleotide
gaggacttgacagagaatgggcaagacctc

SEQ ID NO: 151599 - DNA, 31 bp, Artificial Sequence
  Description of Artificial Sequence: Synthetic oligonucleotide
aggacttgacagagaatgggcaagacctcag

SEQ ID NO: 151600 - DNA, 30 bp, Artificial Sequence
  Description of Artificial Sequence: Synthetic oligonucleotide
ggacttgacagagaatgggcaagacctcag

SEQ ID NO: 151601 - DNA, 30 bp, Artificial Sequence
  Description of Artificial Sequence: Synthetic oligonucleotide
gacttgacagagaatgggcaagacctcagg

SEQ ID NO: 151602 - DNA, 31 bp, Artificial Sequence
  Description of Artificial Sequence: Synthetic oligonucleotide
acttgacagagaatgggcaagacctcaggag

SEQ ID NO: 151603 - DNA, 30 bp, Artificial Sequence
  Description of Artificial Sequence: Synthetic oligonucleotide
cttgacagagaatgggcaagacctcaggag

SEQ ID NO: 151604 - DNA, 30 bp, Artificial Sequence
  Description of Artificial Sequence: Synthetic oligonucleotide
ttgacagagaatgggcaagacctcaggagg

SEQ ID NO: 151605 - DNA, 29 bp, Artificial Sequence
  Description of Artificial Sequence: Synthetic oligonucleotide
tgacagagaatgggcaagacctcaggagg

SEQ ID NO: 151606 - DNA, 28 bp, Artificial Sequence
  Description of Artificial Sequence: Synthetic oligonucleotide
gacagagaatgggcaagacctcaggagg

SEQ ID NO: 151607 - DNA, 29 bp, Artificial Sequence
  Description of Artificial Sequence: Synthetic oligonucleotide
acagagaatgggcaagacctcaggaggac

SEQ ID NO: 151608 - DNA, 28 bp, Artificial Sequence
  Description of Artificial Sequence: Synthetic oligonucleotide
cagagaatgggcaagacctcaggaggac

SEQ ID NO: 151609 - DNA, 28 bp, Artificial Sequence
  Description of Artificial Sequence: Synthetic oligonucleotide
agagaatgggcaagacctcaggaggacc

SEQ ID NO: 151610 - DNA, 27 bp, Artificial Sequence
  Description of Artificial Sequence: Synthetic oligonucleotide
gagaatgggcaagacctcaggaggacc

SEQ ID NO: 151611 - DNA, 27 bp, Artificial Sequence
  Description of Artificial Sequence: Synthetic oligonucleotide
agaatgggcaagacctcaggaggaccc

SEQ ID NO: 151612 - DNA, 27 bp, Artificial Sequence
  Description of Artificial Sequence: Synthetic oligonucleotide
gaatgggcaagacctcaggaggaccct

SEQ ID NO: 151613 - DNA, 27 bp, Artificial Sequence
  Description of Artificial Sequence: Synthetic oligonucleotide
aatgggcaagacctcaggaggaccctg

SEQ ID NO: 151614 - DNA, 27 bp, Artificial Sequence
  Description of Artificial Sequence: Synthetic oligonucleotide
atgggcaagacctcaggaggaccctga

SEQ ID NO: 151615 - DNA, 26 bp, Artificial Sequence
  Description of Artificial Sequence: Synthetic oligonucleotide
tgggcaagacctcaggaggaccctga

SEQ ID NO: 151616 - DNA, 25 bp, Artificial Sequence
  Description of Artificial Sequence: Synthetic oligonucleotide
gggcaagacctcaggaggaccctga

SEQ ID NO: 151617 - DNA, 26 bp, Artificial Sequence
  Description of Artificial Sequence: Synthetic oligonucleotide
ggcaagacctcaggaggaccctgact

SEQ ID NO: 151618 - DNA, 27 bp, Artificial Sequence
  Description of Artificial Sequence: Synthetic oligonucleotide
gcaagacctcaggaggaccctgactca

SEQ ID NO: 151619 - DNA, 30 bp, Artificial Sequence
  Description of Artificial Sequence: Synthetic oligonucleotide
caagacctcaggaggaccctgactcatatc

SEQ ID NO: 151620 - DNA, 32 bp, Artificial Sequence
  Description of Artificial Sequence: Synthetic oligonucleotide
aagacctcaggaggaccctgactcatatcaag

SEQ ID NO: 151621 - DNA, 31 bp, Artificial Sequence
  Description of Artificial Sequence: Synthetic oligonucleotide
agacctcaggaggaccctgactcatatcaag

SEQ ID NO: 151622 - DNA, 30 bp, Artificial Sequence
  Description of Artificial Sequence: Synthetic oligonucleotide
gacctcaggaggaccctgactcatatcaag

SEQ ID NO: 151623 - DNA, 30 bp, Artificial Sequence
  Description of Artificial Sequence: Synthetic oligonucleotide
acctcaggaggaccctgactcatatcaagg

SEQ ID NO: 151624 - DNA, 29 bp, Artificial Sequence
  Description of Artificial Sequence: Synthetic oligonucleotide
cctcaggaggaccctgactcatatcaagg

SEQ ID NO: 151625 - DNA, 30 bp, Artificial Sequence
  Description of Artificial Sequence: Synthetic oligonucleotide
ctcaggaggaccctgactcatatcaaggac

SEQ ID NO: 151626 - DNA, 30 bp, Artificial Sequence
  Description of Artificial Sequence: Synthetic oligonucleotide
tcaggaggaccctgactcatatcaaggacc

SEQ ID NO: 151627 - DNA, 29 bp, Artificial Sequence
  Description of Artificial Sequence: Synthetic oligonucleotide
caggaggaccctgactcatatcaaggacc

SEQ ID NO: 151628 - DNA, 30 bp, Artificial Sequence
  Description of Artificial Sequence: Synthetic oligonucleotide
aggaggaccctgactcatatcaaggaccag

SEQ ID NO: 151629 - DNA, 29 bp, Artificial Sequence
  Description of Artificial Sequence: Synthetic oligonucleotide
ggaggaccctgactcatatcaaggaccag

SEQ ID NO: 151630 - DNA, 32 bp, Artificial Sequence
  Description of Artificial Sequence: Synthetic oligonucleotide
gaggaccctgactcatatcaaggaccagaaag

SEQ ID NO: 151631 - DNA, 32 bp, Artificial Sequence
  Description of Artificial Sequence: Synthetic oligonucleotide
aggaccctgactcatatcaaggaccagaaagg

SEQ ID NO: 151632 - DNA, 31 bp, Artificial Sequence
  Description of Artificial Sequence: Synthetic oligonucleotide
ggaccctgactcatatcaaggaccagaaagg

SEQ ID NO: 151633 - DNA, 32 bp, Artificial Sequence
  Description of Artificial Sequence: Synthetic oligonucleotide
gaccctgactcatatcaaggaccagaaaggag

SEQ ID NO: 151634 - DNA, 32 bp, Artificial Sequence
  Description of Artificial Sequence: Synthetic oligonucleotide
accctgactcatatcaaggaccagaaaggagg

SEQ ID NO: 151635 - DNA, 31 bp, Artificial Sequence
  Description of Artificial Sequence: Synthetic oligonucleotide
ccctgactcatatcaaggaccagaaaggagg

SEQ ID NO: 151636 - DNA, 31 bp, Artificial Sequence
  Description of Artificial Sequence: Synthetic oligonucleotide
cctgactcatatcaaggaccagaaaggaggc

SEQ ID NO: 151637 - DNA, 33 bp, Artificial Sequence
  Description of Artificial Sequence: Synthetic oligonucleotide
ctgactcatatcaaggaccagaaaggaggcttg

SEQ ID NO: 151638 - DNA, 33 bp, Artificial Sequence
  Description of Artificial Sequence: Synthetic oligonucleotide
tgactcatatcaaggaccagaaaggaggcttgc

SEQ ID NO: 151639 - DNA, 32 bp, Artificial Sequence
  Description of Artificial Sequence: Synthetic oligonucleotide
gactcatatcaaggaccagaaaggaggcttgc

SEQ ID NO: 151640 - DNA, 35 bp, Artificial Sequence
  Description of Artificial Sequence: Synthetic oligonucleotide
actcatatcaaggaccagaaaggaggcttgcattc

SEQ ID NO: 151641 - DNA, 34 bp, Artificial Sequence
  Description of Artificial Sequence: Synthetic oligonucleotide
ctcatatcaaggaccagaaaggaggcttgcattc

SEQ ID NO: 151642 - DNA, 34 bp, Artificial Sequence
  Description of Artificial Sequence: Synthetic oligonucleotide
tcatatcaaggaccagaaaggaggcttgcattcc

SEQ ID NO: 151643 - DNA, 33 bp, Artificial Sequence
  Description of Artificial Sequence: Synthetic oligonucleotide
catatcaaggaccagaaaggaggcttgcattcc

SEQ ID NO: 151644 - DNA, 33 bp, Artificial Sequence
  Description of Artificial Sequence: Synthetic oligonucleotide
atatcaaggaccagaaaggaggcttgcattccc

SEQ ID NO: 151645 - DNA, 32 bp, Artificial Sequence
  Description of Artificial Sequence: Synthetic oligonucleotide
tatcaaggaccagaaaggaggcttgcattccc

SEQ ID NO: 151646 - DNA, 31 bp, Artificial Sequence
  Description of Artificial Sequence: Synthetic oligonucleotide
atcaaggaccagaaaggaggcttgcattccc

SEQ ID NO: 151647 - DNA, 30 bp, Artificial Sequence
  Description of Artificial Sequence: Synthetic oligonucleotide
tcaaggaccagaaaggaggcttgcattccc

SEQ ID NO: 151648 - DNA, 29 bp, Artificial Sequence
  Description of Artificial Sequence: Synthetic oligonucleotide
caaggaccagaaaggaggcttgcattccc

SEQ ID NO: 151649 - DNA, 30 bp, Artificial Sequence
  Description of Artificial Sequence: Synthetic oligonucleotide
aaggaccagaaaggaggcttgcattccctc

SEQ ID NO: 151650 - DNA, 29 bp, Artificial Sequence
  Description of Artificial Sequence: Synthetic oligonucleotide
aggaccagaaaggaggcttgcattccctc

SEQ ID NO: 151651 - DNA, 28 bp, Artificial Sequence
  Description of Artificial Sequence: Synthetic oligonucleotide
ggaccagaaaggaggcttgcattccctc

SEQ ID NO: 151652 - DNA, 28 bp, Artificial Sequence
  Description of Artificial Sequence: Synthetic oligonucleotide
gaccagaaaggaggcttgcattccctcc

SEQ ID NO: 151653 - DNA, 29 bp, Artificial Sequence
  Description of Artificial Sequence: Synthetic oligonucleotide
accagaaaggaggcttgcattccctccag

SEQ ID NO: 151654 - DNA, 28 bp, Artificial Sequence
  Description of Artificial Sequence: Synthetic oligonucleotide
ccagaaaggaggcttgcattccctccag

SEQ ID NO: 151655 - DNA, 28 bp, Artificial Sequence
  Description of Artificial Sequence: Synthetic oligonucleotide
cagaaaggaggcttgcattccctccagg

SEQ ID NO: 151656 - DNA, 29 bp, Artificial Sequence
  Description of Artificial Sequence: Synthetic oligonucleotide
agaaaggaggcttgcattccctccaggag

SEQ ID NO: 151657 - DNA, 28 bp, Artificial Sequence
  Description of Artificial Sequence: Synthetic oligonucleotide
gaaaggaggcttgcattccctccaggag

SEQ ID NO: 151658 - DNA, 32 bp, Artificial Sequence
  Description of Artificial Sequence: Synthetic oligonucleotide
aaaggaggcttgcattccctccaggagattag

SEQ ID NO: 151659 - DNA, 31 bp, Artificial Sequence
  Description of Artificial Sequence: Synthetic oligonucleotide
aaggaggcttgcattccctccaggagattag

SEQ ID NO: 151660 - DNA, 30 bp, Artificial Sequence
  Description of Artificial Sequence: Synthetic oligonucleotide
aggaggcttgcattccctccaggagattag

SEQ ID NO: 151661 - DNA, 29 bp, Artificial Sequence
  Description of Artificial Sequence: Synthetic oligonucleotide
ggaggcttgcattccctccaggagattag

SEQ ID NO: 151662 - DNA, 29 bp, Artificial Sequence
  Description of Artificial Sequence: Synthetic oligonucleotide
gaggcttgcattccctccaggagattagg

SEQ ID NO: 151663 - DNA, 34 bp, Artificial Sequence
  Description of Artificial Sequence: Synthetic oligonucleotide
aggagattagggtctgtgagatccatgaagacag

SEQ ID NO: 151664 - DNA, 33 bp, Artificial Sequence
  Description of Artificial Sequence: Synthetic oligonucleotide
ggagattagggtctgtgagatccatgaagacag

SEQ ID NO: 151665 - DNA, 33 bp, Artificial Sequence
  Description of Artificial Sequence: Synthetic oligonucleotide
gagattagggtctgtgagatccatgaagacagc

SEQ ID NO: 151666 - DNA, 34 bp, Artificial Sequence
  Description of Artificial Sequence: Synthetic oligonucleotide
agattagggtctgtgagatccatgaagacagcag

SEQ ID NO: 151667 - DNA, 33 bp, Artificial Sequence
  Description of Artificial Sequence: Synthetic oligonucleotide
gattagggtctgtgagatccatgaagacagcag

SEQ ID NO: 151668 - DNA, 33 bp, Artificial Sequence
  Description of Artificial Sequence: Synthetic oligonucleotide
attagggtctgtgagatccatgaagacagcagc

SEQ ID NO: 151669 - DNA, 32 bp, Artificial Sequence
  Description of Artificial Sequence: Synthetic oligonucleotide
ttagggtctgtgagatccatgaagacagcagc

SEQ ID NO: 151670 - DNA, 31 bp, Artificial Sequence
  Description of Artificial Sequence: Synthetic oligonucleotide
tagggtctgtgagatccatgaagacagcagc

SEQ ID NO: 151671 - DNA, 30 bp, Artificial Sequence
  Description of Artificial Sequence: Synthetic oligonucleotide
agggtctgtgagatccatgaagacagcagc

SEQ ID NO: 151672 - DNA, 29 bp, Artificial Sequence
  Description of Artificial Sequence: Synthetic oligonucleotide
gggtctgtgagatccatgaagacagcagc

SEQ ID NO: 151673 - DNA, 30 bp, Artificial Sequence
  Description of Artificial Sequence: Synthetic oligonucleotide
ggtctgtgagatccatgaagacagcagcac

SEQ ID NO: 151674 - DNA, 30 bp, Artificial Sequence
  Description of Artificial Sequence: Synthetic oligonucleotide
gtctgtgagatccatgaagacagcagcacc

SEQ ID NO: 151675 - DNA, 31 bp, Artificial Sequence
  Description of Artificial Sequence: Synthetic oligonucleotide
tctgtgagatccatgaagacagcagcaccag

SEQ ID NO: 151676 - DNA, 30 bp, Artificial Sequence
  Description of Artificial Sequence: Synthetic oligonucleotide
ctgtgagatccatgaagacagcagcaccag

SEQ ID NO: 151677 - DNA, 30 bp, Artificial Sequence
  Description of Artificial Sequence: Synthetic oligonucleotide
tgtgagatccatgaagacagcagcaccagg

SEQ ID NO: 151678 - DNA, 29 bp, Artificial Sequence
  Description of Artificial Sequence: Synthetic oligonucleotide
gtgagatccatgaagacagcagcaccagg

SEQ ID NO: 151679 - DNA, 29 bp, Artificial Sequence
  Description of Artificial Sequence: Synthetic oligonucleotide
tgagatccatgaagacagcagcaccaggg

SEQ ID NO: 151680 - DNA, 28 bp, Artificial Sequence
  Description of Artificial Sequence: Synthetic oligonucleotide
gagatccatgaagacagcagcaccaggg

SEQ ID NO: 151681 - DNA, 28 bp, Artificial Sequence
  Description of Artificial Sequence: Synthetic oligonucleotide
agatccatgaagacagcagcaccagggg

SEQ ID NO: 151682 - DNA, 27 bp, Artificial Sequence
  Description of Artificial Sequence: Synthetic oligonucleotide
gatccatgaagacagcagcaccagggg

SEQ ID NO: 151683 - DNA, 27 bp, Artificial Sequence
  Description of Artificial Sequence: Synthetic oligonucleotide
atccatgaagacagcagcaccaggggc

SEQ ID NO: 151684 - DNA, 27 bp, Artificial Sequence
  Description of Artificial Sequence: Synthetic oligonucleotide
tccatgaagacagcagcaccaggggct

SEQ ID NO: 151685 - DNA, 26 bp, Artificial Sequence
  Description of Artificial Sequence: Synthetic oligonucleotide
ccatgaagacagcagcaccaggggct

SEQ ID NO: 151686 - DNA, 26 bp, Artificial Sequence
  Description of Artificial Sequence: Synthetic oligonucleotide
catgaagacagcagcaccaggggctc

SEQ ID NO: 151687 - DNA, 26 bp, Artificial Sequence
  Description of Artificial Sequence: Synthetic oligonucleotide
atgaagacagcagcaccaggggctcc

SEQ ID NO: 151688 - DNA, 25 bp, Artificial Sequence
  Description of Artificial Sequence: Synthetic oligonucleotide
tgaagacagcagcaccaggggctcc

SEQ ID NO: 151689 - DNA, 24 bp, Artificial Sequence
  Description of Artificial Sequence: Synthetic oligonucleotide
gaagacagcagcaccaggggctcc

SEQ ID NO: 151690 - DNA, 24 bp, Artificial Sequence
  Description of Artificial Sequence: Synthetic oligonucleotide
aagacagcagcaccaggggctccc

SEQ ID NO: 151691 - DNA, 23 bp, Artificial Sequence
  Description of Artificial Sequence: Synthetic oligonucleotide
agacagcagcaccaggggctccc

SEQ ID NO: 151692 - DNA, 22 bp, Artificial Sequence
  Description of Artificial Sequence: Synthetic oligonucleotide
gacagcagcaccaggggctccc

SEQ ID NO: 151693 - DNA, 22 bp, Artificial Sequence
  Description of Artificial Sequence: Synthetic oligonucleotide
acagcagcaccaggggctcccg

SEQ ID NO: 151694 - DNA, 21 bp, Artificial Sequence
  Description of Artificial Sequence: Synthetic oligonucleotide
cagcagcaccaggggctcccg

SEQ ID NO: 151695 - DNA, 21 bp, Artificial Sequence
  Description of Artificial Sequence: Synthetic oligonucleotide
agcagcaccaggggctcccgg

SEQ ID NO: 151696 - DNA, 20 bp, Artificial Sequence
  Description of Artificial Sequence: Synthetic oligonucleotide
gcagcaccaggggctcccgg

SEQ ID NO: 151697 - DNA, 24 bp, Artificial Sequence
  Description of Artificial Sequence: Synthetic oligonucleotide
cagcaccaggggctcccggcattt

SEQ ID NO: 151698 - DNA, 26 bp, Artificial Sequence
  Description of Artificial Sequence: Synthetic oligonucleotide
agcaccaggggctcccggcatttcta

SEQ ID NO: 151699 - DNA, 25 bp, Artificial Sequence
  Description of Artificial Sequence: Synthetic oligonucleotide
gcaccaggggctcccggcatttcta

SEQ ID NO: 151700 - DNA, 27 bp, Artificial Sequence
  Description of Artificial Sequence: Synthetic oligonucleotide
caccaggggctcccggcatttctacta

SEQ ID NO: 151701 - DNA, 27 bp, Artificial Sequence
  Description of Artificial Sequence: Synthetic oligonucleotide
accaggggctcccggcatttctactac

SEQ ID NO: 151702 - DNA, 26 bp, Artificial Sequence
  Description of Artificial Sequence: Synthetic oligonucleotide
ccaggggctcccggcatttctactac

SEQ ID NO: 151703 - DNA, 27 bp, Artificial Sequence
  Description of Artificial Sequence: Synthetic oligonucleotide
caggggctcccggcatttctactacga

SEQ ID NO: 151704 - DNA, 28 bp, Artificial Sequence
  Description of Artificial Sequence: Synthetic oligonucleotide
aggggctcccggcatttctactacgatg

SEQ ID NO: 151705 - DNA, 27 bp, Artificial Sequence
  Description of Artificial Sequence: Synthetic oligonucleotide
ggggctcccggcatttctactacgatg

SEQ ID NO: 151706 - DNA, 27 bp, Artificial Sequence
  Description of Artificial Sequence: Synthetic oligonucleotide
gggctcccggcatttctactacgatgg

SEQ ID NO: 151707 - DNA, 27 bp, Artificial Sequence
  Description of Artificial Sequence: Synthetic oligonucleotide
ggctcccggcatttctactacgatggg

SEQ ID NO: 151708 - DNA, 27 bp, Artificial Sequence
  Description of Artificial Sequence: Synthetic oligonucleotide
gctcccggcatttctactacgatgggg

SEQ ID NO: 151709 - DNA, 28 bp, Artificial Sequence
  Description of Artificial Sequence: Synthetic oligonucleotide
ctcccggcatttctactacgatggggag

SEQ ID NO: 151710 - DNA, 28 bp, Artificial Sequence
  Description of Artificial Sequence: Synthetic oligonucleotide
tcccggcatttctactacgatggggagc

SEQ ID NO: 151711 - DNA, 27 bp, Artificial Sequence
  Description of Artificial Sequence: Synthetic oligonucleotide
cccggcatttctactacgatggggagc

SEQ ID NO: 151712 - DNA, 28 bp, Artificial Sequence
  Description of Artificial Sequence: Synthetic oligonucleotide
ccggcatttctactacgatggggagctc

SEQ ID NO: 151713 - DNA, 30 bp, Artificial Sequence
  Description of Artificial Sequence: Synthetic oligonucleotide
cggcatttctactacgatggggagctcttc

SEQ ID NO: 151714 - DNA, 30 bp, Artificial Sequence
  Description of Artificial Sequence: Synthetic oligonucleotide
ggcatttctactacgatggggagctcttcc

SEQ ID NO: 151715 - DNA, 30 bp, Artificial Sequence
  Description of Artificial Sequence: Synthetic oligonucleotide
agctcttcctctcccaaaacctggagactc

SEQ ID NO: 151716 - DNA, 29 bp, Artificial Sequence
  Description of Artificial Sequence: Synthetic oligonucleotide
gctcttcctctcccaaaacctggagactc

SEQ ID NO: 151717 - DNA, 31 bp, Artificial Sequence
  Description of Artificial Sequence: Synthetic oligonucleotide
ctcttcctctcccaaaacctggagactcaag

SEQ ID NO: 151718 - DNA, 34 bp, Artificial Sequence
  Description of Artificial Sequence: Synthetic oligonucleotide
tcttcctctcccaaaacctggagactcaagaatc

SEQ ID NO: 151719 - DNA, 33 bp, Artificial Sequence
  Description of Artificial Sequence: Synthetic oligonucleotide
cttcctctcccaaaacctggagactcaagaatc

SEQ ID NO: 151720 - DNA, 33 bp, Artificial Sequence
  Description of Artificial Sequence: Synthetic oligonucleotide
ttcctctcccaaaacctggagactcaagaatcg

SEQ ID NO: 151721 - DNA, 32 bp, Artificial Sequence
  Description of Artificial Sequence: Synthetic oligonucleotide
tcctctcccaaaacctggagactcaagaatcg

SEQ ID NO: 151722 - DNA, 31 bp, Artificial Sequence
  Description of Artificial Sequence: Synthetic oligonucleotide
cctctcccaaaacctggagactcaagaatcg

SEQ ID NO: 151723 - DNA, 32 bp, Artificial Sequence
  Description of Artificial Sequence: Synthetic oligonucleotide
ctctcccaaaacctggagactcaagaatcgac

SEQ ID NO: 151724 - DNA, 33 bp, Artificial Sequence
  Description of Artificial Sequence: Synthetic oligonucleotide
tctcccaaaacctggagactcaagaatcgacag

SEQ ID NO: 151725 - DNA, 32 bp, Artificial Sequence
  Description of Artificial Sequence: Synthetic oligonucleotide
ctcccaaaacctggagactcaagaatcgacag

SEQ ID NO: 151726 - DNA, 33 bp, Artificial Sequence
  Description of Artificial Sequence: Synthetic oligonucleotide
tcccaaaacctggagactcaagaatcgacagtg

SEQ ID NO: 151727 - DNA, 32 bp, Artificial Sequence
  Description of Artificial Sequence: Synthetic oligonucleotide
cccaaaacctggagactcaagaatcgacagtg

SEQ ID NO: 151728 - DNA, 32 bp, Artificial Sequence
  Description of Artificial Sequence: Synthetic oligonucleotide
ccaaaacctggagactcaagaatcgacagtgc

SEQ ID NO: 151729 - DNA, 32 bp, Artificial Sequence
  Description of Artificial Sequence: Synthetic oligonucleotide
caaaacctggagactcaagaatcgacagtgcc

SEQ ID NO: 151730 - DNA, 32 bp, Artificial Sequence
  Description of Artificial Sequence: Synthetic oligonucleotide
aaaacctggagactcaagaatcgacagtgccc

SEQ ID NO: 151731 - DNA, 31 bp, Artificial Sequence
  Description of Artificial Sequence: Synthetic oligonucleotide
aaacctggagactcaagaatcgacagtgccc

SEQ ID NO: 151732 - DNA, 30 bp, Artificial Sequence
  Description of Artificial Sequence: Synthetic oligonucleotide
aacctggagactcaagaatcgacagtgccc

SEQ ID NO: 151733 - DNA, 29 bp, Artificial Sequence
  Description of Artificial Sequence: Synthetic oligonucleotide
acctggagactcaagaatcgacagtgccc

SEQ ID NO: 151734 - DNA, 28 bp, Artificial Sequence
  Description of Artificial Sequence: Synthetic oligonucleotide
cctggagactcaagaatcgacagtgccc

SEQ ID NO: 151735 - DNA, 28 bp, Artificial Sequence
  Description of Artificial Sequence: Synthetic oligonucleotide
ctggagactcaagaatcgacagtgcccc

SEQ ID NO: 151736 - DNA, 29 bp, Artificial Sequence
  Description of Artificial Sequence: Synthetic oligonucleotide
tggagactcaagaatcgacagtgccccag

SEQ ID NO: 151737 - DNA, 28 bp, Artificial Sequence
  Description of Artificial Sequence: Synthetic oligonucleotide
ggagactcaagaatcgacagtgccccag

SEQ ID NO: 151738 - DNA, 29 bp, Artificial Sequence
  Description of Artificial Sequence: Synthetic oligonucleotide
gagactcaagaatcgacagtgccccagtc

SEQ ID NO: 151739 - DNA, 29 bp, Artificial Sequence
  Description of Artificial Sequence: Synthetic oligonucleotide
agactcaagaatcgacagtgccccagtcc

SEQ ID NO: 151740 - DNA, 28 bp, Artificial Sequence
  Description of Artificial Sequence: Synthetic oligonucleotide
gactcaagaatcgacagtgccccagtcc

SEQ ID NO: 151741 - DNA, 29 bp, Artificial Sequence
  Description of Artificial Sequence: Synthetic oligonucleotide
actcaagaatcgacagtgccccagtcctc

SEQ ID NO: 151742 - DNA, 28 bp, Artificial Sequence
  Description of Artificial Sequence: Synthetic oligonucleotide
ctcaagaatcgacagtgccccagtcctc

SEQ ID NO: 151743 - DNA, 28 bp, Artificial Sequence
  Description of Artificial Sequence: Synthetic oligonucleotide
tcaagaatcgacagtgccccagtcctcc

SEQ ID NO: 151744 - DNA, 27 bp, Artificial Sequence
  Description of Artificial Sequence: Synthetic oligonucleotide
caagaatcgacagtgccccagtcctcc

SEQ ID NO: 151745 - DNA, 28 bp, Artificial Sequence
  Description of Artificial Sequence: Synthetic oligonucleotide
aagaatcgacagtgccccagtcctccag

SEQ ID NO: 151746 - DNA, 27 bp, Artificial Sequence
  Description of Artificial Sequence: Synthetic oligonucleotide
agaatcgacagtgccccagtcctccag

SEQ ID NO: 151747 - DNA, 27 bp, Artificial Sequence
  Description of Artificial Sequence: Synthetic oligonucleotide
gaatcgacagtgccccagtcctccaga

SEQ ID NO: 151748 - DNA, 27 bp, Artificial Sequence
  Description of Artificial Sequence: Synthetic oligonucleotide
aatcgacagtgccccagtcctccagag

SEQ ID NO: 151749 - DNA, 26 bp, Artificial Sequence
  Description of Artificial Sequence: Synthetic oligonucleotide
atcgacagtgccccagtcctccagag

SEQ ID NO: 151750 - DNA, 25 bp, Artificial Sequence
  Description of Artificial Sequence: Synthetic oligonucleotide
tcgacagtgccccagtcctccagag

SEQ ID NO: 151751 - DNA, 24 bp, Artificial Sequence
  Description of Artificial Sequence: Synthetic oligonucleotide
cgacagtgccccagtcctccagag

SEQ ID NO: 151752 - DNA, 27 bp, Artificial Sequence
  Description of Artificial Sequence: Synthetic oligonucleotide
cagtcctccagagctcagaccttggct

SEQ ID NO: 151753 - DNA, 29 bp, Artificial Sequence
  Description of Artificial Sequence: Synthetic oligonucleotide
agtcctccagagctcagaccttggctatg

SEQ ID NO: 151754 - DNA, 28 bp, Artificial Sequence
  Description of Artificial Sequence: Synthetic oligonucleotide
gtcctccagagctcagaccttggctatg

SEQ ID NO: 151755 - DNA, 30 bp, Artificial Sequence
  Description of Artificial Sequence: Synthetic oligonucleotide
tcctccagagctcagaccttggctatgaac

SEQ ID NO: 151756 - DNA, 29 bp, Artificial Sequence
  Description of Artificial Sequence: Synthetic oligonucleotide
cctccagagctcagaccttggctatgaac

SEQ ID NO: 151757 - DNA, 29 bp, Artificial Sequence
  Description of Artificial Sequence: Synthetic oligonucleotide
ctccagagctcagaccttggctatgaacg

SEQ ID NO: 151758 - DNA, 30 bp, Artificial Sequence
  Description of Artificial Sequence: Synthetic oligonucleotide
tccagagctcagaccttggctatgaacgtc

SEQ ID NO: 151759 - DNA, 29 bp, Artificial Sequence
  Description of Artificial Sequence: Synthetic oligonucleotide
ccagagctcagaccttggctatgaacgtc

SEQ ID NO: 151760 - DNA, 30 bp, Artificial Sequence
  Description of Artificial Sequence: Synthetic oligonucleotide
cagagctcagaccttggctatgaacgtcac

SEQ ID NO: 151761 - DNA, 36 bp, Artificial Sequence
  Description of Artificial Sequence: Synthetic oligonucleotide
agagctcagaccttggctatgaacgtcacaaatttc

SEQ ID NO: 151762 - DNA, 35 bp, Artificial Sequence
  Description of Artificial Sequence: Synthetic oligonucleotide
gagctcagaccttggctatgaacgtcacaaatttc

SEQ ID NO: 151763 - DNA, 36 bp, Artificial Sequence
  Description of Artificial Sequence: Synthetic oligonucleotide
agctcagaccttggctatgaacgtcacaaatttctg

SEQ ID NO: 151764 - DNA, 35 bp, Artificial Sequence
  Description of Artificial Sequence: Synthetic oligonucleotide
gctcagaccttggctatgaacgtcacaaatttctg

SEQ ID NO: 151765 - DNA, 35 bp, Artificial Sequence
  Description of Artificial Sequence: Synthetic oligonucleotide
ctcagaccttggctatgaacgtcacaaatttctgg

SEQ ID NO: 151766 - DNA, 37 bp, Artificial Sequence
  Description of Artificial Sequence: Synthetic oligonucleotide
tcagaccttggctatgaacgtcacaaatttctggaag

SEQ ID NO: 151767 - DNA, 36 bp, Artificial Sequence
  Description of Artificial Sequence: Synthetic oligonucleotide
cagaccttggctatgaacgtcacaaatttctggaag

SEQ ID NO: 151768 - DNA, 36 bp, Artificial Sequence
  Description of Artificial Sequence: Synthetic oligonucleotide
agaccttggctatgaacgtcacaaatttctggaagg

SEQ ID NO: 151769 - DNA, 35 bp, Artificial Sequence
  Description of Artificial Sequence: Synthetic oligonucleotide
gaccttggctatgaacgtcacaaatttctggaagg

SEQ ID NO: 151770 - DNA, 37 bp, Artificial Sequence
  Description of Artificial Sequence: Synthetic oligonucleotide
accttggctatgaacgtcacaaatttctggaaggaag

SEQ ID NO: 151771 - DNA, 36 bp, Artificial Sequence
  Description of Artificial Sequence: Synthetic oligonucleotide
ccttggctatgaacgtcacaaatttctggaaggaag

SEQ ID NO: 151772 - DNA, 38 bp, Artificial Sequence
  Description of Artificial Sequence: Synthetic oligonucleotide
cttggctatgaacgtcacaaatttctggaaggaagatg

SEQ ID NO: 151773 - DNA, 38 bp, Artificial Sequence
  Description of Artificial Sequence: Synthetic oligonucleotide
ttggctatgaacgtcacaaatttctggaaggaagatgc

SEQ ID NO: 151774 - DNA, 37 bp, Artificial Sequence
  Description of Artificial Sequence: Synthetic oligonucleotide
tggctatgaacgtcacaaatttctggaaggaagatgc

SEQ ID NO: 151775 - DNA, 36 bp, Artificial Sequence
  Description of Artificial Sequence: Synthetic oligonucleotide
ggctatgaacgtcacaaatttctggaaggaagatgc

SEQ ID NO: 151776 - DNA, 36 bp, Artificial Sequence
  Description of Artificial Sequence: Synthetic oligonucleotide
gctatgaacgtcacaaatttctggaaggaagatgcc

SEQ ID NO: 151777 - DNA, 38 bp, Artificial Sequence
  Description of Artificial Sequence: Synthetic oligonucleotide
ctatgaacgtcacaaatttctggaaggaagatgccatg

SEQ ID NO: 151778 - DNA, 40 bp, Artificial Sequence
  Description of Artificial Sequence: Synthetic oligonucleotide
tatgaacgtcacaaatttctggaaggaagatgccatgaag

SEQ ID NO: 151779 - DNA, 39 bp, Artificial Sequence
  Description of Artificial Sequence: Synthetic oligonucleotide
atgaacgtcacaaatttctggaaggaagatgccatgaag

SEQ ID NO: 151780 - DNA, 38 bp, Artificial Sequence
  Description of Artificial Sequence: Synthetic oligonucleotide
tgaacgtcacaaatttctggaaggaagatgccatgaag

SEQ ID NO: 151781 - DNA, 37 bp, Artificial Sequence
  Description of Artificial Sequence: Synthetic oligonucleotide
gaacgtcacaaatttctggaaggaagatgccatgaag

SEQ ID NO: 151782 - DNA, 38 bp, Artificial Sequence
  Description of Artificial Sequence: Synthetic oligonucleotide
aacgtcacaaatttctggaaggaagatgccatgaagac

SEQ ID NO: 151783 - DNA, 37 bp, Artificial Sequence
  Description of Artificial Sequence: Synthetic oligonucleotide
acgtcacaaatttctggaaggaagatgccatgaagac

SEQ ID NO: 151784 - DNA, 36 bp, Artificial Sequence
  Description of Artificial Sequence: Synthetic oligonucleotide
cgtcacaaatttctggaaggaagatgccatgaagac

SEQ ID NO: 151785 - DNA, 36 bp, Artificial Sequence
  Description of Artificial Sequence: Synthetic oligonucleotide
gtcacaaatttctggaaggaagatgccatgaagacc

SEQ ID NO: 151786 - DNA, 38 bp, Artificial Sequence
  Description of Artificial Sequence: Synthetic oligonucleotide
tcacaaatttctggaaggaagatgccatgaagaccaag

SEQ ID NO: 151787 - DNA, 37 bp, Artificial Sequence
  Description of Artificial Sequence: Synthetic oligonucleotide
cacaaatttctggaaggaagatgccatgaagaccaag

SEQ ID NO: 151788 - DNA, 38 bp, Artificial Sequence
  Description of Artificial Sequence: Synthetic oligonucleotide
acaaatttctggaaggaagatgccatgaagaccaagac

SEQ ID NO: 151789 - DNA, 37 bp, Artificial Sequence
  Description of Artificial Sequence: Synthetic oligonucleotide
caaatttctggaaggaagatgccatgaagaccaagac

SEQ ID NO: 151790 - DNA, 38 bp, Artificial Sequence
  Description of Artificial Sequence: Synthetic oligonucleotide
aaatttctggaaggaagatgccatgaagaccaagacac

SEQ ID NO: 151791 - DNA, 37 bp, Artificial Sequence
  Description of Artificial Sequence: Synthetic oligonucleotide
aatttctggaaggaagatgccatgaagaccaagacac

SEQ ID NO: 151792 - DNA, 36 bp, Artificial Sequence
  Description of Artificial Sequence: Synthetic oligonucleotide
atttctggaaggaagatgccatgaagaccaagacac

SEQ ID NO: 151793 - DNA, 35 bp, Artificial Sequence
  Description of Artificial Sequence: Synthetic oligonucleotide
tttctggaaggaagatgccatgaagaccaagacac

SEQ ID NO: 151794 - DNA, 34 bp, Artificial Sequence
  Description of Artificial Sequence: Synthetic oligonucleotide
ttctggaaggaagatgccatgaagaccaagacac

SEQ ID NO: 151795 - DNA, 33 bp, Artificial Sequence
  Description of Artificial Sequence: Synthetic oligonucleotide
tctggaaggaagatgccatgaagaccaagacac

SEQ ID NO: 151796 - DNA, 32 bp, Artificial Sequence
  Description of Artificial Sequence: Synthetic oligonucleotide
ctggaaggaagatgccatgaagaccaagacac

SEQ ID NO: 151797 - DNA, 33 bp, Artificial Sequence
  Description of Artificial Sequence: Synthetic oligonucleotide
tggaaggaagatgccatgaagaccaagacacac

SEQ ID NO: 151798 - DNA, 32 bp, Artificial Sequence
  Description of Artificial Sequence: Synthetic oligonucleotide
ggaaggaagatgccatgaagaccaagacacac

SEQ ID NO: 151799 - DNA, 35 bp, Artificial Sequence
  Description of Artificial Sequence: Synthetic oligonucleotide
aaggaagatgccatgaagaccaagacacactatcg

SEQ ID NO: 151800 - DNA, 34 bp, Artificial Sequence
  Description of Artificial Sequence: Synthetic oligonucleotide
aggaagatgccatgaagaccaagacacactatcg

SEQ ID NO: 151801 - DNA, 33 bp, Artificial Sequence
  Description of Artificial Sequence: Synthetic oligonucleotide
ggaagatgccatgaagaccaagacacactatcg

SEQ ID NO: 151802 - DNA, 33 bp, Artificial Sequence
  Description of Artificial Sequence: Synthetic oligonucleotide
gaagatgccatgaagaccaagacacactatcgc

SEQ ID NO: 151803 - DNA, 33 bp, Artificial Sequence
  Description of Artificial Sequence: Synthetic oligonucleotide
aagatgccatgaagaccaagacacactatcgcg

SEQ ID NO: 151804 - DNA, 32 bp, Artificial Sequence
  Description of Artificial Sequence: Synthetic oligonucleotide
agatgccatgaagaccaagacacactatcgcg

SEQ ID NO: 151805 - DNA, 31 bp, Artificial Sequence
  Description of Artificial Sequence: Synthetic oligonucleotide
gatgccatgaagaccaagacacactatcgcg

SEQ ID NO: 151806 - DNA, 31 bp, Artificial Sequence
  Description of Artificial Sequence: Synthetic oligonucleotide
atgccatgaagaccaagacacactatcgcgc

SEQ ID NO: 151807 - DNA, 30 bp, Artificial Sequence
  Description of Artificial Sequence: Synthetic oligonucleotide
tgccatgaagaccaagacacactatcgcgc

SEQ ID NO: 151808 - DNA, 29 bp, Artificial Sequence
  Description of Artificial Sequence: Synthetic oligonucleotide
gccatgaagaccaagacacactatcgcgc

SEQ ID NO: 151809 - DNA, 32 bp, Artificial Sequence
  Description of Artificial Sequence: Synthetic oligonucleotide
ccatgaagaccaagacacactatcgcgctatg

SEQ ID NO: 151810 - DNA, 32 bp, Artificial Sequence
  Description of Artificial Sequence: Synthetic oligonucleotide
catgaagaccaagacacactatcgcgctatgc

SEQ ID NO: 151811 - DNA, 33 bp, Artificial Sequence
  Description of Artificial Sequence: Synthetic oligonucleotide
atgaagaccaagacacactatcgcgctatgcag

SEQ ID NO: 151812 - DNA, 32 bp, Artificial Sequence
  Description of Artificial Sequence: Synthetic oligonucleotide
tgaagaccaagacacactatcgcgctatgcag

SEQ ID NO: 151813 - DNA, 31 bp, Artificial Sequence
  Description of Artificial Sequence: Synthetic oligonucleotide
gaagaccaagacacactatcgcgctatgcag

SEQ ID NO: 151814 - DNA, 31 bp, Artificial Sequence
  Description of Artificial Sequence: Synthetic oligonucleotide
aagaccaagacacactatcgcgctatgcagg

SEQ ID NO: 151815 - DNA, 30 bp, Artificial Sequence
  Description of Artificial Sequence: Synthetic oligonucleotide
agaccaagacacactatcgcgctatgcagg

SEQ ID NO: 151816 - DNA, 29 bp, Artificial Sequence
  Description of Artificial Sequence: Synthetic oligonucleotide
gaccaagacacactatcgcgctatgcagg

SEQ ID NO: 151817 - DNA, 29 bp, Artificial Sequence
  Description of Artificial Sequence: Synthetic oligonucleotide
accaagacacactatcgcgctatgcaggc

SEQ ID NO: 151818 - DNA, 28 bp, Artificial Sequence
  Description of Artificial Sequence: Synthetic oligonucleotide
ccaagacacactatcgcgctatgcaggc

SEQ ID NO: 151819 - DNA, 29 bp, Artificial Sequence
  Description of Artificial Sequence: Synthetic oligonucleotide
caagacacactatcgcgctatgcaggcag

SEQ ID NO: 151820 - DNA, 30 bp, Artificial Sequence
  Description of Artificial Sequence: Synthetic oligonucleotide
aagacacactatcgcgctatgcaggcagac

SEQ ID NO: 151821 - DNA, 29 bp, Artificial Sequence
  Description of Artificial Sequence: Synthetic oligonucleotide
agacacactatcgcgctatgcaggcagac

SEQ ID NO: 151822 - DNA, 28 bp, Artificial Sequence
  Description of Artificial Sequence: Synthetic oligonucleotide
gacacactatcgcgctatgcaggcagac

SEQ ID NO: 151823 - DNA, 29 bp, Artificial Sequence
  Description of Artificial Sequence: Synthetic oligonucleotide
acacactatcgcgctatgcaggcagactg

SEQ ID NO: 151824 - DNA, 28 bp, Artificial Sequence
  Description of Artificial Sequence: Synthetic oligonucleotide
cacactatcgcgctatgcaggcagactg

SEQ ID NO: 151825 - DNA, 28 bp, Artificial Sequence
  Description of Artificial Sequence: Synthetic oligonucleotide
acactatcgcgctatgcaggcagactgc

SEQ ID NO: 151826 - DNA, 27 bp, Artificial Sequence
  Description of Artificial Sequence: Synthetic oligonucleotide
cactatcgcgctatgcaggcagactgc

SEQ ID NO: 151827 - DNA, 27 bp, Artificial Sequence
  Description of Artificial Sequence: Synthetic oligonucleotide
actatcgcgctatgcaggcagactgcc

SEQ ID NO: 151828 - DNA, 27 bp, Artificial Sequence
  Description of Artificial Sequence: Synthetic oligonucleotide
ctatcgcgctatgcaggcagactgcct

SEQ ID NO: 151829 - DNA, 27 bp, Artificial Sequence
  Description of Artificial Sequence: Synthetic oligonucleotide
tatcgcgctatgcaggcagactgcctg

SEQ ID NO: 151830 - DNA, 26 bp, Artificial Sequence
  Description of Artificial Sequence: Synthetic oligonucleotide
atcgcgctatgcaggcagactgcctg

SEQ ID NO: 151831 - DNA, 25 bp, Artificial Sequence
  Description of Artificial Sequence: Synthetic oligonucleotide
tcgcgctatgcaggcagactgcctg

SEQ ID NO: 151832 - DNA, 24 bp, Artificial Sequence
  Description of Artificial Sequence: Synthetic oligonucleotide
cgcgctatgcaggcagactgcctg

SEQ ID NO: 151833 - DNA, 25 bp, Artificial Sequence
  Description of Artificial Sequence: Synthetic oligonucleotide
gcgctatgcaggcagactgcctgca

SEQ ID NO: 151834 - DNA, 27 bp, Artificial Sequence
  Description of Artificial Sequence: Synthetic oligonucleotide
cgctatgcaggcagactgcctgcagaa

SEQ ID NO: 151835 - DNA, 28 bp, Artificial Sequence
  Description of Artificial Sequence: Synthetic oligonucleotide
gctatgcaggcagactgcctgcagaaac

SEQ ID NO: 151836 - DNA, 30 bp, Artificial Sequence
  Description of Artificial Sequence: Synthetic oligonucleotide
ctatgcaggcagactgcctgcagaaactac

SEQ ID NO: 151837 - DNA, 31 bp, Artificial Sequence
  Description of Artificial Sequence: Synthetic oligonucleotide
tatgcaggcagactgcctgcagaaactacag

SEQ ID NO: 151838 - DNA, 30 bp, Artificial Sequence
  Description of Artificial Sequence: Synthetic oligonucleotide
atgcaggcagactgcctgcagaaactacag

SEQ ID NO: 151839 - DNA, 29 bp, Artificial Sequence
  Description of Artificial Sequence: Synthetic oligonucleotide
tgcaggcagactgcctgcagaaactacag

SEQ ID NO: 151840 - DNA, 28 bp, Artificial Sequence
  Description of Artificial Sequence: Synthetic oligonucleotide
gcaggcagactgcctgcagaaactacag

SEQ ID NO: 151841 - DNA, 28 bp, Artificial Sequence
  Description of Artificial Sequence: Synthetic oligonucleotide
caggcagactgcctgcagaaactacagc

SEQ ID NO: 151842 - DNA, 28 bp, Artificial Sequence
  Description of Artificial Sequence: Synthetic oligonucleotide
aggcagactgcctgcagaaactacagcg

SEQ ID NO: 151843 - DNA, 27 bp, Artificial Sequence
  Description of Artificial Sequence: Synthetic oligonucleotide
ggcagactgcctgcagaaactacagcg

SEQ ID NO: 151844 - DNA, 31 bp, Artificial Sequence
  Description of Artificial Sequence: Synthetic oligonucleotide
gcagactgcctgcagaaactacagcgatatc

SEQ ID NO: 151845 - DNA, 32 bp, Artificial Sequence
  Description of Artificial Sequence: Synthetic oligonucleotide
cagactgcctgcagaaactacagcgatatctg

SEQ ID NO: 151846 - DNA, 36 bp, Artificial Sequence
  Description of Artificial Sequence: Synthetic oligonucleotide
agactgcctgcagaaactacagcgatatctgaaatc

SEQ ID NO: 151847 - DNA, 35 bp, Artificial Sequence
  Description of Artificial Sequence: Synthetic oligonucleotide
gactgcctgcagaaactacagcgatatctgaaatc

SEQ ID NO: 151848 - DNA, 35 bp, Artificial Sequence
  Description of Artificial Sequence: Synthetic oligonucleotide
actgcctgcagaaactacagcgatatctgaaatcc

SEQ ID NO: 151849 - DNA, 34 bp, Artificial Sequence
  Description of Artificial Sequence: Synthetic oligonucleotide
ctgcctgcagaaactacagcgatatctgaaatcc

SEQ ID NO: 151850 - DNA, 34 bp, Artificial Sequence
  Description of Artificial Sequence: Synthetic oligonucleotide
tgcctgcagaaactacagcgatatctgaaatccg

SEQ ID NO: 151851 - DNA, 33 bp, Artificial Sequence
  Description of Artificial Sequence: Synthetic oligonucleotide
gcctgcagaaactacagcgatatctgaaatccg

SEQ ID NO: 151852 - DNA, 33 bp, Artificial Sequence
  Description of Artificial Sequence: Synthetic oligonucleotide
cctgcagaaactacagcgatatctgaaatccgg

SEQ ID NO: 151853 - DNA, 33 bp, Artificial Sequence
  Description of Artificial Sequence: Synthetic oligonucleotide
ctgcagaaactacagcgatatctgaaatccggg

SEQ ID NO: 151854 - DNA, 33 bp, Artificial Sequence
  Description of Artificial Sequence: Synthetic oligonucleotide
tgcagaaactacagcgatatctgaaatccgggg

SEQ ID NO: 151855 - DNA, 32 bp, Artificial Sequence
  Description of Artificial Sequence: Synthetic oligonucleotide
gcagaaactacagcgatatctgaaatccgggg

SEQ ID NO: 151856 - DNA, 33 bp, Artificial Sequence
  Description of Artificial Sequence: Synthetic oligonucleotide
cagaaactacagcgatatctgaaatccggggtg

SEQ ID NO: 151857 - DNA, 33 bp, Artificial Sequence
  Description of Artificial Sequence: Synthetic oligonucleotide
agaaactacagcgatatctgaaatccggggtgg

SEQ ID NO: 151858 - DNA, 32 bp, Artificial Sequence
  Description of Artificial Sequence: Synthetic oligonucleotide
gaaactacagcgatatctgaaatccggggtgg

SEQ ID NO: 151859 - DNA, 32 bp, Artificial Sequence
  Description of Artificial Sequence: Synthetic oligonucleotide
aaactacagcgatatctgaaatccggggtggc

SEQ ID NO: 151860 - DNA, 31 bp, Artificial Sequence
  Description of Artificial Sequence: Synthetic oligonucleotide
aactacagcgatatctgaaatccggggtggc

SEQ ID NO: 151861 - DNA, 30 bp, Artificial Sequence
  Description of Artificial Sequence: Synthetic oligonucleotide
actacagcgatatctgaaatccggggtggc

SEQ ID NO: 151862 - DNA, 29 bp, Artificial Sequence
  Description of Artificial Sequence: Synthetic oligonucleotide
ctacagcgatatctgaaatccggggtggc

SEQ ID NO: 151863 - DNA, 29 bp, Artificial Sequence
  Description of Artificial Sequence: Synthetic oligonucleotide
tacagcgatatctgaaatccggggtggcc

SEQ ID NO: 151864 - DNA, 28 bp, Artificial Sequence
  Description of Artificial Sequence: Synthetic oligonucleotide
acagcgatatctgaaatccggggtggcc

SEQ ID NO: 151865 - DNA, 27 bp, Artificial Sequence
  Description of Artificial Sequence: Synthetic oligonucleotide
cagcgatatctgaaatccggggtggcc

SEQ ID NO: 151866 - DNA, 29 bp, Artificial Sequence
  Description of Artificial Sequence: Synthetic oligonucleotide
agcgatatctgaaatccggggtggccatc

SEQ ID NO: 151867 - DNA, 28 bp, Artificial Sequence
  Description of Artificial Sequence: Synthetic oligonucleotide
gcgatatctgaaatccggggtggccatc

SEQ ID NO: 151868 - DNA, 29 bp, Artificial Sequence
  Description of Artificial Sequence: Synthetic oligonucleotide
cgatatctgaaatccggggtggccatcag

SEQ ID NO: 151869 - DNA, 29 bp, Artificial Sequence
  Description of Artificial Sequence: Synthetic oligonucleotide
gatatctgaaatccggggtggccatcagg

SEQ ID NO: 151870 - DNA, 30 bp, Artificial Sequence
  Description of Artificial Sequence: Synthetic oligonucleotide
atatctgaaatccggggtggccatcaggag

SEQ ID NO: 151871 - DNA, 29 bp, Artificial Sequence
  Description of Artificial Sequence: Synthetic oligonucleotide
tatctgaaatccggggtggccatcaggag

SEQ ID NO: 151872 - DNA, 28 bp, Artificial Sequence
  Description of Artificial Sequence: Synthetic oligonucleotide
atctgaaatccggggtggccatcaggag

SEQ ID NO: 151873 - DNA, 27 bp, Artificial Sequence
  Description of Artificial Sequence: Synthetic oligonucleotide
tctgaaatccggggtggccatcaggag

SEQ ID NO: 151874 - DNA, 27 bp, Artificial Sequence
  Description of Artificial Sequence: Synthetic oligonucleotide
ctgaaatccggggtggccatcaggaga

SEQ ID NO: 151875 - DNA, 28 bp, Artificial Sequence
  Description of Artificial Sequence: Synthetic oligonucleotide
tgaaatccggggtggccatcaggagaac

SEQ ID NO: 151876 - DNA, 27 bp, Artificial Sequence
  Description of Artificial Sequence: Synthetic oligonucleotide
gaaatccggggtggccatcaggagaac

SEQ ID NO: 151877 - DNA, 28 bp, Artificial Sequence
  Description of Artificial Sequence: Synthetic oligonucleotide
aaatccggggtggccatcaggagaacag

SEQ ID NO: 151878 - DNA, 27 bp, Artificial Sequence
  Description of Artificial Sequence: Synthetic oligonucleotide
aatccggggtggccatcaggagaacag

SEQ ID NO: 151879 - DNA, 27 bp, Artificial Sequence
  Description of Artificial Sequence: Synthetic oligonucleotide
atccggggtggccatcaggagaacagt

SEQ ID NO: 151880 - DNA, 26 bp, Artificial Sequence
  Description of Artificial Sequence: Synthetic oligonucleotide
tccggggtggccatcaggagaacagt

SEQ ID NO: 151881 - DNA, 25 bp, Artificial Sequence
  Description of Artificial Sequence: Synthetic oligonucleotide
ccggggtggccatcaggagaacagt

SEQ ID NO: 151882 - DNA, 25 bp, Artificial Sequence
  Description of Artificial Sequence: Synthetic oligonucleotide
cggggtggccatcaggagaacagtg

SEQ ID NO: 151883 - DNA, 25 bp, Artificial Sequence
  Description of Artificial Sequence: Synthetic oligonucleotide
ggggtggccatcaggagaacagtgc

SEQ ID NO: 151884 - DNA, 25 bp, Artificial Sequence
  Description of Artificial Sequence: Synthetic oligonucleotide
gggtggccatcaggagaacagtgcc

SEQ ID NO: 151885 - DNA, 25 bp, Artificial Sequence
  Description of Artificial Sequence: Synthetic oligonucleotide
ggtggccatcaggagaacagtgccc

SEQ ID NO: 151886 - DNA, 25 bp, Artificial Sequence
  Description of Artificial Sequence: Synthetic oligonucleotide
gtggccatcaggagaacagtgcccc

SEQ ID NO: 151887 - DNA, 25 bp, Artificial Sequence
  Description of Artificial Sequence: Synthetic oligonucleotide
tggccatcaggagaacagtgccccc

SEQ ID NO: 151888 - DNA, 24 bp, Artificial Sequence
  Description of Artificial Sequence: Synthetic oligonucleotide
ggccatcaggagaacagtgccccc

SEQ ID NO: 151889 - DNA, 26 bp, Artificial Sequence
  Description of Artificial Sequence: Synthetic oligonucleotide
gccatcaggagaacagtgccccccat

SEQ ID NO: 151890 - DNA, 26 bp, Artificial Sequence
  Description of Artificial Sequence: Synthetic oligonucleotide
ccatcaggagaacagtgccccccatg

SEQ ID NO: 151891 - DNA, 27 bp, Artificial Sequence
  Description of Artificial Sequence: Synthetic oligonucleotide
catcaggagaacagtgccccccatggt

SEQ ID NO: 151892 - DNA, 27 bp, Artificial Sequence
  Description of Artificial Sequence: Synthetic oligonucleotide
atcaggagaacagtgccccccatggtg

SEQ ID NO: 151893 - DNA, 27 bp, Artificial Sequence
  Description of Artificial Sequence: Synthetic oligonucleotide
tcaggagaacagtgccccccatggtga

SEQ ID NO: 151894 - DNA, 27 bp, Artificial Sequence
  Description of Artificial Sequence: Synthetic oligonucleotide
caggagaacagtgccccccatggtgaa

SEQ ID NO: 151895 - DNA, 27 bp, Artificial Sequence
  Description of Artificial Sequence: Synthetic oligonucleotide
cagtgccccccatggtgaatgtcacct

SEQ ID NO: 151896 - DNA, 27 bp, Artificial Sequence
  Description of Artificial Sequence: Synthetic oligonucleotide
agtgccccccatggtgaatgtcacctg

SEQ ID NO: 151897 - DNA, 26 bp, Artificial Sequence
  Description of Artificial Sequence: Synthetic oligonucleotide
gtgccccccatggtgaatgtcacctg

SEQ ID NO: 151898 - DNA, 27 bp, Artificial Sequence
  Description of Artificial Sequence: Synthetic oligonucleotide
tgccccccatggtgaatgtcacctgca

SEQ ID NO: 151899 - DNA, 26 bp, Artificial Sequence
  Description of Artificial Sequence: Synthetic oligonucleotide
gccccccatggtgaatgtcacctgca

SEQ ID NO: 151900 - DNA, 26 bp, Artificial Sequence
  Description of Artificial Sequence: Synthetic oligonucleotide
ccccccatggtgaatgtcacctgcag

SEQ ID NO: 151901 - DNA, 26 bp, Artificial Sequence
  Description of Artificial Sequence: Synthetic oligonucleotide
cccccatggtgaatgtcacctgcagc

SEQ ID NO: 151902 - DNA, 27 bp, Artificial Sequence
  Description of Artificial Sequence: Synthetic oligonucleotide
ccccatggtgaatgtcacctgcagcga

SEQ ID NO: 151903 - DNA, 27 bp, Artificial Sequence
  Description of Artificial Sequence: Synthetic oligonucleotide
cccatggtgaatgtcacctgcagcgag

SEQ ID NO: 151904 - DNA, 27 bp, Artificial Sequence
  Description of Artificial Sequence: Synthetic oligonucleotide
ccatggtgaatgtcacctgcagcgagg

SEQ ID NO: 151905 - DNA, 28 bp, Artificial Sequence
  Description of Artificial Sequence: Synthetic oligonucleotide
catggtgaatgtcacctgcagcgaggtc

SEQ ID NO: 151906 - DNA, 29 bp, Artificial Sequence
  Description of Artificial Sequence: Synthetic oligonucleotide
atggtgaatgtcacctgcagcgaggtctc

SEQ ID NO: 151907 - DNA, 28 bp, Artificial Sequence
  Description of Artificial Sequence: Synthetic oligonucleotide
tggtgaatgtcacctgcagcgaggtctc

SEQ ID NO: 151908 - DNA, 27 bp, Artificial Sequence
  Description of Artificial Sequence: Synthetic oligonucleotide
ggtgaatgtcacctgcagcgaggtctc

SEQ ID NO: 151909 - DNA, 28 bp, Artificial Sequence
  Description of Artificial Sequence: Synthetic oligonucleotide
gtgaatgtcacctgcagcgaggtctcag

SEQ ID NO: 151910 - DNA, 29 bp, Artificial Sequence
  Description of Artificial Sequence: Synthetic oligonucleotide
tgaatgtcacctgcagcgaggtctcagag

SEQ ID NO: 151911 - DNA, 28 bp, Artificial Sequence
  Description of Artificial Sequence: Synthetic oligonucleotide
gaatgtcacctgcagcgaggtctcagag

SEQ ID NO: 151912 - DNA, 28 bp, Artificial Sequence
  Description of Artificial Sequence: Synthetic oligonucleotide
aatgtcacctgcagcgaggtctcagagg

SEQ ID NO: 151913 - DNA, 27 bp, Artificial Sequence
  Description of Artificial Sequence: Synthetic oligonucleotide
atgtcacctgcagcgaggtctcagagg

SEQ ID NO: 151914 - DNA, 26 bp, Artificial Sequence
  Description of Artificial Sequence: Synthetic oligonucleotide
tgtcacctgcagcgaggtctcagagg

SEQ ID NO: 151915 - DNA, 25 bp, Artificial Sequence
  Description of Artificial Sequence: Synthetic oligonucleotide
gtcacctgcagcgaggtctcagagg

SEQ ID NO: 151916 - DNA, 25 bp, Artificial Sequence
  Description of Artificial Sequence: Synthetic oligonucleotide
tcacctgcagcgaggtctcagaggg

SEQ ID NO: 151917 - DNA, 24 bp, Artificial Sequence
  Description of Artificial Sequence: Synthetic oligonucleotide
cacctgcagcgaggtctcagaggg

SEQ ID NO: 151918 - DNA, 26 bp, Artificial Sequence
  Description of Artificial Sequence: Synthetic oligonucleotide
acctgcagcgaggtctcagagggcaa

SEQ ID NO: 151919 - DNA, 25 bp, Artificial Sequence
  Description of Artificial Sequence: Synthetic oligonucleotide
cctgcagcgaggtctcagagggcaa

SEQ ID NO: 151920 - DNA, 27 bp, Artificial Sequence
  Description of Artificial Sequence: Synthetic oligonucleotide
ctgcagcgaggtctcagagggcaacat

SEQ ID NO: 151921 - DNA, 27 bp, Artificial Sequence
  Description of Artificial Sequence: Synthetic oligonucleotide
tgcagcgaggtctcagagggcaacatc

SEQ ID NO: 151922 - DNA, 27 bp, Artificial Sequence
  Description of Artificial Sequence: Synthetic oligonucleotide
gcagcgaggtctcagagggcaacatca

SEQ ID NO: 151923 - DNA, 27 bp, Artificial Sequence
  Description of Artificial Sequence: Synthetic oligonucleotide
cagcgaggtctcagagggcaacatcac

SEQ ID NO: 151924 - DNA, 27 bp, Artificial Sequence
  Description of Artificial Sequence: Synthetic oligonucleotide
agcgaggtctcagagggcaacatcacc

SEQ ID NO: 151925 - DNA, 26 bp, Artificial Sequence
  Description of Artificial Sequence: Synthetic oligonucleotide
gcgaggtctcagagggcaacatcacc

SEQ ID NO: 151926 - DNA, 27 bp, Artificial Sequence
  Description of Artificial Sequence: Synthetic oligonucleotide
cgaggtctcagagggcaacatcaccgt

SEQ ID NO: 151927 - DNA, 27 bp, Artificial Sequence
  Description of Artificial Sequence: Synthetic oligonucleotide
gaggtctcagagggcaacatcaccgtg

SEQ ID NO: 151928 - DNA, 28 bp, Artificial Sequence
  Description of Artificial Sequence: Synthetic oligonucleotide
aggtctcagagggcaacatcaccgtgac

SEQ ID NO: 151929 - DNA, 27 bp, Artificial Sequence
  Description of Artificial Sequence: Synthetic oligonucleotide
ggtctcagagggcaacatcaccgtgac

SEQ ID NO: 151930 - DNA, 29 bp, Artificial Sequence
  Description of Artificial Sequence: Synthetic oligonucleotide
gtctcagagggcaacatcaccgtgacatg

SEQ ID NO: 151931 - DNA, 29 bp, Artificial Sequence
  Description of Artificial Sequence: Synthetic oligonucleotide
tctcagagggcaacatcaccgtgacatgc

SEQ ID NO: 151932 - DNA, 30 bp, Artificial Sequence
  Description of Artificial Sequence: Synthetic oligonucleotide
cgtcaggatggggtatctttgagccacaac

SEQ ID NO: 151933 - DNA, 31 bp, Artificial Sequence
  Description of Artificial Sequence: Synthetic oligonucleotide
gtcaggatggggtatctttgagccacaacac

SEQ ID NO: 151934 - DNA, 31 bp, Artificial Sequence
  Description of Artificial Sequence: Synthetic oligonucleotide
tcaggatggggtatctttgagccacaacacc

SEQ ID NO: 151935 - DNA, 30 bp, Artificial Sequence
  Description of Artificial Sequence: Synthetic oligonucleotide
caggatggggtatctttgagccacaacacc

SEQ ID NO: 151936 - DNA, 30 bp, Artificial Sequence
  Description of Artificial Sequence: Synthetic oligonucleotide
aggatggggtatctttgagccacaacaccc

SEQ ID NO: 151937 - DNA, 29 bp, Artificial Sequence
  Description of Artificial Sequence: Synthetic oligonucleotide
ggatggggtatctttgagccacaacaccc

SEQ ID NO: 151938 - DNA, 30 bp, Artificial Sequence
  Description of Artificial Sequence: Synthetic oligonucleotide
gatggggtatctttgagccacaacacccag

SEQ ID NO: 151939 - DNA, 30 bp, Artificial Sequence
  Description of Artificial Sequence: Synthetic oligonucleotide
atggggtatctttgagccacaacacccagc

SEQ ID NO: 151940 - DNA, 29 bp, Artificial Sequence
  Description of Artificial Sequence: Synthetic oligonucleotide
tggggtatctttgagccacaacacccagc

SEQ ID NO: 151941 - DNA, 28 bp, Artificial Sequence
  Description of Artificial Sequence: Synthetic oligonucleotide
ggggtatctttgagccacaacacccagc

SEQ ID NO: 151942 - DNA, 29 bp, Artificial Sequence
  Description of Artificial Sequence: Synthetic oligonucleotide
gggtatctttgagccacaacacccagcag

SEQ ID NO: 151943 - DNA, 30 bp, Artificial Sequence
  Description of Artificial Sequence: Synthetic oligonucleotide
ggtatctttgagccacaacacccagcagtg

SEQ ID NO: 151944 - DNA, 30 bp, Artificial Sequence
  Description of Artificial Sequence: Synthetic oligonucleotide
gtatctttgagccacaacacccagcagtgg

SEQ ID NO: 151945 - DNA, 30 bp, Artificial Sequence
  Description of Artificial Sequence: Synthetic oligonucleotide
tatctttgagccacaacacccagcagtggg

SEQ ID NO: 151946 - DNA, 29 bp, Artificial Sequence
  Description of Artificial Sequence: Synthetic oligonucleotide
atctttgagccacaacacccagcagtggg

SEQ ID NO: 151947 - DNA, 28 bp, Artificial Sequence
  Description of Artificial Sequence: Synthetic oligonucleotide
tctttgagccacaacacccagcagtggg

SEQ ID NO: 151948 - DNA, 27 bp, Artificial Sequence
  Description of Artificial Sequence: Synthetic oligonucleotide
ctttgagccacaacacccagcagtggg

SEQ ID NO: 151949 - DNA, 27 bp, Artificial Sequence
  Description of Artificial Sequence: Synthetic oligonucleotide
tttgagccacaacacccagcagtgggg

SEQ ID NO: 151950 - DNA, 26 bp, Artificial Sequence
  Description of Artificial Sequence: Synthetic oligonucleotide
ttgagccacaacacccagcagtgggg

SEQ ID NO: 151951 - DNA, 25 bp, Artificial Sequence
  Description of Artificial Sequence: Synthetic oligonucleotide
tgagccacaacacccagcagtgggg

SEQ ID NO: 151952 - DNA, 24 bp, Artificial Sequence
  Description of Artificial Sequence: Synthetic oligonucleotide
gagccacaacacccagcagtgggg

SEQ ID NO: 151953 - DNA, 24 bp, Artificial Sequence
  Description of Artificial Sequence: Synthetic oligonucleotide
agccacaacacccagcagtggggg

SEQ ID NO: 151954 - DNA, 23 bp, Artificial Sequence
  Description of Artificial Sequence: Synthetic oligonucleotide
gccacaacacccagcagtggggg

SEQ ID NO: 151955 - DNA, 25 bp, Artificial Sequence
  Description of Artificial Sequence: Synthetic oligonucleotide
ccacaacacccagcagtggggggat

SEQ ID NO: 151956 - DNA, 26 bp, Artificial Sequence
  Description of Artificial Sequence: Synthetic oligonucleotide
cacaacacccagcagtggggggatgt

SEQ ID NO: 151957 - DNA, 26 bp, Artificial Sequence
  Description of Artificial Sequence: Synthetic oligonucleotide
acaacacccagcagtggggggatgtc

SEQ ID NO: 151958 - DNA, 25 bp, Artificial Sequence
  Description of Artificial Sequence: Synthetic oligonucleotide
caacacccagcagtggggggatgtc

SEQ ID NO: 151959 - DNA, 26 bp, Artificial Sequence
  Description of Artificial Sequence: Synthetic oligonucleotide
aacacccagcagtggggggatgtcct

SEQ ID NO: 151960 - DNA, 26 bp, Artificial Sequence
  Description of Artificial Sequence: Synthetic oligonucleotide
accagacctgggtggccaccaggatt

SEQ ID NO: 151961 - DNA, 25 bp, Artificial Sequence
  Description of Artificial Sequence: Synthetic oligonucleotide
ccagacctgggtggccaccaggatt

SEQ ID NO: 151962 - DNA, 25 bp, Artificial Sequence
  Description of Artificial Sequence: Synthetic oligonucleotide
cagacctgggtggccaccaggattc

SEQ ID NO: 151963 - DNA, 25 bp, Artificial Sequence
  Description of Artificial Sequence: Synthetic oligonucleotide
agacctgggtggccaccaggattcg

SEQ ID NO: 151964 - DNA, 24 bp, Artificial Sequence
  Description of Artificial Sequence: Synthetic oligonucleotide
gacctgggtggccaccaggattcg

SEQ ID NO: 151965 - DNA, 24 bp, Artificial Sequence
  Description of Artificial Sequence: Synthetic oligonucleotide
acctgggtggccaccaggattcgc

SEQ ID NO: 151966 - DNA, 23 bp, Artificial Sequence
  Description of Artificial Sequence: Synthetic oligonucleotide
cctgggtggccaccaggattcgc

SEQ ID NO: 151967 - DNA, 25 bp, Artificial Sequence
  Description of Artificial Sequence: Synthetic oligonucleotide
ctgggtggccaccaggattcgccaa

SEQ ID NO: 151968 - DNA, 25 bp, Artificial Sequence
  Description of Artificial Sequence: Synthetic oligonucleotide
tgggtggccaccaggattcgccaag

SEQ ID NO: 151969 - DNA, 24 bp, Artificial Sequence
  Description of Artificial Sequence: Synthetic oligonucleotide
gggtggccaccaggattcgccaag

SEQ ID NO: 151970 - DNA, 25 bp, Artificial Sequence
  Description of Artificial Sequence: Synthetic oligonucleotide
ggtggccaccaggattcgccaagga

SEQ ID NO: 151971 - DNA, 26 bp, Artificial Sequence
  Description of Artificial Sequence: Synthetic oligonucleotide
gtggccaccaggattcgccaaggaga

SEQ ID NO: 151972 - DNA, 26 bp, Artificial Sequence
  Description of Artificial Sequence: Synthetic oligonucleotide
tggccaccaggattcgccaaggagag

SEQ ID NO: 151973 - DNA, 25 bp, Artificial Sequence
  Description of Artificial Sequence: Synthetic oligonucleotide
ggccaccaggattcgccaaggagag

SEQ ID NO: 151974 - DNA, 26 bp, Artificial Sequence
  Description of Artificial Sequence: Synthetic oligonucleotide
gccaccaggattcgccaaggagagga

SEQ ID NO: 151975 - DNA, 26 bp, Artificial Sequence
  Description of Artificial Sequence: Synthetic oligonucleotide
ccaccaggattcgccaaggagaggag

SEQ ID NO: 151976 - DNA, 27 bp, Artificial Sequence
  Description of Artificial Sequence: Synthetic oligonucleotide
caccaggattcgccaaggagaggagca

SEQ ID NO: 151977 - DNA, 27 bp, Artificial Sequence
  Description of Artificial Sequence: Synthetic oligonucleotide
accaggattcgccaaggagaggagcag

SEQ ID NO: 151978 - DNA, 27 bp, Artificial Sequence
  Description of Artificial Sequence: Synthetic oligonucleotide
ccaggattcgccaaggagaggagcaga

SEQ ID NO: 151979 - DNA, 27 bp, Artificial Sequence
  Description of Artificial Sequence: Synthetic oligonucleotide
caggattcgccaaggagaggagcagag

SEQ ID NO: 151980 - DNA, 27 bp, Artificial Sequence
  Description of Artificial Sequence: Synthetic oligonucleotide
aggattcgccaaggagaggagcagagg

SEQ ID NO: 151981 - DNA, 27 bp, Artificial Sequence
  Description of Artificial Sequence: Synthetic oligonucleotide
ggattcgccaaggagaggagcagaggt

SEQ ID NO: 151982 - DNA, 28 bp, Artificial Sequence
  Description of Artificial Sequence: Synthetic oligonucleotide
gattcgccaaggagaggagcagaggttc

SEQ ID NO: 151983 - DNA, 29 bp, Artificial Sequence
  Description of Artificial Sequence: Synthetic oligonucleotide
attcgccaaggagaggagcagaggttcac

SEQ ID NO: 151984 - DNA, 28 bp, Artificial Sequence
  Description of Artificial Sequence: Synthetic oligonucleotide
ttcgccaaggagaggagcagaggttcac

SEQ ID NO: 151985 - DNA, 27 bp, Artificial Sequence
  Description of Artificial Sequence: Synthetic oligonucleotide
tcgccaaggagaggagcagaggttcac

SEQ ID NO: 151986 - DNA, 26 bp, Artificial Sequence
  Description of Artificial Sequence: Synthetic oligonucleotide
cgccaaggagaggagcagaggttcac

SEQ ID NO: 151987 - DNA, 25 bp, Artificial Sequence
  Description of Artificial Sequence: Synthetic oligonucleotide
gcactcaccctgtgccctctgggaa

SEQ ID NO: 151988 - DNA, 25 bp, Artificial Sequence
  Description of Artificial Sequence: Synthetic oligonucleotide
cactcaccctgtgccctctgggaag

SEQ ID NO: 151989 - DNA, 26 bp, Artificial Sequence
  Description of Artificial Sequence: Synthetic oligonucleotide
actcaccctgtgccctctgggaaggt

SEQ ID NO: 151990 - DNA, 25 bp, Artificial Sequence
  Description of Artificial Sequence: Synthetic oligonucleotide
ctcaccctgtgccctctgggaaggt

SEQ ID NO: 151991 - DNA, 25 bp, Artificial Sequence
  Description of Artificial Sequence: Synthetic oligonucleotide
tcaccctgtgccctctgggaaggtg

SEQ ID NO: 151992 - DNA, 24 bp, Artificial Sequence
  Description of Artificial Sequence: Synthetic oligonucleotide
caccctgtgccctctgggaaggtg

SEQ ID NO: 151993 - DNA, 25 bp, Artificial Sequence
  Description of Artificial Sequence: Synthetic oligonucleotide
accctgtgccctctgggaaggtgct

SEQ ID NO: 151994 - DNA, 24 bp, Artificial Sequence
  Description of Artificial Sequence: Synthetic oligonucleotide
ccctgtgccctctgggaaggtgct

SEQ ID NO: 151995 - DNA, 24 bp, Artificial Sequence
  Description of Artificial Sequence: Synthetic oligonucleotide
cctgtgccctctgggaaggtgctg

SEQ ID NO: 151996 - DNA, 25 bp, Artificial Sequence
  Description of Artificial Sequence: Synthetic oligonucleotide
ctgtgccctctgggaaggtgctggt

SEQ ID NO: 151997 - DNA, 25 bp, Artificial Sequence
  Description of Artificial Sequence: Synthetic oligonucleotide
tgtgccctctgggaaggtgctggtg

SEQ ID NO: 151998 - DNA, 24 bp, Artificial Sequence
  Description of Artificial Sequence: Synthetic oligonucleotide
gtgccctctgggaaggtgctggtg

SEQ ID NO: 151999 - DNA, 26 bp, Artificial Sequence
  Description of Artificial Sequence: Synthetic oligonucleotide
tgccctctgggaaggtgctggtgctt

SEQ ID NO: 152000 - DNA, 25 bp, Artificial Sequence
  Description of Artificial Sequence: Synthetic oligonucleotide
gccctctgggaaggtgctggtgctt

SEQ ID NO: 152001 - DNA, 26 bp, Artificial Sequence
  Description of Artificial Sequence: Synthetic oligonucleotide
ccctctgggaaggtgctggtgcttca

SEQ ID NO: 152002 - DNA, 27 bp, Artificial Sequence
  Description of Artificial Sequence: Synthetic oligonucleotide
cctctgggaaggtgctggtgcttcaga

SEQ ID NO: 152003 - DNA, 27 bp, Artificial Sequence
  Description of Artificial Sequence: Synthetic oligonucleotide
ctctgggaaggtgctggtgcttcagag

SEQ ID NO: 152004 - DNA, 28 bp, Artificial Sequence
  Description of Artificial Sequence: Synthetic oligonucleotide
tctgggaaggtgctggtgcttcagagtc

SEQ ID NO: 152005 - DNA, 27 bp, Artificial Sequence
  Description of Artificial Sequence: Synthetic oligonucleotide
ctgggaaggtgctggtgcttcagagtc

SEQ ID NO: 152006 - DNA, 29 bp, Artificial Sequence
  Description of Artificial Sequence: Synthetic oligonucleotide
tgggaaggtgctggtgcttcagagtcaac

SEQ ID NO: 152007 - DNA, 28 bp, Artificial Sequence
  Description of Artificial Sequence: Synthetic oligonucleotide
gggaaggtgctggtgcttcagagtcaac

SEQ ID NO: 152008 - DNA, 28 bp, Artificial Sequence
  Description of Artificial Sequence: Synthetic oligonucleotide
ggaaggtgctggtgcttcagagtcaacg

SEQ ID NO: 152009 - DNA, 28 bp, Artificial Sequence
  Description of Artificial Sequence: Synthetic oligonucleotide
gaaggtgctggtgcttcagagtcaacgg

SEQ ID NO: 152010 - DNA, 29 bp, Artificial Sequence
  Description of Artificial Sequence: Synthetic oligonucleotide
aaggtgctggtgcttcagagtcaacggac

SEQ ID NO: 152011 - DNA, 28 bp, Artificial Sequence
  Description of Artificial Sequence: Synthetic oligonucleotide
aggtgctggtgcttcagagtcaacggac

SEQ ID NO: 152012 - DNA, 27 bp, Artificial Sequence
  Description of Artificial Sequence: Synthetic oligonucleotide
ggtgctggtgcttcagagtcaacggac

SEQ ID NO: 152013 - DNA, 28 bp, Artificial Sequence
  Description of Artificial Sequence: Synthetic oligonucleotide
gtgctggtgcttcagagtcaacggacag

SEQ ID NO: 152014 - DNA, 29 bp, Artificial Sequence
  Description of Artificial Sequence: Synthetic oligonucleotide
tgctggtgcttcagagtcaacggacagac

SEQ ID NO: 152015 - DNA, 28 bp, Artificial Sequence
  Description of Artificial Sequence: Synthetic oligonucleotide
gctggtgcttcagagtcaacggacagac

SEQ ID NO: 152016 - DNA, 31 bp, Artificial Sequence
  Description of Artificial Sequence: Synthetic oligonucleotide
ctggtgcttcagagtcaacggacagactttc

SEQ ID NO: 152017 - DNA, 31 bp, Artificial Sequence
  Description of Artificial Sequence: Synthetic oligonucleotide
tggtgcttcagagtcaacggacagactttcc

SEQ ID NO: 152018 - DNA, 30 bp, Artificial Sequence
  Description of Artificial Sequence: Synthetic oligonucleotide
ggtgcttcagagtcaacggacagactttcc

SEQ ID NO: 152019 - DNA, 34 bp, Artificial Sequence
  Description of Artificial Sequence: Synthetic oligonucleotide
gtgcttcagagtcaacggacagactttccatatg

SEQ ID NO: 152020 - DNA, 37 bp, Artificial Sequence
  Description of Artificial Sequence: Synthetic oligonucleotide
tgcttcagagtcaacggacagactttccatatgtttc

SEQ ID NO: 152021 - DNA, 36 bp, Artificial Sequence
  Description of Artificial Sequence: Synthetic oligonucleotide
gcttcagagtcaacggacagactttccatatgtttc

SEQ ID NO: 152022 - DNA, 37 bp, Artificial Sequence
  Description of Artificial Sequence: Synthetic oligonucleotide
cttcagagtcaacggacagactttccatatgtttctg

SEQ ID NO: 152023 - DNA, 37 bp, Artificial Sequence
  Description of Artificial Sequence: Synthetic oligonucleotide
ttcagagtcaacggacagactttccatatgtttctgc

SEQ ID NO: 152024 - DNA, 36 bp, Artificial Sequence
  Description of Artificial Sequence: Synthetic oligonucleotide
tcagagtcaacggacagactttccatatgtttctgc

SEQ ID NO: 152025 - DNA, 35 bp, Artificial Sequence
  Description of Artificial Sequence: Synthetic oligonucleotide
cagagtcaacggacagactttccatatgtttctgc

SEQ ID NO: 152026 - DNA, 36 bp, Artificial Sequence
  Description of Artificial Sequence: Synthetic oligonucleotide
agagtcaacggacagactttccatatgtttctgctg

SEQ ID NO: 152027 - DNA, 35 bp, Artificial Sequence
  Description of Artificial Sequence: Synthetic oligonucleotide
gagtcaacggacagactttccatatgtttctgctg

SEQ ID NO: 152028 - DNA, 35 bp, Artificial Sequence
  Description of Artificial Sequence: Synthetic oligonucleotide
agtcaacggacagactttccatatgtttctgctgc

SEQ ID NO: 152029 - DNA, 34 bp, Artificial Sequence
  Description of Artificial Sequence: Synthetic oligonucleotide
gtcaacggacagactttccatatgtttctgctgc

SEQ ID NO: 152030 - DNA, 37 bp, Artificial Sequence
  Description of Artificial Sequence: Synthetic oligonucleotide
tcaacggacagactttccatatgtttctgctgctatg

SEQ ID NO: 152031 - DNA, 36 bp, Artificial Sequence
  Description of Artificial Sequence: Synthetic oligonucleotide
caacggacagactttccatatgtttctgctgctatg

SEQ ID NO: 152032 - DNA, 36 bp, Artificial Sequence
  Description of Artificial Sequence: Synthetic oligonucleotide
aacggacagactttccatatgtttctgctgctatgc

SEQ ID NO: 152033 - DNA, 35 bp, Artificial Sequence
  Description of Artificial Sequence: Synthetic oligonucleotide
acggacagactttccatatgtttctgctgctatgc

SEQ ID NO: 152034 - DNA, 34 bp, Artificial Sequence
  Description of Artificial Sequence: Synthetic oligonucleotide
cggacagactttccatatgtttctgctgctatgc

SEQ ID NO: 152035 - DNA, 34 bp, Artificial Sequence
  Description of Artificial Sequence: Synthetic oligonucleotide
ggacagactttccatatgtttctgctgctatgcc

SEQ ID NO: 152036 - DNA, 36 bp, Artificial Sequence
  Description of Artificial Sequence: Synthetic oligonucleotide
gacagactttccatatgtttctgctgctatgccatg

SEQ ID NO: 152037 - DNA, 40 bp, Artificial Sequence
  Description of Artificial Sequence: Synthetic oligonucleotide
acagactttccatatgtttctgctgctatgccatgttttg

SEQ ID NO: 152038 - DNA, 39 bp, Artificial Sequence
  Description of Artificial Sequence: Synthetic oligonucleotide
cagactttccatatgtttctgctgctatgccatgttttg

SEQ ID NO: 152039 - DNA, 53 bp, Artificial Sequence
  Description of Artificial Sequence: Synthetic oligonucleotide
agactttccatatgtttctgctgctatgccatgttttgttattattattattc

SEQ ID NO: 152040 - DNA, 52 bp, Artificial Sequence
  Description of Artificial Sequence: Synthetic oligonucleotide
gactttccatatgtttctgctgctatgccatgttttgttattattattattc

SEQ ID NO: 152041 - DNA, 53 bp, Artificial Sequence
  Description of Artificial Sequence: Synthetic oligonucleotide
actttccatatgtttctgctgctatgccatgttttgttattattattattctc

SEQ ID NO: 152042 - DNA, 52 bp, Artificial Sequence
  Description of Artificial Sequence: Synthetic oligonucleotide
ctttccatatgtttctgctgctatgccatgttttgttattattattattctc

SEQ ID NO: 152043 - DNA, 53 bp, Artificial Sequence
  Description of Artificial Sequence: Synthetic oligonucleotide
tttccatatgtttctgctgctatgccatgttttgttattattattattctctg

SEQ ID NO: 152044 - DNA, 52 bp, Artificial Sequence
  Description of Artificial Sequence: Synthetic oligonucleotide
ttccatatgtttctgctgctatgccatgttttgttattattattattctctg

SEQ ID NO: 152045 - DNA, 51 bp, Artificial Sequence
  Description of Artificial Sequence: Synthetic oligonucleotide
tccatatgtttctgctgctatgccatgttttgttattattattattctctg

SEQ ID NO: 152046 - DNA, 50 bp, Artificial Sequence
  Description of Artificial Sequence: Synthetic oligonucleotide
ccatatgtttctgctgctatgccatgttttgttattattattattctctg

SEQ ID NO: 152047 - DNA, 51 bp, Artificial Sequence
  Description of Artificial Sequence: Synthetic oligonucleotide
catatgtttctgctgctatgccatgttttgttattattattattctctgtg

SEQ ID NO: 152048 - DNA, 52 bp, Artificial Sequence
  Description of Artificial Sequence: Synthetic oligonucleotide
atatgtttctgctgctatgccatgttttgttattattattattctctgtgtc

SEQ ID NO: 152049 - DNA, 51 bp, Artificial Sequence
  Description of Artificial Sequence: Synthetic oligonucleotide
tatgtttctgctgctatgccatgttttgttattattattattctctgtgtc

SEQ ID NO: 152050 - DNA, 50 bp, Artificial Sequence
  Description of Artificial Sequence: Synthetic oligonucleotide
atgtttctgctgctatgccatgttttgttattattattattctctgtgtc

SEQ ID NO: 152051 - DNA, 49 bp, Artificial Sequence
  Description of Artificial Sequence: Synthetic oligonucleotide
tgtttctgctgctatgccatgttttgttattattattattctctgtgtc

SEQ ID NO: 152052 - DNA, 48 bp, Artificial Sequence
  Description of Artificial Sequence: Synthetic oligonucleotide
gtttctgctgctatgccatgttttgttattattattattctctgtgtc

SEQ ID NO: 152053 - DNA, 48 bp, Artificial Sequence
  Description of Artificial Sequence: Synthetic oligonucleotide
tttctgctgctatgccatgttttgttattattattattctctgtgtcc

SEQ ID NO: 152054 - DNA, 47 bp, Artificial Sequence
  Description of Artificial Sequence: Synthetic oligonucleotide
ttctgctgctatgccatgttttgttattattattattctctgtgtcc

SEQ ID NO: 152055 - DNA, 46 bp, Artificial Sequence
  Description of Artificial Sequence: Synthetic oligonucleotide
tctgctgctatgccatgttttgttattattattattctctgtgtcc

SEQ ID NO: 152056 - DNA, 45 bp, Artificial Sequence
  Description of Artificial Sequence: Synthetic oligonucleotide
ctgctgctatgccatgttttgttattattattattctctgtgtcc

SEQ ID NO: 152057 - DNA, 45 bp, Artificial Sequence
  Description of Artificial Sequence: Synthetic oligonucleotide
tgctgctatgccatgttttgttattattattattctctgtgtccc

SEQ ID NO: 152058 - DNA, 44 bp, Artificial Sequence
  Description of Artificial Sequence: Synthetic oligonucleotide
gctgctatgccatgttttgttattattattattctctgtgtccc

SEQ ID NO: 152059 - DNA, 46 bp, Artificial Sequence
  Description of Artificial Sequence: Synthetic oligonucleotide
ctgctatgccatgttttgttattattattattctctgtgtcccttg

SEQ ID NO: 152060 - DNA, 48 bp, Artificial Sequence
  Description of Artificial Sequence: Synthetic oligonucleotide
tgctatgccatgttttgttattattattattctctgtgtcccttgttg

SEQ ID NO: 152061 - DNA, 47 bp, Artificial Sequence
  Description of Artificial Sequence: Synthetic oligonucleotide
gctatgccatgttttgttattattattattctctgtgtcccttgttg

SEQ ID NO: 152062 - DNA, 47 bp, Artificial Sequence
  Description of Artificial Sequence: Synthetic oligonucleotide
ctatgccatgttttgttattattattattctctgtgtcccttgttgc

SEQ ID NO: 152063 - DNA, 49 bp, Artificial Sequence
  Description of Artificial Sequence: Synthetic oligonucleotide
tatgccatgttttgttattattattattctctgtgtcccttgttgcaag

SEQ ID NO: 152064 - DNA, 48 bp, Artificial Sequence
  Description of Artificial Sequence: Synthetic oligonucleotide
atgccatgttttgttattattattattctctgtgtcccttgttgcaag

SEQ ID NO: 152065 - DNA, 47 bp, Artificial Sequence
  Description of Artificial Sequence: Synthetic oligonucleotide
tgccatgttttgttattattattattctctgtgtcccttgttgcaag

SEQ ID NO: 152066 - DNA, 46 bp, Artificial Sequence
  Description of Artificial Sequence: Synthetic oligonucleotide
gccatgttttgttattattattattctctgtgtcccttgttgcaag

SEQ ID NO: 152067 - DNA, 48 bp, Artificial Sequence
  Description of Artificial Sequence: Synthetic oligonucleotide
ccatgttttgttattattattattctctgtgtcccttgttgcaagaag

SEQ ID NO: 152068 - DNA, 52 bp, Artificial Sequence
  Description of Artificial Sequence: Synthetic oligonucleotide
catgttttgttattattattattctctgtgtcccttgttgcaagaagaaaac

SEQ ID NO: 152069 - DNA, 54 bp, Artificial Sequence
  Description of Artificial Sequence: Synthetic oligonucleotide
atgttttgttattattattattctctgtgtcccttgttgcaagaagaaaacatc

SEQ ID NO: 152070 - DNA, 53 bp, Artificial Sequence
  Description of Artificial Sequence: Synthetic oligonucleotide
tgttttgttattattattattctctgtgtcccttgttgcaagaagaaaacatc

SEQ ID NO: 152071 - DNA, 52 bp, Artificial Sequence
  Description of Artificial Sequence: Synthetic oligonucleotide
gttttgttattattattattctctgtgtcccttgttgcaagaagaaaacatc

SEQ ID NO: 152072 - DNA, 53 bp, Artificial Sequence
  Description of Artificial Sequence: Synthetic oligonucleotide
ttttgttattattattattctctgtgtcccttgttgcaagaagaaaacatcag

SEQ ID NO: 152073 - DNA, 52 bp, Artificial Sequence
  Description of Artificial Sequence: Synthetic oligonucleotide
tttgttattattattattctctgtgtcccttgttgcaagaagaaaacatcag

SEQ ID NO: 152074 - DNA, 51 bp, Artificial Sequence
  Description of Artificial Sequence: Synthetic oligonucleotide
ttgttattattattattctctgtgtcccttgttgcaagaagaaaacatcag

SEQ ID NO: 152075 - DNA, 50 bp, Artificial Sequence
  Description of Artificial Sequence: Synthetic oligonucleotide
tgttattattattattctctgtgtcccttgttgcaagaagaaaacatcag

SEQ ID NO: 152076 - DNA, 49 bp, Artificial Sequence
  Description of Artificial Sequence: Synthetic oligonucleotide
gttattattattattctctgtgtcccttgttgcaagaagaaaacatcag

SEQ ID NO: 152077 - DNA, 49 bp, Artificial Sequence
  Description of Artificial Sequence: Synthetic oligonucleotide
ttattattattattctctgtgtcccttgttgcaagaagaaaacatcagc

SEQ ID NO: 152078 - DNA, 48 bp, Artificial Sequence
  Description of Artificial Sequence: Synthetic oligonucleotide
tattattattattctctgtgtcccttgttgcaagaagaaaacatcagc

SEQ ID NO: 152079 - DNA, 47 bp, Artificial Sequence
  Description of Artificial Sequence: Synthetic oligonucleotide
attattattattctctgtgtcccttgttgcaagaagaaaacatcagc

SEQ ID NO: 152080 - DNA, 46 bp, Artificial Sequence
  Description of Artificial Sequence: Synthetic oligonucleotide
ttattattattctctgtgtcccttgttgcaagaagaaaacatcagc

SEQ ID NO: 152081 - DNA, 45 bp, Artificial Sequence
  Description of Artificial Sequence: Synthetic oligonucleotide
tattattattctctgtgtcccttgttgcaagaagaaaacatcagc

SEQ ID NO: 152082 - DNA, 44 bp, Artificial Sequence
  Description of Artificial Sequence: Synthetic oligonucleotide
attattattctctgtgtcccttgttgcaagaagaaaacatcagc

SEQ ID NO: 152083 - DNA, 43 bp, Artificial Sequence
  Description of Artificial Sequence: Synthetic oligonucleotide
ttattattctctgtgtcccttgttgcaagaagaaaacatcagc

SEQ ID NO: 152084 - DNA, 42 bp, Artificial Sequence
  Description of Artificial Sequence: Synthetic oligonucleotide
tattattctctgtgtcccttgttgcaagaagaaaacatcagc

SEQ ID NO: 152085 - DNA, 41 bp, Artificial Sequence
  Description of Artificial Sequence: Synthetic oligonucleotide
attattctctgtgtcccttgttgcaagaagaaaacatcagc

SEQ ID NO: 152086 - DNA, 40 bp, Artificial Sequence
  Description of Artificial Sequence: Synthetic oligonucleotide
ttattctctgtgtcccttgttgcaagaagaaaacatcagc

SEQ ID NO: 152087 - DNA, 39 bp, Artificial Sequence
  Description of Artificial Sequence: Synthetic oligonucleotide
tattctctgtgtcccttgttgcaagaagaaaacatcagc

SEQ ID NO: 152088 - DNA, 38 bp, Artificial Sequence
  Description of Artificial Sequence: Synthetic oligonucleotide
attctctgtgtcccttgttgcaagaagaaaacatcagc

SEQ ID NO: 152089 - DNA, 37 bp, Artificial Sequence
  Description of Artificial Sequence: Synthetic oligonucleotide
ttctctgtgtcccttgttgcaagaagaaaacatcagc

SEQ ID NO: 152090 - DNA, 36 bp, Artificial Sequence
  Description of Artificial Sequence: Synthetic oligonucleotide
tctctgtgtcccttgttgcaagaagaaaacatcagc

SEQ ID NO: 152091 - DNA, 35 bp, Artificial Sequence
  Description of Artificial Sequence: Synthetic oligonucleotide
ctctgtgtcccttgttgcaagaagaaaacatcagc

SEQ ID NO: 152092 - DNA, 35 bp, Artificial Sequence
  Description of Artificial Sequence: Synthetic oligonucleotide
tctgtgtcccttgttgcaagaagaaaacatcagcg

SEQ ID NO: 152093 - DNA, 34 bp, Artificial Sequence
  Description of Artificial Sequence: Synthetic oligonucleotide
ctgtgtcccttgttgcaagaagaaaacatcagcg

SEQ ID NO: 152094 - DNA, 34 bp, Artificial Sequence
  Description of Artificial Sequence: Synthetic oligonucleotide
tgtgtcccttgttgcaagaagaaaacatcagcgg

SEQ ID NO: 152095 - DNA, 33 bp, Artificial Sequence
  Description of Artificial Sequence: Synthetic oligonucleotide
gtgtcccttgttgcaagaagaaaacatcagcgg

SEQ ID NO: 152096 - DNA, 33 bp, Artificial Sequence
  Description of Artificial Sequence: Synthetic oligonucleotide
tgtcccttgttgcaagaagaaaacatcagcggc

SEQ ID NO: 152097 - DNA, 32 bp, Artificial Sequence
  Description of Artificial Sequence: Synthetic oligonucleotide
gtcccttgttgcaagaagaaaacatcagcggc

SEQ ID NO: 152098 - DNA, 33 bp, Artificial Sequence
  Description of Artificial Sequence: Synthetic oligonucleotide
tcccttgttgcaagaagaaaacatcagcggcag

SEQ ID NO: 152099 - DNA, 32 bp, Artificial Sequence
  Description of Artificial Sequence: Synthetic oligonucleotide
cccttgttgcaagaagaaaacatcagcggcag

SEQ ID NO: 152100 - DNA, 33 bp, Artificial Sequence
  Description of Artificial Sequence: Synthetic oligonucleotide
ccttgttgcaagaagaaaacatcagcggcagag

SEQ ID NO: 152101 - DNA, 33 bp, Artificial Sequence
  Description of Artificial Sequence: Synthetic oligonucleotide
cttgttgcaagaagaaaacatcagcggcagagg

SEQ ID NO: 152102 - DNA, 33 bp, Artificial Sequence
  Description of Artificial Sequence: Synthetic oligonucleotide
ttgttgcaagaagaaaacatcagcggcagaggg

SEQ ID NO: 152103 - DNA, 32 bp, Artificial Sequence
  Description of Artificial Sequence: Synthetic oligonucleotide
tgttgcaagaagaaaacatcagcggcagaggg

SEQ ID NO: 152104 - DNA, 31 bp, Artificial Sequence
  Description of Artificial Sequence: Synthetic oligonucleotide
gttgcaagaagaaaacatcagcggcagaggg

SEQ ID NO: 152105 - DNA, 32 bp, Artificial Sequence
  Description of Artificial Sequence: Synthetic oligonucleotide
ttgcaagaagaaaacatcagcggcagagggtc

SEQ ID NO: 152106 - DNA, 31 bp, Artificial Sequence
  Description of Artificial Sequence: Synthetic oligonucleotide
tgcaagaagaaaacatcagcggcagagggtc

SEQ ID NO: 152107 - DNA, 30 bp, Artificial Sequence
  Description of Artificial Sequence: Synthetic oligonucleotide
gcaagaagaaaacatcagcggcagagggtc

SEQ ID NO: 152108 - DNA, 30 bp, Artificial Sequence
  Description of Artificial Sequence: Synthetic oligonucleotide
caagaagaaaacatcagcggcagagggtcc

SEQ ID NO: 152109 - DNA, 31 bp, Artificial Sequence
  Description of Artificial Sequence: Synthetic oligonucleotide
aagaagaaaacatcagcggcagagggtccag

SEQ ID NO: 152110 - DNA, 30 bp, Artificial Sequence
  Description of Artificial Sequence: Synthetic oligonucleotide
agaagaaaacatcagcggcagagggtccag

SEQ ID NO: 152111 - DNA, 29 bp, Artificial Sequence
  Description of Artificial Sequence: Synthetic oligonucleotide
gaagaaaacatcagcggcagagggtccag

SEQ ID NO: 152112 - DNA, 30 bp, Artificial Sequence
  Description of Artificial Sequence: Synthetic oligonucleotide
aagaaaacatcagcggcagagggtccagag

SEQ ID NO: 152113 - DNA, 29 bp, Artificial Sequence
  Description of Artificial Sequence: Synthetic oligonucleotide
agaaaacatcagcggcagagggtccagag

SEQ ID NO: 152114 - DNA, 28 bp, Artificial Sequence
  Description of Artificial Sequence: Synthetic oligonucleotide
gaaaacatcagcggcagagggtccagag

SEQ ID NO: 152115 - DNA, 28 bp, Artificial Sequence
  Description of Artificial Sequence: Synthetic oligonucleotide
aaaacatcagcggcagagggtccagagc

SEQ ID NO: 152116 - DNA, 27 bp, Artificial Sequence
  Description of Artificial Sequence: Synthetic oligonucleotide
aaacatcagcggcagagggtccagagc

SEQ ID NO: 152117 - DNA, 27 bp, Artificial Sequence
  Description of Artificial Sequence: Synthetic oligonucleotide
aacatcagcggcagagggtccagagct

SEQ ID NO: 152118 - DNA, 27 bp, Artificial Sequence
  Description of Artificial Sequence: Synthetic oligonucleotide
acatcagcggcagagggtccagagctt

SEQ ID NO: 152119 - DNA, 26 bp, Artificial Sequence
  Description of Artificial Sequence: Synthetic oligonucleotide
catcagcggcagagggtccagagctt

SEQ ID NO: 152120 - DNA, 27 bp, Artificial Sequence
  Description of Artificial Sequence: Synthetic oligonucleotide
atcagcggcagagggtccagagcttgt

SEQ ID NO: 152121 - DNA, 26 bp, Artificial Sequence
  Description of Artificial Sequence: Synthetic oligonucleotide
tcagcggcagagggtccagagcttgt

SEQ ID NO: 152122 - DNA, 25 bp, Artificial Sequence
  Description of Artificial Sequence: Synthetic oligonucleotide
cagcggcagagggtccagagcttgt

SEQ ID NO: 152123 - DNA, 26 bp, Artificial Sequence
  Description of Artificial Sequence: Synthetic oligonucleotide
agcggcagagggtccagagcttgtga

SEQ ID NO: 152124 - DNA, 25 bp, Artificial Sequence
  Description of Artificial Sequence: Synthetic oligonucleotide
gcggcagagggtccagagcttgtga

SEQ ID NO: 152125 - DNA, 25 bp, Artificial Sequence
  Description of Artificial Sequence: Synthetic oligonucleotide
cggcagagggtccagagcttgtgag

SEQ ID NO: 152126 - DNA, 25 bp, Artificial Sequence
  Description of Artificial Sequence: Synthetic oligonucleotide
ggcagagggtccagagcttgtgagc

SEQ ID NO: 152127 - DNA, 26 bp, Artificial Sequence
  Description of Artificial Sequence: Synthetic oligonucleotide
gcagagggtccagagcttgtgagcct

SEQ ID NO: 152128 - DNA, 26 bp, Artificial Sequence
  Description of Artificial Sequence: Synthetic oligonucleotide
cagagggtccagagcttgtgagcctg

SEQ ID NO: 152129 - DNA, 27 bp, Artificial Sequence
  Description of Artificial Sequence: Synthetic oligonucleotide
agagggtccagagcttgtgagcctgca

SEQ ID NO: 152130 - DNA, 26 bp, Artificial Sequence
  Description of Artificial Sequence: Synthetic oligonucleotide
gagggtccagagcttgtgagcctgca

SEQ ID NO: 152131 - DNA, 26 bp, Artificial Sequence
  Description of Artificial Sequence: Synthetic oligonucleotide
agggtccagagcttgtgagcctgcag

SEQ ID NO: 152132 - DNA, 25 bp, Artificial Sequence
  Description of Artificial Sequence: Synthetic oligonucleotide
gggtccagagcttgtgagcctgcag

SEQ ID NO: 152133 - DNA, 26 bp, Artificial Sequence
  Description of Artificial Sequence: Synthetic oligonucleotide
ggtccagagcttgtgagcctgcaggt

SEQ ID NO: 152134 - DNA, 26 bp, Artificial Sequence
  Description of Artificial Sequence: Synthetic oligonucleotide
gtccagagcttgtgagcctgcaggtc

SEQ ID NO: 152135 - DNA, 27 bp, Artificial Sequence
  Description of Artificial Sequence: Synthetic oligonucleotide
tccagagcttgtgagcctgcaggtcct

SEQ ID NO: 152136 - DNA, 26 bp, Artificial Sequence
  Description of Artificial Sequence: Synthetic oligonucleotide
ccagagcttgtgagcctgcaggtcct

SEQ ID NO: 152137 - DNA, 26 bp, Artificial Sequence
  Description of Artificial Sequence: Synthetic oligonucleotide
cagagcttgtgagcctgcaggtcctg

SEQ ID NO: 152138 - DNA, 27 bp, Artificial Sequence
  Description of Artificial Sequence: Synthetic oligonucleotide
agagcttgtgagcctgcaggtcctgga

SEQ ID NO: 152139 - DNA, 27 bp, Artificial Sequence
  Description of Artificial Sequence: Synthetic oligonucleotide
gagcttgtgagcctgcaggtcctggat

SEQ ID NO: 152140 - DNA, 27 bp, Artificial Sequence
  Description of Artificial Sequence: Synthetic oligonucleotide
agcttgtgagcctgcaggtcctggatc

SEQ ID NO: 152141 - DNA, 27 bp, Artificial Sequence
  Description of Artificial Sequence: Synthetic oligonucleotide
gcttgtgagcctgcaggtcctggatca

SEQ ID NO: 152142 - DNA, 28 bp, Artificial Sequence
  Description of Artificial Sequence: Synthetic oligonucleotide
cttgtgagcctgcaggtcctggatcaac

SEQ ID NO: 152143 - DNA, 29 bp, Artificial Sequence
  Description of Artificial Sequence: Synthetic oligonucleotide
ttgtgagcctgcaggtcctggatcaacac

SEQ ID NO: 152144 - DNA, 28 bp, Artificial Sequence
  Description of Artificial Sequence: Synthetic oligonucleotide
tgtgagcctgcaggtcctggatcaacac

SEQ ID NO: 152145 - DNA, 28 bp, Artificial Sequence
  Description of Artificial Sequence: Synthetic oligonucleotide
gtcctggatcaacacccagttgggacag

SEQ ID NO: 152146 - DNA, 28 bp, Artificial Sequence
  Description of Artificial Sequence: Synthetic oligonucleotide
tcctggatcaacacccagttgggacagg

SEQ ID NO: 152147 - DNA, 27 bp, Artificial Sequence
  Description of Artificial Sequence: Synthetic oligonucleotide
cctggatcaacacccagttgggacagg

SEQ ID NO: 152148 - DNA, 28 bp, Artificial Sequence
  Description of Artificial Sequence: Synthetic oligonucleotide
ctggatcaacacccagttgggacaggag

SEQ ID NO: 152149 - DNA, 29 bp, Artificial Sequence
  Description of Artificial Sequence: Synthetic oligonucleotide
tggatcaacacccagttgggacaggagac

SEQ ID NO: 152150 - DNA, 28 bp, Artificial Sequence
  Description of Artificial Sequence: Synthetic oligonucleotide
ggatcaacacccagttgggacaggagac

SEQ ID NO: 152151 - DNA, 28 bp, Artificial Sequence
  Description of Artificial Sequence: Synthetic oligonucleotide
gatcaacacccagttgggacaggagacc

SEQ ID NO: 152152 - DNA, 29 bp, Artificial Sequence
  Description of Artificial Sequence: Synthetic oligonucleotide
atcaacacccagttgggacaggagaccac

SEQ ID NO: 152153 - DNA, 28 bp, Artificial Sequence
  Description of Artificial Sequence: Synthetic oligonucleotide
tcaacacccagttgggacaggagaccac

SEQ ID NO: 152154 - DNA, 27 bp, Artificial Sequence
  Description of Artificial Sequence: Synthetic oligonucleotide
caacacccagttgggacaggagaccac

SEQ ID NO: 152155 - DNA, 28 bp, Artificial Sequence
  Description of Artificial Sequence: Synthetic oligonucleotide
aacacccagttgggacaggagaccacag

SEQ ID NO: 152156 - DNA, 27 bp, Artificial Sequence
  Description of Artificial Sequence: Synthetic oligonucleotide
acacccagttgggacaggagaccacag

SEQ ID NO: 152157 - DNA, 26 bp, Artificial Sequence
  Description of Artificial Sequence: Synthetic oligonucleotide
cacccagttgggacaggagaccacag

SEQ ID NO: 152158 - DNA, 26 bp, Artificial Sequence
  Description of Artificial Sequence: Synthetic oligonucleotide
acccagttgggacaggagaccacagg

SEQ ID NO: 152159 - DNA, 25 bp, Artificial Sequence
  Description of Artificial Sequence: Synthetic oligonucleotide
cccagttgggacaggagaccacagg

SEQ ID NO: 152160 - DNA, 27 bp, Artificial Sequence
  Description of Artificial Sequence: Synthetic oligonucleotide
ccagttgggacaggagaccacagggat

SEQ ID NO: 152161 - DNA, 27 bp, Artificial Sequence
  Description of Artificial Sequence: Synthetic oligonucleotide
cagttgggacaggagaccacagggatg

SEQ ID NO: 152162 - DNA, 27 bp, Artificial Sequence
  Description of Artificial Sequence: Synthetic oligonucleotide
agttgggacaggagaccacagggatgc

SEQ ID NO: 152163 - DNA, 27 bp, Artificial Sequence
  Description of Artificial Sequence: Synthetic oligonucleotide
gttgggacaggagaccacagggatgca

SEQ ID NO: 152164 - DNA, 27 bp, Artificial Sequence
  Description of Artificial Sequence: Synthetic oligonucleotide
ttgggacaggagaccacagggatgcag

SEQ ID NO: 152165 - DNA, 26 bp, Artificial Sequence
  Description of Artificial Sequence: Synthetic oligonucleotide
tgggacaggagaccacagggatgcag

SEQ ID NO: 152166 - DNA, 25 bp, Artificial Sequence
  Description of Artificial Sequence: Synthetic oligonucleotide
gggacaggagaccacagggatgcag

SEQ ID NO: 152167 - DNA, 26 bp, Artificial Sequence
  Description of Artificial Sequence: Synthetic oligonucleotide
ggacaggagaccacagggatgcagca

SEQ ID NO: 152168 - DNA, 27 bp, Artificial Sequence
  Description of Artificial Sequence: Synthetic oligonucleotide
gacaggagaccacagggatgcagcaca

SEQ ID NO: 152169 - DNA, 27 bp, Artificial Sequence
  Description of Artificial Sequence: Synthetic oligonucleotide
acaggagaccacagggatgcagcacag

SEQ ID NO: 152170 - DNA, 26 bp, Artificial Sequence
  Description of Artificial Sequence: Synthetic oligonucleotide
caggagaccacagggatgcagcacag

SEQ ID NO: 152171 - DNA, 27 bp, Artificial Sequence
  Description of Artificial Sequence: Synthetic oligonucleotide
aggagaccacagggatgcagcacagct

SEQ ID NO: 152172 - DNA, 26 bp, Artificial Sequence
  Description of Artificial Sequence: Synthetic oligonucleotide
ggagaccacagggatgcagcacagct

SEQ ID NO: 152173 - DNA, 26 bp, Artificial Sequence
  Description of Artificial Sequence: Synthetic oligonucleotide
gagaccacagggatgcagcacagctg

SEQ ID NO: 152174 - DNA, 26 bp, Artificial Sequence
  Description of Artificial Sequence: Synthetic oligonucleotide
agaccacagggatgcagcacagctgg

SEQ ID NO: 152175 - DNA, 25 bp, Artificial Sequence
  Description of Artificial Sequence: Synthetic oligonucleotide
gaccacagggatgcagcacagctgg

SEQ ID NO: 152176 - DNA, 27 bp, Artificial Sequence
  Description of Artificial Sequence: Synthetic oligonucleotide
accacagggatgcagcacagctgggat

SEQ ID NO: 152177 - DNA, 27 bp, Artificial Sequence
  Description of Artificial Sequence: Synthetic oligonucleotide
ccacagggatgcagcacagctgggatt

SEQ ID NO: 152178 - DNA, 28 bp, Artificial Sequence
  Description of Artificial Sequence: Synthetic oligonucleotide
cacagggatgcagcacagctgggatttc

SEQ ID NO: 152179 - DNA, 29 bp, Artificial Sequence
  Description of Artificial Sequence: Synthetic oligonucleotide
acagggatgcagcacagctgggatttcag

SEQ ID NO: 152180 - DNA, 28 bp, Artificial Sequence
  Description of Artificial Sequence: Synthetic oligonucleotide
cagggatgcagcacagctgggatttcag

SEQ ID NO: 152181 - DNA, 28 bp, Artificial Sequence
  Description of Artificial Sequence: Synthetic oligonucleotide
agggatgcagcacagctgggatttcagc

SEQ ID NO: 152182 - DNA, 27 bp, Artificial Sequence
  Description of Artificial Sequence: Synthetic oligonucleotide
gggatgcagcacagctgggatttcagc

SEQ ID NO: 152183 - DNA, 27 bp, Artificial Sequence
  Description of Artificial Sequence: Synthetic oligonucleotide
ggatgcagcacagctgggatttcagcc

SEQ ID NO: 152184 - DNA, 28 bp, Artificial Sequence
  Description of Artificial Sequence: Synthetic oligonucleotide
gatgcagcacagctgggatttcagcctc

SEQ ID NO: 152185 - DNA, 29 bp, Artificial Sequence
  Description of Artificial Sequence: Synthetic oligonucleotide
atgcagcacagctgggatttcagcctctg

SEQ ID NO: 152186 - DNA, 28 bp, Artificial Sequence
  Description of Artificial Sequence: Synthetic oligonucleotide
tgcagcacagctgggatttcagcctctg

SEQ ID NO: 152187 - DNA, 27 bp, Artificial Sequence
  Description of Artificial Sequence: Synthetic oligonucleotide
gcagcacagctgggatttcagcctctg

SEQ ID NO: 152188 - DNA, 29 bp, Artificial Sequence
  Description of Artificial Sequence: Synthetic oligonucleotide
cagcacagctgggatttcagcctctgatg

SEQ ID NO: 152189 - DNA, 30 bp, Artificial Sequence
  Description of Artificial Sequence: Synthetic oligonucleotide
agcacagctgggatttcagcctctgatgtc

SEQ ID NO: 152190 - DNA, 29 bp, Artificial Sequence
  Description of Artificial Sequence: Synthetic oligonucleotide
gcacagctgggatttcagcctctgatgtc

SEQ ID NO: 152191 - DNA, 30 bp, Artificial Sequence
  Description of Artificial Sequence: Synthetic oligonucleotide
cacagctgggatttcagcctctgatgtcag

SEQ ID NO: 152192 - DNA, 30 bp, Artificial Sequence
  Description of Artificial Sequence: Synthetic oligonucleotide
acagctgggatttcagcctctgatgtcagc

SEQ ID NO: 152193 - DNA, 29 bp, Artificial Sequence
  Description of Artificial Sequence: Synthetic oligonucleotide
cagctgggatttcagcctctgatgtcagc

SEQ ID NO: 152194 - DNA, 31 bp, Artificial Sequence
  Description of Artificial Sequence: Synthetic oligonucleotide
agctgggatttcagcctctgatgtcagctac

SEQ ID NO: 152195 - DNA, 30 bp, Artificial Sequence
  Description of Artificial Sequence: Synthetic oligonucleotide
gctgggatttcagcctctgatgtcagctac

SEQ ID NO: 152196 - DNA, 31 bp, Artificial Sequence
  Description of Artificial Sequence: Synthetic oligonucleotide
ctgggatttcagcctctgatgtcagctactg

SEQ ID NO: 152197 - DNA, 31 bp, Artificial Sequence
  Description of Artificial Sequence: Synthetic oligonucleotide
tgggatttcagcctctgatgtcagctactgg

SEQ ID NO: 152198 - DNA, 30 bp, Artificial Sequence
  Description of Artificial Sequence: Synthetic oligonucleotide
gggatttcagcctctgatgtcagctactgg

SEQ ID NO: 152199 - DNA, 30 bp, Artificial Sequence
  Description of Artificial Sequence: Synthetic oligonucleotide
ggatttcagcctctgatgtcagctactggg

SEQ ID NO: 152200 - DNA, 31 bp, Artificial Sequence
  Description of Artificial Sequence: Synthetic oligonucleotide
gatttcagcctctgatgtcagctactgggtc

SEQ ID NO: 152201 - DNA, 31 bp, Artificial Sequence
  Description of Artificial Sequence: Synthetic oligonucleotide
atttcagcctctgatgtcagctactgggtcc

SEQ ID NO: 152202 - DNA, 30 bp, Artificial Sequence
  Description of Artificial Sequence: Synthetic oligonucleotide
tttcagcctctgatgtcagctactgggtcc

SEQ ID NO: 152203 - DNA, 29 bp, Artificial Sequence
  Description of Artificial Sequence: Synthetic oligonucleotide
ttcagcctctgatgtcagctactgggtcc

SEQ ID NO: 152204 - DNA, 28 bp, Artificial Sequence
  Description of Artificial Sequence: Synthetic oligonucleotide
tcagcctctgatgtcagctactgggtcc

SEQ ID NO: 152205 - DNA, 27 bp, Artificial Sequence
  Description of Artificial Sequence: Synthetic oligonucleotide
cagcctctgatgtcagctactgggtcc

SEQ ID NO: 152206 - DNA, 28 bp, Artificial Sequence
  Description of Artificial Sequence: Synthetic oligonucleotide
agcctctgatgtcagctactgggtccac

SEQ ID NO: 152207 - DNA, 27 bp, Artificial Sequence
  Description of Artificial Sequence: Synthetic oligonucleotide
gcctctgatgtcagctactgggtccac

SEQ ID NO: 152208 - DNA, 28 bp, Artificial Sequence
  Description of Artificial Sequence: Synthetic oligonucleotide
cctctgatgtcagctactgggtccactg

SEQ ID NO: 152209 - DNA, 28 bp, Artificial Sequence
  Description of Artificial Sequence: Synthetic oligonucleotide
ctctgatgtcagctactgggtccactgg

SEQ ID NO: 152210 - DNA, 30 bp, Artificial Sequence
  Description of Artificial Sequence: Synthetic oligonucleotide
tctgatgtcagctactgggtccactggttc

SEQ ID NO: 152211 - DNA, 29 bp, Artificial Sequence
  Description of Artificial Sequence: Synthetic oligonucleotide
ctgatgtcagctactgggtccactggttc

SEQ ID NO: 152212 - DNA, 29 bp, Artificial Sequence
  Description of Artificial Sequence: Synthetic oligonucleotide
tgatgtcagctactgggtccactggttcc

SEQ ID NO: 152213 - DNA, 28 bp, Artificial Sequence
  Description of Artificial Sequence: Synthetic oligonucleotide
gatgtcagctactgggtccactggttcc

SEQ ID NO: 152214 - DNA, 29 bp, Artificial Sequence
  Description of Artificial Sequence: Synthetic oligonucleotide
atgtcagctactgggtccactggttccac

SEQ ID NO: 152215 - DNA, 28 bp, Artificial Sequence
  Description of Artificial Sequence: Synthetic oligonucleotide
tgtcagctactgggtccactggttccac

SEQ ID NO: 152216 - DNA, 27 bp, Artificial Sequence
  Description of Artificial Sequence: Synthetic oligonucleotide
gtcagctactgggtccactggttccac

SEQ ID NO: 152217 - DNA, 28 bp, Artificial Sequence
  Description of Artificial Sequence: Synthetic oligonucleotide
tcagctactgggtccactggttccactg

SEQ ID NO: 152218 - DNA, 27 bp, Artificial Sequence
  Description of Artificial Sequence: Synthetic oligonucleotide
cagctactgggtccactggttccactg

SEQ ID NO: 152219 - DNA, 28 bp, Artificial Sequence
  Description of Artificial Sequence: Synthetic oligonucleotide
agctactgggtccactggttccactgag

SEQ ID NO: 152220 - DNA, 27 bp, Artificial Sequence
  Description of Artificial Sequence: Synthetic oligonucleotide
gctactgggtccactggttccactgag

SEQ ID NO: 152221 - DNA, 27 bp, Artificial Sequence
  Description of Artificial Sequence: Synthetic oligonucleotide
ctactgggtccactggttccactgagg

SEQ ID NO: 152222 - DNA, 27 bp, Artificial Sequence
  Description of Artificial Sequence: Synthetic oligonucleotide
tactgggtccactggttccactgaggg

SEQ ID NO: 152223 - DNA, 26 bp, Artificial Sequence
  Description of Artificial Sequence: Synthetic oligonucleotide
actgggtccactggttccactgaggg

SEQ ID NO: 152224 - DNA, 25 bp, Artificial Sequence
  Description of Artificial Sequence: Synthetic oligonucleotide
ctgggtccactggttccactgaggg

SEQ ID NO: 152225 - DNA, 25 bp, Artificial Sequence
  Description of Artificial Sequence: Synthetic oligonucleotide
tgggtccactggttccactgagggc

SEQ ID NO: 152226 - DNA, 24 bp, Artificial Sequence
  Description of Artificial Sequence: Synthetic oligonucleotide
gggtccactggttccactgagggc

SEQ ID NO: 152227 - DNA, 24 bp, Artificial Sequence
  Description of Artificial Sequence: Synthetic oligonucleotide
ggtccactggttccactgagggcg

SEQ ID NO: 152228 - DNA, 24 bp, Artificial Sequence
  Description of Artificial Sequence: Synthetic oligonucleotide
gtccactggttccactgagggcgc

SEQ ID NO: 152229 - DNA, 26 bp, Artificial Sequence
  Description of Artificial Sequence: Synthetic oligonucleotide
tccactggttccactgagggcgccta

SEQ ID NO: 152230 - DNA, 25 bp, Artificial Sequence
  Description of Artificial Sequence: Synthetic oligonucleotide
ccactggttccactgagggcgccta

SEQ ID NO: 152231 - DNA, 25 bp, Artificial Sequence
  Description of Artificial Sequence: Synthetic oligonucleotide
cactggttccactgagggcgcctag

SEQ ID NO: 152232 - DNA, 30 bp, Artificial Sequence
  Description of Artificial Sequence: Synthetic oligonucleotide
ttacaacctcatggtgctgtcccaggatgg

SEQ ID NO: 152233 - DNA, 29 bp, Artificial Sequence
  Description of Artificial Sequence: Synthetic oligonucleotide
tacaacctcatggtgctgtcccaggatgg

SEQ ID NO: 152234 - DNA, 28 bp, Artificial Sequence
  Description of Artificial Sequence: Synthetic oligonucleotide
acaacctcatggtgctgtcccaggatgg

SEQ ID NO: 152235 - DNA, 27 bp, Artificial Sequence
  Description of Artificial Sequence: Synthetic oligonucleotide
caacctcatggtgctgtcccaggatgg

SEQ ID NO: 152236 - DNA, 29 bp, Artificial Sequence
  Description of Artificial Sequence: Synthetic oligonucleotide
aacctcatggtgctgtcccaggatggatc

SEQ ID NO: 152237 - DNA, 28 bp, Artificial Sequence
  Description of Artificial Sequence: Synthetic oligonucleotide
acctcatggtgctgtcccaggatggatc

SEQ ID NO: 152238 - DNA, 27 bp, Artificial Sequence
  Description of Artificial Sequence: Synthetic oligonucleotide
cctcatggtgctgtcccaggatggatc

SEQ ID NO: 152239 - DNA, 28 bp, Artificial Sequence
  Description of Artificial Sequence: Synthetic oligonucleotide
ctcatggtgctgtcccaggatggatctg

SEQ ID NO: 152240 - DNA, 29 bp, Artificial Sequence
  Description of Artificial Sequence: Synthetic oligonucleotide
tcatggtgctgtcccaggatggatctgtg

SEQ ID NO: 152241 - DNA, 28 bp, Artificial Sequence
  Description of Artificial Sequence: Synthetic oligonucleotide
catggtgctgtcccaggatggatctgtg

SEQ ID NO: 152242 - DNA, 28 bp, Artificial Sequence
  Description of Artificial Sequence: Synthetic oligonucleotide
atggtgctgtcccaggatggatctgtgc

SEQ ID NO: 152243 - DNA, 27 bp, Artificial Sequence
  Description of Artificial Sequence: Synthetic oligonucleotide
tggtgctgtcccaggatggatctgtgc

SEQ ID NO: 152244 - DNA, 27 bp, Artificial Sequence
  Description of Artificial Sequence: Synthetic oligonucleotide
ggtgctgtcccaggatggatctgtgca

SEQ ID NO: 152245 - DNA, 27 bp, Artificial Sequence
  Description of Artificial Sequence: Synthetic oligonucleotide
gtgctgtcccaggatggatctgtgcag

SEQ ID NO: 152246 - DNA, 28 bp, Artificial Sequence
  Description of Artificial Sequence: Synthetic oligonucleotide
tgctgtcccaggatggatctgtgcagtc

SEQ ID NO: 152247 - DNA, 27 bp, Artificial Sequence
  Description of Artificial Sequence: Synthetic oligonucleotide
gctgtcccaggatggatctgtgcagtc

SEQ ID NO: 152248 - DNA, 28 bp, Artificial Sequence
  Description of Artificial Sequence: Synthetic oligonucleotide
ctgtcccaggatggatctgtgcagtcag

SEQ ID NO: 152249 - DNA, 28 bp, Artificial Sequence
  Description of Artificial Sequence: Synthetic oligonucleotide
tgtcccaggatggatctgtgcagtcagg

SEQ ID NO: 152250 - DNA, 27 bp, Artificial Sequence
  Description of Artificial Sequence: Synthetic oligonucleotide
gtcccaggatggatctgtgcagtcagg

SEQ ID NO: 152251 - DNA, 27 bp, Artificial Sequence
  Description of Artificial Sequence: Synthetic oligonucleotide
tcccaggatggatctgtgcagtcaggg

SEQ ID NO: 152252 - DNA, 27 bp, Artificial Sequence
  Description of Artificial Sequence: Synthetic oligonucleotide
cccaggatggatctgtgcagtcagggt

SEQ ID NO: 152253 - DNA, 29 bp, Artificial Sequence
  Description of Artificial Sequence: Synthetic oligonucleotide
ccaggatggatctgtgcagtcagggtttc

SEQ ID NO: 152254 - DNA, 30 bp, Artificial Sequence
  Description of Artificial Sequence: Synthetic oligonucleotide
caggatggatctgtgcagtcagggtttctc

SEQ ID NO: 152255 - DNA, 30 bp, Artificial Sequence
  Description of Artificial Sequence: Synthetic oligonucleotide
aggatggatctgtgcagtcagggtttctcg

SEQ ID NO: 152256 - DNA, 27 bp, Artificial Sequence
  Description of Artificial Sequence: Synthetic oligonucleotide
agtgggcagaagatgtcctgggagctg

SEQ ID NO: 152257 - DNA, 27 bp, Artificial Sequence
  Description of Artificial Sequence: Synthetic oligonucleotide
gtgggcagaagatgtcctgggagctga

SEQ ID NO: 152258 - DNA, 27 bp, Artificial Sequence
  Description of Artificial Sequence: Synthetic oligonucleotide
tgggcagaagatgtcctgggagctgag

SEQ ID NO: 152259 - DNA, 27 bp, Artificial Sequence
  Description of Artificial Sequence: Synthetic oligonucleotide
gggcagaagatgtcctgggagctgaga

SEQ ID NO: 152260 - DNA, 27 bp, Artificial Sequence
  Description of Artificial Sequence: Synthetic oligonucleotide
ggcagaagatgtcctgggagctgagac

SEQ ID NO: 152261 - DNA, 27 bp, Artificial Sequence
  Description of Artificial Sequence: Synthetic oligonucleotide
gcagaagatgtcctgggagctgagacc

SEQ ID NO: 152262 - DNA, 28 bp, Artificial Sequence
  Description of Artificial Sequence: Synthetic oligonucleotide
cagaagatgtcctgggagctgagacctg

SEQ ID NO: 152263 - DNA, 28 bp, Artificial Sequence
  Description of Artificial Sequence: Synthetic oligonucleotide
agaagatgtcctgggagctgagacctgg

SEQ ID NO: 152264 - DNA, 27 bp, Artificial Sequence
  Description of Artificial Sequence: Synthetic oligonucleotide
gaagatgtcctgggagctgagacctgg

SEQ ID NO: 152265 - DNA, 27 bp, Artificial Sequence
  Description of Artificial Sequence: Synthetic oligonucleotide
aagatgtcctgggagctgagacctggg

SEQ ID NO: 152266 - DNA, 27 bp, Artificial Sequence
  Description of Artificial Sequence: Synthetic oligonucleotide
agatgtcctgggagctgagacctggga

SEQ ID NO: 152267 - DNA, 26 bp, Artificial Sequence
  Description of Artificial Sequence: Synthetic oligonucleotide
gatgtcctgggagctgagacctggga

SEQ ID NO: 152268 - DNA, 27 bp, Artificial Sequence
  Description of Artificial Sequence: Synthetic oligonucleotide
atgtcctgggagctgagacctgggaca

SEQ ID NO: 152269 - DNA, 26 bp, Artificial Sequence
  Description of Artificial Sequence: Synthetic oligonucleotide
tgtcctgggagctgagacctgggaca

SEQ ID NO: 152270 - DNA, 25 bp, Artificial Sequence
  Description of Artificial Sequence: Synthetic oligonucleotide
gtcctgggagctgagacctgggaca

SEQ ID NO: 152271 - DNA, 26 bp, Artificial Sequence
  Description of Artificial Sequence: Synthetic oligonucleotide
tcctgggagctgagacctgggacaca

SEQ ID NO: 152272 - DNA, 25 bp, Artificial Sequence
  Description of Artificial Sequence: Synthetic oligonucleotide
cctgggagctgagacctgggacaca

SEQ ID NO: 152273 - DNA, 26 bp, Artificial Sequence
  Description of Artificial Sequence: Synthetic oligonucleotide
ctgggagctgagacctgggacacaga

SEQ ID NO: 152274 - DNA, 27 bp, Artificial Sequence
  Description of Artificial Sequence: Synthetic oligonucleotide
tgggagctgagacctgggacacagaga

SEQ ID NO: 152275 - DNA, 26 bp, Artificial Sequence
  Description of Artificial Sequence: Synthetic oligonucleotide
gggagctgagacctgggacacagaga

SEQ ID NO: 152276 - DNA, 26 bp, Artificial Sequence
  Description of Artificial Sequence: Synthetic oligonucleotide
ggagctgagacctgggacacagagac

SEQ ID NO: 152277 - DNA, 26 bp, Artificial Sequence
  Description of Artificial Sequence: Synthetic oligonucleotide
gagctgagacctgggacacagagacc

SEQ ID NO: 152278 - DNA, 27 bp, Artificial Sequence
  Description of Artificial Sequence: Synthetic oligonucleotide
agctgagacctgggacacagagaccga

SEQ ID NO: 152279 - DNA, 26 bp, Artificial Sequence
  Description of Artificial Sequence: Synthetic oligonucleotide
gctgagacctgggacacagagaccga

SEQ ID NO: 152280 - DNA, 26 bp, Artificial Sequence
  Description of Artificial Sequence: Synthetic oligonucleotide
ctgagacctgggacacagagaccgag

SEQ ID NO: 152281 - DNA, 27 bp, Artificial Sequence
  Description of Artificial Sequence: Synthetic oligonucleotide
tgagacctgggacacagagaccgagga

SEQ ID NO: 152282 - DNA, 26 bp, Artificial Sequence
  Description of Artificial Sequence: Synthetic oligonucleotide
gagacctgggacacagagaccgagga

SEQ ID NO: 152283 - DNA, 27 bp, Artificial Sequence
  Description of Artificial Sequence: Synthetic oligonucleotide
ccaggggctcccggcatttctactaca

SEQ ID NO: 152284 - DNA, 29 bp, Artificial Sequence
  Description of Artificial Sequence: Synthetic oligonucleotide
caggggctcccggcatttctactacaatg

SEQ ID NO: 152285 - DNA, 29 bp, Artificial Sequence
  Description of Artificial Sequence: Synthetic oligonucleotide
aggggctcccggcatttctactacaatgg

SEQ ID NO: 152286 - DNA, 28 bp, Artificial Sequence
  Description of Artificial Sequence: Synthetic oligonucleotide
ggggctcccggcatttctactacaatgg

SEQ ID NO: 152287 - DNA, 28 bp, Artificial Sequence
  Description of Artificial Sequence: Synthetic oligonucleotide
gggctcccggcatttctactacaatggg

SEQ ID NO: 152288 - DNA, 28 bp, Artificial Sequence
  Description of Artificial Sequence: Synthetic oligonucleotide
ggctcccggcatttctactacaatgggg

SEQ ID NO: 152289 - DNA, 29 bp, Artificial Sequence
  Description of Artificial Sequence: Synthetic oligonucleotide
gctcccggcatttctactacaatggggag

SEQ ID NO: 152290 - DNA, 29 bp, Artificial Sequence
  Description of Artificial Sequence: Synthetic oligonucleotide
ctcccggcatttctactacaatggggagc

SEQ ID NO: 152291 - DNA, 30 bp, Artificial Sequence
  Description of Artificial Sequence: Synthetic oligonucleotide
tcccggcatttctactacaatggggagctc

SEQ ID NO: 152292 - DNA, 29 bp, Artificial Sequence
  Description of Artificial Sequence: Synthetic oligonucleotide
cccggcatttctactacaatggggagctc

SEQ ID NO: 152293 - DNA, 31 bp, Artificial Sequence
  Description of Artificial Sequence: Synthetic oligonucleotide
ccggcatttctactacaatggggagctcttc

SEQ ID NO: 152294 - DNA, 31 bp, Artificial Sequence
  Description of Artificial Sequence: Synthetic oligonucleotide
cggcatttctactacaatggggagctcttcc

SEQ ID NO: 152295 - DNA, 32 bp, Artificial Sequence
  Description of Artificial Sequence: Synthetic oligonucleotide
ggcatttctactacaatggggagctcttcctc

SEQ ID NO: 152296 - DNA, 33 bp, Artificial Sequence
  Description of Artificial Sequence: Synthetic oligonucleotide
gcatttctactacaatggggagctcttcctctc

SEQ ID NO: 152297 - DNA, 33 bp, Artificial Sequence
  Description of Artificial Sequence: Synthetic oligonucleotide
catttctactacaatggggagctcttcctctcc

SEQ ID NO: 152298 - DNA, 33 bp, Artificial Sequence
  Description of Artificial Sequence: Synthetic oligonucleotide
atttctactacaatggggagctcttcctctccc

SEQ ID NO: 152299 - DNA, 32 bp, Artificial Sequence
  Description of Artificial Sequence: Synthetic oligonucleotide
tttctactacaatggggagctcttcctctccc

SEQ ID NO: 152300 - DNA, 31 bp, Artificial Sequence
  Description of Artificial Sequence: Synthetic oligonucleotide
ttctactacaatggggagctcttcctctccc

SEQ ID NO: 152301 - DNA, 30 bp, Artificial Sequence
  Description of Artificial Sequence: Synthetic oligonucleotide
tctactacaatggggagctcttcctctccc

SEQ ID NO: 152302 - DNA, 29 bp, Artificial Sequence
  Description of Artificial Sequence: Synthetic oligonucleotide
ctactacaatggggagctcttcctctccc

SEQ ID NO: 152303 - DNA, 33 bp, Artificial Sequence
  Description of Artificial Sequence: Synthetic oligonucleotide
tactacaatggggagctcttcctctcccaaaac

SEQ ID NO: 152304 - DNA, 32 bp, Artificial Sequence
  Description of Artificial Sequence: Synthetic oligonucleotide
actacaatggggagctcttcctctcccaaaac

SEQ ID NO: 152305 - DNA, 31 bp, Artificial Sequence
  Description of Artificial Sequence: Synthetic oligonucleotide
ctacaatggggagctcttcctctcccaaaac

SEQ ID NO: 152306 - DNA, 31 bp, Artificial Sequence
  Description of Artificial Sequence: Synthetic oligonucleotide
tacaatggggagctcttcctctcccaaaacc

SEQ ID NO: 152307 - DNA, 30 bp, Artificial Sequence
  Description of Artificial Sequence: Synthetic oligonucleotide
acaatggggagctcttcctctcccaaaacc

SEQ ID NO: 152308 - DNA, 29 bp, Artificial Sequence
  Description of Artificial Sequence: Synthetic oligonucleotide
caatggggagctcttcctctcccaaaacc

SEQ ID NO: 152309 - DNA, 30 bp, Artificial Sequence
  Description of Artificial Sequence: Synthetic oligonucleotide
aatggggagctcttcctctcccaaaacctg

SEQ ID NO: 152310 - DNA, 25 bp, Artificial Sequence
  Description of Artificial Sequence: Synthetic oligonucleotide
actcaccctgtgccctctgggaagg

SEQ ID NO: 152311 - DNA, 24 bp, Artificial Sequence
  Description of Artificial Sequence: Synthetic oligonucleotide
ctcaccctgtgccctctgggaagg

SEQ ID NO: 152312 - DNA, 24 bp, Artificial Sequence
  Description of Artificial Sequence: Synthetic oligonucleotide
tcaccctgtgccctctgggaaggc

SEQ ID NO: 152313 - DNA, 23 bp, Artificial Sequence
  Description of Artificial Sequence: Synthetic oligonucleotide
caccctgtgccctctgggaaggc

SEQ ID NO: 152314 - DNA, 23 bp, Artificial Sequence
  Description of Artificial Sequence: Synthetic oligonucleotide
accctgtgccctctgggaaggcg

SEQ ID NO: 152315 - DNA, 22 bp, Artificial Sequence
  Description of Artificial Sequence: Synthetic oligonucleotide
ccctgtgccctctgggaaggcg

SEQ ID NO: 152316 - DNA, 23 bp, Artificial Sequence
  Description of Artificial Sequence: Synthetic oligonucleotide
cctgtgccctctgggaaggcgct

SEQ ID NO: 152317 - DNA, 23 bp, Artificial Sequence
  Description of Artificial Sequence: Synthetic oligonucleotide
ctgtgccctctgggaaggcgctg

SEQ ID NO: 152318 - DNA, 24 bp, Artificial Sequence
  Description of Artificial Sequence: Synthetic oligonucleotide
tgtgccctctgggaaggcgctggt

SEQ ID NO: 152319 - DNA, 23 bp, Artificial Sequence
  Description of Artificial Sequence: Synthetic oligonucleotide
gtgccctctgggaaggcgctggt

SEQ ID NO: 152320 - DNA, 23 bp, Artificial Sequence
  Description of Artificial Sequence: Synthetic oligonucleotide
tgccctctgggaaggcgctggtg

SEQ ID NO: 152321 - DNA, 22 bp, Artificial Sequence
  Description of Artificial Sequence: Synthetic oligonucleotide
gccctctgggaaggcgctggtg

SEQ ID NO: 152322 - DNA, 24 bp, Artificial Sequence
  Description of Artificial Sequence: Synthetic oligonucleotide
ccctctgggaaggcgctggtgctt

SEQ ID NO: 152323 - DNA, 25 bp, Artificial Sequence
  Description of Artificial Sequence: Synthetic oligonucleotide
cctctgggaaggcgctggtgcttca

SEQ ID NO: 152324 - DNA, 26 bp, Artificial Sequence
  Description of Artificial Sequence: Synthetic oligonucleotide
ctctgggaaggcgctggtgcttcaga

SEQ ID NO: 152325 - DNA, 27 bp, Artificial Sequence
  Description of Artificial Sequence: Synthetic oligonucleotide
tctgggaaggcgctggtgcttcagagt

SEQ ID NO: 152326 - DNA, 26 bp, Artificial Sequence
  Description of Artificial Sequence: Synthetic oligonucleotide
ctgggaaggcgctggtgcttcagagt

SEQ ID NO: 152327 - DNA, 27 bp, Artificial Sequence
  Description of Artificial Sequence: Synthetic oligonucleotide
tgggaaggcgctggtgcttcagagtca

SEQ ID NO: 152328 - DNA, 27 bp, Artificial Sequence
  Description of Artificial Sequence: Synthetic oligonucleotide
gggaaggcgctggtgcttcagagtcaa

SEQ ID NO: 152329 - DNA, 27 bp, Artificial Sequence
  Description of Artificial Sequence: Synthetic oligonucleotide
ggaaggcgctggtgcttcagagtcaac

SEQ ID NO: 152330 - DNA, 27 bp, Artificial Sequence
  Description of Artificial Sequence: Synthetic oligonucleotide
gaaggcgctggtgcttcagagtcaacg

SEQ ID NO: 152331 - DNA, 27 bp, Artificial Sequence
  Description of Artificial Sequence: Synthetic oligonucleotide
aaggcgctggtgcttcagagtcaacgg

SEQ ID NO: 152332 - DNA, 27 bp, Artificial Sequence
  Description of Artificial Sequence: Synthetic oligonucleotide
aggcgctggtgcttcagagtcaacgga

SEQ ID NO: 152333 - DNA, 26 bp, Artificial Sequence
  Description of Artificial Sequence: Synthetic oligonucleotide
ggcgctggtgcttcagagtcaacgga

SEQ ID NO: 152334 - DNA, 27 bp, Artificial Sequence
  Description of Artificial Sequence: Synthetic oligonucleotide
gcgctggtgcttcagagtcaacggaca

SEQ ID NO: 152335 - DNA, 27 bp, Artificial Sequence
  Description of Artificial Sequence: Synthetic oligonucleotide
cgctggtgcttcagagtcaacggacag

SEQ ID NO: 152336 - DNA, 30 bp, Artificial Sequence
  Description of Artificial Sequence: Synthetic oligonucleotide
agaacagtgccccccatggtgaatgtcatc

SEQ ID NO: 152337 - DNA, 29 bp, Artificial Sequence
  Description of Artificial Sequence: Synthetic oligonucleotide
gaacagtgccccccatggtgaatgtcatc

SEQ ID NO: 152338 - DNA, 30 bp, Artificial Sequence
  Description of Artificial Sequence: Synthetic oligonucleotide
aacagtgccccccatggtgaatgtcatctg

SEQ ID NO: 152339 - DNA, 29 bp, Artificial Sequence
  Description of Artificial Sequence: Synthetic oligonucleotide
acagtgccccccatggtgaatgtcatctg

SEQ ID NO: 152340 - DNA, 28 bp, Artificial Sequence
  Description of Artificial Sequence: Synthetic oligonucleotide
cagtgccccccatggtgaatgtcatctg

SEQ ID NO: 152341 - DNA, 28 bp, Artificial Sequence
  Description of Artificial Sequence: Synthetic oligonucleotide
agtgccccccatggtgaatgtcatctgc

SEQ ID NO: 152342 - DNA, 27 bp, Artificial Sequence
  Description of Artificial Sequence: Synthetic oligonucleotide
gtgccccccatggtgaatgtcatctgc

SEQ ID NO: 152343 - DNA, 28 bp, Artificial Sequence
  Description of Artificial Sequence: Synthetic oligonucleotide
tgccccccatggtgaatgtcatctgcag

SEQ ID NO: 152344 - DNA, 27 bp, Artificial Sequence
  Description of Artificial Sequence: Synthetic oligonucleotide
gccccccatggtgaatgtcatctgcag

SEQ ID NO: 152345 - DNA, 27 bp, Artificial Sequence
  Description of Artificial Sequence: Synthetic oligonucleotide
ccccccatggtgaatgtcatctgcagc

SEQ ID NO: 152346 - DNA, 27 bp, Artificial Sequence
  Description of Artificial Sequence: Synthetic oligonucleotide
cccccatggtgaatgtcatctgcagcg

SEQ ID NO: 152347 - DNA, 28 bp, Artificial Sequence
  Description of Artificial Sequence: Synthetic oligonucleotide
ccccatggtgaatgtcatctgcagcgag

SEQ ID NO: 152348 - DNA, 28 bp, Artificial Sequence
  Description of Artificial Sequence: Synthetic oligonucleotide
cccatggtgaatgtcatctgcagcgagg

SEQ ID NO: 152349 - DNA, 29 bp, Artificial Sequence
  Description of Artificial Sequence: Synthetic oligonucleotide
ccatggtgaatgtcatctgcagcgaggtc

SEQ ID NO: 152350 - DNA, 30 bp, Artificial Sequence
  Description of Artificial Sequence: Synthetic oligonucleotide
catggtgaatgtcatctgcagcgaggtctc

SEQ ID NO: 152351 - DNA, 31 bp, Artificial Sequence
  Description of Artificial Sequence: Synthetic oligonucleotide
atggtgaatgtcatctgcagcgaggtctcag

SEQ ID NO: 152352 - DNA, 30 bp, Artificial Sequence
  Description of Artificial Sequence: Synthetic oligonucleotide
tggtgaatgtcatctgcagcgaggtctcag

SEQ ID NO: 152353 - DNA, 29 bp, Artificial Sequence
  Description of Artificial Sequence: Synthetic oligonucleotide
ggtgaatgtcatctgcagcgaggtctcag

SEQ ID NO: 152354 - DNA, 30 bp, Artificial Sequence
  Description of Artificial Sequence: Synthetic oligonucleotide
gtgaatgtcatctgcagcgaggtctcagag

SEQ ID NO: 152355 - DNA, 30 bp, Artificial Sequence
  Description of Artificial Sequence: Synthetic oligonucleotide
tgaatgtcatctgcagcgaggtctcagagg

SEQ ID NO: 152356 - DNA, 29 bp, Artificial Sequence
  Description of Artificial Sequence: Synthetic oligonucleotide
gaatgtcatctgcagcgaggtctcagagg

SEQ ID NO: 152357 - DNA, 29 bp, Artificial Sequence
  Description of Artificial Sequence: Synthetic oligonucleotide
aatgtcatctgcagcgaggtctcagaggg

SEQ ID NO: 152358 - DNA, 28 bp, Artificial Sequence
  Description of Artificial Sequence: Synthetic oligonucleotide
atgtcatctgcagcgaggtctcagaggg

SEQ ID NO: 152359 - DNA, 27 bp, Artificial Sequence
  Description of Artificial Sequence: Synthetic oligonucleotide
tgtcatctgcagcgaggtctcagaggg

SEQ ID NO: 152360 - DNA, 26 bp, Artificial Sequence
  Description of Artificial Sequence: Synthetic oligonucleotide
gtcatctgcagcgaggtctcagaggg

SEQ ID NO: 152361 - DNA, 27 bp, Artificial Sequence
  Description of Artificial Sequence: Synthetic oligonucleotide
tcatctgcagcgaggtctcagagggca

SEQ ID NO: 152362 - DNA, 27 bp, Artificial Sequence
  Description of Artificial Sequence: Synthetic oligonucleotide
catctgcagcgaggtctcagagggcaa

SEQ ID NO: 152363 - DNA, 27 bp, Artificial Sequence
  Description of Artificial Sequence: Synthetic oligonucleotide
atctgcagcgaggtctcagagggcaac

SEQ ID NO: 152364 - DNA, 27 bp, Artificial Sequence
  Description of Artificial Sequence: Synthetic oligonucleotide
tctgcagcgaggtctcagagggcaaca

SEQ ID NO: 152365 - DNA, 26 bp, Artificial Sequence
  Description of Artificial Sequence: Synthetic oligonucleotide
tgggtccactggttccactgagggca

SEQ ID NO: 152366 - DNA, 25 bp, Artificial Sequence
  Description of Artificial Sequence: Synthetic oligonucleotide
gggtccactggttccactgagggca

SEQ ID NO: 152367 - DNA, 25 bp, Artificial Sequence
  Description of Artificial Sequence: Synthetic oligonucleotide
ggtccactggttccactgagggcac

SEQ ID NO: 152368 - DNA, 27 bp, Artificial Sequence
  Description of Artificial Sequence: Synthetic oligonucleotide
gtccactggttccactgagggcaccta

SEQ ID NO: 152369 - DNA, 27 bp, Artificial Sequence
  Description of Artificial Sequence: Synthetic oligonucleotide
tccactggttccactgagggcacctag

SEQ ID NO: 152370 - DNA, 27 bp, Artificial Sequence
  Description of Artificial Sequence: Synthetic oligonucleotide
caaagccccagggacagtgggcagaaa

SEQ ID NO: 152371 - DNA, 29 bp, Artificial Sequence
  Description of Artificial Sequence: Synthetic oligonucleotide
aaagccccagggacagtgggcagaaaatg

SEQ ID NO: 152372 - DNA, 28 bp, Artificial Sequence
  Description of Artificial Sequence: Synthetic oligonucleotide
aagccccagggacagtgggcagaaaatg

SEQ ID NO: 152373 - DNA, 27 bp, Artificial Sequence
  Description of Artificial Sequence: Synthetic oligonucleotide
agccccagggacagtgggcagaaaatg

SEQ ID NO: 152374 - DNA, 27 bp, Artificial Sequence
  Description of Artificial Sequence: Synthetic oligonucleotide
gccccagggacagtgggcagaaaatgt

SEQ ID NO: 152375 - DNA, 27 bp, Artificial Sequence
  Description of Artificial Sequence: Synthetic oligonucleotide
ccccagggacagtgggcagaaaatgtc

SEQ ID NO: 152376 - DNA, 27 bp, Artificial Sequence
  Description of Artificial Sequence: Synthetic oligonucleotide
cccagggacagtgggcagaaaatgtcc

SEQ ID NO: 152377 - DNA, 28 bp, Artificial Sequence
  Description of Artificial Sequence: Synthetic oligonucleotide
ccagggacagtgggcagaaaatgtcctg

SEQ ID NO: 152378 - DNA, 28 bp, Artificial Sequence
  Description of Artificial Sequence: Synthetic oligonucleotide
cagggacagtgggcagaaaatgtcctgg

SEQ ID NO: 152379 - DNA, 28 bp, Artificial Sequence
  Description of Artificial Sequence: Synthetic oligonucleotide
agggacagtgggcagaaaatgtcctggg

SEQ ID NO: 152380 - DNA, 27 bp, Artificial Sequence
  Description of Artificial Sequence: Synthetic oligonucleotide
gggacagtgggcagaaaatgtcctggg

SEQ ID NO: 152381 - DNA, 28 bp, Artificial Sequence
  Description of Artificial Sequence: Synthetic oligonucleotide
ggacagtgggcagaaaatgtcctgggag

SEQ ID NO: 152382 - DNA, 28 bp, Artificial Sequence
  Description of Artificial Sequence: Synthetic oligonucleotide
gacagtgggcagaaaatgtcctgggagc

SEQ ID NO: 152383 - DNA, 31 bp, Artificial Sequence
  Description of Artificial Sequence: Synthetic oligonucleotide
acagtgggcagaaaatgtcctgggagctaag

SEQ ID NO: 152384 - DNA, 30 bp, Artificial Sequence
  Description of Artificial Sequence: Synthetic oligonucleotide
cagtgggcagaaaatgtcctgggagctaag

SEQ ID NO: 152385 - DNA, 31 bp, Artificial Sequence
  Description of Artificial Sequence: Synthetic oligonucleotide
agtgggcagaaaatgtcctgggagctaagac

SEQ ID NO: 152386 - DNA, 30 bp, Artificial Sequence
  Description of Artificial Sequence: Synthetic oligonucleotide
gtgggcagaaaatgtcctgggagctaagac

SEQ ID NO: 152387 - DNA, 30 bp, Artificial Sequence
  Description of Artificial Sequence: Synthetic oligonucleotide
tgggcagaaaatgtcctgggagctaagacc

SEQ ID NO: 152388 - DNA, 29 bp, Artificial Sequence
  Description of Artificial Sequence: Synthetic oligonucleotide
gggcagaaaatgtcctgggagctaagacc

SEQ ID NO: 152389 - DNA, 30 bp, Artificial Sequence
  Description of Artificial Sequence: Synthetic oligonucleotide
ggcagaaaatgtcctgggagctaagacctg

SEQ ID NO: 152390 - DNA, 30 bp, Artificial Sequence
  Description of Artificial Sequence: Synthetic oligonucleotide
gcagaaaatgtcctgggagctaagacctgg

SEQ ID NO: 152391 - DNA, 30 bp, Artificial Sequence
  Description of Artificial Sequence: Synthetic oligonucleotide
cagaaaatgtcctgggagctaagacctggg

SEQ ID NO: 152392 - DNA, 31 bp, Artificial Sequence
  Description of Artificial Sequence: Synthetic oligonucleotide
agaaaatgtcctgggagctaagacctgggac

SEQ ID NO: 152393 - DNA, 30 bp, Artificial Sequence
  Description of Artificial Sequence: Synthetic oligonucleotide
gaaaatgtcctgggagctaagacctgggac

SEQ ID NO: 152394 - DNA, 31 bp, Artificial Sequence
  Description of Artificial Sequence: Synthetic oligonucleotide
aaaatgtcctgggagctaagacctgggacac

SEQ ID NO: 152395 - DNA, 30 bp, Artificial Sequence
  Description of Artificial Sequence: Synthetic oligonucleotide
aaatgtcctgggagctaagacctgggacac

SEQ ID NO: 152396 - DNA, 29 bp, Artificial Sequence
  Description of Artificial Sequence: Synthetic oligonucleotide
aatgtcctgggagctaagacctgggacac

SEQ ID NO: 152397 - DNA, 31 bp, Artificial Sequence
  Description of Artificial Sequence: Synthetic oligonucleotide
acctgctacatggaacacagcgggaatcatg

SEQ ID NO: 152398 - DNA, 30 bp, Artificial Sequence
  Description of Artificial Sequence: Synthetic oligonucleotide
cctgctacatggaacacagcgggaatcatg

SEQ ID NO: 152399 - DNA, 30 bp, Artificial Sequence
  Description of Artificial Sequence: Synthetic oligonucleotide
ctgctacatggaacacagcgggaatcatgg

SEQ ID NO: 152400 - DNA, 30 bp, Artificial Sequence
  Description of Artificial Sequence: Synthetic oligonucleotide
tgctacatggaacacagcgggaatcatggc

SEQ ID NO: 152401 - DNA, 29 bp, Artificial Sequence
  Description of Artificial Sequence: Synthetic oligonucleotide
gctacatggaacacagcgggaatcatggc

SEQ ID NO: 152402 - DNA, 30 bp, Artificial Sequence
  Description of Artificial Sequence: Synthetic oligonucleotide
ctacatggaacacagcgggaatcatggcac

SEQ ID NO: 152403 - DNA, 31 bp, Artificial Sequence
  Description of Artificial Sequence: Synthetic oligonucleotide
tacatggaacacagcgggaatcatggcactc

SEQ ID NO: 152404 - DNA, 30 bp, Artificial Sequence
  Description of Artificial Sequence: Synthetic oligonucleotide
acatggaacacagcgggaatcatggcactc

SEQ ID NO: 152405 - DNA, 29 bp, Artificial Sequence
  Description of Artificial Sequence: Synthetic oligonucleotide
catggaacacagcgggaatcatggcactc

SEQ ID NO: 152406 - DNA, 30 bp, Artificial Sequence
  Description of Artificial Sequence: Synthetic oligonucleotide
atggaacacagcgggaatcatggcactcac

SEQ ID NO: 152407 - DNA, 29 bp, Artificial Sequence
  Description of Artificial Sequence: Synthetic oligonucleotide
tggaacacagcgggaatcatggcactcac

SEQ ID NO: 152408 - DNA, 28 bp, Artificial Sequence
  Description of Artificial Sequence: Synthetic oligonucleotide
ggaacacagcgggaatcatggcactcac

SEQ ID NO: 152409 - DNA, 28 bp, Artificial Sequence
  Description of Artificial Sequence: Synthetic oligonucleotide
gaacacagcgggaatcatggcactcacc

SEQ ID NO: 152410 - DNA, 28 bp, Artificial Sequence
  Description of Artificial Sequence: Synthetic oligonucleotide
aacacagcgggaatcatggcactcaccc

SEQ ID NO: 152411 - DNA, 27 bp, Artificial Sequence
  Description of Artificial Sequence: Synthetic oligonucleotide
acacagcgggaatcatggcactcaccc

SEQ ID NO: 152412 - DNA, 27 bp, Artificial Sequence
  Description of Artificial Sequence: Synthetic oligonucleotide
cacagcgggaatcatggcactcaccct

SEQ ID NO: 152413 - DNA, 27 bp, Artificial Sequence
  Description of Artificial Sequence: Synthetic oligonucleotide
acagcgggaatcatggcactcaccctg

SEQ ID NO: 152414 - DNA, 27 bp, Artificial Sequence
  Description of Artificial Sequence: Synthetic oligonucleotide
cagcgggaatcatggcactcaccctgt

SEQ ID NO: 152415 - DNA, 27 bp, Artificial Sequence
  Description of Artificial Sequence: Synthetic oligonucleotide
agcgggaatcatggcactcaccctgtg

SEQ ID NO: 152416 - DNA, 26 bp, Artificial Sequence
  Description of Artificial Sequence: Synthetic oligonucleotide
gcgggaatcatggcactcaccctgtg

SEQ ID NO: 152417 - DNA, 26 bp, Artificial Sequence
  Description of Artificial Sequence: Synthetic oligonucleotide
cgggaatcatggcactcaccctgtgc

SEQ ID NO: 152418 - DNA, 26 bp, Artificial Sequence
  Description of Artificial Sequence: Synthetic oligonucleotide
gggaatcatggcactcaccctgtgcc

SEQ ID NO: 152419 - DNA, 27 bp, Artificial Sequence
  Description of Artificial Sequence: Synthetic oligonucleotide
ggaatcatggcactcaccctgtgccct

SEQ ID NO: 152420 - DNA, 27 bp, Artificial Sequence
  Description of Artificial Sequence: Synthetic oligonucleotide
gaatcatggcactcaccctgtgccctc

SEQ ID NO: 152421 - DNA, 28 bp, Artificial Sequence
  Description of Artificial Sequence: Synthetic oligonucleotide
aatcatggcactcaccctgtgccctctg

SEQ ID NO: 152422 - DNA, 27 bp, Artificial Sequence
  Description of Artificial Sequence: Synthetic oligonucleotide
atcatggcactcaccctgtgccctctg

SEQ ID NO: 152423 - DNA, 26 bp, Artificial Sequence
  Description of Artificial Sequence: Synthetic oligonucleotide
tcatggcactcaccctgtgccctctg

SEQ ID NO: 152424 - DNA, 25 bp, Artificial Sequence
  Description of Artificial Sequence: Synthetic oligonucleotide
catggcactcaccctgtgccctctg

SEQ ID NO: 152425 - DNA, 25 bp, Artificial Sequence
  Description of Artificial Sequence: Synthetic oligonucleotide
atggcactcaccctgtgccctctgg

SEQ ID NO: 152426 - DNA, 24 bp, Artificial Sequence
  Description of Artificial Sequence: Synthetic oligonucleotide
tggcactcaccctgtgccctctgg

SEQ ID NO: 152427 - DNA, 27 bp, Artificial Sequence
  Description of Artificial Sequence: Synthetic oligonucleotide
tgcagggcttccagcttctatccccga

SEQ ID NO: 152428 - DNA, 27 bp, Artificial Sequence
  Description of Artificial Sequence: Synthetic oligonucleotide
gcagggcttccagcttctatccccgaa

SEQ ID NO: 152429 - DNA, 31 bp, Artificial Sequence
  Description of Artificial Sequence: Synthetic oligonucleotide
cagggcttccagcttctatccccgaaatatc

SEQ ID NO: 152430 - DNA, 32 bp, Artificial Sequence
  Description of Artificial Sequence: Synthetic oligonucleotide
agggcttccagcttctatccccgaaatatcac

SEQ ID NO: 152431 - DNA, 31 bp, Artificial Sequence
  Description of Artificial Sequence: Synthetic oligonucleotide
gggcttccagcttctatccccgaaatatcac

SEQ ID NO: 152432 - DNA, 32 bp, Artificial Sequence
  Description of Artificial Sequence: Synthetic oligonucleotide
ggcttccagcttctatccccgaaatatcacac

SEQ ID NO: 152433 - DNA, 33 bp, Artificial Sequence
  Description of Artificial Sequence: Synthetic oligonucleotide
gcttccagcttctatccccgaaatatcacactg

SEQ ID NO: 152434 - DNA, 34 bp, Artificial Sequence
  Description of Artificial Sequence: Synthetic oligonucleotide
cttccagcttctatccccgaaatatcacactgac

SEQ ID NO: 152435 - DNA, 34 bp, Artificial Sequence
  Description of Artificial Sequence: Synthetic oligonucleotide
ttccagcttctatccccgaaatatcacactgacc

SEQ ID NO: 152436 - DNA, 33 bp, Artificial Sequence
  Description of Artificial Sequence: Synthetic oligonucleotide
tccagcttctatccccgaaatatcacactgacc

SEQ ID NO: 152437 - DNA, 32 bp, Artificial Sequence
  Description of Artificial Sequence: Synthetic oligonucleotide
ccagcttctatccccgaaatatcacactgacc

SEQ ID NO: 152438 - DNA, 33 bp, Artificial Sequence
  Description of Artificial Sequence: Synthetic oligonucleotide
cagcttctatccccgaaatatcacactgacctg

SEQ ID NO: 152439 - DNA, 33 bp, Artificial Sequence
  Description of Artificial Sequence: Synthetic oligonucleotide
agcttctatccccgaaatatcacactgacctgg

SEQ ID NO: 152440 - DNA, 32 bp, Artificial Sequence
  Description of Artificial Sequence: Synthetic oligonucleotide
gcttctatccccgaaatatcacactgacctgg

SEQ ID NO: 152441 - DNA, 32 bp, Artificial Sequence
  Description of Artificial Sequence: Synthetic oligonucleotide
cttctatccccgaaatatcacactgacctggc

SEQ ID NO: 152442 - DNA, 32 bp, Artificial Sequence
  Description of Artificial Sequence: Synthetic oligonucleotide
ttctatccccgaaatatcacactgacctggcg

SEQ ID NO: 152443 - DNA, 31 bp, Artificial Sequence
  Description of Artificial Sequence: Synthetic oligonucleotide
tctatccccgaaatatcacactgacctggcg

SEQ ID NO: 152444 - DNA, 30 bp, Artificial Sequence
  Description of Artificial Sequence: Synthetic oligonucleotide
ctatccccgaaatatcacactgacctggcg

SEQ ID NO: 152445 - DNA, 31 bp, Artificial Sequence
  Description of Artificial Sequence: Synthetic oligonucleotide
tatccccgaaatatcacactgacctggcgtc

SEQ ID NO: 152446 - DNA, 30 bp, Artificial Sequence
  Description of Artificial Sequence: Synthetic oligonucleotide
atccccgaaatatcacactgacctggcgtc

SEQ ID NO: 152447 - DNA, 29 bp, Artificial Sequence
  Description of Artificial Sequence: Synthetic oligonucleotide
tccccgaaatatcacactgacctggcgtc

SEQ ID NO: 152448 - DNA, 28 bp, Artificial Sequence
  Description of Artificial Sequence: Synthetic oligonucleotide
ccccgaaatatcacactgacctggcgtc

SEQ ID NO: 152449 - DNA, 29 bp, Artificial Sequence
  Description of Artificial Sequence: Synthetic oligonucleotide
cccgaaatatcacactgacctggcgtcag

SEQ ID NO: 152450 - DNA, 29 bp, Artificial Sequence
  Description of Artificial Sequence: Synthetic oligonucleotide
ccgaaatatcacactgacctggcgtcagg

SEQ ID NO: 152451 - DNA, 31 bp, Artificial Sequence
  Description of Artificial Sequence: Synthetic oligonucleotide
cgaaatatcacactgacctggcgtcaggatg

SEQ ID NO: 152452 - DNA, 31 bp, Artificial Sequence
  Description of Artificial Sequence: Synthetic oligonucleotide
gaaatatcacactgacctggcgtcaggatgg

SEQ ID NO: 152453 - DNA, 31 bp, Artificial Sequence
  Description of Artificial Sequence: Synthetic oligonucleotide
aaatatcacactgacctggcgtcaggatggg

SEQ ID NO: 152454 - DNA, 29 bp, Artificial Sequence
  Description of Artificial Sequence: Synthetic oligonucleotide
tgcctgatgggaatggaacctaccagacg

SEQ ID NO: 152455 - DNA, 28 bp, Artificial Sequence
  Description of Artificial Sequence: Synthetic oligonucleotide
gcctgatgggaatggaacctaccagacg

SEQ ID NO: 152456 - DNA, 29 bp, Artificial Sequence
  Description of Artificial Sequence: Synthetic oligonucleotide
cctgatgggaatggaacctaccagacgtg

SEQ ID NO: 152457 - DNA, 29 bp, Artificial Sequence
  Description of Artificial Sequence: Synthetic oligonucleotide
ctgatgggaatggaacctaccagacgtgg

SEQ ID NO: 152458 - DNA, 29 bp, Artificial Sequence
  Description of Artificial Sequence: Synthetic oligonucleotide
tgatgggaatggaacctaccagacgtggg

SEQ ID NO: 152459 - DNA, 28 bp, Artificial Sequence
  Description of Artificial Sequence: Synthetic oligonucleotide
gatgggaatggaacctaccagacgtggg

SEQ ID NO: 152460 - DNA, 29 bp, Artificial Sequence
  Description of Artificial Sequence: Synthetic oligonucleotide
atgggaatggaacctaccagacgtgggtg

SEQ ID NO: 152461 - DNA, 28 bp, Artificial Sequence
  Description of Artificial Sequence: Synthetic oligonucleotide
tgggaatggaacctaccagacgtgggtg

SEQ ID NO: 152462 - DNA, 27 bp, Artificial Sequence
  Description of Artificial Sequence: Synthetic oligonucleotide
gggaatggaacctaccagacgtgggtg

SEQ ID NO: 152463 - DNA, 27 bp, Artificial Sequence
  Description of Artificial Sequence: Synthetic oligonucleotide
ggaatggaacctaccagacgtgggtgg

SEQ ID NO: 152464 - DNA, 27 bp, Artificial Sequence
  Description of Artificial Sequence: Synthetic oligonucleotide
gaatggaacctaccagacgtgggtggc

SEQ ID NO: 152465 - DNA, 27 bp, Artificial Sequence
  Description of Artificial Sequence: Synthetic oligonucleotide
aatggaacctaccagacgtgggtggcc

SEQ ID NO: 152466 - DNA, 27 bp, Artificial Sequence
  Description of Artificial Sequence: Synthetic oligonucleotide
atggaacctaccagacgtgggtggcca

SEQ ID NO: 152467 - DNA, 26 bp, Artificial Sequence
  Description of Artificial Sequence: Synthetic oligonucleotide
tggaacctaccagacgtgggtggcca

SEQ ID NO: 152468 - DNA, 25 bp, Artificial Sequence
  Description of Artificial Sequence: Synthetic oligonucleotide
ggaacctaccagacgtgggtggcca

SEQ ID NO: 152469 - DNA, 25 bp, Artificial Sequence
  Description of Artificial Sequence: Synthetic oligonucleotide
gaacctaccagacgtgggtggccac

SEQ ID NO: 152470 - DNA, 26 bp, Artificial Sequence
  Description of Artificial Sequence: Synthetic oligonucleotide
aacctaccagacgtgggtggccacca

SEQ ID NO: 152471 - DNA, 25 bp, Artificial Sequence
  Description of Artificial Sequence: Synthetic oligonucleotide
acctaccagacgtgggtggccacca

SEQ ID NO: 152472 - DNA, 24 bp, Artificial Sequence
  Description of Artificial Sequence: Synthetic oligonucleotide
cctaccagacgtgggtggccacca

SEQ ID NO: 152473 - DNA, 24 bp, Artificial Sequence
  Description of Artificial Sequence: Synthetic oligonucleotide
ctaccagacgtgggtggccaccag

SEQ ID NO: 152474 - DNA, 27 bp, Artificial Sequence
  Description of Artificial Sequence: Synthetic oligonucleotide
taccagacgtgggtggccaccaggatt

SEQ ID NO: 152475 - DNA, 26 bp, Artificial Sequence
  Description of Artificial Sequence: Synthetic oligonucleotide
accagacgtgggtggccaccaggatt

SEQ ID NO: 152476 - DNA, 25 bp, Artificial Sequence
  Description of Artificial Sequence: Synthetic oligonucleotide
ccagacgtgggtggccaccaggatt

SEQ ID NO: 152477 - DNA, 25 bp, Artificial Sequence
  Description of Artificial Sequence: Synthetic oligonucleotide
cagacgtgggtggccaccaggattc

SEQ ID NO: 152478 - DNA, 25 bp, Artificial Sequence
  Description of Artificial Sequence: Synthetic oligonucleotide
agacgtgggtggccaccaggattcg

SEQ ID NO: 152479 - DNA, 24 bp, Artificial Sequence
  Description of Artificial Sequence: Synthetic oligonucleotide
gacgtgggtggccaccaggattcg

SEQ ID NO: 152480 - DNA, 24 bp, Artificial Sequence
  Description of Artificial Sequence: Synthetic oligonucleotide
acgtgggtggccaccaggattcgc

SEQ ID NO: 152481 - DNA, 23 bp, Artificial Sequence
  Description of Artificial Sequence: Synthetic oligonucleotide
cgtgggtggccaccaggattcgc

SEQ ID NO: 152482 - DNA, 25 bp, Artificial Sequence
  Description of Artificial Sequence: Synthetic oligonucleotide
gtgggtggccaccaggattcgccaa

SEQ ID NO: 152483 - DNA, 25 bp, Artificial Sequence
  Description of Artificial Sequence: Synthetic oligonucleotide
ggcaagacctcaggaggaccctgac

SEQ ID NO: 152484 - DNA, 25 bp, Artificial Sequence
  Description of Artificial Sequence: Synthetic oligonucleotide
gcaagacctcaggaggaccctgacc

SEQ ID NO: 152485 - DNA, 27 bp, Artificial Sequence
  Description of Artificial Sequence: Synthetic oligonucleotide
caagacctcaggaggaccctgacccat

SEQ ID NO: 152486 - DNA, 29 bp, Artificial Sequence
  Description of Artificial Sequence: Synthetic oligonucleotide
aagacctcaggaggaccctgacccatatc

SEQ ID NO: 152487 - DNA, 28 bp, Artificial Sequence
  Description of Artificial Sequence: Synthetic oligonucleotide
agacctcaggaggaccctgacccatatc

SEQ ID NO: 152488 - DNA, 27 bp, Artificial Sequence
  Description of Artificial Sequence: Synthetic oligonucleotide
gacctcaggaggaccctgacccatatc

SEQ ID NO: 152489 - DNA, 29 bp, Artificial Sequence
  Description of Artificial Sequence: Synthetic oligonucleotide
acctcaggaggaccctgacccatatcaag

SEQ ID NO: 152490 - DNA, 28 bp, Artificial Sequence
  Description of Artificial Sequence: Synthetic oligonucleotide
cctcaggaggaccctgacccatatcaag

SEQ ID NO: 152491 - DNA, 28 bp, Artificial Sequence
  Description of Artificial Sequence: Synthetic oligonucleotide
ctcaggaggaccctgacccatatcaagg

SEQ ID NO: 152492 - DNA, 29 bp, Artificial Sequence
  Description of Artificial Sequence: Synthetic oligonucleotide
tcaggaggaccctgacccatatcaaggac

SEQ ID NO: 152493 - DNA, 28 bp, Artificial Sequence
  Description of Artificial Sequence: Synthetic oligonucleotide
caggaggaccctgacccatatcaaggac

SEQ ID NO: 152494 - DNA, 28 bp, Artificial Sequence
  Description of Artificial Sequence: Synthetic oligonucleotide
aggaggaccctgacccatatcaaggacc

SEQ ID NO: 152495 - DNA, 27 bp, Artificial Sequence
  Description of Artificial Sequence: Synthetic oligonucleotide
ggaggaccctgacccatatcaaggacc

SEQ ID NO: 152496 - DNA, 28 bp, Artificial Sequence
  Description of Artificial Sequence: Synthetic oligonucleotide
gaggaccctgacccatatcaaggaccag

SEQ ID NO: 152497 - DNA, 31 bp, Artificial Sequence
  Description of Artificial Sequence: Synthetic oligonucleotide
aggaccctgacccatatcaaggaccagaaag

SEQ ID NO: 152498 - DNA, 30 bp, Artificial Sequence
  Description of Artificial Sequence: Synthetic oligonucleotide
ggaccctgacccatatcaaggaccagaaag

SEQ ID NO: 152499 - DNA, 30 bp, Artificial Sequence
  Description of Artificial Sequence: Synthetic oligonucleotide
gaccctgacccatatcaaggaccagaaagg

SEQ ID NO: 152500 - DNA, 31 bp, Artificial Sequence
  Description of Artificial Sequence: Synthetic oligonucleotide
accctgacccatatcaaggaccagaaaggag

SEQ ID NO: 152501 - DNA, 30 bp, Artificial Sequence
  Description of Artificial Sequence: Synthetic oligonucleotide
ccctgacccatatcaaggaccagaaaggag

SEQ ID NO: 152502 - DNA, 30 bp, Artificial Sequence
  Description of Artificial Sequence: Synthetic oligonucleotide
cctgacccatatcaaggaccagaaaggagg

SEQ ID NO: 152503 - DNA, 30 bp, Artificial Sequence
  Description of Artificial Sequence: Synthetic oligonucleotide
ctgacccatatcaaggaccagaaaggaggc

SEQ ID NO: 152504 - DNA, 32 bp, Artificial Sequence
  Description of Artificial Sequence: Synthetic oligonucleotide
tgacccatatcaaggaccagaaaggaggcttg

SEQ ID NO: 152505 - DNA, 31 bp, Artificial Sequence
  Description of Artificial Sequence: Synthetic oligonucleotide
gacccatatcaaggaccagaaaggaggcttg

SEQ ID NO: 152506 - DNA, 31 bp, Artificial Sequence
  Description of Artificial Sequence: Synthetic oligonucleotide
acccatatcaaggaccagaaaggaggcttgc

SEQ ID NO: 152507 - DNA, 30 bp, Artificial Sequence
  Description of Artificial Sequence: Synthetic oligonucleotide
cccatatcaaggaccagaaaggaggcttgc

SEQ ID NO: 152508 - DNA, 33 bp, Artificial Sequence
  Description of Artificial Sequence: Synthetic oligonucleotide
ccatatcaaggaccagaaaggaggcttgcattc

SEQ ID NO: 152509 - DNA, 27 bp, Artificial Sequence
  Description of Artificial Sequence: Synthetic oligonucleotide
cccccatggtgaatgtcacctgcagca

SEQ ID NO: 152510 - DNA, 28 bp, Artificial Sequence
  Description of Artificial Sequence: Synthetic oligonucleotide
ccccatggtgaatgtcacctgcagcaag

SEQ ID NO: 152511 - DNA, 28 bp, Artificial Sequence
  Description of Artificial Sequence: Synthetic oligonucleotide
cccatggtgaatgtcacctgcagcaagg

SEQ ID NO: 152512 - DNA, 29 bp, Artificial Sequence
  Description of Artificial Sequence: Synthetic oligonucleotide
ccatggtgaatgtcacctgcagcaaggtc

SEQ ID NO: 152513 - DNA, 30 bp, Artificial Sequence
  Description of Artificial Sequence: Synthetic oligonucleotide
catggtgaatgtcacctgcagcaaggtctc

SEQ ID NO: 152514 - DNA, 31 bp, Artificial Sequence
  Description of Artificial Sequence: Synthetic oligonucleotide
atggtgaatgtcacctgcagcaaggtctcag

SEQ ID NO: 152515 - DNA, 30 bp, Artificial Sequence
  Description of Artificial Sequence: Synthetic oligonucleotide
tggtgaatgtcacctgcagcaaggtctcag

SEQ ID NO: 152516 - DNA, 29 bp, Artificial Sequence
  Description of Artificial Sequence: Synthetic oligonucleotide
ggtgaatgtcacctgcagcaaggtctcag

SEQ ID NO: 152517 - DNA, 30 bp, Artificial Sequence
  Description of Artificial Sequence: Synthetic oligonucleotide
gtgaatgtcacctgcagcaaggtctcagag

SEQ ID NO: 152518 - DNA, 30 bp, Artificial Sequence
  Description of Artificial Sequence: Synthetic oligonucleotide
tgaatgtcacctgcagcaaggtctcagagg

SEQ ID NO: 152519 - DNA, 29 bp, Artificial Sequence
  Description of Artificial Sequence: Synthetic oligonucleotide
gaatgtcacctgcagcaaggtctcagagg

SEQ ID NO: 152520 - DNA, 29 bp, Artificial Sequence
  Description of Artificial Sequence: Synthetic oligonucleotide
aatgtcacctgcagcaaggtctcagaggg

SEQ ID NO: 152521 - DNA, 28 bp, Artificial Sequence
  Description of Artificial Sequence: Synthetic oligonucleotide
atgtcacctgcagcaaggtctcagaggg

SEQ ID NO: 152522 - DNA, 27 bp, Artificial Sequence
  Description of Artificial Sequence: Synthetic oligonucleotide
tgtcacctgcagcaaggtctcagaggg

SEQ ID NO: 152523 - DNA, 26 bp, Artificial Sequence
  Description of Artificial Sequence: Synthetic oligonucleotide
gtcacctgcagcaaggtctcagaggg

SEQ ID NO: 152524 - DNA, 27 bp, Artificial Sequence
  Description of Artificial Sequence: Synthetic oligonucleotide
tcacctgcagcaaggtctcagagggca

SEQ ID NO: 152525 - DNA, 27 bp, Artificial Sequence
  Description of Artificial Sequence: Synthetic oligonucleotide
cacctgcagcaaggtctcagagggcaa

SEQ ID NO: 152526 - DNA, 27 bp, Artificial Sequence
  Description of Artificial Sequence: Synthetic oligonucleotide
acctgcagcaaggtctcagagggcaac

SEQ ID NO: 152527 - DNA, 27 bp, Artificial Sequence
  Description of Artificial Sequence: Synthetic oligonucleotide
cctgcagcaaggtctcagagggcaaca

SEQ ID NO: 152528 - DNA, 28 bp, Artificial Sequence
  Description of Artificial Sequence: Synthetic oligonucleotide
ctgcagcaaggtctcagagggcaacatc

SEQ ID NO: 152529 - DNA, 29 bp, Artificial Sequence
  Description of Artificial Sequence: Synthetic oligonucleotide
tgcagcaaggtctcagagggcaacatcac

SEQ ID NO: 152530 - DNA, 28 bp, Artificial Sequence
  Description of Artificial Sequence: Synthetic oligonucleotide
gcagcaaggtctcagagggcaacatcac

SEQ ID NO: 152531 - DNA, 28 bp, Artificial Sequence
  Description of Artificial Sequence: Synthetic oligonucleotide
cagcaaggtctcagagggcaacatcacc

SEQ ID NO: 152532 - DNA, 28 bp, Artificial Sequence
  Description of Artificial Sequence: Synthetic oligonucleotide
agcaaggtctcagagggcaacatcaccg

SEQ ID NO: 152533 - DNA, 27 bp, Artificial Sequence
  Description of Artificial Sequence: Synthetic oligonucleotide
gcaaggtctcagagggcaacatcaccg

SEQ ID NO: 152534 - DNA, 28 bp, Artificial Sequence
  Description of Artificial Sequence: Synthetic oligonucleotide
caaggtctcagagggcaacatcaccgtg

SEQ ID NO: 152535 - DNA, 29 bp, Artificial Sequence
  Description of Artificial Sequence: Synthetic oligonucleotide
aaggtctcagagggcaacatcaccgtgac

SEQ ID NO: 152536 - DNA, 28 bp, Artificial Sequence
  Description of Artificial Sequence: Synthetic oligonucleotide
caggattcgccaaggagaggagcagaag

SEQ ID NO: 152537 - DNA, 30 bp, Artificial Sequence
  Description of Artificial Sequence: Synthetic oligonucleotide
aggattcgccaaggagaggagcagaagttc

SEQ ID NO: 152538 - DNA, 29 bp, Artificial Sequence
  Description of Artificial Sequence: Synthetic oligonucleotide
ggattcgccaaggagaggagcagaagttc

SEQ ID NO: 152539 - DNA, 30 bp, Artificial Sequence
  Description of Artificial Sequence: Synthetic oligonucleotide
gattcgccaaggagaggagcagaagttcac

SEQ ID NO: 152540 - DNA, 30 bp, Artificial Sequence
  Description of Artificial Sequence: Synthetic oligonucleotide
attcgccaaggagaggagcagaagttcacc

SEQ ID NO: 152541 - DNA, 29 bp, Artificial Sequence
  Description of Artificial Sequence: Synthetic oligonucleotide
ttcgccaaggagaggagcagaagttcacc

SEQ ID NO: 152542 - DNA, 28 bp, Artificial Sequence
  Description of Artificial Sequence: Synthetic oligonucleotide
tcgccaaggagaggagcagaagttcacc

SEQ ID NO: 152543 - DNA, 27 bp, Artificial Sequence
  Description of Artificial Sequence: Synthetic oligonucleotide
cgccaaggagaggagcagaagttcacc

SEQ ID NO: 152544 - DNA, 28 bp, Artificial Sequence
  Description of Artificial Sequence: Synthetic oligonucleotide
gccaaggagaggagcagaagttcacctg

SEQ ID NO: 152545 - DNA, 28 bp, Artificial Sequence
  Description of Artificial Sequence: Synthetic oligonucleotide
ccaaggagaggagcagaagttcacctgc

SEQ ID NO: 152546 - DNA, 30 bp, Artificial Sequence
  Description of Artificial Sequence: Synthetic oligonucleotide
caaggagaggagcagaagttcacctgctac

SEQ ID NO: 152547 - DNA, 32 bp, Artificial Sequence
  Description of Artificial Sequence: Synthetic oligonucleotide
aaggagaggagcagaagttcacctgctacatg

SEQ ID NO: 152548 - DNA, 31 bp, Artificial Sequence
  Description of Artificial Sequence: Synthetic oligonucleotide
aggagaggagcagaagttcacctgctacatg

SEQ ID NO: 152549 - DNA, 30 bp, Artificial Sequence
  Description of Artificial Sequence: Synthetic oligonucleotide
ggagaggagcagaagttcacctgctacatg

SEQ ID NO: 152550 - DNA, 30 bp, Artificial Sequence
  Description of Artificial Sequence: Synthetic oligonucleotide
gagaggagcagaagttcacctgctacatgg

SEQ ID NO: 152551 - DNA, 32 bp, Artificial Sequence
  Description of Artificial Sequence: Synthetic oligonucleotide
agaggagcagaagttcacctgctacatggaac

SEQ ID NO: 152552 - DNA, 31 bp, Artificial Sequence
  Description of Artificial Sequence: Synthetic oligonucleotide
gaggagcagaagttcacctgctacatggaac

SEQ ID NO: 152553 - DNA, 32 bp, Artificial Sequence
  Description of Artificial Sequence: Synthetic oligonucleotide
aggagcagaagttcacctgctacatggaacac

SEQ ID NO: 152554 - DNA, 31 bp, Artificial Sequence
  Description of Artificial Sequence: Synthetic oligonucleotide
ggagcagaagttcacctgctacatggaacac

SEQ ID NO: 152555 - DNA, 32 bp, Artificial Sequence
  Description of Artificial Sequence: Synthetic oligonucleotide
gagcagaagttcacctgctacatggaacacag

SEQ ID NO: 152556 - DNA, 32 bp, Artificial Sequence
  Description of Artificial Sequence: Synthetic oligonucleotide
agcagaagttcacctgctacatggaacacagc

SEQ ID NO: 152557 - DNA, 31 bp, Artificial Sequence
  Description of Artificial Sequence: Synthetic oligonucleotide
gcagaagttcacctgctacatggaacacagc

SEQ ID NO: 152558 - DNA, 31 bp, Artificial Sequence
  Description of Artificial Sequence: Synthetic oligonucleotide
cagaagttcacctgctacatggaacacagcg

SEQ ID NO: 152559 - DNA, 31 bp, Artificial Sequence
  Description of Artificial Sequence: Synthetic oligonucleotide
agaagttcacctgctacatggaacacagcgg

SEQ ID NO: 152560 - DNA, 30 bp, Artificial Sequence
  Description of Artificial Sequence: Synthetic oligonucleotide
gaagttcacctgctacatggaacacagcgg

SEQ ID NO: 152561 - DNA, 30 bp, Artificial Sequence
  Description of Artificial Sequence: Synthetic oligonucleotide
aagttcacctgctacatggaacacagcggg

SEQ ID NO: 152562 - DNA, 29 bp, Artificial Sequence
  Description of Artificial Sequence: Synthetic oligonucleotide
agttcacctgctacatggaacacagcggg

SEQ ID NO: 152563 - DNA, 32 bp, Artificial Sequence
  Description of Artificial Sequence: Synthetic oligonucleotide
attccctccaggagattagggtctgtgagatg

SEQ ID NO: 152564 - DNA, 31 bp, Artificial Sequence
  Description of Artificial Sequence: Synthetic oligonucleotide
ttccctccaggagattagggtctgtgagatg

SEQ ID NO: 152565 - DNA, 30 bp, Artificial Sequence
  Description of Artificial Sequence: Synthetic oligonucleotide
tccctccaggagattagggtctgtgagatg

SEQ ID NO: 152566 - DNA, 29 bp, Artificial Sequence
  Description of Artificial Sequence: Synthetic oligonucleotide
ccctccaggagattagggtctgtgagatg

SEQ ID NO: 152567 - DNA, 29 bp, Artificial Sequence
  Description of Artificial Sequence: Synthetic oligonucleotide
cctccaggagattagggtctgtgagatgc

SEQ ID NO: 152568 - DNA, 31 bp, Artificial Sequence
  Description of Artificial Sequence: Synthetic oligonucleotide
ctccaggagattagggtctgtgagatgcatg

SEQ ID NO: 152569 - DNA, 33 bp, Artificial Sequence
  Description of Artificial Sequence: Synthetic oligonucleotide
tccaggagattagggtctgtgagatgcatgaag

SEQ ID NO: 152570 - DNA, 32 bp, Artificial Sequence
  Description of Artificial Sequence: Synthetic oligonucleotide
ccaggagattagggtctgtgagatgcatgaag

SEQ ID NO: 152571 - DNA, 33 bp, Artificial Sequence
  Description of Artificial Sequence: Synthetic oligonucleotide
caggagattagggtctgtgagatgcatgaagac

SEQ ID NO: 152572 - DNA, 34 bp, Artificial Sequence
  Description of Artificial Sequence: Synthetic oligonucleotide
aggagattagggtctgtgagatgcatgaagacag

SEQ ID NO: 152573 - DNA, 33 bp, Artificial Sequence
  Description of Artificial Sequence: Synthetic oligonucleotide
ggagattagggtctgtgagatgcatgaagacag

SEQ ID NO: 152574 - DNA, 33 bp, Artificial Sequence
  Description of Artificial Sequence: Synthetic oligonucleotide
gagattagggtctgtgagatgcatgaagacagc

SEQ ID NO: 152575 - DNA, 34 bp, Artificial Sequence
  Description of Artificial Sequence: Synthetic oligonucleotide
agattagggtctgtgagatgcatgaagacagcag

SEQ ID NO: 152576 - DNA, 33 bp, Artificial Sequence
  Description of Artificial Sequence: Synthetic oligonucleotide
gattagggtctgtgagatgcatgaagacagcag

SEQ ID NO: 152577 - DNA, 33 bp, Artificial Sequence
  Description of Artificial Sequence: Synthetic oligonucleotide
attagggtctgtgagatgcatgaagacagcagc

SEQ ID NO: 152578 - DNA, 32 bp, Artificial Sequence
  Description of Artificial Sequence: Synthetic oligonucleotide
ttagggtctgtgagatgcatgaagacagcagc

SEQ ID NO: 152579 - DNA, 31 bp, Artificial Sequence
  Description of Artificial Sequence: Synthetic oligonucleotide
tagggtctgtgagatgcatgaagacagcagc

SEQ ID NO: 152580 - DNA, 30 bp, Artificial Sequence
  Description of Artificial Sequence: Synthetic oligonucleotide
agggtctgtgagatgcatgaagacagcagc

SEQ ID NO: 152581 - DNA, 29 bp, Artificial Sequence
  Description of Artificial Sequence: Synthetic oligonucleotide
gggtctgtgagatgcatgaagacagcagc

SEQ ID NO: 152582 - DNA, 30 bp, Artificial Sequence
  Description of Artificial Sequence: Synthetic oligonucleotide
ggtctgtgagatgcatgaagacagcagcac

SEQ ID NO: 152583 - DNA, 30 bp, Artificial Sequence
  Description of Artificial Sequence: Synthetic oligonucleotide
gtctgtgagatgcatgaagacagcagcacc

SEQ ID NO: 152584 - DNA, 31 bp, Artificial Sequence
  Description of Artificial Sequence: Synthetic oligonucleotide
tctgtgagatgcatgaagacagcagcaccag

SEQ ID NO: 152585 - DNA, 30 bp, Artificial Sequence
  Description of Artificial Sequence: Synthetic oligonucleotide
ctgtgagatgcatgaagacagcagcaccag

SEQ ID NO: 152586 - DNA, 30 bp, Artificial Sequence
  Description of Artificial Sequence: Synthetic oligonucleotide
tgtgagatgcatgaagacagcagcaccagg

SEQ ID NO: 152587 - DNA, 29 bp, Artificial Sequence
  Description of Artificial Sequence: Synthetic oligonucleotide
gtgagatgcatgaagacagcagcaccagg

SEQ ID NO: 152588 - DNA, 29 bp, Artificial Sequence
  Description of Artificial Sequence: Synthetic oligonucleotide
tgagatgcatgaagacagcagcaccaggg

SEQ ID NO: 152589 - DNA, 28 bp, Artificial Sequence
  Description of Artificial Sequence: Synthetic oligonucleotide
gagatgcatgaagacagcagcaccaggg

SEQ ID NO: 152590 - DNA, 28 bp, Artificial Sequence
  Description of Artificial Sequence: Synthetic oligonucleotide
agatgcatgaagacagcagcaccagggg

SEQ ID NO: 152591 - DNA, 27 bp, Artificial Sequence
  Description of Artificial Sequence: Synthetic oligonucleotide
gatgcatgaagacagcagcaccagggg

SEQ ID NO: 152592 - DNA, 27 bp, Artificial Sequence
  Description of Artificial Sequence: Synthetic oligonucleotide
atgcatgaagacagcagcaccaggggc

SEQ ID NO: 152593 - DNA, 27 bp, Artificial Sequence
  Description of Artificial Sequence: Synthetic oligonucleotide
tgcatgaagacagcagcaccaggggct

SEQ ID NO: 152594 - DNA, 26 bp, Artificial Sequence
  Description of Artificial Sequence: Synthetic oligonucleotide
gcatgaagacagcagcaccaggggct

SEQ ID NO: 152595 - DNA, 29 bp, Artificial Sequence
  Description of Artificial Sequence: Synthetic oligonucleotide
caggcagactgcctgcagaaactacagtg

SEQ ID NO: 152596 - DNA, 33 bp, Artificial Sequence
  Description of Artificial Sequence: Synthetic oligonucleotide
aggcagactgcctgcagaaactacagtgatatc

SEQ ID NO: 152597 - DNA, 32 bp, Artificial Sequence
  Description of Artificial Sequence: Synthetic oligonucleotide
ggcagactgcctgcagaaactacagtgatatc

SEQ ID NO: 152598 - DNA, 33 bp, Artificial Sequence
  Description of Artificial Sequence: Synthetic oligonucleotide
gcagactgcctgcagaaactacagtgatatctg

SEQ ID NO: 152599 - DNA, 37 bp, Artificial Sequence
  Description of Artificial Sequence: Synthetic oligonucleotide
cagactgcctgcagaaactacagtgatatctgaaatc

SEQ ID NO: 152600 - DNA, 37 bp, Artificial Sequence
  Description of Artificial Sequence: Synthetic oligonucleotide
agactgcctgcagaaactacagtgatatctgaaatcc

SEQ ID NO: 152601 - DNA, 36 bp, Artificial Sequence
  Description of Artificial Sequence: Synthetic oligonucleotide
gactgcctgcagaaactacagtgatatctgaaatcc

SEQ ID NO: 152602 - DNA, 36 bp, Artificial Sequence
  Description of Artificial Sequence: Synthetic oligonucleotide
actgcctgcagaaactacagtgatatctgaaatccg

SEQ ID NO: 152603 - DNA, 35 bp, Artificial Sequence
  Description of Artificial Sequence: Synthetic oligonucleotide
ctgcctgcagaaactacagtgatatctgaaatccg

SEQ ID NO: 152604 - DNA, 35 bp, Artificial Sequence
  Description of Artificial Sequence: Synthetic oligonucleotide
tgcctgcagaaactacagtgatatctgaaatccgg

SEQ ID NO: 152605 - DNA, 34 bp, Artificial Sequence
  Description of Artificial Sequence: Synthetic oligonucleotide
gcctgcagaaactacagtgatatctgaaatccgg

SEQ ID NO: 152606 - DNA, 34 bp, Artificial Sequence
  Description of Artificial Sequence: Synthetic oligonucleotide
cctgcagaaactacagtgatatctgaaatccggg

SEQ ID NO: 152607 - DNA, 34 bp, Artificial Sequence
  Description of Artificial Sequence: Synthetic oligonucleotide
ctgcagaaactacagtgatatctgaaatccgggg

SEQ ID NO: 152608 - DNA, 35 bp, Artificial Sequence
  Description of Artificial Sequence: Synthetic oligonucleotide
tgcagaaactacagtgatatctgaaatccggggtg

SEQ ID NO: 152609 - DNA, 34 bp, Artificial Sequence
  Description of Artificial Sequence: Synthetic oligonucleotide
gcagaaactacagtgatatctgaaatccggggtg

SEQ ID NO: 152610 - DNA, 34 bp, Artificial Sequence
  Description of Artificial Sequence: Synthetic oligonucleotide
cagaaactacagtgatatctgaaatccggggtgg

SEQ ID NO: 152611 - DNA, 34 bp, Artificial Sequence
  Description of Artificial Sequence: Synthetic oligonucleotide
agaaactacagtgatatctgaaatccggggtggc

SEQ ID NO: 152612 - DNA, 33 bp, Artificial Sequence
  Description of Artificial Sequence: Synthetic oligonucleotide
gaaactacagtgatatctgaaatccggggtggc

SEQ ID NO: 152613 - DNA, 33 bp, Artificial Sequence
  Description of Artificial Sequence: Synthetic oligonucleotide
aaactacagtgatatctgaaatccggggtggcc

SEQ ID NO: 152614 - DNA, 32 bp, Artificial Sequence
  Description of Artificial Sequence: Synthetic oligonucleotide
aactacagtgatatctgaaatccggggtggcc

SEQ ID NO: 152615 - DNA, 31 bp, Artificial Sequence
  Description of Artificial Sequence: Synthetic oligonucleotide
actacagtgatatctgaaatccggggtggcc

SEQ ID NO: 152616 - DNA, 30 bp, Artificial Sequence
  Description of Artificial Sequence: Synthetic oligonucleotide
ctacagtgatatctgaaatccggggtggcc

SEQ ID NO: 152617 - DNA, 32 bp, Artificial Sequence
  Description of Artificial Sequence: Synthetic oligonucleotide
tacagtgatatctgaaatccggggtggccatc

SEQ ID NO: 152618 - DNA, 31 bp, Artificial Sequence
  Description of Artificial Sequence: Synthetic oligonucleotide
acagtgatatctgaaatccggggtggccatc

SEQ ID NO: 152619 - DNA, 30 bp, Artificial Sequence
  Description of Artificial Sequence: Synthetic oligonucleotide
cagtgatatctgaaatccggggtggccatc

SEQ ID NO: 152620 - DNA, 31 bp, Artificial Sequence
  Description of Artificial Sequence: Synthetic oligonucleotide
agtgatatctgaaatccggggtggccatcag

SEQ ID NO: 152621 - DNA, 30 bp, Artificial Sequence
  Description of Artificial Sequence: Synthetic oligonucleotide
gtgatatctgaaatccggggtggccatcag

SEQ ID NO: 152622 - DNA, 30 bp, Artificial Sequence
  Description of Artificial Sequence: Synthetic oligonucleotide
tgatatctgaaatccggggtggccatcagg

SEQ ID NO: 152623 - DNA, 30 bp, Artificial Sequence
  Description of Artificial Sequence: Synthetic oligonucleotide
tatgacaggcagaaacgcagggcaaagcac

SEQ ID NO: 152624 - DNA, 29 bp, Artificial Sequence
  Description of Artificial Sequence: Synthetic oligonucleotide
atgacaggcagaaacgcagggcaaagcac

SEQ ID NO: 152625 - DNA, 28 bp, Artificial Sequence
  Description of Artificial Sequence: Synthetic oligonucleotide
tgacaggcagaaacgcagggcaaagcac

SEQ ID NO: 152626 - DNA, 27 bp, Artificial Sequence
  Description of Artificial Sequence: Synthetic oligonucleotide
gacaggcagaaacgcagggcaaagcac

SEQ ID NO: 152627 - DNA, 27 bp, Artificial Sequence
  Description of Artificial Sequence: Synthetic oligonucleotide
acaggcagaaacgcagggcaaagcacc

SEQ ID NO: 152628 - DNA, 27 bp, Artificial Sequence
  Description of Artificial Sequence: Synthetic oligonucleotide
caggcagaaacgcagggcaaagcacca

SEQ ID NO: 152629 - DNA, 27 bp, Artificial Sequence
  Description of Artificial Sequence: Synthetic oligonucleotide
aggcagaaacgcagggcaaagcaccag

SEQ ID NO: 152630 - DNA, 26 bp, Artificial Sequence
  Description of Artificial Sequence: Synthetic oligonucleotide
ggcagaaacgcagggcaaagcaccag

SEQ ID NO: 152631 - DNA, 26 bp, Artificial Sequence
  Description of Artificial Sequence: Synthetic oligonucleotide
gcagaaacgcagggcaaagcaccagg

SEQ ID NO: 152632 - DNA, 27 bp, Artificial Sequence
  Description of Artificial Sequence: Synthetic oligonucleotide
cagaaacgcagggcaaagcaccaggga

SEQ ID NO: 152633 - DNA, 27 bp, Artificial Sequence
  Description of Artificial Sequence: Synthetic oligonucleotide
agaaacgcagggcaaagcaccagggac

SEQ ID NO: 152634 - DNA, 27 bp, Artificial Sequence
  Description of Artificial Sequence: Synthetic oligonucleotide
gaaacgcagggcaaagcaccagggaca

SEQ ID NO: 152635 - DNA, 27 bp, Artificial Sequence
  Description of Artificial Sequence: Synthetic oligonucleotide
aaacgcagggcaaagcaccagggacag

SEQ ID NO: 152636 - DNA, 27 bp, Artificial Sequence
  Description of Artificial Sequence: Synthetic oligonucleotide
aacgcagggcaaagcaccagggacagt

SEQ ID NO: 152637 - DNA, 26 bp, Artificial Sequence
  Description of Artificial Sequence: Synthetic oligonucleotide
acgcagggcaaagcaccagggacagt

SEQ ID NO: 152638 - DNA, 25 bp, Artificial Sequence
  Description of Artificial Sequence: Synthetic oligonucleotide
cgcagggcaaagcaccagggacagt

SEQ ID NO: 152639 - DNA, 25 bp, Artificial Sequence
  Description of Artificial Sequence: Synthetic oligonucleotide
gcagggcaaagcaccagggacagtg

SEQ ID NO: 152640 - DNA, 25 bp, Artificial Sequence
  Description of Artificial Sequence: Synthetic oligonucleotide
cagggcaaagcaccagggacagtgg

SEQ ID NO: 152641 - DNA, 25 bp, Artificial Sequence
  Description of Artificial Sequence: Synthetic oligonucleotide
agggcaaagcaccagggacagtggg

SEQ ID NO: 152642 - DNA, 24 bp, Artificial Sequence
  Description of Artificial Sequence: Synthetic oligonucleotide
gggcaaagcaccagggacagtggg

SEQ ID NO: 152643 - DNA, 25 bp, Artificial Sequence
  Description of Artificial Sequence: Synthetic oligonucleotide
ggcaaagcaccagggacagtgggca

SEQ ID NO: 152644 - DNA, 27 bp, Artificial Sequence
  Description of Artificial Sequence: Synthetic oligonucleotide
gcaaagcaccagggacagtgggcagaa

SEQ ID NO: 152645 - DNA, 27 bp, Artificial Sequence
  Description of Artificial Sequence: Synthetic oligonucleotide
caaagcaccagggacagtgggcagaag

SEQ ID NO: 152646 - DNA, 29 bp, Artificial Sequence
  Description of Artificial Sequence: Synthetic oligonucleotide
aaagcaccagggacagtgggcagaagatg

SEQ ID NO: 152647 - DNA, 28 bp, Artificial Sequence
  Description of Artificial Sequence: Synthetic oligonucleotide
aagcaccagggacagtgggcagaagatg

SEQ ID NO: 152648 - DNA, 27 bp, Artificial Sequence
  Description of Artificial Sequence: Synthetic oligonucleotide
agcaccagggacagtgggcagaagatg

SEQ ID NO: 152649 - DNA, 27 bp, Artificial Sequence
  Description of Artificial Sequence: Synthetic oligonucleotide
gcaccagggacagtgggcagaagatgt

SEQ ID NO: 152650 - DNA, 27 bp, Artificial Sequence
  Description of Artificial Sequence: Synthetic oligonucleotide
caccagggacagtgggcagaagatgtc

SEQ ID NO: 152651 - DNA, 27 bp, Artificial Sequence
  Description of Artificial Sequence: Synthetic oligonucleotide
accagggacagtgggcagaagatgtcc

SEQ ID NO: 152652 - DNA, 29 bp, Artificial Sequence
  Description of Artificial Sequence: Synthetic oligonucleotide
ctcaggaggaccctgactcatatcaaggg

SEQ ID NO: 152653 - DNA, 29 bp, Artificial Sequence
  Description of Artificial Sequence: Synthetic oligonucleotide
tcaggaggaccctgactcatatcaagggc

SEQ ID NO: 152654 - DNA, 28 bp, Artificial Sequence
  Description of Artificial Sequence: Synthetic oligonucleotide
caggaggaccctgactcatatcaagggc

SEQ ID NO: 152655 - DNA, 28 bp, Artificial Sequence
  Description of Artificial Sequence: Synthetic oligonucleotide
aggaggaccctgactcatatcaagggcc

SEQ ID NO: 152656 - DNA, 27 bp, Artificial Sequence
  Description of Artificial Sequence: Synthetic oligonucleotide
ggaggaccctgactcatatcaagggcc

SEQ ID NO: 152657 - DNA, 28 bp, Artificial Sequence
  Description of Artificial Sequence: Synthetic oligonucleotide
gaggaccctgactcatatcaagggccag

SEQ ID NO: 152658 - DNA, 31 bp, Artificial Sequence
  Description of Artificial Sequence: Synthetic oligonucleotide
aggaccctgactcatatcaagggccagaaag

SEQ ID NO: 152659 - DNA, 30 bp, Artificial Sequence
  Description of Artificial Sequence: Synthetic oligonucleotide
ggaccctgactcatatcaagggccagaaag

SEQ ID NO: 152660 - DNA, 30 bp, Artificial Sequence
  Description of Artificial Sequence: Synthetic oligonucleotide
gaccctgactcatatcaagggccagaaagg

SEQ ID NO: 152661 - DNA, 31 bp, Artificial Sequence
  Description of Artificial Sequence: Synthetic oligonucleotide
accctgactcatatcaagggccagaaaggag

SEQ ID NO: 152662 - DNA, 30 bp, Artificial Sequence
  Description of Artificial Sequence: Synthetic oligonucleotide
ccctgactcatatcaagggccagaaaggag

SEQ ID NO: 152663 - DNA, 30 bp, Artificial Sequence
  Description of Artificial Sequence: Synthetic oligonucleotide
cctgactcatatcaagggccagaaaggagg

SEQ ID NO: 152664 - DNA, 30 bp, Artificial Sequence
  Description of Artificial Sequence: Synthetic oligonucleotide
ctgactcatatcaagggccagaaaggaggc

SEQ ID NO: 152665 - DNA, 32 bp, Artificial Sequence
  Description of Artificial Sequence: Synthetic oligonucleotide
tgactcatatcaagggccagaaaggaggcttg

SEQ ID NO: 152666 - DNA, 31 bp, Artificial Sequence
  Description of Artificial Sequence: Synthetic oligonucleotide
gactcatatcaagggccagaaaggaggcttg

SEQ ID NO: 152667 - DNA, 31 bp, Artificial Sequence
  Description of Artificial Sequence: Synthetic oligonucleotide
actcatatcaagggccagaaaggaggcttgc

SEQ ID NO: 152668 - DNA, 30 bp, Artificial Sequence
  Description of Artificial Sequence: Synthetic oligonucleotide
ctcatatcaagggccagaaaggaggcttgc

SEQ ID NO: 152669 - DNA, 33 bp, Artificial Sequence
  Description of Artificial Sequence: Synthetic oligonucleotide
tcatatcaagggccagaaaggaggcttgcattc

SEQ ID NO: 152670 - DNA, 32 bp, Artificial Sequence
  Description of Artificial Sequence: Synthetic oligonucleotide
catatcaagggccagaaaggaggcttgcattc

SEQ ID NO: 152671 - DNA, 32 bp, Artificial Sequence
  Description of Artificial Sequence: Synthetic oligonucleotide
atatcaagggccagaaaggaggcttgcattcc

SEQ ID NO: 152672 - DNA, 31 bp, Artificial Sequence
  Description of Artificial Sequence: Synthetic oligonucleotide
tatcaagggccagaaaggaggcttgcattcc

SEQ ID NO: 152673 - DNA, 30 bp, Artificial Sequence
  Description of Artificial Sequence: Synthetic oligonucleotide
atcaagggccagaaaggaggcttgcattcc

SEQ ID NO: 152674 - DNA, 29 bp, Artificial Sequence
  Description of Artificial Sequence: Synthetic oligonucleotide
tcaagggccagaaaggaggcttgcattcc

SEQ ID NO: 152675 - DNA, 28 bp, Artificial Sequence
  Description of Artificial Sequence: Synthetic oligonucleotide
caagggccagaaaggaggcttgcattcc

SEQ ID NO: 152676 - DNA, 28 bp, Artificial Sequence
  Description of Artificial Sequence: Synthetic oligonucleotide
aagggccagaaaggaggcttgcattccc

SEQ ID NO: 152677 - DNA, 27 bp, Artificial Sequence
  Description of Artificial Sequence: Synthetic oligonucleotide
agggccagaaaggaggcttgcattccc

SEQ ID NO: 152678 - DNA, 27 bp, Artificial Sequence
  Description of Artificial Sequence: Synthetic oligonucleotide
gggccagaaaggaggcttgcattccct

SEQ ID NO: 152679 - DNA, 27 bp, Artificial Sequence
  Description of Artificial Sequence: Synthetic oligonucleotide
ggccagaaaggaggcttgcattccctc

SEQ ID NO: 152680 - DNA, 27 bp, Artificial Sequence
  Description of Artificial Sequence: Synthetic oligonucleotide
gccagaaaggaggcttgcattccctcc

SEQ ID NO: 152681 - DNA, 26 bp, Artificial Sequence
  Description of Artificial Sequence: Synthetic oligonucleotide
agcactcaccctgtgccctctgggaa

SEQ ID NO: 152682 - DNA, 27 bp, Artificial Sequence
  Description of Artificial Sequence: Synthetic oligonucleotide
acaggcagaaacgcagggcaaagccca

SEQ ID NO: 152683 - DNA, 26 bp, Artificial Sequence
  Description of Artificial Sequence: Synthetic oligonucleotide
caggcagaaacgcagggcaaagccca

SEQ ID NO: 152684 - DNA, 26 bp, Artificial Sequence
  Description of Artificial Sequence: Synthetic oligonucleotide
aggcagaaacgcagggcaaagcccag

SEQ ID NO: 152685 - DNA, 25 bp, Artificial Sequence
  Description of Artificial Sequence: Synthetic oligonucleotide
ggcagaaacgcagggcaaagcccag

SEQ ID NO: 152686 - DNA, 25 bp, Artificial Sequence
  Description of Artificial Sequence: Synthetic oligonucleotide
gcagaaacgcagggcaaagcccagg

SEQ ID NO: 152687 - DNA, 26 bp, Artificial Sequence
  Description of Artificial Sequence: Synthetic oligonucleotide
cagaaacgcagggcaaagcccaggga

SEQ ID NO: 152688 - DNA, 27 bp, Artificial Sequence
  Description of Artificial Sequence: Synthetic oligonucleotide
agaaacgcagggcaaagcccagggaca

SEQ ID NO: 152689 - DNA, 26 bp, Artificial Sequence
  Description of Artificial Sequence: Synthetic oligonucleotide
gaaacgcagggcaaagcccagggaca

SEQ ID NO: 152690 - DNA, 27 bp, Artificial Sequence
  Description of Artificial Sequence: Synthetic oligonucleotide
aaacgcagggcaaagcccagggacagt

SEQ ID NO: 152691 - DNA, 26 bp, Artificial Sequence
  Description of Artificial Sequence: Synthetic oligonucleotide
aacgcagggcaaagcccagggacagt

SEQ ID NO: 152692 - DNA, 25 bp, Artificial Sequence
  Description of Artificial Sequence: Synthetic oligonucleotide
acgcagggcaaagcccagggacagt

SEQ ID NO: 152693 - DNA, 24 bp, Artificial Sequence
  Description of Artificial Sequence: Synthetic oligonucleotide
cgcagggcaaagcccagggacagt

SEQ ID NO: 152694 - DNA, 24 bp, Artificial Sequence
  Description of Artificial Sequence: Synthetic oligonucleotide
gcagggcaaagcccagggacagtg

SEQ ID NO: 152695 - DNA, 24 bp, Artificial Sequence
  Description of Artificial Sequence: Synthetic oligonucleotide
cagggcaaagcccagggacagtgg

SEQ ID NO: 152696 - DNA, 24 bp, Artificial Sequence
  Description of Artificial Sequence: Synthetic oligonucleotide
agggcaaagcccagggacagtggg

SEQ ID NO: 152697 - DNA, 23 bp, Artificial Sequence
  Description of Artificial Sequence: Synthetic oligonucleotide
gggcaaagcccagggacagtggg

SEQ ID NO: 152698 - DNA, 24 bp, Artificial Sequence
  Description of Artificial Sequence: Synthetic oligonucleotide
ggcaaagcccagggacagtgggca

SEQ ID NO: 152699 - DNA, 26 bp, Artificial Sequence
  Description of Artificial Sequence: Synthetic oligonucleotide
gcaaagcccagggacagtgggcagaa

SEQ ID NO: 152700 - DNA, 27 bp, Artificial Sequence
  Description of Artificial Sequence: Synthetic oligonucleotide
caaagcccagggacagtgggcagaaga

SEQ ID NO: 152701 - DNA, 28 bp, Artificial Sequence
  Description of Artificial Sequence: Synthetic oligonucleotide
aaagcccagggacagtgggcagaagatg

SEQ ID NO: 152702 - DNA, 27 bp, Artificial Sequence
  Description of Artificial Sequence: Synthetic oligonucleotide
aagcccagggacagtgggcagaagatg

SEQ ID NO: 152703 - DNA, 27 bp, Artificial Sequence
  Description of Artificial Sequence: Synthetic oligonucleotide
agcccagggacagtgggcagaagatgt

SEQ ID NO: 152704 - DNA, 26 bp, Artificial Sequence
  Description of Artificial Sequence: Synthetic oligonucleotide
gcccagggacagtgggcagaagatgt

SEQ ID NO: 152705 - DNA, 26 bp, Artificial Sequence
  Description of Artificial Sequence: Synthetic oligonucleotide
tgagacctgggacacagagaccgagg

SEQ ID NO: 152706 - DNA, 25 bp, Artificial Sequence
  Description of Artificial Sequence: Synthetic oligonucleotide
gagacctgggacacagagaccgagg

SEQ ID NO: 152707 - DNA, 25 bp, Artificial Sequence
  Description of Artificial Sequence: Synthetic oligonucleotide
agacctgggacacagagaccgaggg

SEQ ID NO: 152708 - DNA, 24 bp, Artificial Sequence
  Description of Artificial Sequence: Synthetic oligonucleotide
gacctgggacacagagaccgaggg

SEQ ID NO: 152709 - DNA, 26 bp, Artificial Sequence
  Description of Artificial Sequence: Synthetic oligonucleotide
acctgggacacagagaccgagggctt

SEQ ID NO: 152710 - DNA, 25 bp, Artificial Sequence
  Description of Artificial Sequence: Synthetic oligonucleotide
cctgggacacagagaccgagggctt

SEQ ID NO: 152711 - DNA, 26 bp, Artificial Sequence
  Description of Artificial Sequence: Synthetic oligonucleotide
ctgggacacagagaccgagggcttga

SEQ ID NO: 152712 - DNA, 27 bp, Artificial Sequence
  Description of Artificial Sequence: Synthetic oligonucleotide
tgggacacagagaccgagggcttgaca

SEQ ID NO: 152713 - DNA, 26 bp, Artificial Sequence
  Description of Artificial Sequence: Synthetic oligonucleotide
gggacacagagaccgagggcttgaca

SEQ ID NO: 152714 - DNA, 27 bp, Artificial Sequence
  Description of Artificial Sequence: Synthetic oligonucleotide
ggacacagagaccgagggcttgacaga

SEQ ID NO: 152715 - DNA, 27 bp, Artificial Sequence
  Description of Artificial Sequence: Synthetic oligonucleotide
gacacagagaccgagggcttgacagag

SEQ ID NO: 152716 - DNA, 30 bp, Artificial Sequence
  Description of Artificial Sequence: Synthetic oligonucleotide
acacagagaccgagggcttgacagagaatg

SEQ ID NO: 152717 - DNA, 29 bp, Artificial Sequence
  Description of Artificial Sequence: Synthetic oligonucleotide
cacagagaccgagggcttgacagagaatg

SEQ ID NO: 152718 - DNA, 29 bp, Artificial Sequence
  Description of Artificial Sequence: Synthetic oligonucleotide
acagagaccgagggcttgacagagaatgg

SEQ ID NO: 152719 - DNA, 28 bp, Artificial Sequence
  Description of Artificial Sequence: Synthetic oligonucleotide
cagagaccgagggcttgacagagaatgg

SEQ ID NO: 152720 - DNA, 28 bp, Artificial Sequence
  Description of Artificial Sequence: Synthetic oligonucleotide
agagaccgagggcttgacagagaatggg

SEQ ID NO: 152721 - DNA, 27 bp, Artificial Sequence
  Description of Artificial Sequence: Synthetic oligonucleotide
gagaccgagggcttgacagagaatggg

SEQ ID NO: 152722 - DNA, 27 bp, Artificial Sequence
  Description of Artificial Sequence: Synthetic oligonucleotide
agaccgagggcttgacagagaatgggc

SEQ ID NO: 152723 - DNA, 27 bp, Artificial Sequence
  Description of Artificial Sequence: Synthetic oligonucleotide
gaccgagggcttgacagagaatgggca

SEQ ID NO: 152724 - DNA, 28 bp, Artificial Sequence
  Description of Artificial Sequence: Synthetic oligonucleotide
accgagggcttgacagagaatgggcaag

SEQ ID NO: 152725 - DNA, 27 bp, Artificial Sequence
  Description of Artificial Sequence: Synthetic oligonucleotide
ccgagggcttgacagagaatgggcaag

SEQ ID NO: 152726 - DNA, 28 bp, Artificial Sequence
  Description of Artificial Sequence: Synthetic oligonucleotide
cgagggcttgacagagaatgggcaagac

SEQ ID NO: 152727 - DNA, 28 bp, Artificial Sequence
  Description of Artificial Sequence: Synthetic oligonucleotide
gagggcttgacagagaatgggcaagacc

SEQ ID NO: 152728 - DNA, 29 bp, Artificial Sequence
  Description of Artificial Sequence: Synthetic oligonucleotide
agggcttgacagagaatgggcaagacctc

SEQ ID NO: 152729 - DNA, 28 bp, Artificial Sequence
  Description of Artificial Sequence: Synthetic oligonucleotide
gggcttgacagagaatgggcaagacctc

SEQ ID NO: 152730 - DNA, 29 bp, Artificial Sequence
  Description of Artificial Sequence: Synthetic oligonucleotide
ggcttgacagagaatgggcaagacctcag

SEQ ID NO: 152731 - DNA, 28 bp, Artificial Sequence
  Description of Artificial Sequence: Synthetic oligonucleotide
gcttgacagagaatgggcaagacctcag

SEQ ID NO: 152732 - DNA, 27 bp, Artificial Sequence
  Description of Artificial Sequence: Synthetic oligonucleotide
atgtcgctcttggtcgtcagcatggcg

SEQ ID NO: 152733 - DNA, 27 bp, Artificial Sequence
  Description of Artificial Sequence: Synthetic oligonucleotide
tgtcgctcttggtcgtcagcatggcgt

SEQ ID NO: 152734 - DNA, 26 bp, Artificial Sequence
  Description of Artificial Sequence: Synthetic oligonucleotide
gtcgctcttggtcgtcagcatggcgt

SEQ ID NO: 152735 - DNA, 27 bp, Artificial Sequence
  Description of Artificial Sequence: Synthetic oligonucleotide
tcgctcttggtcgtcagcatggcgtgt

SEQ ID NO: 152736 - DNA, 26 bp, Artificial Sequence
  Description of Artificial Sequence: Synthetic oligonucleotide
cgctcttggtcgtcagcatggcgtgt

SEQ ID NO: 152737 - DNA, 27 bp, Artificial Sequence
  Description of Artificial Sequence: Synthetic oligonucleotide
gctcttggtcgtcagcatggcgtgtgt

SEQ ID NO: 152738 - DNA, 28 bp, Artificial Sequence
  Description of Artificial Sequence: Synthetic oligonucleotide
ctcttggtcgtcagcatggcgtgtgttg

SEQ ID NO: 152739 - DNA, 28 bp, Artificial Sequence
  Description of Artificial Sequence: Synthetic oligonucleotide
tcttggtcgtcagcatggcgtgtgttgg

SEQ ID NO: 152740 - DNA, 27 bp, Artificial Sequence
  Description of Artificial Sequence: Synthetic oligonucleotide
cttggtcgtcagcatggcgtgtgttgg

SEQ ID NO: 152741 - DNA, 27 bp, Artificial Sequence
  Description of Artificial Sequence: Synthetic oligonucleotide
ttggtcgtcagcatggcgtgtgttggg

SEQ ID NO: 152742 - DNA, 27 bp, Artificial Sequence
  Description of Artificial Sequence: Synthetic oligonucleotide
tggtcgtcagcatggcgtgtgttgggt

SEQ ID NO: 152743 - DNA, 27 bp, Artificial Sequence
  Description of Artificial Sequence: Synthetic oligonucleotide
ggtcgtcagcatggcgtgtgttgggtt

SEQ ID NO: 152744 - DNA, 27 bp, Artificial Sequence
  Description of Artificial Sequence: Synthetic oligonucleotide
gtcgtcagcatggcgtgtgttgggttc

SEQ ID NO: 152745 - DNA, 29 bp, Artificial Sequence
  Description of Artificial Sequence: Synthetic oligonucleotide
tcgtcagcatggcgtgtgttgggttcttc

SEQ ID NO: 152746 - DNA, 28 bp, Artificial Sequence
  Description of Artificial Sequence: Synthetic oligonucleotide
cgtcagcatggcgtgtgttgggttcttc

SEQ ID NO: 152747 - DNA, 30 bp, Artificial Sequence
  Description of Artificial Sequence: Synthetic oligonucleotide
gtcagcatggcgtgtgttgggttcttcttg

SEQ ID NO: 152748 - DNA, 30 bp, Artificial Sequence
  Description of Artificial Sequence: Synthetic oligonucleotide
tcagcatggcgtgtgttgggttcttcttgc

SEQ ID NO: 152749 - DNA, 29 bp, Artificial Sequence
  Description of Artificial Sequence: Synthetic oligonucleotide
cagcatggcgtgtgttgggttcttcttgc

SEQ ID NO: 152750 - DNA, 30 bp, Artificial Sequence
  Description of Artificial Sequence: Synthetic oligonucleotide
agcatggcgtgtgttgggttcttcttgctg

SEQ ID NO: 152751 - DNA, 29 bp, Artificial Sequence
  Description of Artificial Sequence: Synthetic oligonucleotide
gcatggcgtgtgttgggttcttcttgctg

SEQ ID NO: 152752 - DNA, 29 bp, Artificial Sequence
  Description of Artificial Sequence: Synthetic oligonucleotide
catggcgtgtgttgggttcttcttgctgc

SEQ ID NO: 152753 - DNA, 30 bp, Artificial Sequence
  Description of Artificial Sequence: Synthetic oligonucleotide
atggcgtgtgttgggttcttcttgctgcag

SEQ ID NO: 152754 - DNA, 29 bp, Artificial Sequence
  Description of Artificial Sequence: Synthetic oligonucleotide
tggcgtgtgttgggttcttcttgctgcag

SEQ ID NO: 152755 - DNA, 28 bp, Artificial Sequence
  Description of Artificial Sequence: Synthetic oligonucleotide
ggcgtgtgttgggttcttcttgctgcag

SEQ ID NO: 152756 - DNA, 28 bp, Artificial Sequence
  Description of Artificial Sequence: Synthetic oligonucleotide
gcgtgtgttgggttcttcttgctgcagg

SEQ ID NO: 152757 - DNA, 28 bp, Artificial Sequence
  Description of Artificial Sequence: Synthetic oligonucleotide
cgtgtgttgggttcttcttgctgcaggg

SEQ ID NO: 152758 - DNA, 28 bp, Artificial Sequence
  Description of Artificial Sequence: Synthetic oligonucleotide
gtgtgttgggttcttcttgctgcagggg

SEQ ID NO: 152759 - DNA, 28 bp, Artificial Sequence
  Description of Artificial Sequence: Synthetic oligonucleotide
tgtgttgggttcttcttgctgcaggggg

SEQ ID NO: 152760 - DNA, 27 bp, Artificial Sequence
  Description of Artificial Sequence: Synthetic oligonucleotide
gtgttgggttcttcttgctgcaggggg

SEQ ID NO: 152761 - DNA, 27 bp, Artificial Sequence
  Description of Artificial Sequence: Synthetic oligonucleotide
tgttgggttcttcttgctgcagggggc

SEQ ID NO: 152762 - DNA, 26 bp, Artificial Sequence
  Description of Artificial Sequence: Synthetic oligonucleotide
gttgggttcttcttgctgcagggggc

SEQ ID NO: 152763 - DNA, 27 bp, Artificial Sequence
  Description of Artificial Sequence: Synthetic oligonucleotide
ttgggttcttcttgctgcagggggcct

SEQ ID NO: 152764 - DNA, 26 bp, Artificial Sequence
  Description of Artificial Sequence: Synthetic oligonucleotide
tgggttcttcttgctgcagggggcct

SEQ ID NO: 152765 - DNA, 25 bp, Artificial Sequence
  Description of Artificial Sequence: Synthetic oligonucleotide
gggttcttcttgctgcagggggcct

SEQ ID NO: 152766 - DNA, 25 bp, Artificial Sequence
  Description of Artificial Sequence: Synthetic oligonucleotide
ggttcttcttgctgcagggggcctg

SEQ ID NO: 152767 - DNA, 25 bp, Artificial Sequence
  Description of Artificial Sequence: Synthetic oligonucleotide
gttcttcttgctgcagggggcctgg

SEQ ID NO: 152768 - DNA, 25 bp, Artificial Sequence
  Description of Artificial Sequence: Synthetic oligonucleotide
ttcttcttgctgcagggggcctggc

SEQ ID NO: 152769 - DNA, 24 bp, Artificial Sequence
  Description of Artificial Sequence: Synthetic oligonucleotide
tcttcttgctgcagggggcctggc

SEQ ID NO: 152770 - DNA, 23 bp, Artificial Sequence
  Description of Artificial Sequence: Synthetic oligonucleotide
cttcttgctgcagggggcctggc

SEQ ID NO: 152771 - DNA, 24 bp, Artificial Sequence
  Description of Artificial Sequence: Synthetic oligonucleotide
ttcttgctgcagggggcctggcca

SEQ ID NO: 152772 - DNA, 23 bp, Artificial Sequence
  Description of Artificial Sequence: Synthetic oligonucleotide
tcttgctgcagggggcctggcca

SEQ ID NO: 152773 - DNA, 22 bp, Artificial Sequence
  Description of Artificial Sequence: Synthetic oligonucleotide
cttgctgcagggggcctggcca

SEQ ID NO: 152774 - DNA, 24 bp, Artificial Sequence
  Description of Artificial Sequence: Synthetic oligonucleotide
ttgctgcagggggcctggccacat

SEQ ID NO: 152775 - DNA, 23 bp, Artificial Sequence
  Description of Artificial Sequence: Synthetic oligonucleotide
tgctgcagggggcctggccacat

SEQ ID NO: 152776 - DNA, 22 bp, Artificial Sequence
  Description of Artificial Sequence: Synthetic oligonucleotide
gctgcagggggcctggccacat

SEQ ID NO: 152777 - DNA, 23 bp, Artificial Sequence
  Description of Artificial Sequence: Synthetic oligonucleotide
ctgcagggggcctggccacatga

SEQ ID NO: 152778 - DNA, 23 bp, Artificial Sequence
  Description of Artificial Sequence: Synthetic oligonucleotide
tgcagggggcctggccacatgag

SEQ ID NO: 152779 - DNA, 22 bp, Artificial Sequence
  Description of Artificial Sequence: Synthetic oligonucleotide
gcagggggcctggccacatgag

SEQ ID NO: 152780 - DNA, 22 bp, Artificial Sequence
  Description of Artificial Sequence: Synthetic oligonucleotide
cagggggcctggccacatgagg

SEQ ID NO: 152781 - DNA, 23 bp, Artificial Sequence
  Description of Artificial Sequence: Synthetic oligonucleotide
agggggcctggccacatgaggga

SEQ ID NO: 152782 - DNA, 22 bp, Artificial Sequence
  Description of Artificial Sequence: Synthetic oligonucleotide
gggggcctggccacatgaggga

SEQ ID NO: 152783 - DNA, 23 bp, Artificial Sequence
  Description of Artificial Sequence: Synthetic oligonucleotide
ggggcctggccacatgagggagt

SEQ ID NO: 152784 - DNA, 23 bp, Artificial Sequence
  Description of Artificial Sequence: Synthetic oligonucleotide
gggcctggccacatgagggagtc

SEQ ID NO: 152785 - DNA, 24 bp, Artificial Sequence
  Description of Artificial Sequence: Synthetic oligonucleotide
ggcctggccacatgagggagtcca

SEQ ID NO: 152786 - DNA, 25 bp, Artificial Sequence
  Description of Artificial Sequence: Synthetic oligonucleotide
gcctggccacatgagggagtccaca

SEQ ID NO: 152787 - DNA, 27 bp, Artificial Sequence
  Description of Artificial Sequence: Synthetic oligonucleotide
cctggccacatgagggagtccacagaa

SEQ ID NO: 152788 - DNA, 29 bp, Artificial Sequence
  Description of Artificial Sequence: Synthetic oligonucleotide
ctggccacatgagggagtccacagaaaac

SEQ ID NO: 152789 - DNA, 29 bp, Artificial Sequence
  Description of Artificial Sequence: Synthetic oligonucleotide
tggccacatgagggagtccacagaaaacc

SEQ ID NO: 152790 - DNA, 28 bp, Artificial Sequence
  Description of Artificial Sequence: Synthetic oligonucleotide
ggccacatgagggagtccacagaaaacc

SEQ ID NO: 152791 - DNA, 30 bp, Artificial Sequence
  Description of Artificial Sequence: Synthetic oligonucleotide
gccacatgagggagtccacagaaaaccttc

SEQ ID NO: 152792 - DNA, 30 bp, Artificial Sequence
  Description of Artificial Sequence: Synthetic oligonucleotide
ccacatgagggagtccacagaaaaccttcc

SEQ ID NO: 152793 - DNA, 30 bp, Artificial Sequence
  Description of Artificial Sequence: Synthetic oligonucleotide
cacatgagggagtccacagaaaaccttccc

SEQ ID NO: 152794 - DNA, 31 bp, Artificial Sequence
  Description of Artificial Sequence: Synthetic oligonucleotide
acatgagggagtccacagaaaaccttccctc

SEQ ID NO: 152795 - DNA, 30 bp, Artificial Sequence
  Description of Artificial Sequence: Synthetic oligonucleotide
catgagggagtccacagaaaaccttccctc

SEQ ID NO: 152796 - DNA, 30 bp, Artificial Sequence
  Description of Artificial Sequence: Synthetic oligonucleotide
atgagggagtccacagaaaaccttccctcc

SEQ ID NO: 152797 - DNA, 29 bp, Artificial Sequence
  Description of Artificial Sequence: Synthetic oligonucleotide
tgagggagtccacagaaaaccttccctcc

SEQ ID NO: 152798 - DNA, 28 bp, Artificial Sequence
  Description of Artificial Sequence: Synthetic oligonucleotide
gagggagtccacagaaaaccttccctcc

SEQ ID NO: 152799 - DNA, 29 bp, Artificial Sequence
  Description of Artificial Sequence: Synthetic oligonucleotide
agggagtccacagaaaaccttccctcctg

SEQ ID NO: 152800 - DNA, 28 bp, Artificial Sequence
  Description of Artificial Sequence: Synthetic oligonucleotide
gggagtccacagaaaaccttccctcctg

SEQ ID NO: 152801 - DNA, 28 bp, Artificial Sequence
  Description of Artificial Sequence: Synthetic oligonucleotide
ggagtccacagaaaaccttccctcctgg

SEQ ID NO: 152802 - DNA, 28 bp, Artificial Sequence
  Description of Artificial Sequence: Synthetic oligonucleotide
gagtccacagaaaaccttccctcctggc

SEQ ID NO: 152803 - DNA, 28 bp, Artificial Sequence
  Description of Artificial Sequence: Synthetic oligonucleotide
agtccacagaaaaccttccctcctggcc

SEQ ID NO: 152804 - DNA, 27 bp, Artificial Sequence
  Description of Artificial Sequence: Synthetic oligonucleotide
gtccacagaaaaccttccctcctggcc

SEQ ID NO: 152805 - DNA, 27 bp, Artificial Sequence
  Description of Artificial Sequence: Synthetic oligonucleotide
tccacagaaaaccttccctcctggccc

SEQ ID NO: 152806 - DNA, 27 bp, Artificial Sequence
  Description of Artificial Sequence: Synthetic oligonucleotide
ccacagaaaaccttccctcctggccca

SEQ ID NO: 152807 - DNA, 27 bp, Artificial Sequence
  Description of Artificial Sequence: Synthetic oligonucleotide
cacagaaaaccttccctcctggcccac

SEQ ID NO: 152808 - DNA, 27 bp, Artificial Sequence
  Description of Artificial Sequence: Synthetic oligonucleotide
acagaaaaccttccctcctggcccacc

SEQ ID NO: 152809 - DNA, 26 bp, Artificial Sequence
  Description of Artificial Sequence: Synthetic oligonucleotide
cagaaaaccttccctcctggcccacc

SEQ ID NO: 152810 - DNA, 27 bp, Artificial Sequence
  Description of Artificial Sequence: Synthetic oligonucleotide
agaaaaccttccctcctggcccaccca

SEQ ID NO: 152811 - DNA, 26 bp, Artificial Sequence
  Description of Artificial Sequence: Synthetic oligonucleotide
gaaaaccttccctcctggcccaccca

SEQ ID NO: 152812 - DNA, 26 bp, Artificial Sequence
  Description of Artificial Sequence: Synthetic oligonucleotide
aaaaccttccctcctggcccacccag

SEQ ID NO: 152813 - DNA, 25 bp, Artificial Sequence
  Description of Artificial Sequence: Synthetic oligonucleotide
aaaccttccctcctggcccacccag

SEQ ID NO: 152814 - DNA, 24 bp, Artificial Sequence
  Description of Artificial Sequence: Synthetic oligonucleotide
aaccttccctcctggcccacccag

SEQ ID NO: 152815 - DNA, 23 bp, Artificial Sequence
  Description of Artificial Sequence: Synthetic oligonucleotide
accttccctcctggcccacccag

SEQ ID NO: 152816 - DNA, 22 bp, Artificial Sequence
  Description of Artificial Sequence: Synthetic oligonucleotide
ccttccctcctggcccacccag

SEQ ID NO: 152817 - DNA, 23 bp, Artificial Sequence
  Description of Artificial Sequence: Synthetic oligonucleotide
cttccctcctggcccacccaggt

SEQ ID NO: 152818 - DNA, 23 bp, Artificial Sequence
  Description of Artificial Sequence: Synthetic oligonucleotide
ttccctcctggcccacccaggtc

SEQ ID NO: 152819 - DNA, 22 bp, Artificial Sequence
  Description of Artificial Sequence: Synthetic oligonucleotide
tccctcctggcccacccaggtc

SEQ ID NO: 152820 - DNA, 21 bp, Artificial Sequence
  Description of Artificial Sequence: Synthetic oligonucleotide
ccctcctggcccacccaggtc

SEQ ID NO: 152821 - DNA, 21 bp, Artificial Sequence
  Description of Artificial Sequence: Synthetic oligonucleotide
cctcctggcccacccaggtcc

SEQ ID NO: 152822 - DNA, 21 bp, Artificial Sequence
  Description of Artificial Sequence: Synthetic oligonucleotide
ctcctggcccacccaggtccc

SEQ ID NO: 152823 - DNA, 22 bp, Artificial Sequence
  Description of Artificial Sequence: Synthetic oligonucleotide
tcctggcccacccaggtcccct

SEQ ID NO: 152824 - DNA, 21 bp, Artificial Sequence
  Description of Artificial Sequence: Synthetic oligonucleotide
cctggcccacccaggtcccct

SEQ ID NO: 152825 - DNA, 21 bp, Artificial Sequence
  Description of Artificial Sequence: Synthetic oligonucleotide
ctggcccacccaggtcccctg

SEQ ID NO: 152826 - DNA, 22 bp, Artificial Sequence
  Description of Artificial Sequence: Synthetic oligonucleotide
tggcccacccaggtcccctggt

SEQ ID NO: 152827 - DNA, 21 bp, Artificial Sequence
  Description of Artificial Sequence: Synthetic oligonucleotide
ggcccacccaggtcccctggt

SEQ ID NO: 152828 - DNA, 25 bp, Artificial Sequence
  Description of Artificial Sequence: Synthetic oligonucleotide
gcccacccaggtcccctggtgaaat

SEQ ID NO: 152829 - DNA, 26 bp, Artificial Sequence
  Description of Artificial Sequence: Synthetic oligonucleotide
cccacccaggtcccctggtgaaatca

SEQ ID NO: 152830 - DNA, 27 bp, Artificial Sequence
  Description of Artificial Sequence: Synthetic oligonucleotide
ccacccaggtcccctggtgaaatcaga

SEQ ID NO: 152831 - DNA, 28 bp, Artificial Sequence
  Description of Artificial Sequence: Synthetic oligonucleotide
cacccaggtcccctggtgaaatcagaag

SEQ ID NO: 152832 - DNA, 29 bp, Artificial Sequence
  Description of Artificial Sequence: Synthetic oligonucleotide
acccaggtcccctggtgaaatcagaagag

SEQ ID NO: 152833 - DNA, 28 bp, Artificial Sequence
  Description of Artificial Sequence: Synthetic oligonucleotide
cccaggtcccctggtgaaatcagaagag

SEQ ID NO: 152834 - DNA, 29 bp, Artificial Sequence
  Description of Artificial Sequence: Synthetic oligonucleotide
ccaggtcccctggtgaaatcagaagagac

SEQ ID NO: 152835 - DNA, 30 bp, Artificial Sequence
  Description of Artificial Sequence: Synthetic oligonucleotide
caggtcccctggtgaaatcagaagagacag

SEQ ID NO: 152836 - DNA, 31 bp, Artificial Sequence
  Description of Artificial Sequence: Synthetic oligonucleotide
aggtcccctggtgaaatcagaagagacagtc

SEQ ID NO: 152837 - DNA, 30 bp, Artificial Sequence
  Description of Artificial Sequence: Synthetic oligonucleotide
ggtcccctggtgaaatcagaagagacagtc

SEQ ID NO: 152838 - DNA, 32 bp, Artificial Sequence
  Description of Artificial Sequence: Synthetic oligonucleotide
gtcccctggtgaaatcagaagagacagtcatc

SEQ ID NO: 152839 - DNA, 32 bp, Artificial Sequence
  Description of Artificial Sequence: Synthetic oligonucleotide
tcccctggtgaaatcagaagagacagtcatcc

SEQ ID NO: 152840 - DNA, 31 bp, Artificial Sequence
  Description of Artificial Sequence: Synthetic oligonucleotide
cccctggtgaaatcagaagagacagtcatcc

SEQ ID NO: 152841 - DNA, 32 bp, Artificial Sequence
  Description of Artificial Sequence: Synthetic oligonucleotide
ccctggtgaaatcagaagagacagtcatcctg

SEQ ID NO: 152842 - DNA, 32 bp, Artificial Sequence
  Description of Artificial Sequence: Synthetic oligonucleotide
cctggtgaaatcagaagagacagtcatcctgc

SEQ ID NO: 152843 - DNA, 35 bp, Artificial Sequence
  Description of Artificial Sequence: Synthetic oligonucleotide
ctggtgaaatcagaagagacagtcatcctgcaatg

SEQ ID NO: 152844 - DNA, 37 bp, Artificial Sequence
  Description of Artificial Sequence: Synthetic oligonucleotide
tggtgaaatcagaagagacagtcatcctgcaatgttg

SEQ ID NO: 152845 - DNA, 36 bp, Artificial Sequence
  Description of Artificial Sequence: Synthetic oligonucleotide
ggtgaaatcagaagagacagtcatcctgcaatgttg

SEQ ID NO: 152846 - DNA, 36 bp, Artificial Sequence
  Description of Artificial Sequence: Synthetic oligonucleotide
gtgaaatcagaagagacagtcatcctgcaatgttgg

SEQ ID NO: 152847 - DNA, 37 bp, Artificial Sequence
  Description of Artificial Sequence: Synthetic oligonucleotide
tgaaatcagaagagacagtcatcctgcaatgttggtc

SEQ ID NO: 152848 - DNA, 36 bp, Artificial Sequence
  Description of Artificial Sequence: Synthetic oligonucleotide
gaaatcagaagagacagtcatcctgcaatgttggtc

SEQ ID NO: 152849 - DNA, 37 bp, Artificial Sequence
  Description of Artificial Sequence: Synthetic oligonucleotide
aaatcagaagagacagtcatcctgcaatgttggtcag

SEQ ID NO: 152850 - DNA, 36 bp, Artificial Sequence
  Description of Artificial Sequence: Synthetic oligonucleotide
aatcagaagagacagtcatcctgcaatgttggtcag

SEQ ID NO: 152851 - DNA, 35 bp, Artificial Sequence
  Description of Artificial Sequence: Synthetic oligonucleotide
atcagaagagacagtcatcctgcaatgttggtcag

SEQ ID NO: 152852 - DNA, 34 bp, Artificial Sequence
  Description of Artificial Sequence: Synthetic oligonucleotide
tcagaagagacagtcatcctgcaatgttggtcag

SEQ ID NO: 152853 - DNA, 33 bp, Artificial Sequence
  Description of Artificial Sequence: Synthetic oligonucleotide
cagaagagacagtcatcctgcaatgttggtcag

SEQ ID NO: 152854 - DNA, 35 bp, Artificial Sequence
  Description of Artificial Sequence: Synthetic oligonucleotide
agaagagacagtcatcctgcaatgttggtcagatg

SEQ ID NO: 152855 - DNA, 34 bp, Artificial Sequence
  Description of Artificial Sequence: Synthetic oligonucleotide
gaagagacagtcatcctgcaatgttggtcagatg

SEQ ID NO: 152856 - DNA, 35 bp, Artificial Sequence
  Description of Artificial Sequence: Synthetic oligonucleotide
aagagacagtcatcctgcaatgttggtcagatgtc

SEQ ID NO: 152857 - DNA, 34 bp, Artificial Sequence
  Description of Artificial Sequence: Synthetic oligonucleotide
agagacagtcatcctgcaatgttggtcagatgtc

SEQ ID NO: 152858 - DNA, 33 bp, Artificial Sequence
  Description of Artificial Sequence: Synthetic oligonucleotide
gagacagtcatcctgcaatgttggtcagatgtc

SEQ ID NO: 152859 - DNA, 35 bp, Artificial Sequence
  Description of Artificial Sequence: Synthetic oligonucleotide
agacagtcatcctgcaatgttggtcagatgtcatg

SEQ ID NO: 152860 - DNA, 34 bp, Artificial Sequence
  Description of Artificial Sequence: Synthetic oligonucleotide
gacagtcatcctgcaatgttggtcagatgtcatg

SEQ ID NO: 152861 - DNA, 37 bp, Artificial Sequence
  Description of Artificial Sequence: Synthetic oligonucleotide
acagtcatcctgcaatgttggtcagatgtcatgtttg

SEQ ID NO: 152862 - DNA, 36 bp, Artificial Sequence
  Description of Artificial Sequence: Synthetic oligonucleotide
cagtcatcctgcaatgttggtcagatgtcatgtttg

SEQ ID NO: 152863 - DNA, 38 bp, Artificial Sequence
  Description of Artificial Sequence: Synthetic oligonucleotide
agtcatcctgcaatgttggtcagatgtcatgtttgaac

SEQ ID NO: 152864 - DNA, 37 bp, Artificial Sequence
  Description of Artificial Sequence: Synthetic oligonucleotide
gtcatcctgcaatgttggtcagatgtcatgtttgaac

SEQ ID NO: 152865 - DNA, 38 bp, Artificial Sequence
  Description of Artificial Sequence: Synthetic oligonucleotide
tcatcctgcaatgttggtcagatgtcatgtttgaacac

SEQ ID NO: 152866 - DNA, 37 bp, Artificial Sequence
  Description of Artificial Sequence: Synthetic oligonucleotide
catcctgcaatgttggtcagatgtcatgtttgaacac

SEQ ID NO: 152867 - DNA, 39 bp, Artificial Sequence
  Description of Artificial Sequence: Synthetic oligonucleotide
atcctgcaatgttggtcagatgtcatgtttgaacacttc

SEQ ID NO: 152868 - DNA, 38 bp, Artificial Sequence
  Description of Artificial Sequence: Synthetic oligonucleotide
tcctgcaatgttggtcagatgtcatgtttgaacacttc

SEQ ID NO: 152869 - DNA, 37 bp, Artificial Sequence
  Description of Artificial Sequence: Synthetic oligonucleotide
cctgcaatgttggtcagatgtcatgtttgaacacttc

SEQ ID NO: 152870 - DNA, 37 bp, Artificial Sequence
  Description of Artificial Sequence: Synthetic oligonucleotide
ctgcaatgttggtcagatgtcatgtttgaacacttcc

SEQ ID NO: 152871 - DNA, 39 bp, Artificial Sequence
  Description of Artificial Sequence: Synthetic oligonucleotide
tgcaatgttggtcagatgtcatgtttgaacacttccttc

SEQ ID NO: 152872 - DNA, 38 bp, Artificial Sequence
  Description of Artificial Sequence: Synthetic oligonucleotide
gcaatgttggtcagatgtcatgtttgaacacttccttc

SEQ ID NO: 152873 - DNA, 39 bp, Artificial Sequence
  Description of Artificial Sequence: Synthetic oligonucleotide
caatgttggtcagatgtcatgtttgaacacttccttctg

SEQ ID NO: 152874 - DNA, 39 bp, Artificial Sequence
  Description of Artificial Sequence: Synthetic oligonucleotide
aatgttggtcagatgtcatgtttgaacacttccttctgc

SEQ ID NO: 152875 - DNA, 38 bp, Artificial Sequence
  Description of Artificial Sequence: Synthetic oligonucleotide
atgttggtcagatgtcatgtttgaacacttccttctgc

SEQ ID NO: 152876 - DNA, 37 bp, Artificial Sequence
  Description of Artificial Sequence: Synthetic oligonucleotide
tgttggtcagatgtcatgtttgaacacttccttctgc

SEQ ID NO: 152877 - DNA, 36 bp, Artificial Sequence
  Description of Artificial Sequence: Synthetic oligonucleotide
gttggtcagatgtcatgtttgaacacttccttctgc

SEQ ID NO: 152878 - DNA, 37 bp, Artificial Sequence
  Description of Artificial Sequence: Synthetic oligonucleotide
ttggtcagatgtcatgtttgaacacttccttctgcac

SEQ ID NO: 152879 - DNA, 36 bp, Artificial Sequence
  Description of Artificial Sequence: Synthetic oligonucleotide
tggtcagatgtcatgtttgaacacttccttctgcac

SEQ ID NO: 152880 - DNA, 35 bp, Artificial Sequence
  Description of Artificial Sequence: Synthetic oligonucleotide
ggtcagatgtcatgtttgaacacttccttctgcac

SEQ ID NO: 152881 - DNA, 36 bp, Artificial Sequence
  Description of Artificial Sequence: Synthetic oligonucleotide
gtcagatgtcatgtttgaacacttccttctgcacag

SEQ ID NO: 152882 - DNA, 37 bp, Artificial Sequence
  Description of Artificial Sequence: Synthetic oligonucleotide
tcagatgtcatgtttgaacacttccttctgcacagag

SEQ ID NO: 152883 - DNA, 36 bp, Artificial Sequence
  Description of Artificial Sequence: Synthetic oligonucleotide
cagatgtcatgtttgaacacttccttctgcacagag

SEQ ID NO: 152884 - DNA, 37 bp, Artificial Sequence
  Description of Artificial Sequence: Synthetic oligonucleotide
agatgtcatgtttgaacacttccttctgcacagagag

SEQ ID NO: 152885 - DNA, 36 bp, Artificial Sequence
  Description of Artificial Sequence: Synthetic oligonucleotide
gatgtcatgtttgaacacttccttctgcacagagag

SEQ ID NO: 152886 - DNA, 36 bp, Artificial Sequence
  Description of Artificial Sequence: Synthetic oligonucleotide
atgtcatgtttgaacacttccttctgcacagagagg

SEQ ID NO: 152887 - DNA, 35 bp, Artificial Sequence
  Description of Artificial Sequence: Synthetic oligonucleotide
tgtcatgtttgaacacttccttctgcacagagagg

SEQ ID NO: 152888 - DNA, 34 bp, Artificial Sequence
  Description of Artificial Sequence: Synthetic oligonucleotide
gtcatgtttgaacacttccttctgcacagagagg

SEQ ID NO: 152889 - DNA, 34 bp, Artificial Sequence
  Description of Artificial Sequence: Synthetic oligonucleotide
tcatgtttgaacacttccttctgcacagagaggg

SEQ ID NO: 152890 - DNA, 33 bp, Artificial Sequence
  Description of Artificial Sequence: Synthetic oligonucleotide
catgtttgaacacttccttctgcacagagaggg

SEQ ID NO: 152891 - DNA, 33 bp, Artificial Sequence
  Description of Artificial Sequence: Synthetic oligonucleotide
atgtttgaacacttccttctgcacagagagggg

SEQ ID NO: 152892 - DNA, 32 bp, Artificial Sequence
  Description of Artificial Sequence: Synthetic oligonucleotide
tgtttgaacacttccttctgcacagagagggg

SEQ ID NO: 152893 - DNA, 31 bp, Artificial Sequence
  Description of Artificial Sequence: Synthetic oligonucleotide
gtttgaacacttccttctgcacagagagggg

SEQ ID NO: 152894 - DNA, 33 bp, Artificial Sequence
  Description of Artificial Sequence: Synthetic oligonucleotide
tttgaacacttccttctgcacagagaggggatg

SEQ ID NO: 152895 - DNA, 32 bp, Artificial Sequence
  Description of Artificial Sequence: Synthetic oligonucleotide
ttgaacacttccttctgcacagagaggggatg

SEQ ID NO: 152896 - DNA, 31 bp, Artificial Sequence
  Description of Artificial Sequence: Synthetic oligonucleotide
tgaacacttccttctgcacagagaggggatg

SEQ ID NO: 152897 - DNA, 30 bp, Artificial Sequence
  Description of Artificial Sequence: Synthetic oligonucleotide
gaacacttccttctgcacagagaggggatg

SEQ ID NO: 152898 - DNA, 35 bp, Artificial Sequence
  Description of Artificial Sequence: Synthetic oligonucleotide
aacacttccttctgcacagagaggggatgtttaac

SEQ ID NO: 152899 - DNA, 34 bp, Artificial Sequence
  Description of Artificial Sequence: Synthetic oligonucleotide
acacttccttctgcacagagaggggatgtttaac

SEQ ID NO: 152900 - DNA, 33 bp, Artificial Sequence
  Description of Artificial Sequence: Synthetic oligonucleotide
cacttccttctgcacagagaggggatgtttaac

SEQ ID NO: 152901 - DNA, 33 bp, Artificial Sequence
  Description of Artificial Sequence: Synthetic oligonucleotide
acttccttctgcacagagaggggatgtttaacg

SEQ ID NO: 152902 - DNA, 32 bp, Artificial Sequence
  Description of Artificial Sequence: Synthetic oligonucleotide
cttccttctgcacagagaggggatgtttaacg

SEQ ID NO: 152903 - DNA, 33 bp, Artificial Sequence
  Description of Artificial Sequence: Synthetic oligonucleotide
ttccttctgcacagagaggggatgtttaacgac

SEQ ID NO: 152904 - DNA, 32 bp, Artificial Sequence
  Description of Artificial Sequence: Synthetic oligonucleotide
tccttctgcacagagaggggatgtttaacgac

SEQ ID NO: 152905 - DNA, 31 bp, Artificial Sequence
  Description of Artificial Sequence: Synthetic oligonucleotide
ccttctgcacagagaggggatgtttaacgac

SEQ ID NO: 152906 - DNA, 32 bp, Artificial Sequence
  Description of Artificial Sequence: Synthetic oligonucleotide
cttctgcacagagaggggatgtttaacgacac

SEQ ID NO: 152907 - DNA, 35 bp, Artificial Sequence
  Description of Artificial Sequence: Synthetic oligonucleotide
ttctgcacagagaggggatgtttaacgacactttg

SEQ ID NO: 152908 - DNA, 34 bp, Artificial Sequence
  Description of Artificial Sequence: Synthetic oligonucleotide
tctgcacagagaggggatgtttaacgacactttg

SEQ ID NO: 152909 - DNA, 33 bp, Artificial Sequence
  Description of Artificial Sequence: Synthetic oligonucleotide
ctgcacagagaggggatgtttaacgacactttg

SEQ ID NO: 152910 - DNA, 33 bp, Artificial Sequence
  Description of Artificial Sequence: Synthetic oligonucleotide
tgcacagagaggggatgtttaacgacactttgc

SEQ ID NO: 152911 - DNA, 32 bp, Artificial Sequence
  Description of Artificial Sequence: Synthetic oligonucleotide
gcacagagaggggatgtttaacgacactttgc

SEQ ID NO: 152912 - DNA, 32 bp, Artificial Sequence
  Description of Artificial Sequence: Synthetic oligonucleotide
cacagagaggggatgtttaacgacactttgcg

SEQ ID NO: 152913 - DNA, 32 bp, Artificial Sequence
  Description of Artificial Sequence: Synthetic oligonucleotide
acagagaggggatgtttaacgacactttgcgc

SEQ ID NO: 152914 - DNA, 31 bp, Artificial Sequence
  Description of Artificial Sequence: Synthetic oligonucleotide
cagagaggggatgtttaacgacactttgcgc

SEQ ID NO: 152915 - DNA, 31 bp, Artificial Sequence
  Description of Artificial Sequence: Synthetic oligonucleotide
agagaggggatgtttaacgacactttgcgcc

SEQ ID NO: 152916 - DNA, 30 bp, Artificial Sequence
  Description of Artificial Sequence: Synthetic oligonucleotide
gagaggggatgtttaacgacactttgcgcc

SEQ ID NO: 152917 - DNA, 31 bp, Artificial Sequence
  Description of Artificial Sequence: Synthetic oligonucleotide
agaggggatgtttaacgacactttgcgcctc

SEQ ID NO: 152918 - DNA, 30 bp, Artificial Sequence
  Description of Artificial Sequence: Synthetic oligonucleotide
gaggggatgtttaacgacactttgcgcctc

SEQ ID NO: 152919 - DNA, 33 bp, Artificial Sequence
  Description of Artificial Sequence: Synthetic oligonucleotide
aggggatgtttaacgacactttgcgcctcattg

SEQ ID NO: 152920 - DNA, 32 bp, Artificial Sequence
  Description of Artificial Sequence: Synthetic oligonucleotide
ggggatgtttaacgacactttgcgcctcattg

SEQ ID NO: 152921 - DNA, 32 bp, Artificial Sequence
  Description of Artificial Sequence: Synthetic oligonucleotide
gggatgtttaacgacactttgcgcctcattgg

SEQ ID NO: 152922 - DNA, 33 bp, Artificial Sequence
  Description of Artificial Sequence: Synthetic oligonucleotide
ggatgtttaacgacactttgcgcctcattggag

SEQ ID NO: 152923 - DNA, 35 bp, Artificial Sequence
  Description of Artificial Sequence: Synthetic oligonucleotide
gatgtttaacgacactttgcgcctcattggagaac

SEQ ID NO: 152924 - DNA, 36 bp, Artificial Sequence
  Description of Artificial Sequence: Synthetic oligonucleotide
atgtttaacgacactttgcgcctcattggagaacac

SEQ ID NO: 152925 - DNA, 35 bp, Artificial Sequence
  Description of Artificial Sequence: Synthetic oligonucleotide
tgtttaacgacactttgcgcctcattggagaacac

SEQ ID NO: 152926 - DNA, 34 bp, Artificial Sequence
  Description of Artificial Sequence: Synthetic oligonucleotide
gtttaacgacactttgcgcctcattggagaacac

SEQ ID NO: 152927 - DNA, 34 bp, Artificial Sequence
  Description of Artificial Sequence: Synthetic oligonucleotide
tttaacgacactttgcgcctcattggagaacacc

SEQ ID NO: 152928 - DNA, 33 bp, Artificial Sequence
  Description of Artificial Sequence: Synthetic oligonucleotide
ttaacgacactttgcgcctcattggagaacacc

SEQ ID NO: 152929 - DNA, 32 bp, Artificial Sequence
  Description of Artificial Sequence: Synthetic oligonucleotide
taacgacactttgcgcctcattggagaacacc

SEQ ID NO: 152930 - DNA, 31 bp, Artificial Sequence
  Description of Artificial Sequence: Synthetic oligonucleotide
aacgacactttgcgcctcattggagaacacc

SEQ ID NO: 152931 - DNA, 30 bp, Artificial Sequence
  Description of Artificial Sequence: Synthetic oligonucleotide
acgacactttgcgcctcattggagaacacc

SEQ ID NO: 152932 - DNA, 29 bp, Artificial Sequence
  Description of Artificial Sequence: Synthetic oligonucleotide
cgacactttgcgcctcattggagaacacc

SEQ ID NO: 152933 - DNA, 31 bp, Artificial Sequence
  Description of Artificial Sequence: Synthetic oligonucleotide
gacactttgcgcctcattggagaacaccatg

SEQ ID NO: 152934 - DNA, 33 bp, Artificial Sequence
  Description of Artificial Sequence: Synthetic oligonucleotide
acactttgcgcctcattggagaacaccatgatg

SEQ ID NO: 152935 - DNA, 32 bp, Artificial Sequence
  Description of Artificial Sequence: Synthetic oligonucleotide
cactttgcgcctcattggagaacaccatgatg

SEQ ID NO: 152936 - DNA, 32 bp, Artificial Sequence
  Description of Artificial Sequence: Synthetic oligonucleotide
actttgcgcctcattggagaacaccatgatgg

SEQ ID NO: 152937 - DNA, 31 bp, Artificial Sequence
  Description of Artificial Sequence: Synthetic oligonucleotide
ctttgcgcctcattggagaacaccatgatgg

SEQ ID NO: 152938 - DNA, 31 bp, Artificial Sequence
  Description of Artificial Sequence: Synthetic oligonucleotide
tttgcgcctcattggagaacaccatgatggg

SEQ ID NO: 152939 - DNA, 30 bp, Artificial Sequence
  Description of Artificial Sequence: Synthetic oligonucleotide
ttgcgcctcattggagaacaccatgatggg

SEQ ID NO: 152940 - DNA, 29 bp, Artificial Sequence
  Description of Artificial Sequence: Synthetic oligonucleotide
tgcgcctcattggagaacaccatgatggg

SEQ ID NO: 152941 - DNA, 28 bp, Artificial Sequence
  Description of Artificial Sequence: Synthetic oligonucleotide
gcgcctcattggagaacaccatgatggg

SEQ ID NO: 152942 - DNA, 28 bp, Artificial Sequence
  Description of Artificial Sequence: Synthetic oligonucleotide
cgcctcattggagaacaccatgatgggg

SEQ ID NO: 152943 - DNA, 29 bp, Artificial Sequence
  Description of Artificial Sequence: Synthetic oligonucleotide
gcctcattggagaacaccatgatggggtc

SEQ ID NO: 152944 - DNA, 30 bp, Artificial Sequence
  Description of Artificial Sequence: Synthetic oligonucleotide
cctcattggagaacaccatgatggggtctc

SEQ ID NO: 152945 - DNA, 30 bp, Artificial Sequence
  Description of Artificial Sequence: Synthetic oligonucleotide
ctcattggagaacaccatgatggggtctcc

SEQ ID NO: 152946 - DNA, 32 bp, Artificial Sequence
  Description of Artificial Sequence: Synthetic oligonucleotide
tcattggagaacaccatgatggggtctccaag

SEQ ID NO: 152947 - DNA, 31 bp, Artificial Sequence
  Description of Artificial Sequence: Synthetic oligonucleotide
cattggagaacaccatgatggggtctccaag

SEQ ID NO: 152948 - DNA, 31 bp, Artificial Sequence
  Description of Artificial Sequence: Synthetic oligonucleotide
attggagaacaccatgatggggtctccaagg

SEQ ID NO: 152949 - DNA, 30 bp, Artificial Sequence
  Description of Artificial Sequence: Synthetic oligonucleotide
ttggagaacaccatgatggggtctccaagg

SEQ ID NO: 152950 - DNA, 29 bp, Artificial Sequence
  Description of Artificial Sequence: Synthetic oligonucleotide
tggagaacaccatgatggggtctccaagg

SEQ ID NO: 152951 - DNA, 28 bp, Artificial Sequence
  Description of Artificial Sequence: Synthetic oligonucleotide
ggagaacaccatgatggggtctccaagg

SEQ ID NO: 152952 - DNA, 28 bp, Artificial Sequence
  Description of Artificial Sequence: Synthetic oligonucleotide
gagaacaccatgatggggtctccaaggc

SEQ ID NO: 152953 - DNA, 28 bp, Artificial Sequence
  Description of Artificial Sequence: Synthetic oligonucleotide
agaacaccatgatggggtctccaaggcc

SEQ ID NO: 152954 - DNA, 27 bp, Artificial Sequence
  Description of Artificial Sequence: Synthetic oligonucleotide
gaacaccatgatggggtctccaaggcc

SEQ ID NO: 152955 - DNA, 29 bp, Artificial Sequence
  Description of Artificial Sequence: Synthetic oligonucleotide
aacaccatgatggggtctccaaggccaac

SEQ ID NO: 152956 - DNA, 28 bp, Artificial Sequence
  Description of Artificial Sequence: Synthetic oligonucleotide
acaccatgatggggtctccaaggccaac

SEQ ID NO: 152957 - DNA, 27 bp, Artificial Sequence
  Description of Artificial Sequence: Synthetic oligonucleotide
caccatgatggggtctccaaggccaac

SEQ ID NO: 152958 - DNA, 29 bp, Artificial Sequence
  Description of Artificial Sequence: Synthetic oligonucleotide
accatgatggggtctccaaggccaacttc

SEQ ID NO: 152959 - DNA, 28 bp, Artificial Sequence
  Description of Artificial Sequence: Synthetic oligonucleotide
ccatgatggggtctccaaggccaacttc

SEQ ID NO: 152960 - DNA, 29 bp, Artificial Sequence
  Description of Artificial Sequence: Synthetic oligonucleotide
catgatggggtctccaaggccaacttctc

SEQ ID NO: 152961 - DNA, 29 bp, Artificial Sequence
  Description of Artificial Sequence: Synthetic oligonucleotide
atgatggggtctccaaggccaacttctcc

SEQ ID NO: 152962 - DNA, 28 bp, Artificial Sequence
  Description of Artificial Sequence: Synthetic oligonucleotide
tgatggggtctccaaggccaacttctcc

SEQ ID NO: 152963 - DNA, 27 bp, Artificial Sequence
  Description of Artificial Sequence: Synthetic oligonucleotide
gatggggtctccaaggccaacttctcc

SEQ ID NO: 152964 - DNA, 29 bp, Artificial Sequence
  Description of Artificial Sequence: Synthetic oligonucleotide
atggggtctccaaggccaacttctccatc

SEQ ID NO: 152965 - DNA, 28 bp, Artificial Sequence
  Description of Artificial Sequence: Synthetic oligonucleotide
tggggtctccaaggccaacttctccatc

SEQ ID NO: 152966 - DNA, 27 bp, Artificial Sequence
  Description of Artificial Sequence: Synthetic oligonucleotide
ggggtctccaaggccaacttctccatc

SEQ ID NO: 152967 - DNA, 28 bp, Artificial Sequence
  Description of Artificial Sequence: Synthetic oligonucleotide
gggtctccaaggccaacttctccatcag

SEQ ID NO: 152968 - DNA, 29 bp, Artificial Sequence
  Description of Artificial Sequence: Synthetic oligonucleotide
ggtctccaaggccaacttctccatcagtc

SEQ ID NO: 152969 - DNA, 29 bp, Artificial Sequence
  Description of Artificial Sequence: Synthetic oligonucleotide
gtctccaaggccaacttctccatcagtcg

SEQ ID NO: 152970 - DNA, 29 bp, Artificial Sequence
  Description of Artificial Sequence: Synthetic oligonucleotide
tctccaaggccaacttctccatcagtcgc

SEQ ID NO: 152971 - DNA, 28 bp, Artificial Sequence
  Description of Artificial Sequence: Synthetic oligonucleotide
ctccaaggccaacttctccatcagtcgc

SEQ ID NO: 152972 - DNA, 30 bp, Artificial Sequence
  Description of Artificial Sequence: Synthetic oligonucleotide
tccaaggccaacttctccatcagtcgcatg

SEQ ID NO: 152973 - DNA, 29 bp, Artificial Sequence
  Description of Artificial Sequence: Synthetic oligonucleotide
ccaaggccaacttctccatcagtcgcatg

SEQ ID NO: 152974 - DNA, 30 bp, Artificial Sequence
  Description of Artificial Sequence: Synthetic oligonucleotide
caaggccaacttctccatcagtcgcatgac

SEQ ID NO: 152975 - DNA, 30 bp, Artificial Sequence
  Description of Artificial Sequence: Synthetic oligonucleotide
aaggccaacttctccatcagtcgcatgacg

SEQ ID NO: 152976 - DNA, 29 bp, Artificial Sequence
  Description of Artificial Sequence: Synthetic oligonucleotide
aggccaacttctccatcagtcgcatgacg

SEQ ID NO: 152977 - DNA, 28 bp, Artificial Sequence
  Description of Artificial Sequence: Synthetic oligonucleotide
ggccaacttctccatcagtcgcatgacg

SEQ ID NO: 152978 - DNA, 28 bp, Artificial Sequence
  Description of Artificial Sequence: Synthetic oligonucleotide
gccaacttctccatcagtcgcatgacgc

SEQ ID NO: 152979 - DNA, 30 bp, Artificial Sequence
  Description of Artificial Sequence: Synthetic oligonucleotide
ccaacttctccatcagtcgcatgacgcaag

SEQ ID NO: 152980 - DNA, 31 bp, Artificial Sequence
  Description of Artificial Sequence: Synthetic oligonucleotide
caacttctccatcagtcgcatgacgcaagac

SEQ ID NO: 152981 - DNA, 31 bp, Artificial Sequence
  Description of Artificial Sequence: Synthetic oligonucleotide
aacttctccatcagtcgcatgacgcaagacc

SEQ ID NO: 152982 - DNA, 30 bp, Artificial Sequence
  Description of Artificial Sequence: Synthetic oligonucleotide
acttctccatcagtcgcatgacgcaagacc

SEQ ID NO: 152983 - DNA, 29 bp, Artificial Sequence
  Description of Artificial Sequence: Synthetic oligonucleotide
cttctccatcagtcgcatgacgcaagacc

SEQ ID NO: 152984 - DNA, 30 bp, Artificial Sequence
  Description of Artificial Sequence: Synthetic oligonucleotide
ttctccatcagtcgcatgacgcaagacctg

SEQ ID NO: 152985 - DNA, 29 bp, Artificial Sequence
  Description of Artificial Sequence: Synthetic oligonucleotide
tctccatcagtcgcatgacgcaagacctg

SEQ ID NO: 152986 - DNA, 28 bp, Artificial Sequence
  Description of Artificial Sequence: Synthetic oligonucleotide
ctccatcagtcgcatgacgcaagacctg

SEQ ID NO: 152987 - DNA, 28 bp, Artificial Sequence
  Description of Artificial Sequence: Synthetic oligonucleotide
tccatcagtcgcatgacgcaagacctgg

SEQ ID NO: 152988 - DNA, 27 bp, Artificial Sequence
  Description of Artificial Sequence: Synthetic oligonucleotide
ccatcagtcgcatgacgcaagacctgg

SEQ ID NO: 152989 - DNA, 27 bp, Artificial Sequence
  Description of Artificial Sequence: Synthetic oligonucleotide
catcagtcgcatgacgcaagacctggc

SEQ ID NO: 152990 - DNA, 28 bp, Artificial Sequence
  Description of Artificial Sequence: Synthetic oligonucleotide
atcagtcgcatgacgcaagacctggcag

SEQ ID NO: 152991 - DNA, 27 bp, Artificial Sequence
  Description of Artificial Sequence: Synthetic oligonucleotide
tcagtcgcatgacgcaagacctggcag

SEQ ID NO: 152992 - DNA, 26 bp, Artificial Sequence
  Description of Artificial Sequence: Synthetic oligonucleotide
cagtcgcatgacgcaagacctggcag

SEQ ID NO: 152993 - DNA, 26 bp, Artificial Sequence
  Description of Artificial Sequence: Synthetic oligonucleotide
agtcgcatgacgcaagacctggcagg

SEQ ID NO: 152994 - DNA, 25 bp, Artificial Sequence
  Description of Artificial Sequence: Synthetic oligonucleotide
gtcgcatgacgcaagacctggcagg

SEQ ID NO: 152995 - DNA, 26 bp, Artificial Sequence
  Description of Artificial Sequence: Synthetic oligonucleotide
tcgcatgacgcaagacctggcaggga

SEQ ID NO: 152996 - DNA, 25 bp, Artificial Sequence
  Description of Artificial Sequence: Synthetic oligonucleotide
cgcatgacgcaagacctggcaggga

SEQ ID NO: 152997 - DNA, 25 bp, Artificial Sequence
  Description of Artificial Sequence: Synthetic oligonucleotide
gcatgacgcaagacctggcagggac

SEQ ID NO: 152998 - DNA, 27 bp, Artificial Sequence
  Description of Artificial Sequence: Synthetic oligonucleotide
catgacgcaagacctggcagggaccta

SEQ ID NO: 152999 - DNA, 27 bp, Artificial Sequence
  Description of Artificial Sequence: Synthetic oligonucleotide
atgacgcaagacctggcagggacctac

SEQ ID NO: 153000 - DNA, 27 bp, Artificial Sequence
  Description of Artificial Sequence: Synthetic oligonucleotide
tgacgcaagacctggcagggacctaca

SEQ ID NO: 153001 - DNA, 26 bp, Artificial Sequence
  Description of Artificial Sequence: Synthetic oligonucleotide
gacgcaagacctggcagggacctaca

SEQ ID NO: 153002 - DNA, 27 bp, Artificial Sequence
  Description of Artificial Sequence: Synthetic oligonucleotide
acgcaagacctggcagggacctacaga

SEQ ID NO: 153003 - DNA, 27 bp, Artificial Sequence
  Description of Artificial Sequence: Synthetic oligonucleotide
cgcaagacctggcagggacctacagat

SEQ ID NO: 153004 - DNA, 27 bp, Artificial Sequence
  Description of Artificial Sequence: Synthetic oligonucleotide
gcaagacctggcagggacctacagatg

SEQ ID NO: 153005 - DNA, 27 bp, Artificial Sequence
  Description of Artificial Sequence: Synthetic oligonucleotide
caagacctggcagggacctacagatgc

SEQ ID NO: 153006 - DNA, 29 bp, Artificial Sequence
  Description of Artificial Sequence: Synthetic oligonucleotide
aagacctggcagggacctacagatgctac

SEQ ID NO: 153007 - DNA, 28 bp, Artificial Sequence
  Description of Artificial Sequence: Synthetic oligonucleotide
agacctggcagggacctacagatgctac

SEQ ID NO: 153008 - DNA, 27 bp, Artificial Sequence
  Description of Artificial Sequence: Synthetic oligonucleotide
gacctggcagggacctacagatgctac

SEQ ID NO: 153009 - DNA, 27 bp, Artificial Sequence
  Description of Artificial Sequence: Synthetic oligonucleotide
acctggcagggacctacagatgctacg

SEQ ID NO: 153010 - DNA, 26 bp, Artificial Sequence
  Description of Artificial Sequence: Synthetic oligonucleotide
cctggcagggacctacagatgctacg

SEQ ID NO: 153011 - DNA, 27 bp, Artificial Sequence
  Description of Artificial Sequence: Synthetic oligonucleotide
ctggcagggacctacagatgctacggt

SEQ ID NO: 153012 - DNA, 28 bp, Artificial Sequence
  Description of Artificial Sequence: Synthetic oligonucleotide
tggcagggacctacagatgctacggttc

SEQ ID NO: 153013 - DNA, 27 bp, Artificial Sequence
  Description of Artificial Sequence: Synthetic oligonucleotide
ggcagggacctacagatgctacggttc

SEQ ID NO: 153014 - DNA, 28 bp, Artificial Sequence
  Description of Artificial Sequence: Synthetic oligonucleotide
gcagggacctacagatgctacggttctg

SEQ ID NO: 153015 - DNA, 31 bp, Artificial Sequence
  Description of Artificial Sequence: Synthetic oligonucleotide
cagggacctacagatgctacggttctgttac

SEQ ID NO: 153016 - DNA, 32 bp, Artificial Sequence
  Description of Artificial Sequence: Synthetic oligonucleotide
agggacctacagatgctacggttctgttactc

SEQ ID NO: 153017 - DNA, 31 bp, Artificial Sequence
  Description of Artificial Sequence: Synthetic oligonucleotide
gggacctacagatgctacggttctgttactc

SEQ ID NO: 153018 - DNA, 32 bp, Artificial Sequence
  Description of Artificial Sequence: Synthetic oligonucleotide
ggacctacagatgctacggttctgttactcac

SEQ ID NO: 153019 - DNA, 33 bp, Artificial Sequence
  Description of Artificial Sequence: Synthetic oligonucleotide
gacctacagatgctacggttctgttactcactc

SEQ ID NO: 153020 - DNA, 33 bp, Artificial Sequence
  Description of Artificial Sequence: Synthetic oligonucleotide
acctacagatgctacggttctgttactcactcc

SEQ ID NO: 153021 - DNA, 32 bp, Artificial Sequence
  Description of Artificial Sequence: Synthetic oligonucleotide
cctacagatgctacggttctgttactcactcc

SEQ ID NO: 153022 - DNA, 32 bp, Artificial Sequence
  Description of Artificial Sequence: Synthetic oligonucleotide
ctacagatgctacggttctgttactcactccc

SEQ ID NO: 153023 - DNA, 32 bp, Artificial Sequence
  Description of Artificial Sequence: Synthetic oligonucleotide
tacagatgctacggttctgttactcactcccc

SEQ ID NO: 153024 - DNA, 31 bp, Artificial Sequence
  Description of Artificial Sequence: Synthetic oligonucleotide
acagatgctacggttctgttactcactcccc

SEQ ID NO: 153025 - DNA, 30 bp, Artificial Sequence
  Description of Artificial Sequence: Synthetic oligonucleotide
cagatgctacggttctgttactcactcccc

SEQ ID NO: 153026 - DNA, 30 bp, Artificial Sequence
  Description of Artificial Sequence: Synthetic oligonucleotide
agatgctacggttctgttactcactccccc

SEQ ID NO: 153027 - DNA, 29 bp, Artificial Sequence
  Description of Artificial Sequence: Synthetic oligonucleotide
gatgctacggttctgttactcactccccc

SEQ ID NO: 153028 - DNA, 32 bp, Artificial Sequence
  Description of Artificial Sequence: Synthetic oligonucleotide
atgctacggttctgttactcactccccctatc

SEQ ID NO: 153029 - DNA, 31 bp, Artificial Sequence
  Description of Artificial Sequence: Synthetic oligonucleotide
tgctacggttctgttactcactccccctatc

SEQ ID NO: 153030 - DNA, 30 bp, Artificial Sequence
  Description of Artificial Sequence: Synthetic oligonucleotide
gctacggttctgttactcactccccctatc

SEQ ID NO: 153031 - DNA, 31 bp, Artificial Sequence
  Description of Artificial Sequence: Synthetic oligonucleotide
ctacggttctgttactcactccccctatcag

SEQ ID NO: 153032 - DNA, 31 bp, Artificial Sequence
  Description of Artificial Sequence: Synthetic oligonucleotide
tacggttctgttactcactccccctatcagg

SEQ ID NO: 153033 - DNA, 30 bp, Artificial Sequence
  Description of Artificial Sequence: Synthetic oligonucleotide
acggttctgttactcactccccctatcagg

SEQ ID NO: 153034 - DNA, 29 bp, Artificial Sequence
  Description of Artificial Sequence: Synthetic oligonucleotide
cggttctgttactcactccccctatcagg

SEQ ID NO: 153035 - DNA, 30 bp, Artificial Sequence
  Description of Artificial Sequence: Synthetic oligonucleotide
ggttctgttactcactccccctatcaggtg

SEQ ID NO: 153036 - DNA, 31 bp, Artificial Sequence
  Description of Artificial Sequence: Synthetic oligonucleotide
gttctgttactcactccccctatcaggtgtc

SEQ ID NO: 153037 - DNA, 32 bp, Artificial Sequence
  Description of Artificial Sequence: Synthetic oligonucleotide
ttctgttactcactccccctatcaggtgtcag

SEQ ID NO: 153038 - DNA, 31 bp, Artificial Sequence
  Description of Artificial Sequence: Synthetic oligonucleotide
tctgttactcactccccctatcaggtgtcag

SEQ ID NO: 153039 - DNA, 30 bp, Artificial Sequence
  Description of Artificial Sequence: Synthetic oligonucleotide
ctgttactcactccccctatcaggtgtcag

SEQ ID NO: 153040 - DNA, 30 bp, Artificial Sequence
  Description of Artificial Sequence: Synthetic oligonucleotide
tgttactcactccccctatcaggtgtcagc

SEQ ID NO: 153041 - DNA, 29 bp, Artificial Sequence
  Description of Artificial Sequence: Synthetic oligonucleotide
gttactcactccccctatcaggtgtcagc

SEQ ID NO: 153042 - DNA, 30 bp, Artificial Sequence
  Description of Artificial Sequence: Synthetic oligonucleotide
ttactcactccccctatcaggtgtcagctc

SEQ ID NO: 153043 - DNA, 29 bp, Artificial Sequence
  Description of Artificial Sequence: Synthetic oligonucleotide
tactcactccccctatcaggtgtcagctc

SEQ ID NO: 153044 - DNA, 28 bp, Artificial Sequence
  Description of Artificial Sequence: Synthetic oligonucleotide
actcactccccctatcaggtgtcagctc

SEQ ID NO: 153045 - DNA, 27 bp, Artificial Sequence
  Description of Artificial Sequence: Synthetic oligonucleotide
ctcactccccctatcaggtgtcagctc

SEQ ID NO: 153046 - DNA, 27 bp, Artificial Sequence
  Description of Artificial Sequence: Synthetic oligonucleotide
tcactccccctatcaggtgtcagctcc

SEQ ID NO: 153047 - DNA, 26 bp, Artificial Sequence
  Description of Artificial Sequence: Synthetic oligonucleotide
cactccccctatcaggtgtcagctcc

SEQ ID NO: 153048 - DNA, 27 bp, Artificial Sequence
  Description of Artificial Sequence: Synthetic oligonucleotide
actccccctatcaggtgtcagctccca

SEQ ID NO: 153049 - DNA, 26 bp, Artificial Sequence
  Description of Artificial Sequence: Synthetic oligonucleotide
ctccccctatcaggtgtcagctccca

SEQ ID NO: 153050 - DNA, 27 bp, Artificial Sequence
  Description of Artificial Sequence: Synthetic oligonucleotide
tccccctatcaggtgtcagctcccagt

SEQ ID NO: 153051 - DNA, 26 bp, Artificial Sequence
  Description of Artificial Sequence: Synthetic oligonucleotide
ccccctatcaggtgtcagctcccagt

SEQ ID NO: 153052 - DNA, 27 bp, Artificial Sequence
  Description of Artificial Sequence: Synthetic oligonucleotide
cccctatcaggtgtcagctcccagtga

SEQ ID NO: 153053 - DNA, 27 bp, Artificial Sequence
  Description of Artificial Sequence: Synthetic oligonucleotide
ccctatcaggtgtcagctcccagtgac

SEQ ID NO: 153054 - DNA, 27 bp, Artificial Sequence
  Description of Artificial Sequence: Synthetic oligonucleotide
cctatcaggtgtcagctcccagtgacc

SEQ ID NO: 153055 - DNA, 27 bp, Artificial Sequence
  Description of Artificial Sequence: Synthetic oligonucleotide
ctatcaggtgtcagctcccagtgaccc

SEQ ID NO: 153056 - DNA, 28 bp, Artificial Sequence
  Description of Artificial Sequence: Synthetic oligonucleotide
tatcaggtgtcagctcccagtgaccctc

SEQ ID NO: 153057 - DNA, 27 bp, Artificial Sequence
  Description of Artificial Sequence: Synthetic oligonucleotide
atcaggtgtcagctcccagtgaccctc

SEQ ID NO: 153058 - DNA, 27 bp, Artificial Sequence
  Description of Artificial Sequence: Synthetic oligonucleotide
tcaggtgtcagctcccagtgaccctct

SEQ ID NO: 153059 - DNA, 26 bp, Artificial Sequence
  Description of Artificial Sequence: Synthetic oligonucleotide
caggtgtcagctcccagtgaccctct

SEQ ID NO: 153060 - DNA, 26 bp, Artificial Sequence
  Description of Artificial Sequence: Synthetic oligonucleotide
aggtgtcagctcccagtgaccctctg

SEQ ID NO: 153061 - DNA, 25 bp, Artificial Sequence
  Description of Artificial Sequence: Synthetic oligonucleotide
ggtgtcagctcccagtgaccctctg

SEQ ID NO: 153062 - DNA, 26 bp, Artificial Sequence
  Description of Artificial Sequence: Synthetic oligonucleotide
gtgtcagctcccagtgaccctctgga

SEQ ID NO: 153063 - DNA, 27 bp, Artificial Sequence
  Description of Artificial Sequence: Synthetic oligonucleotide
tgtcagctcccagtgaccctctggaca

SEQ ID NO: 153064 - DNA, 27 bp, Artificial Sequence
  Description of Artificial Sequence: Synthetic oligonucleotide
gtcagctcccagtgaccctctggacat

SEQ ID NO: 153065 - DNA, 27 bp, Artificial Sequence
  Description of Artificial Sequence: Synthetic oligonucleotide
tcagctcccagtgaccctctggacatc

SEQ ID NO: 153066 - DNA, 26 bp, Artificial Sequence
  Description of Artificial Sequence: Synthetic oligonucleotide
cagctcccagtgaccctctggacatc

SEQ ID NO: 153067 - DNA, 27 bp, Artificial Sequence
  Description of Artificial Sequence: Synthetic oligonucleotide
agctcccagtgaccctctggacatcgt

SEQ ID NO: 153068 - DNA, 26 bp, Artificial Sequence
  Description of Artificial Sequence: Synthetic oligonucleotide
gctcccagtgaccctctggacatcgt

SEQ ID NO: 153069 - DNA, 27 bp, Artificial Sequence
  Description of Artificial Sequence: Synthetic oligonucleotide
ctcccagtgaccctctggacatcgtga

SEQ ID NO: 153070 - DNA, 28 bp, Artificial Sequence
  Description of Artificial Sequence: Synthetic oligonucleotide
tcccagtgaccctctggacatcgtgatc

SEQ ID NO: 153071 - DNA, 27 bp, Artificial Sequence
  Description of Artificial Sequence: Synthetic oligonucleotide
cccagtgaccctctggacatcgtgatc

SEQ ID NO: 153072 - DNA, 30 bp, Artificial Sequence
  Description of Artificial Sequence: Synthetic oligonucleotide
ccagtgaccctctggacatcgtgatcatag

SEQ ID NO: 153073 - DNA, 30 bp, Artificial Sequence
  Description of Artificial Sequence: Synthetic oligonucleotide
cagtgaccctctggacatcgtgatcatagg

SEQ ID NO: 153074 - DNA, 31 bp, Artificial Sequence
  Description of Artificial Sequence: Synthetic oligonucleotide
agtgaccctctggacatcgtgatcataggtc

SEQ ID NO: 153075 - DNA, 30 bp, Artificial Sequence
  Description of Artificial Sequence: Synthetic oligonucleotide
gtgaccctctggacatcgtgatcataggtc

SEQ ID NO: 153076 - DNA, 35 bp, Artificial Sequence
  Description of Artificial Sequence: Synthetic oligonucleotide
tgaccctctggacatcgtgatcataggtctatatg

SEQ ID NO: 153077 - DNA, 34 bp, Artificial Sequence
  Description of Artificial Sequence: Synthetic oligonucleotide
gaccctctggacatcgtgatcataggtctatatg

SEQ ID NO: 153078 - DNA, 35 bp, Artificial Sequence
  Description of Artificial Sequence: Synthetic oligonucleotide
accctctggacatcgtgatcataggtctatatgag

SEQ ID NO: 153079 - DNA, 34 bp, Artificial Sequence
  Description of Artificial Sequence: Synthetic oligonucleotide
ccctctggacatcgtgatcataggtctatatgag

SEQ ID NO: 153080 - DNA, 37 bp, Artificial Sequence
  Description of Artificial Sequence: Synthetic oligonucleotide
cctctggacatcgtgatcataggtctatatgagaaac

SEQ ID NO: 153081 - DNA, 37 bp, Artificial Sequence
  Description of Artificial Sequence: Synthetic oligonucleotide
ctctggacatcgtgatcataggtctatatgagaaacc

SEQ ID NO: 153082 - DNA, 39 bp, Artificial Sequence
  Description of Artificial Sequence: Synthetic oligonucleotide
tctggacatcgtgatcataggtctatatgagaaaccttc

SEQ ID NO: 153083 - DNA, 38 bp, Artificial Sequence
  Description of Artificial Sequence: Synthetic oligonucleotide
ctggacatcgtgatcataggtctatatgagaaaccttc

SEQ ID NO: 153084 - DNA, 39 bp, Artificial Sequence
  Description of Artificial Sequence: Synthetic oligonucleotide
tggacatcgtgatcataggtctatatgagaaaccttctc

SEQ ID NO: 153085 - DNA, 38 bp, Artificial Sequence
  Description of Artificial Sequence: Synthetic oligonucleotide
ggacatcgtgatcataggtctatatgagaaaccttctc

SEQ ID NO: 153086 - DNA, 39 bp, Artificial Sequence
  Description of Artificial Sequence: Synthetic oligonucleotide
gacatcgtgatcataggtctatatgagaaaccttctctc

SEQ ID NO: 153087 - DNA, 40 bp, Artificial Sequence
  Description of Artificial Sequence: Synthetic oligonucleotide
acatcgtgatcataggtctatatgagaaaccttctctctc

SEQ ID NO: 153088 - DNA, 39 bp, Artificial Sequence
  Description of Artificial Sequence: Synthetic oligonucleotide
catcgtgatcataggtctatatgagaaaccttctctctc

SEQ ID NO: 153089 - DNA, 40 bp, Artificial Sequence
  Description of Artificial Sequence: Synthetic oligonucleotide
atcgtgatcataggtctatatgagaaaccttctctctcag

SEQ ID NO: 153090 - DNA, 39 bp, Artificial Sequence
  Description of Artificial Sequence: Synthetic oligonucleotide
tcgtgatcataggtctatatgagaaaccttctctctcag

SEQ ID NO: 153091 - DNA, 38 bp, Artificial Sequence
  Description of Artificial Sequence: Synthetic oligonucleotide
cgtgatcataggtctatatgagaaaccttctctctcag

SEQ ID NO: 153092 - DNA, 38 bp, Artificial Sequence
  Description of Artificial Sequence: Synthetic oligonucleotide
gtgatcataggtctatatgagaaaccttctctctcagc

SEQ ID NO: 153093 - DNA, 38 bp, Artificial Sequence
  Description of Artificial Sequence: Synthetic oligonucleotide
tgatcataggtctatatgagaaaccttctctctcagcc

SEQ ID NO: 153094 - DNA, 37 bp, Artificial Sequence
  Description of Artificial Sequence: Synthetic oligonucleotide
gatcataggtctatatgagaaaccttctctctcagcc

SEQ ID NO: 153095 - DNA, 37 bp, Artificial Sequence
  Description of Artificial Sequence: Synthetic oligonucleotide
atcataggtctatatgagaaaccttctctctcagccc

SEQ ID NO: 153096 - DNA, 36 bp, Artificial Sequence
  Description of Artificial Sequence: Synthetic oligonucleotide
tcataggtctatatgagaaaccttctctctcagccc

SEQ ID NO: 153097 - DNA, 35 bp, Artificial Sequence
  Description of Artificial Sequence: Synthetic oligonucleotide
cataggtctatatgagaaaccttctctctcagccc

SEQ ID NO: 153098 - DNA, 36 bp, Artificial Sequence
  Description of Artificial Sequence: Synthetic oligonucleotide
ataggtctatatgagaaaccttctctctcagcccag

SEQ ID NO: 153099 - DNA, 35 bp, Artificial Sequence
  Description of Artificial Sequence: Synthetic oligonucleotide
taggtctatatgagaaaccttctctctcagcccag

SEQ ID NO: 153100 - DNA, 34 bp, Artificial Sequence
  Description of Artificial Sequence: Synthetic oligonucleotide
aggtctatatgagaaaccttctctctcagcccag

SEQ ID NO: 153101 - DNA, 33 bp, Artificial Sequence
  Description of Artificial Sequence: Synthetic oligonucleotide
ggtctatatgagaaaccttctctctcagcccag

SEQ ID NO: 153102 - DNA, 33 bp, Artificial Sequence
  Description of Artificial Sequence: Synthetic oligonucleotide
gtctatatgagaaaccttctctctcagcccagc

SEQ ID NO: 153103 - DNA, 33 bp, Artificial Sequence
  Description of Artificial Sequence: Synthetic oligonucleotide
tctatatgagaaaccttctctctcagcccagcc

SEQ ID NO: 153104 - DNA, 32 bp, Artificial Sequence
  Description of Artificial Sequence: Synthetic oligonucleotide
ctatatgagaaaccttctctctcagcccagcc

SEQ ID NO: 153105 - DNA, 32 bp, Artificial Sequence
  Description of Artificial Sequence: Synthetic oligonucleotide
tatatgagaaaccttctctctcagcccagccg

SEQ ID NO: 153106 - DNA, 31 bp, Artificial Sequence
  Description of Artificial Sequence: Synthetic oligonucleotide
atatgagaaaccttctctctcagcccagccg

SEQ ID NO: 153107 - DNA, 30 bp, Artificial Sequence
  Description of Artificial Sequence: Synthetic oligonucleotide
tatgagaaaccttctctctcagcccagccg

SEQ ID NO: 153108 - DNA, 29 bp, Artificial Sequence
  Description of Artificial Sequence: Synthetic oligonucleotide
atgagaaaccttctctctcagcccagccg

SEQ ID NO: 153109 - DNA, 28 bp, Artificial Sequence
  Description of Artificial Sequence: Synthetic oligonucleotide
tgagaaaccttctctctcagcccagccg

SEQ ID NO: 153110 - DNA, 27 bp, Artificial Sequence
  Description of Artificial Sequence: Synthetic oligonucleotide
gagaaaccttctctctcagcccagccg

SEQ ID NO: 153111 - DNA, 27 bp, Artificial Sequence
  Description of Artificial Sequence: Synthetic oligonucleotide
agaaaccttctctctcagcccagccgg

SEQ ID NO: 153112 - DNA, 26 bp, Artificial Sequence
  Description of Artificial Sequence: Synthetic oligonucleotide
gaaaccttctctctcagcccagccgg

SEQ ID NO: 153113 - DNA, 26 bp, Artificial Sequence
  Description of Artificial Sequence: Synthetic oligonucleotide
aaaccttctctctcagcccagccggg

SEQ ID NO: 153114 - DNA, 25 bp, Artificial Sequence
  Description of Artificial Sequence: Synthetic oligonucleotide
aaccttctctctcagcccagccggg

SEQ ID NO: 153115 - DNA, 24 bp, Artificial Sequence
  Description of Artificial Sequence: Synthetic oligonucleotide
accttctctctcagcccagccggg

SEQ ID NO: 153116 - DNA, 23 bp, Artificial Sequence
  Description of Artificial Sequence: Synthetic oligonucleotide
ccttctctctcagcccagccggg

SEQ ID NO: 153117 - DNA, 23 bp, Artificial Sequence
  Description of Artificial Sequence: Synthetic oligonucleotide
cttctctctcagcccagccgggc

SEQ ID NO: 153118 - DNA, 23 bp, Artificial Sequence
  Description of Artificial Sequence: Synthetic oligonucleotide
ttctctctcagcccagccgggcc

SEQ ID NO: 153119 - DNA, 22 bp, Artificial Sequence
  Description of Artificial Sequence: Synthetic oligonucleotide
tctctctcagcccagccgggcc

SEQ ID NO: 153120 - DNA, 21 bp, Artificial Sequence
  Description of Artificial Sequence: Synthetic oligonucleotide
ctctctcagcccagccgggcc

SEQ ID NO: 153121 - DNA, 21 bp, Artificial Sequence
  Description of Artificial Sequence: Synthetic oligonucleotide
tctctcagcccagccgggccc

SEQ ID NO: 153122 - DNA, 20 bp, Artificial Sequence
  Description of Artificial Sequence: Synthetic oligonucleotide
ctctcagcccagccgggccc

SEQ ID NO: 153123 - DNA, 21 bp, Artificial Sequence
  Description of Artificial Sequence: Synthetic oligonucleotide
tctcagcccagccgggcccca

SEQ ID NO: 153124 - DNA, 20 bp, Artificial Sequence
  Description of Artificial Sequence: Synthetic oligonucleotide
ctcagcccagccgggcccca

SEQ ID NO: 153125 - DNA, 20 bp, Artificial Sequence
  Description of Artificial Sequence: Synthetic oligonucleotide
tcagcccagccgggccccac

SEQ ID NO: 153126 - DNA, 20 bp, Artificial Sequence
  Description of Artificial Sequence: Synthetic oligonucleotide
cagcccagccgggccccact

SEQ ID NO: 153127 - DNA, 20 bp, Artificial Sequence
  Description of Artificial Sequence: Synthetic oligonucleotide
agcccagccgggccccacgt

SEQ ID NO: 153128 - DNA, 20 bp, Artificial Sequence
  Description of Artificial Sequence: Synthetic oligonucleotide
gcccagccgggccccacgtt

SEQ ID NO: 153129 - DNA, 20 bp, Artificial Sequence
  Description of Artificial Sequence: Synthetic oligonucleotide
cccagccgggccccacggtt

SEQ ID NO: 153130 - DNA, 21 bp, Artificial Sequence
  Description of Artificial Sequence: Synthetic oligonucleotide
ccagccgggccccacggttct

SEQ ID NO: 153131 - DNA, 21 bp, Artificial Sequence
  Description of Artificial Sequence: Synthetic oligonucleotide
cagccgggccccacggttctg

SEQ ID NO: 153132 - DNA, 21 bp, Artificial Sequence
  Description of Artificial Sequence: Synthetic oligonucleotide
agccgggccccacggttctgg

SEQ ID NO: 153133 - DNA, 20 bp, Artificial Sequence
  Description of Artificial Sequence: Synthetic oligonucleotide
gccgggccccacggttctgg

SEQ ID NO: 153134 - DNA, 21 bp, Artificial Sequence
  Description of Artificial Sequence: Synthetic oligonucleotide
ccgggccccacggttctggca

SEQ ID NO: 153135 - DNA, 21 bp, Artificial Sequence
  Description of Artificial Sequence: Synthetic oligonucleotide
cgggccccacggttctggcag

SEQ ID NO: 153136 - DNA, 22 bp, Artificial Sequence
  Description of Artificial Sequence: Synthetic oligonucleotide
gggccccacggttctggcagga

SEQ ID NO: 153137 - DNA, 23 bp, Artificial Sequence
  Description of Artificial Sequence: Synthetic oligonucleotide
ggccccacggttctggcaggaga

SEQ ID NO: 153138 - DNA, 26 bp, Artificial Sequence
  Description of Artificial Sequence: Synthetic oligonucleotide
gccccacggttctggcaggagagaat

SEQ ID NO: 153139 - DNA, 27 bp, Artificial Sequence
  Description of Artificial Sequence: Synthetic oligonucleotide
ccccacggttctggcaggagagaatgt

SEQ ID NO: 153140 - DNA, 27 bp, Artificial Sequence
  Description of Artificial Sequence: Synthetic oligonucleotide
cccacggttctggcaggagagaatgtg

SEQ ID NO: 153141 - DNA, 28 bp, Artificial Sequence
  Description of Artificial Sequence: Synthetic oligonucleotide
ccacggttctggcaggagagaatgtgac

SEQ ID NO: 153142 - DNA, 28 bp, Artificial Sequence
  Description of Artificial Sequence: Synthetic oligonucleotide
cacggttctggcaggagagaatgtgacc

SEQ ID NO: 153143 - DNA, 30 bp, Artificial Sequence
  Description of Artificial Sequence: Synthetic oligonucleotide
acggttctggcaggagagaatgtgaccttg

SEQ ID NO: 153144 - DNA, 29 bp, Artificial Sequence
  Description of Artificial Sequence: Synthetic oligonucleotide
cggttctggcaggagagaatgtgaccttg

SEQ ID NO: 153145 - DNA, 30 bp, Artificial Sequence
  Description of Artificial Sequence: Synthetic oligonucleotide
ggttctggcaggagagaatgtgaccttgtc

SEQ ID NO: 153146 - DNA, 30 bp, Artificial Sequence
  Description of Artificial Sequence: Synthetic oligonucleotide
gttctggcaggagagaatgtgaccttgtcc

SEQ ID NO: 153147 - DNA, 31 bp, Artificial Sequence
  Description of Artificial Sequence: Synthetic oligonucleotide
ttctggcaggagagaatgtgaccttgtcctg

SEQ ID NO: 153148 - DNA, 30 bp, Artificial Sequence
  Description of Artificial Sequence: Synthetic oligonucleotide
tctggcaggagagaatgtgaccttgtcctg

SEQ ID NO: 153149 - DNA, 29 bp, Artificial Sequence
  Description of Artificial Sequence: Synthetic oligonucleotide
ctggcaggagagaatgtgaccttgtcctg

SEQ ID NO: 153150 - DNA, 29 bp, Artificial Sequence
  Description of Artificial Sequence: Synthetic oligonucleotide
tggcaggagagaatgtgaccttgtcctgc

SEQ ID NO: 153151 - DNA, 28 bp, Artificial Sequence
  Description of Artificial Sequence: Synthetic oligonucleotide
ggcaggagagaatgtgaccttgtcctgc

SEQ ID NO: 153152 - DNA, 29 bp, Artificial Sequence
  Description of Artificial Sequence: Synthetic oligonucleotide
gcaggagagaatgtgaccttgtcctgcag

SEQ ID NO: 153153 - DNA, 29 bp, Artificial Sequence
  Description of Artificial Sequence: Synthetic oligonucleotide
caggagagaatgtgaccttgtcctgcagc

SEQ ID NO: 153154 - DNA, 30 bp, Artificial Sequence
  Description of Artificial Sequence: Synthetic oligonucleotide
aggagagaatgtgaccttgtcctgcagctc

SEQ ID NO: 153155 - DNA, 29 bp, Artificial Sequence
  Description of Artificial Sequence: Synthetic oligonucleotide
ggagagaatgtgaccttgtcctgcagctc

SEQ ID NO: 153156 - DNA, 29 bp, Artificial Sequence
  Description of Artificial Sequence: Synthetic oligonucleotide
gagagaatgtgaccttgtcctgcagctcc

SEQ ID NO: 153157 - DNA, 29 bp, Artificial Sequence
  Description of Artificial Sequence: Synthetic oligonucleotide
agagaatgtgaccttgtcctgcagctccc

SEQ ID NO: 153158 - DNA, 28 bp, Artificial Sequence
  Description of Artificial Sequence: Synthetic oligonucleotide
gagaatgtgaccttgtcctgcagctccc

SEQ ID NO: 153159 - DNA, 28 bp, Artificial Sequence
  Description of Artificial Sequence: Synthetic oligonucleotide
agaatgtgaccttgtcctgcagctcccg

SEQ ID NO: 153160 - DNA, 27 bp, Artificial Sequence
  Description of Artificial Sequence: Synthetic oligonucleotide
gaatgtgaccttgtcctgcagctcccg

SEQ ID NO: 153161 - DNA, 27 bp, Artificial Sequence
  Description of Artificial Sequence: Synthetic oligonucleotide
aatgtgaccttgtcctgcagctcccgg

SEQ ID NO: 153162 - DNA, 27 bp, Artificial Sequence
  Description of Artificial Sequence: Synthetic oligonucleotide
atgtgaccttgtcctgcagctcccgga

SEQ ID NO: 153163 - DNA, 26 bp, Artificial Sequence
  Description of Artificial Sequence: Synthetic oligonucleotide
tgtgaccttgtcctgcagctcccgga

SEQ ID NO: 153164 - DNA, 25 bp, Artificial Sequence
  Description of Artificial Sequence: Synthetic oligonucleotide
gtgaccttgtcctgcagctcccgga

SEQ ID NO: 153165 - DNA, 25 bp, Artificial Sequence
  Description of Artificial Sequence: Synthetic oligonucleotide
tgaccttgtcctgcagctcccggag

SEQ ID NO: 153166 - DNA, 24 bp, Artificial Sequence
  Description of Artificial Sequence: Synthetic oligonucleotide
gaccttgtcctgcagctcccggag

SEQ ID NO: 153167 - DNA, 25 bp, Artificial Sequence
  Description of Artificial Sequence: Synthetic oligonucleotide
accttgtcctgcagctcccggagct

SEQ ID NO: 153168 - DNA, 24 bp, Artificial Sequence
  Description of Artificial Sequence: Synthetic oligonucleotide
ccttgtcctgcagctcccggagct

SEQ ID NO: 153169 - DNA, 24 bp, Artificial Sequence
  Description of Artificial Sequence: Synthetic oligonucleotide
cttgtcctgcagctcccggagctc

SEQ ID NO: 153170 - DNA, 27 bp, Artificial Sequence
  Description of Artificial Sequence: Synthetic oligonucleotide
ttgtcctgcagctcccggagctcctat

SEQ ID NO: 153171 - DNA, 26 bp, Artificial Sequence
  Description of Artificial Sequence: Synthetic oligonucleotide
tgtcctgcagctcccggagctcctat

SEQ ID NO: 153172 - DNA, 25 bp, Artificial Sequence
  Description of Artificial Sequence: Synthetic oligonucleotide
gtcctgcagctcccggagctcctat

SEQ ID NO: 153173 - DNA, 26 bp, Artificial Sequence
  Description of Artificial Sequence: Synthetic oligonucleotide
tcctgcagctcccggagctcctatga

SEQ ID NO: 153174 - DNA, 25 bp, Artificial Sequence
  Description of Artificial Sequence: Synthetic oligonucleotide
cctgcagctcccggagctcctatga

SEQ ID NO: 153175 - DNA, 27 bp, Artificial Sequence
  Description of Artificial Sequence: Synthetic oligonucleotide
ctgcagctcccggagctcctatgacat

SEQ ID NO: 153176 - DNA, 27 bp, Artificial Sequence
  Description of Artificial Sequence: Synthetic oligonucleotide
tgcagctcccggagctcctatgacatg

SEQ ID NO: 153177 - DNA, 27 bp, Artificial Sequence
  Description of Artificial Sequence: Synthetic oligonucleotide
gcagctcccggagctcctatgacatgt

SEQ ID NO: 153178 - DNA, 28 bp, Artificial Sequence
  Description of Artificial Sequence: Synthetic oligonucleotide
cagctcccggagctcctatgacatgtac

SEQ ID NO: 153179 - DNA, 28 bp, Artificial Sequence
  Description of Artificial Sequence: Synthetic oligonucleotide
agctcccggagctcctatgacatgtacc

SEQ ID NO: 153180 - DNA, 27 bp, Artificial Sequence
  Description of Artificial Sequence: Synthetic oligonucleotide
gctcccggagctcctatgacatgtacc

SEQ ID NO: 153181 - DNA, 29 bp, Artificial Sequence
  Description of Artificial Sequence: Synthetic oligonucleotide
ctcccggagctcctatgacatgtaccatc

SEQ ID NO: 153182 - DNA, 32 bp, Artificial Sequence
  Description of Artificial Sequence: Synthetic oligonucleotide
tcccggagctcctatgacatgtaccatctatc

SEQ ID NO: 153183 - DNA, 31 bp, Artificial Sequence
  Description of Artificial Sequence: Synthetic oligonucleotide
cccggagctcctatgacatgtaccatctatc

SEQ ID NO: 153184 - DNA, 31 bp, Artificial Sequence
  Description of Artificial Sequence: Synthetic oligonucleotide
ccggagctcctatgacatgtaccatctatcc

SEQ ID NO: 153185 - DNA, 32 bp, Artificial Sequence
  Description of Artificial Sequence: Synthetic oligonucleotide
cggagctcctatgacatgtaccatctatccag

SEQ ID NO: 153186 - DNA, 32 bp, Artificial Sequence
  Description of Artificial Sequence: Synthetic oligonucleotide
ggagctcctatgacatgtaccatctatccagg

SEQ ID NO: 153187 - DNA, 32 bp, Artificial Sequence
  Description of Artificial Sequence: Synthetic oligonucleotide
gagctcctatgacatgtaccatctatccaggg

SEQ ID NO: 153188 - DNA, 34 bp, Artificial Sequence
  Description of Artificial Sequence: Synthetic oligonucleotide
agctcctatgacatgtaccatctatccagggaag

SEQ ID NO: 153189 - DNA, 33 bp, Artificial Sequence
  Description of Artificial Sequence: Synthetic oligonucleotide
gctcctatgacatgtaccatctatccagggaag

SEQ ID NO: 153190 - DNA, 33 bp, Artificial Sequence
  Description of Artificial Sequence: Synthetic oligonucleotide
ctcctatgacatgtaccatctatccagggaagg

SEQ ID NO: 153191 - DNA, 33 bp, Artificial Sequence
  Description of Artificial Sequence: Synthetic oligonucleotide
tcctatgacatgtaccatctatccagggaaggg

SEQ ID NO: 153192 - DNA, 32 bp, Artificial Sequence
  Description of Artificial Sequence: Synthetic oligonucleotide
cctatgacatgtaccatctatccagggaaggg

SEQ ID NO: 153193 - DNA, 32 bp, Artificial Sequence
  Description of Artificial Sequence: Synthetic oligonucleotide
ctatgacatgtaccatctatccagggaagggg

SEQ ID NO: 153194 - DNA, 33 bp, Artificial Sequence
  Description of Artificial Sequence: Synthetic oligonucleotide
tatgacatgtaccatctatccagggaaggggag

SEQ ID NO: 153195 - DNA, 32 bp, Artificial Sequence
  Description of Artificial Sequence: Synthetic oligonucleotide
atgacatgtaccatctatccagggaaggggag

SEQ ID NO: 153196 - DNA, 31 bp, Artificial Sequence
  Description of Artificial Sequence: Synthetic oligonucleotide
tgacatgtaccatctatccagggaaggggag

SEQ ID NO: 153197 - DNA, 30 bp, Artificial Sequence
  Description of Artificial Sequence: Synthetic oligonucleotide
gacatgtaccatctatccagggaaggggag

SEQ ID NO: 153198 - DNA, 30 bp, Artificial Sequence
  Description of Artificial Sequence: Synthetic oligonucleotide
acatgtaccatctatccagggaaggggagg

SEQ ID NO: 153199 - DNA, 29 bp, Artificial Sequence
  Description of Artificial Sequence: Synthetic oligonucleotide
catgtaccatctatccagggaaggggagg

SEQ ID NO: 153200 - DNA, 29 bp, Artificial Sequence
  Description of Artificial Sequence: Synthetic oligonucleotide
atgtaccatctatccagggaaggggaggc

SEQ ID NO: 153201 - DNA, 28 bp, Artificial Sequence
  Description of Artificial Sequence: Synthetic oligonucleotide
tgtaccatctatccagggaaggggaggc

SEQ ID NO: 153202 - DNA, 27 bp, Artificial Sequence
  Description of Artificial Sequence: Synthetic oligonucleotide
gtaccatctatccagggaaggggaggc

SEQ ID NO: 153203 - DNA, 27 bp, Artificial Sequence
  Description of Artificial Sequence: Synthetic oligonucleotide
taccatctatccagggaaggggaggcc

SEQ ID NO: 153204 - DNA, 26 bp, Artificial Sequence
  Description of Artificial Sequence: Synthetic oligonucleotide
accatctatccagggaaggggaggcc

SEQ ID NO: 153205 - DNA, 25 bp, Artificial Sequence
  Description of Artificial Sequence: Synthetic oligonucleotide
ccatctatccagggaaggggaggcc

SEQ ID NO: 153206 - DNA, 27 bp, Artificial Sequence
  Description of Artificial Sequence: Synthetic oligonucleotide
catctatccagggaaggggaggcccat

SEQ ID NO: 153207 - DNA, 27 bp, Artificial Sequence
  Description of Artificial Sequence: Synthetic oligonucleotide
atctatccagggaaggggaggcccatg

SEQ ID NO: 153208 - DNA, 27 bp, Artificial Sequence
  Description of Artificial Sequence: Synthetic oligonucleotide
tctatccagggaaggggaggcccatga

SEQ ID NO: 153209 - DNA, 27 bp, Artificial Sequence
  Description of Artificial Sequence: Synthetic oligonucleotide
ctatccagggaaggggaggcccatgaa

SEQ ID NO: 153210 - DNA, 27 bp, Artificial Sequence
  Description of Artificial Sequence: Synthetic oligonucleotide
tatccagggaaggggaggcccatgaac

SEQ ID NO: 153211 - DNA, 26 bp, Artificial Sequence
  Description of Artificial Sequence: Synthetic oligonucleotide
atccagggaaggggaggcccatgaac

SEQ ID NO: 153212 - DNA, 25 bp, Artificial Sequence
  Description of Artificial Sequence: Synthetic oligonucleotide
tccagggaaggggaggcccatgaac

SEQ ID NO: 153213 - DNA, 24 bp, Artificial Sequence
  Description of Artificial Sequence: Synthetic oligonucleotide
ccagggaaggggaggcccatgaac

SEQ ID NO: 153214 - DNA, 26 bp, Artificial Sequence
  Description of Artificial Sequence: Synthetic oligonucleotide
cagggaaggggaggcccatgaacgta

SEQ ID NO: 153215 - DNA, 26 bp, Artificial Sequence
  Description of Artificial Sequence: Synthetic oligonucleotide
agggaaggggaggcccatgaacgtag

SEQ ID NO: 153216 - DNA, 25 bp, Artificial Sequence
  Description of Artificial Sequence: Synthetic oligonucleotide
gggaaggggaggcccatgaacgtag

SEQ ID NO: 153217 - DNA, 25 bp, Artificial Sequence
  Description of Artificial Sequence: Synthetic oligonucleotide
ggaaggggaggcccatgaacgtagg

SEQ ID NO: 153218 - DNA, 26 bp, Artificial Sequence
  Description of Artificial Sequence: Synthetic oligonucleotide
gaaggggaggcccatgaacgtaggct

SEQ ID NO: 153219 - DNA, 26 bp, Artificial Sequence
  Description of Artificial Sequence: Synthetic oligonucleotide
aaggggaggcccatgaacgtaggctc

SEQ ID NO: 153220 - DNA, 25 bp, Artificial Sequence
  Description of Artificial Sequence: Synthetic oligonucleotide
aggggaggcccatgaacgtaggctc

SEQ ID NO: 153221 - DNA, 24 bp, Artificial Sequence
  Description of Artificial Sequence: Synthetic oligonucleotide
ggggaggcccatgaacgtaggctc

SEQ ID NO: 153222 - DNA, 24 bp, Artificial Sequence
  Description of Artificial Sequence: Synthetic oligonucleotide
gggaggcccatgaacgtaggctcc

SEQ ID NO: 153223 - DNA, 25 bp, Artificial Sequence
  Description of Artificial Sequence: Synthetic oligonucleotide
ggaggcccatgaacgtaggctccct

SEQ ID NO: 153224 - DNA, 25 bp, Artificial Sequence
  Description of Artificial Sequence: Synthetic oligonucleotide
gaggcccatgaacgtaggctccctg

SEQ ID NO: 153225 - DNA, 26 bp, Artificial Sequence
  Description of Artificial Sequence: Synthetic oligonucleotide
aggcccatgaacgtaggctccctgca

SEQ ID NO: 153226 - DNA, 25 bp, Artificial Sequence
  Description of Artificial Sequence: Synthetic oligonucleotide
ggcccatgaacgtaggctccctgca

SEQ ID NO: 153227 - DNA, 25 bp, Artificial Sequence
  Description of Artificial Sequence: Synthetic oligonucleotide
gcccatgaacgtaggctccctgcag

SEQ ID NO: 153228 - DNA, 25 bp, Artificial Sequence
  Description of Artificial Sequence: Synthetic oligonucleotide
cccatgaacgtaggctccctgcagg

SEQ ID NO: 153229 - DNA, 25 bp, Artificial Sequence
  Description of Artificial Sequence: Synthetic oligonucleotide
ccatgaacgtaggctccctgcaggg

SEQ ID NO: 153230 - DNA, 25 bp, Artificial Sequence
  Description of Artificial Sequence: Synthetic oligonucleotide
catgaacgtaggctccctgcagggc

SEQ ID NO: 153231 - DNA, 25 bp, Artificial Sequence
  Description of Artificial Sequence: Synthetic oligonucleotide
atgaacgtaggctccctgcagggcc

SEQ ID NO: 153232 - DNA, 24 bp, Artificial Sequence
  Description of Artificial Sequence: Synthetic oligonucleotide
tgaacgtaggctccctgcagggcc

SEQ ID NO: 153233 - DNA, 23 bp, Artificial Sequence
  Description of Artificial Sequence: Synthetic oligonucleotide
gaacgtaggctccctgcagggcc

SEQ ID NO: 153234 - DNA, 25 bp, Artificial Sequence
  Description of Artificial Sequence: Synthetic oligonucleotide
aacgtaggctccctgcagggcccaa

SEQ ID NO: 153235 - DNA, 24 bp, Artificial Sequence
  Description of Artificial Sequence: Synthetic oligonucleotide
acgtaggctccctgcagggcccaa

SEQ ID NO: 153236 - DNA, 23 bp, Artificial Sequence
  Description of Artificial Sequence: Synthetic oligonucleotide
cgtaggctccctgcagggcccaa

SEQ ID NO: 153237 - DNA, 23 bp, Artificial Sequence
  Description of Artificial Sequence: Synthetic oligonucleotide
gtaggctccctgcagggcccaag

SEQ ID NO: 153238 - DNA, 24 bp, Artificial Sequence
  Description of Artificial Sequence: Synthetic oligonucleotide
taggctccctgcagggcccaaggt

SEQ ID NO: 153239 - DNA, 23 bp, Artificial Sequence
  Description of Artificial Sequence: Synthetic oligonucleotide
aggctccctgcagggcccaaggt

SEQ ID NO: 153240 - DNA, 22 bp, Artificial Sequence
  Description of Artificial Sequence: Synthetic oligonucleotide
ggctccctgcagggcccaaggt

SEQ ID NO: 153241 - DNA, 24 bp, Artificial Sequence
  Description of Artificial Sequence: Synthetic oligonucleotide
gctccctgcagggcccaaggtcaa

SEQ ID NO: 153242 - DNA, 24 bp, Artificial Sequence
  Description of Artificial Sequence: Synthetic oligonucleotide
ctccctgcagggcccaaggtcaac

SEQ ID NO: 153243 - DNA, 24 bp, Artificial Sequence
  Description of Artificial Sequence: Synthetic oligonucleotide
tccctgcagggcccaaggtcaacg

SEQ ID NO: 153244 - DNA, 23 bp, Artificial Sequence
  Description of Artificial Sequence: Synthetic oligonucleotide
ccctgcagggcccaaggtcaacg

SEQ ID NO: 153245 - DNA, 25 bp, Artificial Sequence
  Description of Artificial Sequence: Synthetic oligonucleotide
cctgcagggcccaaggtcaacggaa

SEQ ID NO: 153246 - DNA, 27 bp, Artificial Sequence
  Description of Artificial Sequence: Synthetic oligonucleotide
ctgcagggcccaaggtcaacggaacat

SEQ ID NO: 153247 - DNA, 28 bp, Artificial Sequence
  Description of Artificial Sequence: Synthetic oligonucleotide
tgcagggcccaaggtcaacggaacattc

SEQ ID NO: 153248 - DNA, 27 bp, Artificial Sequence
  Description of Artificial Sequence: Synthetic oligonucleotide
gcagggcccaaggtcaacggaacattc

SEQ ID NO: 153249 - DNA, 27 bp, Artificial Sequence
  Description of Artificial Sequence: Synthetic oligonucleotide
cagggcccaaggtcaacggaacattcc

SEQ ID NO: 153250 - DNA, 28 bp, Artificial Sequence
  Description of Artificial Sequence: Synthetic oligonucleotide
agggcccaaggtcaacggaacattccag

SEQ ID NO: 153251 - DNA, 27 bp, Artificial Sequence
  Description of Artificial Sequence: Synthetic oligonucleotide
gggcccaaggtcaacggaacattccag

SEQ ID NO: 153252 - DNA, 27 bp, Artificial Sequence
  Description of Artificial Sequence: Synthetic oligonucleotide
ggcccaaggtcaacggaacattccagg

SEQ ID NO: 153253 - DNA, 27 bp, Artificial Sequence
  Description of Artificial Sequence: Synthetic oligonucleotide
gcccaaggtcaacggaacattccaggc

SEQ ID NO: 153254 - DNA, 28 bp, Artificial Sequence
  Description of Artificial Sequence: Synthetic oligonucleotide
cccaaggtcaacggaacattccaggctg

SEQ ID NO: 153255 - DNA, 29 bp, Artificial Sequence
  Description of Artificial Sequence: Synthetic oligonucleotide
ccaaggtcaacggaacattccaggctgac

SEQ ID NO: 153256 - DNA, 32 bp, Artificial Sequence
  Description of Artificial Sequence: Synthetic oligonucleotide
caaggtcaacggaacattccaggctgactttc

SEQ ID NO: 153257 - DNA, 32 bp, Artificial Sequence
  Description of Artificial Sequence: Synthetic oligonucleotide
aaggtcaacggaacattccaggctgactttcc

SEQ ID NO: 153258 - DNA, 31 bp, Artificial Sequence
  Description of Artificial Sequence: Synthetic oligonucleotide
aggtcaacggaacattccaggctgactttcc

SEQ ID NO: 153259 - DNA, 30 bp, Artificial Sequence
  Description of Artificial Sequence: Synthetic oligonucleotide
ggtcaacggaacattccaggctgactttcc

SEQ ID NO: 153260 - DNA, 31 bp, Artificial Sequence
  Description of Artificial Sequence: Synthetic oligonucleotide
gtcaacggaacattccaggctgactttcctc

SEQ ID NO: 153261 - DNA, 32 bp, Artificial Sequence
  Description of Artificial Sequence: Synthetic oligonucleotide
tcaacggaacattccaggctgactttcctctg

SEQ ID NO: 153262 - DNA, 31 bp, Artificial Sequence
  Description of Artificial Sequence: Synthetic oligonucleotide
caacggaacattccaggctgactttcctctg

SEQ ID NO: 153263 - DNA, 31 bp, Artificial Sequence
  Description of Artificial Sequence: Synthetic oligonucleotide
aacggaacattccaggctgactttcctctgg

SEQ ID NO: 153264 - DNA, 30 bp, Artificial Sequence
  Description of Artificial Sequence: Synthetic oligonucleotide
acggaacattccaggctgactttcctctgg

SEQ ID NO: 153265 - DNA, 29 bp, Artificial Sequence
  Description of Artificial Sequence: Synthetic oligonucleotide
cggaacattccaggctgactttcctctgg

SEQ ID NO: 153266 - DNA, 29 bp, Artificial Sequence
  Description of Artificial Sequence: Synthetic oligonucleotide
ggaacattccaggctgactttcctctggg

SEQ ID NO: 153267 - DNA, 29 bp, Artificial Sequence
  Description of Artificial Sequence: Synthetic oligonucleotide
gaacattccaggctgactttcctctgggc

SEQ ID NO: 153268 - DNA, 29 bp, Artificial Sequence
  Description of Artificial Sequence: Synthetic oligonucleotide
aacattccaggctgactttcctctgggcc

SEQ ID NO: 153269 - DNA, 28 bp, Artificial Sequence
  Description of Artificial Sequence: Synthetic oligonucleotide
acattccaggctgactttcctctgggcc

SEQ ID NO: 153270 - DNA, 27 bp, Artificial Sequence
  Description of Artificial Sequence: Synthetic oligonucleotide
cattccaggctgactttcctctgggcc

SEQ ID NO: 153271 - DNA, 27 bp, Artificial Sequence
  Description of Artificial Sequence: Synthetic oligonucleotide
attccaggctgactttcctctgggccc

SEQ ID NO: 153272 - DNA, 27 bp, Artificial Sequence
  Description of Artificial Sequence: Synthetic oligonucleotide
ttccaggctgactttcctctgggccct

SEQ ID NO: 153273 - DNA, 26 bp, Artificial Sequence
  Description of Artificial Sequence: Synthetic oligonucleotide
tccaggctgactttcctctgggccct

SEQ ID NO: 153274 - DNA, 25 bp, Artificial Sequence
  Description of Artificial Sequence: Synthetic oligonucleotide
ccaggctgactttcctctgggccct

SEQ ID NO: 153275 - DNA, 25 bp, Artificial Sequence
  Description of Artificial Sequence: Synthetic oligonucleotide
caggctgactttcctctgggccctg

SEQ ID NO: 153276 - DNA, 25 bp, Artificial Sequence
  Description of Artificial Sequence: Synthetic oligonucleotide
aggctgactttcctctgggccctgc

SEQ ID NO: 153277 - DNA, 24 bp, Artificial Sequence
  Description of Artificial Sequence: Synthetic oligonucleotide
ggctgactttcctctgggccctgc

SEQ ID NO: 153278 - DNA, 25 bp, Artificial Sequence
  Description of Artificial Sequence: Synthetic oligonucleotide
gctgactttcctctgggccctgcca

SEQ ID NO: 153279 - DNA, 25 bp, Artificial Sequence
  Description of Artificial Sequence: Synthetic oligonucleotide
ctgactttcctctgggccctgccac

SEQ ID NO: 153280 - DNA, 25 bp, Artificial Sequence
  Description of Artificial Sequence: Synthetic oligonucleotide
tgactttcctctgggccctgccacc

SEQ ID NO: 153281 - DNA, 24 bp, Artificial Sequence
  Description of Artificial Sequence: Synthetic oligonucleotide
gactttcctctgggccctgccacc

SEQ ID NO: 153282 - DNA, 25 bp, Artificial Sequence
  Description of Artificial Sequence: Synthetic oligonucleotide
actttcctctgggccctgccaccca

SEQ ID NO: 153283 - DNA, 24 bp, Artificial Sequence
  Description of Artificial Sequence: Synthetic oligonucleotide
ctttcctctgggccctgccaccca

SEQ ID NO: 153284 - DNA, 24 bp, Artificial Sequence
  Description of Artificial Sequence: Synthetic oligonucleotide
tttcctctgggccctgccacccac

SEQ ID NO: 153285 - DNA, 23 bp, Artificial Sequence
  Description of Artificial Sequence: Synthetic oligonucleotide
ttcctctgggccctgccacccac

SEQ ID NO: 153286 - DNA, 22 bp, Artificial Sequence
  Description of Artificial Sequence: Synthetic oligonucleotide
tcctctgggccctgccacccac

SEQ ID NO: 153287 - DNA, 21 bp, Artificial Sequence
  Description of Artificial Sequence: Synthetic oligonucleotide
cctctgggccctgccacccac

SEQ ID NO: 153288 - DNA, 21 bp, Artificial Sequence
  Description of Artificial Sequence: Synthetic oligonucleotide
ctctgggccctgccacccacg

SEQ ID NO: 153289 - DNA, 22 bp, Artificial Sequence
  Description of Artificial Sequence: Synthetic oligonucleotide
tctgggccctgccacccacgga

SEQ ID NO: 153290 - DNA, 21 bp, Artificial Sequence
  Description of Artificial Sequence: Synthetic oligonucleotide
ctgggccctgccacccacgga

SEQ ID NO: 153291 - DNA, 21 bp, Artificial Sequence
  Description of Artificial Sequence: Synthetic oligonucleotide
tgggccctgccacccacggag

SEQ ID NO: 153292 - DNA, 20 bp, Artificial Sequence
  Description of Artificial Sequence: Synthetic oligonucleotide
gggccctgccacccacggag

SEQ ID NO: 153293 - DNA, 20 bp, Artificial Sequence
  Description of Artificial Sequence: Synthetic oligonucleotide
ggccctgccacccacggagg

SEQ ID NO: 153294 - DNA, 21 bp, Artificial Sequence
  Description of Artificial Sequence: Synthetic oligonucleotide
gccctgccacccacggaggga

SEQ ID NO: 153295 - DNA, 21 bp, Artificial Sequence
  Description of Artificial Sequence: Synthetic oligonucleotide
ccctgccacccacggagggac

SEQ ID NO: 153296 - DNA, 23 bp, Artificial Sequence
  Description of Artificial Sequence: Synthetic oligonucleotide
cctgccacccacggagggaccta

SEQ ID NO: 153297 - DNA, 24 bp, Artificial Sequence
  Description of Artificial Sequence: Synthetic oligonucleotide
ctgccacccacggagggacctaca

SEQ ID NO: 153298 - DNA, 26 bp, Artificial Sequence
  Description of Artificial Sequence: Synthetic oligonucleotide
tgccacccacggagggacctacagat

SEQ ID NO: 153299 - DNA, 25 bp, Artificial Sequence
  Description of Artificial Sequence: Synthetic oligonucleotide
gccacccacggagggacctacagat

SEQ ID NO: 153300 - DNA, 25 bp, Artificial Sequence
  Description of Artificial Sequence: Synthetic oligonucleotide
ccacccacggagggacctacagatg

SEQ ID NO: 153301 - DNA, 27 bp, Artificial Sequence
  Description of Artificial Sequence: Synthetic oligonucleotide
cacccacggagggacctacagatgctt

SEQ ID NO: 153302 - DNA, 27 bp, Artificial Sequence
  Description of Artificial Sequence: Synthetic oligonucleotide
acccacggagggacctacagatgcttc

SEQ ID NO: 153303 - DNA, 26 bp, Artificial Sequence
  Description of Artificial Sequence: Synthetic oligonucleotide
cccacggagggacctacagatgcttc

SEQ ID NO: 153304 - DNA, 26 bp, Artificial Sequence
  Description of Artificial Sequence: Synthetic oligonucleotide
ccacggagggacctacagatgcttcg

SEQ ID NO: 153305 - DNA, 26 bp, Artificial Sequence
  Description of Artificial Sequence: Synthetic oligonucleotide
cacggagggacctacagatgcttcgg

SEQ ID NO: 153306 - DNA, 27 bp, Artificial Sequence
  Description of Artificial Sequence: Synthetic oligonucleotide
acggagggacctacagatgcttcggct

SEQ ID NO: 153307 - DNA, 26 bp, Artificial Sequence
  Description of Artificial Sequence: Synthetic oligonucleotide
cggagggacctacagatgcttcggct

SEQ ID NO: 153308 - DNA, 27 bp, Artificial Sequence
  Description of Artificial Sequence: Synthetic oligonucleotide
ggagggacctacagatgcttcggctct

SEQ ID NO: 153309 - DNA, 29 bp, Artificial Sequence
  Description of Artificial Sequence: Synthetic oligonucleotide
gagggacctacagatgcttcggctctttc

SEQ ID NO: 153310 - DNA, 29 bp, Artificial Sequence
  Description of Artificial Sequence: Synthetic oligonucleotide
agggacctacagatgcttcggctctttcc

SEQ ID NO: 153311 - DNA, 28 bp, Artificial Sequence
  Description of Artificial Sequence: Synthetic oligonucleotide
gggacctacagatgcttcggctctttcc

SEQ ID NO: 153312 - DNA, 30 bp, Artificial Sequence
  Description of Artificial Sequence: Synthetic oligonucleotide
ggacctacagatgcttcggctctttccatg

SEQ ID NO: 153313 - DNA, 31 bp, Artificial Sequence
  Description of Artificial Sequence: Synthetic oligonucleotide
gacctacagatgcttcggctctttccatgac

SEQ ID NO: 153314 - DNA, 32 bp, Artificial Sequence
  Description of Artificial Sequence: Synthetic oligonucleotide
acctacagatgcttcggctctttccatgactc

SEQ ID NO: 153315 - DNA, 31 bp, Artificial Sequence
  Description of Artificial Sequence: Synthetic oligonucleotide
cctacagatgcttcggctctttccatgactc

SEQ ID NO: 153316 - DNA, 32 bp, Artificial Sequence
  Description of Artificial Sequence: Synthetic oligonucleotide
ctacagatgcttcggctctttccatgactctc

SEQ ID NO: 153317 - DNA, 32 bp, Artificial Sequence
  Description of Artificial Sequence: Synthetic oligonucleotide
tacagatgcttcggctctttccatgactctcc

SEQ ID NO: 153318 - DNA, 31 bp, Artificial Sequence
  Description of Artificial Sequence: Synthetic oligonucleotide
acagatgcttcggctctttccatgactctcc

SEQ ID NO: 153319 - DNA, 30 bp, Artificial Sequence
  Description of Artificial Sequence: Synthetic oligonucleotide
cagatgcttcggctctttccatgactctcc

SEQ ID NO: 153320 - DNA, 33 bp, Artificial Sequence
  Description of Artificial Sequence: Synthetic oligonucleotide
agatgcttcggctctttccatgactctccatac

SEQ ID NO: 153321 - DNA, 32 bp, Artificial Sequence
  Description of Artificial Sequence: Synthetic oligonucleotide
gatgcttcggctctttccatgactctccatac

SEQ ID NO: 153322 - DNA, 32 bp, Artificial Sequence
  Description of Artificial Sequence: Synthetic oligonucleotide
atgcttcggctctttccatgactctccatacg

SEQ ID NO: 153323 - DNA, 31 bp, Artificial Sequence
  Description of Artificial Sequence: Synthetic oligonucleotide
tgcttcggctctttccatgactctccatacg

SEQ ID NO: 153324 - DNA, 30 bp, Artificial Sequence
  Description of Artificial Sequence: Synthetic oligonucleotide
gcttcggctctttccatgactctccatacg

SEQ ID NO: 153325 - DNA, 31 bp, Artificial Sequence
  Description of Artificial Sequence: Synthetic oligonucleotide
cttcggctctttccatgactctccatacgag

SEQ ID NO: 153326 - DNA, 32 bp, Artificial Sequence
  Description of Artificial Sequence: Synthetic oligonucleotide
ttcggctctttccatgactctccatacgagtg

SEQ ID NO: 153327 - DNA, 31 bp, Artificial Sequence
  Description of Artificial Sequence: Synthetic oligonucleotide
tcggctctttccatgactctccatacgagtg

SEQ ID NO: 153328 - DNA, 30 bp, Artificial Sequence
  Description of Artificial Sequence: Synthetic oligonucleotide
cggctctttccatgactctccatacgagtg

SEQ ID NO: 153329 - DNA, 30 bp, Artificial Sequence
  Description of Artificial Sequence: Synthetic oligonucleotide
ggctctttccatgactctccatacgagtgg

SEQ ID NO: 153330 - DNA, 31 bp, Artificial Sequence
  Description of Artificial Sequence: Synthetic oligonucleotide
gctctttccatgactctccatacgagtggtc

SEQ ID NO: 153331 - DNA, 34 bp, Artificial Sequence
  Description of Artificial Sequence: Synthetic oligonucleotide
ctctttccatgactctccatacgagtggtcaaag

SEQ ID NO: 153332 - DNA, 35 bp, Artificial Sequence
  Description of Artificial Sequence: Synthetic oligonucleotide
tctttccatgactctccatacgagtggtcaaagtc

SEQ ID NO: 153333 - DNA, 34 bp, Artificial Sequence
  Description of Artificial Sequence: Synthetic oligonucleotide
ctttccatgactctccatacgagtggtcaaagtc

SEQ ID NO: 153334 - DNA, 36 bp, Artificial Sequence
  Description of Artificial Sequence: Synthetic oligonucleotide
tttccatgactctccatacgagtggtcaaagtcaag

SEQ ID NO: 153335 - DNA, 35 bp, Artificial Sequence
  Description of Artificial Sequence: Synthetic oligonucleotide
ttccatgactctccatacgagtggtcaaagtcaag

SEQ ID NO: 153336 - DNA, 34 bp, Artificial Sequence
  Description of Artificial Sequence: Synthetic oligonucleotide
tccatgactctccatacgagtggtcaaagtcaag

SEQ ID NO: 153337 - DNA, 33 bp, Artificial Sequence
  Description of Artificial Sequence: Synthetic oligonucleotide
ccatgactctccatacgagtggtcaaagtcaag

SEQ ID NO: 153338 - DNA, 34 bp, Artificial Sequence
  Description of Artificial Sequence: Synthetic oligonucleotide
catgactctccatacgagtggtcaaagtcaagtg

SEQ ID NO: 153339 - DNA, 35 bp, Artificial Sequence
  Description of Artificial Sequence: Synthetic oligonucleotide
atgactctccatacgagtggtcaaagtcaagtgac

SEQ ID NO: 153340 - DNA, 34 bp, Artificial Sequence
  Description of Artificial Sequence: Synthetic oligonucleotide
tgactctccatacgagtggtcaaagtcaagtgac

SEQ ID NO: 153341 - DNA, 33 bp, Artificial Sequence
  Description of Artificial Sequence: Synthetic oligonucleotide
gactctccatacgagtggtcaaagtcaagtgac

SEQ ID NO: 153342 - DNA, 33 bp, Artificial Sequence
  Description of Artificial Sequence: Synthetic oligonucleotide
actctccatacgagtggtcaaagtcaagtgacc

SEQ ID NO: 153343 - DNA, 32 bp, Artificial Sequence
  Description of Artificial Sequence: Synthetic oligonucleotide
ctctccatacgagtggtcaaagtcaagtgacc

SEQ ID NO: 153344 - DNA, 32 bp, Artificial Sequence
  Description of Artificial Sequence: Synthetic oligonucleotide
tctccatacgagtggtcaaagtcaagtgaccc

SEQ ID NO: 153345 - DNA, 31 bp, Artificial Sequence
  Description of Artificial Sequence: Synthetic oligonucleotide
ctccatacgagtggtcaaagtcaagtgaccc

SEQ ID NO: 153346 - DNA, 32 bp, Artificial Sequence
  Description of Artificial Sequence: Synthetic oligonucleotide
tccatacgagtggtcaaagtcaagtgacccac

SEQ ID NO: 153347 - DNA, 31 bp, Artificial Sequence
  Description of Artificial Sequence: Synthetic oligonucleotide
ccatacgagtggtcaaagtcaagtgacccac

SEQ ID NO: 153348 - DNA, 32 bp, Artificial Sequence
  Description of Artificial Sequence: Synthetic oligonucleotide
catacgagtggtcaaagtcaagtgacccactg

SEQ ID NO: 153349 - DNA, 32 bp, Artificial Sequence
  Description of Artificial Sequence: Synthetic oligonucleotide
atacgagtggtcaaagtcaagtgacccactgc

SEQ ID NO: 153350 - DNA, 31 bp, Artificial Sequence
  Description of Artificial Sequence: Synthetic oligonucleotide
tacgagtggtcaaagtcaagtgacccactgc

SEQ ID NO: 153351 - DNA, 30 bp, Artificial Sequence
  Description of Artificial Sequence: Synthetic oligonucleotide
acgagtggtcaaagtcaagtgacccactgc

SEQ ID NO: 153352 - DNA, 29 bp, Artificial Sequence
  Description of Artificial Sequence: Synthetic oligonucleotide
cgagtggtcaaagtcaagtgacccactgc

SEQ ID NO: 153353 - DNA, 31 bp, Artificial Sequence
  Description of Artificial Sequence: Synthetic oligonucleotide
gagtggtcaaagtcaagtgacccactgcttg

SEQ ID NO: 153354 - DNA, 34 bp, Artificial Sequence
  Description of Artificial Sequence: Synthetic oligonucleotide
agtggtcaaagtcaagtgacccactgcttgtttc

SEQ ID NO: 153355 - DNA, 33 bp, Artificial Sequence
  Description of Artificial Sequence: Synthetic oligonucleotide
gtggtcaaagtcaagtgacccactgcttgtttc

SEQ ID NO: 153356 - DNA, 34 bp, Artificial Sequence
  Description of Artificial Sequence: Synthetic oligonucleotide
tggtcaaagtcaagtgacccactgcttgtttctg

SEQ ID NO: 153357 - DNA, 33 bp, Artificial Sequence
  Description of Artificial Sequence: Synthetic oligonucleotide
ggtcaaagtcaagtgacccactgcttgtttctg

SEQ ID NO: 153358 - DNA, 34 bp, Artificial Sequence
  Description of Artificial Sequence: Synthetic oligonucleotide
gtcaaagtcaagtgacccactgcttgtttctgtc

SEQ ID NO: 153359 - DNA, 35 bp, Artificial Sequence
  Description of Artificial Sequence: Synthetic oligonucleotide
tcaaagtcaagtgacccactgcttgtttctgtcac

SEQ ID NO: 153360 - DNA, 34 bp, Artificial Sequence
  Description of Artificial Sequence: Synthetic oligonucleotide
caaagtcaagtgacccactgcttgtttctgtcac

SEQ ID NO: 153361 - DNA, 35 bp, Artificial Sequence
  Description of Artificial Sequence: Synthetic oligonucleotide
aaagtcaagtgacccactgcttgtttctgtcacag

SEQ ID NO: 153362 - DNA, 34 bp, Artificial Sequence
  Description of Artificial Sequence: Synthetic oligonucleotide
aagtcaagtgacccactgcttgtttctgtcacag

SEQ ID NO: 153363 - DNA, 33 bp, Artificial Sequence
  Description of Artificial Sequence: Synthetic oligonucleotide
agtcaagtgacccactgcttgtttctgtcacag

SEQ ID NO: 153364 - DNA, 32 bp, Artificial Sequence
  Description of Artificial Sequence: Synthetic oligonucleotide
gtcaagtgacccactgcttgtttctgtcacag

SEQ ID NO: 153365 - DNA, 32 bp, Artificial Sequence
  Description of Artificial Sequence: Synthetic oligonucleotide
tcaagtgacccactgcttgtttctgtcacagg

SEQ ID NO: 153366 - DNA, 31 bp, Artificial Sequence
  Description of Artificial Sequence: Synthetic oligonucleotide
caagtgacccactgcttgtttctgtcacagg

SEQ ID NO: 153367 - DNA, 34 bp, Artificial Sequence
  Description of Artificial Sequence: Synthetic oligonucleotide
aagtgacccactgcttgtttctgtcacaggaaac

SEQ ID NO: 153368 - DNA, 33 bp, Artificial Sequence
  Description of Artificial Sequence: Synthetic oligonucleotide
agtgacccactgcttgtttctgtcacaggaaac

SEQ ID NO: 153369 - DNA, 32 bp, Artificial Sequence
  Description of Artificial Sequence: Synthetic oligonucleotide
gtgacccactgcttgtttctgtcacaggaaac

SEQ ID NO: 153370 - DNA, 32 bp, Artificial Sequence
  Description of Artificial Sequence: Synthetic oligonucleotide
tgacccactgcttgtttctgtcacaggaaacc

SEQ ID NO: 153371 - DNA, 31 bp, Artificial Sequence
  Description of Artificial Sequence: Synthetic oligonucleotide
gacccactgcttgtttctgtcacaggaaacc

SEQ ID NO: 153372 - DNA, 31 bp, Artificial Sequence
  Description of Artificial Sequence: Synthetic oligonucleotide
acccactgcttgtttctgtcacaggaaaccc

SEQ ID NO: 153373 - DNA, 30 bp, Artificial Sequence
  Description of Artificial Sequence: Synthetic oligonucleotide
cccactgcttgtttctgtcacaggaaaccc

SEQ ID NO: 153374 - DNA, 32 bp, Artificial Sequence
  Description of Artificial Sequence: Synthetic oligonucleotide
ccactgcttgtttctgtcacaggaaacccttc

SEQ ID NO: 153375 - DNA, 37 bp, Artificial Sequence
  Description of Artificial Sequence: Synthetic oligonucleotide
cactgcttgtttctgtcacaggaaacccttcaaatag

SEQ ID NO: 153376 - DNA, 39 bp, Artificial Sequence
  Description of Artificial Sequence: Synthetic oligonucleotide
actgcttgtttctgtcacaggaaacccttcaaatagttg

SEQ ID NO: 153377 - DNA, 38 bp, Artificial Sequence
  Description of Artificial Sequence: Synthetic oligonucleotide
ctgcttgtttctgtcacaggaaacccttcaaatagttg

SEQ ID NO: 153378 - DNA, 38 bp, Artificial Sequence
  Description of Artificial Sequence: Synthetic oligonucleotide
tgcttgtttctgtcacaggaaacccttcaaatagttgg

SEQ ID NO: 153379 - DNA, 37 bp, Artificial Sequence
  Description of Artificial Sequence: Synthetic oligonucleotide
gcttgtttctgtcacaggaaacccttcaaatagttgg

SEQ ID NO: 153380 - DNA, 37 bp, Artificial Sequence
  Description of Artificial Sequence: Synthetic oligonucleotide
cttgtttctgtcacaggaaacccttcaaatagttggc

SEQ ID NO: 153381 - DNA, 37 bp, Artificial Sequence
  Description of Artificial Sequence: Synthetic oligonucleotide
ttgtttctgtcacaggaaacccttcaaatagttggcc

SEQ ID NO: 153382 - DNA, 36 bp, Artificial Sequence
  Description of Artificial Sequence: Synthetic oligonucleotide
tgtttctgtcacaggaaacccttcaaatagttggcc

SEQ ID NO: 153383 - DNA, 35 bp, Artificial Sequence
  Description of Artificial Sequence: Synthetic oligonucleotide
gtttctgtcacaggaaacccttcaaatagttggcc

SEQ ID NO: 153384 - DNA, 37 bp, Artificial Sequence
  Description of Artificial Sequence: Synthetic oligonucleotide
tttctgtcacaggaaacccttcaaatagttggccttc

SEQ ID NO: 153385 - DNA, 36 bp, Artificial Sequence
  Description of Artificial Sequence: Synthetic oligonucleotide
ttctgtcacaggaaacccttcaaatagttggccttc

SEQ ID NO: 153386 - DNA, 35 bp, Artificial Sequence
  Description of Artificial Sequence: Synthetic oligonucleotide
tctgtcacaggaaacccttcaaatagttggccttc

SEQ ID NO: 153387 - DNA, 34 bp, Artificial Sequence
  Description of Artificial Sequence: Synthetic oligonucleotide
ctgtcacaggaaacccttcaaatagttggccttc

SEQ ID NO: 153388 - DNA, 35 bp, Artificial Sequence
  Description of Artificial Sequence: Synthetic oligonucleotide
tgtcacaggaaacccttcaaatagttggccttcac

SEQ ID NO: 153389 - DNA, 34 bp, Artificial Sequence
  Description of Artificial Sequence: Synthetic oligonucleotide
gtcacaggaaacccttcaaatagttggccttcac

SEQ ID NO: 153390 - DNA, 34 bp, Artificial Sequence
  Description of Artificial Sequence: Synthetic oligonucleotide
tcacaggaaacccttcaaatagttggccttcacc

SEQ ID NO: 153391 - DNA, 33 bp, Artificial Sequence
  Description of Artificial Sequence: Synthetic oligonucleotide
cacaggaaacccttcaaatagttggccttcacc

SEQ ID NO: 153392 - DNA, 33 bp, Artificial Sequence
  Description of Artificial Sequence: Synthetic oligonucleotide
acaggaaacccttcaaatagttggccttcaccc

SEQ ID NO: 153393 - DNA, 32 bp, Artificial Sequence
  Description of Artificial Sequence: Synthetic oligonucleotide
caggaaacccttcaaatagttggccttcaccc

SEQ ID NO: 153394 - DNA, 33 bp, Artificial Sequence
  Description of Artificial Sequence: Synthetic oligonucleotide
aggaaacccttcaaatagttggccttcacccac

SEQ ID NO: 153395 - DNA, 32 bp, Artificial Sequence
  Description of Artificial Sequence: Synthetic oligonucleotide
ggaaacccttcaaatagttggccttcacccac

SEQ ID NO: 153396 - DNA, 33 bp, Artificial Sequence
  Description of Artificial Sequence: Synthetic oligonucleotide
gaaacccttcaaatagttggccttcacccactg

SEQ ID NO: 153397 - DNA, 35 bp, Artificial Sequence
  Description of Artificial Sequence: Synthetic oligonucleotide
aaacccttcaaatagttggccttcacccactgaac

SEQ ID NO: 153398 - DNA, 34 bp, Artificial Sequence
  Description of Artificial Sequence: Synthetic oligonucleotide
aacccttcaaatagttggccttcacccactgaac

SEQ ID NO: 153399 - DNA, 33 bp, Artificial Sequence
  Description of Artificial Sequence: Synthetic oligonucleotide
acccttcaaatagttggccttcacccactgaac

SEQ ID NO: 153400 - DNA, 32 bp, Artificial Sequence
  Description of Artificial Sequence: Synthetic oligonucleotide
cccttcaaatagttggccttcacccactgaac

SEQ ID NO: 153401 - DNA, 32 bp, Artificial Sequence
  Description of Artificial Sequence: Synthetic oligonucleotide
ccttcaaatagttggccttcacccactgaacc

SEQ ID NO: 153402 - DNA, 34 bp, Artificial Sequence
  Description of Artificial Sequence: Synthetic oligonucleotide
cttcaaatagttggccttcacccactgaaccaag

SEQ ID NO: 153403 - DNA, 34 bp, Artificial Sequence
  Description of Artificial Sequence: Synthetic oligonucleotide
ttcaaatagttggccttcacccactgaaccaagc

SEQ ID NO: 153404 - DNA, 33 bp, Artificial Sequence
  Description of Artificial Sequence: Synthetic oligonucleotide
tcaaatagttggccttcacccactgaaccaagc

SEQ ID NO: 153405 - DNA, 32 bp, Artificial Sequence
  Description of Artificial Sequence: Synthetic oligonucleotide
caaatagttggccttcacccactgaaccaagc

SEQ ID NO: 153406 - DNA, 33 bp, Artificial Sequence
  Description of Artificial Sequence: Synthetic oligonucleotide
aaatagttggccttcacccactgaaccaagctc

SEQ ID NO: 153407 - DNA, 32 bp, Artificial Sequence
  Description of Artificial Sequence: Synthetic oligonucleotide
aatagttggccttcacccactgaaccaagctc

SEQ ID NO: 153408 - DNA, 31 bp, Artificial Sequence
  Description of Artificial Sequence: Synthetic oligonucleotide
atagttggccttcacccactgaaccaagctc

SEQ ID NO: 153409 - DNA, 30 bp, Artificial Sequence
  Description of Artificial Sequence: Synthetic oligonucleotide
tagttggccttcacccactgaaccaagctc

SEQ ID NO: 153410 - DNA, 29 bp, Artificial Sequence
  Description of Artificial Sequence: Synthetic oligonucleotide
agttggccttcacccactgaaccaagctc

SEQ ID NO: 153411 - DNA, 28 bp, Artificial Sequence
  Description of Artificial Sequence: Synthetic oligonucleotide
gttggccttcacccactgaaccaagctc

SEQ ID NO: 153412 - DNA, 28 bp, Artificial Sequence
  Description of Artificial Sequence: Synthetic oligonucleotide
ttggccttcacccactgaaccaagctcc

SEQ ID NO: 153413 - DNA, 27 bp, Artificial Sequence
  Description of Artificial Sequence: Synthetic oligonucleotide
tggccttcacccactgaaccaagctcc

SEQ ID NO: 153414 - DNA, 27 bp, Artificial Sequence
  Description of Artificial Sequence: Synthetic oligonucleotide
ggccttcacccactgaaccaagctcca

SEQ ID NO: 153415 - DNA, 30 bp, Artificial Sequence
  Description of Artificial Sequence: Synthetic oligonucleotide
gccttcacccactgaaccaagctccaaaac

SEQ ID NO: 153416 - DNA, 30 bp, Artificial Sequence
  Description of Artificial Sequence: Synthetic oligonucleotide
ccttcacccactgaaccaagctccaaaacc

SEQ ID NO: 153417 - DNA, 30 bp, Artificial Sequence
  Description of Artificial Sequence: Synthetic oligonucleotide
cttcacccactgaaccaagctccaaaaccg

SEQ ID NO: 153418 - DNA, 30 bp, Artificial Sequence
  Description of Artificial Sequence: Synthetic oligonucleotide
ttcacccactgaaccaagctccaaaaccgg

SEQ ID NO: 153419 - DNA, 29 bp, Artificial Sequence
  Description of Artificial Sequence: Synthetic oligonucleotide
tcacccactgaaccaagctccaaaaccgg

SEQ ID NO: 153420 - DNA, 28 bp, Artificial Sequence
  Description of Artificial Sequence: Synthetic oligonucleotide
cacccactgaaccaagctccaaaaccgg

SEQ ID NO: 153421 - DNA, 31 bp, Artificial Sequence
  Description of Artificial Sequence: Synthetic oligonucleotide
acccactgaaccaagctccaaaaccggtaac

SEQ ID NO: 153422 - DNA, 30 bp, Artificial Sequence
  Description of Artificial Sequence: Synthetic oligonucleotide
cccactgaaccaagctccaaaaccggtaac

SEQ ID NO: 153423 - DNA, 30 bp, Artificial Sequence
  Description of Artificial Sequence: Synthetic oligonucleotide
ccactgaaccaagctccaaaaccggtaacc

SEQ ID NO: 153424 - DNA, 30 bp, Artificial Sequence
  Description of Artificial Sequence: Synthetic oligonucleotide
cactgaaccaagctccaaaaccggtaaccc

SEQ ID NO: 153425 - DNA, 30 bp, Artificial Sequence
  Description of Artificial Sequence: Synthetic oligonucleotide
actgaaccaagctccaaaaccggtaacccc

SEQ ID NO: 153426 - DNA, 29 bp, Artificial Sequence
  Description of Artificial Sequence: Synthetic oligonucleotide
ctgaaccaagctccaaaaccggtaacccc

SEQ ID NO: 153427 - DNA, 29 bp, Artificial Sequence
  Description of Artificial Sequence: Synthetic oligonucleotide
tgaaccaagctccaaaaccggtaaccccc

SEQ ID NO: 153428 - DNA, 28 bp, Artificial Sequence
  Description of Artificial Sequence: Synthetic oligonucleotide
gaaccaagctccaaaaccggtaaccccc

SEQ ID NO: 153429 - DNA, 28 bp, Artificial Sequence
  Description of Artificial Sequence: Synthetic oligonucleotide
aaccaagctccaaaaccggtaacccccg

SEQ ID NO: 153430 - DNA, 27 bp, Artificial Sequence
  Description of Artificial Sequence: Synthetic oligonucleotide
accaagctccaaaaccggtaacccccg

SEQ ID NO: 153431 - DNA, 27 bp, Artificial Sequence
  Description of Artificial Sequence: Synthetic oligonucleotide
ccaagctccaaaaccggtaacccccga

SEQ ID NO: 153432 - DNA, 27 bp, Artificial Sequence
  Description of Artificial Sequence: Synthetic oligonucleotide
caagctccaaaaccggtaacccccgac

SEQ ID NO: 153433 - DNA, 28 bp, Artificial Sequence
  Description of Artificial Sequence: Synthetic oligonucleotide
aagctccaaaaccggtaacccccgacac

SEQ ID NO: 153434 - DNA, 27 bp, Artificial Sequence
  Description of Artificial Sequence: Synthetic oligonucleotide
agctccaaaaccggtaacccccgacac

SEQ ID NO: 153435 - DNA, 26 bp, Artificial Sequence
  Description of Artificial Sequence: Synthetic oligonucleotide
gctccaaaaccggtaacccccgacac

SEQ ID NO: 153436 - DNA, 27 bp, Artificial Sequence
  Description of Artificial Sequence: Synthetic oligonucleotide
ctccaaaaccggtaacccccgacacct

SEQ ID NO: 153437 - DNA, 27 bp, Artificial Sequence
  Description of Artificial Sequence: Synthetic oligonucleotide
tccaaaaccggtaacccccgacacctg

SEQ ID NO: 153438 - DNA, 26 bp, Artificial Sequence
  Description of Artificial Sequence: Synthetic oligonucleotide
ccaaaaccggtaacccccgacacctg

SEQ ID NO: 153439 - DNA, 27 bp, Artificial Sequence
  Description of Artificial Sequence: Synthetic oligonucleotide
caaaaccggtaacccccgacacctgca

SEQ ID NO: 153440 - DNA, 27 bp, Artificial Sequence
  Description of Artificial Sequence: Synthetic oligonucleotide
aaaaccggtaacccccgacacctgcac

SEQ ID NO: 153441 - DNA, 27 bp, Artificial Sequence
  Description of Artificial Sequence: Synthetic oligonucleotide
aaaccggtaacccccgacacctgcaca

SEQ ID NO: 153442 - DNA, 27 bp, Artificial Sequence
  Description of Artificial Sequence: Synthetic oligonucleotide
aaccggtaacccccgacacctgcacat

SEQ ID NO: 153443 - DNA, 27 bp, Artificial Sequence
  Description of Artificial Sequence: Synthetic oligonucleotide
accggtaacccccgacacctgcacatt

SEQ ID NO: 153444 - DNA, 26 bp, Artificial Sequence
  Description of Artificial Sequence: Synthetic oligonucleotide
ccggtaacccccgacacctgcacatt

SEQ ID NO: 153445 - DNA, 27 bp, Artificial Sequence
  Description of Artificial Sequence: Synthetic oligonucleotide
cggtaacccccgacacctgcacattct

SEQ ID NO: 153446 - DNA, 27 bp, Artificial Sequence
  Description of Artificial Sequence: Synthetic oligonucleotide
ggtaacccccgacacctgcacattctg

SEQ ID NO: 153447 - DNA, 30 bp, Artificial Sequence
  Description of Artificial Sequence: Synthetic oligonucleotide
gtaacccccgacacctgcacattctgattg

SEQ ID NO: 153448 - DNA, 30 bp, Artificial Sequence
  Description of Artificial Sequence: Synthetic oligonucleotide
taacccccgacacctgcacattctgattgg

SEQ ID NO: 153449 - DNA, 29 bp, Artificial Sequence
  Description of Artificial Sequence: Synthetic oligonucleotide
aacccccgacacctgcacattctgattgg

SEQ ID NO: 153450 - DNA, 28 bp, Artificial Sequence
  Description of Artificial Sequence: Synthetic oligonucleotide
acccccgacacctgcacattctgattgg

SEQ ID NO: 153451 - DNA, 27 bp, Artificial Sequence
  Description of Artificial Sequence: Synthetic oligonucleotide
cccccgacacctgcacattctgattgg

SEQ ID NO: 153452 - DNA, 27 bp, Artificial Sequence
  Description of Artificial Sequence: Synthetic oligonucleotide
ccccgacacctgcacattctgattggg

SEQ ID NO: 153453 - DNA, 28 bp, Artificial Sequence
  Description of Artificial Sequence: Synthetic oligonucleotide
cccgacacctgcacattctgattgggac

SEQ ID NO: 153454 - DNA, 28 bp, Artificial Sequence
  Description of Artificial Sequence: Synthetic oligonucleotide
ccgacacctgcacattctgattgggacc

SEQ ID NO: 153455 - DNA, 29 bp, Artificial Sequence
  Description of Artificial Sequence: Synthetic oligonucleotide
cgacacctgcacattctgattgggacctc

SEQ ID NO: 153456 - DNA, 30 bp, Artificial Sequence
  Description of Artificial Sequence: Synthetic oligonucleotide
gacacctgcacattctgattgggacctcag

SEQ ID NO: 153457 - DNA, 31 bp, Artificial Sequence
  Description of Artificial Sequence: Synthetic oligonucleotide
acacctgcacattctgattgggacctcagtg

SEQ ID NO: 153458 - DNA, 30 bp, Artificial Sequence
  Description of Artificial Sequence: Synthetic oligonucleotide
cacctgcacattctgattgggacctcagtg

SEQ ID NO: 153459 - DNA, 30 bp, Artificial Sequence
  Description of Artificial Sequence: Synthetic oligonucleotide
acctgcacattctgattgggacctcagtgg

SEQ ID NO: 153460 - DNA, 29 bp, Artificial Sequence
  Description of Artificial Sequence: Synthetic oligonucleotide
cctgcacattctgattgggacctcagtgg

SEQ ID NO: 153461 - DNA, 30 bp, Artificial Sequence
  Description of Artificial Sequence: Synthetic oligonucleotide
ctgcacattctgattgggacctcagtggtc

SEQ ID NO: 153462 - DNA, 32 bp, Artificial Sequence
  Description of Artificial Sequence: Synthetic oligonucleotide
tgcacattctgattgggacctcagtggtcatc

SEQ ID NO: 153463 - DNA, 31 bp, Artificial Sequence
  Description of Artificial Sequence: Synthetic oligonucleotide
gcacattctgattgggacctcagtggtcatc

SEQ ID NO: 153464 - DNA, 33 bp, Artificial Sequence
  Description of Artificial Sequence: Synthetic oligonucleotide
cacattctgattgggacctcagtggtcatcatc

SEQ ID NO: 153465 - DNA, 33 bp, Artificial Sequence
  Description of Artificial Sequence: Synthetic oligonucleotide
acattctgattgggacctcagtggtcatcatcc

SEQ ID NO: 153466 - DNA, 32 bp, Artificial Sequence
  Description of Artificial Sequence: Synthetic oligonucleotide
cattctgattgggacctcagtggtcatcatcc

SEQ ID NO: 153467 - DNA, 33 bp, Artificial Sequence
  Description of Artificial Sequence: Synthetic oligonucleotide
attctgattgggacctcagtggtcatcatcctc

SEQ ID NO: 153468 - DNA, 32 bp, Artificial Sequence
  Description of Artificial Sequence: Synthetic oligonucleotide
ttctgattgggacctcagtggtcatcatcctc

SEQ ID NO: 153469 - DNA, 31 bp, Artificial Sequence
  Description of Artificial Sequence: Synthetic oligonucleotide
tctgattgggacctcagtggtcatcatcctc

SEQ ID NO: 153470 - DNA, 30 bp, Artificial Sequence
  Description of Artificial Sequence: Synthetic oligonucleotide
ctgattgggacctcagtggtcatcatcctc

SEQ ID NO: 153471 - DNA, 32 bp, Artificial Sequence
  Description of Artificial Sequence: Synthetic oligonucleotide
tgattgggacctcagtggtcatcatcctcttc

SEQ ID NO: 153472 - DNA, 31 bp, Artificial Sequence
  Description of Artificial Sequence: Synthetic oligonucleotide
gattgggacctcagtggtcatcatcctcttc

SEQ ID NO: 153473 - DNA, 33 bp, Artificial Sequence
  Description of Artificial Sequence: Synthetic oligonucleotide
attgggacctcagtggtcatcatcctcttcatc

SEQ ID NO: 153474 - DNA, 32 bp, Artificial Sequence
  Description of Artificial Sequence: Synthetic oligonucleotide
ttgggacctcagtggtcatcatcctcttcatc

SEQ ID NO: 153475 - DNA, 31 bp, Artificial Sequence
  Description of Artificial Sequence: Synthetic oligonucleotide
tgggacctcagtggtcatcatcctcttcatc

SEQ ID NO: 153476 - DNA, 30 bp, Artificial Sequence
  Description of Artificial Sequence: Synthetic oligonucleotide
gggacctcagtggtcatcatcctcttcatc

SEQ ID NO: 153477 - DNA, 30 bp, Artificial Sequence
  Description of Artificial Sequence: Synthetic oligonucleotide
ggacctcagtggtcatcatcctcttcatcc

SEQ ID NO: 153478 - DNA, 31 bp, Artificial Sequence
  Description of Artificial Sequence: Synthetic oligonucleotide
gacctcagtggtcatcatcctcttcatcctc

SEQ ID NO: 153479 - DNA, 31 bp, Artificial Sequence
  Description of Artificial Sequence: Synthetic oligonucleotide
acctcagtggtcatcatcctcttcatcctcc

SEQ ID NO: 153480 - DNA, 30 bp, Artificial Sequence
  Description of Artificial Sequence: Synthetic oligonucleotide
cctcagtggtcatcatcctcttcatcctcc

SEQ ID NO: 153481 - DNA, 31 bp, Artificial Sequence
  Description of Artificial Sequence: Synthetic oligonucleotide
ctcagtggtcatcatcctcttcatcctcctc

SEQ ID NO: 153482 - DNA, 33 bp, Artificial Sequence
  Description of Artificial Sequence: Synthetic oligonucleotide
tcagtggtcatcatcctcttcatcctcctcttc

SEQ ID NO: 153483 - DNA, 32 bp, Artificial Sequence
  Description of Artificial Sequence: Synthetic oligonucleotide
cagtggtcatcatcctcttcatcctcctcttc

SEQ ID NO: 153484 - DNA, 35 bp, Artificial Sequence
  Description of Artificial Sequence: Synthetic oligonucleotide
agtggtcatcatcctcttcatcctcctcttctttc

SEQ ID NO: 153485 - DNA, 34 bp, Artificial Sequence
  Description of Artificial Sequence: Synthetic oligonucleotide
gtggtcatcatcctcttcatcctcctcttctttc

SEQ ID NO: 153486 - DNA, 35 bp, Artificial Sequence
  Description of Artificial Sequence: Synthetic oligonucleotide
tggtcatcatcctcttcatcctcctcttctttctc

SEQ ID NO: 153487 - DNA, 34 bp, Artificial Sequence
  Description of Artificial Sequence: Synthetic oligonucleotide
ggtcatcatcctcttcatcctcctcttctttctc

SEQ ID NO: 153488 - DNA, 34 bp, Artificial Sequence
  Description of Artificial Sequence: Synthetic oligonucleotide
gtcatcatcctcttcatcctcctcttctttctcc

SEQ ID NO: 153489 - DNA, 36 bp, Artificial Sequence
  Description of Artificial Sequence: Synthetic oligonucleotide
tcatcatcctcttcatcctcctcttctttctccttc

SEQ ID NO: 153490 - DNA, 35 bp, Artificial Sequence
  Description of Artificial Sequence: Synthetic oligonucleotide
catcatcctcttcatcctcctcttctttctccttc

SEQ ID NO: 153491 - DNA, 37 bp, Artificial Sequence
  Description of Artificial Sequence: Synthetic oligonucleotide
atcatcctcttcatcctcctcttctttctccttcatc

SEQ ID NO: 153492 - DNA, 36 bp, Artificial Sequence
  Description of Artificial Sequence: Synthetic oligonucleotide
tcatcctcttcatcctcctcttctttctccttcatc

SEQ ID NO: 153493 - DNA, 35 bp, Artificial Sequence
  Description of Artificial Sequence: Synthetic oligonucleotide
catcctcttcatcctcctcttctttctccttcatc

SEQ ID NO: 153494 - DNA, 35 bp, Artificial Sequence
  Description of Artificial Sequence: Synthetic oligonucleotide
atcctcttcatcctcctcttctttctccttcatcg

SEQ ID NO: 153495 - DNA, 34 bp, Artificial Sequence
  Description of Artificial Sequence: Synthetic oligonucleotide
tcctcttcatcctcctcttctttctccttcatcg

SEQ ID NO: 153496 - DNA, 33 bp, Artificial Sequence
  Description of Artificial Sequence: Synthetic oligonucleotide
cctcttcatcctcctcttctttctccttcatcg

SEQ ID NO: 153497 - DNA, 33 bp, Artificial Sequence
  Description of Artificial Sequence: Synthetic oligonucleotide
ctcttcatcctcctcttctttctccttcatcgc

SEQ ID NO: 153498 - DNA, 34 bp, Artificial Sequence
  Description of Artificial Sequence: Synthetic oligonucleotide
tcttcatcctcctcttctttctccttcatcgctg

SEQ ID NO: 153499 - DNA, 33 bp, Artificial Sequence
  Description of Artificial Sequence: Synthetic oligonucleotide
cttcatcctcctcttctttctccttcatcgctg

SEQ ID NO: 153500 - DNA, 33 bp, Artificial Sequence
  Description of Artificial Sequence: Synthetic oligonucleotide
ttcatcctcctcttctttctccttcatcgctgg

SEQ ID NO: 153501 - DNA, 32 bp, Artificial Sequence
  Description of Artificial Sequence: Synthetic oligonucleotide
tcatcctcctcttctttctccttcatcgctgg

SEQ ID NO: 153502 - DNA, 31 bp, Artificial Sequence
  Description of Artificial Sequence: Synthetic oligonucleotide
catcctcctcttctttctccttcatcgctgg

SEQ ID NO: 153503 - DNA, 32 bp, Artificial Sequence
  Description of Artificial Sequence: Synthetic oligonucleotide
atcctcctcttctttctccttcatcgctggtg

SEQ ID NO: 153504 - DNA, 31 bp, Artificial Sequence
  Description of Artificial Sequence: Synthetic oligonucleotide
tcctcctcttctttctccttcatcgctggtg

SEQ ID NO: 153505 - DNA, 30 bp, Artificial Sequence
  Description of Artificial Sequence: Synthetic oligonucleotide
cctcctcttctttctccttcatcgctggtg

SEQ ID NO: 153506 - DNA, 30 bp, Artificial Sequence
  Description of Artificial Sequence: Synthetic oligonucleotide
ctcctcttctttctccttcatcgctggtgc

SEQ ID NO: 153507 - DNA, 31 bp, Artificial Sequence
  Description of Artificial Sequence: Synthetic oligonucleotide
tcctcttctttctccttcatcgctggtgctc

SEQ ID NO: 153508 - DNA, 30 bp, Artificial Sequence
  Description of Artificial Sequence: Synthetic oligonucleotide
cctcttctttctccttcatcgctggtgctc

SEQ ID NO: 153509 - DNA, 30 bp, Artificial Sequence
  Description of Artificial Sequence: Synthetic oligonucleotide
ctcttctttctccttcatcgctggtgctcc

SEQ ID NO: 153510 - DNA, 32 bp, Artificial Sequence
  Description of Artificial Sequence: Synthetic oligonucleotide
tcttctttctccttcatcgctggtgctccaac

SEQ ID NO: 153511 - DNA, 31 bp, Artificial Sequence
  Description of Artificial Sequence: Synthetic oligonucleotide
cttctttctccttcatcgctggtgctccaac

SEQ ID NO: 153512 - DNA, 40 bp, Artificial Sequence
  Description of Artificial Sequence: Synthetic oligonucleotide
ttctttctccttcatcgctggtgctccaacaaaaaaaatg

SEQ ID NO: 153513 - DNA, 39 bp, Artificial Sequence
  Description of Artificial Sequence: Synthetic oligonucleotide
tctttctccttcatcgctggtgctccaacaaaaaaaatg

SEQ ID NO: 153514 - DNA, 38 bp, Artificial Sequence
  Description of Artificial Sequence: Synthetic oligonucleotide
ctttctccttcatcgctggtgctccaacaaaaaaaatg

SEQ ID NO: 153515 - DNA, 38 bp, Artificial Sequence
  Description of Artificial Sequence: Synthetic oligonucleotide
tttctccttcatcgctggtgctccaacaaaaaaaatgc

SEQ ID NO: 153516 - DNA, 37 bp, Artificial Sequence
  Description of Artificial Sequence: Synthetic oligonucleotide
ttctccttcatcgctggtgctccaacaaaaaaaatgc

SEQ ID NO: 153517 - DNA, 36 bp, Artificial Sequence
  Description of Artificial Sequence: Synthetic oligonucleotide
tctccttcatcgctggtgctccaacaaaaaaaatgc

SEQ ID NO: 153518 - DNA, 35 bp, Artificial Sequence
  Description of Artificial Sequence: Synthetic oligonucleotide
ctccttcatcgctggtgctccaacaaaaaaaatgc

SEQ ID NO: 153519 - DNA, 36 bp, Artificial Sequence
  Description of Artificial Sequence: Synthetic oligonucleotide
tccttcatcgctggtgctccaacaaaaaaaatgctg

SEQ ID NO: 153520 - DNA, 35 bp, Artificial Sequence
  Description of Artificial Sequence: Synthetic oligonucleotide
ccttcatcgctggtgctccaacaaaaaaaatgctg

SEQ ID NO: 153521 - DNA, 35 bp, Artificial Sequence
  Description of Artificial Sequence: Synthetic oligonucleotide
cttcatcgctggtgctccaacaaaaaaaatgctgc

SEQ ID NO: 153522 - DNA, 35 bp, Artificial Sequence
  Description of Artificial Sequence: Synthetic oligonucleotide
ttcatcgctggtgctccaacaaaaaaaatgctgcg

SEQ ID NO: 153523 - DNA, 34 bp, Artificial Sequence
  Description of Artificial Sequence: Synthetic oligonucleotide
tcatcgctggtgctccaacaaaaaaaatgctgcg

SEQ ID NO: 153524 - DNA, 33 bp, Artificial Sequence
  Description of Artificial Sequence: Synthetic oligonucleotide
catcgctggtgctccaacaaaaaaaatgctgcg

SEQ ID NO: 153525 - DNA, 33 bp, Artificial Sequence
  Description of Artificial Sequence: Synthetic oligonucleotide
atcgctggtgctccaacaaaaaaaatgctgcgg

SEQ ID NO: 153526 - DNA, 32 bp, Artificial Sequence
  Description of Artificial Sequence: Synthetic oligonucleotide
tcgctggtgctccaacaaaaaaaatgctgcgg

SEQ ID NO: 153527 - DNA, 31 bp, Artificial Sequence
  Description of Artificial Sequence: Synthetic oligonucleotide
cgctggtgctccaacaaaaaaaatgctgcgg

SEQ ID NO: 153528 - DNA, 35 bp, Artificial Sequence
  Description of Artificial Sequence: Synthetic oligonucleotide
gctggtgctccaacaaaaaaaatgctgcggtaatg

SEQ ID NO: 153529 - DNA, 35 bp, Artificial Sequence
  Description of Artificial Sequence: Synthetic oligonucleotide
ctggtgctccaacaaaaaaaatgctgcggtaatgg

SEQ ID NO: 153530 - DNA, 36 bp, Artificial Sequence
  Description of Artificial Sequence: Synthetic oligonucleotide
tggtgctccaacaaaaaaaatgctgcggtaatggac

SEQ ID NO: 153531 - DNA, 35 bp, Artificial Sequence
  Description of Artificial Sequence: Synthetic oligonucleotide
ggtgctccaacaaaaaaaatgctgcggtaatggac

SEQ ID NO: 153532 - DNA, 35 bp, Artificial Sequence
  Description of Artificial Sequence: Synthetic oligonucleotide
gtgctccaacaaaaaaaatgctgcggtaatggacc

SEQ ID NO: 153533 - DNA, 37 bp, Artificial Sequence
  Description of Artificial Sequence: Synthetic oligonucleotide
tgctccaacaaaaaaaatgctgcggtaatggaccaag

SEQ ID NO: 153534 - DNA, 36 bp, Artificial Sequence
  Description of Artificial Sequence: Synthetic oligonucleotide
gctccaacaaaaaaaatgctgcggtaatggaccaag

SEQ ID NO: 153535 - DNA, 37 bp, Artificial Sequence
  Description of Artificial Sequence: Synthetic oligonucleotide
ctccaacaaaaaaaatgctgcggtaatggaccaagag

SEQ ID NO: 153536 - DNA, 38 bp, Artificial Sequence
  Description of Artificial Sequence: Synthetic oligonucleotide
tccaacaaaaaaaatgctgcggtaatggaccaagagtc

SEQ ID NO: 153537 - DNA, 37 bp, Artificial Sequence
  Description of Artificial Sequence: Synthetic oligonucleotide
ccaacaaaaaaaatgctgcggtaatggaccaagagtc

SEQ ID NO: 153538 - DNA, 38 bp, Artificial Sequence
  Description of Artificial Sequence: Synthetic oligonucleotide
caacaaaaaaaatgctgcggtaatggaccaagagtctg

SEQ ID NO: 153539 - DNA, 38 bp, Artificial Sequence
  Description of Artificial Sequence: Synthetic oligonucleotide
aacaaaaaaaatgctgcggtaatggaccaagagtctgc

SEQ ID NO: 153540 - DNA, 37 bp, Artificial Sequence
  Description of Artificial Sequence: Synthetic oligonucleotide
acaaaaaaaatgctgcggtaatggaccaagagtctgc

SEQ ID NO: 153541 - DNA, 36 bp, Artificial Sequence
  Description of Artificial Sequence: Synthetic oligonucleotide
caaaaaaaatgctgcggtaatggaccaagagtctgc

SEQ ID NO: 153542 - DNA, 37 bp, Artificial Sequence
  Description of Artificial Sequence: Synthetic oligonucleotide
aaaaaaaatgctgcggtaatggaccaagagtctgcag

SEQ ID NO: 153543 - DNA, 36 bp, Artificial Sequence
  Description of Artificial Sequence: Synthetic oligonucleotide
aaaaaaatgctgcggtaatggaccaagagtctgcag

SEQ ID NO: 153544 - DNA, 35 bp, Artificial Sequence
  Description of Artificial Sequence: Synthetic oligonucleotide
aaaaaatgctgcggtaatggaccaagagtctgcag

SEQ ID NO: 153545 - DNA, 34 bp, Artificial Sequence
  Description of Artificial Sequence: Synthetic oligonucleotide
aaaaatgctgcggtaatggaccaagagtctgcag

SEQ ID NO: 153546 - DNA, 33 bp, Artificial Sequence
  Description of Artificial Sequence: Synthetic oligonucleotide
aaaatgctgcggtaatggaccaagagtctgcag

SEQ ID NO: 153547 - DNA, 32 bp, Artificial Sequence
  Description of Artificial Sequence: Synthetic oligonucleotide
aaatgctgcggtaatggaccaagagtctgcag

SEQ ID NO: 153548 - DNA, 31 bp, Artificial Sequence
  Description of Artificial Sequence: Synthetic oligonucleotide
aatgctgcggtaatggaccaagagtctgcag

SEQ ID NO: 153549 - DNA, 30 bp, Artificial Sequence
  Description of Artificial Sequence: Synthetic oligonucleotide
atgctgcggtaatggaccaagagtctgcag

SEQ ID NO: 153550 - DNA, 29 bp, Artificial Sequence
  Description of Artificial Sequence: Synthetic oligonucleotide
tgctgcggtaatggaccaagagtctgcag

SEQ ID NO: 153551 - DNA, 28 bp, Artificial Sequence
  Description of Artificial Sequence: Synthetic oligonucleotide
gctgcggtaatggaccaagagtctgcag

SEQ ID NO: 153552 - DNA, 28 bp, Artificial Sequence
  Description of Artificial Sequence: Synthetic oligonucleotide
ctgcggtaatggaccaagagtctgcagg

SEQ ID NO: 153553 - DNA, 31 bp, Artificial Sequence
  Description of Artificial Sequence: Synthetic oligonucleotide
tgcggtaatggaccaagagtctgcaggaaac

SEQ ID NO: 153554 - DNA, 30 bp, Artificial Sequence
  Description of Artificial Sequence: Synthetic oligonucleotide
gcggtaatggaccaagagtctgcaggaaac

SEQ ID NO: 153555 - DNA, 31 bp, Artificial Sequence
  Description of Artificial Sequence: Synthetic oligonucleotide
cggtaatggaccaagagtctgcaggaaacag

SEQ ID NO: 153556 - DNA, 33 bp, Artificial Sequence
  Description of Artificial Sequence: Synthetic oligonucleotide
ggtaatggaccaagagtctgcaggaaacagaac

SEQ ID NO: 153557 - DNA, 34 bp, Artificial Sequence
  Description of Artificial Sequence: Synthetic oligonucleotide
gtaatggaccaagagtctgcaggaaacagaacag

SEQ ID NO: 153558 - DNA, 34 bp, Artificial Sequence
  Description of Artificial Sequence: Synthetic oligonucleotide
taatggaccaagagtctgcaggaaacagaacagc

SEQ ID NO: 153559 - DNA, 33 bp, Artificial Sequence
  Description of Artificial Sequence: Synthetic oligonucleotide
aatggaccaagagtctgcaggaaacagaacagc

SEQ ID NO: 153560 - DNA, 32 bp, Artificial Sequence
  Description of Artificial Sequence: Synthetic oligonucleotide
atggaccaagagtctgcaggaaacagaacagc

SEQ ID NO: 153561 - DNA, 31 bp, Artificial Sequence
  Description of Artificial Sequence: Synthetic oligonucleotide
tggaccaagagtctgcaggaaacagaacagc

SEQ ID NO: 153562 - DNA, 30 bp, Artificial Sequence
  Description of Artificial Sequence: Synthetic oligonucleotide
ggaccaagagtctgcaggaaacagaacagc

SEQ ID NO: 153563 - DNA, 30 bp, Artificial Sequence
  Description of Artificial Sequence: Synthetic oligonucleotide
gaccaagagtctgcaggaaacagaacagcg

SEQ ID NO: 153564 - DNA, 34 bp, Artificial Sequence
  Description of Artificial Sequence: Synthetic oligonucleotide
accaagagtctgcaggaaacagaacagcgaatag

SEQ ID NO: 153565 - DNA, 33 bp, Artificial Sequence
  Description of Artificial Sequence: Synthetic oligonucleotide
ccaagagtctgcaggaaacagaacagcgaatag

SEQ ID NO: 153566 - DNA, 33 bp, Artificial Sequence
  Description of Artificial Sequence: Synthetic oligonucleotide
caagagtctgcaggaaacagaacagcgaatagc

SEQ ID NO: 153567 - DNA, 33 bp, Artificial Sequence
  Description of Artificial Sequence: Synthetic oligonucleotide
aagagtctgcaggaaacagaacagcgaatagcg

SEQ ID NO: 153568 - DNA, 32 bp, Artificial Sequence
  Description of Artificial Sequence: Synthetic oligonucleotide
agagtctgcaggaaacagaacagcgaatagcg

SEQ ID NO: 153569 - DNA, 31 bp, Artificial Sequence
  Description of Artificial Sequence: Synthetic oligonucleotide
gagtctgcaggaaacagaacagcgaatagcg

SEQ ID NO: 153570 - DNA, 32 bp, Artificial Sequence
  Description of Artificial Sequence: Synthetic oligonucleotide
agtctgcaggaaacagaacagcgaatagcgag

SEQ ID NO: 153571 - DNA, 31 bp, Artificial Sequence
  Description of Artificial Sequence: Synthetic oligonucleotide
gtctgcaggaaacagaacagcgaatagcgag

SEQ ID NO: 153572 - DNA, 31 bp, Artificial Sequence
  Description of Artificial Sequence: Synthetic oligonucleotide
tctgcaggaaacagaacagcgaatagcgagg

SEQ ID NO: 153573 - DNA, 30 bp, Artificial Sequence
  Description of Artificial Sequence: Synthetic oligonucleotide
ctgcaggaaacagaacagcgaatagcgagg

SEQ ID NO: 153574 - DNA, 31 bp, Artificial Sequence
  Description of Artificial Sequence: Synthetic oligonucleotide
tgcaggaaacagaacagcgaatagcgaggac

SEQ ID NO: 153575 - DNA, 30 bp, Artificial Sequence
  Description of Artificial Sequence: Synthetic oligonucleotide
gcaggaaacagaacagcgaatagcgaggac

SEQ ID NO: 153576 - DNA, 31 bp, Artificial Sequence
  Description of Artificial Sequence: Synthetic oligonucleotide
caggaaacagaacagcgaatagcgaggactc

SEQ ID NO: 153577 - DNA, 32 bp, Artificial Sequence
  Description of Artificial Sequence: Synthetic oligonucleotide
aggaaacagaacagcgaatagcgaggactctg

SEQ ID NO: 153578 - DNA, 31 bp, Artificial Sequence
  Description of Artificial Sequence: Synthetic oligonucleotide
ggaaacagaacagcgaatagcgaggactctg

SEQ ID NO: 153579 - DNA, 33 bp, Artificial Sequence
  Description of Artificial Sequence: Synthetic oligonucleotide
gaaacagaacagcgaatagcgaggactctgatg

SEQ ID NO: 153580 - DNA, 35 bp, Artificial Sequence
  Description of Artificial Sequence: Synthetic oligonucleotide
aaacagaacagcgaatagcgaggactctgatgaac

SEQ ID NO: 153581 - DNA, 34 bp, Artificial Sequence
  Description of Artificial Sequence: Synthetic oligonucleotide
aacagaacagcgaatagcgaggactctgatgaac

SEQ ID NO: 153582 - DNA, 33 bp, Artificial Sequence
  Description of Artificial Sequence: Synthetic oligonucleotide
acagaacagcgaatagcgaggactctgatgaac

SEQ ID NO: 153583 - DNA, 32 bp, Artificial Sequence
  Description of Artificial Sequence: Synthetic oligonucleotide
cagaacagcgaatagcgaggactctgatgaac

SEQ ID NO: 153584 - DNA, 34 bp, Artificial Sequence
  Description of Artificial Sequence: Synthetic oligonucleotide
agaacagcgaatagcgaggactctgatgaacaag

SEQ ID NO: 153585 - DNA, 33 bp, Artificial Sequence
  Description of Artificial Sequence: Synthetic oligonucleotide
gaacagcgaatagcgaggactctgatgaacaag

SEQ ID NO: 153586 - DNA, 34 bp, Artificial Sequence
  Description of Artificial Sequence: Synthetic oligonucleotide
aacagcgaatagcgaggactctgatgaacaagac

SEQ ID NO: 153587 - DNA, 33 bp, Artificial Sequence
  Description of Artificial Sequence: Synthetic oligonucleotide
acagcgaatagcgaggactctgatgaacaagac

SEQ ID NO: 153588 - DNA, 32 bp, Artificial Sequence
  Description of Artificial Sequence: Synthetic oligonucleotide
cagcgaatagcgaggactctgatgaacaagac

SEQ ID NO: 153589 - DNA, 32 bp, Artificial Sequence
  Description of Artificial Sequence: Synthetic oligonucleotide
agcgaatagcgaggactctgatgaacaagacc

SEQ ID NO: 153590 - DNA, 31 bp, Artificial Sequence
  Description of Artificial Sequence: Synthetic oligonucleotide
gcgaatagcgaggactctgatgaacaagacc

SEQ ID NO: 153591 - DNA, 31 bp, Artificial Sequence
  Description of Artificial Sequence: Synthetic oligonucleotide
cgaatagcgaggactctgatgaacaagaccc

SEQ ID NO: 153592 - DNA, 32 bp, Artificial Sequence
  Description of Artificial Sequence: Synthetic oligonucleotide
gaatagcgaggactctgatgaacaagaccctc

SEQ ID NO: 153593 - DNA, 33 bp, Artificial Sequence
  Description of Artificial Sequence: Synthetic oligonucleotide
aatagcgaggactctgatgaacaagaccctcag

SEQ ID NO: 153594 - DNA, 32 bp, Artificial Sequence
  Description of Artificial Sequence: Synthetic oligonucleotide
atagcgaggactctgatgaacaagaccctcag

SEQ ID NO: 153595 - DNA, 31 bp, Artificial Sequence
  Description of Artificial Sequence: Synthetic oligonucleotide
tagcgaggactctgatgaacaagaccctcag

SEQ ID NO: 153596 - DNA, 30 bp, Artificial Sequence
  Description of Artificial Sequence: Synthetic oligonucleotide
agcgaggactctgatgaacaagaccctcag

SEQ ID NO: 153597 - DNA, 29 bp, Artificial Sequence
  Description of Artificial Sequence: Synthetic oligonucleotide
gcgaggactctgatgaacaagaccctcag

SEQ ID NO: 153598 - DNA, 29 bp, Artificial Sequence
  Description of Artificial Sequence: Synthetic oligonucleotide
cgaggactctgatgaacaagaccctcagg

SEQ ID NO: 153599 - DNA, 30 bp, Artificial Sequence
  Description of Artificial Sequence: Synthetic oligonucleotide
gaggactctgatgaacaagaccctcaggag

SEQ ID NO: 153600 - DNA, 30 bp, Artificial Sequence
  Description of Artificial Sequence: Synthetic oligonucleotide
aggactctgatgaacaagaccctcaggagg

SEQ ID NO: 153601 - DNA, 29 bp, Artificial Sequence
  Description of Artificial Sequence: Synthetic oligonucleotide
ggactctgatgaacaagaccctcaggagg

SEQ ID NO: 153602 - DNA, 30 bp, Artificial Sequence
  Description of Artificial Sequence: Synthetic oligonucleotide
gactctgatgaacaagaccctcaggaggtg

SEQ ID NO: 153603 - DNA, 31 bp, Artificial Sequence
  Description of Artificial Sequence: Synthetic oligonucleotide
actctgatgaacaagaccctcaggaggtgac

SEQ ID NO: 153604 - DNA, 30 bp, Artificial Sequence
  Description of Artificial Sequence: Synthetic oligonucleotide
ctctgatgaacaagaccctcaggaggtgac

SEQ ID NO: 153605 - DNA, 33 bp, Artificial Sequence
  Description of Artificial Sequence: Synthetic oligonucleotide
tctgatgaacaagaccctcaggaggtgacatac

SEQ ID NO: 153606 - DNA, 32 bp, Artificial Sequence
  Description of Artificial Sequence: Synthetic oligonucleotide
ctgatgaacaagaccctcaggaggtgacatac

SEQ ID NO: 153607 - DNA, 33 bp, Artificial Sequence
  Description of Artificial Sequence: Synthetic oligonucleotide
tgatgaacaagaccctcaggaggtgacatacac

SEQ ID NO: 153608 - DNA, 32 bp, Artificial Sequence
  Description of Artificial Sequence: Synthetic oligonucleotide
gatgaacaagaccctcaggaggtgacatacac

SEQ ID NO: 153609 - DNA, 33 bp, Artificial Sequence
  Description of Artificial Sequence: Synthetic oligonucleotide
atgaacaagaccctcaggaggtgacatacacac

SEQ ID NO: 153610 - DNA, 32 bp, Artificial Sequence
  Description of Artificial Sequence: Synthetic oligonucleotide
tgaacaagaccctcaggaggtgacatacacac

SEQ ID NO: 153611 - DNA, 31 bp, Artificial Sequence
  Description of Artificial Sequence: Synthetic oligonucleotide
gaacaagaccctcaggaggtgacatacacac

SEQ ID NO: 153612 - DNA, 32 bp, Artificial Sequence
  Description of Artificial Sequence: Synthetic oligonucleotide
aacaagaccctcaggaggtgacatacacacag

SEQ ID NO: 153613 - DNA, 31 bp, Artificial Sequence
  Description of Artificial Sequence: Synthetic oligonucleotide
acaagaccctcaggaggtgacatacacacag

SEQ ID NO: 153614 - DNA, 30 bp, Artificial Sequence
  Description of Artificial Sequence: Synthetic oligonucleotide
caagaccctcaggaggtgacatacacacag

SEQ ID NO: 153615 - DNA, 32 bp, Artificial Sequence
  Description of Artificial Sequence: Synthetic oligonucleotide
aagaccctcaggaggtgacatacacacagttg

SEQ ID NO: 153616 - DNA, 31 bp, Artificial Sequence
  Description of Artificial Sequence: Synthetic oligonucleotide
agaccctcaggaggtgacatacacacagttg

SEQ ID NO: 153617 - DNA, 30 bp, Artificial Sequence
  Description of Artificial Sequence: Synthetic oligonucleotide
gaccctcaggaggtgacatacacacagttg

SEQ ID NO: 153618 - DNA, 33 bp, Artificial Sequence
  Description of Artificial Sequence: Synthetic oligonucleotide
accctcaggaggtgacatacacacagttgaatc

SEQ ID NO: 153619 - DNA, 32 bp, Artificial Sequence
  Description of Artificial Sequence: Synthetic oligonucleotide
ccctcaggaggtgacatacacacagttgaatc

SEQ ID NO: 153620 - DNA, 33 bp, Artificial Sequence
  Description of Artificial Sequence: Synthetic oligonucleotide
cctcaggaggtgacatacacacagttgaatcac

SEQ ID NO: 153621 - DNA, 34 bp, Artificial Sequence
  Description of Artificial Sequence: Synthetic oligonucleotide
ctcaggaggtgacatacacacagttgaatcactg

SEQ ID NO: 153622 - DNA, 34 bp, Artificial Sequence
  Description of Artificial Sequence: Synthetic oligonucleotide
tcaggaggtgacatacacacagttgaatcactgc

SEQ ID NO: 153623 - DNA, 33 bp, Artificial Sequence
  Description of Artificial Sequence: Synthetic oligonucleotide
caggaggtgacatacacacagttgaatcactgc

SEQ ID NO: 153624 - DNA, 33 bp, Artificial Sequence
  Description of Artificial Sequence: Synthetic oligonucleotide
aggaggtgacatacacacagttgaatcactgcg

SEQ ID NO: 153625 - DNA, 32 bp, Artificial Sequence
  Description of Artificial Sequence: Synthetic oligonucleotide
ggaggtgacatacacacagttgaatcactgcg

SEQ ID NO: 153626 - DNA, 36 bp, Artificial Sequence
  Description of Artificial Sequence: Synthetic oligonucleotide
gaggtgacatacacacagttgaatcactgcgttttc

SEQ ID NO: 153627 - DNA, 37 bp, Artificial Sequence
  Description of Artificial Sequence: Synthetic oligonucleotide
aggtgacatacacacagttgaatcactgcgttttcac

SEQ ID NO: 153628 - DNA, 36 bp, Artificial Sequence
  Description of Artificial Sequence: Synthetic oligonucleotide
ggtgacatacacacagttgaatcactgcgttttcac

SEQ ID NO: 153629 - DNA, 37 bp, Artificial Sequence
  Description of Artificial Sequence: Synthetic oligonucleotide
gtgacatacacacagttgaatcactgcgttttcacac

SEQ ID NO: 153630 - DNA, 38 bp, Artificial Sequence
  Description of Artificial Sequence: Synthetic oligonucleotide
tgacatacacacagttgaatcactgcgttttcacacag

SEQ ID NO: 153631 - DNA, 37 bp, Artificial Sequence
  Description of Artificial Sequence: Synthetic oligonucleotide
gacatacacacagttgaatcactgcgttttcacacag

SEQ ID NO: 153632 - DNA, 38 bp, Artificial Sequence
  Description of Artificial Sequence: Synthetic oligonucleotide
acatacacacagttgaatcactgcgttttcacacagag

SEQ ID NO: 153633 - DNA, 37 bp, Artificial Sequence
  Description of Artificial Sequence: Synthetic oligonucleotide
catacacacagttgaatcactgcgttttcacacagag

SEQ ID NO: 153634 - DNA, 43 bp, Artificial Sequence
  Description of Artificial Sequence: Synthetic oligonucleotide
atacacacagttgaatcactgcgttttcacacagagaaaaatc

SEQ ID NO: 153635 - DNA, 42 bp, Artificial Sequence
  Description of Artificial Sequence: Synthetic oligonucleotide
tacacacagttgaatcactgcgttttcacacagagaaaaatc

SEQ ID NO: 153636 - DNA, 41 bp, Artificial Sequence
  Description of Artificial Sequence: Synthetic oligonucleotide
acacacagttgaatcactgcgttttcacacagagaaaaatc

SEQ ID NO: 153637 - DNA, 40 bp, Artificial Sequence
  Description of Artificial Sequence: Synthetic oligonucleotide
cacacagttgaatcactgcgttttcacacagagaaaaatc

SEQ ID NO: 153638 - DNA, 41 bp, Artificial Sequence
  Description of Artificial Sequence: Synthetic oligonucleotide
acacagttgaatcactgcgttttcacacagagaaaaatcac

SEQ ID NO: 153639 - DNA, 40 bp, Artificial Sequence
  Description of Artificial Sequence: Synthetic oligonucleotide
cacagttgaatcactgcgttttcacacagagaaaaatcac

SEQ ID NO: 153640 - DNA, 41 bp, Artificial Sequence
  Description of Artificial Sequence: Synthetic oligonucleotide
acagttgaatcactgcgttttcacacagagaaaaatcactc

SEQ ID NO: 153641 - DNA, 40 bp, Artificial Sequence
  Description of Artificial Sequence: Synthetic oligonucleotide
cagttgaatcactgcgttttcacacagagaaaaatcactc

SEQ ID NO: 153642 - DNA, 40 bp, Artificial Sequence
  Description of Artificial Sequence: Synthetic oligonucleotide
agttgaatcactgcgttttcacacagagaaaaatcactcg

SEQ ID NO: 153643 - DNA, 39 bp, Artificial Sequence
  Description of Artificial Sequence: Synthetic oligonucleotide
gttgaatcactgcgttttcacacagagaaaaatcactcg

SEQ ID NO: 153644 - DNA, 39 bp, Artificial Sequence
  Description of Artificial Sequence: Synthetic oligonucleotide
ttgaatcactgcgttttcacacagagaaaaatcactcgc

SEQ ID NO: 153645 - DNA, 38 bp, Artificial Sequence
  Description of Artificial Sequence: Synthetic oligonucleotide
tgaatcactgcgttttcacacagagaaaaatcactcgc

SEQ ID NO: 153646 - DNA, 37 bp, Artificial Sequence
  Description of Artificial Sequence: Synthetic oligonucleotide
gaatcactgcgttttcacacagagaaaaatcactcgc

SEQ ID NO: 153647 - DNA, 37 bp, Artificial Sequence
  Description of Artificial Sequence: Synthetic oligonucleotide
aatcactgcgttttcacacagagaaaaatcactcgcc

SEQ ID NO: 153648 - DNA, 36 bp, Artificial Sequence
  Description of Artificial Sequence: Synthetic oligonucleotide
atcactgcgttttcacacagagaaaaatcactcgcc

SEQ ID NO: 153649 - DNA, 35 bp, Artificial Sequence
  Description of Artificial Sequence: Synthetic oligonucleotide
tcactgcgttttcacacagagaaaaatcactcgcc

SEQ ID NO: 153650 - DNA, 34 bp, Artificial Sequence
  Description of Artificial Sequence: Synthetic oligonucleotide
cactgcgttttcacacagagaaaaatcactcgcc

SEQ ID NO: 153651 - DNA, 34 bp, Artificial Sequence
  Description of Artificial Sequence: Synthetic oligonucleotide
actgcgttttcacacagagaaaaatcactcgccc

SEQ ID NO: 153652 - DNA, 33 bp, Artificial Sequence
  Description of Artificial Sequence: Synthetic oligonucleotide
ctgcgttttcacacagagaaaaatcactcgccc

SEQ ID NO: 153653 - DNA, 35 bp, Artificial Sequence
  Description of Artificial Sequence: Synthetic oligonucleotide
tgcgttttcacacagagaaaaatcactcgcccttc

SEQ ID NO: 153654 - DNA, 34 bp, Artificial Sequence
  Description of Artificial Sequence: Synthetic oligonucleotide
gcgttttcacacagagaaaaatcactcgcccttc

SEQ ID NO: 153655 - DNA, 35 bp, Artificial Sequence
  Description of Artificial Sequence: Synthetic oligonucleotide
cgttttcacacagagaaaaatcactcgcccttctc

SEQ ID NO: 153656 - DNA, 36 bp, Artificial Sequence
  Description of Artificial Sequence: Synthetic oligonucleotide
gttttcacacagagaaaaatcactcgcccttctcag

SEQ ID NO: 153657 - DNA, 37 bp, Artificial Sequence
  Description of Artificial Sequence: Synthetic oligonucleotide
ttttcacacagagaaaaatcactcgcccttctcagag

SEQ ID NO: 153658 - DNA, 36 bp, Artificial Sequence
  Description of Artificial Sequence: Synthetic oligonucleotide
tttcacacagagaaaaatcactcgcccttctcagag

SEQ ID NO: 153659 - DNA, 35 bp, Artificial Sequence
  Description of Artificial Sequence: Synthetic oligonucleotide
ttcacacagagaaaaatcactcgcccttctcagag

SEQ ID NO: 153660 - DNA, 34 bp, Artificial Sequence
  Description of Artificial Sequence: Synthetic oligonucleotide
tcacacagagaaaaatcactcgcccttctcagag

SEQ ID NO: 153661 - DNA, 33 bp, Artificial Sequence
  Description of Artificial Sequence: Synthetic oligonucleotide
cacacagagaaaaatcactcgcccttctcagag

SEQ ID NO: 153662 - DNA, 33 bp, Artificial Sequence
  Description of Artificial Sequence: Synthetic oligonucleotide
acacagagaaaaatcactcgcccttctcagagg

SEQ ID NO: 153663 - DNA, 32 bp, Artificial Sequence
  Description of Artificial Sequence: Synthetic oligonucleotide
cacagagaaaaatcactcgcccttctcagagg

SEQ ID NO: 153664 - DNA, 32 bp, Artificial Sequence
  Description of Artificial Sequence: Synthetic oligonucleotide
acagagaaaaatcactcgcccttctcagaggc

SEQ ID NO: 153665 - DNA, 31 bp, Artificial Sequence
  Description of Artificial Sequence: Synthetic oligonucleotide
cagagaaaaatcactcgcccttctcagaggc

SEQ ID NO: 153666 - DNA, 31 bp, Artificial Sequence
  Description of Artificial Sequence: Synthetic oligonucleotide
agagaaaaatcactcgcccttctcagaggcc

SEQ ID NO: 153667 - DNA, 30 bp, Artificial Sequence
  Description of Artificial Sequence: Synthetic oligonucleotide
gagaaaaatcactcgcccttctcagaggcc

SEQ ID NO: 153668 - DNA, 30 bp, Artificial Sequence
  Description of Artificial Sequence: Synthetic oligonucleotide
agaaaaatcactcgcccttctcagaggccc

SEQ ID NO: 153669 - DNA, 29 bp, Artificial Sequence
  Description of Artificial Sequence: Synthetic oligonucleotide
gaaaaatcactcgcccttctcagaggccc

SEQ ID NO: 153670 - DNA, 31 bp, Artificial Sequence
  Description of Artificial Sequence: Synthetic oligonucleotide
aaaaatcactcgcccttctcagaggcccaag

SEQ ID NO: 153671 - DNA, 30 bp, Artificial Sequence
  Description of Artificial Sequence: Synthetic oligonucleotide
aaaatcactcgcccttctcagaggcccaag

SEQ ID NO: 153672 - DNA, 29 bp, Artificial Sequence
  Description of Artificial Sequence: Synthetic oligonucleotide
aaatcactcgcccttctcagaggcccaag

SEQ ID NO: 153673 - DNA, 28 bp, Artificial Sequence
  Description of Artificial Sequence: Synthetic oligonucleotide
aatcactcgcccttctcagaggcccaag

SEQ ID NO: 153674 - DNA, 27 bp, Artificial Sequence
  Description of Artificial Sequence: Synthetic oligonucleotide
atcactcgcccttctcagaggcccaag

SEQ ID NO: 153675 - DNA, 27 bp, Artificial Sequence
  Description of Artificial Sequence: Synthetic oligonucleotide
tcactcgcccttctcagaggcccaaga

SEQ ID NO: 153676 - DNA, 26 bp, Artificial Sequence
  Description of Artificial Sequence: Synthetic oligonucleotide
cactcgcccttctcagaggcccaaga

SEQ ID NO: 153677 - DNA, 27 bp, Artificial Sequence
  Description of Artificial Sequence: Synthetic oligonucleotide
actcgcccttctcagaggcccaagaca

SEQ ID NO: 153678 - DNA, 26 bp, Artificial Sequence
  Description of Artificial Sequence: Synthetic oligonucleotide
ctcgcccttctcagaggcccaagaca

SEQ ID NO: 153679 - DNA, 26 bp, Artificial Sequence
  Description of Artificial Sequence: Synthetic oligonucleotide
tcgcccttctcagaggcccaagacac

SEQ ID NO: 153680 - DNA, 25 bp, Artificial Sequence
  Description of Artificial Sequence: Synthetic oligonucleotide
cgcccttctcagaggcccaagacac

SEQ ID NO: 153681 - DNA, 25 bp, Artificial Sequence
  Description of Artificial Sequence: Synthetic oligonucleotide
gcccttctcagaggcccaagacacc

SEQ ID NO: 153682 - DNA, 25 bp, Artificial Sequence
  Description of Artificial Sequence: Synthetic oligonucleotide
cccttctcagaggcccaagacaccc

SEQ ID NO: 153683 - DNA, 25 bp, Artificial Sequence
  Description of Artificial Sequence: Synthetic oligonucleotide
ccttctcagaggcccaagacacccc

SEQ ID NO: 153684 - DNA, 27 bp, Artificial Sequence
  Description of Artificial Sequence: Synthetic oligonucleotide
cttctcagaggcccaagacacccccaa

SEQ ID NO: 153685 - DNA, 27 bp, Artificial Sequence
  Description of Artificial Sequence: Synthetic oligonucleotide
ttctcagaggcccaagacacccccaac

SEQ ID NO: 153686 - DNA, 27 bp, Artificial Sequence
  Description of Artificial Sequence: Synthetic oligonucleotide
tctcagaggcccaagacacccccaaca

SEQ ID NO: 153687 - DNA, 26 bp, Artificial Sequence
  Description of Artificial Sequence: Synthetic oligonucleotide
ctcagaggcccaagacacccccaaca

SEQ ID NO: 153688 - DNA, 27 bp, Artificial Sequence
  Description of Artificial Sequence: Synthetic oligonucleotide
tcagaggcccaagacacccccaacaga

SEQ ID NO: 153689 - DNA, 27 bp, Artificial Sequence
  Description of Artificial Sequence: Synthetic oligonucleotide
cagaggcccaagacacccccaacagat

SEQ ID NO: 153690 - DNA, 29 bp, Artificial Sequence
  Description of Artificial Sequence: Synthetic oligonucleotide
agaggcccaagacacccccaacagatatc

SEQ ID NO: 153691 - DNA, 28 bp, Artificial Sequence
  Description of Artificial Sequence: Synthetic oligonucleotide
gaggcccaagacacccccaacagatatc

SEQ ID NO: 153692 - DNA, 30 bp, Artificial Sequence
  Description of Artificial Sequence: Synthetic oligonucleotide
aggcccaagacacccccaacagatatcatc

SEQ ID NO: 153693 - DNA, 29 bp, Artificial Sequence
  Description of Artificial Sequence: Synthetic oligonucleotide
ggcccaagacacccccaacagatatcatc

SEQ ID NO: 153694 - DNA, 29 bp, Artificial Sequence
  Description of Artificial Sequence: Synthetic oligonucleotide
gcccaagacacccccaacagatatcatcg

SEQ ID NO: 153695 - DNA, 30 bp, Artificial Sequence
  Description of Artificial Sequence: Synthetic oligonucleotide
cccaagacacccccaacagatatcatcgtg

SEQ ID NO: 153696 - DNA, 32 bp, Artificial Sequence
  Description of Artificial Sequence: Synthetic oligonucleotide
ccaagacacccccaacagatatcatcgtgtac

SEQ ID NO: 153697 - DNA, 33 bp, Artificial Sequence
  Description of Artificial Sequence: Synthetic oligonucleotide
caagacacccccaacagatatcatcgtgtacac

SEQ ID NO: 153698 - DNA, 33 bp, Artificial Sequence
  Description of Artificial Sequence: Synthetic oligonucleotide
aagacacccccaacagatatcatcgtgtacacg

SEQ ID NO: 153699 - DNA, 32 bp, Artificial Sequence
  Description of Artificial Sequence: Synthetic oligonucleotide
agacacccccaacagatatcatcgtgtacacg

SEQ ID NO: 153700 - DNA, 31 bp, Artificial Sequence
  Description of Artificial Sequence: Synthetic oligonucleotide
gacacccccaacagatatcatcgtgtacacg

SEQ ID NO: 153701 - DNA, 31 bp, Artificial Sequence
  Description of Artificial Sequence: Synthetic oligonucleotide
acacccccaacagatatcatcgtgtacacgg

SEQ ID NO: 153702 - DNA, 30 bp, Artificial Sequence
  Description of Artificial Sequence: Synthetic oligonucleotide
cacccccaacagatatcatcgtgtacacgg

SEQ ID NO: 153703 - DNA, 32 bp, Artificial Sequence
  Description of Artificial Sequence: Synthetic oligonucleotide
acccccaacagatatcatcgtgtacacggaac

SEQ ID NO: 153704 - DNA, 31 bp, Artificial Sequence
  Description of Artificial Sequence: Synthetic oligonucleotide
cccccaacagatatcatcgtgtacacggaac

SEQ ID NO: 153705 - DNA, 33 bp, Artificial Sequence
  Description of Artificial Sequence: Synthetic oligonucleotide
ccccaacagatatcatcgtgtacacggaacttc

SEQ ID NO: 153706 - DNA, 33 bp, Artificial Sequence
  Description of Artificial Sequence: Synthetic oligonucleotide
cccaacagatatcatcgtgtacacggaacttcc

SEQ ID NO: 153707 - DNA, 37 bp, Artificial Sequence
  Description of Artificial Sequence: Synthetic oligonucleotide
ccaacagatatcatcgtgtacacggaacttccaaatg

SEQ ID NO: 153708 - DNA, 37 bp, Artificial Sequence
  Description of Artificial Sequence: Synthetic oligonucleotide
caacagatatcatcgtgtacacggaacttccaaatgc

SEQ ID NO: 153709 - DNA, 38 bp, Artificial Sequence
  Description of Artificial Sequence: Synthetic oligonucleotide
aacagatatcatcgtgtacacggaacttccaaatgctg

SEQ ID NO: 153710 - DNA, 37 bp, Artificial Sequence
  Description of Artificial Sequence: Synthetic oligonucleotide
acagatatcatcgtgtacacggaacttccaaatgctg

SEQ ID NO: 153711 - DNA, 36 bp, Artificial Sequence
  Description of Artificial Sequence: Synthetic oligonucleotide
cagatatcatcgtgtacacggaacttccaaatgctg

SEQ ID NO: 153712 - DNA, 37 bp, Artificial Sequence
  Description of Artificial Sequence: Synthetic oligonucleotide
agatatcatcgtgtacacggaacttccaaatgctgag

SEQ ID NO: 153713 - DNA, 36 bp, Artificial Sequence
  Description of Artificial Sequence: Synthetic oligonucleotide
gatatcatcgtgtacacggaacttccaaatgctgag

SEQ ID NO: 153714 - DNA, 37 bp, Artificial Sequence
  Description of Artificial Sequence: Synthetic oligonucleotide
atatcatcgtgtacacggaacttccaaatgctgagtc

SEQ ID NO: 153715 - DNA, 36 bp, Artificial Sequence
  Description of Artificial Sequence: Synthetic oligonucleotide
tatcatcgtgtacacggaacttccaaatgctgagtc

SEQ ID NO: 153716 - DNA, 35 bp, Artificial Sequence
  Description of Artificial Sequence: Synthetic oligonucleotide
atcatcgtgtacacggaacttccaaatgctgagtc

SEQ ID NO: 153717 - DNA, 34 bp, Artificial Sequence
  Description of Artificial Sequence: Synthetic oligonucleotide
tcatcgtgtacacggaacttccaaatgctgagtc

SEQ ID NO: 153718 - DNA, 33 bp, Artificial Sequence
  Description of Artificial Sequence: Synthetic oligonucleotide
catcgtgtacacggaacttccaaatgctgagtc

SEQ ID NO: 153719 - DNA, 33 bp, Artificial Sequence
  Description of Artificial Sequence: Synthetic oligonucleotide
atcgtgtacacggaacttccaaatgctgagtcc

SEQ ID NO: 153720 - DNA, 32 bp, Artificial Sequence
  Description of Artificial Sequence: Synthetic oligonucleotide
tcgtgtacacggaacttccaaatgctgagtcc

SEQ ID NO: 153721 - DNA, 31 bp, Artificial Sequence
  Description of Artificial Sequence: Synthetic oligonucleotide
cgtgtacacggaacttccaaatgctgagtcc

SEQ ID NO: 153722 - DNA, 32 bp, Artificial Sequence
  Description of Artificial Sequence: Synthetic oligonucleotide
gtgtacacggaacttccaaatgctgagtccag

SEQ ID NO: 153723 - DNA, 34 bp, Artificial Sequence
  Description of Artificial Sequence: Synthetic oligonucleotide
tgtacacggaacttccaaatgctgagtccagatc

SEQ ID NO: 153724 - DNA, 33 bp, Artificial Sequence
  Description of Artificial Sequence: Synthetic oligonucleotide
gtacacggaacttccaaatgctgagtccagatc

SEQ ID NO: 153725 - DNA, 33 bp, Artificial Sequence
  Description of Artificial Sequence: Synthetic oligonucleotide
tacacggaacttccaaatgctgagtccagatcc

SEQ ID NO: 153726 - DNA, 32 bp, Artificial Sequence
  Description of Artificial Sequence: Synthetic oligonucleotide
acacggaacttccaaatgctgagtccagatcc

SEQ ID NO: 153727 - DNA, 31 bp, Artificial Sequence
  Description of Artificial Sequence: Synthetic oligonucleotide
cacggaacttccaaatgctgagtccagatcc

SEQ ID NO: 153728 - DNA, 34 bp, Artificial Sequence
  Description of Artificial Sequence: Synthetic oligonucleotide
acggaacttccaaatgctgagtccagatccaaag

SEQ ID NO: 153729 - DNA, 33 bp, Artificial Sequence
  Description of Artificial Sequence: Synthetic oligonucleotide
cggaacttccaaatgctgagtccagatccaaag

SEQ ID NO: 153730 - DNA, 35 bp, Artificial Sequence
  Description of Artificial Sequence: Synthetic oligonucleotide
ggaacttccaaatgctgagtccagatccaaagttg

SEQ ID NO: 153731 - DNA, 36 bp, Artificial Sequence
  Description of Artificial Sequence: Synthetic oligonucleotide
gaacttccaaatgctgagtccagatccaaagttgtc

SEQ ID NO: 153732 - DNA, 37 bp, Artificial Sequence
  Description of Artificial Sequence: Synthetic oligonucleotide
aacttccaaatgctgagtccagatccaaagttgtctc

SEQ ID NO: 153733 - DNA, 36 bp, Artificial Sequence
  Description of Artificial Sequence: Synthetic oligonucleotide
acttccaaatgctgagtccagatccaaagttgtctc

SEQ ID NO: 153734 - DNA, 35 bp, Artificial Sequence
  Description of Artificial Sequence: Synthetic oligonucleotide
cttccaaatgctgagtccagatccaaagttgtctc

SEQ ID NO: 153735 - DNA, 35 bp, Artificial Sequence
  Description of Artificial Sequence: Synthetic oligonucleotide
ttccaaatgctgagtccagatccaaagttgtctcc

SEQ ID NO: 153736 - DNA, 34 bp, Artificial Sequence
  Description of Artificial Sequence: Synthetic oligonucleotide
tccaaatgctgagtccagatccaaagttgtctcc

SEQ ID NO: 153737 - DNA, 33 bp, Artificial Sequence
  Description of Artificial Sequence: Synthetic oligonucleotide
ccaaatgctgagtccagatccaaagttgtctcc

SEQ ID NO: 153738 - DNA, 34 bp, Artificial Sequence
  Description of Artificial Sequence: Synthetic oligonucleotide
caaatgctgagtccagatccaaagttgtctcctg

SEQ ID NO: 153739 - DNA, 34 bp, Artificial Sequence
  Description of Artificial Sequence: Synthetic oligonucleotide
aaatgctgagtccagatccaaagttgtctcctgc

SEQ ID NO: 153740 - DNA, 33 bp, Artificial Sequence
  Description of Artificial Sequence: Synthetic oligonucleotide
aatgctgagtccagatccaaagttgtctcctgc

SEQ ID NO: 153741 - DNA, 32 bp, Artificial Sequence
  Description of Artificial Sequence: Synthetic oligonucleotide
atgctgagtccagatccaaagttgtctcctgc

SEQ ID NO: 153742 - DNA, 31 bp, Artificial Sequence
  Description of Artificial Sequence: Synthetic oligonucleotide
tgctgagtccagatccaaagttgtctcctgc

SEQ ID NO: 153743 - DNA, 30 bp, Artificial Sequence
  Description of Artificial Sequence: Synthetic oligonucleotide
gctgagtccagatccaaagttgtctcctgc

SEQ ID NO: 153744 - DNA, 30 bp, Artificial Sequence
  Description of Artificial Sequence: Synthetic oligonucleotide
ctgagtccagatccaaagttgtctcctgcc

SEQ ID NO: 153745 - DNA, 30 bp, Artificial Sequence
  Description of Artificial Sequence: Synthetic oligonucleotide
tgagtccagatccaaagttgtctcctgccc

SEQ ID NO: 153746 - DNA, 29 bp, Artificial Sequence
  Description of Artificial Sequence: Synthetic oligonucleotide
gagtccagatccaaagttgtctcctgccc

SEQ ID NO: 153747 - DNA, 31 bp, Artificial Sequence
  Description of Artificial Sequence: Synthetic oligonucleotide
agtccagatccaaagttgtctcctgcccatg

SEQ ID NO: 153748 - DNA, 30 bp, Artificial Sequence
  Description of Artificial Sequence: Synthetic oligonucleotide
gtccagatccaaagttgtctcctgcccatg

SEQ ID NO: 153749 - DNA, 29 bp, Artificial Sequence
  Description of Artificial Sequence: Synthetic oligonucleotide
atgtcgctcttgttcgtcagcatggcgtg

SEQ ID NO: 153750 - DNA, 28 bp, Artificial Sequence
  Description of Artificial Sequence: Synthetic oligonucleotide
tgtcgctcttgttcgtcagcatggcgtg

SEQ ID NO: 153751 - DNA, 27 bp, Artificial Sequence
  Description of Artificial Sequence: Synthetic oligonucleotide
gtcgctcttgttcgtcagcatggcgtg

SEQ ID NO: 153752 - DNA, 28 bp, Artificial Sequence
  Description of Artificial Sequence: Synthetic oligonucleotide
tcgctcttgttcgtcagcatggcgtgtg

SEQ ID NO: 153753 - DNA, 27 bp, Artificial Sequence
  Description of Artificial Sequence: Synthetic oligonucleotide
cgctcttgttcgtcagcatggcgtgtg

SEQ ID NO: 153754 - DNA, 29 bp, Artificial Sequence
  Description of Artificial Sequence: Synthetic oligonucleotide
gctcttgttcgtcagcatggcgtgtgttg

SEQ ID NO: 153755 - DNA, 29 bp, Artificial Sequence
  Description of Artificial Sequence: Synthetic oligonucleotide
ctcttgttcgtcagcatggcgtgtgttgg

SEQ ID NO: 153756 - DNA, 29 bp, Artificial Sequence
  Description of Artificial Sequence: Synthetic oligonucleotide
tcttgttcgtcagcatggcgtgtgttggg

SEQ ID NO: 153757 - DNA, 28 bp, Artificial Sequence
  Description of Artificial Sequence: Synthetic oligonucleotide
cttgttcgtcagcatggcgtgtgttggg

SEQ ID NO: 153758 - DNA, 30 bp, Artificial Sequence
  Description of Artificial Sequence: Synthetic oligonucleotide
ttgttcgtcagcatggcgtgtgttgggttc

SEQ ID NO: 153759 - DNA, 29 bp, Artificial Sequence
  Description of Artificial Sequence: Synthetic oligonucleotide
tgttcgtcagcatggcgtgtgttgggttc

SEQ ID NO: 153760 - DNA, 28 bp, Artificial Sequence
  Description of Artificial Sequence: Synthetic oligonucleotide
gttcgtcagcatggcgtgtgttgggttc

SEQ ID NO: 153761 - DNA, 30 bp, Artificial Sequence
  Description of Artificial Sequence: Synthetic oligonucleotide
ttcgtcagcatggcgtgtgttgggttcttc

SEQ ID NO: 153762 - DNA, 21 bp, Artificial Sequence
  Description of Artificial Sequence: Synthetic oligonucleotide
cctcctggcccacccaggtcg

SEQ ID NO: 153763 - DNA, 21 bp, Artificial Sequence
  Description of Artificial Sequence: Synthetic oligonucleotide
ctcctggcccacccaggtcgc

SEQ ID NO: 153764 - DNA, 22 bp, Artificial Sequence
  Description of Artificial Sequence: Synthetic oligonucleotide
tcctggcccacccaggtcgcct

SEQ ID NO: 153765 - DNA, 21 bp, Artificial Sequence
  Description of Artificial Sequence: Synthetic oligonucleotide
cctggcccacccaggtcgcct

SEQ ID NO: 153766 - DNA, 21 bp, Artificial Sequence
  Description of Artificial Sequence: Synthetic oligonucleotide
ctggcccacccaggtcgcctg

SEQ ID NO: 153767 - DNA, 22 bp, Artificial Sequence
  Description of Artificial Sequence: Synthetic oligonucleotide
tggcccacccaggtcgcctggt

SEQ ID NO: 153768 - DNA, 21 bp, Artificial Sequence
  Description of Artificial Sequence: Synthetic oligonucleotide
ggcccacccaggtcgcctggt

SEQ ID NO: 153769 - DNA, 25 bp, Artificial Sequence
  Description of Artificial Sequence: Synthetic oligonucleotide
gcccacccaggtcgcctggtgaaat

SEQ ID NO: 153770 - DNA, 26 bp, Artificial Sequence
  Description of Artificial Sequence: Synthetic oligonucleotide
cccacccaggtcgcctggtgaaatca

SEQ ID NO: 153771 - DNA, 27 bp, Artificial Sequence
  Description of Artificial Sequence: Synthetic oligonucleotide
ccacccaggtcgcctggtgaaatcaga

SEQ ID NO: 153772 - DNA, 28 bp, Artificial Sequence
  Description of Artificial Sequence: Synthetic oligonucleotide
cacccaggtcgcctggtgaaatcagaag

SEQ ID NO: 153773 - DNA, 29 bp, Artificial Sequence
  Description of Artificial Sequence: Synthetic oligonucleotide
acccaggtcgcctggtgaaatcagaagag

SEQ ID NO: 153774 - DNA, 28 bp, Artificial Sequence
  Description of Artificial Sequence: Synthetic oligonucleotide
cccaggtcgcctggtgaaatcagaagag

SEQ ID NO: 153775 - DNA, 29 bp, Artificial Sequence
  Description of Artificial Sequence: Synthetic oligonucleotide
ccaggtcgcctggtgaaatcagaagagac

SEQ ID NO: 153776 - DNA, 30 bp, Artificial Sequence
  Description of Artificial Sequence: Synthetic oligonucleotide
caggtcgcctggtgaaatcagaagagacag

SEQ ID NO: 153777 - DNA, 31 bp, Artificial Sequence
  Description of Artificial Sequence: Synthetic oligonucleotide
aggtcgcctggtgaaatcagaagagacagtc

SEQ ID NO: 153778 - DNA, 30 bp, Artificial Sequence
  Description of Artificial Sequence: Synthetic oligonucleotide
ggtcgcctggtgaaatcagaagagacagtc

SEQ ID NO: 153779 - DNA, 32 bp, Artificial Sequence
  Description of Artificial Sequence: Synthetic oligonucleotide
gtcgcctggtgaaatcagaagagacagtcatc

SEQ ID NO: 153780 - DNA, 32 bp, Artificial Sequence
  Description of Artificial Sequence: Synthetic oligonucleotide
tcgcctggtgaaatcagaagagacagtcatcc

SEQ ID NO: 153781 - DNA, 31 bp, Artificial Sequence
  Description of Artificial Sequence: Synthetic oligonucleotide
cgcctggtgaaatcagaagagacagtcatcc

SEQ ID NO: 153782 - DNA, 32 bp, Artificial Sequence
  Description of Artificial Sequence: Synthetic oligonucleotide
gcctggtgaaatcagaagagacagtcatcctg

SEQ ID NO: 153783 - DNA, 33 bp, Artificial Sequence
  Description of Artificial Sequence: Synthetic oligonucleotide
ctggtgaaatcagaagagacagtcatcctgcag

SEQ ID NO: 153784 - DNA, 34 bp, Artificial Sequence
  Description of Artificial Sequence: Synthetic oligonucleotide
tggtgaaatcagaagagacagtcatcctgcagtg

SEQ ID NO: 153785 - DNA, 33 bp, Artificial Sequence
  Description of Artificial Sequence: Synthetic oligonucleotide
ggtgaaatcagaagagacagtcatcctgcagtg

SEQ ID NO: 153786 - DNA, 35 bp, Artificial Sequence
  Description of Artificial Sequence: Synthetic oligonucleotide
gtgaaatcagaagagacagtcatcctgcagtgttg

SEQ ID NO: 153787 - DNA, 35 bp, Artificial Sequence
  Description of Artificial Sequence: Synthetic oligonucleotide
tgaaatcagaagagacagtcatcctgcagtgttgg

SEQ ID NO: 153788 - DNA, 34 bp, Artificial Sequence
  Description of Artificial Sequence: Synthetic oligonucleotide
gaaatcagaagagacagtcatcctgcagtgttgg

SEQ ID NO: 153789 - DNA, 35 bp, Artificial Sequence
  Description of Artificial Sequence: Synthetic oligonucleotide
aaatcagaagagacagtcatcctgcagtgttggtc

SEQ ID NO: 153790 - DNA, 34 bp, Artificial Sequence
  Description of Artificial Sequence: Synthetic oligonucleotide
aatcagaagagacagtcatcctgcagtgttggtc

SEQ ID NO: 153791 - DNA, 33 bp, Artificial Sequence
  Description of Artificial Sequence: Synthetic oligonucleotide
atcagaagagacagtcatcctgcagtgttggtc

SEQ ID NO: 153792 - DNA, 32 bp, Artificial Sequence
  Description of Artificial Sequence: Synthetic oligonucleotide
tcagaagagacagtcatcctgcagtgttggtc

SEQ ID NO: 153793 - DNA, 31 bp, Artificial Sequence
  Description of Artificial Sequence: Synthetic oligonucleotide
cagaagagacagtcatcctgcagtgttggtc

SEQ ID NO: 153794 - DNA, 32 bp, Artificial Sequence
  Description of Artificial Sequence: Synthetic oligonucleotide
agaagagacagtcatcctgcagtgttggtcag

SEQ ID NO: 153795 - DNA, 31 bp, Artificial Sequence
  Description of Artificial Sequence: Synthetic oligonucleotide
gaagagacagtcatcctgcagtgttggtcag

SEQ ID NO: 153796 - DNA, 33 bp, Artificial Sequence
  Description of Artificial Sequence: Synthetic oligonucleotide
aagagacagtcatcctgcagtgttggtcagatg

SEQ ID NO: 153797 - DNA, 32 bp, Artificial Sequence
  Description of Artificial Sequence: Synthetic oligonucleotide
agagacagtcatcctgcagtgttggtcagatg

SEQ ID NO: 153798 - DNA, 31 bp, Artificial Sequence
  Description of Artificial Sequence: Synthetic oligonucleotide
gagacagtcatcctgcagtgttggtcagatg

SEQ ID NO: 153799 - DNA, 32 bp, Artificial Sequence
  Description of Artificial Sequence: Synthetic oligonucleotide
agacagtcatcctgcagtgttggtcagatgtc

SEQ ID NO: 153800 - DNA, 31 bp, Artificial Sequence
  Description of Artificial Sequence: Synthetic oligonucleotide
gacagtcatcctgcagtgttggtcagatgtc

SEQ ID NO: 153801 - DNA, 33 bp, Artificial Sequence
  Description of Artificial Sequence: Synthetic oligonucleotide
acagtcatcctgcagtgttggtcagatgtcatg

SEQ ID NO: 153802 - DNA, 32 bp, Artificial Sequence
  Description of Artificial Sequence: Synthetic oligonucleotide
cagtcatcctgcagtgttggtcagatgtcatg

SEQ ID NO: 153803 - DNA, 35 bp, Artificial Sequence
  Description of Artificial Sequence: Synthetic oligonucleotide
agtcatcctgcagtgttggtcagatgtcatgtttg

SEQ ID NO: 153804 - DNA, 34 bp, Artificial Sequence
  Description of Artificial Sequence: Synthetic oligonucleotide
gtcatcctgcagtgttggtcagatgtcatgtttg

SEQ ID NO: 153805 - DNA, 36 bp, Artificial Sequence
  Description of Artificial Sequence: Synthetic oligonucleotide
tcatcctgcagtgttggtcagatgtcatgtttgaac

SEQ ID NO: 153806 - DNA, 35 bp, Artificial Sequence
  Description of Artificial Sequence: Synthetic oligonucleotide
catcctgcagtgttggtcagatgtcatgtttgaac

SEQ ID NO: 153807 - DNA, 36 bp, Artificial Sequence
  Description of Artificial Sequence: Synthetic oligonucleotide
atcctgcagtgttggtcagatgtcatgtttgaacac

SEQ ID NO: 153808 - DNA, 35 bp, Artificial Sequence
  Description of Artificial Sequence: Synthetic oligonucleotide
tcctgcagtgttggtcagatgtcatgtttgaacac

SEQ ID NO: 153809 - DNA, 34 bp, Artificial Sequence
  Description of Artificial Sequence: Synthetic oligonucleotide
cctgcagtgttggtcagatgtcatgtttgaacac

SEQ ID NO: 153810 - DNA, 36 bp, Artificial Sequence
  Description of Artificial Sequence: Synthetic oligonucleotide
ctgcagtgttggtcagatgtcatgtttgaacacttc

SEQ ID NO: 153811 - DNA, 36 bp, Artificial Sequence
  Description of Artificial Sequence: Synthetic oligonucleotide
tgcagtgttggtcagatgtcatgtttgaacacttcc

SEQ ID NO: 153812 - DNA, 35 bp, Artificial Sequence
  Description of Artificial Sequence: Synthetic oligonucleotide
gcagtgttggtcagatgtcatgtttgaacacttcc

SEQ ID NO: 153813 - DNA, 37 bp, Artificial Sequence
  Description of Artificial Sequence: Synthetic oligonucleotide
cagtgttggtcagatgtcatgtttgaacacttccttc

SEQ ID NO: 153814 - DNA, 38 bp, Artificial Sequence
  Description of Artificial Sequence: Synthetic oligonucleotide
agtgttggtcagatgtcatgtttgaacacttccttctg

SEQ ID NO: 153815 - DNA, 37 bp, Artificial Sequence
  Description of Artificial Sequence: Synthetic oligonucleotide
gtgttggtcagatgtcatgtttgaacacttccttctg

SEQ ID NO: 153816 - DNA, 34 bp, Artificial Sequence
  Description of Artificial Sequence: Synthetic oligonucleotide
tctatatgagaaaccttctctctcagcccagctg

SEQ ID NO: 153817 - DNA, 33 bp, Artificial Sequence
  Description of Artificial Sequence: Synthetic oligonucleotide
ctatatgagaaaccttctctctcagcccagctg

SEQ ID NO: 153818 - DNA, 33 bp, Artificial Sequence
  Description of Artificial Sequence: Synthetic oligonucleotide
tatatgagaaaccttctctctcagcccagctgg

SEQ ID NO: 153819 - DNA, 32 bp, Artificial Sequence
  Description of Artificial Sequence: Synthetic oligonucleotide
atatgagaaaccttctctctcagcccagctgg

SEQ ID NO: 153820 - DNA, 31 bp, Artificial Sequence
  Description of Artificial Sequence: Synthetic oligonucleotide
tatgagaaaccttctctctcagcccagctgg

SEQ ID NO: 153821 - DNA, 30 bp, Artificial Sequence
  Description of Artificial Sequence: Synthetic oligonucleotide
atgagaaaccttctctctcagcccagctgg

SEQ ID NO: 153822 - DNA, 29 bp, Artificial Sequence
  Description of Artificial Sequence: Synthetic oligonucleotide
tgagaaaccttctctctcagcccagctgg

SEQ ID NO: 153823 - DNA, 28 bp, Artificial Sequence
  Description of Artificial Sequence: Synthetic oligonucleotide
gagaaaccttctctctcagcccagctgg

SEQ ID NO: 153824 - DNA, 28 bp, Artificial Sequence
  Description of Artificial Sequence: Synthetic oligonucleotide
agaaaccttctctctcagcccagctggg

SEQ ID NO: 153825 - DNA, 27 bp, Artificial Sequence
  Description of Artificial Sequence: Synthetic oligonucleotide
gaaaccttctctctcagcccagctggg

SEQ ID NO: 153826 - DNA, 27 bp, Artificial Sequence
  Description of Artificial Sequence: Synthetic oligonucleotide
aaaccttctctctcagcccagctgggc

SEQ ID NO: 153827 - DNA, 26 bp, Artificial Sequence
  Description of Artificial Sequence: Synthetic oligonucleotide
aaccttctctctcagcccagctgggc

SEQ ID NO: 153828 - DNA, 25 bp, Artificial Sequence
  Description of Artificial Sequence: Synthetic oligonucleotide
accttctctctcagcccagctgggc

SEQ ID NO: 153829 - DNA, 24 bp, Artificial Sequence
  Description of Artificial Sequence: Synthetic oligonucleotide
ccttctctctcagcccagctgggc

SEQ ID NO: 153830 - DNA, 24 bp, Artificial Sequence
  Description of Artificial Sequence: Synthetic oligonucleotide
cttctctctcagcccagctgggcc

SEQ ID NO: 153831 - DNA, 24 bp, Artificial Sequence
  Description of Artificial Sequence: Synthetic oligonucleotide
ttctctctcagcccagctgggccc

SEQ ID NO: 153832 - DNA, 23 bp, Artificial Sequence
  Description of Artificial Sequence: Synthetic oligonucleotide
tctctctcagcccagctgggccc

SEQ ID NO: 153833 - DNA, 22 bp, Artificial Sequence
  Description of Artificial Sequence: Synthetic oligonucleotide
ctctctcagcccagctgggccc

SEQ ID NO: 153834 - DNA, 23 bp, Artificial Sequence
  Description of Artificial Sequence: Synthetic oligonucleotide
tctctcagcccagctgggcccca

SEQ ID NO: 153835 - DNA, 22 bp, Artificial Sequence
  Description of Artificial Sequence: Synthetic oligonucleotide
ctctcagcccagctgggcccca

SEQ ID NO: 153836 - DNA, 22 bp, Artificial Sequence
  Description of Artificial Sequence: Synthetic oligonucleotide
tctcagcccagctgggccccac

SEQ ID NO: 153837 - DNA, 21 bp, Artificial Sequence
  Description of Artificial Sequence: Synthetic oligonucleotide
ctcagcccagctgggccccac

SEQ ID NO: 153838 - DNA, 21 bp, Artificial Sequence
  Description of Artificial Sequence: Synthetic oligonucleotide
tcagcccagctgggccccacg

SEQ ID NO: 153839 - DNA, 20 bp, Artificial Sequence
  Description of Artificial Sequence: Synthetic oligonucleotide
cagcccagctgggccccacg

SEQ ID NO: 153840 - DNA, 22 bp, Artificial Sequence
  Description of Artificial Sequence: Synthetic oligonucleotide
agcccagctgggccccacggtt

SEQ ID NO: 153841 - DNA, 21 bp, Artificial Sequence
  Description of Artificial Sequence: Synthetic oligonucleotide
gcccagctgggccccacggtt

SEQ ID NO: 153842 - DNA, 22 bp, Artificial Sequence
  Description of Artificial Sequence: Synthetic oligonucleotide
cccagctgggccccacggttct

SEQ ID NO: 153843 - DNA, 22 bp, Artificial Sequence
  Description of Artificial Sequence: Synthetic oligonucleotide
ccagctgggccccacggttctg

SEQ ID NO: 153844 - DNA, 22 bp, Artificial Sequence
  Description of Artificial Sequence: Synthetic oligonucleotide
cagctgggccccacggttctgg

SEQ ID NO: 153845 - DNA, 23 bp, Artificial Sequence
  Description of Artificial Sequence: Synthetic oligonucleotide
agctgggccccacggttctggca

SEQ ID NO: 153846 - DNA, 22 bp, Artificial Sequence
  Description of Artificial Sequence: Synthetic oligonucleotide
gctgggccccacggttctggca

SEQ ID NO: 153847 - DNA, 22 bp, Artificial Sequence
  Description of Artificial Sequence: Synthetic oligonucleotide
ctgggccccacggttctggcag

SEQ ID NO: 153848 - DNA, 23 bp, Artificial Sequence
  Description of Artificial Sequence: Synthetic oligonucleotide
tgggccccacggttctggcagga

SEQ ID NO: 153849 - DNA, 30 bp, Artificial Sequence
  Description of Artificial Sequence: Synthetic oligonucleotide
ccttcacccactgaaccaagctccaaaacg

SEQ ID NO: 153850 - DNA, 30 bp, Artificial Sequence
  Description of Artificial Sequence: Synthetic oligonucleotide
cttcacccactgaaccaagctccaaaacgg

SEQ ID NO: 153851 - DNA, 30 bp, Artificial Sequence
  Description of Artificial Sequence: Synthetic oligonucleotide
ttcacccactgaaccaagctccaaaacggg

SEQ ID NO: 153852 - DNA, 29 bp, Artificial Sequence
  Description of Artificial Sequence: Synthetic oligonucleotide
tcacccactgaaccaagctccaaaacggg

SEQ ID NO: 153853 - DNA, 28 bp, Artificial Sequence
  Description of Artificial Sequence: Synthetic oligonucleotide
cacccactgaaccaagctccaaaacggg

SEQ ID NO: 153854 - DNA, 31 bp, Artificial Sequence
  Description of Artificial Sequence: Synthetic oligonucleotide
acccactgaaccaagctccaaaacgggtaac

SEQ ID NO: 153855 - DNA, 30 bp, Artificial Sequence
  Description of Artificial Sequence: Synthetic oligonucleotide
cccactgaaccaagctccaaaacgggtaac

SEQ ID NO: 153856 - DNA, 30 bp, Artificial Sequence
  Description of Artificial Sequence: Synthetic oligonucleotide
ccactgaaccaagctccaaaacgggtaacc

SEQ ID NO: 153857 - DNA, 30 bp, Artificial Sequence
  Description of Artificial Sequence: Synthetic oligonucleotide
cactgaaccaagctccaaaacgggtaaccc

SEQ ID NO: 153858 - DNA, 30 bp, Artificial Sequence
  Description of Artificial Sequence: Synthetic oligonucleotide
actgaaccaagctccaaaacgggtaacccc

SEQ ID NO: 153859 - DNA, 29 bp, Artificial Sequence
  Description of Artificial Sequence: Synthetic oligonucleotide
ctgaaccaagctccaaaacgggtaacccc

SEQ ID NO: 153860 - DNA, 29 bp, Artificial Sequence
  Description of Artificial Sequence: Synthetic oligonucleotide
tgaaccaagctccaaaacgggtaaccccc

SEQ ID NO: 153861 - DNA, 28 bp, Artificial Sequence
  Description of Artificial Sequence: Synthetic oligonucleotide
gaaccaagctccaaaacgggtaaccccc

SEQ ID NO: 153862 - DNA, 28 bp, Artificial Sequence
  Description of Artificial Sequence: Synthetic oligonucleotide
aaccaagctccaaaacgggtaacccccg

SEQ ID NO: 153863 - DNA, 27 bp, Artificial Sequence
  Description of Artificial Sequence: Synthetic oligonucleotide
accaagctccaaaacgggtaacccccg

SEQ ID NO: 153864 - DNA, 27 bp, Artificial Sequence
  Description of Artificial Sequence: Synthetic oligonucleotide
ccaagctccaaaacgggtaacccccga

SEQ ID NO: 153865 - DNA, 27 bp, Artificial Sequence
  Description of Artificial Sequence: Synthetic oligonucleotide
caagctccaaaacgggtaacccccgac

SEQ ID NO: 153866 - DNA, 28 bp, Artificial Sequence
  Description of Artificial Sequence: Synthetic oligonucleotide
aagctccaaaacgggtaacccccgacac

SEQ ID NO: 153867 - DNA, 27 bp, Artificial Sequence
  Description of Artificial Sequence: Synthetic oligonucleotide
agctccaaaacgggtaacccccgacac

SEQ ID NO: 153868 - DNA, 26 bp, Artificial Sequence
  Description of Artificial Sequence: Synthetic oligonucleotide
gctccaaaacgggtaacccccgacac

SEQ ID NO: 153869 - DNA, 27 bp, Artificial Sequence
  Description of Artificial Sequence: Synthetic oligonucleotide
ctccaaaacgggtaacccccgacacct

SEQ ID NO: 153870 - DNA, 27 bp, Artificial Sequence
  Description of Artificial Sequence: Synthetic oligonucleotide
tccaaaacgggtaacccccgacacctg

SEQ ID NO: 153871 - DNA, 26 bp, Artificial Sequence
  Description of Artificial Sequence: Synthetic oligonucleotide
ccaaaacgggtaacccccgacacctg

SEQ ID NO: 153872 - DNA, 27 bp, Artificial Sequence
  Description of Artificial Sequence: Synthetic oligonucleotide
caaaacgggtaacccccgacacctgca

SEQ ID NO: 153873 - DNA, 27 bp, Artificial Sequence
  Description of Artificial Sequence: Synthetic oligonucleotide
aaaacgggtaacccccgacacctgcac

SEQ ID NO: 153874 - DNA, 27 bp, Artificial Sequence
  Description of Artificial Sequence: Synthetic oligonucleotide
aaacgggtaacccccgacacctgcaca

SEQ ID NO: 153875 - DNA, 27 bp, Artificial Sequence
  Description of Artificial Sequence: Synthetic oligonucleotide
aacgggtaacccccgacacctgcacat

SEQ ID NO: 153876 - DNA, 27 bp, Artificial Sequence
  Description of Artificial Sequence: Synthetic oligonucleotide
acgggtaacccccgacacctgcacatt

SEQ ID NO: 153877 - DNA, 26 bp, Artificial Sequence
  Description of Artificial Sequence: Synthetic oligonucleotide
cgggtaacccccgacacctgcacatt

SEQ ID NO: 153878 - DNA, 27 bp, Artificial Sequence
  Description of Artificial Sequence: Synthetic oligonucleotide
gggtaacccccgacacctgcacattct

SEQ ID NO: 153879 - DNA, 33 bp, Artificial Sequence
  Description of Artificial Sequence: Synthetic oligonucleotide
ttctttctccttcatcgctggtgctccaacaag

SEQ ID NO: 153880 - DNA, 32 bp, Artificial Sequence
  Description of Artificial Sequence: Synthetic oligonucleotide
tctttctccttcatcgctggtgctccaacaag

SEQ ID NO: 153881 - DNA, 31 bp, Artificial Sequence
  Description of Artificial Sequence: Synthetic oligonucleotide
ctttctccttcatcgctggtgctccaacaag

SEQ ID NO: 153882 - DNA, 37 bp, Artificial Sequence
  Description of Artificial Sequence: Synthetic oligonucleotide
tttctccttcatcgctggtgctccaacaagaaaaatg

SEQ ID NO: 153883 - DNA, 36 bp, Artificial Sequence
  Description of Artificial Sequence: Synthetic oligonucleotide
ttctccttcatcgctggtgctccaacaagaaaaatg

SEQ ID NO: 153884 - DNA, 35 bp, Artificial Sequence
  Description of Artificial Sequence: Synthetic oligonucleotide
tctccttcatcgctggtgctccaacaagaaaaatg

SEQ ID NO: 153885 - DNA, 34 bp, Artificial Sequence
  Description of Artificial Sequence: Synthetic oligonucleotide
ctccttcatcgctggtgctccaacaagaaaaatg

SEQ ID NO: 153886 - DNA, 34 bp, Artificial Sequence
  Description of Artificial Sequence: Synthetic oligonucleotide
tccttcatcgctggtgctccaacaagaaaaatgc

SEQ ID NO: 153887 - DNA, 33 bp, Artificial Sequence
  Description of Artificial Sequence: Synthetic oligonucleotide
ccttcatcgctggtgctccaacaagaaaaatgc

SEQ ID NO: 153888 - DNA, 34 bp, Artificial Sequence
  Description of Artificial Sequence: Synthetic oligonucleotide
cttcatcgctggtgctccaacaagaaaaatgctg

SEQ ID NO: 153889 - DNA, 34 bp, Artificial Sequence
  Description of Artificial Sequence: Synthetic oligonucleotide
ttcatcgctggtgctccaacaagaaaaatgctgc

SEQ ID NO: 153890 - DNA, 33 bp, Artificial Sequence
  Description of Artificial Sequence: Synthetic oligonucleotide
tcatcgctggtgctccaacaagaaaaatgctgc

SEQ ID NO: 153891 - DNA, 32 bp, Artificial Sequence
  Description of Artificial Sequence: Synthetic oligonucleotide
catcgctggtgctccaacaagaaaaatgctgc

SEQ ID NO: 153892 - DNA, 32 bp, Artificial Sequence
  Description of Artificial Sequence: Synthetic oligonucleotide
atcgctggtgctccaacaagaaaaatgctgcg

SEQ ID NO: 153893 - DNA, 31 bp, Artificial Sequence
  Description of Artificial Sequence: Synthetic oligonucleotide
tcgctggtgctccaacaagaaaaatgctgcg

SEQ ID NO: 153894 - DNA, 30 bp, Artificial Sequence
  Description of Artificial Sequence: Synthetic oligonucleotide
cgctggtgctccaacaagaaaaatgctgcg

SEQ ID NO: 153895 - DNA, 30 bp, Artificial Sequence
  Description of Artificial Sequence: Synthetic oligonucleotide
gctggtgctccaacaagaaaaatgctgcgg

SEQ ID NO: 153896 - DNA, 34 bp, Artificial Sequence
  Description of Artificial Sequence: Synthetic oligonucleotide
ctggtgctccaacaagaaaaatgctgcggtaatg

SEQ ID NO: 153897 - DNA, 34 bp, Artificial Sequence
  Description of Artificial Sequence: Synthetic oligonucleotide
tggtgctccaacaagaaaaatgctgcggtaatgg

SEQ ID NO: 153898 - DNA, 33 bp, Artificial Sequence
  Description of Artificial Sequence: Synthetic oligonucleotide
ggtgctccaacaagaaaaatgctgcggtaatgg

SEQ ID NO: 153899 - DNA, 34 bp, Artificial Sequence
  Description of Artificial Sequence: Synthetic oligonucleotide
gtgctccaacaagaaaaatgctgcggtaatggac

SEQ ID NO: 153900 - DNA, 34 bp, Artificial Sequence
  Description of Artificial Sequence: Synthetic oligonucleotide
tgctccaacaagaaaaatgctgcggtaatggacc

SEQ ID NO: 153901 - DNA, 33 bp, Artificial Sequence
  Description of Artificial Sequence: Synthetic oligonucleotide
gctccaacaagaaaaatgctgcggtaatggacc

SEQ ID NO: 153902 - DNA, 35 bp, Artificial Sequence
  Description of Artificial Sequence: Synthetic oligonucleotide
ctccaacaagaaaaatgctgcggtaatggaccaag

SEQ ID NO: 153903 - DNA, 36 bp, Artificial Sequence
  Description of Artificial Sequence: Synthetic oligonucleotide
tccaacaagaaaaatgctgcggtaatggaccaagag

SEQ ID NO: 153904 - DNA, 35 bp, Artificial Sequence
  Description of Artificial Sequence: Synthetic oligonucleotide
ccaacaagaaaaatgctgcggtaatggaccaagag

SEQ ID NO: 153905 - DNA, 36 bp, Artificial Sequence
  Description of Artificial Sequence: Synthetic oligonucleotide
caacaagaaaaatgctgcggtaatggaccaagagtc

SEQ ID NO: 153906 - DNA, 37 bp, Artificial Sequence
  Description of Artificial Sequence: Synthetic oligonucleotide
aacaagaaaaatgctgcggtaatggaccaagagtctg

SEQ ID NO: 153907 - DNA, 36 bp, Artificial Sequence
  Description of Artificial Sequence: Synthetic oligonucleotide
acaagaaaaatgctgcggtaatggaccaagagtctg

SEQ ID NO: 153908 - DNA, 35 bp, Artificial Sequence
  Description of Artificial Sequence: Synthetic oligonucleotide
caagaaaaatgctgcggtaatggaccaagagtctg

SEQ ID NO: 153909 - DNA, 35 bp, Artificial Sequence
  Description of Artificial Sequence: Synthetic oligonucleotide
aagaaaaatgctgcggtaatggaccaagagtctgc

SEQ ID NO: 153910 - DNA, 34 bp, Artificial Sequence
  Description of Artificial Sequence: Synthetic oligonucleotide
agaaaaatgctgcggtaatggaccaagagtctgc

SEQ ID NO: 153911 - DNA, 33 bp, Artificial Sequence
  Description of Artificial Sequence: Synthetic oligonucleotide
gaaaaatgctgcggtaatggaccaagagtctgc

SEQ ID NO: 153912 - DNA, 26 bp, Artificial Sequence
  Description of Artificial Sequence: Synthetic oligonucleotide
ccatgaacgtaggctccctgcaggga

SEQ ID NO: 153913 - DNA, 26 bp, Artificial Sequence
  Description of Artificial Sequence: Synthetic oligonucleotide
catgaacgtaggctccctgcagggac

SEQ ID NO: 153914 - DNA, 27 bp, Artificial Sequence
  Description of Artificial Sequence: Synthetic oligonucleotide
atgaacgtaggctccctgcagggacca

SEQ ID NO: 153915 - DNA, 27 bp, Artificial Sequence
  Description of Artificial Sequence: Synthetic oligonucleotide
tgaacgtaggctccctgcagggaccaa

SEQ ID NO: 153916 - DNA, 26 bp, Artificial Sequence
  Description of Artificial Sequence: Synthetic oligonucleotide
gaacgtaggctccctgcagggaccaa

SEQ ID NO: 153917 - DNA, 26 bp, Artificial Sequence
  Description of Artificial Sequence: Synthetic oligonucleotide
aacgtaggctccctgcagggaccaag

SEQ ID NO: 153918 - DNA, 25 bp, Artificial Sequence
  Description of Artificial Sequence: Synthetic oligonucleotide
acgtaggctccctgcagggaccaag

SEQ ID NO: 153919 - DNA, 24 bp, Artificial Sequence
  Description of Artificial Sequence: Synthetic oligonucleotide
cgtaggctccctgcagggaccaag

SEQ ID NO: 153920 - DNA, 25 bp, Artificial Sequence
  Description of Artificial Sequence: Synthetic oligonucleotide
gtaggctccctgcagggaccaaggt

SEQ ID NO: 153921 - DNA, 27 bp, Artificial Sequence
  Description of Artificial Sequence: Synthetic oligonucleotide
taggctccctgcagggaccaaggtcaa

SEQ ID NO: 153922 - DNA, 26 bp, Artificial Sequence
  Description of Artificial Sequence: Synthetic oligonucleotide
aggctccctgcagggaccaaggtcaa

SEQ ID NO: 153923 - DNA, 25 bp, Artificial Sequence
  Description of Artificial Sequence: Synthetic oligonucleotide
ggctccctgcagggaccaaggtcaa

SEQ ID NO: 153924 - DNA, 25 bp, Artificial Sequence
  Description of Artificial Sequence: Synthetic oligonucleotide
gctccctgcagggaccaaggtcaac

SEQ ID NO: 153925 - DNA, 25 bp, Artificial Sequence
  Description of Artificial Sequence: Synthetic oligonucleotide
ctccctgcagggaccaaggtcaacg

SEQ ID NO: 153926 - DNA, 27 bp, Artificial Sequence
  Description of Artificial Sequence: Synthetic oligonucleotide
tccctgcagggaccaaggtcaacggaa

SEQ ID NO: 153927 - DNA, 26 bp, Artificial Sequence
  Description of Artificial Sequence: Synthetic oligonucleotide
ccctgcagggaccaaggtcaacggaa

SEQ ID NO: 153928 - DNA, 27 bp, Artificial Sequence
  Description of Artificial Sequence: Synthetic oligonucleotide
cctgcagggaccaaggtcaacggaaca

SEQ ID NO: 153929 - DNA, 29 bp, Artificial Sequence
  Description of Artificial Sequence: Synthetic oligonucleotide
ctgcagggaccaaggtcaacggaacattc

SEQ ID NO: 153930 - DNA, 29 bp, Artificial Sequence
  Description of Artificial Sequence: Synthetic oligonucleotide
tgcagggaccaaggtcaacggaacattcc

SEQ ID NO: 153931 - DNA, 28 bp, Artificial Sequence
  Description of Artificial Sequence: Synthetic oligonucleotide
gcagggaccaaggtcaacggaacattcc

SEQ ID NO: 153932 - DNA, 29 bp, Artificial Sequence
  Description of Artificial Sequence: Synthetic oligonucleotide
cagggaccaaggtcaacggaacattccag

SEQ ID NO: 153933 - DNA, 29 bp, Artificial Sequence
  Description of Artificial Sequence: Synthetic oligonucleotide
agggaccaaggtcaacggaacattccagg

SEQ ID NO: 153934 - DNA, 28 bp, Artificial Sequence
  Description of Artificial Sequence: Synthetic oligonucleotide
gggaccaaggtcaacggaacattccagg

SEQ ID NO: 153935 - DNA, 28 bp, Artificial Sequence
  Description of Artificial Sequence: Synthetic oligonucleotide
ggaccaaggtcaacggaacattccaggc

SEQ ID NO: 153936 - DNA, 28 bp, Artificial Sequence
  Description of Artificial Sequence: Synthetic oligonucleotide
gaccaaggtcaacggaacattccaggcc

SEQ ID NO: 153937 - DNA, 30 bp, Artificial Sequence
  Description of Artificial Sequence: Synthetic oligonucleotide
accaaggtcaacggaacattccaggccaac

SEQ ID NO: 153938 - DNA, 29 bp, Artificial Sequence
  Description of Artificial Sequence: Synthetic oligonucleotide
ccaaggtcaacggaacattccaggccaac

SEQ ID NO: 153939 - DNA, 32 bp, Artificial Sequence
  Description of Artificial Sequence: Synthetic oligonucleotide
caaggtcaacggaacattccaggccaactttc

SEQ ID NO: 153940 - DNA, 32 bp, Artificial Sequence
  Description of Artificial Sequence: Synthetic oligonucleotide
aaggtcaacggaacattccaggccaactttcc

SEQ ID NO: 153941 - DNA, 31 bp, Artificial Sequence
  Description of Artificial Sequence: Synthetic oligonucleotide
aggtcaacggaacattccaggccaactttcc

SEQ ID NO: 153942 - DNA, 30 bp, Artificial Sequence
  Description of Artificial Sequence: Synthetic oligonucleotide
ggtcaacggaacattccaggccaactttcc

SEQ ID NO: 153943 - DNA, 31 bp, Artificial Sequence
  Description of Artificial Sequence: Synthetic oligonucleotide
gtcaacggaacattccaggccaactttcctc

SEQ ID NO: 153944 - DNA, 32 bp, Artificial Sequence
  Description of Artificial Sequence: Synthetic oligonucleotide
tcaacggaacattccaggccaactttcctctg

SEQ ID NO: 153945 - DNA, 31 bp, Artificial Sequence
  Description of Artificial Sequence: Synthetic oligonucleotide
caacggaacattccaggccaactttcctctg

SEQ ID NO: 153946 - DNA, 31 bp, Artificial Sequence
  Description of Artificial Sequence: Synthetic oligonucleotide
aacggaacattccaggccaactttcctctgg

SEQ ID NO: 153947 - DNA, 30 bp, Artificial Sequence
  Description of Artificial Sequence: Synthetic oligonucleotide
acggaacattccaggccaactttcctctgg

SEQ ID NO: 153948 - DNA, 29 bp, Artificial Sequence
  Description of Artificial Sequence: Synthetic oligonucleotide
cggaacattccaggccaactttcctctgg

SEQ ID NO: 153949 - DNA, 29 bp, Artificial Sequence
  Description of Artificial Sequence: Synthetic oligonucleotide
ggaacattccaggccaactttcctctggg

SEQ ID NO: 153950 - DNA, 29 bp, Artificial Sequence
  Description of Artificial Sequence: Synthetic oligonucleotide
gaacattccaggccaactttcctctgggc

SEQ ID NO: 153951 - DNA, 29 bp, Artificial Sequence
  Description of Artificial Sequence: Synthetic oligonucleotide
aacattccaggccaactttcctctgggcc

SEQ ID NO: 153952 - DNA, 28 bp, Artificial Sequence
  Description of Artificial Sequence: Synthetic oligonucleotide
acattccaggccaactttcctctgggcc

SEQ ID NO: 153953 - DNA, 27 bp, Artificial Sequence
  Description of Artificial Sequence: Synthetic oligonucleotide
cattccaggccaactttcctctgggcc

SEQ ID NO: 153954 - DNA, 27 bp, Artificial Sequence
  Description of Artificial Sequence: Synthetic oligonucleotide
attccaggccaactttcctctgggccc

SEQ ID NO: 153955 - DNA, 27 bp, Artificial Sequence
  Description of Artificial Sequence: Synthetic oligonucleotide
ttccaggccaactttcctctgggccct

SEQ ID NO: 153956 - DNA, 26 bp, Artificial Sequence
  Description of Artificial Sequence: Synthetic oligonucleotide
tccaggccaactttcctctgggccct

SEQ ID NO: 153957 - DNA, 25 bp, Artificial Sequence
  Description of Artificial Sequence: Synthetic oligonucleotide
ccaggccaactttcctctgggccct

SEQ ID NO: 153958 - DNA, 25 bp, Artificial Sequence
  Description of Artificial Sequence: Synthetic oligonucleotide
caggccaactttcctctgggccctg

SEQ ID NO: 153959 - DNA, 25 bp, Artificial Sequence
  Description of Artificial Sequence: Synthetic oligonucleotide
aggccaactttcctctgggccctgc

SEQ ID NO: 153960 - DNA, 24 bp, Artificial Sequence
  Description of Artificial Sequence: Synthetic oligonucleotide
ggccaactttcctctgggccctgc

SEQ ID NO: 153961 - DNA, 25 bp, Artificial Sequence
  Description of Artificial Sequence: Synthetic oligonucleotide
gccaactttcctctgggccctgcca

SEQ ID NO: 153962 - DNA, 25 bp, Artificial Sequence
  Description of Artificial Sequence: Synthetic oligonucleotide
ccaactttcctctgggccctgccac

SEQ ID NO: 153963 - DNA, 25 bp, Artificial Sequence
  Description of Artificial Sequence: Synthetic oligonucleotide
caactttcctctgggccctgccacc

SEQ ID NO: 153964 - DNA, 27 bp, Artificial Sequence
  Description of Artificial Sequence: Synthetic oligonucleotide
aactttcctctgggccctgccacccat

SEQ ID NO: 153965 - DNA, 26 bp, Artificial Sequence
  Description of Artificial Sequence: Synthetic oligonucleotide
actttcctctgggccctgccacccat

SEQ ID NO: 153966 - DNA, 25 bp, Artificial Sequence
  Description of Artificial Sequence: Synthetic oligonucleotide
ctttcctctgggccctgccacccat

SEQ ID NO: 153967 - DNA, 25 bp, Artificial Sequence
  Description of Artificial Sequence: Synthetic oligonucleotide
tttcctctgggccctgccacccatg

SEQ ID NO: 153968 - DNA, 24 bp, Artificial Sequence
  Description of Artificial Sequence: Synthetic oligonucleotide
ttcctctgggccctgccacccatg

SEQ ID NO: 153969 - DNA, 23 bp, Artificial Sequence
  Description of Artificial Sequence: Synthetic oligonucleotide
tcctctgggccctgccacccatg

SEQ ID NO: 153970 - DNA, 22 bp, Artificial Sequence
  Description of Artificial Sequence: Synthetic oligonucleotide
cctctgggccctgccacccatg

SEQ ID NO: 153971 - DNA, 23 bp, Artificial Sequence
  Description of Artificial Sequence: Synthetic oligonucleotide
ctctgggccctgccacccatgga

SEQ ID NO: 153972 - DNA, 23 bp, Artificial Sequence
  Description of Artificial Sequence: Synthetic oligonucleotide
tctgggccctgccacccatggag

SEQ ID NO: 153973 - DNA, 22 bp, Artificial Sequence
  Description of Artificial Sequence: Synthetic oligonucleotide
ctgggccctgccacccatggag

SEQ ID NO: 153974 - DNA, 22 bp, Artificial Sequence
  Description of Artificial Sequence: Synthetic oligonucleotide
tgggccctgccacccatggagg

SEQ ID NO: 153975 - DNA, 21 bp, Artificial Sequence
  Description of Artificial Sequence: Synthetic oligonucleotide
gggccctgccacccatggagg

SEQ ID NO: 153976 - DNA, 22 bp, Artificial Sequence
  Description of Artificial Sequence: Synthetic oligonucleotide
ggccctgccacccatggaggga

SEQ ID NO: 153977 - DNA, 22 bp, Artificial Sequence
  Description of Artificial Sequence: Synthetic oligonucleotide
gccctgccacccatggagggac

SEQ ID NO: 153978 - DNA, 24 bp, Artificial Sequence
  Description of Artificial Sequence: Synthetic oligonucleotide
ccctgccacccatggagggaccta

SEQ ID NO: 153979 - DNA, 25 bp, Artificial Sequence
  Description of Artificial Sequence: Synthetic oligonucleotide
cctgccacccatggagggacctaca

SEQ ID NO: 153980 - DNA, 27 bp, Artificial Sequence
  Description of Artificial Sequence: Synthetic oligonucleotide
ctgccacccatggagggacctacagat

SEQ ID NO: 153981 - DNA, 27 bp, Artificial Sequence
  Description of Artificial Sequence: Synthetic oligonucleotide
tgccacccatggagggacctacagatg

SEQ ID NO: 153982 - DNA, 26 bp, Artificial Sequence
  Description of Artificial Sequence: Synthetic oligonucleotide
gccacccatggagggacctacagatg

SEQ ID NO: 153983 - DNA, 27 bp, Artificial Sequence
  Description of Artificial Sequence: Synthetic oligonucleotide
ccacccatggagggacctacagatgct

SEQ ID NO: 153984 - DNA, 28 bp, Artificial Sequence
  Description of Artificial Sequence: Synthetic oligonucleotide
cacccatggagggacctacagatgcttc

SEQ ID NO: 153985 - DNA, 28 bp, Artificial Sequence
  Description of Artificial Sequence: Synthetic oligonucleotide
acccatggagggacctacagatgcttcg

SEQ ID NO: 153986 - DNA, 27 bp, Artificial Sequence
  Description of Artificial Sequence: Synthetic oligonucleotide
cccatggagggacctacagatgcttcg

SEQ ID NO: 153987 - DNA, 27 bp, Artificial Sequence
  Description of Artificial Sequence: Synthetic oligonucleotide
ccatggagggacctacagatgcttcgg

SEQ ID NO: 153988 - DNA, 27 bp, Artificial Sequence
  Description of Artificial Sequence: Synthetic oligonucleotide
catggagggacctacagatgcttcggc

SEQ ID NO: 153989 - DNA, 28 bp, Artificial Sequence
  Description of Artificial Sequence: Synthetic oligonucleotide
atggagggacctacagatgcttcggctc

SEQ ID NO: 153990 - DNA, 27 bp, Artificial Sequence
  Description of Artificial Sequence: Synthetic oligonucleotide
tggagggacctacagatgcttcggctc

SEQ ID NO: 153991 - DNA, 28 bp, Artificial Sequence
  Description of Artificial Sequence: Synthetic oligonucleotide
ggacctacagatgcttcggctctttccg

SEQ ID NO: 153992 - DNA, 29 bp, Artificial Sequence
  Description of Artificial Sequence: Synthetic oligonucleotide
gacctacagatgcttcggctctttccgtg

SEQ ID NO: 153993 - DNA, 30 bp, Artificial Sequence
  Description of Artificial Sequence: Synthetic oligonucleotide
acctacagatgcttcggctctttccgtgac

SEQ ID NO: 153994 - DNA, 29 bp, Artificial Sequence
  Description of Artificial Sequence: Synthetic oligonucleotide
cctacagatgcttcggctctttccgtgac

SEQ ID NO: 153995 - DNA, 30 bp, Artificial Sequence
  Description of Artificial Sequence: Synthetic oligonucleotide
ctacagatgcttcggctctttccgtgactc

SEQ ID NO: 153996 - DNA, 31 bp, Artificial Sequence
  Description of Artificial Sequence: Synthetic oligonucleotide
tacagatgcttcggctctttccgtgactctc

SEQ ID NO: 153997 - DNA, 30 bp, Artificial Sequence
  Description of Artificial Sequence: Synthetic oligonucleotide
acagatgcttcggctctttccgtgactctc

SEQ ID NO: 153998 - DNA, 29 bp, Artificial Sequence
  Description of Artificial Sequence: Synthetic oligonucleotide
cagatgcttcggctctttccgtgactctc

SEQ ID NO: 153999 - DNA, 29 bp, Artificial Sequence
  Description of Artificial Sequence: Synthetic oligonucleotide
agatgcttcggctctttccgtgactctcc

SEQ ID NO: 154000 - DNA, 28 bp, Artificial Sequence
  Description of Artificial Sequence: Synthetic oligonucleotide
gatgcttcggctctttccgtgactctcc

SEQ ID NO: 154001 - DNA, 31 bp, Artificial Sequence
  Description of Artificial Sequence: Synthetic oligonucleotide
atgcttcggctctttccgtgactctccatac

SEQ ID NO: 154002 - DNA, 30 bp, Artificial Sequence
  Description of Artificial Sequence: Synthetic oligonucleotide
tgcttcggctctttccgtgactctccatac

SEQ ID NO: 154003 - DNA, 29 bp, Artificial Sequence
  Description of Artificial Sequence: Synthetic oligonucleotide
gcttcggctctttccgtgactctccatac

SEQ ID NO: 154004 - DNA, 29 bp, Artificial Sequence
  Description of Artificial Sequence: Synthetic oligonucleotide
cttcggctctttccgtgactctccatacg

SEQ ID NO: 154005 - DNA, 30 bp, Artificial Sequence
  Description of Artificial Sequence: Synthetic oligonucleotide
ttcggctctttccgtgactctccatacgag

SEQ ID NO: 154006 - DNA, 29 bp, Artificial Sequence
  Description of Artificial Sequence: Synthetic oligonucleotide
tcggctctttccgtgactctccatacgag

SEQ ID NO: 154007 - DNA, 28 bp, Artificial Sequence
  Description of Artificial Sequence: Synthetic oligonucleotide
cggctctttccgtgactctccatacgag

SEQ ID NO: 154008 - DNA, 29 bp, Artificial Sequence
  Description of Artificial Sequence: Synthetic oligonucleotide
ggctctttccgtgactctccatacgagtg

SEQ ID NO: 154009 - DNA, 29 bp, Artificial Sequence
  Description of Artificial Sequence: Synthetic oligonucleotide
gctctttccgtgactctccatacgagtgg

SEQ ID NO: 154010 - DNA, 30 bp, Artificial Sequence
  Description of Artificial Sequence: Synthetic oligonucleotide
ctctttccgtgactctccatacgagtggtc

SEQ ID NO: 154011 - DNA, 33 bp, Artificial Sequence
  Description of Artificial Sequence: Synthetic oligonucleotide
tctttccgtgactctccatacgagtggtcaaag

SEQ ID NO: 154012 - DNA, 32 bp, Artificial Sequence
  Description of Artificial Sequence: Synthetic oligonucleotide
ctttccgtgactctccatacgagtggtcaaag

SEQ ID NO: 154013 - DNA, 33 bp, Artificial Sequence
  Description of Artificial Sequence: Synthetic oligonucleotide
tttccgtgactctccatacgagtggtcaaagtc

SEQ ID NO: 154014 - DNA, 32 bp, Artificial Sequence
  Description of Artificial Sequence: Synthetic oligonucleotide
ttccgtgactctccatacgagtggtcaaagtc

SEQ ID NO: 154015 - DNA, 31 bp, Artificial Sequence
  Description of Artificial Sequence: Synthetic oligonucleotide
tccgtgactctccatacgagtggtcaaagtc

SEQ ID NO: 154016 - DNA, 30 bp, Artificial Sequence
  Description of Artificial Sequence: Synthetic oligonucleotide
ccgtgactctccatacgagtggtcaaagtc

SEQ ID NO: 154017 - DNA, 32 bp, Artificial Sequence
  Description of Artificial Sequence: Synthetic oligonucleotide
cgtgactctccatacgagtggtcaaagtcaag

SEQ ID NO: 154018 - DNA, 33 bp, Artificial Sequence
  Description of Artificial Sequence: Synthetic oligonucleotide
gtgactctccatacgagtggtcaaagtcaagtg

SEQ ID NO: 154019 - DNA, 26 bp, Artificial Sequence
  Description of Artificial Sequence: Synthetic oligonucleotide
ggccttcacccactgaaccaagctcc

SEQ ID NO: 154020 - DNA, 27 bp, Artificial Sequence
  Description of Artificial Sequence: Synthetic oligonucleotide
gccttcacccactgaaccaagctccga

SEQ ID NO: 154021 - DNA, 29 bp, Artificial Sequence
  Description of Artificial Sequence: Synthetic oligonucleotide
ccttcacccactgaaccaagctccgaaac

SEQ ID NO: 154022 - DNA, 29 bp, Artificial Sequence
  Description of Artificial Sequence: Synthetic oligonucleotide
cttcacccactgaaccaagctccgaaacc

SEQ ID NO: 154023 - DNA, 29 bp, Artificial Sequence
  Description of Artificial Sequence: Synthetic oligonucleotide
ttcacccactgaaccaagctccgaaaccg

SEQ ID NO: 154024 - DNA, 28 bp, Artificial Sequence
  Description of Artificial Sequence: Synthetic oligonucleotide
tcacccactgaaccaagctccgaaaccg

SEQ ID NO: 154025 - DNA, 27 bp, Artificial Sequence
  Description of Artificial Sequence: Synthetic oligonucleotide
cacccactgaaccaagctccgaaaccg

SEQ ID NO: 154026 - DNA, 27 bp, Artificial Sequence
  Description of Artificial Sequence: Synthetic oligonucleotide
acccactgaaccaagctccgaaaccgg

SEQ ID NO: 154027 - DNA, 27 bp, Artificial Sequence
  Description of Artificial Sequence: Synthetic oligonucleotide
cccactgaaccaagctccgaaaccggt

SEQ ID NO: 154028 - DNA, 29 bp, Artificial Sequence
  Description of Artificial Sequence: Synthetic oligonucleotide
ccactgaaccaagctccgaaaccggtaac

SEQ ID NO: 154029 - DNA, 29 bp, Artificial Sequence
  Description of Artificial Sequence: Synthetic oligonucleotide
cactgaaccaagctccgaaaccggtaacc

SEQ ID NO: 154030 - DNA, 29 bp, Artificial Sequence
  Description of Artificial Sequence: Synthetic oligonucleotide
actgaaccaagctccgaaaccggtaaccc

SEQ ID NO: 154031 - DNA, 28 bp, Artificial Sequence
  Description of Artificial Sequence: Synthetic oligonucleotide
ctgaaccaagctccgaaaccggtaaccc

SEQ ID NO: 154032 - DNA, 28 bp, Artificial Sequence
  Description of Artificial Sequence: Synthetic oligonucleotide
tgaaccaagctccgaaaccggtaacccc

SEQ ID NO: 154033 - DNA, 27 bp, Artificial Sequence
  Description of Artificial Sequence: Synthetic oligonucleotide
gaaccaagctccgaaaccggtaacccc

SEQ ID NO: 154034 - DNA, 27 bp, Artificial Sequence
  Description of Artificial Sequence: Synthetic oligonucleotide
aaccaagctccgaaaccggtaaccccc

SEQ ID NO: 154035 - DNA, 26 bp, Artificial Sequence
  Description of Artificial Sequence: Synthetic oligonucleotide
accaagctccgaaaccggtaaccccc

SEQ ID NO: 154036 - DNA, 25 bp, Artificial Sequence
  Description of Artificial Sequence: Synthetic oligonucleotide
ccaagctccgaaaccggtaaccccc

SEQ ID NO: 154037 - DNA, 26 bp, Artificial Sequence
  Description of Artificial Sequence: Synthetic oligonucleotide
caagctccgaaaccggtaacccccga

SEQ ID NO: 154038 - DNA, 27 bp, Artificial Sequence
  Description of Artificial Sequence: Synthetic oligonucleotide
aagctccgaaaccggtaacccccgaca

SEQ ID NO: 154039 - DNA, 26 bp, Artificial Sequence
  Description of Artificial Sequence: Synthetic oligonucleotide
agctccgaaaccggtaacccccgaca

SEQ ID NO: 154040 - DNA, 25 bp, Artificial Sequence
  Description of Artificial Sequence: Synthetic oligonucleotide
gctccgaaaccggtaacccccgaca

SEQ ID NO: 154041 - DNA, 25 bp, Artificial Sequence
  Description of Artificial Sequence: Synthetic oligonucleotide
ctccgaaaccggtaacccccgacac

SEQ ID NO: 154042 - DNA, 26 bp, Artificial Sequence
  Description of Artificial Sequence: Synthetic oligonucleotide
tccgaaaccggtaacccccgacacct

SEQ ID NO: 154043 - DNA, 25 bp, Artificial Sequence
  Description of Artificial Sequence: Synthetic oligonucleotide
ccgaaaccggtaacccccgacacct

SEQ ID NO: 154044 - DNA, 25 bp, Artificial Sequence
  Description of Artificial Sequence: Synthetic oligonucleotide
cgaaaccggtaacccccgacacctg

SEQ ID NO: 154045 - DNA, 26 bp, Artificial Sequence
  Description of Artificial Sequence: Synthetic oligonucleotide
gaaaccggtaacccccgacacctgca

SEQ ID NO: 154046 - DNA, 38 bp, Artificial Sequence
  Description of Artificial Sequence: Synthetic oligonucleotide
atcatcctcttcatcctcctcttctttctccttcattg

SEQ ID NO: 154047 - DNA, 37 bp, Artificial Sequence
  Description of Artificial Sequence: Synthetic oligonucleotide
tcatcctcttcatcctcctcttctttctccttcattg

SEQ ID NO: 154048 - DNA, 36 bp, Artificial Sequence
  Description of Artificial Sequence: Synthetic oligonucleotide
catcctcttcatcctcctcttctttctccttcattg

SEQ ID NO: 154049 - DNA, 36 bp, Artificial Sequence
  Description of Artificial Sequence: Synthetic oligonucleotide
atcctcttcatcctcctcttctttctccttcattgc

SEQ ID NO: 154050 - DNA, 35 bp, Artificial Sequence
  Description of Artificial Sequence: Synthetic oligonucleotide
tcctcttcatcctcctcttctttctccttcattgc

SEQ ID NO: 154051 - DNA, 34 bp, Artificial Sequence
  Description of Artificial Sequence: Synthetic oligonucleotide
cctcttcatcctcctcttctttctccttcattgc

SEQ ID NO: 154052 - DNA, 35 bp, Artificial Sequence
  Description of Artificial Sequence: Synthetic oligonucleotide
ctcttcatcctcctcttctttctccttcattgctg

SEQ ID NO: 154053 - DNA, 35 bp, Artificial Sequence
  Description of Artificial Sequence: Synthetic oligonucleotide
tcttcatcctcctcttctttctccttcattgctgg

SEQ ID NO: 154054 - DNA, 34 bp, Artificial Sequence
  Description of Artificial Sequence: Synthetic oligonucleotide
cttcatcctcctcttctttctccttcattgctgg

SEQ ID NO: 154055 - DNA, 35 bp, Artificial Sequence
  Description of Artificial Sequence: Synthetic oligonucleotide
ttcatcctcctcttctttctccttcattgctggtg

SEQ ID NO: 154056 - DNA, 34 bp, Artificial Sequence
  Description of Artificial Sequence: Synthetic oligonucleotide
tcatcctcctcttctttctccttcattgctggtg

SEQ ID NO: 154057 - DNA, 33 bp, Artificial Sequence
  Description of Artificial Sequence: Synthetic oligonucleotide
catcctcctcttctttctccttcattgctggtg

SEQ ID NO: 154058 - DNA, 33 bp, Artificial Sequence
  Description of Artificial Sequence: Synthetic oligonucleotide
atcctcctcttctttctccttcattgctggtgc

SEQ ID NO: 154059 - DNA, 32 bp, Artificial Sequence
  Description of Artificial Sequence: Synthetic oligonucleotide
tcctcctcttctttctccttcattgctggtgc

SEQ ID NO: 154060 - DNA, 31 bp, Artificial Sequence
  Description of Artificial Sequence: Synthetic oligonucleotide
cctcctcttctttctccttcattgctggtgc

SEQ ID NO: 154061 - DNA, 32 bp, Artificial Sequence
  Description of Artificial Sequence: Synthetic oligonucleotide
ctcctcttctttctccttcattgctggtgctc

SEQ ID NO: 154062 - DNA, 32 bp, Artificial Sequence
  Description of Artificial Sequence: Synthetic oligonucleotide
tcctcttctttctccttcattgctggtgctcc

SEQ ID NO: 154063 - DNA, 31 bp, Artificial Sequence
  Description of Artificial Sequence: Synthetic oligonucleotide
cctcttctttctccttcattgctggtgctcc

SEQ ID NO: 154064 - DNA, 33 bp, Artificial Sequence
  Description of Artificial Sequence: Synthetic oligonucleotide
ctcttctttctccttcattgctggtgctccaac

SEQ ID NO: 154065 - DNA, 42 bp, Artificial Sequence
  Description of Artificial Sequence: Synthetic oligonucleotide
tcttctttctccttcattgctggtgctccaacaaaaaaaatg

SEQ ID NO: 154066 - DNA, 41 bp, Artificial Sequence
  Description of Artificial Sequence: Synthetic oligonucleotide
cttctttctccttcattgctggtgctccaacaaaaaaaatg

SEQ ID NO: 154067 - DNA, 41 bp, Artificial Sequence
  Description of Artificial Sequence: Synthetic oligonucleotide
ttctttctccttcattgctggtgctccaacaaaaaaaatgc

SEQ ID NO: 154068 - DNA, 40 bp, Artificial Sequence
  Description of Artificial Sequence: Synthetic oligonucleotide
tctttctccttcattgctggtgctccaacaaaaaaaatgc

SEQ ID NO: 154069 - DNA, 39 bp, Artificial Sequence
  Description of Artificial Sequence: Synthetic oligonucleotide
ctttctccttcattgctggtgctccaacaaaaaaaatgc

SEQ ID NO: 154070 - DNA, 40 bp, Artificial Sequence
  Description of Artificial Sequence: Synthetic oligonucleotide
tttctccttcattgctggtgctccaacaaaaaaaatgctg

SEQ ID NO: 154071 - DNA, 39 bp, Artificial Sequence
  Description of Artificial Sequence: Synthetic oligonucleotide
ttctccttcattgctggtgctccaacaaaaaaaatgctg

SEQ ID NO: 154072 - DNA, 38 bp, Artificial Sequence
  Description of Artificial Sequence: Synthetic oligonucleotide
tctccttcattgctggtgctccaacaaaaaaaatgctg

SEQ ID NO: 154073 - DNA, 37 bp, Artificial Sequence
  Description of Artificial Sequence: Synthetic oligonucleotide
ctccttcattgctggtgctccaacaaaaaaaatgctg

SEQ ID NO: 154074 - DNA, 37 bp, Artificial Sequence
  Description of Artificial Sequence: Synthetic oligonucleotide
tccttcattgctggtgctccaacaaaaaaaatgctgc

SEQ ID NO: 154075 - DNA, 36 bp, Artificial Sequence
  Description of Artificial Sequence: Synthetic oligonucleotide
ccttcattgctggtgctccaacaaaaaaaatgctgc

SEQ ID NO: 154076 - DNA, 36 bp, Artificial Sequence
  Description of Artificial Sequence: Synthetic oligonucleotide
cttcattgctggtgctccaacaaaaaaaatgctgcg

SEQ ID NO: 154077 - DNA, 36 bp, Artificial Sequence
  Description of Artificial Sequence: Synthetic oligonucleotide
ttcattgctggtgctccaacaaaaaaaatgctgcgg

SEQ ID NO: 154078 - DNA, 35 bp, Artificial Sequence
  Description of Artificial Sequence: Synthetic oligonucleotide
tcattgctggtgctccaacaaaaaaaatgctgcgg

SEQ ID NO: 154079 - DNA, 34 bp, Artificial Sequence
  Description of Artificial Sequence: Synthetic oligonucleotide
cattgctggtgctccaacaaaaaaaatgctgcgg

SEQ ID NO: 154080 - DNA, 38 bp, Artificial Sequence
  Description of Artificial Sequence: Synthetic oligonucleotide
attgctggtgctccaacaaaaaaaatgctgcggtaatg

SEQ ID NO: 154081 - DNA, 37 bp, Artificial Sequence
  Description of Artificial Sequence: Synthetic oligonucleotide
ttgctggtgctccaacaaaaaaaatgctgcggtaatg

SEQ ID NO: 154082 - DNA, 36 bp, Artificial Sequence
  Description of Artificial Sequence: Synthetic oligonucleotide
tgctggtgctccaacaaaaaaaatgctgcggtaatg

SEQ ID NO: 154083 - DNA, 30 bp, Artificial Sequence
  Description of Artificial Sequence: Synthetic oligonucleotide
tctgatgaacaagaccctcaggaggtgacg

SEQ ID NO: 154084 - DNA, 29 bp, Artificial Sequence
  Description of Artificial Sequence: Synthetic oligonucleotide
ctgatgaacaagaccctcaggaggtgacg

SEQ ID NO: 154085 - DNA, 31 bp, Artificial Sequence
  Description of Artificial Sequence: Synthetic oligonucleotide
tgatgaacaagaccctcaggaggtgacgtac

SEQ ID NO: 154086 - DNA, 30 bp, Artificial Sequence
  Description of Artificial Sequence: Synthetic oligonucleotide
gatgaacaagaccctcaggaggtgacgtac

SEQ ID NO: 154087 - DNA, 31 bp, Artificial Sequence
  Description of Artificial Sequence: Synthetic oligonucleotide
atgaacaagaccctcaggaggtgacgtacac

SEQ ID NO: 154088 - DNA, 30 bp, Artificial Sequence
  Description of Artificial Sequence: Synthetic oligonucleotide
tgaacaagaccctcaggaggtgacgtacac

SEQ ID NO: 154089 - DNA, 29 bp, Artificial Sequence
  Description of Artificial Sequence: Synthetic oligonucleotide
gaacaagaccctcaggaggtgacgtacac

SEQ ID NO: 154090 - DNA, 30 bp, Artificial Sequence
  Description of Artificial Sequence: Synthetic oligonucleotide
aacaagaccctcaggaggtgacgtacacac

SEQ ID NO: 154091 - DNA, 29 bp, Artificial Sequence
  Description of Artificial Sequence: Synthetic oligonucleotide
acaagaccctcaggaggtgacgtacacac

SEQ ID NO: 154092 - DNA, 28 bp, Artificial Sequence
  Description of Artificial Sequence: Synthetic oligonucleotide
caagaccctcaggaggtgacgtacacac

SEQ ID NO: 154093 - DNA, 29 bp, Artificial Sequence
  Description of Artificial Sequence: Synthetic oligonucleotide
aagaccctcaggaggtgacgtacacacag

SEQ ID NO: 154094 - DNA, 28 bp, Artificial Sequence
  Description of Artificial Sequence: Synthetic oligonucleotide
agaccctcaggaggtgacgtacacacag

SEQ ID NO: 154095 - DNA, 27 bp, Artificial Sequence
  Description of Artificial Sequence: Synthetic oligonucleotide
gaccctcaggaggtgacgtacacacag

SEQ ID NO: 154096 - DNA, 29 bp, Artificial Sequence
  Description of Artificial Sequence: Synthetic oligonucleotide
accctcaggaggtgacgtacacacagttg

SEQ ID NO: 154097 - DNA, 28 bp, Artificial Sequence
  Description of Artificial Sequence: Synthetic oligonucleotide
ccctcaggaggtgacgtacacacagttg

SEQ ID NO: 154098 - DNA, 31 bp, Artificial Sequence
  Description of Artificial Sequence: Synthetic oligonucleotide
cctcaggaggtgacgtacacacagttgaatc

SEQ ID NO: 154099 - DNA, 32 bp, Artificial Sequence
  Description of Artificial Sequence: Synthetic oligonucleotide
ctcaggaggtgacgtacacacagttgaatcac

SEQ ID NO: 154100 - DNA, 33 bp, Artificial Sequence
  Description of Artificial Sequence: Synthetic oligonucleotide
tcaggaggtgacgtacacacagttgaatcactg

SEQ ID NO: 154101 - DNA, 32 bp, Artificial Sequence
  Description of Artificial Sequence: Synthetic oligonucleotide
caggaggtgacgtacacacagttgaatcactg

SEQ ID NO: 154102 - DNA, 32 bp, Artificial Sequence
  Description of Artificial Sequence: Synthetic oligonucleotide
aggaggtgacgtacacacagttgaatcactgc

SEQ ID NO: 154103 - DNA, 31 bp, Artificial Sequence
  Description of Artificial Sequence: Synthetic oligonucleotide
ggaggtgacgtacacacagttgaatcactgc

SEQ ID NO: 154104 - DNA, 31 bp, Artificial Sequence
  Description of Artificial Sequence: Synthetic oligonucleotide
gaggtgacgtacacacagttgaatcactgcg

SEQ ID NO: 154105 - DNA, 35 bp, Artificial Sequence
  Description of Artificial Sequence: Synthetic oligonucleotide
aggtgacgtacacacagttgaatcactgcgttttc

SEQ ID NO: 154106 - DNA, 34 bp, Artificial Sequence
  Description of Artificial Sequence: Synthetic oligonucleotide
ggtgacgtacacacagttgaatcactgcgttttc

SEQ ID NO: 154107 - DNA, 35 bp, Artificial Sequence
  Description of Artificial Sequence: Synthetic oligonucleotide
gtgacgtacacacagttgaatcactgcgttttcac

SEQ ID NO: 154108 - DNA, 36 bp, Artificial Sequence
  Description of Artificial Sequence: Synthetic oligonucleotide
tgacgtacacacagttgaatcactgcgttttcacac

SEQ ID NO: 154109 - DNA, 35 bp, Artificial Sequence
  Description of Artificial Sequence: Synthetic oligonucleotide
gacgtacacacagttgaatcactgcgttttcacac

SEQ ID NO: 154110 - DNA, 36 bp, Artificial Sequence
  Description of Artificial Sequence: Synthetic oligonucleotide
acgtacacacagttgaatcactgcgttttcacacag

SEQ ID NO: 154111 - DNA, 35 bp, Artificial Sequence
  Description of Artificial Sequence: Synthetic oligonucleotide
cgtacacacagttgaatcactgcgttttcacacag

SEQ ID NO: 154112 - DNA, 36 bp, Artificial Sequence
  Description of Artificial Sequence: Synthetic oligonucleotide
gtacacacagttgaatcactgcgttttcacacagag

SEQ ID NO: 154113 - DNA, 37 bp, Artificial Sequence
  Description of Artificial Sequence: Synthetic oligonucleotide
cttcattgctggtgctccaacaaaaaaaatgctgctg

SEQ ID NO: 154114 - DNA, 41 bp, Artificial Sequence
  Description of Artificial Sequence: Synthetic oligonucleotide
ttcattgctggtgctccaacaaaaaaaatgctgctgtaatg

SEQ ID NO: 154115 - DNA, 40 bp, Artificial Sequence
  Description of Artificial Sequence: Synthetic oligonucleotide
tcattgctggtgctccaacaaaaaaaatgctgctgtaatg

SEQ ID NO: 154116 - DNA, 39 bp, Artificial Sequence
  Description of Artificial Sequence: Synthetic oligonucleotide
cattgctggtgctccaacaaaaaaaatgctgctgtaatg

SEQ ID NO: 154117 - DNA, 39 bp, Artificial Sequence
  Description of Artificial Sequence: Synthetic oligonucleotide
attgctggtgctccaacaaaaaaaatgctgctgtaatgg

SEQ ID NO: 154118 - DNA, 38 bp, Artificial Sequence
  Description of Artificial Sequence: Synthetic oligonucleotide
ttgctggtgctccaacaaaaaaaatgctgctgtaatgg

SEQ ID NO: 154119 - DNA, 37 bp, Artificial Sequence
  Description of Artificial Sequence: Synthetic oligonucleotide
tgctggtgctccaacaaaaaaaatgctgctgtaatgg

SEQ ID NO: 154120 - DNA, 36 bp, Artificial Sequence
  Description of Artificial Sequence: Synthetic oligonucleotide
gctggtgctccaacaaaaaaaatgctgctgtaatgg

SEQ ID NO: 154121 - DNA, 37 bp, Artificial Sequence
  Description of Artificial Sequence: Synthetic oligonucleotide
ctggtgctccaacaaaaaaaatgctgctgtaatggac

SEQ ID NO: 154122 - DNA, 37 bp, Artificial Sequence
  Description of Artificial Sequence: Synthetic oligonucleotide
tggtgctccaacaaaaaaaatgctgctgtaatggacc

SEQ ID NO: 154123 - DNA, 36 bp, Artificial Sequence
  Description of Artificial Sequence: Synthetic oligonucleotide
ggtgctccaacaaaaaaaatgctgctgtaatggacc

SEQ ID NO: 154124 - DNA, 38 bp, Artificial Sequence
  Description of Artificial Sequence: Synthetic oligonucleotide
gtgctccaacaaaaaaaatgctgctgtaatggaccaag

SEQ ID NO: 154125 - DNA, 39 bp, Artificial Sequence
  Description of Artificial Sequence: Synthetic oligonucleotide
tgctccaacaaaaaaaatgctgctgtaatggaccaagag

SEQ ID NO: 154126 - DNA, 38 bp, Artificial Sequence
  Description of Artificial Sequence: Synthetic oligonucleotide
gctccaacaaaaaaaatgctgctgtaatggaccaagag

SEQ ID NO: 154127 - DNA, 39 bp, Artificial Sequence
  Description of Artificial Sequence: Synthetic oligonucleotide
ctccaacaaaaaaaatgctgctgtaatggaccaagagtc

SEQ ID NO: 154128 - DNA, 40 bp, Artificial Sequence
  Description of Artificial Sequence: Synthetic oligonucleotide
tccaacaaaaaaaatgctgctgtaatggaccaagagtctg

SEQ ID NO: 154129 - DNA, 39 bp, Artificial Sequence
  Description of Artificial Sequence: Synthetic oligonucleotide
ccaacaaaaaaaatgctgctgtaatggaccaagagtctg

SEQ ID NO: 154130 - DNA, 39 bp, Artificial Sequence
  Description of Artificial Sequence: Synthetic oligonucleotide
caacaaaaaaaatgctgctgtaatggaccaagagtctgc

SEQ ID NO: 154131 - DNA, 40 bp, Artificial Sequence
  Description of Artificial Sequence: Synthetic oligonucleotide
aacaaaaaaaatgctgctgtaatggaccaagagtctgcag

SEQ ID NO: 154132 - DNA, 39 bp, Artificial Sequence
  Description of Artificial Sequence: Synthetic oligonucleotide
acaaaaaaaatgctgctgtaatggaccaagagtctgcag

SEQ ID NO: 154133 - DNA, 38 bp, Artificial Sequence
  Description of Artificial Sequence: Synthetic oligonucleotide
caaaaaaaatgctgctgtaatggaccaagagtctgcag

SEQ ID NO: 154134 - DNA, 38 bp, Artificial Sequence
  Description of Artificial Sequence: Synthetic oligonucleotide
aaaaaaaatgctgctgtaatggaccaagagtctgcagg

SEQ ID NO: 154135 - DNA, 37 bp, Artificial Sequence
  Description of Artificial Sequence: Synthetic oligonucleotide
aaaaaaatgctgctgtaatggaccaagagtctgcagg

SEQ ID NO: 154136 - DNA, 36 bp, Artificial Sequence
  Description of Artificial Sequence: Synthetic oligonucleotide
aaaaaatgctgctgtaatggaccaagagtctgcagg

SEQ ID NO: 154137 - DNA, 35 bp, Artificial Sequence
  Description of Artificial Sequence: Synthetic oligonucleotide
aaaaatgctgctgtaatggaccaagagtctgcagg

SEQ ID NO: 154138 - DNA, 34 bp, Artificial Sequence
  Description of Artificial Sequence: Synthetic oligonucleotide
aaaatgctgctgtaatggaccaagagtctgcagg

SEQ ID NO: 154139 - DNA, 33 bp, Artificial Sequence
  Description of Artificial Sequence: Synthetic oligonucleotide
aaatgctgctgtaatggaccaagagtctgcagg

SEQ ID NO: 154140 - DNA, 32 bp, Artificial Sequence
  Description of Artificial Sequence: Synthetic oligonucleotide
aatgctgctgtaatggaccaagagtctgcagg

SEQ ID NO: 154141 - DNA, 31 bp, Artificial Sequence
  Description of Artificial Sequence: Synthetic oligonucleotide
atgctgctgtaatggaccaagagtctgcagg

SEQ ID NO: 154142 - DNA, 30 bp, Artificial Sequence
  Description of Artificial Sequence: Synthetic oligonucleotide
tgctgctgtaatggaccaagagtctgcagg

SEQ ID NO: 154143 - DNA, 29 bp, Artificial Sequence
  Description of Artificial Sequence: Synthetic oligonucleotide
gctgctgtaatggaccaagagtctgcagg

SEQ ID NO: 154144 - DNA, 32 bp, Artificial Sequence
  Description of Artificial Sequence: Synthetic oligonucleotide
ctgctgtaatggaccaagagtctgcaggaaac

SEQ ID NO: 154145 - DNA, 33 bp, Artificial Sequence
  Description of Artificial Sequence: Synthetic oligonucleotide
tgctgtaatggaccaagagtctgcaggaaacag

SEQ ID NO: 154146 - DNA, 32 bp, Artificial Sequence
  Description of Artificial Sequence: Synthetic oligonucleotide
gctgtaatggaccaagagtctgcaggaaacag

SEQ ID NO: 154147 - DNA, 34 bp, Artificial Sequence
  Description of Artificial Sequence: Synthetic oligonucleotide
ctgtaatggaccaagagtctgcaggaaacagaac

SEQ ID NO: 154148 - DNA, 35 bp, Artificial Sequence
  Description of Artificial Sequence: Synthetic oligonucleotide
tgtaatggaccaagagtctgcaggaaacagaacag

SEQ ID NO: 154149 - DNA, 28 bp, Artificial Sequence
  Description of Artificial Sequence: Synthetic oligonucleotide
tgcggtaatggaccaagagtctgcaggg

SEQ ID NO: 154150 - DNA, 27 bp, Artificial Sequence
  Description of Artificial Sequence: Synthetic oligonucleotide
gcggtaatggaccaagagtctgcaggg

SEQ ID NO: 154151 - DNA, 29 bp, Artificial Sequence
  Description of Artificial Sequence: Synthetic oligonucleotide
cggtaatggaccaagagtctgcagggaac

SEQ ID NO: 154152 - DNA, 30 bp, Artificial Sequence
  Description of Artificial Sequence: Synthetic oligonucleotide
ggtaatggaccaagagtctgcagggaacag

SEQ ID NO: 154153 - DNA, 32 bp, Artificial Sequence
  Description of Artificial Sequence: Synthetic oligonucleotide
gtaatggaccaagagtctgcagggaacagaac

SEQ ID NO: 154154 - DNA, 33 bp, Artificial Sequence
  Description of Artificial Sequence: Synthetic oligonucleotide
taatggaccaagagtctgcagggaacagaacag

SEQ ID NO: 154155 - DNA, 32 bp, Artificial Sequence
  Description of Artificial Sequence: Synthetic oligonucleotide
aatggaccaagagtctgcagggaacagaacag

SEQ ID NO: 154156 - DNA, 31 bp, Artificial Sequence
  Description of Artificial Sequence: Synthetic oligonucleotide
atggaccaagagtctgcagggaacagaacag

SEQ ID NO: 154157 - DNA, 30 bp, Artificial Sequence
  Description of Artificial Sequence: Synthetic oligonucleotide
tggaccaagagtctgcagggaacagaacag

SEQ ID NO: 154158 - DNA, 29 bp, Artificial Sequence
  Description of Artificial Sequence: Synthetic oligonucleotide
ggaccaagagtctgcagggaacagaacag

SEQ ID NO: 154159 - DNA, 29 bp, Artificial Sequence
  Description of Artificial Sequence: Synthetic oligonucleotide
gaccaagagtctgcagggaacagaacagc

SEQ ID NO: 154160 - DNA, 29 bp, Artificial Sequence
  Description of Artificial Sequence: Synthetic oligonucleotide
accaagagtctgcagggaacagaacagcg

SEQ ID NO: 154161 - DNA, 28 bp, Artificial Sequence
  Description of Artificial Sequence: Synthetic oligonucleotide
ccaagagtctgcagggaacagaacagcg

SEQ ID NO: 154162 - DNA, 32 bp, Artificial Sequence
  Description of Artificial Sequence: Synthetic oligonucleotide
caagagtctgcagggaacagaacagcgaatag

SEQ ID NO: 154163 - DNA, 32 bp, Artificial Sequence
  Description of Artificial Sequence: Synthetic oligonucleotide
aagagtctgcagggaacagaacagcgaatagc

SEQ ID NO: 154164 - DNA, 31 bp, Artificial Sequence
  Description of Artificial Sequence: Synthetic oligonucleotide
agagtctgcagggaacagaacagcgaatagc

SEQ ID NO: 154165 - DNA, 30 bp, Artificial Sequence
  Description of Artificial Sequence: Synthetic oligonucleotide
gagtctgcagggaacagaacagcgaatagc

SEQ ID NO: 154166 - DNA, 30 bp, Artificial Sequence
  Description of Artificial Sequence: Synthetic oligonucleotide
agtctgcagggaacagaacagcgaatagcg

SEQ ID NO: 154167 - DNA, 29 bp, Artificial Sequence
  Description of Artificial Sequence: Synthetic oligonucleotide
gtctgcagggaacagaacagcgaatagcg

SEQ ID NO: 154168 - DNA, 30 bp, Artificial Sequence
  Description of Artificial Sequence: Synthetic oligonucleotide
tctgcagggaacagaacagcgaatagcgag

SEQ ID NO: 154169 - DNA, 29 bp, Artificial Sequence
  Description of Artificial Sequence: Synthetic oligonucleotide
ctgcagggaacagaacagcgaatagcgag

SEQ ID NO: 154170 - DNA, 29 bp, Artificial Sequence
  Description of Artificial Sequence: Synthetic oligonucleotide
tgcagggaacagaacagcgaatagcgagg

SEQ ID NO: 154171 - DNA, 28 bp, Artificial Sequence
  Description of Artificial Sequence: Synthetic oligonucleotide
gcagggaacagaacagcgaatagcgagg

SEQ ID NO: 154172 - DNA, 29 bp, Artificial Sequence
  Description of Artificial Sequence: Synthetic oligonucleotide
cagggaacagaacagcgaatagcgaggac

SEQ ID NO: 154173 - DNA, 30 bp, Artificial Sequence
  Description of Artificial Sequence: Synthetic oligonucleotide
agggaacagaacagcgaatagcgaggactc

SEQ ID NO: 154174 - DNA, 29 bp, Artificial Sequence
  Description of Artificial Sequence: Synthetic oligonucleotide
gggaacagaacagcgaatagcgaggactc

SEQ ID NO: 154175 - DNA, 30 bp, Artificial Sequence
  Description of Artificial Sequence: Synthetic oligonucleotide
ggaacagaacagcgaatagcgaggactctg

SEQ ID NO: 154176 - DNA, 32 bp, Artificial Sequence
  Description of Artificial Sequence: Synthetic oligonucleotide
gaacagaacagcgaatagcgaggactctgatg

SEQ ID NO: 154177 - DNA, 32 bp, Artificial Sequence
  Description of Artificial Sequence: Synthetic oligonucleotide
caagacacccccaacagatatcatcgtgtacg

SEQ ID NO: 154178 - DNA, 32 bp, Artificial Sequence
  Description of Artificial Sequence: Synthetic oligonucleotide
aagacacccccaacagatatcatcgtgtacgc

SEQ ID NO: 154179 - DNA, 31 bp, Artificial Sequence
  Description of Artificial Sequence: Synthetic oligonucleotide
agacacccccaacagatatcatcgtgtacgc

SEQ ID NO: 154180 - DNA, 30 bp, Artificial Sequence
  Description of Artificial Sequence: Synthetic oligonucleotide
gacacccccaacagatatcatcgtgtacgc

SEQ ID NO: 154181 - DNA, 30 bp, Artificial Sequence
  Description of Artificial Sequence: Synthetic oligonucleotide
acacccccaacagatatcatcgtgtacgcg

SEQ ID NO: 154182 - DNA, 29 bp, Artificial Sequence
  Description of Artificial Sequence: Synthetic oligonucleotide
cacccccaacagatatcatcgtgtacgcg

SEQ ID NO: 154183 - DNA, 29 bp, Artificial Sequence
  Description of Artificial Sequence: Synthetic oligonucleotide
acccccaacagatatcatcgtgtacgcgg

SEQ ID NO: 154184 - DNA, 28 bp, Artificial Sequence
  Description of Artificial Sequence: Synthetic oligonucleotide
cccccaacagatatcatcgtgtacgcgg

SEQ ID NO: 154185 - DNA, 30 bp, Artificial Sequence
  Description of Artificial Sequence: Synthetic oligonucleotide
ccccaacagatatcatcgtgtacgcggaac

SEQ ID NO: 154186 - DNA, 32 bp, Artificial Sequence
  Description of Artificial Sequence: Synthetic oligonucleotide
cccaacagatatcatcgtgtacgcggaacttc

SEQ ID NO: 154187 - DNA, 32 bp, Artificial Sequence
  Description of Artificial Sequence: Synthetic oligonucleotide
ccaacagatatcatcgtgtacgcggaacttcc

SEQ ID NO: 154188 - DNA, 36 bp, Artificial Sequence
  Description of Artificial Sequence: Synthetic oligonucleotide
caacagatatcatcgtgtacgcggaacttccaaatg

SEQ ID NO: 154189 - DNA, 36 bp, Artificial Sequence
  Description of Artificial Sequence: Synthetic oligonucleotide
aacagatatcatcgtgtacgcggaacttccaaatgc

SEQ ID NO: 154190 - DNA, 35 bp, Artificial Sequence
  Description of Artificial Sequence: Synthetic oligonucleotide
acagatatcatcgtgtacgcggaacttccaaatgc

SEQ ID NO: 154191 - DNA, 34 bp, Artificial Sequence
  Description of Artificial Sequence: Synthetic oligonucleotide
cagatatcatcgtgtacgcggaacttccaaatgc

SEQ ID NO: 154192 - DNA, 35 bp, Artificial Sequence
  Description of Artificial Sequence: Synthetic oligonucleotide
agatatcatcgtgtacgcggaacttccaaatgctg

SEQ ID NO: 154193 - DNA, 34 bp, Artificial Sequence
  Description of Artificial Sequence: Synthetic oligonucleotide
gatatcatcgtgtacgcggaacttccaaatgctg

SEQ ID NO: 154194 - DNA, 35 bp, Artificial Sequence
  Description of Artificial Sequence: Synthetic oligonucleotide
atatcatcgtgtacgcggaacttccaaatgctgag

SEQ ID NO: 154195 - DNA, 34 bp, Artificial Sequence
  Description of Artificial Sequence: Synthetic oligonucleotide
tatcatcgtgtacgcggaacttccaaatgctgag

SEQ ID NO: 154196 - DNA, 33 bp, Artificial Sequence
  Description of Artificial Sequence: Synthetic oligonucleotide
atcatcgtgtacgcggaacttccaaatgctgag

SEQ ID NO: 154197 - DNA, 32 bp, Artificial Sequence
  Description of Artificial Sequence: Synthetic oligonucleotide
tcatcgtgtacgcggaacttccaaatgctgag

SEQ ID NO: 154198 - DNA, 31 bp, Artificial Sequence
  Description of Artificial Sequence: Synthetic oligonucleotide
catcgtgtacgcggaacttccaaatgctgag

SEQ ID NO: 154199 - DNA, 32 bp, Artificial Sequence
  Description of Artificial Sequence: Synthetic oligonucleotide
atcgtgtacgcggaacttccaaatgctgagtc

SEQ ID NO: 154200 - DNA, 31 bp, Artificial Sequence
  Description of Artificial Sequence: Synthetic oligonucleotide
tcgtgtacgcggaacttccaaatgctgagtc

SEQ ID NO: 154201 - DNA, 30 bp, Artificial Sequence
  Description of Artificial Sequence: Synthetic oligonucleotide
cgtgtacgcggaacttccaaatgctgagtc

SEQ ID NO: 154202 - DNA, 30 bp, Artificial Sequence
  Description of Artificial Sequence: Synthetic oligonucleotide
gtgtacgcggaacttccaaatgctgagtcc

SEQ ID NO: 154203 - DNA, 31 bp, Artificial Sequence
  Description of Artificial Sequence: Synthetic oligonucleotide
tgtacgcggaacttccaaatgctgagtccag

SEQ ID NO: 154204 - DNA, 30 bp, Artificial Sequence
  Description of Artificial Sequence: Synthetic oligonucleotide
gtacgcggaacttccaaatgctgagtccag

SEQ ID NO: 154205 - DNA, 32 bp, Artificial Sequence
  Description of Artificial Sequence: Synthetic oligonucleotide
tacgcggaacttccaaatgctgagtccagatc

SEQ ID NO: 154206 - DNA, 31 bp, Artificial Sequence
  Description of Artificial Sequence: Synthetic oligonucleotide
acgcggaacttccaaatgctgagtccagatc

SEQ ID NO: 154207 - DNA, 30 bp, Artificial Sequence
  Description of Artificial Sequence: Synthetic oligonucleotide
cgcggaacttccaaatgctgagtccagatc

SEQ ID NO: 154208 - DNA, 30 bp, Artificial Sequence
  Description of Artificial Sequence: Synthetic oligonucleotide
gcggaacttccaaatgctgagtccagatcc

SEQ ID NO: 154209 - DNA, 27 bp, Artificial Sequence
  Description of Artificial Sequence: Synthetic oligonucleotide
cccaaggtcaacggaacattccaggcc

SEQ ID NO: 154210 - DNA, 27 bp, Artificial Sequence
  Description of Artificial Sequence: Synthetic oligonucleotide
ccaaggtcaacggaacattccaggccg

SEQ ID NO: 154211 - DNA, 28 bp, Artificial Sequence
  Description of Artificial Sequence: Synthetic oligonucleotide
caaggtcaacggaacattccaggccgac

SEQ ID NO: 154212 - DNA, 31 bp, Artificial Sequence
  Description of Artificial Sequence: Synthetic oligonucleotide
aaggtcaacggaacattccaggccgactttc

SEQ ID NO: 154213 - DNA, 30 bp, Artificial Sequence
  Description of Artificial Sequence: Synthetic oligonucleotide
aggtcaacggaacattccaggccgactttc

SEQ ID NO: 154214 - DNA, 29 bp, Artificial Sequence
  Description of Artificial Sequence: Synthetic oligonucleotide
ggtcaacggaacattccaggccgactttc

SEQ ID NO: 154215 - DNA, 29 bp, Artificial Sequence
  Description of Artificial Sequence: Synthetic oligonucleotide
gtcaacggaacattccaggccgactttcc

SEQ ID NO: 154216 - DNA, 30 bp, Artificial Sequence
  Description of Artificial Sequence: Synthetic oligonucleotide
tcaacggaacattccaggccgactttcctc

SEQ ID NO: 154217 - DNA, 29 bp, Artificial Sequence
  Description of Artificial Sequence: Synthetic oligonucleotide
caacggaacattccaggccgactttcctc

SEQ ID NO: 154218 - DNA, 30 bp, Artificial Sequence
  Description of Artificial Sequence: Synthetic oligonucleotide
aacggaacattccaggccgactttcctctg

SEQ ID NO: 154219 - DNA, 29 bp, Artificial Sequence
  Description of Artificial Sequence: Synthetic oligonucleotide
acggaacattccaggccgactttcctctg

SEQ ID NO: 154220 - DNA, 28 bp, Artificial Sequence
  Description of Artificial Sequence: Synthetic oligonucleotide
cggaacattccaggccgactttcctctg

SEQ ID NO: 154221 - DNA, 28 bp, Artificial Sequence
  Description of Artificial Sequence: Synthetic oligonucleotide
ggaacattccaggccgactttcctctgg

SEQ ID NO: 154222 - DNA, 28 bp, Artificial Sequence
  Description of Artificial Sequence: Synthetic oligonucleotide
gaacattccaggccgactttcctctggg

SEQ ID NO: 154223 - DNA, 28 bp, Artificial Sequence
  Description of Artificial Sequence: Synthetic oligonucleotide
aacattccaggccgactttcctctgggc

SEQ ID NO: 154224 - DNA, 27 bp, Artificial Sequence
  Description of Artificial Sequence: Synthetic oligonucleotide
acattccaggccgactttcctctgggc

SEQ ID NO: 154225 - DNA, 26 bp, Artificial Sequence
  Description of Artificial Sequence: Synthetic oligonucleotide
cattccaggccgactttcctctgggc

SEQ ID NO: 154226 - DNA, 26 bp, Artificial Sequence
  Description of Artificial Sequence: Synthetic oligonucleotide
attccaggccgactttcctctgggcc

SEQ ID NO: 154227 - DNA, 25 bp, Artificial Sequence
  Description of Artificial Sequence: Synthetic oligonucleotide
ttccaggccgactttcctctgggcc

SEQ ID NO: 154228 - DNA, 24 bp, Artificial Sequence
  Description of Artificial Sequence: Synthetic oligonucleotide
tccaggccgactttcctctgggcc

SEQ ID NO: 154229 - DNA, 23 bp, Artificial Sequence
  Description of Artificial Sequence: Synthetic oligonucleotide
ccaggccgactttcctctgggcc

SEQ ID NO: 154230 - DNA, 24 bp, Artificial Sequence
  Description of Artificial Sequence: Synthetic oligonucleotide
caggccgactttcctctgggccct

SEQ ID NO: 154231 - DNA, 24 bp, Artificial Sequence
  Description of Artificial Sequence: Synthetic oligonucleotide
aggccgactttcctctgggccctg

SEQ ID NO: 154232 - DNA, 23 bp, Artificial Sequence
  Description of Artificial Sequence: Synthetic oligonucleotide
ggccgactttcctctgggccctg

SEQ ID NO: 154233 - DNA, 23 bp, Artificial Sequence
  Description of Artificial Sequence: Synthetic oligonucleotide
gccgactttcctctgggccctgc

SEQ ID NO: 154234 - DNA, 24 bp, Artificial Sequence
  Description of Artificial Sequence: Synthetic oligonucleotide
ccgactttcctctgggccctgcca

SEQ ID NO: 154235 - DNA, 24 bp, Artificial Sequence
  Description of Artificial Sequence: Synthetic oligonucleotide
cgactttcctctgggccctgccac

SEQ ID NO: 154236 - DNA, 26 bp, Artificial Sequence
  Description of Artificial Sequence: Synthetic oligonucleotide
tgtcagctcccagtgaccctctggac

SEQ ID NO: 154237 - DNA, 25 bp, Artificial Sequence
  Description of Artificial Sequence: Synthetic oligonucleotide
gtcagctcccagtgaccctctggac

SEQ ID NO: 154238 - DNA, 26 bp, Artificial Sequence
  Description of Artificial Sequence: Synthetic oligonucleotide
tcagctcccagtgaccctctggacgt

SEQ ID NO: 154239 - DNA, 25 bp, Artificial Sequence
  Description of Artificial Sequence: Synthetic oligonucleotide
cagctcccagtgaccctctggacgt

SEQ ID NO: 154240 - DNA, 25 bp, Artificial Sequence
  Description of Artificial Sequence: Synthetic oligonucleotide
agctcccagtgaccctctggacgtc

SEQ ID NO: 154241 - DNA, 24 bp, Artificial Sequence
  Description of Artificial Sequence: Synthetic oligonucleotide
gctcccagtgaccctctggacgtc

SEQ ID NO: 154242 - DNA, 25 bp, Artificial Sequence
  Description of Artificial Sequence: Synthetic oligonucleotide
ctcccagtgaccctctggacgtcgt

SEQ ID NO: 154243 - DNA, 27 bp, Artificial Sequence
  Description of Artificial Sequence: Synthetic oligonucleotide
tcccagtgaccctctggacgtcgtgat

SEQ ID NO: 154244 - DNA, 26 bp, Artificial Sequence
  Description of Artificial Sequence: Synthetic oligonucleotide
cccagtgaccctctggacgtcgtgat

SEQ ID NO: 154245 - DNA, 27 bp, Artificial Sequence
  Description of Artificial Sequence: Synthetic oligonucleotide
ccagtgaccctctggacgtcgtgatca

SEQ ID NO: 154246 - DNA, 29 bp, Artificial Sequence
  Description of Artificial Sequence: Synthetic oligonucleotide
cagtgaccctctggacgtcgtgatcatag

SEQ ID NO: 154247 - DNA, 29 bp, Artificial Sequence
  Description of Artificial Sequence: Synthetic oligonucleotide
agtgaccctctggacgtcgtgatcatagg

SEQ ID NO: 154248 - DNA, 28 bp, Artificial Sequence
  Description of Artificial Sequence: Synthetic oligonucleotide
gtgaccctctggacgtcgtgatcatagg

SEQ ID NO: 154249 - DNA, 29 bp, Artificial Sequence
  Description of Artificial Sequence: Synthetic oligonucleotide
tgaccctctggacgtcgtgatcataggtc

SEQ ID NO: 154250 - DNA, 28 bp, Artificial Sequence
  Description of Artificial Sequence: Synthetic oligonucleotide
gaccctctggacgtcgtgatcataggtc

SEQ ID NO: 154251 - DNA, 33 bp, Artificial Sequence
  Description of Artificial Sequence: Synthetic oligonucleotide
accctctggacgtcgtgatcataggtctatatg

SEQ ID NO: 154252 - DNA, 32 bp, Artificial Sequence
  Description of Artificial Sequence: Synthetic oligonucleotide
ccctctggacgtcgtgatcataggtctatatg

SEQ ID NO: 154253 - DNA, 33 bp, Artificial Sequence
  Description of Artificial Sequence: Synthetic oligonucleotide
cctctggacgtcgtgatcataggtctatatgag

SEQ ID NO: 154254 - DNA, 36 bp, Artificial Sequence
  Description of Artificial Sequence: Synthetic oligonucleotide
ctctggacgtcgtgatcataggtctatatgagaaac

SEQ ID NO: 154255 - DNA, 36 bp, Artificial Sequence
  Description of Artificial Sequence: Synthetic oligonucleotide
tctggacgtcgtgatcataggtctatatgagaaacc

SEQ ID NO: 154256 - DNA, 35 bp, Artificial Sequence
  Description of Artificial Sequence: Synthetic oligonucleotide
ctggacgtcgtgatcataggtctatatgagaaacc

SEQ ID NO: 154257 - DNA, 37 bp, Artificial Sequence
  Description of Artificial Sequence: Synthetic oligonucleotide
tggacgtcgtgatcataggtctatatgagaaaccttc

SEQ ID NO: 154258 - DNA, 36 bp, Artificial Sequence
  Description of Artificial Sequence: Synthetic oligonucleotide
ggacgtcgtgatcataggtctatatgagaaaccttc

SEQ ID NO: 154259 - DNA, 37 bp, Artificial Sequence
  Description of Artificial Sequence: Synthetic oligonucleotide
gacgtcgtgatcataggtctatatgagaaaccttctc

SEQ ID NO: 154260 - DNA, 38 bp, Artificial Sequence
  Description of Artificial Sequence: Synthetic oligonucleotide
acgtcgtgatcataggtctatatgagaaaccttctctc

SEQ ID NO: 154261 - DNA, 37 bp, Artificial Sequence
  Description of Artificial Sequence: Synthetic oligonucleotide
cgtcgtgatcataggtctatatgagaaaccttctctc

SEQ ID NO: 154262 - DNA, 38 bp, Artificial Sequence
  Description of Artificial Sequence: Synthetic oligonucleotide
gtcgtgatcataggtctatatgagaaaccttctctctc

SEQ ID NO: 154263 - DNA, 27 bp, Artificial Sequence
  Description of Artificial Sequence: Synthetic oligonucleotide
aaaaccttccctcctggcccacccaga

SEQ ID NO: 154264 - DNA, 27 bp, Artificial Sequence
  Description of Artificial Sequence: Synthetic oligonucleotide
aaaccttccctcctggcccacccagat

SEQ ID NO: 154265 - DNA, 26 bp, Artificial Sequence
  Description of Artificial Sequence: Synthetic oligonucleotide
aaccttccctcctggcccacccagat

SEQ ID NO: 154266 - DNA, 25 bp, Artificial Sequence
  Description of Artificial Sequence: Synthetic oligonucleotide
accttccctcctggcccacccagat

SEQ ID NO: 154267 - DNA, 24 bp, Artificial Sequence
  Description of Artificial Sequence: Synthetic oligonucleotide
ccttccctcctggcccacccagat

SEQ ID NO: 154268 - DNA, 24 bp, Artificial Sequence
  Description of Artificial Sequence: Synthetic oligonucleotide
cttccctcctggcccacccagatc

SEQ ID NO: 154269 - DNA, 24 bp, Artificial Sequence
  Description of Artificial Sequence: Synthetic oligonucleotide
ttccctcctggcccacccagatcc

SEQ ID NO: 154270 - DNA, 23 bp, Artificial Sequence
  Description of Artificial Sequence: Synthetic oligonucleotide
tccctcctggcccacccagatcc

SEQ ID NO: 154271 - DNA, 22 bp, Artificial Sequence
  Description of Artificial Sequence: Synthetic oligonucleotide
ccctcctggcccacccagatcc

SEQ ID NO: 154272 - DNA, 22 bp, Artificial Sequence
  Description of Artificial Sequence: Synthetic oligonucleotide
cctcctggcccacccagatccc

SEQ ID NO: 154273 - DNA, 23 bp, Artificial Sequence
  Description of Artificial Sequence: Synthetic oligonucleotide
ctcctggcccacccagatcccct

SEQ ID NO: 154274 - DNA, 23 bp, Artificial Sequence
  Description of Artificial Sequence: Synthetic oligonucleotide
tcctggcccacccagatcccctg

SEQ ID NO: 154275 - DNA, 22 bp, Artificial Sequence
  Description of Artificial Sequence: Synthetic oligonucleotide
cctggcccacccagatcccctg

SEQ ID NO: 154276 - DNA, 23 bp, Artificial Sequence
  Description of Artificial Sequence: Synthetic oligonucleotide
ctggcccacccagatcccctggt

SEQ ID NO: 154277 - DNA, 27 bp, Artificial Sequence
  Description of Artificial Sequence: Synthetic oligonucleotide
tggcccacccagatcccctggtgaaat

SEQ ID NO: 154278 - DNA, 26 bp, Artificial Sequence
  Description of Artificial Sequence: Synthetic oligonucleotide
ggcccacccagatcccctggtgaaat

SEQ ID NO: 154279 - DNA, 27 bp, Artificial Sequence
  Description of Artificial Sequence: Synthetic oligonucleotide
gcccacccagatcccctggtgaaatca

SEQ ID NO: 154280 - DNA, 27 bp, Artificial Sequence
  Description of Artificial Sequence: Synthetic oligonucleotide
cccacccagatcccctggtgaaatcag

SEQ ID NO: 154281 - DNA, 29 bp, Artificial Sequence
  Description of Artificial Sequence: Synthetic oligonucleotide
ccacccagatcccctggtgaaatcagaag

SEQ ID NO: 154282 - DNA, 30 bp, Artificial Sequence
  Description of Artificial Sequence: Synthetic oligonucleotide
cacccagatcccctggtgaaatcagaagag

SEQ ID NO: 154283 - DNA, 31 bp, Artificial Sequence
  Description of Artificial Sequence: Synthetic oligonucleotide
acccagatcccctggtgaaatcagaagagac

SEQ ID NO: 154284 - DNA, 30 bp, Artificial Sequence
  Description of Artificial Sequence: Synthetic oligonucleotide
cccagatcccctggtgaaatcagaagagac

SEQ ID NO: 154285 - DNA, 31 bp, Artificial Sequence
  Description of Artificial Sequence: Synthetic oligonucleotide
ccagatcccctggtgaaatcagaagagacag

SEQ ID NO: 154286 - DNA, 32 bp, Artificial Sequence
  Description of Artificial Sequence: Synthetic oligonucleotide
cagatcccctggtgaaatcagaagagacagtc

SEQ ID NO: 154287 - DNA, 34 bp, Artificial Sequence
  Description of Artificial Sequence: Synthetic oligonucleotide
agatcccctggtgaaatcagaagagacagtcatc

SEQ ID NO: 154288 - DNA, 33 bp, Artificial Sequence
  Description of Artificial Sequence: Synthetic oligonucleotide
gatcccctggtgaaatcagaagagacagtcatc

SEQ ID NO: 154289 - DNA, 33 bp, Artificial Sequence
  Description of Artificial Sequence: Synthetic oligonucleotide
atcccctggtgaaatcagaagagacagtcatcc

SEQ ID NO: 154290 - DNA, 32 bp, Artificial Sequence
  Description of Artificial Sequence: Synthetic oligonucleotide
tgatgaacaagaccctcaggaggtgacatacg

SEQ ID NO: 154291 - DNA, 31 bp, Artificial Sequence
  Description of Artificial Sequence: Synthetic oligonucleotide
gatgaacaagaccctcaggaggtgacatacg

SEQ ID NO: 154292 - DNA, 33 bp, Artificial Sequence
  Description of Artificial Sequence: Synthetic oligonucleotide
atgaacaagaccctcaggaggtgacatacgtac

SEQ ID NO: 154293 - DNA, 32 bp, Artificial Sequence
  Description of Artificial Sequence: Synthetic oligonucleotide
tgaacaagaccctcaggaggtgacatacgtac

SEQ ID NO: 154294 - DNA, 31 bp, Artificial Sequence
  Description of Artificial Sequence: Synthetic oligonucleotide
gaacaagaccctcaggaggtgacatacgtac

SEQ ID NO: 154295 - DNA, 32 bp, Artificial Sequence
  Description of Artificial Sequence: Synthetic oligonucleotide
aacaagaccctcaggaggtgacatacgtacag

SEQ ID NO: 154296 - DNA, 31 bp, Artificial Sequence
  Description of Artificial Sequence: Synthetic oligonucleotide
acaagaccctcaggaggtgacatacgtacag

SEQ ID NO: 154297 - DNA, 30 bp, Artificial Sequence
  Description of Artificial Sequence: Synthetic oligonucleotide
caagaccctcaggaggtgacatacgtacag

SEQ ID NO: 154298 - DNA, 32 bp, Artificial Sequence
  Description of Artificial Sequence: Synthetic oligonucleotide
aagaccctcaggaggtgacatacgtacagttg

SEQ ID NO: 154299 - DNA, 31 bp, Artificial Sequence
  Description of Artificial Sequence: Synthetic oligonucleotide
agaccctcaggaggtgacatacgtacagttg

SEQ ID NO: 154300 - DNA, 30 bp, Artificial Sequence
  Description of Artificial Sequence: Synthetic oligonucleotide
gaccctcaggaggtgacatacgtacagttg

SEQ ID NO: 154301 - DNA, 33 bp, Artificial Sequence
  Description of Artificial Sequence: Synthetic oligonucleotide
accctcaggaggtgacatacgtacagttgaatc

SEQ ID NO: 154302 - DNA, 32 bp, Artificial Sequence
  Description of Artificial Sequence: Synthetic oligonucleotide
ccctcaggaggtgacatacgtacagttgaatc

SEQ ID NO: 154303 - DNA, 33 bp, Artificial Sequence
  Description of Artificial Sequence: Synthetic oligonucleotide
cctcaggaggtgacatacgtacagttgaatcac

SEQ ID NO: 154304 - DNA, 34 bp, Artificial Sequence
  Description of Artificial Sequence: Synthetic oligonucleotide
ctcaggaggtgacatacgtacagttgaatcactg

SEQ ID NO: 154305 - DNA, 34 bp, Artificial Sequence
  Description of Artificial Sequence: Synthetic oligonucleotide
tcaggaggtgacatacgtacagttgaatcactgc

SEQ ID NO: 154306 - DNA, 33 bp, Artificial Sequence
  Description of Artificial Sequence: Synthetic oligonucleotide
caggaggtgacatacgtacagttgaatcactgc

SEQ ID NO: 154307 - DNA, 33 bp, Artificial Sequence
  Description of Artificial Sequence: Synthetic oligonucleotide
aggaggtgacatacgtacagttgaatcactgcg

SEQ ID NO: 154308 - DNA, 32 bp, Artificial Sequence
  Description of Artificial Sequence: Synthetic oligonucleotide
ggaggtgacatacgtacagttgaatcactgcg

SEQ ID NO: 154309 - DNA, 36 bp, Artificial Sequence
  Description of Artificial Sequence: Synthetic oligonucleotide
gaggtgacatacgtacagttgaatcactgcgttttc

SEQ ID NO: 154310 - DNA, 37 bp, Artificial Sequence
  Description of Artificial Sequence: Synthetic oligonucleotide
aggtgacatacgtacagttgaatcactgcgttttcac

SEQ ID NO: 154311 - DNA, 36 bp, Artificial Sequence
  Description of Artificial Sequence: Synthetic oligonucleotide
ggtgacatacgtacagttgaatcactgcgttttcac

SEQ ID NO: 154312 - DNA, 37 bp, Artificial Sequence
  Description of Artificial Sequence: Synthetic oligonucleotide
gtgacatacgtacagttgaatcactgcgttttcacac

SEQ ID NO: 154313 - DNA, 38 bp, Artificial Sequence
  Description of Artificial Sequence: Synthetic oligonucleotide
tgacatacgtacagttgaatcactgcgttttcacacag

SEQ ID NO: 154314 - DNA, 37 bp, Artificial Sequence
  Description of Artificial Sequence: Synthetic oligonucleotide
gacatacgtacagttgaatcactgcgttttcacacag

SEQ ID NO: 154315 - DNA, 38 bp, Artificial Sequence
  Description of Artificial Sequence: Synthetic oligonucleotide
acatacgtacagttgaatcactgcgttttcacacagag

SEQ ID NO: 154316 - DNA, 37 bp, Artificial Sequence
  Description of Artificial Sequence: Synthetic oligonucleotide
catacgtacagttgaatcactgcgttttcacacagag

SEQ ID NO: 154317 - DNA, 43 bp, Artificial Sequence
  Description of Artificial Sequence: Synthetic oligonucleotide
atacgtacagttgaatcactgcgttttcacacagagaaaaatc

SEQ ID NO: 154318 - DNA, 42 bp, Artificial Sequence
  Description of Artificial Sequence: Synthetic oligonucleotide
tacgtacagttgaatcactgcgttttcacacagagaaaaatc

SEQ ID NO: 154319 - DNA, 41 bp, Artificial Sequence
  Description of Artificial Sequence: Synthetic oligonucleotide
acgtacagttgaatcactgcgttttcacacagagaaaaatc

SEQ ID NO: 154320 - DNA, 40 bp, Artificial Sequence
  Description of Artificial Sequence: Synthetic oligonucleotide
cgtacagttgaatcactgcgttttcacacagagaaaaatc

SEQ ID NO: 154321 - DNA, 41 bp, Artificial Sequence
  Description of Artificial Sequence: Synthetic oligonucleotide
gtacagttgaatcactgcgttttcacacagagaaaaatcac

SEQ ID NO: 154322 - DNA, 42 bp, Artificial Sequence
  Description of Artificial Sequence: Synthetic oligonucleotide
tacagttgaatcactgcgttttcacacagagaaaaatcactc

SEQ ID NO: 154323 - DNA, 28 bp, Artificial Sequence
  Description of Artificial Sequence: Synthetic oligonucleotide
aaccaagctccgaaaccggtaaccccag

SEQ ID NO: 154324 - DNA, 27 bp, Artificial Sequence
  Description of Artificial Sequence: Synthetic oligonucleotide
accaagctccgaaaccggtaaccccag

SEQ ID NO: 154325 - DNA, 27 bp, Artificial Sequence
  Description of Artificial Sequence: Synthetic oligonucleotide
ccaagctccgaaaccggtaaccccaga

SEQ ID NO: 154326 - DNA, 27 bp, Artificial Sequence
  Description of Artificial Sequence: Synthetic oligonucleotide
caagctccgaaaccggtaaccccagac

SEQ ID NO: 154327 - DNA, 28 bp, Artificial Sequence
  Description of Artificial Sequence: Synthetic oligonucleotide
aagctccgaaaccggtaaccccagacac

SEQ ID NO: 154328 - DNA, 27 bp, Artificial Sequence
  Description of Artificial Sequence: Synthetic oligonucleotide
agctccgaaaccggtaaccccagacac

SEQ ID NO: 154329 - DNA, 26 bp, Artificial Sequence
  Description of Artificial Sequence: Synthetic oligonucleotide
gctccgaaaccggtaaccccagacac

SEQ ID NO: 154330 - DNA, 27 bp, Artificial Sequence
  Description of Artificial Sequence: Synthetic oligonucleotide
ctccgaaaccggtaaccccagacacct

SEQ ID NO: 154331 - DNA, 27 bp, Artificial Sequence
  Description of Artificial Sequence: Synthetic oligonucleotide
tccgaaaccggtaaccccagacacctg

SEQ ID NO: 154332 - DNA, 26 bp, Artificial Sequence
  Description of Artificial Sequence: Synthetic oligonucleotide
ccgaaaccggtaaccccagacacctg

SEQ ID NO: 154333 - DNA, 27 bp, Artificial Sequence
  Description of Artificial Sequence: Synthetic oligonucleotide
cgaaaccggtaaccccagacacctgca

SEQ ID NO: 154334 - DNA, 27 bp, Artificial Sequence
  Description of Artificial Sequence: Synthetic oligonucleotide
gaaaccggtaaccccagacacctgcac

SEQ ID NO: 154335 - DNA, 30 bp, Artificial Sequence
  Description of Artificial Sequence: Synthetic oligonucleotide
aaaccggtaaccccagacacctgcacattc

SEQ ID NO: 154336 - DNA, 29 bp, Artificial Sequence
  Description of Artificial Sequence: Synthetic oligonucleotide
aaccggtaaccccagacacctgcacattc

SEQ ID NO: 154337 - DNA, 28 bp, Artificial Sequence
  Description of Artificial Sequence: Synthetic oligonucleotide
accggtaaccccagacacctgcacattc

SEQ ID NO: 154338 - DNA, 27 bp, Artificial Sequence
  Description of Artificial Sequence: Synthetic oligonucleotide
ccggtaaccccagacacctgcacattc

SEQ ID NO: 154339 - DNA, 28 bp, Artificial Sequence
  Description of Artificial Sequence: Synthetic oligonucleotide
cggtaaccccagacacctgcacattctg

SEQ ID NO: 154340 - DNA, 31 bp, Artificial Sequence
  Description of Artificial Sequence: Synthetic oligonucleotide
ggtaaccccagacacctgcacattctgattg

SEQ ID NO: 154341 - DNA, 31 bp, Artificial Sequence
  Description of Artificial Sequence: Synthetic oligonucleotide
gtaaccccagacacctgcacattctgattgg

SEQ ID NO: 154342 - DNA, 31 bp, Artificial Sequence
  Description of Artificial Sequence: Synthetic oligonucleotide
taaccccagacacctgcacattctgattggg

SEQ ID NO: 154343 - DNA, 30 bp, Artificial Sequence
  Description of Artificial Sequence: Synthetic oligonucleotide
aaccccagacacctgcacattctgattggg

SEQ ID NO: 154344 - DNA, 29 bp, Artificial Sequence
  Description of Artificial Sequence: Synthetic oligonucleotide
accccagacacctgcacattctgattggg

SEQ ID NO: 154345 - DNA, 28 bp, Artificial Sequence
  Description of Artificial Sequence: Synthetic oligonucleotide
ccccagacacctgcacattctgattggg

SEQ ID NO: 154346 - DNA, 29 bp, Artificial Sequence
  Description of Artificial Sequence: Synthetic oligonucleotide
cccagacacctgcacattctgattgggac

SEQ ID NO: 154347 - DNA, 29 bp, Artificial Sequence
  Description of Artificial Sequence: Synthetic oligonucleotide
ccagacacctgcacattctgattgggacc

SEQ ID NO: 154348 - DNA, 30 bp, Artificial Sequence
  Description of Artificial Sequence: Synthetic oligonucleotide
cagacacctgcacattctgattgggacctc

SEQ ID NO: 154349 - DNA, 31 bp, Artificial Sequence
  Description of Artificial Sequence: Synthetic oligonucleotide
agacacctgcacattctgattgggacctcag

SEQ ID NO: 154350 - DNA, 32 bp, Artificial Sequence
  Description of Artificial Sequence: Synthetic oligonucleotide
atgcttcggctctttccgtgactctccatatg

SEQ ID NO: 154351 - DNA, 31 bp, Artificial Sequence
  Description of Artificial Sequence: Synthetic oligonucleotide
tgcttcggctctttccgtgactctccatatg

SEQ ID NO: 154352 - DNA, 30 bp, Artificial Sequence
  Description of Artificial Sequence: Synthetic oligonucleotide
gcttcggctctttccgtgactctccatatg

SEQ ID NO: 154353 - DNA, 31 bp, Artificial Sequence
  Description of Artificial Sequence: Synthetic oligonucleotide
cttcggctctttccgtgactctccatatgag

SEQ ID NO: 154354 - DNA, 32 bp, Artificial Sequence
  Description of Artificial Sequence: Synthetic oligonucleotide
ttcggctctttccgtgactctccatatgagtg

SEQ ID NO: 154355 - DNA, 31 bp, Artificial Sequence
  Description of Artificial Sequence: Synthetic oligonucleotide
tcggctctttccgtgactctccatatgagtg

SEQ ID NO: 154356 - DNA, 30 bp, Artificial Sequence
  Description of Artificial Sequence: Synthetic oligonucleotide
cggctctttccgtgactctccatatgagtg

SEQ ID NO: 154357 - DNA, 30 bp, Artificial Sequence
  Description of Artificial Sequence: Synthetic oligonucleotide
ggctctttccgtgactctccatatgagtgg

SEQ ID NO: 154358 - DNA, 31 bp, Artificial Sequence
  Description of Artificial Sequence: Synthetic oligonucleotide
gctctttccgtgactctccatatgagtggtc

SEQ ID NO: 154359 - DNA, 34 bp, Artificial Sequence
  Description of Artificial Sequence: Synthetic oligonucleotide
ctctttccgtgactctccatatgagtggtcaaag

SEQ ID NO: 154360 - DNA, 35 bp, Artificial Sequence
  Description of Artificial Sequence: Synthetic oligonucleotide
tctttccgtgactctccatatgagtggtcaaagtc

SEQ ID NO: 154361 - DNA, 34 bp, Artificial Sequence
  Description of Artificial Sequence: Synthetic oligonucleotide
ctttccgtgactctccatatgagtggtcaaagtc

SEQ ID NO: 154362 - DNA, 36 bp, Artificial Sequence
  Description of Artificial Sequence: Synthetic oligonucleotide
tttccgtgactctccatatgagtggtcaaagtcaag

SEQ ID NO: 154363 - DNA, 35 bp, Artificial Sequence
  Description of Artificial Sequence: Synthetic oligonucleotide
ttccgtgactctccatatgagtggtcaaagtcaag

SEQ ID NO: 154364 - DNA, 34 bp, Artificial Sequence
  Description of Artificial Sequence: Synthetic oligonucleotide
tccgtgactctccatatgagtggtcaaagtcaag

SEQ ID NO: 154365 - DNA, 33 bp, Artificial Sequence
  Description of Artificial Sequence: Synthetic oligonucleotide
ccgtgactctccatatgagtggtcaaagtcaag

SEQ ID NO: 154366 - DNA, 34 bp, Artificial Sequence
  Description of Artificial Sequence: Synthetic oligonucleotide
cgtgactctccatatgagtggtcaaagtcaagtg

SEQ ID NO: 154367 - DNA, 35 bp, Artificial Sequence
  Description of Artificial Sequence: Synthetic oligonucleotide
gtgactctccatatgagtggtcaaagtcaagtgac

SEQ ID NO: 154368 - DNA, 35 bp, Artificial Sequence
  Description of Artificial Sequence: Synthetic oligonucleotide
tgactctccatatgagtggtcaaagtcaagtgacc

SEQ ID NO: 154369 - DNA, 34 bp, Artificial Sequence
  Description of Artificial Sequence: Synthetic oligonucleotide
gactctccatatgagtggtcaaagtcaagtgacc

SEQ ID NO: 154370 - DNA, 34 bp, Artificial Sequence
  Description of Artificial Sequence: Synthetic oligonucleotide
actctccatatgagtggtcaaagtcaagtgaccc

SEQ ID NO: 154371 - DNA, 33 bp, Artificial Sequence
  Description of Artificial Sequence: Synthetic oligonucleotide
ctctccatatgagtggtcaaagtcaagtgaccc

SEQ ID NO: 154372 - DNA, 34 bp, Artificial Sequence
  Description of Artificial Sequence: Synthetic oligonucleotide
tctccatatgagtggtcaaagtcaagtgacccac

SEQ ID NO: 154373 - DNA, 33 bp, Artificial Sequence
  Description of Artificial Sequence: Synthetic oligonucleotide
ctccatatgagtggtcaaagtcaagtgacccac

SEQ ID NO: 154374 - DNA, 34 bp, Artificial Sequence
  Description of Artificial Sequence: Synthetic oligonucleotide
tccatatgagtggtcaaagtcaagtgacccactg

SEQ ID NO: 154375 - DNA, 33 bp, Artificial Sequence
  Description of Artificial Sequence: Synthetic oligonucleotide
ccatatgagtggtcaaagtcaagtgacccactg

SEQ ID NO: 154376 - DNA, 33 bp, Artificial Sequence
  Description of Artificial Sequence: Synthetic oligonucleotide
catatgagtggtcaaagtcaagtgacccactgc

SEQ ID NO: 154377 - DNA, 35 bp, Artificial Sequence
  Description of Artificial Sequence: Synthetic oligonucleotide
atatgagtggtcaaagtcaagtgacccactgcttg

SEQ ID NO: 154378 - DNA, 34 bp, Artificial Sequence
  Description of Artificial Sequence: Synthetic oligonucleotide
tatgagtggtcaaagtcaagtgacccactgcttg

SEQ ID NO: 154379 - DNA, 33 bp, Artificial Sequence
  Description of Artificial Sequence: Synthetic oligonucleotide
atgagtggtcaaagtcaagtgacccactgcttg

SEQ ID NO: 154380 - DNA, 32 bp, Artificial Sequence
  Description of Artificial Sequence: Synthetic oligonucleotide
tgagtggtcaaagtcaagtgacccactgcttg

SEQ ID NO: 154381 - DNA, 40 bp, Artificial Sequence
  Description of Artificial Sequence: Synthetic oligonucleotide
acagtcatcctgcaatgttggtcagatgtcatgttttaac

SEQ ID NO: 154382 - DNA, 39 bp, Artificial Sequence
  Description of Artificial Sequence: Synthetic oligonucleotide
cagtcatcctgcaatgttggtcagatgtcatgttttaac

SEQ ID NO: 154383 - DNA, 40 bp, Artificial Sequence
  Description of Artificial Sequence: Synthetic oligonucleotide
agtcatcctgcaatgttggtcagatgtcatgttttaacac

SEQ ID NO: 154384 - DNA, 39 bp, Artificial Sequence
  Description of Artificial Sequence: Synthetic oligonucleotide
gtcatcctgcaatgttggtcagatgtcatgttttaacac

SEQ ID NO: 154385 - DNA, 41 bp, Artificial Sequence
  Description of Artificial Sequence: Synthetic oligonucleotide
tcatcctgcaatgttggtcagatgtcatgttttaacacttc

SEQ ID NO: 154386 - DNA, 40 bp, Artificial Sequence
  Description of Artificial Sequence: Synthetic oligonucleotide
catcctgcaatgttggtcagatgtcatgttttaacacttc

SEQ ID NO: 154387 - DNA, 40 bp, Artificial Sequence
  Description of Artificial Sequence: Synthetic oligonucleotide
atcctgcaatgttggtcagatgtcatgttttaacacttcc

SEQ ID NO: 154388 - DNA, 39 bp, Artificial Sequence
  Description of Artificial Sequence: Synthetic oligonucleotide
tcctgcaatgttggtcagatgtcatgttttaacacttcc

SEQ ID NO: 154389 - DNA, 38 bp, Artificial Sequence
  Description of Artificial Sequence: Synthetic oligonucleotide
cctgcaatgttggtcagatgtcatgttttaacacttcc

SEQ ID NO: 154390 - DNA, 40 bp, Artificial Sequence
  Description of Artificial Sequence: Synthetic oligonucleotide
ctgcaatgttggtcagatgtcatgttttaacacttccttc

SEQ ID NO: 154391 - DNA, 41 bp, Artificial Sequence
  Description of Artificial Sequence: Synthetic oligonucleotide
tgcaatgttggtcagatgtcatgttttaacacttccttctg

SEQ ID NO: 154392 - DNA, 40 bp, Artificial Sequence
  Description of Artificial Sequence: Synthetic oligonucleotide
gcaatgttggtcagatgtcatgttttaacacttccttctg

SEQ ID NO: 154393 - DNA, 40 bp, Artificial Sequence
  Description of Artificial Sequence: Synthetic oligonucleotide
caatgttggtcagatgtcatgttttaacacttccttctgc

SEQ ID NO: 154394 - DNA, 41 bp, Artificial Sequence
  Description of Artificial Sequence: Synthetic oligonucleotide
aatgttggtcagatgtcatgttttaacacttccttctgcac

SEQ ID NO: 154395 - DNA, 40 bp, Artificial Sequence
  Description of Artificial Sequence: Synthetic oligonucleotide
atgttggtcagatgtcatgttttaacacttccttctgcac

SEQ ID NO: 154396 - DNA, 39 bp, Artificial Sequence
  Description of Artificial Sequence: Synthetic oligonucleotide
tgttggtcagatgtcatgttttaacacttccttctgcac

SEQ ID NO: 154397 - DNA, 38 bp, Artificial Sequence
  Description of Artificial Sequence: Synthetic oligonucleotide
gttggtcagatgtcatgttttaacacttccttctgcac

SEQ ID NO: 154398 - DNA, 39 bp, Artificial Sequence
  Description of Artificial Sequence: Synthetic oligonucleotide
ttggtcagatgtcatgttttaacacttccttctgcacag

SEQ ID NO: 154399 - DNA, 38 bp, Artificial Sequence
  Description of Artificial Sequence: Synthetic oligonucleotide
tggtcagatgtcatgttttaacacttccttctgcacag

SEQ ID NO: 154400 - DNA, 37 bp, Artificial Sequence
  Description of Artificial Sequence: Synthetic oligonucleotide
ggtcagatgtcatgttttaacacttccttctgcacag

SEQ ID NO: 154401 - DNA, 38 bp, Artificial Sequence
  Description of Artificial Sequence: Synthetic oligonucleotide
gtcagatgtcatgttttaacacttccttctgcacagag

SEQ ID NO: 154402 - DNA, 39 bp, Artificial Sequence
  Description of Artificial Sequence: Synthetic oligonucleotide
tcagatgtcatgttttaacacttccttctgcacagagag

SEQ ID NO: 154403 - DNA, 38 bp, Artificial Sequence
  Description of Artificial Sequence: Synthetic oligonucleotide
cagatgtcatgttttaacacttccttctgcacagagag

SEQ ID NO: 154404 - DNA, 38 bp, Artificial Sequence
  Description of Artificial Sequence: Synthetic oligonucleotide
agatgtcatgttttaacacttccttctgcacagagagg

SEQ ID NO: 154405 - DNA, 37 bp, Artificial Sequence
  Description of Artificial Sequence: Synthetic oligonucleotide
gatgtcatgttttaacacttccttctgcacagagagg

SEQ ID NO: 154406 - DNA, 37 bp, Artificial Sequence
  Description of Artificial Sequence: Synthetic oligonucleotide
atgtcatgttttaacacttccttctgcacagagaggg

SEQ ID NO: 154407 - DNA, 36 bp, Artificial Sequence
  Description of Artificial Sequence: Synthetic oligonucleotide
tgtcatgttttaacacttccttctgcacagagaggg

SEQ ID NO: 154408 - DNA, 35 bp, Artificial Sequence
  Description of Artificial Sequence: Synthetic oligonucleotide
gtcatgttttaacacttccttctgcacagagaggg

SEQ ID NO: 154409 - DNA, 35 bp, Artificial Sequence
  Description of Artificial Sequence: Synthetic oligonucleotide
tcatgttttaacacttccttctgcacagagagggg

SEQ ID NO: 154410 - DNA, 34 bp, Artificial Sequence
  Description of Artificial Sequence: Synthetic oligonucleotide
catgttttaacacttccttctgcacagagagggg

SEQ ID NO: 154411 - DNA, 36 bp, Artificial Sequence
  Description of Artificial Sequence: Synthetic oligonucleotide
atgttttaacacttccttctgcacagagaggggatg

SEQ ID NO: 154412 - DNA, 35 bp, Artificial Sequence
  Description of Artificial Sequence: Synthetic oligonucleotide
tgttttaacacttccttctgcacagagaggggatg

SEQ ID NO: 154413 - DNA, 34 bp, Artificial Sequence
  Description of Artificial Sequence: Synthetic oligonucleotide
gttttaacacttccttctgcacagagaggggatg

SEQ ID NO: 154414 - DNA, 39 bp, Artificial Sequence
  Description of Artificial Sequence: Synthetic oligonucleotide
ttttaacacttccttctgcacagagaggggatgtttaac

SEQ ID NO: 154415 - DNA, 38 bp, Artificial Sequence
  Description of Artificial Sequence: Synthetic oligonucleotide
tttaacacttccttctgcacagagaggggatgtttaac

SEQ ID NO: 154416 - DNA, 37 bp, Artificial Sequence
  Description of Artificial Sequence: Synthetic oligonucleotide
ttaacacttccttctgcacagagaggggatgtttaac

SEQ ID NO: 154417 - DNA, 36 bp, Artificial Sequence
  Description of Artificial Sequence: Synthetic oligonucleotide
taacacttccttctgcacagagaggggatgtttaac

SEQ ID NO: 154418 - DNA, 27 bp, Artificial Sequence
  Description of Artificial Sequence: Synthetic oligonucleotide
cccacggagggacctacagatgcttca

SEQ ID NO: 154419 - DNA, 27 bp, Artificial Sequence
  Description of Artificial Sequence: Synthetic oligonucleotide
ccacggagggacctacagatgcttcag

SEQ ID NO: 154420 - DNA, 27 bp, Artificial Sequence
  Description of Artificial Sequence: Synthetic oligonucleotide
cacggagggacctacagatgcttcagc

SEQ ID NO: 154421 - DNA, 28 bp, Artificial Sequence
  Description of Artificial Sequence: Synthetic oligonucleotide
acggagggacctacagatgcttcagctc

SEQ ID NO: 154422 - DNA, 27 bp, Artificial Sequence
  Description of Artificial Sequence: Synthetic oligonucleotide
cggagggacctacagatgcttcagctc

SEQ ID NO: 154423 - DNA, 30 bp, Artificial Sequence
  Description of Artificial Sequence: Synthetic oligonucleotide
ggagggacctacagatgcttcagctctttc

SEQ ID NO: 154424 - DNA, 30 bp, Artificial Sequence
  Description of Artificial Sequence: Synthetic oligonucleotide
gagggacctacagatgcttcagctctttcc

SEQ ID NO: 154425 - DNA, 32 bp, Artificial Sequence
  Description of Artificial Sequence: Synthetic oligonucleotide
agggacctacagatgcttcagctctttccatg

SEQ ID NO: 154426 - DNA, 31 bp, Artificial Sequence
  Description of Artificial Sequence: Synthetic oligonucleotide
gggacctacagatgcttcagctctttccatg

SEQ ID NO: 154427 - DNA, 32 bp, Artificial Sequence
  Description of Artificial Sequence: Synthetic oligonucleotide
ggacctacagatgcttcagctctttccatgac

SEQ ID NO: 154428 - DNA, 33 bp, Artificial Sequence
  Description of Artificial Sequence: Synthetic oligonucleotide
gacctacagatgcttcagctctttccatgactc

SEQ ID NO: 154429 - DNA, 34 bp, Artificial Sequence
  Description of Artificial Sequence: Synthetic oligonucleotide
acctacagatgcttcagctctttccatgactctc

SEQ ID NO: 154430 - DNA, 33 bp, Artificial Sequence
  Description of Artificial Sequence: Synthetic oligonucleotide
cctacagatgcttcagctctttccatgactctc

SEQ ID NO: 154431 - DNA, 33 bp, Artificial Sequence
  Description of Artificial Sequence: Synthetic oligonucleotide
ctacagatgcttcagctctttccatgactctcc

SEQ ID NO: 154432 - DNA, 36 bp, Artificial Sequence
  Description of Artificial Sequence: Synthetic oligonucleotide
tacagatgcttcagctctttccatgactctccatac

SEQ ID NO: 154433 - DNA, 35 bp, Artificial Sequence
  Description of Artificial Sequence: Synthetic oligonucleotide
acagatgcttcagctctttccatgactctccatac

SEQ ID NO: 154434 - DNA, 34 bp, Artificial Sequence
  Description of Artificial Sequence: Synthetic oligonucleotide
cagatgcttcagctctttccatgactctccatac

SEQ ID NO: 154435 - DNA, 34 bp, Artificial Sequence
  Description of Artificial Sequence: Synthetic oligonucleotide
agatgcttcagctctttccatgactctccatacg

SEQ ID NO: 154436 - DNA, 33 bp, Artificial Sequence
  Description of Artificial Sequence: Synthetic oligonucleotide
gatgcttcagctctttccatgactctccatacg

SEQ ID NO: 154437 - DNA, 34 bp, Artificial Sequence
  Description of Artificial Sequence: Synthetic oligonucleotide
atgcttcagctctttccatgactctccatacgag

SEQ ID NO: 154438 - DNA, 33 bp, Artificial Sequence
  Description of Artificial Sequence: Synthetic oligonucleotide
tgcttcagctctttccatgactctccatacgag

SEQ ID NO: 154439 - DNA, 32 bp, Artificial Sequence
  Description of Artificial Sequence: Synthetic oligonucleotide
gcttcagctctttccatgactctccatacgag

SEQ ID NO: 154440 - DNA, 33 bp, Artificial Sequence
  Description of Artificial Sequence: Synthetic oligonucleotide
cttcagctctttccatgactctccatacgagtg

SEQ ID NO: 154441 - DNA, 33 bp, Artificial Sequence
  Description of Artificial Sequence: Synthetic oligonucleotide
ttcagctctttccatgactctccatacgagtgg

SEQ ID NO: 154442 - DNA, 32 bp, Artificial Sequence
  Description of Artificial Sequence: Synthetic oligonucleotide
tcagctctttccatgactctccatacgagtgg

SEQ ID NO: 154443 - DNA, 31 bp, Artificial Sequence
  Description of Artificial Sequence: Synthetic oligonucleotide
cagctctttccatgactctccatacgagtgg

SEQ ID NO: 154444 - DNA, 32 bp, Artificial Sequence
  Description of Artificial Sequence: Synthetic oligonucleotide
agctctttccatgactctccatacgagtggtc

SEQ ID NO: 154445 - DNA, 35 bp, Artificial Sequence
  Description of Artificial Sequence: Synthetic oligonucleotide
aacagcgaatagcgaggactctgatgaacaagaac

SEQ ID NO: 154446 - DNA, 34 bp, Artificial Sequence
  Description of Artificial Sequence: Synthetic oligonucleotide
acagcgaatagcgaggactctgatgaacaagaac

SEQ ID NO: 154447 - DNA, 33 bp, Artificial Sequence
  Description of Artificial Sequence: Synthetic oligonucleotide
cagcgaatagcgaggactctgatgaacaagaac

SEQ ID NO: 154448 - DNA, 33 bp, Artificial Sequence
  Description of Artificial Sequence: Synthetic oligonucleotide
agcgaatagcgaggactctgatgaacaagaacc

SEQ ID NO: 154449 - DNA, 32 bp, Artificial Sequence
  Description of Artificial Sequence: Synthetic oligonucleotide
gcgaatagcgaggactctgatgaacaagaacc

SEQ ID NO: 154450 - DNA, 33 bp, Artificial Sequence
  Description of Artificial Sequence: Synthetic oligonucleotide
cgaatagcgaggactctgatgaacaagaacctc

SEQ ID NO: 154451 - DNA, 34 bp, Artificial Sequence
  Description of Artificial Sequence: Synthetic oligonucleotide
gaatagcgaggactctgatgaacaagaacctcag

SEQ ID NO: 154452 - DNA, 34 bp, Artificial Sequence
  Description of Artificial Sequence: Synthetic oligonucleotide
aatagcgaggactctgatgaacaagaacctcagg

SEQ ID NO: 154453 - DNA, 33 bp, Artificial Sequence
  Description of Artificial Sequence: Synthetic oligonucleotide
atagcgaggactctgatgaacaagaacctcagg

SEQ ID NO: 154454 - DNA, 32 bp, Artificial Sequence
  Description of Artificial Sequence: Synthetic oligonucleotide
tagcgaggactctgatgaacaagaacctcagg

SEQ ID NO: 154455 - DNA, 31 bp, Artificial Sequence
  Description of Artificial Sequence: Synthetic oligonucleotide
agcgaggactctgatgaacaagaacctcagg

SEQ ID NO: 154456 - DNA, 30 bp, Artificial Sequence
  Description of Artificial Sequence: Synthetic oligonucleotide
gcgaggactctgatgaacaagaacctcagg

SEQ ID NO: 154457 - DNA, 31 bp, Artificial Sequence
  Description of Artificial Sequence: Synthetic oligonucleotide
cgaggactctgatgaacaagaacctcaggag

SEQ ID NO: 154458 - DNA, 31 bp, Artificial Sequence
  Description of Artificial Sequence: Synthetic oligonucleotide
gaggactctgatgaacaagaacctcaggagg

SEQ ID NO: 154459 - DNA, 32 bp, Artificial Sequence
  Description of Artificial Sequence: Synthetic oligonucleotide
aggactctgatgaacaagaacctcaggaggtg

SEQ ID NO: 154460 - DNA, 31 bp, Artificial Sequence
  Description of Artificial Sequence: Synthetic oligonucleotide
ggactctgatgaacaagaacctcaggaggtg

SEQ ID NO: 154461 - DNA, 32 bp, Artificial Sequence
  Description of Artificial Sequence: Synthetic oligonucleotide
gactctgatgaacaagaacctcaggaggtgac

SEQ ID NO: 154462 - DNA, 35 bp, Artificial Sequence
  Description of Artificial Sequence: Synthetic oligonucleotide
actctgatgaacaagaacctcaggaggtgacatac

SEQ ID NO: 154463 - DNA, 34 bp, Artificial Sequence
  Description of Artificial Sequence: Synthetic oligonucleotide
ctctgatgaacaagaacctcaggaggtgacatac

SEQ ID NO: 154464 - DNA, 35 bp, Artificial Sequence
  Description of Artificial Sequence: Synthetic oligonucleotide
tctgatgaacaagaacctcaggaggtgacatacac

SEQ ID NO: 154465 - DNA, 34 bp, Artificial Sequence
  Description of Artificial Sequence: Synthetic oligonucleotide
ctgatgaacaagaacctcaggaggtgacatacac

SEQ ID NO: 154466 - DNA, 35 bp, Artificial Sequence
  Description of Artificial Sequence: Synthetic oligonucleotide
tgatgaacaagaacctcaggaggtgacatacacac

SEQ ID NO: 154467 - DNA, 34 bp, Artificial Sequence
  Description of Artificial Sequence: Synthetic oligonucleotide
gatgaacaagaacctcaggaggtgacatacacac

SEQ ID NO: 154468 - DNA, 35 bp, Artificial Sequence
  Description of Artificial Sequence: Synthetic oligonucleotide
atgaacaagaacctcaggaggtgacatacacacag

SEQ ID NO: 154469 - DNA, 34 bp, Artificial Sequence
  Description of Artificial Sequence: Synthetic oligonucleotide
tgaacaagaacctcaggaggtgacatacacacag

SEQ ID NO: 154470 - DNA, 33 bp, Artificial Sequence
  Description of Artificial Sequence: Synthetic oligonucleotide
gaacaagaacctcaggaggtgacatacacacag

SEQ ID NO: 154471 - DNA, 35 bp, Artificial Sequence
  Description of Artificial Sequence: Synthetic oligonucleotide
aacaagaacctcaggaggtgacatacacacagttg

SEQ ID NO: 154472 - DNA, 34 bp, Artificial Sequence
  Description of Artificial Sequence: Synthetic oligonucleotide
acaagaacctcaggaggtgacatacacacagttg

SEQ ID NO: 154473 - DNA, 33 bp, Artificial Sequence
  Description of Artificial Sequence: Synthetic oligonucleotide
caagaacctcaggaggtgacatacacacagttg

SEQ ID NO: 154474 - DNA, 36 bp, Artificial Sequence
  Description of Artificial Sequence: Synthetic oligonucleotide
aagaacctcaggaggtgacatacacacagttgaatc

SEQ ID NO: 154475 - DNA, 35 bp, Artificial Sequence
  Description of Artificial Sequence: Synthetic oligonucleotide
agaacctcaggaggtgacatacacacagttgaatc

SEQ ID NO: 154476 - DNA, 34 bp, Artificial Sequence
  Description of Artificial Sequence: Synthetic oligonucleotide
gaacctcaggaggtgacatacacacagttgaatc

SEQ ID NO: 154477 - DNA, 35 bp, Artificial Sequence
  Description of Artificial Sequence: Synthetic oligonucleotide
aacctcaggaggtgacatacacacagttgaatcac

SEQ ID NO: 154478 - DNA, 34 bp, Artificial Sequence
  Description of Artificial Sequence: Synthetic oligonucleotide
acctcaggaggtgacatacacacagttgaatcac

SEQ ID NO: 154479 - DNA, 42 bp, Artificial Sequence
  Description of Artificial Sequence: Synthetic oligonucleotide
acagttgaatcactgcgttttcacacagagaaaaatcacttg

SEQ ID NO: 154480 - DNA, 41 bp, Artificial Sequence
  Description of Artificial Sequence: Synthetic oligonucleotide
cagttgaatcactgcgttttcacacagagaaaaatcacttg

SEQ ID NO: 154481 - DNA, 41 bp, Artificial Sequence
  Description of Artificial Sequence: Synthetic oligonucleotide
agttgaatcactgcgttttcacacagagaaaaatcacttgc

SEQ ID NO: 154482 - DNA, 40 bp, Artificial Sequence
  Description of Artificial Sequence: Synthetic oligonucleotide
gttgaatcactgcgttttcacacagagaaaaatcacttgc

SEQ ID NO: 154483 - DNA, 40 bp, Artificial Sequence
  Description of Artificial Sequence: Synthetic oligonucleotide
ttgaatcactgcgttttcacacagagaaaaatcacttgcc

SEQ ID NO: 154484 - DNA, 39 bp, Artificial Sequence
  Description of Artificial Sequence: Synthetic oligonucleotide
tgaatcactgcgttttcacacagagaaaaatcacttgcc

SEQ ID NO: 154485 - DNA, 38 bp, Artificial Sequence
  Description of Artificial Sequence: Synthetic oligonucleotide
gaatcactgcgttttcacacagagaaaaatcacttgcc

SEQ ID NO: 154486 - DNA, 38 bp, Artificial Sequence
  Description of Artificial Sequence: Synthetic oligonucleotide
aatcactgcgttttcacacagagaaaaatcacttgccc

SEQ ID NO: 154487 - DNA, 37 bp, Artificial Sequence
  Description of Artificial Sequence: Synthetic oligonucleotide
atcactgcgttttcacacagagaaaaatcacttgccc

SEQ ID NO: 154488 - DNA, 36 bp, Artificial Sequence
  Description of Artificial Sequence: Synthetic oligonucleotide
tcactgcgttttcacacagagaaaaatcacttgccc

SEQ ID NO: 154489 - DNA, 35 bp, Artificial Sequence
  Description of Artificial Sequence: Synthetic oligonucleotide
cactgcgttttcacacagagaaaaatcacttgccc

SEQ ID NO: 154490 - DNA, 37 bp, Artificial Sequence
  Description of Artificial Sequence: Synthetic oligonucleotide
actgcgttttcacacagagaaaaatcacttgcccttc

SEQ ID NO: 154491 - DNA, 36 bp, Artificial Sequence
  Description of Artificial Sequence: Synthetic oligonucleotide
ctgcgttttcacacagagaaaaatcacttgcccttc

SEQ ID NO: 154492 - DNA, 37 bp, Artificial Sequence
  Description of Artificial Sequence: Synthetic oligonucleotide
tgcgttttcacacagagaaaaatcacttgcccttctc

SEQ ID NO: 154493 - DNA, 36 bp, Artificial Sequence
  Description of Artificial Sequence: Synthetic oligonucleotide
gcgttttcacacagagaaaaatcacttgcccttctc

SEQ ID NO: 154494 - DNA, 37 bp, Artificial Sequence
  Description of Artificial Sequence: Synthetic oligonucleotide
cgttttcacacagagaaaaatcacttgcccttctcag

SEQ ID NO: 154495 - DNA, 38 bp, Artificial Sequence
  Description of Artificial Sequence: Synthetic oligonucleotide
gttttcacacagagaaaaatcacttgcccttctcagag

SEQ ID NO: 154496 - DNA, 38 bp, Artificial Sequence
  Description of Artificial Sequence: Synthetic oligonucleotide
ttttcacacagagaaaaatcacttgcccttctcagagg

SEQ ID NO: 154497 - DNA, 37 bp, Artificial Sequence
  Description of Artificial Sequence: Synthetic oligonucleotide
tttcacacagagaaaaatcacttgcccttctcagagg

SEQ ID NO: 154498 - DNA, 36 bp, Artificial Sequence
  Description of Artificial Sequence: Synthetic oligonucleotide
ttcacacagagaaaaatcacttgcccttctcagagg

SEQ ID NO: 154499 - DNA, 35 bp, Artificial Sequence
  Description of Artificial Sequence: Synthetic oligonucleotide
tcacacagagaaaaatcacttgcccttctcagagg

SEQ ID NO: 154500 - DNA, 34 bp, Artificial Sequence
  Description of Artificial Sequence: Synthetic oligonucleotide
cacacagagaaaaatcacttgcccttctcagagg

SEQ ID NO: 154501 - DNA, 34 bp, Artificial Sequence
  Description of Artificial Sequence: Synthetic oligonucleotide
acacagagaaaaatcacttgcccttctcagaggc

SEQ ID NO: 154502 - DNA, 33 bp, Artificial Sequence
  Description of Artificial Sequence: Synthetic oligonucleotide
cacagagaaaaatcacttgcccttctcagaggc

SEQ ID NO: 154503 - DNA, 33 bp, Artificial Sequence
  Description of Artificial Sequence: Synthetic oligonucleotide
acagagaaaaatcacttgcccttctcagaggcc

SEQ ID NO: 154504 - DNA, 32 bp, Artificial Sequence
  Description of Artificial Sequence: Synthetic oligonucleotide
cagagaaaaatcacttgcccttctcagaggcc

SEQ ID NO: 154505 - DNA, 32 bp, Artificial Sequence
  Description of Artificial Sequence: Synthetic oligonucleotide
agagaaaaatcacttgcccttctcagaggccc

SEQ ID NO: 154506 - DNA, 31 bp, Artificial Sequence
  Description of Artificial Sequence: Synthetic oligonucleotide
gagaaaaatcacttgcccttctcagaggccc

SEQ ID NO: 154507 - DNA, 33 bp, Artificial Sequence
  Description of Artificial Sequence: Synthetic oligonucleotide
agaaaaatcacttgcccttctcagaggcccaag

SEQ ID NO: 154508 - DNA, 32 bp, Artificial Sequence
  Description of Artificial Sequence: Synthetic oligonucleotide
gaaaaatcacttgcccttctcagaggcccaag

SEQ ID NO: 154509 - DNA, 33 bp, Artificial Sequence
  Description of Artificial Sequence: Synthetic oligonucleotide
aaaaatcacttgcccttctcagaggcccaagac

SEQ ID NO: 154510 - DNA, 32 bp, Artificial Sequence
  Description of Artificial Sequence: Synthetic oligonucleotide
aaaatcacttgcccttctcagaggcccaagac

SEQ ID NO: 154511 - DNA, 31 bp, Artificial Sequence
  Description of Artificial Sequence: Synthetic oligonucleotide
aaatcacttgcccttctcagaggcccaagac

SEQ ID NO: 154512 - DNA, 30 bp, Artificial Sequence
  Description of Artificial Sequence: Synthetic oligonucleotide
aatcacttgcccttctcagaggcccaagac

SEQ ID NO: 154513 - DNA, 29 bp, Artificial Sequence
  Description of Artificial Sequence: Synthetic oligonucleotide
atcacttgcccttctcagaggcccaagac

SEQ ID NO: 154514 - DNA, 28 bp, Artificial Sequence
  Description of Artificial Sequence: Synthetic oligonucleotide
tcacttgcccttctcagaggcccaagac

SEQ ID NO: 154515 - DNA, 27 bp, Artificial Sequence
  Description of Artificial Sequence: Synthetic oligonucleotide
cacttgcccttctcagaggcccaagac

SEQ ID NO: 154516 - DNA, 28 bp, Artificial Sequence
  Description of Artificial Sequence: Synthetic oligonucleotide
acttgcccttctcagaggcccaagacac

SEQ ID NO: 154517 - DNA, 27 bp, Artificial Sequence
  Description of Artificial Sequence: Synthetic oligonucleotide
cttgcccttctcagaggcccaagacac

SEQ ID NO: 154518 - DNA, 27 bp, Artificial Sequence
  Description of Artificial Sequence: Synthetic oligonucleotide
ttgcccttctcagaggcccaagacacc

SEQ ID NO: 154519 - DNA, 26 bp, Artificial Sequence
  Description of Artificial Sequence: Synthetic oligonucleotide
tgcccttctcagaggcccaagacacc

SEQ ID NO: 154520 - DNA, 30 bp, Artificial Sequence
  Description of Artificial Sequence: Synthetic oligonucleotide
aaccaagctccaaaaccggtaacccccaac

SEQ ID NO: 154521 - DNA, 29 bp, Artificial Sequence
  Description of Artificial Sequence: Synthetic oligonucleotide
accaagctccaaaaccggtaacccccaac

SEQ ID NO: 154522 - DNA, 28 bp, Artificial Sequence
  Description of Artificial Sequence: Synthetic oligonucleotide
ccaagctccaaaaccggtaacccccaac

SEQ ID NO: 154523 - DNA, 29 bp, Artificial Sequence
  Description of Artificial Sequence: Synthetic oligonucleotide
caagctccaaaaccggtaacccccaacac

SEQ ID NO: 154524 - DNA, 29 bp, Artificial Sequence
  Description of Artificial Sequence: Synthetic oligonucleotide
aagctccaaaaccggtaacccccaacacc

SEQ ID NO: 154525 - DNA, 28 bp, Artificial Sequence
  Description of Artificial Sequence: Synthetic oligonucleotide
agctccaaaaccggtaacccccaacacc

SEQ ID NO: 154526 - DNA, 27 bp, Artificial Sequence
  Description of Artificial Sequence: Synthetic oligonucleotide
gctccaaaaccggtaacccccaacacc

SEQ ID NO: 154527 - DNA, 28 bp, Artificial Sequence
  Description of Artificial Sequence: Synthetic oligonucleotide
ctccaaaaccggtaacccccaacacctg

SEQ ID NO: 154528 - DNA, 28 bp, Artificial Sequence
  Description of Artificial Sequence: Synthetic oligonucleotide
tccaaaaccggtaacccccaacacctgc

SEQ ID NO: 154529 - DNA, 27 bp, Artificial Sequence
  Description of Artificial Sequence: Synthetic oligonucleotide
ccaaaaccggtaacccccaacacctgc

SEQ ID NO: 154530 - DNA, 28 bp, Artificial Sequence
  Description of Artificial Sequence: Synthetic oligonucleotide
caaaaccggtaacccccaacacctgcac

SEQ ID NO: 154531 - DNA, 31 bp, Artificial Sequence
  Description of Artificial Sequence: Synthetic oligonucleotide
aaaaccggtaacccccaacacctgcacattc

SEQ ID NO: 154532 - DNA, 30 bp, Artificial Sequence
  Description of Artificial Sequence: Synthetic oligonucleotide
aaaccggtaacccccaacacctgcacattc

SEQ ID NO: 154533 - DNA, 29 bp, Artificial Sequence
  Description of Artificial Sequence: Synthetic oligonucleotide
aaccggtaacccccaacacctgcacattc

SEQ ID NO: 154534 - DNA, 28 bp, Artificial Sequence
  Description of Artificial Sequence: Synthetic oligonucleotide
accggtaacccccaacacctgcacattc

SEQ ID NO: 154535 - DNA, 27 bp, Artificial Sequence
  Description of Artificial Sequence: Synthetic oligonucleotide
ccggtaacccccaacacctgcacattc

SEQ ID NO: 154536 - DNA, 28 bp, Artificial Sequence
  Description of Artificial Sequence: Synthetic oligonucleotide
cggtaacccccaacacctgcacattctg

SEQ ID NO: 154537 - DNA, 31 bp, Artificial Sequence
  Description of Artificial Sequence: Synthetic oligonucleotide
ggtaacccccaacacctgcacattctgattg

SEQ ID NO: 154538 - DNA, 31 bp, Artificial Sequence
  Description of Artificial Sequence: Synthetic oligonucleotide
gtaacccccaacacctgcacattctgattgg

SEQ ID NO: 154539 - DNA, 31 bp, Artificial Sequence
  Description of Artificial Sequence: Synthetic oligonucleotide
taacccccaacacctgcacattctgattggg

SEQ ID NO: 154540 - DNA, 30 bp, Artificial Sequence
  Description of Artificial Sequence: Synthetic oligonucleotide
aacccccaacacctgcacattctgattggg

SEQ ID NO: 154541 - DNA, 29 bp, Artificial Sequence
  Description of Artificial Sequence: Synthetic oligonucleotide
acccccaacacctgcacattctgattggg

SEQ ID NO: 154542 - DNA, 28 bp, Artificial Sequence
  Description of Artificial Sequence: Synthetic oligonucleotide
cccccaacacctgcacattctgattggg

SEQ ID NO: 154543 - DNA, 29 bp, Artificial Sequence
  Description of Artificial Sequence: Synthetic oligonucleotide
ccccaacacctgcacattctgattgggac

SEQ ID NO: 154544 - DNA, 29 bp, Artificial Sequence
  Description of Artificial Sequence: Synthetic oligonucleotide
cccaacacctgcacattctgattgggacc

SEQ ID NO: 154545 - DNA, 30 bp, Artificial Sequence
  Description of Artificial Sequence: Synthetic oligonucleotide
ccaacacctgcacattctgattgggacctc

SEQ ID NO: 154546 - DNA, 31 bp, Artificial Sequence
  Description of Artificial Sequence: Synthetic oligonucleotide
caacacctgcacattctgattgggacctcag

SEQ ID NO: 154547 - DNA, 32 bp, Artificial Sequence
  Description of Artificial Sequence: Synthetic oligonucleotide
aacacctgcacattctgattgggacctcagtg

SEQ ID NO: 154548 - DNA, 32 bp, Artificial Sequence
  Description of Artificial Sequence: Synthetic oligonucleotide
tgatgaacaagaccctcaggaggtgacatacc

SEQ ID NO: 154549 - DNA, 31 bp, Artificial Sequence
  Description of Artificial Sequence: Synthetic oligonucleotide
gatgaacaagaccctcaggaggtgacatacc

SEQ ID NO: 154550 - DNA, 31 bp, Artificial Sequence
  Description of Artificial Sequence: Synthetic oligonucleotide
atgaacaagaccctcaggaggtgacataccc

SEQ ID NO: 154551 - DNA, 30 bp, Artificial Sequence
  Description of Artificial Sequence: Synthetic oligonucleotide
tgaacaagaccctcaggaggtgacataccc

SEQ ID NO: 154552 - DNA, 29 bp, Artificial Sequence
  Description of Artificial Sequence: Synthetic oligonucleotide
gaacaagaccctcaggaggtgacataccc

SEQ ID NO: 154553 - DNA, 30 bp, Artificial Sequence
  Description of Artificial Sequence: Synthetic oligonucleotide
aacaagaccctcaggaggtgacatacccac

SEQ ID NO: 154554 - DNA, 29 bp, Artificial Sequence
  Description of Artificial Sequence: Synthetic oligonucleotide
acaagaccctcaggaggtgacatacccac

SEQ ID NO: 154555 - DNA, 28 bp, Artificial Sequence
  Description of Artificial Sequence: Synthetic oligonucleotide
caagaccctcaggaggtgacatacccac

SEQ ID NO: 154556 - DNA, 29 bp, Artificial Sequence
  Description of Artificial Sequence: Synthetic oligonucleotide
aagaccctcaggaggtgacatacccacag

SEQ ID NO: 154557 - DNA, 28 bp, Artificial Sequence
  Description of Artificial Sequence: Synthetic oligonucleotide
agaccctcaggaggtgacatacccacag

SEQ ID NO: 154558 - DNA, 27 bp, Artificial Sequence
  Description of Artificial Sequence: Synthetic oligonucleotide
gaccctcaggaggtgacatacccacag

SEQ ID NO: 154559 - DNA, 29 bp, Artificial Sequence
  Description of Artificial Sequence: Synthetic oligonucleotide
accctcaggaggtgacatacccacagttg

SEQ ID NO: 154560 - DNA, 28 bp, Artificial Sequence
  Description of Artificial Sequence: Synthetic oligonucleotide
ccctcaggaggtgacatacccacagttg

SEQ ID NO: 154561 - DNA, 31 bp, Artificial Sequence
  Description of Artificial Sequence: Synthetic oligonucleotide
cctcaggaggtgacatacccacagttgaatc

SEQ ID NO: 154562 - DNA, 32 bp, Artificial Sequence
  Description of Artificial Sequence: Synthetic oligonucleotide
ctcaggaggtgacatacccacagttgaatcac

SEQ ID NO: 154563 - DNA, 33 bp, Artificial Sequence
  Description of Artificial Sequence: Synthetic oligonucleotide
tcaggaggtgacatacccacagttgaatcactg

SEQ ID NO: 154564 - DNA, 32 bp, Artificial Sequence
  Description of Artificial Sequence: Synthetic oligonucleotide
caggaggtgacatacccacagttgaatcactg

SEQ ID NO: 154565 - DNA, 32 bp, Artificial Sequence
  Description of Artificial Sequence: Synthetic oligonucleotide
aggaggtgacatacccacagttgaatcactgc

SEQ ID NO: 154566 - DNA, 31 bp, Artificial Sequence
  Description of Artificial Sequence: Synthetic oligonucleotide
ggaggtgacatacccacagttgaatcactgc

SEQ ID NO: 154567 - DNA, 31 bp, Artificial Sequence
  Description of Artificial Sequence: Synthetic oligonucleotide
gaggtgacatacccacagttgaatcactgcg

SEQ ID NO: 154568 - DNA, 35 bp, Artificial Sequence
  Description of Artificial Sequence: Synthetic oligonucleotide
aggtgacatacccacagttgaatcactgcgttttc

SEQ ID NO: 154569 - DNA, 34 bp, Artificial Sequence
  Description of Artificial Sequence: Synthetic oligonucleotide
ggtgacatacccacagttgaatcactgcgttttc

SEQ ID NO: 154570 - DNA, 35 bp, Artificial Sequence
  Description of Artificial Sequence: Synthetic oligonucleotide
gtgacatacccacagttgaatcactgcgttttcac

SEQ ID NO: 154571 - DNA, 36 bp, Artificial Sequence
  Description of Artificial Sequence: Synthetic oligonucleotide
tgacatacccacagttgaatcactgcgttttcacac

SEQ ID NO: 154572 - DNA, 35 bp, Artificial Sequence
  Description of Artificial Sequence: Synthetic oligonucleotide
gacatacccacagttgaatcactgcgttttcacac

SEQ ID NO: 154573 - DNA, 36 bp, Artificial Sequence
  Description of Artificial Sequence: Synthetic oligonucleotide
acatacccacagttgaatcactgcgttttcacacag

SEQ ID NO: 154574 - DNA, 35 bp, Artificial Sequence
  Description of Artificial Sequence: Synthetic oligonucleotide
catacccacagttgaatcactgcgttttcacacag

SEQ ID NO: 154575 - DNA, 36 bp, Artificial Sequence
  Description of Artificial Sequence: Synthetic oligonucleotide
atacccacagttgaatcactgcgttttcacacagag

SEQ ID NO: 154576 - DNA, 35 bp, Artificial Sequence
  Description of Artificial Sequence: Synthetic oligonucleotide
tacccacagttgaatcactgcgttttcacacagag

SEQ ID NO: 154577 - DNA, 34 bp, Artificial Sequence
  Description of Artificial Sequence: Synthetic oligonucleotide
acccacagttgaatcactgcgttttcacacagag

SEQ ID NO: 154578 - DNA, 33 bp, Artificial Sequence
  Description of Artificial Sequence: Synthetic oligonucleotide
cccacagttgaatcactgcgttttcacacagag

SEQ ID NO: 154579 - DNA, 39 bp, Artificial Sequence
  Description of Artificial Sequence: Synthetic oligonucleotide
ccacagttgaatcactgcgttttcacacagagaaaaatc

SEQ ID NO: 154580 - DNA, 27 bp, Artificial Sequence
  Description of Artificial Sequence: Synthetic oligonucleotide
cggtaacccccgacacctgcacattgt

SEQ ID NO: 154581 - DNA, 27 bp, Artificial Sequence
  Description of Artificial Sequence: Synthetic oligonucleotide
ggtaacccccgacacctgcacattgtg

SEQ ID NO: 154582 - DNA, 30 bp, Artificial Sequence
  Description of Artificial Sequence: Synthetic oligonucleotide
gtaacccccgacacctgcacattgtgattg

SEQ ID NO: 154583 - DNA, 30 bp, Artificial Sequence
  Description of Artificial Sequence: Synthetic oligonucleotide
taacccccgacacctgcacattgtgattgg

SEQ ID NO: 154584 - DNA, 29 bp, Artificial Sequence
  Description of Artificial Sequence: Synthetic oligonucleotide
aacccccgacacctgcacattgtgattgg

SEQ ID NO: 154585 - DNA, 28 bp, Artificial Sequence
  Description of Artificial Sequence: Synthetic oligonucleotide
acccccgacacctgcacattgtgattgg

SEQ ID NO: 154586 - DNA, 27 bp, Artificial Sequence
  Description of Artificial Sequence: Synthetic oligonucleotide
cccccgacacctgcacattgtgattgg

SEQ ID NO: 154587 - DNA, 27 bp, Artificial Sequence
  Description of Artificial Sequence: Synthetic oligonucleotide
ccccgacacctgcacattgtgattggg

SEQ ID NO: 154588 - DNA, 28 bp, Artificial Sequence
  Description of Artificial Sequence: Synthetic oligonucleotide
cccgacacctgcacattgtgattgggac

SEQ ID NO: 154589 - DNA, 28 bp, Artificial Sequence
  Description of Artificial Sequence: Synthetic oligonucleotide
ccgacacctgcacattgtgattgggacc

SEQ ID NO: 154590 - DNA, 29 bp, Artificial Sequence
  Description of Artificial Sequence: Synthetic oligonucleotide
cgacacctgcacattgtgattgggacctc

SEQ ID NO: 154591 - DNA, 30 bp, Artificial Sequence
  Description of Artificial Sequence: Synthetic oligonucleotide
gacacctgcacattgtgattgggacctcag

SEQ ID NO: 154592 - DNA, 31 bp, Artificial Sequence
  Description of Artificial Sequence: Synthetic oligonucleotide
acacctgcacattgtgattgggacctcagtg

SEQ ID NO: 154593 - DNA, 30 bp, Artificial Sequence
  Description of Artificial Sequence: Synthetic oligonucleotide
cacctgcacattgtgattgggacctcagtg

SEQ ID NO: 154594 - DNA, 30 bp, Artificial Sequence
  Description of Artificial Sequence: Synthetic oligonucleotide
acctgcacattgtgattgggacctcagtgg

SEQ ID NO: 154595 - DNA, 29 bp, Artificial Sequence
  Description of Artificial Sequence: Synthetic oligonucleotide
cctgcacattgtgattgggacctcagtgg

SEQ ID NO: 154596 - DNA, 30 bp, Artificial Sequence
  Description of Artificial Sequence: Synthetic oligonucleotide
ctgcacattgtgattgggacctcagtggtc

SEQ ID NO: 154597 - DNA, 32 bp, Artificial Sequence
  Description of Artificial Sequence: Synthetic oligonucleotide
tgcacattgtgattgggacctcagtggtcatc

SEQ ID NO: 154598 - DNA, 31 bp, Artificial Sequence
  Description of Artificial Sequence: Synthetic oligonucleotide
gcacattgtgattgggacctcagtggtcatc

SEQ ID NO: 154599 - DNA, 33 bp, Artificial Sequence
  Description of Artificial Sequence: Synthetic oligonucleotide
cacattgtgattgggacctcagtggtcatcatc

SEQ ID NO: 154600 - DNA, 33 bp, Artificial Sequence
  Description of Artificial Sequence: Synthetic oligonucleotide
acattgtgattgggacctcagtggtcatcatcc

SEQ ID NO: 154601 - DNA, 32 bp, Artificial Sequence
  Description of Artificial Sequence: Synthetic oligonucleotide
cattgtgattgggacctcagtggtcatcatcc

SEQ ID NO: 154602 - DNA, 33 bp, Artificial Sequence
  Description of Artificial Sequence: Synthetic oligonucleotide
attgtgattgggacctcagtggtcatcatcctc

SEQ ID NO: 154603 - DNA, 32 bp, Artificial Sequence
  Description of Artificial Sequence: Synthetic oligonucleotide
ttgtgattgggacctcagtggtcatcatcctc

SEQ ID NO: 154604 - DNA, 31 bp, Artificial Sequence
  Description of Artificial Sequence: Synthetic oligonucleotide
tgtgattgggacctcagtggtcatcatcctc

SEQ ID NO: 154605 - DNA, 30 bp, Artificial Sequence
  Description of Artificial Sequence: Synthetic oligonucleotide
gtgattgggacctcagtggtcatcatcctc

SEQ ID NO: 154606 - DNA, 30 bp, Artificial Sequence
  Description of Artificial Sequence: Synthetic oligonucleotide
agagaatgtgaccttgtcctgcagctcctg

SEQ ID NO: 154607 - DNA, 29 bp, Artificial Sequence
  Description of Artificial Sequence: Synthetic oligonucleotide
gagaatgtgaccttgtcctgcagctcctg

SEQ ID NO: 154608 - DNA, 29 bp, Artificial Sequence
  Description of Artificial Sequence: Synthetic oligonucleotide
agaatgtgaccttgtcctgcagctcctgg

SEQ ID NO: 154609 - DNA, 28 bp, Artificial Sequence
  Description of Artificial Sequence: Synthetic oligonucleotide
gaatgtgaccttgtcctgcagctcctgg

SEQ ID NO: 154610 - DNA, 29 bp, Artificial Sequence
  Description of Artificial Sequence: Synthetic oligonucleotide
aatgtgaccttgtcctgcagctcctggag

SEQ ID NO: 154611 - DNA, 28 bp, Artificial Sequence
  Description of Artificial Sequence: Synthetic oligonucleotide
atgtgaccttgtcctgcagctcctggag

SEQ ID NO: 154612 - DNA, 27 bp, Artificial Sequence
  Description of Artificial Sequence: Synthetic oligonucleotide
tgtgaccttgtcctgcagctcctggag

SEQ ID NO: 154613 - DNA, 26 bp, Artificial Sequence
  Description of Artificial Sequence: Synthetic oligonucleotide
gtgaccttgtcctgcagctcctggag

SEQ ID NO: 154614 - DNA, 27 bp, Artificial Sequence
  Description of Artificial Sequence: Synthetic oligonucleotide
tgaccttgtcctgcagctcctggagct

SEQ ID NO: 154615 - DNA, 26 bp, Artificial Sequence
  Description of Artificial Sequence: Synthetic oligonucleotide
gaccttgtcctgcagctcctggagct

SEQ ID NO: 154616 - DNA, 26 bp, Artificial Sequence
  Description of Artificial Sequence: Synthetic oligonucleotide
accttgtcctgcagctcctggagctc

SEQ ID NO: 154617 - DNA, 25 bp, Artificial Sequence
  Description of Artificial Sequence: Synthetic oligonucleotide
ccttgtcctgcagctcctggagctc

SEQ ID NO: 154618 - DNA, 27 bp, Artificial Sequence
  Description of Artificial Sequence: Synthetic oligonucleotide
cttgtcctgcagctcctggagctccta

SEQ ID NO: 154619 - DNA, 28 bp, Artificial Sequence
  Description of Artificial Sequence: Synthetic oligonucleotide
ttgtcctgcagctcctggagctcctatg

SEQ ID NO: 154620 - DNA, 27 bp, Artificial Sequence
  Description of Artificial Sequence: Synthetic oligonucleotide
tgtcctgcagctcctggagctcctatg

SEQ ID NO: 154621 - DNA, 27 bp, Artificial Sequence
  Description of Artificial Sequence: Synthetic oligonucleotide
gtcctgcagctcctggagctcctatga

SEQ ID NO: 154622 - DNA, 27 bp, Artificial Sequence
  Description of Artificial Sequence: Synthetic oligonucleotide
tcctgcagctcctggagctcctatgac

SEQ ID NO: 154623 - DNA, 27 bp, Artificial Sequence
  Description of Artificial Sequence: Synthetic oligonucleotide
cctgcagctcctggagctcctatgaca

SEQ ID NO: 154624 - DNA, 28 bp, Artificial Sequence
  Description of Artificial Sequence: Synthetic oligonucleotide
ctgcagctcctggagctcctatgacatg

SEQ ID NO: 154625 - DNA, 30 bp, Artificial Sequence
  Description of Artificial Sequence: Synthetic oligonucleotide
tgcagctcctggagctcctatgacatgtac

SEQ ID NO: 154626 - DNA, 29 bp, Artificial Sequence
  Description of Artificial Sequence: Synthetic oligonucleotide
gcagctcctggagctcctatgacatgtac

SEQ ID NO: 154627 - DNA, 29 bp, Artificial Sequence
  Description of Artificial Sequence: Synthetic oligonucleotide
cagctcctggagctcctatgacatgtacc

SEQ ID NO: 154628 - DNA, 31 bp, Artificial Sequence
  Description of Artificial Sequence: Synthetic oligonucleotide
agctcctggagctcctatgacatgtaccatc

SEQ ID NO: 154629 - DNA, 30 bp, Artificial Sequence
  Description of Artificial Sequence: Synthetic oligonucleotide
gctcctggagctcctatgacatgtaccatc

SEQ ID NO: 154630 - DNA, 33 bp, Artificial Sequence
  Description of Artificial Sequence: Synthetic oligonucleotide
ctcctggagctcctatgacatgtaccatctatc

SEQ ID NO: 154631 - DNA, 33 bp, Artificial Sequence
  Description of Artificial Sequence: Synthetic oligonucleotide
tcctggagctcctatgacatgtaccatctatcc

SEQ ID NO: 154632 - DNA, 32 bp, Artificial Sequence
  Description of Artificial Sequence: Synthetic oligonucleotide
cctggagctcctatgacatgtaccatctatcc

SEQ ID NO: 154633 - DNA, 33 bp, Artificial Sequence
  Description of Artificial Sequence: Synthetic oligonucleotide
ctggagctcctatgacatgtaccatctatccag

SEQ ID NO: 154634 - DNA, 33 bp, Artificial Sequence
  Description of Artificial Sequence: Synthetic oligonucleotide
tggagctcctatgacatgtaccatctatccagg

SEQ ID NO: 154635 - DNA, 27 bp, Artificial Sequence
  Description of Artificial Sequence: Synthetic oligonucleotide
atgtcgctcatggtcgtcagcatggcg

SEQ ID NO: 154636 - DNA, 27 bp, Artificial Sequence
  Description of Artificial Sequence: Synthetic oligonucleotide
tgtcgctcatggtcgtcagcatggcgt

SEQ ID NO: 154637 - DNA, 26 bp, Artificial Sequence
  Description of Artificial Sequence: Synthetic oligonucleotide
gtcgctcatggtcgtcagcatggcgt

SEQ ID NO: 154638 - DNA, 27 bp, Artificial Sequence
  Description of Artificial Sequence: Synthetic oligonucleotide
tcgctcatggtcgtcagcatggcgtgt

SEQ ID NO: 154639 - DNA, 26 bp, Artificial Sequence
  Description of Artificial Sequence: Synthetic oligonucleotide
cgctcatggtcgtcagcatggcgtgt

SEQ ID NO: 154640 - DNA, 27 bp, Artificial Sequence
  Description of Artificial Sequence: Synthetic oligonucleotide
gctcatggtcgtcagcatggcgtgtgt

SEQ ID NO: 154641 - DNA, 28 bp, Artificial Sequence
  Description of Artificial Sequence: Synthetic oligonucleotide
ctcatggtcgtcagcatggcgtgtgttg

SEQ ID NO: 154642 - DNA, 28 bp, Artificial Sequence
  Description of Artificial Sequence: Synthetic oligonucleotide
tcatggtcgtcagcatggcgtgtgttgg

SEQ ID NO: 154643 - DNA, 27 bp, Artificial Sequence
  Description of Artificial Sequence: Synthetic oligonucleotide
catggtcgtcagcatggcgtgtgttgg

SEQ ID NO: 154644 - DNA, 27 bp, Artificial Sequence
  Description of Artificial Sequence: Synthetic oligonucleotide
atggtcgtcagcatggcgtgtgttggg

SEQ ID NO: 154645 - DNA, 34 bp, Artificial Sequence
  Description of Artificial Sequence: Synthetic oligonucleotide
agacagtcatcctgcaatgttggtcagatgtcag

SEQ ID NO: 154646 - DNA, 33 bp, Artificial Sequence
  Description of Artificial Sequence: Synthetic oligonucleotide
gacagtcatcctgcaatgttggtcagatgtcag

SEQ ID NO: 154647 - DNA, 33 bp, Artificial Sequence
  Description of Artificial Sequence: Synthetic oligonucleotide
acagtcatcctgcaatgttggtcagatgtcagg

SEQ ID NO: 154648 - DNA, 32 bp, Artificial Sequence
  Description of Artificial Sequence: Synthetic oligonucleotide
cagtcatcctgcaatgttggtcagatgtcagg

SEQ ID NO: 154649 - DNA, 35 bp, Artificial Sequence
  Description of Artificial Sequence: Synthetic oligonucleotide
agtcatcctgcaatgttggtcagatgtcaggtttg

SEQ ID NO: 154650 - DNA, 34 bp, Artificial Sequence
  Description of Artificial Sequence: Synthetic oligonucleotide
gtcatcctgcaatgttggtcagatgtcaggtttg

SEQ ID NO: 154651 - DNA, 35 bp, Artificial Sequence
  Description of Artificial Sequence: Synthetic oligonucleotide
tcatcctgcaatgttggtcagatgtcaggtttgag

SEQ ID NO: 154652 - DNA, 34 bp, Artificial Sequence
  Description of Artificial Sequence: Synthetic oligonucleotide
catcctgcaatgttggtcagatgtcaggtttgag

SEQ ID NO: 154653 - DNA, 34 bp, Artificial Sequence
  Description of Artificial Sequence: Synthetic oligonucleotide
atcctgcaatgttggtcagatgtcaggtttgagc

SEQ ID NO: 154654 - DNA, 33 bp, Artificial Sequence
  Description of Artificial Sequence: Synthetic oligonucleotide
tcctgcaatgttggtcagatgtcaggtttgagc

SEQ ID NO: 154655 - DNA, 32 bp, Artificial Sequence
  Description of Artificial Sequence: Synthetic oligonucleotide
cctgcaatgttggtcagatgtcaggtttgagc

SEQ ID NO: 154656 - DNA, 33 bp, Artificial Sequence
  Description of Artificial Sequence: Synthetic oligonucleotide
ctgcaatgttggtcagatgtcaggtttgagcac

SEQ ID NO: 154657 - DNA, 35 bp, Artificial Sequence
  Description of Artificial Sequence: Synthetic oligonucleotide
tgcaatgttggtcagatgtcaggtttgagcacttc

SEQ ID NO: 154658 - DNA, 34 bp, Artificial Sequence
  Description of Artificial Sequence: Synthetic oligonucleotide
gcaatgttggtcagatgtcaggtttgagcacttc

SEQ ID NO: 154659 - DNA, 34 bp, Artificial Sequence
  Description of Artificial Sequence: Synthetic oligonucleotide
caatgttggtcagatgtcaggtttgagcacttcc

SEQ ID NO: 154660 - DNA, 36 bp, Artificial Sequence
  Description of Artificial Sequence: Synthetic oligonucleotide
aatgttggtcagatgtcaggtttgagcacttccttc

SEQ ID NO: 154661 - DNA, 35 bp, Artificial Sequence
  Description of Artificial Sequence: Synthetic oligonucleotide
atgttggtcagatgtcaggtttgagcacttccttc

SEQ ID NO: 154662 - DNA, 34 bp, Artificial Sequence
  Description of Artificial Sequence: Synthetic oligonucleotide
tgttggtcagatgtcaggtttgagcacttccttc

SEQ ID NO: 154663 - DNA, 33 bp, Artificial Sequence
  Description of Artificial Sequence: Synthetic oligonucleotide
gttggtcagatgtcaggtttgagcacttccttc

SEQ ID NO: 154664 - DNA, 34 bp, Artificial Sequence
  Description of Artificial Sequence: Synthetic oligonucleotide
ttggtcagatgtcaggtttgagcacttccttctg

SEQ ID NO: 154665 - DNA, 33 bp, Artificial Sequence
  Description of Artificial Sequence: Synthetic oligonucleotide
tggtcagatgtcaggtttgagcacttccttctg

SEQ ID NO: 154666 - DNA, 32 bp, Artificial Sequence
  Description of Artificial Sequence: Synthetic oligonucleotide
ggtcagatgtcaggtttgagcacttccttctg

SEQ ID NO: 154667 - DNA, 32 bp, Artificial Sequence
  Description of Artificial Sequence: Synthetic oligonucleotide
gtcagatgtcaggtttgagcacttccttctgc

SEQ ID NO: 154668 - DNA, 33 bp, Artificial Sequence
  Description of Artificial Sequence: Synthetic oligonucleotide
tcagatgtcaggtttgagcacttccttctgcac

SEQ ID NO: 154669 - DNA, 32 bp, Artificial Sequence
  Description of Artificial Sequence: Synthetic oligonucleotide
cagatgtcaggtttgagcacttccttctgcac

SEQ ID NO: 154670 - DNA, 33 bp, Artificial Sequence
  Description of Artificial Sequence: Synthetic oligonucleotide
agatgtcaggtttgagcacttccttctgcacag

SEQ ID NO: 154671 - DNA, 32 bp, Artificial Sequence
  Description of Artificial Sequence: Synthetic oligonucleotide
gatgtcaggtttgagcacttccttctgcacag

SEQ ID NO: 154672 - DNA, 33 bp, Artificial Sequence
  Description of Artificial Sequence: Synthetic oligonucleotide
atgtcaggtttgagcacttccttctgcacagag

SEQ ID NO: 154673 - DNA, 32 bp, Artificial Sequence
  Description of Artificial Sequence: Synthetic oligonucleotide
tgtcaggtttgagcacttccttctgcacagag

SEQ ID NO: 154674 - DNA, 31 bp, Artificial Sequence
  Description of Artificial Sequence: Synthetic oligonucleotide
gtcaggtttgagcacttccttctgcacagag

SEQ ID NO: 154675 - DNA, 33 bp, Artificial Sequence
  Description of Artificial Sequence: Synthetic oligonucleotide
tcaggtttgagcacttccttctgcacagagaag

SEQ ID NO: 154676 - DNA, 32 bp, Artificial Sequence
  Description of Artificial Sequence: Synthetic oligonucleotide
caggtttgagcacttccttctgcacagagaag

SEQ ID NO: 154677 - DNA, 32 bp, Artificial Sequence
  Description of Artificial Sequence: Synthetic oligonucleotide
aggtttgagcacttccttctgcacagagaagg

SEQ ID NO: 154678 - DNA, 31 bp, Artificial Sequence
  Description of Artificial Sequence: Synthetic oligonucleotide
ggtttgagcacttccttctgcacagagaagg

SEQ ID NO: 154679 - DNA, 31 bp, Artificial Sequence
  Description of Artificial Sequence: Synthetic oligonucleotide
gtttgagcacttccttctgcacagagaaggg

SEQ ID NO: 154680 - DNA, 33 bp, Artificial Sequence
  Description of Artificial Sequence: Synthetic oligonucleotide
tttgagcacttccttctgcacagagaagggaag

SEQ ID NO: 154681 - DNA, 32 bp, Artificial Sequence
  Description of Artificial Sequence: Synthetic oligonucleotide
ttgagcacttccttctgcacagagaagggaag

SEQ ID NO: 154682 - DNA, 31 bp, Artificial Sequence
  Description of Artificial Sequence: Synthetic oligonucleotide
tgagcacttccttctgcacagagaagggaag

SEQ ID NO: 154683 - DNA, 30 bp, Artificial Sequence
  Description of Artificial Sequence: Synthetic oligonucleotide
gagcacttccttctgcacagagaagggaag

SEQ ID NO: 154684 - DNA, 35 bp, Artificial Sequence
  Description of Artificial Sequence: Synthetic oligonucleotide
agcacttccttctgcacagagaagggaagtttaag

SEQ ID NO: 154685 - DNA, 34 bp, Artificial Sequence
  Description of Artificial Sequence: Synthetic oligonucleotide
gcacttccttctgcacagagaagggaagtttaag

SEQ ID NO: 154686 - DNA, 34 bp, Artificial Sequence
  Description of Artificial Sequence: Synthetic oligonucleotide
cacttccttctgcacagagaagggaagtttaagg

SEQ ID NO: 154687 - DNA, 35 bp, Artificial Sequence
  Description of Artificial Sequence: Synthetic oligonucleotide
acttccttctgcacagagaagggaagtttaaggac

SEQ ID NO: 154688 - DNA, 34 bp, Artificial Sequence
  Description of Artificial Sequence: Synthetic oligonucleotide
cttccttctgcacagagaagggaagtttaaggac

SEQ ID NO: 154689 - DNA, 35 bp, Artificial Sequence
  Description of Artificial Sequence: Synthetic oligonucleotide
ttccttctgcacagagaagggaagtttaaggacac

SEQ ID NO: 154690 - DNA, 34 bp, Artificial Sequence
  Description of Artificial Sequence: Synthetic oligonucleotide
tccttctgcacagagaagggaagtttaaggacac

SEQ ID NO: 154691 - DNA, 33 bp, Artificial Sequence
  Description of Artificial Sequence: Synthetic oligonucleotide
ccttctgcacagagaagggaagtttaaggacac

SEQ ID NO: 154692 - DNA, 36 bp, Artificial Sequence
  Description of Artificial Sequence: Synthetic oligonucleotide
cttctgcacagagaagggaagtttaaggacactttg

SEQ ID NO: 154693 - DNA, 36 bp, Artificial Sequence
  Description of Artificial Sequence: Synthetic oligonucleotide
ttctgcacagagaagggaagtttaaggacactttgc

SEQ ID NO: 154694 - DNA, 35 bp, Artificial Sequence
  Description of Artificial Sequence: Synthetic oligonucleotide
tctgcacagagaagggaagtttaaggacactttgc

SEQ ID NO: 154695 - DNA, 34 bp, Artificial Sequence
  Description of Artificial Sequence: Synthetic oligonucleotide
ctgcacagagaagggaagtttaaggacactttgc

SEQ ID NO: 154696 - DNA, 35 bp, Artificial Sequence
  Description of Artificial Sequence: Synthetic oligonucleotide
tgcacagagaagggaagtttaaggacactttgcac

SEQ ID NO: 154697 - DNA, 34 bp, Artificial Sequence
  Description of Artificial Sequence: Synthetic oligonucleotide
gcacagagaagggaagtttaaggacactttgcac

SEQ ID NO: 154698 - DNA, 34 bp, Artificial Sequence
  Description of Artificial Sequence: Synthetic oligonucleotide
cacagagaagggaagtttaaggacactttgcacc

SEQ ID NO: 154699 - DNA, 35 bp, Artificial Sequence
  Description of Artificial Sequence: Synthetic oligonucleotide
acagagaagggaagtttaaggacactttgcacctc

SEQ ID NO: 154700 - DNA, 34 bp, Artificial Sequence
  Description of Artificial Sequence: Synthetic oligonucleotide
cagagaagggaagtttaaggacactttgcacctc

SEQ ID NO: 154701 - DNA, 37 bp, Artificial Sequence
  Description of Artificial Sequence: Synthetic oligonucleotide
agagaagggaagtttaaggacactttgcacctcattg

SEQ ID NO: 154702 - DNA, 36 bp, Artificial Sequence
  Description of Artificial Sequence: Synthetic oligonucleotide
gagaagggaagtttaaggacactttgcacctcattg

SEQ ID NO: 154703 - DNA, 36 bp, Artificial Sequence
  Description of Artificial Sequence: Synthetic oligonucleotide
agaagggaagtttaaggacactttgcacctcattgg

SEQ ID NO: 154704 - DNA, 35 bp, Artificial Sequence
  Description of Artificial Sequence: Synthetic oligonucleotide
gaagggaagtttaaggacactttgcacctcattgg

SEQ ID NO: 154705 - DNA, 36 bp, Artificial Sequence
  Description of Artificial Sequence: Synthetic oligonucleotide
aagggaagtttaaggacactttgcacctcattggag

SEQ ID NO: 154706 - DNA, 35 bp, Artificial Sequence
  Description of Artificial Sequence: Synthetic oligonucleotide
agggaagtttaaggacactttgcacctcattggag

SEQ ID NO: 154707 - DNA, 34 bp, Artificial Sequence
  Description of Artificial Sequence: Synthetic oligonucleotide
gggaagtttaaggacactttgcacctcattggag

SEQ ID NO: 154708 - DNA, 35 bp, Artificial Sequence
  Description of Artificial Sequence: Synthetic oligonucleotide
ggaagtttaaggacactttgcacctcattggagag

SEQ ID NO: 154709 - DNA, 35 bp, Artificial Sequence
  Description of Artificial Sequence: Synthetic oligonucleotide
gaagtttaaggacactttgcacctcattggagagc

SEQ ID NO: 154710 - DNA, 36 bp, Artificial Sequence
  Description of Artificial Sequence: Synthetic oligonucleotide
aagtttaaggacactttgcacctcattggagagcac

SEQ ID NO: 154711 - DNA, 35 bp, Artificial Sequence
  Description of Artificial Sequence: Synthetic oligonucleotide
agtttaaggacactttgcacctcattggagagcac

SEQ ID NO: 154712 - DNA, 34 bp, Artificial Sequence
  Description of Artificial Sequence: Synthetic oligonucleotide
gtttaaggacactttgcacctcattggagagcac

SEQ ID NO: 154713 - DNA, 34 bp, Artificial Sequence
  Description of Artificial Sequence: Synthetic oligonucleotide
tttaaggacactttgcacctcattggagagcacc

SEQ ID NO: 154714 - DNA, 33 bp, Artificial Sequence
  Description of Artificial Sequence: Synthetic oligonucleotide
ttaaggacactttgcacctcattggagagcacc

SEQ ID NO: 154715 - DNA, 32 bp, Artificial Sequence
  Description of Artificial Sequence: Synthetic oligonucleotide
taaggacactttgcacctcattggagagcacc

SEQ ID NO: 154716 - DNA, 31 bp, Artificial Sequence
  Description of Artificial Sequence: Synthetic oligonucleotide
aaggacactttgcacctcattggagagcacc

SEQ ID NO: 154717 - DNA, 30 bp, Artificial Sequence
  Description of Artificial Sequence: Synthetic oligonucleotide
aggacactttgcacctcattggagagcacc

SEQ ID NO: 154718 - DNA, 29 bp, Artificial Sequence
  Description of Artificial Sequence: Synthetic oligonucleotide
ggacactttgcacctcattggagagcacc

SEQ ID NO: 154719 - DNA, 31 bp, Artificial Sequence
  Description of Artificial Sequence: Synthetic oligonucleotide
gacactttgcacctcattggagagcaccatg

SEQ ID NO: 154720 - DNA, 33 bp, Artificial Sequence
  Description of Artificial Sequence: Synthetic oligonucleotide
acactttgcacctcattggagagcaccatgatg

SEQ ID NO: 154721 - DNA, 32 bp, Artificial Sequence
  Description of Artificial Sequence: Synthetic oligonucleotide
cactttgcacctcattggagagcaccatgatg

SEQ ID NO: 154722 - DNA, 32 bp, Artificial Sequence
  Description of Artificial Sequence: Synthetic oligonucleotide
actttgcacctcattggagagcaccatgatgg

SEQ ID NO: 154723 - DNA, 31 bp, Artificial Sequence
  Description of Artificial Sequence: Synthetic oligonucleotide
ctttgcacctcattggagagcaccatgatgg

SEQ ID NO: 154724 - DNA, 31 bp, Artificial Sequence
  Description of Artificial Sequence: Synthetic oligonucleotide
tttgcacctcattggagagcaccatgatggg

SEQ ID NO: 154725 - DNA, 30 bp, Artificial Sequence
  Description of Artificial Sequence: Synthetic oligonucleotide
ttgcacctcattggagagcaccatgatggg

SEQ ID NO: 154726 - DNA, 29 bp, Artificial Sequence
  Description of Artificial Sequence: Synthetic oligonucleotide
tgcacctcattggagagcaccatgatggg

SEQ ID NO: 154727 - DNA, 28 bp, Artificial Sequence
  Description of Artificial Sequence: Synthetic oligonucleotide
gcacctcattggagagcaccatgatggg

SEQ ID NO: 154728 - DNA, 28 bp, Artificial Sequence
  Description of Artificial Sequence: Synthetic oligonucleotide
cacctcattggagagcaccatgatgggg

SEQ ID NO: 154729 - DNA, 29 bp, Artificial Sequence
  Description of Artificial Sequence: Synthetic oligonucleotide
acctcattggagagcaccatgatggggtc

SEQ ID NO: 154730 - DNA, 28 bp, Artificial Sequence
  Description of Artificial Sequence: Synthetic oligonucleotide
cctcattggagagcaccatgatggggtc

SEQ ID NO: 154731 - DNA, 29 bp, Artificial Sequence
  Description of Artificial Sequence: Synthetic oligonucleotide
ctcattggagagcaccatgatggggtctc

SEQ ID NO: 154732 - DNA, 29 bp, Artificial Sequence
  Description of Artificial Sequence: Synthetic oligonucleotide
tcattggagagcaccatgatggggtctcc

SEQ ID NO: 154733 - DNA, 28 bp, Artificial Sequence
  Description of Artificial Sequence: Synthetic oligonucleotide
cattggagagcaccatgatggggtctcc

SEQ ID NO: 154734 - DNA, 31 bp, Artificial Sequence
  Description of Artificial Sequence: Synthetic oligonucleotide
attggagagcaccatgatggggtctccaaag

SEQ ID NO: 154735 - DNA, 30 bp, Artificial Sequence
  Description of Artificial Sequence: Synthetic oligonucleotide
ttggagagcaccatgatggggtctccaaag

SEQ ID NO: 154736 - DNA, 29 bp, Artificial Sequence
  Description of Artificial Sequence: Synthetic oligonucleotide
tggagagcaccatgatggggtctccaaag

SEQ ID NO: 154737 - DNA, 28 bp, Artificial Sequence
  Description of Artificial Sequence: Synthetic oligonucleotide
ggagagcaccatgatggggtctccaaag

SEQ ID NO: 154738 - DNA, 28 bp, Artificial Sequence
  Description of Artificial Sequence: Synthetic oligonucleotide
gagagcaccatgatggggtctccaaagc

SEQ ID NO: 154739 - DNA, 28 bp, Artificial Sequence
  Description of Artificial Sequence: Synthetic oligonucleotide
agagcaccatgatggggtctccaaagcc

SEQ ID NO: 154740 - DNA, 27 bp, Artificial Sequence
  Description of Artificial Sequence: Synthetic oligonucleotide
gagcaccatgatggggtctccaaagcc

SEQ ID NO: 154741 - DNA, 29 bp, Artificial Sequence
  Description of Artificial Sequence: Synthetic oligonucleotide
agcaccatgatggggtctccaaagccaac

SEQ ID NO: 154742 - DNA, 28 bp, Artificial Sequence
  Description of Artificial Sequence: Synthetic oligonucleotide
gcaccatgatggggtctccaaagccaac

SEQ ID NO: 154743 - DNA, 30 bp, Artificial Sequence
  Description of Artificial Sequence: Synthetic oligonucleotide
caccatgatggggtctccaaagccaacttc

SEQ ID NO: 154744 - DNA, 31 bp, Artificial Sequence
  Description of Artificial Sequence: Synthetic oligonucleotide
accatgatggggtctccaaagccaacttctc

SEQ ID NO: 154745 - DNA, 30 bp, Artificial Sequence
  Description of Artificial Sequence: Synthetic oligonucleotide
ccatgatggggtctccaaagccaacttctc

SEQ ID NO: 154746 - DNA, 30 bp, Artificial Sequence
  Description of Artificial Sequence: Synthetic oligonucleotide
catgatggggtctccaaagccaacttctcc

SEQ ID NO: 154747 - DNA, 32 bp, Artificial Sequence
  Description of Artificial Sequence: Synthetic oligonucleotide
atgatggggtctccaaagccaacttctccatc

SEQ ID NO: 154748 - DNA, 31 bp, Artificial Sequence
  Description of Artificial Sequence: Synthetic oligonucleotide
tgatggggtctccaaagccaacttctccatc

SEQ ID NO: 154749 - DNA, 30 bp, Artificial Sequence
  Description of Artificial Sequence: Synthetic oligonucleotide
gatggggtctccaaagccaacttctccatc

SEQ ID NO: 154750 - DNA, 30 bp, Artificial Sequence
  Description of Artificial Sequence: Synthetic oligonucleotide
atggggtctccaaagccaacttctccatcg

SEQ ID NO: 154751 - DNA, 29 bp, Artificial Sequence
  Description of Artificial Sequence: Synthetic oligonucleotide
tggggtctccaaagccaacttctccatcg

SEQ ID NO: 154752 - DNA, 28 bp, Artificial Sequence
  Description of Artificial Sequence: Synthetic oligonucleotide
ggggtctccaaagccaacttctccatcg

SEQ ID NO: 154753 - DNA, 28 bp, Artificial Sequence
  Description of Artificial Sequence: Synthetic oligonucleotide
gggtctccaaagccaacttctccatcgg

SEQ ID NO: 154754 - DNA, 29 bp, Artificial Sequence
  Description of Artificial Sequence: Synthetic oligonucleotide
ggtctccaaagccaacttctccatcggtc

SEQ ID NO: 154755 - DNA, 29 bp, Artificial Sequence
  Description of Artificial Sequence: Synthetic oligonucleotide
gtctccaaagccaacttctccatcggtcc

SEQ ID NO: 154756 - DNA, 29 bp, Artificial Sequence
  Description of Artificial Sequence: Synthetic oligonucleotide
tctccaaagccaacttctccatcggtccc

SEQ ID NO: 154757 - DNA, 28 bp, Artificial Sequence
  Description of Artificial Sequence: Synthetic oligonucleotide
ctccaaagccaacttctccatcggtccc

SEQ ID NO: 154758 - DNA, 30 bp, Artificial Sequence
  Description of Artificial Sequence: Synthetic oligonucleotide
tccaaagccaacttctccatcggtcccatg

SEQ ID NO: 154759 - DNA, 29 bp, Artificial Sequence
  Description of Artificial Sequence: Synthetic oligonucleotide
ccaaagccaacttctccatcggtcccatg

SEQ ID NO: 154760 - DNA, 31 bp, Artificial Sequence
  Description of Artificial Sequence: Synthetic oligonucleotide
caaagccaacttctccatcggtcccatgatg

SEQ ID NO: 154761 - DNA, 31 bp, Artificial Sequence
  Description of Artificial Sequence: Synthetic oligonucleotide
aaagccaacttctccatcggtcccatgatgc

SEQ ID NO: 154762 - DNA, 30 bp, Artificial Sequence
  Description of Artificial Sequence: Synthetic oligonucleotide
aagccaacttctccatcggtcccatgatgc

SEQ ID NO: 154763 - DNA, 29 bp, Artificial Sequence
  Description of Artificial Sequence: Synthetic oligonucleotide
agccaacttctccatcggtcccatgatgc

SEQ ID NO: 154764 - DNA, 28 bp, Artificial Sequence
  Description of Artificial Sequence: Synthetic oligonucleotide
gccaacttctccatcggtcccatgatgc

SEQ ID NO: 154765 - DNA, 30 bp, Artificial Sequence
  Description of Artificial Sequence: Synthetic oligonucleotide
ccaacttctccatcggtcccatgatgcaag

SEQ ID NO: 154766 - DNA, 31 bp, Artificial Sequence
  Description of Artificial Sequence: Synthetic oligonucleotide
caacttctccatcggtcccatgatgcaagac

SEQ ID NO: 154767 - DNA, 31 bp, Artificial Sequence
  Description of Artificial Sequence: Synthetic oligonucleotide
aacttctccatcggtcccatgatgcaagacc

SEQ ID NO: 154768 - DNA, 30 bp, Artificial Sequence
  Description of Artificial Sequence: Synthetic oligonucleotide
acttctccatcggtcccatgatgcaagacc

SEQ ID NO: 154769 - DNA, 29 bp, Artificial Sequence
  Description of Artificial Sequence: Synthetic oligonucleotide
cttctccatcggtcccatgatgcaagacc

SEQ ID NO: 154770 - DNA, 31 bp, Artificial Sequence
  Description of Artificial Sequence: Synthetic oligonucleotide
ttctccatcggtcccatgatgcaagaccttg

SEQ ID NO: 154771 - DNA, 30 bp, Artificial Sequence
  Description of Artificial Sequence: Synthetic oligonucleotide
tctccatcggtcccatgatgcaagaccttg

SEQ ID NO: 154772 - DNA, 29 bp, Artificial Sequence
  Description of Artificial Sequence: Synthetic oligonucleotide
ctccatcggtcccatgatgcaagaccttg

SEQ ID NO: 154773 - DNA, 29 bp, Artificial Sequence
  Description of Artificial Sequence: Synthetic oligonucleotide
tccatcggtcccatgatgcaagaccttgc

SEQ ID NO: 154774 - DNA, 28 bp, Artificial Sequence
  Description of Artificial Sequence: Synthetic oligonucleotide
ccatcggtcccatgatgcaagaccttgc

SEQ ID NO: 154775 - DNA, 29 bp, Artificial Sequence
  Description of Artificial Sequence: Synthetic oligonucleotide
catcggtcccatgatgcaagaccttgcag

SEQ ID NO: 154776 - DNA, 29 bp, Artificial Sequence
  Description of Artificial Sequence: Synthetic oligonucleotide
atcggtcccatgatgcaagaccttgcagg

SEQ ID NO: 154777 - DNA, 28 bp, Artificial Sequence
  Description of Artificial Sequence: Synthetic oligonucleotide
tcggtcccatgatgcaagaccttgcagg

SEQ ID NO: 154778 - DNA, 27 bp, Artificial Sequence
  Description of Artificial Sequence: Synthetic oligonucleotide
cggtcccatgatgcaagaccttgcagg

SEQ ID NO: 154779 - DNA, 27 bp, Artificial Sequence
  Description of Artificial Sequence: Synthetic oligonucleotide
ggtcccatgatgcaagaccttgcaggg

SEQ ID NO: 154780 - DNA, 28 bp, Artificial Sequence
  Description of Artificial Sequence: Synthetic oligonucleotide
gtcccatgatgcaagaccttgcagggac

SEQ ID NO: 154781 - DNA, 28 bp, Artificial Sequence
  Description of Artificial Sequence: Synthetic oligonucleotide
tcccatgatgcaagaccttgcagggacc

SEQ ID NO: 154782 - DNA, 27 bp, Artificial Sequence
  Description of Artificial Sequence: Synthetic oligonucleotide
cccatgatgcaagaccttgcagggacc

SEQ ID NO: 154783 - DNA, 29 bp, Artificial Sequence
  Description of Artificial Sequence: Synthetic oligonucleotide
ccatgatgcaagaccttgcagggacctac

SEQ ID NO: 154784 - DNA, 30 bp, Artificial Sequence
  Description of Artificial Sequence: Synthetic oligonucleotide
catgatgcaagaccttgcagggacctacag

SEQ ID NO: 154785 - DNA, 32 bp, Artificial Sequence
  Description of Artificial Sequence: Synthetic oligonucleotide
atgatgcaagaccttgcagggacctacagatg

SEQ ID NO: 154786 - DNA, 31 bp, Artificial Sequence
  Description of Artificial Sequence: Synthetic oligonucleotide
tgatgcaagaccttgcagggacctacagatg

SEQ ID NO: 154787 - DNA, 30 bp, Artificial Sequence
  Description of Artificial Sequence: Synthetic oligonucleotide
gatgcaagaccttgcagggacctacagatg

SEQ ID NO: 154788 - DNA, 30 bp, Artificial Sequence
  Description of Artificial Sequence: Synthetic oligonucleotide
atgcaagaccttgcagggacctacagatgc

SEQ ID NO: 154789 - DNA, 29 bp, Artificial Sequence
  Description of Artificial Sequence: Synthetic oligonucleotide
tgcaagaccttgcagggacctacagatgc

SEQ ID NO: 154790 - DNA, 28 bp, Artificial Sequence
  Description of Artificial Sequence: Synthetic oligonucleotide
gcaagaccttgcagggacctacagatgc

SEQ ID NO: 154791 - DNA, 30 bp, Artificial Sequence
  Description of Artificial Sequence: Synthetic oligonucleotide
caagaccttgcagggacctacagatgctac

SEQ ID NO: 154792 - DNA, 30 bp, Artificial Sequence
  Description of Artificial Sequence: Synthetic oligonucleotide
aagaccttgcagggacctacagatgctacg

SEQ ID NO: 154793 - DNA, 29 bp, Artificial Sequence
  Description of Artificial Sequence: Synthetic oligonucleotide
agaccttgcagggacctacagatgctacg

SEQ ID NO: 154794 - DNA, 28 bp, Artificial Sequence
  Description of Artificial Sequence: Synthetic oligonucleotide
gaccttgcagggacctacagatgctacg

SEQ ID NO: 154795 - DNA, 28 bp, Artificial Sequence
  Description of Artificial Sequence: Synthetic oligonucleotide
accttgcagggacctacagatgctacgg

SEQ ID NO: 154796 - DNA, 27 bp, Artificial Sequence
  Description of Artificial Sequence: Synthetic oligonucleotide
ccttgcagggacctacagatgctacgg

SEQ ID NO: 154797 - DNA, 29 bp, Artificial Sequence
  Description of Artificial Sequence: Synthetic oligonucleotide
cttgcagggacctacagatgctacggttc

SEQ ID NO: 154798 - DNA, 30 bp, Artificial Sequence
  Description of Artificial Sequence: Synthetic oligonucleotide
ttgcagggacctacagatgctacggttctg

SEQ ID NO: 154799 - DNA, 29 bp, Artificial Sequence
  Description of Artificial Sequence: Synthetic oligonucleotide
tgcagggacctacagatgctacggttctg

SEQ ID NO: 154800 - DNA, 33 bp, Artificial Sequence
  Description of Artificial Sequence: Synthetic oligonucleotide
tacggttctgttactcactccccctatcagttg

SEQ ID NO: 154801 - DNA, 32 bp, Artificial Sequence
  Description of Artificial Sequence: Synthetic oligonucleotide
acggttctgttactcactccccctatcagttg

SEQ ID NO: 154802 - DNA, 31 bp, Artificial Sequence
  Description of Artificial Sequence: Synthetic oligonucleotide
cggttctgttactcactccccctatcagttg

SEQ ID NO: 154803 - DNA, 32 bp, Artificial Sequence
  Description of Artificial Sequence: Synthetic oligonucleotide
ggttctgttactcactccccctatcagttgtc

SEQ ID NO: 154804 - DNA, 33 bp, Artificial Sequence
  Description of Artificial Sequence: Synthetic oligonucleotide
gttctgttactcactccccctatcagttgtcag

SEQ ID NO: 154805 - DNA, 33 bp, Artificial Sequence
  Description of Artificial Sequence: Synthetic oligonucleotide
ttctgttactcactccccctatcagttgtcagc

SEQ ID NO: 154806 - DNA, 32 bp, Artificial Sequence
  Description of Artificial Sequence: Synthetic oligonucleotide
tctgttactcactccccctatcagttgtcagc

SEQ ID NO: 154807 - DNA, 31 bp, Artificial Sequence
  Description of Artificial Sequence: Synthetic oligonucleotide
ctgttactcactccccctatcagttgtcagc

SEQ ID NO: 154808 - DNA, 32 bp, Artificial Sequence
  Description of Artificial Sequence: Synthetic oligonucleotide
tgttactcactccccctatcagttgtcagctc

SEQ ID NO: 154809 - DNA, 31 bp, Artificial Sequence
  Description of Artificial Sequence: Synthetic oligonucleotide
gttactcactccccctatcagttgtcagctc

SEQ ID NO: 154810 - DNA, 31 bp, Artificial Sequence
  Description of Artificial Sequence: Synthetic oligonucleotide
ttactcactccccctatcagttgtcagctcc

SEQ ID NO: 154811 - DNA, 30 bp, Artificial Sequence
  Description of Artificial Sequence: Synthetic oligonucleotide
tactcactccccctatcagttgtcagctcc

SEQ ID NO: 154812 - DNA, 29 bp, Artificial Sequence
  Description of Artificial Sequence: Synthetic oligonucleotide
actcactccccctatcagttgtcagctcc

SEQ ID NO: 154813 - DNA, 28 bp, Artificial Sequence
  Description of Artificial Sequence: Synthetic oligonucleotide
ctcactccccctatcagttgtcagctcc

SEQ ID NO: 154814 - DNA, 28 bp, Artificial Sequence
  Description of Artificial Sequence: Synthetic oligonucleotide
tcactccccctatcagttgtcagctccc

SEQ ID NO: 154815 - DNA, 27 bp, Artificial Sequence
  Description of Artificial Sequence: Synthetic oligonucleotide
cactccccctatcagttgtcagctccc

SEQ ID NO: 154816 - DNA, 28 bp, Artificial Sequence
  Description of Artificial Sequence: Synthetic oligonucleotide
actccccctatcagttgtcagctcccag

SEQ ID NO: 154817 - DNA, 27 bp, Artificial Sequence
  Description of Artificial Sequence: Synthetic oligonucleotide
ctccccctatcagttgtcagctcccag

SEQ ID NO: 154818 - DNA, 28 bp, Artificial Sequence
  Description of Artificial Sequence: Synthetic oligonucleotide
tccccctatcagttgtcagctcccagtg

SEQ ID NO: 154819 - DNA, 27 bp, Artificial Sequence
  Description of Artificial Sequence: Synthetic oligonucleotide
ccccctatcagttgtcagctcccagtg

SEQ ID NO: 154820 - DNA, 28 bp, Artificial Sequence
  Description of Artificial Sequence: Synthetic oligonucleotide
cccctatcagttgtcagctcccagtgac

SEQ ID NO: 154821 - DNA, 28 bp, Artificial Sequence
  Description of Artificial Sequence: Synthetic oligonucleotide
ccctatcagttgtcagctcccagtgacc

SEQ ID NO: 154822 - DNA, 28 bp, Artificial Sequence
  Description of Artificial Sequence: Synthetic oligonucleotide
cctatcagttgtcagctcccagtgaccc

SEQ ID NO: 154823 - DNA, 29 bp, Artificial Sequence
  Description of Artificial Sequence: Synthetic oligonucleotide
ctatcagttgtcagctcccagtgaccctc

SEQ ID NO: 154824 - DNA, 30 bp, Artificial Sequence
  Description of Artificial Sequence: Synthetic oligonucleotide
tatcagttgtcagctcccagtgaccctctg

SEQ ID NO: 154825 - DNA, 29 bp, Artificial Sequence
  Description of Artificial Sequence: Synthetic oligonucleotide
atcagttgtcagctcccagtgaccctctg

SEQ ID NO: 154826 - DNA, 28 bp, Artificial Sequence
  Description of Artificial Sequence: Synthetic oligonucleotide
tcagttgtcagctcccagtgaccctctg

SEQ ID NO: 154827 - DNA, 27 bp, Artificial Sequence
  Description of Artificial Sequence: Synthetic oligonucleotide
cagttgtcagctcccagtgaccctctg

SEQ ID NO: 154828 - DNA, 27 bp, Artificial Sequence
  Description of Artificial Sequence: Synthetic oligonucleotide
agttgtcagctcccagtgaccctctgg

SEQ ID NO: 154829 - DNA, 27 bp, Artificial Sequence
  Description of Artificial Sequence: Synthetic oligonucleotide
gttgtcagctcccagtgaccctctgga

SEQ ID NO: 154830 - DNA, 27 bp, Artificial Sequence
  Description of Artificial Sequence: Synthetic oligonucleotide
ttgtcagctcccagtgaccctctggac

SEQ ID NO: 154831 - DNA, 27 bp, Artificial Sequence
  Description of Artificial Sequence: Synthetic oligonucleotide
ctcccagtgaccctctggacatcgtca

SEQ ID NO: 154832 - DNA, 28 bp, Artificial Sequence
  Description of Artificial Sequence: Synthetic oligonucleotide
tcccagtgaccctctggacatcgtcatc

SEQ ID NO: 154833 - DNA, 27 bp, Artificial Sequence
  Description of Artificial Sequence: Synthetic oligonucleotide
cccagtgaccctctggacatcgtcatc

SEQ ID NO: 154834 - DNA, 28 bp, Artificial Sequence
  Description of Artificial Sequence: Synthetic oligonucleotide
ccagtgaccctctggacatcgtcatcac

SEQ ID NO: 154835 - DNA, 29 bp, Artificial Sequence
  Description of Artificial Sequence: Synthetic oligonucleotide
cagtgaccctctggacatcgtcatcacag

SEQ ID NO: 154836 - DNA, 29 bp, Artificial Sequence
  Description of Artificial Sequence: Synthetic oligonucleotide
agtgaccctctggacatcgtcatcacagg

SEQ ID NO: 154837 - DNA, 28 bp, Artificial Sequence
  Description of Artificial Sequence: Synthetic oligonucleotide
gtgaccctctggacatcgtcatcacagg

SEQ ID NO: 154838 - DNA, 29 bp, Artificial Sequence
  Description of Artificial Sequence: Synthetic oligonucleotide
tgaccctctggacatcgtcatcacaggtc

SEQ ID NO: 154839 - DNA, 28 bp, Artificial Sequence
  Description of Artificial Sequence: Synthetic oligonucleotide
gaccctctggacatcgtcatcacaggtc

SEQ ID NO: 154840 - DNA, 33 bp, Artificial Sequence
  Description of Artificial Sequence: Synthetic oligonucleotide
accctctggacatcgtcatcacaggtctatatg

SEQ ID NO: 154841 - DNA, 32 bp, Artificial Sequence
  Description of Artificial Sequence: Synthetic oligonucleotide
ccctctggacatcgtcatcacaggtctatatg

SEQ ID NO: 154842 - DNA, 33 bp, Artificial Sequence
  Description of Artificial Sequence: Synthetic oligonucleotide
cctctggacatcgtcatcacaggtctatatgag

SEQ ID NO: 154843 - DNA, 36 bp, Artificial Sequence
  Description of Artificial Sequence: Synthetic oligonucleotide
ctctggacatcgtcatcacaggtctatatgagaaac

SEQ ID NO: 154844 - DNA, 36 bp, Artificial Sequence
  Description of Artificial Sequence: Synthetic oligonucleotide
tctggacatcgtcatcacaggtctatatgagaaacc

SEQ ID NO: 154845 - DNA, 35 bp, Artificial Sequence
  Description of Artificial Sequence: Synthetic oligonucleotide
ctggacatcgtcatcacaggtctatatgagaaacc

SEQ ID NO: 154846 - DNA, 37 bp, Artificial Sequence
  Description of Artificial Sequence: Synthetic oligonucleotide
tggacatcgtcatcacaggtctatatgagaaaccttc

SEQ ID NO: 154847 - DNA, 36 bp, Artificial Sequence
  Description of Artificial Sequence: Synthetic oligonucleotide
ggacatcgtcatcacaggtctatatgagaaaccttc

SEQ ID NO: 154848 - DNA, 37 bp, Artificial Sequence
  Description of Artificial Sequence: Synthetic oligonucleotide
gacatcgtcatcacaggtctatatgagaaaccttctc

SEQ ID NO: 154849 - DNA, 38 bp, Artificial Sequence
  Description of Artificial Sequence: Synthetic oligonucleotide
acatcgtcatcacaggtctatatgagaaaccttctctc

SEQ ID NO: 154850 - DNA, 37 bp, Artificial Sequence
  Description of Artificial Sequence: Synthetic oligonucleotide
catcgtcatcacaggtctatatgagaaaccttctctc

SEQ ID NO: 154851 - DNA, 38 bp, Artificial Sequence
  Description of Artificial Sequence: Synthetic oligonucleotide
atcgtcatcacaggtctatatgagaaaccttctctctc

SEQ ID NO: 154852 - DNA, 37 bp, Artificial Sequence
  Description of Artificial Sequence: Synthetic oligonucleotide
tcgtcatcacaggtctatatgagaaaccttctctctc

SEQ ID NO: 154853 - DNA, 36 bp, Artificial Sequence
  Description of Artificial Sequence: Synthetic oligonucleotide
cgtcatcacaggtctatatgagaaaccttctctctc

SEQ ID NO: 154854 - DNA, 37 bp, Artificial Sequence
  Description of Artificial Sequence: Synthetic oligonucleotide
gtcatcacaggtctatatgagaaaccttctctctcag

SEQ ID NO: 154855 - DNA, 37 bp, Artificial Sequence
  Description of Artificial Sequence: Synthetic oligonucleotide
tcatcacaggtctatatgagaaaccttctctctcagc

SEQ ID NO: 154856 - DNA, 36 bp, Artificial Sequence
  Description of Artificial Sequence: Synthetic oligonucleotide
catcacaggtctatatgagaaaccttctctctcagc

SEQ ID NO: 154857 - DNA, 36 bp, Artificial Sequence
  Description of Artificial Sequence: Synthetic oligonucleotide
atcacaggtctatatgagaaaccttctctctcagcc

SEQ ID NO: 154858 - DNA, 35 bp, Artificial Sequence
  Description of Artificial Sequence: Synthetic oligonucleotide
tcacaggtctatatgagaaaccttctctctcagcc

SEQ ID NO: 154859 - DNA, 34 bp, Artificial Sequence
  Description of Artificial Sequence: Synthetic oligonucleotide
cacaggtctatatgagaaaccttctctctcagcc

SEQ ID NO: 154860 - DNA, 34 bp, Artificial Sequence
  Description of Artificial Sequence: Synthetic oligonucleotide
acaggtctatatgagaaaccttctctctcagccc

SEQ ID NO: 154861 - DNA, 33 bp, Artificial Sequence
  Description of Artificial Sequence: Synthetic oligonucleotide
caggtctatatgagaaaccttctctctcagccc

SEQ ID NO: 154862 - DNA, 24 bp, Artificial Sequence
  Description of Artificial Sequence: Synthetic oligonucleotide
gccccacggttctggcaggagaga

SEQ ID NO: 154863 - DNA, 24 bp, Artificial Sequence
  Description of Artificial Sequence: Synthetic oligonucleotide
ccccacggttctggcaggagagag

SEQ ID NO: 154864 - DNA, 24 bp, Artificial Sequence
  Description of Artificial Sequence: Synthetic oligonucleotide
cccacggttctggcaggagagagc

SEQ ID NO: 154865 - DNA, 25 bp, Artificial Sequence
  Description of Artificial Sequence: Synthetic oligonucleotide
ccacggttctggcaggagagagcgt

SEQ ID NO: 154866 - DNA, 26 bp, Artificial Sequence
  Description of Artificial Sequence: Synthetic oligonucleotide
cacggttctggcaggagagagcgtga

SEQ ID NO: 154867 - DNA, 26 bp, Artificial Sequence
  Description of Artificial Sequence: Synthetic oligonucleotide
acggttctggcaggagagagcgtgac

SEQ ID NO: 154868 - DNA, 25 bp, Artificial Sequence
  Description of Artificial Sequence: Synthetic oligonucleotide
cggttctggcaggagagagcgtgac

SEQ ID NO: 154869 - DNA, 27 bp, Artificial Sequence
  Description of Artificial Sequence: Synthetic oligonucleotide
ggttctggcaggagagagcgtgacctt

SEQ ID NO: 154870 - DNA, 27 bp, Artificial Sequence
  Description of Artificial Sequence: Synthetic oligonucleotide
gttctggcaggagagagcgtgaccttg

SEQ ID NO: 154871 - DNA, 28 bp, Artificial Sequence
  Description of Artificial Sequence: Synthetic oligonucleotide
ttctggcaggagagagcgtgaccttgtc

SEQ ID NO: 154872 - DNA, 27 bp, Artificial Sequence
  Description of Artificial Sequence: Synthetic oligonucleotide
tctggcaggagagagcgtgaccttgtc

SEQ ID NO: 154873 - DNA, 26 bp, Artificial Sequence
  Description of Artificial Sequence: Synthetic oligonucleotide
ctggcaggagagagcgtgaccttgtc

SEQ ID NO: 154874 - DNA, 27 bp, Artificial Sequence
  Description of Artificial Sequence: Synthetic oligonucleotide
tggcaggagagagcgtgaccttgtcct

SEQ ID NO: 154875 - DNA, 26 bp, Artificial Sequence
  Description of Artificial Sequence: Synthetic oligonucleotide
ggcaggagagagcgtgaccttgtcct

SEQ ID NO: 154876 - DNA, 26 bp, Artificial Sequence
  Description of Artificial Sequence: Synthetic oligonucleotide
gcaggagagagcgtgaccttgtcctg

SEQ ID NO: 154877 - DNA, 27 bp, Artificial Sequence
  Description of Artificial Sequence: Synthetic oligonucleotide
caggagagagcgtgaccttgtcctgca

SEQ ID NO: 154878 - DNA, 27 bp, Artificial Sequence
  Description of Artificial Sequence: Synthetic oligonucleotide
aggagagagcgtgaccttgtcctgcag

SEQ ID NO: 154879 - DNA, 26 bp, Artificial Sequence
  Description of Artificial Sequence: Synthetic oligonucleotide
ggagagagcgtgaccttgtcctgcag

SEQ ID NO: 154880 - DNA, 27 bp, Artificial Sequence
  Description of Artificial Sequence: Synthetic oligonucleotide
gagagagcgtgaccttgtcctgcagct

SEQ ID NO: 154881 - DNA, 27 bp, Artificial Sequence
  Description of Artificial Sequence: Synthetic oligonucleotide
agagagcgtgaccttgtcctgcagctc

SEQ ID NO: 154882 - DNA, 26 bp, Artificial Sequence
  Description of Artificial Sequence: Synthetic oligonucleotide
gagagcgtgaccttgtcctgcagctc

SEQ ID NO: 154883 - DNA, 26 bp, Artificial Sequence
  Description of Artificial Sequence: Synthetic oligonucleotide
agagcgtgaccttgtcctgcagctcc

SEQ ID NO: 154884 - DNA, 25 bp, Artificial Sequence
  Description of Artificial Sequence: Synthetic oligonucleotide
gagcgtgaccttgtcctgcagctcc

SEQ ID NO: 154885 - DNA, 25 bp, Artificial Sequence
  Description of Artificial Sequence: Synthetic oligonucleotide
agcgtgaccttgtcctgcagctccc

SEQ ID NO: 154886 - DNA, 24 bp, Artificial Sequence
  Description of Artificial Sequence: Synthetic oligonucleotide
gcgtgaccttgtcctgcagctccc

SEQ ID NO: 154887 - DNA, 24 bp, Artificial Sequence
  Description of Artificial Sequence: Synthetic oligonucleotide
cgtgaccttgtcctgcagctcccg

SEQ ID NO: 154888 - DNA, 33 bp, Artificial Sequence
  Description of Artificial Sequence: Synthetic oligonucleotide
agctcctatgacatgtaccatctatccagggag

SEQ ID NO: 154889 - DNA, 32 bp, Artificial Sequence
  Description of Artificial Sequence: Synthetic oligonucleotide
gctcctatgacatgtaccatctatccagggag

SEQ ID NO: 154890 - DNA, 32 bp, Artificial Sequence
  Description of Artificial Sequence: Synthetic oligonucleotide
ctcctatgacatgtaccatctatccagggagg

SEQ ID NO: 154891 - DNA, 32 bp, Artificial Sequence
  Description of Artificial Sequence: Synthetic oligonucleotide
tcctatgacatgtaccatctatccagggaggg

SEQ ID NO: 154892 - DNA, 31 bp, Artificial Sequence
  Description of Artificial Sequence: Synthetic oligonucleotide
cctatgacatgtaccatctatccagggaggg

SEQ ID NO: 154893 - DNA, 31 bp, Artificial Sequence
  Description of Artificial Sequence: Synthetic oligonucleotide
ctatgacatgtaccatctatccagggagggg

SEQ ID NO: 154894 - DNA, 31 bp, Artificial Sequence
  Description of Artificial Sequence: Synthetic oligonucleotide
tatgacatgtaccatctatccagggaggggg

SEQ ID NO: 154895 - DNA, 30 bp, Artificial Sequence
  Description of Artificial Sequence: Synthetic oligonucleotide
atgacatgtaccatctatccagggaggggg

SEQ ID NO: 154896 - DNA, 29 bp, Artificial Sequence
  Description of Artificial Sequence: Synthetic oligonucleotide
tgacatgtaccatctatccagggaggggg

SEQ ID NO: 154897 - DNA, 28 bp, Artificial Sequence
  Description of Artificial Sequence: Synthetic oligonucleotide
gacatgtaccatctatccagggaggggg

SEQ ID NO: 154898 - DNA, 29 bp, Artificial Sequence
  Description of Artificial Sequence: Synthetic oligonucleotide
acatgtaccatctatccagggagggggag

SEQ ID NO: 154899 - DNA, 28 bp, Artificial Sequence
  Description of Artificial Sequence: Synthetic oligonucleotide
catgtaccatctatccagggagggggag

SEQ ID NO: 154900 - DNA, 28 bp, Artificial Sequence
  Description of Artificial Sequence: Synthetic oligonucleotide
atgtaccatctatccagggagggggagg

SEQ ID NO: 154901 - DNA, 27 bp, Artificial Sequence
  Description of Artificial Sequence: Synthetic oligonucleotide
tgtaccatctatccagggagggggagg

SEQ ID NO: 154902 - DNA, 26 bp, Artificial Sequence
  Description of Artificial Sequence: Synthetic oligonucleotide
gtaccatctatccagggagggggagg

SEQ ID NO: 154903 - DNA, 26 bp, Artificial Sequence
  Description of Artificial Sequence: Synthetic oligonucleotide
taccatctatccagggagggggaggc

SEQ ID NO: 154904 - DNA, 25 bp, Artificial Sequence
  Description of Artificial Sequence: Synthetic oligonucleotide
accatctatccagggagggggaggc

SEQ ID NO: 154905 - DNA, 24 bp, Artificial Sequence
  Description of Artificial Sequence: Synthetic oligonucleotide
ccatctatccagggagggggaggc

SEQ ID NO: 154906 - DNA, 24 bp, Artificial Sequence
  Description of Artificial Sequence: Synthetic oligonucleotide
catctatccagggagggggaggcc

SEQ ID NO: 154907 - DNA, 26 bp, Artificial Sequence
  Description of Artificial Sequence: Synthetic oligonucleotide
atctatccagggagggggaggcccat

SEQ ID NO: 154908 - DNA, 25 bp, Artificial Sequence
  Description of Artificial Sequence: Synthetic oligonucleotide
tctatccagggagggggaggcccat

SEQ ID NO: 154909 - DNA, 24 bp, Artificial Sequence
  Description of Artificial Sequence: Synthetic oligonucleotide
ctatccagggagggggaggcccat

SEQ ID NO: 154910 - DNA, 27 bp, Artificial Sequence
  Description of Artificial Sequence: Synthetic oligonucleotide
tatccagggagggggaggcccatgaat

SEQ ID NO: 154911 - DNA, 26 bp, Artificial Sequence
  Description of Artificial Sequence: Synthetic oligonucleotide
atccagggagggggaggcccatgaat

SEQ ID NO: 154912 - DNA, 25 bp, Artificial Sequence
  Description of Artificial Sequence: Synthetic oligonucleotide
tccagggagggggaggcccatgaat

SEQ ID NO: 154913 - DNA, 24 bp, Artificial Sequence
  Description of Artificial Sequence: Synthetic oligonucleotide
ccagggagggggaggcccatgaat

SEQ ID NO: 154914 - DNA, 26 bp, Artificial Sequence
  Description of Artificial Sequence: Synthetic oligonucleotide
cagggagggggaggcccatgaatgta

SEQ ID NO: 154915 - DNA, 26 bp, Artificial Sequence
  Description of Artificial Sequence: Synthetic oligonucleotide
agggagggggaggcccatgaatgtag

SEQ ID NO: 154916 - DNA, 25 bp, Artificial Sequence
  Description of Artificial Sequence: Synthetic oligonucleotide
gggagggggaggcccatgaatgtag

SEQ ID NO: 154917 - DNA, 27 bp, Artificial Sequence
  Description of Artificial Sequence: Synthetic oligonucleotide
ggagggggaggcccatgaatgtaggtt

SEQ ID NO: 154918 - DNA, 27 bp, Artificial Sequence
  Description of Artificial Sequence: Synthetic oligonucleotide
gagggggaggcccatgaatgtaggttc

SEQ ID NO: 154919 - DNA, 28 bp, Artificial Sequence
  Description of Artificial Sequence: Synthetic oligonucleotide
agggggaggcccatgaatgtaggttctc

SEQ ID NO: 154920 - DNA, 27 bp, Artificial Sequence
  Description of Artificial Sequence: Synthetic oligonucleotide
gggggaggcccatgaatgtaggttctc

SEQ ID NO: 154921 - DNA, 28 bp, Artificial Sequence
  Description of Artificial Sequence: Synthetic oligonucleotide
ggggaggcccatgaatgtaggttctctg

SEQ ID NO: 154922 - DNA, 28 bp, Artificial Sequence
  Description of Artificial Sequence: Synthetic oligonucleotide
gggaggcccatgaatgtaggttctctgc

SEQ ID NO: 154923 - DNA, 29 bp, Artificial Sequence
  Description of Artificial Sequence: Synthetic oligonucleotide
ggaggcccatgaatgtaggttctctgcag

SEQ ID NO: 154924 - DNA, 29 bp, Artificial Sequence
  Description of Artificial Sequence: Synthetic oligonucleotide
gaggcccatgaatgtaggttctctgcagg

SEQ ID NO: 154925 - DNA, 29 bp, Artificial Sequence
  Description of Artificial Sequence: Synthetic oligonucleotide
aggcccatgaatgtaggttctctgcaggg

SEQ ID NO: 154926 - DNA, 28 bp, Artificial Sequence
  Description of Artificial Sequence: Synthetic oligonucleotide
ggcccatgaatgtaggttctctgcaggg

SEQ ID NO: 154927 - DNA, 28 bp, Artificial Sequence
  Description of Artificial Sequence: Synthetic oligonucleotide
gcccatgaatgtaggttctctgcagggc

SEQ ID NO: 154928 - DNA, 28 bp, Artificial Sequence
  Description of Artificial Sequence: Synthetic oligonucleotide
cccatgaatgtaggttctctgcagggcc

SEQ ID NO: 154929 - DNA, 28 bp, Artificial Sequence
  Description of Artificial Sequence: Synthetic oligonucleotide
ccatgaatgtaggttctctgcagggccc

SEQ ID NO: 154930 - DNA, 30 bp, Artificial Sequence
  Description of Artificial Sequence: Synthetic oligonucleotide
catgaatgtaggttctctgcagggcccaag

SEQ ID NO: 154931 - DNA, 30 bp, Artificial Sequence
  Description of Artificial Sequence: Synthetic oligonucleotide
atgaatgtaggttctctgcagggcccaagg

SEQ ID NO: 154932 - DNA, 29 bp, Artificial Sequence
  Description of Artificial Sequence: Synthetic oligonucleotide
tgaatgtaggttctctgcagggcccaagg

SEQ ID NO: 154933 - DNA, 28 bp, Artificial Sequence
  Description of Artificial Sequence: Synthetic oligonucleotide
gaatgtaggttctctgcagggcccaagg

SEQ ID NO: 154934 - DNA, 29 bp, Artificial Sequence
  Description of Artificial Sequence: Synthetic oligonucleotide
aatgtaggttctctgcagggcccaaggtc

SEQ ID NO: 154935 - DNA, 28 bp, Artificial Sequence
  Description of Artificial Sequence: Synthetic oligonucleotide
atgtaggttctctgcagggcccaaggtc

SEQ ID NO: 154936 - DNA, 27 bp, Artificial Sequence
  Description of Artificial Sequence: Synthetic oligonucleotide
tgtaggttctctgcagggcccaaggtc

SEQ ID NO: 154937 - DNA, 27 bp, Artificial Sequence
  Description of Artificial Sequence: Synthetic oligonucleotide
gtaggttctctgcagggcccaaggtca

SEQ ID NO: 154938 - DNA, 28 bp, Artificial Sequence
  Description of Artificial Sequence: Synthetic oligonucleotide
taggttctctgcagggcccaaggtcaac

SEQ ID NO: 154939 - DNA, 27 bp, Artificial Sequence
  Description of Artificial Sequence: Synthetic oligonucleotide
aggttctctgcagggcccaaggtcaac

SEQ ID NO: 154940 - DNA, 26 bp, Artificial Sequence
  Description of Artificial Sequence: Synthetic oligonucleotide
ggttctctgcagggcccaaggtcaac

SEQ ID NO: 154941 - DNA, 26 bp, Artificial Sequence
  Description of Artificial Sequence: Synthetic oligonucleotide
gttctctgcagggcccaaggtcaacg

SEQ ID NO: 154942 - DNA, 27 bp, Artificial Sequence
  Description of Artificial Sequence: Synthetic oligonucleotide
ttctctgcagggcccaaggtcaacgga

SEQ ID NO: 154943 - DNA, 27 bp, Artificial Sequence
  Description of Artificial Sequence: Synthetic oligonucleotide
tctctgcagggcccaaggtcaacggaa

SEQ ID NO: 154944 - DNA, 26 bp, Artificial Sequence
  Description of Artificial Sequence: Synthetic oligonucleotide
ctctgcagggcccaaggtcaacggaa

SEQ ID NO: 154945 - DNA, 27 bp, Artificial Sequence
  Description of Artificial Sequence: Synthetic oligonucleotide
tctgcagggcccaaggtcaacggaaca

SEQ ID NO: 154946 - DNA, 22 bp, Artificial Sequence
  Description of Artificial Sequence: Synthetic oligonucleotide
ggccctgccacccacggaggaa

SEQ ID NO: 154947 - DNA, 22 bp, Artificial Sequence
  Description of Artificial Sequence: Synthetic oligonucleotide
gccctgccacccacggaggaac

SEQ ID NO: 154948 - DNA, 24 bp, Artificial Sequence
  Description of Artificial Sequence: Synthetic oligonucleotide
ccctgccacccacggaggaaccta

SEQ ID NO: 154949 - DNA, 25 bp, Artificial Sequence
  Description of Artificial Sequence: Synthetic oligonucleotide
cctgccacccacggaggaacctaca

SEQ ID NO: 154950 - DNA, 27 bp, Artificial Sequence
  Description of Artificial Sequence: Synthetic oligonucleotide
ctgccacccacggaggaacctacagat

SEQ ID NO: 154951 - DNA, 27 bp, Artificial Sequence
  Description of Artificial Sequence: Synthetic oligonucleotide
tgccacccacggaggaacctacagatg

SEQ ID NO: 154952 - DNA, 26 bp, Artificial Sequence
  Description of Artificial Sequence: Synthetic oligonucleotide
gccacccacggaggaacctacagatg

SEQ ID NO: 154953 - DNA, 27 bp, Artificial Sequence
  Description of Artificial Sequence: Synthetic oligonucleotide
ccacccacggaggaacctacagatgct

SEQ ID NO: 154954 - DNA, 28 bp, Artificial Sequence
  Description of Artificial Sequence: Synthetic oligonucleotide
cacccacggaggaacctacagatgcttc

SEQ ID NO: 154955 - DNA, 28 bp, Artificial Sequence
  Description of Artificial Sequence: Synthetic oligonucleotide
acccacggaggaacctacagatgcttcg

SEQ ID NO: 154956 - DNA, 27 bp, Artificial Sequence
  Description of Artificial Sequence: Synthetic oligonucleotide
cccacggaggaacctacagatgcttcg

SEQ ID NO: 154957 - DNA, 27 bp, Artificial Sequence
  Description of Artificial Sequence: Synthetic oligonucleotide
ccacggaggaacctacagatgcttcgg

SEQ ID NO: 154958 - DNA, 27 bp, Artificial Sequence
  Description of Artificial Sequence: Synthetic oligonucleotide
cacggaggaacctacagatgcttcggc

SEQ ID NO: 154959 - DNA, 28 bp, Artificial Sequence
  Description of Artificial Sequence: Synthetic oligonucleotide
acggaggaacctacagatgcttcggctc

SEQ ID NO: 154960 - DNA, 27 bp, Artificial Sequence
  Description of Artificial Sequence: Synthetic oligonucleotide
cggaggaacctacagatgcttcggctc

SEQ ID NO: 154961 - DNA, 30 bp, Artificial Sequence
  Description of Artificial Sequence: Synthetic oligonucleotide
ggaggaacctacagatgcttcggctctttc

SEQ ID NO: 154962 - DNA, 30 bp, Artificial Sequence
  Description of Artificial Sequence: Synthetic oligonucleotide
gaggaacctacagatgcttcggctctttcc

SEQ ID NO: 154963 - DNA, 30 bp, Artificial Sequence
  Description of Artificial Sequence: Synthetic oligonucleotide
aggaacctacagatgcttcggctctttccg

SEQ ID NO: 154964 - DNA, 29 bp, Artificial Sequence
  Description of Artificial Sequence: Synthetic oligonucleotide
ggaacctacagatgcttcggctctttccg

SEQ ID NO: 154965 - DNA, 30 bp, Artificial Sequence
  Description of Artificial Sequence: Synthetic oligonucleotide
gaacctacagatgcttcggctctttccgtg

SEQ ID NO: 154966 - DNA, 31 bp, Artificial Sequence
  Description of Artificial Sequence: Synthetic oligonucleotide
aacctacagatgcttcggctctttccgtgac

SEQ ID NO: 154967 - DNA, 33 bp, Artificial Sequence
  Description of Artificial Sequence: Synthetic oligonucleotide
tctttccgtgactctccatacgagtggtcaaac

SEQ ID NO: 154968 - DNA, 32 bp, Artificial Sequence
  Description of Artificial Sequence: Synthetic oligonucleotide
ctttccgtgactctccatacgagtggtcaaac

SEQ ID NO: 154969 - DNA, 33 bp, Artificial Sequence
  Description of Artificial Sequence: Synthetic oligonucleotide
tttccgtgactctccatacgagtggtcaaactc

SEQ ID NO: 154970 - DNA, 32 bp, Artificial Sequence
  Description of Artificial Sequence: Synthetic oligonucleotide
ttccgtgactctccatacgagtggtcaaactc

SEQ ID NO: 154971 - DNA, 31 bp, Artificial Sequence
  Description of Artificial Sequence: Synthetic oligonucleotide
tccgtgactctccatacgagtggtcaaactc

SEQ ID NO: 154972 - DNA, 30 bp, Artificial Sequence
  Description of Artificial Sequence: Synthetic oligonucleotide
ccgtgactctccatacgagtggtcaaactc

SEQ ID NO: 154973 - DNA, 30 bp, Artificial Sequence
  Description of Artificial Sequence: Synthetic oligonucleotide
cgtgactctccatacgagtggtcaaactcg

SEQ ID NO: 154974 - DNA, 31 bp, Artificial Sequence
  Description of Artificial Sequence: Synthetic oligonucleotide
gtgactctccatacgagtggtcaaactcgag

SEQ ID NO: 154975 - DNA, 32 bp, Artificial Sequence
  Description of Artificial Sequence: Synthetic oligonucleotide
tgactctccatacgagtggtcaaactcgagtg

SEQ ID NO: 154976 - DNA, 31 bp, Artificial Sequence
  Description of Artificial Sequence: Synthetic oligonucleotide
gactctccatacgagtggtcaaactcgagtg

SEQ ID NO: 154977 - DNA, 32 bp, Artificial Sequence
  Description of Artificial Sequence: Synthetic oligonucleotide
actctccatacgagtggtcaaactcgagtgac

SEQ ID NO: 154978 - DNA, 31 bp, Artificial Sequence
  Description of Artificial Sequence: Synthetic oligonucleotide
ctctccatacgagtggtcaaactcgagtgac

SEQ ID NO: 154979 - DNA, 31 bp, Artificial Sequence
  Description of Artificial Sequence: Synthetic oligonucleotide
tctccatacgagtggtcaaactcgagtgacc

SEQ ID NO: 154980 - DNA, 30 bp, Artificial Sequence
  Description of Artificial Sequence: Synthetic oligonucleotide
ctccatacgagtggtcaaactcgagtgacc

SEQ ID NO: 154981 - DNA, 30 bp, Artificial Sequence
  Description of Artificial Sequence: Synthetic oligonucleotide
tccatacgagtggtcaaactcgagtgaccc

SEQ ID NO: 154982 - DNA, 29 bp, Artificial Sequence
  Description of Artificial Sequence: Synthetic oligonucleotide
ccatacgagtggtcaaactcgagtgaccc

SEQ ID NO: 154983 - DNA, 30 bp, Artificial Sequence
  Description of Artificial Sequence: Synthetic oligonucleotide
catacgagtggtcaaactcgagtgacccac

SEQ ID NO: 154984 - DNA, 31 bp, Artificial Sequence
  Description of Artificial Sequence: Synthetic oligonucleotide
atacgagtggtcaaactcgagtgacccactg

SEQ ID NO: 154985 - DNA, 30 bp, Artificial Sequence
  Description of Artificial Sequence: Synthetic oligonucleotide
tacgagtggtcaaactcgagtgacccactg

SEQ ID NO: 154986 - DNA, 29 bp, Artificial Sequence
  Description of Artificial Sequence: Synthetic oligonucleotide
acgagtggtcaaactcgagtgacccactg

SEQ ID NO: 154987 - DNA, 28 bp, Artificial Sequence
  Description of Artificial Sequence: Synthetic oligonucleotide
cgagtggtcaaactcgagtgacccactg

SEQ ID NO: 154988 - DNA, 28 bp, Artificial Sequence
  Description of Artificial Sequence: Synthetic oligonucleotide
gagtggtcaaactcgagtgacccactgc

SEQ ID NO: 154989 - DNA, 30 bp, Artificial Sequence
  Description of Artificial Sequence: Synthetic oligonucleotide
agtggtcaaactcgagtgacccactgcttg

SEQ ID NO: 154990 - DNA, 29 bp, Artificial Sequence
  Description of Artificial Sequence: Synthetic oligonucleotide
gtggtcaaactcgagtgacccactgcttg

SEQ ID NO: 154991 - DNA, 32 bp, Artificial Sequence
  Description of Artificial Sequence: Synthetic oligonucleotide
tggtcaaactcgagtgacccactgcttgtttc

SEQ ID NO: 154992 - DNA, 31 bp, Artificial Sequence
  Description of Artificial Sequence: Synthetic oligonucleotide
ggtcaaactcgagtgacccactgcttgtttc

SEQ ID NO: 154993 - DNA, 32 bp, Artificial Sequence
  Description of Artificial Sequence: Synthetic oligonucleotide
gtcaaactcgagtgacccactgcttgtttctg

SEQ ID NO: 154994 - DNA, 33 bp, Artificial Sequence
  Description of Artificial Sequence: Synthetic oligonucleotide
tcaaactcgagtgacccactgcttgtttctgtc

SEQ ID NO: 154995 - DNA, 32 bp, Artificial Sequence
  Description of Artificial Sequence: Synthetic oligonucleotide
caaactcgagtgacccactgcttgtttctgtc

SEQ ID NO: 154996 - DNA, 35 bp, Artificial Sequence
  Description of Artificial Sequence: Synthetic oligonucleotide
aaactcgagtgacccactgcttgtttctgtcatag

SEQ ID NO: 154997 - DNA, 34 bp, Artificial Sequence
  Description of Artificial Sequence: Synthetic oligonucleotide
aactcgagtgacccactgcttgtttctgtcatag

SEQ ID NO: 154998 - DNA, 33 bp, Artificial Sequence
  Description of Artificial Sequence: Synthetic oligonucleotide
actcgagtgacccactgcttgtttctgtcatag

SEQ ID NO: 154999 - DNA, 32 bp, Artificial Sequence
  Description of Artificial Sequence: Synthetic oligonucleotide
ctcgagtgacccactgcttgtttctgtcatag

SEQ ID NO: 155000 - DNA, 32 bp, Artificial Sequence
  Description of Artificial Sequence: Synthetic oligonucleotide
tcgagtgacccactgcttgtttctgtcatagg

SEQ ID NO: 155001 - DNA, 31 bp, Artificial Sequence
  Description of Artificial Sequence: Synthetic oligonucleotide
cgagtgacccactgcttgtttctgtcatagg

SEQ ID NO: 155002 - DNA, 34 bp, Artificial Sequence
  Description of Artificial Sequence: Synthetic oligonucleotide
gagtgacccactgcttgtttctgtcataggaaac

SEQ ID NO: 155003 - DNA, 34 bp, Artificial Sequence
  Description of Artificial Sequence: Synthetic oligonucleotide
agtgacccactgcttgtttctgtcataggaaacc

SEQ ID NO: 155004 - DNA, 33 bp, Artificial Sequence
  Description of Artificial Sequence: Synthetic oligonucleotide
gtgacccactgcttgtttctgtcataggaaacc

SEQ ID NO: 155005 - DNA, 33 bp, Artificial Sequence
  Description of Artificial Sequence: Synthetic oligonucleotide
tgacccactgcttgtttctgtcataggaaaccc

SEQ ID NO: 155006 - DNA, 32 bp, Artificial Sequence
  Description of Artificial Sequence: Synthetic oligonucleotide
gacccactgcttgtttctgtcataggaaaccc

SEQ ID NO: 155007 - DNA, 34 bp, Artificial Sequence
  Description of Artificial Sequence: Synthetic oligonucleotide
acccactgcttgtttctgtcataggaaacccttc

SEQ ID NO: 155008 - DNA, 33 bp, Artificial Sequence
  Description of Artificial Sequence: Synthetic oligonucleotide
cccactgcttgtttctgtcataggaaacccttc

SEQ ID NO: 155009 - DNA, 38 bp, Artificial Sequence
  Description of Artificial Sequence: Synthetic oligonucleotide
ccactgcttgtttctgtcataggaaacccttcaaatag

SEQ ID NO: 155010 - DNA, 40 bp, Artificial Sequence
  Description of Artificial Sequence: Synthetic oligonucleotide
cactgcttgtttctgtcataggaaacccttcaaatagttg

SEQ ID NO: 155011 - DNA, 40 bp, Artificial Sequence
  Description of Artificial Sequence: Synthetic oligonucleotide
actgcttgtttctgtcataggaaacccttcaaatagttgg

SEQ ID NO: 155012 - DNA, 39 bp, Artificial Sequence
  Description of Artificial Sequence: Synthetic oligonucleotide
ctgcttgtttctgtcataggaaacccttcaaatagttgg

SEQ ID NO: 155013 - DNA, 39 bp, Artificial Sequence
  Description of Artificial Sequence: Synthetic oligonucleotide
tgcttgtttctgtcataggaaacccttcaaatagttggc

SEQ ID NO: 155014 - DNA, 38 bp, Artificial Sequence
  Description of Artificial Sequence: Synthetic oligonucleotide
gcttgtttctgtcataggaaacccttcaaatagttggc

SEQ ID NO: 155015 - DNA, 38 bp, Artificial Sequence
  Description of Artificial Sequence: Synthetic oligonucleotide
cttgtttctgtcataggaaacccttcaaatagttggcc

SEQ ID NO: 155016 - DNA, 40 bp, Artificial Sequence
  Description of Artificial Sequence: Synthetic oligonucleotide
ttgtttctgtcataggaaacccttcaaatagttggccttc

SEQ ID NO: 155017 - DNA, 39 bp, Artificial Sequence
  Description of Artificial Sequence: Synthetic oligonucleotide
tgtttctgtcataggaaacccttcaaatagttggccttc

SEQ ID NO: 155018 - DNA, 38 bp, Artificial Sequence
  Description of Artificial Sequence: Synthetic oligonucleotide
gtttctgtcataggaaacccttcaaatagttggccttc

SEQ ID NO: 155019 - DNA, 39 bp, Artificial Sequence
  Description of Artificial Sequence: Synthetic oligonucleotide
tttctgtcataggaaacccttcaaatagttggccttcac

SEQ ID NO: 155020 - DNA, 38 bp, Artificial Sequence
  Description of Artificial Sequence: Synthetic oligonucleotide
ttctgtcataggaaacccttcaaatagttggccttcac

SEQ ID NO: 155021 - DNA, 37 bp, Artificial Sequence
  Description of Artificial Sequence: Synthetic oligonucleotide
tctgtcataggaaacccttcaaatagttggccttcac

SEQ ID NO: 155022 - DNA, 36 bp, Artificial Sequence
  Description of Artificial Sequence: Synthetic oligonucleotide
ctgtcataggaaacccttcaaatagttggccttcac

SEQ ID NO: 155023 - DNA, 36 bp, Artificial Sequence
  Description of Artificial Sequence: Synthetic oligonucleotide
tgtcataggaaacccttcaaatagttggccttcacc

SEQ ID NO: 155024 - DNA, 35 bp, Artificial Sequence
  Description of Artificial Sequence: Synthetic oligonucleotide
gtcataggaaacccttcaaatagttggccttcacc

SEQ ID NO: 155025 - DNA, 35 bp, Artificial Sequence
  Description of Artificial Sequence: Synthetic oligonucleotide
tcataggaaacccttcaaatagttggccttcaccc

SEQ ID NO: 155026 - DNA, 34 bp, Artificial Sequence
  Description of Artificial Sequence: Synthetic oligonucleotide
cataggaaacccttcaaatagttggccttcaccc

SEQ ID NO: 155027 - DNA, 35 bp, Artificial Sequence
  Description of Artificial Sequence: Synthetic oligonucleotide
ataggaaacccttcaaatagttggccttcacccac

SEQ ID NO: 155028 - DNA, 34 bp, Artificial Sequence
  Description of Artificial Sequence: Synthetic oligonucleotide
taggaaacccttcaaatagttggccttcacccac

SEQ ID NO: 155029 - DNA, 33 bp, Artificial Sequence
  Description of Artificial Sequence: Synthetic oligonucleotide
ttggccttcacccactgaaccaagctctaaaac

SEQ ID NO: 155030 - DNA, 32 bp, Artificial Sequence
  Description of Artificial Sequence: Synthetic oligonucleotide
tggccttcacccactgaaccaagctctaaaac

SEQ ID NO: 155031 - DNA, 31 bp, Artificial Sequence
  Description of Artificial Sequence: Synthetic oligonucleotide
ggccttcacccactgaaccaagctctaaaac

SEQ ID NO: 155032 - DNA, 31 bp, Artificial Sequence
  Description of Artificial Sequence: Synthetic oligonucleotide
gccttcacccactgaaccaagctctaaaacc

SEQ ID NO: 155033 - DNA, 31 bp, Artificial Sequence
  Description of Artificial Sequence: Synthetic oligonucleotide
ccttcacccactgaaccaagctctaaaaccg

SEQ ID NO: 155034 - DNA, 31 bp, Artificial Sequence
  Description of Artificial Sequence: Synthetic oligonucleotide
cttcacccactgaaccaagctctaaaaccgg

SEQ ID NO: 155035 - DNA, 34 bp, Artificial Sequence
  Description of Artificial Sequence: Synthetic oligonucleotide
ttcacccactgaaccaagctctaaaaccggtaac

SEQ ID NO: 155036 - DNA, 33 bp, Artificial Sequence
  Description of Artificial Sequence: Synthetic oligonucleotide
tcacccactgaaccaagctctaaaaccggtaac

SEQ ID NO: 155037 - DNA, 32 bp, Artificial Sequence
  Description of Artificial Sequence: Synthetic oligonucleotide
cacccactgaaccaagctctaaaaccggtaac

SEQ ID NO: 155038 - DNA, 32 bp, Artificial Sequence
  Description of Artificial Sequence: Synthetic oligonucleotide
acccactgaaccaagctctaaaaccggtaacc

SEQ ID NO: 155039 - DNA, 31 bp, Artificial Sequence
  Description of Artificial Sequence: Synthetic oligonucleotide
cccactgaaccaagctctaaaaccggtaacc

SEQ ID NO: 155040 - DNA, 31 bp, Artificial Sequence
  Description of Artificial Sequence: Synthetic oligonucleotide
ccactgaaccaagctctaaaaccggtaaccc

SEQ ID NO: 155041 - DNA, 31 bp, Artificial Sequence
  Description of Artificial Sequence: Synthetic oligonucleotide
cactgaaccaagctctaaaaccggtaacccc

SEQ ID NO: 155042 - DNA, 31 bp, Artificial Sequence
  Description of Artificial Sequence: Synthetic oligonucleotide
actgaaccaagctctaaaaccggtaaccccc

SEQ ID NO: 155043 - DNA, 30 bp, Artificial Sequence
  Description of Artificial Sequence: Synthetic oligonucleotide
ctgaaccaagctctaaaaccggtaaccccc

SEQ ID NO: 155044 - DNA, 30 bp, Artificial Sequence
  Description of Artificial Sequence: Synthetic oligonucleotide
tgaaccaagctctaaaaccggtaacccccg

SEQ ID NO: 155045 - DNA, 29 bp, Artificial Sequence
  Description of Artificial Sequence: Synthetic oligonucleotide
gaaccaagctctaaaaccggtaacccccg

SEQ ID NO: 155046 - DNA, 30 bp, Artificial Sequence
  Description of Artificial Sequence: Synthetic oligonucleotide
aaccaagctctaaaaccggtaacccccgac

SEQ ID NO: 155047 - DNA, 29 bp, Artificial Sequence
  Description of Artificial Sequence: Synthetic oligonucleotide
accaagctctaaaaccggtaacccccgac

SEQ ID NO: 155048 - DNA, 28 bp, Artificial Sequence
  Description of Artificial Sequence: Synthetic oligonucleotide
ccaagctctaaaaccggtaacccccgac

SEQ ID NO: 155049 - DNA, 29 bp, Artificial Sequence
  Description of Artificial Sequence: Synthetic oligonucleotide
caagctctaaaaccggtaacccccgacac

SEQ ID NO: 155050 - DNA, 29 bp, Artificial Sequence
  Description of Artificial Sequence: Synthetic oligonucleotide
aagctctaaaaccggtaacccccgacacc

SEQ ID NO: 155051 - DNA, 28 bp, Artificial Sequence
  Description of Artificial Sequence: Synthetic oligonucleotide
agctctaaaaccggtaacccccgacacc

SEQ ID NO: 155052 - DNA, 27 bp, Artificial Sequence
  Description of Artificial Sequence: Synthetic oligonucleotide
gctctaaaaccggtaacccccgacacc

SEQ ID NO: 155053 - DNA, 28 bp, Artificial Sequence
  Description of Artificial Sequence: Synthetic oligonucleotide
ctctaaaaccggtaacccccgacacctg

SEQ ID NO: 155054 - DNA, 28 bp, Artificial Sequence
  Description of Artificial Sequence: Synthetic oligonucleotide
tctaaaaccggtaacccccgacacctgc

SEQ ID NO: 155055 - DNA, 27 bp, Artificial Sequence
  Description of Artificial Sequence: Synthetic oligonucleotide
ctaaaaccggtaacccccgacacctgc

SEQ ID NO: 155056 - DNA, 28 bp, Artificial Sequence
  Description of Artificial Sequence: Synthetic oligonucleotide
taaaaccggtaacccccgacacctgcac

SEQ ID NO: 155057 - DNA, 31 bp, Artificial Sequence
  Description of Artificial Sequence: Synthetic oligonucleotide
caagaccttgcagggacctacagatgctatg

SEQ ID NO: 155058 - DNA, 31 bp, Artificial Sequence
  Description of Artificial Sequence: Synthetic oligonucleotide
aagaccttgcagggacctacagatgctatgg

SEQ ID NO: 155059 - DNA, 30 bp, Artificial Sequence
  Description of Artificial Sequence: Synthetic oligonucleotide
agaccttgcagggacctacagatgctatgg

SEQ ID NO: 155060 - DNA, 29 bp, Artificial Sequence
  Description of Artificial Sequence: Synthetic oligonucleotide
gaccttgcagggacctacagatgctatgg

SEQ ID NO: 155061 - DNA, 31 bp, Artificial Sequence
  Description of Artificial Sequence: Synthetic oligonucleotide
accttgcagggacctacagatgctatggttc

SEQ ID NO: 155062 - DNA, 30 bp, Artificial Sequence
  Description of Artificial Sequence: Synthetic oligonucleotide
ccttgcagggacctacagatgctatggttc

SEQ ID NO: 155063 - DNA, 31 bp, Artificial Sequence
  Description of Artificial Sequence: Synthetic oligonucleotide
cttgcagggacctacagatgctatggttctg

SEQ ID NO: 155064 - DNA, 34 bp, Artificial Sequence
  Description of Artificial Sequence: Synthetic oligonucleotide
ttgcagggacctacagatgctatggttctgttac

SEQ ID NO: 155065 - DNA, 33 bp, Artificial Sequence
  Description of Artificial Sequence: Synthetic oligonucleotide
tgcagggacctacagatgctatggttctgttac

SEQ ID NO: 155066 - DNA, 32 bp, Artificial Sequence
  Description of Artificial Sequence: Synthetic oligonucleotide
gcagggacctacagatgctatggttctgttac

SEQ ID NO: 155067 - DNA, 33 bp, Artificial Sequence
  Description of Artificial Sequence: Synthetic oligonucleotide
cagggacctacagatgctatggttctgttactc

SEQ ID NO: 155068 - DNA, 34 bp, Artificial Sequence
  Description of Artificial Sequence: Synthetic oligonucleotide
agggacctacagatgctatggttctgttactcac

SEQ ID NO: 155069 - DNA, 33 bp, Artificial Sequence
  Description of Artificial Sequence: Synthetic oligonucleotide
gggacctacagatgctatggttctgttactcac

SEQ ID NO: 155070 - DNA, 34 bp, Artificial Sequence
  Description of Artificial Sequence: Synthetic oligonucleotide
ggacctacagatgctatggttctgttactcactc

SEQ ID NO: 155071 - DNA, 34 bp, Artificial Sequence
  Description of Artificial Sequence: Synthetic oligonucleotide
gacctacagatgctatggttctgttactcactcc

SEQ ID NO: 155072 - DNA, 34 bp, Artificial Sequence
  Description of Artificial Sequence: Synthetic oligonucleotide
acctacagatgctatggttctgttactcactccc

SEQ ID NO: 155073 - DNA, 33 bp, Artificial Sequence
  Description of Artificial Sequence: Synthetic oligonucleotide
cctacagatgctatggttctgttactcactccc

SEQ ID NO: 155074 - DNA, 33 bp, Artificial Sequence
  Description of Artificial Sequence: Synthetic oligonucleotide
ctacagatgctatggttctgttactcactcccc

SEQ ID NO: 155075 - DNA, 33 bp, Artificial Sequence
  Description of Artificial Sequence: Synthetic oligonucleotide
tacagatgctatggttctgttactcactccccc

SEQ ID NO: 155076 - DNA, 32 bp, Artificial Sequence
  Description of Artificial Sequence: Synthetic oligonucleotide
acagatgctatggttctgttactcactccccc

SEQ ID NO: 155077 - DNA, 31 bp, Artificial Sequence
  Description of Artificial Sequence: Synthetic oligonucleotide
cagatgctatggttctgttactcactccccc

SEQ ID NO: 155078 - DNA, 34 bp, Artificial Sequence
  Description of Artificial Sequence: Synthetic oligonucleotide
agatgctatggttctgttactcactccccctatc

SEQ ID NO: 155079 - DNA, 33 bp, Artificial Sequence
  Description of Artificial Sequence: Synthetic oligonucleotide
gatgctatggttctgttactcactccccctatc

SEQ ID NO: 155080 - DNA, 34 bp, Artificial Sequence
  Description of Artificial Sequence: Synthetic oligonucleotide
atgctatggttctgttactcactccccctatcag

SEQ ID NO: 155081 - DNA, 33 bp, Artificial Sequence
  Description of Artificial Sequence: Synthetic oligonucleotide
tgctatggttctgttactcactccccctatcag

SEQ ID NO: 155082 - DNA, 32 bp, Artificial Sequence
  Description of Artificial Sequence: Synthetic oligonucleotide
gctatggttctgttactcactccccctatcag

SEQ ID NO: 155083 - DNA, 34 bp, Artificial Sequence
  Description of Artificial Sequence: Synthetic oligonucleotide
ctatggttctgttactcactccccctatcagttg

SEQ ID NO: 155084 - DNA, 35 bp, Artificial Sequence
  Description of Artificial Sequence: Synthetic oligonucleotide
tatggttctgttactcactccccctatcagttgtc

SEQ ID NO: 155085 - DNA, 34 bp, Artificial Sequence
  Description of Artificial Sequence: Synthetic oligonucleotide
atggttctgttactcactccccctatcagttgtc

SEQ ID NO: 155086 - DNA, 33 bp, Artificial Sequence
  Description of Artificial Sequence: Synthetic oligonucleotide
tggttctgttactcactccccctatcagttgtc

SEQ ID NO: 155087 - DNA, 30 bp, Artificial Sequence
  Description of Artificial Sequence: Synthetic oligonucleotide
caagagtctgcagggaacagaacagcgaac

SEQ ID NO: 155088 - DNA, 31 bp, Artificial Sequence
  Description of Artificial Sequence: Synthetic oligonucleotide
aagagtctgcagggaacagaacagcgaacag

SEQ ID NO: 155089 - DNA, 30 bp, Artificial Sequence
  Description of Artificial Sequence: Synthetic oligonucleotide
agagtctgcagggaacagaacagcgaacag

SEQ ID NO: 155090 - DNA, 29 bp, Artificial Sequence
  Description of Artificial Sequence: Synthetic oligonucleotide
gagtctgcagggaacagaacagcgaacag

SEQ ID NO: 155091 - DNA, 29 bp, Artificial Sequence
  Description of Artificial Sequence: Synthetic oligonucleotide
agtctgcagggaacagaacagcgaacagg

SEQ ID NO: 155092 - DNA, 28 bp, Artificial Sequence
  Description of Artificial Sequence: Synthetic oligonucleotide
gtctgcagggaacagaacagcgaacagg

SEQ ID NO: 155093 - DNA, 28 bp, Artificial Sequence
  Description of Artificial Sequence: Synthetic oligonucleotide
tctgcagggaacagaacagcgaacaggc

SEQ ID NO: 155094 - DNA, 27 bp, Artificial Sequence
  Description of Artificial Sequence: Synthetic oligonucleotide
ctgcagggaacagaacagcgaacaggc

SEQ ID NO: 155095 - DNA, 28 bp, Artificial Sequence
  Description of Artificial Sequence: Synthetic oligonucleotide
tgcagggaacagaacagcgaacaggcag

SEQ ID NO: 155096 - DNA, 27 bp, Artificial Sequence
  Description of Artificial Sequence: Synthetic oligonucleotide
gcagggaacagaacagcgaacaggcag

SEQ ID NO: 155097 - DNA, 27 bp, Artificial Sequence
  Description of Artificial Sequence: Synthetic oligonucleotide
cagggaacagaacagcgaacaggcagg

SEQ ID NO: 155098 - DNA, 28 bp, Artificial Sequence
  Description of Artificial Sequence: Synthetic oligonucleotide
agggaacagaacagcgaacaggcaggac

SEQ ID NO: 155099 - DNA, 27 bp, Artificial Sequence
  Description of Artificial Sequence: Synthetic oligonucleotide
gggaacagaacagcgaacaggcaggac

SEQ ID NO: 155100 - DNA, 28 bp, Artificial Sequence
  Description of Artificial Sequence: Synthetic oligonucleotide
ggaacagaacagcgaacaggcaggactc

SEQ ID NO: 155101 - DNA, 29 bp, Artificial Sequence
  Description of Artificial Sequence: Synthetic oligonucleotide
gaacagaacagcgaacaggcaggactctg

SEQ ID NO: 155102 - DNA, 31 bp, Artificial Sequence
  Description of Artificial Sequence: Synthetic oligonucleotide
aacagaacagcgaacaggcaggactctgatg

SEQ ID NO: 155103 - DNA, 30 bp, Artificial Sequence
  Description of Artificial Sequence: Synthetic oligonucleotide
acagaacagcgaacaggcaggactctgatg

SEQ ID NO: 155104 - DNA, 29 bp, Artificial Sequence
  Description of Artificial Sequence: Synthetic oligonucleotide
cagaacagcgaacaggcaggactctgatg

SEQ ID NO: 155105 - DNA, 31 bp, Artificial Sequence
  Description of Artificial Sequence: Synthetic oligonucleotide
agaacagcgaacaggcaggactctgatgaac

SEQ ID NO: 155106 - DNA, 30 bp, Artificial Sequence
  Description of Artificial Sequence: Synthetic oligonucleotide
gaacagcgaacaggcaggactctgatgaac

SEQ ID NO: 155107 - DNA, 32 bp, Artificial Sequence
  Description of Artificial Sequence: Synthetic oligonucleotide
aacagcgaacaggcaggactctgatgaacaag

SEQ ID NO: 155108 - DNA, 31 bp, Artificial Sequence
  Description of Artificial Sequence: Synthetic oligonucleotide
acagcgaacaggcaggactctgatgaacaag

SEQ ID NO: 155109 - DNA, 30 bp, Artificial Sequence
  Description of Artificial Sequence: Synthetic oligonucleotide
cagcgaacaggcaggactctgatgaacaag

SEQ ID NO: 155110 - DNA, 31 bp, Artificial Sequence
  Description of Artificial Sequence: Synthetic oligonucleotide
agcgaacaggcaggactctgatgaacaagac

SEQ ID NO: 155111 - DNA, 30 bp, Artificial Sequence
  Description of Artificial Sequence: Synthetic oligonucleotide
gcgaacaggcaggactctgatgaacaagac

SEQ ID NO: 155112 - DNA, 30 bp, Artificial Sequence
  Description of Artificial Sequence: Synthetic oligonucleotide
cgaacaggcaggactctgatgaacaagacc

SEQ ID NO: 155113 - DNA, 30 bp, Artificial Sequence
  Description of Artificial Sequence: Synthetic oligonucleotide
gaacaggcaggactctgatgaacaagaccc

SEQ ID NO: 155114 - DNA, 31 bp, Artificial Sequence
  Description of Artificial Sequence: Synthetic oligonucleotide
aacaggcaggactctgatgaacaagaccctc

SEQ ID NO: 155115 - DNA, 30 bp, Artificial Sequence
  Description of Artificial Sequence: Synthetic oligonucleotide
acaggcaggactctgatgaacaagaccctc

SEQ ID NO: 155116 - DNA, 29 bp, Artificial Sequence
  Description of Artificial Sequence: Synthetic oligonucleotide
caggcaggactctgatgaacaagaccctc

SEQ ID NO: 155117 - DNA, 30 bp, Artificial Sequence
  Description of Artificial Sequence: Synthetic oligonucleotide
aggcaggactctgatgaacaagaccctcag

SEQ ID NO: 155118 - DNA, 29 bp, Artificial Sequence
  Description of Artificial Sequence: Synthetic oligonucleotide
ggcaggactctgatgaacaagaccctcag

SEQ ID NO: 155119 - DNA, 29 bp, Artificial Sequence
  Description of Artificial Sequence: Synthetic oligonucleotide
gcaggactctgatgaacaagaccctcagg

SEQ ID NO: 155120 - DNA, 30 bp, Artificial Sequence
  Description of Artificial Sequence: Synthetic oligonucleotide
caggactctgatgaacaagaccctcaggag

SEQ ID NO: 155121 - DNA, 33 bp, Artificial Sequence
  Description of Artificial Sequence: Synthetic oligonucleotide
aaactcgagtgacccactgcttgtttctgtcac

SEQ ID NO: 155122 - DNA, 32 bp, Artificial Sequence
  Description of Artificial Sequence: Synthetic oligonucleotide
aactcgagtgacccactgcttgtttctgtcac

SEQ ID NO: 155123 - DNA, 31 bp, Artificial Sequence
  Description of Artificial Sequence: Synthetic oligonucleotide
actcgagtgacccactgcttgtttctgtcac

SEQ ID NO: 155124 - DNA, 30 bp, Artificial Sequence
  Description of Artificial Sequence: Synthetic oligonucleotide
ctcgagtgacccactgcttgtttctgtcac

SEQ ID NO: 155125 - DNA, 31 bp, Artificial Sequence
  Description of Artificial Sequence: Synthetic oligonucleotide
tcgagtgacccactgcttgtttctgtcacag

SEQ ID NO: 155126 - DNA, 30 bp, Artificial Sequence
  Description of Artificial Sequence: Synthetic oligonucleotide
cgagtgacccactgcttgtttctgtcacag

SEQ ID NO: 155127 - DNA, 30 bp, Artificial Sequence
  Description of Artificial Sequence: Synthetic oligonucleotide
gagtgacccactgcttgtttctgtcacagg

SEQ ID NO: 155128 - DNA, 30 bp, Artificial Sequence
  Description of Artificial Sequence: Synthetic oligonucleotide
attggagagcaccatgatggggtctccaag

SEQ ID NO: 155129 - DNA, 29 bp, Artificial Sequence
  Description of Artificial Sequence: Synthetic oligonucleotide
ttggagagcaccatgatggggtctccaag

SEQ ID NO: 155130 - DNA, 28 bp, Artificial Sequence
  Description of Artificial Sequence: Synthetic oligonucleotide
tggagagcaccatgatggggtctccaag

SEQ ID NO: 155131 - DNA, 27 bp, Artificial Sequence
  Description of Artificial Sequence: Synthetic oligonucleotide
ggagagcaccatgatggggtctccaag

SEQ ID NO: 155132 - DNA, 27 bp, Artificial Sequence
  Description of Artificial Sequence: Synthetic oligonucleotide
gagagcaccatgatggggtctccaagg

SEQ ID NO: 155133 - DNA, 27 bp, Artificial Sequence
  Description of Artificial Sequence: Synthetic oligonucleotide
agagcaccatgatggggtctccaaggc

SEQ ID NO: 155134 - DNA, 26 bp, Artificial Sequence
  Description of Artificial Sequence: Synthetic oligonucleotide
gagcaccatgatggggtctccaaggc

SEQ ID NO: 155135 - DNA, 27 bp, Artificial Sequence
  Description of Artificial Sequence: Synthetic oligonucleotide
agcaccatgatggggtctccaaggcca

SEQ ID NO: 155136 - DNA, 27 bp, Artificial Sequence
  Description of Artificial Sequence: Synthetic oligonucleotide
gcaccatgatggggtctccaaggccaa

SEQ ID NO: 155137 - DNA, 27 bp, Artificial Sequence
  Description of Artificial Sequence: Synthetic oligonucleotide
gggtctccaaggccaacttctccatcg

SEQ ID NO: 155138 - DNA, 27 bp, Artificial Sequence
  Description of Artificial Sequence: Synthetic oligonucleotide
ggtctccaaggccaacttctccatcgg

SEQ ID NO: 155139 - DNA, 28 bp, Artificial Sequence
  Description of Artificial Sequence: Synthetic oligonucleotide
gtctccaaggccaacttctccatcggtc

SEQ ID NO: 155140 - DNA, 28 bp, Artificial Sequence
  Description of Artificial Sequence: Synthetic oligonucleotide
tctccaaggccaacttctccatcggtcc

SEQ ID NO: 155141 - DNA, 27 bp, Artificial Sequence
  Description of Artificial Sequence: Synthetic oligonucleotide
ctccaaggccaacttctccatcggtcc

SEQ ID NO: 155142 - DNA, 27 bp, Artificial Sequence
  Description of Artificial Sequence: Synthetic oligonucleotide
tccaaggccaacttctccatcggtccc

SEQ ID NO: 155143 - DNA, 27 bp, Artificial Sequence
  Description of Artificial Sequence: Synthetic oligonucleotide
ccaaggccaacttctccatcggtccca

SEQ ID NO: 155144 - DNA, 28 bp, Artificial Sequence
  Description of Artificial Sequence: Synthetic oligonucleotide
caaggccaacttctccatcggtcccatg

SEQ ID NO: 155145 - DNA, 30 bp, Artificial Sequence
  Description of Artificial Sequence: Synthetic oligonucleotide
aaggccaacttctccatcggtcccatgatg

SEQ ID NO: 155146 - DNA, 29 bp, Artificial Sequence
  Description of Artificial Sequence: Synthetic oligonucleotide
aggccaacttctccatcggtcccatgatg

SEQ ID NO: 155147 - DNA, 28 bp, Artificial Sequence
  Description of Artificial Sequence: Synthetic oligonucleotide
ggccaacttctccatcggtcccatgatg

SEQ ID NO: 155148 - DNA, 29 bp, Artificial Sequence
  Description of Artificial Sequence: Synthetic oligonucleotide
ggtcccatgatgcaagaccttgcaggaac

SEQ ID NO: 155149 - DNA, 29 bp, Artificial Sequence
  Description of Artificial Sequence: Synthetic oligonucleotide
gtcccatgatgcaagaccttgcaggaacc

SEQ ID NO: 155150 - DNA, 31 bp, Artificial Sequence
  Description of Artificial Sequence: Synthetic oligonucleotide
tcccatgatgcaagaccttgcaggaacctac

SEQ ID NO: 155151 - DNA, 30 bp, Artificial Sequence
  Description of Artificial Sequence: Synthetic oligonucleotide
cccatgatgcaagaccttgcaggaacctac

SEQ ID NO: 155152 - DNA, 31 bp, Artificial Sequence
  Description of Artificial Sequence: Synthetic oligonucleotide
ccatgatgcaagaccttgcaggaacctacag

SEQ ID NO: 155153 - DNA, 33 bp, Artificial Sequence
  Description of Artificial Sequence: Synthetic oligonucleotide
catgatgcaagaccttgcaggaacctacagatg

SEQ ID NO: 155154 - DNA, 33 bp, Artificial Sequence
  Description of Artificial Sequence: Synthetic oligonucleotide
atgatgcaagaccttgcaggaacctacagatgc

SEQ ID NO: 155155 - DNA, 32 bp, Artificial Sequence
  Description of Artificial Sequence: Synthetic oligonucleotide
tgatgcaagaccttgcaggaacctacagatgc

SEQ ID NO: 155156 - DNA, 31 bp, Artificial Sequence
  Description of Artificial Sequence: Synthetic oligonucleotide
gatgcaagaccttgcaggaacctacagatgc

SEQ ID NO: 155157 - DNA, 33 bp, Artificial Sequence
  Description of Artificial Sequence: Synthetic oligonucleotide
atgcaagaccttgcaggaacctacagatgctac

SEQ ID NO: 155158 - DNA, 32 bp, Artificial Sequence
  Description of Artificial Sequence: Synthetic oligonucleotide
tgcaagaccttgcaggaacctacagatgctac

SEQ ID NO: 155159 - DNA, 31 bp, Artificial Sequence
  Description of Artificial Sequence: Synthetic oligonucleotide
gcaagaccttgcaggaacctacagatgctac

SEQ ID NO: 155160 - DNA, 31 bp, Artificial Sequence
  Description of Artificial Sequence: Synthetic oligonucleotide
caagaccttgcaggaacctacagatgctacg

SEQ ID NO: 155161 - DNA, 31 bp, Artificial Sequence
  Description of Artificial Sequence: Synthetic oligonucleotide
aagaccttgcaggaacctacagatgctacgg

SEQ ID NO: 155162 - DNA, 30 bp, Artificial Sequence
  Description of Artificial Sequence: Synthetic oligonucleotide
agaccttgcaggaacctacagatgctacgg

SEQ ID NO: 155163 - DNA, 29 bp, Artificial Sequence
  Description of Artificial Sequence: Synthetic oligonucleotide
gaccttgcaggaacctacagatgctacgg

SEQ ID NO: 155164 - DNA, 31 bp, Artificial Sequence
  Description of Artificial Sequence: Synthetic oligonucleotide
accttgcaggaacctacagatgctacggttc

SEQ ID NO: 155165 - DNA, 30 bp, Artificial Sequence
  Description of Artificial Sequence: Synthetic oligonucleotide
ccttgcaggaacctacagatgctacggttc

SEQ ID NO: 155166 - DNA, 31 bp, Artificial Sequence
  Description of Artificial Sequence: Synthetic oligonucleotide
cttgcaggaacctacagatgctacggttctg

SEQ ID NO: 155167 - DNA, 34 bp, Artificial Sequence
  Description of Artificial Sequence: Synthetic oligonucleotide
ttgcaggaacctacagatgctacggttctgttac

SEQ ID NO: 155168 - DNA, 33 bp, Artificial Sequence
  Description of Artificial Sequence: Synthetic oligonucleotide
tgcaggaacctacagatgctacggttctgttac

SEQ ID NO: 155169 - DNA, 32 bp, Artificial Sequence
  Description of Artificial Sequence: Synthetic oligonucleotide
gcaggaacctacagatgctacggttctgttac

SEQ ID NO: 155170 - DNA, 33 bp, Artificial Sequence
  Description of Artificial Sequence: Synthetic oligonucleotide
caggaacctacagatgctacggttctgttactc

SEQ ID NO: 155171 - DNA, 34 bp, Artificial Sequence
  Description of Artificial Sequence: Synthetic oligonucleotide
aggaacctacagatgctacggttctgttactcac

SEQ ID NO: 155172 - DNA, 33 bp, Artificial Sequence
  Description of Artificial Sequence: Synthetic oligonucleotide
ggaacctacagatgctacggttctgttactcac

SEQ ID NO: 155173 - DNA, 34 bp, Artificial Sequence
  Description of Artificial Sequence: Synthetic oligonucleotide
gaacctacagatgctacggttctgttactcactc

SEQ ID NO: 155174 - DNA, 34 bp, Artificial Sequence
  Description of Artificial Sequence: Synthetic oligonucleotide
aacctacagatgctacggttctgttactcactcc

SEQ ID NO: 155175 - DNA, 35 bp, Artificial Sequence
  Description of Artificial Sequence: Synthetic oligonucleotide
agtcatcctgcaatgttggtcagatgtcaggtttc

SEQ ID NO: 155176 - DNA, 34 bp, Artificial Sequence
  Description of Artificial Sequence: Synthetic oligonucleotide
gtcatcctgcaatgttggtcagatgtcaggtttc

SEQ ID NO: 155177 - DNA, 35 bp, Artificial Sequence
  Description of Artificial Sequence: Synthetic oligonucleotide
tcatcctgcaatgttggtcagatgtcaggtttcag

SEQ ID NO: 155178 - DNA, 34 bp, Artificial Sequence
  Description of Artificial Sequence: Synthetic oligonucleotide
catcctgcaatgttggtcagatgtcaggtttcag

SEQ ID NO: 155179 - DNA, 34 bp, Artificial Sequence
  Description of Artificial Sequence: Synthetic oligonucleotide
atcctgcaatgttggtcagatgtcaggtttcagc

SEQ ID NO: 155180 - DNA, 33 bp, Artificial Sequence
  Description of Artificial Sequence: Synthetic oligonucleotide
tcctgcaatgttggtcagatgtcaggtttcagc

SEQ ID NO: 155181 - DNA, 32 bp, Artificial Sequence
  Description of Artificial Sequence: Synthetic oligonucleotide
cctgcaatgttggtcagatgtcaggtttcagc

SEQ ID NO: 155182 - DNA, 33 bp, Artificial Sequence
  Description of Artificial Sequence: Synthetic oligonucleotide
ctgcaatgttggtcagatgtcaggtttcagcac

SEQ ID NO: 155183 - DNA, 35 bp, Artificial Sequence
  Description of Artificial Sequence: Synthetic oligonucleotide
tgcaatgttggtcagatgtcaggtttcagcacttc

SEQ ID NO: 155184 - DNA, 34 bp, Artificial Sequence
  Description of Artificial Sequence: Synthetic oligonucleotide
gcaatgttggtcagatgtcaggtttcagcacttc

SEQ ID NO: 155185 - DNA, 34 bp, Artificial Sequence
  Description of Artificial Sequence: Synthetic oligonucleotide
caatgttggtcagatgtcaggtttcagcacttcc

SEQ ID NO: 155186 - DNA, 36 bp, Artificial Sequence
  Description of Artificial Sequence: Synthetic oligonucleotide
aatgttggtcagatgtcaggtttcagcacttccttc

SEQ ID NO: 155187 - DNA, 35 bp, Artificial Sequence
  Description of Artificial Sequence: Synthetic oligonucleotide
atgttggtcagatgtcaggtttcagcacttccttc

SEQ ID NO: 155188 - DNA, 34 bp, Artificial Sequence
  Description of Artificial Sequence: Synthetic oligonucleotide
tgttggtcagatgtcaggtttcagcacttccttc

SEQ ID NO: 155189 - DNA, 33 bp, Artificial Sequence
  Description of Artificial Sequence: Synthetic oligonucleotide
gttggtcagatgtcaggtttcagcacttccttc

SEQ ID NO: 155190 - DNA, 34 bp, Artificial Sequence
  Description of Artificial Sequence: Synthetic oligonucleotide
ttggtcagatgtcaggtttcagcacttccttctg

SEQ ID NO: 155191 - DNA, 33 bp, Artificial Sequence
  Description of Artificial Sequence: Synthetic oligonucleotide
tggtcagatgtcaggtttcagcacttccttctg

SEQ ID NO: 155192 - DNA, 32 bp, Artificial Sequence
  Description of Artificial Sequence: Synthetic oligonucleotide
ggtcagatgtcaggtttcagcacttccttctg

SEQ ID NO: 155193 - DNA, 32 bp, Artificial Sequence
  Description of Artificial Sequence: Synthetic oligonucleotide
gtcagatgtcaggtttcagcacttccttctgc

SEQ ID NO: 155194 - DNA, 33 bp, Artificial Sequence
  Description of Artificial Sequence: Synthetic oligonucleotide
tcagatgtcaggtttcagcacttccttctgcac

SEQ ID NO: 155195 - DNA, 32 bp, Artificial Sequence
  Description of Artificial Sequence: Synthetic oligonucleotide
cagatgtcaggtttcagcacttccttctgcac

SEQ ID NO: 155196 - DNA, 33 bp, Artificial Sequence
  Description of Artificial Sequence: Synthetic oligonucleotide
agatgtcaggtttcagcacttccttctgcacac

SEQ ID NO: 155197 - DNA, 32 bp, Artificial Sequence
  Description of Artificial Sequence: Synthetic oligonucleotide
gatgtcaggtttcagcacttccttctgcacac

SEQ ID NO: 155198 - DNA, 33 bp, Artificial Sequence
  Description of Artificial Sequence: Synthetic oligonucleotide
atgtcaggtttcagcacttccttctgcacacag

SEQ ID NO: 155199 - DNA, 32 bp, Artificial Sequence
  Description of Artificial Sequence: Synthetic oligonucleotide
tgtcaggtttcagcacttccttctgcacacag

SEQ ID NO: 155200 - DNA, 31 bp, Artificial Sequence
  Description of Artificial Sequence: Synthetic oligonucleotide
gtcaggtttcagcacttccttctgcacacag

SEQ ID NO: 155201 - DNA, 33 bp, Artificial Sequence
  Description of Artificial Sequence: Synthetic oligonucleotide
tcaggtttcagcacttccttctgcacacagaag

SEQ ID NO: 155202 - DNA, 32 bp, Artificial Sequence
  Description of Artificial Sequence: Synthetic oligonucleotide
caggtttcagcacttccttctgcacacagaag

SEQ ID NO: 155203 - DNA, 32 bp, Artificial Sequence
  Description of Artificial Sequence: Synthetic oligonucleotide
aggtttcagcacttccttctgcacacagaagg

SEQ ID NO: 155204 - DNA, 31 bp, Artificial Sequence
  Description of Artificial Sequence: Synthetic oligonucleotide
ggtttcagcacttccttctgcacacagaagg

SEQ ID NO: 155205 - DNA, 31 bp, Artificial Sequence
  Description of Artificial Sequence: Synthetic oligonucleotide
gtttcagcacttccttctgcacacagaaggg

SEQ ID NO: 155206 - DNA, 33 bp, Artificial Sequence
  Description of Artificial Sequence: Synthetic oligonucleotide
tttcagcacttccttctgcacacagaagggaag

SEQ ID NO: 155207 - DNA, 32 bp, Artificial Sequence
  Description of Artificial Sequence: Synthetic oligonucleotide
ttcagcacttccttctgcacacagaagggaag

SEQ ID NO: 155208 - DNA, 31 bp, Artificial Sequence
  Description of Artificial Sequence: Synthetic oligonucleotide
tcagcacttccttctgcacacagaagggaag

SEQ ID NO: 155209 - DNA, 30 bp, Artificial Sequence
  Description of Artificial Sequence: Synthetic oligonucleotide
cagcacttccttctgcacacagaagggaag

SEQ ID NO: 155210 - DNA, 35 bp, Artificial Sequence
  Description of Artificial Sequence: Synthetic oligonucleotide
agcacttccttctgcacacagaagggaagtttaag

SEQ ID NO: 155211 - DNA, 34 bp, Artificial Sequence
  Description of Artificial Sequence: Synthetic oligonucleotide
gcacttccttctgcacacagaagggaagtttaag

SEQ ID NO: 155212 - DNA, 34 bp, Artificial Sequence
  Description of Artificial Sequence: Synthetic oligonucleotide
cacttccttctgcacacagaagggaagtttaagg

SEQ ID NO: 155213 - DNA, 35 bp, Artificial Sequence
  Description of Artificial Sequence: Synthetic oligonucleotide
acttccttctgcacacagaagggaagtttaaggac

SEQ ID NO: 155214 - DNA, 34 bp, Artificial Sequence
  Description of Artificial Sequence: Synthetic oligonucleotide
cttccttctgcacacagaagggaagtttaaggac

SEQ ID NO: 155215 - DNA, 35 bp, Artificial Sequence
  Description of Artificial Sequence: Synthetic oligonucleotide
ttccttctgcacacagaagggaagtttaaggacac

SEQ ID NO: 155216 - DNA, 34 bp, Artificial Sequence
  Description of Artificial Sequence: Synthetic oligonucleotide
tccttctgcacacagaagggaagtttaaggacac

SEQ ID NO: 155217 - DNA, 33 bp, Artificial Sequence
  Description of Artificial Sequence: Synthetic oligonucleotide
ccttctgcacacagaagggaagtttaaggacac

SEQ ID NO: 155218 - DNA, 36 bp, Artificial Sequence
  Description of Artificial Sequence: Synthetic oligonucleotide
cttctgcacacagaagggaagtttaaggacactttg

SEQ ID NO: 155219 - DNA, 36 bp, Artificial Sequence
  Description of Artificial Sequence: Synthetic oligonucleotide
ttctgcacacagaagggaagtttaaggacactttgc

SEQ ID NO: 155220 - DNA, 35 bp, Artificial Sequence
  Description of Artificial Sequence: Synthetic oligonucleotide
tctgcacacagaagggaagtttaaggacactttgc

SEQ ID NO: 155221 - DNA, 34 bp, Artificial Sequence
  Description of Artificial Sequence: Synthetic oligonucleotide
ctgcacacagaagggaagtttaaggacactttgc

SEQ ID NO: 155222 - DNA, 35 bp, Artificial Sequence
  Description of Artificial Sequence: Synthetic oligonucleotide
tgcacacagaagggaagtttaaggacactttgcac

SEQ ID NO: 155223 - DNA, 34 bp, Artificial Sequence
  Description of Artificial Sequence: Synthetic oligonucleotide
gcacacagaagggaagtttaaggacactttgcac

SEQ ID NO: 155224 - DNA, 34 bp, Artificial Sequence
  Description of Artificial Sequence: Synthetic oligonucleotide
cacacagaagggaagtttaaggacactttgcacc

SEQ ID NO: 155225 - DNA, 35 bp, Artificial Sequence
  Description of Artificial Sequence: Synthetic oligonucleotide
acacagaagggaagtttaaggacactttgcacctc

SEQ ID NO: 155226 - DNA, 34 bp, Artificial Sequence
  Description of Artificial Sequence: Synthetic oligonucleotide
cacagaagggaagtttaaggacactttgcacctc

SEQ ID NO: 155227 - DNA, 37 bp, Artificial Sequence
  Description of Artificial Sequence: Synthetic oligonucleotide
acagaagggaagtttaaggacactttgcacctcattg

SEQ ID NO: 155228 - DNA, 36 bp, Artificial Sequence
  Description of Artificial Sequence: Synthetic oligonucleotide
cagaagggaagtttaaggacactttgcacctcattg

SEQ ID NO: 155229 - DNA, 30 bp, Artificial Sequence
  Description of Artificial Sequence: Synthetic oligonucleotide
atggggtctccaaggccaacttctccattg

SEQ ID NO: 155230 - DNA, 29 bp, Artificial Sequence
  Description of Artificial Sequence: Synthetic oligonucleotide
tggggtctccaaggccaacttctccattg

SEQ ID NO: 155231 - DNA, 28 bp, Artificial Sequence
  Description of Artificial Sequence: Synthetic oligonucleotide
ggggtctccaaggccaacttctccattg

SEQ ID NO: 155232 - DNA, 28 bp, Artificial Sequence
  Description of Artificial Sequence: Synthetic oligonucleotide
gggtctccaaggccaacttctccattgg

SEQ ID NO: 155233 - DNA, 29 bp, Artificial Sequence
  Description of Artificial Sequence: Synthetic oligonucleotide
ggtctccaaggccaacttctccattggtc

SEQ ID NO: 155234 - DNA, 29 bp, Artificial Sequence
  Description of Artificial Sequence: Synthetic oligonucleotide
gtctccaaggccaacttctccattggtcc

SEQ ID NO: 155235 - DNA, 29 bp, Artificial Sequence
  Description of Artificial Sequence: Synthetic oligonucleotide
tctccaaggccaacttctccattggtccc

SEQ ID NO: 155236 - DNA, 28 bp, Artificial Sequence
  Description of Artificial Sequence: Synthetic oligonucleotide
ctccaaggccaacttctccattggtccc

SEQ ID NO: 155237 - DNA, 30 bp, Artificial Sequence
  Description of Artificial Sequence: Synthetic oligonucleotide
tccaaggccaacttctccattggtcccatg

SEQ ID NO: 155238 - DNA, 29 bp, Artificial Sequence
  Description of Artificial Sequence: Synthetic oligonucleotide
ccaaggccaacttctccattggtcccatg

SEQ ID NO: 155239 - DNA, 31 bp, Artificial Sequence
  Description of Artificial Sequence: Synthetic oligonucleotide
caaggccaacttctccattggtcccatgatg

SEQ ID NO: 155240 - DNA, 31 bp, Artificial Sequence
  Description of Artificial Sequence: Synthetic oligonucleotide
aaggccaacttctccattggtcccatgatgc

SEQ ID NO: 155241 - DNA, 30 bp, Artificial Sequence
  Description of Artificial Sequence: Synthetic oligonucleotide
aggccaacttctccattggtcccatgatgc

SEQ ID NO: 155242 - DNA, 29 bp, Artificial Sequence
  Description of Artificial Sequence: Synthetic oligonucleotide
ggccaacttctccattggtcccatgatgc

SEQ ID NO: 155243 - DNA, 31 bp, Artificial Sequence
  Description of Artificial Sequence: Synthetic oligonucleotide
gccaacttctccattggtcccatgatgcaag

SEQ ID NO: 155244 - DNA, 32 bp, Artificial Sequence
  Description of Artificial Sequence: Synthetic oligonucleotide
ccaacttctccattggtcccatgatgcaagac

SEQ ID NO: 155245 - DNA, 32 bp, Artificial Sequence
  Description of Artificial Sequence: Synthetic oligonucleotide
caacttctccattggtcccatgatgcaagacc

SEQ ID NO: 155246 - DNA, 34 bp, Artificial Sequence
  Description of Artificial Sequence: Synthetic oligonucleotide
aacttctccattggtcccatgatgcaagaccttg

SEQ ID NO: 155247 - DNA, 33 bp, Artificial Sequence
  Description of Artificial Sequence: Synthetic oligonucleotide
acttctccattggtcccatgatgcaagaccttg

SEQ ID NO: 155248 - DNA, 32 bp, Artificial Sequence
  Description of Artificial Sequence: Synthetic oligonucleotide
cttctccattggtcccatgatgcaagaccttg

SEQ ID NO: 155249 - DNA, 32 bp, Artificial Sequence
  Description of Artificial Sequence: Synthetic oligonucleotide
ttctccattggtcccatgatgcaagaccttgc

SEQ ID NO: 155250 - DNA, 31 bp, Artificial Sequence
  Description of Artificial Sequence: Synthetic oligonucleotide
tctccattggtcccatgatgcaagaccttgc

SEQ ID NO: 155251 - DNA, 30 bp, Artificial Sequence
  Description of Artificial Sequence: Synthetic oligonucleotide
ctccattggtcccatgatgcaagaccttgc

SEQ ID NO: 155252 - DNA, 31 bp, Artificial Sequence
  Description of Artificial Sequence: Synthetic oligonucleotide
tccattggtcccatgatgcaagaccttgcag

SEQ ID NO: 155253 - DNA, 30 bp, Artificial Sequence
  Description of Artificial Sequence: Synthetic oligonucleotide
ccattggtcccatgatgcaagaccttgcag

SEQ ID NO: 155254 - DNA, 30 bp, Artificial Sequence
  Description of Artificial Sequence: Synthetic oligonucleotide
cattggtcccatgatgcaagaccttgcagg

SEQ ID NO: 155255 - DNA, 30 bp, Artificial Sequence
  Description of Artificial Sequence: Synthetic oligonucleotide
attggtcccatgatgcaagaccttgcaggg

SEQ ID NO: 155256 - DNA, 29 bp, Artificial Sequence
  Description of Artificial Sequence: Synthetic oligonucleotide
ttggtcccatgatgcaagaccttgcaggg

SEQ ID NO: 155257 - DNA, 28 bp, Artificial Sequence
  Description of Artificial Sequence: Synthetic oligonucleotide
tggtcccatgatgcaagaccttgcaggg

SEQ ID NO: 155258 - DNA, 29 bp, Artificial Sequence
  Description of Artificial Sequence: Synthetic oligonucleotide
gaacattccaggccgactttcctctggac

SEQ ID NO: 155259 - DNA, 29 bp, Artificial Sequence
  Description of Artificial Sequence: Synthetic oligonucleotide
aacattccaggccgactttcctctggacc

SEQ ID NO: 155260 - DNA, 28 bp, Artificial Sequence
  Description of Artificial Sequence: Synthetic oligonucleotide
acattccaggccgactttcctctggacc

SEQ ID NO: 155261 - DNA, 27 bp, Artificial Sequence
  Description of Artificial Sequence: Synthetic oligonucleotide
cattccaggccgactttcctctggacc

SEQ ID NO: 155262 - DNA, 27 bp, Artificial Sequence
  Description of Artificial Sequence: Synthetic oligonucleotide
attccaggccgactttcctctggaccc

SEQ ID NO: 155263 - DNA, 27 bp, Artificial Sequence
  Description of Artificial Sequence: Synthetic oligonucleotide
ttccaggccgactttcctctggaccct

SEQ ID NO: 155264 - DNA, 26 bp, Artificial Sequence
  Description of Artificial Sequence: Synthetic oligonucleotide
tccaggccgactttcctctggaccct

SEQ ID NO: 155265 - DNA, 25 bp, Artificial Sequence
  Description of Artificial Sequence: Synthetic oligonucleotide
ccaggccgactttcctctggaccct

SEQ ID NO: 155266 - DNA, 25 bp, Artificial Sequence
  Description of Artificial Sequence: Synthetic oligonucleotide
caggccgactttcctctggaccctg

SEQ ID NO: 155267 - DNA, 25 bp, Artificial Sequence
  Description of Artificial Sequence: Synthetic oligonucleotide
aggccgactttcctctggaccctgc

SEQ ID NO: 155268 - DNA, 24 bp, Artificial Sequence
  Description of Artificial Sequence: Synthetic oligonucleotide
ggccgactttcctctggaccctgc

SEQ ID NO: 155269 - DNA, 25 bp, Artificial Sequence
  Description of Artificial Sequence: Synthetic oligonucleotide
gccgactttcctctggaccctgcca

SEQ ID NO: 155270 - DNA, 25 bp, Artificial Sequence
  Description of Artificial Sequence: Synthetic oligonucleotide
ccgactttcctctggaccctgccac

SEQ ID NO: 155271 - DNA, 25 bp, Artificial Sequence
  Description of Artificial Sequence: Synthetic oligonucleotide
cgactttcctctggaccctgccacc

SEQ ID NO: 155272 - DNA, 26 bp, Artificial Sequence
  Description of Artificial Sequence: Synthetic oligonucleotide
gactttcctctggaccctgccaccca

SEQ ID NO: 155273 - DNA, 26 bp, Artificial Sequence
  Description of Artificial Sequence: Synthetic oligonucleotide
actttcctctggaccctgccacccac

SEQ ID NO: 155274 - DNA, 25 bp, Artificial Sequence
  Description of Artificial Sequence: Synthetic oligonucleotide
ctttcctctggaccctgccacccac

SEQ ID NO: 155275 - DNA, 25 bp, Artificial Sequence
  Description of Artificial Sequence: Synthetic oligonucleotide
tttcctctggaccctgccacccacg

SEQ ID NO: 155276 - DNA, 24 bp, Artificial Sequence
  Description of Artificial Sequence: Synthetic oligonucleotide
ttcctctggaccctgccacccacg

SEQ ID NO: 155277 - DNA, 23 bp, Artificial Sequence
  Description of Artificial Sequence: Synthetic oligonucleotide
tcctctggaccctgccacccacg

SEQ ID NO: 155278 - DNA, 22 bp, Artificial Sequence
  Description of Artificial Sequence: Synthetic oligonucleotide
cctctggaccctgccacccacg

SEQ ID NO: 155279 - DNA, 23 bp, Artificial Sequence
  Description of Artificial Sequence: Synthetic oligonucleotide
ctctggaccctgccacccacgga

SEQ ID NO: 155280 - DNA, 23 bp, Artificial Sequence
  Description of Artificial Sequence: Synthetic oligonucleotide
tctggaccctgccacccacggag

SEQ ID NO: 155281 - DNA, 22 bp, Artificial Sequence
  Description of Artificial Sequence: Synthetic oligonucleotide
ctggaccctgccacccacggag

SEQ ID NO: 155282 - DNA, 24 bp, Artificial Sequence
  Description of Artificial Sequence: Synthetic oligonucleotide
tggaccctgccacccacggaggaa

SEQ ID NO: 155283 - DNA, 23 bp, Artificial Sequence
  Description of Artificial Sequence: Synthetic oligonucleotide
ggaccctgccacccacggaggaa

SEQ ID NO: 155284 - DNA, 23 bp, Artificial Sequence
  Description of Artificial Sequence: Synthetic oligonucleotide
gaccctgccacccacggaggaac

SEQ ID NO: 155285 - DNA, 25 bp, Artificial Sequence
  Description of Artificial Sequence: Synthetic oligonucleotide
accctgccacccacggaggaacgta

SEQ ID NO: 155286 - DNA, 24 bp, Artificial Sequence
  Description of Artificial Sequence: Synthetic oligonucleotide
ccctgccacccacggaggaacgta

SEQ ID NO: 155287 - DNA, 25 bp, Artificial Sequence
  Description of Artificial Sequence: Synthetic oligonucleotide
cctgccacccacggaggaacgtaca

SEQ ID NO: 155288 - DNA, 27 bp, Artificial Sequence
  Description of Artificial Sequence: Synthetic oligonucleotide
ctgccacccacggaggaacgtacagat

SEQ ID NO: 155289 - DNA, 27 bp, Artificial Sequence
  Description of Artificial Sequence: Synthetic oligonucleotide
tgccacccacggaggaacgtacagatg

SEQ ID NO: 155290 - DNA, 26 bp, Artificial Sequence
  Description of Artificial Sequence: Synthetic oligonucleotide
gccacccacggaggaacgtacagatg

SEQ ID NO: 155291 - DNA, 27 bp, Artificial Sequence
  Description of Artificial Sequence: Synthetic oligonucleotide
ccacccacggaggaacgtacagatgct

SEQ ID NO: 155292 - DNA, 28 bp, Artificial Sequence
  Description of Artificial Sequence: Synthetic oligonucleotide
cacccacggaggaacgtacagatgcttc

SEQ ID NO: 155293 - DNA, 28 bp, Artificial Sequence
  Description of Artificial Sequence: Synthetic oligonucleotide
acccacggaggaacgtacagatgcttcg

SEQ ID NO: 155294 - DNA, 27 bp, Artificial Sequence
  Description of Artificial Sequence: Synthetic oligonucleotide
cccacggaggaacgtacagatgcttcg

SEQ ID NO: 155295 - DNA, 27 bp, Artificial Sequence
  Description of Artificial Sequence: Synthetic oligonucleotide
ccacggaggaacgtacagatgcttcgg

SEQ ID NO: 155296 - DNA, 27 bp, Artificial Sequence
  Description of Artificial Sequence: Synthetic oligonucleotide
cacggaggaacgtacagatgcttcggc

SEQ ID NO: 155297 - DNA, 28 bp, Artificial Sequence
  Description of Artificial Sequence: Synthetic oligonucleotide
acggaggaacgtacagatgcttcggctc

SEQ ID NO: 155298 - DNA, 27 bp, Artificial Sequence
  Description of Artificial Sequence: Synthetic oligonucleotide
cggaggaacgtacagatgcttcggctc

SEQ ID NO: 155299 - DNA, 30 bp, Artificial Sequence
  Description of Artificial Sequence: Synthetic oligonucleotide
ggaggaacgtacagatgcttcggctctttc

SEQ ID NO: 155300 - DNA, 30 bp, Artificial Sequence
  Description of Artificial Sequence: Synthetic oligonucleotide
gaggaacgtacagatgcttcggctctttcc

SEQ ID NO: 155301 - DNA, 30 bp, Artificial Sequence
  Description of Artificial Sequence: Synthetic oligonucleotide
aggaacgtacagatgcttcggctctttccg

SEQ ID NO: 155302 - DNA, 29 bp, Artificial Sequence
  Description of Artificial Sequence: Synthetic oligonucleotide
ggaacgtacagatgcttcggctctttccg

SEQ ID NO: 155303 - DNA, 30 bp, Artificial Sequence
  Description of Artificial Sequence: Synthetic oligonucleotide
gaacgtacagatgcttcggctctttccgtg

SEQ ID NO: 155304 - DNA, 31 bp, Artificial Sequence
  Description of Artificial Sequence: Synthetic oligonucleotide
aacgtacagatgcttcggctctttccgtgac

SEQ ID NO: 155305 - DNA, 30 bp, Artificial Sequence
  Description of Artificial Sequence: Synthetic oligonucleotide
acgtacagatgcttcggctctttccgtgac

SEQ ID NO: 155306 - DNA, 29 bp, Artificial Sequence
  Description of Artificial Sequence: Synthetic oligonucleotide
cgtacagatgcttcggctctttccgtgac

SEQ ID NO: 155307 - DNA, 30 bp, Artificial Sequence
  Description of Artificial Sequence: Synthetic oligonucleotide
gtacagatgcttcggctctttccgtgactc

SEQ ID NO: 155308 - DNA, 36 bp, Artificial Sequence
  Description of Artificial Sequence: Synthetic oligonucleotide
ttcatcgctggtgctccaacaaaaaaaatgctgctg

SEQ ID NO: 155309 - DNA, 35 bp, Artificial Sequence
  Description of Artificial Sequence: Synthetic oligonucleotide
tcatcgctggtgctccaacaaaaaaaatgctgctg

SEQ ID NO: 155310 - DNA, 34 bp, Artificial Sequence
  Description of Artificial Sequence: Synthetic oligonucleotide
catcgctggtgctccaacaaaaaaaatgctgctg

SEQ ID NO: 155311 - DNA, 38 bp, Artificial Sequence
  Description of Artificial Sequence: Synthetic oligonucleotide
atcgctggtgctccaacaaaaaaaatgctgctgtaatg

SEQ ID NO: 155312 - DNA, 37 bp, Artificial Sequence
  Description of Artificial Sequence: Synthetic oligonucleotide
tcgctggtgctccaacaaaaaaaatgctgctgtaatg

SEQ ID NO: 155313 - DNA, 36 bp, Artificial Sequence
  Description of Artificial Sequence: Synthetic oligonucleotide
cgctggtgctccaacaaaaaaaatgctgctgtaatg

SEQ ID NO: 155314 - DNA, 35 bp, Artificial Sequence
  Description of Artificial Sequence: Synthetic oligonucleotide
accaagagtctgcaggaaacagaacagcgaatatc

SEQ ID NO: 155315 - DNA, 34 bp, Artificial Sequence
  Description of Artificial Sequence: Synthetic oligonucleotide
ccaagagtctgcaggaaacagaacagcgaatatc

SEQ ID NO: 155316 - DNA, 34 bp, Artificial Sequence
  Description of Artificial Sequence: Synthetic oligonucleotide
caagagtctgcaggaaacagaacagcgaatatcg

SEQ ID NO: 155317 - DNA, 35 bp, Artificial Sequence
  Description of Artificial Sequence: Synthetic oligonucleotide
aagagtctgcaggaaacagaacagcgaatatcgag

SEQ ID NO: 155318 - DNA, 34 bp, Artificial Sequence
  Description of Artificial Sequence: Synthetic oligonucleotide
agagtctgcaggaaacagaacagcgaatatcgag

SEQ ID NO: 155319 - DNA, 33 bp, Artificial Sequence
  Description of Artificial Sequence: Synthetic oligonucleotide
gagtctgcaggaaacagaacagcgaatatcgag

SEQ ID NO: 155320 - DNA, 33 bp, Artificial Sequence
  Description of Artificial Sequence: Synthetic oligonucleotide
agtctgcaggaaacagaacagcgaatatcgagg

SEQ ID NO: 155321 - DNA, 32 bp, Artificial Sequence
  Description of Artificial Sequence: Synthetic oligonucleotide
gtctgcaggaaacagaacagcgaatatcgagg

SEQ ID NO: 155322 - DNA, 33 bp, Artificial Sequence
  Description of Artificial Sequence: Synthetic oligonucleotide
tctgcaggaaacagaacagcgaatatcgaggac

SEQ ID NO: 155323 - DNA, 32 bp, Artificial Sequence
  Description of Artificial Sequence: Synthetic oligonucleotide
ctgcaggaaacagaacagcgaatatcgaggac

SEQ ID NO: 155324 - DNA, 33 bp, Artificial Sequence
  Description of Artificial Sequence: Synthetic oligonucleotide
tgcaggaaacagaacagcgaatatcgaggactc

SEQ ID NO: 155325 - DNA, 32 bp, Artificial Sequence
  Description of Artificial Sequence: Synthetic oligonucleotide
gcaggaaacagaacagcgaatatcgaggactc

SEQ ID NO: 155326 - DNA, 33 bp, Artificial Sequence
  Description of Artificial Sequence: Synthetic oligonucleotide
caggaaacagaacagcgaatatcgaggactctg

SEQ ID NO: 155327 - DNA, 35 bp, Artificial Sequence
  Description of Artificial Sequence: Synthetic oligonucleotide
aggaaacagaacagcgaatatcgaggactctgatg

SEQ ID NO: 155328 - DNA, 34 bp, Artificial Sequence
  Description of Artificial Sequence: Synthetic oligonucleotide
ggaaacagaacagcgaatatcgaggactctgatg

SEQ ID NO: 155329 - DNA, 36 bp, Artificial Sequence
  Description of Artificial Sequence: Synthetic oligonucleotide
gaaacagaacagcgaatatcgaggactctgatgaac

SEQ ID NO: 155330 - DNA, 38 bp, Artificial Sequence
  Description of Artificial Sequence: Synthetic oligonucleotide
aaacagaacagcgaatatcgaggactctgatgaacaag

SEQ ID NO: 155331 - DNA, 37 bp, Artificial Sequence
  Description of Artificial Sequence: Synthetic oligonucleotide
aacagaacagcgaatatcgaggactctgatgaacaag

SEQ ID NO: 155332 - DNA, 36 bp, Artificial Sequence
  Description of Artificial Sequence: Synthetic oligonucleotide
acagaacagcgaatatcgaggactctgatgaacaag

SEQ ID NO: 155333 - DNA, 35 bp, Artificial Sequence
  Description of Artificial Sequence: Synthetic oligonucleotide
cagaacagcgaatatcgaggactctgatgaacaag

SEQ ID NO: 155334 - DNA, 36 bp, Artificial Sequence
  Description of Artificial Sequence: Synthetic oligonucleotide
agaacagcgaatatcgaggactctgatgaacaagac

SEQ ID NO: 155335 - DNA, 35 bp, Artificial Sequence
  Description of Artificial Sequence: Synthetic oligonucleotide
gaacagcgaatatcgaggactctgatgaacaagac

SEQ ID NO: 155336 - DNA, 35 bp, Artificial Sequence
  Description of Artificial Sequence: Synthetic oligonucleotide
aacagcgaatatcgaggactctgatgaacaagacc

SEQ ID NO: 155337 - DNA, 34 bp, Artificial Sequence
  Description of Artificial Sequence: Synthetic oligonucleotide
acagcgaatatcgaggactctgatgaacaagacc

SEQ ID NO: 155338 - DNA, 33 bp, Artificial Sequence
  Description of Artificial Sequence: Synthetic oligonucleotide
cagcgaatatcgaggactctgatgaacaagacc

SEQ ID NO: 155339 - DNA, 33 bp, Artificial Sequence
  Description of Artificial Sequence: Synthetic oligonucleotide
agcgaatatcgaggactctgatgaacaagaccc

SEQ ID NO: 155340 - DNA, 32 bp, Artificial Sequence
  Description of Artificial Sequence: Synthetic oligonucleotide
gcgaatatcgaggactctgatgaacaagaccc

SEQ ID NO: 155341 - DNA, 33 bp, Artificial Sequence
  Description of Artificial Sequence: Synthetic oligonucleotide
cgaatatcgaggactctgatgaacaagaccctc

SEQ ID NO: 155342 - DNA, 34 bp, Artificial Sequence
  Description of Artificial Sequence: Synthetic oligonucleotide
gaatatcgaggactctgatgaacaagaccctcag

SEQ ID NO: 155343 - DNA, 34 bp, Artificial Sequence
  Description of Artificial Sequence: Synthetic oligonucleotide
aatatcgaggactctgatgaacaagaccctcagg

SEQ ID NO: 155344 - DNA, 33 bp, Artificial Sequence
  Description of Artificial Sequence: Synthetic oligonucleotide
atatcgaggactctgatgaacaagaccctcagg

SEQ ID NO: 155345 - DNA, 32 bp, Artificial Sequence
  Description of Artificial Sequence: Synthetic oligonucleotide
tatcgaggactctgatgaacaagaccctcagg

SEQ ID NO: 155346 - DNA, 31 bp, Artificial Sequence
  Description of Artificial Sequence: Synthetic oligonucleotide
atcgaggactctgatgaacaagaccctcagg

SEQ ID NO: 155347 - DNA, 30 bp, Artificial Sequence
  Description of Artificial Sequence: Synthetic oligonucleotide
tcgaggactctgatgaacaagaccctcagg

SEQ ID NO: 155348 - DNA, 41 bp, Artificial Sequence
  Description of Artificial Sequence: Synthetic oligonucleotide
agttgaatcactgcgttttcacacagagaaaaatcactcac

SEQ ID NO: 155349 - DNA, 40 bp, Artificial Sequence
  Description of Artificial Sequence: Synthetic oligonucleotide
gttgaatcactgcgttttcacacagagaaaaatcactcac

SEQ ID NO: 155350 - DNA, 40 bp, Artificial Sequence
  Description of Artificial Sequence: Synthetic oligonucleotide
ttgaatcactgcgttttcacacagagaaaaatcactcacc

SEQ ID NO: 155351 - DNA, 39 bp, Artificial Sequence
  Description of Artificial Sequence: Synthetic oligonucleotide
tgaatcactgcgttttcacacagagaaaaatcactcacc

SEQ ID NO: 155352 - DNA, 38 bp, Artificial Sequence
  Description of Artificial Sequence: Synthetic oligonucleotide
gaatcactgcgttttcacacagagaaaaatcactcacc

SEQ ID NO: 155353 - DNA, 38 bp, Artificial Sequence
  Description of Artificial Sequence: Synthetic oligonucleotide
aatcactgcgttttcacacagagaaaaatcactcaccc

SEQ ID NO: 155354 - DNA, 37 bp, Artificial Sequence
  Description of Artificial Sequence: Synthetic oligonucleotide
atcactgcgttttcacacagagaaaaatcactcaccc

SEQ ID NO: 155355 - DNA, 36 bp, Artificial Sequence
  Description of Artificial Sequence: Synthetic oligonucleotide
tcactgcgttttcacacagagaaaaatcactcaccc

SEQ ID NO: 155356 - DNA, 35 bp, Artificial Sequence
  Description of Artificial Sequence: Synthetic oligonucleotide
cactgcgttttcacacagagaaaaatcactcaccc

SEQ ID NO: 155357 - DNA, 37 bp, Artificial Sequence
  Description of Artificial Sequence: Synthetic oligonucleotide
actgcgttttcacacagagaaaaatcactcacccttc

SEQ ID NO: 155358 - DNA, 36 bp, Artificial Sequence
  Description of Artificial Sequence: Synthetic oligonucleotide
ctgcgttttcacacagagaaaaatcactcacccttc

SEQ ID NO: 155359 - DNA, 37 bp, Artificial Sequence
  Description of Artificial Sequence: Synthetic oligonucleotide
tgcgttttcacacagagaaaaatcactcacccttctc

SEQ ID NO: 155360 - DNA, 36 bp, Artificial Sequence
  Description of Artificial Sequence: Synthetic oligonucleotide
gcgttttcacacagagaaaaatcactcacccttctc

SEQ ID NO: 155361 - DNA, 37 bp, Artificial Sequence
  Description of Artificial Sequence: Synthetic oligonucleotide
cgttttcacacagagaaaaatcactcacccttctcag

SEQ ID NO: 155362 - DNA, 38 bp, Artificial Sequence
  Description of Artificial Sequence: Synthetic oligonucleotide
gttttcacacagagaaaaatcactcacccttctcagag

SEQ ID NO: 155363 - DNA, 38 bp, Artificial Sequence
  Description of Artificial Sequence: Synthetic oligonucleotide
ttttcacacagagaaaaatcactcacccttctcagagg

SEQ ID NO: 155364 - DNA, 37 bp, Artificial Sequence
  Description of Artificial Sequence: Synthetic oligonucleotide
tttcacacagagaaaaatcactcacccttctcagagg

SEQ ID NO: 155365 - DNA, 36 bp, Artificial Sequence
  Description of Artificial Sequence: Synthetic oligonucleotide
ttcacacagagaaaaatcactcacccttctcagagg

SEQ ID NO: 155366 - DNA, 35 bp, Artificial Sequence
  Description of Artificial Sequence: Synthetic oligonucleotide
tcacacagagaaaaatcactcacccttctcagagg

SEQ ID NO: 155367 - DNA, 34 bp, Artificial Sequence
  Description of Artificial Sequence: Synthetic oligonucleotide
cacacagagaaaaatcactcacccttctcagagg

SEQ ID NO: 155368 - DNA, 34 bp, Artificial Sequence
  Description of Artificial Sequence: Synthetic oligonucleotide
acacagagaaaaatcactcacccttctcagaggc

SEQ ID NO: 155369 - DNA, 33 bp, Artificial Sequence
  Description of Artificial Sequence: Synthetic oligonucleotide
cacagagaaaaatcactcacccttctcagaggc

SEQ ID NO: 155370 - DNA, 33 bp, Artificial Sequence
  Description of Artificial Sequence: Synthetic oligonucleotide
acagagaaaaatcactcacccttctcagaggcc

SEQ ID NO: 155371 - DNA, 32 bp, Artificial Sequence
  Description of Artificial Sequence: Synthetic oligonucleotide
cagagaaaaatcactcacccttctcagaggcc

SEQ ID NO: 155372 - DNA, 32 bp, Artificial Sequence
  Description of Artificial Sequence: Synthetic oligonucleotide
agagaaaaatcactcacccttctcagaggccc

SEQ ID NO: 155373 - DNA, 31 bp, Artificial Sequence
  Description of Artificial Sequence: Synthetic oligonucleotide
gagaaaaatcactcacccttctcagaggccc

SEQ ID NO: 155374 - DNA, 33 bp, Artificial Sequence
  Description of Artificial Sequence: Synthetic oligonucleotide
agaaaaatcactcacccttctcagaggcccaag

SEQ ID NO: 155375 - DNA, 32 bp, Artificial Sequence
  Description of Artificial Sequence: Synthetic oligonucleotide
gaaaaatcactcacccttctcagaggcccaag

SEQ ID NO: 155376 - DNA, 33 bp, Artificial Sequence
  Description of Artificial Sequence: Synthetic oligonucleotide
aaaaatcactcacccttctcagaggcccaagac

SEQ ID NO: 155377 - DNA, 32 bp, Artificial Sequence
  Description of Artificial Sequence: Synthetic oligonucleotide
aaaatcactcacccttctcagaggcccaagac

SEQ ID NO: 155378 - DNA, 31 bp, Artificial Sequence
  Description of Artificial Sequence: Synthetic oligonucleotide
aaatcactcacccttctcagaggcccaagac

SEQ ID NO: 155379 - DNA, 30 bp, Artificial Sequence
  Description of Artificial Sequence: Synthetic oligonucleotide
aatcactcacccttctcagaggcccaagac

SEQ ID NO: 155380 - DNA, 29 bp, Artificial Sequence
  Description of Artificial Sequence: Synthetic oligonucleotide
atcactcacccttctcagaggcccaagac

SEQ ID NO: 155381 - DNA, 28 bp, Artificial Sequence
  Description of Artificial Sequence: Synthetic oligonucleotide
tcactcacccttctcagaggcccaagac

SEQ ID NO: 155382 - DNA, 27 bp, Artificial Sequence
  Description of Artificial Sequence: Synthetic oligonucleotide
cactcacccttctcagaggcccaagac

SEQ ID NO: 155383 - DNA, 28 bp, Artificial Sequence
  Description of Artificial Sequence: Synthetic oligonucleotide
actcacccttctcagaggcccaagacac

SEQ ID NO: 155384 - DNA, 27 bp, Artificial Sequence
  Description of Artificial Sequence: Synthetic oligonucleotide
ctcacccttctcagaggcccaagacac

SEQ ID NO: 155385 - DNA, 27 bp, Artificial Sequence
  Description of Artificial Sequence: Synthetic oligonucleotide
tcacccttctcagaggcccaagacacc

SEQ ID NO: 155386 - DNA, 26 bp, Artificial Sequence
  Description of Artificial Sequence: Synthetic oligonucleotide
cacccttctcagaggcccaagacacc

SEQ ID NO: 155387 - DNA, 26 bp, Artificial Sequence
  Description of Artificial Sequence: Synthetic oligonucleotide
acccttctcagaggcccaagacaccc

SEQ ID NO: 155388 - DNA, 35 bp, Artificial Sequence
  Description of Artificial Sequence: Synthetic oligonucleotide
ccaacagatatcatcgtgtacacggaacttccaag

SEQ ID NO: 155389 - DNA, 36 bp, Artificial Sequence
  Description of Artificial Sequence: Synthetic oligonucleotide
caacagatatcatcgtgtacacggaacttccaagtg

SEQ ID NO: 155390 - DNA, 36 bp, Artificial Sequence
  Description of Artificial Sequence: Synthetic oligonucleotide
aacagatatcatcgtgtacacggaacttccaagtgc

SEQ ID NO: 155391 - DNA, 35 bp, Artificial Sequence
  Description of Artificial Sequence: Synthetic oligonucleotide
acagatatcatcgtgtacacggaacttccaagtgc

SEQ ID NO: 155392 - DNA, 34 bp, Artificial Sequence
  Description of Artificial Sequence: Synthetic oligonucleotide
cagatatcatcgtgtacacggaacttccaagtgc

SEQ ID NO: 155393 - DNA, 35 bp, Artificial Sequence
  Description of Artificial Sequence: Synthetic oligonucleotide
agatatcatcgtgtacacggaacttccaagtgctg

SEQ ID NO: 155394 - DNA, 34 bp, Artificial Sequence
  Description of Artificial Sequence: Synthetic oligonucleotide
gatatcatcgtgtacacggaacttccaagtgctg

SEQ ID NO: 155395 - DNA, 35 bp, Artificial Sequence
  Description of Artificial Sequence: Synthetic oligonucleotide
atatcatcgtgtacacggaacttccaagtgctgag

SEQ ID NO: 155396 - DNA, 34 bp, Artificial Sequence
  Description of Artificial Sequence: Synthetic oligonucleotide
tatcatcgtgtacacggaacttccaagtgctgag

SEQ ID NO: 155397 - DNA, 33 bp, Artificial Sequence
  Description of Artificial Sequence: Synthetic oligonucleotide
atcatcgtgtacacggaacttccaagtgctgag

SEQ ID NO: 155398 - DNA, 32 bp, Artificial Sequence
  Description of Artificial Sequence: Synthetic oligonucleotide
tcatcgtgtacacggaacttccaagtgctgag

SEQ ID NO: 155399 - DNA, 31 bp, Artificial Sequence
  Description of Artificial Sequence: Synthetic oligonucleotide
catcgtgtacacggaacttccaagtgctgag

SEQ ID NO: 155400 - DNA, 32 bp, Artificial Sequence
  Description of Artificial Sequence: Synthetic oligonucleotide
atcgtgtacacggaacttccaagtgctgagtc

SEQ ID NO: 155401 - DNA, 31 bp, Artificial Sequence
  Description of Artificial Sequence: Synthetic oligonucleotide
tcgtgtacacggaacttccaagtgctgagtc

SEQ ID NO: 155402 - DNA, 30 bp, Artificial Sequence
  Description of Artificial Sequence: Synthetic oligonucleotide
cgtgtacacggaacttccaagtgctgagtc

SEQ ID NO: 155403 - DNA, 30 bp, Artificial Sequence
  Description of Artificial Sequence: Synthetic oligonucleotide
gtgtacacggaacttccaagtgctgagtcc

SEQ ID NO: 155404 - DNA, 31 bp, Artificial Sequence
  Description of Artificial Sequence: Synthetic oligonucleotide
tgtacacggaacttccaagtgctgagtccag

SEQ ID NO: 155405 - DNA, 30 bp, Artificial Sequence
  Description of Artificial Sequence: Synthetic oligonucleotide
gtacacggaacttccaagtgctgagtccag

SEQ ID NO: 155406 - DNA, 32 bp, Artificial Sequence
  Description of Artificial Sequence: Synthetic oligonucleotide
tacacggaacttccaagtgctgagtccagatc

SEQ ID NO: 155407 - DNA, 31 bp, Artificial Sequence
  Description of Artificial Sequence: Synthetic oligonucleotide
acacggaacttccaagtgctgagtccagatc

SEQ ID NO: 155408 - DNA, 30 bp, Artificial Sequence
  Description of Artificial Sequence: Synthetic oligonucleotide
cacggaacttccaagtgctgagtccagatc

SEQ ID NO: 155409 - DNA, 30 bp, Artificial Sequence
  Description of Artificial Sequence: Synthetic oligonucleotide
acggaacttccaagtgctgagtccagatcc

SEQ ID NO: 155410 - DNA, 29 bp, Artificial Sequence
  Description of Artificial Sequence: Synthetic oligonucleotide
cggaacttccaagtgctgagtccagatcc

SEQ ID NO: 155411 - DNA, 32 bp, Artificial Sequence
  Description of Artificial Sequence: Synthetic oligonucleotide
ggaacttccaagtgctgagtccagatccaaag

SEQ ID NO: 155412 - DNA, 34 bp, Artificial Sequence
  Description of Artificial Sequence: Synthetic oligonucleotide
gaacttccaagtgctgagtccagatccaaagttg

SEQ ID NO: 155413 - DNA, 35 bp, Artificial Sequence
  Description of Artificial Sequence: Synthetic oligonucleotide
aacttccaagtgctgagtccagatccaaagttgtc

SEQ ID NO: 155414 - DNA, 34 bp, Artificial Sequence
  Description of Artificial Sequence: Synthetic oligonucleotide
acttccaagtgctgagtccagatccaaagttgtc

SEQ ID NO: 155415 - DNA, 33 bp, Artificial Sequence
  Description of Artificial Sequence: Synthetic oligonucleotide
cttccaagtgctgagtccagatccaaagttgtc

SEQ ID NO: 155416 - DNA, 34 bp, Artificial Sequence
  Description of Artificial Sequence: Synthetic oligonucleotide
ttccaagtgctgagtccagatccaaagttgtctc

SEQ ID NO: 155417 - DNA, 33 bp, Artificial Sequence
  Description of Artificial Sequence: Synthetic oligonucleotide
tccaagtgctgagtccagatccaaagttgtctc

SEQ ID NO: 155418 - DNA, 32 bp, Artificial Sequence
  Description of Artificial Sequence: Synthetic oligonucleotide
ccaagtgctgagtccagatccaaagttgtctc

SEQ ID NO: 155419 - DNA, 32 bp, Artificial Sequence
  Description of Artificial Sequence: Synthetic oligonucleotide
caagtgctgagtccagatccaaagttgtctcc

SEQ ID NO: 155420 - DNA, 33 bp, Artificial Sequence
  Description of Artificial Sequence: Synthetic oligonucleotide
aagtgctgagtccagatccaaagttgtctcctg

SEQ ID NO: 155421 - DNA, 32 bp, Artificial Sequence
  Description of Artificial Sequence: Synthetic oligonucleotide
agtgctgagtccagatccaaagttgtctcctg

SEQ ID NO: 155422 - DNA, 31 bp, Artificial Sequence
  Description of Artificial Sequence: Synthetic oligonucleotide
gtgctgagtccagatccaaagttgtctcctg

SEQ ID NO: 155423 - DNA, 34 bp, Artificial Sequence
  Description of Artificial Sequence: Synthetic oligonucleotide
agaagagacagtcatcctgcaatgttggtcagac

SEQ ID NO: 155424 - DNA, 33 bp, Artificial Sequence
  Description of Artificial Sequence: Synthetic oligonucleotide
gaagagacagtcatcctgcaatgttggtcagac

SEQ ID NO: 155425 - DNA, 33 bp, Artificial Sequence
  Description of Artificial Sequence: Synthetic oligonucleotide
aagagacagtcatcctgcaatgttggtcagacg

SEQ ID NO: 155426 - DNA, 32 bp, Artificial Sequence
  Description of Artificial Sequence: Synthetic oligonucleotide
agagacagtcatcctgcaatgttggtcagacg

SEQ ID NO: 155427 - DNA, 31 bp, Artificial Sequence
  Description of Artificial Sequence: Synthetic oligonucleotide
gagacagtcatcctgcaatgttggtcagacg

SEQ ID NO: 155428 - DNA, 32 bp, Artificial Sequence
  Description of Artificial Sequence: Synthetic oligonucleotide
agacagtcatcctgcaatgttggtcagacgtc

SEQ ID NO: 155429 - DNA, 31 bp, Artificial Sequence
  Description of Artificial Sequence: Synthetic oligonucleotide
gacagtcatcctgcaatgttggtcagacgtc

SEQ ID NO: 155430 - DNA, 32 bp, Artificial Sequence
  Description of Artificial Sequence: Synthetic oligonucleotide
acagtcatcctgcaatgttggtcagacgtcag

SEQ ID NO: 155431 - DNA, 31 bp, Artificial Sequence
  Description of Artificial Sequence: Synthetic oligonucleotide
cagtcatcctgcaatgttggtcagacgtcag

SEQ ID NO: 155432 - DNA, 31 bp, Artificial Sequence
  Description of Artificial Sequence: Synthetic oligonucleotide
agtcatcctgcaatgttggtcagacgtcagg

SEQ ID NO: 155433 - DNA, 30 bp, Artificial Sequence
  Description of Artificial Sequence: Synthetic oligonucleotide
gtcatcctgcaatgttggtcagacgtcagg

SEQ ID NO: 155434 - DNA, 33 bp, Artificial Sequence
  Description of Artificial Sequence: Synthetic oligonucleotide
tcatcctgcaatgttggtcagacgtcaggtttg

SEQ ID NO: 155435 - DNA, 32 bp, Artificial Sequence
  Description of Artificial Sequence: Synthetic oligonucleotide
catcctgcaatgttggtcagacgtcaggtttg

SEQ ID NO: 155436 - DNA, 33 bp, Artificial Sequence
  Description of Artificial Sequence: Synthetic oligonucleotide
atcctgcaatgttggtcagacgtcaggtttgag

SEQ ID NO: 155437 - DNA, 32 bp, Artificial Sequence
  Description of Artificial Sequence: Synthetic oligonucleotide
tcctgcaatgttggtcagacgtcaggtttgag

SEQ ID NO: 155438 - DNA, 31 bp, Artificial Sequence
  Description of Artificial Sequence: Synthetic oligonucleotide
cctgcaatgttggtcagacgtcaggtttgag

SEQ ID NO: 155439 - DNA, 31 bp, Artificial Sequence
  Description of Artificial Sequence: Synthetic oligonucleotide
ctgcaatgttggtcagacgtcaggtttgagc

SEQ ID NO: 155440 - DNA, 32 bp, Artificial Sequence
  Description of Artificial Sequence: Synthetic oligonucleotide
tgcaatgttggtcagacgtcaggtttgagcac

SEQ ID NO: 155441 - DNA, 31 bp, Artificial Sequence
  Description of Artificial Sequence: Synthetic oligonucleotide
gcaatgttggtcagacgtcaggtttgagcac

SEQ ID NO: 155442 - DNA, 33 bp, Artificial Sequence
  Description of Artificial Sequence: Synthetic oligonucleotide
caatgttggtcagacgtcaggtttgagcacttc

SEQ ID NO: 155443 - DNA, 33 bp, Artificial Sequence
  Description of Artificial Sequence: Synthetic oligonucleotide
aatgttggtcagacgtcaggtttgagcacttcc

SEQ ID NO: 155444 - DNA, 32 bp, Artificial Sequence
  Description of Artificial Sequence: Synthetic oligonucleotide
atgttggtcagacgtcaggtttgagcacttcc

SEQ ID NO: 155445 - DNA, 31 bp, Artificial Sequence
  Description of Artificial Sequence: Synthetic oligonucleotide
tgttggtcagacgtcaggtttgagcacttcc

SEQ ID NO: 155446 - DNA, 30 bp, Artificial Sequence
  Description of Artificial Sequence: Synthetic oligonucleotide
gttggtcagacgtcaggtttgagcacttcc

SEQ ID NO: 155447 - DNA, 32 bp, Artificial Sequence
  Description of Artificial Sequence: Synthetic oligonucleotide
ttggtcagacgtcaggtttgagcacttccttc

SEQ ID NO: 155448 - DNA, 31 bp, Artificial Sequence
  Description of Artificial Sequence: Synthetic oligonucleotide
tggtcagacgtcaggtttgagcacttccttc

SEQ ID NO: 155449 - DNA, 30 bp, Artificial Sequence
  Description of Artificial Sequence: Synthetic oligonucleotide
ggtcagacgtcaggtttgagcacttccttc

SEQ ID NO: 155450 - DNA, 31 bp, Artificial Sequence
  Description of Artificial Sequence: Synthetic oligonucleotide
gtcagacgtcaggtttgagcacttccttctg

SEQ ID NO: 155451 - DNA, 31 bp, Artificial Sequence
  Description of Artificial Sequence: Synthetic oligonucleotide
tcagacgtcaggtttgagcacttccttctgc

SEQ ID NO: 155452 - DNA, 30 bp, Artificial Sequence
  Description of Artificial Sequence: Synthetic oligonucleotide
cagacgtcaggtttgagcacttccttctgc

SEQ ID NO: 155453 - DNA, 31 bp, Artificial Sequence
  Description of Artificial Sequence: Synthetic oligonucleotide
agacgtcaggtttgagcacttccttctgcac

SEQ ID NO: 155454 - DNA, 30 bp, Artificial Sequence
  Description of Artificial Sequence: Synthetic oligonucleotide
gacgtcaggtttgagcacttccttctgcac

SEQ ID NO: 155455 - DNA, 31 bp, Artificial Sequence
  Description of Artificial Sequence: Synthetic oligonucleotide
acgtcaggtttgagcacttccttctgcacag

SEQ ID NO: 155456 - DNA, 30 bp, Artificial Sequence
  Description of Artificial Sequence: Synthetic oligonucleotide
cgtcaggtttgagcacttccttctgcacag

SEQ ID NO: 155457 - DNA, 29 bp, Artificial Sequence
  Description of Artificial Sequence: Synthetic oligonucleotide
ctgcacattctgattgggacctcagtggc

SEQ ID NO: 155458 - DNA, 29 bp, Artificial Sequence
  Description of Artificial Sequence: Synthetic oligonucleotide
tgcacattctgattgggacctcagtggcc

SEQ ID NO: 155459 - DNA, 28 bp, Artificial Sequence
  Description of Artificial Sequence: Synthetic oligonucleotide
gcacattctgattgggacctcagtggcc

SEQ ID NO: 155460 - DNA, 30 bp, Artificial Sequence
  Description of Artificial Sequence: Synthetic oligonucleotide
cacattctgattgggacctcagtggccatc

SEQ ID NO: 155461 - DNA, 32 bp, Artificial Sequence
  Description of Artificial Sequence: Synthetic oligonucleotide
acattctgattgggacctcagtggccatcatc

SEQ ID NO: 155462 - DNA, 31 bp, Artificial Sequence
  Description of Artificial Sequence: Synthetic oligonucleotide
cattctgattgggacctcagtggccatcatc

SEQ ID NO: 155463 - DNA, 31 bp, Artificial Sequence
  Description of Artificial Sequence: Synthetic oligonucleotide
attctgattgggacctcagtggccatcatcc

SEQ ID NO: 155464 - DNA, 30 bp, Artificial Sequence
  Description of Artificial Sequence: Synthetic oligonucleotide
ttctgattgggacctcagtggccatcatcc

SEQ ID NO: 155465 - DNA, 29 bp, Artificial Sequence
  Description of Artificial Sequence: Synthetic oligonucleotide
tctgattgggacctcagtggccatcatcc

SEQ ID NO: 155466 - DNA, 28 bp, Artificial Sequence
  Description of Artificial Sequence: Synthetic oligonucleotide
ctgattgggacctcagtggccatcatcc

SEQ ID NO: 155467 - DNA, 29 bp, Artificial Sequence
  Description of Artificial Sequence: Synthetic oligonucleotide
tgattgggacctcagtggccatcatcctc

SEQ ID NO: 155468 - DNA, 28 bp, Artificial Sequence
  Description of Artificial Sequence: Synthetic oligonucleotide
gattgggacctcagtggccatcatcctc

SEQ ID NO: 155469 - DNA, 30 bp, Artificial Sequence
  Description of Artificial Sequence: Synthetic oligonucleotide
attgggacctcagtggccatcatcctcttc

SEQ ID NO: 155470 - DNA, 29 bp, Artificial Sequence
  Description of Artificial Sequence: Synthetic oligonucleotide
ttgggacctcagtggccatcatcctcttc

SEQ ID NO: 155471 - DNA, 28 bp, Artificial Sequence
  Description of Artificial Sequence: Synthetic oligonucleotide
tgggacctcagtggccatcatcctcttc

SEQ ID NO: 155472 - DNA, 27 bp, Artificial Sequence
  Description of Artificial Sequence: Synthetic oligonucleotide
gggacctcagtggccatcatcctcttc

SEQ ID NO: 155473 - DNA, 29 bp, Artificial Sequence
  Description of Artificial Sequence: Synthetic oligonucleotide
ggacctcagtggccatcatcctcttcatc

SEQ ID NO: 155474 - DNA, 29 bp, Artificial Sequence
  Description of Artificial Sequence: Synthetic oligonucleotide
gacctcagtggccatcatcctcttcatcc

SEQ ID NO: 155475 - DNA, 30 bp, Artificial Sequence
  Description of Artificial Sequence: Synthetic oligonucleotide
acctcagtggccatcatcctcttcatcctc

SEQ ID NO: 155476 - DNA, 29 bp, Artificial Sequence
  Description of Artificial Sequence: Synthetic oligonucleotide
cctcagtggccatcatcctcttcatcctc

SEQ ID NO: 155477 - DNA, 29 bp, Artificial Sequence
  Description of Artificial Sequence: Synthetic oligonucleotide
ctcagtggccatcatcctcttcatcctcc

SEQ ID NO: 155478 - DNA, 30 bp, Artificial Sequence
  Description of Artificial Sequence: Synthetic oligonucleotide
tcagtggccatcatcctcttcatcctcctc

SEQ ID NO: 155479 - DNA, 29 bp, Artificial Sequence
  Description of Artificial Sequence: Synthetic oligonucleotide
cagtggccatcatcctcttcatcctcctc

SEQ ID NO: 155480 - DNA, 31 bp, Artificial Sequence
  Description of Artificial Sequence: Synthetic oligonucleotide
agtggccatcatcctcttcatcctcctcttc

SEQ ID NO: 155481 - DNA, 30 bp, Artificial Sequence
  Description of Artificial Sequence: Synthetic oligonucleotide
gtggccatcatcctcttcatcctcctcttc

SEQ ID NO: 155482 - DNA, 33 bp, Artificial Sequence
  Description of Artificial Sequence: Synthetic oligonucleotide
tggccatcatcctcttcatcctcctcttctttc

SEQ ID NO: 155483 - DNA, 32 bp, Artificial Sequence
  Description of Artificial Sequence: Synthetic oligonucleotide
ggccatcatcctcttcatcctcctcttctttc

SEQ ID NO: 155484 - DNA, 33 bp, Artificial Sequence
  Description of Artificial Sequence: Synthetic oligonucleotide
gccatcatcctcttcatcctcctcttctttctc

SEQ ID NO: 155485 - DNA, 33 bp, Artificial Sequence
  Description of Artificial Sequence: Synthetic oligonucleotide
ccatcatcctcttcatcctcctcttctttctcc

SEQ ID NO: 155486 - DNA, 26 bp, Artificial Sequence
  Description of Artificial Sequence: Synthetic oligonucleotide
tatccagggagggggaggcccatgaa

SEQ ID NO: 155487 - DNA, 25 bp, Artificial Sequence
  Description of Artificial Sequence: Synthetic oligonucleotide
atccagggagggggaggcccatgaa

SEQ ID NO: 155488 - DNA, 24 bp, Artificial Sequence
  Description of Artificial Sequence: Synthetic oligonucleotide
tccagggagggggaggcccatgaa

SEQ ID NO: 155489 - DNA, 23 bp, Artificial Sequence
  Description of Artificial Sequence: Synthetic oligonucleotide
ccagggagggggaggcccatgaa

SEQ ID NO: 155490 - DNA, 23 bp, Artificial Sequence
  Description of Artificial Sequence: Synthetic oligonucleotide
cagggagggggaggcccatgaac

SEQ ID NO: 155491 - DNA, 25 bp, Artificial Sequence
  Description of Artificial Sequence: Synthetic oligonucleotide
agggagggggaggcccatgaacgta

SEQ ID NO: 155492 - DNA, 24 bp, Artificial Sequence
  Description of Artificial Sequence: Synthetic oligonucleotide
gggagggggaggcccatgaacgta

SEQ ID NO: 155493 - DNA, 24 bp, Artificial Sequence
  Description of Artificial Sequence: Synthetic oligonucleotide
ggagggggaggcccatgaacgtag

SEQ ID NO: 155494 - DNA, 26 bp, Artificial Sequence
  Description of Artificial Sequence: Synthetic oligonucleotide
gagggggaggcccatgaacgtaggtt

SEQ ID NO: 155495 - DNA, 27 bp, Artificial Sequence
  Description of Artificial Sequence: Synthetic oligonucleotide
agggggaggcccatgaacgtaggttct

SEQ ID NO: 155496 - DNA, 26 bp, Artificial Sequence
  Description of Artificial Sequence: Synthetic oligonucleotide
gggggaggcccatgaacgtaggttct

SEQ ID NO: 155497 - DNA, 27 bp, Artificial Sequence
  Description of Artificial Sequence: Synthetic oligonucleotide
ggggaggcccatgaacgtaggttctct

SEQ ID NO: 155498 - DNA, 27 bp, Artificial Sequence
  Description of Artificial Sequence: Synthetic oligonucleotide
gggaggcccatgaacgtaggttctctg

SEQ ID NO: 155499 - DNA, 27 bp, Artificial Sequence
  Description of Artificial Sequence: Synthetic oligonucleotide
ggaggcccatgaacgtaggttctctgc

SEQ ID NO: 155500 - DNA, 28 bp, Artificial Sequence
  Description of Artificial Sequence: Synthetic oligonucleotide
gaggcccatgaacgtaggttctctgcag

SEQ ID NO: 155501 - DNA, 28 bp, Artificial Sequence
  Description of Artificial Sequence: Synthetic oligonucleotide
aggcccatgaacgtaggttctctgcagg

SEQ ID NO: 155502 - DNA, 27 bp, Artificial Sequence
  Description of Artificial Sequence: Synthetic oligonucleotide
ggcccatgaacgtaggttctctgcagg

SEQ ID NO: 155503 - DNA, 27 bp, Artificial Sequence
  Description of Artificial Sequence: Synthetic oligonucleotide
gcccatgaacgtaggttctctgcaggg

SEQ ID NO: 155504 - DNA, 27 bp, Artificial Sequence
  Description of Artificial Sequence: Synthetic oligonucleotide
cccatgaacgtaggttctctgcagggc

SEQ ID NO: 155505 - DNA, 27 bp, Artificial Sequence
  Description of Artificial Sequence: Synthetic oligonucleotide
ccatgaacgtaggttctctgcagggcc

SEQ ID NO: 155506 - DNA, 27 bp, Artificial Sequence
  Description of Artificial Sequence: Synthetic oligonucleotide
catgaacgtaggttctctgcagggccc

SEQ ID NO: 155507 - DNA, 29 bp, Artificial Sequence
  Description of Artificial Sequence: Synthetic oligonucleotide
atgaacgtaggttctctgcagggcccaag

SEQ ID NO: 155508 - DNA, 28 bp, Artificial Sequence
  Description of Artificial Sequence: Synthetic oligonucleotide
tgaacgtaggttctctgcagggcccaag

SEQ ID NO: 155509 - DNA, 27 bp, Artificial Sequence
  Description of Artificial Sequence: Synthetic oligonucleotide
gaacgtaggttctctgcagggcccaag

SEQ ID NO: 155510 - DNA, 27 bp, Artificial Sequence
  Description of Artificial Sequence: Synthetic oligonucleotide
aacgtaggttctctgcagggcccaagg

SEQ ID NO: 155511 - DNA, 27 bp, Artificial Sequence
  Description of Artificial Sequence: Synthetic oligonucleotide
acgtaggttctctgcagggcccaaggt

SEQ ID NO: 155512 - DNA, 26 bp, Artificial Sequence
  Description of Artificial Sequence: Synthetic oligonucleotide
cgtaggttctctgcagggcccaaggt

SEQ ID NO: 155513 - DNA, 35 bp, Artificial Sequence
  Description of Artificial Sequence: Synthetic oligonucleotide
aggaaacagaacagcgaatagcgaggactcttatg

SEQ ID NO: 155514 - DNA, 34 bp, Artificial Sequence
  Description of Artificial Sequence: Synthetic oligonucleotide
ggaaacagaacagcgaatagcgaggactcttatg

SEQ ID NO: 155515 - DNA, 36 bp, Artificial Sequence
  Description of Artificial Sequence: Synthetic oligonucleotide
gaaacagaacagcgaatagcgaggactcttatgaac

SEQ ID NO: 155516 - DNA, 38 bp, Artificial Sequence
  Description of Artificial Sequence: Synthetic oligonucleotide
aaacagaacagcgaatagcgaggactcttatgaacaag

SEQ ID NO: 155517 - DNA, 37 bp, Artificial Sequence
  Description of Artificial Sequence: Synthetic oligonucleotide
aacagaacagcgaatagcgaggactcttatgaacaag

SEQ ID NO: 155518 - DNA, 36 bp, Artificial Sequence
  Description of Artificial Sequence: Synthetic oligonucleotide
acagaacagcgaatagcgaggactcttatgaacaag

SEQ ID NO: 155519 - DNA, 35 bp, Artificial Sequence
  Description of Artificial Sequence: Synthetic oligonucleotide
cagaacagcgaatagcgaggactcttatgaacaag

SEQ ID NO: 155520 - DNA, 36 bp, Artificial Sequence
  Description of Artificial Sequence: Synthetic oligonucleotide
agaacagcgaatagcgaggactcttatgaacaagac

SEQ ID NO: 155521 - DNA, 35 bp, Artificial Sequence
  Description of Artificial Sequence: Synthetic oligonucleotide
gaacagcgaatagcgaggactcttatgaacaagac

SEQ ID NO: 155522 - DNA, 35 bp, Artificial Sequence
  Description of Artificial Sequence: Synthetic oligonucleotide
aacagcgaatagcgaggactcttatgaacaagacc

SEQ ID NO: 155523 - DNA, 34 bp, Artificial Sequence
  Description of Artificial Sequence: Synthetic oligonucleotide
acagcgaatagcgaggactcttatgaacaagacc

SEQ ID NO: 155524 - DNA, 33 bp, Artificial Sequence
  Description of Artificial Sequence: Synthetic oligonucleotide
cagcgaatagcgaggactcttatgaacaagacc

SEQ ID NO: 155525 - DNA, 33 bp, Artificial Sequence
  Description of Artificial Sequence: Synthetic oligonucleotide
agcgaatagcgaggactcttatgaacaagaccc

SEQ ID NO: 155526 - DNA, 32 bp, Artificial Sequence
  Description of Artificial Sequence: Synthetic oligonucleotide
gcgaatagcgaggactcttatgaacaagaccc

SEQ ID NO: 155527 - DNA, 33 bp, Artificial Sequence
  Description of Artificial Sequence: Synthetic oligonucleotide
cgaatagcgaggactcttatgaacaagaccctc

SEQ ID NO: 155528 - DNA, 34 bp, Artificial Sequence
  Description of Artificial Sequence: Synthetic oligonucleotide
gaatagcgaggactcttatgaacaagaccctcag

SEQ ID NO: 155529 - DNA, 34 bp, Artificial Sequence
  Description of Artificial Sequence: Synthetic oligonucleotide
aatagcgaggactcttatgaacaagaccctcagg

SEQ ID NO: 155530 - DNA, 33 bp, Artificial Sequence
  Description of Artificial Sequence: Synthetic oligonucleotide
atagcgaggactcttatgaacaagaccctcagg

SEQ ID NO: 155531 - DNA, 32 bp, Artificial Sequence
  Description of Artificial Sequence: Synthetic oligonucleotide
tagcgaggactcttatgaacaagaccctcagg

SEQ ID NO: 155532 - DNA, 31 bp, Artificial Sequence
  Description of Artificial Sequence: Synthetic oligonucleotide
agcgaggactcttatgaacaagaccctcagg

SEQ ID NO: 155533 - DNA, 30 bp, Artificial Sequence
  Description of Artificial Sequence: Synthetic oligonucleotide
gcgaggactcttatgaacaagaccctcagg

SEQ ID NO: 155534 - DNA, 31 bp, Artificial Sequence
  Description of Artificial Sequence: Synthetic oligonucleotide
cgaggactcttatgaacaagaccctcaggag

SEQ ID NO: 155535 - DNA, 31 bp, Artificial Sequence
  Description of Artificial Sequence: Synthetic oligonucleotide
gaggactcttatgaacaagaccctcaggagg

SEQ ID NO: 155536 - DNA, 32 bp, Artificial Sequence
  Description of Artificial Sequence: Synthetic oligonucleotide
aggactcttatgaacaagaccctcaggaggtg

SEQ ID NO: 155537 - DNA, 31 bp, Artificial Sequence
  Description of Artificial Sequence: Synthetic oligonucleotide
ggactcttatgaacaagaccctcaggaggtg

SEQ ID NO: 155538 - DNA, 32 bp, Artificial Sequence
  Description of Artificial Sequence: Synthetic oligonucleotide
gactcttatgaacaagaccctcaggaggtgac

SEQ ID NO: 155539 - DNA, 35 bp, Artificial Sequence
  Description of Artificial Sequence: Synthetic oligonucleotide
actcttatgaacaagaccctcaggaggtgacatac

SEQ ID NO: 155540 - DNA, 34 bp, Artificial Sequence
  Description of Artificial Sequence: Synthetic oligonucleotide
ctcttatgaacaagaccctcaggaggtgacatac

SEQ ID NO: 155541 - DNA, 35 bp, Artificial Sequence
  Description of Artificial Sequence: Synthetic oligonucleotide
tcttatgaacaagaccctcaggaggtgacatacac

SEQ ID NO: 155542 - DNA, 34 bp, Artificial Sequence
  Description of Artificial Sequence: Synthetic oligonucleotide
cttatgaacaagaccctcaggaggtgacatacac

SEQ ID NO: 155543 - DNA, 35 bp, Artificial Sequence
  Description of Artificial Sequence: Synthetic oligonucleotide
ttatgaacaagaccctcaggaggtgacatacacac

SEQ ID NO: 155544 - DNA, 34 bp, Artificial Sequence
  Description of Artificial Sequence: Synthetic oligonucleotide
tatgaacaagaccctcaggaggtgacatacacac

SEQ ID NO: 155545 - DNA, 29 bp, Artificial Sequence
  Description of Artificial Sequence: Synthetic oligonucleotide
atgtcgctcatggtcgtcagcatggtgtg

SEQ ID NO: 155546 - DNA, 28 bp, Artificial Sequence
  Description of Artificial Sequence: Synthetic oligonucleotide
tgtcgctcatggtcgtcagcatggtgtg

SEQ ID NO: 155547 - DNA, 27 bp, Artificial Sequence
  Description of Artificial Sequence: Synthetic oligonucleotide
gtcgctcatggtcgtcagcatggtgtg

SEQ ID NO: 155548 - DNA, 28 bp, Artificial Sequence
  Description of Artificial Sequence: Synthetic oligonucleotide
tcgctcatggtcgtcagcatggtgtgtg

SEQ ID NO: 155549 - DNA, 27 bp, Artificial Sequence
  Description of Artificial Sequence: Synthetic oligonucleotide
cgctcatggtcgtcagcatggtgtgtg

SEQ ID NO: 155550 - DNA, 29 bp, Artificial Sequence
  Description of Artificial Sequence: Synthetic oligonucleotide
gctcatggtcgtcagcatggtgtgtgttg

SEQ ID NO: 155551 - DNA, 29 bp, Artificial Sequence
  Description of Artificial Sequence: Synthetic oligonucleotide
ctcatggtcgtcagcatggtgtgtgttgg

SEQ ID NO: 155552 - DNA, 29 bp, Artificial Sequence
  Description of Artificial Sequence: Synthetic oligonucleotide
tcatggtcgtcagcatggtgtgtgttggg

SEQ ID NO: 155553 - DNA, 28 bp, Artificial Sequence
  Description of Artificial Sequence: Synthetic oligonucleotide
catggtcgtcagcatggtgtgtgttggg

SEQ ID NO: 155554 - DNA, 30 bp, Artificial Sequence
  Description of Artificial Sequence: Synthetic oligonucleotide
atggtcgtcagcatggtgtgtgttgggttc

SEQ ID NO: 155555 - DNA, 29 bp, Artificial Sequence
  Description of Artificial Sequence: Synthetic oligonucleotide
tggtcgtcagcatggtgtgtgttgggttc

SEQ ID NO: 155556 - DNA, 28 bp, Artificial Sequence
  Description of Artificial Sequence: Synthetic oligonucleotide
ggtcgtcagcatggtgtgtgttgggttc

SEQ ID NO: 155557 - DNA, 30 bp, Artificial Sequence
  Description of Artificial Sequence: Synthetic oligonucleotide
gtcgtcagcatggtgtgtgttgggttcttc

SEQ ID NO: 155558 - DNA, 32 bp, Artificial Sequence
  Description of Artificial Sequence: Synthetic oligonucleotide
tcgtcagcatggtgtgtgttgggttcttcttg

SEQ ID NO: 155559 - DNA, 31 bp, Artificial Sequence
  Description of Artificial Sequence: Synthetic oligonucleotide
cgtcagcatggtgtgtgttgggttcttcttg

SEQ ID NO: 155560 - DNA, 31 bp, Artificial Sequence
  Description of Artificial Sequence: Synthetic oligonucleotide
gtcagcatggtgtgtgttgggttcttcttgc

SEQ ID NO: 155561 - DNA, 32 bp, Artificial Sequence
  Description of Artificial Sequence: Synthetic oligonucleotide
tcagcatggtgtgtgttgggttcttcttgctg

SEQ ID NO: 155562 - DNA, 31 bp, Artificial Sequence
  Description of Artificial Sequence: Synthetic oligonucleotide
cagcatggtgtgtgttgggttcttcttgctg

SEQ ID NO: 155563 - DNA, 31 bp, Artificial Sequence
  Description of Artificial Sequence: Synthetic oligonucleotide
agcatggtgtgtgttgggttcttcttgctgc

SEQ ID NO: 155564 - DNA, 30 bp, Artificial Sequence
  Description of Artificial Sequence: Synthetic oligonucleotide
gcatggtgtgtgttgggttcttcttgctgc

SEQ ID NO: 155565 - DNA, 31 bp, Artificial Sequence
  Description of Artificial Sequence: Synthetic oligonucleotide
catggtgtgtgttgggttcttcttgctgcag

SEQ ID NO: 155566 - DNA, 31 bp, Artificial Sequence
  Description of Artificial Sequence: Synthetic oligonucleotide
atggtgtgtgttgggttcttcttgctgcagg

SEQ ID NO: 155567 - DNA, 30 bp, Artificial Sequence
  Description of Artificial Sequence: Synthetic oligonucleotide
tggtgtgtgttgggttcttcttgctgcagg

SEQ ID NO: 155568 - DNA, 29 bp, Artificial Sequence
  Description of Artificial Sequence: Synthetic oligonucleotide
ggtgtgtgttgggttcttcttgctgcagg

SEQ ID NO: 155569 - DNA, 29 bp, Artificial Sequence
  Description of Artificial Sequence: Synthetic oligonucleotide
gtgtgtgttgggttcttcttgctgcaggg

SEQ ID NO: 155570 - DNA, 29 bp, Artificial Sequence
  Description of Artificial Sequence: Synthetic oligonucleotide
tgtgtgttgggttcttcttgctgcagggg

SEQ ID NO: 155571 - DNA, 33 bp, Artificial Sequence
  Description of Artificial Sequence: Synthetic oligonucleotide
agatgtcaggtttcagcacttccttctgcacag

SEQ ID NO: 155572 - DNA, 32 bp, Artificial Sequence
  Description of Artificial Sequence: Synthetic oligonucleotide
gatgtcaggtttcagcacttccttctgcacag

SEQ ID NO: 155573 - DNA, 33 bp, Artificial Sequence
  Description of Artificial Sequence: Synthetic oligonucleotide
atgtcaggtttcagcacttccttctgcacagag

SEQ ID NO: 155574 - DNA, 32 bp, Artificial Sequence
  Description of Artificial Sequence: Synthetic oligonucleotide
tgtcaggtttcagcacttccttctgcacagag

SEQ ID NO: 155575 - DNA, 31 bp, Artificial Sequence
  Description of Artificial Sequence: Synthetic oligonucleotide
gtcaggtttcagcacttccttctgcacagag

SEQ ID NO: 155576 - DNA, 33 bp, Artificial Sequence
  Description of Artificial Sequence: Synthetic oligonucleotide
tcaggtttcagcacttccttctgcacagagaag

SEQ ID NO: 155577 - DNA, 32 bp, Artificial Sequence
  Description of Artificial Sequence: Synthetic oligonucleotide
caggtttcagcacttccttctgcacagagaag

SEQ ID NO: 155578 - DNA, 32 bp, Artificial Sequence
  Description of Artificial Sequence: Synthetic oligonucleotide
aggtttcagcacttccttctgcacagagaagg

SEQ ID NO: 155579 - DNA, 31 bp, Artificial Sequence
  Description of Artificial Sequence: Synthetic oligonucleotide
ggtttcagcacttccttctgcacagagaagg

SEQ ID NO: 155580 - DNA, 31 bp, Artificial Sequence
  Description of Artificial Sequence: Synthetic oligonucleotide
gtttcagcacttccttctgcacagagaaggg

SEQ ID NO: 155581 - DNA, 33 bp, Artificial Sequence
  Description of Artificial Sequence: Synthetic oligonucleotide
tttcagcacttccttctgcacagagaagggaag

SEQ ID NO: 155582 - DNA, 32 bp, Artificial Sequence
  Description of Artificial Sequence: Synthetic oligonucleotide
ttcagcacttccttctgcacagagaagggaag

SEQ ID NO: 155583 - DNA, 31 bp, Artificial Sequence
  Description of Artificial Sequence: Synthetic oligonucleotide
tcagcacttccttctgcacagagaagggaag

SEQ ID NO: 155584 - DNA, 30 bp, Artificial Sequence
  Description of Artificial Sequence: Synthetic oligonucleotide
cagcacttccttctgcacagagaagggaag

SEQ ID NO: 155585 - DNA, 28 bp, Artificial Sequence
  Description of Artificial Sequence: Synthetic oligonucleotide
gaaaccggtaaccccagacacctgcatg

SEQ ID NO: 155586 - DNA, 30 bp, Artificial Sequence
  Description of Artificial Sequence: Synthetic oligonucleotide
aaaccggtaaccccagacacctgcatgttc

SEQ ID NO: 155587 - DNA, 29 bp, Artificial Sequence
  Description of Artificial Sequence: Synthetic oligonucleotide
aaccggtaaccccagacacctgcatgttc

SEQ ID NO: 155588 - DNA, 28 bp, Artificial Sequence
  Description of Artificial Sequence: Synthetic oligonucleotide
accggtaaccccagacacctgcatgttc

SEQ ID NO: 155589 - DNA, 27 bp, Artificial Sequence
  Description of Artificial Sequence: Synthetic oligonucleotide
ccggtaaccccagacacctgcatgttc

SEQ ID NO: 155590 - DNA, 28 bp, Artificial Sequence
  Description of Artificial Sequence: Synthetic oligonucleotide
cggtaaccccagacacctgcatgttctg

SEQ ID NO: 155591 - DNA, 31 bp, Artificial Sequence
  Description of Artificial Sequence: Synthetic oligonucleotide
ggtaaccccagacacctgcatgttctgattg

SEQ ID NO: 155592 - DNA, 31 bp, Artificial Sequence
  Description of Artificial Sequence: Synthetic oligonucleotide
gtaaccccagacacctgcatgttctgattgg

SEQ ID NO: 155593 - DNA, 31 bp, Artificial Sequence
  Description of Artificial Sequence: Synthetic oligonucleotide
taaccccagacacctgcatgttctgattggg

SEQ ID NO: 155594 - DNA, 30 bp, Artificial Sequence
  Description of Artificial Sequence: Synthetic oligonucleotide
aaccccagacacctgcatgttctgattggg

SEQ ID NO: 155595 - DNA, 29 bp, Artificial Sequence
  Description of Artificial Sequence: Synthetic oligonucleotide
accccagacacctgcatgttctgattggg

SEQ ID NO: 155596 - DNA, 28 bp, Artificial Sequence
  Description of Artificial Sequence: Synthetic oligonucleotide
ccccagacacctgcatgttctgattggg

SEQ ID NO: 155597 - DNA, 29 bp, Artificial Sequence
  Description of Artificial Sequence: Synthetic oligonucleotide
cccagacacctgcatgttctgattgggac

SEQ ID NO: 155598 - DNA, 29 bp, Artificial Sequence
  Description of Artificial Sequence: Synthetic oligonucleotide
ccagacacctgcatgttctgattgggacc

SEQ ID NO: 155599 - DNA, 30 bp, Artificial Sequence
  Description of Artificial Sequence: Synthetic oligonucleotide
cagacacctgcatgttctgattgggacctc

SEQ ID NO: 155600 - DNA, 31 bp, Artificial Sequence
  Description of Artificial Sequence: Synthetic oligonucleotide
agacacctgcatgttctgattgggacctcag

SEQ ID NO: 155601 - DNA, 30 bp, Artificial Sequence
  Description of Artificial Sequence: Synthetic oligonucleotide
gacacctgcatgttctgattgggacctcag

SEQ ID NO: 155602 - DNA, 31 bp, Artificial Sequence
  Description of Artificial Sequence: Synthetic oligonucleotide
acacctgcatgttctgattgggacctcagtg

SEQ ID NO: 155603 - DNA, 30 bp, Artificial Sequence
  Description of Artificial Sequence: Synthetic oligonucleotide
cacctgcatgttctgattgggacctcagtg

SEQ ID NO: 155604 - DNA, 30 bp, Artificial Sequence
  Description of Artificial Sequence: Synthetic oligonucleotide
acctgcatgttctgattgggacctcagtgg

SEQ ID NO: 155605 - DNA, 29 bp, Artificial Sequence
  Description of Artificial Sequence: Synthetic oligonucleotide
cctgcatgttctgattgggacctcagtgg

SEQ ID NO: 155606 - DNA, 30 bp, Artificial Sequence
  Description of Artificial Sequence: Synthetic oligonucleotide
ctgcatgttctgattgggacctcagtggtc

SEQ ID NO: 155607 - DNA, 32 bp, Artificial Sequence
  Description of Artificial Sequence: Synthetic oligonucleotide
tgcatgttctgattgggacctcagtggtcatc

SEQ ID NO: 155608 - DNA, 31 bp, Artificial Sequence
  Description of Artificial Sequence: Synthetic oligonucleotide
gcatgttctgattgggacctcagtggtcatc

SEQ ID NO: 155609 - DNA, 33 bp, Artificial Sequence
  Description of Artificial Sequence: Synthetic oligonucleotide
catgttctgattgggacctcagtggtcatcatc

SEQ ID NO: 155610 - DNA, 33 bp, Artificial Sequence
  Description of Artificial Sequence: Synthetic oligonucleotide
atgttctgattgggacctcagtggtcatcatcc

SEQ ID NO: 155611 - DNA, 32 bp, Artificial Sequence
  Description of Artificial Sequence: Synthetic oligonucleotide
tgttctgattgggacctcagtggtcatcatcc

SEQ ID NO: 155612 - DNA, 31 bp, Artificial Sequence
  Description of Artificial Sequence: Synthetic oligonucleotide
gttctgattgggacctcagtggtcatcatcc

SEQ ID NO: 155613 - DNA, 31 bp, Artificial Sequence
  Description of Artificial Sequence: Synthetic oligonucleotide
tcagtggtcatcatcctcttcatcctcctcc

SEQ ID NO: 155614 - DNA, 30 bp, Artificial Sequence
  Description of Artificial Sequence: Synthetic oligonucleotide
cagtggtcatcatcctcttcatcctcctcc

SEQ ID NO: 155615 - DNA, 31 bp, Artificial Sequence
  Description of Artificial Sequence: Synthetic oligonucleotide
agtggtcatcatcctcttcatcctcctcctc

SEQ ID NO: 155616 - DNA, 30 bp, Artificial Sequence
  Description of Artificial Sequence: Synthetic oligonucleotide
gtggtcatcatcctcttcatcctcctcctc

SEQ ID NO: 155617 - DNA, 32 bp, Artificial Sequence
  Description of Artificial Sequence: Synthetic oligonucleotide
tggtcatcatcctcttcatcctcctcctcttc

SEQ ID NO: 155618 - DNA, 31 bp, Artificial Sequence
  Description of Artificial Sequence: Synthetic oligonucleotide
ggtcatcatcctcttcatcctcctcctcttc

SEQ ID NO: 155619 - DNA, 34 bp, Artificial Sequence
  Description of Artificial Sequence: Synthetic oligonucleotide
gtcatcatcctcttcatcctcctcctcttctttc

SEQ ID NO: 155620 - DNA, 35 bp, Artificial Sequence
  Description of Artificial Sequence: Synthetic oligonucleotide
tcatcatcctcttcatcctcctcctcttctttctc

SEQ ID NO: 155621 - DNA, 34 bp, Artificial Sequence
  Description of Artificial Sequence: Synthetic oligonucleotide
catcatcctcttcatcctcctcctcttctttctc

SEQ ID NO: 155622 - DNA, 34 bp, Artificial Sequence
  Description of Artificial Sequence: Synthetic oligonucleotide
atcatcctcttcatcctcctcctcttctttctcc

SEQ ID NO: 155623 - DNA, 33 bp, Artificial Sequence
  Description of Artificial Sequence: Synthetic oligonucleotide
tcatcctcttcatcctcctcctcttctttctcc

SEQ ID NO: 155624 - DNA, 32 bp, Artificial Sequence
  Description of Artificial Sequence: Synthetic oligonucleotide
catcctcttcatcctcctcctcttctttctcc

SEQ ID NO: 155625 - DNA, 34 bp, Artificial Sequence
  Description of Artificial Sequence: Synthetic oligonucleotide
atcctcttcatcctcctcctcttctttctccttc

SEQ ID NO: 155626 - DNA, 33 bp, Artificial Sequence
  Description of Artificial Sequence: Synthetic oligonucleotide
tcctcttcatcctcctcctcttctttctccttc

SEQ ID NO: 155627 - DNA, 32 bp, Artificial Sequence
  Description of Artificial Sequence: Synthetic oligonucleotide
cctcttcatcctcctcctcttctttctccttc

SEQ ID NO: 155628 - DNA, 34 bp, Artificial Sequence
  Description of Artificial Sequence: Synthetic oligonucleotide
ctcttcatcctcctcctcttctttctccttcatc

SEQ ID NO: 155629 - DNA, 34 bp, Artificial Sequence
  Description of Artificial Sequence: Synthetic oligonucleotide
tcttcatcctcctcctcttctttctccttcatcg

SEQ ID NO: 155630 - DNA, 33 bp, Artificial Sequence
  Description of Artificial Sequence: Synthetic oligonucleotide
cttcatcctcctcctcttctttctccttcatcg

SEQ ID NO: 155631 - DNA, 33 bp, Artificial Sequence
  Description of Artificial Sequence: Synthetic oligonucleotide
ttcatcctcctcctcttctttctccttcatcgc

SEQ ID NO: 155632 - DNA, 32 bp, Artificial Sequence
  Description of Artificial Sequence: Synthetic oligonucleotide
tcatcctcctcctcttctttctccttcatcgc

SEQ ID NO: 155633 - DNA, 31 bp, Artificial Sequence
  Description of Artificial Sequence: Synthetic oligonucleotide
catcctcctcctcttctttctccttcatcgc

SEQ ID NO: 155634 - DNA, 32 bp, Artificial Sequence
  Description of Artificial Sequence: Synthetic oligonucleotide
atcctcctcctcttctttctccttcatcgctg

SEQ ID NO: 155635 - DNA, 31 bp, Artificial Sequence
  Description of Artificial Sequence: Synthetic oligonucleotide
tcctcctcctcttctttctccttcatcgctg

SEQ ID NO: 155636 - DNA, 30 bp, Artificial Sequence
  Description of Artificial Sequence: Synthetic oligonucleotide
cctcctcctcttctttctccttcatcgctg

SEQ ID NO: 155637 - DNA, 30 bp, Artificial Sequence
  Description of Artificial Sequence: Synthetic oligonucleotide
ctcctcctcttctttctccttcatcgctgg

SEQ ID NO: 155638 - DNA, 31 bp, Artificial Sequence
  Description of Artificial Sequence: Synthetic oligonucleotide
tcctcttctttctccttcatcgctggtgctg

SEQ ID NO: 155639 - DNA, 30 bp, Artificial Sequence
  Description of Artificial Sequence: Synthetic oligonucleotide
cctcttctttctccttcatcgctggtgctg

SEQ ID NO: 155640 - DNA, 30 bp, Artificial Sequence
  Description of Artificial Sequence: Synthetic oligonucleotide
ctcttctttctccttcatcgctggtgctgc

SEQ ID NO: 155641 - DNA, 32 bp, Artificial Sequence
  Description of Artificial Sequence: Synthetic oligonucleotide
tcttctttctccttcatcgctggtgctgcaac

SEQ ID NO: 155642 - DNA, 31 bp, Artificial Sequence
  Description of Artificial Sequence: Synthetic oligonucleotide
cttctttctccttcatcgctggtgctgcaac

SEQ ID NO: 155643 - DNA, 40 bp, Artificial Sequence
  Description of Artificial Sequence: Synthetic oligonucleotide
ttctttctccttcatcgctggtgctgcaacaaaaaaaatg

SEQ ID NO: 155644 - DNA, 39 bp, Artificial Sequence
  Description of Artificial Sequence: Synthetic oligonucleotide
tctttctccttcatcgctggtgctgcaacaaaaaaaatg

SEQ ID NO: 155645 - DNA, 38 bp, Artificial Sequence
  Description of Artificial Sequence: Synthetic oligonucleotide
ctttctccttcatcgctggtgctgcaacaaaaaaaatg

SEQ ID NO: 155646 - DNA, 38 bp, Artificial Sequence
  Description of Artificial Sequence: Synthetic oligonucleotide
tttctccttcatcgctggtgctgcaacaaaaaaaatgc

SEQ ID NO: 155647 - DNA, 37 bp, Artificial Sequence
  Description of Artificial Sequence: Synthetic oligonucleotide
ttctccttcatcgctggtgctgcaacaaaaaaaatgc

SEQ ID NO: 155648 - DNA, 36 bp, Artificial Sequence
  Description of Artificial Sequence: Synthetic oligonucleotide
tctccttcatcgctggtgctgcaacaaaaaaaatgc

SEQ ID NO: 155649 - DNA, 35 bp, Artificial Sequence
  Description of Artificial Sequence: Synthetic oligonucleotide
ctccttcatcgctggtgctgcaacaaaaaaaatgc

SEQ ID NO: 155650 - DNA, 36 bp, Artificial Sequence
  Description of Artificial Sequence: Synthetic oligonucleotide
tccttcatcgctggtgctgcaacaaaaaaaatgctg

SEQ ID NO: 155651 - DNA, 35 bp, Artificial Sequence
  Description of Artificial Sequence: Synthetic oligonucleotide
ccttcatcgctggtgctgcaacaaaaaaaatgctg

SEQ ID NO: 155652 - DNA, 37 bp, Artificial Sequence
  Description of Artificial Sequence: Synthetic oligonucleotide
cttcatcgctggtgctgcaacaaaaaaaatgctgttg

SEQ ID NO: 155653 - DNA, 41 bp, Artificial Sequence
  Description of Artificial Sequence: Synthetic oligonucleotide
ttcatcgctggtgctgcaacaaaaaaaatgctgttgtaatg

SEQ ID NO: 155654 - DNA, 40 bp, Artificial Sequence
  Description of Artificial Sequence: Synthetic oligonucleotide
tcatcgctggtgctgcaacaaaaaaaatgctgttgtaatg

SEQ ID NO: 155655 - DNA, 39 bp, Artificial Sequence
  Description of Artificial Sequence: Synthetic oligonucleotide
catcgctggtgctgcaacaaaaaaaatgctgttgtaatg

SEQ ID NO: 155656 - DNA, 39 bp, Artificial Sequence
  Description of Artificial Sequence: Synthetic oligonucleotide
atcgctggtgctgcaacaaaaaaaatgctgttgtaatgg

SEQ ID NO: 155657 - DNA, 38 bp, Artificial Sequence
  Description of Artificial Sequence: Synthetic oligonucleotide
tcgctggtgctgcaacaaaaaaaatgctgttgtaatgg

SEQ ID NO: 155658 - DNA, 37 bp, Artificial Sequence
  Description of Artificial Sequence: Synthetic oligonucleotide
cgctggtgctgcaacaaaaaaaatgctgttgtaatgg

SEQ ID NO: 155659 - DNA, 38 bp, Artificial Sequence
  Description of Artificial Sequence: Synthetic oligonucleotide
gctggtgctgcaacaaaaaaaatgctgttgtaatggac

SEQ ID NO: 155660 - DNA, 38 bp, Artificial Sequence
  Description of Artificial Sequence: Synthetic oligonucleotide
ctggtgctgcaacaaaaaaaatgctgttgtaatggacc

SEQ ID NO: 155661 - DNA, 40 bp, Artificial Sequence
  Description of Artificial Sequence: Synthetic oligonucleotide
tggtgctgcaacaaaaaaaatgctgttgtaatggaccaag

SEQ ID NO: 155662 - DNA, 39 bp, Artificial Sequence
  Description of Artificial Sequence: Synthetic oligonucleotide
ggtgctgcaacaaaaaaaatgctgttgtaatggaccaag

SEQ ID NO: 155663 - DNA, 40 bp, Artificial Sequence
  Description of Artificial Sequence: Synthetic oligonucleotide
gtgctgcaacaaaaaaaatgctgttgtaatggaccaagag

SEQ ID NO: 155664 - DNA, 40 bp, Artificial Sequence
  Description of Artificial Sequence: Synthetic oligonucleotide
tgctgcaacaaaaaaaatgctgttgtaatggaccaagagc

SEQ ID NO: 155665 - DNA, 39 bp, Artificial Sequence
  Description of Artificial Sequence: Synthetic oligonucleotide
gctgcaacaaaaaaaatgctgttgtaatggaccaagagc

SEQ ID NO: 155666 - DNA, 39 bp, Artificial Sequence
  Description of Artificial Sequence: Synthetic oligonucleotide
ctgcaacaaaaaaaatgctgttgtaatggaccaagagcc

SEQ ID NO: 155667 - DNA, 40 bp, Artificial Sequence
  Description of Artificial Sequence: Synthetic oligonucleotide
tgcaacaaaaaaaatgctgttgtaatggaccaagagcctg

SEQ ID NO: 155668 - DNA, 39 bp, Artificial Sequence
  Description of Artificial Sequence: Synthetic oligonucleotide
gcaacaaaaaaaatgctgttgtaatggaccaagagcctg

SEQ ID NO: 155669 - DNA, 39 bp, Artificial Sequence
  Description of Artificial Sequence: Synthetic oligonucleotide
caacaaaaaaaatgctgttgtaatggaccaagagcctgc

SEQ ID NO: 155670 - DNA, 40 bp, Artificial Sequence
  Description of Artificial Sequence: Synthetic oligonucleotide
aacaaaaaaaatgctgttgtaatggaccaagagcctgcag

SEQ ID NO: 155671 - DNA, 39 bp, Artificial Sequence
  Description of Artificial Sequence: Synthetic oligonucleotide
acaaaaaaaatgctgttgtaatggaccaagagcctgcag

SEQ ID NO: 155672 - DNA, 38 bp, Artificial Sequence
  Description of Artificial Sequence: Synthetic oligonucleotide
caaaaaaaatgctgttgtaatggaccaagagcctgcag

SEQ ID NO: 155673 - DNA, 38 bp, Artificial Sequence
  Description of Artificial Sequence: Synthetic oligonucleotide
aaaaaaaatgctgttgtaatggaccaagagcctgcagg

SEQ ID NO: 155674 - DNA, 37 bp, Artificial Sequence
  Description of Artificial Sequence: Synthetic oligonucleotide
aaaaaaatgctgttgtaatggaccaagagcctgcagg

SEQ ID NO: 155675 - DNA, 36 bp, Artificial Sequence
  Description of Artificial Sequence: Synthetic oligonucleotide
aaaaaatgctgttgtaatggaccaagagcctgcagg

SEQ ID NO: 155676 - DNA, 35 bp, Artificial Sequence
  Description of Artificial Sequence: Synthetic oligonucleotide
aaaaatgctgttgtaatggaccaagagcctgcagg

SEQ ID NO: 155677 - DNA, 34 bp, Artificial Sequence
  Description of Artificial Sequence: Synthetic oligonucleotide
aaaatgctgttgtaatggaccaagagcctgcagg

SEQ ID NO: 155678 - DNA, 33 bp, Artificial Sequence
  Description of Artificial Sequence: Synthetic oligonucleotide
aaatgctgttgtaatggaccaagagcctgcagg

SEQ ID NO: 155679 - DNA, 32 bp, Artificial Sequence
  Description of Artificial Sequence: Synthetic oligonucleotide
aatgctgttgtaatggaccaagagcctgcagg

SEQ ID NO: 155680 - DNA, 31 bp, Artificial Sequence
  Description of Artificial Sequence: Synthetic oligonucleotide
atgctgttgtaatggaccaagagcctgcagg

SEQ ID NO: 155681 - DNA, 30 bp, Artificial Sequence
  Description of Artificial Sequence: Synthetic oligonucleotide
tgctgttgtaatggaccaagagcctgcagg

SEQ ID NO: 155682 - DNA, 29 bp, Artificial Sequence
  Description of Artificial Sequence: Synthetic oligonucleotide
gctgttgtaatggaccaagagcctgcagg

SEQ ID NO: 155683 - DNA, 29 bp, Artificial Sequence
  Description of Artificial Sequence: Synthetic oligonucleotide
ctgttgtaatggaccaagagcctgcaggg

SEQ ID NO: 155684 - DNA, 31 bp, Artificial Sequence
  Description of Artificial Sequence: Synthetic oligonucleotide
tgttgtaatggaccaagagcctgcagggaac

SEQ ID NO: 155685 - DNA, 30 bp, Artificial Sequence
  Description of Artificial Sequence: Synthetic oligonucleotide
gttgtaatggaccaagagcctgcagggaac

SEQ ID NO: 155686 - DNA, 31 bp, Artificial Sequence
  Description of Artificial Sequence: Synthetic oligonucleotide
ttgtaatggaccaagagcctgcagggaacag

SEQ ID NO: 155687 - DNA, 30 bp, Artificial Sequence
  Description of Artificial Sequence: Synthetic oligonucleotide
tgtaatggaccaagagcctgcagggaacag

SEQ ID NO: 155688 - DNA, 29 bp, Artificial Sequence
  Description of Artificial Sequence: Synthetic oligonucleotide
gtaatggaccaagagcctgcagggaacag

SEQ ID NO: 155689 - DNA, 31 bp, Artificial Sequence
  Description of Artificial Sequence: Synthetic oligonucleotide
taatggaccaagagcctgcagggaacagaac

SEQ ID NO: 155690 - DNA, 30 bp, Artificial Sequence
  Description of Artificial Sequence: Synthetic oligonucleotide
aatggaccaagagcctgcagggaacagaac

SEQ ID NO: 155691 - DNA, 29 bp, Artificial Sequence
  Description of Artificial Sequence: Synthetic oligonucleotide
atggaccaagagcctgcagggaacagaac

SEQ ID NO: 155692 - DNA, 28 bp, Artificial Sequence
  Description of Artificial Sequence: Synthetic oligonucleotide
tggaccaagagcctgcagggaacagaac

SEQ ID NO: 155693 - DNA, 27 bp, Artificial Sequence
  Description of Artificial Sequence: Synthetic oligonucleotide
ggaccaagagcctgcagggaacagaac

SEQ ID NO: 155694 - DNA, 28 bp, Artificial Sequence
  Description of Artificial Sequence: Synthetic oligonucleotide
gaccaagagcctgcagggaacagaacag

SEQ ID NO: 155695 - DNA, 29 bp, Artificial Sequence
  Description of Artificial Sequence: Synthetic oligonucleotide
accaagagcctgcagggaacagaacagtg

SEQ ID NO: 155696 - DNA, 28 bp, Artificial Sequence
  Description of Artificial Sequence: Synthetic oligonucleotide
ccaagagcctgcagggaacagaacagtg

SEQ ID NO: 155697 - DNA, 30 bp, Artificial Sequence
  Description of Artificial Sequence: Synthetic oligonucleotide
caagagcctgcagggaacagaacagtgaac

SEQ ID NO: 155698 - DNA, 31 bp, Artificial Sequence
  Description of Artificial Sequence: Synthetic oligonucleotide
aagagcctgcagggaacagaacagtgaacag

SEQ ID NO: 155699 - DNA, 30 bp, Artificial Sequence
  Description of Artificial Sequence: Synthetic oligonucleotide
agagcctgcagggaacagaacagtgaacag

SEQ ID NO: 155700 - DNA, 29 bp, Artificial Sequence
  Description of Artificial Sequence: Synthetic oligonucleotide
gagcctgcagggaacagaacagtgaacag

SEQ ID NO: 155701 - DNA, 29 bp, Artificial Sequence
  Description of Artificial Sequence: Synthetic oligonucleotide
agcctgcagggaacagaacagtgaacagg

SEQ ID NO: 155702 - DNA, 28 bp, Artificial Sequence
  Description of Artificial Sequence: Synthetic oligonucleotide
gcctgcagggaacagaacagtgaacagg

SEQ ID NO: 155703 - DNA, 28 bp, Artificial Sequence
  Description of Artificial Sequence: Synthetic oligonucleotide
cctgcagggaacagaacagtgaacaggg

SEQ ID NO: 155704 - DNA, 29 bp, Artificial Sequence
  Description of Artificial Sequence: Synthetic oligonucleotide
ctgcagggaacagaacagtgaacagggag

SEQ ID NO: 155705 - DNA, 29 bp, Artificial Sequence
  Description of Artificial Sequence: Synthetic oligonucleotide
tgcagggaacagaacagtgaacagggagg

SEQ ID NO: 155706 - DNA, 28 bp, Artificial Sequence
  Description of Artificial Sequence: Synthetic oligonucleotide
gcagggaacagaacagtgaacagggagg

SEQ ID NO: 155707 - DNA, 29 bp, Artificial Sequence
  Description of Artificial Sequence: Synthetic oligonucleotide
cagggaacagaacagtgaacagggaggac

SEQ ID NO: 155708 - DNA, 30 bp, Artificial Sequence
  Description of Artificial Sequence: Synthetic oligonucleotide
agggaacagaacagtgaacagggaggactc

SEQ ID NO: 155709 - DNA, 29 bp, Artificial Sequence
  Description of Artificial Sequence: Synthetic oligonucleotide
gggaacagaacagtgaacagggaggactc

SEQ ID NO: 155710 - DNA, 30 bp, Artificial Sequence
  Description of Artificial Sequence: Synthetic oligonucleotide
ggaacagaacagtgaacagggaggactctg

SEQ ID NO: 155711 - DNA, 32 bp, Artificial Sequence
  Description of Artificial Sequence: Synthetic oligonucleotide
gaacagaacagtgaacagggaggactctgatg

SEQ ID NO: 155712 - DNA, 34 bp, Artificial Sequence
  Description of Artificial Sequence: Synthetic oligonucleotide
aacagaacagtgaacagggaggactctgatgaac

SEQ ID NO: 155713 - DNA, 33 bp, Artificial Sequence
  Description of Artificial Sequence: Synthetic oligonucleotide
acagaacagtgaacagggaggactctgatgaac

SEQ ID NO: 155714 - DNA, 32 bp, Artificial Sequence
  Description of Artificial Sequence: Synthetic oligonucleotide
cagaacagtgaacagggaggactctgatgaac

SEQ ID NO: 155715 - DNA, 34 bp, Artificial Sequence
  Description of Artificial Sequence: Synthetic oligonucleotide
agaacagtgaacagggaggactctgatgaacaag

SEQ ID NO: 155716 - DNA, 33 bp, Artificial Sequence
  Description of Artificial Sequence: Synthetic oligonucleotide
gaacagtgaacagggaggactctgatgaacaag

SEQ ID NO: 155717 - DNA, 34 bp, Artificial Sequence
  Description of Artificial Sequence: Synthetic oligonucleotide
aacagtgaacagggaggactctgatgaacaagac

SEQ ID NO: 155718 - DNA, 33 bp, Artificial Sequence
  Description of Artificial Sequence: Synthetic oligonucleotide
acagtgaacagggaggactctgatgaacaagac

SEQ ID NO: 155719 - DNA, 32 bp, Artificial Sequence
  Description of Artificial Sequence: Synthetic oligonucleotide
cagtgaacagggaggactctgatgaacaagac

SEQ ID NO: 155720 - DNA, 32 bp, Artificial Sequence
  Description of Artificial Sequence: Synthetic oligonucleotide
agtgaacagggaggactctgatgaacaagacc

SEQ ID NO: 155721 - DNA, 31 bp, Artificial Sequence
  Description of Artificial Sequence: Synthetic oligonucleotide
gtgaacagggaggactctgatgaacaagacc

SEQ ID NO: 155722 - DNA, 31 bp, Artificial Sequence
  Description of Artificial Sequence: Synthetic oligonucleotide
tgaacagggaggactctgatgaacaagaccc

SEQ ID NO: 155723 - DNA, 30 bp, Artificial Sequence
  Description of Artificial Sequence: Synthetic oligonucleotide
gaacagggaggactctgatgaacaagaccc

SEQ ID NO: 155724 - DNA, 31 bp, Artificial Sequence
  Description of Artificial Sequence: Synthetic oligonucleotide
aacagggaggactctgatgaacaagaccctc

SEQ ID NO: 155725 - DNA, 30 bp, Artificial Sequence
  Description of Artificial Sequence: Synthetic oligonucleotide
acagggaggactctgatgaacaagaccctc

SEQ ID NO: 155726 - DNA, 29 bp, Artificial Sequence
  Description of Artificial Sequence: Synthetic oligonucleotide
cagggaggactctgatgaacaagaccctc

SEQ ID NO: 155727 - DNA, 30 bp, Artificial Sequence
  Description of Artificial Sequence: Synthetic oligonucleotide
agggaggactctgatgaacaagaccctcag

SEQ ID NO: 155728 - DNA, 29 bp, Artificial Sequence
  Description of Artificial Sequence: Synthetic oligonucleotide
gggaggactctgatgaacaagaccctcag

SEQ ID NO: 155729 - DNA, 29 bp, Artificial Sequence
  Description of Artificial Sequence: Synthetic oligonucleotide
ggaggactctgatgaacaagaccctcagg

SEQ ID NO: 155730 - DNA, 34 bp, Artificial Sequence
  Description of Artificial Sequence: Synthetic oligonucleotide
tctgatgaacaagaccctcaggaggtgacatatg

SEQ ID NO: 155731 - DNA, 33 bp, Artificial Sequence
  Description of Artificial Sequence: Synthetic oligonucleotide
ctgatgaacaagaccctcaggaggtgacatatg

SEQ ID NO: 155732 - DNA, 33 bp, Artificial Sequence
  Description of Artificial Sequence: Synthetic oligonucleotide
tgatgaacaagaccctcaggaggtgacatatgc

SEQ ID NO: 155733 - DNA, 32 bp, Artificial Sequence
  Description of Artificial Sequence: Synthetic oligonucleotide
gatgaacaagaccctcaggaggtgacatatgc

SEQ ID NO: 155734 - DNA, 33 bp, Artificial Sequence
  Description of Artificial Sequence: Synthetic oligonucleotide
atgaacaagaccctcaggaggtgacatatgcac

SEQ ID NO: 155735 - DNA, 32 bp, Artificial Sequence
  Description of Artificial Sequence: Synthetic oligonucleotide
tgaacaagaccctcaggaggtgacatatgcac

SEQ ID NO: 155736 - DNA, 31 bp, Artificial Sequence
  Description of Artificial Sequence: Synthetic oligonucleotide
gaacaagaccctcaggaggtgacatatgcac

SEQ ID NO: 155737 - DNA, 32 bp, Artificial Sequence
  Description of Artificial Sequence: Synthetic oligonucleotide
aacaagaccctcaggaggtgacatatgcacag

SEQ ID NO: 155738 - DNA, 31 bp, Artificial Sequence
  Description of Artificial Sequence: Synthetic oligonucleotide
acaagaccctcaggaggtgacatatgcacag

SEQ ID NO: 155739 - DNA, 30 bp, Artificial Sequence
  Description of Artificial Sequence: Synthetic oligonucleotide
caagaccctcaggaggtgacatatgcacag

SEQ ID NO: 155740 - DNA, 32 bp, Artificial Sequence
  Description of Artificial Sequence: Synthetic oligonucleotide
aagaccctcaggaggtgacatatgcacagttg

SEQ ID NO: 155741 - DNA, 31 bp, Artificial Sequence
  Description of Artificial Sequence: Synthetic oligonucleotide
agaccctcaggaggtgacatatgcacagttg

SEQ ID NO: 155742 - DNA, 30 bp, Artificial Sequence
  Description of Artificial Sequence: Synthetic oligonucleotide
gaccctcaggaggtgacatatgcacagttg

SEQ ID NO: 155743 - DNA, 33 bp, Artificial Sequence
  Description of Artificial Sequence: Synthetic oligonucleotide
accctcaggaggtgacatatgcacagttgaatc

SEQ ID NO: 155744 - DNA, 32 bp, Artificial Sequence
  Description of Artificial Sequence: Synthetic oligonucleotide
ccctcaggaggtgacatatgcacagttgaatc

SEQ ID NO: 155745 - DNA, 33 bp, Artificial Sequence
  Description of Artificial Sequence: Synthetic oligonucleotide
cctcaggaggtgacatatgcacagttgaatcac

SEQ ID NO: 155746 - DNA, 34 bp, Artificial Sequence
  Description of Artificial Sequence: Synthetic oligonucleotide
ctcaggaggtgacatatgcacagttgaatcactg

SEQ ID NO: 155747 - DNA, 34 bp, Artificial Sequence
  Description of Artificial Sequence: Synthetic oligonucleotide
tcaggaggtgacatatgcacagttgaatcactgc

SEQ ID NO: 155748 - DNA, 33 bp, Artificial Sequence
  Description of Artificial Sequence: Synthetic oligonucleotide
caggaggtgacatatgcacagttgaatcactgc

SEQ ID NO: 155749 - DNA, 33 bp, Artificial Sequence
  Description of Artificial Sequence: Synthetic oligonucleotide
aggaggtgacatatgcacagttgaatcactgcg

SEQ ID NO: 155750 - DNA, 32 bp, Artificial Sequence
  Description of Artificial Sequence: Synthetic oligonucleotide
ggaggtgacatatgcacagttgaatcactgcg

SEQ ID NO: 155751 - DNA, 36 bp, Artificial Sequence
  Description of Artificial Sequence: Synthetic oligonucleotide
gaggtgacatatgcacagttgaatcactgcgttttc

SEQ ID NO: 155752 - DNA, 37 bp, Artificial Sequence
  Description of Artificial Sequence: Synthetic oligonucleotide
aggtgacatatgcacagttgaatcactgcgttttcac

SEQ ID NO: 155753 - DNA, 36 bp, Artificial Sequence
  Description of Artificial Sequence: Synthetic oligonucleotide
ggtgacatatgcacagttgaatcactgcgttttcac

SEQ ID NO: 155754 - DNA, 37 bp, Artificial Sequence
  Description of Artificial Sequence: Synthetic oligonucleotide
gtgacatatgcacagttgaatcactgcgttttcacac

SEQ ID NO: 155755 - DNA, 38 bp, Artificial Sequence
  Description of Artificial Sequence: Synthetic oligonucleotide
tgacatatgcacagttgaatcactgcgttttcacacag

SEQ ID NO: 155756 - DNA, 37 bp, Artificial Sequence
  Description of Artificial Sequence: Synthetic oligonucleotide
gacatatgcacagttgaatcactgcgttttcacacag

SEQ ID NO: 155757 - DNA, 38 bp, Artificial Sequence
  Description of Artificial Sequence: Synthetic oligonucleotide
acatatgcacagttgaatcactgcgttttcacacagag

SEQ ID NO: 155758 - DNA, 37 bp, Artificial Sequence
  Description of Artificial Sequence: Synthetic oligonucleotide
catatgcacagttgaatcactgcgttttcacacagag

SEQ ID NO: 155759 - DNA, 43 bp, Artificial Sequence
  Description of Artificial Sequence: Synthetic oligonucleotide
atatgcacagttgaatcactgcgttttcacacagagaaaaatc

SEQ ID NO: 155760 - DNA, 42 bp, Artificial Sequence
  Description of Artificial Sequence: Synthetic oligonucleotide
tatgcacagttgaatcactgcgttttcacacagagaaaaatc

SEQ ID NO: 155761 - DNA, 41 bp, Artificial Sequence
  Description of Artificial Sequence: Synthetic oligonucleotide
atgcacagttgaatcactgcgttttcacacagagaaaaatc

SEQ ID NO: 155762 - DNA, 40 bp, Artificial Sequence
  Description of Artificial Sequence: Synthetic oligonucleotide
tgcacagttgaatcactgcgttttcacacagagaaaaatc

SEQ ID NO: 155763 - DNA, 39 bp, Artificial Sequence
  Description of Artificial Sequence: Synthetic oligonucleotide
gcacagttgaatcactgcgttttcacacagagaaaaatc

SEQ ID NO: 155764 - DNA, 36 bp, Artificial Sequence
  Description of Artificial Sequence: Synthetic oligonucleotide
atatcatcgtgtacacggaacttccaaatgctgagc

SEQ ID NO: 155765 - DNA, 35 bp, Artificial Sequence
  Description of Artificial Sequence: Synthetic oligonucleotide
tatcatcgtgtacacggaacttccaaatgctgagc

SEQ ID NO: 155766 - DNA, 34 bp, Artificial Sequence
  Description of Artificial Sequence: Synthetic oligonucleotide
atcatcgtgtacacggaacttccaaatgctgagc

SEQ ID NO: 155767 - DNA, 33 bp, Artificial Sequence
  Description of Artificial Sequence: Synthetic oligonucleotide
tcatcgtgtacacggaacttccaaatgctgagc

SEQ ID NO: 155768 - DNA, 32 bp, Artificial Sequence
  Description of Artificial Sequence: Synthetic oligonucleotide
catcgtgtacacggaacttccaaatgctgagc

SEQ ID NO: 155769 - DNA, 32 bp, Artificial Sequence
  Description of Artificial Sequence: Synthetic oligonucleotide
atcgtgtacacggaacttccaaatgctgagcc

SEQ ID NO: 155770 - DNA, 31 bp, Artificial Sequence
  Description of Artificial Sequence: Synthetic oligonucleotide
tcgtgtacacggaacttccaaatgctgagcc

SEQ ID NO: 155771 - DNA, 30 bp, Artificial Sequence
  Description of Artificial Sequence: Synthetic oligonucleotide
cgtgtacacggaacttccaaatgctgagcc

SEQ ID NO: 155772 - DNA, 30 bp, Artificial Sequence
  Description of Artificial Sequence: Synthetic oligonucleotide
gtgtacacggaacttccaaatgctgagccc

SEQ ID NO: 155773 - DNA, 31 bp, Artificial Sequence
  Description of Artificial Sequence: Synthetic oligonucleotide
tgtacacggaacttccaaatgctgagccctg

SEQ ID NO: 155774 - DNA, 30 bp, Artificial Sequence
  Description of Artificial Sequence: Synthetic oligonucleotide
gtacacggaacttccaaatgctgagccctg

SEQ ID NO: 155775 - DNA, 33 bp, Artificial Sequence
  Description of Artificial Sequence: Synthetic oligonucleotide
ttcatcctcctcctcttctttctccttcatcgg

SEQ ID NO: 155776 - DNA, 32 bp, Artificial Sequence
  Description of Artificial Sequence: Synthetic oligonucleotide
tcatcctcctcctcttctttctccttcatcgg

SEQ ID NO: 155777 - DNA, 31 bp, Artificial Sequence
  Description of Artificial Sequence: Synthetic oligonucleotide
catcctcctcctcttctttctccttcatcgg

SEQ ID NO: 155778 - DNA, 32 bp, Artificial Sequence
  Description of Artificial Sequence: Synthetic oligonucleotide
atcctcctcctcttctttctccttcatcggtg

SEQ ID NO: 155779 - DNA, 31 bp, Artificial Sequence
  Description of Artificial Sequence: Synthetic oligonucleotide
tcctcctcctcttctttctccttcatcggtg

SEQ ID NO: 155780 - DNA, 30 bp, Artificial Sequence
  Description of Artificial Sequence: Synthetic oligonucleotide
cctcctcctcttctttctccttcatcggtg

SEQ ID NO: 155781 - DNA, 30 bp, Artificial Sequence
  Description of Artificial Sequence: Synthetic oligonucleotide
ctcctcctcttctttctccttcatcggtgg

SEQ ID NO: 155782 - DNA, 31 bp, Artificial Sequence
  Description of Artificial Sequence: Synthetic oligonucleotide
tcctcctcttctttctccttcatcggtggtg

SEQ ID NO: 155783 - DNA, 30 bp, Artificial Sequence
  Description of Artificial Sequence: Synthetic oligonucleotide
cctcctcttctttctccttcatcggtggtg

SEQ ID NO: 155784 - DNA, 30 bp, Artificial Sequence
  Description of Artificial Sequence: Synthetic oligonucleotide
ctcctcttctttctccttcatcggtggtgc

SEQ ID NO: 155785 - DNA, 31 bp, Artificial Sequence
  Description of Artificial Sequence: Synthetic oligonucleotide
tcctcttctttctccttcatcggtggtgctg

SEQ ID NO: 155786 - DNA, 30 bp, Artificial Sequence
  Description of Artificial Sequence: Synthetic oligonucleotide
cctcttctttctccttcatcggtggtgctg

SEQ ID NO: 155787 - DNA, 30 bp, Artificial Sequence
  Description of Artificial Sequence: Synthetic oligonucleotide
ctcttctttctccttcatcggtggtgctgc

SEQ ID NO: 155788 - DNA, 32 bp, Artificial Sequence
  Description of Artificial Sequence: Synthetic oligonucleotide
tcttctttctccttcatcggtggtgctgcaac

SEQ ID NO: 155789 - DNA, 31 bp, Artificial Sequence
  Description of Artificial Sequence: Synthetic oligonucleotide
cttctttctccttcatcggtggtgctgcaac

SEQ ID NO: 155790 - DNA, 40 bp, Artificial Sequence
  Description of Artificial Sequence: Synthetic oligonucleotide
ttctttctccttcatcggtggtgctgcaacaaaaaaaatg

SEQ ID NO: 155791 - DNA, 39 bp, Artificial Sequence
  Description of Artificial Sequence: Synthetic oligonucleotide
tctttctccttcatcggtggtgctgcaacaaaaaaaatg

SEQ ID NO: 155792 - DNA, 38 bp, Artificial Sequence
  Description of Artificial Sequence: Synthetic oligonucleotide
ctttctccttcatcggtggtgctgcaacaaaaaaaatg

SEQ ID NO: 155793 - DNA, 38 bp, Artificial Sequence
  Description of Artificial Sequence: Synthetic oligonucleotide
tttctccttcatcggtggtgctgcaacaaaaaaaatgc

SEQ ID NO: 155794 - DNA, 37 bp, Artificial Sequence
  Description of Artificial Sequence: Synthetic oligonucleotide
ttctccttcatcggtggtgctgcaacaaaaaaaatgc

SEQ ID NO: 155795 - DNA, 36 bp, Artificial Sequence
  Description of Artificial Sequence: Synthetic oligonucleotide
tctccttcatcggtggtgctgcaacaaaaaaaatgc

SEQ ID NO: 155796 - DNA, 35 bp, Artificial Sequence
  Description of Artificial Sequence: Synthetic oligonucleotide
ctccttcatcggtggtgctgcaacaaaaaaaatgc

SEQ ID NO: 155797 - DNA, 36 bp, Artificial Sequence
  Description of Artificial Sequence: Synthetic oligonucleotide
tccttcatcggtggtgctgcaacaaaaaaaatgctg

SEQ ID NO: 155798 - DNA, 35 bp, Artificial Sequence
  Description of Artificial Sequence: Synthetic oligonucleotide
ccttcatcggtggtgctgcaacaaaaaaaatgctg

SEQ ID NO: 155799 - DNA, 37 bp, Artificial Sequence
  Description of Artificial Sequence: Synthetic oligonucleotide
cttcatcggtggtgctgcaacaaaaaaaatgctgttg

SEQ ID NO: 155800 - DNA, 41 bp, Artificial Sequence
  Description of Artificial Sequence: Synthetic oligonucleotide
ttcatcggtggtgctgcaacaaaaaaaatgctgttgtaatg

SEQ ID NO: 155801 - DNA, 40 bp, Artificial Sequence
  Description of Artificial Sequence: Synthetic oligonucleotide
tcatcggtggtgctgcaacaaaaaaaatgctgttgtaatg

SEQ ID NO: 155802 - DNA, 39 bp, Artificial Sequence
  Description of Artificial Sequence: Synthetic oligonucleotide
catcggtggtgctgcaacaaaaaaaatgctgttgtaatg

SEQ ID NO: 155803 - DNA, 39 bp, Artificial Sequence
  Description of Artificial Sequence: Synthetic oligonucleotide
atcggtggtgctgcaacaaaaaaaatgctgttgtaatgg

SEQ ID NO: 155804 - DNA, 38 bp, Artificial Sequence
  Description of Artificial Sequence: Synthetic oligonucleotide
tcggtggtgctgcaacaaaaaaaatgctgttgtaatgg

SEQ ID NO: 155805 - DNA, 37 bp, Artificial Sequence
  Description of Artificial Sequence: Synthetic oligonucleotide
cggtggtgctgcaacaaaaaaaatgctgttgtaatgg

SEQ ID NO: 155806 - DNA, 38 bp, Artificial Sequence
  Description of Artificial Sequence: Synthetic oligonucleotide
ggtggtgctgcaacaaaaaaaatgctgttgtaatggac

SEQ ID NO: 155807 - DNA, 38 bp, Artificial Sequence
  Description of Artificial Sequence: Synthetic oligonucleotide
gtggtgctgcaacaaaaaaaatgctgttgtaatggacc

SEQ ID NO: 155808 - DNA, 31 bp, Artificial Sequence
  Description of Artificial Sequence: Synthetic oligonucleotide
acctcattggagagcaccatgatggggtttc

SEQ ID NO: 155809 - DNA, 30 bp, Artificial Sequence
  Description of Artificial Sequence: Synthetic oligonucleotide
cctcattggagagcaccatgatggggtttc

SEQ ID NO: 155810 - DNA, 30 bp, Artificial Sequence
  Description of Artificial Sequence: Synthetic oligonucleotide
ctcattggagagcaccatgatggggtttcc

SEQ ID NO: 155811 - DNA, 32 bp, Artificial Sequence
  Description of Artificial Sequence: Synthetic oligonucleotide
tcattggagagcaccatgatggggtttccaag

SEQ ID NO: 155812 - DNA, 31 bp, Artificial Sequence
  Description of Artificial Sequence: Synthetic oligonucleotide
cattggagagcaccatgatggggtttccaag

SEQ ID NO: 155813 - DNA, 31 bp, Artificial Sequence
  Description of Artificial Sequence: Synthetic oligonucleotide
attggagagcaccatgatggggtttccaagg

SEQ ID NO: 155814 - DNA, 30 bp, Artificial Sequence
  Description of Artificial Sequence: Synthetic oligonucleotide
ttggagagcaccatgatggggtttccaagg

SEQ ID NO: 155815 - DNA, 29 bp, Artificial Sequence
  Description of Artificial Sequence: Synthetic oligonucleotide
tggagagcaccatgatggggtttccaagg

SEQ ID NO: 155816 - DNA, 28 bp, Artificial Sequence
  Description of Artificial Sequence: Synthetic oligonucleotide
ggagagcaccatgatggggtttccaagg

SEQ ID NO: 155817 - DNA, 28 bp, Artificial Sequence
  Description of Artificial Sequence: Synthetic oligonucleotide
gagagcaccatgatggggtttccaaggc

SEQ ID NO: 155818 - DNA, 28 bp, Artificial Sequence
  Description of Artificial Sequence: Synthetic oligonucleotide
agagcaccatgatggggtttccaaggcc

SEQ ID NO: 155819 - DNA, 27 bp, Artificial Sequence
  Description of Artificial Sequence: Synthetic oligonucleotide
gagcaccatgatggggtttccaaggcc

SEQ ID NO: 155820 - DNA, 29 bp, Artificial Sequence
  Description of Artificial Sequence: Synthetic oligonucleotide
agcaccatgatggggtttccaaggccaac

SEQ ID NO: 155821 - DNA, 28 bp, Artificial Sequence
  Description of Artificial Sequence: Synthetic oligonucleotide
gcaccatgatggggtttccaaggccaac

SEQ ID NO: 155822 - DNA, 30 bp, Artificial Sequence
  Description of Artificial Sequence: Synthetic oligonucleotide
caccatgatggggtttccaaggccaacttc

SEQ ID NO: 155823 - DNA, 31 bp, Artificial Sequence
  Description of Artificial Sequence: Synthetic oligonucleotide
accatgatggggtttccaaggccaacttctc

SEQ ID NO: 155824 - DNA, 30 bp, Artificial Sequence
  Description of Artificial Sequence: Synthetic oligonucleotide
ccatgatggggtttccaaggccaacttctc

SEQ ID NO: 155825 - DNA, 30 bp, Artificial Sequence
  Description of Artificial Sequence: Synthetic oligonucleotide
catgatggggtttccaaggccaacttctcc

SEQ ID NO: 155826 - DNA, 32 bp, Artificial Sequence
  Description of Artificial Sequence: Synthetic oligonucleotide
atgatggggtttccaaggccaacttctccatc

SEQ ID NO: 155827 - DNA, 31 bp, Artificial Sequence
  Description of Artificial Sequence: Synthetic oligonucleotide
tgatggggtttccaaggccaacttctccatc

SEQ ID NO: 155828 - DNA, 30 bp, Artificial Sequence
  Description of Artificial Sequence: Synthetic oligonucleotide
gatggggtttccaaggccaacttctccatc

SEQ ID NO: 155829 - DNA, 30 bp, Artificial Sequence
  Description of Artificial Sequence: Synthetic oligonucleotide
atggggtttccaaggccaacttctccatcg

SEQ ID NO: 155830 - DNA, 29 bp, Artificial Sequence
  Description of Artificial Sequence: Synthetic oligonucleotide
tggggtttccaaggccaacttctccatcg

SEQ ID NO: 155831 - DNA, 28 bp, Artificial Sequence
  Description of Artificial Sequence: Synthetic oligonucleotide
ggggtttccaaggccaacttctccatcg

SEQ ID NO: 155832 - DNA, 28 bp, Artificial Sequence
  Description of Artificial Sequence: Synthetic oligonucleotide
gggtttccaaggccaacttctccatcgg

SEQ ID NO: 155833 - DNA, 29 bp, Artificial Sequence
  Description of Artificial Sequence: Synthetic oligonucleotide
ggtttccaaggccaacttctccatcggtc

SEQ ID NO: 155834 - DNA, 29 bp, Artificial Sequence
  Description of Artificial Sequence: Synthetic oligonucleotide
gtttccaaggccaacttctccatcggtcc

SEQ ID NO: 155835 - DNA, 29 bp, Artificial Sequence
  Description of Artificial Sequence: Synthetic oligonucleotide
tttccaaggccaacttctccatcggtccc

SEQ ID NO: 155836 - DNA, 28 bp, Artificial Sequence
  Description of Artificial Sequence: Synthetic oligonucleotide
ttccaaggccaacttctccatcggtccc

SEQ ID NO: 155837 - DNA, 36 bp, Artificial Sequence
  Description of Artificial Sequence: Synthetic oligonucleotide
ggaagtttaaggacactttgcacctcattggagaac

SEQ ID NO: 155838 - DNA, 37 bp, Artificial Sequence
  Description of Artificial Sequence: Synthetic oligonucleotide
gaagtttaaggacactttgcacctcattggagaacac

SEQ ID NO: 155839 - DNA, 37 bp, Artificial Sequence
  Description of Artificial Sequence: Synthetic oligonucleotide
aagtttaaggacactttgcacctcattggagaacacc

SEQ ID NO: 155840 - DNA, 36 bp, Artificial Sequence
  Description of Artificial Sequence: Synthetic oligonucleotide
agtttaaggacactttgcacctcattggagaacacc

SEQ ID NO: 155841 - DNA, 35 bp, Artificial Sequence
  Description of Artificial Sequence: Synthetic oligonucleotide
gtttaaggacactttgcacctcattggagaacacc

SEQ ID NO: 155842 - DNA, 37 bp, Artificial Sequence
  Description of Artificial Sequence: Synthetic oligonucleotide
tttaaggacactttgcacctcattggagaacaccatg

SEQ ID NO: 155843 - DNA, 36 bp, Artificial Sequence
  Description of Artificial Sequence: Synthetic oligonucleotide
ttaaggacactttgcacctcattggagaacaccatg

SEQ ID NO: 155844 - DNA, 35 bp, Artificial Sequence
  Description of Artificial Sequence: Synthetic oligonucleotide
taaggacactttgcacctcattggagaacaccatg

SEQ ID NO: 155845 - DNA, 34 bp, Artificial Sequence
  Description of Artificial Sequence: Synthetic oligonucleotide
aaggacactttgcacctcattggagaacaccatg

SEQ ID NO: 155846 - DNA, 33 bp, Artificial Sequence
  Description of Artificial Sequence: Synthetic oligonucleotide
aggacactttgcacctcattggagaacaccatg

SEQ ID NO: 155847 - DNA, 32 bp, Artificial Sequence
  Description of Artificial Sequence: Synthetic oligonucleotide
ggacactttgcacctcattggagaacaccatg

SEQ ID NO: 155848 - DNA, 34 bp, Artificial Sequence
  Description of Artificial Sequence: Synthetic oligonucleotide
gacactttgcacctcattggagaacaccatgatg

SEQ ID NO: 155849 - DNA, 34 bp, Artificial Sequence
  Description of Artificial Sequence: Synthetic oligonucleotide
acactttgcacctcattggagaacaccatgatgg

SEQ ID NO: 155850 - DNA, 33 bp, Artificial Sequence
  Description of Artificial Sequence: Synthetic oligonucleotide
cactttgcacctcattggagaacaccatgatgg

SEQ ID NO: 155851 - DNA, 33 bp, Artificial Sequence
  Description of Artificial Sequence: Synthetic oligonucleotide
actttgcacctcattggagaacaccatgatggg

SEQ ID NO: 155852 - DNA, 32 bp, Artificial Sequence
  Description of Artificial Sequence: Synthetic oligonucleotide
ctttgcacctcattggagaacaccatgatggg

SEQ ID NO: 155853 - DNA, 32 bp, Artificial Sequence
  Description of Artificial Sequence: Synthetic oligonucleotide
tttgcacctcattggagaacaccatgatgggg

SEQ ID NO: 155854 - DNA, 31 bp, Artificial Sequence
  Description of Artificial Sequence: Synthetic oligonucleotide
ttgcacctcattggagaacaccatgatgggg

SEQ ID NO: 155855 - DNA, 30 bp, Artificial Sequence
  Description of Artificial Sequence: Synthetic oligonucleotide
tgcacctcattggagaacaccatgatgggg

SEQ ID NO: 155856 - DNA, 29 bp, Artificial Sequence
  Description of Artificial Sequence: Synthetic oligonucleotide
gcacctcattggagaacaccatgatgggg

SEQ ID NO: 155857 - DNA, 30 bp, Artificial Sequence
  Description of Artificial Sequence: Synthetic oligonucleotide
cacctcattggagaacaccatgatggggtc

SEQ ID NO: 155858 - DNA, 31 bp, Artificial Sequence
  Description of Artificial Sequence: Synthetic oligonucleotide
acctcattggagaacaccatgatggggtctc

SEQ ID NO: 155859 - DNA, 40 bp, Artificial Sequence
  Description of Artificial Sequence: Synthetic oligonucleotide
ttgtttctgtcacaggaaacccttcaaatagttggctttc

SEQ ID NO: 155860 - DNA, 39 bp, Artificial Sequence
  Description of Artificial Sequence: Synthetic oligonucleotide
tgtttctgtcacaggaaacccttcaaatagttggctttc

SEQ ID NO: 155861 - DNA, 38 bp, Artificial Sequence
  Description of Artificial Sequence: Synthetic oligonucleotide
gtttctgtcacaggaaacccttcaaatagttggctttc

SEQ ID NO: 155862 - DNA, 39 bp, Artificial Sequence
  Description of Artificial Sequence: Synthetic oligonucleotide
tttctgtcacaggaaacccttcaaatagttggctttcac

SEQ ID NO: 155863 - DNA, 38 bp, Artificial Sequence
  Description of Artificial Sequence: Synthetic oligonucleotide
ttctgtcacaggaaacccttcaaatagttggctttcac

SEQ ID NO: 155864 - DNA, 37 bp, Artificial Sequence
  Description of Artificial Sequence: Synthetic oligonucleotide
tctgtcacaggaaacccttcaaatagttggctttcac

SEQ ID NO: 155865 - DNA, 36 bp, Artificial Sequence
  Description of Artificial Sequence: Synthetic oligonucleotide
ctgtcacaggaaacccttcaaatagttggctttcac

SEQ ID NO: 155866 - DNA, 36 bp, Artificial Sequence
  Description of Artificial Sequence: Synthetic oligonucleotide
tgtcacaggaaacccttcaaatagttggctttcacc

SEQ ID NO: 155867 - DNA, 35 bp, Artificial Sequence
  Description of Artificial Sequence: Synthetic oligonucleotide
gtcacaggaaacccttcaaatagttggctttcacc

SEQ ID NO: 155868 - DNA, 35 bp, Artificial Sequence
  Description of Artificial Sequence: Synthetic oligonucleotide
tcacaggaaacccttcaaatagttggctttcaccc

SEQ ID NO: 155869 - DNA, 34 bp, Artificial Sequence
  Description of Artificial Sequence: Synthetic oligonucleotide
cacaggaaacccttcaaatagttggctttcaccc

SEQ ID NO: 155870 - DNA, 35 bp, Artificial Sequence
  Description of Artificial Sequence: Synthetic oligonucleotide
acaggaaacccttcaaatagttggctttcacccac

SEQ ID NO: 155871 - DNA, 34 bp, Artificial Sequence
  Description of Artificial Sequence: Synthetic oligonucleotide
caggaaacccttcaaatagttggctttcacccac

SEQ ID NO: 155872 - DNA, 35 bp, Artificial Sequence
  Description of Artificial Sequence: Synthetic oligonucleotide
aggaaacccttcaaatagttggctttcacccactg

SEQ ID NO: 155873 - DNA, 34 bp, Artificial Sequence
  Description of Artificial Sequence: Synthetic oligonucleotide
ggaaacccttcaaatagttggctttcacccactg

SEQ ID NO: 155874 - DNA, 36 bp, Artificial Sequence
  Description of Artificial Sequence: Synthetic oligonucleotide
gaaacccttcaaatagttggctttcacccactgaac

SEQ ID NO: 155875 - DNA, 36 bp, Artificial Sequence
  Description of Artificial Sequence: Synthetic oligonucleotide
aaacccttcaaatagttggctttcacccactgaacc

SEQ ID NO: 155876 - DNA, 35 bp, Artificial Sequence
  Description of Artificial Sequence: Synthetic oligonucleotide
aacccttcaaatagttggctttcacccactgaacc

SEQ ID NO: 155877 - DNA, 34 bp, Artificial Sequence
  Description of Artificial Sequence: Synthetic oligonucleotide
acccttcaaatagttggctttcacccactgaacc

SEQ ID NO: 155878 - DNA, 33 bp, Artificial Sequence
  Description of Artificial Sequence: Synthetic oligonucleotide
cccttcaaatagttggctttcacccactgaacc

SEQ ID NO: 155879 - DNA, 35 bp, Artificial Sequence
  Description of Artificial Sequence: Synthetic oligonucleotide
ccttcaaatagttggctttcacccactgaaccaag

SEQ ID NO: 155880 - DNA, 35 bp, Artificial Sequence
  Description of Artificial Sequence: Synthetic oligonucleotide
cttcaaatagttggctttcacccactgaaccaagc

SEQ ID NO: 155881 - DNA, 36 bp, Artificial Sequence
  Description of Artificial Sequence: Synthetic oligonucleotide
ttcaaatagttggctttcacccactgaaccaagctc

SEQ ID NO: 155882 - DNA, 35 bp, Artificial Sequence
  Description of Artificial Sequence: Synthetic oligonucleotide
tcaaatagttggctttcacccactgaaccaagctc

SEQ ID NO: 155883 - DNA, 34 bp, Artificial Sequence
  Description of Artificial Sequence: Synthetic oligonucleotide
caaatagttggctttcacccactgaaccaagctc

SEQ ID NO: 155884 - DNA, 34 bp, Artificial Sequence
  Description of Artificial Sequence: Synthetic oligonucleotide
aaatagttggctttcacccactgaaccaagctcc

SEQ ID NO: 155885 - DNA, 33 bp, Artificial Sequence
  Description of Artificial Sequence: Synthetic oligonucleotide
aatagttggctttcacccactgaaccaagctcc

SEQ ID NO: 155886 - DNA, 32 bp, Artificial Sequence
  Description of Artificial Sequence: Synthetic oligonucleotide
atagttggctttcacccactgaaccaagctcc

SEQ ID NO: 155887 - DNA, 31 bp, Artificial Sequence
  Description of Artificial Sequence: Synthetic oligonucleotide
tagttggctttcacccactgaaccaagctcc

SEQ ID NO: 155888 - DNA, 30 bp, Artificial Sequence
  Description of Artificial Sequence: Synthetic oligonucleotide
agttggctttcacccactgaaccaagctcc

SEQ ID NO: 155889 - DNA, 29 bp, Artificial Sequence
  Description of Artificial Sequence: Synthetic oligonucleotide
gttggctttcacccactgaaccaagctcc

SEQ ID NO: 155890 - DNA, 29 bp, Artificial Sequence
  Description of Artificial Sequence: Synthetic oligonucleotide
ttggctttcacccactgaaccaagctccg

SEQ ID NO: 155891 - DNA, 28 bp, Artificial Sequence
  Description of Artificial Sequence: Synthetic oligonucleotide
tggctttcacccactgaaccaagctccg

SEQ ID NO: 155892 - DNA, 27 bp, Artificial Sequence
  Description of Artificial Sequence: Synthetic oligonucleotide
ggctttcacccactgaaccaagctccg

SEQ ID NO: 155893 - DNA, 30 bp, Artificial Sequence
  Description of Artificial Sequence: Synthetic oligonucleotide
gctttcacccactgaaccaagctccgaaac

SEQ ID NO: 155894 - DNA, 30 bp, Artificial Sequence
  Description of Artificial Sequence: Synthetic oligonucleotide
ctttcacccactgaaccaagctccgaaacc

SEQ ID NO: 155895 - DNA, 30 bp, Artificial Sequence
  Description of Artificial Sequence: Synthetic oligonucleotide
tttcacccactgaaccaagctccgaaaccg

SEQ ID NO: 155896 - DNA, 28 bp, Artificial Sequence
  Description of Artificial Sequence: Synthetic oligonucleotide
agggagtccacagaaaaccttccctccg

SEQ ID NO: 155897 - DNA, 27 bp, Artificial Sequence
  Description of Artificial Sequence: Synthetic oligonucleotide
gggagtccacagaaaaccttccctccg

SEQ ID NO: 155898 - DNA, 27 bp, Artificial Sequence
  Description of Artificial Sequence: Synthetic oligonucleotide
ggagtccacagaaaaccttccctccgg

SEQ ID NO: 155899 - DNA, 27 bp, Artificial Sequence
  Description of Artificial Sequence: Synthetic oligonucleotide
gagtccacagaaaaccttccctccggg

SEQ ID NO: 155900 - DNA, 27 bp, Artificial Sequence
  Description of Artificial Sequence: Synthetic oligonucleotide
agtccacagaaaaccttccctccgggc

SEQ ID NO: 155901 - DNA, 26 bp, Artificial Sequence
  Description of Artificial Sequence: Synthetic oligonucleotide
gtccacagaaaaccttccctccgggc

SEQ ID NO: 155902 - DNA, 26 bp, Artificial Sequence
  Description of Artificial Sequence: Synthetic oligonucleotide
tccacagaaaaccttccctccgggcc

SEQ ID NO: 155903 - DNA, 25 bp, Artificial Sequence
  Description of Artificial Sequence: Synthetic oligonucleotide
ccacagaaaaccttccctccgggcc

SEQ ID NO: 155904 - DNA, 26 bp, Artificial Sequence
  Description of Artificial Sequence: Synthetic oligonucleotide
cacagaaaaccttccctccgggccca

SEQ ID NO: 155905 - DNA, 26 bp, Artificial Sequence
  Description of Artificial Sequence: Synthetic oligonucleotide
acagaaaaccttccctccgggcccac

SEQ ID NO: 155906 - DNA, 25 bp, Artificial Sequence
  Description of Artificial Sequence: Synthetic oligonucleotide
cagaaaaccttccctccgggcccac

SEQ ID NO: 155907 - DNA, 25 bp, Artificial Sequence
  Description of Artificial Sequence: Synthetic oligonucleotide
agaaaaccttccctccgggcccacc

SEQ ID NO: 155908 - DNA, 24 bp, Artificial Sequence
  Description of Artificial Sequence: Synthetic oligonucleotide
gaaaaccttccctccgggcccacc

SEQ ID NO: 155909 - DNA, 25 bp, Artificial Sequence
  Description of Artificial Sequence: Synthetic oligonucleotide
aaaaccttccctccgggcccaccca

SEQ ID NO: 155910 - DNA, 24 bp, Artificial Sequence
  Description of Artificial Sequence: Synthetic oligonucleotide
aaaccttccctccgggcccaccca

SEQ ID NO: 155911 - DNA, 23 bp, Artificial Sequence
  Description of Artificial Sequence: Synthetic oligonucleotide
aaccttccctccgggcccaccca

SEQ ID NO: 155912 - DNA, 22 bp, Artificial Sequence
  Description of Artificial Sequence: Synthetic oligonucleotide
accttccctccgggcccaccca

SEQ ID NO: 155913 - DNA, 21 bp, Artificial Sequence
  Description of Artificial Sequence: Synthetic oligonucleotide
ccttccctccgggcccaccca

SEQ ID NO: 155914 - DNA, 21 bp, Artificial Sequence
  Description of Artificial Sequence: Synthetic oligonucleotide
cttccctccgggcccacccag

SEQ ID NO: 155915 - DNA, 22 bp, Artificial Sequence
  Description of Artificial Sequence: Synthetic oligonucleotide
ttccctccgggcccacccaggt

SEQ ID NO: 155916 - DNA, 21 bp, Artificial Sequence
  Description of Artificial Sequence: Synthetic oligonucleotide
tccctccgggcccacccaggt

SEQ ID NO: 155917 - DNA, 20 bp, Artificial Sequence
  Description of Artificial Sequence: Synthetic oligonucleotide
ccctccgggcccacccaggt

SEQ ID NO: 155918 - DNA, 20 bp, Artificial Sequence
  Description of Artificial Sequence: Synthetic oligonucleotide
cctccgggcccacccaggtc

SEQ ID NO: 155919 - DNA, 20 bp, Artificial Sequence
  Description of Artificial Sequence: Synthetic oligonucleotide
ctccgggcccacccaggtcc

SEQ ID NO: 155920 - DNA, 20 bp, Artificial Sequence
  Description of Artificial Sequence: Synthetic oligonucleotide
tccgggcccacccaggtccc

SEQ ID NO: 155921 - DNA, 20 bp, Artificial Sequence
  Description of Artificial Sequence: Synthetic oligonucleotide
ccgggcccacccaggtccct

SEQ ID NO: 155922 - DNA, 20 bp, Artificial Sequence
  Description of Artificial Sequence: Synthetic oligonucleotide
cgggcccacccaggtcccct

SEQ ID NO: 155923 - DNA, 20 bp, Artificial Sequence
  Description of Artificial Sequence: Synthetic oligonucleotide
gggcccacccaggtcccctg

SEQ ID NO: 155924 - DNA, 34 bp, Artificial Sequence
  Description of Artificial Sequence: Synthetic oligonucleotide
tgcacagagaagggaagtttaaggacactttgcg

SEQ ID NO: 155925 - DNA, 33 bp, Artificial Sequence
  Description of Artificial Sequence: Synthetic oligonucleotide
gcacagagaagggaagtttaaggacactttgcg

SEQ ID NO: 155926 - DNA, 33 bp, Artificial Sequence
  Description of Artificial Sequence: Synthetic oligonucleotide
cacagagaagggaagtttaaggacactttgcgc

SEQ ID NO: 155927 - DNA, 33 bp, Artificial Sequence
  Description of Artificial Sequence: Synthetic oligonucleotide
acagagaagggaagtttaaggacactttgcgcc

SEQ ID NO: 155928 - DNA, 32 bp, Artificial Sequence
  Description of Artificial Sequence: Synthetic oligonucleotide
cagagaagggaagtttaaggacactttgcgcc

SEQ ID NO: 155929 - DNA, 33 bp, Artificial Sequence
  Description of Artificial Sequence: Synthetic oligonucleotide
agagaagggaagtttaaggacactttgcgcctc

SEQ ID NO: 155930 - DNA, 32 bp, Artificial Sequence
  Description of Artificial Sequence: Synthetic oligonucleotide
gagaagggaagtttaaggacactttgcgcctc

SEQ ID NO: 155931 - DNA, 35 bp, Artificial Sequence
  Description of Artificial Sequence: Synthetic oligonucleotide
agaagggaagtttaaggacactttgcgcctcattg

SEQ ID NO: 155932 - DNA, 34 bp, Artificial Sequence
  Description of Artificial Sequence: Synthetic oligonucleotide
gaagggaagtttaaggacactttgcgcctcattg

SEQ ID NO: 155933 - DNA, 34 bp, Artificial Sequence
  Description of Artificial Sequence: Synthetic oligonucleotide
aagggaagtttaaggacactttgcgcctcattgg

SEQ ID NO: 155934 - DNA, 33 bp, Artificial Sequence
  Description of Artificial Sequence: Synthetic oligonucleotide
agggaagtttaaggacactttgcgcctcattgg

SEQ ID NO: 155935 - DNA, 32 bp, Artificial Sequence
  Description of Artificial Sequence: Synthetic oligonucleotide
gggaagtttaaggacactttgcgcctcattgg

SEQ ID NO: 155936 - DNA, 33 bp, Artificial Sequence
  Description of Artificial Sequence: Synthetic oligonucleotide
ggaagtttaaggacactttgcgcctcattggag

SEQ ID NO: 155937 - DNA, 34 bp, Artificial Sequence
  Description of Artificial Sequence: Synthetic oligonucleotide
gaagtttaaggacactttgcgcctcattggagag

SEQ ID NO: 155938 - DNA, 34 bp, Artificial Sequence
  Description of Artificial Sequence: Synthetic oligonucleotide
aagtttaaggacactttgcgcctcattggagagc

SEQ ID NO: 155939 - DNA, 33 bp, Artificial Sequence
  Description of Artificial Sequence: Synthetic oligonucleotide
agtttaaggacactttgcgcctcattggagagc

SEQ ID NO: 155940 - DNA, 32 bp, Artificial Sequence
  Description of Artificial Sequence: Synthetic oligonucleotide
gtttaaggacactttgcgcctcattggagagc

SEQ ID NO: 155941 - DNA, 33 bp, Artificial Sequence
  Description of Artificial Sequence: Synthetic oligonucleotide
tttaaggacactttgcgcctcattggagagcac

SEQ ID NO: 155942 - DNA, 32 bp, Artificial Sequence
  Description of Artificial Sequence: Synthetic oligonucleotide
ttaaggacactttgcgcctcattggagagcac

SEQ ID NO: 155943 - DNA, 31 bp, Artificial Sequence
  Description of Artificial Sequence: Synthetic oligonucleotide
taaggacactttgcgcctcattggagagcac

SEQ ID NO: 155944 - DNA, 30 bp, Artificial Sequence
  Description of Artificial Sequence: Synthetic oligonucleotide
aaggacactttgcgcctcattggagagcac

SEQ ID NO: 155945 - DNA, 29 bp, Artificial Sequence
  Description of Artificial Sequence: Synthetic oligonucleotide
aggacactttgcgcctcattggagagcac

SEQ ID NO: 155946 - DNA, 28 bp, Artificial Sequence
  Description of Artificial Sequence: Synthetic oligonucleotide
ggacactttgcgcctcattggagagcac

SEQ ID NO: 155947 - DNA, 28 bp, Artificial Sequence
  Description of Artificial Sequence: Synthetic oligonucleotide
gacactttgcgcctcattggagagcacc

SEQ ID NO: 155948 - DNA, 30 bp, Artificial Sequence
  Description of Artificial Sequence: Synthetic oligonucleotide
acactttgcgcctcattggagagcaccatg

SEQ ID NO: 155949 - DNA, 29 bp, Artificial Sequence
  Description of Artificial Sequence: Synthetic oligonucleotide
cactttgcgcctcattggagagcaccatg

SEQ ID NO: 155950 - DNA, 31 bp, Artificial Sequence
  Description of Artificial Sequence: Synthetic oligonucleotide
actttgcgcctcattggagagcaccatgatg

SEQ ID NO: 155951 - DNA, 30 bp, Artificial Sequence
  Description of Artificial Sequence: Synthetic oligonucleotide
ctttgcgcctcattggagagcaccatgatg

SEQ ID NO: 155952 - DNA, 30 bp, Artificial Sequence
  Description of Artificial Sequence: Synthetic oligonucleotide
tttgcgcctcattggagagcaccatgatgg

SEQ ID NO: 155953 - DNA, 29 bp, Artificial Sequence
  Description of Artificial Sequence: Synthetic oligonucleotide
ttgcgcctcattggagagcaccatgatgg

SEQ ID NO: 155954 - DNA, 28 bp, Artificial Sequence
  Description of Artificial Sequence: Synthetic oligonucleotide
tgcgcctcattggagagcaccatgatgg

SEQ ID NO: 155955 - DNA, 27 bp, Artificial Sequence
  Description of Artificial Sequence: Synthetic oligonucleotide
gcgcctcattggagagcaccatgatgg

SEQ ID NO: 155956 - DNA, 27 bp, Artificial Sequence
  Description of Artificial Sequence: Synthetic oligonucleotide
cgcctcattggagagcaccatgatggg

SEQ ID NO: 155957 - DNA, 27 bp, Artificial Sequence
  Description of Artificial Sequence: Synthetic oligonucleotide
gcctcattggagagcaccatgatgggg

SEQ ID NO: 155958 - DNA, 30 bp, Artificial Sequence
  Description of Artificial Sequence: Synthetic oligonucleotide
aaccaagctccgaaaccggtaaccccatac

SEQ ID NO: 155959 - DNA, 29 bp, Artificial Sequence
  Description of Artificial Sequence: Synthetic oligonucleotide
accaagctccgaaaccggtaaccccatac

SEQ ID NO: 155960 - DNA, 28 bp, Artificial Sequence
  Description of Artificial Sequence: Synthetic oligonucleotide
ccaagctccgaaaccggtaaccccatac

SEQ ID NO: 155961 - DNA, 29 bp, Artificial Sequence
  Description of Artificial Sequence: Synthetic oligonucleotide
caagctccgaaaccggtaaccccatacac

SEQ ID NO: 155962 - DNA, 29 bp, Artificial Sequence
  Description of Artificial Sequence: Synthetic oligonucleotide
aagctccgaaaccggtaaccccatacacc

SEQ ID NO: 155963 - DNA, 28 bp, Artificial Sequence
  Description of Artificial Sequence: Synthetic oligonucleotide
agctccgaaaccggtaaccccatacacc

SEQ ID NO: 155964 - DNA, 27 bp, Artificial Sequence
  Description of Artificial Sequence: Synthetic oligonucleotide
gctccgaaaccggtaaccccatacacc

SEQ ID NO: 155965 - DNA, 28 bp, Artificial Sequence
  Description of Artificial Sequence: Synthetic oligonucleotide
ctccgaaaccggtaaccccatacacctg

SEQ ID NO: 155966 - DNA, 28 bp, Artificial Sequence
  Description of Artificial Sequence: Synthetic oligonucleotide
tccgaaaccggtaaccccatacacctgc

SEQ ID NO: 155967 - DNA, 27 bp, Artificial Sequence
  Description of Artificial Sequence: Synthetic oligonucleotide
ccgaaaccggtaaccccatacacctgc

SEQ ID NO: 155968 - DNA, 29 bp, Artificial Sequence
  Description of Artificial Sequence: Synthetic oligonucleotide
cgaaaccggtaaccccatacacctgcatg

SEQ ID NO: 155969 - DNA, 31 bp, Artificial Sequence
  Description of Artificial Sequence: Synthetic oligonucleotide
gaaaccggtaaccccatacacctgcatgttc

SEQ ID NO: 155970 - DNA, 32 bp, Artificial Sequence
  Description of Artificial Sequence: Synthetic oligonucleotide
aaaccggtaaccccatacacctgcatgttctg

SEQ ID NO: 155971 - DNA, 31 bp, Artificial Sequence
  Description of Artificial Sequence: Synthetic oligonucleotide
aaccggtaaccccatacacctgcatgttctg

SEQ ID NO: 155972 - DNA, 30 bp, Artificial Sequence
  Description of Artificial Sequence: Synthetic oligonucleotide
accggtaaccccatacacctgcatgttctg

SEQ ID NO: 155973 - DNA, 29 bp, Artificial Sequence
  Description of Artificial Sequence: Synthetic oligonucleotide
ccggtaaccccatacacctgcatgttctg

SEQ ID NO: 155974 - DNA, 32 bp, Artificial Sequence
  Description of Artificial Sequence: Synthetic oligonucleotide
cggtaaccccatacacctgcatgttctgattg

SEQ ID NO: 155975 - DNA, 32 bp, Artificial Sequence
  Description of Artificial Sequence: Synthetic oligonucleotide
ggtaaccccatacacctgcatgttctgattgg

SEQ ID NO: 155976 - DNA, 32 bp, Artificial Sequence
  Description of Artificial Sequence: Synthetic oligonucleotide
gtaaccccatacacctgcatgttctgattggg

SEQ ID NO: 155977 - DNA, 33 bp, Artificial Sequence
  Description of Artificial Sequence: Synthetic oligonucleotide
taaccccatacacctgcatgttctgattgggac

SEQ ID NO: 155978 - DNA, 32 bp, Artificial Sequence
  Description of Artificial Sequence: Synthetic oligonucleotide
aaccccatacacctgcatgttctgattgggac

SEQ ID NO: 155979 - DNA, 31 bp, Artificial Sequence
  Description of Artificial Sequence: Synthetic oligonucleotide
accccatacacctgcatgttctgattgggac

SEQ ID NO: 155980 - DNA, 30 bp, Artificial Sequence
  Description of Artificial Sequence: Synthetic oligonucleotide
ccccatacacctgcatgttctgattgggac

SEQ ID NO: 155981 - DNA, 30 bp, Artificial Sequence
  Description of Artificial Sequence: Synthetic oligonucleotide
cccatacacctgcatgttctgattgggacc

SEQ ID NO: 155982 - DNA, 31 bp, Artificial Sequence
  Description of Artificial Sequence: Synthetic oligonucleotide
ccatacacctgcatgttctgattgggacctc

SEQ ID NO: 155983 - DNA, 32 bp, Artificial Sequence
  Description of Artificial Sequence: Synthetic oligonucleotide
catacacctgcatgttctgattgggacctcag

SEQ ID NO: 155984 - DNA, 33 bp, Artificial Sequence
  Description of Artificial Sequence: Synthetic oligonucleotide
atacacctgcatgttctgattgggacctcagtg

SEQ ID NO: 155985 - DNA, 32 bp, Artificial Sequence
  Description of Artificial Sequence: Synthetic oligonucleotide
tacacctgcatgttctgattgggacctcagtg

SEQ ID NO: 155986 - DNA, 35 bp, Artificial Sequence
  Description of Artificial Sequence: Synthetic oligonucleotide
cttcatcgctggtgctgcaacaaaaaaaatgctgc

SEQ ID NO: 155987 - DNA, 35 bp, Artificial Sequence
  Description of Artificial Sequence: Synthetic oligonucleotide
ttcatcgctggtgctgcaacaaaaaaaatgctgcg

SEQ ID NO: 155988 - DNA, 34 bp, Artificial Sequence
  Description of Artificial Sequence: Synthetic oligonucleotide
tcatcgctggtgctgcaacaaaaaaaatgctgcg

SEQ ID NO: 155989 - DNA, 33 bp, Artificial Sequence
  Description of Artificial Sequence: Synthetic oligonucleotide
catcgctggtgctgcaacaaaaaaaatgctgcg

SEQ ID NO: 155990 - DNA, 33 bp, Artificial Sequence
  Description of Artificial Sequence: Synthetic oligonucleotide
atcgctggtgctgcaacaaaaaaaatgctgcgg

SEQ ID NO: 155991 - DNA, 32 bp, Artificial Sequence
  Description of Artificial Sequence: Synthetic oligonucleotide
tcgctggtgctgcaacaaaaaaaatgctgcgg

SEQ ID NO: 155992 - DNA, 31 bp, Artificial Sequence
  Description of Artificial Sequence: Synthetic oligonucleotide
cgctggtgctgcaacaaaaaaaatgctgcgg

SEQ ID NO: 155993 - DNA, 35 bp, Artificial Sequence
  Description of Artificial Sequence: Synthetic oligonucleotide
gctggtgctgcaacaaaaaaaatgctgcggtaatg

SEQ ID NO: 155994 - DNA, 35 bp, Artificial Sequence
  Description of Artificial Sequence: Synthetic oligonucleotide
ctggtgctgcaacaaaaaaaatgctgcggtaatgg

SEQ ID NO: 155995 - DNA, 36 bp, Artificial Sequence
  Description of Artificial Sequence: Synthetic oligonucleotide
tggtgctgcaacaaaaaaaatgctgcggtaatggac

SEQ ID NO: 155996 - DNA, 35 bp, Artificial Sequence
  Description of Artificial Sequence: Synthetic oligonucleotide
ggtgctgcaacaaaaaaaatgctgcggtaatggac

SEQ ID NO: 155997 - DNA, 35 bp, Artificial Sequence
  Description of Artificial Sequence: Synthetic oligonucleotide
gtgctgcaacaaaaaaaatgctgcggtaatggacc

SEQ ID NO: 155998 - DNA, 37 bp, Artificial Sequence
  Description of Artificial Sequence: Synthetic oligonucleotide
tgctgcaacaaaaaaaatgctgcggtaatggaccaag

SEQ ID NO: 155999 - DNA, 36 bp, Artificial Sequence
  Description of Artificial Sequence: Synthetic oligonucleotide
gctgcaacaaaaaaaatgctgcggtaatggaccaag

SEQ ID NO: 156000 - DNA, 37 bp, Artificial Sequence
  Description of Artificial Sequence: Synthetic oligonucleotide
ctgcaacaaaaaaaatgctgcggtaatggaccaagag

SEQ ID NO: 156001 - DNA, 38 bp, Artificial Sequence
  Description of Artificial Sequence: Synthetic oligonucleotide
tgcaacaaaaaaaatgctgcggtaatggaccaagagtc

SEQ ID NO: 156002 - DNA, 37 bp, Artificial Sequence
  Description of Artificial Sequence: Synthetic oligonucleotide
gcaacaaaaaaaatgctgcggtaatggaccaagagtc

SEQ ID NO: 156003 - DNA, 32 bp, Artificial Sequence
  Description of Artificial Sequence: Synthetic oligonucleotide
gacctacagatgctacggttctgttactcacc

SEQ ID NO: 156004 - DNA, 32 bp, Artificial Sequence
  Description of Artificial Sequence: Synthetic oligonucleotide
acctacagatgctacggttctgttactcaccc

SEQ ID NO: 156005 - DNA, 31 bp, Artificial Sequence
  Description of Artificial Sequence: Synthetic oligonucleotide
cctacagatgctacggttctgttactcaccc

SEQ ID NO: 156006 - DNA, 31 bp, Artificial Sequence
  Description of Artificial Sequence: Synthetic oligonucleotide
ctacagatgctacggttctgttactcacccc

SEQ ID NO: 156007 - DNA, 31 bp, Artificial Sequence
  Description of Artificial Sequence: Synthetic oligonucleotide
tacagatgctacggttctgttactcaccccc

SEQ ID NO: 156008 - DNA, 30 bp, Artificial Sequence
  Description of Artificial Sequence: Synthetic oligonucleotide
acagatgctacggttctgttactcaccccc

SEQ ID NO: 156009 - DNA, 29 bp, Artificial Sequence
  Description of Artificial Sequence: Synthetic oligonucleotide
cagatgctacggttctgttactcaccccc

SEQ ID NO: 156010 - DNA, 29 bp, Artificial Sequence
  Description of Artificial Sequence: Synthetic oligonucleotide
agatgctacggttctgttactcacccccc

SEQ ID NO: 156011 - DNA, 28 bp, Artificial Sequence
  Description of Artificial Sequence: Synthetic oligonucleotide
gatgctacggttctgttactcacccccc

SEQ ID NO: 156012 - DNA, 31 bp, Artificial Sequence
  Description of Artificial Sequence: Synthetic oligonucleotide
atgctacggttctgttactcacccccctatc

SEQ ID NO: 156013 - DNA, 30 bp, Artificial Sequence
  Description of Artificial Sequence: Synthetic oligonucleotide
tgctacggttctgttactcacccccctatc

SEQ ID NO: 156014 - DNA, 29 bp, Artificial Sequence
  Description of Artificial Sequence: Synthetic oligonucleotide
gctacggttctgttactcacccccctatc

SEQ ID NO: 156015 - DNA, 30 bp, Artificial Sequence
  Description of Artificial Sequence: Synthetic oligonucleotide
ctacggttctgttactcacccccctatcag

SEQ ID NO: 156016 - DNA, 32 bp, Artificial Sequence
  Description of Artificial Sequence: Synthetic oligonucleotide
tacggttctgttactcacccccctatcagttg

SEQ ID NO: 156017 - DNA, 31 bp, Artificial Sequence
  Description of Artificial Sequence: Synthetic oligonucleotide
acggttctgttactcacccccctatcagttg

SEQ ID NO: 156018 - DNA, 30 bp, Artificial Sequence
  Description of Artificial Sequence: Synthetic oligonucleotide
cggttctgttactcacccccctatcagttg

SEQ ID NO: 156019 - DNA, 31 bp, Artificial Sequence
  Description of Artificial Sequence: Synthetic oligonucleotide
ggttctgttactcacccccctatcagttgtc

SEQ ID NO: 156020 - DNA, 32 bp, Artificial Sequence
  Description of Artificial Sequence: Synthetic oligonucleotide
gttctgttactcacccccctatcagttgtcag

SEQ ID NO: 156021 - DNA, 32 bp, Artificial Sequence
  Description of Artificial Sequence: Synthetic oligonucleotide
ttctgttactcacccccctatcagttgtcagc

SEQ ID NO: 156022 - DNA, 31 bp, Artificial Sequence
  Description of Artificial Sequence: Synthetic oligonucleotide
tctgttactcacccccctatcagttgtcagc

SEQ ID NO: 156023 - DNA, 30 bp, Artificial Sequence
  Description of Artificial Sequence: Synthetic oligonucleotide
ctgttactcacccccctatcagttgtcagc

SEQ ID NO: 156024 - DNA, 31 bp, Artificial Sequence
  Description of Artificial Sequence: Synthetic oligonucleotide
tgttactcacccccctatcagttgtcagctc

SEQ ID NO: 156025 - DNA, 30 bp, Artificial Sequence
  Description of Artificial Sequence: Synthetic oligonucleotide
gttactcacccccctatcagttgtcagctc

SEQ ID NO: 156026 - DNA, 30 bp, Artificial Sequence
  Description of Artificial Sequence: Synthetic oligonucleotide
ttactcacccccctatcagttgtcagctcc

SEQ ID NO: 156027 - DNA, 29 bp, Artificial Sequence
  Description of Artificial Sequence: Synthetic oligonucleotide
tactcacccccctatcagttgtcagctcc

SEQ ID NO: 156028 - DNA, 28 bp, Artificial Sequence
  Description of Artificial Sequence: Synthetic oligonucleotide
actcacccccctatcagttgtcagctcc

SEQ ID NO: 156029 - DNA, 27 bp, Artificial Sequence
  Description of Artificial Sequence: Synthetic oligonucleotide
ctcacccccctatcagttgtcagctcc

SEQ ID NO: 156030 - DNA, 27 bp, Artificial Sequence
  Description of Artificial Sequence: Synthetic oligonucleotide
tcacccccctatcagttgtcagctccc

SEQ ID NO: 156031 - DNA, 27 bp, Artificial Sequence
  Description of Artificial Sequence: Synthetic oligonucleotide
cacccccctatcagttgtcagctccca

SEQ ID NO: 156032 - DNA, 27 bp, Artificial Sequence
  Description of Artificial Sequence: Synthetic oligonucleotide
acccccctatcagttgtcagctcccag

SEQ ID NO: 156033 - DNA, 27 bp, Artificial Sequence
  Description of Artificial Sequence: Synthetic oligonucleotide
cccccctatcagttgtcagctcccagt

SEQ ID NO: 156034 - DNA, 25 bp, Artificial Sequence
  Description of Artificial Sequence: Synthetic oligonucleotide
agggagggggaggcccatgaaccta

SEQ ID NO: 156035 - DNA, 24 bp, Artificial Sequence
  Description of Artificial Sequence: Synthetic oligonucleotide
gggagggggaggcccatgaaccta

SEQ ID NO: 156036 - DNA, 24 bp, Artificial Sequence
  Description of Artificial Sequence: Synthetic oligonucleotide
ggagggggaggcccatgaacctag

SEQ ID NO: 156037 - DNA, 26 bp, Artificial Sequence
  Description of Artificial Sequence: Synthetic oligonucleotide
gagggggaggcccatgaacctaggtt

SEQ ID NO: 156038 - DNA, 27 bp, Artificial Sequence
  Description of Artificial Sequence: Synthetic oligonucleotide
agggggaggcccatgaacctaggttct

SEQ ID NO: 156039 - DNA, 26 bp, Artificial Sequence
  Description of Artificial Sequence: Synthetic oligonucleotide
gggggaggcccatgaacctaggttct

SEQ ID NO: 156040 - DNA, 27 bp, Artificial Sequence
  Description of Artificial Sequence: Synthetic oligonucleotide
ggggaggcccatgaacctaggttctct

SEQ ID NO: 156041 - DNA, 27 bp, Artificial Sequence
  Description of Artificial Sequence: Synthetic oligonucleotide
gggaggcccatgaacctaggttctctg

SEQ ID NO: 156042 - DNA, 27 bp, Artificial Sequence
  Description of Artificial Sequence: Synthetic oligonucleotide
ggaggcccatgaacctaggttctctgc

SEQ ID NO: 156043 - DNA, 28 bp, Artificial Sequence
  Description of Artificial Sequence: Synthetic oligonucleotide
gaggcccatgaacctaggttctctgcag

SEQ ID NO: 156044 - DNA, 28 bp, Artificial Sequence
  Description of Artificial Sequence: Synthetic oligonucleotide
aggcccatgaacctaggttctctgcagg

SEQ ID NO: 156045 - DNA, 27 bp, Artificial Sequence
  Description of Artificial Sequence: Synthetic oligonucleotide
ggcccatgaacctaggttctctgcagg

SEQ ID NO: 156046 - DNA, 27 bp, Artificial Sequence
  Description of Artificial Sequence: Synthetic oligonucleotide
gcccatgaacctaggttctctgcaggg

SEQ ID NO: 156047 - DNA, 27 bp, Artificial Sequence
  Description of Artificial Sequence: Synthetic oligonucleotide
cccatgaacctaggttctctgcagggc

SEQ ID NO: 156048 - DNA, 27 bp, Artificial Sequence
  Description of Artificial Sequence: Synthetic oligonucleotide
ccatgaacctaggttctctgcagggcc

SEQ ID NO: 156049 - DNA, 27 bp, Artificial Sequence
  Description of Artificial Sequence: Synthetic oligonucleotide
catgaacctaggttctctgcagggccc

SEQ ID NO: 156050 - DNA, 29 bp, Artificial Sequence
  Description of Artificial Sequence: Synthetic oligonucleotide
atgaacctaggttctctgcagggcccaag

SEQ ID NO: 156051 - DNA, 28 bp, Artificial Sequence
  Description of Artificial Sequence: Synthetic oligonucleotide
tgaacctaggttctctgcagggcccaag

SEQ ID NO: 156052 - DNA, 27 bp, Artificial Sequence
  Description of Artificial Sequence: Synthetic oligonucleotide
gaacctaggttctctgcagggcccaag

SEQ ID NO: 156053 - DNA, 27 bp, Artificial Sequence
  Description of Artificial Sequence: Synthetic oligonucleotide
aacctaggttctctgcagggcccaagg

SEQ ID NO: 156054 - DNA, 27 bp, Artificial Sequence
  Description of Artificial Sequence: Synthetic oligonucleotide
acctaggttctctgcagggcccaaggt

SEQ ID NO: 156055 - DNA, 26 bp, Artificial Sequence
  Description of Artificial Sequence: Synthetic oligonucleotide
cctaggttctctgcagggcccaaggt

SEQ ID NO: 156056 - DNA, 27 bp, Artificial Sequence
  Description of Artificial Sequence: Synthetic oligonucleotide
ctaggttctctgcagggcccaaggtca

SEQ ID NO: 156057 - DNA, 30 bp, Artificial Sequence
  Description of Artificial Sequence: Synthetic oligonucleotide
tgaaccaagctccaaaaccggtaaccccag

SEQ ID NO: 156058 - DNA, 29 bp, Artificial Sequence
  Description of Artificial Sequence: Synthetic oligonucleotide
gaaccaagctccaaaaccggtaaccccag

SEQ ID NO: 156059 - DNA, 30 bp, Artificial Sequence
  Description of Artificial Sequence: Synthetic oligonucleotide
aaccaagctccaaaaccggtaaccccagac

SEQ ID NO: 156060 - DNA, 29 bp, Artificial Sequence
  Description of Artificial Sequence: Synthetic oligonucleotide
accaagctccaaaaccggtaaccccagac

SEQ ID NO: 156061 - DNA, 28 bp, Artificial Sequence
  Description of Artificial Sequence: Synthetic oligonucleotide
ccaagctccaaaaccggtaaccccagac

SEQ ID NO: 156062 - DNA, 29 bp, Artificial Sequence
  Description of Artificial Sequence: Synthetic oligonucleotide
caagctccaaaaccggtaaccccagacac

SEQ ID NO: 156063 - DNA, 29 bp, Artificial Sequence
  Description of Artificial Sequence: Synthetic oligonucleotide
aagctccaaaaccggtaaccccagacacc

SEQ ID NO: 156064 - DNA, 28 bp, Artificial Sequence
  Description of Artificial Sequence: Synthetic oligonucleotide
agctccaaaaccggtaaccccagacacc

SEQ ID NO: 156065 - DNA, 27 bp, Artificial Sequence
  Description of Artificial Sequence: Synthetic oligonucleotide
gctccaaaaccggtaaccccagacacc

SEQ ID NO: 156066 - DNA, 28 bp, Artificial Sequence
  Description of Artificial Sequence: Synthetic oligonucleotide
ctccaaaaccggtaaccccagacacctg

SEQ ID NO: 156067 - DNA, 28 bp, Artificial Sequence
  Description of Artificial Sequence: Synthetic oligonucleotide
tccaaaaccggtaaccccagacacctgc

SEQ ID NO: 156068 - DNA, 27 bp, Artificial Sequence
  Description of Artificial Sequence: Synthetic oligonucleotide
ccaaaaccggtaaccccagacacctgc

SEQ ID NO: 156069 - DNA, 28 bp, Artificial Sequence
  Description of Artificial Sequence: Synthetic oligonucleotide
caaaaccggtaaccccagacacctgcac

SEQ ID NO: 156070 - DNA, 28 bp, Artificial Sequence
  Description of Artificial Sequence: Synthetic oligonucleotide
aaaaccggtaaccccagacacctgcacg

SEQ ID NO: 156071 - DNA, 27 bp, Artificial Sequence
  Description of Artificial Sequence: Synthetic oligonucleotide
aaaccggtaaccccagacacctgcacg

SEQ ID NO: 156072 - DNA, 27 bp, Artificial Sequence
  Description of Artificial Sequence: Synthetic oligonucleotide
aaccggtaaccccagacacctgcacgt

SEQ ID NO: 156073 - DNA, 27 bp, Artificial Sequence
  Description of Artificial Sequence: Synthetic oligonucleotide
accggtaaccccagacacctgcacgtt

SEQ ID NO: 156074 - DNA, 26 bp, Artificial Sequence
  Description of Artificial Sequence: Synthetic oligonucleotide
ccggtaaccccagacacctgcacgtt

SEQ ID NO: 156075 - DNA, 27 bp, Artificial Sequence
  Description of Artificial Sequence: Synthetic oligonucleotide
cggtaaccccagacacctgcacgttct

SEQ ID NO: 156076 - DNA, 27 bp, Artificial Sequence
  Description of Artificial Sequence: Synthetic oligonucleotide
ggtaaccccagacacctgcacgttctg

SEQ ID NO: 156077 - DNA, 30 bp, Artificial Sequence
  Description of Artificial Sequence: Synthetic oligonucleotide
gtaaccccagacacctgcacgttctgattg

SEQ ID NO: 156078 - DNA, 30 bp, Artificial Sequence
  Description of Artificial Sequence: Synthetic oligonucleotide
taaccccagacacctgcacgttctgattgg

SEQ ID NO: 156079 - DNA, 29 bp, Artificial Sequence
  Description of Artificial Sequence: Synthetic oligonucleotide
aaccccagacacctgcacgttctgattgg

SEQ ID NO: 156080 - DNA, 28 bp, Artificial Sequence
  Description of Artificial Sequence: Synthetic oligonucleotide
accccagacacctgcacgttctgattgg

SEQ ID NO: 156081 - DNA, 27 bp, Artificial Sequence
  Description of Artificial Sequence: Synthetic oligonucleotide
ccccagacacctgcacgttctgattgg

SEQ ID NO: 156082 - DNA, 27 bp, Artificial Sequence
  Description of Artificial Sequence: Synthetic oligonucleotide
cccagacacctgcacgttctgattggg

SEQ ID NO: 156083 - DNA, 28 bp, Artificial Sequence
  Description of Artificial Sequence: Synthetic oligonucleotide
ccagacacctgcacgttctgattgggac

SEQ ID NO: 156084 - DNA, 28 bp, Artificial Sequence
  Description of Artificial Sequence: Synthetic oligonucleotide
cagacacctgcacgttctgattgggacc

SEQ ID NO: 156085 - DNA, 29 bp, Artificial Sequence
  Description of Artificial Sequence: Synthetic oligonucleotide
agacacctgcacgttctgattgggacctc

SEQ ID NO: 156086 - DNA, 28 bp, Artificial Sequence
  Description of Artificial Sequence: Synthetic oligonucleotide
gacacctgcacgttctgattgggacctc

SEQ ID NO: 156087 - DNA, 29 bp, Artificial Sequence
  Description of Artificial Sequence: Synthetic oligonucleotide
acacctgcacgttctgattgggacctcag

SEQ ID NO: 156088 - DNA, 28 bp, Artificial Sequence
  Description of Artificial Sequence: Synthetic oligonucleotide
cacctgcacgttctgattgggacctcag

SEQ ID NO: 156089 - DNA, 29 bp, Artificial Sequence
  Description of Artificial Sequence: Synthetic oligonucleotide
acctgcacgttctgattgggacctcagtg

SEQ ID NO: 156090 - DNA, 28 bp, Artificial Sequence
  Description of Artificial Sequence: Synthetic oligonucleotide
cctgcacgttctgattgggacctcagtg

SEQ ID NO: 156091 - DNA, 28 bp, Artificial Sequence
  Description of Artificial Sequence: Synthetic oligonucleotide
ctgcacgttctgattgggacctcagtgg

SEQ ID NO: 156092 - DNA, 29 bp, Artificial Sequence
  Description of Artificial Sequence: Synthetic oligonucleotide
tgcacgttctgattgggacctcagtggtc

SEQ ID NO: 156093 - DNA, 28 bp, Artificial Sequence
  Description of Artificial Sequence: Synthetic oligonucleotide
gcacgttctgattgggacctcagtggtc

SEQ ID NO: 156094 - DNA, 30 bp, Artificial Sequence
  Description of Artificial Sequence: Synthetic oligonucleotide
cacgttctgattgggacctcagtggtcatc

SEQ ID NO: 156095 - DNA, 32 bp, Artificial Sequence
  Description of Artificial Sequence: Synthetic oligonucleotide
acgttctgattgggacctcagtggtcatcatc

SEQ ID NO: 156096 - DNA, 31 bp, Artificial Sequence
  Description of Artificial Sequence: Synthetic oligonucleotide
cgttctgattgggacctcagtggtcatcatc

SEQ ID NO: 156097 - DNA, 31 bp, Artificial Sequence
  Description of Artificial Sequence: Synthetic oligonucleotide
attgggacctcagtggtcatcatcctcttcg

SEQ ID NO: 156098 - DNA, 30 bp, Artificial Sequence
  Description of Artificial Sequence: Synthetic oligonucleotide
ttgggacctcagtggtcatcatcctcttcg

SEQ ID NO: 156099 - DNA, 29 bp, Artificial Sequence
  Description of Artificial Sequence: Synthetic oligonucleotide
tgggacctcagtggtcatcatcctcttcg

SEQ ID NO: 156100 - DNA, 28 bp, Artificial Sequence
  Description of Artificial Sequence: Synthetic oligonucleotide
gggacctcagtggtcatcatcctcttcg

SEQ ID NO: 156101 - DNA, 29 bp, Artificial Sequence
  Description of Artificial Sequence: Synthetic oligonucleotide
ggacctcagtggtcatcatcctcttcgtc

SEQ ID NO: 156102 - DNA, 29 bp, Artificial Sequence
  Description of Artificial Sequence: Synthetic oligonucleotide
gacctcagtggtcatcatcctcttcgtcc

SEQ ID NO: 156103 - DNA, 30 bp, Artificial Sequence
  Description of Artificial Sequence: Synthetic oligonucleotide
acctcagtggtcatcatcctcttcgtcctc

SEQ ID NO: 156104 - DNA, 29 bp, Artificial Sequence
  Description of Artificial Sequence: Synthetic oligonucleotide
cctcagtggtcatcatcctcttcgtcctc

SEQ ID NO: 156105 - DNA, 29 bp, Artificial Sequence
  Description of Artificial Sequence: Synthetic oligonucleotide
ctcagtggtcatcatcctcttcgtcctcc

SEQ ID NO: 156106 - DNA, 30 bp, Artificial Sequence
  Description of Artificial Sequence: Synthetic oligonucleotide
tcagtggtcatcatcctcttcgtcctcctc

SEQ ID NO: 156107 - DNA, 29 bp, Artificial Sequence
  Description of Artificial Sequence: Synthetic oligonucleotide
cagtggtcatcatcctcttcgtcctcctc

SEQ ID NO: 156108 - DNA, 29 bp, Artificial Sequence
  Description of Artificial Sequence: Synthetic oligonucleotide
agtggtcatcatcctcttcgtcctcctcc

SEQ ID NO: 156109 - DNA, 28 bp, Artificial Sequence
  Description of Artificial Sequence: Synthetic oligonucleotide
gtggtcatcatcctcttcgtcctcctcc

SEQ ID NO: 156110 - DNA, 29 bp, Artificial Sequence
  Description of Artificial Sequence: Synthetic oligonucleotide
tggtcatcatcctcttcgtcctcctcctc

SEQ ID NO: 156111 - DNA, 28 bp, Artificial Sequence
  Description of Artificial Sequence: Synthetic oligonucleotide
ggtcatcatcctcttcgtcctcctcctc

SEQ ID NO: 156112 - DNA, 30 bp, Artificial Sequence
  Description of Artificial Sequence: Synthetic oligonucleotide
gtcatcatcctcttcgtcctcctcctcttc

SEQ ID NO: 156113 - DNA, 33 bp, Artificial Sequence
  Description of Artificial Sequence: Synthetic oligonucleotide
tcatcatcctcttcgtcctcctcctcttctttc

SEQ ID NO: 156114 - DNA, 32 bp, Artificial Sequence
  Description of Artificial Sequence: Synthetic oligonucleotide
catcatcctcttcgtcctcctcctcttctttc

SEQ ID NO: 156115 - DNA, 33 bp, Artificial Sequence
  Description of Artificial Sequence: Synthetic oligonucleotide
atcatcctcttcgtcctcctcctcttctttctc

SEQ ID NO: 156116 - DNA, 32 bp, Artificial Sequence
  Description of Artificial Sequence: Synthetic oligonucleotide
tcatcctcttcgtcctcctcctcttctttctc

SEQ ID NO: 156117 - DNA, 31 bp, Artificial Sequence
  Description of Artificial Sequence: Synthetic oligonucleotide
catcctcttcgtcctcctcctcttctttctc

SEQ ID NO: 156118 - DNA, 31 bp, Artificial Sequence
  Description of Artificial Sequence: Synthetic oligonucleotide
atcctcttcgtcctcctcctcttctttctcc

SEQ ID NO: 156119 - DNA, 30 bp, Artificial Sequence
  Description of Artificial Sequence: Synthetic oligonucleotide
tcctcttcgtcctcctcctcttctttctcc

SEQ ID NO: 156120 - DNA, 29 bp, Artificial Sequence
  Description of Artificial Sequence: Synthetic oligonucleotide
cctcttcgtcctcctcctcttctttctcc

SEQ ID NO: 156121 - DNA, 31 bp, Artificial Sequence
  Description of Artificial Sequence: Synthetic oligonucleotide
ctcttcgtcctcctcctcttctttctccttc

SEQ ID NO: 156122 - DNA, 33 bp, Artificial Sequence
  Description of Artificial Sequence: Synthetic oligonucleotide
tcttcgtcctcctcctcttctttctccttcatc

SEQ ID NO: 156123 - DNA, 32 bp, Artificial Sequence
  Description of Artificial Sequence: Synthetic oligonucleotide
cttcgtcctcctcctcttctttctccttcatc

SEQ ID NO: 156124 - DNA, 32 bp, Artificial Sequence
  Description of Artificial Sequence: Synthetic oligonucleotide
ttcgtcctcctcctcttctttctccttcatcg

SEQ ID NO: 156125 - DNA, 31 bp, Artificial Sequence
  Description of Artificial Sequence: Synthetic oligonucleotide
tcgtcctcctcctcttctttctccttcatcg

SEQ ID NO: 156126 - DNA, 30 bp, Artificial Sequence
  Description of Artificial Sequence: Synthetic oligonucleotide
cgtcctcctcctcttctttctccttcatcg

SEQ ID NO: 156127 - DNA, 30 bp, Artificial Sequence
  Description of Artificial Sequence: Synthetic oligonucleotide
gtcctcctcctcttctttctccttcatcgc

SEQ ID NO: 156128 - DNA, 37 bp, Artificial Sequence
  Description of Artificial Sequence: Synthetic oligonucleotide
cttcatcgctggtgctccaacaaaaaaaatgctgttg

SEQ ID NO: 156129 - DNA, 41 bp, Artificial Sequence
  Description of Artificial Sequence: Synthetic oligonucleotide
ttcatcgctggtgctccaacaaaaaaaatgctgttgtaatg

SEQ ID NO: 156130 - DNA, 40 bp, Artificial Sequence
  Description of Artificial Sequence: Synthetic oligonucleotide
tcatcgctggtgctccaacaaaaaaaatgctgttgtaatg

SEQ ID NO: 156131 - DNA, 39 bp, Artificial Sequence
  Description of Artificial Sequence: Synthetic oligonucleotide
catcgctggtgctccaacaaaaaaaatgctgttgtaatg

SEQ ID NO: 156132 - DNA, 39 bp, Artificial Sequence
  Description of Artificial Sequence: Synthetic oligonucleotide
atcgctggtgctccaacaaaaaaaatgctgttgtaatgg

SEQ ID NO: 156133 - DNA, 38 bp, Artificial Sequence
  Description of Artificial Sequence: Synthetic oligonucleotide
tcgctggtgctccaacaaaaaaaatgctgttgtaatgg

SEQ ID NO: 156134 - DNA, 37 bp, Artificial Sequence
  Description of Artificial Sequence: Synthetic oligonucleotide
cgctggtgctccaacaaaaaaaatgctgttgtaatgg

SEQ ID NO: 156135 - DNA, 38 bp, Artificial Sequence
  Description of Artificial Sequence: Synthetic oligonucleotide
gctggtgctccaacaaaaaaaatgctgttgtaatggac

SEQ ID NO: 156136 - DNA, 38 bp, Artificial Sequence
  Description of Artificial Sequence: Synthetic oligonucleotide
ctggtgctccaacaaaaaaaatgctgttgtaatggacc

SEQ ID NO: 156137 - DNA, 40 bp, Artificial Sequence
  Description of Artificial Sequence: Synthetic oligonucleotide
tggtgctccaacaaaaaaaatgctgttgtaatggaccaag

SEQ ID NO: 156138 - DNA, 39 bp, Artificial Sequence
  Description of Artificial Sequence: Synthetic oligonucleotide
ggtgctccaacaaaaaaaatgctgttgtaatggaccaag

SEQ ID NO: 156139 - DNA, 40 bp, Artificial Sequence
  Description of Artificial Sequence: Synthetic oligonucleotide
gtgctccaacaaaaaaaatgctgttgtaatggaccaagag

SEQ ID NO: 156140 - DNA, 40 bp, Artificial Sequence
  Description of Artificial Sequence: Synthetic oligonucleotide
tgctccaacaaaaaaaatgctgttgtaatggaccaagagc

SEQ ID NO: 156141 - DNA, 39 bp, Artificial Sequence
  Description of Artificial Sequence: Synthetic oligonucleotide
gctccaacaaaaaaaatgctgttgtaatggaccaagagc

SEQ ID NO: 156142 - DNA, 39 bp, Artificial Sequence
  Description of Artificial Sequence: Synthetic oligonucleotide
ctccaacaaaaaaaatgctgttgtaatggaccaagagcc

SEQ ID NO: 156143 - DNA, 40 bp, Artificial Sequence
  Description of Artificial Sequence: Synthetic oligonucleotide
tccaacaaaaaaaatgctgttgtaatggaccaagagcctg

SEQ ID NO: 156144 - DNA, 39 bp, Artificial Sequence
  Description of Artificial Sequence: Synthetic oligonucleotide
ccaacaaaaaaaatgctgttgtaatggaccaagagcctg

SEQ ID NO: 156145 - DNA, 31 bp, Artificial Sequence
  Description of Artificial Sequence: Synthetic oligonucleotide
tgtacacggaacttccaaatgctgagcccag

SEQ ID NO: 156146 - DNA, 30 bp, Artificial Sequence
  Description of Artificial Sequence: Synthetic oligonucleotide
gtacacggaacttccaaatgctgagcccag

SEQ ID NO: 156147 - DNA, 32 bp, Artificial Sequence
  Description of Artificial Sequence: Synthetic oligonucleotide
tacacggaacttccaaatgctgagcccagatc

SEQ ID NO: 156148 - DNA, 31 bp, Artificial Sequence
  Description of Artificial Sequence: Synthetic oligonucleotide
acacggaacttccaaatgctgagcccagatc

SEQ ID NO: 156149 - DNA, 30 bp, Artificial Sequence
  Description of Artificial Sequence: Synthetic oligonucleotide
cacggaacttccaaatgctgagcccagatc

SEQ ID NO: 156150 - DNA, 30 bp, Artificial Sequence
  Description of Artificial Sequence: Synthetic oligonucleotide
acggaacttccaaatgctgagcccagatcc

SEQ ID NO: 156151 - DNA, 29 bp, Artificial Sequence
  Description of Artificial Sequence: Synthetic oligonucleotide
cggaacttccaaatgctgagcccagatcc

SEQ ID NO: 156152 - DNA, 32 bp, Artificial Sequence
  Description of Artificial Sequence: Synthetic oligonucleotide
ggaacttccaaatgctgagcccagatccaaag

SEQ ID NO: 156153 - DNA, 34 bp, Artificial Sequence
  Description of Artificial Sequence: Synthetic oligonucleotide
gaacttccaaatgctgagcccagatccaaagttg

SEQ ID NO: 156154 - DNA, 35 bp, Artificial Sequence
  Description of Artificial Sequence: Synthetic oligonucleotide
aacttccaaatgctgagcccagatccaaagttgtc

SEQ ID NO: 156155 - DNA, 34 bp, Artificial Sequence
  Description of Artificial Sequence: Synthetic oligonucleotide
acttccaaatgctgagcccagatccaaagttgtc

SEQ ID NO: 156156 - DNA, 33 bp, Artificial Sequence
  Description of Artificial Sequence: Synthetic oligonucleotide
cttccaaatgctgagcccagatccaaagttgtc

SEQ ID NO: 156157 - DNA, 34 bp, Artificial Sequence
  Description of Artificial Sequence: Synthetic oligonucleotide
ttccaaatgctgagcccagatccaaagttgtctc

SEQ ID NO: 156158 - DNA, 33 bp, Artificial Sequence
  Description of Artificial Sequence: Synthetic oligonucleotide
tccaaatgctgagcccagatccaaagttgtctc

SEQ ID NO: 156159 - DNA, 32 bp, Artificial Sequence
  Description of Artificial Sequence: Synthetic oligonucleotide
ccaaatgctgagcccagatccaaagttgtctc

SEQ ID NO: 156160 - DNA, 32 bp, Artificial Sequence
  Description of Artificial Sequence: Synthetic oligonucleotide
caaatgctgagcccagatccaaagttgtctcc

SEQ ID NO: 156161 - DNA, 33 bp, Artificial Sequence
  Description of Artificial Sequence: Synthetic oligonucleotide
aaatgctgagcccagatccaaagttgtctcctg

SEQ ID NO: 156162 - DNA, 32 bp, Artificial Sequence
  Description of Artificial Sequence: Synthetic oligonucleotide
aatgctgagcccagatccaaagttgtctcctg

SEQ ID NO: 156163 - DNA, 31 bp, Artificial Sequence
  Description of Artificial Sequence: Synthetic oligonucleotide
atgctgagcccagatccaaagttgtctcctg

SEQ ID NO: 156164 - DNA, 30 bp, Artificial Sequence
  Description of Artificial Sequence: Synthetic oligonucleotide
tgctgagcccagatccaaagttgtctcctg

SEQ ID NO: 156165 - DNA, 29 bp, Artificial Sequence
  Description of Artificial Sequence: Synthetic oligonucleotide
gctgagcccagatccaaagttgtctcctg

SEQ ID NO: 156166 - DNA, 29 bp, Artificial Sequence
  Description of Artificial Sequence: Synthetic oligonucleotide
ctgagcccagatccaaagttgtctcctgc

SEQ ID NO: 156167 - DNA, 29 bp, Artificial Sequence
  Description of Artificial Sequence: Synthetic oligonucleotide
tgagcccagatccaaagttgtctcctgcc

SEQ ID NO: 156168 - DNA, 28 bp, Artificial Sequence
  Description of Artificial Sequence: Synthetic oligonucleotide
gagcccagatccaaagttgtctcctgcc

SEQ ID NO: 156169 - DNA, 28 bp, Artificial Sequence
  Description of Artificial Sequence: Synthetic oligonucleotide
agcccagatccaaagttgtctcctgccc

SEQ ID NO: 156170 - DNA, 27 bp, Artificial Sequence
  Description of Artificial Sequence: Synthetic oligonucleotide
gcccagatccaaagttgtctcctgccc

SEQ ID NO: 156171 - DNA, 29 bp, Artificial Sequence
  Description of Artificial Sequence: Synthetic oligonucleotide
cccagatccaaagttgtctcctgcccatg

SEQ ID NO: 156172 - DNA, 36 bp, Artificial Sequence
  Description of Artificial Sequence: Synthetic oligonucleotide
ttcatcgctggtgctgcaacaaaaaaaatgctgctg

SEQ ID NO: 156173 - DNA, 35 bp, Artificial Sequence
  Description of Artificial Sequence: Synthetic oligonucleotide
tcatcgctggtgctgcaacaaaaaaaatgctgctg

SEQ ID NO: 156174 - DNA, 34 bp, Artificial Sequence
  Description of Artificial Sequence: Synthetic oligonucleotide
catcgctggtgctgcaacaaaaaaaatgctgctg

SEQ ID NO: 156175 - DNA, 38 bp, Artificial Sequence
  Description of Artificial Sequence: Synthetic oligonucleotide
atcgctggtgctgcaacaaaaaaaatgctgctgtaatg

SEQ ID NO: 156176 - DNA, 37 bp, Artificial Sequence
  Description of Artificial Sequence: Synthetic oligonucleotide
tcgctggtgctgcaacaaaaaaaatgctgctgtaatg

SEQ ID NO: 156177 - DNA, 36 bp, Artificial Sequence
  Description of Artificial Sequence: Synthetic oligonucleotide
cgctggtgctgcaacaaaaaaaatgctgctgtaatg

SEQ ID NO: 156178 - DNA, 36 bp, Artificial Sequence
  Description of Artificial Sequence: Synthetic oligonucleotide
gctggtgctgcaacaaaaaaaatgctgctgtaatgg

SEQ ID NO: 156179 - DNA, 37 bp, Artificial Sequence
  Description of Artificial Sequence: Synthetic oligonucleotide
ctggtgctgcaacaaaaaaaatgctgctgtaatggac

SEQ ID NO: 156180 - DNA, 37 bp, Artificial Sequence
  Description of Artificial Sequence: Synthetic oligonucleotide
tggtgctgcaacaaaaaaaatgctgctgtaatggacc

SEQ ID NO: 156181 - DNA, 36 bp, Artificial Sequence
  Description of Artificial Sequence: Synthetic oligonucleotide
ggtgctgcaacaaaaaaaatgctgctgtaatggacc

SEQ ID NO: 156182 - DNA, 38 bp, Artificial Sequence
  Description of Artificial Sequence: Synthetic oligonucleotide
gtgctgcaacaaaaaaaatgctgctgtaatggaccaag

SEQ ID NO: 156183 - DNA, 39 bp, Artificial Sequence
  Description of Artificial Sequence: Synthetic oligonucleotide
tgctgcaacaaaaaaaatgctgctgtaatggaccaagag

SEQ ID NO: 156184 - DNA, 38 bp, Artificial Sequence
  Description of Artificial Sequence: Synthetic oligonucleotide
gctgcaacaaaaaaaatgctgctgtaatggaccaagag

SEQ ID NO: 156185 - DNA, 38 bp, Artificial Sequence
  Description of Artificial Sequence: Synthetic oligonucleotide
ctgcaacaaaaaaaatgctgctgtaatggaccaagagc

SEQ ID NO: 156186 - DNA, 38 bp, Artificial Sequence
  Description of Artificial Sequence: Synthetic oligonucleotide
tgcaacaaaaaaaatgctgctgtaatggaccaagagcc

SEQ ID NO: 156187 - DNA, 37 bp, Artificial Sequence
  Description of Artificial Sequence: Synthetic oligonucleotide
gcaacaaaaaaaatgctgctgtaatggaccaagagcc

SEQ ID NO: 156188 - DNA, 38 bp, Artificial Sequence
  Description of Artificial Sequence: Synthetic oligonucleotide
caacaaaaaaaatgctgctgtaatggaccaagagcctg

SEQ ID NO: 156189 - DNA, 38 bp, Artificial Sequence
  Description of Artificial Sequence: Synthetic oligonucleotide
aacaaaaaaaatgctgctgtaatggaccaagagcctgc

SEQ ID NO: 156190 - DNA, 37 bp, Artificial Sequence
  Description of Artificial Sequence: Synthetic oligonucleotide
acaaaaaaaatgctgctgtaatggaccaagagcctgc

SEQ ID NO: 156191 - DNA, 36 bp, Artificial Sequence
  Description of Artificial Sequence: Synthetic oligonucleotide
caaaaaaaatgctgctgtaatggaccaagagcctgc

SEQ ID NO: 156192 - DNA, 37 bp, Artificial Sequence
  Description of Artificial Sequence: Synthetic oligonucleotide
aaaaaaaatgctgctgtaatggaccaagagcctgcag

SEQ ID NO: 156193 - DNA, 36 bp, Artificial Sequence
  Description of Artificial Sequence: Synthetic oligonucleotide
aaaaaaatgctgctgtaatggaccaagagcctgcag

SEQ ID NO: 156194 - DNA, 35 bp, Artificial Sequence
  Description of Artificial Sequence: Synthetic oligonucleotide
aaaaaatgctgctgtaatggaccaagagcctgcag

SEQ ID NO: 156195 - DNA, 34 bp, Artificial Sequence
  Description of Artificial Sequence: Synthetic oligonucleotide
aaaaatgctgctgtaatggaccaagagcctgcag

SEQ ID NO: 156196 - DNA, 33 bp, Artificial Sequence
  Description of Artificial Sequence: Synthetic oligonucleotide
aaaatgctgctgtaatggaccaagagcctgcag

SEQ ID NO: 156197 - DNA, 32 bp, Artificial Sequence
  Description of Artificial Sequence: Synthetic oligonucleotide
aaatgctgctgtaatggaccaagagcctgcag

SEQ ID NO: 156198 - DNA, 31 bp, Artificial Sequence
  Description of Artificial Sequence: Synthetic oligonucleotide
aatgctgctgtaatggaccaagagcctgcag

SEQ ID NO: 156199 - DNA, 30 bp, Artificial Sequence
  Description of Artificial Sequence: Synthetic oligonucleotide
atgctgctgtaatggaccaagagcctgcag

SEQ ID NO: 156200 - DNA, 29 bp, Artificial Sequence
  Description of Artificial Sequence: Synthetic oligonucleotide
tgctgctgtaatggaccaagagcctgcag

SEQ ID NO: 156201 - DNA, 28 bp, Artificial Sequence
  Description of Artificial Sequence: Synthetic oligonucleotide
gctgctgtaatggaccaagagcctgcag

SEQ ID NO: 156202 - DNA, 28 bp, Artificial Sequence
  Description of Artificial Sequence: Synthetic oligonucleotide
ctgctgtaatggaccaagagcctgcagg

SEQ ID NO: 156203 - DNA, 28 bp, Artificial Sequence
  Description of Artificial Sequence: Synthetic oligonucleotide
tgctgtaatggaccaagagcctgcaggg

SEQ ID NO: 156204 - DNA, 27 bp, Artificial Sequence
  Description of Artificial Sequence: Synthetic oligonucleotide
gctgtaatggaccaagagcctgcaggg

SEQ ID NO: 156205 - DNA, 29 bp, Artificial Sequence
  Description of Artificial Sequence: Synthetic oligonucleotide
ctgtaatggaccaagagcctgcagggaac

SEQ ID NO: 156206 - DNA, 39 bp, Artificial Sequence
  Description of Artificial Sequence: Synthetic oligonucleotide
actgcgttttcacacagagaaaaatcactcacccttttc

SEQ ID NO: 156207 - DNA, 38 bp, Artificial Sequence
  Description of Artificial Sequence: Synthetic oligonucleotide
ctgcgttttcacacagagaaaaatcactcacccttttc

SEQ ID NO: 156208 - DNA, 39 bp, Artificial Sequence
  Description of Artificial Sequence: Synthetic oligonucleotide
tgcgttttcacacagagaaaaatcactcacccttttcag

SEQ ID NO: 156209 - DNA, 38 bp, Artificial Sequence
  Description of Artificial Sequence: Synthetic oligonucleotide
gcgttttcacacagagaaaaatcactcacccttttcag

SEQ ID NO: 156210 - DNA, 39 bp, Artificial Sequence
  Description of Artificial Sequence: Synthetic oligonucleotide
cgttttcacacagagaaaaatcactcacccttttcagag

SEQ ID NO: 156211 - DNA, 39 bp, Artificial Sequence
  Description of Artificial Sequence: Synthetic oligonucleotide
gttttcacacagagaaaaatcactcacccttttcagagg

SEQ ID NO: 156212 - DNA, 39 bp, Artificial Sequence
  Description of Artificial Sequence: Synthetic oligonucleotide
ttttcacacagagaaaaatcactcacccttttcagaggc

SEQ ID NO: 156213 - DNA, 38 bp, Artificial Sequence
  Description of Artificial Sequence: Synthetic oligonucleotide
tttcacacagagaaaaatcactcacccttttcagaggc

SEQ ID NO: 156214 - DNA, 37 bp, Artificial Sequence
  Description of Artificial Sequence: Synthetic oligonucleotide
ttcacacagagaaaaatcactcacccttttcagaggc

SEQ ID NO: 156215 - DNA, 36 bp, Artificial Sequence
  Description of Artificial Sequence: Synthetic oligonucleotide
tcacacagagaaaaatcactcacccttttcagaggc

SEQ ID NO: 156216 - DNA, 35 bp, Artificial Sequence
  Description of Artificial Sequence: Synthetic oligonucleotide
cacacagagaaaaatcactcacccttttcagaggc

SEQ ID NO: 156217 - DNA, 35 bp, Artificial Sequence
  Description of Artificial Sequence: Synthetic oligonucleotide
acacagagaaaaatcactcacccttttcagaggcc

SEQ ID NO: 156218 - DNA, 34 bp, Artificial Sequence
  Description of Artificial Sequence: Synthetic oligonucleotide
cacagagaaaaatcactcacccttttcagaggcc

SEQ ID NO: 156219 - DNA, 34 bp, Artificial Sequence
  Description of Artificial Sequence: Synthetic oligonucleotide
acagagaaaaatcactcacccttttcagaggccc

SEQ ID NO: 156220 - DNA, 33 bp, Artificial Sequence
  Description of Artificial Sequence: Synthetic oligonucleotide
cagagaaaaatcactcacccttttcagaggccc

SEQ ID NO: 156221 - DNA, 35 bp, Artificial Sequence
  Description of Artificial Sequence: Synthetic oligonucleotide
agagaaaaatcactcacccttttcagaggcccaag

SEQ ID NO: 156222 - DNA, 34 bp, Artificial Sequence
  Description of Artificial Sequence: Synthetic oligonucleotide
gagaaaaatcactcacccttttcagaggcccaag

SEQ ID NO: 156223 - DNA, 35 bp, Artificial Sequence
  Description of Artificial Sequence: Synthetic oligonucleotide
agaaaaatcactcacccttttcagaggcccaagac

SEQ ID NO: 156224 - DNA, 34 bp, Artificial Sequence
  Description of Artificial Sequence: Synthetic oligonucleotide
gaaaaatcactcacccttttcagaggcccaagac

SEQ ID NO: 156225 - DNA, 35 bp, Artificial Sequence
  Description of Artificial Sequence: Synthetic oligonucleotide
aaaaatcactcacccttttcagaggcccaagacac

SEQ ID NO: 156226 - DNA, 34 bp, Artificial Sequence
  Description of Artificial Sequence: Synthetic oligonucleotide
aaaatcactcacccttttcagaggcccaagacac

SEQ ID NO: 156227 - DNA, 33 bp, Artificial Sequence
  Description of Artificial Sequence: Synthetic oligonucleotide
aaatcactcacccttttcagaggcccaagacac

SEQ ID NO: 156228 - DNA, 32 bp, Artificial Sequence
  Description of Artificial Sequence: Synthetic oligonucleotide
aatcactcacccttttcagaggcccaagacac

SEQ ID NO: 156229 - DNA, 31 bp, Artificial Sequence
  Description of Artificial Sequence: Synthetic oligonucleotide
atcactcacccttttcagaggcccaagacac

SEQ ID NO: 156230 - DNA, 30 bp, Artificial Sequence
  Description of Artificial Sequence: Synthetic oligonucleotide
tcactcacccttttcagaggcccaagacac

SEQ ID NO: 156231 - DNA, 29 bp, Artificial Sequence
  Description of Artificial Sequence: Synthetic oligonucleotide
cactcacccttttcagaggcccaagacac

SEQ ID NO: 156232 - DNA, 29 bp, Artificial Sequence
  Description of Artificial Sequence: Synthetic oligonucleotide
actcacccttttcagaggcccaagacacc

SEQ ID NO: 156233 - DNA, 28 bp, Artificial Sequence
  Description of Artificial Sequence: Synthetic oligonucleotide
ctcacccttttcagaggcccaagacacc

SEQ ID NO: 156234 - DNA, 28 bp, Artificial Sequence
  Description of Artificial Sequence: Synthetic oligonucleotide
tcacccttttcagaggcccaagacaccc

SEQ ID NO: 156235 - DNA, 27 bp, Artificial Sequence
  Description of Artificial Sequence: Synthetic oligonucleotide
cacccttttcagaggcccaagacaccc

SEQ ID NO: 156236 - DNA, 27 bp, Artificial Sequence
  Description of Artificial Sequence: Synthetic oligonucleotide
acccttttcagaggcccaagacacccc

SEQ ID NO: 156237 - DNA, 26 bp, Artificial Sequence
  Description of Artificial Sequence: Synthetic oligonucleotide
cccttttcagaggcccaagacacccc

SEQ ID NO: 156238 - DNA, 27 bp, Artificial Sequence
  Description of Artificial Sequence: Synthetic oligonucleotide
ccttttcagaggcccaagacaccccca

SEQ ID NO: 156239 - DNA, 28 bp, Artificial Sequence
  Description of Artificial Sequence: Synthetic oligonucleotide
cttttcagaggcccaagacacccccaac

SEQ ID NO: 156240 - DNA, 29 bp, Artificial Sequence
  Description of Artificial Sequence: Synthetic oligonucleotide
ttttcagaggcccaagacacccccaacag

SEQ ID NO: 156241 - DNA, 28 bp, Artificial Sequence
  Description of Artificial Sequence: Synthetic oligonucleotide
tttcagaggcccaagacacccccaacag

SEQ ID NO: 156242 - DNA, 27 bp, Artificial Sequence
  Description of Artificial Sequence: Synthetic oligonucleotide
ttcagaggcccaagacacccccaacag

SEQ ID NO: 156243 - DNA, 26 bp, Artificial Sequence
  Description of Artificial Sequence: Synthetic oligonucleotide
agcgtgaccttgtcctgcagctccca

SEQ ID NO: 156244 - DNA, 25 bp, Artificial Sequence
  Description of Artificial Sequence: Synthetic oligonucleotide
gcgtgaccttgtcctgcagctccca

SEQ ID NO: 156245 - DNA, 26 bp, Artificial Sequence
  Description of Artificial Sequence: Synthetic oligonucleotide
cgtgaccttgtcctgcagctcccaga

SEQ ID NO: 156246 - DNA, 26 bp, Artificial Sequence
  Description of Artificial Sequence: Synthetic oligonucleotide
gtgaccttgtcctgcagctcccagag

SEQ ID NO: 156247 - DNA, 27 bp, Artificial Sequence
  Description of Artificial Sequence: Synthetic oligonucleotide
tgaccttgtcctgcagctcccagagct

SEQ ID NO: 156248 - DNA, 26 bp, Artificial Sequence
  Description of Artificial Sequence: Synthetic oligonucleotide
gaccttgtcctgcagctcccagagct

SEQ ID NO: 156249 - DNA, 26 bp, Artificial Sequence
  Description of Artificial Sequence: Synthetic oligonucleotide
accttgtcctgcagctcccagagctc

SEQ ID NO: 156250 - DNA, 25 bp, Artificial Sequence
  Description of Artificial Sequence: Synthetic oligonucleotide
ccttgtcctgcagctcccagagctc

SEQ ID NO: 156251 - DNA, 27 bp, Artificial Sequence
  Description of Artificial Sequence: Synthetic oligonucleotide
cttgtcctgcagctcccagagctccta

SEQ ID NO: 156252 - DNA, 28 bp, Artificial Sequence
  Description of Artificial Sequence: Synthetic oligonucleotide
ttgtcctgcagctcccagagctcctatg

SEQ ID NO: 156253 - DNA, 27 bp, Artificial Sequence
  Description of Artificial Sequence: Synthetic oligonucleotide
tgtcctgcagctcccagagctcctatg

SEQ ID NO: 156254 - DNA, 27 bp, Artificial Sequence
  Description of Artificial Sequence: Synthetic oligonucleotide
gtcctgcagctcccagagctcctatga

SEQ ID NO: 156255 - DNA, 27 bp, Artificial Sequence
  Description of Artificial Sequence: Synthetic oligonucleotide
tcctgcagctcccagagctcctatgac

SEQ ID NO: 156256 - DNA, 27 bp, Artificial Sequence
  Description of Artificial Sequence: Synthetic oligonucleotide
cctgcagctcccagagctcctatgaca

SEQ ID NO: 156257 - DNA, 28 bp, Artificial Sequence
  Description of Artificial Sequence: Synthetic oligonucleotide
ctgcagctcccagagctcctatgacatg

SEQ ID NO: 156258 - DNA, 30 bp, Artificial Sequence
  Description of Artificial Sequence: Synthetic oligonucleotide
tgcagctcccagagctcctatgacatgtac

SEQ ID NO: 156259 - DNA, 29 bp, Artificial Sequence
  Description of Artificial Sequence: Synthetic oligonucleotide
gcagctcccagagctcctatgacatgtac

SEQ ID NO: 156260 - DNA, 29 bp, Artificial Sequence
  Description of Artificial Sequence: Synthetic oligonucleotide
cagctcccagagctcctatgacatgtacc

SEQ ID NO: 156261 - DNA, 31 bp, Artificial Sequence
  Description of Artificial Sequence: Synthetic oligonucleotide
agctcccagagctcctatgacatgtaccatc

SEQ ID NO: 156262 - DNA, 30 bp, Artificial Sequence
  Description of Artificial Sequence: Synthetic oligonucleotide
gctcccagagctcctatgacatgtaccatc

SEQ ID NO: 156263 - DNA, 33 bp, Artificial Sequence
  Description of Artificial Sequence: Synthetic oligonucleotide
ctcccagagctcctatgacatgtaccatctatc

SEQ ID NO: 156264 - DNA, 33 bp, Artificial Sequence
  Description of Artificial Sequence: Synthetic oligonucleotide
tcccagagctcctatgacatgtaccatctatcc

SEQ ID NO: 156265 - DNA, 32 bp, Artificial Sequence
  Description of Artificial Sequence: Synthetic oligonucleotide
cccagagctcctatgacatgtaccatctatcc

SEQ ID NO: 156266 - DNA, 33 bp, Artificial Sequence
  Description of Artificial Sequence: Synthetic oligonucleotide
ccagagctcctatgacatgtaccatctatccag

SEQ ID NO: 156267 - DNA, 33 bp, Artificial Sequence
  Description of Artificial Sequence: Synthetic oligonucleotide
cagagctcctatgacatgtaccatctatccagg

SEQ ID NO: 156268 - DNA, 33 bp, Artificial Sequence
  Description of Artificial Sequence: Synthetic oligonucleotide
agagctcctatgacatgtaccatctatccaggg

SEQ ID NO: 156269 - DNA, 27 bp, Artificial Sequence
  Description of Artificial Sequence: Synthetic oligonucleotide
ggaaggggaggcccatgaacgtaggtt

SEQ ID NO: 156270 - DNA, 27 bp, Artificial Sequence
  Description of Artificial Sequence: Synthetic oligonucleotide
gaaggggaggcccatgaacgtaggttc

SEQ ID NO: 156271 - DNA, 28 bp, Artificial Sequence
  Description of Artificial Sequence: Synthetic oligonucleotide
aaggggaggcccatgaacgtaggttctc

SEQ ID NO: 156272 - DNA, 27 bp, Artificial Sequence
  Description of Artificial Sequence: Synthetic oligonucleotide
aggggaggcccatgaacgtaggttctc

SEQ ID NO: 156273 - DNA, 31 bp, Artificial Sequence
  Description of Artificial Sequence: Synthetic oligonucleotide
atgaacaagaccctcaggaggtgacatacgc

SEQ ID NO: 156274 - DNA, 30 bp, Artificial Sequence
  Description of Artificial Sequence: Synthetic oligonucleotide
tgaacaagaccctcaggaggtgacatacgc

SEQ ID NO: 156275 - DNA, 29 bp, Artificial Sequence
  Description of Artificial Sequence: Synthetic oligonucleotide
gaacaagaccctcaggaggtgacatacgc

SEQ ID NO: 156276 - DNA, 30 bp, Artificial Sequence
  Description of Artificial Sequence: Synthetic oligonucleotide
aacaagaccctcaggaggtgacatacgcac

SEQ ID NO: 156277 - DNA, 29 bp, Artificial Sequence
  Description of Artificial Sequence: Synthetic oligonucleotide
acaagaccctcaggaggtgacatacgcac

SEQ ID NO: 156278 - DNA, 28 bp, Artificial Sequence
  Description of Artificial Sequence: Synthetic oligonucleotide
caagaccctcaggaggtgacatacgcac

SEQ ID NO: 156279 - DNA, 29 bp, Artificial Sequence
  Description of Artificial Sequence: Synthetic oligonucleotide
aagaccctcaggaggtgacatacgcacag

SEQ ID NO: 156280 - DNA, 28 bp, Artificial Sequence
  Description of Artificial Sequence: Synthetic oligonucleotide
agaccctcaggaggtgacatacgcacag

SEQ ID NO: 156281 - DNA, 27 bp, Artificial Sequence
  Description of Artificial Sequence: Synthetic oligonucleotide
gaccctcaggaggtgacatacgcacag

SEQ ID NO: 156282 - DNA, 29 bp, Artificial Sequence
  Description of Artificial Sequence: Synthetic oligonucleotide
accctcaggaggtgacatacgcacagttg

SEQ ID NO: 156283 - DNA, 28 bp, Artificial Sequence
  Description of Artificial Sequence: Synthetic oligonucleotide
ccctcaggaggtgacatacgcacagttg

SEQ ID NO: 156284 - DNA, 31 bp, Artificial Sequence
  Description of Artificial Sequence: Synthetic oligonucleotide
cctcaggaggtgacatacgcacagttgaatc

SEQ ID NO: 156285 - DNA, 32 bp, Artificial Sequence
  Description of Artificial Sequence: Synthetic oligonucleotide
ctcaggaggtgacatacgcacagttgaatcac

SEQ ID NO: 156286 - DNA, 33 bp, Artificial Sequence
  Description of Artificial Sequence: Synthetic oligonucleotide
tcaggaggtgacatacgcacagttgaatcactg

SEQ ID NO: 156287 - DNA, 32 bp, Artificial Sequence
  Description of Artificial Sequence: Synthetic oligonucleotide
caggaggtgacatacgcacagttgaatcactg

SEQ ID NO: 156288 - DNA, 32 bp, Artificial Sequence
  Description of Artificial Sequence: Synthetic oligonucleotide
aggaggtgacatacgcacagttgaatcactgc

SEQ ID NO: 156289 - DNA, 31 bp, Artificial Sequence
  Description of Artificial Sequence: Synthetic oligonucleotide
ggaggtgacatacgcacagttgaatcactgc

SEQ ID NO: 156290 - DNA, 31 bp, Artificial Sequence
  Description of Artificial Sequence: Synthetic oligonucleotide
gaggtgacatacgcacagttgaatcactgcg

SEQ ID NO: 156291 - DNA, 35 bp, Artificial Sequence
  Description of Artificial Sequence: Synthetic oligonucleotide
aggtgacatacgcacagttgaatcactgcgttttc

SEQ ID NO: 156292 - DNA, 34 bp, Artificial Sequence
  Description of Artificial Sequence: Synthetic oligonucleotide
ggtgacatacgcacagttgaatcactgcgttttc

SEQ ID NO: 156293 - DNA, 35 bp, Artificial Sequence
  Description of Artificial Sequence: Synthetic oligonucleotide
gtgacatacgcacagttgaatcactgcgttttcac

SEQ ID NO: 156294 - DNA, 36 bp, Artificial Sequence
  Description of Artificial Sequence: Synthetic oligonucleotide
tgacatacgcacagttgaatcactgcgttttcacac

SEQ ID NO: 156295 - DNA, 35 bp, Artificial Sequence
  Description of Artificial Sequence: Synthetic oligonucleotide
gacatacgcacagttgaatcactgcgttttcacac

SEQ ID NO: 156296 - DNA, 36 bp, Artificial Sequence
  Description of Artificial Sequence: Synthetic oligonucleotide
acatacgcacagttgaatcactgcgttttcacacag

SEQ ID NO: 156297 - DNA, 35 bp, Artificial Sequence
  Description of Artificial Sequence: Synthetic oligonucleotide
catacgcacagttgaatcactgcgttttcacacag

SEQ ID NO: 156298 - DNA, 36 bp, Artificial Sequence
  Description of Artificial Sequence: Synthetic oligonucleotide
atacgcacagttgaatcactgcgttttcacacagag

SEQ ID NO: 156299 - DNA, 35 bp, Artificial Sequence
  Description of Artificial Sequence: Synthetic oligonucleotide
tacgcacagttgaatcactgcgttttcacacagag

SEQ ID NO: 156300 - DNA, 34 bp, Artificial Sequence
  Description of Artificial Sequence: Synthetic oligonucleotide
acgcacagttgaatcactgcgttttcacacagag

SEQ ID NO: 156301 - DNA, 33 bp, Artificial Sequence
  Description of Artificial Sequence: Synthetic oligonucleotide
cgcacagttgaatcactgcgttttcacacagag

SEQ ID NO: 156302 - DNA, 30 bp, Artificial Sequence
  Description of Artificial Sequence: Synthetic oligonucleotide
atgtccatgtcacccacggtcatcatcctg

SEQ ID NO: 156303 - DNA, 29 bp, Artificial Sequence
  Description of Artificial Sequence: Synthetic oligonucleotide
tgtccatgtcacccacggtcatcatcctg

SEQ ID NO: 156304 - DNA, 28 bp, Artificial Sequence
  Description of Artificial Sequence: Synthetic oligonucleotide
gtccatgtcacccacggtcatcatcctg

SEQ ID NO: 156305 - DNA, 28 bp, Artificial Sequence
  Description of Artificial Sequence: Synthetic oligonucleotide
tccatgtcacccacggtcatcatcctgg

SEQ ID NO: 156306 - DNA, 27 bp, Artificial Sequence
  Description of Artificial Sequence: Synthetic oligonucleotide
ccatgtcacccacggtcatcatcctgg

SEQ ID NO: 156307 - DNA, 27 bp, Artificial Sequence
  Description of Artificial Sequence: Synthetic oligonucleotide
catgtcacccacggtcatcatcctggc

SEQ ID NO: 156308 - DNA, 29 bp, Artificial Sequence
  Description of Artificial Sequence: Synthetic oligonucleotide
atgtcacccacggtcatcatcctggcatg

SEQ ID NO: 156309 - DNA, 28 bp, Artificial Sequence
  Description of Artificial Sequence: Synthetic oligonucleotide
tgtcacccacggtcatcatcctggcatg

SEQ ID NO: 156310 - DNA, 27 bp, Artificial Sequence
  Description of Artificial Sequence: Synthetic oligonucleotide
gtcacccacggtcatcatcctggcatg

SEQ ID NO: 156311 - DNA, 28 bp, Artificial Sequence
  Description of Artificial Sequence: Synthetic oligonucleotide
tcacccacggtcatcatcctggcatgtc

SEQ ID NO: 156312 - DNA, 27 bp, Artificial Sequence
  Description of Artificial Sequence: Synthetic oligonucleotide
cacccacggtcatcatcctggcatgtc

SEQ ID NO: 156313 - DNA, 29 bp, Artificial Sequence
  Description of Artificial Sequence: Synthetic oligonucleotide
acccacggtcatcatcctggcatgtcttg

SEQ ID NO: 156314 - DNA, 28 bp, Artificial Sequence
  Description of Artificial Sequence: Synthetic oligonucleotide
cccacggtcatcatcctggcatgtcttg

SEQ ID NO: 156315 - DNA, 28 bp, Artificial Sequence
  Description of Artificial Sequence: Synthetic oligonucleotide
ccacggtcatcatcctggcatgtcttgg

SEQ ID NO: 156316 - DNA, 28 bp, Artificial Sequence
  Description of Artificial Sequence: Synthetic oligonucleotide
cacggtcatcatcctggcatgtcttggg

SEQ ID NO: 156317 - DNA, 30 bp, Artificial Sequence
  Description of Artificial Sequence: Synthetic oligonucleotide
acggtcatcatcctggcatgtcttgggttc

SEQ ID NO: 156318 - DNA, 29 bp, Artificial Sequence
  Description of Artificial Sequence: Synthetic oligonucleotide
cggtcatcatcctggcatgtcttgggttc

SEQ ID NO: 156319 - DNA, 31 bp, Artificial Sequence
  Description of Artificial Sequence: Synthetic oligonucleotide
ggtcatcatcctggcatgtcttgggttcttc

SEQ ID NO: 156320 - DNA, 33 bp, Artificial Sequence
  Description of Artificial Sequence: Synthetic oligonucleotide
gtcatcatcctggcatgtcttgggttcttcttg

SEQ ID NO: 156321 - DNA, 33 bp, Artificial Sequence
  Description of Artificial Sequence: Synthetic oligonucleotide
tcatcatcctggcatgtcttgggttcttcttgg

SEQ ID NO: 156322 - DNA, 32 bp, Artificial Sequence
  Description of Artificial Sequence: Synthetic oligonucleotide
catcatcctggcatgtcttgggttcttcttgg

SEQ ID NO: 156323 - DNA, 33 bp, Artificial Sequence
  Description of Artificial Sequence: Synthetic oligonucleotide
atcatcctggcatgtcttgggttcttcttggac

SEQ ID NO: 156324 - DNA, 32 bp, Artificial Sequence
  Description of Artificial Sequence: Synthetic oligonucleotide
tcatcctggcatgtcttgggttcttcttggac

SEQ ID NO: 156325 - DNA, 31 bp, Artificial Sequence
  Description of Artificial Sequence: Synthetic oligonucleotide
catcctggcatgtcttgggttcttcttggac

SEQ ID NO: 156326 - DNA, 31 bp, Artificial Sequence
  Description of Artificial Sequence: Synthetic oligonucleotide
atcctggcatgtcttgggttcttcttggacc

SEQ ID NO: 156327 - DNA, 30 bp, Artificial Sequence
  Description of Artificial Sequence: Synthetic oligonucleotide
tcctggcatgtcttgggttcttcttggacc

SEQ ID NO: 156328 - DNA, 29 bp, Artificial Sequence
  Description of Artificial Sequence: Synthetic oligonucleotide
cctggcatgtcttgggttcttcttggacc

SEQ ID NO: 156329 - DNA, 30 bp, Artificial Sequence
  Description of Artificial Sequence: Synthetic oligonucleotide
ctggcatgtcttgggttcttcttggaccag

SEQ ID NO: 156330 - DNA, 31 bp, Artificial Sequence
  Description of Artificial Sequence: Synthetic oligonucleotide
tggcatgtcttgggttcttcttggaccagag

SEQ ID NO: 156331 - DNA, 30 bp, Artificial Sequence
  Description of Artificial Sequence: Synthetic oligonucleotide
ggcatgtcttgggttcttcttggaccagag

SEQ ID NO: 156332 - DNA, 31 bp, Artificial Sequence
  Description of Artificial Sequence: Synthetic oligonucleotide
gcatgtcttgggttcttcttggaccagagtg

SEQ ID NO: 156333 - DNA, 32 bp, Artificial Sequence
  Description of Artificial Sequence: Synthetic oligonucleotide
catgtcttgggttcttcttggaccagagtgtg

SEQ ID NO: 156334 - DNA, 33 bp, Artificial Sequence
  Description of Artificial Sequence: Synthetic oligonucleotide
atgtcttgggttcttcttggaccagagtgtgtg

SEQ ID NO: 156335 - DNA, 32 bp, Artificial Sequence
  Description of Artificial Sequence: Synthetic oligonucleotide
tgtcttgggttcttcttggaccagagtgtgtg

SEQ ID NO: 156336 - DNA, 31 bp, Artificial Sequence
  Description of Artificial Sequence: Synthetic oligonucleotide
gtcttgggttcttcttggaccagagtgtgtg

SEQ ID NO: 156337 - DNA, 31 bp, Artificial Sequence
  Description of Artificial Sequence: Synthetic oligonucleotide
tcttgggttcttcttggaccagagtgtgtgg

SEQ ID NO: 156338 - DNA, 30 bp, Artificial Sequence
  Description of Artificial Sequence: Synthetic oligonucleotide
cttgggttcttcttggaccagagtgtgtgg

SEQ ID NO: 156339 - DNA, 30 bp, Artificial Sequence
  Description of Artificial Sequence: Synthetic oligonucleotide
ttgggttcttcttggaccagagtgtgtggg

SEQ ID NO: 156340 - DNA, 29 bp, Artificial Sequence
  Description of Artificial Sequence: Synthetic oligonucleotide
tgggttcttcttggaccagagtgtgtggg

SEQ ID NO: 156341 - DNA, 28 bp, Artificial Sequence
  Description of Artificial Sequence: Synthetic oligonucleotide
gggttcttcttggaccagagtgtgtggg

SEQ ID NO: 156342 - DNA, 28 bp, Artificial Sequence
  Description of Artificial Sequence: Synthetic oligonucleotide
ggttcttcttggaccagagtgtgtgggc

SEQ ID NO: 156343 - DNA, 29 bp, Artificial Sequence
  Description of Artificial Sequence: Synthetic oligonucleotide
gttcttcttggaccagagtgtgtgggcac

SEQ ID NO: 156344 - DNA, 30 bp, Artificial Sequence
  Description of Artificial Sequence: Synthetic oligonucleotide
ttcttcttggaccagagtgtgtgggcacac

SEQ ID NO: 156345 - DNA, 29 bp, Artificial Sequence
  Description of Artificial Sequence: Synthetic oligonucleotide
tcttcttggaccagagtgtgtgggcacac

SEQ ID NO: 156346 - DNA, 28 bp, Artificial Sequence
  Description of Artificial Sequence: Synthetic oligonucleotide
cttcttggaccagagtgtgtgggcacac

SEQ ID NO: 156347 - DNA, 28 bp, Artificial Sequence
  Description of Artificial Sequence: Synthetic oligonucleotide
ttcttggaccagagtgtgtgggcacacg

SEQ ID NO: 156348 - DNA, 27 bp, Artificial Sequence
  Description of Artificial Sequence: Synthetic oligonucleotide
tcttggaccagagtgtgtgggcacacg

SEQ ID NO: 156349 - DNA, 27 bp, Artificial Sequence
  Description of Artificial Sequence: Synthetic oligonucleotide
cttggaccagagtgtgtgggcacacgt

SEQ ID NO: 156350 - DNA, 27 bp, Artificial Sequence
  Description of Artificial Sequence: Synthetic oligonucleotide
ttggaccagagtgtgtgggcacacgtg

SEQ ID NO: 156351 - DNA, 26 bp, Artificial Sequence
  Description of Artificial Sequence: Synthetic oligonucleotide
tggaccagagtgtgtgggcacacgtg

SEQ ID NO: 156352 - DNA, 25 bp, Artificial Sequence
  Description of Artificial Sequence: Synthetic oligonucleotide
ggaccagagtgtgtgggcacacgtg

SEQ ID NO: 156353 - DNA, 25 bp, Artificial Sequence
  Description of Artificial Sequence: Synthetic oligonucleotide
gaccagagtgtgtgggcacacgtgg

SEQ ID NO: 156354 - DNA, 26 bp, Artificial Sequence
  Description of Artificial Sequence: Synthetic oligonucleotide
accagagtgtgtgggcacacgtgggt

SEQ ID NO: 156355 - DNA, 25 bp, Artificial Sequence
  Description of Artificial Sequence: Synthetic oligonucleotide
ccagagtgtgtgggcacacgtgggt

SEQ ID NO: 156356 - DNA, 25 bp, Artificial Sequence
  Description of Artificial Sequence: Synthetic oligonucleotide
cagagtgtgtgggcacacgtgggtg

SEQ ID NO: 156357 - DNA, 26 bp, Artificial Sequence
  Description of Artificial Sequence: Synthetic oligonucleotide
agagtgtgtgggcacacgtgggtggt

SEQ ID NO: 156358 - DNA, 25 bp, Artificial Sequence
  Description of Artificial Sequence: Synthetic oligonucleotide
gagtgtgtgggcacacgtgggtggt

SEQ ID NO: 156359 - DNA, 26 bp, Artificial Sequence
  Description of Artificial Sequence: Synthetic oligonucleotide
agtgtgtgggcacacgtgggtggtca

SEQ ID NO: 156360 - DNA, 25 bp, Artificial Sequence
  Description of Artificial Sequence: Synthetic oligonucleotide
gtgtgtgggcacacgtgggtggtca

SEQ ID NO: 156361 - DNA, 25 bp, Artificial Sequence
  Description of Artificial Sequence: Synthetic oligonucleotide
tgtgtgggcacacgtgggtggtcag

SEQ ID NO: 156362 - DNA, 24 bp, Artificial Sequence
  Description of Artificial Sequence: Synthetic oligonucleotide
gtgtgggcacacgtgggtggtcag

SEQ ID NO: 156363 - DNA, 25 bp, Artificial Sequence
  Description of Artificial Sequence: Synthetic oligonucleotide
tgtgggcacacgtgggtggtcagga

SEQ ID NO: 156364 - DNA, 24 bp, Artificial Sequence
  Description of Artificial Sequence: Synthetic oligonucleotide
gtgggcacacgtgggtggtcagga

SEQ ID NO: 156365 - DNA, 26 bp, Artificial Sequence
  Description of Artificial Sequence: Synthetic oligonucleotide
tgggcacacgtgggtggtcaggacaa

SEQ ID NO: 156366 - DNA, 25 bp, Artificial Sequence
  Description of Artificial Sequence: Synthetic oligonucleotide
gggcacacgtgggtggtcaggacaa

SEQ ID NO: 156367 - DNA, 25 bp, Artificial Sequence
  Description of Artificial Sequence: Synthetic oligonucleotide
ggcacacgtgggtggtcaggacaag

SEQ ID NO: 156368 - DNA, 25 bp, Artificial Sequence
  Description of Artificial Sequence: Synthetic oligonucleotide
gcacacgtgggtggtcaggacaagc

SEQ ID NO: 156369 - DNA, 25 bp, Artificial Sequence
  Description of Artificial Sequence: Synthetic oligonucleotide
cacacgtgggtggtcaggacaagcc

SEQ ID NO: 156370 - DNA, 27 bp, Artificial Sequence
  Description of Artificial Sequence: Synthetic oligonucleotide
acacgtgggtggtcaggacaagccctt

SEQ ID NO: 156371 - DNA, 26 bp, Artificial Sequence
  Description of Artificial Sequence: Synthetic oligonucleotide
cacgtgggtggtcaggacaagccctt

SEQ ID NO: 156372 - DNA, 27 bp, Artificial Sequence
  Description of Artificial Sequence: Synthetic oligonucleotide
acgtgggtggtcaggacaagcccttct

SEQ ID NO: 156373 - DNA, 26 bp, Artificial Sequence
  Description of Artificial Sequence: Synthetic oligonucleotide
cgtgggtggtcaggacaagcccttct

SEQ ID NO: 156374 - DNA, 26 bp, Artificial Sequence
  Description of Artificial Sequence: Synthetic oligonucleotide
gtgggtggtcaggacaagcccttctg

SEQ ID NO: 156375 - DNA, 27 bp, Artificial Sequence
  Description of Artificial Sequence: Synthetic oligonucleotide
tgggtggtcaggacaagcccttctgct

SEQ ID NO: 156376 - DNA, 26 bp, Artificial Sequence
  Description of Artificial Sequence: Synthetic oligonucleotide
gggtggtcaggacaagcccttctgct

SEQ ID NO: 156377 - DNA, 27 bp, Artificial Sequence
  Description of Artificial Sequence: Synthetic oligonucleotide
ggtggtcaggacaagcccttctgctct

SEQ ID NO: 156378 - DNA, 27 bp, Artificial Sequence
  Description of Artificial Sequence: Synthetic oligonucleotide
gtggtcaggacaagcccttctgctctg

SEQ ID NO: 156379 - DNA, 27 bp, Artificial Sequence
  Description of Artificial Sequence: Synthetic oligonucleotide
tggtcaggacaagcccttctgctctgc

SEQ ID NO: 156380 - DNA, 26 bp, Artificial Sequence
  Description of Artificial Sequence: Synthetic oligonucleotide
ggtcaggacaagcccttctgctctgc

SEQ ID NO: 156381 - DNA, 27 bp, Artificial Sequence
  Description of Artificial Sequence: Synthetic oligonucleotide
gtcaggacaagcccttctgctctgcct

SEQ ID NO: 156382 - DNA, 27 bp, Artificial Sequence
  Description of Artificial Sequence: Synthetic oligonucleotide
tcaggacaagcccttctgctctgcctg

SEQ ID NO: 156383 - DNA, 26 bp, Artificial Sequence
  Description of Artificial Sequence: Synthetic oligonucleotide
caggacaagcccttctgctctgcctg

SEQ ID NO: 156384 - DNA, 26 bp, Artificial Sequence
  Description of Artificial Sequence: Synthetic oligonucleotide
aggacaagcccttctgctctgcctgg

SEQ ID NO: 156385 - DNA, 25 bp, Artificial Sequence
  Description of Artificial Sequence: Synthetic oligonucleotide
ggacaagcccttctgctctgcctgg

SEQ ID NO: 156386 - DNA, 25 bp, Artificial Sequence
  Description of Artificial Sequence: Synthetic oligonucleotide
gacaagcccttctgctctgcctggc

SEQ ID NO: 156387 - DNA, 25 bp, Artificial Sequence
  Description of Artificial Sequence: Synthetic oligonucleotide
acaagcccttctgctctgcctggcc

SEQ ID NO: 156388 - DNA, 24 bp, Artificial Sequence
  Description of Artificial Sequence: Synthetic oligonucleotide
caagcccttctgctctgcctggcc

SEQ ID NO: 156389 - DNA, 25 bp, Artificial Sequence
  Description of Artificial Sequence: Synthetic oligonucleotide
aagcccttctgctctgcctggccca

SEQ ID NO: 156390 - DNA, 24 bp, Artificial Sequence
  Description of Artificial Sequence: Synthetic oligonucleotide
agcccttctgctctgcctggccca

SEQ ID NO: 156391 - DNA, 23 bp, Artificial Sequence
  Description of Artificial Sequence: Synthetic oligonucleotide
gcccttctgctctgcctggccca

SEQ ID NO: 156392 - DNA, 23 bp, Artificial Sequence
  Description of Artificial Sequence: Synthetic oligonucleotide
cccttctgctctgcctggcccag

SEQ ID NO: 156393 - DNA, 23 bp, Artificial Sequence
  Description of Artificial Sequence: Synthetic oligonucleotide
ccttctgctctgcctggcccagc

SEQ ID NO: 156394 - DNA, 23 bp, Artificial Sequence
  Description of Artificial Sequence: Synthetic oligonucleotide
cttctgctctgcctggcccagcg

SEQ ID NO: 156395 - DNA, 24 bp, Artificial Sequence
  Description of Artificial Sequence: Synthetic oligonucleotide
ttctgctctgcctggcccagcgct

SEQ ID NO: 156396 - DNA, 23 bp, Artificial Sequence
  Description of Artificial Sequence: Synthetic oligonucleotide
tctgctctgcctggcccagcgct

SEQ ID NO: 156397 - DNA, 22 bp, Artificial Sequence
  Description of Artificial Sequence: Synthetic oligonucleotide
ctgctctgcctggcccagcgct

SEQ ID NO: 156398 - DNA, 23 bp, Artificial Sequence
  Description of Artificial Sequence: Synthetic oligonucleotide
tgctctgcctggcccagcgctgt

SEQ ID NO: 156399 - DNA, 22 bp, Artificial Sequence
  Description of Artificial Sequence: Synthetic oligonucleotide
gctctgcctggcccagcgctgt

SEQ ID NO: 156400 - DNA, 22 bp, Artificial Sequence
  Description of Artificial Sequence: Synthetic oligonucleotide
ctctgcctggcccagcgctgtg

SEQ ID NO: 156401 - DNA, 23 bp, Artificial Sequence
  Description of Artificial Sequence: Synthetic oligonucleotide
tctgcctggcccagcgctgtggt

SEQ ID NO: 156402 - DNA, 22 bp, Artificial Sequence
  Description of Artificial Sequence: Synthetic oligonucleotide
ctgcctggcccagcgctgtggt

SEQ ID NO: 156403 - DNA, 22 bp, Artificial Sequence
  Description of Artificial Sequence: Synthetic oligonucleotide
tgcctggcccagcgctgtggtg

SEQ ID NO: 156404 - DNA, 21 bp, Artificial Sequence
  Description of Artificial Sequence: Synthetic oligonucleotide
gcctggcccagcgctgtggtg

SEQ ID NO: 156405 - DNA, 21 bp, Artificial Sequence
  Description of Artificial Sequence: Synthetic oligonucleotide
cctggcccagcgctgtggtgc

SEQ ID NO: 156406 - DNA, 22 bp, Artificial Sequence
  Description of Artificial Sequence: Synthetic oligonucleotide
ctggcccagcgctgtggtgcct

SEQ ID NO: 156407 - DNA, 24 bp, Artificial Sequence
  Description of Artificial Sequence: Synthetic oligonucleotide
tggcccagcgctgtggtgcctcaa

SEQ ID NO: 156408 - DNA, 23 bp, Artificial Sequence
  Description of Artificial Sequence: Synthetic oligonucleotide
ggcccagcgctgtggtgcctcaa

SEQ ID NO: 156409 - DNA, 23 bp, Artificial Sequence
  Description of Artificial Sequence: Synthetic oligonucleotide
gcccagcgctgtggtgcctcaag

SEQ ID NO: 156410 - DNA, 24 bp, Artificial Sequence
  Description of Artificial Sequence: Synthetic oligonucleotide
cccagcgctgtggtgcctcaagga

SEQ ID NO: 156411 - DNA, 24 bp, Artificial Sequence
  Description of Artificial Sequence: Synthetic oligonucleotide
ccagcgctgtggtgcctcaaggag

SEQ ID NO: 156412 - DNA, 25 bp, Artificial Sequence
  Description of Artificial Sequence: Synthetic oligonucleotide
cagcgctgtggtgcctcaaggagga

SEQ ID NO: 156413 - DNA, 26 bp, Artificial Sequence
  Description of Artificial Sequence: Synthetic oligonucleotide
agcgctgtggtgcctcaaggaggaca

SEQ ID NO: 156414 - DNA, 25 bp, Artificial Sequence
  Description of Artificial Sequence: Synthetic oligonucleotide
gcgctgtggtgcctcaaggaggaca

SEQ ID NO: 156415 - DNA, 25 bp, Artificial Sequence
  Description of Artificial Sequence: Synthetic oligonucleotide
cgctgtggtgcctcaaggaggacac

SEQ ID NO: 156416 - DNA, 26 bp, Artificial Sequence
  Description of Artificial Sequence: Synthetic oligonucleotide
gctgtggtgcctcaaggaggacacgt

SEQ ID NO: 156417 - DNA, 27 bp, Artificial Sequence
  Description of Artificial Sequence: Synthetic oligonucleotide
ctgtggtgcctcaaggaggacacgtga

SEQ ID NO: 156418 - DNA, 27 bp, Artificial Sequence
  Description of Artificial Sequence: Synthetic oligonucleotide
tgtggtgcctcaaggaggacacgtgac

SEQ ID NO: 156419 - DNA, 27 bp, Artificial Sequence
  Description of Artificial Sequence: Synthetic oligonucleotide
gtggtgcctcaaggaggacacgtgact

SEQ ID NO: 156420 - DNA, 27 bp, Artificial Sequence
  Description of Artificial Sequence: Synthetic oligonucleotide
tggtgcctcaaggaggacacgtgactc

SEQ ID NO: 156421 - DNA, 27 bp, Artificial Sequence
  Description of Artificial Sequence: Synthetic oligonucleotide
ggtgcctcaaggaggacacgtgactct

SEQ ID NO: 156422 - DNA, 28 bp, Artificial Sequence
  Description of Artificial Sequence: Synthetic oligonucleotide
gtgcctcaaggaggacacgtgactcttc

SEQ ID NO: 156423 - DNA, 28 bp, Artificial Sequence
  Description of Artificial Sequence: Synthetic oligonucleotide
tgcctcaaggaggacacgtgactcttcg

SEQ ID NO: 156424 - DNA, 27 bp, Artificial Sequence
  Description of Artificial Sequence: Synthetic oligonucleotide
gcctcaaggaggacacgtgactcttcg

SEQ ID NO: 156425 - DNA, 27 bp, Artificial Sequence
  Description of Artificial Sequence: Synthetic oligonucleotide
cctcaaggaggacacgtgactcttcgg

SEQ ID NO: 156426 - DNA, 28 bp, Artificial Sequence
  Description of Artificial Sequence: Synthetic oligonucleotide
ctcaaggaggacacgtgactcttcggtg

SEQ ID NO: 156427 - DNA, 29 bp, Artificial Sequence
  Description of Artificial Sequence: Synthetic oligonucleotide
tcaaggaggacacgtgactcttcggtgtc

SEQ ID NO: 156428 - DNA, 28 bp, Artificial Sequence
  Description of Artificial Sequence: Synthetic oligonucleotide
caaggaggacacgtgactcttcggtgtc

SEQ ID NO: 156429 - DNA, 29 bp, Artificial Sequence
  Description of Artificial Sequence: Synthetic oligonucleotide
aaggaggacacgtgactcttcggtgtcac

SEQ ID NO: 156430 - DNA, 28 bp, Artificial Sequence
  Description of Artificial Sequence: Synthetic oligonucleotide
aggaggacacgtgactcttcggtgtcac

SEQ ID NO: 156431 - DNA, 27 bp, Artificial Sequence
  Description of Artificial Sequence: Synthetic oligonucleotide
ggaggacacgtgactcttcggtgtcac

SEQ ID NO: 156432 - DNA, 30 bp, Artificial Sequence
  Description of Artificial Sequence: Synthetic oligonucleotide
gaggacacgtgactcttcggtgtcactatc

SEQ ID NO: 156433 - DNA, 30 bp, Artificial Sequence
  Description of Artificial Sequence: Synthetic oligonucleotide
aggacacgtgactcttcggtgtcactatcg

SEQ ID NO: 156434 - DNA, 29 bp, Artificial Sequence
  Description of Artificial Sequence: Synthetic oligonucleotide
ggacacgtgactcttcggtgtcactatcg

SEQ ID NO: 156435 - DNA, 30 bp, Artificial Sequence
  Description of Artificial Sequence: Synthetic oligonucleotide
gacacgtgactcttcggtgtcactatcgtc

SEQ ID NO: 156436 - DNA, 30 bp, Artificial Sequence
  Description of Artificial Sequence: Synthetic oligonucleotide
acacgtgactcttcggtgtcactatcgtcg

SEQ ID NO: 156437 - DNA, 29 bp, Artificial Sequence
  Description of Artificial Sequence: Synthetic oligonucleotide
cacgtgactcttcggtgtcactatcgtcg

SEQ ID NO: 156438 - DNA, 30 bp, Artificial Sequence
  Description of Artificial Sequence: Synthetic oligonucleotide
acgtgactcttcggtgtcactatcgtcgtg

SEQ ID NO: 156439 - DNA, 29 bp, Artificial Sequence
  Description of Artificial Sequence: Synthetic oligonucleotide
cgtgactcttcggtgtcactatcgtcgtg

SEQ ID NO: 156440 - DNA, 29 bp, Artificial Sequence
  Description of Artificial Sequence: Synthetic oligonucleotide
gtgactcttcggtgtcactatcgtcgtgg

SEQ ID NO: 156441 - DNA, 29 bp, Artificial Sequence
  Description of Artificial Sequence: Synthetic oligonucleotide
tgactcttcggtgtcactatcgtcgtggg

SEQ ID NO: 156442 - DNA, 28 bp, Artificial Sequence
  Description of Artificial Sequence: Synthetic oligonucleotide
gactcttcggtgtcactatcgtcgtggg

SEQ ID NO: 156443 - DNA, 33 bp, Artificial Sequence
  Description of Artificial Sequence: Synthetic oligonucleotide
actcttcggtgtcactatcgtcgtgggtttaac

SEQ ID NO: 156444 - DNA, 32 bp, Artificial Sequence
  Description of Artificial Sequence: Synthetic oligonucleotide
ctcttcggtgtcactatcgtcgtgggtttaac

SEQ ID NO: 156445 - DNA, 34 bp, Artificial Sequence
  Description of Artificial Sequence: Synthetic oligonucleotide
tcttcggtgtcactatcgtcgtgggtttaacatc

SEQ ID NO: 156446 - DNA, 33 bp, Artificial Sequence
  Description of Artificial Sequence: Synthetic oligonucleotide
cttcggtgtcactatcgtcgtgggtttaacatc

SEQ ID NO: 156447 - DNA, 35 bp, Artificial Sequence
  Description of Artificial Sequence: Synthetic oligonucleotide
ttcggtgtcactatcgtcgtgggtttaacatcttc

SEQ ID NO: 156448 - DNA, 34 bp, Artificial Sequence
  Description of Artificial Sequence: Synthetic oligonucleotide
tcggtgtcactatcgtcgtgggtttaacatcttc

SEQ ID NO: 156449 - DNA, 33 bp, Artificial Sequence
  Description of Artificial Sequence: Synthetic oligonucleotide
cggtgtcactatcgtcgtgggtttaacatcttc

SEQ ID NO: 156450 - DNA, 34 bp, Artificial Sequence
  Description of Artificial Sequence: Synthetic oligonucleotide
ggtgtcactatcgtcgtgggtttaacatcttcac

SEQ ID NO: 156451 - DNA, 34 bp, Artificial Sequence
  Description of Artificial Sequence: Synthetic oligonucleotide
gtgtcactatcgtcgtgggtttaacatcttcacg

SEQ ID NO: 156452 - DNA, 34 bp, Artificial Sequence
  Description of Artificial Sequence: Synthetic oligonucleotide
tgtcactatcgtcgtgggtttaacatcttcacgc

SEQ ID NO: 156453 - DNA, 33 bp, Artificial Sequence
  Description of Artificial Sequence: Synthetic oligonucleotide
gtcactatcgtcgtgggtttaacatcttcacgc

SEQ ID NO: 156454 - DNA, 34 bp, Artificial Sequence
  Description of Artificial Sequence: Synthetic oligonucleotide
tcactatcgtcgtgggtttaacatcttcacgctg

SEQ ID NO: 156455 - DNA, 33 bp, Artificial Sequence
  Description of Artificial Sequence: Synthetic oligonucleotide
cactatcgtcgtgggtttaacatcttcacgctg

SEQ ID NO: 156456 - DNA, 35 bp, Artificial Sequence
  Description of Artificial Sequence: Synthetic oligonucleotide
actatcgtcgtgggtttaacatcttcacgctgtac

SEQ ID NO: 156457 - DNA, 34 bp, Artificial Sequence
  Description of Artificial Sequence: Synthetic oligonucleotide
ctatcgtcgtgggtttaacatcttcacgctgtac

SEQ ID NO: 156458 - DNA, 36 bp, Artificial Sequence
  Description of Artificial Sequence: Synthetic oligonucleotide
tatcgtcgtgggtttaacatcttcacgctgtacaag

SEQ ID NO: 156459 - DNA, 35 bp, Artificial Sequence
  Description of Artificial Sequence: Synthetic oligonucleotide
atcgtcgtgggtttaacatcttcacgctgtacaag

SEQ ID NO: 156460 - DNA, 34 bp, Artificial Sequence
  Description of Artificial Sequence: Synthetic oligonucleotide
tcgtcgtgggtttaacatcttcacgctgtacaag

SEQ ID NO: 156461 - DNA, 33 bp, Artificial Sequence
  Description of Artificial Sequence: Synthetic oligonucleotide
cgtcgtgggtttaacatcttcacgctgtacaag

SEQ ID NO: 156462 - DNA, 36 bp, Artificial Sequence
  Description of Artificial Sequence: Synthetic oligonucleotide
gtcgtgggtttaacatcttcacgctgtacaagaaag

SEQ ID NO: 156463 - DNA, 38 bp, Artificial Sequence
  Description of Artificial Sequence: Synthetic oligonucleotide
tcgtgggtttaacatcttcacgctgtacaagaaagatg

SEQ ID NO: 156464 - DNA, 37 bp, Artificial Sequence
  Description of Artificial Sequence: Synthetic oligonucleotide
cgtgggtttaacatcttcacgctgtacaagaaagatg

SEQ ID NO: 156465 - DNA, 37 bp, Artificial Sequence
  Description of Artificial Sequence: Synthetic oligonucleotide
gtgggtttaacatcttcacgctgtacaagaaagatgg

SEQ ID NO: 156466 - DNA, 37 bp, Artificial Sequence
  Description of Artificial Sequence: Synthetic oligonucleotide
tgggtttaacatcttcacgctgtacaagaaagatggg

SEQ ID NO: 156467 - DNA, 36 bp, Artificial Sequence
  Description of Artificial Sequence: Synthetic oligonucleotide
gggtttaacatcttcacgctgtacaagaaagatggg

SEQ ID NO: 156468 - DNA, 36 bp, Artificial Sequence
  Description of Artificial Sequence: Synthetic oligonucleotide
ggtttaacatcttcacgctgtacaagaaagatgggg

SEQ ID NO: 156469 - DNA, 37 bp, Artificial Sequence
  Description of Artificial Sequence: Synthetic oligonucleotide
gtttaacatcttcacgctgtacaagaaagatggggtc

SEQ ID NO: 156470 - DNA, 37 bp, Artificial Sequence
  Description of Artificial Sequence: Synthetic oligonucleotide
tttaacatcttcacgctgtacaagaaagatggggtcc

SEQ ID NO: 156471 - DNA, 36 bp, Artificial Sequence
  Description of Artificial Sequence: Synthetic oligonucleotide
ttaacatcttcacgctgtacaagaaagatggggtcc

SEQ ID NO: 156472 - DNA, 35 bp, Artificial Sequence
  Description of Artificial Sequence: Synthetic oligonucleotide
taacatcttcacgctgtacaagaaagatggggtcc

SEQ ID NO: 156473 - DNA, 34 bp, Artificial Sequence
  Description of Artificial Sequence: Synthetic oligonucleotide
aacatcttcacgctgtacaagaaagatggggtcc

SEQ ID NO: 156474 - DNA, 33 bp, Artificial Sequence
  Description of Artificial Sequence: Synthetic oligonucleotide
acatcttcacgctgtacaagaaagatggggtcc

SEQ ID NO: 156475 - DNA, 32 bp, Artificial Sequence
  Description of Artificial Sequence: Synthetic oligonucleotide
catcttcacgctgtacaagaaagatggggtcc

SEQ ID NO: 156476 - DNA, 32 bp, Artificial Sequence
  Description of Artificial Sequence: Synthetic oligonucleotide
atcttcacgctgtacaagaaagatggggtccc

SEQ ID NO: 156477 - DNA, 31 bp, Artificial Sequence
  Description of Artificial Sequence: Synthetic oligonucleotide
tcttcacgctgtacaagaaagatggggtccc

SEQ ID NO: 156478 - DNA, 30 bp, Artificial Sequence
  Description of Artificial Sequence: Synthetic oligonucleotide
cttcacgctgtacaagaaagatggggtccc

SEQ ID NO: 156479 - DNA, 31 bp, Artificial Sequence
  Description of Artificial Sequence: Synthetic oligonucleotide
ttcacgctgtacaagaaagatggggtccctg

SEQ ID NO: 156480 - DNA, 30 bp, Artificial Sequence
  Description of Artificial Sequence: Synthetic oligonucleotide
tcacgctgtacaagaaagatggggtccctg

SEQ ID NO: 156481 - DNA, 29 bp, Artificial Sequence
  Description of Artificial Sequence: Synthetic oligonucleotide
cacgctgtacaagaaagatggggtccctg

SEQ ID NO: 156482 - DNA, 30 bp, Artificial Sequence
  Description of Artificial Sequence: Synthetic oligonucleotide
acgctgtacaagaaagatggggtccctgtc

SEQ ID NO: 156483 - DNA, 29 bp, Artificial Sequence
  Description of Artificial Sequence: Synthetic oligonucleotide
cgctgtacaagaaagatggggtccctgtc

SEQ ID NO: 156484 - DNA, 29 bp, Artificial Sequence
  Description of Artificial Sequence: Synthetic oligonucleotide
gctgtacaagaaagatggggtccctgtcc

SEQ ID NO: 156485 - DNA, 29 bp, Artificial Sequence
  Description of Artificial Sequence: Synthetic oligonucleotide
ctgtacaagaaagatggggtccctgtccc

SEQ ID NO: 156486 - DNA, 30 bp, Artificial Sequence
  Description of Artificial Sequence: Synthetic oligonucleotide
tgtacaagaaagatggggtccctgtccctg

SEQ ID NO: 156487 - DNA, 29 bp, Artificial Sequence
  Description of Artificial Sequence: Synthetic oligonucleotide
gtacaagaaagatggggtccctgtccctg

SEQ ID NO: 156488 - DNA, 30 bp, Artificial Sequence
  Description of Artificial Sequence: Synthetic oligonucleotide
tacaagaaagatggggtccctgtccctgag

SEQ ID NO: 156489 - DNA, 29 bp, Artificial Sequence
  Description of Artificial Sequence: Synthetic oligonucleotide
acaagaaagatggggtccctgtccctgag

SEQ ID NO: 156490 - DNA, 28 bp, Artificial Sequence
  Description of Artificial Sequence: Synthetic oligonucleotide
caagaaagatggggtccctgtccctgag

SEQ ID NO: 156491 - DNA, 28 bp, Artificial Sequence
  Description of Artificial Sequence: Synthetic oligonucleotide
aagaaagatggggtccctgtccctgagc

SEQ ID NO: 156492 - DNA, 27 bp, Artificial Sequence
  Description of Artificial Sequence: Synthetic oligonucleotide
agaaagatggggtccctgtccctgagc

SEQ ID NO: 156493 - DNA, 27 bp, Artificial Sequence
  Description of Artificial Sequence: Synthetic oligonucleotide
gaaagatggggtccctgtccctgagct

SEQ ID NO: 156494 - DNA, 27 bp, Artificial Sequence
  Description of Artificial Sequence: Synthetic oligonucleotide
aaagatggggtccctgtccctgagctc

SEQ ID NO: 156495 - DNA, 27 bp, Artificial Sequence
  Description of Artificial Sequence: Synthetic oligonucleotide
aagatggggtccctgtccctgagctct

SEQ ID NO: 156496 - DNA, 27 bp, Artificial Sequence
  Description of Artificial Sequence: Synthetic oligonucleotide
agatggggtccctgtccctgagctcta

SEQ ID NO: 156497 - DNA, 26 bp, Artificial Sequence
  Description of Artificial Sequence: Synthetic oligonucleotide
gatggggtccctgtccctgagctcta

SEQ ID NO: 156498 - DNA, 27 bp, Artificial Sequence
  Description of Artificial Sequence: Synthetic oligonucleotide
atggggtccctgtccctgagctctaca

SEQ ID NO: 156499 - DNA, 27 bp, Artificial Sequence
  Description of Artificial Sequence: Synthetic oligonucleotide
tggggtccctgtccctgagctctacaa

SEQ ID NO: 156500 - DNA, 26 bp, Artificial Sequence
  Description of Artificial Sequence: Synthetic oligonucleotide
ggggtccctgtccctgagctctacaa

SEQ ID NO: 156501 - DNA, 27 bp, Artificial Sequence
  Description of Artificial Sequence: Synthetic oligonucleotide
gggtccctgtccctgagctctacaaca

SEQ ID NO: 156502 - DNA, 27 bp, Artificial Sequence
  Description of Artificial Sequence: Synthetic oligonucleotide
ggtccctgtccctgagctctacaacag

SEQ ID NO: 156503 - DNA, 33 bp, Artificial Sequence
  Description of Artificial Sequence: Synthetic oligonucleotide
gtccctgtccctgagctctacaacagaatattc

SEQ ID NO: 156504 - DNA, 34 bp, Artificial Sequence
  Description of Artificial Sequence: Synthetic oligonucleotide
tccctgtccctgagctctacaacagaatattctg

SEQ ID NO: 156505 - DNA, 33 bp, Artificial Sequence
  Description of Artificial Sequence: Synthetic oligonucleotide
ccctgtccctgagctctacaacagaatattctg

SEQ ID NO: 156506 - DNA, 33 bp, Artificial Sequence
  Description of Artificial Sequence: Synthetic oligonucleotide
cctgtccctgagctctacaacagaatattctgg

SEQ ID NO: 156507 - DNA, 35 bp, Artificial Sequence
  Description of Artificial Sequence: Synthetic oligonucleotide
ctgtccctgagctctacaacagaatattctggaac

SEQ ID NO: 156508 - DNA, 36 bp, Artificial Sequence
  Description of Artificial Sequence: Synthetic oligonucleotide
tgtccctgagctctacaacagaatattctggaacag

SEQ ID NO: 156509 - DNA, 35 bp, Artificial Sequence
  Description of Artificial Sequence: Synthetic oligonucleotide
gtccctgagctctacaacagaatattctggaacag

SEQ ID NO: 156510 - DNA, 38 bp, Artificial Sequence
  Description of Artificial Sequence: Synthetic oligonucleotide
tccctgagctctacaacagaatattctggaacagtttc

SEQ ID NO: 156511 - DNA, 37 bp, Artificial Sequence
  Description of Artificial Sequence: Synthetic oligonucleotide
ccctgagctctacaacagaatattctggaacagtttc

SEQ ID NO: 156512 - DNA, 37 bp, Artificial Sequence
  Description of Artificial Sequence: Synthetic oligonucleotide
cctgagctctacaacagaatattctggaacagtttcc

SEQ ID NO: 156513 - DNA, 38 bp, Artificial Sequence
  Description of Artificial Sequence: Synthetic oligonucleotide
ctgagctctacaacagaatattctggaacagtttcctc

SEQ ID NO: 156514 - DNA, 42 bp, Artificial Sequence
  Description of Artificial Sequence: Synthetic oligonucleotide
tgagctctacaacagaatattctggaacagtttcctcattag

SEQ ID NO: 156515 - DNA, 41 bp, Artificial Sequence
  Description of Artificial Sequence: Synthetic oligonucleotide
gagctctacaacagaatattctggaacagtttcctcattag

SEQ ID NO: 156516 - DNA, 41 bp, Artificial Sequence
  Description of Artificial Sequence: Synthetic oligonucleotide
agctctacaacagaatattctggaacagtttcctcattagc

SEQ ID NO: 156517 - DNA, 40 bp, Artificial Sequence
  Description of Artificial Sequence: Synthetic oligonucleotide
gctctacaacagaatattctggaacagtttcctcattagc

SEQ ID NO: 156518 - DNA, 40 bp, Artificial Sequence
  Description of Artificial Sequence: Synthetic oligonucleotide
ctctacaacagaatattctggaacagtttcctcattagcc

SEQ ID NO: 156519 - DNA, 40 bp, Artificial Sequence
  Description of Artificial Sequence: Synthetic oligonucleotide
tctacaacagaatattctggaacagtttcctcattagccc

SEQ ID NO: 156520 - DNA, 39 bp, Artificial Sequence
  Description of Artificial Sequence: Synthetic oligonucleotide
ctacaacagaatattctggaacagtttcctcattagccc

SEQ ID NO: 156521 - DNA, 40 bp, Artificial Sequence
  Description of Artificial Sequence: Synthetic oligonucleotide
tacaacagaatattctggaacagtttcctcattagccctg

SEQ ID NO: 156522 - DNA, 39 bp, Artificial Sequence
  Description of Artificial Sequence: Synthetic oligonucleotide
acaacagaatattctggaacagtttcctcattagccctg

SEQ ID NO: 156523 - DNA, 38 bp, Artificial Sequence
  Description of Artificial Sequence: Synthetic oligonucleotide
caacagaatattctggaacagtttcctcattagccctg

SEQ ID NO: 156524 - DNA, 39 bp, Artificial Sequence
  Description of Artificial Sequence: Synthetic oligonucleotide
aacagaatattctggaacagtttcctcattagccctgtg

SEQ ID NO: 156525 - DNA, 38 bp, Artificial Sequence
  Description of Artificial Sequence: Synthetic oligonucleotide
acagaatattctggaacagtttcctcattagccctgtg

SEQ ID NO: 156526 - DNA, 37 bp, Artificial Sequence
  Description of Artificial Sequence: Synthetic oligonucleotide
cagaatattctggaacagtttcctcattagccctgtg

SEQ ID NO: 156527 - DNA, 38 bp, Artificial Sequence
  Description of Artificial Sequence: Synthetic oligonucleotide
agaatattctggaacagtttcctcattagccctgtgac

SEQ ID NO: 156528 - DNA, 37 bp, Artificial Sequence
  Description of Artificial Sequence: Synthetic oligonucleotide
gaatattctggaacagtttcctcattagccctgtgac

SEQ ID NO: 156529 - DNA, 37 bp, Artificial Sequence
  Description of Artificial Sequence: Synthetic oligonucleotide
aatattctggaacagtttcctcattagccctgtgacc

SEQ ID NO: 156530 - DNA, 36 bp, Artificial Sequence
  Description of Artificial Sequence: Synthetic oligonucleotide
atattctggaacagtttcctcattagccctgtgacc

SEQ ID NO: 156531 - DNA, 35 bp, Artificial Sequence
  Description of Artificial Sequence: Synthetic oligonucleotide
tattctggaacagtttcctcattagccctgtgacc

SEQ ID NO: 156532 - DNA, 34 bp, Artificial Sequence
  Description of Artificial Sequence: Synthetic oligonucleotide
attctggaacagtttcctcattagccctgtgacc

SEQ ID NO: 156533 - DNA, 33 bp, Artificial Sequence
  Description of Artificial Sequence: Synthetic oligonucleotide
ttctggaacagtttcctcattagccctgtgacc

SEQ ID NO: 156534 - DNA, 32 bp, Artificial Sequence
  Description of Artificial Sequence: Synthetic oligonucleotide
tctggaacagtttcctcattagccctgtgacc

SEQ ID NO: 156535 - DNA, 31 bp, Artificial Sequence
  Description of Artificial Sequence: Synthetic oligonucleotide
ctggaacagtttcctcattagccctgtgacc

SEQ ID NO: 156536 - DNA, 31 bp, Artificial Sequence
  Description of Artificial Sequence: Synthetic oligonucleotide
tggaacagtttcctcattagccctgtgaccc

SEQ ID NO: 156537 - DNA, 30 bp, Artificial Sequence
  Description of Artificial Sequence: Synthetic oligonucleotide
ggaacagtttcctcattagccctgtgaccc

SEQ ID NO: 156538 - DNA, 30 bp, Artificial Sequence
  Description of Artificial Sequence: Synthetic oligonucleotide
gaacagtttcctcattagccctgtgacccc

SEQ ID NO: 156539 - DNA, 31 bp, Artificial Sequence
  Description of Artificial Sequence: Synthetic oligonucleotide
aacagtttcctcattagccctgtgaccccag

SEQ ID NO: 156540 - DNA, 30 bp, Artificial Sequence
  Description of Artificial Sequence: Synthetic oligonucleotide
acagtttcctcattagccctgtgaccccag

SEQ ID NO: 156541 - DNA, 29 bp, Artificial Sequence
  Description of Artificial Sequence: Synthetic oligonucleotide
cagtttcctcattagccctgtgaccccag

SEQ ID NO: 156542 - DNA, 29 bp, Artificial Sequence
  Description of Artificial Sequence: Synthetic oligonucleotide
agtttcctcattagccctgtgaccccagc

SEQ ID NO: 156543 - DNA, 28 bp, Artificial Sequence
  Description of Artificial Sequence: Synthetic oligonucleotide
gtttcctcattagccctgtgaccccagc

SEQ ID NO: 156544 - DNA, 29 bp, Artificial Sequence
  Description of Artificial Sequence: Synthetic oligonucleotide
tttcctcattagccctgtgaccccagcac

SEQ ID NO: 156545 - DNA, 28 bp, Artificial Sequence
  Description of Artificial Sequence: Synthetic oligonucleotide
ttcctcattagccctgtgaccccagcac

SEQ ID NO: 156546 - DNA, 27 bp, Artificial Sequence
  Description of Artificial Sequence: Synthetic oligonucleotide
tcctcattagccctgtgaccccagcac

SEQ ID NO: 156547 - DNA, 27 bp, Artificial Sequence
  Description of Artificial Sequence: Synthetic oligonucleotide
cctcattagccctgtgaccccagcaca

SEQ ID NO: 156548 - DNA, 27 bp, Artificial Sequence
  Description of Artificial Sequence: Synthetic oligonucleotide
ctcattagccctgtgaccccagcacac

SEQ ID NO: 156549 - DNA, 27 bp, Artificial Sequence
  Description of Artificial Sequence: Synthetic oligonucleotide
tcattagccctgtgaccccagcacacg

SEQ ID NO: 156550 - DNA, 26 bp, Artificial Sequence
  Description of Artificial Sequence: Synthetic oligonucleotide
cattagccctgtgaccccagcacacg

SEQ ID NO: 156551 - DNA, 27 bp, Artificial Sequence
  Description of Artificial Sequence: Synthetic oligonucleotide
attagccctgtgaccccagcacacgca

SEQ ID NO: 156552 - DNA, 26 bp, Artificial Sequence
  Description of Artificial Sequence: Synthetic oligonucleotide
ttagccctgtgaccccagcacacgca

SEQ ID NO: 156553 - DNA, 25 bp, Artificial Sequence
  Description of Artificial Sequence: Synthetic oligonucleotide
tagccctgtgaccccagcacacgca

SEQ ID NO: 156554 - DNA, 24 bp, Artificial Sequence
  Description of Artificial Sequence: Synthetic oligonucleotide
agccctgtgaccccagcacacgca

SEQ ID NO: 156555 - DNA, 23 bp, Artificial Sequence
  Description of Artificial Sequence: Synthetic oligonucleotide
gccctgtgaccccagcacacgca

SEQ ID NO: 156556 - DNA, 23 bp, Artificial Sequence
  Description of Artificial Sequence: Synthetic oligonucleotide
ccctgtgaccccagcacacgcag

SEQ ID NO: 156557 - DNA, 23 bp, Artificial Sequence
  Description of Artificial Sequence: Synthetic oligonucleotide
cctgtgaccccagcacacgcagg

SEQ ID NO: 156558 - DNA, 24 bp, Artificial Sequence
  Description of Artificial Sequence: Synthetic oligonucleotide
ctgtgaccccagcacacgcaggga

SEQ ID NO: 156559 - DNA, 24 bp, Artificial Sequence
  Description of Artificial Sequence: Synthetic oligonucleotide
tgtgaccccagcacacgcagggac

SEQ ID NO: 156560 - DNA, 23 bp, Artificial Sequence
  Description of Artificial Sequence: Synthetic oligonucleotide
gtgaccccagcacacgcagggac

SEQ ID NO: 156561 - DNA, 25 bp, Artificial Sequence
  Description of Artificial Sequence: Synthetic oligonucleotide
tgaccccagcacacgcagggaccta

SEQ ID NO: 156562 - DNA, 24 bp, Artificial Sequence
  Description of Artificial Sequence: Synthetic oligonucleotide
gaccccagcacacgcagggaccta

SEQ ID NO: 156563 - DNA, 25 bp, Artificial Sequence
  Description of Artificial Sequence: Synthetic oligonucleotide
accccagcacacgcagggacctaca

SEQ ID NO: 156564 - DNA, 24 bp, Artificial Sequence
  Description of Artificial Sequence: Synthetic oligonucleotide
ccccagcacacgcagggacctaca

SEQ ID NO: 156565 - DNA, 26 bp, Artificial Sequence
  Description of Artificial Sequence: Synthetic oligonucleotide
cccagcacacgcagggacctacagat

SEQ ID NO: 156566 - DNA, 27 bp, Artificial Sequence
  Description of Artificial Sequence: Synthetic oligonucleotide
ccagcacacgcagggacctacagatgt

SEQ ID NO: 156567 - DNA, 27 bp, Artificial Sequence
  Description of Artificial Sequence: Synthetic oligonucleotide
cagcacacgcagggacctacagatgtc

SEQ ID NO: 156568 - DNA, 27 bp, Artificial Sequence
  Description of Artificial Sequence: Synthetic oligonucleotide
agcacacgcagggacctacagatgtcg

SEQ ID NO: 156569 - DNA, 27 bp, Artificial Sequence
  Description of Artificial Sequence: Synthetic oligonucleotide
gcacacgcagggacctacagatgtcga

SEQ ID NO: 156570 - DNA, 27 bp, Artificial Sequence
  Description of Artificial Sequence: Synthetic oligonucleotide
cacacgcagggacctacagatgtcgag

SEQ ID NO: 156571 - DNA, 27 bp, Artificial Sequence
  Description of Artificial Sequence: Synthetic oligonucleotide
acacgcagggacctacagatgtcgagg

SEQ ID NO: 156572 - DNA, 27 bp, Artificial Sequence
  Description of Artificial Sequence: Synthetic oligonucleotide
cacgcagggacctacagatgtcgaggt

SEQ ID NO: 156573 - DNA, 30 bp, Artificial Sequence
  Description of Artificial Sequence: Synthetic oligonucleotide
acgcagggacctacagatgtcgaggttttc

SEQ ID NO: 156574 - DNA, 29 bp, Artificial Sequence
  Description of Artificial Sequence: Synthetic oligonucleotide
cgcagggacctacagatgtcgaggttttc

SEQ ID NO: 156575 - DNA, 30 bp, Artificial Sequence
  Description of Artificial Sequence: Synthetic oligonucleotide
gcagggacctacagatgtcgaggttttcac

SEQ ID NO: 156576 - DNA, 30 bp, Artificial Sequence
  Description of Artificial Sequence: Synthetic oligonucleotide
cagggacctacagatgtcgaggttttcacc

SEQ ID NO: 156577 - DNA, 30 bp, Artificial Sequence
  Description of Artificial Sequence: Synthetic oligonucleotide
agggacctacagatgtcgaggttttcaccc

SEQ ID NO: 156578 - DNA, 29 bp, Artificial Sequence
  Description of Artificial Sequence: Synthetic oligonucleotide
gggacctacagatgtcgaggttttcaccc

SEQ ID NO: 156579 - DNA, 29 bp, Artificial Sequence
  Description of Artificial Sequence: Synthetic oligonucleotide
ggacctacagatgtcgaggttttcacccg

SEQ ID NO: 156580 - DNA, 29 bp, Artificial Sequence
  Description of Artificial Sequence: Synthetic oligonucleotide
gacctacagatgtcgaggttttcacccgc

SEQ ID NO: 156581 - DNA, 30 bp, Artificial Sequence
  Description of Artificial Sequence: Synthetic oligonucleotide
acctacagatgtcgaggttttcacccgcac

SEQ ID NO: 156582 - DNA, 29 bp, Artificial Sequence
  Description of Artificial Sequence: Synthetic oligonucleotide
cctacagatgtcgaggttttcacccgcac

SEQ ID NO: 156583 - DNA, 30 bp, Artificial Sequence
  Description of Artificial Sequence: Synthetic oligonucleotide
ctacagatgtcgaggttttcacccgcactc

SEQ ID NO: 156584 - DNA, 30 bp, Artificial Sequence
  Description of Artificial Sequence: Synthetic oligonucleotide
tacagatgtcgaggttttcacccgcactcc

SEQ ID NO: 156585 - DNA, 29 bp, Artificial Sequence
  Description of Artificial Sequence: Synthetic oligonucleotide
acagatgtcgaggttttcacccgcactcc

SEQ ID NO: 156586 - DNA, 28 bp, Artificial Sequence
  Description of Artificial Sequence: Synthetic oligonucleotide
cagatgtcgaggttttcacccgcactcc

SEQ ID NO: 156587 - DNA, 28 bp, Artificial Sequence
  Description of Artificial Sequence: Synthetic oligonucleotide
agatgtcgaggttttcacccgcactccc

SEQ ID NO: 156588 - DNA, 27 bp, Artificial Sequence
  Description of Artificial Sequence: Synthetic oligonucleotide
gatgtcgaggttttcacccgcactccc

SEQ ID NO: 156589 - DNA, 27 bp, Artificial Sequence
  Description of Artificial Sequence: Synthetic oligonucleotide
atgtcgaggttttcacccgcactcccc

SEQ ID NO: 156590 - DNA, 26 bp, Artificial Sequence
  Description of Artificial Sequence: Synthetic oligonucleotide
tgtcgaggttttcacccgcactcccc

SEQ ID NO: 156591 - DNA, 25 bp, Artificial Sequence
  Description of Artificial Sequence: Synthetic oligonucleotide
gtcgaggttttcacccgcactcccc

SEQ ID NO: 156592 - DNA, 26 bp, Artificial Sequence
  Description of Artificial Sequence: Synthetic oligonucleotide
tcgaggttttcacccgcactccccca

SEQ ID NO: 156593 - DNA, 25 bp, Artificial Sequence
  Description of Artificial Sequence: Synthetic oligonucleotide
cgaggttttcacccgcactccccca

SEQ ID NO: 156594 - DNA, 26 bp, Artificial Sequence
  Description of Artificial Sequence: Synthetic oligonucleotide
gaggttttcacccgcactcccccact

SEQ ID NO: 156595 - DNA, 27 bp, Artificial Sequence
  Description of Artificial Sequence: Synthetic oligonucleotide
aggttttcacccgcactcccccactga

SEQ ID NO: 156596 - DNA, 26 bp, Artificial Sequence
  Description of Artificial Sequence: Synthetic oligonucleotide
ggttttcacccgcactcccccactga

SEQ ID NO: 156597 - DNA, 27 bp, Artificial Sequence
  Description of Artificial Sequence: Synthetic oligonucleotide
gttttcacccgcactcccccactgagt

SEQ ID NO: 156598 - DNA, 27 bp, Artificial Sequence
  Description of Artificial Sequence: Synthetic oligonucleotide
ttttcacccgcactcccccactgagtg

SEQ ID NO: 156599 - DNA, 26 bp, Artificial Sequence
  Description of Artificial Sequence: Synthetic oligonucleotide
tttcacccgcactcccccactgagtg

SEQ ID NO: 156600 - DNA, 25 bp, Artificial Sequence
  Description of Artificial Sequence: Synthetic oligonucleotide
ttcacccgcactcccccactgagtg

SEQ ID NO: 156601 - DNA, 24 bp, Artificial Sequence
  Description of Artificial Sequence: Synthetic oligonucleotide
tcacccgcactcccccactgagtg

SEQ ID NO: 156602 - DNA, 23 bp, Artificial Sequence
  Description of Artificial Sequence: Synthetic oligonucleotide
cacccgcactcccccactgagtg

SEQ ID NO: 156603 - DNA, 24 bp, Artificial Sequence
  Description of Artificial Sequence: Synthetic oligonucleotide
acccgcactcccccactgagtggt

SEQ ID NO: 156604 - DNA, 23 bp, Artificial Sequence
  Description of Artificial Sequence: Synthetic oligonucleotide
cccgcactcccccactgagtggt

SEQ ID NO: 156605 - DNA, 23 bp, Artificial Sequence
  Description of Artificial Sequence: Synthetic oligonucleotide
ccgcactcccccactgagtggtc

SEQ ID NO: 156606 - DNA, 23 bp, Artificial Sequence
  Description of Artificial Sequence: Synthetic oligonucleotide
cgcactcccccactgagtggtcg

SEQ ID NO: 156607 - DNA, 23 bp, Artificial Sequence
  Description of Artificial Sequence: Synthetic oligonucleotide
gcactcccccactgagtggtcgg

SEQ ID NO: 156608 - DNA, 24 bp, Artificial Sequence
  Description of Artificial Sequence: Synthetic oligonucleotide
cactcccccactgagtggtcggca

SEQ ID NO: 156609 - DNA, 24 bp, Artificial Sequence
  Description of Artificial Sequence: Synthetic oligonucleotide
actcccccactgagtggtcggcac

SEQ ID NO: 156610 - DNA, 23 bp, Artificial Sequence
  Description of Artificial Sequence: Synthetic oligonucleotide
ctcccccactgagtggtcggcac

SEQ ID NO: 156611 - DNA, 23 bp, Artificial Sequence
  Description of Artificial Sequence: Synthetic oligonucleotide
tcccccactgagtggtcggcacc

SEQ ID NO: 156612 - DNA, 22 bp, Artificial Sequence
  Description of Artificial Sequence: Synthetic oligonucleotide
cccccactgagtggtcggcacc

SEQ ID NO: 156613 - DNA, 23 bp, Artificial Sequence
  Description of Artificial Sequence: Synthetic oligonucleotide
ccccactgagtggtcggcaccca

SEQ ID NO: 156614 - DNA, 23 bp, Artificial Sequence
  Description of Artificial Sequence: Synthetic oligonucleotide
cccactgagtggtcggcacccag

SEQ ID NO: 156615 - DNA, 25 bp, Artificial Sequence
  Description of Artificial Sequence: Synthetic oligonucleotide
ccactgagtggtcggcacccagcaa

SEQ ID NO: 156616 - DNA, 25 bp, Artificial Sequence
  Description of Artificial Sequence: Synthetic oligonucleotide
cactgagtggtcggcacccagcaac

SEQ ID NO: 156617 - DNA, 25 bp, Artificial Sequence
  Description of Artificial Sequence: Synthetic oligonucleotide
actgagtggtcggcacccagcaacc

SEQ ID NO: 156618 - DNA, 24 bp, Artificial Sequence
  Description of Artificial Sequence: Synthetic oligonucleotide
ctgagtggtcggcacccagcaacc

SEQ ID NO: 156619 - DNA, 24 bp, Artificial Sequence
  Description of Artificial Sequence: Synthetic oligonucleotide
tgagtggtcggcacccagcaaccc

SEQ ID NO: 156620 - DNA, 23 bp, Artificial Sequence
  Description of Artificial Sequence: Synthetic oligonucleotide
gagtggtcggcacccagcaaccc

SEQ ID NO: 156621 - DNA, 23 bp, Artificial Sequence
  Description of Artificial Sequence: Synthetic oligonucleotide
agtggtcggcacccagcaacccc

SEQ ID NO: 156622 - DNA, 22 bp, Artificial Sequence
  Description of Artificial Sequence: Synthetic oligonucleotide
gtggtcggcacccagcaacccc

SEQ ID NO: 156623 - DNA, 23 bp, Artificial Sequence
  Description of Artificial Sequence: Synthetic oligonucleotide
tggtcggcacccagcaaccccct

SEQ ID NO: 156624 - DNA, 22 bp, Artificial Sequence
  Description of Artificial Sequence: Synthetic oligonucleotide
ggtcggcacccagcaaccccct

SEQ ID NO: 156625 - DNA, 22 bp, Artificial Sequence
  Description of Artificial Sequence: Synthetic oligonucleotide
gtcggcacccagcaaccccctg

SEQ ID NO: 156626 - DNA, 23 bp, Artificial Sequence
  Description of Artificial Sequence: Synthetic oligonucleotide
tcggcacccagcaaccccctggt

SEQ ID NO: 156627 - DNA, 22 bp, Artificial Sequence
  Description of Artificial Sequence: Synthetic oligonucleotide
cggcacccagcaaccccctggt

SEQ ID NO: 156628 - DNA, 24 bp, Artificial Sequence
  Description of Artificial Sequence: Synthetic oligonucleotide
ggcacccagcaaccccctggtgat

SEQ ID NO: 156629 - DNA, 26 bp, Artificial Sequence
  Description of Artificial Sequence: Synthetic oligonucleotide
gcacccagcaaccccctggtgatcat

SEQ ID NO: 156630 - DNA, 26 bp, Artificial Sequence
  Description of Artificial Sequence: Synthetic oligonucleotide
cacccagcaaccccctggtgatcatg

SEQ ID NO: 156631 - DNA, 27 bp, Artificial Sequence
  Description of Artificial Sequence: Synthetic oligonucleotide
acccagcaaccccctggtgatcatggt

SEQ ID NO: 156632 - DNA, 26 bp, Artificial Sequence
  Description of Artificial Sequence: Synthetic oligonucleotide
cccagcaaccccctggtgatcatggt

SEQ ID NO: 156633 - DNA, 27 bp, Artificial Sequence
  Description of Artificial Sequence: Synthetic oligonucleotide
ccagcaaccccctggtgatcatggtca

SEQ ID NO: 156634 - DNA, 27 bp, Artificial Sequence
  Description of Artificial Sequence: Synthetic oligonucleotide
cagcaaccccctggtgatcatggtcac

SEQ ID NO: 156635 - DNA, 28 bp, Artificial Sequence
  Description of Artificial Sequence: Synthetic oligonucleotide
agcaaccccctggtgatcatggtcacag

SEQ ID NO: 156636 - DNA, 27 bp, Artificial Sequence
  Description of Artificial Sequence: Synthetic oligonucleotide
gcaaccccctggtgatcatggtcacag

SEQ ID NO: 156637 - DNA, 27 bp, Artificial Sequence
  Description of Artificial Sequence: Synthetic oligonucleotide
caaccccctggtgatcatggtcacagg

SEQ ID NO: 156638 - DNA, 28 bp, Artificial Sequence
  Description of Artificial Sequence: Synthetic oligonucleotide
aaccccctggtgatcatggtcacaggtc

SEQ ID NO: 156639 - DNA, 27 bp, Artificial Sequence
  Description of Artificial Sequence: Synthetic oligonucleotide
accccctggtgatcatggtcacaggtc

SEQ ID NO: 156640 - DNA, 27 bp, Artificial Sequence
  Description of Artificial Sequence: Synthetic oligonucleotide
ccccctggtgatcatggtcacaggtct

SEQ ID NO: 156641 - DNA, 31 bp, Artificial Sequence
  Description of Artificial Sequence: Synthetic oligonucleotide
cccctggtgatcatggtcacaggtctatatg

SEQ ID NO: 156642 - DNA, 32 bp, Artificial Sequence
  Description of Artificial Sequence: Synthetic oligonucleotide
ccctggtgatcatggtcacaggtctatatgag

SEQ ID NO: 156643 - DNA, 35 bp, Artificial Sequence
  Description of Artificial Sequence: Synthetic oligonucleotide
cctggtgatcatggtcacaggtctatatgagaaac

SEQ ID NO: 156644 - DNA, 35 bp, Artificial Sequence
  Description of Artificial Sequence: Synthetic oligonucleotide
ctggtgatcatggtcacaggtctatatgagaaacc

SEQ ID NO: 156645 - DNA, 37 bp, Artificial Sequence
  Description of Artificial Sequence: Synthetic oligonucleotide
tggtgatcatggtcacaggtctatatgagaaaccttc

SEQ ID NO: 156646 - DNA, 36 bp, Artificial Sequence
  Description of Artificial Sequence: Synthetic oligonucleotide
ggtgatcatggtcacaggtctatatgagaaaccttc

SEQ ID NO: 156647 - DNA, 36 bp, Artificial Sequence
  Description of Artificial Sequence: Synthetic oligonucleotide
gtgatcatggtcacaggtctatatgagaaaccttcg

SEQ ID NO: 156648 - DNA, 36 bp, Artificial Sequence
  Description of Artificial Sequence: Synthetic oligonucleotide
tgatcatggtcacaggtctatatgagaaaccttcgc

SEQ ID NO: 156649 - DNA, 35 bp, Artificial Sequence
  Description of Artificial Sequence: Synthetic oligonucleotide
gatcatggtcacaggtctatatgagaaaccttcgc

SEQ ID NO: 156650 - DNA, 38 bp, Artificial Sequence
  Description of Artificial Sequence: Synthetic oligonucleotide
atcatggtcacaggtctatatgagaaaccttcgcttac

SEQ ID NO: 156651 - DNA, 37 bp, Artificial Sequence
  Description of Artificial Sequence: Synthetic oligonucleotide
tcatggtcacaggtctatatgagaaaccttcgcttac

SEQ ID NO: 156652 - DNA, 36 bp, Artificial Sequence
  Description of Artificial Sequence: Synthetic oligonucleotide
catggtcacaggtctatatgagaaaccttcgcttac

SEQ ID NO: 156653 - DNA, 37 bp, Artificial Sequence
  Description of Artificial Sequence: Synthetic oligonucleotide
atggtcacaggtctatatgagaaaccttcgcttacag

SEQ ID NO: 156654 - DNA, 36 bp, Artificial Sequence
  Description of Artificial Sequence: Synthetic oligonucleotide
tggtcacaggtctatatgagaaaccttcgcttacag

SEQ ID NO: 156655 - DNA, 35 bp, Artificial Sequence
  Description of Artificial Sequence: Synthetic oligonucleotide
ggtcacaggtctatatgagaaaccttcgcttacag

SEQ ID NO: 156656 - DNA, 35 bp, Artificial Sequence
  Description of Artificial Sequence: Synthetic oligonucleotide
gtcacaggtctatatgagaaaccttcgcttacagc

SEQ ID NO: 156657 - DNA, 35 bp, Artificial Sequence
  Description of Artificial Sequence: Synthetic oligonucleotide
tcacaggtctatatgagaaaccttcgcttacagcc

SEQ ID NO: 156658 - DNA, 34 bp, Artificial Sequence
  Description of Artificial Sequence: Synthetic oligonucleotide
cacaggtctatatgagaaaccttcgcttacagcc

SEQ ID NO: 156659 - DNA, 34 bp, Artificial Sequence
  Description of Artificial Sequence: Synthetic oligonucleotide
acaggtctatatgagaaaccttcgcttacagccc

SEQ ID NO: 156660 - DNA, 33 bp, Artificial Sequence
  Description of Artificial Sequence: Synthetic oligonucleotide
caggtctatatgagaaaccttcgcttacagccc

SEQ ID NO: 156661 - DNA, 33 bp, Artificial Sequence
  Description of Artificial Sequence: Synthetic oligonucleotide
aggtctatatgagaaaccttcgcttacagcccg

SEQ ID NO: 156662 - DNA, 32 bp, Artificial Sequence
  Description of Artificial Sequence: Synthetic oligonucleotide
ggtctatatgagaaaccttcgcttacagcccg

SEQ ID NO: 156663 - DNA, 32 bp, Artificial Sequence
  Description of Artificial Sequence: Synthetic oligonucleotide
gtctatatgagaaaccttcgcttacagcccgg

SEQ ID NO: 156664 - DNA, 32 bp, Artificial Sequence
  Description of Artificial Sequence: Synthetic oligonucleotide
tctatatgagaaaccttcgcttacagcccggc

SEQ ID NO: 156665 - DNA, 31 bp, Artificial Sequence
  Description of Artificial Sequence: Synthetic oligonucleotide
ctatatgagaaaccttcgcttacagcccggc

SEQ ID NO: 156666 - DNA, 31 bp, Artificial Sequence
  Description of Artificial Sequence: Synthetic oligonucleotide
tatatgagaaaccttcgcttacagcccggcc

SEQ ID NO: 156667 - DNA, 30 bp, Artificial Sequence
  Description of Artificial Sequence: Synthetic oligonucleotide
atatgagaaaccttcgcttacagcccggcc

SEQ ID NO: 156668 - DNA, 29 bp, Artificial Sequence
  Description of Artificial Sequence: Synthetic oligonucleotide
tatgagaaaccttcgcttacagcccggcc

SEQ ID NO: 156669 - DNA, 28 bp, Artificial Sequence
  Description of Artificial Sequence: Synthetic oligonucleotide
atgagaaaccttcgcttacagcccggcc

SEQ ID NO: 156670 - DNA, 27 bp, Artificial Sequence
  Description of Artificial Sequence: Synthetic oligonucleotide
tgagaaaccttcgcttacagcccggcc

SEQ ID NO: 156671 - DNA, 26 bp, Artificial Sequence
  Description of Artificial Sequence: Synthetic oligonucleotide
gagaaaccttcgcttacagcccggcc

SEQ ID NO: 156672 - DNA, 26 bp, Artificial Sequence
  Description of Artificial Sequence: Synthetic oligonucleotide
agaaaccttcgcttacagcccggccg

SEQ ID NO: 156673 - DNA, 25 bp, Artificial Sequence
  Description of Artificial Sequence: Synthetic oligonucleotide
gaaaccttcgcttacagcccggccg

SEQ ID NO: 156674 - DNA, 25 bp, Artificial Sequence
  Description of Artificial Sequence: Synthetic oligonucleotide
aaaccttcgcttacagcccggccgg

SEQ ID NO: 156675 - DNA, 24 bp, Artificial Sequence
  Description of Artificial Sequence: Synthetic oligonucleotide
aaccttcgcttacagcccggccgg

SEQ ID NO: 156676 - DNA, 23 bp, Artificial Sequence
  Description of Artificial Sequence: Synthetic oligonucleotide
accttcgcttacagcccggccgg

SEQ ID NO: 156677 - DNA, 22 bp, Artificial Sequence
  Description of Artificial Sequence: Synthetic oligonucleotide
ccttcgcttacagcccggccgg

SEQ ID NO: 156678 - DNA, 22 bp, Artificial Sequence
  Description of Artificial Sequence: Synthetic oligonucleotide
cttcgcttacagcccggccggg

SEQ ID NO: 156679 - DNA, 22 bp, Artificial Sequence
  Description of Artificial Sequence: Synthetic oligonucleotide
ttcgcttacagcccggccgggc

SEQ ID NO: 156680 - DNA, 21 bp, Artificial Sequence
  Description of Artificial Sequence: Synthetic oligonucleotide
tcgcttacagcccggccgggc

SEQ ID NO: 156681 - DNA, 20 bp, Artificial Sequence
  Description of Artificial Sequence: Synthetic oligonucleotide
cgcttacagcccggccgggc

SEQ ID NO: 156682 - DNA, 20 bp, Artificial Sequence
  Description of Artificial Sequence: Synthetic oligonucleotide
gcttacagcccggccgggcc

SEQ ID NO: 156683 - DNA, 20 bp, Artificial Sequence
  Description of Artificial Sequence: Synthetic oligonucleotide
cttacagcccggccgggccc

SEQ ID NO: 156684 - DNA, 21 bp, Artificial Sequence
  Description of Artificial Sequence: Synthetic oligonucleotide
ttacagcccggccgggcccca

SEQ ID NO: 156685 - DNA, 20 bp, Artificial Sequence
  Description of Artificial Sequence: Synthetic oligonucleotide
tacagcccggccgggcccca

SEQ ID NO: 156686 - DNA, 20 bp, Artificial Sequence
  Description of Artificial Sequence: Synthetic oligonucleotide
acagcccggccgggccccat

SEQ ID NO: 156687 - DNA, 20 bp, Artificial Sequence
  Description of Artificial Sequence: Synthetic oligonucleotide
cagcccggccgggccccatt

SEQ ID NO: 156688 - DNA, 20 bp, Artificial Sequence
  Description of Artificial Sequence: Synthetic oligonucleotide
agcccggccgggccccactt

SEQ ID NO: 156689 - DNA, 20 bp, Artificial Sequence
  Description of Artificial Sequence: Synthetic oligonucleotide
gcccggccgggccccacttt

SEQ ID NO: 156690 - DNA, 20 bp, Artificial Sequence
  Description of Artificial Sequence: Synthetic oligonucleotide
cccggccgggccccacgttt

SEQ ID NO: 156691 - DNA, 20 bp, Artificial Sequence
  Description of Artificial Sequence: Synthetic oligonucleotide
ccggccgggccccacggttt

SEQ ID NO: 156692 - DNA, 20 bp, Artificial Sequence
  Description of Artificial Sequence: Synthetic oligonucleotide
cggccgggccccacggttct

SEQ ID NO: 156693 - DNA, 20 bp, Artificial Sequence
  Description of Artificial Sequence: Synthetic oligonucleotide
ggccgggccccacggttcgt

SEQ ID NO: 156694 - DNA, 20 bp, Artificial Sequence
  Description of Artificial Sequence: Synthetic oligonucleotide
gccgggccccacggttcgca

SEQ ID NO: 156695 - DNA, 21 bp, Artificial Sequence
  Description of Artificial Sequence: Synthetic oligonucleotide
ccgggccccacggttcgcaca

SEQ ID NO: 156696 - DNA, 21 bp, Artificial Sequence
  Description of Artificial Sequence: Synthetic oligonucleotide
cgggccccacggttcgcacag

SEQ ID NO: 156697 - DNA, 22 bp, Artificial Sequence
  Description of Artificial Sequence: Synthetic oligonucleotide
gggccccacggttcgcacagga

SEQ ID NO: 156698 - DNA, 23 bp, Artificial Sequence
  Description of Artificial Sequence: Synthetic oligonucleotide
ggccccacggttcgcacaggaga

SEQ ID NO: 156699 - DNA, 25 bp, Artificial Sequence
  Description of Artificial Sequence: Synthetic oligonucleotide
gccccacggttcgcacaggagagaa

SEQ ID NO: 156700 - DNA, 25 bp, Artificial Sequence
  Description of Artificial Sequence: Synthetic oligonucleotide
ccccacggttcgcacaggagagaac

SEQ ID NO: 156701 - DNA, 26 bp, Artificial Sequence
  Description of Artificial Sequence: Synthetic oligonucleotide
cccacggttcgcacaggagagaacgt

SEQ ID NO: 156702 - DNA, 27 bp, Artificial Sequence
  Description of Artificial Sequence: Synthetic oligonucleotide
ccacggttcgcacaggagagaacgtga

SEQ ID NO: 156703 - DNA, 27 bp, Artificial Sequence
  Description of Artificial Sequence: Synthetic oligonucleotide
cacggttcgcacaggagagaacgtgac

SEQ ID NO: 156704 - DNA, 27 bp, Artificial Sequence
  Description of Artificial Sequence: Synthetic oligonucleotide
acggttcgcacaggagagaacgtgacc

SEQ ID NO: 156705 - DNA, 27 bp, Artificial Sequence
  Description of Artificial Sequence: Synthetic oligonucleotide
cggttcgcacaggagagaacgtgacct

SEQ ID NO: 156706 - DNA, 28 bp, Artificial Sequence
  Description of Artificial Sequence: Synthetic oligonucleotide
ggttcgcacaggagagaacgtgaccttg

SEQ ID NO: 156707 - DNA, 29 bp, Artificial Sequence
  Description of Artificial Sequence: Synthetic oligonucleotide
gttcgcacaggagagaacgtgaccttgtc

SEQ ID NO: 156708 - DNA, 29 bp, Artificial Sequence
  Description of Artificial Sequence: Synthetic oligonucleotide
ttcgcacaggagagaacgtgaccttgtcc

SEQ ID NO: 156709 - DNA, 28 bp, Artificial Sequence
  Description of Artificial Sequence: Synthetic oligonucleotide
tcgcacaggagagaacgtgaccttgtcc

SEQ ID NO: 156710 - DNA, 27 bp, Artificial Sequence
  Description of Artificial Sequence: Synthetic oligonucleotide
cgcacaggagagaacgtgaccttgtcc

SEQ ID NO: 156711 - DNA, 28 bp, Artificial Sequence
  Description of Artificial Sequence: Synthetic oligonucleotide
gcacaggagagaacgtgaccttgtcctg

SEQ ID NO: 156712 - DNA, 28 bp, Artificial Sequence
  Description of Artificial Sequence: Synthetic oligonucleotide
cacaggagagaacgtgaccttgtcctgc

SEQ ID NO: 156713 - DNA, 29 bp, Artificial Sequence
  Description of Artificial Sequence: Synthetic oligonucleotide
acaggagagaacgtgaccttgtcctgcag

SEQ ID NO: 156714 - DNA, 28 bp, Artificial Sequence
  Description of Artificial Sequence: Synthetic oligonucleotide
caggagagaacgtgaccttgtcctgcag

SEQ ID NO: 156715 - DNA, 28 bp, Artificial Sequence
  Description of Artificial Sequence: Synthetic oligonucleotide
aggagagaacgtgaccttgtcctgcagc

SEQ ID NO: 156716 - DNA, 27 bp, Artificial Sequence
  Description of Artificial Sequence: Synthetic oligonucleotide
ggagagaacgtgaccttgtcctgcagc

SEQ ID NO: 156717 - DNA, 28 bp, Artificial Sequence
  Description of Artificial Sequence: Synthetic oligonucleotide
gagagaacgtgaccttgtcctgcagctc

SEQ ID NO: 156718 - DNA, 28 bp, Artificial Sequence
  Description of Artificial Sequence: Synthetic oligonucleotide
agagaacgtgaccttgtcctgcagctcc

SEQ ID NO: 156719 - DNA, 27 bp, Artificial Sequence
  Description of Artificial Sequence: Synthetic oligonucleotide
gagaacgtgaccttgtcctgcagctcc

SEQ ID NO: 156720 - DNA, 27 bp, Artificial Sequence
  Description of Artificial Sequence: Synthetic oligonucleotide
agaacgtgaccttgtcctgcagctccc

SEQ ID NO: 156721 - DNA, 27 bp, Artificial Sequence
  Description of Artificial Sequence: Synthetic oligonucleotide
gaacgtgaccttgtcctgcagctccca

SEQ ID NO: 156722 - DNA, 27 bp, Artificial Sequence
  Description of Artificial Sequence: Synthetic oligonucleotide
aacgtgaccttgtcctgcagctcccag

SEQ ID NO: 156723 - DNA, 27 bp, Artificial Sequence
  Description of Artificial Sequence: Synthetic oligonucleotide
acgtgaccttgtcctgcagctcccaga

SEQ ID NO: 156724 - DNA, 27 bp, Artificial Sequence
  Description of Artificial Sequence: Synthetic oligonucleotide
cttgtcctgcagctcccagagctcctt

SEQ ID NO: 156725 - DNA, 28 bp, Artificial Sequence
  Description of Artificial Sequence: Synthetic oligonucleotide
ttgtcctgcagctcccagagctcctttg

SEQ ID NO: 156726 - DNA, 27 bp, Artificial Sequence
  Description of Artificial Sequence: Synthetic oligonucleotide
tgtcctgcagctcccagagctcctttg

SEQ ID NO: 156727 - DNA, 27 bp, Artificial Sequence
  Description of Artificial Sequence: Synthetic oligonucleotide
gtcctgcagctcccagagctcctttga

SEQ ID NO: 156728 - DNA, 27 bp, Artificial Sequence
  Description of Artificial Sequence: Synthetic oligonucleotide
tcctgcagctcccagagctcctttgac

SEQ ID NO: 156729 - DNA, 27 bp, Artificial Sequence
  Description of Artificial Sequence: Synthetic oligonucleotide
cctgcagctcccagagctcctttgaca

SEQ ID NO: 156730 - DNA, 28 bp, Artificial Sequence
  Description of Artificial Sequence: Synthetic oligonucleotide
ctgcagctcccagagctcctttgacatc

SEQ ID NO: 156731 - DNA, 30 bp, Artificial Sequence
  Description of Artificial Sequence: Synthetic oligonucleotide
tgcagctcccagagctcctttgacatctac

SEQ ID NO: 156732 - DNA, 29 bp, Artificial Sequence
  Description of Artificial Sequence: Synthetic oligonucleotide
gcagctcccagagctcctttgacatctac

SEQ ID NO: 156733 - DNA, 29 bp, Artificial Sequence
  Description of Artificial Sequence: Synthetic oligonucleotide
cagctcccagagctcctttgacatctacc

SEQ ID NO: 156734 - DNA, 31 bp, Artificial Sequence
  Description of Artificial Sequence: Synthetic oligonucleotide
agctcccagagctcctttgacatctaccatc

SEQ ID NO: 156735 - DNA, 30 bp, Artificial Sequence
  Description of Artificial Sequence: Synthetic oligonucleotide
gctcccagagctcctttgacatctaccatc

SEQ ID NO: 156736 - DNA, 33 bp, Artificial Sequence
  Description of Artificial Sequence: Synthetic oligonucleotide
ctcccagagctcctttgacatctaccatctatc

SEQ ID NO: 156737 - DNA, 33 bp, Artificial Sequence
  Description of Artificial Sequence: Synthetic oligonucleotide
tcccagagctcctttgacatctaccatctatcc

SEQ ID NO: 156738 - DNA, 32 bp, Artificial Sequence
  Description of Artificial Sequence: Synthetic oligonucleotide
cccagagctcctttgacatctaccatctatcc

SEQ ID NO: 156739 - DNA, 33 bp, Artificial Sequence
  Description of Artificial Sequence: Synthetic oligonucleotide
ccagagctcctttgacatctaccatctatccag

SEQ ID NO: 156740 - DNA, 33 bp, Artificial Sequence
  Description of Artificial Sequence: Synthetic oligonucleotide
cagagctcctttgacatctaccatctatccagg

SEQ ID NO: 156741 - DNA, 33 bp, Artificial Sequence
  Description of Artificial Sequence: Synthetic oligonucleotide
agagctcctttgacatctaccatctatccaggg

SEQ ID NO: 156742 - DNA, 32 bp, Artificial Sequence
  Description of Artificial Sequence: Synthetic oligonucleotide
gagctcctttgacatctaccatctatccaggg

SEQ ID NO: 156743 - DNA, 34 bp, Artificial Sequence
  Description of Artificial Sequence: Synthetic oligonucleotide
agctcctttgacatctaccatctatccagggaag

SEQ ID NO: 156744 - DNA, 33 bp, Artificial Sequence
  Description of Artificial Sequence: Synthetic oligonucleotide
gctcctttgacatctaccatctatccagggaag

SEQ ID NO: 156745 - DNA, 33 bp, Artificial Sequence
  Description of Artificial Sequence: Synthetic oligonucleotide
ctcctttgacatctaccatctatccagggaagg

SEQ ID NO: 156746 - DNA, 33 bp, Artificial Sequence
  Description of Artificial Sequence: Synthetic oligonucleotide
tcctttgacatctaccatctatccagggaaggg

SEQ ID NO: 156747 - DNA, 32 bp, Artificial Sequence
  Description of Artificial Sequence: Synthetic oligonucleotide
cctttgacatctaccatctatccagggaaggg

SEQ ID NO: 156748 - DNA, 32 bp, Artificial Sequence
  Description of Artificial Sequence: Synthetic oligonucleotide
ctttgacatctaccatctatccagggaagggg

SEQ ID NO: 156749 - DNA, 34 bp, Artificial Sequence
  Description of Artificial Sequence: Synthetic oligonucleotide
tttgacatctaccatctatccagggaaggggaag

SEQ ID NO: 156750 - DNA, 33 bp, Artificial Sequence
  Description of Artificial Sequence: Synthetic oligonucleotide
ttgacatctaccatctatccagggaaggggaag

SEQ ID NO: 156751 - DNA, 32 bp, Artificial Sequence
  Description of Artificial Sequence: Synthetic oligonucleotide
tgacatctaccatctatccagggaaggggaag

SEQ ID NO: 156752 - DNA, 31 bp, Artificial Sequence
  Description of Artificial Sequence: Synthetic oligonucleotide
gacatctaccatctatccagggaaggggaag

SEQ ID NO: 156753 - DNA, 31 bp, Artificial Sequence
  Description of Artificial Sequence: Synthetic oligonucleotide
acatctaccatctatccagggaaggggaagc

SEQ ID NO: 156754 - DNA, 30 bp, Artificial Sequence
  Description of Artificial Sequence: Synthetic oligonucleotide
catctaccatctatccagggaaggggaagc

SEQ ID NO: 156755 - DNA, 30 bp, Artificial Sequence
  Description of Artificial Sequence: Synthetic oligonucleotide
atctaccatctatccagggaaggggaagcc

SEQ ID NO: 156756 - DNA, 29 bp, Artificial Sequence
  Description of Artificial Sequence: Synthetic oligonucleotide
tctaccatctatccagggaaggggaagcc

SEQ ID NO: 156757 - DNA, 28 bp, Artificial Sequence
  Description of Artificial Sequence: Synthetic oligonucleotide
ctaccatctatccagggaaggggaagcc

SEQ ID NO: 156758 - DNA, 28 bp, Artificial Sequence
  Description of Artificial Sequence: Synthetic oligonucleotide
taccatctatccagggaaggggaagccc

SEQ ID NO: 156759 - DNA, 27 bp, Artificial Sequence
  Description of Artificial Sequence: Synthetic oligonucleotide
accatctatccagggaaggggaagccc

SEQ ID NO: 156760 - DNA, 27 bp, Artificial Sequence
  Description of Artificial Sequence: Synthetic oligonucleotide
ccatctatccagggaaggggaagccca

SEQ ID NO: 156761 - DNA, 28 bp, Artificial Sequence
  Description of Artificial Sequence: Synthetic oligonucleotide
catctatccagggaaggggaagcccatg

SEQ ID NO: 156762 - DNA, 30 bp, Artificial Sequence
  Description of Artificial Sequence: Synthetic oligonucleotide
atctatccagggaaggggaagcccatgaac

SEQ ID NO: 156763 - DNA, 29 bp, Artificial Sequence
  Description of Artificial Sequence: Synthetic oligonucleotide
tctatccagggaaggggaagcccatgaac

SEQ ID NO: 156764 - DNA, 28 bp, Artificial Sequence
  Description of Artificial Sequence: Synthetic oligonucleotide
ctatccagggaaggggaagcccatgaac

SEQ ID NO: 156765 - DNA, 31 bp, Artificial Sequence
  Description of Artificial Sequence: Synthetic oligonucleotide
tatccagggaaggggaagcccatgaacttag

SEQ ID NO: 156766 - DNA, 30 bp, Artificial Sequence
  Description of Artificial Sequence: Synthetic oligonucleotide
atccagggaaggggaagcccatgaacttag

SEQ ID NO: 156767 - DNA, 29 bp, Artificial Sequence
  Description of Artificial Sequence: Synthetic oligonucleotide
tccagggaaggggaagcccatgaacttag

SEQ ID NO: 156768 - DNA, 28 bp, Artificial Sequence
  Description of Artificial Sequence: Synthetic oligonucleotide
ccagggaaggggaagcccatgaacttag

SEQ ID NO: 156769 - DNA, 28 bp, Artificial Sequence
  Description of Artificial Sequence: Synthetic oligonucleotide
cagggaaggggaagcccatgaacttagg

SEQ ID NO: 156770 - DNA, 28 bp, Artificial Sequence
  Description of Artificial Sequence: Synthetic oligonucleotide
agggaaggggaagcccatgaacttaggc

SEQ ID NO: 156771 - DNA, 27 bp, Artificial Sequence
  Description of Artificial Sequence: Synthetic oligonucleotide
gggaaggggaagcccatgaacttaggc

SEQ ID NO: 156772 - DNA, 28 bp, Artificial Sequence
  Description of Artificial Sequence: Synthetic oligonucleotide
ggaaggggaagcccatgaacttaggctc

SEQ ID NO: 156773 - DNA, 28 bp, Artificial Sequence
  Description of Artificial Sequence: Synthetic oligonucleotide
gaaggggaagcccatgaacttaggctcc

SEQ ID NO: 156774 - DNA, 28 bp, Artificial Sequence
  Description of Artificial Sequence: Synthetic oligonucleotide
aaggggaagcccatgaacttaggctccc

SEQ ID NO: 156775 - DNA, 27 bp, Artificial Sequence
  Description of Artificial Sequence: Synthetic oligonucleotide
aggggaagcccatgaacttaggctccc

SEQ ID NO: 156776 - DNA, 27 bp, Artificial Sequence
  Description of Artificial Sequence: Synthetic oligonucleotide
ggggaagcccatgaacttaggctccct

SEQ ID NO: 156777 - DNA, 27 bp, Artificial Sequence
  Description of Artificial Sequence: Synthetic oligonucleotide
gggaagcccatgaacttaggctccctg

SEQ ID NO: 156778 - DNA, 27 bp, Artificial Sequence
  Description of Artificial Sequence: Synthetic oligonucleotide
ggaagcccatgaacttaggctccctgc

SEQ ID NO: 156779 - DNA, 28 bp, Artificial Sequence
  Description of Artificial Sequence: Synthetic oligonucleotide
gaagcccatgaacttaggctccctgcag

SEQ ID NO: 156780 - DNA, 29 bp, Artificial Sequence
  Description of Artificial Sequence: Synthetic oligonucleotide
aagcccatgaacttaggctccctgcagtg

SEQ ID NO: 156781 - DNA, 28 bp, Artificial Sequence
  Description of Artificial Sequence: Synthetic oligonucleotide
agcccatgaacttaggctccctgcagtg

SEQ ID NO: 156782 - DNA, 27 bp, Artificial Sequence
  Description of Artificial Sequence: Synthetic oligonucleotide
gcccatgaacttaggctccctgcagtg

SEQ ID NO: 156783 - DNA, 27 bp, Artificial Sequence
  Description of Artificial Sequence: Synthetic oligonucleotide
cccatgaacttaggctccctgcagtgc

SEQ ID NO: 156784 - DNA, 27 bp, Artificial Sequence
  Description of Artificial Sequence: Synthetic oligonucleotide
ccatgaacttaggctccctgcagtgcc

SEQ ID NO: 156785 - DNA, 27 bp, Artificial Sequence
  Description of Artificial Sequence: Synthetic oligonucleotide
catgaacttaggctccctgcagtgccc

SEQ ID NO: 156786 - DNA, 28 bp, Artificial Sequence
  Description of Artificial Sequence: Synthetic oligonucleotide
atgaacttaggctccctgcagtgcccag

SEQ ID NO: 156787 - DNA, 27 bp, Artificial Sequence
  Description of Artificial Sequence: Synthetic oligonucleotide
tgaacttaggctccctgcagtgcccag

SEQ ID NO: 156788 - DNA, 26 bp, Artificial Sequence
  Description of Artificial Sequence: Synthetic oligonucleotide
gaacttaggctccctgcagtgcccag

SEQ ID NO: 156789 - DNA, 27 bp, Artificial Sequence
  Description of Artificial Sequence: Synthetic oligonucleotide
aacttaggctccctgcagtgcccagca

SEQ ID NO: 156790 - DNA, 27 bp, Artificial Sequence
  Description of Artificial Sequence: Synthetic oligonucleotide
acttaggctccctgcagtgcccagcat

SEQ ID NO: 156791 - DNA, 26 bp, Artificial Sequence
  Description of Artificial Sequence: Synthetic oligonucleotide
cttaggctccctgcagtgcccagcat

SEQ ID NO: 156792 - DNA, 27 bp, Artificial Sequence
  Description of Artificial Sequence: Synthetic oligonucleotide
ttaggctccctgcagtgcccagcatca

SEQ ID NO: 156793 - DNA, 27 bp, Artificial Sequence
  Description of Artificial Sequence: Synthetic oligonucleotide
taggctccctgcagtgcccagcatcaa

SEQ ID NO: 156794 - DNA, 27 bp, Artificial Sequence
  Description of Artificial Sequence: Synthetic oligonucleotide
aggctccctgcagtgcccagcatcaat

SEQ ID NO: 156795 - DNA, 26 bp, Artificial Sequence
  Description of Artificial Sequence: Synthetic oligonucleotide
ggctccctgcagtgcccagcatcaat

SEQ ID NO: 156796 - DNA, 26 bp, Artificial Sequence
  Description of Artificial Sequence: Synthetic oligonucleotide
gctccctgcagtgcccagcatcaatg

SEQ ID NO: 156797 - DNA, 27 bp, Artificial Sequence
  Description of Artificial Sequence: Synthetic oligonucleotide
ctccctgcagtgcccagcatcaatgga

SEQ ID NO: 156798 - DNA, 28 bp, Artificial Sequence
  Description of Artificial Sequence: Synthetic oligonucleotide
tccctgcagtgcccagcatcaatggaac

SEQ ID NO: 156799 - DNA, 27 bp, Artificial Sequence
  Description of Artificial Sequence: Synthetic oligonucleotide
ccctgcagtgcccagcatcaatggaac

SEQ ID NO: 156800 - DNA, 30 bp, Artificial Sequence
  Description of Artificial Sequence: Synthetic oligonucleotide
cctgcagtgcccagcatcaatggaacattc

SEQ ID NO: 156801 - DNA, 30 bp, Artificial Sequence
  Description of Artificial Sequence: Synthetic oligonucleotide
ctgcagtgcccagcatcaatggaacattcc

SEQ ID NO: 156802 - DNA, 31 bp, Artificial Sequence
  Description of Artificial Sequence: Synthetic oligonucleotide
tgcagtgcccagcatcaatggaacattccag

SEQ ID NO: 156803 - DNA, 30 bp, Artificial Sequence
  Description of Artificial Sequence: Synthetic oligonucleotide
gcagtgcccagcatcaatggaacattccag

SEQ ID NO: 156804 - DNA, 30 bp, Artificial Sequence
  Description of Artificial Sequence: Synthetic oligonucleotide
cagtgcccagcatcaatggaacattccagg

SEQ ID NO: 156805 - DNA, 30 bp, Artificial Sequence
  Description of Artificial Sequence: Synthetic oligonucleotide
agtgcccagcatcaatggaacattccaggc

SEQ ID NO: 156806 - DNA, 29 bp, Artificial Sequence
  Description of Artificial Sequence: Synthetic oligonucleotide
gtgcccagcatcaatggaacattccaggc

SEQ ID NO: 156807 - DNA, 29 bp, Artificial Sequence
  Description of Artificial Sequence: Synthetic oligonucleotide
tgcccagcatcaatggaacattccaggcc

SEQ ID NO: 156808 - DNA, 28 bp, Artificial Sequence
  Description of Artificial Sequence: Synthetic oligonucleotide
gcccagcatcaatggaacattccaggcc

SEQ ID NO: 156809 - DNA, 28 bp, Artificial Sequence
  Description of Artificial Sequence: Synthetic oligonucleotide
cccagcatcaatggaacattccaggccg

SEQ ID NO: 156810 - DNA, 29 bp, Artificial Sequence
  Description of Artificial Sequence: Synthetic oligonucleotide
ccagcatcaatggaacattccaggccgac

SEQ ID NO: 156811 - DNA, 31 bp, Artificial Sequence
  Description of Artificial Sequence: Synthetic oligonucleotide
cagcatcaatggaacattccaggccgacttc

SEQ ID NO: 156812 - DNA, 31 bp, Artificial Sequence
  Description of Artificial Sequence: Synthetic oligonucleotide
agcatcaatggaacattccaggccgacttcc

SEQ ID NO: 156813 - DNA, 30 bp, Artificial Sequence
  Description of Artificial Sequence: Synthetic oligonucleotide
gcatcaatggaacattccaggccgacttcc

SEQ ID NO: 156814 - DNA, 30 bp, Artificial Sequence
  Description of Artificial Sequence: Synthetic oligonucleotide
catcaatggaacattccaggccgacttccc

SEQ ID NO: 156815 - DNA, 31 bp, Artificial Sequence
  Description of Artificial Sequence: Synthetic oligonucleotide
atcaatggaacattccaggccgacttccctc

SEQ ID NO: 156816 - DNA, 30 bp, Artificial Sequence
  Description of Artificial Sequence: Synthetic oligonucleotide
tcaatggaacattccaggccgacttccctc

SEQ ID NO: 156817 - DNA, 29 bp, Artificial Sequence
  Description of Artificial Sequence: Synthetic oligonucleotide
caatggaacattccaggccgacttccctc

SEQ ID NO: 156818 - DNA, 30 bp, Artificial Sequence
  Description of Artificial Sequence: Synthetic oligonucleotide
aatggaacattccaggccgacttccctctg

SEQ ID NO: 156819 - DNA, 29 bp, Artificial Sequence
  Description of Artificial Sequence: Synthetic oligonucleotide
atggaacattccaggccgacttccctctg

SEQ ID NO: 156820 - DNA, 28 bp, Artificial Sequence
  Description of Artificial Sequence: Synthetic oligonucleotide
tggaacattccaggccgacttccctctg

SEQ ID NO: 156821 - DNA, 27 bp, Artificial Sequence
  Description of Artificial Sequence: Synthetic oligonucleotide
ggaacattccaggccgacttccctctg

SEQ ID NO: 156822 - DNA, 27 bp, Artificial Sequence
  Description of Artificial Sequence: Synthetic oligonucleotide
gaacattccaggccgacttccctctgg

SEQ ID NO: 156823 - DNA, 27 bp, Artificial Sequence
  Description of Artificial Sequence: Synthetic oligonucleotide
aacattccaggccgacttccctctggg

SEQ ID NO: 156824 - DNA, 27 bp, Artificial Sequence
  Description of Artificial Sequence: Synthetic oligonucleotide
acattccaggccgacttccctctgggt

SEQ ID NO: 156825 - DNA, 26 bp, Artificial Sequence
  Description of Artificial Sequence: Synthetic oligonucleotide
cattccaggccgacttccctctgggt

SEQ ID NO: 156826 - DNA, 26 bp, Artificial Sequence
  Description of Artificial Sequence: Synthetic oligonucleotide
attccaggccgacttccctctgggtc

SEQ ID NO: 156827 - DNA, 25 bp, Artificial Sequence
  Description of Artificial Sequence: Synthetic oligonucleotide
ttccaggccgacttccctctgggtc

SEQ ID NO: 156828 - DNA, 24 bp, Artificial Sequence
  Description of Artificial Sequence: Synthetic oligonucleotide
tccaggccgacttccctctgggtc

SEQ ID NO: 156829 - DNA, 23 bp, Artificial Sequence
  Description of Artificial Sequence: Synthetic oligonucleotide
ccaggccgacttccctctgggtc

SEQ ID NO: 156830 - DNA, 24 bp, Artificial Sequence
  Description of Artificial Sequence: Synthetic oligonucleotide
caggccgacttccctctgggtcct

SEQ ID NO: 156831 - DNA, 24 bp, Artificial Sequence
  Description of Artificial Sequence: Synthetic oligonucleotide
aggccgacttccctctgggtcctg

SEQ ID NO: 156832 - DNA, 23 bp, Artificial Sequence
  Description of Artificial Sequence: Synthetic oligonucleotide
ggccgacttccctctgggtcctg

SEQ ID NO: 156833 - DNA, 23 bp, Artificial Sequence
  Description of Artificial Sequence: Synthetic oligonucleotide
gccgacttccctctgggtcctgc

SEQ ID NO: 156834 - DNA, 24 bp, Artificial Sequence
  Description of Artificial Sequence: Synthetic oligonucleotide
ccgacttccctctgggtcctgcca

SEQ ID NO: 156835 - DNA, 24 bp, Artificial Sequence
  Description of Artificial Sequence: Synthetic oligonucleotide
cgacttccctctgggtcctgccac

SEQ ID NO: 156836 - DNA, 24 bp, Artificial Sequence
  Description of Artificial Sequence: Synthetic oligonucleotide
gacttccctctgggtcctgccacc

SEQ ID NO: 156837 - DNA, 25 bp, Artificial Sequence
  Description of Artificial Sequence: Synthetic oligonucleotide
acttccctctgggtcctgccaccca

SEQ ID NO: 156838 - DNA, 24 bp, Artificial Sequence
  Description of Artificial Sequence: Synthetic oligonucleotide
cttccctctgggtcctgccaccca

SEQ ID NO: 156839 - DNA, 24 bp, Artificial Sequence
  Description of Artificial Sequence: Synthetic oligonucleotide
ttccctctgggtcctgccacccac

SEQ ID NO: 156840 - DNA, 23 bp, Artificial Sequence
  Description of Artificial Sequence: Synthetic oligonucleotide
tccctctgggtcctgccacccac

SEQ ID NO: 156841 - DNA, 22 bp, Artificial Sequence
  Description of Artificial Sequence: Synthetic oligonucleotide
ccctctgggtcctgccacccac

SEQ ID NO: 156842 - DNA, 22 bp, Artificial Sequence
  Description of Artificial Sequence: Synthetic oligonucleotide
cctctgggtcctgccacccacg

SEQ ID NO: 156843 - DNA, 23 bp, Artificial Sequence
  Description of Artificial Sequence: Synthetic oligonucleotide
ctctgggtcctgccacccacgga

SEQ ID NO: 156844 - DNA, 24 bp, Artificial Sequence
  Description of Artificial Sequence: Synthetic oligonucleotide
tctgggtcctgccacccacggaga

SEQ ID NO: 156845 - DNA, 23 bp, Artificial Sequence
  Description of Artificial Sequence: Synthetic oligonucleotide
ctgggtcctgccacccacggaga

SEQ ID NO: 156846 - DNA, 24 bp, Artificial Sequence
  Description of Artificial Sequence: Synthetic oligonucleotide
tgggtcctgccacccacggagaga

SEQ ID NO: 156847 - DNA, 23 bp, Artificial Sequence
  Description of Artificial Sequence: Synthetic oligonucleotide
gggtcctgccacccacggagaga

SEQ ID NO: 156848 - DNA, 23 bp, Artificial Sequence
  Description of Artificial Sequence: Synthetic oligonucleotide
ggtcctgccacccacggagagac

SEQ ID NO: 156849 - DNA, 25 bp, Artificial Sequence
  Description of Artificial Sequence: Synthetic oligonucleotide
gtcctgccacccacggagagaccta

SEQ ID NO: 156850 - DNA, 26 bp, Artificial Sequence
  Description of Artificial Sequence: Synthetic oligonucleotide
tcctgccacccacggagagacctaca

SEQ ID NO: 156851 - DNA, 25 bp, Artificial Sequence
  Description of Artificial Sequence: Synthetic oligonucleotide
cctgccacccacggagagacctaca

SEQ ID NO: 156852 - DNA, 27 bp, Artificial Sequence
  Description of Artificial Sequence: Synthetic oligonucleotide
ctgccacccacggagagacctacagat

SEQ ID NO: 156853 - DNA, 27 bp, Artificial Sequence
  Description of Artificial Sequence: Synthetic oligonucleotide
tgccacccacggagagacctacagatg

SEQ ID NO: 156854 - DNA, 26 bp, Artificial Sequence
  Description of Artificial Sequence: Synthetic oligonucleotide
gccacccacggagagacctacagatg

SEQ ID NO: 156855 - DNA, 27 bp, Artificial Sequence
  Description of Artificial Sequence: Synthetic oligonucleotide
ccacccacggagagacctacagatgct

SEQ ID NO: 156856 - DNA, 28 bp, Artificial Sequence
  Description of Artificial Sequence: Synthetic oligonucleotide
cacccacggagagacctacagatgcttc

SEQ ID NO: 156857 - DNA, 28 bp, Artificial Sequence
  Description of Artificial Sequence: Synthetic oligonucleotide
acccacggagagacctacagatgcttcg

SEQ ID NO: 156858 - DNA, 27 bp, Artificial Sequence
  Description of Artificial Sequence: Synthetic oligonucleotide
cccacggagagacctacagatgcttcg

SEQ ID NO: 156859 - DNA, 27 bp, Artificial Sequence
  Description of Artificial Sequence: Synthetic oligonucleotide
ccacggagagacctacagatgcttcgg

SEQ ID NO: 156860 - DNA, 27 bp, Artificial Sequence
  Description of Artificial Sequence: Synthetic oligonucleotide
cacggagagacctacagatgcttcggc

SEQ ID NO: 156861 - DNA, 28 bp, Artificial Sequence
  Description of Artificial Sequence: Synthetic oligonucleotide
acggagagacctacagatgcttcggctc

SEQ ID NO: 156862 - DNA, 27 bp, Artificial Sequence
  Description of Artificial Sequence: Synthetic oligonucleotide
cggagagacctacagatgcttcggctc

SEQ ID NO: 156863 - DNA, 30 bp, Artificial Sequence
  Description of Artificial Sequence: Synthetic oligonucleotide
ggagagacctacagatgcttcggctctttc

SEQ ID NO: 156864 - DNA, 30 bp, Artificial Sequence
  Description of Artificial Sequence: Synthetic oligonucleotide
gagagacctacagatgcttcggctctttcc

SEQ ID NO: 156865 - DNA, 32 bp, Artificial Sequence
  Description of Artificial Sequence: Synthetic oligonucleotide
agagacctacagatgcttcggctctttccatg

SEQ ID NO: 156866 - DNA, 31 bp, Artificial Sequence
  Description of Artificial Sequence: Synthetic oligonucleotide
gagacctacagatgcttcggctctttccatg

SEQ ID NO: 156867 - DNA, 31 bp, Artificial Sequence
  Description of Artificial Sequence: Synthetic oligonucleotide
agacctacagatgcttcggctctttccatgg

SEQ ID NO: 156868 - DNA, 30 bp, Artificial Sequence
  Description of Artificial Sequence: Synthetic oligonucleotide
gacctacagatgcttcggctctttccatgg

SEQ ID NO: 156869 - DNA, 32 bp, Artificial Sequence
  Description of Artificial Sequence: Synthetic oligonucleotide
acctacagatgcttcggctctttccatggatc

SEQ ID NO: 156870 - DNA, 31 bp, Artificial Sequence
  Description of Artificial Sequence: Synthetic oligonucleotide
cctacagatgcttcggctctttccatggatc

SEQ ID NO: 156871 - DNA, 32 bp, Artificial Sequence
  Description of Artificial Sequence: Synthetic oligonucleotide
ctacagatgcttcggctctttccatggatctc

SEQ ID NO: 156872 - DNA, 32 bp, Artificial Sequence
  Description of Artificial Sequence: Synthetic oligonucleotide
tacagatgcttcggctctttccatggatctcc

SEQ ID NO: 156873 - DNA, 31 bp, Artificial Sequence
  Description of Artificial Sequence: Synthetic oligonucleotide
acagatgcttcggctctttccatggatctcc

SEQ ID NO: 156874 - DNA, 30 bp, Artificial Sequence
  Description of Artificial Sequence: Synthetic oligonucleotide
cagatgcttcggctctttccatggatctcc

SEQ ID NO: 156875 - DNA, 30 bp, Artificial Sequence
  Description of Artificial Sequence: Synthetic oligonucleotide
agatgcttcggctctttccatggatctccc

SEQ ID NO: 156876 - DNA, 29 bp, Artificial Sequence
  Description of Artificial Sequence: Synthetic oligonucleotide
gatgcttcggctctttccatggatctccc

SEQ ID NO: 156877 - DNA, 31 bp, Artificial Sequence
  Description of Artificial Sequence: Synthetic oligonucleotide
atgcttcggctctttccatggatctccctac

SEQ ID NO: 156878 - DNA, 30 bp, Artificial Sequence
  Description of Artificial Sequence: Synthetic oligonucleotide
tgcttcggctctttccatggatctccctac

SEQ ID NO: 156879 - DNA, 29 bp, Artificial Sequence
  Description of Artificial Sequence: Synthetic oligonucleotide
gcttcggctctttccatggatctccctac

SEQ ID NO: 156880 - DNA, 29 bp, Artificial Sequence
  Description of Artificial Sequence: Synthetic oligonucleotide
cttcggctctttccatggatctccctacg

SEQ ID NO: 156881 - DNA, 32 bp, Artificial Sequence
  Description of Artificial Sequence: Synthetic oligonucleotide
ttcggctctttccatggatctccctacgaatg

SEQ ID NO: 156882 - DNA, 31 bp, Artificial Sequence
  Description of Artificial Sequence: Synthetic oligonucleotide
tcggctctttccatggatctccctacgaatg

SEQ ID NO: 156883 - DNA, 30 bp, Artificial Sequence
  Description of Artificial Sequence: Synthetic oligonucleotide
cggctctttccatggatctccctacgaatg

SEQ ID NO: 156884 - DNA, 30 bp, Artificial Sequence
  Description of Artificial Sequence: Synthetic oligonucleotide
ggctctttccatggatctccctacgaatgg

SEQ ID NO: 156885 - DNA, 31 bp, Artificial Sequence
  Description of Artificial Sequence: Synthetic oligonucleotide
gctctttccatggatctccctacgaatggtc

SEQ ID NO: 156886 - DNA, 32 bp, Artificial Sequence
  Description of Artificial Sequence: Synthetic oligonucleotide
ctctttccatggatctccctacgaatggtcag

SEQ ID NO: 156887 - DNA, 33 bp, Artificial Sequence
  Description of Artificial Sequence: Synthetic oligonucleotide
tctttccatggatctccctacgaatggtcagac

SEQ ID NO: 156888 - DNA, 32 bp, Artificial Sequence
  Description of Artificial Sequence: Synthetic oligonucleotide
ctttccatggatctccctacgaatggtcagac

SEQ ID NO: 156889 - DNA, 32 bp, Artificial Sequence
  Description of Artificial Sequence: Synthetic oligonucleotide
tttccatggatctccctacgaatggtcagacg

SEQ ID NO: 156890 - DNA, 31 bp, Artificial Sequence
  Description of Artificial Sequence: Synthetic oligonucleotide
ttccatggatctccctacgaatggtcagacg

SEQ ID NO: 156891 - DNA, 30 bp, Artificial Sequence
  Description of Artificial Sequence: Synthetic oligonucleotide
tccatggatctccctacgaatggtcagacg

SEQ ID NO: 156892 - DNA, 29 bp, Artificial Sequence
  Description of Artificial Sequence: Synthetic oligonucleotide
ccatggatctccctacgaatggtcagacg

SEQ ID NO: 156893 - DNA, 29 bp, Artificial Sequence
  Description of Artificial Sequence: Synthetic oligonucleotide
catggatctccctacgaatggtcagacgc

SEQ ID NO: 156894 - DNA, 29 bp, Artificial Sequence
  Description of Artificial Sequence: Synthetic oligonucleotide
atggatctccctacgaatggtcagacgcg

SEQ ID NO: 156895 - DNA, 28 bp, Artificial Sequence
  Description of Artificial Sequence: Synthetic oligonucleotide
tggatctccctacgaatggtcagacgcg

SEQ ID NO: 156896 - DNA, 27 bp, Artificial Sequence
  Description of Artificial Sequence: Synthetic oligonucleotide
ggatctccctacgaatggtcagacgcg

SEQ ID NO: 156897 - DNA, 28 bp, Artificial Sequence
  Description of Artificial Sequence: Synthetic oligonucleotide
gatctccctacgaatggtcagacgcgag

SEQ ID NO: 156898 - DNA, 29 bp, Artificial Sequence
  Description of Artificial Sequence: Synthetic oligonucleotide
atctccctacgaatggtcagacgcgagtg

SEQ ID NO: 156899 - DNA, 28 bp, Artificial Sequence
  Description of Artificial Sequence: Synthetic oligonucleotide
tctccctacgaatggtcagacgcgagtg

SEQ ID NO: 156900 - DNA, 27 bp, Artificial Sequence
  Description of Artificial Sequence: Synthetic oligonucleotide
ctccctacgaatggtcagacgcgagtg

SEQ ID NO: 156901 - DNA, 28 bp, Artificial Sequence
  Description of Artificial Sequence: Synthetic oligonucleotide
tccctacgaatggtcagacgcgagtgac

SEQ ID NO: 156902 - DNA, 27 bp, Artificial Sequence
  Description of Artificial Sequence: Synthetic oligonucleotide
ccctacgaatggtcagacgcgagtgac

SEQ ID NO: 156903 - DNA, 27 bp, Artificial Sequence
  Description of Artificial Sequence: Synthetic oligonucleotide
cctacgaatggtcagacgcgagtgacc

SEQ ID NO: 156904 - DNA, 27 bp, Artificial Sequence
  Description of Artificial Sequence: Synthetic oligonucleotide
ctacgaatggtcagacgcgagtgaccc

SEQ ID NO: 156905 - DNA, 28 bp, Artificial Sequence
  Description of Artificial Sequence: Synthetic oligonucleotide
tacgaatggtcagacgcgagtgacccac

SEQ ID NO: 156906 - DNA, 27 bp, Artificial Sequence
  Description of Artificial Sequence: Synthetic oligonucleotide
acgaatggtcagacgcgagtgacccac

SEQ ID NO: 156907 - DNA, 27 bp, Artificial Sequence
  Description of Artificial Sequence: Synthetic oligonucleotide
cgaatggtcagacgcgagtgacccact

SEQ ID NO: 156908 - DNA, 27 bp, Artificial Sequence
  Description of Artificial Sequence: Synthetic oligonucleotide
gaatggtcagacgcgagtgacccactg

SEQ ID NO: 156909 - DNA, 27 bp, Artificial Sequence
  Description of Artificial Sequence: Synthetic oligonucleotide
aatggtcagacgcgagtgacccactgc

SEQ ID NO: 156910 - DNA, 26 bp, Artificial Sequence
  Description of Artificial Sequence: Synthetic oligonucleotide
atggtcagacgcgagtgacccactgc

SEQ ID NO: 156911 - DNA, 25 bp, Artificial Sequence
  Description of Artificial Sequence: Synthetic oligonucleotide
tggtcagacgcgagtgacccactgc

SEQ ID NO: 156912 - DNA, 24 bp, Artificial Sequence
  Description of Artificial Sequence: Synthetic oligonucleotide
ggtcagacgcgagtgacccactgc

SEQ ID NO: 156913 - DNA, 25 bp, Artificial Sequence
  Description of Artificial Sequence: Synthetic oligonucleotide
gtcagacgcgagtgacccactgcct

SEQ ID NO: 156914 - DNA, 27 bp, Artificial Sequence
  Description of Artificial Sequence: Synthetic oligonucleotide
tcagacgcgagtgacccactgcctgtt

SEQ ID NO: 156915 - DNA, 27 bp, Artificial Sequence
  Description of Artificial Sequence: Synthetic oligonucleotide
cagacgcgagtgacccactgcctgttt

SEQ ID NO: 156916 - DNA, 27 bp, Artificial Sequence
  Description of Artificial Sequence: Synthetic oligonucleotide
agacgcgagtgacccactgcctgtttc

SEQ ID NO: 156917 - DNA, 27 bp, Artificial Sequence
  Description of Artificial Sequence: Synthetic oligonucleotide
gacgcgagtgacccactgcctgtttct

SEQ ID NO: 156918 - DNA, 27 bp, Artificial Sequence
  Description of Artificial Sequence: Synthetic oligonucleotide
acgcgagtgacccactgcctgtttctg

SEQ ID NO: 156919 - DNA, 27 bp, Artificial Sequence
  Description of Artificial Sequence: Synthetic oligonucleotide
cgcgagtgacccactgcctgtttctgt

SEQ ID NO: 156920 - DNA, 27 bp, Artificial Sequence
  Description of Artificial Sequence: Synthetic oligonucleotide
gcgagtgacccactgcctgtttctgtc

SEQ ID NO: 156921 - DNA, 28 bp, Artificial Sequence
  Description of Artificial Sequence: Synthetic oligonucleotide
cgagtgacccactgcctgtttctgtcac

SEQ ID NO: 156922 - DNA, 29 bp, Artificial Sequence
  Description of Artificial Sequence: Synthetic oligonucleotide
gagtgacccactgcctgtttctgtcacag

SEQ ID NO: 156923 - DNA, 29 bp, Artificial Sequence
  Description of Artificial Sequence: Synthetic oligonucleotide
agtgacccactgcctgtttctgtcacagg

SEQ ID NO: 156924 - DNA, 28 bp, Artificial Sequence
  Description of Artificial Sequence: Synthetic oligonucleotide
gtgacccactgcctgtttctgtcacagg

SEQ ID NO: 156925 - DNA, 31 bp, Artificial Sequence
  Description of Artificial Sequence: Synthetic oligonucleotide
tgacccactgcctgtttctgtcacaggaaac

SEQ ID NO: 156926 - DNA, 30 bp, Artificial Sequence
  Description of Artificial Sequence: Synthetic oligonucleotide
gacccactgcctgtttctgtcacaggaaac

SEQ ID NO: 156927 - DNA, 30 bp, Artificial Sequence
  Description of Artificial Sequence: Synthetic oligonucleotide
acccactgcctgtttctgtcacaggaaacc

SEQ ID NO: 156928 - DNA, 29 bp, Artificial Sequence
  Description of Artificial Sequence: Synthetic oligonucleotide
cccactgcctgtttctgtcacaggaaacc

SEQ ID NO: 156929 - DNA, 29 bp, Artificial Sequence
  Description of Artificial Sequence: Synthetic oligonucleotide
ccactgcctgtttctgtcacaggaaaccc

SEQ ID NO: 156930 - DNA, 31 bp, Artificial Sequence
  Description of Artificial Sequence: Synthetic oligonucleotide
cactgcctgtttctgtcacaggaaacccttc

SEQ ID NO: 156931 - DNA, 33 bp, Artificial Sequence
  Description of Artificial Sequence: Synthetic oligonucleotide
actgcctgtttctgtcacaggaaacccttctag

SEQ ID NO: 156932 - DNA, 32 bp, Artificial Sequence
  Description of Artificial Sequence: Synthetic oligonucleotide
ctgcctgtttctgtcacaggaaacccttctag

SEQ ID NO: 156933 - DNA, 34 bp, Artificial Sequence
  Description of Artificial Sequence: Synthetic oligonucleotide
tgcctgtttctgtcacaggaaacccttctagtag

SEQ ID NO: 156934 - DNA, 33 bp, Artificial Sequence
  Description of Artificial Sequence: Synthetic oligonucleotide
gcctgtttctgtcacaggaaacccttctagtag

SEQ ID NO: 156935 - DNA, 35 bp, Artificial Sequence
  Description of Artificial Sequence: Synthetic oligonucleotide
cctgtttctgtcacaggaaacccttctagtagttg

SEQ ID NO: 156936 - DNA, 35 bp, Artificial Sequence
  Description of Artificial Sequence: Synthetic oligonucleotide
ctgtttctgtcacaggaaacccttctagtagttgg

SEQ ID NO: 156937 - DNA, 35 bp, Artificial Sequence
  Description of Artificial Sequence: Synthetic oligonucleotide
tgtttctgtcacaggaaacccttctagtagttggc

SEQ ID NO: 156938 - DNA, 34 bp, Artificial Sequence
  Description of Artificial Sequence: Synthetic oligonucleotide
gtttctgtcacaggaaacccttctagtagttggc

SEQ ID NO: 156939 - DNA, 34 bp, Artificial Sequence
  Description of Artificial Sequence: Synthetic oligonucleotide
tttctgtcacaggaaacccttctagtagttggcc

SEQ ID NO: 156940 - DNA, 33 bp, Artificial Sequence
  Description of Artificial Sequence: Synthetic oligonucleotide
ttctgtcacaggaaacccttctagtagttggcc

SEQ ID NO: 156941 - DNA, 32 bp, Artificial Sequence
  Description of Artificial Sequence: Synthetic oligonucleotide
tctgtcacaggaaacccttctagtagttggcc

SEQ ID NO: 156942 - DNA, 31 bp, Artificial Sequence
  Description of Artificial Sequence: Synthetic oligonucleotide
ctgtcacaggaaacccttctagtagttggcc

SEQ ID NO: 156943 - DNA, 33 bp, Artificial Sequence
  Description of Artificial Sequence: Synthetic oligonucleotide
tgtcacaggaaacccttctagtagttggccttc

SEQ ID NO: 156944 - DNA, 32 bp, Artificial Sequence
  Description of Artificial Sequence: Synthetic oligonucleotide
gtcacaggaaacccttctagtagttggccttc

SEQ ID NO: 156945 - DNA, 33 bp, Artificial Sequence
  Description of Artificial Sequence: Synthetic oligonucleotide
tcacaggaaacccttctagtagttggccttcac

SEQ ID NO: 156946 - DNA, 32 bp, Artificial Sequence
  Description of Artificial Sequence: Synthetic oligonucleotide
cacaggaaacccttctagtagttggccttcac

SEQ ID NO: 156947 - DNA, 32 bp, Artificial Sequence
  Description of Artificial Sequence: Synthetic oligonucleotide
acaggaaacccttctagtagttggccttcacc

SEQ ID NO: 156948 - DNA, 31 bp, Artificial Sequence
  Description of Artificial Sequence: Synthetic oligonucleotide
caggaaacccttctagtagttggccttcacc

SEQ ID NO: 156949 - DNA, 31 bp, Artificial Sequence
  Description of Artificial Sequence: Synthetic oligonucleotide
aggaaacccttctagtagttggccttcaccc

SEQ ID NO: 156950 - DNA, 30 bp, Artificial Sequence
  Description of Artificial Sequence: Synthetic oligonucleotide
ggaaacccttctagtagttggccttcaccc

SEQ ID NO: 156951 - DNA, 31 bp, Artificial Sequence
  Description of Artificial Sequence: Synthetic oligonucleotide
gaaacccttctagtagttggccttcacccac

SEQ ID NO: 156952 - DNA, 32 bp, Artificial Sequence
  Description of Artificial Sequence: Synthetic oligonucleotide
aaacccttctagtagttggccttcacccactg

SEQ ID NO: 156953 - DNA, 31 bp, Artificial Sequence
  Description of Artificial Sequence: Synthetic oligonucleotide
aacccttctagtagttggccttcacccactg

SEQ ID NO: 156954 - DNA, 30 bp, Artificial Sequence
  Description of Artificial Sequence: Synthetic oligonucleotide
acccttctagtagttggccttcacccactg

SEQ ID NO: 156955 - DNA, 29 bp, Artificial Sequence
  Description of Artificial Sequence: Synthetic oligonucleotide
cccttctagtagttggccttcacccactg

SEQ ID NO: 156956 - DNA, 31 bp, Artificial Sequence
  Description of Artificial Sequence: Synthetic oligonucleotide
ccttctagtagttggccttcacccactgaac

SEQ ID NO: 156957 - DNA, 31 bp, Artificial Sequence
  Description of Artificial Sequence: Synthetic oligonucleotide
cttctagtagttggccttcacccactgaacc

SEQ ID NO: 156958 - DNA, 33 bp, Artificial Sequence
  Description of Artificial Sequence: Synthetic oligonucleotide
ttctagtagttggccttcacccactgaaccaag

SEQ ID NO: 156959 - DNA, 32 bp, Artificial Sequence
  Description of Artificial Sequence: Synthetic oligonucleotide
tctagtagttggccttcacccactgaaccaag

SEQ ID NO: 156960 - DNA, 31 bp, Artificial Sequence
  Description of Artificial Sequence: Synthetic oligonucleotide
ctagtagttggccttcacccactgaaccaag

SEQ ID NO: 156961 - DNA, 31 bp, Artificial Sequence
  Description of Artificial Sequence: Synthetic oligonucleotide
tagtagttggccttcacccactgaaccaagc

SEQ ID NO: 156962 - DNA, 30 bp, Artificial Sequence
  Description of Artificial Sequence: Synthetic oligonucleotide
agtagttggccttcacccactgaaccaagc

SEQ ID NO: 156963 - DNA, 29 bp, Artificial Sequence
  Description of Artificial Sequence: Synthetic oligonucleotide
gtagttggccttcacccactgaaccaagc

SEQ ID NO: 156964 - DNA, 31 bp, Artificial Sequence
  Description of Artificial Sequence: Synthetic oligonucleotide
tagttggccttcacccactgaaccaagcttc

SEQ ID NO: 156965 - DNA, 30 bp, Artificial Sequence
  Description of Artificial Sequence: Synthetic oligonucleotide
agttggccttcacccactgaaccaagcttc

SEQ ID NO: 156966 - DNA, 29 bp, Artificial Sequence
  Description of Artificial Sequence: Synthetic oligonucleotide
gttggccttcacccactgaaccaagcttc

SEQ ID NO: 156967 - DNA, 33 bp, Artificial Sequence
  Description of Artificial Sequence: Synthetic oligonucleotide
ttggccttcacccactgaaccaagcttcaaaac

SEQ ID NO: 156968 - DNA, 32 bp, Artificial Sequence
  Description of Artificial Sequence: Synthetic oligonucleotide
tggccttcacccactgaaccaagcttcaaaac

SEQ ID NO: 156969 - DNA, 31 bp, Artificial Sequence
  Description of Artificial Sequence: Synthetic oligonucleotide
ggccttcacccactgaaccaagcttcaaaac

SEQ ID NO: 156970 - DNA, 32 bp, Artificial Sequence
  Description of Artificial Sequence: Synthetic oligonucleotide
gccttcacccactgaaccaagcttcaaaactg

SEQ ID NO: 156971 - DNA, 32 bp, Artificial Sequence
  Description of Artificial Sequence: Synthetic oligonucleotide
ccttcacccactgaaccaagcttcaaaactgg

SEQ ID NO: 156972 - DNA, 35 bp, Artificial Sequence
  Description of Artificial Sequence: Synthetic oligonucleotide
cttcacccactgaaccaagcttcaaaactggtatc

SEQ ID NO: 156973 - DNA, 35 bp, Artificial Sequence
  Description of Artificial Sequence: Synthetic oligonucleotide
ttcacccactgaaccaagcttcaaaactggtatcg

SEQ ID NO: 156974 - DNA, 34 bp, Artificial Sequence
  Description of Artificial Sequence: Synthetic oligonucleotide
tcacccactgaaccaagcttcaaaactggtatcg

SEQ ID NO: 156975 - DNA, 33 bp, Artificial Sequence
  Description of Artificial Sequence: Synthetic oligonucleotide
cacccactgaaccaagcttcaaaactggtatcg

SEQ ID NO: 156976 - DNA, 33 bp, Artificial Sequence
  Description of Artificial Sequence: Synthetic oligonucleotide
acccactgaaccaagcttcaaaactggtatcgc

SEQ ID NO: 156977 - DNA, 32 bp, Artificial Sequence
  Description of Artificial Sequence: Synthetic oligonucleotide
cccactgaaccaagcttcaaaactggtatcgc

SEQ ID NO: 156978 - DNA, 32 bp, Artificial Sequence
  Description of Artificial Sequence: Synthetic oligonucleotide
ccactgaaccaagcttcaaaactggtatcgcc

SEQ ID NO: 156979 - DNA, 33 bp, Artificial Sequence
  Description of Artificial Sequence: Synthetic oligonucleotide
cactgaaccaagcttcaaaactggtatcgccag

SEQ ID NO: 156980 - DNA, 34 bp, Artificial Sequence
  Description of Artificial Sequence: Synthetic oligonucleotide
actgaaccaagcttcaaaactggtatcgccagac

SEQ ID NO: 156981 - DNA, 33 bp, Artificial Sequence
  Description of Artificial Sequence: Synthetic oligonucleotide
ctgaaccaagcttcaaaactggtatcgccagac

SEQ ID NO: 156982 - DNA, 34 bp, Artificial Sequence
  Description of Artificial Sequence: Synthetic oligonucleotide
tgaaccaagcttcaaaactggtatcgccagacac

SEQ ID NO: 156983 - DNA, 33 bp, Artificial Sequence
  Description of Artificial Sequence: Synthetic oligonucleotide
gaaccaagcttcaaaactggtatcgccagacac

SEQ ID NO: 156984 - DNA, 33 bp, Artificial Sequence
  Description of Artificial Sequence: Synthetic oligonucleotide
aaccaagcttcaaaactggtatcgccagacacc

SEQ ID NO: 156985 - DNA, 32 bp, Artificial Sequence
  Description of Artificial Sequence: Synthetic oligonucleotide
accaagcttcaaaactggtatcgccagacacc

SEQ ID NO: 156986 - DNA, 31 bp, Artificial Sequence
  Description of Artificial Sequence: Synthetic oligonucleotide
ccaagcttcaaaactggtatcgccagacacc

SEQ ID NO: 156987 - DNA, 32 bp, Artificial Sequence
  Description of Artificial Sequence: Synthetic oligonucleotide
caagcttcaaaactggtatcgccagacacctg

SEQ ID NO: 156988 - DNA, 32 bp, Artificial Sequence
  Description of Artificial Sequence: Synthetic oligonucleotide
aagcttcaaaactggtatcgccagacacctgc

SEQ ID NO: 156989 - DNA, 31 bp, Artificial Sequence
  Description of Artificial Sequence: Synthetic oligonucleotide
agcttcaaaactggtatcgccagacacctgc

SEQ ID NO: 156990 - DNA, 30 bp, Artificial Sequence
  Description of Artificial Sequence: Synthetic oligonucleotide
gcttcaaaactggtatcgccagacacctgc

SEQ ID NO: 156991 - DNA, 32 bp, Artificial Sequence
  Description of Artificial Sequence: Synthetic oligonucleotide
cttcaaaactggtatcgccagacacctgcatg

SEQ ID NO: 156992 - DNA, 32 bp, Artificial Sequence
  Description of Artificial Sequence: Synthetic oligonucleotide
ttcaaaactggtatcgccagacacctgcatgc

SEQ ID NO: 156993 - DNA, 31 bp, Artificial Sequence
  Description of Artificial Sequence: Synthetic oligonucleotide
tcaaaactggtatcgccagacacctgcatgc

SEQ ID NO: 156994 - DNA, 30 bp, Artificial Sequence
  Description of Artificial Sequence: Synthetic oligonucleotide
caaaactggtatcgccagacacctgcatgc

SEQ ID NO: 156995 - DNA, 31 bp, Artificial Sequence
  Description of Artificial Sequence: Synthetic oligonucleotide
aaaactggtatcgccagacacctgcatgctg

SEQ ID NO: 156996 - DNA, 30 bp, Artificial Sequence
  Description of Artificial Sequence: Synthetic oligonucleotide
aaactggtatcgccagacacctgcatgctg

SEQ ID NO: 156997 - DNA, 29 bp, Artificial Sequence
  Description of Artificial Sequence: Synthetic oligonucleotide
aactggtatcgccagacacctgcatgctg

SEQ ID NO: 156998 - DNA, 28 bp, Artificial Sequence
  Description of Artificial Sequence: Synthetic oligonucleotide
actggtatcgccagacacctgcatgctg

SEQ ID NO: 156999 - DNA, 27 bp, Artificial Sequence
  Description of Artificial Sequence: Synthetic oligonucleotide
ctggtatcgccagacacctgcatgctg

SEQ ID NO: 157000 - DNA, 28 bp, Artificial Sequence
  Description of Artificial Sequence: Synthetic oligonucleotide
tggtatcgccagacacctgcatgctgtg

SEQ ID NO: 157001 - DNA, 27 bp, Artificial Sequence
  Description of Artificial Sequence: Synthetic oligonucleotide
ggtatcgccagacacctgcatgctgtg

SEQ ID NO: 157002 - DNA, 31 bp, Artificial Sequence
  Description of Artificial Sequence: Synthetic oligonucleotide
gtatcgccagacacctgcatgctgtgattag

SEQ ID NO: 157003 - DNA, 31 bp, Artificial Sequence
  Description of Artificial Sequence: Synthetic oligonucleotide
tatcgccagacacctgcatgctgtgattagg

SEQ ID NO: 157004 - DNA, 30 bp, Artificial Sequence
  Description of Artificial Sequence: Synthetic oligonucleotide
atcgccagacacctgcatgctgtgattagg

SEQ ID NO: 157005 - DNA, 29 bp, Artificial Sequence
  Description of Artificial Sequence: Synthetic oligonucleotide
tcgccagacacctgcatgctgtgattagg

SEQ ID NO: 157006 - DNA, 28 bp, Artificial Sequence
  Description of Artificial Sequence: Synthetic oligonucleotide
cgccagacacctgcatgctgtgattagg

SEQ ID NO: 157007 - DNA, 30 bp, Artificial Sequence
  Description of Artificial Sequence: Synthetic oligonucleotide
gccagacacctgcatgctgtgattaggtac

SEQ ID NO: 157008 - DNA, 31 bp, Artificial Sequence
  Description of Artificial Sequence: Synthetic oligonucleotide
ccagacacctgcatgctgtgattaggtactc

SEQ ID NO: 157009 - DNA, 32 bp, Artificial Sequence
  Description of Artificial Sequence: Synthetic oligonucleotide
cagacacctgcatgctgtgattaggtactcag

SEQ ID NO: 157010 - DNA, 33 bp, Artificial Sequence
  Description of Artificial Sequence: Synthetic oligonucleotide
agacacctgcatgctgtgattaggtactcagtg

SEQ ID NO: 157011 - DNA, 32 bp, Artificial Sequence
  Description of Artificial Sequence: Synthetic oligonucleotide
gacacctgcatgctgtgattaggtactcagtg

SEQ ID NO: 157012 - DNA, 32 bp, Artificial Sequence
  Description of Artificial Sequence: Synthetic oligonucleotide
acacctgcatgctgtgattaggtactcagtgg

SEQ ID NO: 157013 - DNA, 31 bp, Artificial Sequence
  Description of Artificial Sequence: Synthetic oligonucleotide
cacctgcatgctgtgattaggtactcagtgg

SEQ ID NO: 157014 - DNA, 31 bp, Artificial Sequence
  Description of Artificial Sequence: Synthetic oligonucleotide
acctgcatgctgtgattaggtactcagtggc

SEQ ID NO: 157015 - DNA, 30 bp, Artificial Sequence
  Description of Artificial Sequence: Synthetic oligonucleotide
cctgcatgctgtgattaggtactcagtggc

SEQ ID NO: 157016 - DNA, 30 bp, Artificial Sequence
  Description of Artificial Sequence: Synthetic oligonucleotide
ctgcatgctgtgattaggtactcagtggcc

SEQ ID NO: 157017 - DNA, 32 bp, Artificial Sequence
  Description of Artificial Sequence: Synthetic oligonucleotide
tgcatgctgtgattaggtactcagtggccatc

SEQ ID NO: 157018 - DNA, 31 bp, Artificial Sequence
  Description of Artificial Sequence: Synthetic oligonucleotide
gcatgctgtgattaggtactcagtggccatc

SEQ ID NO: 157019 - DNA, 33 bp, Artificial Sequence
  Description of Artificial Sequence: Synthetic oligonucleotide
catgctgtgattaggtactcagtggccatcatc

SEQ ID NO: 157020 - DNA, 33 bp, Artificial Sequence
  Description of Artificial Sequence: Synthetic oligonucleotide
atgctgtgattaggtactcagtggccatcatcc

SEQ ID NO: 157021 - DNA, 32 bp, Artificial Sequence
  Description of Artificial Sequence: Synthetic oligonucleotide
tgctgtgattaggtactcagtggccatcatcc

SEQ ID NO: 157022 - DNA, 31 bp, Artificial Sequence
  Description of Artificial Sequence: Synthetic oligonucleotide
gctgtgattaggtactcagtggccatcatcc

SEQ ID NO: 157023 - DNA, 32 bp, Artificial Sequence
  Description of Artificial Sequence: Synthetic oligonucleotide
ctgtgattaggtactcagtggccatcatcctc

SEQ ID NO: 157024 - DNA, 36 bp, Artificial Sequence
  Description of Artificial Sequence: Synthetic oligonucleotide
tgtgattaggtactcagtggccatcatcctctttac

SEQ ID NO: 157025 - DNA, 35 bp, Artificial Sequence
  Description of Artificial Sequence: Synthetic oligonucleotide
gtgattaggtactcagtggccatcatcctctttac

SEQ ID NO: 157026 - DNA, 35 bp, Artificial Sequence
  Description of Artificial Sequence: Synthetic oligonucleotide
tgattaggtactcagtggccatcatcctctttacc

SEQ ID NO: 157027 - DNA, 34 bp, Artificial Sequence
  Description of Artificial Sequence: Synthetic oligonucleotide
gattaggtactcagtggccatcatcctctttacc

SEQ ID NO: 157028 - DNA, 36 bp, Artificial Sequence
  Description of Artificial Sequence: Synthetic oligonucleotide
attaggtactcagtggccatcatcctctttaccatc

SEQ ID NO: 157029 - DNA, 35 bp, Artificial Sequence
  Description of Artificial Sequence: Synthetic oligonucleotide
ttaggtactcagtggccatcatcctctttaccatc

SEQ ID NO: 157030 - DNA, 34 bp, Artificial Sequence
  Description of Artificial Sequence: Synthetic oligonucleotide
taggtactcagtggccatcatcctctttaccatc

SEQ ID NO: 157031 - DNA, 33 bp, Artificial Sequence
  Description of Artificial Sequence: Synthetic oligonucleotide
aggtactcagtggccatcatcctctttaccatc

SEQ ID NO: 157032 - DNA, 32 bp, Artificial Sequence
  Description of Artificial Sequence: Synthetic oligonucleotide
ggtactcagtggccatcatcctctttaccatc

SEQ ID NO: 157033 - DNA, 32 bp, Artificial Sequence
  Description of Artificial Sequence: Synthetic oligonucleotide
gtactcagtggccatcatcctctttaccatcc

SEQ ID NO: 157034 - DNA, 34 bp, Artificial Sequence
  Description of Artificial Sequence: Synthetic oligonucleotide
tactcagtggccatcatcctctttaccatccttc

SEQ ID NO: 157035 - DNA, 33 bp, Artificial Sequence
  Description of Artificial Sequence: Synthetic oligonucleotide
actcagtggccatcatcctctttaccatccttc

SEQ ID NO: 157036 - DNA, 32 bp, Artificial Sequence
  Description of Artificial Sequence: Synthetic oligonucleotide
ctcagtggccatcatcctctttaccatccttc

SEQ ID NO: 157037 - DNA, 32 bp, Artificial Sequence
  Description of Artificial Sequence: Synthetic oligonucleotide
tcagtggccatcatcctctttaccatccttcc

SEQ ID NO: 157038 - DNA, 31 bp, Artificial Sequence
  Description of Artificial Sequence: Synthetic oligonucleotide
cagtggccatcatcctctttaccatccttcc

SEQ ID NO: 157039 - DNA, 31 bp, Artificial Sequence
  Description of Artificial Sequence: Synthetic oligonucleotide
agtggccatcatcctctttaccatccttccc

SEQ ID NO: 157040 - DNA, 30 bp, Artificial Sequence
  Description of Artificial Sequence: Synthetic oligonucleotide
gtggccatcatcctctttaccatccttccc

SEQ ID NO: 157041 - DNA, 32 bp, Artificial Sequence
  Description of Artificial Sequence: Synthetic oligonucleotide
tggccatcatcctctttaccatccttcccttc

SEQ ID NO: 157042 - DNA, 31 bp, Artificial Sequence
  Description of Artificial Sequence: Synthetic oligonucleotide
ggccatcatcctctttaccatccttcccttc

SEQ ID NO: 157043 - DNA, 34 bp, Artificial Sequence
  Description of Artificial Sequence: Synthetic oligonucleotide
gccatcatcctctttaccatccttcccttctttc

SEQ ID NO: 157044 - DNA, 35 bp, Artificial Sequence
  Description of Artificial Sequence: Synthetic oligonucleotide
ccatcatcctctttaccatccttcccttctttctc

SEQ ID NO: 157045 - DNA, 35 bp, Artificial Sequence
  Description of Artificial Sequence: Synthetic oligonucleotide
catcatcctctttaccatccttcccttctttctcc

SEQ ID NO: 157046 - DNA, 37 bp, Artificial Sequence
  Description of Artificial Sequence: Synthetic oligonucleotide
atcatcctctttaccatccttcccttctttctccttc

SEQ ID NO: 157047 - DNA, 36 bp, Artificial Sequence
  Description of Artificial Sequence: Synthetic oligonucleotide
tcatcctctttaccatccttcccttctttctccttc

SEQ ID NO: 157048 - DNA, 35 bp, Artificial Sequence
  Description of Artificial Sequence: Synthetic oligonucleotide
catcctctttaccatccttcccttctttctccttc

SEQ ID NO: 157049 - DNA, 37 bp, Artificial Sequence
  Description of Artificial Sequence: Synthetic oligonucleotide
atcctctttaccatccttcccttctttctccttcatc

SEQ ID NO: 157050 - DNA, 36 bp, Artificial Sequence
  Description of Artificial Sequence: Synthetic oligonucleotide
tcctctttaccatccttcccttctttctccttcatc

SEQ ID NO: 157051 - DNA, 35 bp, Artificial Sequence
  Description of Artificial Sequence: Synthetic oligonucleotide
cctctttaccatccttcccttctttctccttcatc

SEQ ID NO: 157052 - DNA, 35 bp, Artificial Sequence
  Description of Artificial Sequence: Synthetic oligonucleotide
ctctttaccatccttcccttctttctccttcatcg

SEQ ID NO: 157053 - DNA, 35 bp, Artificial Sequence
  Description of Artificial Sequence: Synthetic oligonucleotide
tctttaccatccttcccttctttctccttcatcgc

SEQ ID NO: 157054 - DNA, 34 bp, Artificial Sequence
  Description of Artificial Sequence: Synthetic oligonucleotide
ctttaccatccttcccttctttctccttcatcgc

SEQ ID NO: 157055 - DNA, 35 bp, Artificial Sequence
  Description of Artificial Sequence: Synthetic oligonucleotide
tttaccatccttcccttctttctccttcatcgctg

SEQ ID NO: 157056 - DNA, 34 bp, Artificial Sequence
  Description of Artificial Sequence: Synthetic oligonucleotide
ttaccatccttcccttctttctccttcatcgctg

SEQ ID NO: 157057 - DNA, 33 bp, Artificial Sequence
  Description of Artificial Sequence: Synthetic oligonucleotide
taccatccttcccttctttctccttcatcgctg

SEQ ID NO: 157058 - DNA, 32 bp, Artificial Sequence
  Description of Artificial Sequence: Synthetic oligonucleotide
accatccttcccttctttctccttcatcgctg

SEQ ID NO: 157059 - DNA, 31 bp, Artificial Sequence
  Description of Artificial Sequence: Synthetic oligonucleotide
ccatccttcccttctttctccttcatcgctg

SEQ ID NO: 157060 - DNA, 31 bp, Artificial Sequence
  Description of Artificial Sequence: Synthetic oligonucleotide
catccttcccttctttctccttcatcgctgg

SEQ ID NO: 157061 - DNA, 32 bp, Artificial Sequence
  Description of Artificial Sequence: Synthetic oligonucleotide
atccttcccttctttctccttcatcgctggtg

SEQ ID NO: 157062 - DNA, 31 bp, Artificial Sequence
  Description of Artificial Sequence: Synthetic oligonucleotide
tccttcccttctttctccttcatcgctggtg

SEQ ID NO: 157063 - DNA, 30 bp, Artificial Sequence
  Description of Artificial Sequence: Synthetic oligonucleotide
ccttcccttctttctccttcatcgctggtg

SEQ ID NO: 157064 - DNA, 30 bp, Artificial Sequence
  Description of Artificial Sequence: Synthetic oligonucleotide
cttcccttctttctccttcatcgctggtgc

SEQ ID NO: 157065 - DNA, 31 bp, Artificial Sequence
  Description of Artificial Sequence: Synthetic oligonucleotide
ttcccttctttctccttcatcgctggtgctc

SEQ ID NO: 157066 - DNA, 30 bp, Artificial Sequence
  Description of Artificial Sequence: Synthetic oligonucleotide
tcccttctttctccttcatcgctggtgctc

SEQ ID NO: 157067 - DNA, 29 bp, Artificial Sequence
  Description of Artificial Sequence: Synthetic oligonucleotide
cccttctttctccttcatcgctggtgctc

SEQ ID NO: 157068 - DNA, 29 bp, Artificial Sequence
  Description of Artificial Sequence: Synthetic oligonucleotide
ccttctttctccttcatcgctggtgctcc

SEQ ID NO: 157069 - DNA, 41 bp, Artificial Sequence
  Description of Artificial Sequence: Synthetic oligonucleotide
cttctttctccttcatcgctggtgctccaaaaaaaaaaatg

SEQ ID NO: 157070 - DNA, 41 bp, Artificial Sequence
  Description of Artificial Sequence: Synthetic oligonucleotide
ttctttctccttcatcgctggtgctccaaaaaaaaaaatgc

SEQ ID NO: 157071 - DNA, 40 bp, Artificial Sequence
  Description of Artificial Sequence: Synthetic oligonucleotide
tctttctccttcatcgctggtgctccaaaaaaaaaaatgc

SEQ ID NO: 157072 - DNA, 39 bp, Artificial Sequence
  Description of Artificial Sequence: Synthetic oligonucleotide
ctttctccttcatcgctggtgctccaaaaaaaaaaatgc

SEQ ID NO: 157073 - DNA, 40 bp, Artificial Sequence
  Description of Artificial Sequence: Synthetic oligonucleotide
tttctccttcatcgctggtgctccaaaaaaaaaaatgctg

SEQ ID NO: 157074 - DNA, 39 bp, Artificial Sequence
  Description of Artificial Sequence: Synthetic oligonucleotide
ttctccttcatcgctggtgctccaaaaaaaaaaatgctg

SEQ ID NO: 157075 - DNA, 38 bp, Artificial Sequence
  Description of Artificial Sequence: Synthetic oligonucleotide
tctccttcatcgctggtgctccaaaaaaaaaaatgctg

SEQ ID NO: 157076 - DNA, 37 bp, Artificial Sequence
  Description of Artificial Sequence: Synthetic oligonucleotide
ctccttcatcgctggtgctccaaaaaaaaaaatgctg

SEQ ID NO: 157077 - DNA, 37 bp, Artificial Sequence
  Description of Artificial Sequence: Synthetic oligonucleotide
tccttcatcgctggtgctccaaaaaaaaaaatgctgc

SEQ ID NO: 157078 - DNA, 36 bp, Artificial Sequence
  Description of Artificial Sequence: Synthetic oligonucleotide
ccttcatcgctggtgctccaaaaaaaaaaatgctgc

SEQ ID NO: 157079 - DNA, 37 bp, Artificial Sequence
  Description of Artificial Sequence: Synthetic oligonucleotide
cttcatcgctggtgctccaaaaaaaaaaatgctgctg

SEQ ID NO: 157080 - DNA, 41 bp, Artificial Sequence
  Description of Artificial Sequence: Synthetic oligonucleotide
ttcatcgctggtgctccaaaaaaaaaaatgctgctgtaatg

SEQ ID NO: 157081 - DNA, 40 bp, Artificial Sequence
  Description of Artificial Sequence: Synthetic oligonucleotide
tcatcgctggtgctccaaaaaaaaaaatgctgctgtaatg

SEQ ID NO: 157082 - DNA, 39 bp, Artificial Sequence
  Description of Artificial Sequence: Synthetic oligonucleotide
catcgctggtgctccaaaaaaaaaaatgctgctgtaatg

SEQ ID NO: 157083 - DNA, 41 bp, Artificial Sequence
  Description of Artificial Sequence: Synthetic oligonucleotide
atcgctggtgctccaaaaaaaaaaatgctgctgtaatgaac

SEQ ID NO: 157084 - DNA, 40 bp, Artificial Sequence
  Description of Artificial Sequence: Synthetic oligonucleotide
tcgctggtgctccaaaaaaaaaaatgctgctgtaatgaac

SEQ ID NO: 157085 - DNA, 39 bp, Artificial Sequence
  Description of Artificial Sequence: Synthetic oligonucleotide
cgctggtgctccaaaaaaaaaaatgctgctgtaatgaac

SEQ ID NO: 157086 - DNA, 39 bp, Artificial Sequence
  Description of Artificial Sequence: Synthetic oligonucleotide
gctggtgctccaaaaaaaaaaatgctgctgtaatgaacc

SEQ ID NO: 157087 - DNA, 41 bp, Artificial Sequence
  Description of Artificial Sequence: Synthetic oligonucleotide
ctggtgctccaaaaaaaaaaatgctgctgtaatgaaccaag

SEQ ID NO: 157088 - DNA, 42 bp, Artificial Sequence
  Description of Artificial Sequence: Synthetic oligonucleotide
tggtgctccaaaaaaaaaaatgctgctgtaatgaaccaagag

SEQ ID NO: 157089 - DNA, 41 bp, Artificial Sequence
  Description of Artificial Sequence: Synthetic oligonucleotide
ggtgctccaaaaaaaaaaatgctgctgtaatgaaccaagag

SEQ ID NO: 157090 - DNA, 41 bp, Artificial Sequence
  Description of Artificial Sequence: Synthetic oligonucleotide
gtgctccaaaaaaaaaaatgctgctgtaatgaaccaagagc

SEQ ID NO: 157091 - DNA, 41 bp, Artificial Sequence
  Description of Artificial Sequence: Synthetic oligonucleotide
tgctccaaaaaaaaaaatgctgctgtaatgaaccaagagcc

SEQ ID NO: 157092 - DNA, 40 bp, Artificial Sequence
  Description of Artificial Sequence: Synthetic oligonucleotide
gctccaaaaaaaaaaatgctgctgtaatgaaccaagagcc

SEQ ID NO: 157093 - DNA, 41 bp, Artificial Sequence
  Description of Artificial Sequence: Synthetic oligonucleotide
ctccaaaaaaaaaaatgctgctgtaatgaaccaagagcctg

SEQ ID NO: 157094 - DNA, 41 bp, Artificial Sequence
  Description of Artificial Sequence: Synthetic oligonucleotide
tccaaaaaaaaaaatgctgctgtaatgaaccaagagcctgc

SEQ ID NO: 157095 - DNA, 40 bp, Artificial Sequence
  Description of Artificial Sequence: Synthetic oligonucleotide
ccaaaaaaaaaaatgctgctgtaatgaaccaagagcctgc

SEQ ID NO: 157096 - DNA, 40 bp, Artificial Sequence
  Description of Artificial Sequence: Synthetic oligonucleotide
caaaaaaaaaaatgctgctgtaatgaaccaagagcctgcg

SEQ ID NO: 157097 - DNA, 40 bp, Artificial Sequence
  Description of Artificial Sequence: Synthetic oligonucleotide
aaaaaaaaaaatgctgctgtaatgaaccaagagcctgcgg

SEQ ID NO: 157098 - DNA, 39 bp, Artificial Sequence
  Description of Artificial Sequence: Synthetic oligonucleotide
aaaaaaaaaatgctgctgtaatgaaccaagagcctgcgg

SEQ ID NO: 157099 - DNA, 38 bp, Artificial Sequence
  Description of Artificial Sequence: Synthetic oligonucleotide
aaaaaaaaatgctgctgtaatgaaccaagagcctgcgg

SEQ ID NO: 157100 - DNA, 37 bp, Artificial Sequence
  Description of Artificial Sequence: Synthetic oligonucleotide
aaaaaaaatgctgctgtaatgaaccaagagcctgcgg

SEQ ID NO: 157101 - DNA, 36 bp, Artificial Sequence
  Description of Artificial Sequence: Synthetic oligonucleotide
aaaaaaatgctgctgtaatgaaccaagagcctgcgg

SEQ ID NO: 157102 - DNA, 35 bp, Artificial Sequence
  Description of Artificial Sequence: Synthetic oligonucleotide
aaaaaatgctgctgtaatgaaccaagagcctgcgg

SEQ ID NO: 157103 - DNA, 34 bp, Artificial Sequence
  Description of Artificial Sequence: Synthetic oligonucleotide
aaaaatgctgctgtaatgaaccaagagcctgcgg

SEQ ID NO: 157104 - DNA, 33 bp, Artificial Sequence
  Description of Artificial Sequence: Synthetic oligonucleotide
aaaatgctgctgtaatgaaccaagagcctgcgg

SEQ ID NO: 157105 - DNA, 32 bp, Artificial Sequence
  Description of Artificial Sequence: Synthetic oligonucleotide
aaatgctgctgtaatgaaccaagagcctgcgg

SEQ ID NO: 157106 - DNA, 31 bp, Artificial Sequence
  Description of Artificial Sequence: Synthetic oligonucleotide
aatgctgctgtaatgaaccaagagcctgcgg

SEQ ID NO: 157107 - DNA, 30 bp, Artificial Sequence
  Description of Artificial Sequence: Synthetic oligonucleotide
atgctgctgtaatgaaccaagagcctgcgg

SEQ ID NO: 157108 - DNA, 29 bp, Artificial Sequence
  Description of Artificial Sequence: Synthetic oligonucleotide
tgctgctgtaatgaaccaagagcctgcgg

SEQ ID NO: 157109 - DNA, 28 bp, Artificial Sequence
  Description of Artificial Sequence: Synthetic oligonucleotide
gctgctgtaatgaaccaagagcctgcgg

SEQ ID NO: 157110 - DNA, 28 bp, Artificial Sequence
  Description of Artificial Sequence: Synthetic oligonucleotide
ctgctgtaatgaaccaagagcctgcggg

SEQ ID NO: 157111 - DNA, 29 bp, Artificial Sequence
  Description of Artificial Sequence: Synthetic oligonucleotide
tgctgtaatgaaccaagagcctgcgggac

SEQ ID NO: 157112 - DNA, 28 bp, Artificial Sequence
  Description of Artificial Sequence: Synthetic oligonucleotide
gctgtaatgaaccaagagcctgcgggac

SEQ ID NO: 157113 - DNA, 29 bp, Artificial Sequence
  Description of Artificial Sequence: Synthetic oligonucleotide
ctgtaatgaaccaagagcctgcgggacac

SEQ ID NO: 157114 - DNA, 30 bp, Artificial Sequence
  Description of Artificial Sequence: Synthetic oligonucleotide
tgtaatgaaccaagagcctgcgggacacag

SEQ ID NO: 157115 - DNA, 29 bp, Artificial Sequence
  Description of Artificial Sequence: Synthetic oligonucleotide
gtaatgaaccaagagcctgcgggacacag

SEQ ID NO: 157116 - DNA, 31 bp, Artificial Sequence
  Description of Artificial Sequence: Synthetic oligonucleotide
taatgaaccaagagcctgcgggacacagaac

SEQ ID NO: 157117 - DNA, 30 bp, Artificial Sequence
  Description of Artificial Sequence: Synthetic oligonucleotide
aatgaaccaagagcctgcgggacacagaac

SEQ ID NO: 157118 - DNA, 29 bp, Artificial Sequence
  Description of Artificial Sequence: Synthetic oligonucleotide
atgaaccaagagcctgcgggacacagaac

SEQ ID NO: 157119 - DNA, 28 bp, Artificial Sequence
  Description of Artificial Sequence: Synthetic oligonucleotide
tgaaccaagagcctgcgggacacagaac

SEQ ID NO: 157120 - DNA, 27 bp, Artificial Sequence
  Description of Artificial Sequence: Synthetic oligonucleotide
gaaccaagagcctgcgggacacagaac

SEQ ID NO: 157121 - DNA, 28 bp, Artificial Sequence
  Description of Artificial Sequence: Synthetic oligonucleotide
aaccaagagcctgcgggacacagaacag

SEQ ID NO: 157122 - DNA, 27 bp, Artificial Sequence
  Description of Artificial Sequence: Synthetic oligonucleotide
accaagagcctgcgggacacagaacag

SEQ ID NO: 157123 - DNA, 27 bp, Artificial Sequence
  Description of Artificial Sequence: Synthetic oligonucleotide
ccaagagcctgcgggacacagaacagt

SEQ ID NO: 157124 - DNA, 27 bp, Artificial Sequence
  Description of Artificial Sequence: Synthetic oligonucleotide
caagagcctgcgggacacagaacagtg

SEQ ID NO: 157125 - DNA, 29 bp, Artificial Sequence
  Description of Artificial Sequence: Synthetic oligonucleotide
aagagcctgcgggacacagaacagtgaac

SEQ ID NO: 157126 - DNA, 28 bp, Artificial Sequence
  Description of Artificial Sequence: Synthetic oligonucleotide
agagcctgcgggacacagaacagtgaac

SEQ ID NO: 157127 - DNA, 27 bp, Artificial Sequence
  Description of Artificial Sequence: Synthetic oligonucleotide
gagcctgcgggacacagaacagtgaac

SEQ ID NO: 157128 - DNA, 28 bp, Artificial Sequence
  Description of Artificial Sequence: Synthetic oligonucleotide
agcctgcgggacacagaacagtgaacag

SEQ ID NO: 157129 - DNA, 27 bp, Artificial Sequence
  Description of Artificial Sequence: Synthetic oligonucleotide
gcctgcgggacacagaacagtgaacag

SEQ ID NO: 157130 - DNA, 27 bp, Artificial Sequence
  Description of Artificial Sequence: Synthetic oligonucleotide
cctgcgggacacagaacagtgaacagg

SEQ ID NO: 157131 - DNA, 27 bp, Artificial Sequence
  Description of Artificial Sequence: Synthetic oligonucleotide
ctgcgggacacagaacagtgaacaggg

SEQ ID NO: 157132 - DNA, 28 bp, Artificial Sequence
  Description of Artificial Sequence: Synthetic oligonucleotide
tgcgggacacagaacagtgaacagggag

SEQ ID NO: 157133 - DNA, 27 bp, Artificial Sequence
  Description of Artificial Sequence: Synthetic oligonucleotide
gcgggacacagaacagtgaacagggag

SEQ ID NO: 157134 - DNA, 27 bp, Artificial Sequence
  Description of Artificial Sequence: Synthetic oligonucleotide
cgggacacagaacagtgaacagggagg

SEQ ID NO: 157135 - DNA, 28 bp, Artificial Sequence
  Description of Artificial Sequence: Synthetic oligonucleotide
gggacacagaacagtgaacagggaggac

SEQ ID NO: 157136 - DNA, 29 bp, Artificial Sequence
  Description of Artificial Sequence: Synthetic oligonucleotide
ggacacagaacagtgaacagggaggactc

SEQ ID NO: 157137 - DNA, 30 bp, Artificial Sequence
  Description of Artificial Sequence: Synthetic oligonucleotide
gacacagaacagtgaacagggaggactctg

SEQ ID NO: 157138 - DNA, 32 bp, Artificial Sequence
  Description of Artificial Sequence: Synthetic oligonucleotide
acacagaacagtgaacagggaggactctgatg

SEQ ID NO: 157139 - DNA, 31 bp, Artificial Sequence
  Description of Artificial Sequence: Synthetic oligonucleotide
cacagaacagtgaacagggaggactctgatg

SEQ ID NO: 157140 - DNA, 28 bp, Artificial Sequence
  Description of Artificial Sequence: Synthetic oligonucleotide
cctcaggaggtgacatacgcacagttgg

SEQ ID NO: 157141 - DNA, 30 bp, Artificial Sequence
  Description of Artificial Sequence: Synthetic oligonucleotide
ctcaggaggtgacatacgcacagttggatc

SEQ ID NO: 157142 - DNA, 31 bp, Artificial Sequence
  Description of Artificial Sequence: Synthetic oligonucleotide
tcaggaggtgacatacgcacagttggatcac

SEQ ID NO: 157143 - DNA, 30 bp, Artificial Sequence
  Description of Artificial Sequence: Synthetic oligonucleotide
caggaggtgacatacgcacagttggatcac

SEQ ID NO: 157144 - DNA, 31 bp, Artificial Sequence
  Description of Artificial Sequence: Synthetic oligonucleotide
aggaggtgacatacgcacagttggatcactg

SEQ ID NO: 157145 - DNA, 30 bp, Artificial Sequence
  Description of Artificial Sequence: Synthetic oligonucleotide
ggaggtgacatacgcacagttggatcactg

SEQ ID NO: 157146 - DNA, 30 bp, Artificial Sequence
  Description of Artificial Sequence: Synthetic oligonucleotide
gaggtgacatacgcacagttggatcactgc

SEQ ID NO: 157147 - DNA, 35 bp, Artificial Sequence
  Description of Artificial Sequence: Synthetic oligonucleotide
aggtgacatacgcacagttggatcactgcattttc

SEQ ID NO: 157148 - DNA, 34 bp, Artificial Sequence
  Description of Artificial Sequence: Synthetic oligonucleotide
ggtgacatacgcacagttggatcactgcattttc

SEQ ID NO: 157149 - DNA, 35 bp, Artificial Sequence
  Description of Artificial Sequence: Synthetic oligonucleotide
gtgacatacgcacagttggatcactgcattttcac

SEQ ID NO: 157150 - DNA, 36 bp, Artificial Sequence
  Description of Artificial Sequence: Synthetic oligonucleotide
tgacatacgcacagttggatcactgcattttcacac

SEQ ID NO: 157151 - DNA, 35 bp, Artificial Sequence
  Description of Artificial Sequence: Synthetic oligonucleotide
gacatacgcacagttggatcactgcattttcacac

SEQ ID NO: 157152 - DNA, 36 bp, Artificial Sequence
  Description of Artificial Sequence: Synthetic oligonucleotide
acatacgcacagttggatcactgcattttcacacag

SEQ ID NO: 157153 - DNA, 35 bp, Artificial Sequence
  Description of Artificial Sequence: Synthetic oligonucleotide
catacgcacagttggatcactgcattttcacacag

SEQ ID NO: 157154 - DNA, 36 bp, Artificial Sequence
  Description of Artificial Sequence: Synthetic oligonucleotide
atacgcacagttggatcactgcattttcacacagag

SEQ ID NO: 157155 - DNA, 35 bp, Artificial Sequence
  Description of Artificial Sequence: Synthetic oligonucleotide
tacgcacagttggatcactgcattttcacacagag

SEQ ID NO: 157156 - DNA, 34 bp, Artificial Sequence
  Description of Artificial Sequence: Synthetic oligonucleotide
acgcacagttggatcactgcattttcacacagag

SEQ ID NO: 157157 - DNA, 33 bp, Artificial Sequence
  Description of Artificial Sequence: Synthetic oligonucleotide
cgcacagttggatcactgcattttcacacagag

SEQ ID NO: 157158 - DNA, 39 bp, Artificial Sequence
  Description of Artificial Sequence: Synthetic oligonucleotide
gcacagttggatcactgcattttcacacagagaaaaatc

SEQ ID NO: 157159 - DNA, 40 bp, Artificial Sequence
  Description of Artificial Sequence: Synthetic oligonucleotide
cacagttggatcactgcattttcacacagagaaaaatcac

SEQ ID NO: 157160 - DNA, 41 bp, Artificial Sequence
  Description of Artificial Sequence: Synthetic oligonucleotide
acagttggatcactgcattttcacacagagaaaaatcactg

SEQ ID NO: 157161 - DNA, 40 bp, Artificial Sequence
  Description of Artificial Sequence: Synthetic oligonucleotide
cagttggatcactgcattttcacacagagaaaaatcactg

SEQ ID NO: 157162 - DNA, 40 bp, Artificial Sequence
  Description of Artificial Sequence: Synthetic oligonucleotide
agttggatcactgcattttcacacagagaaaaatcactgg

SEQ ID NO: 157163 - DNA, 39 bp, Artificial Sequence
  Description of Artificial Sequence: Synthetic oligonucleotide
gttggatcactgcattttcacacagagaaaaatcactgg

SEQ ID NO: 157164 - DNA, 39 bp, Artificial Sequence
  Description of Artificial Sequence: Synthetic oligonucleotide
ttggatcactgcattttcacacagagaaaaatcactggc

SEQ ID NO: 157165 - DNA, 38 bp, Artificial Sequence
  Description of Artificial Sequence: Synthetic oligonucleotide
tggatcactgcattttcacacagagaaaaatcactggc

SEQ ID NO: 157166 - DNA, 37 bp, Artificial Sequence
  Description of Artificial Sequence: Synthetic oligonucleotide
ggatcactgcattttcacacagagaaaaatcactggc

SEQ ID NO: 157167 - DNA, 37 bp, Artificial Sequence
  Description of Artificial Sequence: Synthetic oligonucleotide
gatcactgcattttcacacagagaaaaatcactggcc

SEQ ID NO: 157168 - DNA, 37 bp, Artificial Sequence
  Description of Artificial Sequence: Synthetic oligonucleotide
atcactgcattttcacacagagaaaaatcactggccc

SEQ ID NO: 157169 - DNA, 36 bp, Artificial Sequence
  Description of Artificial Sequence: Synthetic oligonucleotide
tcactgcattttcacacagagaaaaatcactggccc

SEQ ID NO: 157170 - DNA, 35 bp, Artificial Sequence
  Description of Artificial Sequence: Synthetic oligonucleotide
cactgcattttcacacagagaaaaatcactggccc

SEQ ID NO: 157171 - DNA, 37 bp, Artificial Sequence
  Description of Artificial Sequence: Synthetic oligonucleotide
actgcattttcacacagagaaaaatcactggcccttc

SEQ ID NO: 157172 - DNA, 36 bp, Artificial Sequence
  Description of Artificial Sequence: Synthetic oligonucleotide
ctgcattttcacacagagaaaaatcactggcccttc

SEQ ID NO: 157173 - DNA, 37 bp, Artificial Sequence
  Description of Artificial Sequence: Synthetic oligonucleotide
tgcattttcacacagagaaaaatcactggcccttctc

SEQ ID NO: 157174 - DNA, 36 bp, Artificial Sequence
  Description of Artificial Sequence: Synthetic oligonucleotide
gcattttcacacagagaaaaatcactggcccttctc

SEQ ID NO: 157175 - DNA, 37 bp, Artificial Sequence
  Description of Artificial Sequence: Synthetic oligonucleotide
cattttcacacagagaaaaatcactggcccttctcag

SEQ ID NO: 157176 - DNA, 38 bp, Artificial Sequence
  Description of Artificial Sequence: Synthetic oligonucleotide
attttcacacagagaaaaatcactggcccttctcagag

SEQ ID NO: 157177 - DNA, 37 bp, Artificial Sequence
  Description of Artificial Sequence: Synthetic oligonucleotide
ttttcacacagagaaaaatcactggcccttctcagag

SEQ ID NO: 157178 - DNA, 36 bp, Artificial Sequence
  Description of Artificial Sequence: Synthetic oligonucleotide
tttcacacagagaaaaatcactggcccttctcagag

SEQ ID NO: 157179 - DNA, 35 bp, Artificial Sequence
  Description of Artificial Sequence: Synthetic oligonucleotide
ttcacacagagaaaaatcactggcccttctcagag

SEQ ID NO: 157180 - DNA, 34 bp, Artificial Sequence
  Description of Artificial Sequence: Synthetic oligonucleotide
tcacacagagaaaaatcactggcccttctcagag

SEQ ID NO: 157181 - DNA, 33 bp, Artificial Sequence
  Description of Artificial Sequence: Synthetic oligonucleotide
cacacagagaaaaatcactggcccttctcagag

SEQ ID NO: 157182 - DNA, 33 bp, Artificial Sequence
  Description of Artificial Sequence: Synthetic oligonucleotide
acacagagaaaaatcactggcccttctcagagg

SEQ ID NO: 157183 - DNA, 32 bp, Artificial Sequence
  Description of Artificial Sequence: Synthetic oligonucleotide
cacagagaaaaatcactggcccttctcagagg

SEQ ID NO: 157184 - DNA, 33 bp, Artificial Sequence
  Description of Artificial Sequence: Synthetic oligonucleotide
acagagaaaaatcactggcccttctcagaggag

SEQ ID NO: 157185 - DNA, 32 bp, Artificial Sequence
  Description of Artificial Sequence: Synthetic oligonucleotide
cagagaaaaatcactggcccttctcagaggag

SEQ ID NO: 157186 - DNA, 32 bp, Artificial Sequence
  Description of Artificial Sequence: Synthetic oligonucleotide
agagaaaaatcactggcccttctcagaggagc

SEQ ID NO: 157187 - DNA, 31 bp, Artificial Sequence
  Description of Artificial Sequence: Synthetic oligonucleotide
gagaaaaatcactggcccttctcagaggagc

SEQ ID NO: 157188 - DNA, 33 bp, Artificial Sequence
  Description of Artificial Sequence: Synthetic oligonucleotide
agaaaaatcactggcccttctcagaggagcaag

SEQ ID NO: 157189 - DNA, 32 bp, Artificial Sequence
  Description of Artificial Sequence: Synthetic oligonucleotide
gaaaaatcactggcccttctcagaggagcaag

SEQ ID NO: 157190 - DNA, 33 bp, Artificial Sequence
  Description of Artificial Sequence: Synthetic oligonucleotide
aaaaatcactggcccttctcagaggagcaagag

SEQ ID NO: 157191 - DNA, 32 bp, Artificial Sequence
  Description of Artificial Sequence: Synthetic oligonucleotide
aaaatcactggcccttctcagaggagcaagag

SEQ ID NO: 157192 - DNA, 31 bp, Artificial Sequence
  Description of Artificial Sequence: Synthetic oligonucleotide
aaatcactggcccttctcagaggagcaagag

SEQ ID NO: 157193 - DNA, 30 bp, Artificial Sequence
  Description of Artificial Sequence: Synthetic oligonucleotide
aatcactggcccttctcagaggagcaagag

SEQ ID NO: 157194 - DNA, 29 bp, Artificial Sequence
  Description of Artificial Sequence: Synthetic oligonucleotide
atcactggcccttctcagaggagcaagag

SEQ ID NO: 157195 - DNA, 28 bp, Artificial Sequence
  Description of Artificial Sequence: Synthetic oligonucleotide
tcactggcccttctcagaggagcaagag

SEQ ID NO: 157196 - DNA, 27 bp, Artificial Sequence
  Description of Artificial Sequence: Synthetic oligonucleotide
cactggcccttctcagaggagcaagag

SEQ ID NO: 157197 - DNA, 28 bp, Artificial Sequence
  Description of Artificial Sequence: Synthetic oligonucleotide
actggcccttctcagaggagcaagagac

SEQ ID NO: 157198 - DNA, 27 bp, Artificial Sequence
  Description of Artificial Sequence: Synthetic oligonucleotide
ctggcccttctcagaggagcaagagac

SEQ ID NO: 157199 - DNA, 27 bp, Artificial Sequence
  Description of Artificial Sequence: Synthetic oligonucleotide
tggcccttctcagaggagcaagagacc

SEQ ID NO: 157200 - DNA, 26 bp, Artificial Sequence
  Description of Artificial Sequence: Synthetic oligonucleotide
ggcccttctcagaggagcaagagacc

SEQ ID NO: 157201 - DNA, 27 bp, Artificial Sequence
  Description of Artificial Sequence: Synthetic oligonucleotide
gcccttctcagaggagcaagagaccct

SEQ ID NO: 157202 - DNA, 27 bp, Artificial Sequence
  Description of Artificial Sequence: Synthetic oligonucleotide
cccttctcagaggagcaagagaccctc

SEQ ID NO: 157203 - DNA, 29 bp, Artificial Sequence
  Description of Artificial Sequence: Synthetic oligonucleotide
ccttctcagaggagcaagagaccctcaac

SEQ ID NO: 157204 - DNA, 30 bp, Artificial Sequence
  Description of Artificial Sequence: Synthetic oligonucleotide
cttctcagaggagcaagagaccctcaacag

SEQ ID NO: 157205 - DNA, 33 bp, Artificial Sequence
  Description of Artificial Sequence: Synthetic oligonucleotide
ttctcagaggagcaagagaccctcaacagatac

SEQ ID NO: 157206 - DNA, 32 bp, Artificial Sequence
  Description of Artificial Sequence: Synthetic oligonucleotide
tctcagaggagcaagagaccctcaacagatac

SEQ ID NO: 157207 - DNA, 31 bp, Artificial Sequence
  Description of Artificial Sequence: Synthetic oligonucleotide
ctcagaggagcaagagaccctcaacagatac

SEQ ID NO: 157208 - DNA, 31 bp, Artificial Sequence
  Description of Artificial Sequence: Synthetic oligonucleotide
tcagaggagcaagagaccctcaacagatacc

SEQ ID NO: 157209 - DNA, 30 bp, Artificial Sequence
  Description of Artificial Sequence: Synthetic oligonucleotide
cagaggagcaagagaccctcaacagatacc

SEQ ID NO: 157210 - DNA, 31 bp, Artificial Sequence
  Description of Artificial Sequence: Synthetic oligonucleotide
agaggagcaagagaccctcaacagataccag

SEQ ID NO: 157211 - DNA, 30 bp, Artificial Sequence
  Description of Artificial Sequence: Synthetic oligonucleotide
gaggagcaagagaccctcaacagataccag

SEQ ID NO: 157212 - DNA, 30 bp, Artificial Sequence
  Description of Artificial Sequence: Synthetic oligonucleotide
aggagcaagagaccctcaacagataccagc

SEQ ID NO: 157213 - DNA, 29 bp, Artificial Sequence
  Description of Artificial Sequence: Synthetic oligonucleotide
ggagcaagagaccctcaacagataccagc

SEQ ID NO: 157214 - DNA, 29 bp, Artificial Sequence
  Description of Artificial Sequence: Synthetic oligonucleotide
gagcaagagaccctcaacagataccagcg

SEQ ID NO: 157215 - DNA, 30 bp, Artificial Sequence
  Description of Artificial Sequence: Synthetic oligonucleotide
agcaagagaccctcaacagataccagcgtg

SEQ ID NO: 157216 - DNA, 29 bp, Artificial Sequence
  Description of Artificial Sequence: Synthetic oligonucleotide
gcaagagaccctcaacagataccagcgtg

SEQ ID NO: 157217 - DNA, 30 bp, Artificial Sequence
  Description of Artificial Sequence: Synthetic oligonucleotide
caagagaccctcaacagataccagcgtgtg

SEQ ID NO: 157218 - DNA, 34 bp, Artificial Sequence
  Description of Artificial Sequence: Synthetic oligonucleotide
aagagaccctcaacagataccagcgtgtgtatag

SEQ ID NO: 157219 - DNA, 33 bp, Artificial Sequence
  Description of Artificial Sequence: Synthetic oligonucleotide
agagaccctcaacagataccagcgtgtgtatag

SEQ ID NO: 157220 - DNA, 32 bp, Artificial Sequence
  Description of Artificial Sequence: Synthetic oligonucleotide
gagaccctcaacagataccagcgtgtgtatag

SEQ ID NO: 157221 - DNA, 34 bp, Artificial Sequence
  Description of Artificial Sequence: Synthetic oligonucleotide
agaccctcaacagataccagcgtgtgtatagaac

SEQ ID NO: 157222 - DNA, 33 bp, Artificial Sequence
  Description of Artificial Sequence: Synthetic oligonucleotide
gaccctcaacagataccagcgtgtgtatagaac

SEQ ID NO: 157223 - DNA, 35 bp, Artificial Sequence
  Description of Artificial Sequence: Synthetic oligonucleotide
accctcaacagataccagcgtgtgtatagaacttc

SEQ ID NO: 157224 - DNA, 34 bp, Artificial Sequence
  Description of Artificial Sequence: Synthetic oligonucleotide
ccctcaacagataccagcgtgtgtatagaacttc

SEQ ID NO: 157225 - DNA, 34 bp, Artificial Sequence
  Description of Artificial Sequence: Synthetic oligonucleotide
cctcaacagataccagcgtgtgtatagaacttcc

SEQ ID NO: 157226 - DNA, 38 bp, Artificial Sequence
  Description of Artificial Sequence: Synthetic oligonucleotide
ctcaacagataccagcgtgtgtatagaacttccaaatg

SEQ ID NO: 157227 - DNA, 38 bp, Artificial Sequence
  Description of Artificial Sequence: Synthetic oligonucleotide
tcaacagataccagcgtgtgtatagaacttccaaatgc

SEQ ID NO: 157228 - DNA, 37 bp, Artificial Sequence
  Description of Artificial Sequence: Synthetic oligonucleotide
caacagataccagcgtgtgtatagaacttccaaatgc

SEQ ID NO: 157229 - DNA, 38 bp, Artificial Sequence
  Description of Artificial Sequence: Synthetic oligonucleotide
aacagataccagcgtgtgtatagaacttccaaatgctg

SEQ ID NO: 157230 - DNA, 37 bp, Artificial Sequence
  Description of Artificial Sequence: Synthetic oligonucleotide
acagataccagcgtgtgtatagaacttccaaatgctg

SEQ ID NO: 157231 - DNA, 36 bp, Artificial Sequence
  Description of Artificial Sequence: Synthetic oligonucleotide
cagataccagcgtgtgtatagaacttccaaatgctg

SEQ ID NO: 157232 - DNA, 37 bp, Artificial Sequence
  Description of Artificial Sequence: Synthetic oligonucleotide
agataccagcgtgtgtatagaacttccaaatgctgag

SEQ ID NO: 157233 - DNA, 36 bp, Artificial Sequence
  Description of Artificial Sequence: Synthetic oligonucleotide
gataccagcgtgtgtatagaacttccaaatgctgag

SEQ ID NO: 157234 - DNA, 36 bp, Artificial Sequence
  Description of Artificial Sequence: Synthetic oligonucleotide
ataccagcgtgtgtatagaacttccaaatgctgagc

SEQ ID NO: 157235 - DNA, 35 bp, Artificial Sequence
  Description of Artificial Sequence: Synthetic oligonucleotide
taccagcgtgtgtatagaacttccaaatgctgagc

SEQ ID NO: 157236 - DNA, 34 bp, Artificial Sequence
  Description of Artificial Sequence: Synthetic oligonucleotide
accagcgtgtgtatagaacttccaaatgctgagc

SEQ ID NO: 157237 - DNA, 33 bp, Artificial Sequence
  Description of Artificial Sequence: Synthetic oligonucleotide
ccagcgtgtgtatagaacttccaaatgctgagc

SEQ ID NO: 157238 - DNA, 33 bp, Artificial Sequence
  Description of Artificial Sequence: Synthetic oligonucleotide
cagcgtgtgtatagaacttccaaatgctgagcc

SEQ ID NO: 157239 - DNA, 33 bp, Artificial Sequence
  Description of Artificial Sequence: Synthetic oligonucleotide
agcgtgtgtatagaacttccaaatgctgagccc

SEQ ID NO: 157240 - DNA, 32 bp, Artificial Sequence
  Description of Artificial Sequence: Synthetic oligonucleotide
gcgtgtgtatagaacttccaaatgctgagccc

SEQ ID NO: 157241 - DNA, 33 bp, Artificial Sequence
  Description of Artificial Sequence: Synthetic oligonucleotide
cgtgtgtatagaacttccaaatgctgagcccag

SEQ ID NO: 157242 - DNA, 34 bp, Artificial Sequence
  Description of Artificial Sequence: Synthetic oligonucleotide
gtgtgtatagaacttccaaatgctgagcccagag

SEQ ID NO: 157243 - DNA, 34 bp, Artificial Sequence
  Description of Artificial Sequence: Synthetic oligonucleotide
tgtgtatagaacttccaaatgctgagcccagagc

SEQ ID NO: 157244 - DNA, 33 bp, Artificial Sequence
  Description of Artificial Sequence: Synthetic oligonucleotide
gtgtatagaacttccaaatgctgagcccagagc

SEQ ID NO: 157245 - DNA, 33 bp, Artificial Sequence
  Description of Artificial Sequence: Synthetic oligonucleotide
tgtatagaacttccaaatgctgagcccagagcg

SEQ ID NO: 157246 - DNA, 32 bp, Artificial Sequence
  Description of Artificial Sequence: Synthetic oligonucleotide
gtatagaacttccaaatgctgagcccagagcg

SEQ ID NO: 157247 - DNA, 34 bp, Artificial Sequence
  Description of Artificial Sequence: Synthetic oligonucleotide
tatagaacttccaaatgctgagcccagagcgttg

SEQ ID NO: 157248 - DNA, 33 bp, Artificial Sequence
  Description of Artificial Sequence: Synthetic oligonucleotide
atagaacttccaaatgctgagcccagagcgttg

SEQ ID NO: 157249 - DNA, 32 bp, Artificial Sequence
  Description of Artificial Sequence: Synthetic oligonucleotide
tagaacttccaaatgctgagcccagagcgttg

SEQ ID NO: 157250 - DNA, 31 bp, Artificial Sequence
  Description of Artificial Sequence: Synthetic oligonucleotide
agaacttccaaatgctgagcccagagcgttg

SEQ ID NO: 157251 - DNA, 30 bp, Artificial Sequence
  Description of Artificial Sequence: Synthetic oligonucleotide
gaacttccaaatgctgagcccagagcgttg

SEQ ID NO: 157252 - DNA, 31 bp, Artificial Sequence
  Description of Artificial Sequence: Synthetic oligonucleotide
aacttccaaatgctgagcccagagcgttgtc

SEQ ID NO: 157253 - DNA, 30 bp, Artificial Sequence
  Description of Artificial Sequence: Synthetic oligonucleotide
acttccaaatgctgagcccagagcgttgtc

SEQ ID NO: 157254 - DNA, 29 bp, Artificial Sequence
  Description of Artificial Sequence: Synthetic oligonucleotide
cttccaaatgctgagcccagagcgttgtc

SEQ ID NO: 157255 - DNA, 30 bp, Artificial Sequence
  Description of Artificial Sequence: Synthetic oligonucleotide
ttccaaatgctgagcccagagcgttgtctc

SEQ ID NO: 157256 - DNA, 29 bp, Artificial Sequence
  Description of Artificial Sequence: Synthetic oligonucleotide
tccaaatgctgagcccagagcgttgtctc

SEQ ID NO: 157257 - DNA, 28 bp, Artificial Sequence
  Description of Artificial Sequence: Synthetic oligonucleotide
ccaaatgctgagcccagagcgttgtctc

SEQ ID NO: 157258 - DNA, 28 bp, Artificial Sequence
  Description of Artificial Sequence: Synthetic oligonucleotide
caaatgctgagcccagagcgttgtctcc

SEQ ID NO: 157259 - DNA, 29 bp, Artificial Sequence
  Description of Artificial Sequence: Synthetic oligonucleotide
aaatgctgagcccagagcgttgtctcctg

SEQ ID NO: 157260 - DNA, 28 bp, Artificial Sequence
  Description of Artificial Sequence: Synthetic oligonucleotide
aatgctgagcccagagcgttgtctcctg

SEQ ID NO: 157261 - DNA, 27 bp, Artificial Sequence
  Description of Artificial Sequence: Synthetic oligonucleotide
atgctgagcccagagcgttgtctcctg

SEQ ID NO: 157262 - DNA, 26 bp, Artificial Sequence
  Description of Artificial Sequence: Synthetic oligonucleotide
tgctgagcccagagcgttgtctcctg

SEQ ID NO: 157263 - DNA, 25 bp, Artificial Sequence
  Description of Artificial Sequence: Synthetic oligonucleotide
gctgagcccagagcgttgtctcctg

SEQ ID NO: 157264 - DNA, 25 bp, Artificial Sequence
  Description of Artificial Sequence: Synthetic oligonucleotide
ctgagcccagagcgttgtctcctgc

SEQ ID NO: 157265 - DNA, 25 bp, Artificial Sequence
  Description of Artificial Sequence: Synthetic oligonucleotide
tgagcccagagcgttgtctcctgcc

SEQ ID NO: 157266 - DNA, 24 bp, Artificial Sequence
  Description of Artificial Sequence: Synthetic oligonucleotide
gagcccagagcgttgtctcctgcc

SEQ ID NO: 157267 - DNA, 26 bp, Artificial Sequence
  Description of Artificial Sequence: Synthetic oligonucleotide
agcccagagcgttgtctcctgcccat

SEQ ID NO: 157268 - DNA, 25 bp, Artificial Sequence
  Description of Artificial Sequence: Synthetic oligonucleotide
gcccagagcgttgtctcctgcccat

SEQ ID NO: 157269 - DNA, 26 bp, Artificial Sequence
  Description of Artificial Sequence: Synthetic oligonucleotide
cccagagcgttgtctcctgcccatga

SEQ ID NO: 157270 - DNA, 26 bp, Artificial Sequence
  Description of Artificial Sequence: Synthetic oligonucleotide
ccagagcgttgtctcctgcccatgag

SEQ ID NO: 157271 - DNA, 27 bp, Artificial Sequence
  Description of Artificial Sequence: Synthetic oligonucleotide
cagagcgttgtctcctgcccatgagca

SEQ ID NO: 157272 - DNA, 27 bp, Artificial Sequence
  Description of Artificial Sequence: Synthetic oligonucleotide
agagcgttgtctcctgcccatgagcac

SEQ ID NO: 157273 - DNA, 26 bp, Artificial Sequence
  Description of Artificial Sequence: Synthetic oligonucleotide
gagcgttgtctcctgcccatgagcac

SEQ ID NO: 157274 - DNA, 27 bp, Artificial Sequence
  Description of Artificial Sequence: Synthetic oligonucleotide
agcgttgtctcctgcccatgagcacca

SEQ ID NO: 157275 - DNA, 26 bp, Artificial Sequence
  Description of Artificial Sequence: Synthetic oligonucleotide
gcgttgtctcctgcccatgagcacca

SEQ ID NO: 157276 - DNA, 27 bp, Artificial Sequence
  Description of Artificial Sequence: Synthetic oligonucleotide
cgttgtctcctgcccatgagcaccaca

SEQ ID NO: 157277 - DNA, 27 bp, Artificial Sequence
  Description of Artificial Sequence: Synthetic oligonucleotide
gttgtctcctgcccatgagcaccacag

SEQ ID NO: 157278 - DNA, 28 bp, Artificial Sequence
  Description of Artificial Sequence: Synthetic oligonucleotide
ttgtctcctgcccatgagcaccacagtc

SEQ ID NO: 157279 - DNA, 27 bp, Artificial Sequence
  Description of Artificial Sequence: Synthetic oligonucleotide
tgtctcctgcccatgagcaccacagtc

SEQ ID NO: 157280 - DNA, 27 bp, Artificial Sequence
  Description of Artificial Sequence: Synthetic oligonucleotide
gtctcctgcccatgagcaccacagtca

SEQ ID NO: 157281 - DNA, 27 bp, Artificial Sequence
  Description of Artificial Sequence: Synthetic oligonucleotide
tctcctgcccatgagcaccacagtcag

SEQ ID NO: 157282 - DNA, 26 bp, Artificial Sequence
  Description of Artificial Sequence: Synthetic oligonucleotide
ctcctgcccatgagcaccacagtcag

SEQ ID NO: 157283 - DNA, 26 bp, Artificial Sequence
  Description of Artificial Sequence: Synthetic oligonucleotide
tcctgcccatgagcaccacagtcagg

SEQ ID NO: 157284 - DNA, 25 bp, Artificial Sequence
  Description of Artificial Sequence: Synthetic oligonucleotide
cctgcccatgagcaccacagtcagg

SEQ ID NO: 157285 - DNA, 25 bp, Artificial Sequence
  Description of Artificial Sequence: Synthetic oligonucleotide
ctgcccatgagcaccacagtcaggc

SEQ ID NO: 157286 - DNA, 27 bp, Artificial Sequence
  Description of Artificial Sequence: Synthetic oligonucleotide
tgcccatgagcaccacagtcaggcctt

SEQ ID NO: 157287 - DNA, 26 bp, Artificial Sequence
  Description of Artificial Sequence: Synthetic oligonucleotide
gcccatgagcaccacagtcaggcctt

SEQ ID NO: 157288 - DNA, 27 bp, Artificial Sequence
  Description of Artificial Sequence: Synthetic oligonucleotide
cccatgagcaccacagtcaggccttga

SEQ ID NO: 157289 - DNA, 28 bp, Artificial Sequence
  Description of Artificial Sequence: Synthetic oligonucleotide
ccatgagcaccacagtcaggccttgatg

SEQ ID NO: 157290 - DNA, 28 bp, Artificial Sequence
  Description of Artificial Sequence: Synthetic oligonucleotide
catgagcaccacagtcaggccttgatgg

SEQ ID NO: 157291 - DNA, 28 bp, Artificial Sequence
  Description of Artificial Sequence: Synthetic oligonucleotide
atgagcaccacagtcaggccttgatggg

SEQ ID NO: 157292 - DNA, 27 bp, Artificial Sequence
  Description of Artificial Sequence: Synthetic oligonucleotide
tgagcaccacagtcaggccttgatggg

SEQ ID NO: 157293 - DNA, 27 bp, Artificial Sequence
  Description of Artificial Sequence: Synthetic oligonucleotide
gagcaccacagtcaggccttgatggga

SEQ ID NO: 157294 - DNA, 28 bp, Artificial Sequence
  Description of Artificial Sequence: Synthetic oligonucleotide
agcaccacagtcaggccttgatgggatc

SEQ ID NO: 157295 - DNA, 27 bp, Artificial Sequence
  Description of Artificial Sequence: Synthetic oligonucleotide
gcaccacagtcaggccttgatgggatc

SEQ ID NO: 157296 - DNA, 29 bp, Artificial Sequence
  Description of Artificial Sequence: Synthetic oligonucleotide
caccacagtcaggccttgatgggatcttc

SEQ ID NO: 157297 - DNA, 31 bp, Artificial Sequence
  Description of Artificial Sequence: Synthetic oligonucleotide
accacagtcaggccttgatgggatcttctag

SEQ ID NO: 157298 - DNA, 30 bp, Artificial Sequence
  Description of Artificial Sequence: Synthetic oligonucleotide
ccacagtcaggccttgatgggatcttctag

SEQ ID NO: 157299 - DNA, 30 bp, Artificial Sequence
  Description of Artificial Sequence: Synthetic oligonucleotide
cacagtcaggccttgatgggatcttctagg

SEQ ID NO: 157300 - DNA, 30 bp, Artificial Sequence
  Description of Artificial Sequence: Synthetic oligonucleotide
acagtcaggccttgatgggatcttctaggg

SEQ ID NO: 157301 - DNA, 29 bp, Artificial Sequence
  Description of Artificial Sequence: Synthetic oligonucleotide
cagtcaggccttgatgggatcttctaggg

SEQ ID NO: 157302 - DNA, 30 bp, Artificial Sequence
  Description of Artificial Sequence: Synthetic oligonucleotide
agtcaggccttgatgggatcttctagggag

SEQ ID NO: 157303 - DNA, 29 bp, Artificial Sequence
  Description of Artificial Sequence: Synthetic oligonucleotide
gtcaggccttgatgggatcttctagggag

SEQ ID NO: 157304 - DNA, 30 bp, Artificial Sequence
  Description of Artificial Sequence: Synthetic oligonucleotide
tcaggccttgatgggatcttctagggagac

SEQ ID NO: 157305 - DNA, 29 bp, Artificial Sequence
  Description of Artificial Sequence: Synthetic oligonucleotide
caggccttgatgggatcttctagggagac

SEQ ID NO: 157306 - DNA, 31 bp, Artificial Sequence
  Description of Artificial Sequence: Synthetic oligonucleotide
aggccttgatgggatcttctagggagacaac

SEQ ID NO: 157307 - DNA, 30 bp, Artificial Sequence
  Description of Artificial Sequence: Synthetic oligonucleotide
ggccttgatgggatcttctagggagacaac

SEQ ID NO: 157308 - DNA, 31 bp, Artificial Sequence
  Description of Artificial Sequence: Synthetic oligonucleotide
gccttgatgggatcttctagggagacaacag

SEQ ID NO: 157309 - DNA, 31 bp, Artificial Sequence
  Description of Artificial Sequence: Synthetic oligonucleotide
ccttgatgggatcttctagggagacaacagc

SEQ ID NO: 157310 - DNA, 31 bp, Artificial Sequence
  Description of Artificial Sequence: Synthetic oligonucleotide
cttgatgggatcttctagggagacaacagcc

SEQ ID NO: 157311 - DNA, 31 bp, Artificial Sequence
  Description of Artificial Sequence: Synthetic oligonucleotide
ttgatgggatcttctagggagacaacagccc

SEQ ID NO: 157312 - DNA, 30 bp, Artificial Sequence
  Description of Artificial Sequence: Synthetic oligonucleotide
tgatgggatcttctagggagacaacagccc

SEQ ID NO: 157313 - DNA, 29 bp, Artificial Sequence
  Description of Artificial Sequence: Synthetic oligonucleotide
gatgggatcttctagggagacaacagccc

SEQ ID NO: 157314 - DNA, 30 bp, Artificial Sequence
  Description of Artificial Sequence: Synthetic oligonucleotide
atgggatcttctagggagacaacagccctg

SEQ ID NO: 157315 - DNA, 29 bp, Artificial Sequence
  Description of Artificial Sequence: Synthetic oligonucleotide
tgggatcttctagggagacaacagccctg

SEQ ID NO: 157316 - DNA, 28 bp, Artificial Sequence
  Description of Artificial Sequence: Synthetic oligonucleotide
gggatcttctagggagacaacagccctg

SEQ ID NO: 157317 - DNA, 29 bp, Artificial Sequence
  Description of Artificial Sequence: Synthetic oligonucleotide
ggatcttctagggagacaacagccctgtc

SEQ ID NO: 157318 - DNA, 30 bp, Artificial Sequence
  Description of Artificial Sequence: Synthetic oligonucleotide
gatcttctagggagacaacagccctgtctc

SEQ ID NO: 157319 - DNA, 33 bp, Artificial Sequence
  Description of Artificial Sequence: Synthetic oligonucleotide
atcttctagggagacaacagccctgtctcaaac

SEQ ID NO: 157320 - DNA, 32 bp, Artificial Sequence
  Description of Artificial Sequence: Synthetic oligonucleotide
tcttctagggagacaacagccctgtctcaaac

SEQ ID NO: 157321 - DNA, 31 bp, Artificial Sequence
  Description of Artificial Sequence: Synthetic oligonucleotide
cttctagggagacaacagccctgtctcaaac

SEQ ID NO: 157322 - DNA, 31 bp, Artificial Sequence
  Description of Artificial Sequence: Synthetic oligonucleotide
ttctagggagacaacagccctgtctcaaacc

SEQ ID NO: 157323 - DNA, 30 bp, Artificial Sequence
  Description of Artificial Sequence: Synthetic oligonucleotide
tctagggagacaacagccctgtctcaaacc

SEQ ID NO: 157324 - DNA, 29 bp, Artificial Sequence
  Description of Artificial Sequence: Synthetic oligonucleotide
ctagggagacaacagccctgtctcaaacc

SEQ ID NO: 157325 - DNA, 29 bp, Artificial Sequence
  Description of Artificial Sequence: Synthetic oligonucleotide
tagggagacaacagccctgtctcaaaccc

SEQ ID NO: 157326 - DNA, 28 bp, Artificial Sequence
  Description of Artificial Sequence: Synthetic oligonucleotide
agggagacaacagccctgtctcaaaccc

SEQ ID NO: 157327 - DNA, 27 bp, Artificial Sequence
  Description of Artificial Sequence: Synthetic oligonucleotide
gggagacaacagccctgtctcaaaccc

SEQ ID NO: 157328 - DNA, 28 bp, Artificial Sequence
  Description of Artificial Sequence: Synthetic oligonucleotide
ggagacaacagccctgtctcaaacccag

SEQ ID NO: 157329 - DNA, 28 bp, Artificial Sequence
  Description of Artificial Sequence: Synthetic oligonucleotide
gagacaacagccctgtctcaaacccagc

SEQ ID NO: 157330 - DNA, 30 bp, Artificial Sequence
  Description of Artificial Sequence: Synthetic oligonucleotide
agacaacagccctgtctcaaacccagcttg

SEQ ID NO: 157331 - DNA, 29 bp, Artificial Sequence
  Description of Artificial Sequence: Synthetic oligonucleotide
gacaacagccctgtctcaaacccagcttg

SEQ ID NO: 157332 - DNA, 29 bp, Artificial Sequence
  Description of Artificial Sequence: Synthetic oligonucleotide
acaacagccctgtctcaaacccagcttgc

SEQ ID NO: 157333 - DNA, 28 bp, Artificial Sequence
  Description of Artificial Sequence: Synthetic oligonucleotide
caacagccctgtctcaaacccagcttgc

SEQ ID NO: 157334 - DNA, 28 bp, Artificial Sequence
  Description of Artificial Sequence: Synthetic oligonucleotide
aacagccctgtctcaaacccagcttgcc

SEQ ID NO: 157335 - DNA, 27 bp, Artificial Sequence
  Description of Artificial Sequence: Synthetic oligonucleotide
acagccctgtctcaaacccagcttgcc

SEQ ID NO: 157336 - DNA, 27 bp, Artificial Sequence
  Description of Artificial Sequence: Synthetic oligonucleotide
cagccctgtctcaaacccagcttgcca

SEQ ID NO: 157337 - DNA, 27 bp, Artificial Sequence
  Description of Artificial Sequence: Synthetic oligonucleotide
agccctgtctcaaacccagcttgccag

SEQ ID NO: 157338 - DNA, 26 bp, Artificial Sequence
  Description of Artificial Sequence: Synthetic oligonucleotide
gccctgtctcaaacccagcttgccag

SEQ ID NO: 157339 - DNA, 27 bp, Artificial Sequence
  Description of Artificial Sequence: Synthetic oligonucleotide
ccctgtctcaaacccagcttgccagct

SEQ ID NO: 157340 - DNA, 27 bp, Artificial Sequence
  Description of Artificial Sequence: Synthetic oligonucleotide
cctgtctcaaacccagcttgccagctc

SEQ ID NO: 157341 - DNA, 31 bp, Artificial Sequence
  Description of Artificial Sequence: Synthetic oligonucleotide
ctgtctcaaacccagcttgccagctctaatg

SEQ ID NO: 157342 - DNA, 33 bp, Artificial Sequence
  Description of Artificial Sequence: Synthetic oligonucleotide
tgtctcaaacccagcttgccagctctaatgtac

SEQ ID NO: 157343 - DNA, 32 bp, Artificial Sequence
  Description of Artificial Sequence: Synthetic oligonucleotide
gtctcaaacccagcttgccagctctaatgtac

SEQ ID NO: 157344 - DNA, 32 bp, Artificial Sequence
  Description of Artificial Sequence: Synthetic oligonucleotide
tctcaaacccagcttgccagctctaatgtacc

SEQ ID NO: 157345 - DNA, 31 bp, Artificial Sequence
  Description of Artificial Sequence: Synthetic oligonucleotide
ctcaaacccagcttgccagctctaatgtacc

SEQ ID NO: 157346 - DNA, 32 bp, Artificial Sequence
  Description of Artificial Sequence: Synthetic oligonucleotide
tcaaacccagcttgccagctctaatgtaccag

SEQ ID NO: 157347 - DNA, 31 bp, Artificial Sequence
  Description of Artificial Sequence: Synthetic oligonucleotide
caaacccagcttgccagctctaatgtaccag

SEQ ID NO: 157348 - DNA, 31 bp, Artificial Sequence
  Description of Artificial Sequence: Synthetic oligonucleotide
aaacccagcttgccagctctaatgtaccagc

SEQ ID NO: 157349 - DNA, 30 bp, Artificial Sequence
  Description of Artificial Sequence: Synthetic oligonucleotide
aacccagcttgccagctctaatgtaccagc

SEQ ID NO: 157350 - DNA, 29 bp, Artificial Sequence
  Description of Artificial Sequence: Synthetic oligonucleotide
acccagcttgccagctctaatgtaccagc

SEQ ID NO: 157351 - DNA, 28 bp, Artificial Sequence
  Description of Artificial Sequence: Synthetic oligonucleotide
cccagcttgccagctctaatgtaccagc

SEQ ID NO: 157352 - DNA, 29 bp, Artificial Sequence
  Description of Artificial Sequence: Synthetic oligonucleotide
ccagcttgccagctctaatgtaccagcag

SEQ ID NO: 157353 - DNA, 29 bp, Artificial Sequence
  Description of Artificial Sequence: Synthetic oligonucleotide
cagcttgccagctctaatgtaccagcagc

SEQ ID NO: 157354 - DNA, 30 bp, Artificial Sequence
  Description of Artificial Sequence: Synthetic oligonucleotide
agcttgccagctctaatgtaccagcagctg

SEQ ID NO: 157355 - DNA, 29 bp, Artificial Sequence
  Description of Artificial Sequence: Synthetic oligonucleotide
gcttgccagctctaatgtaccagcagctg

SEQ ID NO: 157356 - DNA, 29 bp, Artificial Sequence
  Description of Artificial Sequence: Synthetic oligonucleotide
cttgccagctctaatgtaccagcagctgg

SEQ ID NO: 157357 - DNA, 32 bp, Artificial Sequence
  Description of Artificial Sequence: Synthetic oligonucleotide
ttgccagctctaatgtaccagcagctggaatc

SEQ ID NO: 157358 - DNA, 31 bp, Artificial Sequence
  Description of Artificial Sequence: Synthetic oligonucleotide
tgccagctctaatgtaccagcagctggaatc

SEQ ID NO: 157359 - DNA, 30 bp, Artificial Sequence
  Description of Artificial Sequence: Synthetic oligonucleotide
gccagctctaatgtaccagcagctggaatc

SEQ ID NO: 157360 - DNA, 31 bp, Artificial Sequence
  Description of Artificial Sequence: Synthetic oligonucleotide
ccagctctaatgtaccagcagctggaatctg

SEQ ID NO: 157361 - DNA, 33 bp, Artificial Sequence
  Description of Artificial Sequence: Synthetic oligonucleotide
agctcctttgacatctaccatctatccagggag

SEQ ID NO: 157362 - DNA, 32 bp, Artificial Sequence
  Description of Artificial Sequence: Synthetic oligonucleotide
gctcctttgacatctaccatctatccagggag

SEQ ID NO: 157363 - DNA, 32 bp, Artificial Sequence
  Description of Artificial Sequence: Synthetic oligonucleotide
ctcctttgacatctaccatctatccagggagg

SEQ ID NO: 157364 - DNA, 32 bp, Artificial Sequence
  Description of Artificial Sequence: Synthetic oligonucleotide
tcctttgacatctaccatctatccagggaggg

SEQ ID NO: 157365 - DNA, 31 bp, Artificial Sequence
  Description of Artificial Sequence: Synthetic oligonucleotide
cctttgacatctaccatctatccagggaggg

SEQ ID NO: 157366 - DNA, 31 bp, Artificial Sequence
  Description of Artificial Sequence: Synthetic oligonucleotide
ctttgacatctaccatctatccagggagggg

SEQ ID NO: 157367 - DNA, 31 bp, Artificial Sequence
  Description of Artificial Sequence: Synthetic oligonucleotide
tttgacatctaccatctatccagggaggggg

SEQ ID NO: 157368 - DNA, 30 bp, Artificial Sequence
  Description of Artificial Sequence: Synthetic oligonucleotide
ttgacatctaccatctatccagggaggggg

SEQ ID NO: 157369 - DNA, 29 bp, Artificial Sequence
  Description of Artificial Sequence: Synthetic oligonucleotide
tgacatctaccatctatccagggaggggg

SEQ ID NO: 157370 - DNA, 28 bp, Artificial Sequence
  Description of Artificial Sequence: Synthetic oligonucleotide
gacatctaccatctatccagggaggggg

SEQ ID NO: 157371 - DNA, 30 bp, Artificial Sequence
  Description of Artificial Sequence: Synthetic oligonucleotide
acatctaccatctatccagggagggggaag

SEQ ID NO: 157372 - DNA, 29 bp, Artificial Sequence
  Description of Artificial Sequence: Synthetic oligonucleotide
catctaccatctatccagggagggggaag

SEQ ID NO: 157373 - DNA, 29 bp, Artificial Sequence
  Description of Artificial Sequence: Synthetic oligonucleotide
atctaccatctatccagggagggggaagc

SEQ ID NO: 157374 - DNA, 28 bp, Artificial Sequence
  Description of Artificial Sequence: Synthetic oligonucleotide
tctaccatctatccagggagggggaagc

SEQ ID NO: 157375 - DNA, 27 bp, Artificial Sequence
  Description of Artificial Sequence: Synthetic oligonucleotide
ctaccatctatccagggagggggaagc

SEQ ID NO: 157376 - DNA, 27 bp, Artificial Sequence
  Description of Artificial Sequence: Synthetic oligonucleotide
taccatctatccagggagggggaagcc

SEQ ID NO: 157377 - DNA, 26 bp, Artificial Sequence
  Description of Artificial Sequence: Synthetic oligonucleotide
accatctatccagggagggggaagcc

SEQ ID NO: 157378 - DNA, 25 bp, Artificial Sequence
  Description of Artificial Sequence: Synthetic oligonucleotide
ccatctatccagggagggggaagcc

SEQ ID NO: 157379 - DNA, 27 bp, Artificial Sequence
  Description of Artificial Sequence: Synthetic oligonucleotide
catctatccagggagggggaagcccat

SEQ ID NO: 157380 - DNA, 27 bp, Artificial Sequence
  Description of Artificial Sequence: Synthetic oligonucleotide
atctatccagggagggggaagcccatg

SEQ ID NO: 157381 - DNA, 27 bp, Artificial Sequence
  Description of Artificial Sequence: Synthetic oligonucleotide
tctatccagggagggggaagcccatga

SEQ ID NO: 157382 - DNA, 27 bp, Artificial Sequence
  Description of Artificial Sequence: Synthetic oligonucleotide
ctatccagggagggggaagcccatgaa

SEQ ID NO: 157383 - DNA, 27 bp, Artificial Sequence
  Description of Artificial Sequence: Synthetic oligonucleotide
tatccagggagggggaagcccatgaac

SEQ ID NO: 157384 - DNA, 27 bp, Artificial Sequence
  Description of Artificial Sequence: Synthetic oligonucleotide
atccagggagggggaagcccatgaact

SEQ ID NO: 157385 - DNA, 27 bp, Artificial Sequence
  Description of Artificial Sequence: Synthetic oligonucleotide
tccagggagggggaagcccatgaactt

SEQ ID NO: 157386 - DNA, 27 bp, Artificial Sequence
  Description of Artificial Sequence: Synthetic oligonucleotide
ccagggagggggaagcccatgaactta

SEQ ID NO: 157387 - DNA, 27 bp, Artificial Sequence
  Description of Artificial Sequence: Synthetic oligonucleotide
cagggagggggaagcccatgaacttag

SEQ ID NO: 157388 - DNA, 27 bp, Artificial Sequence
  Description of Artificial Sequence: Synthetic oligonucleotide
agggagggggaagcccatgaacttagg

SEQ ID NO: 157389 - DNA, 26 bp, Artificial Sequence
  Description of Artificial Sequence: Synthetic oligonucleotide
gggagggggaagcccatgaacttagg

SEQ ID NO: 157390 - DNA, 27 bp, Artificial Sequence
  Description of Artificial Sequence: Synthetic oligonucleotide
ggagggggaagcccatgaacttaggct

SEQ ID NO: 157391 - DNA, 27 bp, Artificial Sequence
  Description of Artificial Sequence: Synthetic oligonucleotide
gagggggaagcccatgaacttaggctc

SEQ ID NO: 157392 - DNA, 27 bp, Artificial Sequence
  Description of Artificial Sequence: Synthetic oligonucleotide
agggggaagcccatgaacttaggctcc

SEQ ID NO: 157393 - DNA, 26 bp, Artificial Sequence
  Description of Artificial Sequence: Synthetic oligonucleotide
gggggaagcccatgaacttaggctcc

SEQ ID NO: 157394 - DNA, 30 bp, Artificial Sequence
  Description of Artificial Sequence: Synthetic oligonucleotide
ttcggctctttccatggatctccctacgag

SEQ ID NO: 157395 - DNA, 29 bp, Artificial Sequence
  Description of Artificial Sequence: Synthetic oligonucleotide
tcggctctttccatggatctccctacgag

SEQ ID NO: 157396 - DNA, 28 bp, Artificial Sequence
  Description of Artificial Sequence: Synthetic oligonucleotide
cggctctttccatggatctccctacgag

SEQ ID NO: 157397 - DNA, 29 bp, Artificial Sequence
  Description of Artificial Sequence: Synthetic oligonucleotide
ggctctttccatggatctccctacgagtg

SEQ ID NO: 157398 - DNA, 29 bp, Artificial Sequence
  Description of Artificial Sequence: Synthetic oligonucleotide
gctctttccatggatctccctacgagtgg

SEQ ID NO: 157399 - DNA, 30 bp, Artificial Sequence
  Description of Artificial Sequence: Synthetic oligonucleotide
ctctttccatggatctccctacgagtggtc

SEQ ID NO: 157400 - DNA, 31 bp, Artificial Sequence
  Description of Artificial Sequence: Synthetic oligonucleotide
tctttccatggatctccctacgagtggtcag

SEQ ID NO: 157401 - DNA, 30 bp, Artificial Sequence
  Description of Artificial Sequence: Synthetic oligonucleotide
ctttccatggatctccctacgagtggtcag

SEQ ID NO: 157402 - DNA, 31 bp, Artificial Sequence
  Description of Artificial Sequence: Synthetic oligonucleotide
tttccatggatctccctacgagtggtcagac

SEQ ID NO: 157403 - DNA, 30 bp, Artificial Sequence
  Description of Artificial Sequence: Synthetic oligonucleotide
ttccatggatctccctacgagtggtcagac

SEQ ID NO: 157404 - DNA, 29 bp, Artificial Sequence
  Description of Artificial Sequence: Synthetic oligonucleotide
tccatggatctccctacgagtggtcagac

SEQ ID NO: 157405 - DNA, 28 bp, Artificial Sequence
  Description of Artificial Sequence: Synthetic oligonucleotide
ccatggatctccctacgagtggtcagac

SEQ ID NO: 157406 - DNA, 28 bp, Artificial Sequence
  Description of Artificial Sequence: Synthetic oligonucleotide
catggatctccctacgagtggtcagacg

SEQ ID NO: 157407 - DNA, 28 bp, Artificial Sequence
  Description of Artificial Sequence: Synthetic oligonucleotide
atggatctccctacgagtggtcagacgc

SEQ ID NO: 157408 - DNA, 27 bp, Artificial Sequence
  Description of Artificial Sequence: Synthetic oligonucleotide
tggatctccctacgagtggtcagacgc

SEQ ID NO: 157409 - DNA, 26 bp, Artificial Sequence
  Description of Artificial Sequence: Synthetic oligonucleotide
ggatctccctacgagtggtcagacgc

SEQ ID NO: 157410 - DNA, 27 bp, Artificial Sequence
  Description of Artificial Sequence: Synthetic oligonucleotide
gatctccctacgagtggtcagacgcga

SEQ ID NO: 157411 - DNA, 27 bp, Artificial Sequence
  Description of Artificial Sequence: Synthetic oligonucleotide
atctccctacgagtggtcagacgcgag

SEQ ID NO: 157412 - DNA, 27 bp, Artificial Sequence
  Description of Artificial Sequence: Synthetic oligonucleotide
tctccctacgagtggtcagacgcgagt

SEQ ID NO: 157413 - DNA, 26 bp, Artificial Sequence
  Description of Artificial Sequence: Synthetic oligonucleotide
ctccctacgagtggtcagacgcgagt

SEQ ID NO: 157414 - DNA, 27 bp, Artificial Sequence
  Description of Artificial Sequence: Synthetic oligonucleotide
tccctacgagtggtcagacgcgagtga

SEQ ID NO: 157415 - DNA, 26 bp, Artificial Sequence
  Description of Artificial Sequence: Synthetic oligonucleotide
ccctacgagtggtcagacgcgagtga

SEQ ID NO: 157416 - DNA, 26 bp, Artificial Sequence
  Description of Artificial Sequence: Synthetic oligonucleotide
cctacgagtggtcagacgcgagtgac

SEQ ID NO: 157417 - DNA, 26 bp, Artificial Sequence
  Description of Artificial Sequence: Synthetic oligonucleotide
ctacgagtggtcagacgcgagtgacc

SEQ ID NO: 157418 - DNA, 27 bp, Artificial Sequence
  Description of Artificial Sequence: Synthetic oligonucleotide
tacgagtggtcagacgcgagtgaccca

SEQ ID NO: 157419 - DNA, 26 bp, Artificial Sequence
  Description of Artificial Sequence: Synthetic oligonucleotide
acgagtggtcagacgcgagtgaccca

SEQ ID NO: 157420 - DNA, 25 bp, Artificial Sequence
  Description of Artificial Sequence: Synthetic oligonucleotide
cgagtggtcagacgcgagtgaccca

SEQ ID NO: 157421 - DNA, 26 bp, Artificial Sequence
  Description of Artificial Sequence: Synthetic oligonucleotide
gagtggtcagacgcgagtgacccact

SEQ ID NO: 157422 - DNA, 26 bp, Artificial Sequence
  Description of Artificial Sequence: Synthetic oligonucleotide
agtggtcagacgcgagtgacccactg

SEQ ID NO: 157423 - DNA, 25 bp, Artificial Sequence
  Description of Artificial Sequence: Synthetic oligonucleotide
gtggtcagacgcgagtgacccactg

SEQ ID NO: 157424 - DNA, 34 bp, Artificial Sequence
  Description of Artificial Sequence: Synthetic oligonucleotide
tgtgattaggtactcagtggccatcatcctcttc

SEQ ID NO: 157425 - DNA, 33 bp, Artificial Sequence
  Description of Artificial Sequence: Synthetic oligonucleotide
gtgattaggtactcagtggccatcatcctcttc

SEQ ID NO: 157426 - DNA, 34 bp, Artificial Sequence
  Description of Artificial Sequence: Synthetic oligonucleotide
tgattaggtactcagtggccatcatcctcttcac

SEQ ID NO: 157427 - DNA, 33 bp, Artificial Sequence
  Description of Artificial Sequence: Synthetic oligonucleotide
gattaggtactcagtggccatcatcctcttcac

SEQ ID NO: 157428 - DNA, 33 bp, Artificial Sequence
  Description of Artificial Sequence: Synthetic oligonucleotide
attaggtactcagtggccatcatcctcttcacc

SEQ ID NO: 157429 - DNA, 32 bp, Artificial Sequence
  Description of Artificial Sequence: Synthetic oligonucleotide
ttaggtactcagtggccatcatcctcttcacc

SEQ ID NO: 157430 - DNA, 31 bp, Artificial Sequence
  Description of Artificial Sequence: Synthetic oligonucleotide
taggtactcagtggccatcatcctcttcacc

SEQ ID NO: 157431 - DNA, 30 bp, Artificial Sequence
  Description of Artificial Sequence: Synthetic oligonucleotide
aggtactcagtggccatcatcctcttcacc

SEQ ID NO: 157432 - DNA, 29 bp, Artificial Sequence
  Description of Artificial Sequence: Synthetic oligonucleotide
ggtactcagtggccatcatcctcttcacc

SEQ ID NO: 157433 - DNA, 31 bp, Artificial Sequence
  Description of Artificial Sequence: Synthetic oligonucleotide
gtactcagtggccatcatcctcttcaccatc

SEQ ID NO: 157434 - DNA, 31 bp, Artificial Sequence
  Description of Artificial Sequence: Synthetic oligonucleotide
tactcagtggccatcatcctcttcaccatcc

SEQ ID NO: 157435 - DNA, 30 bp, Artificial Sequence
  Description of Artificial Sequence: Synthetic oligonucleotide
actcagtggccatcatcctcttcaccatcc

SEQ ID NO: 157436 - DNA, 29 bp, Artificial Sequence
  Description of Artificial Sequence: Synthetic oligonucleotide
ctcagtggccatcatcctcttcaccatcc

SEQ ID NO: 157437 - DNA, 31 bp, Artificial Sequence
  Description of Artificial Sequence: Synthetic oligonucleotide
tcagtggccatcatcctcttcaccatccttc

SEQ ID NO: 157438 - DNA, 30 bp, Artificial Sequence
  Description of Artificial Sequence: Synthetic oligonucleotide
cagtggccatcatcctcttcaccatccttc

SEQ ID NO: 157439 - DNA, 30 bp, Artificial Sequence
  Description of Artificial Sequence: Synthetic oligonucleotide
agtggccatcatcctcttcaccatccttcc

SEQ ID NO: 157440 - DNA, 29 bp, Artificial Sequence
  Description of Artificial Sequence: Synthetic oligonucleotide
gtggccatcatcctcttcaccatccttcc

SEQ ID NO: 157441 - DNA, 29 bp, Artificial Sequence
  Description of Artificial Sequence: Synthetic oligonucleotide
tggccatcatcctcttcaccatccttccc

SEQ ID NO: 157442 - DNA, 28 bp, Artificial Sequence
  Description of Artificial Sequence: Synthetic oligonucleotide
ggccatcatcctcttcaccatccttccc

SEQ ID NO: 157443 - DNA, 30 bp, Artificial Sequence
  Description of Artificial Sequence: Synthetic oligonucleotide
gccatcatcctcttcaccatccttcccttc

SEQ ID NO: 157444 - DNA, 33 bp, Artificial Sequence
  Description of Artificial Sequence: Synthetic oligonucleotide
ccatcatcctcttcaccatccttcccttctttc

SEQ ID NO: 157445 - DNA, 34 bp, Artificial Sequence
  Description of Artificial Sequence: Synthetic oligonucleotide
catcatcctcttcaccatccttcccttctttctc

SEQ ID NO: 157446 - DNA, 34 bp, Artificial Sequence
  Description of Artificial Sequence: Synthetic oligonucleotide
atcatcctcttcaccatccttcccttctttctcc

SEQ ID NO: 157447 - DNA, 33 bp, Artificial Sequence
  Description of Artificial Sequence: Synthetic oligonucleotide
tcatcctcttcaccatccttcccttctttctcc

SEQ ID NO: 157448 - DNA, 32 bp, Artificial Sequence
  Description of Artificial Sequence: Synthetic oligonucleotide
catcctcttcaccatccttcccttctttctcc

SEQ ID NO: 157449 - DNA, 34 bp, Artificial Sequence
  Description of Artificial Sequence: Synthetic oligonucleotide
atcctcttcaccatccttcccttctttctccttc

SEQ ID NO: 157450 - DNA, 33 bp, Artificial Sequence
  Description of Artificial Sequence: Synthetic oligonucleotide
tcctcttcaccatccttcccttctttctccttc

SEQ ID NO: 157451 - DNA, 32 bp, Artificial Sequence
  Description of Artificial Sequence: Synthetic oligonucleotide
cctcttcaccatccttcccttctttctccttc

SEQ ID NO: 157452 - DNA, 34 bp, Artificial Sequence
  Description of Artificial Sequence: Synthetic oligonucleotide
ctcttcaccatccttcccttctttctccttcatc

SEQ ID NO: 157453 - DNA, 34 bp, Artificial Sequence
  Description of Artificial Sequence: Synthetic oligonucleotide
tcttcaccatccttcccttctttctccttcatcg

SEQ ID NO: 157454 - DNA, 33 bp, Artificial Sequence
  Description of Artificial Sequence: Synthetic oligonucleotide
cttcaccatccttcccttctttctccttcatcg

SEQ ID NO: 157455 - DNA, 33 bp, Artificial Sequence
  Description of Artificial Sequence: Synthetic oligonucleotide
ttcaccatccttcccttctttctccttcatcgc

SEQ ID NO: 157456 - DNA, 32 bp, Artificial Sequence
  Description of Artificial Sequence: Synthetic oligonucleotide
tcaccatccttcccttctttctccttcatcgc

SEQ ID NO: 157457 - DNA, 31 bp, Artificial Sequence
  Description of Artificial Sequence: Synthetic oligonucleotide
caccatccttcccttctttctccttcatcgc

SEQ ID NO: 157458 - DNA, 36 bp, Artificial Sequence
  Description of Artificial Sequence: Synthetic oligonucleotide
tatagaacttccaaatgctgagcccagagcgttatc

SEQ ID NO: 157459 - DNA, 35 bp, Artificial Sequence
  Description of Artificial Sequence: Synthetic oligonucleotide
atagaacttccaaatgctgagcccagagcgttatc

SEQ ID NO: 157460 - DNA, 34 bp, Artificial Sequence
  Description of Artificial Sequence: Synthetic oligonucleotide
tagaacttccaaatgctgagcccagagcgttatc

SEQ ID NO: 157461 - DNA, 33 bp, Artificial Sequence
  Description of Artificial Sequence: Synthetic oligonucleotide
agaacttccaaatgctgagcccagagcgttatc

SEQ ID NO: 157462 - DNA, 32 bp, Artificial Sequence
  Description of Artificial Sequence: Synthetic oligonucleotide
gaacttccaaatgctgagcccagagcgttatc

SEQ ID NO: 157463 - DNA, 33 bp, Artificial Sequence
  Description of Artificial Sequence: Synthetic oligonucleotide
aacttccaaatgctgagcccagagcgttatctc

SEQ ID NO: 157464 - DNA, 32 bp, Artificial Sequence
  Description of Artificial Sequence: Synthetic oligonucleotide
acttccaaatgctgagcccagagcgttatctc

SEQ ID NO: 157465 - DNA, 31 bp, Artificial Sequence
  Description of Artificial Sequence: Synthetic oligonucleotide
cttccaaatgctgagcccagagcgttatctc

SEQ ID NO: 157466 - DNA, 31 bp, Artificial Sequence
  Description of Artificial Sequence: Synthetic oligonucleotide
ttccaaatgctgagcccagagcgttatctcc

SEQ ID NO: 157467 - DNA, 30 bp, Artificial Sequence
  Description of Artificial Sequence: Synthetic oligonucleotide
tccaaatgctgagcccagagcgttatctcc

SEQ ID NO: 157468 - DNA, 29 bp, Artificial Sequence
  Description of Artificial Sequence: Synthetic oligonucleotide
ccaaatgctgagcccagagcgttatctcc

SEQ ID NO: 157469 - DNA, 30 bp, Artificial Sequence
  Description of Artificial Sequence: Synthetic oligonucleotide
caaatgctgagcccagagcgttatctcctg

SEQ ID NO: 157470 - DNA, 30 bp, Artificial Sequence
  Description of Artificial Sequence: Synthetic oligonucleotide
aaatgctgagcccagagcgttatctcctgc

SEQ ID NO: 157471 - DNA, 29 bp, Artificial Sequence
  Description of Artificial Sequence: Synthetic oligonucleotide
aatgctgagcccagagcgttatctcctgc

SEQ ID NO: 157472 - DNA, 28 bp, Artificial Sequence
  Description of Artificial Sequence: Synthetic oligonucleotide
atgctgagcccagagcgttatctcctgc

SEQ ID NO: 157473 - DNA, 27 bp, Artificial Sequence
  Description of Artificial Sequence: Synthetic oligonucleotide
tgctgagcccagagcgttatctcctgc

SEQ ID NO: 157474 - DNA, 26 bp, Artificial Sequence
  Description of Artificial Sequence: Synthetic oligonucleotide
gctgagcccagagcgttatctcctgc

SEQ ID NO: 157475 - DNA, 26 bp, Artificial Sequence
  Description of Artificial Sequence: Synthetic oligonucleotide
ctgagcccagagcgttatctcctgcc

SEQ ID NO: 157476 - DNA, 27 bp, Artificial Sequence
  Description of Artificial Sequence: Synthetic oligonucleotide
tgagcccagagcgttatctcctgccca

SEQ ID NO: 157477 - DNA, 27 bp, Artificial Sequence
  Description of Artificial Sequence: Synthetic oligonucleotide
gagcccagagcgttatctcctgcccat

SEQ ID NO: 157478 - DNA, 27 bp, Artificial Sequence
  Description of Artificial Sequence: Synthetic oligonucleotide
agcccagagcgttatctcctgcccatg

SEQ ID NO: 157479 - DNA, 27 bp, Artificial Sequence
  Description of Artificial Sequence: Synthetic oligonucleotide
gcccagagcgttatctcctgcccatga

SEQ ID NO: 157480 - DNA, 27 bp, Artificial Sequence
  Description of Artificial Sequence: Synthetic oligonucleotide
cccagagcgttatctcctgcccatgag

SEQ ID NO: 157481 - DNA, 27 bp, Artificial Sequence
  Description of Artificial Sequence: Synthetic oligonucleotide
ccagagcgttatctcctgcccatgagc

SEQ ID NO: 157482 - DNA, 28 bp, Artificial Sequence
  Description of Artificial Sequence: Synthetic oligonucleotide
cagagcgttatctcctgcccatgagcac

SEQ ID NO: 157483 - DNA, 28 bp, Artificial Sequence
  Description of Artificial Sequence: Synthetic oligonucleotide
agagcgttatctcctgcccatgagcacc

SEQ ID NO: 157484 - DNA, 27 bp, Artificial Sequence
  Description of Artificial Sequence: Synthetic oligonucleotide
gagcgttatctcctgcccatgagcacc

SEQ ID NO: 157485 - DNA, 28 bp, Artificial Sequence
  Description of Artificial Sequence: Synthetic oligonucleotide
agcgttatctcctgcccatgagcaccac

SEQ ID NO: 157486 - DNA, 27 bp, Artificial Sequence
  Description of Artificial Sequence: Synthetic oligonucleotide
gcgttatctcctgcccatgagcaccac

SEQ ID NO: 157487 - DNA, 28 bp, Artificial Sequence
  Description of Artificial Sequence: Synthetic oligonucleotide
cgttatctcctgcccatgagcaccacag

SEQ ID NO: 157488 - DNA, 29 bp, Artificial Sequence
  Description of Artificial Sequence: Synthetic oligonucleotide
gttatctcctgcccatgagcaccacagtc

SEQ ID NO: 157489 - DNA, 30 bp, Artificial Sequence
  Description of Artificial Sequence: Synthetic oligonucleotide
ttatctcctgcccatgagcaccacagtcag

SEQ ID NO: 157490 - DNA, 29 bp, Artificial Sequence
  Description of Artificial Sequence: Synthetic oligonucleotide
tatctcctgcccatgagcaccacagtcag

SEQ ID NO: 157491 - DNA, 28 bp, Artificial Sequence
  Description of Artificial Sequence: Synthetic oligonucleotide
atctcctgcccatgagcaccacagtcag

SEQ ID NO: 157492 - DNA, 41 bp, Artificial Sequence
  Description of Artificial Sequence: Synthetic oligonucleotide
caaaaaaaaaaatgctgctgtaatgaaccaagagcctgcag

SEQ ID NO: 157493 - DNA, 41 bp, Artificial Sequence
  Description of Artificial Sequence: Synthetic oligonucleotide
aaaaaaaaaaatgctgctgtaatgaaccaagagcctgcagg

SEQ ID NO: 157494 - DNA, 40 bp, Artificial Sequence
  Description of Artificial Sequence: Synthetic oligonucleotide
aaaaaaaaaatgctgctgtaatgaaccaagagcctgcagg

SEQ ID NO: 157495 - DNA, 39 bp, Artificial Sequence
  Description of Artificial Sequence: Synthetic oligonucleotide
aaaaaaaaatgctgctgtaatgaaccaagagcctgcagg

SEQ ID NO: 157496 - DNA, 38 bp, Artificial Sequence
  Description of Artificial Sequence: Synthetic oligonucleotide
aaaaaaaatgctgctgtaatgaaccaagagcctgcagg

SEQ ID NO: 157497 - DNA, 37 bp, Artificial Sequence
  Description of Artificial Sequence: Synthetic oligonucleotide
aaaaaaatgctgctgtaatgaaccaagagcctgcagg

SEQ ID NO: 157498 - DNA, 36 bp, Artificial Sequence
  Description of Artificial Sequence: Synthetic oligonucleotide
aaaaaatgctgctgtaatgaaccaagagcctgcagg

SEQ ID NO: 157499 - DNA, 35 bp, Artificial Sequence
  Description of Artificial Sequence: Synthetic oligonucleotide
aaaaatgctgctgtaatgaaccaagagcctgcagg

SEQ ID NO: 157500 - DNA, 34 bp, Artificial Sequence
  Description of Artificial Sequence: Synthetic oligonucleotide
aaaatgctgctgtaatgaaccaagagcctgcagg

SEQ ID NO: 157501 - DNA, 33 bp, Artificial Sequence
  Description of Artificial Sequence: Synthetic oligonucleotide
aaatgctgctgtaatgaaccaagagcctgcagg

SEQ ID NO: 157502 - DNA, 32 bp, Artificial Sequence
  Description of Artificial Sequence: Synthetic oligonucleotide
aatgctgctgtaatgaaccaagagcctgcagg

SEQ ID NO: 157503 - DNA, 31 bp, Artificial Sequence
  Description of Artificial Sequence: Synthetic oligonucleotide
atgctgctgtaatgaaccaagagcctgcagg

SEQ ID NO: 157504 - DNA, 30 bp, Artificial Sequence
  Description of Artificial Sequence: Synthetic oligonucleotide
tgctgctgtaatgaaccaagagcctgcagg

SEQ ID NO: 157505 - DNA, 29 bp, Artificial Sequence
  Description of Artificial Sequence: Synthetic oligonucleotide
gctgctgtaatgaaccaagagcctgcagg

SEQ ID NO: 157506 - DNA, 30 bp, Artificial Sequence
  Description of Artificial Sequence: Synthetic oligonucleotide
ctgctgtaatgaaccaagagcctgcaggac

SEQ ID NO: 157507 - DNA, 31 bp, Artificial Sequence
  Description of Artificial Sequence: Synthetic oligonucleotide
tgctgtaatgaaccaagagcctgcaggacac

SEQ ID NO: 157508 - DNA, 30 bp, Artificial Sequence
  Description of Artificial Sequence: Synthetic oligonucleotide
gctgtaatgaaccaagagcctgcaggacac

SEQ ID NO: 157509 - DNA, 31 bp, Artificial Sequence
  Description of Artificial Sequence: Synthetic oligonucleotide
ctgtaatgaaccaagagcctgcaggacacag

SEQ ID NO: 157510 - DNA, 33 bp, Artificial Sequence
  Description of Artificial Sequence: Synthetic oligonucleotide
tgtaatgaaccaagagcctgcaggacacagaac

SEQ ID NO: 157511 - DNA, 32 bp, Artificial Sequence
  Description of Artificial Sequence: Synthetic oligonucleotide
gtaatgaaccaagagcctgcaggacacagaac

SEQ ID NO: 157512 - DNA, 33 bp, Artificial Sequence
  Description of Artificial Sequence: Synthetic oligonucleotide
taatgaaccaagagcctgcaggacacagaacag

SEQ ID NO: 157513 - DNA, 32 bp, Artificial Sequence
  Description of Artificial Sequence: Synthetic oligonucleotide
aatgaaccaagagcctgcaggacacagaacag

SEQ ID NO: 157514 - DNA, 31 bp, Artificial Sequence
  Description of Artificial Sequence: Synthetic oligonucleotide
atgaaccaagagcctgcaggacacagaacag

SEQ ID NO: 157515 - DNA, 30 bp, Artificial Sequence
  Description of Artificial Sequence: Synthetic oligonucleotide
tgaaccaagagcctgcaggacacagaacag

SEQ ID NO: 157516 - DNA, 29 bp, Artificial Sequence
  Description of Artificial Sequence: Synthetic oligonucleotide
gaaccaagagcctgcaggacacagaacag

SEQ ID NO: 157517 - DNA, 30 bp, Artificial Sequence
  Description of Artificial Sequence: Synthetic oligonucleotide
aaccaagagcctgcaggacacagaacagtg

SEQ ID NO: 157518 - DNA, 29 bp, Artificial Sequence
  Description of Artificial Sequence: Synthetic oligonucleotide
accaagagcctgcaggacacagaacagtg

SEQ ID NO: 157519 - DNA, 28 bp, Artificial Sequence
  Description of Artificial Sequence: Synthetic oligonucleotide
ccaagagcctgcaggacacagaacagtg

SEQ ID NO: 157520 - DNA, 30 bp, Artificial Sequence
  Description of Artificial Sequence: Synthetic oligonucleotide
caagagcctgcaggacacagaacagtgaac

SEQ ID NO: 157521 - DNA, 31 bp, Artificial Sequence
  Description of Artificial Sequence: Synthetic oligonucleotide
aagagcctgcaggacacagaacagtgaacag

SEQ ID NO: 157522 - DNA, 30 bp, Artificial Sequence
  Description of Artificial Sequence: Synthetic oligonucleotide
agagcctgcaggacacagaacagtgaacag

SEQ ID NO: 157523 - DNA, 29 bp, Artificial Sequence
  Description of Artificial Sequence: Synthetic oligonucleotide
gagcctgcaggacacagaacagtgaacag

SEQ ID NO: 157524 - DNA, 29 bp, Artificial Sequence
  Description of Artificial Sequence: Synthetic oligonucleotide
agcctgcaggacacagaacagtgaacagg

SEQ ID NO: 157525 - DNA, 28 bp, Artificial Sequence
  Description of Artificial Sequence: Synthetic oligonucleotide
gcctgcaggacacagaacagtgaacagg

SEQ ID NO: 157526 - DNA, 28 bp, Artificial Sequence
  Description of Artificial Sequence: Synthetic oligonucleotide
cctgcaggacacagaacagtgaacaggg

SEQ ID NO: 157527 - DNA, 29 bp, Artificial Sequence
  Description of Artificial Sequence: Synthetic oligonucleotide
ctgcaggacacagaacagtgaacagggag

SEQ ID NO: 157528 - DNA, 29 bp, Artificial Sequence
  Description of Artificial Sequence: Synthetic oligonucleotide
tgcaggacacagaacagtgaacagggagg

SEQ ID NO: 157529 - DNA, 28 bp, Artificial Sequence
  Description of Artificial Sequence: Synthetic oligonucleotide
gcaggacacagaacagtgaacagggagg

SEQ ID NO: 157530 - DNA, 29 bp, Artificial Sequence
  Description of Artificial Sequence: Synthetic oligonucleotide
caggacacagaacagtgaacagggaggac

SEQ ID NO: 157531 - DNA, 30 bp, Artificial Sequence
  Description of Artificial Sequence: Synthetic oligonucleotide
aggacacagaacagtgaacagggaggactc

SEQ ID NO: 157532 - DNA, 20 bp, Artificial Sequence
  Description of Artificial Sequence: Synthetic oligonucleotide
gccgggccccacggttcgct

SEQ ID NO: 157533 - DNA, 20 bp, Artificial Sequence
  Description of Artificial Sequence: Synthetic oligonucleotide
ccgggccccacggttcgcgt

SEQ ID NO: 157534 - DNA, 20 bp, Artificial Sequence
  Description of Artificial Sequence: Synthetic oligonucleotide
cgggccccacggttcgcgca

SEQ ID NO: 157535 - DNA, 20 bp, Artificial Sequence
  Description of Artificial Sequence: Synthetic oligonucleotide
gggccccacggttcgcgcag

SEQ ID NO: 157536 - DNA, 21 bp, Artificial Sequence
  Description of Artificial Sequence: Synthetic oligonucleotide
ggccccacggttcgcgcagga

SEQ ID NO: 157537 - DNA, 22 bp, Artificial Sequence
  Description of Artificial Sequence: Synthetic oligonucleotide
gccccacggttcgcgcaggaga

SEQ ID NO: 157538 - DNA, 24 bp, Artificial Sequence
  Description of Artificial Sequence: Synthetic oligonucleotide
ccccacggttcgcgcaggagagaa

SEQ ID NO: 157539 - DNA, 24 bp, Artificial Sequence
  Description of Artificial Sequence: Synthetic oligonucleotide
cccacggttcgcgcaggagagaac

SEQ ID NO: 157540 - DNA, 25 bp, Artificial Sequence
  Description of Artificial Sequence: Synthetic oligonucleotide
ccacggttcgcgcaggagagaacgt

SEQ ID NO: 157541 - DNA, 26 bp, Artificial Sequence
  Description of Artificial Sequence: Synthetic oligonucleotide
cacggttcgcgcaggagagaacgtga

SEQ ID NO: 157542 - DNA, 26 bp, Artificial Sequence
  Description of Artificial Sequence: Synthetic oligonucleotide
acggttcgcgcaggagagaacgtgac

SEQ ID NO: 157543 - DNA, 25 bp, Artificial Sequence
  Description of Artificial Sequence: Synthetic oligonucleotide
cggttcgcgcaggagagaacgtgac

SEQ ID NO: 157544 - DNA, 27 bp, Artificial Sequence
  Description of Artificial Sequence: Synthetic oligonucleotide
ggttcgcgcaggagagaacgtgacctt

SEQ ID NO: 157545 - DNA, 27 bp, Artificial Sequence
  Description of Artificial Sequence: Synthetic oligonucleotide
gttcgcgcaggagagaacgtgaccttg

SEQ ID NO: 157546 - DNA, 28 bp, Artificial Sequence
  Description of Artificial Sequence: Synthetic oligonucleotide
ttcgcgcaggagagaacgtgaccttgtc

SEQ ID NO: 157547 - DNA, 27 bp, Artificial Sequence
  Description of Artificial Sequence: Synthetic oligonucleotide
tcgcgcaggagagaacgtgaccttgtc

SEQ ID NO: 157548 - DNA, 26 bp, Artificial Sequence
  Description of Artificial Sequence: Synthetic oligonucleotide
cgcgcaggagagaacgtgaccttgtc

SEQ ID NO: 157549 - DNA, 27 bp, Artificial Sequence
  Description of Artificial Sequence: Synthetic oligonucleotide
gcgcaggagagaacgtgaccttgtcct

SEQ ID NO: 157550 - DNA, 27 bp, Artificial Sequence
  Description of Artificial Sequence: Synthetic oligonucleotide
cgcaggagagaacgtgaccttgtcctg

SEQ ID NO: 157551 - DNA, 27 bp, Artificial Sequence
  Description of Artificial Sequence: Synthetic oligonucleotide
gcaggagagaacgtgaccttgtcctgc

SEQ ID NO: 157552 - DNA, 28 bp, Artificial Sequence
  Description of Artificial Sequence: Synthetic oligonucleotide
catggatctccctacgagtggtcagacc

SEQ ID NO: 157553 - DNA, 28 bp, Artificial Sequence
  Description of Artificial Sequence: Synthetic oligonucleotide
atggatctccctacgagtggtcagaccc

SEQ ID NO: 157554 - DNA, 27 bp, Artificial Sequence
  Description of Artificial Sequence: Synthetic oligonucleotide
tggatctccctacgagtggtcagaccc

SEQ ID NO: 157555 - DNA, 26 bp, Artificial Sequence
  Description of Artificial Sequence: Synthetic oligonucleotide
ggatctccctacgagtggtcagaccc

SEQ ID NO: 157556 - DNA, 27 bp, Artificial Sequence
  Description of Artificial Sequence: Synthetic oligonucleotide
gatctccctacgagtggtcagacccga

SEQ ID NO: 157557 - DNA, 27 bp, Artificial Sequence
  Description of Artificial Sequence: Synthetic oligonucleotide
atctccctacgagtggtcagacccgag

SEQ ID NO: 157558 - DNA, 27 bp, Artificial Sequence
  Description of Artificial Sequence: Synthetic oligonucleotide
tctccctacgagtggtcagacccgagt

SEQ ID NO: 157559 - DNA, 26 bp, Artificial Sequence
  Description of Artificial Sequence: Synthetic oligonucleotide
ctccctacgagtggtcagacccgagt

SEQ ID NO: 157560 - DNA, 27 bp, Artificial Sequence
  Description of Artificial Sequence: Synthetic oligonucleotide
tccctacgagtggtcagacccgagtga

SEQ ID NO: 157561 - DNA, 26 bp, Artificial Sequence
  Description of Artificial Sequence: Synthetic oligonucleotide
ccctacgagtggtcagacccgagtga

SEQ ID NO: 157562 - DNA, 26 bp, Artificial Sequence
  Description of Artificial Sequence: Synthetic oligonucleotide
cctacgagtggtcagacccgagtgac

SEQ ID NO: 157563 - DNA, 26 bp, Artificial Sequence
  Description of Artificial Sequence: Synthetic oligonucleotide
ctacgagtggtcagacccgagtgacc

SEQ ID NO: 157564 - DNA, 27 bp, Artificial Sequence
  Description of Artificial Sequence: Synthetic oligonucleotide
tacgagtggtcagacccgagtgaccca

SEQ ID NO: 157565 - DNA, 26 bp, Artificial Sequence
  Description of Artificial Sequence: Synthetic oligonucleotide
acgagtggtcagacccgagtgaccca

SEQ ID NO: 157566 - DNA, 25 bp, Artificial Sequence
  Description of Artificial Sequence: Synthetic oligonucleotide
cgagtggtcagacccgagtgaccca

SEQ ID NO: 157567 - DNA, 26 bp, Artificial Sequence
  Description of Artificial Sequence: Synthetic oligonucleotide
gagtggtcagacccgagtgacccact

SEQ ID NO: 157568 - DNA, 26 bp, Artificial Sequence
  Description of Artificial Sequence: Synthetic oligonucleotide
agtggtcagacccgagtgacccactg

SEQ ID NO: 157569 - DNA, 25 bp, Artificial Sequence
  Description of Artificial Sequence: Synthetic oligonucleotide
gtggtcagacccgagtgacccactg

SEQ ID NO: 157570 - DNA, 25 bp, Artificial Sequence
  Description of Artificial Sequence: Synthetic oligonucleotide
tggtcagacccgagtgacccactgc

SEQ ID NO: 157571 - DNA, 24 bp, Artificial Sequence
  Description of Artificial Sequence: Synthetic oligonucleotide
ggtcagacccgagtgacccactgc

SEQ ID NO: 157572 - DNA, 25 bp, Artificial Sequence
  Description of Artificial Sequence: Synthetic oligonucleotide
gtcagacccgagtgacccactgcct

SEQ ID NO: 157573 - DNA, 27 bp, Artificial Sequence
  Description of Artificial Sequence: Synthetic oligonucleotide
tcagacccgagtgacccactgcctgtt

SEQ ID NO: 157574 - DNA, 27 bp, Artificial Sequence
  Description of Artificial Sequence: Synthetic oligonucleotide
cagacccgagtgacccactgcctgttt

SEQ ID NO: 157575 - DNA, 27 bp, Artificial Sequence
  Description of Artificial Sequence: Synthetic oligonucleotide
agacccgagtgacccactgcctgtttc

SEQ ID NO: 157576 - DNA, 27 bp, Artificial Sequence
  Description of Artificial Sequence: Synthetic oligonucleotide
gacccgagtgacccactgcctgtttct

SEQ ID NO: 157577 - DNA, 27 bp, Artificial Sequence
  Description of Artificial Sequence: Synthetic oligonucleotide
acccgagtgacccactgcctgtttctg

SEQ ID NO: 157578 - DNA, 27 bp, Artificial Sequence
  Description of Artificial Sequence: Synthetic oligonucleotide
cccgagtgacccactgcctgtttctgt

SEQ ID NO: 157579 - DNA, 27 bp, Artificial Sequence
  Description of Artificial Sequence: Synthetic oligonucleotide
ccgagtgacccactgcctgtttctgtc

SEQ ID NO: 157580 - DNA, 40 bp, Artificial Sequence
  Description of Artificial Sequence: Synthetic oligonucleotide
tacaacagaatattctggaacagtttcctcattagccctc

SEQ ID NO: 157581 - DNA, 39 bp, Artificial Sequence
  Description of Artificial Sequence: Synthetic oligonucleotide
acaacagaatattctggaacagtttcctcattagccctc

SEQ ID NO: 157582 - DNA, 38 bp, Artificial Sequence
  Description of Artificial Sequence: Synthetic oligonucleotide
caacagaatattctggaacagtttcctcattagccctc

SEQ ID NO: 157583 - DNA, 39 bp, Artificial Sequence
  Description of Artificial Sequence: Synthetic oligonucleotide
aacagaatattctggaacagtttcctcattagccctctg

SEQ ID NO: 157584 - DNA, 38 bp, Artificial Sequence
  Description of Artificial Sequence: Synthetic oligonucleotide
acagaatattctggaacagtttcctcattagccctctg

SEQ ID NO: 157585 - DNA, 37 bp, Artificial Sequence
  Description of Artificial Sequence: Synthetic oligonucleotide
cagaatattctggaacagtttcctcattagccctctg

SEQ ID NO: 157586 - DNA, 38 bp, Artificial Sequence
  Description of Artificial Sequence: Synthetic oligonucleotide
agaatattctggaacagtttcctcattagccctctgac

SEQ ID NO: 157587 - DNA, 37 bp, Artificial Sequence
  Description of Artificial Sequence: Synthetic oligonucleotide
gaatattctggaacagtttcctcattagccctctgac

SEQ ID NO: 157588 - DNA, 37 bp, Artificial Sequence
  Description of Artificial Sequence: Synthetic oligonucleotide
aatattctggaacagtttcctcattagccctctgacc

SEQ ID NO: 157589 - DNA, 36 bp, Artificial Sequence
  Description of Artificial Sequence: Synthetic oligonucleotide
atattctggaacagtttcctcattagccctctgacc

SEQ ID NO: 157590 - DNA, 35 bp, Artificial Sequence
  Description of Artificial Sequence: Synthetic oligonucleotide
tattctggaacagtttcctcattagccctctgacc

SEQ ID NO: 157591 - DNA, 34 bp, Artificial Sequence
  Description of Artificial Sequence: Synthetic oligonucleotide
attctggaacagtttcctcattagccctctgacc

SEQ ID NO: 157592 - DNA, 33 bp, Artificial Sequence
  Description of Artificial Sequence: Synthetic oligonucleotide
ttctggaacagtttcctcattagccctctgacc

SEQ ID NO: 157593 - DNA, 32 bp, Artificial Sequence
  Description of Artificial Sequence: Synthetic oligonucleotide
tctggaacagtttcctcattagccctctgacc

SEQ ID NO: 157594 - DNA, 31 bp, Artificial Sequence
  Description of Artificial Sequence: Synthetic oligonucleotide
ctggaacagtttcctcattagccctctgacc

SEQ ID NO: 157595 - DNA, 31 bp, Artificial Sequence
  Description of Artificial Sequence: Synthetic oligonucleotide
tggaacagtttcctcattagccctctgaccc

SEQ ID NO: 157596 - DNA, 30 bp, Artificial Sequence
  Description of Artificial Sequence: Synthetic oligonucleotide
ggaacagtttcctcattagccctctgaccc

SEQ ID NO: 157597 - DNA, 30 bp, Artificial Sequence
  Description of Artificial Sequence: Synthetic oligonucleotide
gaacagtttcctcattagccctctgacccc

SEQ ID NO: 157598 - DNA, 31 bp, Artificial Sequence
  Description of Artificial Sequence: Synthetic oligonucleotide
aacagtttcctcattagccctctgacccctg

SEQ ID NO: 157599 - DNA, 30 bp, Artificial Sequence
  Description of Artificial Sequence: Synthetic oligonucleotide
acagtttcctcattagccctctgacccctg

SEQ ID NO: 157600 - DNA, 29 bp, Artificial Sequence
  Description of Artificial Sequence: Synthetic oligonucleotide
cagtttcctcattagccctctgacccctg

SEQ ID NO: 157601 - DNA, 29 bp, Artificial Sequence
  Description of Artificial Sequence: Synthetic oligonucleotide
agtttcctcattagccctctgacccctgc

SEQ ID NO: 157602 - DNA, 28 bp, Artificial Sequence
  Description of Artificial Sequence: Synthetic oligonucleotide
gtttcctcattagccctctgacccctgc

SEQ ID NO: 157603 - DNA, 29 bp, Artificial Sequence
  Description of Artificial Sequence: Synthetic oligonucleotide
tttcctcattagccctctgacccctgcac

SEQ ID NO: 157604 - DNA, 28 bp, Artificial Sequence
  Description of Artificial Sequence: Synthetic oligonucleotide
ttcctcattagccctctgacccctgcac

SEQ ID NO: 157605 - DNA, 27 bp, Artificial Sequence
  Description of Artificial Sequence: Synthetic oligonucleotide
tcctcattagccctctgacccctgcac

SEQ ID NO: 157606 - DNA, 27 bp, Artificial Sequence
  Description of Artificial Sequence: Synthetic oligonucleotide
cctcattagccctctgacccctgcaca

SEQ ID NO: 157607 - DNA, 27 bp, Artificial Sequence
  Description of Artificial Sequence: Synthetic oligonucleotide
ctcattagccctctgacccctgcacac

SEQ ID NO: 157608 - DNA, 27 bp, Artificial Sequence
  Description of Artificial Sequence: Synthetic oligonucleotide
tcattagccctctgacccctgcacacg

SEQ ID NO: 157609 - DNA, 26 bp, Artificial Sequence
  Description of Artificial Sequence: Synthetic oligonucleotide
cattagccctctgacccctgcacacg

SEQ ID NO: 157610 - DNA, 27 bp, Artificial Sequence
  Description of Artificial Sequence: Synthetic oligonucleotide
attagccctctgacccctgcacacgca

SEQ ID NO: 157611 - DNA, 26 bp, Artificial Sequence
  Description of Artificial Sequence: Synthetic oligonucleotide
ttagccctctgacccctgcacacgca

SEQ ID NO: 157612 - DNA, 25 bp, Artificial Sequence
  Description of Artificial Sequence: Synthetic oligonucleotide
tagccctctgacccctgcacacgca

SEQ ID NO: 157613 - DNA, 24 bp, Artificial Sequence
  Description of Artificial Sequence: Synthetic oligonucleotide
agccctctgacccctgcacacgca

SEQ ID NO: 157614 - DNA, 23 bp, Artificial Sequence
  Description of Artificial Sequence: Synthetic oligonucleotide
gccctctgacccctgcacacgca

SEQ ID NO: 157615 - DNA, 23 bp, Artificial Sequence
  Description of Artificial Sequence: Synthetic oligonucleotide
ccctctgacccctgcacacgcag

SEQ ID NO: 157616 - DNA, 23 bp, Artificial Sequence
  Description of Artificial Sequence: Synthetic oligonucleotide
cctctgacccctgcacacgcagg

SEQ ID NO: 157617 - DNA, 24 bp, Artificial Sequence
  Description of Artificial Sequence: Synthetic oligonucleotide
ctctgacccctgcacacgcaggga

SEQ ID NO: 157618 - DNA, 24 bp, Artificial Sequence
  Description of Artificial Sequence: Synthetic oligonucleotide
tctgacccctgcacacgcagggac

SEQ ID NO: 157619 - DNA, 23 bp, Artificial Sequence
  Description of Artificial Sequence: Synthetic oligonucleotide
ctgacccctgcacacgcagggac

SEQ ID NO: 157620 - DNA, 25 bp, Artificial Sequence
  Description of Artificial Sequence: Synthetic oligonucleotide
tgacccctgcacacgcagggaccta

SEQ ID NO: 157621 - DNA, 24 bp, Artificial Sequence
  Description of Artificial Sequence: Synthetic oligonucleotide
gacccctgcacacgcagggaccta

SEQ ID NO: 157622 - DNA, 25 bp, Artificial Sequence
  Description of Artificial Sequence: Synthetic oligonucleotide
acccctgcacacgcagggacctaca

SEQ ID NO: 157623 - DNA, 24 bp, Artificial Sequence
  Description of Artificial Sequence: Synthetic oligonucleotide
cccctgcacacgcagggacctaca

SEQ ID NO: 157624 - DNA, 26 bp, Artificial Sequence
  Description of Artificial Sequence: Synthetic oligonucleotide
ccctgcacacgcagggacctacagat

SEQ ID NO: 157625 - DNA, 27 bp, Artificial Sequence
  Description of Artificial Sequence: Synthetic oligonucleotide
cctgcacacgcagggacctacagatgt

SEQ ID NO: 157626 - DNA, 27 bp, Artificial Sequence
  Description of Artificial Sequence: Synthetic oligonucleotide
ctgcacacgcagggacctacagatgtc

SEQ ID NO: 157627 - DNA, 27 bp, Artificial Sequence
  Description of Artificial Sequence: Synthetic oligonucleotide
tgcacacgcagggacctacagatgtcg

SEQ ID NO: 157628 - DNA, 32 bp, Artificial Sequence
  Description of Artificial Sequence: Synthetic oligonucleotide
aaacccttctagtagttggccttcacccacag

SEQ ID NO: 157629 - DNA, 31 bp, Artificial Sequence
  Description of Artificial Sequence: Synthetic oligonucleotide
aacccttctagtagttggccttcacccacag

SEQ ID NO: 157630 - DNA, 30 bp, Artificial Sequence
  Description of Artificial Sequence: Synthetic oligonucleotide
acccttctagtagttggccttcacccacag

SEQ ID NO: 157631 - DNA, 29 bp, Artificial Sequence
  Description of Artificial Sequence: Synthetic oligonucleotide
cccttctagtagttggccttcacccacag

SEQ ID NO: 157632 - DNA, 31 bp, Artificial Sequence
  Description of Artificial Sequence: Synthetic oligonucleotide
ccttctagtagttggccttcacccacagaac

SEQ ID NO: 157633 - DNA, 31 bp, Artificial Sequence
  Description of Artificial Sequence: Synthetic oligonucleotide
cttctagtagttggccttcacccacagaacc

SEQ ID NO: 157634 - DNA, 33 bp, Artificial Sequence
  Description of Artificial Sequence: Synthetic oligonucleotide
ttctagtagttggccttcacccacagaaccaag

SEQ ID NO: 157635 - DNA, 32 bp, Artificial Sequence
  Description of Artificial Sequence: Synthetic oligonucleotide
tctagtagttggccttcacccacagaaccaag

SEQ ID NO: 157636 - DNA, 31 bp, Artificial Sequence
  Description of Artificial Sequence: Synthetic oligonucleotide
ctagtagttggccttcacccacagaaccaag

SEQ ID NO: 157637 - DNA, 31 bp, Artificial Sequence
  Description of Artificial Sequence: Synthetic oligonucleotide
tagtagttggccttcacccacagaaccaagc

SEQ ID NO: 157638 - DNA, 30 bp, Artificial Sequence
  Description of Artificial Sequence: Synthetic oligonucleotide
agtagttggccttcacccacagaaccaagc

SEQ ID NO: 157639 - DNA, 29 bp, Artificial Sequence
  Description of Artificial Sequence: Synthetic oligonucleotide
gtagttggccttcacccacagaaccaagc

SEQ ID NO: 157640 - DNA, 31 bp, Artificial Sequence
  Description of Artificial Sequence: Synthetic oligonucleotide
tagttggccttcacccacagaaccaagcttc

SEQ ID NO: 157641 - DNA, 30 bp, Artificial Sequence
  Description of Artificial Sequence: Synthetic oligonucleotide
agttggccttcacccacagaaccaagcttc

SEQ ID NO: 157642 - DNA, 29 bp, Artificial Sequence
  Description of Artificial Sequence: Synthetic oligonucleotide
gttggccttcacccacagaaccaagcttc

SEQ ID NO: 157643 - DNA, 33 bp, Artificial Sequence
  Description of Artificial Sequence: Synthetic oligonucleotide
ttggccttcacccacagaaccaagcttcaaaac

SEQ ID NO: 157644 - DNA, 32 bp, Artificial Sequence
  Description of Artificial Sequence: Synthetic oligonucleotide
tggccttcacccacagaaccaagcttcaaaac

SEQ ID NO: 157645 - DNA, 31 bp, Artificial Sequence
  Description of Artificial Sequence: Synthetic oligonucleotide
ggccttcacccacagaaccaagcttcaaaac

SEQ ID NO: 157646 - DNA, 32 bp, Artificial Sequence
  Description of Artificial Sequence: Synthetic oligonucleotide
gccttcacccacagaaccaagcttcaaaactg

SEQ ID NO: 157647 - DNA, 32 bp, Artificial Sequence
  Description of Artificial Sequence: Synthetic oligonucleotide
ccttcacccacagaaccaagcttcaaaactgg

SEQ ID NO: 157648 - DNA, 35 bp, Artificial Sequence
  Description of Artificial Sequence: Synthetic oligonucleotide
cttcacccacagaaccaagcttcaaaactggtatc

SEQ ID NO: 157649 - DNA, 35 bp, Artificial Sequence
  Description of Artificial Sequence: Synthetic oligonucleotide
ttcacccacagaaccaagcttcaaaactggtatcg

SEQ ID NO: 157650 - DNA, 34 bp, Artificial Sequence
  Description of Artificial Sequence: Synthetic oligonucleotide
tcacccacagaaccaagcttcaaaactggtatcg

SEQ ID NO: 157651 - DNA, 33 bp, Artificial Sequence
  Description of Artificial Sequence: Synthetic oligonucleotide
cacccacagaaccaagcttcaaaactggtatcg

SEQ ID NO: 157652 - DNA, 33 bp, Artificial Sequence
  Description of Artificial Sequence: Synthetic oligonucleotide
acccacagaaccaagcttcaaaactggtatcgc

SEQ ID NO: 157653 - DNA, 32 bp, Artificial Sequence
  Description of Artificial Sequence: Synthetic oligonucleotide
cccacagaaccaagcttcaaaactggtatcgc

SEQ ID NO: 157654 - DNA, 32 bp, Artificial Sequence
  Description of Artificial Sequence: Synthetic oligonucleotide
ccacagaaccaagcttcaaaactggtatcgcc

SEQ ID NO: 157655 - DNA, 33 bp, Artificial Sequence
  Description of Artificial Sequence: Synthetic oligonucleotide
cacagaaccaagcttcaaaactggtatcgccag

SEQ ID NO: 157656 - DNA, 34 bp, Artificial Sequence
  Description of Artificial Sequence: Synthetic oligonucleotide
acagaaccaagcttcaaaactggtatcgccagac

SEQ ID NO: 157657 - DNA, 33 bp, Artificial Sequence
  Description of Artificial Sequence: Synthetic oligonucleotide
cagaaccaagcttcaaaactggtatcgccagac

SEQ ID NO: 157658 - DNA, 34 bp, Artificial Sequence
  Description of Artificial Sequence: Synthetic oligonucleotide
agaaccaagcttcaaaactggtatcgccagacac

SEQ ID NO: 157659 - DNA, 30 bp, Artificial Sequence
  Description of Artificial Sequence: Synthetic oligonucleotide
tcagtggccatcatcctcttcaccatcctc

SEQ ID NO: 157660 - DNA, 29 bp, Artificial Sequence
  Description of Artificial Sequence: Synthetic oligonucleotide
cagtggccatcatcctcttcaccatcctc

SEQ ID NO: 157661 - DNA, 29 bp, Artificial Sequence
  Description of Artificial Sequence: Synthetic oligonucleotide
agtggccatcatcctcttcaccatcctcc

SEQ ID NO: 157662 - DNA, 28 bp, Artificial Sequence
  Description of Artificial Sequence: Synthetic oligonucleotide
gtggccatcatcctcttcaccatcctcc

SEQ ID NO: 157663 - DNA, 28 bp, Artificial Sequence
  Description of Artificial Sequence: Synthetic oligonucleotide
tggccatcatcctcttcaccatcctccc

SEQ ID NO: 157664 - DNA, 27 bp, Artificial Sequence
  Description of Artificial Sequence: Synthetic oligonucleotide
ggccatcatcctcttcaccatcctccc

SEQ ID NO: 157665 - DNA, 27 bp, Artificial Sequence
  Description of Artificial Sequence: Synthetic oligonucleotide
gccatcatcctcttcaccatcctcccc

SEQ ID NO: 157666 - DNA, 29 bp, Artificial Sequence
  Description of Artificial Sequence: Synthetic oligonucleotide
ccatcatcctcttcaccatcctccccttc

SEQ ID NO: 157667 - DNA, 32 bp, Artificial Sequence
  Description of Artificial Sequence: Synthetic oligonucleotide
catcatcctcttcaccatcctccccttctttc

SEQ ID NO: 157668 - DNA, 33 bp, Artificial Sequence
  Description of Artificial Sequence: Synthetic oligonucleotide
atcatcctcttcaccatcctccccttctttctc

SEQ ID NO: 157669 - DNA, 32 bp, Artificial Sequence
  Description of Artificial Sequence: Synthetic oligonucleotide
tcatcctcttcaccatcctccccttctttctc

SEQ ID NO: 157670 - DNA, 31 bp, Artificial Sequence
  Description of Artificial Sequence: Synthetic oligonucleotide
catcctcttcaccatcctccccttctttctc

SEQ ID NO: 157671 - DNA, 31 bp, Artificial Sequence
  Description of Artificial Sequence: Synthetic oligonucleotide
atcctcttcaccatcctccccttctttctcc

SEQ ID NO: 157672 - DNA, 30 bp, Artificial Sequence
  Description of Artificial Sequence: Synthetic oligonucleotide
tcctcttcaccatcctccccttctttctcc

SEQ ID NO: 157673 - DNA, 29 bp, Artificial Sequence
  Description of Artificial Sequence: Synthetic oligonucleotide
cctcttcaccatcctccccttctttctcc

SEQ ID NO: 157674 - DNA, 31 bp, Artificial Sequence
  Description of Artificial Sequence: Synthetic oligonucleotide
ctcttcaccatcctccccttctttctccttc

SEQ ID NO: 157675 - DNA, 33 bp, Artificial Sequence
  Description of Artificial Sequence: Synthetic oligonucleotide
tcttcaccatcctccccttctttctccttcatc

SEQ ID NO: 157676 - DNA, 32 bp, Artificial Sequence
  Description of Artificial Sequence: Synthetic oligonucleotide
cttcaccatcctccccttctttctccttcatc

SEQ ID NO: 157677 - DNA, 32 bp, Artificial Sequence
  Description of Artificial Sequence: Synthetic oligonucleotide
ttcaccatcctccccttctttctccttcatcg

SEQ ID NO: 157678 - DNA, 31 bp, Artificial Sequence
  Description of Artificial Sequence: Synthetic oligonucleotide
tcaccatcctccccttctttctccttcatcg

SEQ ID NO: 157679 - DNA, 30 bp, Artificial Sequence
  Description of Artificial Sequence: Synthetic oligonucleotide
caccatcctccccttctttctccttcatcg

SEQ ID NO: 157680 - DNA, 30 bp, Artificial Sequence
  Description of Artificial Sequence: Synthetic oligonucleotide
accatcctccccttctttctccttcatcgc

SEQ ID NO: 157681 - DNA, 29 bp, Artificial Sequence
  Description of Artificial Sequence: Synthetic oligonucleotide
ccatcctccccttctttctccttcatcgc

SEQ ID NO: 157682 - DNA, 30 bp, Artificial Sequence
  Description of Artificial Sequence: Synthetic oligonucleotide
catcctccccttctttctccttcatcgctg

SEQ ID NO: 157683 - DNA, 30 bp, Artificial Sequence
  Description of Artificial Sequence: Synthetic oligonucleotide
atcctccccttctttctccttcatcgctgg

SEQ ID NO: 157684 - DNA, 29 bp, Artificial Sequence
  Description of Artificial Sequence: Synthetic oligonucleotide
tcctccccttctttctccttcatcgctgg

SEQ ID NO: 157685 - DNA, 28 bp, Artificial Sequence
  Description of Artificial Sequence: Synthetic oligonucleotide
cctccccttctttctccttcatcgctgg

SEQ ID NO: 157686 - DNA, 29 bp, Artificial Sequence
  Description of Artificial Sequence: Synthetic oligonucleotide
ctccccttctttctccttcatcgctggtg

SEQ ID NO: 157687 - DNA, 29 bp, Artificial Sequence
  Description of Artificial Sequence: Synthetic oligonucleotide
tccccttctttctccttcatcgctggtgc

SEQ ID NO: 157688 - DNA, 28 bp, Artificial Sequence
  Description of Artificial Sequence: Synthetic oligonucleotide
ccccttctttctccttcatcgctggtgc

SEQ ID NO: 157689 - DNA, 38 bp, Artificial Sequence
  Description of Artificial Sequence: Synthetic oligonucleotide
cttctttctccttcatcgctggtgctccaaaaaaaaag

SEQ ID NO: 157690 - DNA, 40 bp, Artificial Sequence
  Description of Artificial Sequence: Synthetic oligonucleotide
ttctttctccttcatcgctggtgctccaaaaaaaaagatg

SEQ ID NO: 157691 - DNA, 39 bp, Artificial Sequence
  Description of Artificial Sequence: Synthetic oligonucleotide
tctttctccttcatcgctggtgctccaaaaaaaaagatg

SEQ ID NO: 157692 - DNA, 38 bp, Artificial Sequence
  Description of Artificial Sequence: Synthetic oligonucleotide
ctttctccttcatcgctggtgctccaaaaaaaaagatg

SEQ ID NO: 157693 - DNA, 38 bp, Artificial Sequence
  Description of Artificial Sequence: Synthetic oligonucleotide
tttctccttcatcgctggtgctccaaaaaaaaagatgc

SEQ ID NO: 157694 - DNA, 37 bp, Artificial Sequence
  Description of Artificial Sequence: Synthetic oligonucleotide
ttctccttcatcgctggtgctccaaaaaaaaagatgc

SEQ ID NO: 157695 - DNA, 36 bp, Artificial Sequence
  Description of Artificial Sequence: Synthetic oligonucleotide
tctccttcatcgctggtgctccaaaaaaaaagatgc

SEQ ID NO: 157696 - DNA, 35 bp, Artificial Sequence
  Description of Artificial Sequence: Synthetic oligonucleotide
ctccttcatcgctggtgctccaaaaaaaaagatgc

SEQ ID NO: 157697 - DNA, 36 bp, Artificial Sequence
  Description of Artificial Sequence: Synthetic oligonucleotide
tccttcatcgctggtgctccaaaaaaaaagatgctg

SEQ ID NO: 157698 - DNA, 35 bp, Artificial Sequence
  Description of Artificial Sequence: Synthetic oligonucleotide
ccttcatcgctggtgctccaaaaaaaaagatgctg

SEQ ID NO: 157699 - DNA, 35 bp, Artificial Sequence
  Description of Artificial Sequence: Synthetic oligonucleotide
cttcatcgctggtgctccaaaaaaaaagatgctgc

SEQ ID NO: 157700 - DNA, 36 bp, Artificial Sequence
  Description of Artificial Sequence: Synthetic oligonucleotide
ttcatcgctggtgctccaaaaaaaaagatgctgctg

SEQ ID NO: 157701 - DNA, 35 bp, Artificial Sequence
  Description of Artificial Sequence: Synthetic oligonucleotide
tcatcgctggtgctccaaaaaaaaagatgctgctg

SEQ ID NO: 157702 - DNA, 34 bp, Artificial Sequence
  Description of Artificial Sequence: Synthetic oligonucleotide
catcgctggtgctccaaaaaaaaagatgctgctg

SEQ ID NO: 157703 - DNA, 38 bp, Artificial Sequence
  Description of Artificial Sequence: Synthetic oligonucleotide
atcgctggtgctccaaaaaaaaagatgctgctgtaatg

SEQ ID NO: 157704 - DNA, 37 bp, Artificial Sequence
  Description of Artificial Sequence: Synthetic oligonucleotide
tcgctggtgctccaaaaaaaaagatgctgctgtaatg

SEQ ID NO: 157705 - DNA, 36 bp, Artificial Sequence
  Description of Artificial Sequence: Synthetic oligonucleotide
cgctggtgctccaaaaaaaaagatgctgctgtaatg

SEQ ID NO: 157706 - DNA, 38 bp, Artificial Sequence
  Description of Artificial Sequence: Synthetic oligonucleotide
gctggtgctccaaaaaaaaagatgctgctgtaatgaac

SEQ ID NO: 157707 - DNA, 38 bp, Artificial Sequence
  Description of Artificial Sequence: Synthetic oligonucleotide
ctggtgctccaaaaaaaaagatgctgctgtaatgaacc

SEQ ID NO: 157708 - DNA, 40 bp, Artificial Sequence
  Description of Artificial Sequence: Synthetic oligonucleotide
tggtgctccaaaaaaaaagatgctgctgtaatgaaccaag

SEQ ID NO: 157709 - DNA, 39 bp, Artificial Sequence
  Description of Artificial Sequence: Synthetic oligonucleotide
ggtgctccaaaaaaaaagatgctgctgtaatgaaccaag

SEQ ID NO: 157710 - DNA, 40 bp, Artificial Sequence
  Description of Artificial Sequence: Synthetic oligonucleotide
gtgctccaaaaaaaaagatgctgctgtaatgaaccaagag

SEQ ID NO: 157711 - DNA, 40 bp, Artificial Sequence
  Description of Artificial Sequence: Synthetic oligonucleotide
tgctccaaaaaaaaagatgctgctgtaatgaaccaagagc

SEQ ID NO: 157712 - DNA, 39 bp, Artificial Sequence
  Description of Artificial Sequence: Synthetic oligonucleotide
gctccaaaaaaaaagatgctgctgtaatgaaccaagagc

SEQ ID NO: 157713 - DNA, 39 bp, Artificial Sequence
  Description of Artificial Sequence: Synthetic oligonucleotide
ctccaaaaaaaaagatgctgctgtaatgaaccaagagcc

SEQ ID NO: 157714 - DNA, 40 bp, Artificial Sequence
  Description of Artificial Sequence: Synthetic oligonucleotide
tccaaaaaaaaagatgctgctgtaatgaaccaagagcctg

SEQ ID NO: 157715 - DNA, 39 bp, Artificial Sequence
  Description of Artificial Sequence: Synthetic oligonucleotide
ccaaaaaaaaagatgctgctgtaatgaaccaagagcctg

SEQ ID NO: 157716 - DNA, 39 bp, Artificial Sequence
  Description of Artificial Sequence: Synthetic oligonucleotide
caaaaaaaaagatgctgctgtaatgaaccaagagcctgc

SEQ ID NO: 157717 - DNA, 39 bp, Artificial Sequence
  Description of Artificial Sequence: Synthetic oligonucleotide
aaaaaaaaagatgctgctgtaatgaaccaagagcctgcg

SEQ ID NO: 157718 - DNA, 38 bp, Artificial Sequence
  Description of Artificial Sequence: Synthetic oligonucleotide
aaaaaaaagatgctgctgtaatgaaccaagagcctgcg

SEQ ID NO: 157719 - DNA, 37 bp, Artificial Sequence
  Description of Artificial Sequence: Synthetic oligonucleotide
aaaaaaagatgctgctgtaatgaaccaagagcctgcg

SEQ ID NO: 157720 - DNA, 36 bp, Artificial Sequence
  Description of Artificial Sequence: Synthetic oligonucleotide
aaaaaagatgctgctgtaatgaaccaagagcctgcg

SEQ ID NO: 157721 - DNA, 35 bp, Artificial Sequence
  Description of Artificial Sequence: Synthetic oligonucleotide
aaaaagatgctgctgtaatgaaccaagagcctgcg

SEQ ID NO: 157722 - DNA, 34 bp, Artificial Sequence
  Description of Artificial Sequence: Synthetic oligonucleotide
aaaagatgctgctgtaatgaaccaagagcctgcg

SEQ ID NO: 157723 - DNA, 33 bp, Artificial Sequence
  Description of Artificial Sequence: Synthetic oligonucleotide
aaagatgctgctgtaatgaaccaagagcctgcg

SEQ ID NO: 157724 - DNA, 32 bp, Artificial Sequence
  Description of Artificial Sequence: Synthetic oligonucleotide
aagatgctgctgtaatgaaccaagagcctgcg

SEQ ID NO: 157725 - DNA, 31 bp, Artificial Sequence
  Description of Artificial Sequence: Synthetic oligonucleotide
agatgctgctgtaatgaaccaagagcctgcg

SEQ ID NO: 157726 - DNA, 30 bp, Artificial Sequence
  Description of Artificial Sequence: Synthetic oligonucleotide
gatgctgctgtaatgaaccaagagcctgcg

SEQ ID NO: 157727 - DNA, 26 bp, Artificial Sequence
  Description of Artificial Sequence: Synthetic oligonucleotide
ctgagcccagagcgttatctcctgcg

SEQ ID NO: 157728 - DNA, 27 bp, Artificial Sequence
  Description of Artificial Sequence: Synthetic oligonucleotide
tgagcccagagcgttatctcctgcgca

SEQ ID NO: 157729 - DNA, 27 bp, Artificial Sequence
  Description of Artificial Sequence: Synthetic oligonucleotide
gagcccagagcgttatctcctgcgcat

SEQ ID NO: 157730 - DNA, 27 bp, Artificial Sequence
  Description of Artificial Sequence: Synthetic oligonucleotide
agcccagagcgttatctcctgcgcatg

SEQ ID NO: 157731 - DNA, 27 bp, Artificial Sequence
  Description of Artificial Sequence: Synthetic oligonucleotide
gcccagagcgttatctcctgcgcatga

SEQ ID NO: 157732 - DNA, 27 bp, Artificial Sequence
  Description of Artificial Sequence: Synthetic oligonucleotide
cccagagcgttatctcctgcgcatgag

SEQ ID NO: 157733 - DNA, 27 bp, Artificial Sequence
  Description of Artificial Sequence: Synthetic oligonucleotide
ccagagcgttatctcctgcgcatgagc

SEQ ID NO: 157734 - DNA, 28 bp, Artificial Sequence
  Description of Artificial Sequence: Synthetic oligonucleotide
cagagcgttatctcctgcgcatgagcac

SEQ ID NO: 157735 - DNA, 28 bp, Artificial Sequence
  Description of Artificial Sequence: Synthetic oligonucleotide
agagcgttatctcctgcgcatgagcacc

SEQ ID NO: 157736 - DNA, 27 bp, Artificial Sequence
  Description of Artificial Sequence: Synthetic oligonucleotide
gagcgttatctcctgcgcatgagcacc

SEQ ID NO: 157737 - DNA, 28 bp, Artificial Sequence
  Description of Artificial Sequence: Synthetic oligonucleotide
agcgttatctcctgcgcatgagcaccac

SEQ ID NO: 157738 - DNA, 27 bp, Artificial Sequence
  Description of Artificial Sequence: Synthetic oligonucleotide
gcgttatctcctgcgcatgagcaccac

SEQ ID NO: 157739 - DNA, 28 bp, Artificial Sequence
  Description of Artificial Sequence: Synthetic oligonucleotide
cgttatctcctgcgcatgagcaccacag

SEQ ID NO: 157740 - DNA, 29 bp, Artificial Sequence
  Description of Artificial Sequence: Synthetic oligonucleotide
gttatctcctgcgcatgagcaccacagtc

SEQ ID NO: 157741 - DNA, 30 bp, Artificial Sequence
  Description of Artificial Sequence: Synthetic oligonucleotide
ttatctcctgcgcatgagcaccacagtcag

SEQ ID NO: 157742 - DNA, 29 bp, Artificial Sequence
  Description of Artificial Sequence: Synthetic oligonucleotide
tatctcctgcgcatgagcaccacagtcag

SEQ ID NO: 157743 - DNA, 28 bp, Artificial Sequence
  Description of Artificial Sequence: Synthetic oligonucleotide
atctcctgcgcatgagcaccacagtcag

SEQ ID NO: 157744 - DNA, 27 bp, Artificial Sequence
  Description of Artificial Sequence: Synthetic oligonucleotide
tctcctgcgcatgagcaccacagtcag

SEQ ID NO: 157745 - DNA, 26 bp, Artificial Sequence
  Description of Artificial Sequence: Synthetic oligonucleotide
ctcctgcgcatgagcaccacagtcag

SEQ ID NO: 157746 - DNA, 26 bp, Artificial Sequence
  Description of Artificial Sequence: Synthetic oligonucleotide
tcctgcgcatgagcaccacagtcagg

SEQ ID NO: 157747 - DNA, 25 bp, Artificial Sequence
  Description of Artificial Sequence: Synthetic oligonucleotide
cctgcgcatgagcaccacagtcagg

SEQ ID NO: 157748 - DNA, 25 bp, Artificial Sequence
  Description of Artificial Sequence: Synthetic oligonucleotide
ctgcgcatgagcaccacagtcaggc

SEQ ID NO: 157749 - DNA, 27 bp, Artificial Sequence
  Description of Artificial Sequence: Synthetic oligonucleotide
tgcgcatgagcaccacagtcaggcctt

SEQ ID NO: 157750 - DNA, 26 bp, Artificial Sequence
  Description of Artificial Sequence: Synthetic oligonucleotide
gcgcatgagcaccacagtcaggcctt

SEQ ID NO: 157751 - DNA, 27 bp, Artificial Sequence
  Description of Artificial Sequence: Synthetic oligonucleotide
cgcatgagcaccacagtcaggccttga

SEQ ID NO: 157752 - DNA, 28 bp, Artificial Sequence
  Description of Artificial Sequence: Synthetic oligonucleotide
gcatgagcaccacagtcaggccttgatg

SEQ ID NO: 157753 - DNA, 27 bp, Artificial Sequence
  Description of Artificial Sequence: Synthetic oligonucleotide
ctgtctcaaacccagcttgccagctcc

SEQ ID NO: 157754 - DNA, 27 bp, Artificial Sequence
  Description of Artificial Sequence: Synthetic oligonucleotide
tgtctcaaacccagcttgccagctccc

SEQ ID NO: 157755 - DNA, 27 bp, Artificial Sequence
  Description of Artificial Sequence: Synthetic oligonucleotide
gtctcaaacccagcttgccagctccca

SEQ ID NO: 157756 - DNA, 28 bp, Artificial Sequence
  Description of Artificial Sequence: Synthetic oligonucleotide
tctcaaacccagcttgccagctcccatg

SEQ ID NO: 157757 - DNA, 27 bp, Artificial Sequence
  Description of Artificial Sequence: Synthetic oligonucleotide
ctcaaacccagcttgccagctcccatg

SEQ ID NO: 157758 - DNA, 29 bp, Artificial Sequence
  Description of Artificial Sequence: Synthetic oligonucleotide
tcaaacccagcttgccagctcccatgtac

SEQ ID NO: 157759 - DNA, 28 bp, Artificial Sequence
  Description of Artificial Sequence: Synthetic oligonucleotide
caaacccagcttgccagctcccatgtac

SEQ ID NO: 157760 - DNA, 28 bp, Artificial Sequence
  Description of Artificial Sequence: Synthetic oligonucleotide
aaacccagcttgccagctcccatgtacc

SEQ ID NO: 157761 - DNA, 27 bp, Artificial Sequence
  Description of Artificial Sequence: Synthetic oligonucleotide
aacccagcttgccagctcccatgtacc

SEQ ID NO: 157762 - DNA, 27 bp, Artificial Sequence
  Description of Artificial Sequence: Synthetic oligonucleotide
acccagcttgccagctcccatgtacca

SEQ ID NO: 157763 - DNA, 26 bp, Artificial Sequence
  Description of Artificial Sequence: Synthetic oligonucleotide
cccagcttgccagctcccatgtacca

SEQ ID NO: 157764 - DNA, 26 bp, Artificial Sequence
  Description of Artificial Sequence: Synthetic oligonucleotide
ccagcttgccagctcccatgtaccag

SEQ ID NO: 157765 - DNA, 27 bp, Artificial Sequence
  Description of Artificial Sequence: Synthetic oligonucleotide
cagcttgccagctcccatgtaccagca

SEQ ID NO: 157766 - DNA, 27 bp, Artificial Sequence
  Description of Artificial Sequence: Synthetic oligonucleotide
agcttgccagctcccatgtaccagcag

SEQ ID NO: 157767 - DNA, 26 bp, Artificial Sequence
  Description of Artificial Sequence: Synthetic oligonucleotide
gcttgccagctcccatgtaccagcag

SEQ ID NO: 157768 - DNA, 27 bp, Artificial Sequence
  Description of Artificial Sequence: Synthetic oligonucleotide
cttgccagctcccatgtaccagcagct

SEQ ID NO: 157769 - DNA, 27 bp, Artificial Sequence
  Description of Artificial Sequence: Synthetic oligonucleotide
ttgccagctcccatgtaccagcagctg

SEQ ID NO: 157770 - DNA, 26 bp, Artificial Sequence
  Description of Artificial Sequence: Synthetic oligonucleotide
tgccagctcccatgtaccagcagctg

SEQ ID NO: 157771 - DNA, 25 bp, Artificial Sequence
  Description of Artificial Sequence: Synthetic oligonucleotide
gccagctcccatgtaccagcagctg

SEQ ID NO: 157772 - DNA, 27 bp, Artificial Sequence
  Description of Artificial Sequence: Synthetic oligonucleotide
ccagctcccatgtaccagcagctggaa

SEQ ID NO: 157773 - DNA, 28 bp, Artificial Sequence
  Description of Artificial Sequence: Synthetic oligonucleotide
cagctcccatgtaccagcagctggaatc

SEQ ID NO: 157774 - DNA, 29 bp, Artificial Sequence
  Description of Artificial Sequence: Synthetic oligonucleotide
agctcccatgtaccagcagctggaatctg

SEQ ID NO: 157775 - DNA, 28 bp, Artificial Sequence
  Description of Artificial Sequence: Synthetic oligonucleotide
gctcccatgtaccagcagctggaatctg

SEQ ID NO: 157776 - DNA, 31 bp, Artificial Sequence
  Description of Artificial Sequence: Synthetic oligonucleotide
aacagtttcctcattagccctctgaccccag

SEQ ID NO: 157777 - DNA, 30 bp, Artificial Sequence
  Description of Artificial Sequence: Synthetic oligonucleotide
acagtttcctcattagccctctgaccccag

SEQ ID NO: 157778 - DNA, 29 bp, Artificial Sequence
  Description of Artificial Sequence: Synthetic oligonucleotide
cagtttcctcattagccctctgaccccag

SEQ ID NO: 157779 - DNA, 29 bp, Artificial Sequence
  Description of Artificial Sequence: Synthetic oligonucleotide
agtttcctcattagccctctgaccccagc

SEQ ID NO: 157780 - DNA, 28 bp, Artificial Sequence
  Description of Artificial Sequence: Synthetic oligonucleotide
gtttcctcattagccctctgaccccagc

SEQ ID NO: 157781 - DNA, 29 bp, Artificial Sequence
  Description of Artificial Sequence: Synthetic oligonucleotide
tttcctcattagccctctgaccccagcac

SEQ ID NO: 157782 - DNA, 28 bp, Artificial Sequence
  Description of Artificial Sequence: Synthetic oligonucleotide
ttcctcattagccctctgaccccagcac

SEQ ID NO: 157783 - DNA, 27 bp, Artificial Sequence
  Description of Artificial Sequence: Synthetic oligonucleotide
tcctcattagccctctgaccccagcac

SEQ ID NO: 157784 - DNA, 27 bp, Artificial Sequence
  Description of Artificial Sequence: Synthetic oligonucleotide
cctcattagccctctgaccccagcaca

SEQ ID NO: 157785 - DNA, 27 bp, Artificial Sequence
  Description of Artificial Sequence: Synthetic oligonucleotide
ctcattagccctctgaccccagcacac

SEQ ID NO: 157786 - DNA, 27 bp, Artificial Sequence
  Description of Artificial Sequence: Synthetic oligonucleotide
tcattagccctctgaccccagcacacg

SEQ ID NO: 157787 - DNA, 26 bp, Artificial Sequence
  Description of Artificial Sequence: Synthetic oligonucleotide
cattagccctctgaccccagcacacg

SEQ ID NO: 157788 - DNA, 27 bp, Artificial Sequence
  Description of Artificial Sequence: Synthetic oligonucleotide
attagccctctgaccccagcacacgca

SEQ ID NO: 157789 - DNA, 26 bp, Artificial Sequence
  Description of Artificial Sequence: Synthetic oligonucleotide
ttagccctctgaccccagcacacgca

SEQ ID NO: 157790 - DNA, 25 bp, Artificial Sequence
  Description of Artificial Sequence: Synthetic oligonucleotide
tagccctctgaccccagcacacgca

SEQ ID NO: 157791 - DNA, 24 bp, Artificial Sequence
  Description of Artificial Sequence: Synthetic oligonucleotide
agccctctgaccccagcacacgca

SEQ ID NO: 157792 - DNA, 23 bp, Artificial Sequence
  Description of Artificial Sequence: Synthetic oligonucleotide
gccctctgaccccagcacacgca

SEQ ID NO: 157793 - DNA, 23 bp, Artificial Sequence
  Description of Artificial Sequence: Synthetic oligonucleotide
ccctctgaccccagcacacgcag

SEQ ID NO: 157794 - DNA, 23 bp, Artificial Sequence
  Description of Artificial Sequence: Synthetic oligonucleotide
cctctgaccccagcacacgcagg

SEQ ID NO: 157795 - DNA, 24 bp, Artificial Sequence
  Description of Artificial Sequence: Synthetic oligonucleotide
ctctgaccccagcacacgcaggga

SEQ ID NO: 157796 - DNA, 24 bp, Artificial Sequence
  Description of Artificial Sequence: Synthetic oligonucleotide
tctgaccccagcacacgcagggac

SEQ ID NO: 157797 - DNA, 23 bp, Artificial Sequence
  Description of Artificial Sequence: Synthetic oligonucleotide
ctgaccccagcacacgcagggac

SEQ ID NO: 157798 - DNA, 25 bp, Artificial Sequence
  Description of Artificial Sequence: Synthetic oligonucleotide
tgagcccagagcgttgtctcctgcg

SEQ ID NO: 157799 - DNA, 24 bp, Artificial Sequence
  Description of Artificial Sequence: Synthetic oligonucleotide
gagcccagagcgttgtctcctgcg

SEQ ID NO: 157800 - DNA, 26 bp, Artificial Sequence
  Description of Artificial Sequence: Synthetic oligonucleotide
agcccagagcgttgtctcctgcgcat

SEQ ID NO: 157801 - DNA, 25 bp, Artificial Sequence
  Description of Artificial Sequence: Synthetic oligonucleotide
gcccagagcgttgtctcctgcgcat

SEQ ID NO: 157802 - DNA, 26 bp, Artificial Sequence
  Description of Artificial Sequence: Synthetic oligonucleotide
cccagagcgttgtctcctgcgcatga

SEQ ID NO: 157803 - DNA, 26 bp, Artificial Sequence
  Description of Artificial Sequence: Synthetic oligonucleotide
ccagagcgttgtctcctgcgcatgag

SEQ ID NO: 157804 - DNA, 27 bp, Artificial Sequence
  Description of Artificial Sequence: Synthetic oligonucleotide
cagagcgttgtctcctgcgcatgagca

SEQ ID NO: 157805 - DNA, 27 bp, Artificial Sequence
  Description of Artificial Sequence: Synthetic oligonucleotide
agagcgttgtctcctgcgcatgagcac

SEQ ID NO: 157806 - DNA, 26 bp, Artificial Sequence
  Description of Artificial Sequence: Synthetic oligonucleotide
gagcgttgtctcctgcgcatgagcac

SEQ ID NO: 157807 - DNA, 27 bp, Artificial Sequence
  Description of Artificial Sequence: Synthetic oligonucleotide
agcgttgtctcctgcgcatgagcacca

SEQ ID NO: 157808 - DNA, 26 bp, Artificial Sequence
  Description of Artificial Sequence: Synthetic oligonucleotide
gcgttgtctcctgcgcatgagcacca

SEQ ID NO: 157809 - DNA, 27 bp, Artificial Sequence
  Description of Artificial Sequence: Synthetic oligonucleotide
cgttgtctcctgcgcatgagcaccaca

SEQ ID NO: 157810 - DNA, 27 bp, Artificial Sequence
  Description of Artificial Sequence: Synthetic oligonucleotide
gttgtctcctgcgcatgagcaccacag

SEQ ID NO: 157811 - DNA, 28 bp, Artificial Sequence
  Description of Artificial Sequence: Synthetic oligonucleotide
ttgtctcctgcgcatgagcaccacagtc

SEQ ID NO: 157812 - DNA, 27 bp, Artificial Sequence
  Description of Artificial Sequence: Synthetic oligonucleotide
tgtctcctgcgcatgagcaccacagtc

SEQ ID NO: 157813 - DNA, 27 bp, Artificial Sequence
  Description of Artificial Sequence: Synthetic oligonucleotide
gtctcctgcgcatgagcaccacagtca

SEQ ID NO: 157814 - DNA, 28 bp, Artificial Sequence
  Description of Artificial Sequence: Synthetic oligonucleotide
gaggacacgtgactcttcggtgtcactg

SEQ ID NO: 157815 - DNA, 29 bp, Artificial Sequence
  Description of Artificial Sequence: Synthetic oligonucleotide
aggacacgtgactcttcggtgtcactgtc

SEQ ID NO: 157816 - DNA, 28 bp, Artificial Sequence
  Description of Artificial Sequence: Synthetic oligonucleotide
ggacacgtgactcttcggtgtcactgtc

SEQ ID NO: 157817 - DNA, 28 bp, Artificial Sequence
  Description of Artificial Sequence: Synthetic oligonucleotide
gacacgtgactcttcggtgtcactgtcg

SEQ ID NO: 157818 - DNA, 29 bp, Artificial Sequence
  Description of Artificial Sequence: Synthetic oligonucleotide
acacgtgactcttcggtgtcactgtcgtc

SEQ ID NO: 157819 - DNA, 28 bp, Artificial Sequence
  Description of Artificial Sequence: Synthetic oligonucleotide
cacgtgactcttcggtgtcactgtcgtc

SEQ ID NO: 157820 - DNA, 28 bp, Artificial Sequence
  Description of Artificial Sequence: Synthetic oligonucleotide
acgtgactcttcggtgtcactgtcgtcg

SEQ ID NO: 157821 - DNA, 27 bp, Artificial Sequence
  Description of Artificial Sequence: Synthetic oligonucleotide
cgtgactcttcggtgtcactgtcgtcg

SEQ ID NO: 157822 - DNA, 28 bp, Artificial Sequence
  Description of Artificial Sequence: Synthetic oligonucleotide
gtgactcttcggtgtcactgtcgtcgtg

SEQ ID NO: 157823 - DNA, 28 bp, Artificial Sequence
  Description of Artificial Sequence: Synthetic oligonucleotide
tgactcttcggtgtcactgtcgtcgtgg

SEQ ID NO: 157824 - DNA, 27 bp, Artificial Sequence
  Description of Artificial Sequence: Synthetic oligonucleotide
gactcttcggtgtcactgtcgtcgtgg

SEQ ID NO: 157825 - DNA, 27 bp, Artificial Sequence
  Description of Artificial Sequence: Synthetic oligonucleotide
actcttcggtgtcactgtcgtcgtggg

SEQ ID NO: 157826 - DNA, 27 bp, Artificial Sequence
  Description of Artificial Sequence: Synthetic oligonucleotide
ctcttcggtgtcactgtcgtcgtgggt

SEQ ID NO: 157827 - DNA, 31 bp, Artificial Sequence
  Description of Artificial Sequence: Synthetic oligonucleotide
tcttcggtgtcactgtcgtcgtgggtttaac

SEQ ID NO: 157828 - DNA, 30 bp, Artificial Sequence
  Description of Artificial Sequence: Synthetic oligonucleotide
cttcggtgtcactgtcgtcgtgggtttaac

SEQ ID NO: 157829 - DNA, 32 bp, Artificial Sequence
  Description of Artificial Sequence: Synthetic oligonucleotide
ttcggtgtcactgtcgtcgtgggtttaacatc

SEQ ID NO: 157830 - DNA, 31 bp, Artificial Sequence
  Description of Artificial Sequence: Synthetic oligonucleotide
tcggtgtcactgtcgtcgtgggtttaacatc

SEQ ID NO: 157831 - DNA, 30 bp, Artificial Sequence
  Description of Artificial Sequence: Synthetic oligonucleotide
cggtgtcactgtcgtcgtgggtttaacatc

SEQ ID NO: 157832 - DNA, 32 bp, Artificial Sequence
  Description of Artificial Sequence: Synthetic oligonucleotide
ggtgtcactgtcgtcgtgggtttaacatcttc

SEQ ID NO: 157833 - DNA, 33 bp, Artificial Sequence
  Description of Artificial Sequence: Synthetic oligonucleotide
gtgtcactgtcgtcgtgggtttaacatcttcac

SEQ ID NO: 157834 - DNA, 33 bp, Artificial Sequence
  Description of Artificial Sequence: Synthetic oligonucleotide
tgtcactgtcgtcgtgggtttaacatcttcacg

SEQ ID NO: 157835 - DNA, 32 bp, Artificial Sequence
  Description of Artificial Sequence: Synthetic oligonucleotide
gtcactgtcgtcgtgggtttaacatcttcacg

SEQ ID NO: 157836 - DNA, 32 bp, Artificial Sequence
  Description of Artificial Sequence: Synthetic oligonucleotide
tcactgtcgtcgtgggtttaacatcttcacgc

SEQ ID NO: 157837 - DNA, 31 bp, Artificial Sequence
  Description of Artificial Sequence: Synthetic oligonucleotide
cactgtcgtcgtgggtttaacatcttcacgc

SEQ ID NO: 157838 - DNA, 32 bp, Artificial Sequence
  Description of Artificial Sequence: Synthetic oligonucleotide
actgtcgtcgtgggtttaacatcttcacgctg

SEQ ID NO: 157839 - DNA, 31 bp, Artificial Sequence
  Description of Artificial Sequence: Synthetic oligonucleotide
ctgtcgtcgtgggtttaacatcttcacgctg

SEQ ID NO: 157840 - DNA, 33 bp, Artificial Sequence
  Description of Artificial Sequence: Synthetic oligonucleotide
tgtcgtcgtgggtttaacatcttcacgctgtac

SEQ ID NO: 157841 - DNA, 32 bp, Artificial Sequence
  Description of Artificial Sequence: Synthetic oligonucleotide
gtcgtcgtgggtttaacatcttcacgctgtac

SEQ ID NO: 157842 - DNA, 32 bp, Artificial Sequence
  Description of Artificial Sequence: Synthetic oligonucleotide
tatatgagaaaccttcgcttacagcccggctg

SEQ ID NO: 157843 - DNA, 31 bp, Artificial Sequence
  Description of Artificial Sequence: Synthetic oligonucleotide
atatgagaaaccttcgcttacagcccggctg

SEQ ID NO: 157844 - DNA, 30 bp, Artificial Sequence
  Description of Artificial Sequence: Synthetic oligonucleotide
tatgagaaaccttcgcttacagcccggctg

SEQ ID NO: 157845 - DNA, 29 bp, Artificial Sequence
  Description of Artificial Sequence: Synthetic oligonucleotide
atgagaaaccttcgcttacagcccggctg

SEQ ID NO: 157846 - DNA, 28 bp, Artificial Sequence
  Description of Artificial Sequence: Synthetic oligonucleotide
tgagaaaccttcgcttacagcccggctg

SEQ ID NO: 157847 - DNA, 27 bp, Artificial Sequence
  Description of Artificial Sequence: Synthetic oligonucleotide
gagaaaccttcgcttacagcccggctg

SEQ ID NO: 157848 - DNA, 27 bp, Artificial Sequence
  Description of Artificial Sequence: Synthetic oligonucleotide
agaaaccttcgcttacagcccggctgg

SEQ ID NO: 157849 - DNA, 26 bp, Artificial Sequence
  Description of Artificial Sequence: Synthetic oligonucleotide
gaaaccttcgcttacagcccggctgg

SEQ ID NO: 157850 - DNA, 26 bp, Artificial Sequence
  Description of Artificial Sequence: Synthetic oligonucleotide
aaaccttcgcttacagcccggctggg

SEQ ID NO: 157851 - DNA, 25 bp, Artificial Sequence
  Description of Artificial Sequence: Synthetic oligonucleotide
aaccttcgcttacagcccggctggg

SEQ ID NO: 157852 - DNA, 24 bp, Artificial Sequence
  Description of Artificial Sequence: Synthetic oligonucleotide
accttcgcttacagcccggctggg

SEQ ID NO: 157853 - DNA, 23 bp, Artificial Sequence
  Description of Artificial Sequence: Synthetic oligonucleotide
ccttcgcttacagcccggctggg

SEQ ID NO: 157854 - DNA, 23 bp, Artificial Sequence
  Description of Artificial Sequence: Synthetic oligonucleotide
cttcgcttacagcccggctgggc

SEQ ID NO: 157855 - DNA, 23 bp, Artificial Sequence
  Description of Artificial Sequence: Synthetic oligonucleotide
ttcgcttacagcccggctgggcc

SEQ ID NO: 157856 - DNA, 22 bp, Artificial Sequence
  Description of Artificial Sequence: Synthetic oligonucleotide
tcgcttacagcccggctgggcc

SEQ ID NO: 157857 - DNA, 21 bp, Artificial Sequence
  Description of Artificial Sequence: Synthetic oligonucleotide
cgcttacagcccggctgggcc

SEQ ID NO: 157858 - DNA, 21 bp, Artificial Sequence
  Description of Artificial Sequence: Synthetic oligonucleotide
gcttacagcccggctgggccc

SEQ ID NO: 157859 - DNA, 22 bp, Artificial Sequence
  Description of Artificial Sequence: Synthetic oligonucleotide
cttacagcccggctgggcccca

SEQ ID NO: 157860 - DNA, 22 bp, Artificial Sequence
  Description of Artificial Sequence: Synthetic oligonucleotide
ttacagcccggctgggccccac

SEQ ID NO: 157861 - DNA, 21 bp, Artificial Sequence
  Description of Artificial Sequence: Synthetic oligonucleotide
tacagcccggctgggccccac

SEQ ID NO: 157862 - DNA, 20 bp, Artificial Sequence
  Description of Artificial Sequence: Synthetic oligonucleotide
acagcccggctgggccccac

SEQ ID NO: 157863 - DNA, 20 bp, Artificial Sequence
  Description of Artificial Sequence: Synthetic oligonucleotide
cagcccggctgggccccact

SEQ ID NO: 157864 - DNA, 20 bp, Artificial Sequence
  Description of Artificial Sequence: Synthetic oligonucleotide
agcccggctgggccccacgt

SEQ ID NO: 157865 - DNA, 20 bp, Artificial Sequence
  Description of Artificial Sequence: Synthetic oligonucleotide
gcccggctgggccccacgtt

SEQ ID NO: 157866 - DNA, 20 bp, Artificial Sequence
  Description of Artificial Sequence: Synthetic oligonucleotide
cccggctgggccccacggtt

SEQ ID NO: 157867 - DNA, 20 bp, Artificial Sequence
  Description of Artificial Sequence: Synthetic oligonucleotide
ccggctgggccccacggttc

SEQ ID NO: 157868 - DNA, 20 bp, Artificial Sequence
  Description of Artificial Sequence: Synthetic oligonucleotide
cggctgggccccacggttcg

SEQ ID NO: 157869 - DNA, 20 bp, Artificial Sequence
  Description of Artificial Sequence: Synthetic oligonucleotide
ggctgggccccacggttcgc

SEQ ID NO: 157870 - DNA, 20 bp, Artificial Sequence
  Description of Artificial Sequence: Synthetic oligonucleotide
gctgggccccacggttcgcg

SEQ ID NO: 157871 - DNA, 21 bp, Artificial Sequence
  Description of Artificial Sequence: Synthetic oligonucleotide
ctgggccccacggttcgcgca

SEQ ID NO: 157872 - DNA, 21 bp, Artificial Sequence
  Description of Artificial Sequence: Synthetic oligonucleotide
tgggccccacggttcgcgcag

SEQ ID NO: 157873 - DNA, 25 bp, Artificial Sequence
  Description of Artificial Sequence: Synthetic oligonucleotide
tgaccccagcacacgcagggaccaa

SEQ ID NO: 157874 - DNA, 24 bp, Artificial Sequence
  Description of Artificial Sequence: Synthetic oligonucleotide
gaccccagcacacgcagggaccaa

SEQ ID NO: 157875 - DNA, 25 bp, Artificial Sequence
  Description of Artificial Sequence: Synthetic oligonucleotide
accccagcacacgcagggaccaaca

SEQ ID NO: 157876 - DNA, 24 bp, Artificial Sequence
  Description of Artificial Sequence: Synthetic oligonucleotide
ccccagcacacgcagggaccaaca

SEQ ID NO: 157877 - DNA, 26 bp, Artificial Sequence
  Description of Artificial Sequence: Synthetic oligonucleotide
cccagcacacgcagggaccaacagat

SEQ ID NO: 157878 - DNA, 27 bp, Artificial Sequence
  Description of Artificial Sequence: Synthetic oligonucleotide
ccagcacacgcagggaccaacagatgt

SEQ ID NO: 157879 - DNA, 27 bp, Artificial Sequence
  Description of Artificial Sequence: Synthetic oligonucleotide
cagcacacgcagggaccaacagatgtc

SEQ ID NO: 157880 - DNA, 27 bp, Artificial Sequence
  Description of Artificial Sequence: Synthetic oligonucleotide
agcacacgcagggaccaacagatgtcg

SEQ ID NO: 157881 - DNA, 27 bp, Artificial Sequence
  Description of Artificial Sequence: Synthetic oligonucleotide
gcacacgcagggaccaacagatgtcga

SEQ ID NO: 157882 - DNA, 27 bp, Artificial Sequence
  Description of Artificial Sequence: Synthetic oligonucleotide
cacacgcagggaccaacagatgtcgag

SEQ ID NO: 157883 - DNA, 27 bp, Artificial Sequence
  Description of Artificial Sequence: Synthetic oligonucleotide
acacgcagggaccaacagatgtcgagg

SEQ ID NO: 157884 - DNA, 27 bp, Artificial Sequence
  Description of Artificial Sequence: Synthetic oligonucleotide
cacgcagggaccaacagatgtcgaggt

SEQ ID NO: 157885 - DNA, 30 bp, Artificial Sequence
  Description of Artificial Sequence: Synthetic oligonucleotide
acgcagggaccaacagatgtcgaggttttc

SEQ ID NO: 157886 - DNA, 29 bp, Artificial Sequence
  Description of Artificial Sequence: Synthetic oligonucleotide
cgcagggaccaacagatgtcgaggttttc

SEQ ID NO: 157887 - DNA, 29 bp, Artificial Sequence
  Description of Artificial Sequence: Synthetic oligonucleotide
gcagggaccaacagatgtcgaggttttcg

SEQ ID NO: 157888 - DNA, 29 bp, Artificial Sequence
  Description of Artificial Sequence: Synthetic oligonucleotide
cagggaccaacagatgtcgaggttttcgc

SEQ ID NO: 157889 - DNA, 29 bp, Artificial Sequence
  Description of Artificial Sequence: Synthetic oligonucleotide
agggaccaacagatgtcgaggttttcgcc

SEQ ID NO: 157890 - DNA, 28 bp, Artificial Sequence
  Description of Artificial Sequence: Synthetic oligonucleotide
gggaccaacagatgtcgaggttttcgcc

SEQ ID NO: 157891 - DNA, 28 bp, Artificial Sequence
  Description of Artificial Sequence: Synthetic oligonucleotide
ggaccaacagatgtcgaggttttcgccc

SEQ ID NO: 157892 - DNA, 28 bp, Artificial Sequence
  Description of Artificial Sequence: Synthetic oligonucleotide
gaccaacagatgtcgaggttttcgcccg

SEQ ID NO: 157893 - DNA, 28 bp, Artificial Sequence
  Description of Artificial Sequence: Synthetic oligonucleotide
accaacagatgtcgaggttttcgcccgc

SEQ ID NO: 157894 - DNA, 27 bp, Artificial Sequence
  Description of Artificial Sequence: Synthetic oligonucleotide
ccaacagatgtcgaggttttcgcccgc

SEQ ID NO: 157895 - DNA, 28 bp, Artificial Sequence
  Description of Artificial Sequence: Synthetic oligonucleotide
caacagatgtcgaggttttcgcccgcac

SEQ ID NO: 157896 - DNA, 29 bp, Artificial Sequence
  Description of Artificial Sequence: Synthetic oligonucleotide
aacagatgtcgaggttttcgcccgcactc

SEQ ID NO: 157897 - DNA, 28 bp, Artificial Sequence
  Description of Artificial Sequence: Synthetic oligonucleotide
acagatgtcgaggttttcgcccgcactc

SEQ ID NO: 157898 - DNA, 27 bp, Artificial Sequence
  Description of Artificial Sequence: Synthetic oligonucleotide
cagatgtcgaggttttcgcccgcactc

SEQ ID NO: 157899 - DNA, 27 bp, Artificial Sequence
  Description of Artificial Sequence: Synthetic oligonucleotide
agatgtcgaggttttcgcccgcactcc

SEQ ID NO: 157900 - DNA, 26 bp, Artificial Sequence
  Description of Artificial Sequence: Synthetic oligonucleotide
gatgtcgaggttttcgcccgcactcc

SEQ ID NO: 157901 - DNA, 26 bp, Artificial Sequence
  Description of Artificial Sequence: Synthetic oligonucleotide
atgtcgaggttttcgcccgcactccc

SEQ ID NO: 157902 - DNA, 25 bp, Artificial Sequence
  Description of Artificial Sequence: Synthetic oligonucleotide
tgtcgaggttttcgcccgcactccc

SEQ ID NO: 157903 - DNA, 24 bp, Artificial Sequence
  Description of Artificial Sequence: Synthetic oligonucleotide
gtcgaggttttcgcccgcactccc

SEQ ID NO: 157904 - DNA, 24 bp, Artificial Sequence
  Description of Artificial Sequence: Synthetic oligonucleotide
tcgaggttttcgcccgcactcccc

SEQ ID NO: 157905 - DNA, 23 bp, Artificial Sequence
  Description of Artificial Sequence: Synthetic oligonucleotide
cgaggttttcgcccgcactcccc

SEQ ID NO: 157906 - DNA, 24 bp, Artificial Sequence
  Description of Artificial Sequence: Synthetic oligonucleotide
gaggttttcgcccgcactccccca

SEQ ID NO: 157907 - DNA, 25 bp, Artificial Sequence
  Description of Artificial Sequence: Synthetic oligonucleotide
aggttttcgcccgcactcccccact

SEQ ID NO: 157908 - DNA, 24 bp, Artificial Sequence
  Description of Artificial Sequence: Synthetic oligonucleotide
ggttttcgcccgcactcccccact

SEQ ID NO: 157909 - DNA, 25 bp, Artificial Sequence
  Description of Artificial Sequence: Synthetic oligonucleotide
gttttcgcccgcactcccccactga

SEQ ID NO: 157910 - DNA, 26 bp, Artificial Sequence
  Description of Artificial Sequence: Synthetic oligonucleotide
ttttcgcccgcactcccccactgagt

SEQ ID NO: 157911 - DNA, 25 bp, Artificial Sequence
  Description of Artificial Sequence: Synthetic oligonucleotide
tttcgcccgcactcccccactgagt

SEQ ID NO: 157912 - DNA, 24 bp, Artificial Sequence
  Description of Artificial Sequence: Synthetic oligonucleotide
ttcgcccgcactcccccactgagt

SEQ ID NO: 157913 - DNA, 23 bp, Artificial Sequence
  Description of Artificial Sequence: Synthetic oligonucleotide
tcgcccgcactcccccactgagt

SEQ ID NO: 157914 - DNA, 22 bp, Artificial Sequence
  Description of Artificial Sequence: Synthetic oligonucleotide
cgcccgcactcccccactgagt

SEQ ID NO: 157915 - DNA, 22 bp, Artificial Sequence
  Description of Artificial Sequence: Synthetic oligonucleotide
gcccgcactcccccactgagtg

SEQ ID NO: 157916 - DNA, 40 bp, Artificial Sequence
  Description of Artificial Sequence: Synthetic oligonucleotide
cttctttctccttcatcgctggtgctccaaaaaaaaaatg

SEQ ID NO: 157917 - DNA, 40 bp, Artificial Sequence
  Description of Artificial Sequence: Synthetic oligonucleotide
ttctttctccttcatcgctggtgctccaaaaaaaaaatgc

SEQ ID NO: 157918 - DNA, 39 bp, Artificial Sequence
  Description of Artificial Sequence: Synthetic oligonucleotide
tctttctccttcatcgctggtgctccaaaaaaaaaatgc

SEQ ID NO: 157919 - DNA, 38 bp, Artificial Sequence
  Description of Artificial Sequence: Synthetic oligonucleotide
ctttctccttcatcgctggtgctccaaaaaaaaaatgc

SEQ ID NO: 157920 - DNA, 39 bp, Artificial Sequence
  Description of Artificial Sequence: Synthetic oligonucleotide
tttctccttcatcgctggtgctccaaaaaaaaaatgctg

SEQ ID NO: 157921 - DNA, 38 bp, Artificial Sequence
  Description of Artificial Sequence: Synthetic oligonucleotide
ttctccttcatcgctggtgctccaaaaaaaaaatgctg

SEQ ID NO: 157922 - DNA, 37 bp, Artificial Sequence
  Description of Artificial Sequence: Synthetic oligonucleotide
tctccttcatcgctggtgctccaaaaaaaaaatgctg

SEQ ID NO: 157923 - DNA, 36 bp, Artificial Sequence
  Description of Artificial Sequence: Synthetic oligonucleotide
ctccttcatcgctggtgctccaaaaaaaaaatgctg

SEQ ID NO: 157924 - DNA, 36 bp, Artificial Sequence
  Description of Artificial Sequence: Synthetic oligonucleotide
tccttcatcgctggtgctccaaaaaaaaaatgctgc

SEQ ID NO: 157925 - DNA, 35 bp, Artificial Sequence
  Description of Artificial Sequence: Synthetic oligonucleotide
ccttcatcgctggtgctccaaaaaaaaaatgctgc

SEQ ID NO: 157926 - DNA, 36 bp, Artificial Sequence
  Description of Artificial Sequence: Synthetic oligonucleotide
cttcatcgctggtgctccaaaaaaaaaatgctgctg

SEQ ID NO: 157927 - DNA, 40 bp, Artificial Sequence
  Description of Artificial Sequence: Synthetic oligonucleotide
ttcatcgctggtgctccaaaaaaaaaatgctgctgtaatg

SEQ ID NO: 157928 - DNA, 39 bp, Artificial Sequence
  Description of Artificial Sequence: Synthetic oligonucleotide
tcatcgctggtgctccaaaaaaaaaatgctgctgtaatg

SEQ ID NO: 157929 - DNA, 38 bp, Artificial Sequence
  Description of Artificial Sequence: Synthetic oligonucleotide
catcgctggtgctccaaaaaaaaaatgctgctgtaatg

SEQ ID NO: 157930 - DNA, 40 bp, Artificial Sequence
  Description of Artificial Sequence: Synthetic oligonucleotide
atcgctggtgctccaaaaaaaaaatgctgctgtaatgaac

SEQ ID NO: 157931 - DNA, 39 bp, Artificial Sequence
  Description of Artificial Sequence: Synthetic oligonucleotide
tcgctggtgctccaaaaaaaaaatgctgctgtaatgaac

SEQ ID NO: 157932 - DNA, 38 bp, Artificial Sequence
  Description of Artificial Sequence: Synthetic oligonucleotide
cgctggtgctccaaaaaaaaaatgctgctgtaatgaac

SEQ ID NO: 157933 - DNA, 38 bp, Artificial Sequence
  Description of Artificial Sequence: Synthetic oligonucleotide
gctggtgctccaaaaaaaaaatgctgctgtaatgaacc

SEQ ID NO: 157934 - DNA, 40 bp, Artificial Sequence
  Description of Artificial Sequence: Synthetic oligonucleotide
ctggtgctccaaaaaaaaaatgctgctgtaatgaaccaag

SEQ ID NO: 157935 - DNA, 41 bp, Artificial Sequence
  Description of Artificial Sequence: Synthetic oligonucleotide
tggtgctccaaaaaaaaaatgctgctgtaatgaaccaagag

SEQ ID NO: 157936 - DNA, 40 bp, Artificial Sequence
  Description of Artificial Sequence: Synthetic oligonucleotide
ggtgctccaaaaaaaaaatgctgctgtaatgaaccaagag

SEQ ID NO: 157937 - DNA, 40 bp, Artificial Sequence
  Description of Artificial Sequence: Synthetic oligonucleotide
gtgctccaaaaaaaaaatgctgctgtaatgaaccaagagc

SEQ ID NO: 157938 - DNA, 40 bp, Artificial Sequence
  Description of Artificial Sequence: Synthetic oligonucleotide
tgctccaaaaaaaaaatgctgctgtaatgaaccaagagcc

SEQ ID NO: 157939 - DNA, 39 bp, Artificial Sequence
  Description of Artificial Sequence: Synthetic oligonucleotide
gctccaaaaaaaaaatgctgctgtaatgaaccaagagcc

SEQ ID NO: 157940 - DNA, 40 bp, Artificial Sequence
  Description of Artificial Sequence: Synthetic oligonucleotide
ctccaaaaaaaaaatgctgctgtaatgaaccaagagcctg

SEQ ID NO: 157941 - DNA, 40 bp, Artificial Sequence
  Description of Artificial Sequence: Synthetic oligonucleotide
tccaaaaaaaaaatgctgctgtaatgaaccaagagcctgc

SEQ ID NO: 157942 - DNA, 39 bp, Artificial Sequence
  Description of Artificial Sequence: Synthetic oligonucleotide
ccaaaaaaaaaatgctgctgtaatgaaccaagagcctgc

SEQ ID NO: 157943 - DNA, 39 bp, Artificial Sequence
  Description of Artificial Sequence: Synthetic oligonucleotide
caaaaaaaaaatgctgctgtaatgaaccaagagcctgcg

SEQ ID NO: 157944 - DNA, 34 bp, Artificial Sequence
  Description of Artificial Sequence: Synthetic oligonucleotide
gtgtgtatagaacttccaaatgctgagcccagtg

SEQ ID NO: 157945 - DNA, 34 bp, Artificial Sequence
  Description of Artificial Sequence: Synthetic oligonucleotide
tgtgtatagaacttccaaatgctgagcccagtgc

SEQ ID NO: 157946 - DNA, 33 bp, Artificial Sequence
  Description of Artificial Sequence: Synthetic oligonucleotide
gtgtatagaacttccaaatgctgagcccagtgc

SEQ ID NO: 157947 - DNA, 33 bp, Artificial Sequence
  Description of Artificial Sequence: Synthetic oligonucleotide
tgtatagaacttccaaatgctgagcccagtgcg

SEQ ID NO: 157948 - DNA, 32 bp, Artificial Sequence
  Description of Artificial Sequence: Synthetic oligonucleotide
gtatagaacttccaaatgctgagcccagtgcg

SEQ ID NO: 157949 - DNA, 34 bp, Artificial Sequence
  Description of Artificial Sequence: Synthetic oligonucleotide
tatagaacttccaaatgctgagcccagtgcgttg

SEQ ID NO: 157950 - DNA, 33 bp, Artificial Sequence
  Description of Artificial Sequence: Synthetic oligonucleotide
atagaacttccaaatgctgagcccagtgcgttg

SEQ ID NO: 157951 - DNA, 32 bp, Artificial Sequence
  Description of Artificial Sequence: Synthetic oligonucleotide
tagaacttccaaatgctgagcccagtgcgttg

SEQ ID NO: 157952 - DNA, 31 bp, Artificial Sequence
  Description of Artificial Sequence: Synthetic oligonucleotide
agaacttccaaatgctgagcccagtgcgttg

SEQ ID NO: 157953 - DNA, 30 bp, Artificial Sequence
  Description of Artificial Sequence: Synthetic oligonucleotide
gaacttccaaatgctgagcccagtgcgttg

SEQ ID NO: 157954 - DNA, 31 bp, Artificial Sequence
  Description of Artificial Sequence: Synthetic oligonucleotide
aacttccaaatgctgagcccagtgcgttgtc

SEQ ID NO: 157955 - DNA, 30 bp, Artificial Sequence
  Description of Artificial Sequence: Synthetic oligonucleotide
acttccaaatgctgagcccagtgcgttgtc

SEQ ID NO: 157956 - DNA, 29 bp, Artificial Sequence
  Description of Artificial Sequence: Synthetic oligonucleotide
cttccaaatgctgagcccagtgcgttgtc

SEQ ID NO: 157957 - DNA, 30 bp, Artificial Sequence
  Description of Artificial Sequence: Synthetic oligonucleotide
ttccaaatgctgagcccagtgcgttgtctc

SEQ ID NO: 157958 - DNA, 29 bp, Artificial Sequence
  Description of Artificial Sequence: Synthetic oligonucleotide
tccaaatgctgagcccagtgcgttgtctc

SEQ ID NO: 157959 - DNA, 28 bp, Artificial Sequence
  Description of Artificial Sequence: Synthetic oligonucleotide
ccaaatgctgagcccagtgcgttgtctc

SEQ ID NO: 157960 - DNA, 28 bp, Artificial Sequence
  Description of Artificial Sequence: Synthetic oligonucleotide
caaatgctgagcccagtgcgttgtctcc

SEQ ID NO: 157961 - DNA, 29 bp, Artificial Sequence
  Description of Artificial Sequence: Synthetic oligonucleotide
aaatgctgagcccagtgcgttgtctcctg

SEQ ID NO: 157962 - DNA, 28 bp, Artificial Sequence
  Description of Artificial Sequence: Synthetic oligonucleotide
aatgctgagcccagtgcgttgtctcctg

SEQ ID NO: 157963 - DNA, 27 bp, Artificial Sequence
  Description of Artificial Sequence: Synthetic oligonucleotide
atgctgagcccagtgcgttgtctcctg

SEQ ID NO: 157964 - DNA, 26 bp, Artificial Sequence
  Description of Artificial Sequence: Synthetic oligonucleotide
tgctgagcccagtgcgttgtctcctg

SEQ ID NO: 157965 - DNA, 25 bp, Artificial Sequence
  Description of Artificial Sequence: Synthetic oligonucleotide
gctgagcccagtgcgttgtctcctg

SEQ ID NO: 157966 - DNA, 25 bp, Artificial Sequence
  Description of Artificial Sequence: Synthetic oligonucleotide
ctgagcccagtgcgttgtctcctgc

SEQ ID NO: 157967 - DNA, 25 bp, Artificial Sequence
  Description of Artificial Sequence: Synthetic oligonucleotide
tgagcccagtgcgttgtctcctgcc

SEQ ID NO: 157968 - DNA, 24 bp, Artificial Sequence
  Description of Artificial Sequence: Synthetic oligonucleotide
gagcccagtgcgttgtctcctgcc

SEQ ID NO: 157969 - DNA, 26 bp, Artificial Sequence
  Description of Artificial Sequence: Synthetic oligonucleotide
agcccagtgcgttgtctcctgcccat

SEQ ID NO: 157970 - DNA, 25 bp, Artificial Sequence
  Description of Artificial Sequence: Synthetic oligonucleotide
gcccagtgcgttgtctcctgcccat

SEQ ID NO: 157971 - DNA, 26 bp, Artificial Sequence
  Description of Artificial Sequence: Synthetic oligonucleotide
cccagtgcgttgtctcctgcccatga

SEQ ID NO: 157972 - DNA, 26 bp, Artificial Sequence
  Description of Artificial Sequence: Synthetic oligonucleotide
ccagtgcgttgtctcctgcccatgag

SEQ ID NO: 157973 - DNA, 27 bp, Artificial Sequence
  Description of Artificial Sequence: Synthetic oligonucleotide
cagtgcgttgtctcctgcccatgagca

SEQ ID NO: 157974 - DNA, 27 bp, Artificial Sequence
  Description of Artificial Sequence: Synthetic oligonucleotide
agtgcgttgtctcctgcccatgagcac

SEQ ID NO: 157975 - DNA, 26 bp, Artificial Sequence
  Description of Artificial Sequence: Synthetic oligonucleotide
gtgcgttgtctcctgcccatgagcac

SEQ ID NO: 157976 - DNA, 27 bp, Artificial Sequence
  Description of Artificial Sequence: Synthetic oligonucleotide
tgcgttgtctcctgcccatgagcacca

SEQ ID NO: 157977 - DNA, 26 bp, Artificial Sequence
  Description of Artificial Sequence: Synthetic oligonucleotide
ccctgtctcaaacccagcttgccagc

SEQ ID NO: 157978 - DNA, 34 bp, Artificial Sequence
  Description of Artificial Sequence: Synthetic oligonucleotide
gtgtgtatagaacttccaaatgctgagcccagac

SEQ ID NO: 157979 - DNA, 34 bp, Artificial Sequence
  Description of Artificial Sequence: Synthetic oligonucleotide
tgtgtatagaacttccaaatgctgagcccagacc

SEQ ID NO: 157980 - DNA, 33 bp, Artificial Sequence
  Description of Artificial Sequence: Synthetic oligonucleotide
gtgtatagaacttccaaatgctgagcccagacc

SEQ ID NO: 157981 - DNA, 33 bp, Artificial Sequence
  Description of Artificial Sequence: Synthetic oligonucleotide
tgtatagaacttccaaatgctgagcccagaccg

SEQ ID NO: 157982 - DNA, 32 bp, Artificial Sequence
  Description of Artificial Sequence: Synthetic oligonucleotide
gtatagaacttccaaatgctgagcccagaccg

SEQ ID NO: 157983 - DNA, 34 bp, Artificial Sequence
  Description of Artificial Sequence: Synthetic oligonucleotide
tatagaacttccaaatgctgagcccagaccgttg

SEQ ID NO: 157984 - DNA, 33 bp, Artificial Sequence
  Description of Artificial Sequence: Synthetic oligonucleotide
atagaacttccaaatgctgagcccagaccgttg

SEQ ID NO: 157985 - DNA, 32 bp, Artificial Sequence
  Description of Artificial Sequence: Synthetic oligonucleotide
tagaacttccaaatgctgagcccagaccgttg

SEQ ID NO: 157986 - DNA, 31 bp, Artificial Sequence
  Description of Artificial Sequence: Synthetic oligonucleotide
agaacttccaaatgctgagcccagaccgttg

SEQ ID NO: 157987 - DNA, 30 bp, Artificial Sequence
  Description of Artificial Sequence: Synthetic oligonucleotide
gaacttccaaatgctgagcccagaccgttg

SEQ ID NO: 157988 - DNA, 31 bp, Artificial Sequence
  Description of Artificial Sequence: Synthetic oligonucleotide
aacttccaaatgctgagcccagaccgttgtc

SEQ ID NO: 157989 - DNA, 30 bp, Artificial Sequence
  Description of Artificial Sequence: Synthetic oligonucleotide
acttccaaatgctgagcccagaccgttgtc

SEQ ID NO: 157990 - DNA, 29 bp, Artificial Sequence
  Description of Artificial Sequence: Synthetic oligonucleotide
cttccaaatgctgagcccagaccgttgtc

SEQ ID NO: 157991 - DNA, 30 bp, Artificial Sequence
  Description of Artificial Sequence: Synthetic oligonucleotide
ttccaaatgctgagcccagaccgttgtctc

SEQ ID NO: 157992 - DNA, 29 bp, Artificial Sequence
  Description of Artificial Sequence: Synthetic oligonucleotide
tccaaatgctgagcccagaccgttgtctc

SEQ ID NO: 157993 - DNA, 28 bp, Artificial Sequence
  Description of Artificial Sequence: Synthetic oligonucleotide
ccaaatgctgagcccagaccgttgtctc

SEQ ID NO: 157994 - DNA, 28 bp, Artificial Sequence
  Description of Artificial Sequence: Synthetic oligonucleotide
caaatgctgagcccagaccgttgtctcc

SEQ ID NO: 157995 - DNA, 29 bp, Artificial Sequence
  Description of Artificial Sequence: Synthetic oligonucleotide
aaatgctgagcccagaccgttgtctcctg

SEQ ID NO: 157996 - DNA, 28 bp, Artificial Sequence
  Description of Artificial Sequence: Synthetic oligonucleotide
aatgctgagcccagaccgttgtctcctg

SEQ ID NO: 157997 - DNA, 27 bp, Artificial Sequence
  Description of Artificial Sequence: Synthetic oligonucleotide
atgctgagcccagaccgttgtctcctg

SEQ ID NO: 157998 - DNA, 26 bp, Artificial Sequence
  Description of Artificial Sequence: Synthetic oligonucleotide
tgctgagcccagaccgttgtctcctg

SEQ ID NO: 157999 - DNA, 25 bp, Artificial Sequence
  Description of Artificial Sequence: Synthetic oligonucleotide
gctgagcccagaccgttgtctcctg

SEQ ID NO: 158000 - DNA, 25 bp, Artificial Sequence
  Description of Artificial Sequence: Synthetic oligonucleotide
ctgagcccagaccgttgtctcctgc

SEQ ID NO: 158001 - DNA, 25 bp, Artificial Sequence
  Description of Artificial Sequence: Synthetic oligonucleotide
tgagcccagaccgttgtctcctgcc

SEQ ID NO: 158002 - DNA, 24 bp, Artificial Sequence
  Description of Artificial Sequence: Synthetic oligonucleotide
gagcccagaccgttgtctcctgcc

SEQ ID NO: 158003 - DNA, 26 bp, Artificial Sequence
  Description of Artificial Sequence: Synthetic oligonucleotide
agcccagaccgttgtctcctgcccat

SEQ ID NO: 158004 - DNA, 25 bp, Artificial Sequence
  Description of Artificial Sequence: Synthetic oligonucleotide
gcccagaccgttgtctcctgcccat

SEQ ID NO: 158005 - DNA, 26 bp, Artificial Sequence
  Description of Artificial Sequence: Synthetic oligonucleotide
cccagaccgttgtctcctgcccatga

SEQ ID NO: 158006 - DNA, 26 bp, Artificial Sequence
  Description of Artificial Sequence: Synthetic oligonucleotide
ccagaccgttgtctcctgcccatgag

SEQ ID NO: 158007 - DNA, 27 bp, Artificial Sequence
  Description of Artificial Sequence: Synthetic oligonucleotide
cagaccgttgtctcctgcccatgagca

SEQ ID NO: 158008 - DNA, 27 bp, Artificial Sequence
  Description of Artificial Sequence: Synthetic oligonucleotide
agaccgttgtctcctgcccatgagcac

SEQ ID NO: 158009 - DNA, 26 bp, Artificial Sequence
  Description of Artificial Sequence: Synthetic oligonucleotide
gaccgttgtctcctgcccatgagcac

SEQ ID NO: 158010 - DNA, 27 bp, Artificial Sequence
  Description of Artificial Sequence: Synthetic oligonucleotide
accgttgtctcctgcccatgagcacca

SEQ ID NO: 158011 - DNA, 26 bp, Artificial Sequence
  Description of Artificial Sequence: Synthetic oligonucleotide
ccgttgtctcctgcccatgagcacca

SEQ ID NO: 158012 - DNA, 31 bp, Artificial Sequence
  Description of Artificial Sequence: Synthetic oligonucleotide
gagacaacagccctgtctcaaacccagtttg

SEQ ID NO: 158013 - DNA, 31 bp, Artificial Sequence
  Description of Artificial Sequence: Synthetic oligonucleotide
agacaacagccctgtctcaaacccagtttgc

SEQ ID NO: 158014 - DNA, 30 bp, Artificial Sequence
  Description of Artificial Sequence: Synthetic oligonucleotide
gacaacagccctgtctcaaacccagtttgc

SEQ ID NO: 158015 - DNA, 30 bp, Artificial Sequence
  Description of Artificial Sequence: Synthetic oligonucleotide
acaacagccctgtctcaaacccagtttgcc

SEQ ID NO: 158016 - DNA, 29 bp, Artificial Sequence
  Description of Artificial Sequence: Synthetic oligonucleotide
caacagccctgtctcaaacccagtttgcc

SEQ ID NO: 158017 - DNA, 30 bp, Artificial Sequence
  Description of Artificial Sequence: Synthetic oligonucleotide
aacagccctgtctcaaacccagtttgccag

SEQ ID NO: 158018 - DNA, 29 bp, Artificial Sequence
  Description of Artificial Sequence: Synthetic oligonucleotide
acagccctgtctcaaacccagtttgccag

SEQ ID NO: 158019 - DNA, 28 bp, Artificial Sequence
  Description of Artificial Sequence: Synthetic oligonucleotide
cagccctgtctcaaacccagtttgccag

SEQ ID NO: 158020 - DNA, 28 bp, Artificial Sequence
  Description of Artificial Sequence: Synthetic oligonucleotide
agccctgtctcaaacccagtttgccagc

SEQ ID NO: 158021 - DNA, 27 bp, Artificial Sequence
  Description of Artificial Sequence: Synthetic oligonucleotide
gccctgtctcaaacccagtttgccagc

SEQ ID NO: 158022 - DNA, 28 bp, Artificial Sequence
  Description of Artificial Sequence: Synthetic oligonucleotide
ccctgtctcaaacccagtttgccagctc

SEQ ID NO: 158023 - DNA, 32 bp, Artificial Sequence
  Description of Artificial Sequence: Synthetic oligonucleotide
cctgtctcaaacccagtttgccagctctaatg

SEQ ID NO: 158024 - DNA, 34 bp, Artificial Sequence
  Description of Artificial Sequence: Synthetic oligonucleotide
ctgtctcaaacccagtttgccagctctaatgtac

SEQ ID NO: 158025 - DNA, 34 bp, Artificial Sequence
  Description of Artificial Sequence: Synthetic oligonucleotide
tgtctcaaacccagtttgccagctctaatgtacc

SEQ ID NO: 158026 - DNA, 33 bp, Artificial Sequence
  Description of Artificial Sequence: Synthetic oligonucleotide
gtctcaaacccagtttgccagctctaatgtacc

SEQ ID NO: 158027 - DNA, 34 bp, Artificial Sequence
  Description of Artificial Sequence: Synthetic oligonucleotide
tctcaaacccagtttgccagctctaatgtaccag

SEQ ID NO: 158028 - DNA, 33 bp, Artificial Sequence
  Description of Artificial Sequence: Synthetic oligonucleotide
ctcaaacccagtttgccagctctaatgtaccag

SEQ ID NO: 158029 - DNA, 33 bp, Artificial Sequence
  Description of Artificial Sequence: Synthetic oligonucleotide
tcaaacccagtttgccagctctaatgtaccagc

SEQ ID NO: 158030 - DNA, 32 bp, Artificial Sequence
  Description of Artificial Sequence: Synthetic oligonucleotide
caaacccagtttgccagctctaatgtaccagc

SEQ ID NO: 158031 - DNA, 33 bp, Artificial Sequence
  Description of Artificial Sequence: Synthetic oligonucleotide
aaacccagtttgccagctctaatgtaccagcag

SEQ ID NO: 158032 - DNA, 32 bp, Artificial Sequence
  Description of Artificial Sequence: Synthetic oligonucleotide
aacccagtttgccagctctaatgtaccagcag

SEQ ID NO: 158033 - DNA, 31 bp, Artificial Sequence
  Description of Artificial Sequence: Synthetic oligonucleotide
acccagtttgccagctctaatgtaccagcag

SEQ ID NO: 158034 - DNA, 30 bp, Artificial Sequence
  Description of Artificial Sequence: Synthetic oligonucleotide
cccagtttgccagctctaatgtaccagcag

SEQ ID NO: 158035 - DNA, 30 bp, Artificial Sequence
  Description of Artificial Sequence: Synthetic oligonucleotide
ccagtttgccagctctaatgtaccagcagc

SEQ ID NO: 158036 - DNA, 31 bp, Artificial Sequence
  Description of Artificial Sequence: Synthetic oligonucleotide
cagtttgccagctctaatgtaccagcagctg

SEQ ID NO: 158037 - DNA, 31 bp, Artificial Sequence
  Description of Artificial Sequence: Synthetic oligonucleotide
agtttgccagctctaatgtaccagcagctgg

SEQ ID NO: 158038 - DNA, 30 bp, Artificial Sequence
  Description of Artificial Sequence: Synthetic oligonucleotide
gtttgccagctctaatgtaccagcagctgg

SEQ ID NO: 158039 - DNA, 33 bp, Artificial Sequence
  Description of Artificial Sequence: Synthetic oligonucleotide
tttgccagctctaatgtaccagcagctggaatc

SEQ ID NO: 158040 - DNA, 31 bp, Artificial Sequence
  Description of Artificial Sequence: Synthetic oligonucleotide
atcaatggaacattccaggccgacttccctg

SEQ ID NO: 158041 - DNA, 30 bp, Artificial Sequence
  Description of Artificial Sequence: Synthetic oligonucleotide
tcaatggaacattccaggccgacttccctg

SEQ ID NO: 158042 - DNA, 29 bp, Artificial Sequence
  Description of Artificial Sequence: Synthetic oligonucleotide
caatggaacattccaggccgacttccctg

SEQ ID NO: 158043 - DNA, 30 bp, Artificial Sequence
  Description of Artificial Sequence: Synthetic oligonucleotide
aatggaacattccaggccgacttccctgtg

SEQ ID NO: 158044 - DNA, 29 bp, Artificial Sequence
  Description of Artificial Sequence: Synthetic oligonucleotide
atggaacattccaggccgacttccctgtg

SEQ ID NO: 158045 - DNA, 28 bp, Artificial Sequence
  Description of Artificial Sequence: Synthetic oligonucleotide
tggaacattccaggccgacttccctgtg

SEQ ID NO: 158046 - DNA, 27 bp, Artificial Sequence
  Description of Artificial Sequence: Synthetic oligonucleotide
ggaacattccaggccgacttccctgtg

SEQ ID NO: 158047 - DNA, 27 bp, Artificial Sequence
  Description of Artificial Sequence: Synthetic oligonucleotide
gaacattccaggccgacttccctgtgg

SEQ ID NO: 158048 - DNA, 27 bp, Artificial Sequence
  Description of Artificial Sequence: Synthetic oligonucleotide
aacattccaggccgacttccctgtggg

SEQ ID NO: 158049 - DNA, 27 bp, Artificial Sequence
  Description of Artificial Sequence: Synthetic oligonucleotide
acattccaggccgacttccctgtgggt

SEQ ID NO: 158050 - DNA, 26 bp, Artificial Sequence
  Description of Artificial Sequence: Synthetic oligonucleotide
cattccaggccgacttccctgtgggt

SEQ ID NO: 158051 - DNA, 26 bp, Artificial Sequence
  Description of Artificial Sequence: Synthetic oligonucleotide
attccaggccgacttccctgtgggtc

SEQ ID NO: 158052 - DNA, 25 bp, Artificial Sequence
  Description of Artificial Sequence: Synthetic oligonucleotide
ttccaggccgacttccctgtgggtc

SEQ ID NO: 158053 - DNA, 24 bp, Artificial Sequence
  Description of Artificial Sequence: Synthetic oligonucleotide
tccaggccgacttccctgtgggtc

SEQ ID NO: 158054 - DNA, 23 bp, Artificial Sequence
  Description of Artificial Sequence: Synthetic oligonucleotide
ccaggccgacttccctgtgggtc

SEQ ID NO: 158055 - DNA, 24 bp, Artificial Sequence
  Description of Artificial Sequence: Synthetic oligonucleotide
caggccgacttccctgtgggtcct

SEQ ID NO: 158056 - DNA, 24 bp, Artificial Sequence
  Description of Artificial Sequence: Synthetic oligonucleotide
aggccgacttccctgtgggtcctg

SEQ ID NO: 158057 - DNA, 23 bp, Artificial Sequence
  Description of Artificial Sequence: Synthetic oligonucleotide
ggccgacttccctgtgggtcctg

SEQ ID NO: 158058 - DNA, 23 bp, Artificial Sequence
  Description of Artificial Sequence: Synthetic oligonucleotide
gccgacttccctgtgggtcctgc

SEQ ID NO: 158059 - DNA, 24 bp, Artificial Sequence
  Description of Artificial Sequence: Synthetic oligonucleotide
ccgacttccctgtgggtcctgcca

SEQ ID NO: 158060 - DNA, 24 bp, Artificial Sequence
  Description of Artificial Sequence: Synthetic oligonucleotide
cgacttccctgtgggtcctgccac

SEQ ID NO: 158061 - DNA, 24 bp, Artificial Sequence
  Description of Artificial Sequence: Synthetic oligonucleotide
gacttccctgtgggtcctgccacc

SEQ ID NO: 158062 - DNA, 25 bp, Artificial Sequence
  Description of Artificial Sequence: Synthetic oligonucleotide
acttccctgtgggtcctgccaccca

SEQ ID NO: 158063 - DNA, 24 bp, Artificial Sequence
  Description of Artificial Sequence: Synthetic oligonucleotide
cttccctgtgggtcctgccaccca

SEQ ID NO: 158064 - DNA, 24 bp, Artificial Sequence
  Description of Artificial Sequence: Synthetic oligonucleotide
ttccctgtgggtcctgccacccac

SEQ ID NO: 158065 - DNA, 23 bp, Artificial Sequence
  Description of Artificial Sequence: Synthetic oligonucleotide
tccctgtgggtcctgccacccac

SEQ ID NO: 158066 - DNA, 22 bp, Artificial Sequence
  Description of Artificial Sequence: Synthetic oligonucleotide
ccctgtgggtcctgccacccac

SEQ ID NO: 158067 - DNA, 22 bp, Artificial Sequence
  Description of Artificial Sequence: Synthetic oligonucleotide
cctgtgggtcctgccacccacg

SEQ ID NO: 158068 - DNA, 23 bp, Artificial Sequence
  Description of Artificial Sequence: Synthetic oligonucleotide
ctgtgggtcctgccacccacgga

SEQ ID NO: 158069 - DNA, 24 bp, Artificial Sequence
  Description of Artificial Sequence: Synthetic oligonucleotide
tgtgggtcctgccacccacggaga

SEQ ID NO: 158070 - DNA, 23 bp, Artificial Sequence
  Description of Artificial Sequence: Synthetic oligonucleotide
gtgggtcctgccacccacggaga

SEQ ID NO: 158071 - DNA, 27 bp, Artificial Sequence
  Description of Artificial Sequence: Synthetic oligonucleotide
gggggaagcccatgaacttaggctcca

SEQ ID NO: 158072 - DNA, 28 bp, Artificial Sequence
  Description of Artificial Sequence: Synthetic oligonucleotide
ggggaagcccatgaacttaggctccatg

SEQ ID NO: 158073 - DNA, 28 bp, Artificial Sequence
  Description of Artificial Sequence: Synthetic oligonucleotide
gggaagcccatgaacttaggctccatgc

SEQ ID NO: 158074 - DNA, 29 bp, Artificial Sequence
  Description of Artificial Sequence: Synthetic oligonucleotide
ggaagcccatgaacttaggctccatgcag

SEQ ID NO: 158075 - DNA, 30 bp, Artificial Sequence
  Description of Artificial Sequence: Synthetic oligonucleotide
gaagcccatgaacttaggctccatgcagtg

SEQ ID NO: 158076 - DNA, 30 bp, Artificial Sequence
  Description of Artificial Sequence: Synthetic oligonucleotide
aagcccatgaacttaggctccatgcagtgc

SEQ ID NO: 158077 - DNA, 29 bp, Artificial Sequence
  Description of Artificial Sequence: Synthetic oligonucleotide
agcccatgaacttaggctccatgcagtgc

SEQ ID NO: 158078 - DNA, 28 bp, Artificial Sequence
  Description of Artificial Sequence: Synthetic oligonucleotide
gcccatgaacttaggctccatgcagtgc

SEQ ID NO: 158079 - DNA, 28 bp, Artificial Sequence
  Description of Artificial Sequence: Synthetic oligonucleotide
cccatgaacttaggctccatgcagtgcc

SEQ ID NO: 158080 - DNA, 28 bp, Artificial Sequence
  Description of Artificial Sequence: Synthetic oligonucleotide
ccatgaacttaggctccatgcagtgccc

SEQ ID NO: 158081 - DNA, 29 bp, Artificial Sequence
  Description of Artificial Sequence: Synthetic oligonucleotide
catgaacttaggctccatgcagtgcccag

SEQ ID NO: 158082 - DNA, 29 bp, Artificial Sequence
  Description of Artificial Sequence: Synthetic oligonucleotide
atgaacttaggctccatgcagtgcccagc

SEQ ID NO: 158083 - DNA, 28 bp, Artificial Sequence
  Description of Artificial Sequence: Synthetic oligonucleotide
tgaacttaggctccatgcagtgcccagc

SEQ ID NO: 158084 - DNA, 27 bp, Artificial Sequence
  Description of Artificial Sequence: Synthetic oligonucleotide
gaacttaggctccatgcagtgcccagc

SEQ ID NO: 158085 - DNA, 29 bp, Artificial Sequence
  Description of Artificial Sequence: Synthetic oligonucleotide
aacttaggctccatgcagtgcccagcatc

SEQ ID NO: 158086 - DNA, 28 bp, Artificial Sequence
  Description of Artificial Sequence: Synthetic oligonucleotide
acttaggctccatgcagtgcccagcatc

SEQ ID NO: 158087 - DNA, 27 bp, Artificial Sequence
  Description of Artificial Sequence: Synthetic oligonucleotide
cttaggctccatgcagtgcccagcatc

SEQ ID NO: 158088 - DNA, 30 bp, Artificial Sequence
  Description of Artificial Sequence: Synthetic oligonucleotide
ttaggctccatgcagtgcccagcatcaatg

SEQ ID NO: 158089 - DNA, 29 bp, Artificial Sequence
  Description of Artificial Sequence: Synthetic oligonucleotide
taggctccatgcagtgcccagcatcaatg

SEQ ID NO: 158090 - DNA, 28 bp, Artificial Sequence
  Description of Artificial Sequence: Synthetic oligonucleotide
aggctccatgcagtgcccagcatcaatg

SEQ ID NO: 158091 - DNA, 27 bp, Artificial Sequence
  Description of Artificial Sequence: Synthetic oligonucleotide
ggctccatgcagtgcccagcatcaatg

SEQ ID NO: 158092 - DNA, 27 bp, Artificial Sequence
  Description of Artificial Sequence: Synthetic oligonucleotide
gctccatgcagtgcccagcatcaatgg

SEQ ID NO: 158093 - DNA, 29 bp, Artificial Sequence
  Description of Artificial Sequence: Synthetic oligonucleotide
ctccatgcagtgcccagcatcaatggaac

SEQ ID NO: 158094 - DNA, 32 bp, Artificial Sequence
  Description of Artificial Sequence: Synthetic oligonucleotide
tccatgcagtgcccagcatcaatggaacattc

SEQ ID NO: 158095 - DNA, 31 bp, Artificial Sequence
  Description of Artificial Sequence: Synthetic oligonucleotide
ccatgcagtgcccagcatcaatggaacattc

SEQ ID NO: 158096 - DNA, 31 bp, Artificial Sequence
  Description of Artificial Sequence: Synthetic oligonucleotide
catgcagtgcccagcatcaatggaacattcc

SEQ ID NO: 158097 - DNA, 32 bp, Artificial Sequence
  Description of Artificial Sequence: Synthetic oligonucleotide
atgcagtgcccagcatcaatggaacattccag

SEQ ID NO: 158098 - DNA, 31 bp, Artificial Sequence
  Description of Artificial Sequence: Synthetic oligonucleotide
aacagggaggactctgatgaacaagaccctg

SEQ ID NO: 158099 - DNA, 30 bp, Artificial Sequence
  Description of Artificial Sequence: Synthetic oligonucleotide
acagggaggactctgatgaacaagaccctg

SEQ ID NO: 158100 - DNA, 29 bp, Artificial Sequence
  Description of Artificial Sequence: Synthetic oligonucleotide
cagggaggactctgatgaacaagaccctg

SEQ ID NO: 158101 - DNA, 30 bp, Artificial Sequence
  Description of Artificial Sequence: Synthetic oligonucleotide
agggaggactctgatgaacaagaccctgag

SEQ ID NO: 158102 - DNA, 29 bp, Artificial Sequence
  Description of Artificial Sequence: Synthetic oligonucleotide
gggaggactctgatgaacaagaccctgag

SEQ ID NO: 158103 - DNA, 29 bp, Artificial Sequence
  Description of Artificial Sequence: Synthetic oligonucleotide
ggaggactctgatgaacaagaccctgagg

SEQ ID NO: 158104 - DNA, 30 bp, Artificial Sequence
  Description of Artificial Sequence: Synthetic oligonucleotide
gaggactctgatgaacaagaccctgaggag

SEQ ID NO: 158105 - DNA, 30 bp, Artificial Sequence
  Description of Artificial Sequence: Synthetic oligonucleotide
aggactctgatgaacaagaccctgaggagg

SEQ ID NO: 158106 - DNA, 29 bp, Artificial Sequence
  Description of Artificial Sequence: Synthetic oligonucleotide
ggactctgatgaacaagaccctgaggagg

SEQ ID NO: 158107 - DNA, 30 bp, Artificial Sequence
  Description of Artificial Sequence: Synthetic oligonucleotide
gactctgatgaacaagaccctgaggaggtg

SEQ ID NO: 158108 - DNA, 31 bp, Artificial Sequence
  Description of Artificial Sequence: Synthetic oligonucleotide
actctgatgaacaagaccctgaggaggtgac

SEQ ID NO: 158109 - DNA, 30 bp, Artificial Sequence
  Description of Artificial Sequence: Synthetic oligonucleotide
ctctgatgaacaagaccctgaggaggtgac

SEQ ID NO: 158110 - DNA, 33 bp, Artificial Sequence
  Description of Artificial Sequence: Synthetic oligonucleotide
tctgatgaacaagaccctgaggaggtgacatac

SEQ ID NO: 158111 - DNA, 32 bp, Artificial Sequence
  Description of Artificial Sequence: Synthetic oligonucleotide
ctgatgaacaagaccctgaggaggtgacatac

SEQ ID NO: 158112 - DNA, 32 bp, Artificial Sequence
  Description of Artificial Sequence: Synthetic oligonucleotide
tgatgaacaagaccctgaggaggtgacatacg

SEQ ID NO: 158113 - DNA, 31 bp, Artificial Sequence
  Description of Artificial Sequence: Synthetic oligonucleotide
gatgaacaagaccctgaggaggtgacatacg

SEQ ID NO: 158114 - DNA, 31 bp, Artificial Sequence
  Description of Artificial Sequence: Synthetic oligonucleotide
atgaacaagaccctgaggaggtgacatacgc

SEQ ID NO: 158115 - DNA, 30 bp, Artificial Sequence
  Description of Artificial Sequence: Synthetic oligonucleotide
tgaacaagaccctgaggaggtgacatacgc

SEQ ID NO: 158116 - DNA, 29 bp, Artificial Sequence
  Description of Artificial Sequence: Synthetic oligonucleotide
gaacaagaccctgaggaggtgacatacgc

SEQ ID NO: 158117 - DNA, 30 bp, Artificial Sequence
  Description of Artificial Sequence: Synthetic oligonucleotide
aacaagaccctgaggaggtgacatacgcac

SEQ ID NO: 158118 - DNA, 29 bp, Artificial Sequence
  Description of Artificial Sequence: Synthetic oligonucleotide
acaagaccctgaggaggtgacatacgcac

SEQ ID NO: 158119 - DNA, 28 bp, Artificial Sequence
  Description of Artificial Sequence: Synthetic oligonucleotide
caagaccctgaggaggtgacatacgcac

SEQ ID NO: 158120 - DNA, 29 bp, Artificial Sequence
  Description of Artificial Sequence: Synthetic oligonucleotide
aagaccctgaggaggtgacatacgcacag

SEQ ID NO: 158121 - DNA, 28 bp, Artificial Sequence
  Description of Artificial Sequence: Synthetic oligonucleotide
agaccctgaggaggtgacatacgcacag

SEQ ID NO: 158122 - DNA, 27 bp, Artificial Sequence
  Description of Artificial Sequence: Synthetic oligonucleotide
gaccctgaggaggtgacatacgcacag

SEQ ID NO: 158123 - DNA, 29 bp, Artificial Sequence
  Description of Artificial Sequence: Synthetic oligonucleotide
accctgaggaggtgacatacgcacagttg

SEQ ID NO: 158124 - DNA, 28 bp, Artificial Sequence
  Description of Artificial Sequence: Synthetic oligonucleotide
ccctgaggaggtgacatacgcacagttg

SEQ ID NO: 158125 - DNA, 28 bp, Artificial Sequence
  Description of Artificial Sequence: Synthetic oligonucleotide
cctgaggaggtgacatacgcacagttgg

SEQ ID NO: 158126 - DNA, 30 bp, Artificial Sequence
  Description of Artificial Sequence: Synthetic oligonucleotide
ctgaggaggtgacatacgcacagttggatc

SEQ ID NO: 158127 - DNA, 31 bp, Artificial Sequence
  Description of Artificial Sequence: Synthetic oligonucleotide
tgaggaggtgacatacgcacagttggatcac

SEQ ID NO: 158128 - DNA, 30 bp, Artificial Sequence
  Description of Artificial Sequence: Synthetic oligonucleotide
gaggaggtgacatacgcacagttggatcac

SEQ ID NO: 158129 - DNA, 25 bp, Artificial Sequence
  Description of Artificial Sequence: Synthetic oligonucleotide
cccagcgctgtggtgcctcaaggaa

SEQ ID NO: 158130 - DNA, 26 bp, Artificial Sequence
  Description of Artificial Sequence: Synthetic oligonucleotide
ccagcgctgtggtgcctcaaggaaga

SEQ ID NO: 158131 - DNA, 27 bp, Artificial Sequence
  Description of Artificial Sequence: Synthetic oligonucleotide
cagcgctgtggtgcctcaaggaagaca

SEQ ID NO: 158132 - DNA, 27 bp, Artificial Sequence
  Description of Artificial Sequence: Synthetic oligonucleotide
agcgctgtggtgcctcaaggaagacac

SEQ ID NO: 158133 - DNA, 26 bp, Artificial Sequence
  Description of Artificial Sequence: Synthetic oligonucleotide
gcgctgtggtgcctcaaggaagacac

SEQ ID NO: 158134 - DNA, 27 bp, Artificial Sequence
  Description of Artificial Sequence: Synthetic oligonucleotide
cgctgtggtgcctcaaggaagacacgt

SEQ ID NO: 158135 - DNA, 27 bp, Artificial Sequence
  Description of Artificial Sequence: Synthetic oligonucleotide
gctgtggtgcctcaaggaagacacgtg

SEQ ID NO: 158136 - DNA, 28 bp, Artificial Sequence
  Description of Artificial Sequence: Synthetic oligonucleotide
ctgtggtgcctcaaggaagacacgtgac

SEQ ID NO: 158137 - DNA, 29 bp, Artificial Sequence
  Description of Artificial Sequence: Synthetic oligonucleotide
tgtggtgcctcaaggaagacacgtgactc

SEQ ID NO: 158138 - DNA, 28 bp, Artificial Sequence
  Description of Artificial Sequence: Synthetic oligonucleotide
gtggtgcctcaaggaagacacgtgactc

SEQ ID NO: 158139 - DNA, 30 bp, Artificial Sequence
  Description of Artificial Sequence: Synthetic oligonucleotide
tggtgcctcaaggaagacacgtgactcttc

SEQ ID NO: 158140 - DNA, 29 bp, Artificial Sequence
  Description of Artificial Sequence: Synthetic oligonucleotide
ggtgcctcaaggaagacacgtgactcttc

SEQ ID NO: 158141 - DNA, 29 bp, Artificial Sequence
  Description of Artificial Sequence: Synthetic oligonucleotide
gtgcctcaaggaagacacgtgactcttcg

SEQ ID NO: 158142 - DNA, 29 bp, Artificial Sequence
  Description of Artificial Sequence: Synthetic oligonucleotide
tgcctcaaggaagacacgtgactcttcgg

SEQ ID NO: 158143 - DNA, 28 bp, Artificial Sequence
  Description of Artificial Sequence: Synthetic oligonucleotide
gcctcaaggaagacacgtgactcttcgg

SEQ ID NO: 158144 - DNA, 29 bp, Artificial Sequence
  Description of Artificial Sequence: Synthetic oligonucleotide
cctcaaggaagacacgtgactcttcggtg

SEQ ID NO: 158145 - DNA, 30 bp, Artificial Sequence
  Description of Artificial Sequence: Synthetic oligonucleotide
ctcaaggaagacacgtgactcttcggtgtc

SEQ ID NO: 158146 - DNA, 31 bp, Artificial Sequence
  Description of Artificial Sequence: Synthetic oligonucleotide
tcaaggaagacacgtgactcttcggtgtcac

SEQ ID NO: 158147 - DNA, 30 bp, Artificial Sequence
  Description of Artificial Sequence: Synthetic oligonucleotide
caaggaagacacgtgactcttcggtgtcac

SEQ ID NO: 158148 - DNA, 33 bp, Artificial Sequence
  Description of Artificial Sequence: Synthetic oligonucleotide
aaggaagacacgtgactcttcggtgtcactatc

SEQ ID NO: 158149 - DNA, 32 bp, Artificial Sequence
  Description of Artificial Sequence: Synthetic oligonucleotide
aggaagacacgtgactcttcggtgtcactatc

SEQ ID NO: 158150 - DNA, 31 bp, Artificial Sequence
  Description of Artificial Sequence: Synthetic oligonucleotide
ggaagacacgtgactcttcggtgtcactatc

SEQ ID NO: 158151 - DNA, 31 bp, Artificial Sequence
  Description of Artificial Sequence: Synthetic oligonucleotide
gaagacacgtgactcttcggtgtcactatcg

SEQ ID NO: 158152 - DNA, 32 bp, Artificial Sequence
  Description of Artificial Sequence: Synthetic oligonucleotide
aagacacgtgactcttcggtgtcactatcgtc

SEQ ID NO: 158153 - DNA, 31 bp, Artificial Sequence
  Description of Artificial Sequence: Synthetic oligonucleotide
agacacgtgactcttcggtgtcactatcgtc

SEQ ID NO: 158154 - DNA, 29 bp, Artificial Sequence
  Description of Artificial Sequence: Synthetic oligonucleotide
atgtcgctcatggtcatcagcatggcgtg

SEQ ID NO: 158155 - DNA, 28 bp, Artificial Sequence
  Description of Artificial Sequence: Synthetic oligonucleotide
tgtcgctcatggtcatcagcatggcgtg

SEQ ID NO: 158156 - DNA, 27 bp, Artificial Sequence
  Description of Artificial Sequence: Synthetic oligonucleotide
gtcgctcatggtcatcagcatggcgtg

SEQ ID NO: 158157 - DNA, 28 bp, Artificial Sequence
  Description of Artificial Sequence: Synthetic oligonucleotide
tcgctcatggtcatcagcatggcgtgtg

SEQ ID NO: 158158 - DNA, 27 bp, Artificial Sequence
  Description of Artificial Sequence: Synthetic oligonucleotide
cgctcatggtcatcagcatggcgtgtg

SEQ ID NO: 158159 - DNA, 29 bp, Artificial Sequence
  Description of Artificial Sequence: Synthetic oligonucleotide
gctcatggtcatcagcatggcgtgtgttg

SEQ ID NO: 158160 - DNA, 29 bp, Artificial Sequence
  Description of Artificial Sequence: Synthetic oligonucleotide
ctcatggtcatcagcatggcgtgtgttgg

SEQ ID NO: 158161 - DNA, 29 bp, Artificial Sequence
  Description of Artificial Sequence: Synthetic oligonucleotide
tcatggtcatcagcatggcgtgtgttggg

SEQ ID NO: 158162 - DNA, 28 bp, Artificial Sequence
  Description of Artificial Sequence: Synthetic oligonucleotide
catggtcatcagcatggcgtgtgttggg

SEQ ID NO: 158163 - DNA, 30 bp, Artificial Sequence
  Description of Artificial Sequence: Synthetic oligonucleotide
atggtcatcagcatggcgtgtgttgggttc

SEQ ID NO: 158164 - DNA, 29 bp, Artificial Sequence
  Description of Artificial Sequence: Synthetic oligonucleotide
tggtcatcagcatggcgtgtgttgggttc

SEQ ID NO: 158165 - DNA, 28 bp, Artificial Sequence
  Description of Artificial Sequence: Synthetic oligonucleotide
ggtcatcagcatggcgtgtgttgggttc

SEQ ID NO: 158166 - DNA, 30 bp, Artificial Sequence
  Description of Artificial Sequence: Synthetic oligonucleotide
gtcatcagcatggcgtgtgttgggttcttc

SEQ ID NO: 158167 - DNA, 32 bp, Artificial Sequence
  Description of Artificial Sequence: Synthetic oligonucleotide
tcatcagcatggcgtgtgttgggttcttcttg

SEQ ID NO: 158168 - DNA, 31 bp, Artificial Sequence
  Description of Artificial Sequence: Synthetic oligonucleotide
catcagcatggcgtgtgttgggttcttcttg

SEQ ID NO: 158169 - DNA, 31 bp, Artificial Sequence
  Description of Artificial Sequence: Synthetic oligonucleotide
atcagcatggcgtgtgttgggttcttcttgc

SEQ ID NO: 158170 - DNA, 26 bp, Artificial Sequence
  Description of Artificial Sequence: Synthetic oligonucleotide
gttcttcttgctgcagggggcctgga

SEQ ID NO: 158171 - DNA, 27 bp, Artificial Sequence
  Description of Artificial Sequence: Synthetic oligonucleotide
ttcttcttgctgcagggggcctggaca

SEQ ID NO: 158172 - DNA, 26 bp, Artificial Sequence
  Description of Artificial Sequence: Synthetic oligonucleotide
tcttcttgctgcagggggcctggaca

SEQ ID NO: 158173 - DNA, 25 bp, Artificial Sequence
  Description of Artificial Sequence: Synthetic oligonucleotide
cttcttgctgcagggggcctggaca

SEQ ID NO: 158174 - DNA, 27 bp, Artificial Sequence
  Description of Artificial Sequence: Synthetic oligonucleotide
ttcttgctgcagggggcctggacacat

SEQ ID NO: 158175 - DNA, 26 bp, Artificial Sequence
  Description of Artificial Sequence: Synthetic oligonucleotide
tcttgctgcagggggcctggacacat

SEQ ID NO: 158176 - DNA, 25 bp, Artificial Sequence
  Description of Artificial Sequence: Synthetic oligonucleotide
cttgctgcagggggcctggacacat

SEQ ID NO: 158177 - DNA, 26 bp, Artificial Sequence
  Description of Artificial Sequence: Synthetic oligonucleotide
ttgctgcagggggcctggacacatga

SEQ ID NO: 158178 - DNA, 25 bp, Artificial Sequence
  Description of Artificial Sequence: Synthetic oligonucleotide
tgctgcagggggcctggacacatga

SEQ ID NO: 158179 - DNA, 24 bp, Artificial Sequence
  Description of Artificial Sequence: Synthetic oligonucleotide
gctgcagggggcctggacacatga

SEQ ID NO: 158180 - DNA, 24 bp, Artificial Sequence
  Description of Artificial Sequence: Synthetic oligonucleotide
ctgcagggggcctggacacatgag

SEQ ID NO: 158181 - DNA, 24 bp, Artificial Sequence
  Description of Artificial Sequence: Synthetic oligonucleotide
tgcagggggcctggacacatgagg

SEQ ID NO: 158182 - DNA, 23 bp, Artificial Sequence
  Description of Artificial Sequence: Synthetic oligonucleotide
gcagggggcctggacacatgagg

SEQ ID NO: 158183 - DNA, 24 bp, Artificial Sequence
  Description of Artificial Sequence: Synthetic oligonucleotide
cagggggcctggacacatgagggt

SEQ ID NO: 158184 - DNA, 24 bp, Artificial Sequence
  Description of Artificial Sequence: Synthetic oligonucleotide
agggggcctggacacatgagggtg

SEQ ID NO: 158185 - DNA, 23 bp, Artificial Sequence
  Description of Artificial Sequence: Synthetic oligonucleotide
gggggcctggacacatgagggtg

SEQ ID NO: 158186 - DNA, 24 bp, Artificial Sequence
  Description of Artificial Sequence: Synthetic oligonucleotide
ggggcctggacacatgagggtggt

SEQ ID NO: 158187 - DNA, 25 bp, Artificial Sequence
  Description of Artificial Sequence: Synthetic oligonucleotide
gggcctggacacatgagggtggtca

SEQ ID NO: 158188 - DNA, 25 bp, Artificial Sequence
  Description of Artificial Sequence: Synthetic oligonucleotide
ggcctggacacatgagggtggtcag

SEQ ID NO: 158189 - DNA, 26 bp, Artificial Sequence
  Description of Artificial Sequence: Synthetic oligonucleotide
gcctggacacatgagggtggtcagga

SEQ ID NO: 158190 - DNA, 27 bp, Artificial Sequence
  Description of Artificial Sequence: Synthetic oligonucleotide
cctggacacatgagggtggtcaggaca

SEQ ID NO: 158191 - DNA, 28 bp, Artificial Sequence
  Description of Artificial Sequence: Synthetic oligonucleotide
ctggacacatgagggtggtcaggacaag

SEQ ID NO: 158192 - DNA, 28 bp, Artificial Sequence
  Description of Artificial Sequence: Synthetic oligonucleotide
tggacacatgagggtggtcaggacaagc

SEQ ID NO: 158193 - DNA, 27 bp, Artificial Sequence
  Description of Artificial Sequence: Synthetic oligonucleotide
ggacacatgagggtggtcaggacaagc

SEQ ID NO: 158194 - DNA, 27 bp, Artificial Sequence
  Description of Artificial Sequence: Synthetic oligonucleotide
gacacatgagggtggtcaggacaagcc

SEQ ID NO: 158195 - DNA, 27 bp, Artificial Sequence
  Description of Artificial Sequence: Synthetic oligonucleotide
acacatgagggtggtcaggacaagccc

SEQ ID NO: 158196 - DNA, 27 bp, Artificial Sequence
  Description of Artificial Sequence: Synthetic oligonucleotide
cacatgagggtggtcaggacaagccct

SEQ ID NO: 158197 - DNA, 28 bp, Artificial Sequence
  Description of Artificial Sequence: Synthetic oligonucleotide
acatgagggtggtcaggacaagcccttg

SEQ ID NO: 158198 - DNA, 27 bp, Artificial Sequence
  Description of Artificial Sequence: Synthetic oligonucleotide
catgagggtggtcaggacaagcccttg

SEQ ID NO: 158199 - DNA, 27 bp, Artificial Sequence
  Description of Artificial Sequence: Synthetic oligonucleotide
atgagggtggtcaggacaagcccttgc

SEQ ID NO: 158200 - DNA, 27 bp, Artificial Sequence
  Description of Artificial Sequence: Synthetic oligonucleotide
tgagggtggtcaggacaagcccttgct

SEQ ID NO: 158201 - DNA, 26 bp, Artificial Sequence
  Description of Artificial Sequence: Synthetic oligonucleotide
gagggtggtcaggacaagcccttgct

SEQ ID NO: 158202 - DNA, 27 bp, Artificial Sequence
  Description of Artificial Sequence: Synthetic oligonucleotide
agggtggtcaggacaagcccttgctgt

SEQ ID NO: 158203 - DNA, 26 bp, Artificial Sequence
  Description of Artificial Sequence: Synthetic oligonucleotide
gggtggtcaggacaagcccttgctgt

SEQ ID NO: 158204 - DNA, 27 bp, Artificial Sequence
  Description of Artificial Sequence: Synthetic oligonucleotide
ggtggtcaggacaagcccttgctgtct

SEQ ID NO: 158205 - DNA, 27 bp, Artificial Sequence
  Description of Artificial Sequence: Synthetic oligonucleotide
gtggtcaggacaagcccttgctgtctg

SEQ ID NO: 158206 - DNA, 27 bp, Artificial Sequence
  Description of Artificial Sequence: Synthetic oligonucleotide
tggtcaggacaagcccttgctgtctgc

SEQ ID NO: 158207 - DNA, 26 bp, Artificial Sequence
  Description of Artificial Sequence: Synthetic oligonucleotide
ggtcaggacaagcccttgctgtctgc

SEQ ID NO: 158208 - DNA, 27 bp, Artificial Sequence
  Description of Artificial Sequence: Synthetic oligonucleotide
gtcaggacaagcccttgctgtctgcct

SEQ ID NO: 158209 - DNA, 27 bp, Artificial Sequence
  Description of Artificial Sequence: Synthetic oligonucleotide
tcaggacaagcccttgctgtctgcctg

SEQ ID NO: 158210 - DNA, 26 bp, Artificial Sequence
  Description of Artificial Sequence: Synthetic oligonucleotide
caggacaagcccttgctgtctgcctg

SEQ ID NO: 158211 - DNA, 26 bp, Artificial Sequence
  Description of Artificial Sequence: Synthetic oligonucleotide
aggacaagcccttgctgtctgcctgg

SEQ ID NO: 158212 - DNA, 25 bp, Artificial Sequence
  Description of Artificial Sequence: Synthetic oligonucleotide
ggacaagcccttgctgtctgcctgg

SEQ ID NO: 158213 - DNA, 25 bp, Artificial Sequence
  Description of Artificial Sequence: Synthetic oligonucleotide
gacaagcccttgctgtctgcctggc

SEQ ID NO: 158214 - DNA, 25 bp, Artificial Sequence
  Description of Artificial Sequence: Synthetic oligonucleotide
acaagcccttgctgtctgcctggcc

SEQ ID NO: 158215 - DNA, 24 bp, Artificial Sequence
  Description of Artificial Sequence: Synthetic oligonucleotide
caagcccttgctgtctgcctggcc

SEQ ID NO: 158216 - DNA, 25 bp, Artificial Sequence
  Description of Artificial Sequence: Synthetic oligonucleotide
aagcccttgctgtctgcctggccca

SEQ ID NO: 158217 - DNA, 24 bp, Artificial Sequence
  Description of Artificial Sequence: Synthetic oligonucleotide
agcccttgctgtctgcctggccca

SEQ ID NO: 158218 - DNA, 23 bp, Artificial Sequence
  Description of Artificial Sequence: Synthetic oligonucleotide
gcccttgctgtctgcctggccca

SEQ ID NO: 158219 - DNA, 23 bp, Artificial Sequence
  Description of Artificial Sequence: Synthetic oligonucleotide
cccttgctgtctgcctggcccag

SEQ ID NO: 158220 - DNA, 23 bp, Artificial Sequence
  Description of Artificial Sequence: Synthetic oligonucleotide
ccttgctgtctgcctggcccagc

SEQ ID NO: 158221 - DNA, 23 bp, Artificial Sequence
  Description of Artificial Sequence: Synthetic oligonucleotide
cttgctgtctgcctggcccagcg

SEQ ID NO: 158222 - DNA, 24 bp, Artificial Sequence
  Description of Artificial Sequence: Synthetic oligonucleotide
ttgctgtctgcctggcccagcgct

SEQ ID NO: 158223 - DNA, 23 bp, Artificial Sequence
  Description of Artificial Sequence: Synthetic oligonucleotide
tgctgtctgcctggcccagcgct

SEQ ID NO: 158224 - DNA, 22 bp, Artificial Sequence
  Description of Artificial Sequence: Synthetic oligonucleotide
gctgtctgcctggcccagcgct

SEQ ID NO: 158225 - DNA, 23 bp, Artificial Sequence
  Description of Artificial Sequence: Synthetic oligonucleotide
ctgtctgcctggcccagcgctgt

SEQ ID NO: 158226 - DNA, 23 bp, Artificial Sequence
  Description of Artificial Sequence: Synthetic oligonucleotide
tgtctgcctggcccagcgctgtg

SEQ ID NO: 158227 - DNA, 22 bp, Artificial Sequence
  Description of Artificial Sequence: Synthetic oligonucleotide
gtctgcctggcccagcgctgtg

SEQ ID NO: 158228 - DNA, 22 bp, Artificial Sequence
  Description of Artificial Sequence: Synthetic oligonucleotide
tggcccagcgctgtggtgcctc

SEQ ID NO: 158229 - DNA, 21 bp, Artificial Sequence
  Description of Artificial Sequence: Synthetic oligonucleotide
ggcccagcgctgtggtgcctc

SEQ ID NO: 158230 - DNA, 22 bp, Artificial Sequence
  Description of Artificial Sequence: Synthetic oligonucleotide
gcccagcgctgtggtgcctcga

SEQ ID NO: 158231 - DNA, 22 bp, Artificial Sequence
  Description of Artificial Sequence: Synthetic oligonucleotide
cccagcgctgtggtgcctcgag

SEQ ID NO: 158232 - DNA, 23 bp, Artificial Sequence
  Description of Artificial Sequence: Synthetic oligonucleotide
ccagcgctgtggtgcctcgagga

SEQ ID NO: 158233 - DNA, 23 bp, Artificial Sequence
  Description of Artificial Sequence: Synthetic oligonucleotide
cagcgctgtggtgcctcgaggag

SEQ ID NO: 158234 - DNA, 24 bp, Artificial Sequence
  Description of Artificial Sequence: Synthetic oligonucleotide
agcgctgtggtgcctcgaggagga

SEQ ID NO: 158235 - DNA, 23 bp, Artificial Sequence
  Description of Artificial Sequence: Synthetic oligonucleotide
gcgctgtggtgcctcgaggagga

SEQ ID NO: 158236 - DNA, 25 bp, Artificial Sequence
  Description of Artificial Sequence: Synthetic oligonucleotide
cgctgtggtgcctcgaggaggacat

SEQ ID NO: 158237 - DNA, 26 bp, Artificial Sequence
  Description of Artificial Sequence: Synthetic oligonucleotide
gctgtggtgcctcgaggaggacatgt

SEQ ID NO: 158238 - DNA, 27 bp, Artificial Sequence
  Description of Artificial Sequence: Synthetic oligonucleotide
ctgtggtgcctcgaggaggacatgtga

SEQ ID NO: 158239 - DNA, 27 bp, Artificial Sequence
  Description of Artificial Sequence: Synthetic oligonucleotide
tgtggtgcctcgaggaggacatgtgac

SEQ ID NO: 158240 - DNA, 27 bp, Artificial Sequence
  Description of Artificial Sequence: Synthetic oligonucleotide
gtggtgcctcgaggaggacatgtgact

SEQ ID NO: 158241 - DNA, 27 bp, Artificial Sequence
  Description of Artificial Sequence: Synthetic oligonucleotide
tggtgcctcgaggaggacatgtgactc

SEQ ID NO: 158242 - DNA, 27 bp, Artificial Sequence
  Description of Artificial Sequence: Synthetic oligonucleotide
ggtgcctcgaggaggacatgtgactct

SEQ ID NO: 158243 - DNA, 28 bp, Artificial Sequence
  Description of Artificial Sequence: Synthetic oligonucleotide
gtgcctcgaggaggacatgtgactcttc

SEQ ID NO: 158244 - DNA, 29 bp, Artificial Sequence
  Description of Artificial Sequence: Synthetic oligonucleotide
tgcctcgaggaggacatgtgactcttctg

SEQ ID NO: 158245 - DNA, 28 bp, Artificial Sequence
  Description of Artificial Sequence: Synthetic oligonucleotide
gcctcgaggaggacatgtgactcttctg

SEQ ID NO: 158246 - DNA, 29 bp, Artificial Sequence
  Description of Artificial Sequence: Synthetic oligonucleotide
cctcgaggaggacatgtgactcttctgtg

SEQ ID NO: 158247 - DNA, 30 bp, Artificial Sequence
  Description of Artificial Sequence: Synthetic oligonucleotide
ctcgaggaggacatgtgactcttctgtgtc

SEQ ID NO: 158248 - DNA, 30 bp, Artificial Sequence
  Description of Artificial Sequence: Synthetic oligonucleotide
tcgaggaggacatgtgactcttctgtgtcg

SEQ ID NO: 158249 - DNA, 29 bp, Artificial Sequence
  Description of Artificial Sequence: Synthetic oligonucleotide
cgaggaggacatgtgactcttctgtgtcg

SEQ ID NO: 158250 - DNA, 29 bp, Artificial Sequence
  Description of Artificial Sequence: Synthetic oligonucleotide
gaggaggacatgtgactcttctgtgtcgc

SEQ ID NO: 158251 - DNA, 30 bp, Artificial Sequence
  Description of Artificial Sequence: Synthetic oligonucleotide
aggaggacatgtgactcttctgtgtcgctc

SEQ ID NO: 158252 - DNA, 29 bp, Artificial Sequence
  Description of Artificial Sequence: Synthetic oligonucleotide
ggaggacatgtgactcttctgtgtcgctc

SEQ ID NO: 158253 - DNA, 30 bp, Artificial Sequence
  Description of Artificial Sequence: Synthetic oligonucleotide
gaggacatgtgactcttctgtgtcgctctc

SEQ ID NO: 158254 - DNA, 30 bp, Artificial Sequence
  Description of Artificial Sequence: Synthetic oligonucleotide
aggacatgtgactcttctgtgtcgctctcg

SEQ ID NO: 158255 - DNA, 29 bp, Artificial Sequence
  Description of Artificial Sequence: Synthetic oligonucleotide
ggacatgtgactcttctgtgtcgctctcg

SEQ ID NO: 158256 - DNA, 30 bp, Artificial Sequence
  Description of Artificial Sequence: Synthetic oligonucleotide
gacatgtgactcttctgtgtcgctctcgtc

SEQ ID NO: 158257 - DNA, 32 bp, Artificial Sequence
  Description of Artificial Sequence: Synthetic oligonucleotide
acatgtgactcttctgtgtcgctctcgtcttg

SEQ ID NO: 158258 - DNA, 31 bp, Artificial Sequence
  Description of Artificial Sequence: Synthetic oligonucleotide
catgtgactcttctgtgtcgctctcgtcttg

SEQ ID NO: 158259 - DNA, 31 bp, Artificial Sequence
  Description of Artificial Sequence: Synthetic oligonucleotide
atgtgactcttctgtgtcgctctcgtcttgg

SEQ ID NO: 158260 - DNA, 30 bp, Artificial Sequence
  Description of Artificial Sequence: Synthetic oligonucleotide
tgtgactcttctgtgtcgctctcgtcttgg

SEQ ID NO: 158261 - DNA, 29 bp, Artificial Sequence
  Description of Artificial Sequence: Synthetic oligonucleotide
gtgactcttctgtgtcgctctcgtcttgg

SEQ ID NO: 158262 - DNA, 29 bp, Artificial Sequence
  Description of Artificial Sequence: Synthetic oligonucleotide
tgactcttctgtgtcgctctcgtcttggg

SEQ ID NO: 158263 - DNA, 28 bp, Artificial Sequence
  Description of Artificial Sequence: Synthetic oligonucleotide
gactcttctgtgtcgctctcgtcttggg

SEQ ID NO: 158264 - DNA, 32 bp, Artificial Sequence
  Description of Artificial Sequence: Synthetic oligonucleotide
actcttctgtgtcgctctcgtcttgggtttac

SEQ ID NO: 158265 - DNA, 31 bp, Artificial Sequence
  Description of Artificial Sequence: Synthetic oligonucleotide
ctcttctgtgtcgctctcgtcttgggtttac

SEQ ID NO: 158266 - DNA, 31 bp, Artificial Sequence
  Description of Artificial Sequence: Synthetic oligonucleotide
tcttctgtgtcgctctcgtcttgggtttacc

SEQ ID NO: 158267 - DNA, 30 bp, Artificial Sequence
  Description of Artificial Sequence: Synthetic oligonucleotide
cttctgtgtcgctctcgtcttgggtttacc

SEQ ID NO: 158268 - DNA, 32 bp, Artificial Sequence
  Description of Artificial Sequence: Synthetic oligonucleotide
ttctgtgtcgctctcgtcttgggtttaccatc

SEQ ID NO: 158269 - DNA, 31 bp, Artificial Sequence
  Description of Artificial Sequence: Synthetic oligonucleotide
tctgtgtcgctctcgtcttgggtttaccatc

SEQ ID NO: 158270 - DNA, 30 bp, Artificial Sequence
  Description of Artificial Sequence: Synthetic oligonucleotide
ctgtgtcgctctcgtcttgggtttaccatc

SEQ ID NO: 158271 - DNA, 32 bp, Artificial Sequence
  Description of Artificial Sequence: Synthetic oligonucleotide
tgtgtcgctctcgtcttgggtttaccatcttc

SEQ ID NO: 158272 - DNA, 31 bp, Artificial Sequence
  Description of Artificial Sequence: Synthetic oligonucleotide
gtgtcgctctcgtcttgggtttaccatcttc

SEQ ID NO: 158273 - DNA, 32 bp, Artificial Sequence
  Description of Artificial Sequence: Synthetic oligonucleotide
tgtcgctctcgtcttgggtttaccatcttcag

SEQ ID NO: 158274 - DNA, 31 bp, Artificial Sequence
  Description of Artificial Sequence: Synthetic oligonucleotide
gtcgctctcgtcttgggtttaccatcttcag

SEQ ID NO: 158275 - DNA, 32 bp, Artificial Sequence
  Description of Artificial Sequence: Synthetic oligonucleotide
tcgctctcgtcttgggtttaccatcttcagtc

SEQ ID NO: 158276 - DNA, 31 bp, Artificial Sequence
  Description of Artificial Sequence: Synthetic oligonucleotide
cgctctcgtcttgggtttaccatcttcagtc

SEQ ID NO: 158277 - DNA, 32 bp, Artificial Sequence
  Description of Artificial Sequence: Synthetic oligonucleotide
gctctcgtcttgggtttaccatcttcagtctg

SEQ ID NO: 158278 - DNA, 34 bp, Artificial Sequence
  Description of Artificial Sequence: Synthetic oligonucleotide
ctctcgtcttgggtttaccatcttcagtctgtac

SEQ ID NO: 158279 - DNA, 37 bp, Artificial Sequence
  Description of Artificial Sequence: Synthetic oligonucleotide
tctcgtcttgggtttaccatcttcagtctgtacaaag

SEQ ID NO: 158280 - DNA, 36 bp, Artificial Sequence
  Description of Artificial Sequence: Synthetic oligonucleotide
ctcgtcttgggtttaccatcttcagtctgtacaaag

SEQ ID NO: 158281 - DNA, 38 bp, Artificial Sequence
  Description of Artificial Sequence: Synthetic oligonucleotide
tcgtcttgggtttaccatcttcagtctgtacaaagaag

SEQ ID NO: 158282 - DNA, 37 bp, Artificial Sequence
  Description of Artificial Sequence: Synthetic oligonucleotide
cgtcttgggtttaccatcttcagtctgtacaaagaag

SEQ ID NO: 158283 - DNA, 39 bp, Artificial Sequence
  Description of Artificial Sequence: Synthetic oligonucleotide
gtcttgggtttaccatcttcagtctgtacaaagaagatg

SEQ ID NO: 158284 - DNA, 39 bp, Artificial Sequence
  Description of Artificial Sequence: Synthetic oligonucleotide
tcttgggtttaccatcttcagtctgtacaaagaagatgg

SEQ ID NO: 158285 - DNA, 38 bp, Artificial Sequence
  Description of Artificial Sequence: Synthetic oligonucleotide
cttgggtttaccatcttcagtctgtacaaagaagatgg

SEQ ID NO: 158286 - DNA, 38 bp, Artificial Sequence
  Description of Artificial Sequence: Synthetic oligonucleotide
ttgggtttaccatcttcagtctgtacaaagaagatggg

SEQ ID NO: 158287 - DNA, 37 bp, Artificial Sequence
  Description of Artificial Sequence: Synthetic oligonucleotide
tgggtttaccatcttcagtctgtacaaagaagatggg

SEQ ID NO: 158288 - DNA, 36 bp, Artificial Sequence
  Description of Artificial Sequence: Synthetic oligonucleotide
gggtttaccatcttcagtctgtacaaagaagatggg

SEQ ID NO: 158289 - DNA, 36 bp, Artificial Sequence
  Description of Artificial Sequence: Synthetic oligonucleotide
ggtttaccatcttcagtctgtacaaagaagatgggg

SEQ ID NO: 158290 - DNA, 37 bp, Artificial Sequence
  Description of Artificial Sequence: Synthetic oligonucleotide
gtttaccatcttcagtctgtacaaagaagatggggtg

SEQ ID NO: 158291 - DNA, 37 bp, Artificial Sequence
  Description of Artificial Sequence: Synthetic oligonucleotide
tttaccatcttcagtctgtacaaagaagatggggtgc

SEQ ID NO: 158292 - DNA, 36 bp, Artificial Sequence
  Description of Artificial Sequence: Synthetic oligonucleotide
ttaccatcttcagtctgtacaaagaagatggggtgc

SEQ ID NO: 158293 - DNA, 35 bp, Artificial Sequence
  Description of Artificial Sequence: Synthetic oligonucleotide
taccatcttcagtctgtacaaagaagatggggtgc

SEQ ID NO: 158294 - DNA, 34 bp, Artificial Sequence
  Description of Artificial Sequence: Synthetic oligonucleotide
accatcttcagtctgtacaaagaagatggggtgc

SEQ ID NO: 158295 - DNA, 33 bp, Artificial Sequence
  Description of Artificial Sequence: Synthetic oligonucleotide
ccatcttcagtctgtacaaagaagatggggtgc

SEQ ID NO: 158296 - DNA, 33 bp, Artificial Sequence
  Description of Artificial Sequence: Synthetic oligonucleotide
catcttcagtctgtacaaagaagatggggtgcc

SEQ ID NO: 158297 - DNA, 34 bp, Artificial Sequence
  Description of Artificial Sequence: Synthetic oligonucleotide
atcttcagtctgtacaaagaagatggggtgcctg

SEQ ID NO: 158298 - DNA, 33 bp, Artificial Sequence
  Description of Artificial Sequence: Synthetic oligonucleotide
tcttcagtctgtacaaagaagatggggtgcctg

SEQ ID NO: 158299 - DNA, 32 bp, Artificial Sequence
  Description of Artificial Sequence: Synthetic oligonucleotide
cttcagtctgtacaaagaagatggggtgcctg

SEQ ID NO: 158300 - DNA, 33 bp, Artificial Sequence
  Description of Artificial Sequence: Synthetic oligonucleotide
ttcagtctgtacaaagaagatggggtgcctgtc

SEQ ID NO: 158301 - DNA, 32 bp, Artificial Sequence
  Description of Artificial Sequence: Synthetic oligonucleotide
tcagtctgtacaaagaagatggggtgcctgtc

SEQ ID NO: 158302 - DNA, 31 bp, Artificial Sequence
  Description of Artificial Sequence: Synthetic oligonucleotide
cagtctgtacaaagaagatggggtgcctgtc

SEQ ID NO: 158303 - DNA, 31 bp, Artificial Sequence
  Description of Artificial Sequence: Synthetic oligonucleotide
agtctgtacaaagaagatggggtgcctgtcc

SEQ ID NO: 158304 - DNA, 30 bp, Artificial Sequence
  Description of Artificial Sequence: Synthetic oligonucleotide
gtctgtacaaagaagatggggtgcctgtcc

SEQ ID NO: 158305 - DNA, 30 bp, Artificial Sequence
  Description of Artificial Sequence: Synthetic oligonucleotide
tctgtacaaagaagatggggtgcctgtccc

SEQ ID NO: 158306 - DNA, 29 bp, Artificial Sequence
  Description of Artificial Sequence: Synthetic oligonucleotide
ctgtacaaagaagatggggtgcctgtccc

SEQ ID NO: 158307 - DNA, 30 bp, Artificial Sequence
  Description of Artificial Sequence: Synthetic oligonucleotide
tgtacaaagaagatggggtgcctgtccctg

SEQ ID NO: 158308 - DNA, 29 bp, Artificial Sequence
  Description of Artificial Sequence: Synthetic oligonucleotide
gtacaaagaagatggggtgcctgtccctg

SEQ ID NO: 158309 - DNA, 30 bp, Artificial Sequence
  Description of Artificial Sequence: Synthetic oligonucleotide
tacaaagaagatggggtgcctgtccctgag

SEQ ID NO: 158310 - DNA, 29 bp, Artificial Sequence
  Description of Artificial Sequence: Synthetic oligonucleotide
acaaagaagatggggtgcctgtccctgag

SEQ ID NO: 158311 - DNA, 28 bp, Artificial Sequence
  Description of Artificial Sequence: Synthetic oligonucleotide
caaagaagatggggtgcctgtccctgag

SEQ ID NO: 158312 - DNA, 28 bp, Artificial Sequence
  Description of Artificial Sequence: Synthetic oligonucleotide
aaagaagatggggtgcctgtccctgagc

SEQ ID NO: 158313 - DNA, 27 bp, Artificial Sequence
  Description of Artificial Sequence: Synthetic oligonucleotide
aagaagatggggtgcctgtccctgagc

SEQ ID NO: 158314 - DNA, 27 bp, Artificial Sequence
  Description of Artificial Sequence: Synthetic oligonucleotide
agaagatggggtgcctgtccctgagct

SEQ ID NO: 158315 - DNA, 26 bp, Artificial Sequence
  Description of Artificial Sequence: Synthetic oligonucleotide
gaagatggggtgcctgtccctgagct

SEQ ID NO: 158316 - DNA, 27 bp, Artificial Sequence
  Description of Artificial Sequence: Synthetic oligonucleotide
aagatggggtgcctgtccctgagctct

SEQ ID NO: 158317 - DNA, 27 bp, Artificial Sequence
  Description of Artificial Sequence: Synthetic oligonucleotide
agatggggtgcctgtccctgagctcta

SEQ ID NO: 158318 - DNA, 26 bp, Artificial Sequence
  Description of Artificial Sequence: Synthetic oligonucleotide
gatggggtgcctgtccctgagctcta

SEQ ID NO: 158319 - DNA, 27 bp, Artificial Sequence
  Description of Artificial Sequence: Synthetic oligonucleotide
atggggtgcctgtccctgagctctaca

SEQ ID NO: 158320 - DNA, 27 bp, Artificial Sequence
  Description of Artificial Sequence: Synthetic oligonucleotide
tggggtgcctgtccctgagctctacaa

SEQ ID NO: 158321 - DNA, 26 bp, Artificial Sequence
  Description of Artificial Sequence: Synthetic oligonucleotide
ggggtgcctgtccctgagctctacaa

SEQ ID NO: 158322 - DNA, 27 bp, Artificial Sequence
  Description of Artificial Sequence: Synthetic oligonucleotide
gggtgcctgtccctgagctctacaaca

SEQ ID NO: 158323 - DNA, 34 bp, Artificial Sequence
  Description of Artificial Sequence: Synthetic oligonucleotide
ggtgcctgtccctgagctctacaacaaaatattc

SEQ ID NO: 158324 - DNA, 35 bp, Artificial Sequence
  Description of Artificial Sequence: Synthetic oligonucleotide
gtgcctgtccctgagctctacaacaaaatattctg

SEQ ID NO: 158325 - DNA, 35 bp, Artificial Sequence
  Description of Artificial Sequence: Synthetic oligonucleotide
tgcctgtccctgagctctacaacaaaatattctgg

SEQ ID NO: 158326 - DNA, 34 bp, Artificial Sequence
  Description of Artificial Sequence: Synthetic oligonucleotide
gcctgtccctgagctctacaacaaaatattctgg

SEQ ID NO: 158327 - DNA, 36 bp, Artificial Sequence
  Description of Artificial Sequence: Synthetic oligonucleotide
cctgtccctgagctctacaacaaaatattctggaag

SEQ ID NO: 158328 - DNA, 37 bp, Artificial Sequence
  Description of Artificial Sequence: Synthetic oligonucleotide
ctgtccctgagctctacaacaaaatattctggaagag

SEQ ID NO: 158329 - DNA, 37 bp, Artificial Sequence
  Description of Artificial Sequence: Synthetic oligonucleotide
tgtccctgagctctacaacaaaatattctggaagagc

SEQ ID NO: 158330 - DNA, 36 bp, Artificial Sequence
  Description of Artificial Sequence: Synthetic oligonucleotide
gtccctgagctctacaacaaaatattctggaagagc

SEQ ID NO: 158331 - DNA, 38 bp, Artificial Sequence
  Description of Artificial Sequence: Synthetic oligonucleotide
tccctgagctctacaacaaaatattctggaagagcatc

SEQ ID NO: 158332 - DNA, 37 bp, Artificial Sequence
  Description of Artificial Sequence: Synthetic oligonucleotide
ccctgagctctacaacaaaatattctggaagagcatc

SEQ ID NO: 158333 - DNA, 37 bp, Artificial Sequence
  Description of Artificial Sequence: Synthetic oligonucleotide
cctgagctctacaacaaaatattctggaagagcatcc

SEQ ID NO: 158334 - DNA, 38 bp, Artificial Sequence
  Description of Artificial Sequence: Synthetic oligonucleotide
ctgagctctacaacaaaatattctggaagagcatcctc

SEQ ID NO: 158335 - DNA, 40 bp, Artificial Sequence
  Description of Artificial Sequence: Synthetic oligonucleotide
tgagctctacaacaaaatattctggaagagcatcctcatg

SEQ ID NO: 158336 - DNA, 39 bp, Artificial Sequence
  Description of Artificial Sequence: Synthetic oligonucleotide
gagctctacaacaaaatattctggaagagcatcctcatg

SEQ ID NO: 158337 - DNA, 39 bp, Artificial Sequence
  Description of Artificial Sequence: Synthetic oligonucleotide
agctctacaacaaaatattctggaagagcatcctcatgg

SEQ ID NO: 158338 - DNA, 38 bp, Artificial Sequence
  Description of Artificial Sequence: Synthetic oligonucleotide
gctctacaacaaaatattctggaagagcatcctcatgg

SEQ ID NO: 158339 - DNA, 38 bp, Artificial Sequence
  Description of Artificial Sequence: Synthetic oligonucleotide
ctctacaacaaaatattctggaagagcatcctcatggg

SEQ ID NO: 158340 - DNA, 38 bp, Artificial Sequence
  Description of Artificial Sequence: Synthetic oligonucleotide
tctacaacaaaatattctggaagagcatcctcatgggc

SEQ ID NO: 158341 - DNA, 37 bp, Artificial Sequence
  Description of Artificial Sequence: Synthetic oligonucleotide
ctacaacaaaatattctggaagagcatcctcatgggc

SEQ ID NO: 158342 - DNA, 37 bp, Artificial Sequence
  Description of Artificial Sequence: Synthetic oligonucleotide
tacaacaaaatattctggaagagcatcctcatgggcc

SEQ ID NO: 158343 - DNA, 36 bp, Artificial Sequence
  Description of Artificial Sequence: Synthetic oligonucleotide
acaacaaaatattctggaagagcatcctcatgggcc

SEQ ID NO: 158344 - DNA, 35 bp, Artificial Sequence
  Description of Artificial Sequence: Synthetic oligonucleotide
caacaaaatattctggaagagcatcctcatgggcc

SEQ ID NO: 158345 - DNA, 35 bp, Artificial Sequence
  Description of Artificial Sequence: Synthetic oligonucleotide
aacaaaatattctggaagagcatcctcatgggccc

SEQ ID NO: 158346 - DNA, 34 bp, Artificial Sequence
  Description of Artificial Sequence: Synthetic oligonucleotide
acaaaatattctggaagagcatcctcatgggccc

SEQ ID NO: 158347 - DNA, 33 bp, Artificial Sequence
  Description of Artificial Sequence: Synthetic oligonucleotide
caaaatattctggaagagcatcctcatgggccc

SEQ ID NO: 158348 - DNA, 34 bp, Artificial Sequence
  Description of Artificial Sequence: Synthetic oligonucleotide
aaaatattctggaagagcatcctcatgggccctg

SEQ ID NO: 158349 - DNA, 33 bp, Artificial Sequence
  Description of Artificial Sequence: Synthetic oligonucleotide
aaatattctggaagagcatcctcatgggccctg

SEQ ID NO: 158350 - DNA, 32 bp, Artificial Sequence
  Description of Artificial Sequence: Synthetic oligonucleotide
aatattctggaagagcatcctcatgggccctg

SEQ ID NO: 158351 - DNA, 31 bp, Artificial Sequence
  Description of Artificial Sequence: Synthetic oligonucleotide
atattctggaagagcatcctcatgggccctg

SEQ ID NO: 158352 - DNA, 30 bp, Artificial Sequence
  Description of Artificial Sequence: Synthetic oligonucleotide
tattctggaagagcatcctcatgggccctg

SEQ ID NO: 158353 - DNA, 29 bp, Artificial Sequence
  Description of Artificial Sequence: Synthetic oligonucleotide
attctggaagagcatcctcatgggccctg

SEQ ID NO: 158354 - DNA, 28 bp, Artificial Sequence
  Description of Artificial Sequence: Synthetic oligonucleotide
ttctggaagagcatcctcatgggccctg

SEQ ID NO: 158355 - DNA, 27 bp, Artificial Sequence
  Description of Artificial Sequence: Synthetic oligonucleotide
tctggaagagcatcctcatgggccctg

SEQ ID NO: 158356 - DNA, 27 bp, Artificial Sequence
  Description of Artificial Sequence: Synthetic oligonucleotide
ctggaagagcatcctcatgggccctgt

SEQ ID NO: 158357 - DNA, 27 bp, Artificial Sequence
  Description of Artificial Sequence: Synthetic oligonucleotide
tggaagagcatcctcatgggccctgtg

SEQ ID NO: 158358 - DNA, 27 bp, Artificial Sequence
  Description of Artificial Sequence: Synthetic oligonucleotide
ggaagagcatcctcatgggccctgtga

SEQ ID NO: 158359 - DNA, 27 bp, Artificial Sequence
  Description of Artificial Sequence: Synthetic oligonucleotide
gaagagcatcctcatgggccctgtgac

SEQ ID NO: 158360 - DNA, 27 bp, Artificial Sequence
  Description of Artificial Sequence: Synthetic oligonucleotide
aagagcatcctcatgggccctgtgacc

SEQ ID NO: 158361 - DNA, 26 bp, Artificial Sequence
  Description of Artificial Sequence: Synthetic oligonucleotide
agagcatcctcatgggccctgtgacc

SEQ ID NO: 158362 - DNA, 25 bp, Artificial Sequence
  Description of Artificial Sequence: Synthetic oligonucleotide
gagcatcctcatgggccctgtgacc

SEQ ID NO: 158363 - DNA, 25 bp, Artificial Sequence
  Description of Artificial Sequence: Synthetic oligonucleotide
agcatcctcatgggccctgtgaccc

SEQ ID NO: 158364 - DNA, 24 bp, Artificial Sequence
  Description of Artificial Sequence: Synthetic oligonucleotide
gcatcctcatgggccctgtgaccc

SEQ ID NO: 158365 - DNA, 25 bp, Artificial Sequence
  Description of Artificial Sequence: Synthetic oligonucleotide
catcctcatgggccctgtgacccct

SEQ ID NO: 158366 - DNA, 25 bp, Artificial Sequence
  Description of Artificial Sequence: Synthetic oligonucleotide
atcctcatgggccctgtgacccctg

SEQ ID NO: 158367 - DNA, 24 bp, Artificial Sequence
  Description of Artificial Sequence: Synthetic oligonucleotide
tcctcatgggccctgtgacccctg

SEQ ID NO: 158368 - DNA, 23 bp, Artificial Sequence
  Description of Artificial Sequence: Synthetic oligonucleotide
cctcatgggccctgtgacccctg

SEQ ID NO: 158369 - DNA, 24 bp, Artificial Sequence
  Description of Artificial Sequence: Synthetic oligonucleotide
ctcatgggccctgtgacccctgca

SEQ ID NO: 158370 - DNA, 25 bp, Artificial Sequence
  Description of Artificial Sequence: Synthetic oligonucleotide
tcatgggccctgtgacccctgcaca

SEQ ID NO: 158371 - DNA, 24 bp, Artificial Sequence
  Description of Artificial Sequence: Synthetic oligonucleotide
catgggccctgtgacccctgcaca

SEQ ID NO: 158372 - DNA, 24 bp, Artificial Sequence
  Description of Artificial Sequence: Synthetic oligonucleotide
atgggccctgtgacccctgcacac

SEQ ID NO: 158373 - DNA, 23 bp, Artificial Sequence
  Description of Artificial Sequence: Synthetic oligonucleotide
tgggccctgtgacccctgcacac

SEQ ID NO: 158374 - DNA, 22 bp, Artificial Sequence
  Description of Artificial Sequence: Synthetic oligonucleotide
gggccctgtgacccctgcacac

SEQ ID NO: 158375 - DNA, 22 bp, Artificial Sequence
  Description of Artificial Sequence: Synthetic oligonucleotide
ggccctgtgacccctgcacacg

SEQ ID NO: 158376 - DNA, 23 bp, Artificial Sequence
  Description of Artificial Sequence: Synthetic oligonucleotide
gccctgtgacccctgcacacgca

SEQ ID NO: 158377 - DNA, 23 bp, Artificial Sequence
  Description of Artificial Sequence: Synthetic oligonucleotide
ccctgtgacccctgcacacgcag

SEQ ID NO: 158378 - DNA, 23 bp, Artificial Sequence
  Description of Artificial Sequence: Synthetic oligonucleotide
cctgtgacccctgcacacgcagg

SEQ ID NO: 158379 - DNA, 24 bp, Artificial Sequence
  Description of Artificial Sequence: Synthetic oligonucleotide
ctgtgacccctgcacacgcaggga

SEQ ID NO: 158380 - DNA, 24 bp, Artificial Sequence
  Description of Artificial Sequence: Synthetic oligonucleotide
tgtgacccctgcacacgcagggac

SEQ ID NO: 158381 - DNA, 23 bp, Artificial Sequence
  Description of Artificial Sequence: Synthetic oligonucleotide
gtgacccctgcacacgcagggac

SEQ ID NO: 158382 - DNA, 26 bp, Artificial Sequence
  Description of Artificial Sequence: Synthetic oligonucleotide
gcacacgcagggacctacagatgtcg

SEQ ID NO: 158383 - DNA, 26 bp, Artificial Sequence
  Description of Artificial Sequence: Synthetic oligonucleotide
cacacgcagggacctacagatgtcgg

SEQ ID NO: 158384 - DNA, 26 bp, Artificial Sequence
  Description of Artificial Sequence: Synthetic oligonucleotide
acacgcagggacctacagatgtcggg

SEQ ID NO: 158385 - DNA, 25 bp, Artificial Sequence
  Description of Artificial Sequence: Synthetic oligonucleotide
cacgcagggacctacagatgtcggg

SEQ ID NO: 158386 - DNA, 27 bp, Artificial Sequence
  Description of Artificial Sequence: Synthetic oligonucleotide
acgcagggacctacagatgtcggggtt

SEQ ID NO: 158387 - DNA, 26 bp, Artificial Sequence
  Description of Artificial Sequence: Synthetic oligonucleotide
cgcagggacctacagatgtcggggtt

SEQ ID NO: 158388 - DNA, 27 bp, Artificial Sequence
  Description of Artificial Sequence: Synthetic oligonucleotide
gcagggacctacagatgtcggggttca

SEQ ID NO: 158389 - DNA, 27 bp, Artificial Sequence
  Description of Artificial Sequence: Synthetic oligonucleotide
cagggacctacagatgtcggggttcac

SEQ ID NO: 158390 - DNA, 28 bp, Artificial Sequence
  Description of Artificial Sequence: Synthetic oligonucleotide
agggacctacagatgtcggggttcacac

SEQ ID NO: 158391 - DNA, 27 bp, Artificial Sequence
  Description of Artificial Sequence: Synthetic oligonucleotide
gggacctacagatgtcggggttcacac

SEQ ID NO: 158392 - DNA, 27 bp, Artificial Sequence
  Description of Artificial Sequence: Synthetic oligonucleotide
ggacctacagatgtcggggttcacacc

SEQ ID NO: 158393 - DNA, 27 bp, Artificial Sequence
  Description of Artificial Sequence: Synthetic oligonucleotide
gacctacagatgtcggggttcacaccc

SEQ ID NO: 158394 - DNA, 28 bp, Artificial Sequence
  Description of Artificial Sequence: Synthetic oligonucleotide
acctacagatgtcggggttcacacccac

SEQ ID NO: 158395 - DNA, 27 bp, Artificial Sequence
  Description of Artificial Sequence: Synthetic oligonucleotide
cctacagatgtcggggttcacacccac

SEQ ID NO: 158396 - DNA, 27 bp, Artificial Sequence
  Description of Artificial Sequence: Synthetic oligonucleotide
ctacagatgtcggggttcacacccacg

SEQ ID NO: 158397 - DNA, 27 bp, Artificial Sequence
  Description of Artificial Sequence: Synthetic oligonucleotide
tacagatgtcggggttcacacccacgc

SEQ ID NO: 158398 - DNA, 27 bp, Artificial Sequence
  Description of Artificial Sequence: Synthetic oligonucleotide
acagatgtcggggttcacacccacgct

SEQ ID NO: 158399 - DNA, 26 bp, Artificial Sequence
  Description of Artificial Sequence: Synthetic oligonucleotide
cagatgtcggggttcacacccacgct

SEQ ID NO: 158400 - DNA, 26 bp, Artificial Sequence
  Description of Artificial Sequence: Synthetic oligonucleotide
agatgtcggggttcacacccacgctc

SEQ ID NO: 158401 - DNA, 25 bp, Artificial Sequence
  Description of Artificial Sequence: Synthetic oligonucleotide
gatgtcggggttcacacccacgctc

SEQ ID NO: 158402 - DNA, 25 bp, Artificial Sequence
  Description of Artificial Sequence: Synthetic oligonucleotide
atgtcggggttcacacccacgctcc

SEQ ID NO: 158403 - DNA, 24 bp, Artificial Sequence
  Description of Artificial Sequence: Synthetic oligonucleotide
tgtcggggttcacacccacgctcc

SEQ ID NO: 158404 - DNA, 23 bp, Artificial Sequence
  Description of Artificial Sequence: Synthetic oligonucleotide
gtcggggttcacacccacgctcc

SEQ ID NO: 158405 - DNA, 23 bp, Artificial Sequence
  Description of Artificial Sequence: Synthetic oligonucleotide
tcggggttcacacccacgctccc

SEQ ID NO: 158406 - DNA, 22 bp, Artificial Sequence
  Description of Artificial Sequence: Synthetic oligonucleotide
cggggttcacacccacgctccc

SEQ ID NO: 158407 - DNA, 22 bp, Artificial Sequence
  Description of Artificial Sequence: Synthetic oligonucleotide
ggggttcacacccacgctcccc

SEQ ID NO: 158408 - DNA, 25 bp, Artificial Sequence
  Description of Artificial Sequence: Synthetic oligonucleotide
gggttcacacccacgctcccccatt

SEQ ID NO: 158409 - DNA, 26 bp, Artificial Sequence
  Description of Artificial Sequence: Synthetic oligonucleotide
ggttcacacccacgctcccccattga

SEQ ID NO: 158410 - DNA, 27 bp, Artificial Sequence
  Description of Artificial Sequence: Synthetic oligonucleotide
gttcacacccacgctcccccattgagt

SEQ ID NO: 158411 - DNA, 27 bp, Artificial Sequence
  Description of Artificial Sequence: Synthetic oligonucleotide
ttcacacccacgctcccccattgagtg

SEQ ID NO: 158412 - DNA, 26 bp, Artificial Sequence
  Description of Artificial Sequence: Synthetic oligonucleotide
tcacacccacgctcccccattgagtg

SEQ ID NO: 158413 - DNA, 25 bp, Artificial Sequence
  Description of Artificial Sequence: Synthetic oligonucleotide
cacacccacgctcccccattgagtg

SEQ ID NO: 158414 - DNA, 26 bp, Artificial Sequence
  Description of Artificial Sequence: Synthetic oligonucleotide
acacccacgctcccccattgagtggt

SEQ ID NO: 158415 - DNA, 25 bp, Artificial Sequence
  Description of Artificial Sequence: Synthetic oligonucleotide
cacccacgctcccccattgagtggt

SEQ ID NO: 158416 - DNA, 26 bp, Artificial Sequence
  Description of Artificial Sequence: Synthetic oligonucleotide
acccacgctcccccattgagtggtca

SEQ ID NO: 158417 - DNA, 25 bp, Artificial Sequence
  Description of Artificial Sequence: Synthetic oligonucleotide
cccacgctcccccattgagtggtca

SEQ ID NO: 158418 - DNA, 25 bp, Artificial Sequence
  Description of Artificial Sequence: Synthetic oligonucleotide
ccacgctcccccattgagtggtcag

SEQ ID NO: 158419 - DNA, 26 bp, Artificial Sequence
  Description of Artificial Sequence: Synthetic oligonucleotide
cacgctcccccattgagtggtcagca

SEQ ID NO: 158420 - DNA, 26 bp, Artificial Sequence
  Description of Artificial Sequence: Synthetic oligonucleotide
acgctcccccattgagtggtcagcac

SEQ ID NO: 158421 - DNA, 25 bp, Artificial Sequence
  Description of Artificial Sequence: Synthetic oligonucleotide
cgctcccccattgagtggtcagcac

SEQ ID NO: 158422 - DNA, 25 bp, Artificial Sequence
  Description of Artificial Sequence: Synthetic oligonucleotide
gctcccccattgagtggtcagcacc

SEQ ID NO: 158423 - DNA, 26 bp, Artificial Sequence
  Description of Artificial Sequence: Synthetic oligonucleotide
ctcccccattgagtggtcagcaccca

SEQ ID NO: 158424 - DNA, 26 bp, Artificial Sequence
  Description of Artificial Sequence: Synthetic oligonucleotide
tcccccattgagtggtcagcacccag

SEQ ID NO: 158425 - DNA, 25 bp, Artificial Sequence
  Description of Artificial Sequence: Synthetic oligonucleotide
cccccattgagtggtcagcacccag

SEQ ID NO: 158426 - DNA, 27 bp, Artificial Sequence
  Description of Artificial Sequence: Synthetic oligonucleotide
ccccattgagtggtcagcacccagcaa

SEQ ID NO: 158427 - DNA, 27 bp, Artificial Sequence
  Description of Artificial Sequence: Synthetic oligonucleotide
cccattgagtggtcagcacccagcaac

SEQ ID NO: 158428 - DNA, 27 bp, Artificial Sequence
  Description of Artificial Sequence: Synthetic oligonucleotide
ccattgagtggtcagcacccagcaacc

SEQ ID NO: 158429 - DNA, 27 bp, Artificial Sequence
  Description of Artificial Sequence: Synthetic oligonucleotide
cattgagtggtcagcacccagcaaccc

SEQ ID NO: 158430 - DNA, 27 bp, Artificial Sequence
  Description of Artificial Sequence: Synthetic oligonucleotide
attgagtggtcagcacccagcaacccc

SEQ ID NO: 158431 - DNA, 26 bp, Artificial Sequence
  Description of Artificial Sequence: Synthetic oligonucleotide
ttgagtggtcagcacccagcaacccc

SEQ ID NO: 158432 - DNA, 25 bp, Artificial Sequence
  Description of Artificial Sequence: Synthetic oligonucleotide
tgagtggtcagcacccagcaacccc

SEQ ID NO: 158433 - DNA, 24 bp, Artificial Sequence
  Description of Artificial Sequence: Synthetic oligonucleotide
gagtggtcagcacccagcaacccc

SEQ ID NO: 158434 - DNA, 25 bp, Artificial Sequence
  Description of Artificial Sequence: Synthetic oligonucleotide
agtggtcagcacccagcaaccccct

SEQ ID NO: 158435 - DNA, 24 bp, Artificial Sequence
  Description of Artificial Sequence: Synthetic oligonucleotide
gtggtcagcacccagcaaccccct

SEQ ID NO: 158436 - DNA, 24 bp, Artificial Sequence
  Description of Artificial Sequence: Synthetic oligonucleotide
tggtcagcacccagcaaccccctg

SEQ ID NO: 158437 - DNA, 23 bp, Artificial Sequence
  Description of Artificial Sequence: Synthetic oligonucleotide
ggtcagcacccagcaaccccctg

SEQ ID NO: 158438 - DNA, 24 bp, Artificial Sequence
  Description of Artificial Sequence: Synthetic oligonucleotide
gtcagcacccagcaaccccctggt

SEQ ID NO: 158439 - DNA, 26 bp, Artificial Sequence
  Description of Artificial Sequence: Synthetic oligonucleotide
tcagcacccagcaaccccctggtgat

SEQ ID NO: 158440 - DNA, 25 bp, Artificial Sequence
  Description of Artificial Sequence: Synthetic oligonucleotide
cagcacccagcaaccccctggtgat

SEQ ID NO: 158441 - DNA, 25 bp, Artificial Sequence
  Description of Artificial Sequence: Synthetic oligonucleotide
agcacccagcaaccccctggtgatc

SEQ ID NO: 158442 - DNA, 24 bp, Artificial Sequence
  Description of Artificial Sequence: Synthetic oligonucleotide
gcacccagcaaccccctggtgatc

SEQ ID NO: 158443 - DNA, 25 bp, Artificial Sequence
  Description of Artificial Sequence: Synthetic oligonucleotide
cacccagcaaccccctggtgatcgt

SEQ ID NO: 158444 - DNA, 25 bp, Artificial Sequence
  Description of Artificial Sequence: Synthetic oligonucleotide
acccagcaaccccctggtgatcgtg

SEQ ID NO: 158445 - DNA, 24 bp, Artificial Sequence
  Description of Artificial Sequence: Synthetic oligonucleotide
cccagcaaccccctggtgatcgtg

SEQ ID NO: 158446 - DNA, 25 bp, Artificial Sequence
  Description of Artificial Sequence: Synthetic oligonucleotide
ccagcaaccccctggtgatcgtggt

SEQ ID NO: 158447 - DNA, 26 bp, Artificial Sequence
  Description of Artificial Sequence: Synthetic oligonucleotide
cagcaaccccctggtgatcgtggtca

SEQ ID NO: 158448 - DNA, 27 bp, Artificial Sequence
  Description of Artificial Sequence: Synthetic oligonucleotide
agcaaccccctggtgatcgtggtcaca

SEQ ID NO: 158449 - DNA, 26 bp, Artificial Sequence
  Description of Artificial Sequence: Synthetic oligonucleotide
gcaaccccctggtgatcgtggtcaca

SEQ ID NO: 158450 - DNA, 26 bp, Artificial Sequence
  Description of Artificial Sequence: Synthetic oligonucleotide
caaccccctggtgatcgtggtcacag

SEQ ID NO: 158451 - DNA, 27 bp, Artificial Sequence
  Description of Artificial Sequence: Synthetic oligonucleotide
aaccccctggtgatcgtggtcacaggt

SEQ ID NO: 158452 - DNA, 26 bp, Artificial Sequence
  Description of Artificial Sequence: Synthetic oligonucleotide
accccctggtgatcgtggtcacaggt

SEQ ID NO: 158453 - DNA, 25 bp, Artificial Sequence
  Description of Artificial Sequence: Synthetic oligonucleotide
ccccctggtgatcgtggtcacaggt

SEQ ID NO: 158454 - DNA, 27 bp, Artificial Sequence
  Description of Artificial Sequence: Synthetic oligonucleotide
cccctggtgatcgtggtcacaggtcta

SEQ ID NO: 158455 - DNA, 30 bp, Artificial Sequence
  Description of Artificial Sequence: Synthetic oligonucleotide
ccctggtgatcgtggtcacaggtctatttg

SEQ ID NO: 158456 - DNA, 30 bp, Artificial Sequence
  Description of Artificial Sequence: Synthetic oligonucleotide
cctggtgatcgtggtcacaggtctatttgg

SEQ ID NO: 158457 - DNA, 30 bp, Artificial Sequence
  Description of Artificial Sequence: Synthetic oligonucleotide
ctggtgatcgtggtcacaggtctatttggg

SEQ ID NO: 158458 - DNA, 33 bp, Artificial Sequence
  Description of Artificial Sequence: Synthetic oligonucleotide
tggtgatcgtggtcacaggtctatttgggaaac

SEQ ID NO: 158459 - DNA, 32 bp, Artificial Sequence
  Description of Artificial Sequence: Synthetic oligonucleotide
ggtgatcgtggtcacaggtctatttgggaaac

SEQ ID NO: 158460 - DNA, 32 bp, Artificial Sequence
  Description of Artificial Sequence: Synthetic oligonucleotide
gtgatcgtggtcacaggtctatttgggaaacc

SEQ ID NO: 158461 - DNA, 34 bp, Artificial Sequence
  Description of Artificial Sequence: Synthetic oligonucleotide
tgatcgtggtcacaggtctatttgggaaaccttc

SEQ ID NO: 158462 - DNA, 33 bp, Artificial Sequence
  Description of Artificial Sequence: Synthetic oligonucleotide
gatcgtggtcacaggtctatttgggaaaccttc

SEQ ID NO: 158463 - DNA, 34 bp, Artificial Sequence
  Description of Artificial Sequence: Synthetic oligonucleotide
atcgtggtcacaggtctatttgggaaaccttcac

SEQ ID NO: 158464 - DNA, 33 bp, Artificial Sequence
  Description of Artificial Sequence: Synthetic oligonucleotide
tcgtggtcacaggtctatttgggaaaccttcac

SEQ ID NO: 158465 - DNA, 32 bp, Artificial Sequence
  Description of Artificial Sequence: Synthetic oligonucleotide
cgtggtcacaggtctatttgggaaaccttcac

SEQ ID NO: 158466 - DNA, 33 bp, Artificial Sequence
  Description of Artificial Sequence: Synthetic oligonucleotide
gtggtcacaggtctatttgggaaaccttcactc

SEQ ID NO: 158467 - DNA, 34 bp, Artificial Sequence
  Description of Artificial Sequence: Synthetic oligonucleotide
tggtcacaggtctatttgggaaaccttcactctc

SEQ ID NO: 158468 - DNA, 33 bp, Artificial Sequence
  Description of Artificial Sequence: Synthetic oligonucleotide
ggtcacaggtctatttgggaaaccttcactctc

SEQ ID NO: 158469 - DNA, 34 bp, Artificial Sequence
  Description of Artificial Sequence: Synthetic oligonucleotide
gtcacaggtctatttgggaaaccttcactctcag

SEQ ID NO: 158470 - DNA, 34 bp, Artificial Sequence
  Description of Artificial Sequence: Synthetic oligonucleotide
tcacaggtctatttgggaaaccttcactctcagc

SEQ ID NO: 158471 - DNA, 33 bp, Artificial Sequence
  Description of Artificial Sequence: Synthetic oligonucleotide
cacaggtctatttgggaaaccttcactctcagc

SEQ ID NO: 158472 - DNA, 33 bp, Artificial Sequence
  Description of Artificial Sequence: Synthetic oligonucleotide
acaggtctatttgggaaaccttcactctcagcc

SEQ ID NO: 158473 - DNA, 32 bp, Artificial Sequence
  Description of Artificial Sequence: Synthetic oligonucleotide
caggtctatttgggaaaccttcactctcagcc

SEQ ID NO: 158474 - DNA, 32 bp, Artificial Sequence
  Description of Artificial Sequence: Synthetic oligonucleotide
aggtctatttgggaaaccttcactctcagccc

SEQ ID NO: 158475 - DNA, 31 bp, Artificial Sequence
  Description of Artificial Sequence: Synthetic oligonucleotide
ggtctatttgggaaaccttcactctcagccc

SEQ ID NO: 158476 - DNA, 32 bp, Artificial Sequence
  Description of Artificial Sequence: Synthetic oligonucleotide
gtctatttgggaaaccttcactctcagcccag

SEQ ID NO: 158477 - DNA, 32 bp, Artificial Sequence
  Description of Artificial Sequence: Synthetic oligonucleotide
tctatttgggaaaccttcactctcagcccagc

SEQ ID NO: 158478 - DNA, 31 bp, Artificial Sequence
  Description of Artificial Sequence: Synthetic oligonucleotide
ctatttgggaaaccttcactctcagcccagc

SEQ ID NO: 158479 - DNA, 31 bp, Artificial Sequence
  Description of Artificial Sequence: Synthetic oligonucleotide
tatttgggaaaccttcactctcagcccagcc

SEQ ID NO: 158480 - DNA, 30 bp, Artificial Sequence
  Description of Artificial Sequence: Synthetic oligonucleotide
atttgggaaaccttcactctcagcccagcc

SEQ ID NO: 158481 - DNA, 29 bp, Artificial Sequence
  Description of Artificial Sequence: Synthetic oligonucleotide
tttgggaaaccttcactctcagcccagcc

SEQ ID NO: 158482 - DNA, 28 bp, Artificial Sequence
  Description of Artificial Sequence: Synthetic oligonucleotide
ttgggaaaccttcactctcagcccagcc

SEQ ID NO: 158483 - DNA, 27 bp, Artificial Sequence
  Description of Artificial Sequence: Synthetic oligonucleotide
tgggaaaccttcactctcagcccagcc

SEQ ID NO: 158484 - DNA, 26 bp, Artificial Sequence
  Description of Artificial Sequence: Synthetic oligonucleotide
gggaaaccttcactctcagcccagcc

SEQ ID NO: 158485 - DNA, 26 bp, Artificial Sequence
  Description of Artificial Sequence: Synthetic oligonucleotide
ggaaaccttcactctcagcccagccg

SEQ ID NO: 158486 - DNA, 26 bp, Artificial Sequence
  Description of Artificial Sequence: Synthetic oligonucleotide
gaaaccttcactctcagcccagccgg

SEQ ID NO: 158487 - DNA, 26 bp, Artificial Sequence
  Description of Artificial Sequence: Synthetic oligonucleotide
aaaccttcactctcagcccagccggg

SEQ ID NO: 158488 - DNA, 25 bp, Artificial Sequence
  Description of Artificial Sequence: Synthetic oligonucleotide
aaccttcactctcagcccagccggg

SEQ ID NO: 158489 - DNA, 24 bp, Artificial Sequence
  Description of Artificial Sequence: Synthetic oligonucleotide
accttcactctcagcccagccggg

SEQ ID NO: 158490 - DNA, 23 bp, Artificial Sequence
  Description of Artificial Sequence: Synthetic oligonucleotide
ccttcactctcagcccagccggg

SEQ ID NO: 158491 - DNA, 23 bp, Artificial Sequence
  Description of Artificial Sequence: Synthetic oligonucleotide
cttcactctcagcccagccgggc

SEQ ID NO: 158492 - DNA, 23 bp, Artificial Sequence
  Description of Artificial Sequence: Synthetic oligonucleotide
ttcactctcagcccagccgggcc

SEQ ID NO: 158493 - DNA, 22 bp, Artificial Sequence
  Description of Artificial Sequence: Synthetic oligonucleotide
tcactctcagcccagccgggcc

SEQ ID NO: 158494 - DNA, 21 bp, Artificial Sequence
  Description of Artificial Sequence: Synthetic oligonucleotide
cactctcagcccagccgggcc

SEQ ID NO: 158495 - DNA, 21 bp, Artificial Sequence
  Description of Artificial Sequence: Synthetic oligonucleotide
actctcagcccagccgggccc

SEQ ID NO: 158496 - DNA, 20 bp, Artificial Sequence
  Description of Artificial Sequence: Synthetic oligonucleotide
ccagccgggccccacggttc

SEQ ID NO: 158497 - DNA, 20 bp, Artificial Sequence
  Description of Artificial Sequence: Synthetic oligonucleotide
cagccgggccccacggttcg

SEQ ID NO: 158498 - DNA, 21 bp, Artificial Sequence
  Description of Artificial Sequence: Synthetic oligonucleotide
agccgggccccacggttcgca

SEQ ID NO: 158499 - DNA, 28 bp, Artificial Sequence
  Description of Artificial Sequence: Synthetic oligonucleotide
agaacgtgaccttgtcctgcagctccag

SEQ ID NO: 158500 - DNA, 27 bp, Artificial Sequence
  Description of Artificial Sequence: Synthetic oligonucleotide
gaacgtgaccttgtcctgcagctccag

SEQ ID NO: 158501 - DNA, 27 bp, Artificial Sequence
  Description of Artificial Sequence: Synthetic oligonucleotide
aacgtgaccttgtcctgcagctccagg

SEQ ID NO: 158502 - DNA, 27 bp, Artificial Sequence
  Description of Artificial Sequence: Synthetic oligonucleotide
acgtgaccttgtcctgcagctccagga

SEQ ID NO: 158503 - DNA, 26 bp, Artificial Sequence
  Description of Artificial Sequence: Synthetic oligonucleotide
cgtgaccttgtcctgcagctccagga

SEQ ID NO: 158504 - DNA, 26 bp, Artificial Sequence
  Description of Artificial Sequence: Synthetic oligonucleotide
gtgaccttgtcctgcagctccaggag

SEQ ID NO: 158505 - DNA, 27 bp, Artificial Sequence
  Description of Artificial Sequence: Synthetic oligonucleotide
tgaccttgtcctgcagctccaggagct

SEQ ID NO: 158506 - DNA, 26 bp, Artificial Sequence
  Description of Artificial Sequence: Synthetic oligonucleotide
gaccttgtcctgcagctccaggagct

SEQ ID NO: 158507 - DNA, 27 bp, Artificial Sequence
  Description of Artificial Sequence: Synthetic oligonucleotide
accttgtcctgcagctccaggagctca

SEQ ID NO: 158508 - DNA, 27 bp, Artificial Sequence
  Description of Artificial Sequence: Synthetic oligonucleotide
ccttgtcctgcagctccaggagctcat

SEQ ID NO: 158509 - DNA, 29 bp, Artificial Sequence
  Description of Artificial Sequence: Synthetic oligonucleotide
cttgtcctgcagctccaggagctcatttg

SEQ ID NO: 158510 - DNA, 30 bp, Artificial Sequence
  Description of Artificial Sequence: Synthetic oligonucleotide
ttgtcctgcagctccaggagctcatttgac

SEQ ID NO: 158511 - DNA, 29 bp, Artificial Sequence
  Description of Artificial Sequence: Synthetic oligonucleotide
tgtcctgcagctccaggagctcatttgac

SEQ ID NO: 158512 - DNA, 28 bp, Artificial Sequence
  Description of Artificial Sequence: Synthetic oligonucleotide
gtcctgcagctccaggagctcatttgac

SEQ ID NO: 158513 - DNA, 30 bp, Artificial Sequence
  Description of Artificial Sequence: Synthetic oligonucleotide
tcctgcagctccaggagctcatttgacatg

SEQ ID NO: 158514 - DNA, 29 bp, Artificial Sequence
  Description of Artificial Sequence: Synthetic oligonucleotide
cctgcagctccaggagctcatttgacatg

SEQ ID NO: 158515 - DNA, 31 bp, Artificial Sequence
  Description of Artificial Sequence: Synthetic oligonucleotide
ctgcagctccaggagctcatttgacatgtac

SEQ ID NO: 158516 - DNA, 31 bp, Artificial Sequence
  Description of Artificial Sequence: Synthetic oligonucleotide
tgcagctccaggagctcatttgacatgtacc

SEQ ID NO: 158517 - DNA, 30 bp, Artificial Sequence
  Description of Artificial Sequence: Synthetic oligonucleotide
gcagctccaggagctcatttgacatgtacc

SEQ ID NO: 158518 - DNA, 32 bp, Artificial Sequence
  Description of Artificial Sequence: Synthetic oligonucleotide
cagctccaggagctcatttgacatgtaccatc

SEQ ID NO: 158519 - DNA, 35 bp, Artificial Sequence
  Description of Artificial Sequence: Synthetic oligonucleotide
agctccaggagctcatttgacatgtaccatctatc

SEQ ID NO: 158520 - DNA, 34 bp, Artificial Sequence
  Description of Artificial Sequence: Synthetic oligonucleotide
gctccaggagctcatttgacatgtaccatctatc

SEQ ID NO: 158521 - DNA, 34 bp, Artificial Sequence
  Description of Artificial Sequence: Synthetic oligonucleotide
ctccaggagctcatttgacatgtaccatctatcc

SEQ ID NO: 158522 - DNA, 35 bp, Artificial Sequence
  Description of Artificial Sequence: Synthetic oligonucleotide
tccaggagctcatttgacatgtaccatctatccag

SEQ ID NO: 158523 - DNA, 34 bp, Artificial Sequence
  Description of Artificial Sequence: Synthetic oligonucleotide
ccaggagctcatttgacatgtaccatctatccag

SEQ ID NO: 158524 - DNA, 34 bp, Artificial Sequence
  Description of Artificial Sequence: Synthetic oligonucleotide
caggagctcatttgacatgtaccatctatccagg

SEQ ID NO: 158525 - DNA, 34 bp, Artificial Sequence
  Description of Artificial Sequence: Synthetic oligonucleotide
aggagctcatttgacatgtaccatctatccaggg

SEQ ID NO: 158526 - DNA, 33 bp, Artificial Sequence
  Description of Artificial Sequence: Synthetic oligonucleotide
ggagctcatttgacatgtaccatctatccaggg

SEQ ID NO: 158527 - DNA, 34 bp, Artificial Sequence
  Description of Artificial Sequence: Synthetic oligonucleotide
gagctcatttgacatgtaccatctatccagggag

SEQ ID NO: 158528 - DNA, 34 bp, Artificial Sequence
  Description of Artificial Sequence: Synthetic oligonucleotide
agctcatttgacatgtaccatctatccagggagg

SEQ ID NO: 158529 - DNA, 33 bp, Artificial Sequence
  Description of Artificial Sequence: Synthetic oligonucleotide
gctcatttgacatgtaccatctatccagggagg

SEQ ID NO: 158530 - DNA, 33 bp, Artificial Sequence
  Description of Artificial Sequence: Synthetic oligonucleotide
ctcatttgacatgtaccatctatccagggaggg

SEQ ID NO: 158531 - DNA, 33 bp, Artificial Sequence
  Description of Artificial Sequence: Synthetic oligonucleotide
tcatttgacatgtaccatctatccagggagggg

SEQ ID NO: 158532 - DNA, 32 bp, Artificial Sequence
  Description of Artificial Sequence: Synthetic oligonucleotide
catttgacatgtaccatctatccagggagggg

SEQ ID NO: 158533 - DNA, 33 bp, Artificial Sequence
  Description of Artificial Sequence: Synthetic oligonucleotide
atttgacatgtaccatctatccagggaggggag

SEQ ID NO: 158534 - DNA, 32 bp, Artificial Sequence
  Description of Artificial Sequence: Synthetic oligonucleotide
tttgacatgtaccatctatccagggaggggag

SEQ ID NO: 158535 - DNA, 31 bp, Artificial Sequence
  Description of Artificial Sequence: Synthetic oligonucleotide
ttgacatgtaccatctatccagggaggggag

SEQ ID NO: 158536 - DNA, 30 bp, Artificial Sequence
  Description of Artificial Sequence: Synthetic oligonucleotide
tgacatgtaccatctatccagggaggggag

SEQ ID NO: 158537 - DNA, 29 bp, Artificial Sequence
  Description of Artificial Sequence: Synthetic oligonucleotide
gacatgtaccatctatccagggaggggag

SEQ ID NO: 158538 - DNA, 29 bp, Artificial Sequence
  Description of Artificial Sequence: Synthetic oligonucleotide
acatgtaccatctatccagggaggggagg

SEQ ID NO: 158539 - DNA, 28 bp, Artificial Sequence
  Description of Artificial Sequence: Synthetic oligonucleotide
catgtaccatctatccagggaggggagg

SEQ ID NO: 158540 - DNA, 28 bp, Artificial Sequence
  Description of Artificial Sequence: Synthetic oligonucleotide
atgtaccatctatccagggaggggaggg

SEQ ID NO: 158541 - DNA, 27 bp, Artificial Sequence
  Description of Artificial Sequence: Synthetic oligonucleotide
tgtaccatctatccagggaggggaggg

SEQ ID NO: 158542 - DNA, 26 bp, Artificial Sequence
  Description of Artificial Sequence: Synthetic oligonucleotide
gtaccatctatccagggaggggaggg

SEQ ID NO: 158543 - DNA, 26 bp, Artificial Sequence
  Description of Artificial Sequence: Synthetic oligonucleotide
taccatctatccagggaggggagggc

SEQ ID NO: 158544 - DNA, 25 bp, Artificial Sequence
  Description of Artificial Sequence: Synthetic oligonucleotide
accatctatccagggaggggagggc

SEQ ID NO: 158545 - DNA, 24 bp, Artificial Sequence
  Description of Artificial Sequence: Synthetic oligonucleotide
ccatctatccagggaggggagggc

SEQ ID NO: 158546 - DNA, 24 bp, Artificial Sequence
  Description of Artificial Sequence: Synthetic oligonucleotide
catctatccagggaggggagggcc

SEQ ID NO: 158547 - DNA, 26 bp, Artificial Sequence
  Description of Artificial Sequence: Synthetic oligonucleotide
atctatccagggaggggagggcccat

SEQ ID NO: 158548 - DNA, 25 bp, Artificial Sequence
  Description of Artificial Sequence: Synthetic oligonucleotide
tctatccagggaggggagggcccat

SEQ ID NO: 158549 - DNA, 24 bp, Artificial Sequence
  Description of Artificial Sequence: Synthetic oligonucleotide
ctatccagggaggggagggcccat

SEQ ID NO: 158550 - DNA, 26 bp, Artificial Sequence
  Description of Artificial Sequence: Synthetic oligonucleotide
tatccagggaggggagggcccatgaa

SEQ ID NO: 158551 - DNA, 25 bp, Artificial Sequence
  Description of Artificial Sequence: Synthetic oligonucleotide
atccagggaggggagggcccatgaa

SEQ ID NO: 158552 - DNA, 24 bp, Artificial Sequence
  Description of Artificial Sequence: Synthetic oligonucleotide
tccagggaggggagggcccatgaa

SEQ ID NO: 158553 - DNA, 23 bp, Artificial Sequence
  Description of Artificial Sequence: Synthetic oligonucleotide
ccagggaggggagggcccatgaa

SEQ ID NO: 158554 - DNA, 23 bp, Artificial Sequence
  Description of Artificial Sequence: Synthetic oligonucleotide
cagggaggggagggcccatgaac

SEQ ID NO: 158555 - DNA, 25 bp, Artificial Sequence
  Description of Artificial Sequence: Synthetic oligonucleotide
agggaggggagggcccatgaaccta

SEQ ID NO: 158556 - DNA, 24 bp, Artificial Sequence
  Description of Artificial Sequence: Synthetic oligonucleotide
gggaggggagggcccatgaaccta

SEQ ID NO: 158557 - DNA, 24 bp, Artificial Sequence
  Description of Artificial Sequence: Synthetic oligonucleotide
ggaggggagggcccatgaacctag

SEQ ID NO: 158558 - DNA, 24 bp, Artificial Sequence
  Description of Artificial Sequence: Synthetic oligonucleotide
gaggggagggcccatgaacctagg

SEQ ID NO: 158559 - DNA, 25 bp, Artificial Sequence
  Description of Artificial Sequence: Synthetic oligonucleotide
aggggagggcccatgaacctaggct

SEQ ID NO: 158560 - DNA, 24 bp, Artificial Sequence
  Description of Artificial Sequence: Synthetic oligonucleotide
ggggagggcccatgaacctaggct

SEQ ID NO: 158561 - DNA, 24 bp, Artificial Sequence
  Description of Artificial Sequence: Synthetic oligonucleotide
gggagggcccatgaacctaggctc

SEQ ID NO: 158562 - DNA, 24 bp, Artificial Sequence
  Description of Artificial Sequence: Synthetic oligonucleotide
ggagggcccatgaacctaggctcc

SEQ ID NO: 158563 - DNA, 25 bp, Artificial Sequence
  Description of Artificial Sequence: Synthetic oligonucleotide
gagggcccatgaacctaggctccct

SEQ ID NO: 158564 - DNA, 25 bp, Artificial Sequence
  Description of Artificial Sequence: Synthetic oligonucleotide
agggcccatgaacctaggctccctg

SEQ ID NO: 158565 - DNA, 24 bp, Artificial Sequence
  Description of Artificial Sequence: Synthetic oligonucleotide
gggcccatgaacctaggctccctg

SEQ ID NO: 158566 - DNA, 25 bp, Artificial Sequence
  Description of Artificial Sequence: Synthetic oligonucleotide
ggcccatgaacctaggctccctgca

SEQ ID NO: 158567 - DNA, 26 bp, Artificial Sequence
  Description of Artificial Sequence: Synthetic oligonucleotide
gcccatgaacctaggctccctgcagt

SEQ ID NO: 158568 - DNA, 26 bp, Artificial Sequence
  Description of Artificial Sequence: Synthetic oligonucleotide
cccatgaacctaggctccctgcagtg

SEQ ID NO: 158569 - DNA, 26 bp, Artificial Sequence
  Description of Artificial Sequence: Synthetic oligonucleotide
ccatgaacctaggctccctgcagtgc

SEQ ID NO: 158570 - DNA, 26 bp, Artificial Sequence
  Description of Artificial Sequence: Synthetic oligonucleotide
catgaacctaggctccctgcagtgcc

SEQ ID NO: 158571 - DNA, 27 bp, Artificial Sequence
  Description of Artificial Sequence: Synthetic oligonucleotide
atgaacctaggctccctgcagtgccca

SEQ ID NO: 158572 - DNA, 26 bp, Artificial Sequence
  Description of Artificial Sequence: Synthetic oligonucleotide
tgaacctaggctccctgcagtgccca

SEQ ID NO: 158573 - DNA, 25 bp, Artificial Sequence
  Description of Artificial Sequence: Synthetic oligonucleotide
gaacctaggctccctgcagtgccca

SEQ ID NO: 158574 - DNA, 25 bp, Artificial Sequence
  Description of Artificial Sequence: Synthetic oligonucleotide
aacctaggctccctgcagtgcccag

SEQ ID NO: 158575 - DNA, 24 bp, Artificial Sequence
  Description of Artificial Sequence: Synthetic oligonucleotide
acctaggctccctgcagtgcccag

SEQ ID NO: 158576 - DNA, 23 bp, Artificial Sequence
  Description of Artificial Sequence: Synthetic oligonucleotide
cctaggctccctgcagtgcccag

SEQ ID NO: 158577 - DNA, 23 bp, Artificial Sequence
  Description of Artificial Sequence: Synthetic oligonucleotide
ctaggctccctgcagtgcccagc

SEQ ID NO: 158578 - DNA, 24 bp, Artificial Sequence
  Description of Artificial Sequence: Synthetic oligonucleotide
taggctccctgcagtgcccagcgt

SEQ ID NO: 158579 - DNA, 23 bp, Artificial Sequence
  Description of Artificial Sequence: Synthetic oligonucleotide
aggctccctgcagtgcccagcgt

SEQ ID NO: 158580 - DNA, 22 bp, Artificial Sequence
  Description of Artificial Sequence: Synthetic oligonucleotide
ggctccctgcagtgcccagcgt

SEQ ID NO: 158581 - DNA, 25 bp, Artificial Sequence
  Description of Artificial Sequence: Synthetic oligonucleotide
gctccctgcagtgcccagcgtcaat

SEQ ID NO: 158582 - DNA, 25 bp, Artificial Sequence
  Description of Artificial Sequence: Synthetic oligonucleotide
ctccctgcagtgcccagcgtcaatg

SEQ ID NO: 158583 - DNA, 27 bp, Artificial Sequence
  Description of Artificial Sequence: Synthetic oligonucleotide
tccctgcagtgcccagcgtcaatggaa

SEQ ID NO: 158584 - DNA, 26 bp, Artificial Sequence
  Description of Artificial Sequence: Synthetic oligonucleotide
ccctgcagtgcccagcgtcaatggaa

SEQ ID NO: 158585 - DNA, 27 bp, Artificial Sequence
  Description of Artificial Sequence: Synthetic oligonucleotide
cctgcagtgcccagcgtcaatggaaca

SEQ ID NO: 158586 - DNA, 29 bp, Artificial Sequence
  Description of Artificial Sequence: Synthetic oligonucleotide
ctgcagtgcccagcgtcaatggaacattc

SEQ ID NO: 158587 - DNA, 29 bp, Artificial Sequence
  Description of Artificial Sequence: Synthetic oligonucleotide
tgcagtgcccagcgtcaatggaacattcc

SEQ ID NO: 158588 - DNA, 28 bp, Artificial Sequence
  Description of Artificial Sequence: Synthetic oligonucleotide
gcagtgcccagcgtcaatggaacattcc

SEQ ID NO: 158589 - DNA, 29 bp, Artificial Sequence
  Description of Artificial Sequence: Synthetic oligonucleotide
cagtgcccagcgtcaatggaacattccag

SEQ ID NO: 158590 - DNA, 29 bp, Artificial Sequence
  Description of Artificial Sequence: Synthetic oligonucleotide
agtgcccagcgtcaatggaacattccagg

SEQ ID NO: 158591 - DNA, 28 bp, Artificial Sequence
  Description of Artificial Sequence: Synthetic oligonucleotide
gtgcccagcgtcaatggaacattccagg

SEQ ID NO: 158592 - DNA, 28 bp, Artificial Sequence
  Description of Artificial Sequence: Synthetic oligonucleotide
tgcccagcgtcaatggaacattccaggc

SEQ ID NO: 158593 - DNA, 27 bp, Artificial Sequence
  Description of Artificial Sequence: Synthetic oligonucleotide
gcccagcgtcaatggaacattccaggc

SEQ ID NO: 158594 - DNA, 28 bp, Artificial Sequence
  Description of Artificial Sequence: Synthetic oligonucleotide
cccagcgtcaatggaacattccaggctg

SEQ ID NO: 158595 - DNA, 29 bp, Artificial Sequence
  Description of Artificial Sequence: Synthetic oligonucleotide
ccagcgtcaatggaacattccaggctgac

SEQ ID NO: 158596 - DNA, 32 bp, Artificial Sequence
  Description of Artificial Sequence: Synthetic oligonucleotide
cagcgtcaatggaacattccaggctgactttc

SEQ ID NO: 158597 - DNA, 32 bp, Artificial Sequence
  Description of Artificial Sequence: Synthetic oligonucleotide
agcgtcaatggaacattccaggctgactttcc

SEQ ID NO: 158598 - DNA, 31 bp, Artificial Sequence
  Description of Artificial Sequence: Synthetic oligonucleotide
gcgtcaatggaacattccaggctgactttcc

SEQ ID NO: 158599 - DNA, 32 bp, Artificial Sequence
  Description of Artificial Sequence: Synthetic oligonucleotide
cgtcaatggaacattccaggctgactttcctc

SEQ ID NO: 158600 - DNA, 33 bp, Artificial Sequence
  Description of Artificial Sequence: Synthetic oligonucleotide
gtcaatggaacattccaggctgactttcctctg

SEQ ID NO: 158601 - DNA, 33 bp, Artificial Sequence
  Description of Artificial Sequence: Synthetic oligonucleotide
tcaatggaacattccaggctgactttcctctgg

SEQ ID NO: 158602 - DNA, 32 bp, Artificial Sequence
  Description of Artificial Sequence: Synthetic oligonucleotide
caatggaacattccaggctgactttcctctgg

SEQ ID NO: 158603 - DNA, 32 bp, Artificial Sequence
  Description of Artificial Sequence: Synthetic oligonucleotide
aatggaacattccaggctgactttcctctggg

SEQ ID NO: 158604 - DNA, 31 bp, Artificial Sequence
  Description of Artificial Sequence: Synthetic oligonucleotide
atggaacattccaggctgactttcctctggg

SEQ ID NO: 158605 - DNA, 30 bp, Artificial Sequence
  Description of Artificial Sequence: Synthetic oligonucleotide
tggaacattccaggctgactttcctctggg

SEQ ID NO: 158606 - DNA, 26 bp, Artificial Sequence
  Description of Artificial Sequence: Synthetic oligonucleotide
tgccacccacggagggacctacacat

SEQ ID NO: 158607 - DNA, 25 bp, Artificial Sequence
  Description of Artificial Sequence: Synthetic oligonucleotide
gccacccacggagggacctacacat

SEQ ID NO: 158608 - DNA, 25 bp, Artificial Sequence
  Description of Artificial Sequence: Synthetic oligonucleotide
ccacccacggagggacctacacatg

SEQ ID NO: 158609 - DNA, 27 bp, Artificial Sequence
  Description of Artificial Sequence: Synthetic oligonucleotide
cacccacggagggacctacacatgctt

SEQ ID NO: 158610 - DNA, 27 bp, Artificial Sequence
  Description of Artificial Sequence: Synthetic oligonucleotide
acccacggagggacctacacatgcttc

SEQ ID NO: 158611 - DNA, 26 bp, Artificial Sequence
  Description of Artificial Sequence: Synthetic oligonucleotide
cccacggagggacctacacatgcttc

SEQ ID NO: 158612 - DNA, 26 bp, Artificial Sequence
  Description of Artificial Sequence: Synthetic oligonucleotide
ccacggagggacctacacatgcttcg

SEQ ID NO: 158613 - DNA, 26 bp, Artificial Sequence
  Description of Artificial Sequence: Synthetic oligonucleotide
cacggagggacctacacatgcttcgg

SEQ ID NO: 158614 - DNA, 27 bp, Artificial Sequence
  Description of Artificial Sequence: Synthetic oligonucleotide
acggagggacctacacatgcttcggct

SEQ ID NO: 158615 - DNA, 26 bp, Artificial Sequence
  Description of Artificial Sequence: Synthetic oligonucleotide
cggagggacctacacatgcttcggct

SEQ ID NO: 158616 - DNA, 27 bp, Artificial Sequence
  Description of Artificial Sequence: Synthetic oligonucleotide
ggagggacctacacatgcttcggctct

SEQ ID NO: 158617 - DNA, 27 bp, Artificial Sequence
  Description of Artificial Sequence: Synthetic oligonucleotide
gagggacctacacatgcttcggctctc

SEQ ID NO: 158618 - DNA, 28 bp, Artificial Sequence
  Description of Artificial Sequence: Synthetic oligonucleotide
agggacctacacatgcttcggctctctc

SEQ ID NO: 158619 - DNA, 27 bp, Artificial Sequence
  Description of Artificial Sequence: Synthetic oligonucleotide
gggacctacacatgcttcggctctctc

SEQ ID NO: 158620 - DNA, 27 bp, Artificial Sequence
  Description of Artificial Sequence: Synthetic oligonucleotide
ggacctacacatgcttcggctctctcc

SEQ ID NO: 158621 - DNA, 29 bp, Artificial Sequence
  Description of Artificial Sequence: Synthetic oligonucleotide
gacctacacatgcttcggctctctccatg

SEQ ID NO: 158622 - DNA, 30 bp, Artificial Sequence
  Description of Artificial Sequence: Synthetic oligonucleotide
acctacacatgcttcggctctctccatgac

SEQ ID NO: 158623 - DNA, 29 bp, Artificial Sequence
  Description of Artificial Sequence: Synthetic oligonucleotide
cctacacatgcttcggctctctccatgac

SEQ ID NO: 158624 - DNA, 30 bp, Artificial Sequence
  Description of Artificial Sequence: Synthetic oligonucleotide
ctacacatgcttcggctctctccatgactc

SEQ ID NO: 158625 - DNA, 31 bp, Artificial Sequence
  Description of Artificial Sequence: Synthetic oligonucleotide
tacacatgcttcggctctctccatgactcac

SEQ ID NO: 158626 - DNA, 30 bp, Artificial Sequence
  Description of Artificial Sequence: Synthetic oligonucleotide
acacatgcttcggctctctccatgactcac

SEQ ID NO: 158627 - DNA, 29 bp, Artificial Sequence
  Description of Artificial Sequence: Synthetic oligonucleotide
cacatgcttcggctctctccatgactcac

SEQ ID NO: 158628 - DNA, 29 bp, Artificial Sequence
  Description of Artificial Sequence: Synthetic oligonucleotide
acatgcttcggctctctccatgactcacc

SEQ ID NO: 158629 - DNA, 28 bp, Artificial Sequence
  Description of Artificial Sequence: Synthetic oligonucleotide
catgcttcggctctctccatgactcacc

SEQ ID NO: 158630 - DNA, 28 bp, Artificial Sequence
  Description of Artificial Sequence: Synthetic oligonucleotide
atgcttcggctctctccatgactcaccc

SEQ ID NO: 158631 - DNA, 27 bp, Artificial Sequence
  Description of Artificial Sequence: Synthetic oligonucleotide
tgcttcggctctctccatgactcaccc

SEQ ID NO: 158632 - DNA, 27 bp, Artificial Sequence
  Description of Artificial Sequence: Synthetic oligonucleotide
gcttcggctctctccatgactcaccct

SEQ ID NO: 158633 - DNA, 29 bp, Artificial Sequence
  Description of Artificial Sequence: Synthetic oligonucleotide
cttcggctctctccatgactcaccctatg

SEQ ID NO: 158634 - DNA, 30 bp, Artificial Sequence
  Description of Artificial Sequence: Synthetic oligonucleotide
ttcggctctctccatgactcaccctatgag

SEQ ID NO: 158635 - DNA, 29 bp, Artificial Sequence
  Description of Artificial Sequence: Synthetic oligonucleotide
tcggctctctccatgactcaccctatgag

SEQ ID NO: 158636 - DNA, 28 bp, Artificial Sequence
  Description of Artificial Sequence: Synthetic oligonucleotide
cggctctctccatgactcaccctatgag

SEQ ID NO: 158637 - DNA, 29 bp, Artificial Sequence
  Description of Artificial Sequence: Synthetic oligonucleotide
ggctctctccatgactcaccctatgagtg

SEQ ID NO: 158638 - DNA, 29 bp, Artificial Sequence
  Description of Artificial Sequence: Synthetic oligonucleotide
gctctctccatgactcaccctatgagtgg

SEQ ID NO: 158639 - DNA, 30 bp, Artificial Sequence
  Description of Artificial Sequence: Synthetic oligonucleotide
ctctctccatgactcaccctatgagtggtc

SEQ ID NO: 158640 - DNA, 31 bp, Artificial Sequence
  Description of Artificial Sequence: Synthetic oligonucleotide
tctctccatgactcaccctatgagtggtcag

SEQ ID NO: 158641 - DNA, 30 bp, Artificial Sequence
  Description of Artificial Sequence: Synthetic oligonucleotide
ctctccatgactcaccctatgagtggtcag

SEQ ID NO: 158642 - DNA, 31 bp, Artificial Sequence
  Description of Artificial Sequence: Synthetic oligonucleotide
tctccatgactcaccctatgagtggtcagac

SEQ ID NO: 158643 - DNA, 30 bp, Artificial Sequence
  Description of Artificial Sequence: Synthetic oligonucleotide
ctccatgactcaccctatgagtggtcagac

SEQ ID NO: 158644 - DNA, 30 bp, Artificial Sequence
  Description of Artificial Sequence: Synthetic oligonucleotide
tccatgactcaccctatgagtggtcagacc

SEQ ID NO: 158645 - DNA, 29 bp, Artificial Sequence
  Description of Artificial Sequence: Synthetic oligonucleotide
ccatgactcaccctatgagtggtcagacc

SEQ ID NO: 158646 - DNA, 29 bp, Artificial Sequence
  Description of Artificial Sequence: Synthetic oligonucleotide
catgactcaccctatgagtggtcagaccc

SEQ ID NO: 158647 - DNA, 29 bp, Artificial Sequence
  Description of Artificial Sequence: Synthetic oligonucleotide
atgactcaccctatgagtggtcagacccg

SEQ ID NO: 158648 - DNA, 28 bp, Artificial Sequence
  Description of Artificial Sequence: Synthetic oligonucleotide
tgactcaccctatgagtggtcagacccg

SEQ ID NO: 158649 - DNA, 27 bp, Artificial Sequence
  Description of Artificial Sequence: Synthetic oligonucleotide
gactcaccctatgagtggtcagacccg

SEQ ID NO: 158650 - DNA, 28 bp, Artificial Sequence
  Description of Artificial Sequence: Synthetic oligonucleotide
actcaccctatgagtggtcagacccgag

SEQ ID NO: 158651 - DNA, 27 bp, Artificial Sequence
  Description of Artificial Sequence: Synthetic oligonucleotide
ctcaccctatgagtggtcagacccgag

SEQ ID NO: 158652 - DNA, 28 bp, Artificial Sequence
  Description of Artificial Sequence: Synthetic oligonucleotide
tcaccctatgagtggtcagacccgagtg

SEQ ID NO: 158653 - DNA, 27 bp, Artificial Sequence
  Description of Artificial Sequence: Synthetic oligonucleotide
caccctatgagtggtcagacccgagtg

SEQ ID NO: 158654 - DNA, 28 bp, Artificial Sequence
  Description of Artificial Sequence: Synthetic oligonucleotide
accctatgagtggtcagacccgagtgac

SEQ ID NO: 158655 - DNA, 27 bp, Artificial Sequence
  Description of Artificial Sequence: Synthetic oligonucleotide
ccctatgagtggtcagacccgagtgac

SEQ ID NO: 158656 - DNA, 27 bp, Artificial Sequence
  Description of Artificial Sequence: Synthetic oligonucleotide
cctatgagtggtcagacccgagtgacc

SEQ ID NO: 158657 - DNA, 27 bp, Artificial Sequence
  Description of Artificial Sequence: Synthetic oligonucleotide
ctatgagtggtcagacccgagtgaccc

SEQ ID NO: 158658 - DNA, 28 bp, Artificial Sequence
  Description of Artificial Sequence: Synthetic oligonucleotide
tatgagtggtcagacccgagtgacccac

SEQ ID NO: 158659 - DNA, 27 bp, Artificial Sequence
  Description of Artificial Sequence: Synthetic oligonucleotide
atgagtggtcagacccgagtgacccac

SEQ ID NO: 158660 - DNA, 27 bp, Artificial Sequence
  Description of Artificial Sequence: Synthetic oligonucleotide
tgagtggtcagacccgagtgacccact

SEQ ID NO: 158661 - DNA, 27 bp, Artificial Sequence
  Description of Artificial Sequence: Synthetic oligonucleotide
tggtcagacccgagtgacccactgctt

SEQ ID NO: 158662 - DNA, 26 bp, Artificial Sequence
  Description of Artificial Sequence: Synthetic oligonucleotide
ggtcagacccgagtgacccactgctt

SEQ ID NO: 158663 - DNA, 27 bp, Artificial Sequence
  Description of Artificial Sequence: Synthetic oligonucleotide
gtcagacccgagtgacccactgcttgt

SEQ ID NO: 158664 - DNA, 29 bp, Artificial Sequence
  Description of Artificial Sequence: Synthetic oligonucleotide
tcagacccgagtgacccactgcttgtttc

SEQ ID NO: 158665 - DNA, 28 bp, Artificial Sequence
  Description of Artificial Sequence: Synthetic oligonucleotide
cagacccgagtgacccactgcttgtttc

SEQ ID NO: 158666 - DNA, 29 bp, Artificial Sequence
  Description of Artificial Sequence: Synthetic oligonucleotide
agacccgagtgacccactgcttgtttctg

SEQ ID NO: 158667 - DNA, 28 bp, Artificial Sequence
  Description of Artificial Sequence: Synthetic oligonucleotide
gacccgagtgacccactgcttgtttctg

SEQ ID NO: 158668 - DNA, 29 bp, Artificial Sequence
  Description of Artificial Sequence: Synthetic oligonucleotide
acccgagtgacccactgcttgtttctgtc

SEQ ID NO: 158669 - DNA, 28 bp, Artificial Sequence
  Description of Artificial Sequence: Synthetic oligonucleotide
cccgagtgacccactgcttgtttctgtc

SEQ ID NO: 158670 - DNA, 29 bp, Artificial Sequence
  Description of Artificial Sequence: Synthetic oligonucleotide
ccgagtgacccactgcttgtttctgtcac

SEQ ID NO: 158671 - DNA, 33 bp, Artificial Sequence
  Description of Artificial Sequence: Synthetic oligonucleotide
tgacccactgcttgtttctgtcacaggaaactc

SEQ ID NO: 158672 - DNA, 32 bp, Artificial Sequence
  Description of Artificial Sequence: Synthetic oligonucleotide
gacccactgcttgtttctgtcacaggaaactc

SEQ ID NO: 158673 - DNA, 34 bp, Artificial Sequence
  Description of Artificial Sequence: Synthetic oligonucleotide
acccactgcttgtttctgtcacaggaaactcttc

SEQ ID NO: 158674 - DNA, 33 bp, Artificial Sequence
  Description of Artificial Sequence: Synthetic oligonucleotide
cccactgcttgtttctgtcacaggaaactcttc

SEQ ID NO: 158675 - DNA, 35 bp, Artificial Sequence
  Description of Artificial Sequence: Synthetic oligonucleotide
ccactgcttgtttctgtcacaggaaactcttcaag

SEQ ID NO: 158676 - DNA, 37 bp, Artificial Sequence
  Description of Artificial Sequence: Synthetic oligonucleotide
cactgcttgtttctgtcacaggaaactcttcaagtag

SEQ ID NO: 158677 - DNA, 39 bp, Artificial Sequence
  Description of Artificial Sequence: Synthetic oligonucleotide
actgcttgtttctgtcacaggaaactcttcaagtagttc

SEQ ID NO: 158678 - DNA, 38 bp, Artificial Sequence
  Description of Artificial Sequence: Synthetic oligonucleotide
ctgcttgtttctgtcacaggaaactcttcaagtagttc

SEQ ID NO: 158679 - DNA, 40 bp, Artificial Sequence
  Description of Artificial Sequence: Synthetic oligonucleotide
tgcttgtttctgtcacaggaaactcttcaagtagttcatc

SEQ ID NO: 158680 - DNA, 39 bp, Artificial Sequence
  Description of Artificial Sequence: Synthetic oligonucleotide
gcttgtttctgtcacaggaaactcttcaagtagttcatc

SEQ ID NO: 158681 - DNA, 41 bp, Artificial Sequence
  Description of Artificial Sequence: Synthetic oligonucleotide
cttgtttctgtcacaggaaactcttcaagtagttcatcttc

SEQ ID NO: 158682 - DNA, 42 bp, Artificial Sequence
  Description of Artificial Sequence: Synthetic oligonucleotide
ttgtttctgtcacaggaaactcttcaagtagttcatcttcac

SEQ ID NO: 158683 - DNA, 41 bp, Artificial Sequence
  Description of Artificial Sequence: Synthetic oligonucleotide
tgtttctgtcacaggaaactcttcaagtagttcatcttcac

SEQ ID NO: 158684 - DNA, 40 bp, Artificial Sequence
  Description of Artificial Sequence: Synthetic oligonucleotide
gtttctgtcacaggaaactcttcaagtagttcatcttcac

SEQ ID NO: 158685 - DNA, 40 bp, Artificial Sequence
  Description of Artificial Sequence: Synthetic oligonucleotide
tttctgtcacaggaaactcttcaagtagttcatcttcacc

SEQ ID NO: 158686 - DNA, 39 bp, Artificial Sequence
  Description of Artificial Sequence: Synthetic oligonucleotide
ttctgtcacaggaaactcttcaagtagttcatcttcacc

SEQ ID NO: 158687 - DNA, 38 bp, Artificial Sequence
  Description of Artificial Sequence: Synthetic oligonucleotide
tctgtcacaggaaactcttcaagtagttcatcttcacc

SEQ ID NO: 158688 - DNA, 37 bp, Artificial Sequence
  Description of Artificial Sequence: Synthetic oligonucleotide
ctgtcacaggaaactcttcaagtagttcatcttcacc

SEQ ID NO: 158689 - DNA, 37 bp, Artificial Sequence
  Description of Artificial Sequence: Synthetic oligonucleotide
tgtcacaggaaactcttcaagtagttcatcttcaccc

SEQ ID NO: 158690 - DNA, 36 bp, Artificial Sequence
  Description of Artificial Sequence: Synthetic oligonucleotide
gtcacaggaaactcttcaagtagttcatcttcaccc

SEQ ID NO: 158691 - DNA, 37 bp, Artificial Sequence
  Description of Artificial Sequence: Synthetic oligonucleotide
tcacaggaaactcttcaagtagttcatcttcacccac

SEQ ID NO: 158692 - DNA, 36 bp, Artificial Sequence
  Description of Artificial Sequence: Synthetic oligonucleotide
cacaggaaactcttcaagtagttcatcttcacccac

SEQ ID NO: 158693 - DNA, 37 bp, Artificial Sequence
  Description of Artificial Sequence: Synthetic oligonucleotide
acaggaaactcttcaagtagttcatcttcacccactg

SEQ ID NO: 158694 - DNA, 36 bp, Artificial Sequence
  Description of Artificial Sequence: Synthetic oligonucleotide
caggaaactcttcaagtagttcatcttcacccactg

SEQ ID NO: 158695 - DNA, 38 bp, Artificial Sequence
  Description of Artificial Sequence: Synthetic oligonucleotide
aggaaactcttcaagtagttcatcttcacccactgaac

SEQ ID NO: 158696 - DNA, 37 bp, Artificial Sequence
  Description of Artificial Sequence: Synthetic oligonucleotide
ggaaactcttcaagtagttcatcttcacccactgaac

SEQ ID NO: 158697 - DNA, 37 bp, Artificial Sequence
  Description of Artificial Sequence: Synthetic oligonucleotide
gaaactcttcaagtagttcatcttcacccactgaacc

SEQ ID NO: 158698 - DNA, 39 bp, Artificial Sequence
  Description of Artificial Sequence: Synthetic oligonucleotide
aaactcttcaagtagttcatcttcacccactgaaccaag

SEQ ID NO: 158699 - DNA, 38 bp, Artificial Sequence
  Description of Artificial Sequence: Synthetic oligonucleotide
aactcttcaagtagttcatcttcacccactgaaccaag

SEQ ID NO: 158700 - DNA, 37 bp, Artificial Sequence
  Description of Artificial Sequence: Synthetic oligonucleotide
actcttcaagtagttcatcttcacccactgaaccaag

SEQ ID NO: 158701 - DNA, 36 bp, Artificial Sequence
  Description of Artificial Sequence: Synthetic oligonucleotide
ctcttcaagtagttcatcttcacccactgaaccaag

SEQ ID NO: 158702 - DNA, 36 bp, Artificial Sequence
  Description of Artificial Sequence: Synthetic oligonucleotide
tcttcaagtagttcatcttcacccactgaaccaagc

SEQ ID NO: 158703 - DNA, 35 bp, Artificial Sequence
  Description of Artificial Sequence: Synthetic oligonucleotide
cttcaagtagttcatcttcacccactgaaccaagc

SEQ ID NO: 158704 - DNA, 36 bp, Artificial Sequence
  Description of Artificial Sequence: Synthetic oligonucleotide
ttcaagtagttcatcttcacccactgaaccaagctc

SEQ ID NO: 158705 - DNA, 35 bp, Artificial Sequence
  Description of Artificial Sequence: Synthetic oligonucleotide
tcaagtagttcatcttcacccactgaaccaagctc

SEQ ID NO: 158706 - DNA, 34 bp, Artificial Sequence
  Description of Artificial Sequence: Synthetic oligonucleotide
caagtagttcatcttcacccactgaaccaagctc

SEQ ID NO: 158707 - DNA, 34 bp, Artificial Sequence
  Description of Artificial Sequence: Synthetic oligonucleotide
aagtagttcatcttcacccactgaaccaagctcc

SEQ ID NO: 158708 - DNA, 33 bp, Artificial Sequence
  Description of Artificial Sequence: Synthetic oligonucleotide
agtagttcatcttcacccactgaaccaagctcc

SEQ ID NO: 158709 - DNA, 32 bp, Artificial Sequence
  Description of Artificial Sequence: Synthetic oligonucleotide
gtagttcatcttcacccactgaaccaagctcc

SEQ ID NO: 158710 - DNA, 36 bp, Artificial Sequence
  Description of Artificial Sequence: Synthetic oligonucleotide
tagttcatcttcacccactgaaccaagctccaaaac

SEQ ID NO: 158711 - DNA, 35 bp, Artificial Sequence
  Description of Artificial Sequence: Synthetic oligonucleotide
agttcatcttcacccactgaaccaagctccaaaac

SEQ ID NO: 158712 - DNA, 34 bp, Artificial Sequence
  Description of Artificial Sequence: Synthetic oligonucleotide
gttcatcttcacccactgaaccaagctccaaaac

SEQ ID NO: 158713 - DNA, 35 bp, Artificial Sequence
  Description of Artificial Sequence: Synthetic oligonucleotide
ttcatcttcacccactgaaccaagctccaaaactg

SEQ ID NO: 158714 - DNA, 34 bp, Artificial Sequence
  Description of Artificial Sequence: Synthetic oligonucleotide
tcatcttcacccactgaaccaagctccaaaactg

SEQ ID NO: 158715 - DNA, 33 bp, Artificial Sequence
  Description of Artificial Sequence: Synthetic oligonucleotide
catcttcacccactgaaccaagctccaaaactg

SEQ ID NO: 158716 - DNA, 33 bp, Artificial Sequence
  Description of Artificial Sequence: Synthetic oligonucleotide
atcttcacccactgaaccaagctccaaaactgg

SEQ ID NO: 158717 - DNA, 32 bp, Artificial Sequence
  Description of Artificial Sequence: Synthetic oligonucleotide
tcttcacccactgaaccaagctccaaaactgg

SEQ ID NO: 158718 - DNA, 31 bp, Artificial Sequence
  Description of Artificial Sequence: Synthetic oligonucleotide
cttcacccactgaaccaagctccaaaactgg

SEQ ID NO: 158719 - DNA, 34 bp, Artificial Sequence
  Description of Artificial Sequence: Synthetic oligonucleotide
ttcacccactgaaccaagctccaaaactggtatc

SEQ ID NO: 158720 - DNA, 33 bp, Artificial Sequence
  Description of Artificial Sequence: Synthetic oligonucleotide
tcacccactgaaccaagctccaaaactggtatc

SEQ ID NO: 158721 - DNA, 32 bp, Artificial Sequence
  Description of Artificial Sequence: Synthetic oligonucleotide
cacccactgaaccaagctccaaaactggtatc

SEQ ID NO: 158722 - DNA, 32 bp, Artificial Sequence
  Description of Artificial Sequence: Synthetic oligonucleotide
acccactgaaccaagctccaaaactggtatcc

SEQ ID NO: 158723 - DNA, 31 bp, Artificial Sequence
  Description of Artificial Sequence: Synthetic oligonucleotide
cccactgaaccaagctccaaaactggtatcc

SEQ ID NO: 158724 - DNA, 31 bp, Artificial Sequence
  Description of Artificial Sequence: Synthetic oligonucleotide
ccactgaaccaagctccaaaactggtatccg

SEQ ID NO: 158725 - DNA, 31 bp, Artificial Sequence
  Description of Artificial Sequence: Synthetic oligonucleotide
cactgaaccaagctccaaaactggtatccgc

SEQ ID NO: 158726 - DNA, 32 bp, Artificial Sequence
  Description of Artificial Sequence: Synthetic oligonucleotide
actgaaccaagctccaaaactggtatccgcag

SEQ ID NO: 158727 - DNA, 31 bp, Artificial Sequence
  Description of Artificial Sequence: Synthetic oligonucleotide
ctgaaccaagctccaaaactggtatccgcag

SEQ ID NO: 158728 - DNA, 32 bp, Artificial Sequence
  Description of Artificial Sequence: Synthetic oligonucleotide
tgaaccaagctccaaaactggtatccgcagac

SEQ ID NO: 158729 - DNA, 31 bp, Artificial Sequence
  Description of Artificial Sequence: Synthetic oligonucleotide
gaaccaagctccaaaactggtatccgcagac

SEQ ID NO: 158730 - DNA, 32 bp, Artificial Sequence
  Description of Artificial Sequence: Synthetic oligonucleotide
aaccaagctccaaaactggtatccgcagacac

SEQ ID NO: 158731 - DNA, 31 bp, Artificial Sequence
  Description of Artificial Sequence: Synthetic oligonucleotide
accaagctccaaaactggtatccgcagacac

SEQ ID NO: 158732 - DNA, 30 bp, Artificial Sequence
  Description of Artificial Sequence: Synthetic oligonucleotide
ccaagctccaaaactggtatccgcagacac

SEQ ID NO: 158733 - DNA, 30 bp, Artificial Sequence
  Description of Artificial Sequence: Synthetic oligonucleotide
caagctccaaaactggtatccgcagacacc

SEQ ID NO: 158734 - DNA, 31 bp, Artificial Sequence
  Description of Artificial Sequence: Synthetic oligonucleotide
aagctccaaaactggtatccgcagacacctg

SEQ ID NO: 158735 - DNA, 30 bp, Artificial Sequence
  Description of Artificial Sequence: Synthetic oligonucleotide
agctccaaaactggtatccgcagacacctg

SEQ ID NO: 158736 - DNA, 29 bp, Artificial Sequence
  Description of Artificial Sequence: Synthetic oligonucleotide
gctccaaaactggtatccgcagacacctg

SEQ ID NO: 158737 - DNA, 29 bp, Artificial Sequence
  Description of Artificial Sequence: Synthetic oligonucleotide
ctccaaaactggtatccgcagacacctgc

SEQ ID NO: 158738 - DNA, 30 bp, Artificial Sequence
  Description of Artificial Sequence: Synthetic oligonucleotide
tccaaaactggtatccgcagacacctgcac

SEQ ID NO: 158739 - DNA, 29 bp, Artificial Sequence
  Description of Artificial Sequence: Synthetic oligonucleotide
ccaaaactggtatccgcagacacctgcac

SEQ ID NO: 158740 - DNA, 32 bp, Artificial Sequence
  Description of Artificial Sequence: Synthetic oligonucleotide
caaaactggtatccgcagacacctgcacattc

SEQ ID NO: 158741 - DNA, 33 bp, Artificial Sequence
  Description of Artificial Sequence: Synthetic oligonucleotide
aaaactggtatccgcagacacctgcacattctg

SEQ ID NO: 158742 - DNA, 32 bp, Artificial Sequence
  Description of Artificial Sequence: Synthetic oligonucleotide
aaactggtatccgcagacacctgcacattctg

SEQ ID NO: 158743 - DNA, 31 bp, Artificial Sequence
  Description of Artificial Sequence: Synthetic oligonucleotide
aactggtatccgcagacacctgcacattctg

SEQ ID NO: 158744 - DNA, 30 bp, Artificial Sequence
  Description of Artificial Sequence: Synthetic oligonucleotide
actggtatccgcagacacctgcacattctg

SEQ ID NO: 158745 - DNA, 29 bp, Artificial Sequence
  Description of Artificial Sequence: Synthetic oligonucleotide
ctggtatccgcagacacctgcacattctg

SEQ ID NO: 158746 - DNA, 32 bp, Artificial Sequence
  Description of Artificial Sequence: Synthetic oligonucleotide
tggtatccgcagacacctgcacattctgattg

SEQ ID NO: 158747 - DNA, 31 bp, Artificial Sequence
  Description of Artificial Sequence: Synthetic oligonucleotide
ggtatccgcagacacctgcacattctgattg

SEQ ID NO: 158748 - DNA, 31 bp, Artificial Sequence
  Description of Artificial Sequence: Synthetic oligonucleotide
gtatccgcagacacctgcacattctgattgg

SEQ ID NO: 158749 - DNA, 31 bp, Artificial Sequence
  Description of Artificial Sequence: Synthetic oligonucleotide
tatccgcagacacctgcacattctgattggg

SEQ ID NO: 158750 - DNA, 30 bp, Artificial Sequence
  Description of Artificial Sequence: Synthetic oligonucleotide
atccgcagacacctgcacattctgattggg

SEQ ID NO: 158751 - DNA, 29 bp, Artificial Sequence
  Description of Artificial Sequence: Synthetic oligonucleotide
tccgcagacacctgcacattctgattggg

SEQ ID NO: 158752 - DNA, 28 bp, Artificial Sequence
  Description of Artificial Sequence: Synthetic oligonucleotide
ccgcagacacctgcacattctgattggg

SEQ ID NO: 158753 - DNA, 29 bp, Artificial Sequence
  Description of Artificial Sequence: Synthetic oligonucleotide
cgcagacacctgcacattctgattgggac

SEQ ID NO: 158754 - DNA, 29 bp, Artificial Sequence
  Description of Artificial Sequence: Synthetic oligonucleotide
gcagacacctgcacattctgattgggacc

SEQ ID NO: 158755 - DNA, 32 bp, Artificial Sequence
  Description of Artificial Sequence: Synthetic oligonucleotide
tgcacattctgattgggacctcagtggctatc

SEQ ID NO: 158756 - DNA, 31 bp, Artificial Sequence
  Description of Artificial Sequence: Synthetic oligonucleotide
gcacattctgattgggacctcagtggctatc

SEQ ID NO: 158757 - DNA, 33 bp, Artificial Sequence
  Description of Artificial Sequence: Synthetic oligonucleotide
cacattctgattgggacctcagtggctatcatc

SEQ ID NO: 158758 - DNA, 33 bp, Artificial Sequence
  Description of Artificial Sequence: Synthetic oligonucleotide
acattctgattgggacctcagtggctatcatcc

SEQ ID NO: 158759 - DNA, 32 bp, Artificial Sequence
  Description of Artificial Sequence: Synthetic oligonucleotide
cattctgattgggacctcagtggctatcatcc

SEQ ID NO: 158760 - DNA, 33 bp, Artificial Sequence
  Description of Artificial Sequence: Synthetic oligonucleotide
attctgattgggacctcagtggctatcatcctc

SEQ ID NO: 158761 - DNA, 32 bp, Artificial Sequence
  Description of Artificial Sequence: Synthetic oligonucleotide
ttctgattgggacctcagtggctatcatcctc

SEQ ID NO: 158762 - DNA, 31 bp, Artificial Sequence
  Description of Artificial Sequence: Synthetic oligonucleotide
tctgattgggacctcagtggctatcatcctc

SEQ ID NO: 158763 - DNA, 30 bp, Artificial Sequence
  Description of Artificial Sequence: Synthetic oligonucleotide
ctgattgggacctcagtggctatcatcctc

SEQ ID NO: 158764 - DNA, 32 bp, Artificial Sequence
  Description of Artificial Sequence: Synthetic oligonucleotide
tgattgggacctcagtggctatcatcctcttc

SEQ ID NO: 158765 - DNA, 31 bp, Artificial Sequence
  Description of Artificial Sequence: Synthetic oligonucleotide
gattgggacctcagtggctatcatcctcttc

SEQ ID NO: 158766 - DNA, 33 bp, Artificial Sequence
  Description of Artificial Sequence: Synthetic oligonucleotide
attgggacctcagtggctatcatcctcttcatc

SEQ ID NO: 158767 - DNA, 32 bp, Artificial Sequence
  Description of Artificial Sequence: Synthetic oligonucleotide
ttgggacctcagtggctatcatcctcttcatc

SEQ ID NO: 158768 - DNA, 31 bp, Artificial Sequence
  Description of Artificial Sequence: Synthetic oligonucleotide
tgggacctcagtggctatcatcctcttcatc

SEQ ID NO: 158769 - DNA, 30 bp, Artificial Sequence
  Description of Artificial Sequence: Synthetic oligonucleotide
gggacctcagtggctatcatcctcttcatc

SEQ ID NO: 158770 - DNA, 32 bp, Artificial Sequence
  Description of Artificial Sequence: Synthetic oligonucleotide
ggacctcagtggctatcatcctcttcatcatc

SEQ ID NO: 158771 - DNA, 32 bp, Artificial Sequence
  Description of Artificial Sequence: Synthetic oligonucleotide
gacctcagtggctatcatcctcttcatcatcc

SEQ ID NO: 158772 - DNA, 33 bp, Artificial Sequence
  Description of Artificial Sequence: Synthetic oligonucleotide
acctcagtggctatcatcctcttcatcatcctc

SEQ ID NO: 158773 - DNA, 32 bp, Artificial Sequence
  Description of Artificial Sequence: Synthetic oligonucleotide
cctcagtggctatcatcctcttcatcatcctc

SEQ ID NO: 158774 - DNA, 34 bp, Artificial Sequence
  Description of Artificial Sequence: Synthetic oligonucleotide
ctcagtggctatcatcctcttcatcatcctcttc

SEQ ID NO: 158775 - DNA, 36 bp, Artificial Sequence
  Description of Artificial Sequence: Synthetic oligonucleotide
tcagtggctatcatcctcttcatcatcctcttcttc

SEQ ID NO: 158776 - DNA, 35 bp, Artificial Sequence
  Description of Artificial Sequence: Synthetic oligonucleotide
cagtggctatcatcctcttcatcatcctcttcttc

SEQ ID NO: 158777 - DNA, 38 bp, Artificial Sequence
  Description of Artificial Sequence: Synthetic oligonucleotide
agtggctatcatcctcttcatcatcctcttcttctttc

SEQ ID NO: 158778 - DNA, 37 bp, Artificial Sequence
  Description of Artificial Sequence: Synthetic oligonucleotide
gtggctatcatcctcttcatcatcctcttcttctttc

SEQ ID NO: 158779 - DNA, 38 bp, Artificial Sequence
  Description of Artificial Sequence: Synthetic oligonucleotide
tggctatcatcctcttcatcatcctcttcttctttctc

SEQ ID NO: 158780 - DNA, 37 bp, Artificial Sequence
  Description of Artificial Sequence: Synthetic oligonucleotide
ggctatcatcctcttcatcatcctcttcttctttctc

SEQ ID NO: 158781 - DNA, 37 bp, Artificial Sequence
  Description of Artificial Sequence: Synthetic oligonucleotide
gctatcatcctcttcatcatcctcttcttctttctcc

SEQ ID NO: 158782 - DNA, 39 bp, Artificial Sequence
  Description of Artificial Sequence: Synthetic oligonucleotide
ctatcatcctcttcatcatcctcttcttctttctccttc

SEQ ID NO: 158783 - DNA, 42 bp, Artificial Sequence
  Description of Artificial Sequence: Synthetic oligonucleotide
tatcatcctcttcatcatcctcttcttctttctccttcattg

SEQ ID NO: 158784 - DNA, 41 bp, Artificial Sequence
  Description of Artificial Sequence: Synthetic oligonucleotide
atcatcctcttcatcatcctcttcttctttctccttcattg

SEQ ID NO: 158785 - DNA, 40 bp, Artificial Sequence
  Description of Artificial Sequence: Synthetic oligonucleotide
tcatcctcttcatcatcctcttcttctttctccttcattg

SEQ ID NO: 158786 - DNA, 39 bp, Artificial Sequence
  Description of Artificial Sequence: Synthetic oligonucleotide
catcctcttcatcatcctcttcttctttctccttcattg

SEQ ID NO: 158787 - DNA, 39 bp, Artificial Sequence
  Description of Artificial Sequence: Synthetic oligonucleotide
atcctcttcatcatcctcttcttctttctccttcattgc

SEQ ID NO: 158788 - DNA, 38 bp, Artificial Sequence
  Description of Artificial Sequence: Synthetic oligonucleotide
tcctcttcatcatcctcttcttctttctccttcattgc

SEQ ID NO: 158789 - DNA, 37 bp, Artificial Sequence
  Description of Artificial Sequence: Synthetic oligonucleotide
cctcttcatcatcctcttcttctttctccttcattgc

SEQ ID NO: 158790 - DNA, 38 bp, Artificial Sequence
  Description of Artificial Sequence: Synthetic oligonucleotide
ctcttcatcatcctcttcttctttctccttcattgctg

SEQ ID NO: 158791 - DNA, 38 bp, Artificial Sequence
  Description of Artificial Sequence: Synthetic oligonucleotide
tcttcatcatcctcttcttctttctccttcattgctgc

SEQ ID NO: 158792 - DNA, 37 bp, Artificial Sequence
  Description of Artificial Sequence: Synthetic oligonucleotide
cttcatcatcctcttcttctttctccttcattgctgc

SEQ ID NO: 158793 - DNA, 38 bp, Artificial Sequence
  Description of Artificial Sequence: Synthetic oligonucleotide
ttcatcatcctcttcttctttctccttcattgctgctg

SEQ ID NO: 158794 - DNA, 37 bp, Artificial Sequence
  Description of Artificial Sequence: Synthetic oligonucleotide
tcatcatcctcttcttctttctccttcattgctgctg

SEQ ID NO: 158795 - DNA, 36 bp, Artificial Sequence
  Description of Artificial Sequence: Synthetic oligonucleotide
catcatcctcttcttctttctccttcattgctgctg

SEQ ID NO: 158796 - DNA, 36 bp, Artificial Sequence
  Description of Artificial Sequence: Synthetic oligonucleotide
atcatcctcttcttctttctccttcattgctgctgc

SEQ ID NO: 158797 - DNA, 35 bp, Artificial Sequence
  Description of Artificial Sequence: Synthetic oligonucleotide
tcatcctcttcttctttctccttcattgctgctgc

SEQ ID NO: 158798 - DNA, 34 bp, Artificial Sequence
  Description of Artificial Sequence: Synthetic oligonucleotide
catcctcttcttctttctccttcattgctgctgc

SEQ ID NO: 158799 - DNA, 35 bp, Artificial Sequence
  Description of Artificial Sequence: Synthetic oligonucleotide
atcctcttcttctttctccttcattgctgctgctc

SEQ ID NO: 158800 - DNA, 34 bp, Artificial Sequence
  Description of Artificial Sequence: Synthetic oligonucleotide
tcctcttcttctttctccttcattgctgctgctc

SEQ ID NO: 158801 - DNA, 33 bp, Artificial Sequence
  Description of Artificial Sequence: Synthetic oligonucleotide
cctcttcttctttctccttcattgctgctgctc

SEQ ID NO: 158802 - DNA, 33 bp, Artificial Sequence
  Description of Artificial Sequence: Synthetic oligonucleotide
ctcttcttctttctccttcattgctgctgctcc

SEQ ID NO: 158803 - DNA, 35 bp, Artificial Sequence
  Description of Artificial Sequence: Synthetic oligonucleotide
tcttcttctttctccttcattgctgctgctccaac

SEQ ID NO: 158804 - DNA, 34 bp, Artificial Sequence
  Description of Artificial Sequence: Synthetic oligonucleotide
cttcttctttctccttcattgctgctgctccaac

SEQ ID NO: 158805 - DNA, 39 bp, Artificial Sequence
  Description of Artificial Sequence: Synthetic oligonucleotide
ttcttctttctccttcattgctgctgctccaacaaaaag

SEQ ID NO: 158806 - DNA, 38 bp, Artificial Sequence
  Description of Artificial Sequence: Synthetic oligonucleotide
tcttctttctccttcattgctgctgctccaacaaaaag

SEQ ID NO: 158807 - DNA, 37 bp, Artificial Sequence
  Description of Artificial Sequence: Synthetic oligonucleotide
cttctttctccttcattgctgctgctccaacaaaaag

SEQ ID NO: 158808 - DNA, 40 bp, Artificial Sequence
  Description of Artificial Sequence: Synthetic oligonucleotide
ttctttctccttcattgctgctgctccaacaaaaagaatg

SEQ ID NO: 158809 - DNA, 39 bp, Artificial Sequence
  Description of Artificial Sequence: Synthetic oligonucleotide
tctttctccttcattgctgctgctccaacaaaaagaatg

SEQ ID NO: 158810 - DNA, 38 bp, Artificial Sequence
  Description of Artificial Sequence: Synthetic oligonucleotide
ctttctccttcattgctgctgctccaacaaaaagaatg

SEQ ID NO: 158811 - DNA, 38 bp, Artificial Sequence
  Description of Artificial Sequence: Synthetic oligonucleotide
tttctccttcattgctgctgctccaacaaaaagaatgc

SEQ ID NO: 158812 - DNA, 37 bp, Artificial Sequence
  Description of Artificial Sequence: Synthetic oligonucleotide
ttctccttcattgctgctgctccaacaaaaagaatgc

SEQ ID NO: 158813 - DNA, 36 bp, Artificial Sequence
  Description of Artificial Sequence: Synthetic oligonucleotide
tctccttcattgctgctgctccaacaaaaagaatgc

SEQ ID NO: 158814 - DNA, 35 bp, Artificial Sequence
  Description of Artificial Sequence: Synthetic oligonucleotide
ctccttcattgctgctgctccaacaaaaagaatgc

SEQ ID NO: 158815 - DNA, 36 bp, Artificial Sequence
  Description of Artificial Sequence: Synthetic oligonucleotide
tccttcattgctgctgctccaacaaaaagaatgctg

SEQ ID NO: 158816 - DNA, 35 bp, Artificial Sequence
  Description of Artificial Sequence: Synthetic oligonucleotide
ccttcattgctgctgctccaacaaaaagaatgctg

SEQ ID NO: 158817 - DNA, 35 bp, Artificial Sequence
  Description of Artificial Sequence: Synthetic oligonucleotide
cttcattgctgctgctccaacaaaaagaatgctgc

SEQ ID NO: 158818 - DNA, 36 bp, Artificial Sequence
  Description of Artificial Sequence: Synthetic oligonucleotide
ttcattgctgctgctccaacaaaaagaatgctgctg

SEQ ID NO: 158819 - DNA, 35 bp, Artificial Sequence
  Description of Artificial Sequence: Synthetic oligonucleotide
tcattgctgctgctccaacaaaaagaatgctgctg

SEQ ID NO: 158820 - DNA, 34 bp, Artificial Sequence
  Description of Artificial Sequence: Synthetic oligonucleotide
cattgctgctgctccaacaaaaagaatgctgctg

SEQ ID NO: 158821 - DNA, 38 bp, Artificial Sequence
  Description of Artificial Sequence: Synthetic oligonucleotide
attgctgctgctccaacaaaaagaatgctgctgtaatg

SEQ ID NO: 158822 - DNA, 37 bp, Artificial Sequence
  Description of Artificial Sequence: Synthetic oligonucleotide
ttgctgctgctccaacaaaaagaatgctgctgtaatg

SEQ ID NO: 158823 - DNA, 36 bp, Artificial Sequence
  Description of Artificial Sequence: Synthetic oligonucleotide
tgctgctgctccaacaaaaagaatgctgctgtaatg

SEQ ID NO: 158824 - DNA, 35 bp, Artificial Sequence
  Description of Artificial Sequence: Synthetic oligonucleotide
gctgctgctccaacaaaaagaatgctgctgtaatg

SEQ ID NO: 158825 - DNA, 35 bp, Artificial Sequence
  Description of Artificial Sequence: Synthetic oligonucleotide
ctgctgctccaacaaaaagaatgctgctgtaatgg

SEQ ID NO: 158826 - DNA, 36 bp, Artificial Sequence
  Description of Artificial Sequence: Synthetic oligonucleotide
tgctgctccaacaaaaagaatgctgctgtaatggac

SEQ ID NO: 158827 - DNA, 35 bp, Artificial Sequence
  Description of Artificial Sequence: Synthetic oligonucleotide
gctgctccaacaaaaagaatgctgctgtaatggac

SEQ ID NO: 158828 - DNA, 35 bp, Artificial Sequence
  Description of Artificial Sequence: Synthetic oligonucleotide
ctgctccaacaaaaagaatgctgctgtaatggacc

SEQ ID NO: 158829 - DNA, 37 bp, Artificial Sequence
  Description of Artificial Sequence: Synthetic oligonucleotide
tgctccaacaaaaagaatgctgctgtaatggaccaag

SEQ ID NO: 158830 - DNA, 36 bp, Artificial Sequence
  Description of Artificial Sequence: Synthetic oligonucleotide
gctccaacaaaaagaatgctgctgtaatggaccaag

SEQ ID NO: 158831 - DNA, 37 bp, Artificial Sequence
  Description of Artificial Sequence: Synthetic oligonucleotide
ctccaacaaaaagaatgctgctgtaatggaccaagag

SEQ ID NO: 158832 - DNA, 37 bp, Artificial Sequence
  Description of Artificial Sequence: Synthetic oligonucleotide
tccaacaaaaagaatgctgctgtaatggaccaagagc

SEQ ID NO: 158833 - DNA, 36 bp, Artificial Sequence
  Description of Artificial Sequence: Synthetic oligonucleotide
ccaacaaaaagaatgctgctgtaatggaccaagagc

SEQ ID NO: 158834 - DNA, 36 bp, Artificial Sequence
  Description of Artificial Sequence: Synthetic oligonucleotide
caacaaaaagaatgctgctgtaatggaccaagagcc

SEQ ID NO: 158835 - DNA, 37 bp, Artificial Sequence
  Description of Artificial Sequence: Synthetic oligonucleotide
aacaaaaagaatgctgctgtaatggaccaagagcctg

SEQ ID NO: 158836 - DNA, 36 bp, Artificial Sequence
  Description of Artificial Sequence: Synthetic oligonucleotide
acaaaaagaatgctgctgtaatggaccaagagcctg

SEQ ID NO: 158837 - DNA, 35 bp, Artificial Sequence
  Description of Artificial Sequence: Synthetic oligonucleotide
caaaaagaatgctgctgtaatggaccaagagcctg

SEQ ID NO: 158838 - DNA, 35 bp, Artificial Sequence
  Description of Artificial Sequence: Synthetic oligonucleotide
aaaaagaatgctgctgtaatggaccaagagcctgc

SEQ ID NO: 158839 - DNA, 34 bp, Artificial Sequence
  Description of Artificial Sequence: Synthetic oligonucleotide
aaaagaatgctgctgtaatggaccaagagcctgc

SEQ ID NO: 158840 - DNA, 33 bp, Artificial Sequence
  Description of Artificial Sequence: Synthetic oligonucleotide
aaagaatgctgctgtaatggaccaagagcctgc

SEQ ID NO: 158841 - DNA, 32 bp, Artificial Sequence
  Description of Artificial Sequence: Synthetic oligonucleotide
aagaatgctgctgtaatggaccaagagcctgc

SEQ ID NO: 158842 - DNA, 31 bp, Artificial Sequence
  Description of Artificial Sequence: Synthetic oligonucleotide
agaatgctgctgtaatggaccaagagcctgc

SEQ ID NO: 158843 - DNA, 30 bp, Artificial Sequence
  Description of Artificial Sequence: Synthetic oligonucleotide
gaatgctgctgtaatggaccaagagcctgc

SEQ ID NO: 158844 - DNA, 30 bp, Artificial Sequence
  Description of Artificial Sequence: Synthetic oligonucleotide
aatgctgctgtaatggaccaagagcctgcc

SEQ ID NO: 158845 - DNA, 29 bp, Artificial Sequence
  Description of Artificial Sequence: Synthetic oligonucleotide
atgctgctgtaatggaccaagagcctgcc

SEQ ID NO: 158846 - DNA, 28 bp, Artificial Sequence
  Description of Artificial Sequence: Synthetic oligonucleotide
tgctgctgtaatggaccaagagcctgcc

SEQ ID NO: 158847 - DNA, 27 bp, Artificial Sequence
  Description of Artificial Sequence: Synthetic oligonucleotide
gctgctgtaatggaccaagagcctgcc

SEQ ID NO: 158848 - DNA, 27 bp, Artificial Sequence
  Description of Artificial Sequence: Synthetic oligonucleotide
ctgctgtaatggaccaagagcctgccg

SEQ ID NO: 158849 - DNA, 27 bp, Artificial Sequence
  Description of Artificial Sequence: Synthetic oligonucleotide
tgctgtaatggaccaagagcctgccgg

SEQ ID NO: 158850 - DNA, 26 bp, Artificial Sequence
  Description of Artificial Sequence: Synthetic oligonucleotide
gctgtaatggaccaagagcctgccgg

SEQ ID NO: 158851 - DNA, 26 bp, Artificial Sequence
  Description of Artificial Sequence: Synthetic oligonucleotide
ctgtaatggaccaagagcctgccggg

SEQ ID NO: 158852 - DNA, 27 bp, Artificial Sequence
  Description of Artificial Sequence: Synthetic oligonucleotide
tgtaatggaccaagagcctgccgggga

SEQ ID NO: 158853 - DNA, 26 bp, Artificial Sequence
  Description of Artificial Sequence: Synthetic oligonucleotide
gtaatggaccaagagcctgccgggga

SEQ ID NO: 158854 - DNA, 27 bp, Artificial Sequence
  Description of Artificial Sequence: Synthetic oligonucleotide
taatggaccaagagcctgccggggaca

SEQ ID NO: 158855 - DNA, 26 bp, Artificial Sequence
  Description of Artificial Sequence: Synthetic oligonucleotide
aatggaccaagagcctgccggggaca

SEQ ID NO: 158856 - DNA, 25 bp, Artificial Sequence
  Description of Artificial Sequence: Synthetic oligonucleotide
atggaccaagagcctgccggggaca

SEQ ID NO: 158857 - DNA, 24 bp, Artificial Sequence
  Description of Artificial Sequence: Synthetic oligonucleotide
tggaccaagagcctgccggggaca

SEQ ID NO: 158858 - DNA, 23 bp, Artificial Sequence
  Description of Artificial Sequence: Synthetic oligonucleotide
ggaccaagagcctgccggggaca

SEQ ID NO: 158859 - DNA, 25 bp, Artificial Sequence
  Description of Artificial Sequence: Synthetic oligonucleotide
gaccaagagcctgccggggacagaa

SEQ ID NO: 158860 - DNA, 26 bp, Artificial Sequence
  Description of Artificial Sequence: Synthetic oligonucleotide
accaagagcctgccggggacagaaca

SEQ ID NO: 158861 - DNA, 25 bp, Artificial Sequence
  Description of Artificial Sequence: Synthetic oligonucleotide
ccaagagcctgccggggacagaaca

SEQ ID NO: 158862 - DNA, 26 bp, Artificial Sequence
  Description of Artificial Sequence: Synthetic oligonucleotide
caagagcctgccggggacagaacagt

SEQ ID NO: 158863 - DNA, 27 bp, Artificial Sequence
  Description of Artificial Sequence: Synthetic oligonucleotide
aagagcctgccggggacagaacagtga

SEQ ID NO: 158864 - DNA, 27 bp, Artificial Sequence
  Description of Artificial Sequence: Synthetic oligonucleotide
agagcctgccggggacagaacagtgaa

SEQ ID NO: 158865 - DNA, 26 bp, Artificial Sequence
  Description of Artificial Sequence: Synthetic oligonucleotide
gagcctgccggggacagaacagtgaa

SEQ ID NO: 158866 - DNA, 27 bp, Artificial Sequence
  Description of Artificial Sequence: Synthetic oligonucleotide
agcctgccggggacagaacagtgaaca

SEQ ID NO: 158867 - DNA, 26 bp, Artificial Sequence
  Description of Artificial Sequence: Synthetic oligonucleotide
gcctgccggggacagaacagtgaaca

SEQ ID NO: 158868 - DNA, 26 bp, Artificial Sequence
  Description of Artificial Sequence: Synthetic oligonucleotide
cctgccggggacagaacagtgaacag

SEQ ID NO: 158869 - DNA, 26 bp, Artificial Sequence
  Description of Artificial Sequence: Synthetic oligonucleotide
ctgccggggacagaacagtgaacagg

SEQ ID NO: 158870 - DNA, 27 bp, Artificial Sequence
  Description of Artificial Sequence: Synthetic oligonucleotide
tgccggggacagaacagtgaacaggga

SEQ ID NO: 158871 - DNA, 26 bp, Artificial Sequence
  Description of Artificial Sequence: Synthetic oligonucleotide
gccggggacagaacagtgaacaggga

SEQ ID NO: 158872 - DNA, 26 bp, Artificial Sequence
  Description of Artificial Sequence: Synthetic oligonucleotide
ccggggacagaacagtgaacagggag

SEQ ID NO: 158873 - DNA, 27 bp, Artificial Sequence
  Description of Artificial Sequence: Synthetic oligonucleotide
cggggacagaacagtgaacagggagga

SEQ ID NO: 158874 - DNA, 27 bp, Artificial Sequence
  Description of Artificial Sequence: Synthetic oligonucleotide
ggggacagaacagtgaacagggaggac

SEQ ID NO: 158875 - DNA, 28 bp, Artificial Sequence
  Description of Artificial Sequence: Synthetic oligonucleotide
gggacagaacagtgaacagggaggactc

SEQ ID NO: 158876 - DNA, 29 bp, Artificial Sequence
  Description of Artificial Sequence: Synthetic oligonucleotide
ggacagaacagtgaacagggaggactctg

SEQ ID NO: 158877 - DNA, 31 bp, Artificial Sequence
  Description of Artificial Sequence: Synthetic oligonucleotide
gacagaacagtgaacagggaggactctgatg

SEQ ID NO: 158878 - DNA, 33 bp, Artificial Sequence
  Description of Artificial Sequence: Synthetic oligonucleotide
acagaacagtgaacagggaggactctgatgatc

SEQ ID NO: 158879 - DNA, 32 bp, Artificial Sequence
  Description of Artificial Sequence: Synthetic oligonucleotide
cagaacagtgaacagggaggactctgatgatc

SEQ ID NO: 158880 - DNA, 34 bp, Artificial Sequence
  Description of Artificial Sequence: Synthetic oligonucleotide
agaacagtgaacagggaggactctgatgatcaag

SEQ ID NO: 158881 - DNA, 33 bp, Artificial Sequence
  Description of Artificial Sequence: Synthetic oligonucleotide
gaacagtgaacagggaggactctgatgatcaag

SEQ ID NO: 158882 - DNA, 34 bp, Artificial Sequence
  Description of Artificial Sequence: Synthetic oligonucleotide
aacagtgaacagggaggactctgatgatcaagac

SEQ ID NO: 158883 - DNA, 33 bp, Artificial Sequence
  Description of Artificial Sequence: Synthetic oligonucleotide
acagtgaacagggaggactctgatgatcaagac

SEQ ID NO: 158884 - DNA, 32 bp, Artificial Sequence
  Description of Artificial Sequence: Synthetic oligonucleotide
cagtgaacagggaggactctgatgatcaagac

SEQ ID NO: 158885 - DNA, 32 bp, Artificial Sequence
  Description of Artificial Sequence: Synthetic oligonucleotide
agtgaacagggaggactctgatgatcaagacc

SEQ ID NO: 158886 - DNA, 31 bp, Artificial Sequence
  Description of Artificial Sequence: Synthetic oligonucleotide
gtgaacagggaggactctgatgatcaagacc

SEQ ID NO: 158887 - DNA, 31 bp, Artificial Sequence
  Description of Artificial Sequence: Synthetic oligonucleotide
tgaacagggaggactctgatgatcaagaccc

SEQ ID NO: 158888 - DNA, 30 bp, Artificial Sequence
  Description of Artificial Sequence: Synthetic oligonucleotide
gaacagggaggactctgatgatcaagaccc

SEQ ID NO: 158889 - DNA, 31 bp, Artificial Sequence
  Description of Artificial Sequence: Synthetic oligonucleotide
aacagggaggactctgatgatcaagaccctc

SEQ ID NO: 158890 - DNA, 30 bp, Artificial Sequence
  Description of Artificial Sequence: Synthetic oligonucleotide
acagggaggactctgatgatcaagaccctc

SEQ ID NO: 158891 - DNA, 29 bp, Artificial Sequence
  Description of Artificial Sequence: Synthetic oligonucleotide
cagggaggactctgatgatcaagaccctc

SEQ ID NO: 158892 - DNA, 30 bp, Artificial Sequence
  Description of Artificial Sequence: Synthetic oligonucleotide
agggaggactctgatgatcaagaccctcag

SEQ ID NO: 158893 - DNA, 29 bp, Artificial Sequence
  Description of Artificial Sequence: Synthetic oligonucleotide
gggaggactctgatgatcaagaccctcag

SEQ ID NO: 158894 - DNA, 29 bp, Artificial Sequence
  Description of Artificial Sequence: Synthetic oligonucleotide
ggaggactctgatgatcaagaccctcagg

SEQ ID NO: 158895 - DNA, 30 bp, Artificial Sequence
  Description of Artificial Sequence: Synthetic oligonucleotide
gaggactctgatgatcaagaccctcaggag

SEQ ID NO: 158896 - DNA, 30 bp, Artificial Sequence
  Description of Artificial Sequence: Synthetic oligonucleotide
aggactctgatgatcaagaccctcaggagg

SEQ ID NO: 158897 - DNA, 29 bp, Artificial Sequence
  Description of Artificial Sequence: Synthetic oligonucleotide
ggactctgatgatcaagaccctcaggagg

SEQ ID NO: 158898 - DNA, 30 bp, Artificial Sequence
  Description of Artificial Sequence: Synthetic oligonucleotide
gactctgatgatcaagaccctcaggaggtg

SEQ ID NO: 158899 - DNA, 31 bp, Artificial Sequence
  Description of Artificial Sequence: Synthetic oligonucleotide
actctgatgatcaagaccctcaggaggtgac

SEQ ID NO: 158900 - DNA, 30 bp, Artificial Sequence
  Description of Artificial Sequence: Synthetic oligonucleotide
ctctgatgatcaagaccctcaggaggtgac

SEQ ID NO: 158901 - DNA, 34 bp, Artificial Sequence
  Description of Artificial Sequence: Synthetic oligonucleotide
tctgatgatcaagaccctcaggaggtgacatatg

SEQ ID NO: 158902 - DNA, 33 bp, Artificial Sequence
  Description of Artificial Sequence: Synthetic oligonucleotide
ctgatgatcaagaccctcaggaggtgacatatg

SEQ ID NO: 158903 - DNA, 33 bp, Artificial Sequence
  Description of Artificial Sequence: Synthetic oligonucleotide
tgatgatcaagaccctcaggaggtgacatatgc

SEQ ID NO: 158904 - DNA, 32 bp, Artificial Sequence
  Description of Artificial Sequence: Synthetic oligonucleotide
gatgatcaagaccctcaggaggtgacatatgc

SEQ ID NO: 158905 - DNA, 33 bp, Artificial Sequence
  Description of Artificial Sequence: Synthetic oligonucleotide
atgatcaagaccctcaggaggtgacatatgcac

SEQ ID NO: 158906 - DNA, 32 bp, Artificial Sequence
  Description of Artificial Sequence: Synthetic oligonucleotide
tgatcaagaccctcaggaggtgacatatgcac

SEQ ID NO: 158907 - DNA, 31 bp, Artificial Sequence
  Description of Artificial Sequence: Synthetic oligonucleotide
gatcaagaccctcaggaggtgacatatgcac

SEQ ID NO: 158908 - DNA, 32 bp, Artificial Sequence
  Description of Artificial Sequence: Synthetic oligonucleotide
atcaagaccctcaggaggtgacatatgcacag

SEQ ID NO: 158909 - DNA, 31 bp, Artificial Sequence
  Description of Artificial Sequence: Synthetic oligonucleotide
tcaagaccctcaggaggtgacatatgcacag

SEQ ID NO: 158910 - DNA, 30 bp, Artificial Sequence
  Description of Artificial Sequence: Synthetic oligonucleotide
accctcaggaggtgacatatgcacagttgg

SEQ ID NO: 158911 - DNA, 29 bp, Artificial Sequence
  Description of Artificial Sequence: Synthetic oligonucleotide
ccctcaggaggtgacatatgcacagttgg

SEQ ID NO: 158912 - DNA, 31 bp, Artificial Sequence
  Description of Artificial Sequence: Synthetic oligonucleotide
cctcaggaggtgacatatgcacagttggatc

SEQ ID NO: 158913 - DNA, 32 bp, Artificial Sequence
  Description of Artificial Sequence: Synthetic oligonucleotide
ctcaggaggtgacatatgcacagttggatcac

SEQ ID NO: 158914 - DNA, 33 bp, Artificial Sequence
  Description of Artificial Sequence: Synthetic oligonucleotide
tcaggaggtgacatatgcacagttggatcactg

SEQ ID NO: 158915 - DNA, 32 bp, Artificial Sequence
  Description of Artificial Sequence: Synthetic oligonucleotide
caggaggtgacatatgcacagttggatcactg

SEQ ID NO: 158916 - DNA, 32 bp, Artificial Sequence
  Description of Artificial Sequence: Synthetic oligonucleotide
aggaggtgacatatgcacagttggatcactgc

SEQ ID NO: 158917 - DNA, 31 bp, Artificial Sequence
  Description of Artificial Sequence: Synthetic oligonucleotide
ggaggtgacatatgcacagttggatcactgc

SEQ ID NO: 158918 - DNA, 31 bp, Artificial Sequence
  Description of Artificial Sequence: Synthetic oligonucleotide
gaggtgacatatgcacagttggatcactgcg

SEQ ID NO: 158919 - DNA, 35 bp, Artificial Sequence
  Description of Artificial Sequence: Synthetic oligonucleotide
aggtgacatatgcacagttggatcactgcgttttc

SEQ ID NO: 158920 - DNA, 34 bp, Artificial Sequence
  Description of Artificial Sequence: Synthetic oligonucleotide
ggtgacatatgcacagttggatcactgcgttttc

SEQ ID NO: 158921 - DNA, 35 bp, Artificial Sequence
  Description of Artificial Sequence: Synthetic oligonucleotide
gtgacatatgcacagttggatcactgcgttttcac

SEQ ID NO: 158922 - DNA, 36 bp, Artificial Sequence
  Description of Artificial Sequence: Synthetic oligonucleotide
tgacatatgcacagttggatcactgcgttttcacac

SEQ ID NO: 158923 - DNA, 35 bp, Artificial Sequence
  Description of Artificial Sequence: Synthetic oligonucleotide
gacatatgcacagttggatcactgcgttttcacac

SEQ ID NO: 158924 - DNA, 36 bp, Artificial Sequence
  Description of Artificial Sequence: Synthetic oligonucleotide
acatatgcacagttggatcactgcgttttcacacag

SEQ ID NO: 158925 - DNA, 35 bp, Artificial Sequence
  Description of Artificial Sequence: Synthetic oligonucleotide
catatgcacagttggatcactgcgttttcacacag

SEQ ID NO: 158926 - DNA, 36 bp, Artificial Sequence
  Description of Artificial Sequence: Synthetic oligonucleotide
atatgcacagttggatcactgcgttttcacacagac

SEQ ID NO: 158927 - DNA, 35 bp, Artificial Sequence
  Description of Artificial Sequence: Synthetic oligonucleotide
tatgcacagttggatcactgcgttttcacacagac

SEQ ID NO: 158928 - DNA, 34 bp, Artificial Sequence
  Description of Artificial Sequence: Synthetic oligonucleotide
atgcacagttggatcactgcgttttcacacagac

SEQ ID NO: 158929 - DNA, 33 bp, Artificial Sequence
  Description of Artificial Sequence: Synthetic oligonucleotide
tgcacagttggatcactgcgttttcacacagac

SEQ ID NO: 158930 - DNA, 32 bp, Artificial Sequence
  Description of Artificial Sequence: Synthetic oligonucleotide
gcacagttggatcactgcgttttcacacagac

SEQ ID NO: 158931 - DNA, 38 bp, Artificial Sequence
  Description of Artificial Sequence: Synthetic oligonucleotide
cacagttggatcactgcgttttcacacagacaaaaatc

SEQ ID NO: 158932 - DNA, 39 bp, Artificial Sequence
  Description of Artificial Sequence: Synthetic oligonucleotide
acagttggatcactgcgttttcacacagacaaaaatcac

SEQ ID NO: 158933 - DNA, 38 bp, Artificial Sequence
  Description of Artificial Sequence: Synthetic oligonucleotide
cagttggatcactgcgttttcacacagacaaaaatcac

SEQ ID NO: 158934 - DNA, 40 bp, Artificial Sequence
  Description of Artificial Sequence: Synthetic oligonucleotide
agttggatcactgcgttttcacacagacaaaaatcacttc

SEQ ID NO: 158935 - DNA, 39 bp, Artificial Sequence
  Description of Artificial Sequence: Synthetic oligonucleotide
gttggatcactgcgttttcacacagacaaaaatcacttc

SEQ ID NO: 158936 - DNA, 39 bp, Artificial Sequence
  Description of Artificial Sequence: Synthetic oligonucleotide
ttggatcactgcgttttcacacagacaaaaatcacttcc

SEQ ID NO: 158937 - DNA, 38 bp, Artificial Sequence
  Description of Artificial Sequence: Synthetic oligonucleotide
tggatcactgcgttttcacacagacaaaaatcacttcc

SEQ ID NO: 158938 - DNA, 37 bp, Artificial Sequence
  Description of Artificial Sequence: Synthetic oligonucleotide
ggatcactgcgttttcacacagacaaaaatcacttcc

SEQ ID NO: 158939 - DNA, 37 bp, Artificial Sequence
  Description of Artificial Sequence: Synthetic oligonucleotide
gatcactgcgttttcacacagacaaaaatcacttccc

SEQ ID NO: 158940 - DNA, 37 bp, Artificial Sequence
  Description of Artificial Sequence: Synthetic oligonucleotide
atcactgcgttttcacacagacaaaaatcacttcccc

SEQ ID NO: 158941 - DNA, 36 bp, Artificial Sequence
  Description of Artificial Sequence: Synthetic oligonucleotide
tcactgcgttttcacacagacaaaaatcacttcccc

SEQ ID NO: 158942 - DNA, 35 bp, Artificial Sequence
  Description of Artificial Sequence: Synthetic oligonucleotide
cactgcgttttcacacagacaaaaatcacttcccc

SEQ ID NO: 158943 - DNA, 37 bp, Artificial Sequence
  Description of Artificial Sequence: Synthetic oligonucleotide
actgcgttttcacacagacaaaaatcacttccccttc

SEQ ID NO: 158944 - DNA, 36 bp, Artificial Sequence
  Description of Artificial Sequence: Synthetic oligonucleotide
ctgcgttttcacacagacaaaaatcacttccccttc

SEQ ID NO: 158945 - DNA, 37 bp, Artificial Sequence
  Description of Artificial Sequence: Synthetic oligonucleotide
tgcgttttcacacagacaaaaatcacttccccttctc

SEQ ID NO: 158946 - DNA, 36 bp, Artificial Sequence
  Description of Artificial Sequence: Synthetic oligonucleotide
gcgttttcacacagacaaaaatcacttccccttctc

SEQ ID NO: 158947 - DNA, 37 bp, Artificial Sequence
  Description of Artificial Sequence: Synthetic oligonucleotide
cgttttcacacagacaaaaatcacttccccttctcag

SEQ ID NO: 158948 - DNA, 38 bp, Artificial Sequence
  Description of Artificial Sequence: Synthetic oligonucleotide
gttttcacacagacaaaaatcacttccccttctcagag

SEQ ID NO: 158949 - DNA, 38 bp, Artificial Sequence
  Description of Artificial Sequence: Synthetic oligonucleotide
ttttcacacagacaaaaatcacttccccttctcagagg

SEQ ID NO: 158950 - DNA, 37 bp, Artificial Sequence
  Description of Artificial Sequence: Synthetic oligonucleotide
tttcacacagacaaaaatcacttccccttctcagagg

SEQ ID NO: 158951 - DNA, 36 bp, Artificial Sequence
  Description of Artificial Sequence: Synthetic oligonucleotide
ttcacacagacaaaaatcacttccccttctcagagg

SEQ ID NO: 158952 - DNA, 35 bp, Artificial Sequence
  Description of Artificial Sequence: Synthetic oligonucleotide
tcacacagacaaaaatcacttccccttctcagagg

SEQ ID NO: 158953 - DNA, 34 bp, Artificial Sequence
  Description of Artificial Sequence: Synthetic oligonucleotide
cacacagacaaaaatcacttccccttctcagagg

SEQ ID NO: 158954 - DNA, 34 bp, Artificial Sequence
  Description of Artificial Sequence: Synthetic oligonucleotide
acacagacaaaaatcacttccccttctcagaggc

SEQ ID NO: 158955 - DNA, 33 bp, Artificial Sequence
  Description of Artificial Sequence: Synthetic oligonucleotide
cacagacaaaaatcacttccccttctcagaggc

SEQ ID NO: 158956 - DNA, 33 bp, Artificial Sequence
  Description of Artificial Sequence: Synthetic oligonucleotide
acagacaaaaatcacttccccttctcagaggcc

SEQ ID NO: 158957 - DNA, 32 bp, Artificial Sequence
  Description of Artificial Sequence: Synthetic oligonucleotide
cagacaaaaatcacttccccttctcagaggcc

SEQ ID NO: 158958 - DNA, 32 bp, Artificial Sequence
  Description of Artificial Sequence: Synthetic oligonucleotide
agacaaaaatcacttccccttctcagaggccc

SEQ ID NO: 158959 - DNA, 31 bp, Artificial Sequence
  Description of Artificial Sequence: Synthetic oligonucleotide
gacaaaaatcacttccccttctcagaggccc

SEQ ID NO: 158960 - DNA, 33 bp, Artificial Sequence
  Description of Artificial Sequence: Synthetic oligonucleotide
acaaaaatcacttccccttctcagaggcccaag

SEQ ID NO: 158961 - DNA, 32 bp, Artificial Sequence
  Description of Artificial Sequence: Synthetic oligonucleotide
caaaaatcacttccccttctcagaggcccaag

SEQ ID NO: 158962 - DNA, 33 bp, Artificial Sequence
  Description of Artificial Sequence: Synthetic oligonucleotide
aaaaatcacttccccttctcagaggcccaagac

SEQ ID NO: 158963 - DNA, 32 bp, Artificial Sequence
  Description of Artificial Sequence: Synthetic oligonucleotide
aaaatcacttccccttctcagaggcccaagac

SEQ ID NO: 158964 - DNA, 31 bp, Artificial Sequence
  Description of Artificial Sequence: Synthetic oligonucleotide
aaatcacttccccttctcagaggcccaagac

SEQ ID NO: 158965 - DNA, 30 bp, Artificial Sequence
  Description of Artificial Sequence: Synthetic oligonucleotide
aatcacttccccttctcagaggcccaagac

SEQ ID NO: 158966 - DNA, 29 bp, Artificial Sequence
  Description of Artificial Sequence: Synthetic oligonucleotide
atcacttccccttctcagaggcccaagac

SEQ ID NO: 158967 - DNA, 28 bp, Artificial Sequence
  Description of Artificial Sequence: Synthetic oligonucleotide
tcacttccccttctcagaggcccaagac

SEQ ID NO: 158968 - DNA, 27 bp, Artificial Sequence
  Description of Artificial Sequence: Synthetic oligonucleotide
cacttccccttctcagaggcccaagac

SEQ ID NO: 158969 - DNA, 28 bp, Artificial Sequence
  Description of Artificial Sequence: Synthetic oligonucleotide
acttccccttctcagaggcccaagacac

SEQ ID NO: 158970 - DNA, 27 bp, Artificial Sequence
  Description of Artificial Sequence: Synthetic oligonucleotide
cttccccttctcagaggcccaagacac

SEQ ID NO: 158971 - DNA, 27 bp, Artificial Sequence
  Description of Artificial Sequence: Synthetic oligonucleotide
ttccccttctcagaggcccaagacacc

SEQ ID NO: 158972 - DNA, 27 bp, Artificial Sequence
  Description of Artificial Sequence: Synthetic oligonucleotide
tccccttctcagaggcccaagacacct

SEQ ID NO: 158973 - DNA, 26 bp, Artificial Sequence
  Description of Artificial Sequence: Synthetic oligonucleotide
ccccttctcagaggcccaagacacct

SEQ ID NO: 158974 - DNA, 26 bp, Artificial Sequence
  Description of Artificial Sequence: Synthetic oligonucleotide
cccttctcagaggcccaagacacctc

SEQ ID NO: 158975 - DNA, 27 bp, Artificial Sequence
  Description of Artificial Sequence: Synthetic oligonucleotide
ccttctcagaggcccaagacacctcca

SEQ ID NO: 158976 - DNA, 28 bp, Artificial Sequence
  Description of Artificial Sequence: Synthetic oligonucleotide
cttctcagaggcccaagacacctccaac

SEQ ID NO: 158977 - DNA, 29 bp, Artificial Sequence
  Description of Artificial Sequence: Synthetic oligonucleotide
ttctcagaggcccaagacacctccaacag

SEQ ID NO: 158978 - DNA, 28 bp, Artificial Sequence
  Description of Artificial Sequence: Synthetic oligonucleotide
tctcagaggcccaagacacctccaacag

SEQ ID NO: 158979 - DNA, 27 bp, Artificial Sequence
  Description of Artificial Sequence: Synthetic oligonucleotide
ctcagaggcccaagacacctccaacag

SEQ ID NO: 158980 - DNA, 30 bp, Artificial Sequence
  Description of Artificial Sequence: Synthetic oligonucleotide
tcagaggcccaagacacctccaacagatac

SEQ ID NO: 158981 - DNA, 29 bp, Artificial Sequence
  Description of Artificial Sequence: Synthetic oligonucleotide
cagaggcccaagacacctccaacagatac

SEQ ID NO: 158982 - DNA, 29 bp, Artificial Sequence
  Description of Artificial Sequence: Synthetic oligonucleotide
agaggcccaagacacctccaacagatacc

SEQ ID NO: 158983 - DNA, 28 bp, Artificial Sequence
  Description of Artificial Sequence: Synthetic oligonucleotide
gaggcccaagacacctccaacagatacc

SEQ ID NO: 158984 - DNA, 29 bp, Artificial Sequence
  Description of Artificial Sequence: Synthetic oligonucleotide
aggcccaagacacctccaacagataccac

SEQ ID NO: 158985 - DNA, 28 bp, Artificial Sequence
  Description of Artificial Sequence: Synthetic oligonucleotide
ggcccaagacacctccaacagataccac

SEQ ID NO: 158986 - DNA, 28 bp, Artificial Sequence
  Description of Artificial Sequence: Synthetic oligonucleotide
gcccaagacacctccaacagataccacc

SEQ ID NO: 158987 - DNA, 30 bp, Artificial Sequence
  Description of Artificial Sequence: Synthetic oligonucleotide
cccaagacacctccaacagataccaccatg

SEQ ID NO: 158988 - DNA, 32 bp, Artificial Sequence
  Description of Artificial Sequence: Synthetic oligonucleotide
ccaagacacctccaacagataccaccatgtac

SEQ ID NO: 158989 - DNA, 34 bp, Artificial Sequence
  Description of Artificial Sequence: Synthetic oligonucleotide
caagacacctccaacagataccaccatgtacatg

SEQ ID NO: 158990 - DNA, 34 bp, Artificial Sequence
  Description of Artificial Sequence: Synthetic oligonucleotide
aagacacctccaacagataccaccatgtacatgg

SEQ ID NO: 158991 - DNA, 33 bp, Artificial Sequence
  Description of Artificial Sequence: Synthetic oligonucleotide
agacacctccaacagataccaccatgtacatgg

SEQ ID NO: 158992 - DNA, 32 bp, Artificial Sequence
  Description of Artificial Sequence: Synthetic oligonucleotide
gacacctccaacagataccaccatgtacatgg

SEQ ID NO: 158993 - DNA, 34 bp, Artificial Sequence
  Description of Artificial Sequence: Synthetic oligonucleotide
acacctccaacagataccaccatgtacatggaac

SEQ ID NO: 158994 - DNA, 33 bp, Artificial Sequence
  Description of Artificial Sequence: Synthetic oligonucleotide
cacctccaacagataccaccatgtacatggaac

SEQ ID NO: 158995 - DNA, 35 bp, Artificial Sequence
  Description of Artificial Sequence: Synthetic oligonucleotide
acctccaacagataccaccatgtacatggaacttc

SEQ ID NO: 158996 - DNA, 34 bp, Artificial Sequence
  Description of Artificial Sequence: Synthetic oligonucleotide
cctccaacagataccaccatgtacatggaacttc

SEQ ID NO: 158997 - DNA, 34 bp, Artificial Sequence
  Description of Artificial Sequence: Synthetic oligonucleotide
ctccaacagataccaccatgtacatggaacttcc

SEQ ID NO: 158998 - DNA, 38 bp, Artificial Sequence
  Description of Artificial Sequence: Synthetic oligonucleotide
tccaacagataccaccatgtacatggaacttccaaatg

SEQ ID NO: 158999 - DNA, 37 bp, Artificial Sequence
  Description of Artificial Sequence: Synthetic oligonucleotide
ccaacagataccaccatgtacatggaacttccaaatg

SEQ ID NO: 159000 - DNA, 37 bp, Artificial Sequence
  Description of Artificial Sequence: Synthetic oligonucleotide
caacagataccaccatgtacatggaacttccaaatgc

SEQ ID NO: 159001 - DNA, 40 bp, Artificial Sequence
  Description of Artificial Sequence: Synthetic oligonucleotide
aacagataccaccatgtacatggaacttccaaatgctaag

SEQ ID NO: 159002 - DNA, 39 bp, Artificial Sequence
  Description of Artificial Sequence: Synthetic oligonucleotide
acagataccaccatgtacatggaacttccaaatgctaag

SEQ ID NO: 159003 - DNA, 38 bp, Artificial Sequence
  Description of Artificial Sequence: Synthetic oligonucleotide
cagataccaccatgtacatggaacttccaaatgctaag

SEQ ID NO: 159004 - DNA, 38 bp, Artificial Sequence
  Description of Artificial Sequence: Synthetic oligonucleotide
agataccaccatgtacatggaacttccaaatgctaagc

SEQ ID NO: 159005 - DNA, 37 bp, Artificial Sequence
  Description of Artificial Sequence: Synthetic oligonucleotide
gataccaccatgtacatggaacttccaaatgctaagc

SEQ ID NO: 159006 - DNA, 37 bp, Artificial Sequence
  Description of Artificial Sequence: Synthetic oligonucleotide
ataccaccatgtacatggaacttccaaatgctaagcc

SEQ ID NO: 159007 - DNA, 36 bp, Artificial Sequence
  Description of Artificial Sequence: Synthetic oligonucleotide
taccaccatgtacatggaacttccaaatgctaagcc

SEQ ID NO: 159008 - DNA, 35 bp, Artificial Sequence
  Description of Artificial Sequence: Synthetic oligonucleotide
accaccatgtacatggaacttccaaatgctaagcc

SEQ ID NO: 159009 - DNA, 34 bp, Artificial Sequence
  Description of Artificial Sequence: Synthetic oligonucleotide
ccaccatgtacatggaacttccaaatgctaagcc

SEQ ID NO: 159010 - DNA, 36 bp, Artificial Sequence
  Description of Artificial Sequence: Synthetic oligonucleotide
caccatgtacatggaacttccaaatgctaagccaag

SEQ ID NO: 159011 - DNA, 38 bp, Artificial Sequence
  Description of Artificial Sequence: Synthetic oligonucleotide
accatgtacatggaacttccaaatgctaagccaagatc

SEQ ID NO: 159012 - DNA, 37 bp, Artificial Sequence
  Description of Artificial Sequence: Synthetic oligonucleotide
ccatgtacatggaacttccaaatgctaagccaagatc

SEQ ID NO: 159013 - DNA, 40 bp, Artificial Sequence
  Description of Artificial Sequence: Synthetic oligonucleotide
catgtacatggaacttccaaatgctaagccaagatcattg

SEQ ID NO: 159014 - DNA, 41 bp, Artificial Sequence
  Description of Artificial Sequence: Synthetic oligonucleotide
atgtacatggaacttccaaatgctaagccaagatcattgtc

SEQ ID NO: 159015 - DNA, 40 bp, Artificial Sequence
  Description of Artificial Sequence: Synthetic oligonucleotide
tgtacatggaacttccaaatgctaagccaagatcattgtc

SEQ ID NO: 159016 - DNA, 39 bp, Artificial Sequence
  Description of Artificial Sequence: Synthetic oligonucleotide
gtacatggaacttccaaatgctaagccaagatcattgtc

SEQ ID NO: 159017 - DNA, 40 bp, Artificial Sequence
  Description of Artificial Sequence: Synthetic oligonucleotide
tacatggaacttccaaatgctaagccaagatcattgtctc

SEQ ID NO: 159018 - DNA, 39 bp, Artificial Sequence
  Description of Artificial Sequence: Synthetic oligonucleotide
acatggaacttccaaatgctaagccaagatcattgtctc

SEQ ID NO: 159019 - DNA, 38 bp, Artificial Sequence
  Description of Artificial Sequence: Synthetic oligonucleotide
catggaacttccaaatgctaagccaagatcattgtctc

SEQ ID NO: 159020 - DNA, 38 bp, Artificial Sequence
  Description of Artificial Sequence: Synthetic oligonucleotide
atggaacttccaaatgctaagccaagatcattgtctcc

SEQ ID NO: 159021 - DNA, 37 bp, Artificial Sequence
  Description of Artificial Sequence: Synthetic oligonucleotide
tggaacttccaaatgctaagccaagatcattgtctcc

SEQ ID NO: 159022 - DNA, 36 bp, Artificial Sequence
  Description of Artificial Sequence: Synthetic oligonucleotide
ggaacttccaaatgctaagccaagatcattgtctcc

SEQ ID NO: 159023 - DNA, 37 bp, Artificial Sequence
  Description of Artificial Sequence: Synthetic oligonucleotide
gaacttccaaatgctaagccaagatcattgtctcctg

SEQ ID NO: 159024 - DNA, 37 bp, Artificial Sequence
  Description of Artificial Sequence: Synthetic oligonucleotide
aacttccaaatgctaagccaagatcattgtctcctgc

SEQ ID NO: 159025 - DNA, 36 bp, Artificial Sequence
  Description of Artificial Sequence: Synthetic oligonucleotide
acttccaaatgctaagccaagatcattgtctcctgc

SEQ ID NO: 159026 - DNA, 35 bp, Artificial Sequence
  Description of Artificial Sequence: Synthetic oligonucleotide
cttccaaatgctaagccaagatcattgtctcctgc

SEQ ID NO: 159027 - DNA, 35 bp, Artificial Sequence
  Description of Artificial Sequence: Synthetic oligonucleotide
ttccaaatgctaagccaagatcattgtctcctgcc

SEQ ID NO: 159028 - DNA, 34 bp, Artificial Sequence
  Description of Artificial Sequence: Synthetic oligonucleotide
tccaaatgctaagccaagatcattgtctcctgcc

SEQ ID NO: 159029 - DNA, 33 bp, Artificial Sequence
  Description of Artificial Sequence: Synthetic oligonucleotide
ccaaatgctaagccaagatcattgtctcctgcc

SEQ ID NO: 159030 - DNA, 33 bp, Artificial Sequence
  Description of Artificial Sequence: Synthetic oligonucleotide
caaatgctaagccaagatcattgtctcctgccc

SEQ ID NO: 159031 - DNA, 37 bp, Artificial Sequence
  Description of Artificial Sequence: Synthetic oligonucleotide
aaatgctaagccaagatcattgtctcctgcccataag

SEQ ID NO: 159032 - DNA, 36 bp, Artificial Sequence
  Description of Artificial Sequence: Synthetic oligonucleotide
aatgctaagccaagatcattgtctcctgcccataag

SEQ ID NO: 159033 - DNA, 35 bp, Artificial Sequence
  Description of Artificial Sequence: Synthetic oligonucleotide
atgctaagccaagatcattgtctcctgcccataag

SEQ ID NO: 159034 - DNA, 34 bp, Artificial Sequence
  Description of Artificial Sequence: Synthetic oligonucleotide
tgctaagccaagatcattgtctcctgcccataag

SEQ ID NO: 159035 - DNA, 33 bp, Artificial Sequence
  Description of Artificial Sequence: Synthetic oligonucleotide
gctaagccaagatcattgtctcctgcccataag

SEQ ID NO: 159036 - DNA, 33 bp, Artificial Sequence
  Description of Artificial Sequence: Synthetic oligonucleotide
ctaagccaagatcattgtctcctgcccataagc

SEQ ID NO: 159037 - DNA, 34 bp, Artificial Sequence
  Description of Artificial Sequence: Synthetic oligonucleotide
taagccaagatcattgtctcctgcccataagcac

SEQ ID NO: 159038 - DNA, 33 bp, Artificial Sequence
  Description of Artificial Sequence: Synthetic oligonucleotide
aagccaagatcattgtctcctgcccataagcac

SEQ ID NO: 159039 - DNA, 32 bp, Artificial Sequence
  Description of Artificial Sequence: Synthetic oligonucleotide
agccaagatcattgtctcctgcccataagcac

SEQ ID NO: 159040 - DNA, 31 bp, Artificial Sequence
  Description of Artificial Sequence: Synthetic oligonucleotide
gccaagatcattgtctcctgcccataagcac

SEQ ID NO: 159041 - DNA, 31 bp, Artificial Sequence
  Description of Artificial Sequence: Synthetic oligonucleotide
ccaagatcattgtctcctgcccataagcacc

SEQ ID NO: 159042 - DNA, 32 bp, Artificial Sequence
  Description of Artificial Sequence: Synthetic oligonucleotide
caagatcattgtctcctgcccataagcaccac

SEQ ID NO: 159043 - DNA, 33 bp, Artificial Sequence
  Description of Artificial Sequence: Synthetic oligonucleotide
aagatcattgtctcctgcccataagcaccacag

SEQ ID NO: 159044 - DNA, 32 bp, Artificial Sequence
  Description of Artificial Sequence: Synthetic oligonucleotide
agatcattgtctcctgcccataagcaccacag

SEQ ID NO: 159045 - DNA, 31 bp, Artificial Sequence
  Description of Artificial Sequence: Synthetic oligonucleotide
gatcattgtctcctgcccataagcaccacag

SEQ ID NO: 159046 - DNA, 32 bp, Artificial Sequence
  Description of Artificial Sequence: Synthetic oligonucleotide
atcattgtctcctgcccataagcaccacagtc

SEQ ID NO: 159047 - DNA, 31 bp, Artificial Sequence
  Description of Artificial Sequence: Synthetic oligonucleotide
tcattgtctcctgcccataagcaccacagtc

SEQ ID NO: 159048 - DNA, 30 bp, Artificial Sequence
  Description of Artificial Sequence: Synthetic oligonucleotide
cattgtctcctgcccataagcaccacagtc

SEQ ID NO: 159049 - DNA, 31 bp, Artificial Sequence
  Description of Artificial Sequence: Synthetic oligonucleotide
attgtctcctgcccataagcaccacagtcag

SEQ ID NO: 159050 - DNA, 30 bp, Artificial Sequence
  Description of Artificial Sequence: Synthetic oligonucleotide
ttgtctcctgcccataagcaccacagtcag

SEQ ID NO: 159051 - DNA, 29 bp, Artificial Sequence
  Description of Artificial Sequence: Synthetic oligonucleotide
tgtctcctgcccataagcaccacagtcag

SEQ ID NO: 159052 - DNA, 28 bp, Artificial Sequence
  Description of Artificial Sequence: Synthetic oligonucleotide
gtctcctgcccataagcaccacagtcag

SEQ ID NO: 159053 - DNA, 28 bp, Artificial Sequence
  Description of Artificial Sequence: Synthetic oligonucleotide
tctcctgcccataagcaccacagtcagg

SEQ ID NO: 159054 - DNA, 27 bp, Artificial Sequence
  Description of Artificial Sequence: Synthetic oligonucleotide
ctcctgcccataagcaccacagtcagg

SEQ ID NO: 159055 - DNA, 27 bp, Artificial Sequence
  Description of Artificial Sequence: Synthetic oligonucleotide
tcctgcccataagcaccacagtcaggc

SEQ ID NO: 159056 - DNA, 26 bp, Artificial Sequence
  Description of Artificial Sequence: Synthetic oligonucleotide
cctgcccataagcaccacagtcaggc

SEQ ID NO: 159057 - DNA, 27 bp, Artificial Sequence
  Description of Artificial Sequence: Synthetic oligonucleotide
ctgcccataagcaccacagtcaggcct

SEQ ID NO: 159058 - DNA, 28 bp, Artificial Sequence
  Description of Artificial Sequence: Synthetic oligonucleotide
tgcccataagcaccacagtcaggccttg

SEQ ID NO: 159059 - DNA, 27 bp, Artificial Sequence
  Description of Artificial Sequence: Synthetic oligonucleotide
gcccataagcaccacagtcaggccttg

SEQ ID NO: 159060 - DNA, 28 bp, Artificial Sequence
  Description of Artificial Sequence: Synthetic oligonucleotide
cccataagcaccacagtcaggccttgag

SEQ ID NO: 159061 - DNA, 28 bp, Artificial Sequence
  Description of Artificial Sequence: Synthetic oligonucleotide
ccataagcaccacagtcaggccttgagg

SEQ ID NO: 159062 - DNA, 28 bp, Artificial Sequence
  Description of Artificial Sequence: Synthetic oligonucleotide
cataagcaccacagtcaggccttgaggg

SEQ ID NO: 159063 - DNA, 28 bp, Artificial Sequence
  Description of Artificial Sequence: Synthetic oligonucleotide
ataagcaccacagtcaggccttgagggg

SEQ ID NO: 159064 - DNA, 27 bp, Artificial Sequence
  Description of Artificial Sequence: Synthetic oligonucleotide
taagcaccacagtcaggccttgagggg

SEQ ID NO: 159065 - DNA, 27 bp, Artificial Sequence
  Description of Artificial Sequence: Synthetic oligonucleotide
aagcaccacagtcaggccttgagggga

SEQ ID NO: 159066 - DNA, 27 bp, Artificial Sequence
  Description of Artificial Sequence: Synthetic oligonucleotide
agcaccacagtcaggccttgaggggat

SEQ ID NO: 159067 - DNA, 26 bp, Artificial Sequence
  Description of Artificial Sequence: Synthetic oligonucleotide
gcaccacagtcaggccttgaggggat

SEQ ID NO: 159068 - DNA, 27 bp, Artificial Sequence
  Description of Artificial Sequence: Synthetic oligonucleotide
caccacagtcaggccttgaggggatct

SEQ ID NO: 159069 - DNA, 28 bp, Artificial Sequence
  Description of Artificial Sequence: Synthetic oligonucleotide
accacagtcaggccttgaggggatcttc

SEQ ID NO: 159070 - DNA, 27 bp, Artificial Sequence
  Description of Artificial Sequence: Synthetic oligonucleotide
ccacagtcaggccttgaggggatcttc

SEQ ID NO: 159071 - DNA, 29 bp, Artificial Sequence
  Description of Artificial Sequence: Synthetic oligonucleotide
cacagtcaggccttgaggggatcttctag

SEQ ID NO: 159072 - DNA, 29 bp, Artificial Sequence
  Description of Artificial Sequence: Synthetic oligonucleotide
acagtcaggccttgaggggatcttctagg

SEQ ID NO: 159073 - DNA, 28 bp, Artificial Sequence
  Description of Artificial Sequence: Synthetic oligonucleotide
cagtcaggccttgaggggatcttctagg

SEQ ID NO: 159074 - DNA, 28 bp, Artificial Sequence
  Description of Artificial Sequence: Synthetic oligonucleotide
agtcaggccttgaggggatcttctaggg

SEQ ID NO: 159075 - DNA, 27 bp, Artificial Sequence
  Description of Artificial Sequence: Synthetic oligonucleotide
gtcaggccttgaggggatcttctaggg

SEQ ID NO: 159076 - DNA, 28 bp, Artificial Sequence
  Description of Artificial Sequence: Synthetic oligonucleotide
tcaggccttgaggggatcttctagggag

SEQ ID NO: 159077 - DNA, 27 bp, Artificial Sequence
  Description of Artificial Sequence: Synthetic oligonucleotide
caggccttgaggggatcttctagggag

SEQ ID NO: 159078 - DNA, 28 bp, Artificial Sequence
  Description of Artificial Sequence: Synthetic oligonucleotide
aggccttgaggggatcttctagggagac

SEQ ID NO: 159079 - DNA, 27 bp, Artificial Sequence
  Description of Artificial Sequence: Synthetic oligonucleotide
ggccttgaggggatcttctagggagac

SEQ ID NO: 159080 - DNA, 29 bp, Artificial Sequence
  Description of Artificial Sequence: Synthetic oligonucleotide
gccttgaggggatcttctagggagacaac

SEQ ID NO: 159081 - DNA, 30 bp, Artificial Sequence
  Description of Artificial Sequence: Synthetic oligonucleotide
ccttgaggggatcttctagggagacaacag

SEQ ID NO: 159082 - DNA, 30 bp, Artificial Sequence
  Description of Artificial Sequence: Synthetic oligonucleotide
cttgaggggatcttctagggagacaacagc

SEQ ID NO: 159083 - DNA, 30 bp, Artificial Sequence
  Description of Artificial Sequence: Synthetic oligonucleotide
ttgaggggatcttctagggagacaacagcc

SEQ ID NO: 159084 - DNA, 29 bp, Artificial Sequence
  Description of Artificial Sequence: Synthetic oligonucleotide
tgaggggatcttctagggagacaacagcc

SEQ ID NO: 159085 - DNA, 28 bp, Artificial Sequence
  Description of Artificial Sequence: Synthetic oligonucleotide
gaggggatcttctagggagacaacagcc

SEQ ID NO: 159086 - DNA, 28 bp, Artificial Sequence
  Description of Artificial Sequence: Synthetic oligonucleotide
aggggatcttctagggagacaacagccc

SEQ ID NO: 159087 - DNA, 27 bp, Artificial Sequence
  Description of Artificial Sequence: Synthetic oligonucleotide
ggggatcttctagggagacaacagccc

SEQ ID NO: 159088 - DNA, 34 bp, Artificial Sequence
  Description of Artificial Sequence: Synthetic oligonucleotide
atcttctagggagacaacagccctgtctcaaaac

SEQ ID NO: 159089 - DNA, 33 bp, Artificial Sequence
  Description of Artificial Sequence: Synthetic oligonucleotide
tcttctagggagacaacagccctgtctcaaaac

SEQ ID NO: 159090 - DNA, 32 bp, Artificial Sequence
  Description of Artificial Sequence: Synthetic oligonucleotide
cttctagggagacaacagccctgtctcaaaac

SEQ ID NO: 159091 - DNA, 32 bp, Artificial Sequence
  Description of Artificial Sequence: Synthetic oligonucleotide
ttctagggagacaacagccctgtctcaaaacc

SEQ ID NO: 159092 - DNA, 31 bp, Artificial Sequence
  Description of Artificial Sequence: Synthetic oligonucleotide
tctagggagacaacagccctgtctcaaaacc

SEQ ID NO: 159093 - DNA, 30 bp, Artificial Sequence
  Description of Artificial Sequence: Synthetic oligonucleotide
ctagggagacaacagccctgtctcaaaacc

SEQ ID NO: 159094 - DNA, 30 bp, Artificial Sequence
  Description of Artificial Sequence: Synthetic oligonucleotide
tagggagacaacagccctgtctcaaaaccg

SEQ ID NO: 159095 - DNA, 29 bp, Artificial Sequence
  Description of Artificial Sequence: Synthetic oligonucleotide
agggagacaacagccctgtctcaaaaccg

SEQ ID NO: 159096 - DNA, 28 bp, Artificial Sequence
  Description of Artificial Sequence: Synthetic oligonucleotide
gggagacaacagccctgtctcaaaaccg

SEQ ID NO: 159097 - DNA, 28 bp, Artificial Sequence
  Description of Artificial Sequence: Synthetic oligonucleotide
ggagacaacagccctgtctcaaaaccgg

SEQ ID NO: 159098 - DNA, 28 bp, Artificial Sequence
  Description of Artificial Sequence: Synthetic oligonucleotide
gagacaacagccctgtctcaaaaccggg

SEQ ID NO: 159099 - DNA, 30 bp, Artificial Sequence
  Description of Artificial Sequence: Synthetic oligonucleotide
agacaacagccctgtctcaaaaccgggttg

SEQ ID NO: 159100 - DNA, 29 bp, Artificial Sequence
  Description of Artificial Sequence: Synthetic oligonucleotide
gacaacagccctgtctcaaaaccgggttg

SEQ ID NO: 159101 - DNA, 29 bp, Artificial Sequence
  Description of Artificial Sequence: Synthetic oligonucleotide
acaacagccctgtctcaaaaccgggttgc

SEQ ID NO: 159102 - DNA, 28 bp, Artificial Sequence
  Description of Artificial Sequence: Synthetic oligonucleotide
caacagccctgtctcaaaaccgggttgc

SEQ ID NO: 159103 - DNA, 30 bp, Artificial Sequence
  Description of Artificial Sequence: Synthetic oligonucleotide
aacagccctgtctcaaaaccgggttgctag

SEQ ID NO: 159104 - DNA, 29 bp, Artificial Sequence
  Description of Artificial Sequence: Synthetic oligonucleotide
acagccctgtctcaaaaccgggttgctag

SEQ ID NO: 159105 - DNA, 28 bp, Artificial Sequence
  Description of Artificial Sequence: Synthetic oligonucleotide
cagccctgtctcaaaaccgggttgctag

SEQ ID NO: 159106 - DNA, 28 bp, Artificial Sequence
  Description of Artificial Sequence: Synthetic oligonucleotide
agccctgtctcaaaaccgggttgctagc

SEQ ID NO: 159107 - DNA, 27 bp, Artificial Sequence
  Description of Artificial Sequence: Synthetic oligonucleotide
gccctgtctcaaaaccgggttgctagc

SEQ ID NO: 159108 - DNA, 28 bp, Artificial Sequence
  Description of Artificial Sequence: Synthetic oligonucleotide
ccctgtctcaaaaccgggttgctagctc

SEQ ID NO: 159109 - DNA, 28 bp, Artificial Sequence
  Description of Artificial Sequence: Synthetic oligonucleotide
cctgtctcaaaaccgggttgctagctcc

SEQ ID NO: 159110 - DNA, 28 bp, Artificial Sequence
  Description of Artificial Sequence: Synthetic oligonucleotide
ctgtctcaaaaccgggttgctagctccc

SEQ ID NO: 159111 - DNA, 30 bp, Artificial Sequence
  Description of Artificial Sequence: Synthetic oligonucleotide
tgtctcaaaaccgggttgctagctcccatg

SEQ ID NO: 159112 - DNA, 29 bp, Artificial Sequence
  Description of Artificial Sequence: Synthetic oligonucleotide
gtctcaaaaccgggttgctagctcccatg

SEQ ID NO: 159113 - DNA, 31 bp, Artificial Sequence
  Description of Artificial Sequence: Synthetic oligonucleotide
tctcaaaaccgggttgctagctcccatgtac

SEQ ID NO: 159114 - DNA, 30 bp, Artificial Sequence
  Description of Artificial Sequence: Synthetic oligonucleotide
ctcaaaaccgggttgctagctcccatgtac

SEQ ID NO: 159115 - DNA, 30 bp, Artificial Sequence
  Description of Artificial Sequence: Synthetic oligonucleotide
tcaaaaccgggttgctagctcccatgtacc

SEQ ID NO: 159116 - DNA, 29 bp, Artificial Sequence
  Description of Artificial Sequence: Synthetic oligonucleotide
caaaaccgggttgctagctcccatgtacc

SEQ ID NO: 159117 - DNA, 30 bp, Artificial Sequence
  Description of Artificial Sequence: Synthetic oligonucleotide
aaaaccgggttgctagctcccatgtaccag

SEQ ID NO: 159118 - DNA, 29 bp, Artificial Sequence
  Description of Artificial Sequence: Synthetic oligonucleotide
aaaccgggttgctagctcccatgtaccag

SEQ ID NO: 159119 - DNA, 28 bp, Artificial Sequence
  Description of Artificial Sequence: Synthetic oligonucleotide
aaccgggttgctagctcccatgtaccag

SEQ ID NO: 159120 - DNA, 27 bp, Artificial Sequence
  Description of Artificial Sequence: Synthetic oligonucleotide
accgggttgctagctcccatgtaccag

SEQ ID NO: 159121 - DNA, 26 bp, Artificial Sequence
  Description of Artificial Sequence: Synthetic oligonucleotide
ccgggttgctagctcccatgtaccag

SEQ ID NO: 159122 - DNA, 27 bp, Artificial Sequence
  Description of Artificial Sequence: Synthetic oligonucleotide
cgggttgctagctcccatgtaccagca

SEQ ID NO: 159123 - DNA, 27 bp, Artificial Sequence
  Description of Artificial Sequence: Synthetic oligonucleotide
gggttgctagctcccatgtaccagcag

SEQ ID NO: 159124 - DNA, 27 bp, Artificial Sequence
  Description of Artificial Sequence: Synthetic oligonucleotide
ggttgctagctcccatgtaccagcagc

SEQ ID NO: 159125 - DNA, 28 bp, Artificial Sequence
  Description of Artificial Sequence: Synthetic oligonucleotide
gttgctagctcccatgtaccagcagctg

SEQ ID NO: 159126 - DNA, 28 bp, Artificial Sequence
  Description of Artificial Sequence: Synthetic oligonucleotide
ttgctagctcccatgtaccagcagctgg

SEQ ID NO: 159127 - DNA, 27 bp, Artificial Sequence
  Description of Artificial Sequence: Synthetic oligonucleotide
tgctagctcccatgtaccagcagctgg

SEQ ID NO: 159128 - DNA, 27 bp, Artificial Sequence
  Description of Artificial Sequence: Synthetic oligonucleotide
gctagctcccatgtaccagcagctgga

SEQ ID NO: 159129 - DNA, 29 bp, Artificial Sequence
  Description of Artificial Sequence: Synthetic oligonucleotide
ctagctcccatgtaccagcagctggaatc

SEQ ID NO: 159130 - DNA, 30 bp, Artificial Sequence
  Description of Artificial Sequence: Synthetic oligonucleotide
tagctcccatgtaccagcagctggaatctg

SEQ ID NO: 159131 - DNA, 27 bp, Artificial Sequence
  Description of Artificial Sequence: Synthetic oligonucleotide
acctacagatgtcggggttcacacccg

SEQ ID NO: 159132 - DNA, 26 bp, Artificial Sequence
  Description of Artificial Sequence: Synthetic oligonucleotide
cctacagatgtcggggttcacacccg

SEQ ID NO: 159133 - DNA, 26 bp, Artificial Sequence
  Description of Artificial Sequence: Synthetic oligonucleotide
ctacagatgtcggggttcacacccgc

SEQ ID NO: 159134 - DNA, 26 bp, Artificial Sequence
  Description of Artificial Sequence: Synthetic oligonucleotide
tacagatgtcggggttcacacccgcg

SEQ ID NO: 159135 - DNA, 25 bp, Artificial Sequence
  Description of Artificial Sequence: Synthetic oligonucleotide
acagatgtcggggttcacacccgcg

SEQ ID NO: 159136 - DNA, 24 bp, Artificial Sequence
  Description of Artificial Sequence: Synthetic oligonucleotide
cagatgtcggggttcacacccgcg

SEQ ID NO: 159137 - DNA, 25 bp, Artificial Sequence
  Description of Artificial Sequence: Synthetic oligonucleotide
agatgtcggggttcacacccgcgct

SEQ ID NO: 159138 - DNA, 24 bp, Artificial Sequence
  Description of Artificial Sequence: Synthetic oligonucleotide
gatgtcggggttcacacccgcgct

SEQ ID NO: 159139 - DNA, 24 bp, Artificial Sequence
  Description of Artificial Sequence: Synthetic oligonucleotide
atgtcggggttcacacccgcgctc

SEQ ID NO: 159140 - DNA, 23 bp, Artificial Sequence
  Description of Artificial Sequence: Synthetic oligonucleotide
tgtcggggttcacacccgcgctc

SEQ ID NO: 159141 - DNA, 22 bp, Artificial Sequence
  Description of Artificial Sequence: Synthetic oligonucleotide
gtcggggttcacacccgcgctc

SEQ ID NO: 159142 - DNA, 22 bp, Artificial Sequence
  Description of Artificial Sequence: Synthetic oligonucleotide
tcggggttcacacccgcgctcc

SEQ ID NO: 159143 - DNA, 21 bp, Artificial Sequence
  Description of Artificial Sequence: Synthetic oligonucleotide
cggggttcacacccgcgctcc

SEQ ID NO: 159144 - DNA, 21 bp, Artificial Sequence
  Description of Artificial Sequence: Synthetic oligonucleotide
ggggttcacacccgcgctccc

SEQ ID NO: 159145 - DNA, 21 bp, Artificial Sequence
  Description of Artificial Sequence: Synthetic oligonucleotide
gggttcacacccgcgctcccc

SEQ ID NO: 159146 - DNA, 24 bp, Artificial Sequence
  Description of Artificial Sequence: Synthetic oligonucleotide
ggttcacacccgcgctcccccatt

SEQ ID NO: 159147 - DNA, 25 bp, Artificial Sequence
  Description of Artificial Sequence: Synthetic oligonucleotide
gttcacacccgcgctcccccattga

SEQ ID NO: 159148 - DNA, 26 bp, Artificial Sequence
  Description of Artificial Sequence: Synthetic oligonucleotide
ttcacacccgcgctcccccattgagt

SEQ ID NO: 159149 - DNA, 25 bp, Artificial Sequence
  Description of Artificial Sequence: Synthetic oligonucleotide
tcacacccgcgctcccccattgagt

SEQ ID NO: 159150 - DNA, 24 bp, Artificial Sequence
  Description of Artificial Sequence: Synthetic oligonucleotide
cacacccgcgctcccccattgagt

SEQ ID NO: 159151 - DNA, 24 bp, Artificial Sequence
  Description of Artificial Sequence: Synthetic oligonucleotide
acacccgcgctcccccattgagtg

SEQ ID NO: 159152 - DNA, 23 bp, Artificial Sequence
  Description of Artificial Sequence: Synthetic oligonucleotide
cacccgcgctcccccattgagtg

SEQ ID NO: 159153 - DNA, 24 bp, Artificial Sequence
  Description of Artificial Sequence: Synthetic oligonucleotide
acccgcgctcccccattgagtggt

SEQ ID NO: 159154 - DNA, 23 bp, Artificial Sequence
  Description of Artificial Sequence: Synthetic oligonucleotide
cccgcgctcccccattgagtggt

SEQ ID NO: 159155 - DNA, 24 bp, Artificial Sequence
  Description of Artificial Sequence: Synthetic oligonucleotide
ccgcgctcccccattgagtggtca

SEQ ID NO: 159156 - DNA, 24 bp, Artificial Sequence
  Description of Artificial Sequence: Synthetic oligonucleotide
cgcgctcccccattgagtggtcag

SEQ ID NO: 159157 - DNA, 25 bp, Artificial Sequence
  Description of Artificial Sequence: Synthetic oligonucleotide
gcgctcccccattgagtggtcagca

SEQ ID NO: 159158 - DNA, 25 bp, Artificial Sequence
  Description of Artificial Sequence: Synthetic oligonucleotide
acccacgctcccccattgagtggtc

SEQ ID NO: 159159 - DNA, 24 bp, Artificial Sequence
  Description of Artificial Sequence: Synthetic oligonucleotide
cccacgctcccccattgagtggtc

SEQ ID NO: 159160 - DNA, 24 bp, Artificial Sequence
  Description of Artificial Sequence: Synthetic oligonucleotide
ccacgctcccccattgagtggtcg

SEQ ID NO: 159161 - DNA, 24 bp, Artificial Sequence
  Description of Artificial Sequence: Synthetic oligonucleotide
cacgctcccccattgagtggtcgg

SEQ ID NO: 159162 - DNA, 25 bp, Artificial Sequence
  Description of Artificial Sequence: Synthetic oligonucleotide
acgctcccccattgagtggtcggca

SEQ ID NO: 159163 - DNA, 24 bp, Artificial Sequence
  Description of Artificial Sequence: Synthetic oligonucleotide
cgctcccccattgagtggtcggca

SEQ ID NO: 159164 - DNA, 24 bp, Artificial Sequence
  Description of Artificial Sequence: Synthetic oligonucleotide
gctcccccattgagtggtcggcac

SEQ ID NO: 159165 - DNA, 24 bp, Artificial Sequence
  Description of Artificial Sequence: Synthetic oligonucleotide
ctcccccattgagtggtcggcacc

SEQ ID NO: 159166 - DNA, 25 bp, Artificial Sequence
  Description of Artificial Sequence: Synthetic oligonucleotide
tcccccattgagtggtcggcaccca

SEQ ID NO: 159167 - DNA, 24 bp, Artificial Sequence
  Description of Artificial Sequence: Synthetic oligonucleotide
cccccattgagtggtcggcaccca

SEQ ID NO: 159168 - DNA, 24 bp, Artificial Sequence
  Description of Artificial Sequence: Synthetic oligonucleotide
ccccattgagtggtcggcacccag

SEQ ID NO: 159169 - DNA, 26 bp, Artificial Sequence
  Description of Artificial Sequence: Synthetic oligonucleotide
cccattgagtggtcggcacccagcaa

SEQ ID NO: 159170 - DNA, 26 bp, Artificial Sequence
  Description of Artificial Sequence: Synthetic oligonucleotide
ccattgagtggtcggcacccagcaac

SEQ ID NO: 159171 - DNA, 26 bp, Artificial Sequence
  Description of Artificial Sequence: Synthetic oligonucleotide
cattgagtggtcggcacccagcaacc

SEQ ID NO: 159172 - DNA, 26 bp, Artificial Sequence
  Description of Artificial Sequence: Synthetic oligonucleotide
attgagtggtcggcacccagcaaccc

SEQ ID NO: 159173 - DNA, 25 bp, Artificial Sequence
  Description of Artificial Sequence: Synthetic oligonucleotide
ttgagtggtcggcacccagcaaccc

SEQ ID NO: 159174 - DNA, 24 bp, Artificial Sequence
  Description of Artificial Sequence: Synthetic oligonucleotide
ggggcctggacacatgagggtgga

SEQ ID NO: 159175 - DNA, 25 bp, Artificial Sequence
  Description of Artificial Sequence: Synthetic oligonucleotide
gggcctggacacatgagggtggaca

SEQ ID NO: 159176 - DNA, 25 bp, Artificial Sequence
  Description of Artificial Sequence: Synthetic oligonucleotide
ggcctggacacatgagggtggacag

SEQ ID NO: 159177 - DNA, 26 bp, Artificial Sequence
  Description of Artificial Sequence: Synthetic oligonucleotide
gcctggacacatgagggtggacagga

SEQ ID NO: 159178 - DNA, 27 bp, Artificial Sequence
  Description of Artificial Sequence: Synthetic oligonucleotide
cctggacacatgagggtggacaggaca

SEQ ID NO: 159179 - DNA, 28 bp, Artificial Sequence
  Description of Artificial Sequence: Synthetic oligonucleotide
ctggacacatgagggtggacaggacaag

SEQ ID NO: 159180 - DNA, 28 bp, Artificial Sequence
  Description of Artificial Sequence: Synthetic oligonucleotide
tggacacatgagggtggacaggacaagc

SEQ ID NO: 159181 - DNA, 27 bp, Artificial Sequence
  Description of Artificial Sequence: Synthetic oligonucleotide
ggacacatgagggtggacaggacaagc

SEQ ID NO: 159182 - DNA, 27 bp, Artificial Sequence
  Description of Artificial Sequence: Synthetic oligonucleotide
gacacatgagggtggacaggacaagcc

SEQ ID NO: 159183 - DNA, 27 bp, Artificial Sequence
  Description of Artificial Sequence: Synthetic oligonucleotide
acacatgagggtggacaggacaagccc

SEQ ID NO: 159184 - DNA, 27 bp, Artificial Sequence
  Description of Artificial Sequence: Synthetic oligonucleotide
cacatgagggtggacaggacaagccct

SEQ ID NO: 159185 - DNA, 28 bp, Artificial Sequence
  Description of Artificial Sequence: Synthetic oligonucleotide
acatgagggtggacaggacaagcccttg

SEQ ID NO: 159186 - DNA, 27 bp, Artificial Sequence
  Description of Artificial Sequence: Synthetic oligonucleotide
catgagggtggacaggacaagcccttg

SEQ ID NO: 159187 - DNA, 27 bp, Artificial Sequence
  Description of Artificial Sequence: Synthetic oligonucleotide
atgagggtggacaggacaagcccttgc

SEQ ID NO: 159188 - DNA, 27 bp, Artificial Sequence
  Description of Artificial Sequence: Synthetic oligonucleotide
tgagggtggacaggacaagcccttgct

SEQ ID NO: 159189 - DNA, 26 bp, Artificial Sequence
  Description of Artificial Sequence: Synthetic oligonucleotide
gagggtggacaggacaagcccttgct

SEQ ID NO: 159190 - DNA, 27 bp, Artificial Sequence
  Description of Artificial Sequence: Synthetic oligonucleotide
agggtggacaggacaagcccttgctgt

SEQ ID NO: 159191 - DNA, 26 bp, Artificial Sequence
  Description of Artificial Sequence: Synthetic oligonucleotide
gggtggacaggacaagcccttgctgt

SEQ ID NO: 159192 - DNA, 27 bp, Artificial Sequence
  Description of Artificial Sequence: Synthetic oligonucleotide
ggtggacaggacaagcccttgctgtct

SEQ ID NO: 159193 - DNA, 27 bp, Artificial Sequence
  Description of Artificial Sequence: Synthetic oligonucleotide
gtggacaggacaagcccttgctgtctg

SEQ ID NO: 159194 - DNA, 27 bp, Artificial Sequence
  Description of Artificial Sequence: Synthetic oligonucleotide
tggacaggacaagcccttgctgtctgc

SEQ ID NO: 159195 - DNA, 26 bp, Artificial Sequence
  Description of Artificial Sequence: Synthetic oligonucleotide
ggacaggacaagcccttgctgtctgc

SEQ ID NO: 159196 - DNA, 27 bp, Artificial Sequence
  Description of Artificial Sequence: Synthetic oligonucleotide
gacaggacaagcccttgctgtctgcct

SEQ ID NO: 159197 - DNA, 27 bp, Artificial Sequence
  Description of Artificial Sequence: Synthetic oligonucleotide
acaggacaagcccttgctgtctgcctg

SEQ ID NO: 159198 - DNA, 28 bp, Artificial Sequence
  Description of Artificial Sequence: Synthetic oligonucleotide
acccacggagggacctacacatgctttg

SEQ ID NO: 159199 - DNA, 27 bp, Artificial Sequence
  Description of Artificial Sequence: Synthetic oligonucleotide
cccacggagggacctacacatgctttg

SEQ ID NO: 159200 - DNA, 27 bp, Artificial Sequence
  Description of Artificial Sequence: Synthetic oligonucleotide
ccacggagggacctacacatgctttgg

SEQ ID NO: 159201 - DNA, 27 bp, Artificial Sequence
  Description of Artificial Sequence: Synthetic oligonucleotide
cacggagggacctacacatgctttggc

SEQ ID NO: 159202 - DNA, 28 bp, Artificial Sequence
  Description of Artificial Sequence: Synthetic oligonucleotide
acggagggacctacacatgctttggctc

SEQ ID NO: 159203 - DNA, 27 bp, Artificial Sequence
  Description of Artificial Sequence: Synthetic oligonucleotide
cggagggacctacacatgctttggctc

SEQ ID NO: 159204 - DNA, 28 bp, Artificial Sequence
  Description of Artificial Sequence: Synthetic oligonucleotide
ggagggacctacacatgctttggctctc

SEQ ID NO: 159205 - DNA, 29 bp, Artificial Sequence
  Description of Artificial Sequence: Synthetic oligonucleotide
gagggacctacacatgctttggctctctc

SEQ ID NO: 159206 - DNA, 29 bp, Artificial Sequence
  Description of Artificial Sequence: Synthetic oligonucleotide
agggacctacacatgctttggctctctcc

SEQ ID NO: 159207 - DNA, 28 bp, Artificial Sequence
  Description of Artificial Sequence: Synthetic oligonucleotide
gggacctacacatgctttggctctctcc

SEQ ID NO: 159208 - DNA, 30 bp, Artificial Sequence
  Description of Artificial Sequence: Synthetic oligonucleotide
ggacctacacatgctttggctctctccatg

SEQ ID NO: 159209 - DNA, 31 bp, Artificial Sequence
  Description of Artificial Sequence: Synthetic oligonucleotide
gacctacacatgctttggctctctccatgac

SEQ ID NO: 159210 - DNA, 32 bp, Artificial Sequence
  Description of Artificial Sequence: Synthetic oligonucleotide
acctacacatgctttggctctctccatgactc

SEQ ID NO: 159211 - DNA, 31 bp, Artificial Sequence
  Description of Artificial Sequence: Synthetic oligonucleotide
cctacacatgctttggctctctccatgactc

SEQ ID NO: 159212 - DNA, 32 bp, Artificial Sequence
  Description of Artificial Sequence: Synthetic oligonucleotide
ctacacatgctttggctctctccatgactcac

SEQ ID NO: 159213 - DNA, 32 bp, Artificial Sequence
  Description of Artificial Sequence: Synthetic oligonucleotide
tacacatgctttggctctctccatgactcacc

SEQ ID NO: 159214 - DNA, 31 bp, Artificial Sequence
  Description of Artificial Sequence: Synthetic oligonucleotide
acacatgctttggctctctccatgactcacc

SEQ ID NO: 159215 - DNA, 30 bp, Artificial Sequence
  Description of Artificial Sequence: Synthetic oligonucleotide
cacatgctttggctctctccatgactcacc

SEQ ID NO: 159216 - DNA, 30 bp, Artificial Sequence
  Description of Artificial Sequence: Synthetic oligonucleotide
acatgctttggctctctccatgactcaccc

SEQ ID NO: 159217 - DNA, 29 bp, Artificial Sequence
  Description of Artificial Sequence: Synthetic oligonucleotide
catgctttggctctctccatgactcaccc

SEQ ID NO: 159218 - DNA, 32 bp, Artificial Sequence
  Description of Artificial Sequence: Synthetic oligonucleotide
atgctttggctctctccatgactcaccctatg

SEQ ID NO: 159219 - DNA, 31 bp, Artificial Sequence
  Description of Artificial Sequence: Synthetic oligonucleotide
tgctttggctctctccatgactcaccctatg

SEQ ID NO: 159220 - DNA, 30 bp, Artificial Sequence
  Description of Artificial Sequence: Synthetic oligonucleotide
gctttggctctctccatgactcaccctatg

SEQ ID NO: 159221 - DNA, 31 bp, Artificial Sequence
  Description of Artificial Sequence: Synthetic oligonucleotide
ctttggctctctccatgactcaccctatgag

SEQ ID NO: 159222 - DNA, 32 bp, Artificial Sequence
  Description of Artificial Sequence: Synthetic oligonucleotide
tttggctctctccatgactcaccctatgagtg

SEQ ID NO: 159223 - DNA, 31 bp, Artificial Sequence
  Description of Artificial Sequence: Synthetic oligonucleotide
ttggctctctccatgactcaccctatgagtg

SEQ ID NO: 159224 - DNA, 30 bp, Artificial Sequence
  Description of Artificial Sequence: Synthetic oligonucleotide
tggctctctccatgactcaccctatgagtg

SEQ ID NO: 159225 - DNA, 23 bp, Artificial Sequence
  Description of Artificial Sequence: Synthetic oligonucleotide
ccgcgctcccccattgagtggtc

SEQ ID NO: 159226 - DNA, 23 bp, Artificial Sequence
  Description of Artificial Sequence: Synthetic oligonucleotide
cgcgctcccccattgagtggtcg

SEQ ID NO: 159227 - DNA, 23 bp, Artificial Sequence
  Description of Artificial Sequence: Synthetic oligonucleotide
gcgctcccccattgagtggtcgg

SEQ ID NO: 159228 - DNA, 22 bp, Artificial Sequence
  Description of Artificial Sequence: Synthetic oligonucleotide
gctccctgcagtgcccagcgtc

SEQ ID NO: 159229 - DNA, 24 bp, Artificial Sequence
  Description of Artificial Sequence: Synthetic oligonucleotide
ctccctgcagtgcccagcgtcgat

SEQ ID NO: 159230 - DNA, 24 bp, Artificial Sequence
  Description of Artificial Sequence: Synthetic oligonucleotide
tccctgcagtgcccagcgtcgatg

SEQ ID NO: 159231 - DNA, 23 bp, Artificial Sequence
  Description of Artificial Sequence: Synthetic oligonucleotide
ccctgcagtgcccagcgtcgatg

SEQ ID NO: 159232 - DNA, 25 bp, Artificial Sequence
  Description of Artificial Sequence: Synthetic oligonucleotide
cctgcagtgcccagcgtcgatggaa

SEQ ID NO: 159233 - DNA, 27 bp, Artificial Sequence
  Description of Artificial Sequence: Synthetic oligonucleotide
ctgcagtgcccagcgtcgatggaacat

SEQ ID NO: 159234 - DNA, 28 bp, Artificial Sequence
  Description of Artificial Sequence: Synthetic oligonucleotide
tgcagtgcccagcgtcgatggaacattc

SEQ ID NO: 159235 - DNA, 27 bp, Artificial Sequence
  Description of Artificial Sequence: Synthetic oligonucleotide
gcagtgcccagcgtcgatggaacattc

SEQ ID NO: 159236 - DNA, 27 bp, Artificial Sequence
  Description of Artificial Sequence: Synthetic oligonucleotide
cagtgcccagcgtcgatggaacattcc

SEQ ID NO: 159237 - DNA, 28 bp, Artificial Sequence
  Description of Artificial Sequence: Synthetic oligonucleotide
agtgcccagcgtcgatggaacattccag

SEQ ID NO: 159238 - DNA, 27 bp, Artificial Sequence
  Description of Artificial Sequence: Synthetic oligonucleotide
gtgcccagcgtcgatggaacattccag

SEQ ID NO: 159239 - DNA, 27 bp, Artificial Sequence
  Description of Artificial Sequence: Synthetic oligonucleotide
tgcccagcgtcgatggaacattccagg

SEQ ID NO: 159240 - DNA, 26 bp, Artificial Sequence
  Description of Artificial Sequence: Synthetic oligonucleotide
gcccagcgtcgatggaacattccagg

SEQ ID NO: 159241 - DNA, 27 bp, Artificial Sequence
  Description of Artificial Sequence: Synthetic oligonucleotide
cccagcgtcgatggaacattccaggct

SEQ ID NO: 159242 - DNA, 27 bp, Artificial Sequence
  Description of Artificial Sequence: Synthetic oligonucleotide
ccagcgtcgatggaacattccaggctg

SEQ ID NO: 159243 - DNA, 28 bp, Artificial Sequence
  Description of Artificial Sequence: Synthetic oligonucleotide
cagcgtcgatggaacattccaggctgac

SEQ ID NO: 159244 - DNA, 31 bp, Artificial Sequence
  Description of Artificial Sequence: Synthetic oligonucleotide
agcgtcgatggaacattccaggctgactttc

SEQ ID NO: 159245 - DNA, 30 bp, Artificial Sequence
  Description of Artificial Sequence: Synthetic oligonucleotide
gcgtcgatggaacattccaggctgactttc

SEQ ID NO: 159246 - DNA, 30 bp, Artificial Sequence
  Description of Artificial Sequence: Synthetic oligonucleotide
cgtcgatggaacattccaggctgactttcc

SEQ ID NO: 159247 - DNA, 31 bp, Artificial Sequence
  Description of Artificial Sequence: Synthetic oligonucleotide
gtcgatggaacattccaggctgactttcctc

SEQ ID NO: 159248 - DNA, 32 bp, Artificial Sequence
  Description of Artificial Sequence: Synthetic oligonucleotide
tcgatggaacattccaggctgactttcctctg

SEQ ID NO: 159249 - DNA, 31 bp, Artificial Sequence
  Description of Artificial Sequence: Synthetic oligonucleotide
cgatggaacattccaggctgactttcctctg

SEQ ID NO: 159250 - DNA, 31 bp, Artificial Sequence
  Description of Artificial Sequence: Synthetic oligonucleotide
gatggaacattccaggctgactttcctctgg

SEQ ID NO: 159251 - DNA, 27 bp, Artificial Sequence
  Description of Artificial Sequence: Synthetic oligonucleotide
cccacggagggacctacacatgcttca

SEQ ID NO: 159252 - DNA, 27 bp, Artificial Sequence
  Description of Artificial Sequence: Synthetic oligonucleotide
ccacggagggacctacacatgcttcag

SEQ ID NO: 159253 - DNA, 27 bp, Artificial Sequence
  Description of Artificial Sequence: Synthetic oligonucleotide
cacggagggacctacacatgcttcagc

SEQ ID NO: 159254 - DNA, 28 bp, Artificial Sequence
  Description of Artificial Sequence: Synthetic oligonucleotide
acggagggacctacacatgcttcagctc

SEQ ID NO: 159255 - DNA, 27 bp, Artificial Sequence
  Description of Artificial Sequence: Synthetic oligonucleotide
cggagggacctacacatgcttcagctc

SEQ ID NO: 159256 - DNA, 28 bp, Artificial Sequence
  Description of Artificial Sequence: Synthetic oligonucleotide
ggagggacctacacatgcttcagctctc

SEQ ID NO: 159257 - DNA, 29 bp, Artificial Sequence
  Description of Artificial Sequence: Synthetic oligonucleotide
gagggacctacacatgcttcagctctctc

SEQ ID NO: 159258 - DNA, 29 bp, Artificial Sequence
  Description of Artificial Sequence: Synthetic oligonucleotide
agggacctacacatgcttcagctctctcc

SEQ ID NO: 159259 - DNA, 28 bp, Artificial Sequence
  Description of Artificial Sequence: Synthetic oligonucleotide
gggacctacacatgcttcagctctctcc

SEQ ID NO: 159260 - DNA, 30 bp, Artificial Sequence
  Description of Artificial Sequence: Synthetic oligonucleotide
ggacctacacatgcttcagctctctccatg

SEQ ID NO: 159261 - DNA, 31 bp, Artificial Sequence
  Description of Artificial Sequence: Synthetic oligonucleotide
gacctacacatgcttcagctctctccatgac

SEQ ID NO: 159262 - DNA, 32 bp, Artificial Sequence
  Description of Artificial Sequence: Synthetic oligonucleotide
acctacacatgcttcagctctctccatgactc

SEQ ID NO: 159263 - DNA, 31 bp, Artificial Sequence
  Description of Artificial Sequence: Synthetic oligonucleotide
cctacacatgcttcagctctctccatgactc

SEQ ID NO: 159264 - DNA, 32 bp, Artificial Sequence
  Description of Artificial Sequence: Synthetic oligonucleotide
ctacacatgcttcagctctctccatgactcac

SEQ ID NO: 159265 - DNA, 32 bp, Artificial Sequence
  Description of Artificial Sequence: Synthetic oligonucleotide
tacacatgcttcagctctctccatgactcacc

SEQ ID NO: 159266 - DNA, 31 bp, Artificial Sequence
  Description of Artificial Sequence: Synthetic oligonucleotide
acacatgcttcagctctctccatgactcacc

SEQ ID NO: 159267 - DNA, 30 bp, Artificial Sequence
  Description of Artificial Sequence: Synthetic oligonucleotide
cacatgcttcagctctctccatgactcacc

SEQ ID NO: 159268 - DNA, 30 bp, Artificial Sequence
  Description of Artificial Sequence: Synthetic oligonucleotide
acatgcttcagctctctccatgactcaccc

SEQ ID NO: 159269 - DNA, 29 bp, Artificial Sequence
  Description of Artificial Sequence: Synthetic oligonucleotide
catgcttcagctctctccatgactcaccc

SEQ ID NO: 159270 - DNA, 32 bp, Artificial Sequence
  Description of Artificial Sequence: Synthetic oligonucleotide
atgcttcagctctctccatgactcaccctatg

SEQ ID NO: 159271 - DNA, 31 bp, Artificial Sequence
  Description of Artificial Sequence: Synthetic oligonucleotide
tgcttcagctctctccatgactcaccctatg

SEQ ID NO: 159272 - DNA, 30 bp, Artificial Sequence
  Description of Artificial Sequence: Synthetic oligonucleotide
gcttcagctctctccatgactcaccctatg

SEQ ID NO: 159273 - DNA, 31 bp, Artificial Sequence
  Description of Artificial Sequence: Synthetic oligonucleotide
cttcagctctctccatgactcaccctatgag

SEQ ID NO: 159274 - DNA, 32 bp, Artificial Sequence
  Description of Artificial Sequence: Synthetic oligonucleotide
ttcagctctctccatgactcaccctatgagtg

SEQ ID NO: 159275 - DNA, 31 bp, Artificial Sequence
  Description of Artificial Sequence: Synthetic oligonucleotide
tcagctctctccatgactcaccctatgagtg

SEQ ID NO: 159276 - DNA, 30 bp, Artificial Sequence
  Description of Artificial Sequence: Synthetic oligonucleotide
cagctctctccatgactcaccctatgagtg

SEQ ID NO: 159277 - DNA, 30 bp, Artificial Sequence
  Description of Artificial Sequence: Synthetic oligonucleotide
agctctctccatgactcaccctatgagtgg

SEQ ID NO: 159278 - DNA, 23 bp, Artificial Sequence
  Description of Artificial Sequence: Synthetic oligonucleotide
agggggcctggccacatgagggt

SEQ ID NO: 159279 - DNA, 22 bp, Artificial Sequence
  Description of Artificial Sequence: Synthetic oligonucleotide
gggggcctggccacatgagggt

SEQ ID NO: 159280 - DNA, 22 bp, Artificial Sequence
  Description of Artificial Sequence: Synthetic oligonucleotide
ggggcctggccacatgagggtg

SEQ ID NO: 159281 - DNA, 23 bp, Artificial Sequence
  Description of Artificial Sequence: Synthetic oligonucleotide
gggcctggccacatgagggtggt

SEQ ID NO: 159282 - DNA, 24 bp, Artificial Sequence
  Description of Artificial Sequence: Synthetic oligonucleotide
ggcctggccacatgagggtggtca

SEQ ID NO: 159283 - DNA, 24 bp, Artificial Sequence
  Description of Artificial Sequence: Synthetic oligonucleotide
gcctggccacatgagggtggtcag

SEQ ID NO: 159284 - DNA, 25 bp, Artificial Sequence
  Description of Artificial Sequence: Synthetic oligonucleotide
cctggccacatgagggtggtcagga

SEQ ID NO: 159285 - DNA, 27 bp, Artificial Sequence
  Description of Artificial Sequence: Synthetic oligonucleotide
ctggccacatgagggtggtcaggacaa

SEQ ID NO: 159286 - DNA, 27 bp, Artificial Sequence
  Description of Artificial Sequence: Synthetic oligonucleotide
tggccacatgagggtggtcaggacaag

SEQ ID NO: 159287 - DNA, 26 bp, Artificial Sequence
  Description of Artificial Sequence: Synthetic oligonucleotide
ggccacatgagggtggtcaggacaag

SEQ ID NO: 159288 - DNA, 26 bp, Artificial Sequence
  Description of Artificial Sequence: Synthetic oligonucleotide
gccacatgagggtggtcaggacaagc

SEQ ID NO: 159289 - DNA, 26 bp, Artificial Sequence
  Description of Artificial Sequence: Synthetic oligonucleotide
ccacatgagggtggtcaggacaagcc

SEQ ID NO: 159290 - DNA, 34 bp, Artificial Sequence
  Description of Artificial Sequence: Synthetic oligonucleotide
aagtagttcatcttcacccactgaaccaagctcg

SEQ ID NO: 159291 - DNA, 33 bp, Artificial Sequence
  Description of Artificial Sequence: Synthetic oligonucleotide
agtagttcatcttcacccactgaaccaagctcg

SEQ ID NO: 159292 - DNA, 32 bp, Artificial Sequence
  Description of Artificial Sequence: Synthetic oligonucleotide
gtagttcatcttcacccactgaaccaagctcg

SEQ ID NO: 159293 - DNA, 36 bp, Artificial Sequence
  Description of Artificial Sequence: Synthetic oligonucleotide
tagttcatcttcacccactgaaccaagctcgaaaac

SEQ ID NO: 159294 - DNA, 35 bp, Artificial Sequence
  Description of Artificial Sequence: Synthetic oligonucleotide
agttcatcttcacccactgaaccaagctcgaaaac

SEQ ID NO: 159295 - DNA, 34 bp, Artificial Sequence
  Description of Artificial Sequence: Synthetic oligonucleotide
gttcatcttcacccactgaaccaagctcgaaaac

SEQ ID NO: 159296 - DNA, 35 bp, Artificial Sequence
  Description of Artificial Sequence: Synthetic oligonucleotide
ttcatcttcacccactgaaccaagctcgaaaactg

SEQ ID NO: 159297 - DNA, 34 bp, Artificial Sequence
  Description of Artificial Sequence: Synthetic oligonucleotide
tcatcttcacccactgaaccaagctcgaaaactg

SEQ ID NO: 159298 - DNA, 33 bp, Artificial Sequence
  Description of Artificial Sequence: Synthetic oligonucleotide
catcttcacccactgaaccaagctcgaaaactg

SEQ ID NO: 159299 - DNA, 33 bp, Artificial Sequence
  Description of Artificial Sequence: Synthetic oligonucleotide
atcttcacccactgaaccaagctcgaaaactgg

SEQ ID NO: 159300 - DNA, 32 bp, Artificial Sequence
  Description of Artificial Sequence: Synthetic oligonucleotide
tcttcacccactgaaccaagctcgaaaactgg

SEQ ID NO: 159301 - DNA, 31 bp, Artificial Sequence
  Description of Artificial Sequence: Synthetic oligonucleotide
cttcacccactgaaccaagctcgaaaactgg

SEQ ID NO: 159302 - DNA, 34 bp, Artificial Sequence
  Description of Artificial Sequence: Synthetic oligonucleotide
ttcacccactgaaccaagctcgaaaactggtatc

SEQ ID NO: 159303 - DNA, 33 bp, Artificial Sequence
  Description of Artificial Sequence: Synthetic oligonucleotide
tcacccactgaaccaagctcgaaaactggtatc

SEQ ID NO: 159304 - DNA, 32 bp, Artificial Sequence
  Description of Artificial Sequence: Synthetic oligonucleotide
cacccactgaaccaagctcgaaaactggtatc

SEQ ID NO: 159305 - DNA, 32 bp, Artificial Sequence
  Description of Artificial Sequence: Synthetic oligonucleotide
acccactgaaccaagctcgaaaactggtatcc

SEQ ID NO: 159306 - DNA, 31 bp, Artificial Sequence
  Description of Artificial Sequence: Synthetic oligonucleotide
cccactgaaccaagctcgaaaactggtatcc

SEQ ID NO: 159307 - DNA, 31 bp, Artificial Sequence
  Description of Artificial Sequence: Synthetic oligonucleotide
ccactgaaccaagctcgaaaactggtatccg

SEQ ID NO: 159308 - DNA, 31 bp, Artificial Sequence
  Description of Artificial Sequence: Synthetic oligonucleotide
cactgaaccaagctcgaaaactggtatccgc

SEQ ID NO: 159309 - DNA, 32 bp, Artificial Sequence
  Description of Artificial Sequence: Synthetic oligonucleotide
actgaaccaagctcgaaaactggtatccgcag

SEQ ID NO: 159310 - DNA, 31 bp, Artificial Sequence
  Description of Artificial Sequence: Synthetic oligonucleotide
ctgaaccaagctcgaaaactggtatccgcag

SEQ ID NO: 159311 - DNA, 32 bp, Artificial Sequence
  Description of Artificial Sequence: Synthetic oligonucleotide
tgaaccaagctcgaaaactggtatccgcagac

SEQ ID NO: 159312 - DNA, 31 bp, Artificial Sequence
  Description of Artificial Sequence: Synthetic oligonucleotide
gaaccaagctcgaaaactggtatccgcagac

SEQ ID NO: 159313 - DNA, 32 bp, Artificial Sequence
  Description of Artificial Sequence: Synthetic oligonucleotide
aaccaagctcgaaaactggtatccgcagacac

SEQ ID NO: 159314 - DNA, 31 bp, Artificial Sequence
  Description of Artificial Sequence: Synthetic oligonucleotide
accaagctcgaaaactggtatccgcagacac

SEQ ID NO: 159315 - DNA, 30 bp, Artificial Sequence
  Description of Artificial Sequence: Synthetic oligonucleotide
ccaagctcgaaaactggtatccgcagacac

SEQ ID NO: 159316 - DNA, 30 bp, Artificial Sequence
  Description of Artificial Sequence: Synthetic oligonucleotide
caagctcgaaaactggtatccgcagacacc

SEQ ID NO: 159317 - DNA, 31 bp, Artificial Sequence
  Description of Artificial Sequence: Synthetic oligonucleotide
aagctcgaaaactggtatccgcagacacctg

SEQ ID NO: 159318 - DNA, 30 bp, Artificial Sequence
  Description of Artificial Sequence: Synthetic oligonucleotide
agctcgaaaactggtatccgcagacacctg

SEQ ID NO: 159319 - DNA, 29 bp, Artificial Sequence
  Description of Artificial Sequence: Synthetic oligonucleotide
gctcgaaaactggtatccgcagacacctg

SEQ ID NO: 159320 - DNA, 29 bp, Artificial Sequence
  Description of Artificial Sequence: Synthetic oligonucleotide
ctcgaaaactggtatccgcagacacctgc

SEQ ID NO: 159321 - DNA, 30 bp, Artificial Sequence
  Description of Artificial Sequence: Synthetic oligonucleotide
tcgaaaactggtatccgcagacacctgcac

SEQ ID NO: 159322 - DNA, 29 bp, Artificial Sequence
  Description of Artificial Sequence: Synthetic oligonucleotide
cgaaaactggtatccgcagacacctgcac

SEQ ID NO: 159323 - DNA, 32 bp, Artificial Sequence
  Description of Artificial Sequence: Synthetic oligonucleotide
gaaaactggtatccgcagacacctgcacattc

SEQ ID NO: 159324 - DNA, 28 bp, Artificial Sequence
  Description of Artificial Sequence: Synthetic oligonucleotide
aacagccctgtctcaaaaccgggttgcc

SEQ ID NO: 159325 - DNA, 27 bp, Artificial Sequence
  Description of Artificial Sequence: Synthetic oligonucleotide
acagccctgtctcaaaaccgggttgcc

SEQ ID NO: 159326 - DNA, 27 bp, Artificial Sequence
  Description of Artificial Sequence: Synthetic oligonucleotide
cagccctgtctcaaaaccgggttgcca

SEQ ID NO: 159327 - DNA, 27 bp, Artificial Sequence
  Description of Artificial Sequence: Synthetic oligonucleotide
agccctgtctcaaaaccgggttgccag

SEQ ID NO: 159328 - DNA, 26 bp, Artificial Sequence
  Description of Artificial Sequence: Synthetic oligonucleotide
gccctgtctcaaaaccgggttgccag

SEQ ID NO: 159329 - DNA, 27 bp, Artificial Sequence
  Description of Artificial Sequence: Synthetic oligonucleotide
ccctgtctcaaaaccgggttgccagct

SEQ ID NO: 159330 - DNA, 27 bp, Artificial Sequence
  Description of Artificial Sequence: Synthetic oligonucleotide
cctgtctcaaaaccgggttgccagctc

SEQ ID NO: 159331 - DNA, 27 bp, Artificial Sequence
  Description of Artificial Sequence: Synthetic oligonucleotide
ctgtctcaaaaccgggttgccagctcc

SEQ ID NO: 159332 - DNA, 27 bp, Artificial Sequence
  Description of Artificial Sequence: Synthetic oligonucleotide
tgtctcaaaaccgggttgccagctccc

SEQ ID NO: 159333 - DNA, 27 bp, Artificial Sequence
  Description of Artificial Sequence: Synthetic oligonucleotide
gtctcaaaaccgggttgccagctccca

SEQ ID NO: 159334 - DNA, 28 bp, Artificial Sequence
  Description of Artificial Sequence: Synthetic oligonucleotide
tctcaaaaccgggttgccagctcccatg

SEQ ID NO: 159335 - DNA, 27 bp, Artificial Sequence
  Description of Artificial Sequence: Synthetic oligonucleotide
ctcaaaaccgggttgccagctcccatg

SEQ ID NO: 159336 - DNA, 29 bp, Artificial Sequence
  Description of Artificial Sequence: Synthetic oligonucleotide
tcaaaaccgggttgccagctcccatgtac

SEQ ID NO: 159337 - DNA, 28 bp, Artificial Sequence
  Description of Artificial Sequence: Synthetic oligonucleotide
caaaaccgggttgccagctcccatgtac

SEQ ID NO: 159338 - DNA, 28 bp, Artificial Sequence
  Description of Artificial Sequence: Synthetic oligonucleotide
aaaaccgggttgccagctcccatgtacc

SEQ ID NO: 159339 - DNA, 27 bp, Artificial Sequence
  Description of Artificial Sequence: Synthetic oligonucleotide
aaaccgggttgccagctcccatgtacc

SEQ ID NO: 159340 - DNA, 27 bp, Artificial Sequence
  Description of Artificial Sequence: Synthetic oligonucleotide
aaccgggttgccagctcccatgtacca

SEQ ID NO: 159341 - DNA, 26 bp, Artificial Sequence
  Description of Artificial Sequence: Synthetic oligonucleotide
accgggttgccagctcccatgtacca

SEQ ID NO: 159342 - DNA, 25 bp, Artificial Sequence
  Description of Artificial Sequence: Synthetic oligonucleotide
ccgggttgccagctcccatgtacca

SEQ ID NO: 159343 - DNA, 25 bp, Artificial Sequence
  Description of Artificial Sequence: Synthetic oligonucleotide
cgggttgccagctcccatgtaccag

SEQ ID NO: 159344 - DNA, 26 bp, Artificial Sequence
  Description of Artificial Sequence: Synthetic oligonucleotide
gggttgccagctcccatgtaccagca

SEQ ID NO: 159345 - DNA, 26 bp, Artificial Sequence
  Description of Artificial Sequence: Synthetic oligonucleotide
ggttgccagctcccatgtaccagcag

SEQ ID NO: 159346 - DNA, 27 bp, Artificial Sequence
  Description of Artificial Sequence: Synthetic oligonucleotide
gttgccagctcccatgtaccagcagct

SEQ ID NO: 159347 - DNA, 27 bp, Artificial Sequence
  Description of Artificial Sequence: Synthetic oligonucleotide
agcacccagcaaccccctggtgatcat

SEQ ID NO: 159348 - DNA, 31 bp, Artificial Sequence
  Description of Artificial Sequence: Synthetic oligonucleotide
cccctggtgatcatggtcacaggtctatttg

SEQ ID NO: 159349 - DNA, 31 bp, Artificial Sequence
  Description of Artificial Sequence: Synthetic oligonucleotide
ccctggtgatcatggtcacaggtctatttgg

SEQ ID NO: 159350 - DNA, 31 bp, Artificial Sequence
  Description of Artificial Sequence: Synthetic oligonucleotide
cctggtgatcatggtcacaggtctatttggg

SEQ ID NO: 159351 - DNA, 34 bp, Artificial Sequence
  Description of Artificial Sequence: Synthetic oligonucleotide
ctggtgatcatggtcacaggtctatttgggaaac

SEQ ID NO: 159352 - DNA, 34 bp, Artificial Sequence
  Description of Artificial Sequence: Synthetic oligonucleotide
tggtgatcatggtcacaggtctatttgggaaacc

SEQ ID NO: 159353 - DNA, 33 bp, Artificial Sequence
  Description of Artificial Sequence: Synthetic oligonucleotide
ggtgatcatggtcacaggtctatttgggaaacc

SEQ ID NO: 159354 - DNA, 35 bp, Artificial Sequence
  Description of Artificial Sequence: Synthetic oligonucleotide
gtgatcatggtcacaggtctatttgggaaaccttc

SEQ ID NO: 159355 - DNA, 36 bp, Artificial Sequence
  Description of Artificial Sequence: Synthetic oligonucleotide
tgatcatggtcacaggtctatttgggaaaccttcac

SEQ ID NO: 159356 - DNA, 35 bp, Artificial Sequence
  Description of Artificial Sequence: Synthetic oligonucleotide
gatcatggtcacaggtctatttgggaaaccttcac

SEQ ID NO: 159357 - DNA, 36 bp, Artificial Sequence
  Description of Artificial Sequence: Synthetic oligonucleotide
atcatggtcacaggtctatttgggaaaccttcactc

SEQ ID NO: 159358 - DNA, 35 bp, Artificial Sequence
  Description of Artificial Sequence: Synthetic oligonucleotide
tcatggtcacaggtctatttgggaaaccttcactc

SEQ ID NO: 159359 - DNA, 34 bp, Artificial Sequence
  Description of Artificial Sequence: Synthetic oligonucleotide
catggtcacaggtctatttgggaaaccttcactc

SEQ ID NO: 159360 - DNA, 35 bp, Artificial Sequence
  Description of Artificial Sequence: Synthetic oligonucleotide
atggtcacaggtctatttgggaaaccttcactctc

SEQ ID NO: 159361 - DNA, 24 bp, Artificial Sequence
  Description of Artificial Sequence: Synthetic oligonucleotide
ccttgctgtctgcctggcccagca

SEQ ID NO: 159362 - DNA, 25 bp, Artificial Sequence
  Description of Artificial Sequence: Synthetic oligonucleotide
cttgctgtctgcctggcccagcact

SEQ ID NO: 159363 - DNA, 26 bp, Artificial Sequence
  Description of Artificial Sequence: Synthetic oligonucleotide
ttgctgtctgcctggcccagcactgt

SEQ ID NO: 159364 - DNA, 25 bp, Artificial Sequence
  Description of Artificial Sequence: Synthetic oligonucleotide
tgctgtctgcctggcccagcactgt

SEQ ID NO: 159365 - DNA, 24 bp, Artificial Sequence
  Description of Artificial Sequence: Synthetic oligonucleotide
gctgtctgcctggcccagcactgt

SEQ ID NO: 159366 - DNA, 24 bp, Artificial Sequence
  Description of Artificial Sequence: Synthetic oligonucleotide
ctgtctgcctggcccagcactgtg

SEQ ID NO: 159367 - DNA, 25 bp, Artificial Sequence
  Description of Artificial Sequence: Synthetic oligonucleotide
tgtctgcctggcccagcactgtggt

SEQ ID NO: 159368 - DNA, 24 bp, Artificial Sequence
  Description of Artificial Sequence: Synthetic oligonucleotide
gtctgcctggcccagcactgtggt

SEQ ID NO: 159369 - DNA, 24 bp, Artificial Sequence
  Description of Artificial Sequence: Synthetic oligonucleotide
tctgcctggcccagcactgtggtg

SEQ ID NO: 159370 - DNA, 23 bp, Artificial Sequence
  Description of Artificial Sequence: Synthetic oligonucleotide
ctgcctggcccagcactgtggtg

SEQ ID NO: 159371 - DNA, 23 bp, Artificial Sequence
  Description of Artificial Sequence: Synthetic oligonucleotide
tgcctggcccagcactgtggtgc

SEQ ID NO: 159372 - DNA, 22 bp, Artificial Sequence
  Description of Artificial Sequence: Synthetic oligonucleotide
gcctggcccagcactgtggtgc

SEQ ID NO: 159373 - DNA, 23 bp, Artificial Sequence
  Description of Artificial Sequence: Synthetic oligonucleotide
cctggcccagcactgtggtgcct

SEQ ID NO: 159374 - DNA, 23 bp, Artificial Sequence
  Description of Artificial Sequence: Synthetic oligonucleotide
ctggcccagcactgtggtgcctc

SEQ ID NO: 159375 - DNA, 24 bp, Artificial Sequence
  Description of Artificial Sequence: Synthetic oligonucleotide
tggcccagcactgtggtgcctcga

SEQ ID NO: 159376 - DNA, 23 bp, Artificial Sequence
  Description of Artificial Sequence: Synthetic oligonucleotide
ggcccagcactgtggtgcctcga

SEQ ID NO: 159377 - DNA, 23 bp, Artificial Sequence
  Description of Artificial Sequence: Synthetic oligonucleotide
gcccagcactgtggtgcctcgag

SEQ ID NO: 159378 - DNA, 24 bp, Artificial Sequence
  Description of Artificial Sequence: Synthetic oligonucleotide
cccagcactgtggtgcctcgagga

SEQ ID NO: 159379 - DNA, 24 bp, Artificial Sequence
  Description of Artificial Sequence: Synthetic oligonucleotide
ccagcactgtggtgcctcgaggag

SEQ ID NO: 159380 - DNA, 25 bp, Artificial Sequence
  Description of Artificial Sequence: Synthetic oligonucleotide
cagcactgtggtgcctcgaggagga

SEQ ID NO: 159381 - DNA, 27 bp, Artificial Sequence
  Description of Artificial Sequence: Synthetic oligonucleotide
agcactgtggtgcctcgaggaggacat

SEQ ID NO: 159382 - DNA, 26 bp, Artificial Sequence
  Description of Artificial Sequence: Synthetic oligonucleotide
gcactgtggtgcctcgaggaggacat

SEQ ID NO: 159383 - DNA, 27 bp, Artificial Sequence
  Description of Artificial Sequence: Synthetic oligonucleotide
cactgtggtgcctcgaggaggacatgt

SEQ ID NO: 159384 - DNA, 27 bp, Artificial Sequence
  Description of Artificial Sequence: Synthetic oligonucleotide
actgtggtgcctcgaggaggacatgtg

SEQ ID NO: 159385 - DNA, 32 bp, Artificial Sequence
  Description of Artificial Sequence: Synthetic oligonucleotide
ccactgaaccaagctccaaaactggtatcctc

SEQ ID NO: 159386 - DNA, 33 bp, Artificial Sequence
  Description of Artificial Sequence: Synthetic oligonucleotide
cactgaaccaagctccaaaactggtatcctcag

SEQ ID NO: 159387 - DNA, 34 bp, Artificial Sequence
  Description of Artificial Sequence: Synthetic oligonucleotide
actgaaccaagctccaaaactggtatcctcagac

SEQ ID NO: 159388 - DNA, 33 bp, Artificial Sequence
  Description of Artificial Sequence: Synthetic oligonucleotide
ctgaaccaagctccaaaactggtatcctcagac

SEQ ID NO: 159389 - DNA, 34 bp, Artificial Sequence
  Description of Artificial Sequence: Synthetic oligonucleotide
tgaaccaagctccaaaactggtatcctcagacac

SEQ ID NO: 159390 - DNA, 33 bp, Artificial Sequence
  Description of Artificial Sequence: Synthetic oligonucleotide
gaaccaagctccaaaactggtatcctcagacac

SEQ ID NO: 159391 - DNA, 33 bp, Artificial Sequence
  Description of Artificial Sequence: Synthetic oligonucleotide
aaccaagctccaaaactggtatcctcagacacc

SEQ ID NO: 159392 - DNA, 32 bp, Artificial Sequence
  Description of Artificial Sequence: Synthetic oligonucleotide
accaagctccaaaactggtatcctcagacacc

SEQ ID NO: 159393 - DNA, 31 bp, Artificial Sequence
  Description of Artificial Sequence: Synthetic oligonucleotide
ccaagctccaaaactggtatcctcagacacc

SEQ ID NO: 159394 - DNA, 32 bp, Artificial Sequence
  Description of Artificial Sequence: Synthetic oligonucleotide
caagctccaaaactggtatcctcagacacctg

SEQ ID NO: 159395 - DNA, 32 bp, Artificial Sequence
  Description of Artificial Sequence: Synthetic oligonucleotide
aagctccaaaactggtatcctcagacacctgc

SEQ ID NO: 159396 - DNA, 31 bp, Artificial Sequence
  Description of Artificial Sequence: Synthetic oligonucleotide
agctccaaaactggtatcctcagacacctgc

SEQ ID NO: 159397 - DNA, 30 bp, Artificial Sequence
  Description of Artificial Sequence: Synthetic oligonucleotide
gctccaaaactggtatcctcagacacctgc

SEQ ID NO: 159398 - DNA, 31 bp, Artificial Sequence
  Description of Artificial Sequence: Synthetic oligonucleotide
ctccaaaactggtatcctcagacacctgcac

SEQ ID NO: 159399 - DNA, 34 bp, Artificial Sequence
  Description of Artificial Sequence: Synthetic oligonucleotide
tccaaaactggtatcctcagacacctgcacattc

SEQ ID NO: 159400 - DNA, 33 bp, Artificial Sequence
  Description of Artificial Sequence: Synthetic oligonucleotide
ccaaaactggtatcctcagacacctgcacattc

SEQ ID NO: 159401 - DNA, 34 bp, Artificial Sequence
  Description of Artificial Sequence: Synthetic oligonucleotide
caaaactggtatcctcagacacctgcacattctg

SEQ ID NO: 159402 - DNA, 37 bp, Artificial Sequence
  Description of Artificial Sequence: Synthetic oligonucleotide
aaaactggtatcctcagacacctgcacattctgattg

SEQ ID NO: 159403 - DNA, 36 bp, Artificial Sequence
  Description of Artificial Sequence: Synthetic oligonucleotide
aaactggtatcctcagacacctgcacattctgattg

SEQ ID NO: 159404 - DNA, 35 bp, Artificial Sequence
  Description of Artificial Sequence: Synthetic oligonucleotide
aactggtatcctcagacacctgcacattctgattg

SEQ ID NO: 159405 - DNA, 34 bp, Artificial Sequence
  Description of Artificial Sequence: Synthetic oligonucleotide
actggtatcctcagacacctgcacattctgattg

SEQ ID NO: 159406 - DNA, 33 bp, Artificial Sequence
  Description of Artificial Sequence: Synthetic oligonucleotide
ctggtatcctcagacacctgcacattctgattg

SEQ ID NO: 159407 - DNA, 33 bp, Artificial Sequence
  Description of Artificial Sequence: Synthetic oligonucleotide
tggtatcctcagacacctgcacattctgattgg

SEQ ID NO: 159408 - DNA, 32 bp, Artificial Sequence
  Description of Artificial Sequence: Synthetic oligonucleotide
ggtatcctcagacacctgcacattctgattgg

SEQ ID NO: 159409 - DNA, 32 bp, Artificial Sequence
  Description of Artificial Sequence: Synthetic oligonucleotide
gtatcctcagacacctgcacattctgattggg

SEQ ID NO: 159410 - DNA, 33 bp, Artificial Sequence
  Description of Artificial Sequence: Synthetic oligonucleotide
tatcctcagacacctgcacattctgattgggac

SEQ ID NO: 159411 - DNA, 32 bp, Artificial Sequence
  Description of Artificial Sequence: Synthetic oligonucleotide
atcctcagacacctgcacattctgattgggac

SEQ ID NO: 159412 - DNA, 31 bp, Artificial Sequence
  Description of Artificial Sequence: Synthetic oligonucleotide
tcctcagacacctgcacattctgattgggac

SEQ ID NO: 159413 - DNA, 30 bp, Artificial Sequence
  Description of Artificial Sequence: Synthetic oligonucleotide
cctcagacacctgcacattctgattgggac

SEQ ID NO: 159414 - DNA, 30 bp, Artificial Sequence
  Description of Artificial Sequence: Synthetic oligonucleotide
ctcagacacctgcacattctgattgggacc

SEQ ID NO: 159415 - DNA, 31 bp, Artificial Sequence
  Description of Artificial Sequence: Synthetic oligonucleotide
tcagacacctgcacattctgattgggacctc

SEQ ID NO: 159416 - DNA, 23 bp, Artificial Sequence
  Description of Artificial Sequence: Synthetic oligonucleotide
gggcctggccacatgagggtgga

SEQ ID NO: 159417 - DNA, 24 bp, Artificial Sequence
  Description of Artificial Sequence: Synthetic oligonucleotide
ggcctggccacatgagggtggaca

SEQ ID NO: 159418 - DNA, 24 bp, Artificial Sequence
  Description of Artificial Sequence: Synthetic oligonucleotide
gcctggccacatgagggtggacag

SEQ ID NO: 159419 - DNA, 25 bp, Artificial Sequence
  Description of Artificial Sequence: Synthetic oligonucleotide
cctggccacatgagggtggacagga

SEQ ID NO: 159420 - DNA, 27 bp, Artificial Sequence
  Description of Artificial Sequence: Synthetic oligonucleotide
ctggccacatgagggtggacaggacaa

SEQ ID NO: 159421 - DNA, 27 bp, Artificial Sequence
  Description of Artificial Sequence: Synthetic oligonucleotide
tggccacatgagggtggacaggacaag

SEQ ID NO: 159422 - DNA, 26 bp, Artificial Sequence
  Description of Artificial Sequence: Synthetic oligonucleotide
ggccacatgagggtggacaggacaag

SEQ ID NO: 159423 - DNA, 26 bp, Artificial Sequence
  Description of Artificial Sequence: Synthetic oligonucleotide
gccacatgagggtggacaggacaagc

SEQ ID NO: 159424 - DNA, 26 bp, Artificial Sequence
  Description of Artificial Sequence: Synthetic oligonucleotide
ccacatgagggtggacaggacaagcc

SEQ ID NO: 159425 - DNA, 36 bp, Artificial Sequence
  Description of Artificial Sequence: Synthetic oligonucleotide
gaggtgacatatgcacagttggatcactgcattttc

SEQ ID NO: 159426 - DNA, 37 bp, Artificial Sequence
  Description of Artificial Sequence: Synthetic oligonucleotide
aggtgacatatgcacagttggatcactgcattttcac

SEQ ID NO: 159427 - DNA, 36 bp, Artificial Sequence
  Description of Artificial Sequence: Synthetic oligonucleotide
ggtgacatatgcacagttggatcactgcattttcac

SEQ ID NO: 159428 - DNA, 37 bp, Artificial Sequence
  Description of Artificial Sequence: Synthetic oligonucleotide
gtgacatatgcacagttggatcactgcattttcacac

SEQ ID NO: 159429 - DNA, 38 bp, Artificial Sequence
  Description of Artificial Sequence: Synthetic oligonucleotide
tgacatatgcacagttggatcactgcattttcacacag

SEQ ID NO: 159430 - DNA, 37 bp, Artificial Sequence
  Description of Artificial Sequence: Synthetic oligonucleotide
gacatatgcacagttggatcactgcattttcacacag

SEQ ID NO: 159431 - DNA, 38 bp, Artificial Sequence
  Description of Artificial Sequence: Synthetic oligonucleotide
acatatgcacagttggatcactgcattttcacacagac

SEQ ID NO: 159432 - DNA, 37 bp, Artificial Sequence
  Description of Artificial Sequence: Synthetic oligonucleotide
catatgcacagttggatcactgcattttcacacagac

SEQ ID NO: 159433 - DNA, 43 bp, Artificial Sequence
  Description of Artificial Sequence: Synthetic oligonucleotide
atatgcacagttggatcactgcattttcacacagacaaaaatc

SEQ ID NO: 159434 - DNA, 42 bp, Artificial Sequence
  Description of Artificial Sequence: Synthetic oligonucleotide
tatgcacagttggatcactgcattttcacacagacaaaaatc

SEQ ID NO: 159435 - DNA, 41 bp, Artificial Sequence
  Description of Artificial Sequence: Synthetic oligonucleotide
atgcacagttggatcactgcattttcacacagacaaaaatc

SEQ ID NO: 159436 - DNA, 40 bp, Artificial Sequence
  Description of Artificial Sequence: Synthetic oligonucleotide
tgcacagttggatcactgcattttcacacagacaaaaatc

SEQ ID NO: 159437 - DNA, 39 bp, Artificial Sequence
  Description of Artificial Sequence: Synthetic oligonucleotide
gcacagttggatcactgcattttcacacagacaaaaatc

SEQ ID NO: 159438 - DNA, 40 bp, Artificial Sequence
  Description of Artificial Sequence: Synthetic oligonucleotide
cacagttggatcactgcattttcacacagacaaaaatcac

SEQ ID NO: 159439 - DNA, 42 bp, Artificial Sequence
  Description of Artificial Sequence: Synthetic oligonucleotide
acagttggatcactgcattttcacacagacaaaaatcacttc

SEQ ID NO: 159440 - DNA, 41 bp, Artificial Sequence
  Description of Artificial Sequence: Synthetic oligonucleotide
cagttggatcactgcattttcacacagacaaaaatcacttc

SEQ ID NO: 159441 - DNA, 41 bp, Artificial Sequence
  Description of Artificial Sequence: Synthetic oligonucleotide
agttggatcactgcattttcacacagacaaaaatcacttcc

SEQ ID NO: 159442 - DNA, 40 bp, Artificial Sequence
  Description of Artificial Sequence: Synthetic oligonucleotide
gttggatcactgcattttcacacagacaaaaatcacttcc

SEQ ID NO: 159443 - DNA, 40 bp, Artificial Sequence
  Description of Artificial Sequence: Synthetic oligonucleotide
ttggatcactgcattttcacacagacaaaaatcacttccc

SEQ ID NO: 159444 - DNA, 39 bp, Artificial Sequence
  Description of Artificial Sequence: Synthetic oligonucleotide
tggatcactgcattttcacacagacaaaaatcacttccc

SEQ ID NO: 159445 - DNA, 38 bp, Artificial Sequence
  Description of Artificial Sequence: Synthetic oligonucleotide
ggatcactgcattttcacacagacaaaaatcacttccc

SEQ ID NO: 159446 - DNA, 38 bp, Artificial Sequence
  Description of Artificial Sequence: Synthetic oligonucleotide
gatcactgcattttcacacagacaaaaatcacttcccc

SEQ ID NO: 159447 - DNA, 40 bp, Artificial Sequence
  Description of Artificial Sequence: Synthetic oligonucleotide
atcactgcattttcacacagacaaaaatcacttccccttc

SEQ ID NO: 159448 - DNA, 39 bp, Artificial Sequence
  Description of Artificial Sequence: Synthetic oligonucleotide
tcactgcattttcacacagacaaaaatcacttccccttc

SEQ ID NO: 159449 - DNA, 38 bp, Artificial Sequence
  Description of Artificial Sequence: Synthetic oligonucleotide
cactgcattttcacacagacaaaaatcacttccccttc

SEQ ID NO: 159450 - DNA, 39 bp, Artificial Sequence
  Description of Artificial Sequence: Synthetic oligonucleotide
actgcattttcacacagacaaaaatcacttccccttctc

SEQ ID NO: 159451 - DNA, 38 bp, Artificial Sequence
  Description of Artificial Sequence: Synthetic oligonucleotide
ctgcattttcacacagacaaaaatcacttccccttctc

SEQ ID NO: 159452 - DNA, 39 bp, Artificial Sequence
  Description of Artificial Sequence: Synthetic oligonucleotide
tgcattttcacacagacaaaaatcacttccccttctcag

SEQ ID NO: 159453 - DNA, 38 bp, Artificial Sequence
  Description of Artificial Sequence: Synthetic oligonucleotide
gcattttcacacagacaaaaatcacttccccttctcag

SEQ ID NO: 159454 - DNA, 39 bp, Artificial Sequence
  Description of Artificial Sequence: Synthetic oligonucleotide
cattttcacacagacaaaaatcacttccccttctcagag

SEQ ID NO: 159455 - DNA, 39 bp, Artificial Sequence
  Description of Artificial Sequence: Synthetic oligonucleotide
attttcacacagacaaaaatcacttccccttctcagagg

SEQ ID NO: 159456 - DNA, 21 bp, Artificial Sequence
  Description of Artificial Sequence: Synthetic oligonucleotide
cccagccgggccccacggttt

SEQ ID NO: 159457 - DNA, 21 bp, Artificial Sequence
  Description of Artificial Sequence: Synthetic oligonucleotide
ccagccgggccccacggtttg

SEQ ID NO: 159458 - DNA, 22 bp, Artificial Sequence
  Description of Artificial Sequence: Synthetic oligonucleotide
cagccgggccccacggtttgca

SEQ ID NO: 159459 - DNA, 23 bp, Artificial Sequence
  Description of Artificial Sequence: Synthetic oligonucleotide
agccgggccccacggtttgcaca

SEQ ID NO: 159460 - DNA, 22 bp, Artificial Sequence
  Description of Artificial Sequence: Synthetic oligonucleotide
gccgggccccacggtttgcaca

SEQ ID NO: 159461 - DNA, 22 bp, Artificial Sequence
  Description of Artificial Sequence: Synthetic oligonucleotide
ccgggccccacggtttgcacag

SEQ ID NO: 159462 - DNA, 23 bp, Artificial Sequence
  Description of Artificial Sequence: Synthetic oligonucleotide
cgggccccacggtttgcacagga

SEQ ID NO: 159463 - DNA, 24 bp, Artificial Sequence
  Description of Artificial Sequence: Synthetic oligonucleotide
gggccccacggtttgcacaggaga

SEQ ID NO: 159464 - DNA, 26 bp, Artificial Sequence
  Description of Artificial Sequence: Synthetic oligonucleotide
ggccccacggtttgcacaggagagaa

SEQ ID NO: 159465 - DNA, 26 bp, Artificial Sequence
  Description of Artificial Sequence: Synthetic oligonucleotide
gccccacggtttgcacaggagagaac

SEQ ID NO: 159466 - DNA, 27 bp, Artificial Sequence
  Description of Artificial Sequence: Synthetic oligonucleotide
ccccacggtttgcacaggagagaacgt

SEQ ID NO: 159467 - DNA, 27 bp, Artificial Sequence
  Description of Artificial Sequence: Synthetic oligonucleotide
cccacggtttgcacaggagagaacgtg

SEQ ID NO: 159468 - DNA, 28 bp, Artificial Sequence
  Description of Artificial Sequence: Synthetic oligonucleotide
ccacggtttgcacaggagagaacgtgac

SEQ ID NO: 159469 - DNA, 28 bp, Artificial Sequence
  Description of Artificial Sequence: Synthetic oligonucleotide
cacggtttgcacaggagagaacgtgacc

SEQ ID NO: 159470 - DNA, 30 bp, Artificial Sequence
  Description of Artificial Sequence: Synthetic oligonucleotide
acggtttgcacaggagagaacgtgaccttg

SEQ ID NO: 159471 - DNA, 29 bp, Artificial Sequence
  Description of Artificial Sequence: Synthetic oligonucleotide
cggtttgcacaggagagaacgtgaccttg

SEQ ID NO: 159472 - DNA, 30 bp, Artificial Sequence
  Description of Artificial Sequence: Synthetic oligonucleotide
ggtttgcacaggagagaacgtgaccttgtc

SEQ ID NO: 159473 - DNA, 30 bp, Artificial Sequence
  Description of Artificial Sequence: Synthetic oligonucleotide
gtttgcacaggagagaacgtgaccttgtcc

SEQ ID NO: 159474 - DNA, 31 bp, Artificial Sequence
  Description of Artificial Sequence: Synthetic oligonucleotide
tttgcacaggagagaacgtgaccttgtcctg

SEQ ID NO: 159475 - DNA, 30 bp, Artificial Sequence
  Description of Artificial Sequence: Synthetic oligonucleotide
ttgcacaggagagaacgtgaccttgtcctg

SEQ ID NO: 159476 - DNA, 29 bp, Artificial Sequence
  Description of Artificial Sequence: Synthetic oligonucleotide
tgcacaggagagaacgtgaccttgtcctg

SEQ ID NO: 159477 - DNA, 27 bp, Artificial Sequence
  Description of Artificial Sequence: Synthetic oligonucleotide
ctgccacccatggagggacctacacat

SEQ ID NO: 159478 - DNA, 27 bp, Artificial Sequence
  Description of Artificial Sequence: Synthetic oligonucleotide
tgccacccatggagggacctacacatg

SEQ ID NO: 159479 - DNA, 26 bp, Artificial Sequence
  Description of Artificial Sequence: Synthetic oligonucleotide
gccacccatggagggacctacacatg

SEQ ID NO: 159480 - DNA, 27 bp, Artificial Sequence
  Description of Artificial Sequence: Synthetic oligonucleotide
ccacccatggagggacctacacatgct

SEQ ID NO: 159481 - DNA, 28 bp, Artificial Sequence
  Description of Artificial Sequence: Synthetic oligonucleotide
cacccatggagggacctacacatgcttc

SEQ ID NO: 159482 - DNA, 28 bp, Artificial Sequence
  Description of Artificial Sequence: Synthetic oligonucleotide
acccatggagggacctacacatgcttcg

SEQ ID NO: 159483 - DNA, 27 bp, Artificial Sequence
  Description of Artificial Sequence: Synthetic oligonucleotide
cccatggagggacctacacatgcttcg

SEQ ID NO: 159484 - DNA, 27 bp, Artificial Sequence
  Description of Artificial Sequence: Synthetic oligonucleotide
ccatggagggacctacacatgcttcgg

SEQ ID NO: 159485 - DNA, 27 bp, Artificial Sequence
  Description of Artificial Sequence: Synthetic oligonucleotide
catggagggacctacacatgcttcggc

SEQ ID NO: 159486 - DNA, 28 bp, Artificial Sequence
  Description of Artificial Sequence: Synthetic oligonucleotide
atggagggacctacacatgcttcggctc

SEQ ID NO: 159487 - DNA, 27 bp, Artificial Sequence
  Description of Artificial Sequence: Synthetic oligonucleotide
tggagggacctacacatgcttcggctc

SEQ ID NO: 159488 - DNA, 27 bp, Artificial Sequence
  Description of Artificial Sequence: Synthetic oligonucleotide
atgtcgctcatggtggtcagcatggcg

SEQ ID NO: 159489 - DNA, 27 bp, Artificial Sequence
  Description of Artificial Sequence: Synthetic oligonucleotide
tgtcgctcatggtggtcagcatggcgt

SEQ ID NO: 159490 - DNA, 26 bp, Artificial Sequence
  Description of Artificial Sequence: Synthetic oligonucleotide
gtcgctcatggtggtcagcatggcgt

SEQ ID NO: 159491 - DNA, 27 bp, Artificial Sequence
  Description of Artificial Sequence: Synthetic oligonucleotide
tcgctcatggtggtcagcatggcgtgt

SEQ ID NO: 159492 - DNA, 26 bp, Artificial Sequence
  Description of Artificial Sequence: Synthetic oligonucleotide
cgctcatggtggtcagcatggcgtgt

SEQ ID NO: 159493 - DNA, 27 bp, Artificial Sequence
  Description of Artificial Sequence: Synthetic oligonucleotide
gctcatggtggtcagcatggcgtgtgt

SEQ ID NO: 159494 - DNA, 28 bp, Artificial Sequence
  Description of Artificial Sequence: Synthetic oligonucleotide
ctcatggtggtcagcatggcgtgtgttg

SEQ ID NO: 159495 - DNA, 28 bp, Artificial Sequence
  Description of Artificial Sequence: Synthetic oligonucleotide
tcatggtggtcagcatggcgtgtgttgg

SEQ ID NO: 159496 - DNA, 27 bp, Artificial Sequence
  Description of Artificial Sequence: Synthetic oligonucleotide
catggtggtcagcatggcgtgtgttgg

SEQ ID NO: 159497 - DNA, 27 bp, Artificial Sequence
  Description of Artificial Sequence: Synthetic oligonucleotide
atggtggtcagcatggcgtgtgttggg

SEQ ID NO: 159498 - DNA, 27 bp, Artificial Sequence
  Description of Artificial Sequence: Synthetic oligonucleotide
tggtggtcagcatggcgtgtgttgggt

SEQ ID NO: 159499 - DNA, 27 bp, Artificial Sequence
  Description of Artificial Sequence: Synthetic oligonucleotide
ggtggtcagcatggcgtgtgttgggtt

SEQ ID NO: 159500 - DNA, 27 bp, Artificial Sequence
  Description of Artificial Sequence: Synthetic oligonucleotide
gtggtcagcatggcgtgtgttgggttc

SEQ ID NO: 159501 - DNA, 29 bp, Artificial Sequence
  Description of Artificial Sequence: Synthetic oligonucleotide
tggtcagcatggcgtgtgttgggttcttc

SEQ ID NO: 159502 - DNA, 28 bp, Artificial Sequence
  Description of Artificial Sequence: Synthetic oligonucleotide
ggtcagcatggcgtgtgttgggttcttc

SEQ ID NO: 159503 - DNA, 24 bp, Artificial Sequence
  Description of Artificial Sequence: Synthetic oligonucleotide
ccttgctgtctgcctggcccagct

SEQ ID NO: 159504 - DNA, 25 bp, Artificial Sequence
  Description of Artificial Sequence: Synthetic oligonucleotide
cttgctgtctgcctggcccagctct

SEQ ID NO: 159505 - DNA, 26 bp, Artificial Sequence
  Description of Artificial Sequence: Synthetic oligonucleotide
ttgctgtctgcctggcccagctctgt

SEQ ID NO: 159506 - DNA, 25 bp, Artificial Sequence
  Description of Artificial Sequence: Synthetic oligonucleotide
tgctgtctgcctggcccagctctgt

SEQ ID NO: 159507 - DNA, 24 bp, Artificial Sequence
  Description of Artificial Sequence: Synthetic oligonucleotide
gctgtctgcctggcccagctctgt

SEQ ID NO: 159508 - DNA, 24 bp, Artificial Sequence
  Description of Artificial Sequence: Synthetic oligonucleotide
ctgtctgcctggcccagctctgtg

SEQ ID NO: 159509 - DNA, 25 bp, Artificial Sequence
  Description of Artificial Sequence: Synthetic oligonucleotide
tgtctgcctggcccagctctgtggt

SEQ ID NO: 159510 - DNA, 24 bp, Artificial Sequence
  Description of Artificial Sequence: Synthetic oligonucleotide
gtctgcctggcccagctctgtggt

SEQ ID NO: 159511 - DNA, 24 bp, Artificial Sequence
  Description of Artificial Sequence: Synthetic oligonucleotide
tctgcctggcccagctctgtggtg

SEQ ID NO: 159512 - DNA, 23 bp, Artificial Sequence
  Description of Artificial Sequence: Synthetic oligonucleotide
ctgcctggcccagctctgtggtg

SEQ ID NO: 159513 - DNA, 23 bp, Artificial Sequence
  Description of Artificial Sequence: Synthetic oligonucleotide
tgcctggcccagctctgtggtgc

SEQ ID NO: 159514 - DNA, 22 bp, Artificial Sequence
  Description of Artificial Sequence: Synthetic oligonucleotide
gcctggcccagctctgtggtgc

SEQ ID NO: 159515 - DNA, 23 bp, Artificial Sequence
  Description of Artificial Sequence: Synthetic oligonucleotide
cctggcccagctctgtggtgcct

SEQ ID NO: 159516 - DNA, 23 bp, Artificial Sequence
  Description of Artificial Sequence: Synthetic oligonucleotide
ctggcccagctctgtggtgcctc

SEQ ID NO: 159517 - DNA, 24 bp, Artificial Sequence
  Description of Artificial Sequence: Synthetic oligonucleotide
tggcccagctctgtggtgcctcca

SEQ ID NO: 159518 - DNA, 23 bp, Artificial Sequence
  Description of Artificial Sequence: Synthetic oligonucleotide
ggcccagctctgtggtgcctcca

SEQ ID NO: 159519 - DNA, 23 bp, Artificial Sequence
  Description of Artificial Sequence: Synthetic oligonucleotide
gcccagctctgtggtgcctccag

SEQ ID NO: 159520 - DNA, 24 bp, Artificial Sequence
  Description of Artificial Sequence: Synthetic oligonucleotide
cccagctctgtggtgcctccagga

SEQ ID NO: 159521 - DNA, 26 bp, Artificial Sequence
  Description of Artificial Sequence: Synthetic oligonucleotide
ccagctctgtggtgcctccaggacat

SEQ ID NO: 159522 - DNA, 27 bp, Artificial Sequence
  Description of Artificial Sequence: Synthetic oligonucleotide
cagctctgtggtgcctccaggacatgt

SEQ ID NO: 159523 - DNA, 27 bp, Artificial Sequence
  Description of Artificial Sequence: Synthetic oligonucleotide
agctctgtggtgcctccaggacatgtg

SEQ ID NO: 159524 - DNA, 27 bp, Artificial Sequence
  Description of Artificial Sequence: Synthetic oligonucleotide
gctctgtggtgcctccaggacatgtga

SEQ ID NO: 159525 - DNA, 29 bp, Artificial Sequence
  Description of Artificial Sequence: Synthetic oligonucleotide
ctctgtggtgcctccaggacatgtgattc

SEQ ID NO: 159526 - DNA, 31 bp, Artificial Sequence
  Description of Artificial Sequence: Synthetic oligonucleotide
tctgtggtgcctccaggacatgtgattcttc

SEQ ID NO: 159527 - DNA, 30 bp, Artificial Sequence
  Description of Artificial Sequence: Synthetic oligonucleotide
ctgtggtgcctccaggacatgtgattcttc

SEQ ID NO: 159528 - DNA, 30 bp, Artificial Sequence
  Description of Artificial Sequence: Synthetic oligonucleotide
tgtggtgcctccaggacatgtgattcttcg

SEQ ID NO: 159529 - DNA, 29 bp, Artificial Sequence
  Description of Artificial Sequence: Synthetic oligonucleotide
gtggtgcctccaggacatgtgattcttcg

SEQ ID NO: 159530 - DNA, 29 bp, Artificial Sequence
  Description of Artificial Sequence: Synthetic oligonucleotide
tggtgcctccaggacatgtgattcttcgg

SEQ ID NO: 159531 - DNA, 28 bp, Artificial Sequence
  Description of Artificial Sequence: Synthetic oligonucleotide
ggtgcctccaggacatgtgattcttcgg

SEQ ID NO: 159532 - DNA, 29 bp, Artificial Sequence
  Description of Artificial Sequence: Synthetic oligonucleotide
gtgcctccaggacatgtgattcttcggtg

SEQ ID NO: 159533 - DNA, 30 bp, Artificial Sequence
  Description of Artificial Sequence: Synthetic oligonucleotide
tgcctccaggacatgtgattcttcggtgtc

SEQ ID NO: 159534 - DNA, 29 bp, Artificial Sequence
  Description of Artificial Sequence: Synthetic oligonucleotide
gcctccaggacatgtgattcttcggtgtc

SEQ ID NO: 159535 - DNA, 32 bp, Artificial Sequence
  Description of Artificial Sequence: Synthetic oligonucleotide
cctccaggacatgtgattcttcggtgtcattc

SEQ ID NO: 159536 - DNA, 36 bp, Artificial Sequence
  Description of Artificial Sequence: Synthetic oligonucleotide
ctccaggacatgtgattcttcggtgtcattcttatc

SEQ ID NO: 159537 - DNA, 38 bp, Artificial Sequence
  Description of Artificial Sequence: Synthetic oligonucleotide
tccaggacatgtgattcttcggtgtcattcttatcttg

SEQ ID NO: 159538 - DNA, 37 bp, Artificial Sequence
  Description of Artificial Sequence: Synthetic oligonucleotide
ccaggacatgtgattcttcggtgtcattcttatcttg

SEQ ID NO: 159539 - DNA, 37 bp, Artificial Sequence
  Description of Artificial Sequence: Synthetic oligonucleotide
caggacatgtgattcttcggtgtcattcttatcttgg

SEQ ID NO: 159540 - DNA, 37 bp, Artificial Sequence
  Description of Artificial Sequence: Synthetic oligonucleotide
aggacatgtgattcttcggtgtcattcttatcttggg

SEQ ID NO: 159541 - DNA, 36 bp, Artificial Sequence
  Description of Artificial Sequence: Synthetic oligonucleotide
ggacatgtgattcttcggtgtcattcttatcttggg

SEQ ID NO: 159542 - DNA, 41 bp, Artificial Sequence
  Description of Artificial Sequence: Synthetic oligonucleotide
gacatgtgattcttcggtgtcattcttatcttgggtttaac

SEQ ID NO: 159543 - DNA, 43 bp, Artificial Sequence
  Description of Artificial Sequence: Synthetic oligonucleotide
acatgtgattcttcggtgtcattcttatcttgggtttaacaac

SEQ ID NO: 159544 - DNA, 42 bp, Artificial Sequence
  Description of Artificial Sequence: Synthetic oligonucleotide
catgtgattcttcggtgtcattcttatcttgggtttaacaac

SEQ ID NO: 159545 - DNA, 44 bp, Artificial Sequence
  Description of Artificial Sequence: Synthetic oligonucleotide
atgtgattcttcggtgtcattcttatcttgggtttaacaacttc

SEQ ID NO: 159546 - DNA, 43 bp, Artificial Sequence
  Description of Artificial Sequence: Synthetic oligonucleotide
tgtgattcttcggtgtcattcttatcttgggtttaacaacttc

SEQ ID NO: 159547 - DNA, 42 bp, Artificial Sequence
  Description of Artificial Sequence: Synthetic oligonucleotide
gtgattcttcggtgtcattcttatcttgggtttaacaacttc

SEQ ID NO: 159548 - DNA, 43 bp, Artificial Sequence
  Description of Artificial Sequence: Synthetic oligonucleotide
tgattcttcggtgtcattcttatcttgggtttaacaacttcag

SEQ ID NO: 159549 - DNA, 42 bp, Artificial Sequence
  Description of Artificial Sequence: Synthetic oligonucleotide
gattcttcggtgtcattcttatcttgggtttaacaacttcag

SEQ ID NO: 159550 - DNA, 43 bp, Artificial Sequence
  Description of Artificial Sequence: Synthetic oligonucleotide
attcttcggtgtcattcttatcttgggtttaacaacttcagtc

SEQ ID NO: 159551 - DNA, 42 bp, Artificial Sequence
  Description of Artificial Sequence: Synthetic oligonucleotide
ttcttcggtgtcattcttatcttgggtttaacaacttcagtc

SEQ ID NO: 159552 - DNA, 41 bp, Artificial Sequence
  Description of Artificial Sequence: Synthetic oligonucleotide
tcttcggtgtcattcttatcttgggtttaacaacttcagtc

SEQ ID NO: 159553 - DNA, 40 bp, Artificial Sequence
  Description of Artificial Sequence: Synthetic oligonucleotide
cttcggtgtcattcttatcttgggtttaacaacttcagtc

SEQ ID NO: 159554 - DNA, 41 bp, Artificial Sequence
  Description of Artificial Sequence: Synthetic oligonucleotide
ttcggtgtcattcttatcttgggtttaacaacttcagtctg

SEQ ID NO: 159555 - DNA, 40 bp, Artificial Sequence
  Description of Artificial Sequence: Synthetic oligonucleotide
tcggtgtcattcttatcttgggtttaacaacttcagtctg

SEQ ID NO: 159556 - DNA, 39 bp, Artificial Sequence
  Description of Artificial Sequence: Synthetic oligonucleotide
cggtgtcattcttatcttgggtttaacaacttcagtctg

SEQ ID NO: 159557 - DNA, 44 bp, Artificial Sequence
  Description of Artificial Sequence: Synthetic oligonucleotide
ggtgtcattcttatcttgggtttaacaacttcagtctgtaaaag

SEQ ID NO: 159558 - DNA, 44 bp, Artificial Sequence
  Description of Artificial Sequence: Synthetic oligonucleotide
gtgtcattcttatcttgggtttaacaacttcagtctgtaaaagg

SEQ ID NO: 159559 - DNA, 46 bp, Artificial Sequence
  Description of Artificial Sequence: Synthetic oligonucleotide
tgtcattcttatcttgggtttaacaacttcagtctgtaaaaggaag

SEQ ID NO: 159560 - DNA, 45 bp, Artificial Sequence
  Description of Artificial Sequence: Synthetic oligonucleotide
gtcattcttatcttgggtttaacaacttcagtctgtaaaaggaag

SEQ ID NO: 159561 - DNA, 47 bp, Artificial Sequence
  Description of Artificial Sequence: Synthetic oligonucleotide
tcattcttatcttgggtttaacaacttcagtctgtaaaaggaagatg

SEQ ID NO: 159562 - DNA, 46 bp, Artificial Sequence
  Description of Artificial Sequence: Synthetic oligonucleotide
cattcttatcttgggtttaacaacttcagtctgtaaaaggaagatg

SEQ ID NO: 159563 - DNA, 46 bp, Artificial Sequence
  Description of Artificial Sequence: Synthetic oligonucleotide
attcttatcttgggtttaacaacttcagtctgtaaaaggaagatgg

SEQ ID NO: 159564 - DNA, 45 bp, Artificial Sequence
  Description of Artificial Sequence: Synthetic oligonucleotide
ttcttatcttgggtttaacaacttcagtctgtaaaaggaagatgg

SEQ ID NO: 159565 - DNA, 44 bp, Artificial Sequence
  Description of Artificial Sequence: Synthetic oligonucleotide
tcttatcttgggtttaacaacttcagtctgtaaaaggaagatgg

SEQ ID NO: 159566 - DNA, 43 bp, Artificial Sequence
  Description of Artificial Sequence: Synthetic oligonucleotide
cttatcttgggtttaacaacttcagtctgtaaaaggaagatgg

SEQ ID NO: 159567 - DNA, 43 bp, Artificial Sequence
  Description of Artificial Sequence: Synthetic oligonucleotide
ttatcttgggtttaacaacttcagtctgtaaaaggaagatggg

SEQ ID NO: 159568 - DNA, 42 bp, Artificial Sequence
  Description of Artificial Sequence: Synthetic oligonucleotide
tatcttgggtttaacaacttcagtctgtaaaaggaagatggg

SEQ ID NO: 159569 - DNA, 41 bp, Artificial Sequence
  Description of Artificial Sequence: Synthetic oligonucleotide
atcttgggtttaacaacttcagtctgtaaaaggaagatggg

SEQ ID NO: 159570 - DNA, 40 bp, Artificial Sequence
  Description of Artificial Sequence: Synthetic oligonucleotide
tcttgggtttaacaacttcagtctgtaaaaggaagatggg

SEQ ID NO: 159571 - DNA, 39 bp, Artificial Sequence
  Description of Artificial Sequence: Synthetic oligonucleotide
cttgggtttaacaacttcagtctgtaaaaggaagatggg

SEQ ID NO: 159572 - DNA, 39 bp, Artificial Sequence
  Description of Artificial Sequence: Synthetic oligonucleotide
ttgggtttaacaacttcagtctgtaaaaggaagatgggg

SEQ ID NO: 159573 - DNA, 38 bp, Artificial Sequence
  Description of Artificial Sequence: Synthetic oligonucleotide
tgggtttaacaacttcagtctgtaaaaggaagatgggg

SEQ ID NO: 159574 - DNA, 37 bp, Artificial Sequence
  Description of Artificial Sequence: Synthetic oligonucleotide
gggtttaacaacttcagtctgtaaaaggaagatgggg

SEQ ID NO: 159575 - DNA, 38 bp, Artificial Sequence
  Description of Artificial Sequence: Synthetic oligonucleotide
ggtttaacaacttcagtctgtaaaaggaagatggggtg

SEQ ID NO: 159576 - DNA, 38 bp, Artificial Sequence
  Description of Artificial Sequence: Synthetic oligonucleotide
gtttaacaacttcagtctgtaaaaggaagatggggtgc

SEQ ID NO: 159577 - DNA, 38 bp, Artificial Sequence
  Description of Artificial Sequence: Synthetic oligonucleotide
tttaacaacttcagtctgtaaaaggaagatggggtgcc

SEQ ID NO: 159578 - DNA, 37 bp, Artificial Sequence
  Description of Artificial Sequence: Synthetic oligonucleotide
ttaacaacttcagtctgtaaaaggaagatggggtgcc

SEQ ID NO: 159579 - DNA, 36 bp, Artificial Sequence
  Description of Artificial Sequence: Synthetic oligonucleotide
taacaacttcagtctgtaaaaggaagatggggtgcc

SEQ ID NO: 159580 - DNA, 35 bp, Artificial Sequence
  Description of Artificial Sequence: Synthetic oligonucleotide
aacaacttcagtctgtaaaaggaagatggggtgcc

SEQ ID NO: 159581 - DNA, 34 bp, Artificial Sequence
  Description of Artificial Sequence: Synthetic oligonucleotide
acaacttcagtctgtaaaaggaagatggggtgcc

SEQ ID NO: 159582 - DNA, 33 bp, Artificial Sequence
  Description of Artificial Sequence: Synthetic oligonucleotide
caacttcagtctgtaaaaggaagatggggtgcc

SEQ ID NO: 159583 - DNA, 34 bp, Artificial Sequence
  Description of Artificial Sequence: Synthetic oligonucleotide
aacttcagtctgtaaaaggaagatggggtgcctg

SEQ ID NO: 159584 - DNA, 33 bp, Artificial Sequence
  Description of Artificial Sequence: Synthetic oligonucleotide
acttcagtctgtaaaaggaagatggggtgcctg

SEQ ID NO: 159585 - DNA, 32 bp, Artificial Sequence
  Description of Artificial Sequence: Synthetic oligonucleotide
cttcagtctgtaaaaggaagatggggtgcctg

SEQ ID NO: 159586 - DNA, 32 bp, Artificial Sequence
  Description of Artificial Sequence: Synthetic oligonucleotide
ttcagtctgtaaaaggaagatggggtgcctgg

SEQ ID NO: 159587 - DNA, 31 bp, Artificial Sequence
  Description of Artificial Sequence: Synthetic oligonucleotide
tcagtctgtaaaaggaagatggggtgcctgg

SEQ ID NO: 159588 - DNA, 30 bp, Artificial Sequence
  Description of Artificial Sequence: Synthetic oligonucleotide
cagtctgtaaaaggaagatggggtgcctgg

SEQ ID NO: 159589 - DNA, 30 bp, Artificial Sequence
  Description of Artificial Sequence: Synthetic oligonucleotide
agtctgtaaaaggaagatggggtgcctggc

SEQ ID NO: 159590 - DNA, 29 bp, Artificial Sequence
  Description of Artificial Sequence: Synthetic oligonucleotide
gtctgtaaaaggaagatggggtgcctggc

SEQ ID NO: 159591 - DNA, 30 bp, Artificial Sequence
  Description of Artificial Sequence: Synthetic oligonucleotide
tctgtaaaaggaagatggggtgcctggcac

SEQ ID NO: 159592 - DNA, 29 bp, Artificial Sequence
  Description of Artificial Sequence: Synthetic oligonucleotide
ctgtaaaaggaagatggggtgcctggcac

SEQ ID NO: 159593 - DNA, 30 bp, Artificial Sequence
  Description of Artificial Sequence: Synthetic oligonucleotide
tgtaaaaggaagatggggtgcctggcactg

SEQ ID NO: 159594 - DNA, 29 bp, Artificial Sequence
  Description of Artificial Sequence: Synthetic oligonucleotide
gtaaaaggaagatggggtgcctggcactg

SEQ ID NO: 159595 - DNA, 30 bp, Artificial Sequence
  Description of Artificial Sequence: Synthetic oligonucleotide
taaaaggaagatggggtgcctggcactgag

SEQ ID NO: 159596 - DNA, 29 bp, Artificial Sequence
  Description of Artificial Sequence: Synthetic oligonucleotide
aaaaggaagatggggtgcctggcactgag

SEQ ID NO: 159597 - DNA, 28 bp, Artificial Sequence
  Description of Artificial Sequence: Synthetic oligonucleotide
aaaggaagatggggtgcctggcactgag

SEQ ID NO: 159598 - DNA, 27 bp, Artificial Sequence
  Description of Artificial Sequence: Synthetic oligonucleotide
aaggaagatggggtgcctggcactgag

SEQ ID NO: 159599 - DNA, 26 bp, Artificial Sequence
  Description of Artificial Sequence: Synthetic oligonucleotide
aggaagatggggtgcctggcactgag

SEQ ID NO: 159600 - DNA, 25 bp, Artificial Sequence
  Description of Artificial Sequence: Synthetic oligonucleotide
ggaagatggggtgcctggcactgag

SEQ ID NO: 159601 - DNA, 26 bp, Artificial Sequence
  Description of Artificial Sequence: Synthetic oligonucleotide
gaagatggggtgcctggcactgagct

SEQ ID NO: 159602 - DNA, 27 bp, Artificial Sequence
  Description of Artificial Sequence: Synthetic oligonucleotide
aagatggggtgcctggcactgagctct

SEQ ID NO: 159603 - DNA, 27 bp, Artificial Sequence
  Description of Artificial Sequence: Synthetic oligonucleotide
agatggggtgcctggcactgagctcta

SEQ ID NO: 159604 - DNA, 26 bp, Artificial Sequence
  Description of Artificial Sequence: Synthetic oligonucleotide
gatggggtgcctggcactgagctcta

SEQ ID NO: 159605 - DNA, 27 bp, Artificial Sequence
  Description of Artificial Sequence: Synthetic oligonucleotide
atggggtgcctggcactgagctctaca

SEQ ID NO: 159606 - DNA, 27 bp, Artificial Sequence
  Description of Artificial Sequence: Synthetic oligonucleotide
tggggtgcctggcactgagctctacaa

SEQ ID NO: 159607 - DNA, 26 bp, Artificial Sequence
  Description of Artificial Sequence: Synthetic oligonucleotide
ggggtgcctggcactgagctctacaa

SEQ ID NO: 159608 - DNA, 27 bp, Artificial Sequence
  Description of Artificial Sequence: Synthetic oligonucleotide
gggtgcctggcactgagctctacaaca

SEQ ID NO: 159609 - DNA, 27 bp, Artificial Sequence
  Description of Artificial Sequence: Synthetic oligonucleotide
ggtgcctggcactgagctctacaacag

SEQ ID NO: 159610 - DNA, 33 bp, Artificial Sequence
  Description of Artificial Sequence: Synthetic oligonucleotide
gtgcctggcactgagctctacaacagaatattc

SEQ ID NO: 159611 - DNA, 34 bp, Artificial Sequence
  Description of Artificial Sequence: Synthetic oligonucleotide
tgcctggcactgagctctacaacagaatattctg

SEQ ID NO: 159612 - DNA, 33 bp, Artificial Sequence
  Description of Artificial Sequence: Synthetic oligonucleotide
gcctggcactgagctctacaacagaatattctg

SEQ ID NO: 159613 - DNA, 33 bp, Artificial Sequence
  Description of Artificial Sequence: Synthetic oligonucleotide
cctggcactgagctctacaacagaatattctgg

SEQ ID NO: 159614 - DNA, 35 bp, Artificial Sequence
  Description of Artificial Sequence: Synthetic oligonucleotide
ctggcactgagctctacaacagaatattctggaag

SEQ ID NO: 159615 - DNA, 36 bp, Artificial Sequence
  Description of Artificial Sequence: Synthetic oligonucleotide
tggcactgagctctacaacagaatattctggaagag

SEQ ID NO: 159616 - DNA, 35 bp, Artificial Sequence
  Description of Artificial Sequence: Synthetic oligonucleotide
ggcactgagctctacaacagaatattctggaagag

SEQ ID NO: 159617 - DNA, 35 bp, Artificial Sequence
  Description of Artificial Sequence: Synthetic oligonucleotide
gcactgagctctacaacagaatattctggaagagc

SEQ ID NO: 159618 - DNA, 35 bp, Artificial Sequence
  Description of Artificial Sequence: Synthetic oligonucleotide
cactgagctctacaacagaatattctggaagagcc

SEQ ID NO: 159619 - DNA, 39 bp, Artificial Sequence
  Description of Artificial Sequence: Synthetic oligonucleotide
actgagctctacaacagaatattctggaagagccttttc

SEQ ID NO: 159620 - DNA, 38 bp, Artificial Sequence
  Description of Artificial Sequence: Synthetic oligonucleotide
ctgagctctacaacagaatattctggaagagccttttc

SEQ ID NO: 159621 - DNA, 40 bp, Artificial Sequence
  Description of Artificial Sequence: Synthetic oligonucleotide
tgagctctacaacagaatattctggaagagccttttcatg

SEQ ID NO: 159622 - DNA, 39 bp, Artificial Sequence
  Description of Artificial Sequence: Synthetic oligonucleotide
gagctctacaacagaatattctggaagagccttttcatg

SEQ ID NO: 159623 - DNA, 39 bp, Artificial Sequence
  Description of Artificial Sequence: Synthetic oligonucleotide
agctctacaacagaatattctggaagagccttttcatgg

SEQ ID NO: 159624 - DNA, 38 bp, Artificial Sequence
  Description of Artificial Sequence: Synthetic oligonucleotide
gctctacaacagaatattctggaagagccttttcatgg

SEQ ID NO: 159625 - DNA, 38 bp, Artificial Sequence
  Description of Artificial Sequence: Synthetic oligonucleotide
ctctacaacagaatattctggaagagccttttcatggg

SEQ ID NO: 159626 - DNA, 38 bp, Artificial Sequence
  Description of Artificial Sequence: Synthetic oligonucleotide
tctacaacagaatattctggaagagccttttcatgggc

SEQ ID NO: 159627 - DNA, 37 bp, Artificial Sequence
  Description of Artificial Sequence: Synthetic oligonucleotide
ctacaacagaatattctggaagagccttttcatgggc

SEQ ID NO: 159628 - DNA, 37 bp, Artificial Sequence
  Description of Artificial Sequence: Synthetic oligonucleotide
tacaacagaatattctggaagagccttttcatgggcc

SEQ ID NO: 159629 - DNA, 36 bp, Artificial Sequence
  Description of Artificial Sequence: Synthetic oligonucleotide
acaacagaatattctggaagagccttttcatgggcc

SEQ ID NO: 159630 - DNA, 35 bp, Artificial Sequence
  Description of Artificial Sequence: Synthetic oligonucleotide
caacagaatattctggaagagccttttcatgggcc

SEQ ID NO: 159631 - DNA, 35 bp, Artificial Sequence
  Description of Artificial Sequence: Synthetic oligonucleotide
aacagaatattctggaagagccttttcatgggccc

SEQ ID NO: 159632 - DNA, 34 bp, Artificial Sequence
  Description of Artificial Sequence: Synthetic oligonucleotide
acagaatattctggaagagccttttcatgggccc

SEQ ID NO: 159633 - DNA, 33 bp, Artificial Sequence
  Description of Artificial Sequence: Synthetic oligonucleotide
cagaatattctggaagagccttttcatgggccc

SEQ ID NO: 159634 - DNA, 34 bp, Artificial Sequence
  Description of Artificial Sequence: Synthetic oligonucleotide
agaatattctggaagagccttttcatgggccctg

SEQ ID NO: 159635 - DNA, 33 bp, Artificial Sequence
  Description of Artificial Sequence: Synthetic oligonucleotide
gaatattctggaagagccttttcatgggccctg

SEQ ID NO: 159636 - DNA, 34 bp, Artificial Sequence
  Description of Artificial Sequence: Synthetic oligonucleotide
aatattctggaagagccttttcatgggccctgtg

SEQ ID NO: 159637 - DNA, 33 bp, Artificial Sequence
  Description of Artificial Sequence: Synthetic oligonucleotide
atattctggaagagccttttcatgggccctgtg

SEQ ID NO: 159638 - DNA, 32 bp, Artificial Sequence
  Description of Artificial Sequence: Synthetic oligonucleotide
tattctggaagagccttttcatgggccctgtg

SEQ ID NO: 159639 - DNA, 31 bp, Artificial Sequence
  Description of Artificial Sequence: Synthetic oligonucleotide
attctggaagagccttttcatgggccctgtg

SEQ ID NO: 159640 - DNA, 30 bp, Artificial Sequence
  Description of Artificial Sequence: Synthetic oligonucleotide
ttctggaagagccttttcatgggccctgtg

SEQ ID NO: 159641 - DNA, 29 bp, Artificial Sequence
  Description of Artificial Sequence: Synthetic oligonucleotide
tctggaagagccttttcatgggccctgtg

SEQ ID NO: 159642 - DNA, 28 bp, Artificial Sequence
  Description of Artificial Sequence: Synthetic oligonucleotide
ctggaagagccttttcatgggccctgtg

SEQ ID NO: 159643 - DNA, 29 bp, Artificial Sequence
  Description of Artificial Sequence: Synthetic oligonucleotide
tggaagagccttttcatgggccctgtgac

SEQ ID NO: 159644 - DNA, 28 bp, Artificial Sequence
  Description of Artificial Sequence: Synthetic oligonucleotide
ggaagagccttttcatgggccctgtgac

SEQ ID NO: 159645 - DNA, 28 bp, Artificial Sequence
  Description of Artificial Sequence: Synthetic oligonucleotide
gaagagccttttcatgggccctgtgacc

SEQ ID NO: 159646 - DNA, 28 bp, Artificial Sequence
  Description of Artificial Sequence: Synthetic oligonucleotide
aagagccttttcatgggccctgtgaccc

SEQ ID NO: 159647 - DNA, 27 bp, Artificial Sequence
  Description of Artificial Sequence: Synthetic oligonucleotide
agagccttttcatgggccctgtgaccc

SEQ ID NO: 159648 - DNA, 26 bp, Artificial Sequence
  Description of Artificial Sequence: Synthetic oligonucleotide
gagccttttcatgggccctgtgaccc

SEQ ID NO: 159649 - DNA, 27 bp, Artificial Sequence
  Description of Artificial Sequence: Synthetic oligonucleotide
agccttttcatgggccctgtgacccca

SEQ ID NO: 159650 - DNA, 26 bp, Artificial Sequence
  Description of Artificial Sequence: Synthetic oligonucleotide
gccttttcatgggccctgtgacccca

SEQ ID NO: 159651 - DNA, 26 bp, Artificial Sequence
  Description of Artificial Sequence: Synthetic oligonucleotide
ccttttcatgggccctgtgaccccag

SEQ ID NO: 159652 - DNA, 27 bp, Artificial Sequence
  Description of Artificial Sequence: Synthetic oligonucleotide
cttttcatgggccctgtgaccccagca

SEQ ID NO: 159653 - DNA, 27 bp, Artificial Sequence
  Description of Artificial Sequence: Synthetic oligonucleotide
ttttcatgggccctgtgaccccagcac

SEQ ID NO: 159654 - DNA, 27 bp, Artificial Sequence
  Description of Artificial Sequence: Synthetic oligonucleotide
tttcatgggccctgtgaccccagcaca

SEQ ID NO: 159655 - DNA, 26 bp, Artificial Sequence
  Description of Artificial Sequence: Synthetic oligonucleotide
ttcatgggccctgtgaccccagcaca

SEQ ID NO: 159656 - DNA, 25 bp, Artificial Sequence
  Description of Artificial Sequence: Synthetic oligonucleotide
tcatgggccctgtgaccccagcaca

SEQ ID NO: 159657 - DNA, 24 bp, Artificial Sequence
  Description of Artificial Sequence: Synthetic oligonucleotide
catgggccctgtgaccccagcaca

SEQ ID NO: 159658 - DNA, 25 bp, Artificial Sequence
  Description of Artificial Sequence: Synthetic oligonucleotide
atgggccctgtgaccccagcacaca

SEQ ID NO: 159659 - DNA, 24 bp, Artificial Sequence
  Description of Artificial Sequence: Synthetic oligonucleotide
tgggccctgtgaccccagcacaca

SEQ ID NO: 159660 - DNA, 23 bp, Artificial Sequence
  Description of Artificial Sequence: Synthetic oligonucleotide
gggccctgtgaccccagcacaca

SEQ ID NO: 159661 - DNA, 24 bp, Artificial Sequence
  Description of Artificial Sequence: Synthetic oligonucleotide
ggccctgtgaccccagcacacaca

SEQ ID NO: 159662 - DNA, 24 bp, Artificial Sequence
  Description of Artificial Sequence: Synthetic oligonucleotide
gccctgtgaccccagcacacacag

SEQ ID NO: 159663 - DNA, 24 bp, Artificial Sequence
  Description of Artificial Sequence: Synthetic oligonucleotide
ccctgtgaccccagcacacacagg

SEQ ID NO: 159664 - DNA, 25 bp, Artificial Sequence
  Description of Artificial Sequence: Synthetic oligonucleotide
cctgtgaccccagcacacacaggga

SEQ ID NO: 159665 - DNA, 25 bp, Artificial Sequence
  Description of Artificial Sequence: Synthetic oligonucleotide
ctgtgaccccagcacacacagggac

SEQ ID NO: 159666 - DNA, 27 bp, Artificial Sequence
  Description of Artificial Sequence: Synthetic oligonucleotide
tgtgaccccagcacacacagggacgta

SEQ ID NO: 159667 - DNA, 26 bp, Artificial Sequence
  Description of Artificial Sequence: Synthetic oligonucleotide
gtgaccccagcacacacagggacgta

SEQ ID NO: 159668 - DNA, 27 bp, Artificial Sequence
  Description of Artificial Sequence: Synthetic oligonucleotide
tgaccccagcacacacagggacgtaca

SEQ ID NO: 159669 - DNA, 26 bp, Artificial Sequence
  Description of Artificial Sequence: Synthetic oligonucleotide
gaccccagcacacacagggacgtaca

SEQ ID NO: 159670 - DNA, 27 bp, Artificial Sequence
  Description of Artificial Sequence: Synthetic oligonucleotide
accccagcacacacagggacgtacaga

SEQ ID NO: 159671 - DNA, 27 bp, Artificial Sequence
  Description of Artificial Sequence: Synthetic oligonucleotide
ccccagcacacacagggacgtacagat

SEQ ID NO: 159672 - DNA, 27 bp, Artificial Sequence
  Description of Artificial Sequence: Synthetic oligonucleotide
cccagcacacacagggacgtacagatg

SEQ ID NO: 159673 - DNA, 28 bp, Artificial Sequence
  Description of Artificial Sequence: Synthetic oligonucleotide
ccagcacacacagggacgtacagatgtc

SEQ ID NO: 159674 - DNA, 28 bp, Artificial Sequence
  Description of Artificial Sequence: Synthetic oligonucleotide
cagcacacacagggacgtacagatgtcg

SEQ ID NO: 159675 - DNA, 28 bp, Artificial Sequence
  Description of Artificial Sequence: Synthetic oligonucleotide
agcacacacagggacgtacagatgtcgg

SEQ ID NO: 159676 - DNA, 27 bp, Artificial Sequence
  Description of Artificial Sequence: Synthetic oligonucleotide
gcacacacagggacgtacagatgtcgg

SEQ ID NO: 159677 - DNA, 27 bp, Artificial Sequence
  Description of Artificial Sequence: Synthetic oligonucleotide
cacacacagggacgtacagatgtcggg

SEQ ID NO: 159678 - DNA, 27 bp, Artificial Sequence
  Description of Artificial Sequence: Synthetic oligonucleotide
acacacagggacgtacagatgtcgggg

SEQ ID NO: 159679 - DNA, 27 bp, Artificial Sequence
  Description of Artificial Sequence: Synthetic oligonucleotide
cacacagggacgtacagatgtcggggt

SEQ ID NO: 159680 - DNA, 28 bp, Artificial Sequence
  Description of Artificial Sequence: Synthetic oligonucleotide
acacagggacgtacagatgtcggggttc

SEQ ID NO: 159681 - DNA, 27 bp, Artificial Sequence
  Description of Artificial Sequence: Synthetic oligonucleotide
cacagggacgtacagatgtcggggttc

SEQ ID NO: 159682 - DNA, 28 bp, Artificial Sequence
  Description of Artificial Sequence: Synthetic oligonucleotide
acagggacgtacagatgtcggggttcac

SEQ ID NO: 159683 - DNA, 27 bp, Artificial Sequence
  Description of Artificial Sequence: Synthetic oligonucleotide
cagggacgtacagatgtcggggttcac

SEQ ID NO: 159684 - DNA, 28 bp, Artificial Sequence
  Description of Artificial Sequence: Synthetic oligonucleotide
agggacgtacagatgtcggggttcacac

SEQ ID NO: 159685 - DNA, 27 bp, Artificial Sequence
  Description of Artificial Sequence: Synthetic oligonucleotide
gggacgtacagatgtcggggttcacac

SEQ ID NO: 159686 - DNA, 27 bp, Artificial Sequence
  Description of Artificial Sequence: Synthetic oligonucleotide
ggacgtacagatgtcggggttcacacc

SEQ ID NO: 159687 - DNA, 27 bp, Artificial Sequence
  Description of Artificial Sequence: Synthetic oligonucleotide
gacgtacagatgtcggggttcacaccc

SEQ ID NO: 159688 - DNA, 28 bp, Artificial Sequence
  Description of Artificial Sequence: Synthetic oligonucleotide
acgtacagatgtcggggttcacacccac

SEQ ID NO: 159689 - DNA, 27 bp, Artificial Sequence
  Description of Artificial Sequence: Synthetic oligonucleotide
cgtacagatgtcggggttcacacccac

SEQ ID NO: 159690 - DNA, 28 bp, Artificial Sequence
  Description of Artificial Sequence: Synthetic oligonucleotide
gtacagatgtcggggttcacacccacac

SEQ ID NO: 159691 - DNA, 29 bp, Artificial Sequence
  Description of Artificial Sequence: Synthetic oligonucleotide
tacagatgtcggggttcacacccacactc

SEQ ID NO: 159692 - DNA, 28 bp, Artificial Sequence
  Description of Artificial Sequence: Synthetic oligonucleotide
acagatgtcggggttcacacccacactc

SEQ ID NO: 159693 - DNA, 27 bp, Artificial Sequence
  Description of Artificial Sequence: Synthetic oligonucleotide
cagatgtcggggttcacacccacactc

SEQ ID NO: 159694 - DNA, 27 bp, Artificial Sequence
  Description of Artificial Sequence: Synthetic oligonucleotide
agatgtcggggttcacacccacactcc

SEQ ID NO: 159695 - DNA, 26 bp, Artificial Sequence
  Description of Artificial Sequence: Synthetic oligonucleotide
gatgtcggggttcacacccacactcc

SEQ ID NO: 159696 - DNA, 26 bp, Artificial Sequence
  Description of Artificial Sequence: Synthetic oligonucleotide
atgtcggggttcacacccacactccc

SEQ ID NO: 159697 - DNA, 25 bp, Artificial Sequence
  Description of Artificial Sequence: Synthetic oligonucleotide
tgtcggggttcacacccacactccc

SEQ ID NO: 159698 - DNA, 24 bp, Artificial Sequence
  Description of Artificial Sequence: Synthetic oligonucleotide
gtcggggttcacacccacactccc

SEQ ID NO: 159699 - DNA, 24 bp, Artificial Sequence
  Description of Artificial Sequence: Synthetic oligonucleotide
tcggggttcacacccacactcccc

SEQ ID NO: 159700 - DNA, 23 bp, Artificial Sequence
  Description of Artificial Sequence: Synthetic oligonucleotide
cggggttcacacccacactcccc

SEQ ID NO: 159701 - DNA, 24 bp, Artificial Sequence
  Description of Artificial Sequence: Synthetic oligonucleotide
ggggttcacacccacactccccca

SEQ ID NO: 159702 - DNA, 25 bp, Artificial Sequence
  Description of Artificial Sequence: Synthetic oligonucleotide
gggttcacacccacactcccccagt

SEQ ID NO: 159703 - DNA, 25 bp, Artificial Sequence
  Description of Artificial Sequence: Synthetic oligonucleotide
ggttcacacccacactcccccagtg

SEQ ID NO: 159704 - DNA, 25 bp, Artificial Sequence
  Description of Artificial Sequence: Synthetic oligonucleotide
gttcacacccacactcccccagtgg

SEQ ID NO: 159705 - DNA, 26 bp, Artificial Sequence
  Description of Artificial Sequence: Synthetic oligonucleotide
ttcacacccacactcccccagtgggt

SEQ ID NO: 159706 - DNA, 25 bp, Artificial Sequence
  Description of Artificial Sequence: Synthetic oligonucleotide
tcacacccacactcccccagtgggt

SEQ ID NO: 159707 - DNA, 24 bp, Artificial Sequence
  Description of Artificial Sequence: Synthetic oligonucleotide
cacacccacactcccccagtgggt

SEQ ID NO: 159708 - DNA, 24 bp, Artificial Sequence
  Description of Artificial Sequence: Synthetic oligonucleotide
acacccacactcccccagtgggtg

SEQ ID NO: 159709 - DNA, 23 bp, Artificial Sequence
  Description of Artificial Sequence: Synthetic oligonucleotide
cacccacactcccccagtgggtg

SEQ ID NO: 159710 - DNA, 24 bp, Artificial Sequence
  Description of Artificial Sequence: Synthetic oligonucleotide
acccacactcccccagtgggtggt

SEQ ID NO: 159711 - DNA, 23 bp, Artificial Sequence
  Description of Artificial Sequence: Synthetic oligonucleotide
cccacactcccccagtgggtggt

SEQ ID NO: 159712 - DNA, 23 bp, Artificial Sequence
  Description of Artificial Sequence: Synthetic oligonucleotide
ccacactcccccagtgggtggtc

SEQ ID NO: 159713 - DNA, 23 bp, Artificial Sequence
  Description of Artificial Sequence: Synthetic oligonucleotide
cacactcccccagtgggtggtcg

SEQ ID NO: 159714 - DNA, 23 bp, Artificial Sequence
  Description of Artificial Sequence: Synthetic oligonucleotide
acactcccccagtgggtggtcgg

SEQ ID NO: 159715 - DNA, 22 bp, Artificial Sequence
  Description of Artificial Sequence: Synthetic oligonucleotide
cactcccccagtgggtggtcgg

SEQ ID NO: 159716 - DNA, 23 bp, Artificial Sequence
  Description of Artificial Sequence: Synthetic oligonucleotide
actcccccagtgggtggtcggca

SEQ ID NO: 159717 - DNA, 22 bp, Artificial Sequence
  Description of Artificial Sequence: Synthetic oligonucleotide
ctcccccagtgggtggtcggca

SEQ ID NO: 159718 - DNA, 22 bp, Artificial Sequence
  Description of Artificial Sequence: Synthetic oligonucleotide
tcccccagtgggtggtcggcac

SEQ ID NO: 159719 - DNA, 21 bp, Artificial Sequence
  Description of Artificial Sequence: Synthetic oligonucleotide
cccccagtgggtggtcggcac

SEQ ID NO: 159720 - DNA, 21 bp, Artificial Sequence
  Description of Artificial Sequence: Synthetic oligonucleotide
ccccagtgggtggtcggcacc

SEQ ID NO: 159721 - DNA, 22 bp, Artificial Sequence
  Description of Artificial Sequence: Synthetic oligonucleotide
cccagtgggtggtcggcaccca

SEQ ID NO: 159722 - DNA, 22 bp, Artificial Sequence
  Description of Artificial Sequence: Synthetic oligonucleotide
ccagtgggtggtcggcacccag

SEQ ID NO: 159723 - DNA, 24 bp, Artificial Sequence
  Description of Artificial Sequence: Synthetic oligonucleotide
cagtgggtggtcggcacccagcaa

SEQ ID NO: 159724 - DNA, 24 bp, Artificial Sequence
  Description of Artificial Sequence: Synthetic oligonucleotide
agtgggtggtcggcacccagcaac

SEQ ID NO: 159725 - DNA, 23 bp, Artificial Sequence
  Description of Artificial Sequence: Synthetic oligonucleotide
gtgggtggtcggcacccagcaac

SEQ ID NO: 159726 - DNA, 23 bp, Artificial Sequence
  Description of Artificial Sequence: Synthetic oligonucleotide
tgggtggtcggcacccagcaacc

SEQ ID NO: 159727 - DNA, 22 bp, Artificial Sequence
  Description of Artificial Sequence: Synthetic oligonucleotide
gggtggtcggcacccagcaacc

SEQ ID NO: 159728 - DNA, 22 bp, Artificial Sequence
  Description of Artificial Sequence: Synthetic oligonucleotide
ggtggtcggcacccagcaaccc

SEQ ID NO: 159729 - DNA, 26 bp, Artificial Sequence
  Description of Artificial Sequence: Synthetic oligonucleotide
acccagcaaccccctggtgatcatgg

SEQ ID NO: 159730 - DNA, 25 bp, Artificial Sequence
  Description of Artificial Sequence: Synthetic oligonucleotide
cccagcaaccccctggtgatcatgg

SEQ ID NO: 159731 - DNA, 25 bp, Artificial Sequence
  Description of Artificial Sequence: Synthetic oligonucleotide
ccagcaaccccctggtgatcatggc

SEQ ID NO: 159732 - DNA, 26 bp, Artificial Sequence
  Description of Artificial Sequence: Synthetic oligonucleotide
cagcaaccccctggtgatcatggcca

SEQ ID NO: 159733 - DNA, 27 bp, Artificial Sequence
  Description of Artificial Sequence: Synthetic oligonucleotide
agcaaccccctggtgatcatggccaca

SEQ ID NO: 159734 - DNA, 26 bp, Artificial Sequence
  Description of Artificial Sequence: Synthetic oligonucleotide
gcaaccccctggtgatcatggccaca

SEQ ID NO: 159735 - DNA, 26 bp, Artificial Sequence
  Description of Artificial Sequence: Synthetic oligonucleotide
caaccccctggtgatcatggccacag

SEQ ID NO: 159736 - DNA, 27 bp, Artificial Sequence
  Description of Artificial Sequence: Synthetic oligonucleotide
aaccccctggtgatcatggccacagga

SEQ ID NO: 159737 - DNA, 26 bp, Artificial Sequence
  Description of Artificial Sequence: Synthetic oligonucleotide
accccctggtgatcatggccacagga

SEQ ID NO: 159738 - DNA, 25 bp, Artificial Sequence
  Description of Artificial Sequence: Synthetic oligonucleotide
ccccctggtgatcatggccacagga

SEQ ID NO: 159739 - DNA, 26 bp, Artificial Sequence
  Description of Artificial Sequence: Synthetic oligonucleotide
cccctggtgatcatggccacaggagt

SEQ ID NO: 159740 - DNA, 26 bp, Artificial Sequence
  Description of Artificial Sequence: Synthetic oligonucleotide
ccctggtgatcatggccacaggagtc

SEQ ID NO: 159741 - DNA, 27 bp, Artificial Sequence
  Description of Artificial Sequence: Synthetic oligonucleotide
cctggtgatcatggccacaggagtcca

SEQ ID NO: 159742 - DNA, 27 bp, Artificial Sequence
  Description of Artificial Sequence: Synthetic oligonucleotide
ctggtgatcatggccacaggagtccac

SEQ ID NO: 159743 - DNA, 28 bp, Artificial Sequence
  Description of Artificial Sequence: Synthetic oligonucleotide
tggtgatcatggccacaggagtccacag

SEQ ID NO: 159744 - DNA, 27 bp, Artificial Sequence
  Description of Artificial Sequence: Synthetic oligonucleotide
ggtgatcatggccacaggagtccacag

SEQ ID NO: 159745 - DNA, 31 bp, Artificial Sequence
  Description of Artificial Sequence: Synthetic oligonucleotide
gtgatcatggccacaggagtccacagaaaac

SEQ ID NO: 159746 - DNA, 31 bp, Artificial Sequence
  Description of Artificial Sequence: Synthetic oligonucleotide
tgatcatggccacaggagtccacagaaaacc

SEQ ID NO: 159747 - DNA, 30 bp, Artificial Sequence
  Description of Artificial Sequence: Synthetic oligonucleotide
gatcatggccacaggagtccacagaaaacc

SEQ ID NO: 159748 - DNA, 32 bp, Artificial Sequence
  Description of Artificial Sequence: Synthetic oligonucleotide
atcatggccacaggagtccacagaaaaccttc

SEQ ID NO: 159749 - DNA, 31 bp, Artificial Sequence
  Description of Artificial Sequence: Synthetic oligonucleotide
tcatggccacaggagtccacagaaaaccttc

SEQ ID NO: 159750 - DNA, 30 bp, Artificial Sequence
  Description of Artificial Sequence: Synthetic oligonucleotide
catggccacaggagtccacagaaaaccttc

SEQ ID NO: 159751 - DNA, 30 bp, Artificial Sequence
  Description of Artificial Sequence: Synthetic oligonucleotide
atggccacaggagtccacagaaaaccttcc

SEQ ID NO: 159752 - DNA, 29 bp, Artificial Sequence
  Description of Artificial Sequence: Synthetic oligonucleotide
tggccacaggagtccacagaaaaccttcc

SEQ ID NO: 159753 - DNA, 28 bp, Artificial Sequence
  Description of Artificial Sequence: Synthetic oligonucleotide
ggccacaggagtccacagaaaaccttcc

SEQ ID NO: 159754 - DNA, 28 bp, Artificial Sequence
  Description of Artificial Sequence: Synthetic oligonucleotide
gccacaggagtccacagaaaaccttccc

SEQ ID NO: 159755 - DNA, 29 bp, Artificial Sequence
  Description of Artificial Sequence: Synthetic oligonucleotide
ccacaggagtccacagaaaaccttccctc

SEQ ID NO: 159756 - DNA, 29 bp, Artificial Sequence
  Description of Artificial Sequence: Synthetic oligonucleotide
cacaggagtccacagaaaaccttccctcc

SEQ ID NO: 159757 - DNA, 30 bp, Artificial Sequence
  Description of Artificial Sequence: Synthetic oligonucleotide
acaggagtccacagaaaaccttccctcctg

SEQ ID NO: 159758 - DNA, 29 bp, Artificial Sequence
  Description of Artificial Sequence: Synthetic oligonucleotide
caggagtccacagaaaaccttccctcctg

SEQ ID NO: 159759 - DNA, 29 bp, Artificial Sequence
  Description of Artificial Sequence: Synthetic oligonucleotide
aggagtccacagaaaaccttccctcctgg

SEQ ID NO: 159760 - DNA, 32 bp, Artificial Sequence
  Description of Artificial Sequence: Synthetic oligonucleotide
tcaggtttgagcacttccttctgcacagagag

SEQ ID NO: 159761 - DNA, 31 bp, Artificial Sequence
  Description of Artificial Sequence: Synthetic oligonucleotide
caggtttgagcacttccttctgcacagagag

SEQ ID NO: 159762 - DNA, 31 bp, Artificial Sequence
  Description of Artificial Sequence: Synthetic oligonucleotide
aggtttgagcacttccttctgcacagagagg

SEQ ID NO: 159763 - DNA, 30 bp, Artificial Sequence
  Description of Artificial Sequence: Synthetic oligonucleotide
ggtttgagcacttccttctgcacagagagg

SEQ ID NO: 159764 - DNA, 30 bp, Artificial Sequence
  Description of Artificial Sequence: Synthetic oligonucleotide
gtttgagcacttccttctgcacagagaggg

SEQ ID NO: 159765 - DNA, 30 bp, Artificial Sequence
  Description of Artificial Sequence: Synthetic oligonucleotide
tttgagcacttccttctgcacagagagggg

SEQ ID NO: 159766 - DNA, 29 bp, Artificial Sequence
  Description of Artificial Sequence: Synthetic oligonucleotide
ttgagcacttccttctgcacagagagggg

SEQ ID NO: 159767 - DNA, 28 bp, Artificial Sequence
  Description of Artificial Sequence: Synthetic oligonucleotide
tgagcacttccttctgcacagagagggg

SEQ ID NO: 159768 - DNA, 27 bp, Artificial Sequence
  Description of Artificial Sequence: Synthetic oligonucleotide
gagcacttccttctgcacagagagggg

SEQ ID NO: 159769 - DNA, 28 bp, Artificial Sequence
  Description of Artificial Sequence: Synthetic oligonucleotide
agcacttccttctgcacagagaggggac

SEQ ID NO: 159770 - DNA, 27 bp, Artificial Sequence
  Description of Artificial Sequence: Synthetic oligonucleotide
gcacttccttctgcacagagaggggac

SEQ ID NO: 159771 - DNA, 33 bp, Artificial Sequence
  Description of Artificial Sequence: Synthetic oligonucleotide
cacttccttctgcacagagaggggacatttaac

SEQ ID NO: 159772 - DNA, 33 bp, Artificial Sequence
  Description of Artificial Sequence: Synthetic oligonucleotide
acttccttctgcacagagaggggacatttaacg

SEQ ID NO: 159773 - DNA, 32 bp, Artificial Sequence
  Description of Artificial Sequence: Synthetic oligonucleotide
cttccttctgcacagagaggggacatttaacg

SEQ ID NO: 159774 - DNA, 33 bp, Artificial Sequence
  Description of Artificial Sequence: Synthetic oligonucleotide
ttccttctgcacagagaggggacatttaacgac

SEQ ID NO: 159775 - DNA, 32 bp, Artificial Sequence
  Description of Artificial Sequence: Synthetic oligonucleotide
tccttctgcacagagaggggacatttaacgac

SEQ ID NO: 159776 - DNA, 31 bp, Artificial Sequence
  Description of Artificial Sequence: Synthetic oligonucleotide
ccttctgcacagagaggggacatttaacgac

SEQ ID NO: 159777 - DNA, 32 bp, Artificial Sequence
  Description of Artificial Sequence: Synthetic oligonucleotide
cttctgcacagagaggggacatttaacgacac

SEQ ID NO: 159778 - DNA, 35 bp, Artificial Sequence
  Description of Artificial Sequence: Synthetic oligonucleotide
ttctgcacagagaggggacatttaacgacactttg

SEQ ID NO: 159779 - DNA, 34 bp, Artificial Sequence
  Description of Artificial Sequence: Synthetic oligonucleotide
tctgcacagagaggggacatttaacgacactttg

SEQ ID NO: 159780 - DNA, 33 bp, Artificial Sequence
  Description of Artificial Sequence: Synthetic oligonucleotide
ctgcacagagaggggacatttaacgacactttg

SEQ ID NO: 159781 - DNA, 33 bp, Artificial Sequence
  Description of Artificial Sequence: Synthetic oligonucleotide
tgcacagagaggggacatttaacgacactttgc

SEQ ID NO: 159782 - DNA, 32 bp, Artificial Sequence
  Description of Artificial Sequence: Synthetic oligonucleotide
gcacagagaggggacatttaacgacactttgc

SEQ ID NO: 159783 - DNA, 33 bp, Artificial Sequence
  Description of Artificial Sequence: Synthetic oligonucleotide
cacagagaggggacatttaacgacactttgcac

SEQ ID NO: 159784 - DNA, 33 bp, Artificial Sequence
  Description of Artificial Sequence: Synthetic oligonucleotide
acagagaggggacatttaacgacactttgcacc

SEQ ID NO: 159785 - DNA, 32 bp, Artificial Sequence
  Description of Artificial Sequence: Synthetic oligonucleotide
cagagaggggacatttaacgacactttgcacc

SEQ ID NO: 159786 - DNA, 33 bp, Artificial Sequence
  Description of Artificial Sequence: Synthetic oligonucleotide
agagaggggacatttaacgacactttgcacctc

SEQ ID NO: 159787 - DNA, 32 bp, Artificial Sequence
  Description of Artificial Sequence: Synthetic oligonucleotide
gagaggggacatttaacgacactttgcacctc

SEQ ID NO: 159788 - DNA, 33 bp, Artificial Sequence
  Description of Artificial Sequence: Synthetic oligonucleotide
agaggggacatttaacgacactttgcacctcac

SEQ ID NO: 159789 - DNA, 32 bp, Artificial Sequence
  Description of Artificial Sequence: Synthetic oligonucleotide
gaggggacatttaacgacactttgcacctcac

SEQ ID NO: 159790 - DNA, 33 bp, Artificial Sequence
  Description of Artificial Sequence: Synthetic oligonucleotide
aggggacatttaacgacactttgcacctcactg

SEQ ID NO: 159791 - DNA, 32 bp, Artificial Sequence
  Description of Artificial Sequence: Synthetic oligonucleotide
ggggacatttaacgacactttgcacctcactg

SEQ ID NO: 159792 - DNA, 32 bp, Artificial Sequence
  Description of Artificial Sequence: Synthetic oligonucleotide
gggacatttaacgacactttgcacctcactgg

SEQ ID NO: 159793 - DNA, 33 bp, Artificial Sequence
  Description of Artificial Sequence: Synthetic oligonucleotide
ggacatttaacgacactttgcacctcactggag

SEQ ID NO: 159794 - DNA, 34 bp, Artificial Sequence
  Description of Artificial Sequence: Synthetic oligonucleotide
gacatttaacgacactttgcacctcactggagag

SEQ ID NO: 159795 - DNA, 34 bp, Artificial Sequence
  Description of Artificial Sequence: Synthetic oligonucleotide
acatttaacgacactttgcacctcactggagagc

SEQ ID NO: 159796 - DNA, 33 bp, Artificial Sequence
  Description of Artificial Sequence: Synthetic oligonucleotide
catttaacgacactttgcacctcactggagagc

SEQ ID NO: 159797 - DNA, 34 bp, Artificial Sequence
  Description of Artificial Sequence: Synthetic oligonucleotide
atttaacgacactttgcacctcactggagagcac

SEQ ID NO: 159798 - DNA, 33 bp, Artificial Sequence
  Description of Artificial Sequence: Synthetic oligonucleotide
tttaacgacactttgcacctcactggagagcac

SEQ ID NO: 159799 - DNA, 32 bp, Artificial Sequence
  Description of Artificial Sequence: Synthetic oligonucleotide
ttaacgacactttgcacctcactggagagcac

SEQ ID NO: 159800 - DNA, 31 bp, Artificial Sequence
  Description of Artificial Sequence: Synthetic oligonucleotide
taacgacactttgcacctcactggagagcac

SEQ ID NO: 159801 - DNA, 30 bp, Artificial Sequence
  Description of Artificial Sequence: Synthetic oligonucleotide
aacgacactttgcacctcactggagagcac

SEQ ID NO: 159802 - DNA, 29 bp, Artificial Sequence
  Description of Artificial Sequence: Synthetic oligonucleotide
acgacactttgcacctcactggagagcac

SEQ ID NO: 159803 - DNA, 28 bp, Artificial Sequence
  Description of Artificial Sequence: Synthetic oligonucleotide
cgacactttgcacctcactggagagcac

SEQ ID NO: 159804 - DNA, 28 bp, Artificial Sequence
  Description of Artificial Sequence: Synthetic oligonucleotide
gacactttgcacctcactggagagcacc

SEQ ID NO: 159805 - DNA, 30 bp, Artificial Sequence
  Description of Artificial Sequence: Synthetic oligonucleotide
acactttgcacctcactggagagcaccatg

SEQ ID NO: 159806 - DNA, 29 bp, Artificial Sequence
  Description of Artificial Sequence: Synthetic oligonucleotide
cactttgcacctcactggagagcaccatg

SEQ ID NO: 159807 - DNA, 31 bp, Artificial Sequence
  Description of Artificial Sequence: Synthetic oligonucleotide
actttgcacctcactggagagcaccatgatg

SEQ ID NO: 159808 - DNA, 30 bp, Artificial Sequence
  Description of Artificial Sequence: Synthetic oligonucleotide
ctttgcacctcactggagagcaccatgatg

SEQ ID NO: 159809 - DNA, 30 bp, Artificial Sequence
  Description of Artificial Sequence: Synthetic oligonucleotide
tttgcacctcactggagagcaccatgatgg

SEQ ID NO: 159810 - DNA, 29 bp, Artificial Sequence
  Description of Artificial Sequence: Synthetic oligonucleotide
ttgcacctcactggagagcaccatgatgg

SEQ ID NO: 159811 - DNA, 28 bp, Artificial Sequence
  Description of Artificial Sequence: Synthetic oligonucleotide
tgcacctcactggagagcaccatgatgg

SEQ ID NO: 159812 - DNA, 27 bp, Artificial Sequence
  Description of Artificial Sequence: Synthetic oligonucleotide
gcacctcactggagagcaccatgatgg

SEQ ID NO: 159813 - DNA, 27 bp, Artificial Sequence
  Description of Artificial Sequence: Synthetic oligonucleotide
cacctcactggagagcaccatgatggg

SEQ ID NO: 159814 - DNA, 27 bp, Artificial Sequence
  Description of Artificial Sequence: Synthetic oligonucleotide
acctcactggagagcaccatgatgggg

SEQ ID NO: 159815 - DNA, 27 bp, Artificial Sequence
  Description of Artificial Sequence: Synthetic oligonucleotide
cctcactggagagcaccatgatggggt

SEQ ID NO: 159816 - DNA, 27 bp, Artificial Sequence
  Description of Artificial Sequence: Synthetic oligonucleotide
ctcactggagagcaccatgatggggtc

SEQ ID NO: 159817 - DNA, 28 bp, Artificial Sequence
  Description of Artificial Sequence: Synthetic oligonucleotide
tcactggagagcaccatgatggggtctc

SEQ ID NO: 159818 - DNA, 27 bp, Artificial Sequence
  Description of Artificial Sequence: Synthetic oligonucleotide
cactggagagcaccatgatggggtctc

SEQ ID NO: 159819 - DNA, 27 bp, Artificial Sequence
  Description of Artificial Sequence: Synthetic oligonucleotide
actggagagcaccatgatggggtctcc

SEQ ID NO: 159820 - DNA, 27 bp, Artificial Sequence
  Description of Artificial Sequence: Synthetic oligonucleotide
ctggagagcaccatgatggggtctcca

SEQ ID NO: 159821 - DNA, 28 bp, Artificial Sequence
  Description of Artificial Sequence: Synthetic oligonucleotide
gccaacttctccatcggtcccatgatgg

SEQ ID NO: 159822 - DNA, 30 bp, Artificial Sequence
  Description of Artificial Sequence: Synthetic oligonucleotide
ccaacttctccatcggtcccatgatggaag

SEQ ID NO: 159823 - DNA, 31 bp, Artificial Sequence
  Description of Artificial Sequence: Synthetic oligonucleotide
caacttctccatcggtcccatgatggaagac

SEQ ID NO: 159824 - DNA, 31 bp, Artificial Sequence
  Description of Artificial Sequence: Synthetic oligonucleotide
aacttctccatcggtcccatgatggaagacc

SEQ ID NO: 159825 - DNA, 30 bp, Artificial Sequence
  Description of Artificial Sequence: Synthetic oligonucleotide
acttctccatcggtcccatgatggaagacc

SEQ ID NO: 159826 - DNA, 29 bp, Artificial Sequence
  Description of Artificial Sequence: Synthetic oligonucleotide
cttctccatcggtcccatgatggaagacc

SEQ ID NO: 159827 - DNA, 30 bp, Artificial Sequence
  Description of Artificial Sequence: Synthetic oligonucleotide
ttctccatcggtcccatgatggaagacctg

SEQ ID NO: 159828 - DNA, 29 bp, Artificial Sequence
  Description of Artificial Sequence: Synthetic oligonucleotide
tctccatcggtcccatgatggaagacctg

SEQ ID NO: 159829 - DNA, 28 bp, Artificial Sequence
  Description of Artificial Sequence: Synthetic oligonucleotide
ctccatcggtcccatgatggaagacctg

SEQ ID NO: 159830 - DNA, 28 bp, Artificial Sequence
  Description of Artificial Sequence: Synthetic oligonucleotide
tccatcggtcccatgatggaagacctgg

SEQ ID NO: 159831 - DNA, 27 bp, Artificial Sequence
  Description of Artificial Sequence: Synthetic oligonucleotide
ccatcggtcccatgatggaagacctgg

SEQ ID NO: 159832 - DNA, 27 bp, Artificial Sequence
  Description of Artificial Sequence: Synthetic oligonucleotide
catcggtcccatgatggaagacctggc

SEQ ID NO: 159833 - DNA, 28 bp, Artificial Sequence
  Description of Artificial Sequence: Synthetic oligonucleotide
atcggtcccatgatggaagacctggcag

SEQ ID NO: 159834 - DNA, 27 bp, Artificial Sequence
  Description of Artificial Sequence: Synthetic oligonucleotide
tcggtcccatgatggaagacctggcag

SEQ ID NO: 159835 - DNA, 26 bp, Artificial Sequence
  Description of Artificial Sequence: Synthetic oligonucleotide
cggtcccatgatggaagacctggcag

SEQ ID NO: 159836 - DNA, 26 bp, Artificial Sequence
  Description of Artificial Sequence: Synthetic oligonucleotide
ggtcccatgatggaagacctggcagg

SEQ ID NO: 159837 - DNA, 27 bp, Artificial Sequence
  Description of Artificial Sequence: Synthetic oligonucleotide
gtcccatgatggaagacctggcaggga

SEQ ID NO: 159838 - DNA, 27 bp, Artificial Sequence
  Description of Artificial Sequence: Synthetic oligonucleotide
tcccatgatggaagacctggcagggac

SEQ ID NO: 159839 - DNA, 26 bp, Artificial Sequence
  Description of Artificial Sequence: Synthetic oligonucleotide
cccatgatggaagacctggcagggac

SEQ ID NO: 159840 - DNA, 27 bp, Artificial Sequence
  Description of Artificial Sequence: Synthetic oligonucleotide
ccatgatggaagacctggcagggacct

SEQ ID NO: 159841 - DNA, 28 bp, Artificial Sequence
  Description of Artificial Sequence: Synthetic oligonucleotide
catgatggaagacctggcagggacctac

SEQ ID NO: 159842 - DNA, 29 bp, Artificial Sequence
  Description of Artificial Sequence: Synthetic oligonucleotide
atgatggaagacctggcagggacctacag

SEQ ID NO: 159843 - DNA, 28 bp, Artificial Sequence
  Description of Artificial Sequence: Synthetic oligonucleotide
tgatggaagacctggcagggacctacag

SEQ ID NO: 159844 - DNA, 27 bp, Artificial Sequence
  Description of Artificial Sequence: Synthetic oligonucleotide
gatggaagacctggcagggacctacag

SEQ ID NO: 159845 - DNA, 29 bp, Artificial Sequence
  Description of Artificial Sequence: Synthetic oligonucleotide
atggaagacctggcagggacctacagatg

SEQ ID NO: 159846 - DNA, 28 bp, Artificial Sequence
  Description of Artificial Sequence: Synthetic oligonucleotide
tggaagacctggcagggacctacagatg

SEQ ID NO: 159847 - DNA, 27 bp, Artificial Sequence
  Description of Artificial Sequence: Synthetic oligonucleotide
ggaagacctggcagggacctacagatg

SEQ ID NO: 159848 - DNA, 27 bp, Artificial Sequence
  Description of Artificial Sequence: Synthetic oligonucleotide
gaagacctggcagggacctacagatgc

SEQ ID NO: 159849 - DNA, 31 bp, Artificial Sequence
  Description of Artificial Sequence: Synthetic oligonucleotide
atgctacggttctgttactcactcccccatc

SEQ ID NO: 159850 - DNA, 30 bp, Artificial Sequence
  Description of Artificial Sequence: Synthetic oligonucleotide
tgctacggttctgttactcactcccccatc

SEQ ID NO: 159851 - DNA, 29 bp, Artificial Sequence
  Description of Artificial Sequence: Synthetic oligonucleotide
gctacggttctgttactcactcccccatc

SEQ ID NO: 159852 - DNA, 30 bp, Artificial Sequence
  Description of Artificial Sequence: Synthetic oligonucleotide
ctacggttctgttactcactcccccatcag

SEQ ID NO: 159853 - DNA, 32 bp, Artificial Sequence
  Description of Artificial Sequence: Synthetic oligonucleotide
tacggttctgttactcactcccccatcagttg

SEQ ID NO: 159854 - DNA, 31 bp, Artificial Sequence
  Description of Artificial Sequence: Synthetic oligonucleotide
acggttctgttactcactcccccatcagttg

SEQ ID NO: 159855 - DNA, 30 bp, Artificial Sequence
  Description of Artificial Sequence: Synthetic oligonucleotide
cggttctgttactcactcccccatcagttg

SEQ ID NO: 159856 - DNA, 31 bp, Artificial Sequence
  Description of Artificial Sequence: Synthetic oligonucleotide
ggttctgttactcactcccccatcagttgtc

SEQ ID NO: 159857 - DNA, 32 bp, Artificial Sequence
  Description of Artificial Sequence: Synthetic oligonucleotide
gttctgttactcactcccccatcagttgtcag

SEQ ID NO: 159858 - DNA, 32 bp, Artificial Sequence
  Description of Artificial Sequence: Synthetic oligonucleotide
ttctgttactcactcccccatcagttgtcagc

SEQ ID NO: 159859 - DNA, 31 bp, Artificial Sequence
  Description of Artificial Sequence: Synthetic oligonucleotide
tctgttactcactcccccatcagttgtcagc

SEQ ID NO: 159860 - DNA, 30 bp, Artificial Sequence
  Description of Artificial Sequence: Synthetic oligonucleotide
ctgttactcactcccccatcagttgtcagc

SEQ ID NO: 159861 - DNA, 31 bp, Artificial Sequence
  Description of Artificial Sequence: Synthetic oligonucleotide
tgttactcactcccccatcagttgtcagctc

SEQ ID NO: 159862 - DNA, 30 bp, Artificial Sequence
  Description of Artificial Sequence: Synthetic oligonucleotide
gttactcactcccccatcagttgtcagctc

SEQ ID NO: 159863 - DNA, 30 bp, Artificial Sequence
  Description of Artificial Sequence: Synthetic oligonucleotide
ttactcactcccccatcagttgtcagctcc

SEQ ID NO: 159864 - DNA, 29 bp, Artificial Sequence
  Description of Artificial Sequence: Synthetic oligonucleotide
tactcactcccccatcagttgtcagctcc

SEQ ID NO: 159865 - DNA, 28 bp, Artificial Sequence
  Description of Artificial Sequence: Synthetic oligonucleotide
actcactcccccatcagttgtcagctcc

SEQ ID NO: 159866 - DNA, 27 bp, Artificial Sequence
  Description of Artificial Sequence: Synthetic oligonucleotide
ctcactcccccatcagttgtcagctcc

SEQ ID NO: 159867 - DNA, 27 bp, Artificial Sequence
  Description of Artificial Sequence: Synthetic oligonucleotide
tcactcccccatcagttgtcagctccc

SEQ ID NO: 159868 - DNA, 27 bp, Artificial Sequence
  Description of Artificial Sequence: Synthetic oligonucleotide
cactcccccatcagttgtcagctccca

SEQ ID NO: 159869 - DNA, 27 bp, Artificial Sequence
  Description of Artificial Sequence: Synthetic oligonucleotide
actcccccatcagttgtcagctcccag

SEQ ID NO: 159870 - DNA, 27 bp, Artificial Sequence
  Description of Artificial Sequence: Synthetic oligonucleotide
ctcccccatcagttgtcagctcccagt

SEQ ID NO: 159871 - DNA, 27 bp, Artificial Sequence
  Description of Artificial Sequence: Synthetic oligonucleotide
tcccccatcagttgtcagctcccagtg

SEQ ID NO: 159872 - DNA, 27 bp, Artificial Sequence
  Description of Artificial Sequence: Synthetic oligonucleotide
cccccatcagttgtcagctcccagtga

SEQ ID NO: 159873 - DNA, 27 bp, Artificial Sequence
  Description of Artificial Sequence: Synthetic oligonucleotide
ccccatcagttgtcagctcccagtgac

SEQ ID NO: 159874 - DNA, 27 bp, Artificial Sequence
  Description of Artificial Sequence: Synthetic oligonucleotide
cccatcagttgtcagctcccagtgacc

SEQ ID NO: 159875 - DNA, 27 bp, Artificial Sequence
  Description of Artificial Sequence: Synthetic oligonucleotide
ccatcagttgtcagctcccagtgaccc

SEQ ID NO: 159876 - DNA, 28 bp, Artificial Sequence
  Description of Artificial Sequence: Synthetic oligonucleotide
catcagttgtcagctcccagtgaccctc

SEQ ID NO: 159877 - DNA, 32 bp, Artificial Sequence
  Description of Artificial Sequence: Synthetic oligonucleotide
cggagctcctatgacatgtaccatctatccac

SEQ ID NO: 159878 - DNA, 32 bp, Artificial Sequence
  Description of Artificial Sequence: Synthetic oligonucleotide
ggagctcctatgacatgtaccatctatccacg

SEQ ID NO: 159879 - DNA, 32 bp, Artificial Sequence
  Description of Artificial Sequence: Synthetic oligonucleotide
gagctcctatgacatgtaccatctatccacgg

SEQ ID NO: 159880 - DNA, 33 bp, Artificial Sequence
  Description of Artificial Sequence: Synthetic oligonucleotide
agctcctatgacatgtaccatctatccacggag

SEQ ID NO: 159881 - DNA, 32 bp, Artificial Sequence
  Description of Artificial Sequence: Synthetic oligonucleotide
gctcctatgacatgtaccatctatccacggag

SEQ ID NO: 159882 - DNA, 32 bp, Artificial Sequence
  Description of Artificial Sequence: Synthetic oligonucleotide
ctcctatgacatgtaccatctatccacggagg

SEQ ID NO: 159883 - DNA, 32 bp, Artificial Sequence
  Description of Artificial Sequence: Synthetic oligonucleotide
tcctatgacatgtaccatctatccacggaggg

SEQ ID NO: 159884 - DNA, 31 bp, Artificial Sequence
  Description of Artificial Sequence: Synthetic oligonucleotide
cctatgacatgtaccatctatccacggaggg

SEQ ID NO: 159885 - DNA, 31 bp, Artificial Sequence
  Description of Artificial Sequence: Synthetic oligonucleotide
ctatgacatgtaccatctatccacggagggg

SEQ ID NO: 159886 - DNA, 31 bp, Artificial Sequence
  Description of Artificial Sequence: Synthetic oligonucleotide
tatgacatgtaccatctatccacggaggggg

SEQ ID NO: 159887 - DNA, 30 bp, Artificial Sequence
  Description of Artificial Sequence: Synthetic oligonucleotide
atgacatgtaccatctatccacggaggggg

SEQ ID NO: 159888 - DNA, 29 bp, Artificial Sequence
  Description of Artificial Sequence: Synthetic oligonucleotide
tgacatgtaccatctatccacggaggggg

SEQ ID NO: 159889 - DNA, 28 bp, Artificial Sequence
  Description of Artificial Sequence: Synthetic oligonucleotide
gacatgtaccatctatccacggaggggg

SEQ ID NO: 159890 - DNA, 29 bp, Artificial Sequence
  Description of Artificial Sequence: Synthetic oligonucleotide
acatgtaccatctatccacggagggggag

SEQ ID NO: 159891 - DNA, 28 bp, Artificial Sequence
  Description of Artificial Sequence: Synthetic oligonucleotide
catgtaccatctatccacggagggggag

SEQ ID NO: 159892 - DNA, 28 bp, Artificial Sequence
  Description of Artificial Sequence: Synthetic oligonucleotide
atgtaccatctatccacggagggggagg

SEQ ID NO: 159893 - DNA, 27 bp, Artificial Sequence
  Description of Artificial Sequence: Synthetic oligonucleotide
tgtaccatctatccacggagggggagg

SEQ ID NO: 159894 - DNA, 26 bp, Artificial Sequence
  Description of Artificial Sequence: Synthetic oligonucleotide
gtaccatctatccacggagggggagg

SEQ ID NO: 159895 - DNA, 26 bp, Artificial Sequence
  Description of Artificial Sequence: Synthetic oligonucleotide
taccatctatccacggagggggaggc

SEQ ID NO: 159896 - DNA, 25 bp, Artificial Sequence
  Description of Artificial Sequence: Synthetic oligonucleotide
accatctatccacggagggggaggc

SEQ ID NO: 159897 - DNA, 24 bp, Artificial Sequence
  Description of Artificial Sequence: Synthetic oligonucleotide
ccatctatccacggagggggaggc

SEQ ID NO: 159898 - DNA, 24 bp, Artificial Sequence
  Description of Artificial Sequence: Synthetic oligonucleotide
catctatccacggagggggaggcc

SEQ ID NO: 159899 - DNA, 26 bp, Artificial Sequence
  Description of Artificial Sequence: Synthetic oligonucleotide
atctatccacggagggggaggcccat

SEQ ID NO: 159900 - DNA, 25 bp, Artificial Sequence
  Description of Artificial Sequence: Synthetic oligonucleotide
tctatccacggagggggaggcccat

SEQ ID NO: 159901 - DNA, 24 bp, Artificial Sequence
  Description of Artificial Sequence: Synthetic oligonucleotide
ctatccacggagggggaggcccat

SEQ ID NO: 159902 - DNA, 26 bp, Artificial Sequence
  Description of Artificial Sequence: Synthetic oligonucleotide
tatccacggagggggaggcccatgaa

SEQ ID NO: 159903 - DNA, 25 bp, Artificial Sequence
  Description of Artificial Sequence: Synthetic oligonucleotide
atccacggagggggaggcccatgaa

SEQ ID NO: 159904 - DNA, 24 bp, Artificial Sequence
  Description of Artificial Sequence: Synthetic oligonucleotide
tccacggagggggaggcccatgaa

SEQ ID NO: 159905 - DNA, 23 bp, Artificial Sequence
  Description of Artificial Sequence: Synthetic oligonucleotide
ccacggagggggaggcccatgaa

SEQ ID NO: 159906 - DNA, 23 bp, Artificial Sequence
  Description of Artificial Sequence: Synthetic oligonucleotide
cacggagggggaggcccatgaac

SEQ ID NO: 159907 - DNA, 25 bp, Artificial Sequence
  Description of Artificial Sequence: Synthetic oligonucleotide
acggagggggaggcccatgaacgta

SEQ ID NO: 159908 - DNA, 24 bp, Artificial Sequence
  Description of Artificial Sequence: Synthetic oligonucleotide
cggagggggaggcccatgaacgta

SEQ ID NO: 159909 - DNA, 28 bp, Artificial Sequence
  Description of Artificial Sequence: Synthetic oligonucleotide
cccatgaacgtaggttctctgcagggac

SEQ ID NO: 159910 - DNA, 28 bp, Artificial Sequence
  Description of Artificial Sequence: Synthetic oligonucleotide
ccatgaacgtaggttctctgcagggacc

SEQ ID NO: 159911 - DNA, 30 bp, Artificial Sequence
  Description of Artificial Sequence: Synthetic oligonucleotide
catgaacgtaggttctctgcagggaccaag

SEQ ID NO: 159912 - DNA, 30 bp, Artificial Sequence
  Description of Artificial Sequence: Synthetic oligonucleotide
atgaacgtaggttctctgcagggaccaagg

SEQ ID NO: 159913 - DNA, 29 bp, Artificial Sequence
  Description of Artificial Sequence: Synthetic oligonucleotide
tgaacgtaggttctctgcagggaccaagg

SEQ ID NO: 159914 - DNA, 28 bp, Artificial Sequence
  Description of Artificial Sequence: Synthetic oligonucleotide
gaacgtaggttctctgcagggaccaagg

SEQ ID NO: 159915 - DNA, 29 bp, Artificial Sequence
  Description of Artificial Sequence: Synthetic oligonucleotide
aacgtaggttctctgcagggaccaaggtc

SEQ ID NO: 159916 - DNA, 28 bp, Artificial Sequence
  Description of Artificial Sequence: Synthetic oligonucleotide
acgtaggttctctgcagggaccaaggtc

SEQ ID NO: 159917 - DNA, 27 bp, Artificial Sequence
  Description of Artificial Sequence: Synthetic oligonucleotide
cgtaggttctctgcagggaccaaggtc

SEQ ID NO: 159918 - DNA, 29 bp, Artificial Sequence
  Description of Artificial Sequence: Synthetic oligonucleotide
gtaggttctctgcagggaccaaggtcaac

SEQ ID NO: 159919 - DNA, 29 bp, Artificial Sequence
  Description of Artificial Sequence: Synthetic oligonucleotide
taggttctctgcagggaccaaggtcaacg

SEQ ID NO: 159920 - DNA, 28 bp, Artificial Sequence
  Description of Artificial Sequence: Synthetic oligonucleotide
aggttctctgcagggaccaaggtcaacg

SEQ ID NO: 159921 - DNA, 27 bp, Artificial Sequence
  Description of Artificial Sequence: Synthetic oligonucleotide
ggttctctgcagggaccaaggtcaacg

SEQ ID NO: 159922 - DNA, 27 bp, Artificial Sequence
  Description of Artificial Sequence: Synthetic oligonucleotide
gttctctgcagggaccaaggtcaacgg

SEQ ID NO: 159923 - DNA, 29 bp, Artificial Sequence
  Description of Artificial Sequence: Synthetic oligonucleotide
ttctctgcagggaccaaggtcaacggaac

SEQ ID NO: 159924 - DNA, 28 bp, Artificial Sequence
  Description of Artificial Sequence: Synthetic oligonucleotide
tctctgcagggaccaaggtcaacggaac

SEQ ID NO: 159925 - DNA, 27 bp, Artificial Sequence
  Description of Artificial Sequence: Synthetic oligonucleotide
ctctgcagggaccaaggtcaacggaac

SEQ ID NO: 159926 - DNA, 30 bp, Artificial Sequence
  Description of Artificial Sequence: Synthetic oligonucleotide
tctgcagggaccaaggtcaacggaacattc

SEQ ID NO: 159927 - DNA, 29 bp, Artificial Sequence
  Description of Artificial Sequence: Synthetic oligonucleotide
gaccaaggtcaacggaacattccaggctg

SEQ ID NO: 159928 - DNA, 30 bp, Artificial Sequence
  Description of Artificial Sequence: Synthetic oligonucleotide
accaaggtcaacggaacattccaggctgac

SEQ ID NO: 159929 - DNA, 26 bp, Artificial Sequence
  Description of Artificial Sequence: Synthetic oligonucleotide
atgtcgctcacggtcgtcagcatggc

SEQ ID NO: 159930 - DNA, 25 bp, Artificial Sequence
  Description of Artificial Sequence: Synthetic oligonucleotide
tgtcgctcacggtcgtcagcatggc

SEQ ID NO: 159931 - DNA, 24 bp, Artificial Sequence
  Description of Artificial Sequence: Synthetic oligonucleotide
gtcgctcacggtcgtcagcatggc

SEQ ID NO: 159932 - DNA, 25 bp, Artificial Sequence
  Description of Artificial Sequence: Synthetic oligonucleotide
tcgctcacggtcgtcagcatggcgt

SEQ ID NO: 159933 - DNA, 24 bp, Artificial Sequence
  Description of Artificial Sequence: Synthetic oligonucleotide
cgctcacggtcgtcagcatggcgt

SEQ ID NO: 159934 - DNA, 25 bp, Artificial Sequence
  Description of Artificial Sequence: Synthetic oligonucleotide
gctcacggtcgtcagcatggcgtgt

SEQ ID NO: 159935 - DNA, 27 bp, Artificial Sequence
  Description of Artificial Sequence: Synthetic oligonucleotide
ctcacggtcgtcagcatggcgtgtgtt

SEQ ID NO: 159936 - DNA, 27 bp, Artificial Sequence
  Description of Artificial Sequence: Synthetic oligonucleotide
tcacggtcgtcagcatggcgtgtgttg

SEQ ID NO: 159937 - DNA, 26 bp, Artificial Sequence
  Description of Artificial Sequence: Synthetic oligonucleotide
cacggtcgtcagcatggcgtgtgttg

SEQ ID NO: 159938 - DNA, 26 bp, Artificial Sequence
  Description of Artificial Sequence: Synthetic oligonucleotide
acggtcgtcagcatggcgtgtgttgg

SEQ ID NO: 159939 - DNA, 25 bp, Artificial Sequence
  Description of Artificial Sequence: Synthetic oligonucleotide
cggtcgtcagcatggcgtgtgttgg

SEQ ID NO: 159940 - DNA, 28 bp, Artificial Sequence
  Description of Artificial Sequence: Synthetic oligonucleotide
atgcttcggctctttccgtgactctccc

SEQ ID NO: 159941 - DNA, 27 bp, Artificial Sequence
  Description of Artificial Sequence: Synthetic oligonucleotide
tgcttcggctctttccgtgactctccc

SEQ ID NO: 159942 - DNA, 27 bp, Artificial Sequence
  Description of Artificial Sequence: Synthetic oligonucleotide
gcttcggctctttccgtgactctccct

SEQ ID NO: 159943 - DNA, 28 bp, Artificial Sequence
  Description of Artificial Sequence: Synthetic oligonucleotide
cttcggctctttccgtgactctccctac

SEQ ID NO: 159944 - DNA, 28 bp, Artificial Sequence
  Description of Artificial Sequence: Synthetic oligonucleotide
ttcggctctttccgtgactctccctacg

SEQ ID NO: 159945 - DNA, 27 bp, Artificial Sequence
  Description of Artificial Sequence: Synthetic oligonucleotide
tcggctctttccgtgactctccctacg

SEQ ID NO: 159946 - DNA, 27 bp, Artificial Sequence
  Description of Artificial Sequence: Synthetic oligonucleotide
cggctctttccgtgactctccctacga

SEQ ID NO: 159947 - DNA, 27 bp, Artificial Sequence
  Description of Artificial Sequence: Synthetic oligonucleotide
ggctctttccgtgactctccctacgag

SEQ ID NO: 159948 - DNA, 28 bp, Artificial Sequence
  Description of Artificial Sequence: Synthetic oligonucleotide
gctctttccgtgactctccctacgagtg

SEQ ID NO: 159949 - DNA, 28 bp, Artificial Sequence
  Description of Artificial Sequence: Synthetic oligonucleotide
ctctttccgtgactctccctacgagtgg

SEQ ID NO: 159950 - DNA, 29 bp, Artificial Sequence
  Description of Artificial Sequence: Synthetic oligonucleotide
tctttccgtgactctccctacgagtggtc

SEQ ID NO: 159951 - DNA, 28 bp, Artificial Sequence
  Description of Artificial Sequence: Synthetic oligonucleotide
ctttccgtgactctccctacgagtggtc

SEQ ID NO: 159952 - DNA, 31 bp, Artificial Sequence
  Description of Artificial Sequence: Synthetic oligonucleotide
tttccgtgactctccctacgagtggtcaaac

SEQ ID NO: 159953 - DNA, 30 bp, Artificial Sequence
  Description of Artificial Sequence: Synthetic oligonucleotide
ttccgtgactctccctacgagtggtcaaac

SEQ ID NO: 159954 - DNA, 29 bp, Artificial Sequence
  Description of Artificial Sequence: Synthetic oligonucleotide
tccgtgactctccctacgagtggtcaaac

SEQ ID NO: 159955 - DNA, 28 bp, Artificial Sequence
  Description of Artificial Sequence: Synthetic oligonucleotide
ccgtgactctccctacgagtggtcaaac

SEQ ID NO: 159956 - DNA, 29 bp, Artificial Sequence
  Description of Artificial Sequence: Synthetic oligonucleotide
cgtgactctccctacgagtggtcaaactc

SEQ ID NO: 159957 - DNA, 29 bp, Artificial Sequence
  Description of Artificial Sequence: Synthetic oligonucleotide
gtgactctccctacgagtggtcaaactcg

SEQ ID NO: 159958 - DNA, 30 bp, Artificial Sequence
  Description of Artificial Sequence: Synthetic oligonucleotide
tgactctccctacgagtggtcaaactcgag

SEQ ID NO: 159959 - DNA, 29 bp, Artificial Sequence
  Description of Artificial Sequence: Synthetic oligonucleotide
gactctccctacgagtggtcaaactcgag

SEQ ID NO: 159960 - DNA, 30 bp, Artificial Sequence
  Description of Artificial Sequence: Synthetic oligonucleotide
actctccctacgagtggtcaaactcgagtg

SEQ ID NO: 159961 - DNA, 29 bp, Artificial Sequence
  Description of Artificial Sequence: Synthetic oligonucleotide
ctctccctacgagtggtcaaactcgagtg

SEQ ID NO: 159962 - DNA, 30 bp, Artificial Sequence
  Description of Artificial Sequence: Synthetic oligonucleotide
tctccctacgagtggtcaaactcgagtgac

SEQ ID NO: 159963 - DNA, 29 bp, Artificial Sequence
  Description of Artificial Sequence: Synthetic oligonucleotide
ctccctacgagtggtcaaactcgagtgac

SEQ ID NO: 159964 - DNA, 29 bp, Artificial Sequence
  Description of Artificial Sequence: Synthetic oligonucleotide
tccctacgagtggtcaaactcgagtgacc

SEQ ID NO: 159965 - DNA, 28 bp, Artificial Sequence
  Description of Artificial Sequence: Synthetic oligonucleotide
ccctacgagtggtcaaactcgagtgacc

SEQ ID NO: 159966 - DNA, 28 bp, Artificial Sequence
  Description of Artificial Sequence: Synthetic oligonucleotide
cctacgagtggtcaaactcgagtgaccc

SEQ ID NO: 159967 - DNA, 29 bp, Artificial Sequence
  Description of Artificial Sequence: Synthetic oligonucleotide
ctacgagtggtcaaactcgagtgacccac

SEQ ID NO: 159968 - DNA, 30 bp, Artificial Sequence
  Description of Artificial Sequence: Synthetic oligonucleotide
tgaaccaagctccgaaaccggtaacccaag

SEQ ID NO: 159969 - DNA, 29 bp, Artificial Sequence
  Description of Artificial Sequence: Synthetic oligonucleotide
gaaccaagctccgaaaccggtaacccaag

SEQ ID NO: 159970 - DNA, 30 bp, Artificial Sequence
  Description of Artificial Sequence: Synthetic oligonucleotide
aaccaagctccgaaaccggtaacccaagac

SEQ ID NO: 159971 - DNA, 29 bp, Artificial Sequence
  Description of Artificial Sequence: Synthetic oligonucleotide
accaagctccgaaaccggtaacccaagac

SEQ ID NO: 159972 - DNA, 28 bp, Artificial Sequence
  Description of Artificial Sequence: Synthetic oligonucleotide
ccaagctccgaaaccggtaacccaagac

SEQ ID NO: 159973 - DNA, 29 bp, Artificial Sequence
  Description of Artificial Sequence: Synthetic oligonucleotide
caagctccgaaaccggtaacccaagacac

SEQ ID NO: 159974 - DNA, 29 bp, Artificial Sequence
  Description of Artificial Sequence: Synthetic oligonucleotide
aagctccgaaaccggtaacccaagacacc

SEQ ID NO: 159975 - DNA, 28 bp, Artificial Sequence
  Description of Artificial Sequence: Synthetic oligonucleotide
agctccgaaaccggtaacccaagacacc

SEQ ID NO: 159976 - DNA, 27 bp, Artificial Sequence
  Description of Artificial Sequence: Synthetic oligonucleotide
gctccgaaaccggtaacccaagacacc

SEQ ID NO: 159977 - DNA, 28 bp, Artificial Sequence
  Description of Artificial Sequence: Synthetic oligonucleotide
ctccgaaaccggtaacccaagacacctg

SEQ ID NO: 159978 - DNA, 28 bp, Artificial Sequence
  Description of Artificial Sequence: Synthetic oligonucleotide
tccgaaaccggtaacccaagacacctgc

SEQ ID NO: 159979 - DNA, 27 bp, Artificial Sequence
  Description of Artificial Sequence: Synthetic oligonucleotide
ccgaaaccggtaacccaagacacctgc

SEQ ID NO: 159980 - DNA, 28 bp, Artificial Sequence
  Description of Artificial Sequence: Synthetic oligonucleotide
cgaaaccggtaacccaagacacctgcac

SEQ ID NO: 159981 - DNA, 28 bp, Artificial Sequence
  Description of Artificial Sequence: Synthetic oligonucleotide
gaaaccggtaacccaagacacctgcacg

SEQ ID NO: 159982 - DNA, 30 bp, Artificial Sequence
  Description of Artificial Sequence: Synthetic oligonucleotide
aaaccggtaacccaagacacctgcacgttc

SEQ ID NO: 159983 - DNA, 29 bp, Artificial Sequence
  Description of Artificial Sequence: Synthetic oligonucleotide
aaccggtaacccaagacacctgcacgttc

SEQ ID NO: 159984 - DNA, 28 bp, Artificial Sequence
  Description of Artificial Sequence: Synthetic oligonucleotide
accggtaacccaagacacctgcacgttc

SEQ ID NO: 159985 - DNA, 27 bp, Artificial Sequence
  Description of Artificial Sequence: Synthetic oligonucleotide
ccggtaacccaagacacctgcacgttc

SEQ ID NO: 159986 - DNA, 28 bp, Artificial Sequence
  Description of Artificial Sequence: Synthetic oligonucleotide
cggtaacccaagacacctgcacgttctg

SEQ ID NO: 159987 - DNA, 31 bp, Artificial Sequence
  Description of Artificial Sequence: Synthetic oligonucleotide
ggtaacccaagacacctgcacgttctgattg

SEQ ID NO: 159988 - DNA, 31 bp, Artificial Sequence
  Description of Artificial Sequence: Synthetic oligonucleotide
gtaacccaagacacctgcacgttctgattgg

SEQ ID NO: 159989 - DNA, 31 bp, Artificial Sequence
  Description of Artificial Sequence: Synthetic oligonucleotide
taacccaagacacctgcacgttctgattggg

SEQ ID NO: 159990 - DNA, 30 bp, Artificial Sequence
  Description of Artificial Sequence: Synthetic oligonucleotide
aacccaagacacctgcacgttctgattggg

SEQ ID NO: 159991 - DNA, 29 bp, Artificial Sequence
  Description of Artificial Sequence: Synthetic oligonucleotide
acccaagacacctgcacgttctgattggg

SEQ ID NO: 159992 - DNA, 28 bp, Artificial Sequence
  Description of Artificial Sequence: Synthetic oligonucleotide
cccaagacacctgcacgttctgattggg

SEQ ID NO: 159993 - DNA, 29 bp, Artificial Sequence
  Description of Artificial Sequence: Synthetic oligonucleotide
ccaagacacctgcacgttctgattgggac

SEQ ID NO: 159994 - DNA, 29 bp, Artificial Sequence
  Description of Artificial Sequence: Synthetic oligonucleotide
caagacacctgcacgttctgattgggacc

SEQ ID NO: 159995 - DNA, 30 bp, Artificial Sequence
  Description of Artificial Sequence: Synthetic oligonucleotide
aagacacctgcacgttctgattgggacctc

SEQ ID NO: 159996 - DNA, 33 bp, Artificial Sequence
  Description of Artificial Sequence: Synthetic oligonucleotide
atcgctggtgctccaacaagaaaaatgctgctg

SEQ ID NO: 159997 - DNA, 32 bp, Artificial Sequence
  Description of Artificial Sequence: Synthetic oligonucleotide
tcgctggtgctccaacaagaaaaatgctgctg

SEQ ID NO: 159998 - DNA, 31 bp, Artificial Sequence
  Description of Artificial Sequence: Synthetic oligonucleotide
cgctggtgctccaacaagaaaaatgctgctg

SEQ ID NO: 159999 - DNA, 35 bp, Artificial Sequence
  Description of Artificial Sequence: Synthetic oligonucleotide
gctggtgctccaacaagaaaaatgctgctgtaatg

SEQ ID NO: 160000 - DNA, 35 bp, Artificial Sequence
  Description of Artificial Sequence: Synthetic oligonucleotide
ctggtgctccaacaagaaaaatgctgctgtaatgg

SEQ ID NO: 160001 - DNA, 36 bp, Artificial Sequence
  Description of Artificial Sequence: Synthetic oligonucleotide
tggtgctccaacaagaaaaatgctgctgtaatggac

SEQ ID NO: 160002 - DNA, 35 bp, Artificial Sequence
  Description of Artificial Sequence: Synthetic oligonucleotide
ggtgctccaacaagaaaaatgctgctgtaatggac

SEQ ID NO: 160003 - DNA, 35 bp, Artificial Sequence
  Description of Artificial Sequence: Synthetic oligonucleotide
gtgctccaacaagaaaaatgctgctgtaatggacc

SEQ ID NO: 160004 - DNA, 37 bp, Artificial Sequence
  Description of Artificial Sequence: Synthetic oligonucleotide
tgctccaacaagaaaaatgctgctgtaatggaccaag

SEQ ID NO: 160005 - DNA, 36 bp, Artificial Sequence
  Description of Artificial Sequence: Synthetic oligonucleotide
gctccaacaagaaaaatgctgctgtaatggaccaag

SEQ ID NO: 160006 - DNA, 37 bp, Artificial Sequence
  Description of Artificial Sequence: Synthetic oligonucleotide
ctccaacaagaaaaatgctgctgtaatggaccaagag

SEQ ID NO: 160007 - DNA, 37 bp, Artificial Sequence
  Description of Artificial Sequence: Synthetic oligonucleotide
tccaacaagaaaaatgctgctgtaatggaccaagagc

SEQ ID NO: 160008 - DNA, 36 bp, Artificial Sequence
  Description of Artificial Sequence: Synthetic oligonucleotide
ccaacaagaaaaatgctgctgtaatggaccaagagc

SEQ ID NO: 160009 - DNA, 36 bp, Artificial Sequence
  Description of Artificial Sequence: Synthetic oligonucleotide
caacaagaaaaatgctgctgtaatggaccaagagcc

SEQ ID NO: 160010 - DNA, 37 bp, Artificial Sequence
  Description of Artificial Sequence: Synthetic oligonucleotide
aacaagaaaaatgctgctgtaatggaccaagagcctg

SEQ ID NO: 160011 - DNA, 36 bp, Artificial Sequence
  Description of Artificial Sequence: Synthetic oligonucleotide
acaagaaaaatgctgctgtaatggaccaagagcctg

SEQ ID NO: 160012 - DNA, 35 bp, Artificial Sequence
  Description of Artificial Sequence: Synthetic oligonucleotide
caagaaaaatgctgctgtaatggaccaagagcctg

SEQ ID NO: 160013 - DNA, 35 bp, Artificial Sequence
  Description of Artificial Sequence: Synthetic oligonucleotide
aagaaaaatgctgctgtaatggaccaagagcctgc

SEQ ID NO: 160014 - DNA, 34 bp, Artificial Sequence
  Description of Artificial Sequence: Synthetic oligonucleotide
agaaaaatgctgctgtaatggaccaagagcctgc

SEQ ID NO: 160015 - DNA, 33 bp, Artificial Sequence
  Description of Artificial Sequence: Synthetic oligonucleotide
gaaaaatgctgctgtaatggaccaagagcctgc

SEQ ID NO: 160016 - DNA, 28 bp, Artificial Sequence
  Description of Artificial Sequence: Synthetic oligonucleotide
accaagagcctgcagggaacagaacagc

SEQ ID NO: 160017 - DNA, 27 bp, Artificial Sequence
  Description of Artificial Sequence: Synthetic oligonucleotide
ccaagagcctgcagggaacagaacagc

SEQ ID NO: 160018 - DNA, 27 bp, Artificial Sequence
  Description of Artificial Sequence: Synthetic oligonucleotide
caagagcctgcagggaacagaacagcg

SEQ ID NO: 160019 - DNA, 31 bp, Artificial Sequence
  Description of Artificial Sequence: Synthetic oligonucleotide
aagagcctgcagggaacagaacagcgaatag

SEQ ID NO: 160020 - DNA, 30 bp, Artificial Sequence
  Description of Artificial Sequence: Synthetic oligonucleotide
agagcctgcagggaacagaacagcgaatag

SEQ ID NO: 160021 - DNA, 29 bp, Artificial Sequence
  Description of Artificial Sequence: Synthetic oligonucleotide
gagcctgcagggaacagaacagcgaatag

SEQ ID NO: 160022 - DNA, 29 bp, Artificial Sequence
  Description of Artificial Sequence: Synthetic oligonucleotide
agcctgcagggaacagaacagcgaatagc

SEQ ID NO: 160023 - DNA, 28 bp, Artificial Sequence
  Description of Artificial Sequence: Synthetic oligonucleotide
gcctgcagggaacagaacagcgaatagc

SEQ ID NO: 160024 - DNA, 30 bp, Artificial Sequence
  Description of Artificial Sequence: Synthetic oligonucleotide
cctgcagggaacagaacagcgaatagctag

SEQ ID NO: 160025 - DNA, 30 bp, Artificial Sequence
  Description of Artificial Sequence: Synthetic oligonucleotide
ctgcagggaacagaacagcgaatagctagg

SEQ ID NO: 160026 - DNA, 31 bp, Artificial Sequence
  Description of Artificial Sequence: Synthetic oligonucleotide
tgcagggaacagaacagcgaatagctaggac

SEQ ID NO: 160027 - DNA, 30 bp, Artificial Sequence
  Description of Artificial Sequence: Synthetic oligonucleotide
gcagggaacagaacagcgaatagctaggac

SEQ ID NO: 160028 - DNA, 31 bp, Artificial Sequence
  Description of Artificial Sequence: Synthetic oligonucleotide
cagggaacagaacagcgaatagctaggactc

SEQ ID NO: 160029 - DNA, 32 bp, Artificial Sequence
  Description of Artificial Sequence: Synthetic oligonucleotide
agggaacagaacagcgaatagctaggactctg

SEQ ID NO: 160030 - DNA, 31 bp, Artificial Sequence
  Description of Artificial Sequence: Synthetic oligonucleotide
gggaacagaacagcgaatagctaggactctg

SEQ ID NO: 160031 - DNA, 33 bp, Artificial Sequence
  Description of Artificial Sequence: Synthetic oligonucleotide
ggaacagaacagcgaatagctaggactctgatg

SEQ ID NO: 160032 - DNA, 35 bp, Artificial Sequence
  Description of Artificial Sequence: Synthetic oligonucleotide
gaacagaacagcgaatagctaggactctgatgaac

SEQ ID NO: 160033 - DNA, 37 bp, Artificial Sequence
  Description of Artificial Sequence: Synthetic oligonucleotide
aacagaacagcgaatagctaggactctgatgaacaag

SEQ ID NO: 160034 - DNA, 36 bp, Artificial Sequence
  Description of Artificial Sequence: Synthetic oligonucleotide
acagaacagcgaatagctaggactctgatgaacaag

SEQ ID NO: 160035 - DNA, 35 bp, Artificial Sequence
  Description of Artificial Sequence: Synthetic oligonucleotide
cagaacagcgaatagctaggactctgatgaacaag

SEQ ID NO: 160036 - DNA, 36 bp, Artificial Sequence
  Description of Artificial Sequence: Synthetic oligonucleotide
agaacagcgaatagctaggactctgatgaacaagac

SEQ ID NO: 160037 - DNA, 35 bp, Artificial Sequence
  Description of Artificial Sequence: Synthetic oligonucleotide
gaacagcgaatagctaggactctgatgaacaagac

SEQ ID NO: 160038 - DNA, 35 bp, Artificial Sequence
  Description of Artificial Sequence: Synthetic oligonucleotide
aacagcgaatagctaggactctgatgaacaagacc

SEQ ID NO: 160039 - DNA, 34 bp, Artificial Sequence
  Description of Artificial Sequence: Synthetic oligonucleotide
acagcgaatagctaggactctgatgaacaagacc

SEQ ID NO: 160040 - DNA, 33 bp, Artificial Sequence
  Description of Artificial Sequence: Synthetic oligonucleotide
cagcgaatagctaggactctgatgaacaagacc

SEQ ID NO: 160041 - DNA, 33 bp, Artificial Sequence
  Description of Artificial Sequence: Synthetic oligonucleotide
agcgaatagctaggactctgatgaacaagaccc

SEQ ID NO: 160042 - DNA, 32 bp, Artificial Sequence
  Description of Artificial Sequence: Synthetic oligonucleotide
gcgaatagctaggactctgatgaacaagaccc

SEQ ID NO: 160043 - DNA, 33 bp, Artificial Sequence
  Description of Artificial Sequence: Synthetic oligonucleotide
cgaatagctaggactctgatgaacaagaccctc

SEQ ID NO: 160044 - DNA, 34 bp, Artificial Sequence
  Description of Artificial Sequence: Synthetic oligonucleotide
gaatagctaggactctgatgaacaagaccctcag

SEQ ID NO: 160045 - DNA, 34 bp, Artificial Sequence
  Description of Artificial Sequence: Synthetic oligonucleotide
aatagctaggactctgatgaacaagaccctcagg

SEQ ID NO: 160046 - DNA, 33 bp, Artificial Sequence
  Description of Artificial Sequence: Synthetic oligonucleotide
atagctaggactctgatgaacaagaccctcagg

SEQ ID NO: 160047 - DNA, 32 bp, Artificial Sequence
  Description of Artificial Sequence: Synthetic oligonucleotide
tagctaggactctgatgaacaagaccctcagg

SEQ ID NO: 160048 - DNA, 31 bp, Artificial Sequence
  Description of Artificial Sequence: Synthetic oligonucleotide
agctaggactctgatgaacaagaccctcagg

SEQ ID NO: 160049 - DNA, 30 bp, Artificial Sequence
  Description of Artificial Sequence: Synthetic oligonucleotide
gctaggactctgatgaacaagaccctcagg

SEQ ID NO: 160050 - DNA, 31 bp, Artificial Sequence
  Description of Artificial Sequence: Synthetic oligonucleotide
ctaggactctgatgaacaagaccctcaggag

SEQ ID NO: 160051 - DNA, 31 bp, Artificial Sequence
  Description of Artificial Sequence: Synthetic oligonucleotide
taggactctgatgaacaagaccctcaggagg

SEQ ID NO: 160052 - DNA, 30 bp, Artificial Sequence
  Description of Artificial Sequence: Synthetic oligonucleotide
accctcaggaggtgacatacgtacagttgg

SEQ ID NO: 160053 - DNA, 29 bp, Artificial Sequence
  Description of Artificial Sequence: Synthetic oligonucleotide
ccctcaggaggtgacatacgtacagttgg

SEQ ID NO: 160054 - DNA, 31 bp, Artificial Sequence
  Description of Artificial Sequence: Synthetic oligonucleotide
cctcaggaggtgacatacgtacagttggatc

SEQ ID NO: 160055 - DNA, 32 bp, Artificial Sequence
  Description of Artificial Sequence: Synthetic oligonucleotide
ctcaggaggtgacatacgtacagttggatcac

SEQ ID NO: 160056 - DNA, 33 bp, Artificial Sequence
  Description of Artificial Sequence: Synthetic oligonucleotide
tcaggaggtgacatacgtacagttggatcactg

SEQ ID NO: 160057 - DNA, 32 bp, Artificial Sequence
  Description of Artificial Sequence: Synthetic oligonucleotide
caggaggtgacatacgtacagttggatcactg

SEQ ID NO: 160058 - DNA, 32 bp, Artificial Sequence
  Description of Artificial Sequence: Synthetic oligonucleotide
aggaggtgacatacgtacagttggatcactgc

SEQ ID NO: 160059 - DNA, 31 bp, Artificial Sequence
  Description of Artificial Sequence: Synthetic oligonucleotide
ggaggtgacatacgtacagttggatcactgc

SEQ ID NO: 160060 - DNA, 31 bp, Artificial Sequence
  Description of Artificial Sequence: Synthetic oligonucleotide
gaggtgacatacgtacagttggatcactgcg

SEQ ID NO: 160061 - DNA, 35 bp, Artificial Sequence
  Description of Artificial Sequence: Synthetic oligonucleotide
aggtgacatacgtacagttggatcactgcgttttc

SEQ ID NO: 160062 - DNA, 34 bp, Artificial Sequence
  Description of Artificial Sequence: Synthetic oligonucleotide
ggtgacatacgtacagttggatcactgcgttttc

SEQ ID NO: 160063 - DNA, 35 bp, Artificial Sequence
  Description of Artificial Sequence: Synthetic oligonucleotide
gtgacatacgtacagttggatcactgcgttttcac

SEQ ID NO: 160064 - DNA, 36 bp, Artificial Sequence
  Description of Artificial Sequence: Synthetic oligonucleotide
tgacatacgtacagttggatcactgcgttttcacac

SEQ ID NO: 160065 - DNA, 35 bp, Artificial Sequence
  Description of Artificial Sequence: Synthetic oligonucleotide
gacatacgtacagttggatcactgcgttttcacac

SEQ ID NO: 160066 - DNA, 36 bp, Artificial Sequence
  Description of Artificial Sequence: Synthetic oligonucleotide
acatacgtacagttggatcactgcgttttcacacag

SEQ ID NO: 160067 - DNA, 35 bp, Artificial Sequence
  Description of Artificial Sequence: Synthetic oligonucleotide
catacgtacagttggatcactgcgttttcacacag

SEQ ID NO: 160068 - DNA, 36 bp, Artificial Sequence
  Description of Artificial Sequence: Synthetic oligonucleotide
atacgtacagttggatcactgcgttttcacacagag

SEQ ID NO: 160069 - DNA, 35 bp, Artificial Sequence
  Description of Artificial Sequence: Synthetic oligonucleotide
tacgtacagttggatcactgcgttttcacacagag

SEQ ID NO: 160070 - DNA, 34 bp, Artificial Sequence
  Description of Artificial Sequence: Synthetic oligonucleotide
acgtacagttggatcactgcgttttcacacagag

SEQ ID NO: 160071 - DNA, 33 bp, Artificial Sequence
  Description of Artificial Sequence: Synthetic oligonucleotide
cgtacagttggatcactgcgttttcacacagag

SEQ ID NO: 160072 - DNA, 39 bp, Artificial Sequence
  Description of Artificial Sequence: Synthetic oligonucleotide
gtacagttggatcactgcgttttcacacagagaaaaatc

SEQ ID NO: 160073 - DNA, 40 bp, Artificial Sequence
  Description of Artificial Sequence: Synthetic oligonucleotide
tacagttggatcactgcgttttcacacagagaaaaatcac

SEQ ID NO: 160074 - DNA, 39 bp, Artificial Sequence
  Description of Artificial Sequence: Synthetic oligonucleotide
acagttggatcactgcgttttcacacagagaaaaatcac

SEQ ID NO: 160075 - DNA, 38 bp, Artificial Sequence
  Description of Artificial Sequence: Synthetic oligonucleotide
cagttggatcactgcgttttcacacagagaaaaatcac

SEQ ID NO: 160076 - DNA, 39 bp, Artificial Sequence
  Description of Artificial Sequence: Synthetic oligonucleotide
agttggatcactgcgttttcacacagagaaaaatcactc

SEQ ID NO: 160077 - DNA, 38 bp, Artificial Sequence
  Description of Artificial Sequence: Synthetic oligonucleotide
gttggatcactgcgttttcacacagagaaaaatcactc

SEQ ID NO: 160078 - DNA, 38 bp, Artificial Sequence
  Description of Artificial Sequence: Synthetic oligonucleotide
ttggatcactgcgttttcacacagagaaaaatcactcg

SEQ ID NO: 160079 - DNA, 37 bp, Artificial Sequence
  Description of Artificial Sequence: Synthetic oligonucleotide
tggatcactgcgttttcacacagagaaaaatcactcg

SEQ ID NO: 160080 - DNA, 36 bp, Artificial Sequence
  Description of Artificial Sequence: Synthetic oligonucleotide
ggatcactgcgttttcacacagagaaaaatcactcg

SEQ ID NO: 160081 - DNA, 36 bp, Artificial Sequence
  Description of Artificial Sequence: Synthetic oligonucleotide
gatcactgcgttttcacacagagaaaaatcactcgc

SEQ ID NO: 160082 - DNA, 28 bp, Artificial Sequence
  Description of Artificial Sequence: Synthetic oligonucleotide
agaggcccaagacacccccaacagatac

SEQ ID NO: 160083 - DNA, 27 bp, Artificial Sequence
  Description of Artificial Sequence: Synthetic oligonucleotide
gaggcccaagacacccccaacagatac

SEQ ID NO: 160084 - DNA, 27 bp, Artificial Sequence
  Description of Artificial Sequence: Synthetic oligonucleotide
aggcccaagacacccccaacagatacc

SEQ ID NO: 160085 - DNA, 27 bp, Artificial Sequence
  Description of Artificial Sequence: Synthetic oligonucleotide
ggcccaagacacccccaacagatacca

SEQ ID NO: 160086 - DNA, 27 bp, Artificial Sequence
  Description of Artificial Sequence: Synthetic oligonucleotide
gcccaagacacccccaacagataccag

SEQ ID NO: 160087 - DNA, 28 bp, Artificial Sequence
  Description of Artificial Sequence: Synthetic oligonucleotide
cccaagacacccccaacagataccagag

SEQ ID NO: 160088 - DNA, 29 bp, Artificial Sequence
  Description of Artificial Sequence: Synthetic oligonucleotide
ccaagacacccccaacagataccagagtg

SEQ ID NO: 160089 - DNA, 31 bp, Artificial Sequence
  Description of Artificial Sequence: Synthetic oligonucleotide
caagacacccccaacagataccagagtgtac

SEQ ID NO: 160090 - DNA, 32 bp, Artificial Sequence
  Description of Artificial Sequence: Synthetic oligonucleotide
aagacacccccaacagataccagagtgtacac

SEQ ID NO: 160091 - DNA, 31 bp, Artificial Sequence
  Description of Artificial Sequence: Synthetic oligonucleotide
agacacccccaacagataccagagtgtacac

SEQ ID NO: 160092 - DNA, 30 bp, Artificial Sequence
  Description of Artificial Sequence: Synthetic oligonucleotide
gacacccccaacagataccagagtgtacac

SEQ ID NO: 160093 - DNA, 30 bp, Artificial Sequence
  Description of Artificial Sequence: Synthetic oligonucleotide
acacccccaacagataccagagtgtacacg

SEQ ID NO: 160094 - DNA, 29 bp, Artificial Sequence
  Description of Artificial Sequence: Synthetic oligonucleotide
cacccccaacagataccagagtgtacacg

SEQ ID NO: 160095 - DNA, 29 bp, Artificial Sequence
  Description of Artificial Sequence: Synthetic oligonucleotide
acccccaacagataccagagtgtacacgg

SEQ ID NO: 160096 - DNA, 28 bp, Artificial Sequence
  Description of Artificial Sequence: Synthetic oligonucleotide
cccccaacagataccagagtgtacacgg

SEQ ID NO: 160097 - DNA, 30 bp, Artificial Sequence
  Description of Artificial Sequence: Synthetic oligonucleotide
ccccaacagataccagagtgtacacggaac

SEQ ID NO: 160098 - DNA, 32 bp, Artificial Sequence
  Description of Artificial Sequence: Synthetic oligonucleotide
cccaacagataccagagtgtacacggaacttc

SEQ ID NO: 160099 - DNA, 32 bp, Artificial Sequence
  Description of Artificial Sequence: Synthetic oligonucleotide
ccaacagataccagagtgtacacggaacttcc

SEQ ID NO: 160100 - DNA, 36 bp, Artificial Sequence
  Description of Artificial Sequence: Synthetic oligonucleotide
caacagataccagagtgtacacggaacttccaaatg

SEQ ID NO: 160101 - DNA, 36 bp, Artificial Sequence
  Description of Artificial Sequence: Synthetic oligonucleotide
aacagataccagagtgtacacggaacttccaaatgc

SEQ ID NO: 160102 - DNA, 35 bp, Artificial Sequence
  Description of Artificial Sequence: Synthetic oligonucleotide
acagataccagagtgtacacggaacttccaaatgc

SEQ ID NO: 160103 - DNA, 34 bp, Artificial Sequence
  Description of Artificial Sequence: Synthetic oligonucleotide
cagataccagagtgtacacggaacttccaaatgc

SEQ ID NO: 160104 - DNA, 35 bp, Artificial Sequence
  Description of Artificial Sequence: Synthetic oligonucleotide
agataccagagtgtacacggaacttccaaatgctg

SEQ ID NO: 160105 - DNA, 34 bp, Artificial Sequence
  Description of Artificial Sequence: Synthetic oligonucleotide
gataccagagtgtacacggaacttccaaatgctg

SEQ ID NO: 160106 - DNA, 35 bp, Artificial Sequence
  Description of Artificial Sequence: Synthetic oligonucleotide
ataccagagtgtacacggaacttccaaatgctgag

SEQ ID NO: 160107 - DNA, 34 bp, Artificial Sequence
  Description of Artificial Sequence: Synthetic oligonucleotide
taccagagtgtacacggaacttccaaatgctgag

SEQ ID NO: 160108 - DNA, 33 bp, Artificial Sequence
  Description of Artificial Sequence: Synthetic oligonucleotide
accagagtgtacacggaacttccaaatgctgag

SEQ ID NO: 160109 - DNA, 32 bp, Artificial Sequence
  Description of Artificial Sequence: Synthetic oligonucleotide
ccagagtgtacacggaacttccaaatgctgag

SEQ ID NO: 160110 - DNA, 33 bp, Artificial Sequence
  Description of Artificial Sequence: Synthetic oligonucleotide
cagagtgtacacggaacttccaaatgctgagtc

SEQ ID NO: 160111 - DNA, 33 bp, Artificial Sequence
  Description of Artificial Sequence: Synthetic oligonucleotide
agagtgtacacggaacttccaaatgctgagtcc

SEQ ID NO: 160112 - DNA, 32 bp, Artificial Sequence
  Description of Artificial Sequence: Synthetic oligonucleotide
gagtgtacacggaacttccaaatgctgagtcc

SEQ ID NO: 160113 - DNA, 33 bp, Artificial Sequence
  Description of Artificial Sequence: Synthetic oligonucleotide
agtgtacacggaacttccaaatgctgagtccag

SEQ ID NO: 160114 - DNA, 33 bp, Artificial Sequence
  Description of Artificial Sequence: Synthetic oligonucleotide
acggaacttccaaatgctgagtccagatccaac

SEQ ID NO: 160115 - DNA, 32 bp, Artificial Sequence
  Description of Artificial Sequence: Synthetic oligonucleotide
cggaacttccaaatgctgagtccagatccaac

SEQ ID NO: 160116 - DNA, 32 bp, Artificial Sequence
  Description of Artificial Sequence: Synthetic oligonucleotide
ggaacttccaaatgctgagtccagatccaacg

SEQ ID NO: 160117 - DNA, 34 bp, Artificial Sequence
  Description of Artificial Sequence: Synthetic oligonucleotide
gaacttccaaatgctgagtccagatccaacgttg

SEQ ID NO: 160118 - DNA, 35 bp, Artificial Sequence
  Description of Artificial Sequence: Synthetic oligonucleotide
aacttccaaatgctgagtccagatccaacgttgtc

SEQ ID NO: 160119 - DNA, 34 bp, Artificial Sequence
  Description of Artificial Sequence: Synthetic oligonucleotide
acttccaaatgctgagtccagatccaacgttgtc

SEQ ID NO: 160120 - DNA, 33 bp, Artificial Sequence
  Description of Artificial Sequence: Synthetic oligonucleotide
cttccaaatgctgagtccagatccaacgttgtc

SEQ ID NO: 160121 - DNA, 34 bp, Artificial Sequence
  Description of Artificial Sequence: Synthetic oligonucleotide
ttccaaatgctgagtccagatccaacgttgtctc

SEQ ID NO: 160122 - DNA, 33 bp, Artificial Sequence
  Description of Artificial Sequence: Synthetic oligonucleotide
tccaaatgctgagtccagatccaacgttgtctc

SEQ ID NO: 160123 - DNA, 32 bp, Artificial Sequence
  Description of Artificial Sequence: Synthetic oligonucleotide
ccaaatgctgagtccagatccaacgttgtctc

SEQ ID NO: 160124 - DNA, 32 bp, Artificial Sequence
  Description of Artificial Sequence: Synthetic oligonucleotide
caaatgctgagtccagatccaacgttgtctcc

SEQ ID NO: 160125 - DNA, 33 bp, Artificial Sequence
  Description of Artificial Sequence: Synthetic oligonucleotide
aaatgctgagtccagatccaacgttgtctcctg

SEQ ID NO: 160126 - DNA, 32 bp, Artificial Sequence
  Description of Artificial Sequence: Synthetic oligonucleotide
aatgctgagtccagatccaacgttgtctcctg

SEQ ID NO: 160127 - DNA, 31 bp, Artificial Sequence
  Description of Artificial Sequence: Synthetic oligonucleotide
atgctgagtccagatccaacgttgtctcctg

SEQ ID NO: 160128 - DNA, 30 bp, Artificial Sequence
  Description of Artificial Sequence: Synthetic oligonucleotide
tgctgagtccagatccaacgttgtctcctg

SEQ ID NO: 160129 - DNA, 29 bp, Artificial Sequence
  Description of Artificial Sequence: Synthetic oligonucleotide
gctgagtccagatccaacgttgtctcctg

SEQ ID NO: 160130 - DNA, 29 bp, Artificial Sequence
  Description of Artificial Sequence: Synthetic oligonucleotide
ctgagtccagatccaacgttgtctcctgc

SEQ ID NO: 160131 - DNA, 29 bp, Artificial Sequence
  Description of Artificial Sequence: Synthetic oligonucleotide
tgagtccagatccaacgttgtctcctgcc

SEQ ID NO: 160132 - DNA, 28 bp, Artificial Sequence
  Description of Artificial Sequence: Synthetic oligonucleotide
gagtccagatccaacgttgtctcctgcc

SEQ ID NO: 160133 - DNA, 28 bp, Artificial Sequence
  Description of Artificial Sequence: Synthetic oligonucleotide
agtccagatccaacgttgtctcctgccc

SEQ ID NO: 160134 - DNA, 27 bp, Artificial Sequence
  Description of Artificial Sequence: Synthetic oligonucleotide
gtccagatccaacgttgtctcctgccc

SEQ ID NO: 160135 - DNA, 29 bp, Artificial Sequence
  Description of Artificial Sequence: Synthetic oligonucleotide
tccagatccaacgttgtctcctgcccatg

SEQ ID NO: 160136 - DNA, 28 bp, Artificial Sequence
  Description of Artificial Sequence: Synthetic oligonucleotide
ccagatccaacgttgtctcctgcccatg

SEQ ID NO: 160137 - DNA, 30 bp, Artificial Sequence
  Description of Artificial Sequence: Synthetic oligonucleotide
tacagatgtcggggttcacacccacactac

SEQ ID NO: 160138 - DNA, 29 bp, Artificial Sequence
  Description of Artificial Sequence: Synthetic oligonucleotide
acagatgtcggggttcacacccacactac

SEQ ID NO: 160139 - DNA, 28 bp, Artificial Sequence
  Description of Artificial Sequence: Synthetic oligonucleotide
cagatgtcggggttcacacccacactac

SEQ ID NO: 160140 - DNA, 28 bp, Artificial Sequence
  Description of Artificial Sequence: Synthetic oligonucleotide
agatgtcggggttcacacccacactacc

SEQ ID NO: 160141 - DNA, 27 bp, Artificial Sequence
  Description of Artificial Sequence: Synthetic oligonucleotide
gatgtcggggttcacacccacactacc

SEQ ID NO: 160142 - DNA, 27 bp, Artificial Sequence
  Description of Artificial Sequence: Synthetic oligonucleotide
atgtcggggttcacacccacactaccc

SEQ ID NO: 160143 - DNA, 26 bp, Artificial Sequence
  Description of Artificial Sequence: Synthetic oligonucleotide
tgtcggggttcacacccacactaccc

SEQ ID NO: 160144 - DNA, 25 bp, Artificial Sequence
  Description of Artificial Sequence: Synthetic oligonucleotide
gtcggggttcacacccacactaccc

SEQ ID NO: 160145 - DNA, 26 bp, Artificial Sequence
  Description of Artificial Sequence: Synthetic oligonucleotide
tcggggttcacacccacactacccca

SEQ ID NO: 160146 - DNA, 25 bp, Artificial Sequence
  Description of Artificial Sequence: Synthetic oligonucleotide
cggggttcacacccacactacccca

SEQ ID NO: 160147 - DNA, 26 bp, Artificial Sequence
  Description of Artificial Sequence: Synthetic oligonucleotide
ggggttcacacccacactaccccagt

SEQ ID NO: 160148 - DNA, 26 bp, Artificial Sequence
  Description of Artificial Sequence: Synthetic oligonucleotide
gggttcacacccacactaccccagtg

SEQ ID NO: 160149 - DNA, 26 bp, Artificial Sequence
  Description of Artificial Sequence: Synthetic oligonucleotide
ggttcacacccacactaccccagtgg

SEQ ID NO: 160150 - DNA, 27 bp, Artificial Sequence
  Description of Artificial Sequence: Synthetic oligonucleotide
gttcacacccacactaccccagtgggt

SEQ ID NO: 160151 - DNA, 27 bp, Artificial Sequence
  Description of Artificial Sequence: Synthetic oligonucleotide
ttcacacccacactaccccagtgggtg

SEQ ID NO: 160152 - DNA, 26 bp, Artificial Sequence
  Description of Artificial Sequence: Synthetic oligonucleotide
tcacacccacactaccccagtgggtg

SEQ ID NO: 160153 - DNA, 25 bp, Artificial Sequence
  Description of Artificial Sequence: Synthetic oligonucleotide
cacacccacactaccccagtgggtg

SEQ ID NO: 160154 - DNA, 26 bp, Artificial Sequence
  Description of Artificial Sequence: Synthetic oligonucleotide
acacccacactaccccagtgggtggt

SEQ ID NO: 160155 - DNA, 25 bp, Artificial Sequence
  Description of Artificial Sequence: Synthetic oligonucleotide
cacccacactaccccagtgggtggt

SEQ ID NO: 160156 - DNA, 25 bp, Artificial Sequence
  Description of Artificial Sequence: Synthetic oligonucleotide
acccacactaccccagtgggtggtc

SEQ ID NO: 160157 - DNA, 24 bp, Artificial Sequence
  Description of Artificial Sequence: Synthetic oligonucleotide
cccacactaccccagtgggtggtc

SEQ ID NO: 160158 - DNA, 24 bp, Artificial Sequence
  Description of Artificial Sequence: Synthetic oligonucleotide
ccacactaccccagtgggtggtcg

SEQ ID NO: 160159 - DNA, 24 bp, Artificial Sequence
  Description of Artificial Sequence: Synthetic oligonucleotide
cacactaccccagtgggtggtcgg

SEQ ID NO: 160160 - DNA, 25 bp, Artificial Sequence
  Description of Artificial Sequence: Synthetic oligonucleotide
acactaccccagtgggtggtcggca

SEQ ID NO: 160161 - DNA, 24 bp, Artificial Sequence
  Description of Artificial Sequence: Synthetic oligonucleotide
cactaccccagtgggtggtcggca

SEQ ID NO: 160162 - DNA, 24 bp, Artificial Sequence
  Description of Artificial Sequence: Synthetic oligonucleotide
actaccccagtgggtggtcggcac

SEQ ID NO: 160163 - DNA, 23 bp, Artificial Sequence
  Description of Artificial Sequence: Synthetic oligonucleotide
ctaccccagtgggtggtcggcac

SEQ ID NO: 160164 - DNA, 23 bp, Artificial Sequence
  Description of Artificial Sequence: Synthetic oligonucleotide
taccccagtgggtggtcggcacc

SEQ ID NO: 160165 - DNA, 22 bp, Artificial Sequence
  Description of Artificial Sequence: Synthetic oligonucleotide
accccagtgggtggtcggcacc

SEQ ID NO: 160166 - DNA, 25 bp, Artificial Sequence
  Description of Artificial Sequence: Synthetic oligonucleotide
agtgggtggtcggcacccagcaaca

SEQ ID NO: 160167 - DNA, 24 bp, Artificial Sequence
  Description of Artificial Sequence: Synthetic oligonucleotide
gtgggtggtcggcacccagcaaca

SEQ ID NO: 160168 - DNA, 24 bp, Artificial Sequence
  Description of Artificial Sequence: Synthetic oligonucleotide
tgggtggtcggcacccagcaacac

SEQ ID NO: 160169 - DNA, 23 bp, Artificial Sequence
  Description of Artificial Sequence: Synthetic oligonucleotide
gggtggtcggcacccagcaacac

SEQ ID NO: 160170 - DNA, 23 bp, Artificial Sequence
  Description of Artificial Sequence: Synthetic oligonucleotide
ggtggtcggcacccagcaacacc

SEQ ID NO: 160171 - DNA, 24 bp, Artificial Sequence
  Description of Artificial Sequence: Synthetic oligonucleotide
gtggtcggcacccagcaacaccct

SEQ ID NO: 160172 - DNA, 24 bp, Artificial Sequence
  Description of Artificial Sequence: Synthetic oligonucleotide
tggtcggcacccagcaacaccctg

SEQ ID NO: 160173 - DNA, 23 bp, Artificial Sequence
  Description of Artificial Sequence: Synthetic oligonucleotide
ggtcggcacccagcaacaccctg

SEQ ID NO: 160174 - DNA, 24 bp, Artificial Sequence
  Description of Artificial Sequence: Synthetic oligonucleotide
gtcggcacccagcaacaccctggt

SEQ ID NO: 160175 - DNA, 26 bp, Artificial Sequence
  Description of Artificial Sequence: Synthetic oligonucleotide
tcggcacccagcaacaccctggtgat

SEQ ID NO: 160176 - DNA, 25 bp, Artificial Sequence
  Description of Artificial Sequence: Synthetic oligonucleotide
cggcacccagcaacaccctggtgat

SEQ ID NO: 160177 - DNA, 27 bp, Artificial Sequence
  Description of Artificial Sequence: Synthetic oligonucleotide
ggcacccagcaacaccctggtgatcat

SEQ ID NO: 160178 - DNA, 27 bp, Artificial Sequence
  Description of Artificial Sequence: Synthetic oligonucleotide
gcacccagcaacaccctggtgatcatg

SEQ ID NO: 160179 - DNA, 27 bp, Artificial Sequence
  Description of Artificial Sequence: Synthetic oligonucleotide
cacccagcaacaccctggtgatcatgg

SEQ ID NO: 160180 - DNA, 27 bp, Artificial Sequence
  Description of Artificial Sequence: Synthetic oligonucleotide
acccagcaacaccctggtgatcatggc

SEQ ID NO: 160181 - DNA, 26 bp, Artificial Sequence
  Description of Artificial Sequence: Synthetic oligonucleotide
cccagcaacaccctggtgatcatggc

SEQ ID NO: 160182 - DNA, 27 bp, Artificial Sequence
  Description of Artificial Sequence: Synthetic oligonucleotide
ccagcaacaccctggtgatcatggcca

SEQ ID NO: 160183 - DNA, 27 bp, Artificial Sequence
  Description of Artificial Sequence: Synthetic oligonucleotide
cagcaacaccctggtgatcatggccac

SEQ ID NO: 160184 - DNA, 28 bp, Artificial Sequence
  Description of Artificial Sequence: Synthetic oligonucleotide
agcaacaccctggtgatcatggccacag

SEQ ID NO: 160185 - DNA, 27 bp, Artificial Sequence
  Description of Artificial Sequence: Synthetic oligonucleotide
gcaacaccctggtgatcatggccacag

SEQ ID NO: 160186 - DNA, 27 bp, Artificial Sequence
  Description of Artificial Sequence: Synthetic oligonucleotide
caacaccctggtgatcatggccacagg

SEQ ID NO: 160187 - DNA, 28 bp, Artificial Sequence
  Description of Artificial Sequence: Synthetic oligonucleotide
aacaccctggtgatcatggccacaggag

SEQ ID NO: 160188 - DNA, 27 bp, Artificial Sequence
  Description of Artificial Sequence: Synthetic oligonucleotide
acaccctggtgatcatggccacaggag

SEQ ID NO: 160189 - DNA, 27 bp, Artificial Sequence
  Description of Artificial Sequence: Synthetic oligonucleotide
caccctggtgatcatggccacaggagt

SEQ ID NO: 160190 - DNA, 27 bp, Artificial Sequence
  Description of Artificial Sequence: Synthetic oligonucleotide
accctggtgatcatggccacaggagtc

SEQ ID NO: 160191 - DNA, 35 bp, Artificial Sequence
  Description of Artificial Sequence: Synthetic oligonucleotide
agcacttccttctgcacagagaagggaagtttaac

SEQ ID NO: 160192 - DNA, 34 bp, Artificial Sequence
  Description of Artificial Sequence: Synthetic oligonucleotide
gcacttccttctgcacagagaagggaagtttaac

SEQ ID NO: 160193 - DNA, 34 bp, Artificial Sequence
  Description of Artificial Sequence: Synthetic oligonucleotide
cacttccttctgcacagagaagggaagtttaacg

SEQ ID NO: 160194 - DNA, 35 bp, Artificial Sequence
  Description of Artificial Sequence: Synthetic oligonucleotide
acttccttctgcacagagaagggaagtttaacgac

SEQ ID NO: 160195 - DNA, 34 bp, Artificial Sequence
  Description of Artificial Sequence: Synthetic oligonucleotide
cttccttctgcacagagaagggaagtttaacgac

SEQ ID NO: 160196 - DNA, 35 bp, Artificial Sequence
  Description of Artificial Sequence: Synthetic oligonucleotide
ttccttctgcacagagaagggaagtttaacgacac

SEQ ID NO: 160197 - DNA, 34 bp, Artificial Sequence
  Description of Artificial Sequence: Synthetic oligonucleotide
tccttctgcacagagaagggaagtttaacgacac

SEQ ID NO: 160198 - DNA, 33 bp, Artificial Sequence
  Description of Artificial Sequence: Synthetic oligonucleotide
ccttctgcacagagaagggaagtttaacgacac

SEQ ID NO: 160199 - DNA, 36 bp, Artificial Sequence
  Description of Artificial Sequence: Synthetic oligonucleotide
cttctgcacagagaagggaagtttaacgacactttg

SEQ ID NO: 160200 - DNA, 36 bp, Artificial Sequence
  Description of Artificial Sequence: Synthetic oligonucleotide
ttctgcacagagaagggaagtttaacgacactttgc

SEQ ID NO: 160201 - DNA, 35 bp, Artificial Sequence
  Description of Artificial Sequence: Synthetic oligonucleotide
tctgcacagagaagggaagtttaacgacactttgc

SEQ ID NO: 160202 - DNA, 34 bp, Artificial Sequence
  Description of Artificial Sequence: Synthetic oligonucleotide
ctgcacagagaagggaagtttaacgacactttgc

SEQ ID NO: 160203 - DNA, 35 bp, Artificial Sequence
  Description of Artificial Sequence: Synthetic oligonucleotide
tgcacagagaagggaagtttaacgacactttgcac

SEQ ID NO: 160204 - DNA, 34 bp, Artificial Sequence
  Description of Artificial Sequence: Synthetic oligonucleotide
gcacagagaagggaagtttaacgacactttgcac

SEQ ID NO: 160205 - DNA, 34 bp, Artificial Sequence
  Description of Artificial Sequence: Synthetic oligonucleotide
cacagagaagggaagtttaacgacactttgcacc

SEQ ID NO: 160206 - DNA, 35 bp, Artificial Sequence
  Description of Artificial Sequence: Synthetic oligonucleotide
acagagaagggaagtttaacgacactttgcacctc

SEQ ID NO: 160207 - DNA, 34 bp, Artificial Sequence
  Description of Artificial Sequence: Synthetic oligonucleotide
cagagaagggaagtttaacgacactttgcacctc

SEQ ID NO: 160208 - DNA, 35 bp, Artificial Sequence
  Description of Artificial Sequence: Synthetic oligonucleotide
agagaagggaagtttaacgacactttgcacctcac

SEQ ID NO: 160209 - DNA, 34 bp, Artificial Sequence
  Description of Artificial Sequence: Synthetic oligonucleotide
gagaagggaagtttaacgacactttgcacctcac

SEQ ID NO: 160210 - DNA, 35 bp, Artificial Sequence
  Description of Artificial Sequence: Synthetic oligonucleotide
agaagggaagtttaacgacactttgcacctcactg

SEQ ID NO: 160211 - DNA, 34 bp, Artificial Sequence
  Description of Artificial Sequence: Synthetic oligonucleotide
gaagggaagtttaacgacactttgcacctcactg

SEQ ID NO: 160212 - DNA, 34 bp, Artificial Sequence
  Description of Artificial Sequence: Synthetic oligonucleotide
aagggaagtttaacgacactttgcacctcactgg

SEQ ID NO: 160213 - DNA, 33 bp, Artificial Sequence
  Description of Artificial Sequence: Synthetic oligonucleotide
agggaagtttaacgacactttgcacctcactgg

SEQ ID NO: 160214 - DNA, 32 bp, Artificial Sequence
  Description of Artificial Sequence: Synthetic oligonucleotide
gggaagtttaacgacactttgcacctcactgg

SEQ ID NO: 160215 - DNA, 33 bp, Artificial Sequence
  Description of Artificial Sequence: Synthetic oligonucleotide
ggaagtttaacgacactttgcacctcactggag

SEQ ID NO: 160216 - DNA, 34 bp, Artificial Sequence
  Description of Artificial Sequence: Synthetic oligonucleotide
gaagtttaacgacactttgcacctcactggagag

SEQ ID NO: 160217 - DNA, 34 bp, Artificial Sequence
  Description of Artificial Sequence: Synthetic oligonucleotide
aagtttaacgacactttgcacctcactggagagc

SEQ ID NO: 160218 - DNA, 33 bp, Artificial Sequence
  Description of Artificial Sequence: Synthetic oligonucleotide
agtttaacgacactttgcacctcactggagagc

SEQ ID NO: 160219 - DNA, 32 bp, Artificial Sequence
  Description of Artificial Sequence: Synthetic oligonucleotide
gtttaacgacactttgcacctcactggagagc

SEQ ID NO: 160220 - DNA, 29 bp, Artificial Sequence
  Description of Artificial Sequence: Synthetic oligonucleotide
ctcactggagagcaccatgatggggtttc

SEQ ID NO: 160221 - DNA, 29 bp, Artificial Sequence
  Description of Artificial Sequence: Synthetic oligonucleotide
tcactggagagcaccatgatggggtttcc

SEQ ID NO: 160222 - DNA, 28 bp, Artificial Sequence
  Description of Artificial Sequence: Synthetic oligonucleotide
cactggagagcaccatgatggggtttcc

SEQ ID NO: 160223 - DNA, 30 bp, Artificial Sequence
  Description of Artificial Sequence: Synthetic oligonucleotide
actggagagcaccatgatggggtttccaag

SEQ ID NO: 160224 - DNA, 29 bp, Artificial Sequence
  Description of Artificial Sequence: Synthetic oligonucleotide
ctggagagcaccatgatggggtttccaag

SEQ ID NO: 160225 - DNA, 32 bp, Artificial Sequence
  Description of Artificial Sequence: Synthetic oligonucleotide
actgaaccaagctccaaaaccggtaacccaag

SEQ ID NO: 160226 - DNA, 31 bp, Artificial Sequence
  Description of Artificial Sequence: Synthetic oligonucleotide
ctgaaccaagctccaaaaccggtaacccaag

SEQ ID NO: 160227 - DNA, 32 bp, Artificial Sequence
  Description of Artificial Sequence: Synthetic oligonucleotide
tgaaccaagctccaaaaccggtaacccaagac

SEQ ID NO: 160228 - DNA, 31 bp, Artificial Sequence
  Description of Artificial Sequence: Synthetic oligonucleotide
gaaccaagctccaaaaccggtaacccaagac

SEQ ID NO: 160229 - DNA, 32 bp, Artificial Sequence
  Description of Artificial Sequence: Synthetic oligonucleotide
aaccaagctccaaaaccggtaacccaagacac

SEQ ID NO: 160230 - DNA, 31 bp, Artificial Sequence
  Description of Artificial Sequence: Synthetic oligonucleotide
accaagctccaaaaccggtaacccaagacac

SEQ ID NO: 160231 - DNA, 30 bp, Artificial Sequence
  Description of Artificial Sequence: Synthetic oligonucleotide
ccaagctccaaaaccggtaacccaagacac

SEQ ID NO: 160232 - DNA, 30 bp, Artificial Sequence
  Description of Artificial Sequence: Synthetic oligonucleotide
caagctccaaaaccggtaacccaagacacc

SEQ ID NO: 160233 - DNA, 31 bp, Artificial Sequence
  Description of Artificial Sequence: Synthetic oligonucleotide
aagctccaaaaccggtaacccaagacacctg

SEQ ID NO: 160234 - DNA, 30 bp, Artificial Sequence
  Description of Artificial Sequence: Synthetic oligonucleotide
agctccaaaaccggtaacccaagacacctg

SEQ ID NO: 160235 - DNA, 29 bp, Artificial Sequence
  Description of Artificial Sequence: Synthetic oligonucleotide
gctccaaaaccggtaacccaagacacctg

SEQ ID NO: 160236 - DNA, 29 bp, Artificial Sequence
  Description of Artificial Sequence: Synthetic oligonucleotide
ctccaaaaccggtaacccaagacacctgc

SEQ ID NO: 160237 - DNA, 30 bp, Artificial Sequence
  Description of Artificial Sequence: Synthetic oligonucleotide
tccaaaaccggtaacccaagacacctgcac

SEQ ID NO: 160238 - DNA, 29 bp, Artificial Sequence
  Description of Artificial Sequence: Synthetic oligonucleotide
ccaaaaccggtaacccaagacacctgcac

SEQ ID NO: 160239 - DNA, 29 bp, Artificial Sequence
  Description of Artificial Sequence: Synthetic oligonucleotide
caaaaccggtaacccaagacacctgcacg

SEQ ID NO: 160240 - DNA, 31 bp, Artificial Sequence
  Description of Artificial Sequence: Synthetic oligonucleotide
aaaaccggtaacccaagacacctgcacgttc

SEQ ID NO: 160241 - DNA, 28 bp, Artificial Sequence
  Description of Artificial Sequence: Synthetic oligonucleotide
cctgcagggaacagaacagcgaatagcg

SEQ ID NO: 160242 - DNA, 25 bp, Artificial Sequence
  Description of Artificial Sequence: Synthetic oligonucleotide
atgtcgctcacggtcgtcagcgtgg

SEQ ID NO: 160243 - DNA, 24 bp, Artificial Sequence
  Description of Artificial Sequence: Synthetic oligonucleotide
tgtcgctcacggtcgtcagcgtgg

SEQ ID NO: 160244 - DNA, 23 bp, Artificial Sequence
  Description of Artificial Sequence: Synthetic oligonucleotide
gtcgctcacggtcgtcagcgtgg

SEQ ID NO: 160245 - DNA, 23 bp, Artificial Sequence
  Description of Artificial Sequence: Synthetic oligonucleotide
tcgctcacggtcgtcagcgtggc

SEQ ID NO: 160246 - DNA, 22 bp, Artificial Sequence
  Description of Artificial Sequence: Synthetic oligonucleotide
cgctcacggtcgtcagcgtggc

SEQ ID NO: 160247 - DNA, 23 bp, Artificial Sequence
  Description of Artificial Sequence: Synthetic oligonucleotide
gctcacggtcgtcagcgtggcgt

SEQ ID NO: 160248 - DNA, 24 bp, Artificial Sequence
  Description of Artificial Sequence: Synthetic oligonucleotide
ctcacggtcgtcagcgtggcgtgt

SEQ ID NO: 160249 - DNA, 26 bp, Artificial Sequence
  Description of Artificial Sequence: Synthetic oligonucleotide
tcacggtcgtcagcgtggcgtgtgtt

SEQ ID NO: 160250 - DNA, 25 bp, Artificial Sequence
  Description of Artificial Sequence: Synthetic oligonucleotide
cacggtcgtcagcgtggcgtgtgtt

SEQ ID NO: 160251 - DNA, 25 bp, Artificial Sequence
  Description of Artificial Sequence: Synthetic oligonucleotide
acggtcgtcagcgtggcgtgtgttg

SEQ ID NO: 160252 - DNA, 24 bp, Artificial Sequence
  Description of Artificial Sequence: Synthetic oligonucleotide
cggtcgtcagcgtggcgtgtgttg

SEQ ID NO: 160253 - DNA, 24 bp, Artificial Sequence
  Description of Artificial Sequence: Synthetic oligonucleotide
ggtcgtcagcgtggcgtgtgttgg

SEQ ID NO: 160254 - DNA, 26 bp, Artificial Sequence
  Description of Artificial Sequence: Synthetic oligonucleotide
gtcgtcagcgtggcgtgtgttgggtt

SEQ ID NO: 160255 - DNA, 27 bp, Artificial Sequence
  Description of Artificial Sequence: Synthetic oligonucleotide
tcgtcagcgtggcgtgtgttgggttct

SEQ ID NO: 160256 - DNA, 27 bp, Artificial Sequence
  Description of Artificial Sequence: Synthetic oligonucleotide
cgtcagcgtggcgtgtgttgggttctt

SEQ ID NO: 160257 - DNA, 27 bp, Artificial Sequence
  Description of Artificial Sequence: Synthetic oligonucleotide
gtcagcgtggcgtgtgttgggttcttc

SEQ ID NO: 160258 - DNA, 29 bp, Artificial Sequence
  Description of Artificial Sequence: Synthetic oligonucleotide
tcagcgtggcgtgtgttgggttcttcttg

SEQ ID NO: 160259 - DNA, 28 bp, Artificial Sequence
  Description of Artificial Sequence: Synthetic oligonucleotide
cagcgtggcgtgtgttgggttcttcttg

SEQ ID NO: 160260 - DNA, 28 bp, Artificial Sequence
  Description of Artificial Sequence: Synthetic oligonucleotide
agcgtggcgtgtgttgggttcttcttgc

SEQ ID NO: 160261 - DNA, 27 bp, Artificial Sequence
  Description of Artificial Sequence: Synthetic oligonucleotide
gcgtggcgtgtgttgggttcttcttgc

SEQ ID NO: 160262 - DNA, 28 bp, Artificial Sequence
  Description of Artificial Sequence: Synthetic oligonucleotide
cgtggcgtgtgttgggttcttcttgctg

SEQ ID NO: 160263 - DNA, 28 bp, Artificial Sequence
  Description of Artificial Sequence: Synthetic oligonucleotide
gtggcgtgtgttgggttcttcttgctgc

SEQ ID NO: 160264 - DNA, 35 bp, Artificial Sequence
  Description of Artificial Sequence: Synthetic oligonucleotide
ctggcactgagctctacaacagaatattctggaac

SEQ ID NO: 160265 - DNA, 36 bp, Artificial Sequence
  Description of Artificial Sequence: Synthetic oligonucleotide
tggcactgagctctacaacagaatattctggaacag

SEQ ID NO: 160266 - DNA, 35 bp, Artificial Sequence
  Description of Artificial Sequence: Synthetic oligonucleotide
ggcactgagctctacaacagaatattctggaacag

SEQ ID NO: 160267 - DNA, 35 bp, Artificial Sequence
  Description of Artificial Sequence: Synthetic oligonucleotide
gcactgagctctacaacagaatattctggaacagc

SEQ ID NO: 160268 - DNA, 35 bp, Artificial Sequence
  Description of Artificial Sequence: Synthetic oligonucleotide
cactgagctctacaacagaatattctggaacagcc

SEQ ID NO: 160269 - DNA, 39 bp, Artificial Sequence
  Description of Artificial Sequence: Synthetic oligonucleotide
actgagctctacaacagaatattctggaacagccttttc

SEQ ID NO: 160270 - DNA, 38 bp, Artificial Sequence
  Description of Artificial Sequence: Synthetic oligonucleotide
ctgagctctacaacagaatattctggaacagccttttc

SEQ ID NO: 160271 - DNA, 40 bp, Artificial Sequence
  Description of Artificial Sequence: Synthetic oligonucleotide
tgagctctacaacagaatattctggaacagccttttcatg

SEQ ID NO: 160272 - DNA, 39 bp, Artificial Sequence
  Description of Artificial Sequence: Synthetic oligonucleotide
gagctctacaacagaatattctggaacagccttttcatg

SEQ ID NO: 160273 - DNA, 39 bp, Artificial Sequence
  Description of Artificial Sequence: Synthetic oligonucleotide
agctctacaacagaatattctggaacagccttttcatgg

SEQ ID NO: 160274 - DNA, 38 bp, Artificial Sequence
  Description of Artificial Sequence: Synthetic oligonucleotide
gctctacaacagaatattctggaacagccttttcatgg

SEQ ID NO: 160275 - DNA, 38 bp, Artificial Sequence
  Description of Artificial Sequence: Synthetic oligonucleotide
ctctacaacagaatattctggaacagccttttcatggg

SEQ ID NO: 160276 - DNA, 38 bp, Artificial Sequence
  Description of Artificial Sequence: Synthetic oligonucleotide
tctacaacagaatattctggaacagccttttcatgggc

SEQ ID NO: 160277 - DNA, 37 bp, Artificial Sequence
  Description of Artificial Sequence: Synthetic oligonucleotide
ctacaacagaatattctggaacagccttttcatgggc

SEQ ID NO: 160278 - DNA, 37 bp, Artificial Sequence
  Description of Artificial Sequence: Synthetic oligonucleotide
tacaacagaatattctggaacagccttttcatgggcc

SEQ ID NO: 160279 - DNA, 36 bp, Artificial Sequence
  Description of Artificial Sequence: Synthetic oligonucleotide
acaacagaatattctggaacagccttttcatgggcc

SEQ ID NO: 160280 - DNA, 35 bp, Artificial Sequence
  Description of Artificial Sequence: Synthetic oligonucleotide
caacagaatattctggaacagccttttcatgggcc

SEQ ID NO: 160281 - DNA, 35 bp, Artificial Sequence
  Description of Artificial Sequence: Synthetic oligonucleotide
aacagaatattctggaacagccttttcatgggccc

SEQ ID NO: 160282 - DNA, 34 bp, Artificial Sequence
  Description of Artificial Sequence: Synthetic oligonucleotide
acagaatattctggaacagccttttcatgggccc

SEQ ID NO: 160283 - DNA, 33 bp, Artificial Sequence
  Description of Artificial Sequence: Synthetic oligonucleotide
cagaatattctggaacagccttttcatgggccc

SEQ ID NO: 160284 - DNA, 34 bp, Artificial Sequence
  Description of Artificial Sequence: Synthetic oligonucleotide
agaatattctggaacagccttttcatgggccctg

SEQ ID NO: 160285 - DNA, 33 bp, Artificial Sequence
  Description of Artificial Sequence: Synthetic oligonucleotide
gaatattctggaacagccttttcatgggccctg

SEQ ID NO: 160286 - DNA, 34 bp, Artificial Sequence
  Description of Artificial Sequence: Synthetic oligonucleotide
aatattctggaacagccttttcatgggccctgtg

SEQ ID NO: 160287 - DNA, 33 bp, Artificial Sequence
  Description of Artificial Sequence: Synthetic oligonucleotide
atattctggaacagccttttcatgggccctgtg

SEQ ID NO: 160288 - DNA, 32 bp, Artificial Sequence
  Description of Artificial Sequence: Synthetic oligonucleotide
tattctggaacagccttttcatgggccctgtg

SEQ ID NO: 160289 - DNA, 31 bp, Artificial Sequence
  Description of Artificial Sequence: Synthetic oligonucleotide
attctggaacagccttttcatgggccctgtg

SEQ ID NO: 160290 - DNA, 30 bp, Artificial Sequence
  Description of Artificial Sequence: Synthetic oligonucleotide
ttctggaacagccttttcatgggccctgtg

SEQ ID NO: 160291 - DNA, 29 bp, Artificial Sequence
  Description of Artificial Sequence: Synthetic oligonucleotide
tctggaacagccttttcatgggccctgtg

SEQ ID NO: 160292 - DNA, 28 bp, Artificial Sequence
  Description of Artificial Sequence: Synthetic oligonucleotide
ctggaacagccttttcatgggccctgtg

SEQ ID NO: 160293 - DNA, 29 bp, Artificial Sequence
  Description of Artificial Sequence: Synthetic oligonucleotide
tggaacagccttttcatgggccctgtgac

SEQ ID NO: 160294 - DNA, 28 bp, Artificial Sequence
  Description of Artificial Sequence: Synthetic oligonucleotide
ggaacagccttttcatgggccctgtgac

SEQ ID NO: 160295 - DNA, 28 bp, Artificial Sequence
  Description of Artificial Sequence: Synthetic oligonucleotide
gaacagccttttcatgggccctgtgacc

SEQ ID NO: 160296 - DNA, 28 bp, Artificial Sequence
  Description of Artificial Sequence: Synthetic oligonucleotide
aacagccttttcatgggccctgtgaccc

SEQ ID NO: 160297 - DNA, 27 bp, Artificial Sequence
  Description of Artificial Sequence: Synthetic oligonucleotide
acagccttttcatgggccctgtgaccc

SEQ ID NO: 160298 - DNA, 26 bp, Artificial Sequence
  Description of Artificial Sequence: Synthetic oligonucleotide
cagccttttcatgggccctgtgaccc

SEQ ID NO: 160299 - DNA, 27 bp, Artificial Sequence
  Description of Artificial Sequence: Synthetic oligonucleotide
ggttctctgcagggcccaaggtcaaca

SEQ ID NO: 160300 - DNA, 27 bp, Artificial Sequence
  Description of Artificial Sequence: Synthetic oligonucleotide
gttctctgcagggcccaaggtcaacag

SEQ ID NO: 160301 - DNA, 29 bp, Artificial Sequence
  Description of Artificial Sequence: Synthetic oligonucleotide
ttctctgcagggcccaaggtcaacagaac

SEQ ID NO: 160302 - DNA, 28 bp, Artificial Sequence
  Description of Artificial Sequence: Synthetic oligonucleotide
tctctgcagggcccaaggtcaacagaac

SEQ ID NO: 160303 - DNA, 27 bp, Artificial Sequence
  Description of Artificial Sequence: Synthetic oligonucleotide
ctctgcagggcccaaggtcaacagaac

SEQ ID NO: 160304 - DNA, 30 bp, Artificial Sequence
  Description of Artificial Sequence: Synthetic oligonucleotide
tctgcagggcccaaggtcaacagaacattc

SEQ ID NO: 160305 - DNA, 29 bp, Artificial Sequence
  Description of Artificial Sequence: Synthetic oligonucleotide
ctgcagggcccaaggtcaacagaacattc

SEQ ID NO: 160306 - DNA, 29 bp, Artificial Sequence
  Description of Artificial Sequence: Synthetic oligonucleotide
tgcagggcccaaggtcaacagaacattcc

SEQ ID NO: 160307 - DNA, 28 bp, Artificial Sequence
  Description of Artificial Sequence: Synthetic oligonucleotide
gcagggcccaaggtcaacagaacattcc

SEQ ID NO: 160308 - DNA, 29 bp, Artificial Sequence
  Description of Artificial Sequence: Synthetic oligonucleotide
cagggcccaaggtcaacagaacattccag

SEQ ID NO: 160309 - DNA, 29 bp, Artificial Sequence
  Description of Artificial Sequence: Synthetic oligonucleotide
agggcccaaggtcaacagaacattccagg

SEQ ID NO: 160310 - DNA, 28 bp, Artificial Sequence
  Description of Artificial Sequence: Synthetic oligonucleotide
gggcccaaggtcaacagaacattccagg

SEQ ID NO: 160311 - DNA, 28 bp, Artificial Sequence
  Description of Artificial Sequence: Synthetic oligonucleotide
ggcccaaggtcaacagaacattccaggc

SEQ ID NO: 160312 - DNA, 29 bp, Artificial Sequence
  Description of Artificial Sequence: Synthetic oligonucleotide
gcccaaggtcaacagaacattccaggctg

SEQ ID NO: 160313 - DNA, 30 bp, Artificial Sequence
  Description of Artificial Sequence: Synthetic oligonucleotide
cccaaggtcaacagaacattccaggctgac

SEQ ID NO: 160314 - DNA, 33 bp, Artificial Sequence
  Description of Artificial Sequence: Synthetic oligonucleotide
ccaaggtcaacagaacattccaggctgactttc

SEQ ID NO: 160315 - DNA, 33 bp, Artificial Sequence
  Description of Artificial Sequence: Synthetic oligonucleotide
caaggtcaacagaacattccaggctgactttcc

SEQ ID NO: 160316 - DNA, 34 bp, Artificial Sequence
  Description of Artificial Sequence: Synthetic oligonucleotide
aaggtcaacagaacattccaggctgactttcctc

SEQ ID NO: 160317 - DNA, 33 bp, Artificial Sequence
  Description of Artificial Sequence: Synthetic oligonucleotide
aggtcaacagaacattccaggctgactttcctc

SEQ ID NO: 160318 - DNA, 32 bp, Artificial Sequence
  Description of Artificial Sequence: Synthetic oligonucleotide
ggtcaacagaacattccaggctgactttcctc

SEQ ID NO: 160319 - DNA, 33 bp, Artificial Sequence
  Description of Artificial Sequence: Synthetic oligonucleotide
gtcaacagaacattccaggctgactttcctctg

SEQ ID NO: 160320 - DNA, 33 bp, Artificial Sequence
  Description of Artificial Sequence: Synthetic oligonucleotide
tcaacagaacattccaggctgactttcctctgg

SEQ ID NO: 160321 - DNA, 32 bp, Artificial Sequence
  Description of Artificial Sequence: Synthetic oligonucleotide
caacagaacattccaggctgactttcctctgg

SEQ ID NO: 160322 - DNA, 32 bp, Artificial Sequence
  Description of Artificial Sequence: Synthetic oligonucleotide
aacagaacattccaggctgactttcctctggg

SEQ ID NO: 160323 - DNA, 31 bp, Artificial Sequence
  Description of Artificial Sequence: Synthetic oligonucleotide
acagaacattccaggctgactttcctctggg

SEQ ID NO: 160324 - DNA, 30 bp, Artificial Sequence
  Description of Artificial Sequence: Synthetic oligonucleotide
cagaacattccaggctgactttcctctggg

SEQ ID NO: 160325 - DNA, 30 bp, Artificial Sequence
  Description of Artificial Sequence: Synthetic oligonucleotide
agaacattccaggctgactttcctctgggc

SEQ ID NO: 160326 - DNA, 30 bp, Artificial Sequence
  Description of Artificial Sequence: Synthetic oligonucleotide
acccactgaaccaagctccaaaaccggtag

SEQ ID NO: 160327 - DNA, 29 bp, Artificial Sequence
  Description of Artificial Sequence: Synthetic oligonucleotide
cccactgaaccaagctccaaaaccggtag

SEQ ID NO: 160328 - DNA, 29 bp, Artificial Sequence
  Description of Artificial Sequence: Synthetic oligonucleotide
ccactgaaccaagctccaaaaccggtagc

SEQ ID NO: 160329 - DNA, 29 bp, Artificial Sequence
  Description of Artificial Sequence: Synthetic oligonucleotide
cactgaaccaagctccaaaaccggtagcc

SEQ ID NO: 160330 - DNA, 29 bp, Artificial Sequence
  Description of Artificial Sequence: Synthetic oligonucleotide
actgaaccaagctccaaaaccggtagccc

SEQ ID NO: 160331 - DNA, 28 bp, Artificial Sequence
  Description of Artificial Sequence: Synthetic oligonucleotide
ctgaaccaagctccaaaaccggtagccc

SEQ ID NO: 160332 - DNA, 30 bp, Artificial Sequence
  Description of Artificial Sequence: Synthetic oligonucleotide
tgaaccaagctccaaaaccggtagcccaag

SEQ ID NO: 160333 - DNA, 29 bp, Artificial Sequence
  Description of Artificial Sequence: Synthetic oligonucleotide
gaaccaagctccaaaaccggtagcccaag

SEQ ID NO: 160334 - DNA, 30 bp, Artificial Sequence
  Description of Artificial Sequence: Synthetic oligonucleotide
aaccaagctccaaaaccggtagcccaagac

SEQ ID NO: 160335 - DNA, 29 bp, Artificial Sequence
  Description of Artificial Sequence: Synthetic oligonucleotide
accaagctccaaaaccggtagcccaagac

SEQ ID NO: 160336 - DNA, 28 bp, Artificial Sequence
  Description of Artificial Sequence: Synthetic oligonucleotide
ccaagctccaaaaccggtagcccaagac

SEQ ID NO: 160337 - DNA, 29 bp, Artificial Sequence
  Description of Artificial Sequence: Synthetic oligonucleotide
caagctccaaaaccggtagcccaagacac

SEQ ID NO: 160338 - DNA, 29 bp, Artificial Sequence
  Description of Artificial Sequence: Synthetic oligonucleotide
aagctccaaaaccggtagcccaagacacc

SEQ ID NO: 160339 - DNA, 28 bp, Artificial Sequence
  Description of Artificial Sequence: Synthetic oligonucleotide
agctccaaaaccggtagcccaagacacc

SEQ ID NO: 160340 - DNA, 27 bp, Artificial Sequence
  Description of Artificial Sequence: Synthetic oligonucleotide
gctccaaaaccggtagcccaagacacc

SEQ ID NO: 160341 - DNA, 28 bp, Artificial Sequence
  Description of Artificial Sequence: Synthetic oligonucleotide
ctccaaaaccggtagcccaagacacctg

SEQ ID NO: 160342 - DNA, 28 bp, Artificial Sequence
  Description of Artificial Sequence: Synthetic oligonucleotide
tccaaaaccggtagcccaagacacctgc

SEQ ID NO: 160343 - DNA, 27 bp, Artificial Sequence
  Description of Artificial Sequence: Synthetic oligonucleotide
ccaaaaccggtagcccaagacacctgc

SEQ ID NO: 160344 - DNA, 28 bp, Artificial Sequence
  Description of Artificial Sequence: Synthetic oligonucleotide
caaaaccggtagcccaagacacctgcac

SEQ ID NO: 160345 - DNA, 28 bp, Artificial Sequence
  Description of Artificial Sequence: Synthetic oligonucleotide
aaaaccggtagcccaagacacctgcacg

SEQ ID NO: 160346 - DNA, 27 bp, Artificial Sequence
  Description of Artificial Sequence: Synthetic oligonucleotide
aaaccggtagcccaagacacctgcacg

SEQ ID NO: 160347 - DNA, 27 bp, Artificial Sequence
  Description of Artificial Sequence: Synthetic oligonucleotide
aaccggtagcccaagacacctgcacgt

SEQ ID NO: 160348 - DNA, 27 bp, Artificial Sequence
  Description of Artificial Sequence: Synthetic oligonucleotide
accggtagcccaagacacctgcacgtt

SEQ ID NO: 160349 - DNA, 26 bp, Artificial Sequence
  Description of Artificial Sequence: Synthetic oligonucleotide
ccggtagcccaagacacctgcacgtt

SEQ ID NO: 160350 - DNA, 27 bp, Artificial Sequence
  Description of Artificial Sequence: Synthetic oligonucleotide
cggtagcccaagacacctgcacgttct

SEQ ID NO: 160351 - DNA, 27 bp, Artificial Sequence
  Description of Artificial Sequence: Synthetic oligonucleotide
ggtagcccaagacacctgcacgttctg

SEQ ID NO: 160352 - DNA, 30 bp, Artificial Sequence
  Description of Artificial Sequence: Synthetic oligonucleotide
gtagcccaagacacctgcacgttctgattg

SEQ ID NO: 160353 - DNA, 30 bp, Artificial Sequence
  Description of Artificial Sequence: Synthetic oligonucleotide
tagcccaagacacctgcacgttctgattgg

SEQ ID NO: 160354 - DNA, 29 bp, Artificial Sequence
  Description of Artificial Sequence: Synthetic oligonucleotide
agcccaagacacctgcacgttctgattgg

SEQ ID NO: 160355 - DNA, 28 bp, Artificial Sequence
  Description of Artificial Sequence: Synthetic oligonucleotide
gcccaagacacctgcacgttctgattgg

SEQ ID NO: 160356 - DNA, 27 bp, Artificial Sequence
  Description of Artificial Sequence: Synthetic oligonucleotide
gagggggaggcccatgaacgtaggttt

SEQ ID NO: 160357 - DNA, 28 bp, Artificial Sequence
  Description of Artificial Sequence: Synthetic oligonucleotide
agggggaggcccatgaacgtaggttttc

SEQ ID NO: 160358 - DNA, 27 bp, Artificial Sequence
  Description of Artificial Sequence: Synthetic oligonucleotide
gggggaggcccatgaacgtaggttttc

SEQ ID NO: 160359 - DNA, 28 bp, Artificial Sequence
  Description of Artificial Sequence: Synthetic oligonucleotide
ggggaggcccatgaacgtaggttttctg

SEQ ID NO: 160360 - DNA, 28 bp, Artificial Sequence
  Description of Artificial Sequence: Synthetic oligonucleotide
gggaggcccatgaacgtaggttttctgc

SEQ ID NO: 160361 - DNA, 29 bp, Artificial Sequence
  Description of Artificial Sequence: Synthetic oligonucleotide
ggaggcccatgaacgtaggttttctgcag

SEQ ID NO: 160362 - DNA, 29 bp, Artificial Sequence
  Description of Artificial Sequence: Synthetic oligonucleotide
gaggcccatgaacgtaggttttctgcagg

SEQ ID NO: 160363 - DNA, 29 bp, Artificial Sequence
  Description of Artificial Sequence: Synthetic oligonucleotide
aggcccatgaacgtaggttttctgcaggg

SEQ ID NO: 160364 - DNA, 28 bp, Artificial Sequence
  Description of Artificial Sequence: Synthetic oligonucleotide
ggcccatgaacgtaggttttctgcaggg

SEQ ID NO: 160365 - DNA, 28 bp, Artificial Sequence
  Description of Artificial Sequence: Synthetic oligonucleotide
gcccatgaacgtaggttttctgcagggc

SEQ ID NO: 160366 - DNA, 28 bp, Artificial Sequence
  Description of Artificial Sequence: Synthetic oligonucleotide
cccatgaacgtaggttttctgcagggcc

SEQ ID NO: 160367 - DNA, 28 bp, Artificial Sequence
  Description of Artificial Sequence: Synthetic oligonucleotide
ccatgaacgtaggttttctgcagggccc

SEQ ID NO: 160368 - DNA, 30 bp, Artificial Sequence
  Description of Artificial Sequence: Synthetic oligonucleotide
catgaacgtaggttttctgcagggcccaag

SEQ ID NO: 160369 - DNA, 30 bp, Artificial Sequence
  Description of Artificial Sequence: Synthetic oligonucleotide
atgaacgtaggttttctgcagggcccaagg

SEQ ID NO: 160370 - DNA, 29 bp, Artificial Sequence
  Description of Artificial Sequence: Synthetic oligonucleotide
tgaacgtaggttttctgcagggcccaagg

SEQ ID NO: 160371 - DNA, 28 bp, Artificial Sequence
  Description of Artificial Sequence: Synthetic oligonucleotide
gaacgtaggttttctgcagggcccaagg

SEQ ID NO: 160372 - DNA, 29 bp, Artificial Sequence
  Description of Artificial Sequence: Synthetic oligonucleotide
aacgtaggttttctgcagggcccaaggtc

SEQ ID NO: 160373 - DNA, 28 bp, Artificial Sequence
  Description of Artificial Sequence: Synthetic oligonucleotide
acgtaggttttctgcagggcccaaggtc

SEQ ID NO: 160374 - DNA, 27 bp, Artificial Sequence
  Description of Artificial Sequence: Synthetic oligonucleotide
cgtaggttttctgcagggcccaaggtc

SEQ ID NO: 160375 - DNA, 29 bp, Artificial Sequence
  Description of Artificial Sequence: Synthetic oligonucleotide
gtaggttttctgcagggcccaaggtcaac

SEQ ID NO: 160376 - DNA, 29 bp, Artificial Sequence
  Description of Artificial Sequence: Synthetic oligonucleotide
taggttttctgcagggcccaaggtcaacg

SEQ ID NO: 160377 - DNA, 28 bp, Artificial Sequence
  Description of Artificial Sequence: Synthetic oligonucleotide
aggttttctgcagggcccaaggtcaacg

SEQ ID NO: 160378 - DNA, 27 bp, Artificial Sequence
  Description of Artificial Sequence: Synthetic oligonucleotide
ggttttctgcagggcccaaggtcaacg

SEQ ID NO: 160379 - DNA, 27 bp, Artificial Sequence
  Description of Artificial Sequence: Synthetic oligonucleotide
gttttctgcagggcccaaggtcaacgg

SEQ ID NO: 160380 - DNA, 29 bp, Artificial Sequence
  Description of Artificial Sequence: Synthetic oligonucleotide
ttttctgcagggcccaaggtcaacggaac

SEQ ID NO: 160381 - DNA, 28 bp, Artificial Sequence
  Description of Artificial Sequence: Synthetic oligonucleotide
tttctgcagggcccaaggtcaacggaac

SEQ ID NO: 160382 - DNA, 27 bp, Artificial Sequence
  Description of Artificial Sequence: Synthetic oligonucleotide
ttctgcagggcccaaggtcaacggaac

SEQ ID NO: 160383 - DNA, 29 bp, Artificial Sequence
  Description of Artificial Sequence: Synthetic oligonucleotide
cttcggctctttccgtgactctccctatg

SEQ ID NO: 160384 - DNA, 30 bp, Artificial Sequence
  Description of Artificial Sequence: Synthetic oligonucleotide
ttcggctctttccgtgactctccctatgag

SEQ ID NO: 160385 - DNA, 29 bp, Artificial Sequence
  Description of Artificial Sequence: Synthetic oligonucleotide
tcggctctttccgtgactctccctatgag

SEQ ID NO: 160386 - DNA, 28 bp, Artificial Sequence
  Description of Artificial Sequence: Synthetic oligonucleotide
cggctctttccgtgactctccctatgag

SEQ ID NO: 160387 - DNA, 29 bp, Artificial Sequence
  Description of Artificial Sequence: Synthetic oligonucleotide
ggctctttccgtgactctccctatgagtg

SEQ ID NO: 160388 - DNA, 29 bp, Artificial Sequence
  Description of Artificial Sequence: Synthetic oligonucleotide
gctctttccgtgactctccctatgagtgg

SEQ ID NO: 160389 - DNA, 30 bp, Artificial Sequence
  Description of Artificial Sequence: Synthetic oligonucleotide
ctctttccgtgactctccctatgagtggtc

SEQ ID NO: 160390 - DNA, 33 bp, Artificial Sequence
  Description of Artificial Sequence: Synthetic oligonucleotide
tctttccgtgactctccctatgagtggtcaaac

SEQ ID NO: 160391 - DNA, 32 bp, Artificial Sequence
  Description of Artificial Sequence: Synthetic oligonucleotide
ctttccgtgactctccctatgagtggtcaaac

SEQ ID NO: 160392 - DNA, 33 bp, Artificial Sequence
  Description of Artificial Sequence: Synthetic oligonucleotide
tttccgtgactctccctatgagtggtcaaactc

SEQ ID NO: 160393 - DNA, 32 bp, Artificial Sequence
  Description of Artificial Sequence: Synthetic oligonucleotide
ttccgtgactctccctatgagtggtcaaactc

SEQ ID NO: 160394 - DNA, 31 bp, Artificial Sequence
  Description of Artificial Sequence: Synthetic oligonucleotide
tccgtgactctccctatgagtggtcaaactc

SEQ ID NO: 160395 - DNA, 30 bp, Artificial Sequence
  Description of Artificial Sequence: Synthetic oligonucleotide
ccgtgactctccctatgagtggtcaaactc

SEQ ID NO: 160396 - DNA, 30 bp, Artificial Sequence
  Description of Artificial Sequence: Synthetic oligonucleotide
cgtgactctccctatgagtggtcaaactcg

SEQ ID NO: 160397 - DNA, 31 bp, Artificial Sequence
  Description of Artificial Sequence: Synthetic oligonucleotide
gtgactctccctatgagtggtcaaactcgag

SEQ ID NO: 160398 - DNA, 32 bp, Artificial Sequence
  Description of Artificial Sequence: Synthetic oligonucleotide
tgactctccctatgagtggtcaaactcgagtg

SEQ ID NO: 160399 - DNA, 31 bp, Artificial Sequence
  Description of Artificial Sequence: Synthetic oligonucleotide
gactctccctatgagtggtcaaactcgagtg

SEQ ID NO: 160400 - DNA, 32 bp, Artificial Sequence
  Description of Artificial Sequence: Synthetic oligonucleotide
actctccctatgagtggtcaaactcgagtgac

SEQ ID NO: 160401 - DNA, 31 bp, Artificial Sequence
  Description of Artificial Sequence: Synthetic oligonucleotide
ctctccctatgagtggtcaaactcgagtgac

SEQ ID NO: 160402 - DNA, 31 bp, Artificial Sequence
  Description of Artificial Sequence: Synthetic oligonucleotide
tctccctatgagtggtcaaactcgagtgacc

SEQ ID NO: 160403 - DNA, 30 bp, Artificial Sequence
  Description of Artificial Sequence: Synthetic oligonucleotide
ctccctatgagtggtcaaactcgagtgacc

SEQ ID NO: 160404 - DNA, 30 bp, Artificial Sequence
  Description of Artificial Sequence: Synthetic oligonucleotide
tccctatgagtggtcaaactcgagtgaccc

SEQ ID NO: 160405 - DNA, 29 bp, Artificial Sequence
  Description of Artificial Sequence: Synthetic oligonucleotide
ccctatgagtggtcaaactcgagtgaccc

SEQ ID NO: 160406 - DNA, 30 bp, Artificial Sequence
  Description of Artificial Sequence: Synthetic oligonucleotide
cctatgagtggtcaaactcgagtgacccac

SEQ ID NO: 160407 - DNA, 31 bp, Artificial Sequence
  Description of Artificial Sequence: Synthetic oligonucleotide
ctatgagtggtcaaactcgagtgacccactg

SEQ ID NO: 160408 - DNA, 31 bp, Artificial Sequence
  Description of Artificial Sequence: Synthetic oligonucleotide
tatgagtggtcaaactcgagtgacccactgc

SEQ ID NO: 160409 - DNA, 30 bp, Artificial Sequence
  Description of Artificial Sequence: Synthetic oligonucleotide
atgagtggtcaaactcgagtgacccactgc

SEQ ID NO: 160410 - DNA, 29 bp, Artificial Sequence
  Description of Artificial Sequence: Synthetic oligonucleotide
tgagtggtcaaactcgagtgacccactgc

SEQ ID NO: 160411 - DNA, 31 bp, Artificial Sequence
  Description of Artificial Sequence: Synthetic oligonucleotide
tcagtggtcatcatcctcttcatcctcctcg

SEQ ID NO: 160412 - DNA, 30 bp, Artificial Sequence
  Description of Artificial Sequence: Synthetic oligonucleotide
cagtggtcatcatcctcttcatcctcctcg

SEQ ID NO: 160413 - DNA, 31 bp, Artificial Sequence
  Description of Artificial Sequence: Synthetic oligonucleotide
agtggtcatcatcctcttcatcctcctcgtc

SEQ ID NO: 160414 - DNA, 30 bp, Artificial Sequence
  Description of Artificial Sequence: Synthetic oligonucleotide
gtggtcatcatcctcttcatcctcctcgtc

SEQ ID NO: 160415 - DNA, 32 bp, Artificial Sequence
  Description of Artificial Sequence: Synthetic oligonucleotide
tggtcatcatcctcttcatcctcctcgtcttc

SEQ ID NO: 160416 - DNA, 31 bp, Artificial Sequence
  Description of Artificial Sequence: Synthetic oligonucleotide
ggtcatcatcctcttcatcctcctcgtcttc

SEQ ID NO: 160417 - DNA, 34 bp, Artificial Sequence
  Description of Artificial Sequence: Synthetic oligonucleotide
gtcatcatcctcttcatcctcctcgtcttctttc

SEQ ID NO: 160418 - DNA, 35 bp, Artificial Sequence
  Description of Artificial Sequence: Synthetic oligonucleotide
tcatcatcctcttcatcctcctcgtcttctttctc

SEQ ID NO: 160419 - DNA, 34 bp, Artificial Sequence
  Description of Artificial Sequence: Synthetic oligonucleotide
catcatcctcttcatcctcctcgtcttctttctc

SEQ ID NO: 160420 - DNA, 34 bp, Artificial Sequence
  Description of Artificial Sequence: Synthetic oligonucleotide
atcatcctcttcatcctcctcgtcttctttctcc

SEQ ID NO: 160421 - DNA, 33 bp, Artificial Sequence
  Description of Artificial Sequence: Synthetic oligonucleotide
tcatcctcttcatcctcctcgtcttctttctcc

SEQ ID NO: 160422 - DNA, 32 bp, Artificial Sequence
  Description of Artificial Sequence: Synthetic oligonucleotide
catcctcttcatcctcctcgtcttctttctcc

SEQ ID NO: 160423 - DNA, 34 bp, Artificial Sequence
  Description of Artificial Sequence: Synthetic oligonucleotide
atcctcttcatcctcctcgtcttctttctccttc

SEQ ID NO: 160424 - DNA, 33 bp, Artificial Sequence
  Description of Artificial Sequence: Synthetic oligonucleotide
tcctcttcatcctcctcgtcttctttctccttc

SEQ ID NO: 160425 - DNA, 32 bp, Artificial Sequence
  Description of Artificial Sequence: Synthetic oligonucleotide
cctcttcatcctcctcgtcttctttctccttc

SEQ ID NO: 160426 - DNA, 34 bp, Artificial Sequence
  Description of Artificial Sequence: Synthetic oligonucleotide
ctcttcatcctcctcgtcttctttctccttcatc

SEQ ID NO: 160427 - DNA, 34 bp, Artificial Sequence
  Description of Artificial Sequence: Synthetic oligonucleotide
tcttcatcctcctcgtcttctttctccttcatcg

SEQ ID NO: 160428 - DNA, 33 bp, Artificial Sequence
  Description of Artificial Sequence: Synthetic oligonucleotide
cttcatcctcctcgtcttctttctccttcatcg

SEQ ID NO: 160429 - DNA, 33 bp, Artificial Sequence
  Description of Artificial Sequence: Synthetic oligonucleotide
ttcatcctcctcgtcttctttctccttcatcgc

SEQ ID NO: 160430 - DNA, 32 bp, Artificial Sequence
  Description of Artificial Sequence: Synthetic oligonucleotide
tcatcctcctcgtcttctttctccttcatcgc

SEQ ID NO: 160431 - DNA, 31 bp, Artificial Sequence
  Description of Artificial Sequence: Synthetic oligonucleotide
catcctcctcgtcttctttctccttcatcgc

SEQ ID NO: 160432 - DNA, 32 bp, Artificial Sequence
  Description of Artificial Sequence: Synthetic oligonucleotide
atcctcctcgtcttctttctccttcatcgctg

SEQ ID NO: 160433 - DNA, 31 bp, Artificial Sequence
  Description of Artificial Sequence: Synthetic oligonucleotide
tcctcctcgtcttctttctccttcatcgctg

SEQ ID NO: 160434 - DNA, 30 bp, Artificial Sequence
  Description of Artificial Sequence: Synthetic oligonucleotide
cctcctcgtcttctttctccttcatcgctg

SEQ ID NO: 160435 - DNA, 30 bp, Artificial Sequence
  Description of Artificial Sequence: Synthetic oligonucleotide
ctcctcgtcttctttctccttcatcgctgg

SEQ ID NO: 160436 - DNA, 31 bp, Artificial Sequence
  Description of Artificial Sequence: Synthetic oligonucleotide
tcctcgtcttctttctccttcatcgctggtg

SEQ ID NO: 160437 - DNA, 30 bp, Artificial Sequence
  Description of Artificial Sequence: Synthetic oligonucleotide
cctcgtcttctttctccttcatcgctggtg

SEQ ID NO: 160438 - DNA, 30 bp, Artificial Sequence
  Description of Artificial Sequence: Synthetic oligonucleotide
ctcgtcttctttctccttcatcgctggtgc

SEQ ID NO: 160439 - DNA, 31 bp, Artificial Sequence
  Description of Artificial Sequence: Synthetic oligonucleotide
tcgtcttctttctccttcatcgctggtgctc

SEQ ID NO: 160440 - DNA, 30 bp, Artificial Sequence
  Description of Artificial Sequence: Synthetic oligonucleotide
cgtcttctttctccttcatcgctggtgctc

SEQ ID NO: 160441 - DNA, 30 bp, Artificial Sequence
  Description of Artificial Sequence: Synthetic oligonucleotide
gtcttctttctccttcatcgctggtgctcc

SEQ ID NO: 160442 - DNA, 32 bp, Artificial Sequence
  Description of Artificial Sequence: Synthetic oligonucleotide
cctctggacatcgtcatcacaggtctatatgg

SEQ ID NO: 160443 - DNA, 32 bp, Artificial Sequence
  Description of Artificial Sequence: Synthetic oligonucleotide
ctctggacatcgtcatcacaggtctatatggg

SEQ ID NO: 160444 - DNA, 35 bp, Artificial Sequence
  Description of Artificial Sequence: Synthetic oligonucleotide
tctggacatcgtcatcacaggtctatatgggaaac

SEQ ID NO: 160445 - DNA, 34 bp, Artificial Sequence
  Description of Artificial Sequence: Synthetic oligonucleotide
ctggacatcgtcatcacaggtctatatgggaaac

SEQ ID NO: 160446 - DNA, 34 bp, Artificial Sequence
  Description of Artificial Sequence: Synthetic oligonucleotide
tggacatcgtcatcacaggtctatatgggaaacc

SEQ ID NO: 160447 - DNA, 33 bp, Artificial Sequence
  Description of Artificial Sequence: Synthetic oligonucleotide
ggacatcgtcatcacaggtctatatgggaaacc

SEQ ID NO: 160448 - DNA, 35 bp, Artificial Sequence
  Description of Artificial Sequence: Synthetic oligonucleotide
gacatcgtcatcacaggtctatatgggaaaccttc

SEQ ID NO: 160449 - DNA, 36 bp, Artificial Sequence
  Description of Artificial Sequence: Synthetic oligonucleotide
acatcgtcatcacaggtctatatgggaaaccttctc

SEQ ID NO: 160450 - DNA, 35 bp, Artificial Sequence
  Description of Artificial Sequence: Synthetic oligonucleotide
catcgtcatcacaggtctatatgggaaaccttctc

SEQ ID NO: 160451 - DNA, 36 bp, Artificial Sequence
  Description of Artificial Sequence: Synthetic oligonucleotide
atcgtcatcacaggtctatatgggaaaccttctctc

SEQ ID NO: 160452 - DNA, 35 bp, Artificial Sequence
  Description of Artificial Sequence: Synthetic oligonucleotide
tcgtcatcacaggtctatatgggaaaccttctctc

SEQ ID NO: 160453 - DNA, 34 bp, Artificial Sequence
  Description of Artificial Sequence: Synthetic oligonucleotide
cgtcatcacaggtctatatgggaaaccttctctc

SEQ ID NO: 160454 - DNA, 35 bp, Artificial Sequence
  Description of Artificial Sequence: Synthetic oligonucleotide
gtcatcacaggtctatatgggaaaccttctctctc

SEQ ID NO: 160455 - DNA, 36 bp, Artificial Sequence
  Description of Artificial Sequence: Synthetic oligonucleotide
tcatcacaggtctatatgggaaaccttctctctcag

SEQ ID NO: 160456 - DNA, 35 bp, Artificial Sequence
  Description of Artificial Sequence: Synthetic oligonucleotide
catcacaggtctatatgggaaaccttctctctcag

SEQ ID NO: 160457 - DNA, 35 bp, Artificial Sequence
  Description of Artificial Sequence: Synthetic oligonucleotide
atcacaggtctatatgggaaaccttctctctcagc

SEQ ID NO: 160458 - DNA, 34 bp, Artificial Sequence
  Description of Artificial Sequence: Synthetic oligonucleotide
tcacaggtctatatgggaaaccttctctctcagc

SEQ ID NO: 160459 - DNA, 33 bp, Artificial Sequence
  Description of Artificial Sequence: Synthetic oligonucleotide
cacaggtctatatgggaaaccttctctctcagc

SEQ ID NO: 160460 - DNA, 33 bp, Artificial Sequence
  Description of Artificial Sequence: Synthetic oligonucleotide
acaggtctatatgggaaaccttctctctcagcc

SEQ ID NO: 160461 - DNA, 32 bp, Artificial Sequence
  Description of Artificial Sequence: Synthetic oligonucleotide
caggtctatatgggaaaccttctctctcagcc

SEQ ID NO: 160462 - DNA, 32 bp, Artificial Sequence
  Description of Artificial Sequence: Synthetic oligonucleotide
aggtctatatgggaaaccttctctctcagccc

SEQ ID NO: 160463 - DNA, 31 bp, Artificial Sequence
  Description of Artificial Sequence: Synthetic oligonucleotide
ggtctatatgggaaaccttctctctcagccc

SEQ ID NO: 160464 - DNA, 32 bp, Artificial Sequence
  Description of Artificial Sequence: Synthetic oligonucleotide
gtctatatgggaaaccttctctctcagcccag

SEQ ID NO: 160465 - DNA, 32 bp, Artificial Sequence
  Description of Artificial Sequence: Synthetic oligonucleotide
tctatatgggaaaccttctctctcagcccagc

SEQ ID NO: 160466 - DNA, 31 bp, Artificial Sequence
  Description of Artificial Sequence: Synthetic oligonucleotide
ctatatgggaaaccttctctctcagcccagc

SEQ ID NO: 160467 - DNA, 31 bp, Artificial Sequence
  Description of Artificial Sequence: Synthetic oligonucleotide
tatatgggaaaccttctctctcagcccagcc

SEQ ID NO: 160468 - DNA, 30 bp, Artificial Sequence
  Description of Artificial Sequence: Synthetic oligonucleotide
atatgggaaaccttctctctcagcccagcc

SEQ ID NO: 160469 - DNA, 29 bp, Artificial Sequence
  Description of Artificial Sequence: Synthetic oligonucleotide
tatgggaaaccttctctctcagcccagcc

SEQ ID NO: 160470 - DNA, 28 bp, Artificial Sequence
  Description of Artificial Sequence: Synthetic oligonucleotide
atgggaaaccttctctctcagcccagcc

SEQ ID NO: 160471 - DNA, 27 bp, Artificial Sequence
  Description of Artificial Sequence: Synthetic oligonucleotide
tgggaaaccttctctctcagcccagcc

SEQ ID NO: 160472 - DNA, 26 bp, Artificial Sequence
  Description of Artificial Sequence: Synthetic oligonucleotide
gggaaaccttctctctcagcccagcc

SEQ ID NO: 160473 - DNA, 26 bp, Artificial Sequence
  Description of Artificial Sequence: Synthetic oligonucleotide
ggaaaccttctctctcagcccagccg

SEQ ID NO: 160474 - DNA, 30 bp, Artificial Sequence
  Description of Artificial Sequence: Synthetic oligonucleotide
caaggccaacttctccatcagtcgcatgag

SEQ ID NO: 160475 - DNA, 30 bp, Artificial Sequence
  Description of Artificial Sequence: Synthetic oligonucleotide
aaggccaacttctccatcagtcgcatgagg

SEQ ID NO: 160476 - DNA, 29 bp, Artificial Sequence
  Description of Artificial Sequence: Synthetic oligonucleotide
aggccaacttctccatcagtcgcatgagg

SEQ ID NO: 160477 - DNA, 28 bp, Artificial Sequence
  Description of Artificial Sequence: Synthetic oligonucleotide
ggccaacttctccatcagtcgcatgagg

SEQ ID NO: 160478 - DNA, 28 bp, Artificial Sequence
  Description of Artificial Sequence: Synthetic oligonucleotide
gccaacttctccatcagtcgcatgaggc

SEQ ID NO: 160479 - DNA, 30 bp, Artificial Sequence
  Description of Artificial Sequence: Synthetic oligonucleotide
ccaacttctccatcagtcgcatgaggcaag

SEQ ID NO: 160480 - DNA, 31 bp, Artificial Sequence
  Description of Artificial Sequence: Synthetic oligonucleotide
caacttctccatcagtcgcatgaggcaagac

SEQ ID NO: 160481 - DNA, 31 bp, Artificial Sequence
  Description of Artificial Sequence: Synthetic oligonucleotide
aacttctccatcagtcgcatgaggcaagacc

SEQ ID NO: 160482 - DNA, 30 bp, Artificial Sequence
  Description of Artificial Sequence: Synthetic oligonucleotide
acttctccatcagtcgcatgaggcaagacc

SEQ ID NO: 160483 - DNA, 29 bp, Artificial Sequence
  Description of Artificial Sequence: Synthetic oligonucleotide
cttctccatcagtcgcatgaggcaagacc

SEQ ID NO: 160484 - DNA, 30 bp, Artificial Sequence
  Description of Artificial Sequence: Synthetic oligonucleotide
ttctccatcagtcgcatgaggcaagacctg

SEQ ID NO: 160485 - DNA, 29 bp, Artificial Sequence
  Description of Artificial Sequence: Synthetic oligonucleotide
tctccatcagtcgcatgaggcaagacctg

SEQ ID NO: 160486 - DNA, 28 bp, Artificial Sequence
  Description of Artificial Sequence: Synthetic oligonucleotide
ctccatcagtcgcatgaggcaagacctg

SEQ ID NO: 160487 - DNA, 28 bp, Artificial Sequence
  Description of Artificial Sequence: Synthetic oligonucleotide
tccatcagtcgcatgaggcaagacctgg

SEQ ID NO: 160488 - DNA, 27 bp, Artificial Sequence
  Description of Artificial Sequence: Synthetic oligonucleotide
ccatcagtcgcatgaggcaagacctgg

SEQ ID NO: 160489 - DNA, 27 bp, Artificial Sequence
  Description of Artificial Sequence: Synthetic oligonucleotide
catcagtcgcatgaggcaagacctggc

SEQ ID NO: 160490 - DNA, 28 bp, Artificial Sequence
  Description of Artificial Sequence: Synthetic oligonucleotide
atcagtcgcatgaggcaagacctggcag

SEQ ID NO: 160491 - DNA, 27 bp, Artificial Sequence
  Description of Artificial Sequence: Synthetic oligonucleotide
tcagtcgcatgaggcaagacctggcag

SEQ ID NO: 160492 - DNA, 26 bp, Artificial Sequence
  Description of Artificial Sequence: Synthetic oligonucleotide
cagtcgcatgaggcaagacctggcag

SEQ ID NO: 160493 - DNA, 26 bp, Artificial Sequence
  Description of Artificial Sequence: Synthetic oligonucleotide
agtcgcatgaggcaagacctggcagg

SEQ ID NO: 160494 - DNA, 25 bp, Artificial Sequence
  Description of Artificial Sequence: Synthetic oligonucleotide
gtcgcatgaggcaagacctggcagg

SEQ ID NO: 160495 - DNA, 26 bp, Artificial Sequence
  Description of Artificial Sequence: Synthetic oligonucleotide
tcgcatgaggcaagacctggcaggga

SEQ ID NO: 160496 - DNA, 25 bp, Artificial Sequence
  Description of Artificial Sequence: Synthetic oligonucleotide
cgcatgaggcaagacctggcaggga

SEQ ID NO: 160497 - DNA, 25 bp, Artificial Sequence
  Description of Artificial Sequence: Synthetic oligonucleotide
gcatgaggcaagacctggcagggac

SEQ ID NO: 160498 - DNA, 27 bp, Artificial Sequence
  Description of Artificial Sequence: Synthetic oligonucleotide
catgaggcaagacctggcagggaccta

SEQ ID NO: 160499 - DNA, 27 bp, Artificial Sequence
  Description of Artificial Sequence: Synthetic oligonucleotide
atgaggcaagacctggcagggacctac

SEQ ID NO: 160500 - DNA, 27 bp, Artificial Sequence
  Description of Artificial Sequence: Synthetic oligonucleotide
tgaggcaagacctggcagggacctaca

SEQ ID NO: 160501 - DNA, 26 bp, Artificial Sequence
  Description of Artificial Sequence: Synthetic oligonucleotide
gaggcaagacctggcagggacctaca

SEQ ID NO: 160502 - DNA, 27 bp, Artificial Sequence
  Description of Artificial Sequence: Synthetic oligonucleotide
aggcaagacctggcagggacctacaga

SEQ ID NO: 160503 - DNA, 27 bp, Artificial Sequence
  Description of Artificial Sequence: Synthetic oligonucleotide
ggcaagacctggcagggacctacagat

SEQ ID NO: 160504 - DNA, 28 bp, Artificial Sequence
  Description of Artificial Sequence: Synthetic oligonucleotide
tccgaaaccggtaaccccagacacctac

SEQ ID NO: 160505 - DNA, 27 bp, Artificial Sequence
  Description of Artificial Sequence: Synthetic oligonucleotide
ccgaaaccggtaaccccagacacctac

SEQ ID NO: 160506 - DNA, 29 bp, Artificial Sequence
  Description of Artificial Sequence: Synthetic oligonucleotide
cgaaaccggtaaccccagacacctacatg

SEQ ID NO: 160507 - DNA, 31 bp, Artificial Sequence
  Description of Artificial Sequence: Synthetic oligonucleotide
gaaaccggtaaccccagacacctacatgttc

SEQ ID NO: 160508 - DNA, 32 bp, Artificial Sequence
  Description of Artificial Sequence: Synthetic oligonucleotide
aaaccggtaaccccagacacctacatgttctg

SEQ ID NO: 160509 - DNA, 31 bp, Artificial Sequence
  Description of Artificial Sequence: Synthetic oligonucleotide
aaccggtaaccccagacacctacatgttctg

SEQ ID NO: 160510 - DNA, 30 bp, Artificial Sequence
  Description of Artificial Sequence: Synthetic oligonucleotide
accggtaaccccagacacctacatgttctg

SEQ ID NO: 160511 - DNA, 29 bp, Artificial Sequence
  Description of Artificial Sequence: Synthetic oligonucleotide
ccggtaaccccagacacctacatgttctg

SEQ ID NO: 160512 - DNA, 32 bp, Artificial Sequence
  Description of Artificial Sequence: Synthetic oligonucleotide
cggtaaccccagacacctacatgttctgattg

SEQ ID NO: 160513 - DNA, 32 bp, Artificial Sequence
  Description of Artificial Sequence: Synthetic oligonucleotide
ggtaaccccagacacctacatgttctgattgg

SEQ ID NO: 160514 - DNA, 32 bp, Artificial Sequence
  Description of Artificial Sequence: Synthetic oligonucleotide
gtaaccccagacacctacatgttctgattggg

SEQ ID NO: 160515 - DNA, 33 bp, Artificial Sequence
  Description of Artificial Sequence: Synthetic oligonucleotide
taaccccagacacctacatgttctgattgggac

SEQ ID NO: 160516 - DNA, 32 bp, Artificial Sequence
  Description of Artificial Sequence: Synthetic oligonucleotide
aaccccagacacctacatgttctgattgggac

SEQ ID NO: 160517 - DNA, 31 bp, Artificial Sequence
  Description of Artificial Sequence: Synthetic oligonucleotide
accccagacacctacatgttctgattgggac

SEQ ID NO: 160518 - DNA, 30 bp, Artificial Sequence
  Description of Artificial Sequence: Synthetic oligonucleotide
ccccagacacctacatgttctgattgggac

SEQ ID NO: 160519 - DNA, 30 bp, Artificial Sequence
  Description of Artificial Sequence: Synthetic oligonucleotide
cccagacacctacatgttctgattgggacc

SEQ ID NO: 160520 - DNA, 31 bp, Artificial Sequence
  Description of Artificial Sequence: Synthetic oligonucleotide
ccagacacctacatgttctgattgggacctc

SEQ ID NO: 160521 - DNA, 32 bp, Artificial Sequence
  Description of Artificial Sequence: Synthetic oligonucleotide
cagacacctacatgttctgattgggacctcag

SEQ ID NO: 160522 - DNA, 33 bp, Artificial Sequence
  Description of Artificial Sequence: Synthetic oligonucleotide
agacacctacatgttctgattgggacctcagtg

SEQ ID NO: 160523 - DNA, 32 bp, Artificial Sequence
  Description of Artificial Sequence: Synthetic oligonucleotide
gacacctacatgttctgattgggacctcagtg

SEQ ID NO: 160524 - DNA, 32 bp, Artificial Sequence
  Description of Artificial Sequence: Synthetic oligonucleotide
acacctacatgttctgattgggacctcagtgg

SEQ ID NO: 160525 - DNA, 31 bp, Artificial Sequence
  Description of Artificial Sequence: Synthetic oligonucleotide
cacctacatgttctgattgggacctcagtgg

SEQ ID NO: 160526 - DNA, 32 bp, Artificial Sequence
  Description of Artificial Sequence: Synthetic oligonucleotide
acctacatgttctgattgggacctcagtggtc

SEQ ID NO: 160527 - DNA, 31 bp, Artificial Sequence
  Description of Artificial Sequence: Synthetic oligonucleotide
cctacatgttctgattgggacctcagtggtc

SEQ ID NO: 160528 - DNA, 36 bp, Artificial Sequence
  Description of Artificial Sequence: Synthetic oligonucleotide
ctacatgttctgattgggacctcagtggtcaaaatc

SEQ ID NO: 160529 - DNA, 36 bp, Artificial Sequence
  Description of Artificial Sequence: Synthetic oligonucleotide
tacatgttctgattgggacctcagtggtcaaaatcc

SEQ ID NO: 160530 - DNA, 35 bp, Artificial Sequence
  Description of Artificial Sequence: Synthetic oligonucleotide
acatgttctgattgggacctcagtggtcaaaatcc

SEQ ID NO: 160531 - DNA, 34 bp, Artificial Sequence
  Description of Artificial Sequence: Synthetic oligonucleotide
catgttctgattgggacctcagtggtcaaaatcc

SEQ ID NO: 160532 - DNA, 34 bp, Artificial Sequence
  Description of Artificial Sequence: Synthetic oligonucleotide
atgttctgattgggacctcagtggtcaaaatccc

SEQ ID NO: 160533 - DNA, 33 bp, Artificial Sequence
  Description of Artificial Sequence: Synthetic oligonucleotide
tgttctgattgggacctcagtggtcaaaatccc

SEQ ID NO: 160534 - DNA, 32 bp, Artificial Sequence
  Description of Artificial Sequence: Synthetic oligonucleotide
gttctgattgggacctcagtggtcaaaatccc

SEQ ID NO: 160535 - DNA, 35 bp, Artificial Sequence
  Description of Artificial Sequence: Synthetic oligonucleotide
ttctgattgggacctcagtggtcaaaatccctttc

SEQ ID NO: 160536 - DNA, 34 bp, Artificial Sequence
  Description of Artificial Sequence: Synthetic oligonucleotide
tctgattgggacctcagtggtcaaaatccctttc

SEQ ID NO: 160537 - DNA, 33 bp, Artificial Sequence
  Description of Artificial Sequence: Synthetic oligonucleotide
ctgattgggacctcagtggtcaaaatccctttc

SEQ ID NO: 160538 - DNA, 34 bp, Artificial Sequence
  Description of Artificial Sequence: Synthetic oligonucleotide
tgattgggacctcagtggtcaaaatccctttcac

SEQ ID NO: 160539 - DNA, 33 bp, Artificial Sequence
  Description of Artificial Sequence: Synthetic oligonucleotide
gattgggacctcagtggtcaaaatccctttcac

SEQ ID NO: 160540 - DNA, 33 bp, Artificial Sequence
  Description of Artificial Sequence: Synthetic oligonucleotide
attgggacctcagtggtcaaaatccctttcacc

SEQ ID NO: 160541 - DNA, 32 bp, Artificial Sequence
  Description of Artificial Sequence: Synthetic oligonucleotide
ttgggacctcagtggtcaaaatccctttcacc

SEQ ID NO: 160542 - DNA, 31 bp, Artificial Sequence
  Description of Artificial Sequence: Synthetic oligonucleotide
tgggacctcagtggtcaaaatccctttcacc

SEQ ID NO: 160543 - DNA, 30 bp, Artificial Sequence
  Description of Artificial Sequence: Synthetic oligonucleotide
gggacctcagtggtcaaaatccctttcacc

SEQ ID NO: 160544 - DNA, 32 bp, Artificial Sequence
  Description of Artificial Sequence: Synthetic oligonucleotide
ggacctcagtggtcaaaatccctttcaccatc

SEQ ID NO: 160545 - DNA, 32 bp, Artificial Sequence
  Description of Artificial Sequence: Synthetic oligonucleotide
gacctcagtggtcaaaatccctttcaccatcc

SEQ ID NO: 160546 - DNA, 33 bp, Artificial Sequence
  Description of Artificial Sequence: Synthetic oligonucleotide
acctcagtggtcaaaatccctttcaccatcctc

SEQ ID NO: 160547 - DNA, 32 bp, Artificial Sequence
  Description of Artificial Sequence: Synthetic oligonucleotide
cctcagtggtcaaaatccctttcaccatcctc

SEQ ID NO: 160548 - DNA, 32 bp, Artificial Sequence
  Description of Artificial Sequence: Synthetic oligonucleotide
ctcagtggtcaaaatccctttcaccatcctcc

SEQ ID NO: 160549 - DNA, 33 bp, Artificial Sequence
  Description of Artificial Sequence: Synthetic oligonucleotide
tcagtggtcaaaatccctttcaccatcctcctc

SEQ ID NO: 160550 - DNA, 32 bp, Artificial Sequence
  Description of Artificial Sequence: Synthetic oligonucleotide
cagtggtcaaaatccctttcaccatcctcctc

SEQ ID NO: 160551 - DNA, 34 bp, Artificial Sequence
  Description of Artificial Sequence: Synthetic oligonucleotide
agtggtcaaaatccctttcaccatcctcctcttc

SEQ ID NO: 160552 - DNA, 33 bp, Artificial Sequence
  Description of Artificial Sequence: Synthetic oligonucleotide
gtggtcaaaatccctttcaccatcctcctcttc

SEQ ID NO: 160553 - DNA, 36 bp, Artificial Sequence
  Description of Artificial Sequence: Synthetic oligonucleotide
tggtcaaaatccctttcaccatcctcctcttctttc

SEQ ID NO: 160554 - DNA, 35 bp, Artificial Sequence
  Description of Artificial Sequence: Synthetic oligonucleotide
ggtcaaaatccctttcaccatcctcctcttctttc

SEQ ID NO: 160555 - DNA, 36 bp, Artificial Sequence
  Description of Artificial Sequence: Synthetic oligonucleotide
gtcaaaatccctttcaccatcctcctcttctttctc

SEQ ID NO: 160556 - DNA, 36 bp, Artificial Sequence
  Description of Artificial Sequence: Synthetic oligonucleotide
tcaaaatccctttcaccatcctcctcttctttctcc

SEQ ID NO: 160557 - DNA, 35 bp, Artificial Sequence
  Description of Artificial Sequence: Synthetic oligonucleotide
caaaatccctttcaccatcctcctcttctttctcc

SEQ ID NO: 160558 - DNA, 37 bp, Artificial Sequence
  Description of Artificial Sequence: Synthetic oligonucleotide
aaaatccctttcaccatcctcctcttctttctccttc

SEQ ID NO: 160559 - DNA, 36 bp, Artificial Sequence
  Description of Artificial Sequence: Synthetic oligonucleotide
aaatccctttcaccatcctcctcttctttctccttc

SEQ ID NO: 160560 - DNA, 35 bp, Artificial Sequence
  Description of Artificial Sequence: Synthetic oligonucleotide
aatccctttcaccatcctcctcttctttctccttc

SEQ ID NO: 160561 - DNA, 34 bp, Artificial Sequence
  Description of Artificial Sequence: Synthetic oligonucleotide
atccctttcaccatcctcctcttctttctccttc

SEQ ID NO: 160562 - DNA, 33 bp, Artificial Sequence
  Description of Artificial Sequence: Synthetic oligonucleotide
tccctttcaccatcctcctcttctttctccttc

SEQ ID NO: 160563 - DNA, 32 bp, Artificial Sequence
  Description of Artificial Sequence: Synthetic oligonucleotide
ccctttcaccatcctcctcttctttctccttc

SEQ ID NO: 160564 - DNA, 34 bp, Artificial Sequence
  Description of Artificial Sequence: Synthetic oligonucleotide
cctttcaccatcctcctcttctttctccttcatc

SEQ ID NO: 160565 - DNA, 34 bp, Artificial Sequence
  Description of Artificial Sequence: Synthetic oligonucleotide
ctttcaccatcctcctcttctttctccttcatcg

SEQ ID NO: 160566 - DNA, 34 bp, Artificial Sequence
  Description of Artificial Sequence: Synthetic oligonucleotide
tttcaccatcctcctcttctttctccttcatcgc

SEQ ID NO: 160567 - DNA, 33 bp, Artificial Sequence
  Description of Artificial Sequence: Synthetic oligonucleotide
ttcaccatcctcctcttctttctccttcatcgc

SEQ ID NO: 160568 - DNA, 32 bp, Artificial Sequence
  Description of Artificial Sequence: Synthetic oligonucleotide
tcaccatcctcctcttctttctccttcatcgc

SEQ ID NO: 160569 - DNA, 31 bp, Artificial Sequence
  Description of Artificial Sequence: Synthetic oligonucleotide
caccatcctcctcttctttctccttcatcgc

SEQ ID NO: 160570 - DNA, 32 bp, Artificial Sequence
  Description of Artificial Sequence: Synthetic oligonucleotide
accatcctcctcttctttctccttcatcgctg

SEQ ID NO: 160571 - DNA, 31 bp, Artificial Sequence
  Description of Artificial Sequence: Synthetic oligonucleotide
ccatcctcctcttctttctccttcatcgctg

SEQ ID NO: 160572 - DNA, 30 bp, Artificial Sequence
  Description of Artificial Sequence: Synthetic oligonucleotide
tcttctttctccttcatcgctggtgctccg

SEQ ID NO: 160573 - DNA, 29 bp, Artificial Sequence
  Description of Artificial Sequence: Synthetic oligonucleotide
cttctttctccttcatcgctggtgctccg

SEQ ID NO: 160574 - DNA, 30 bp, Artificial Sequence
  Description of Artificial Sequence: Synthetic oligonucleotide
ttctttctccttcatcgctggtgctccgac

SEQ ID NO: 160575 - DNA, 29 bp, Artificial Sequence
  Description of Artificial Sequence: Synthetic oligonucleotide
tctttctccttcatcgctggtgctccgac

SEQ ID NO: 160576 - DNA, 28 bp, Artificial Sequence
  Description of Artificial Sequence: Synthetic oligonucleotide
ctttctccttcatcgctggtgctccgac

SEQ ID NO: 160577 - DNA, 37 bp, Artificial Sequence
  Description of Artificial Sequence: Synthetic oligonucleotide
tttctccttcatcgctggtgctccgacaaaaaaaatg

SEQ ID NO: 160578 - DNA, 36 bp, Artificial Sequence
  Description of Artificial Sequence: Synthetic oligonucleotide
ttctccttcatcgctggtgctccgacaaaaaaaatg

SEQ ID NO: 160579 - DNA, 35 bp, Artificial Sequence
  Description of Artificial Sequence: Synthetic oligonucleotide
tctccttcatcgctggtgctccgacaaaaaaaatg

SEQ ID NO: 160580 - DNA, 34 bp, Artificial Sequence
  Description of Artificial Sequence: Synthetic oligonucleotide
ctccttcatcgctggtgctccgacaaaaaaaatg

SEQ ID NO: 160581 - DNA, 34 bp, Artificial Sequence
  Description of Artificial Sequence: Synthetic oligonucleotide
tccttcatcgctggtgctccgacaaaaaaaatgc

SEQ ID NO: 160582 - DNA, 33 bp, Artificial Sequence
  Description of Artificial Sequence: Synthetic oligonucleotide
ccttcatcgctggtgctccgacaaaaaaaatgc

SEQ ID NO: 160583 - DNA, 34 bp, Artificial Sequence
  Description of Artificial Sequence: Synthetic oligonucleotide
cttcatcgctggtgctccgacaaaaaaaatgctg

SEQ ID NO: 160584 - DNA, 34 bp, Artificial Sequence
  Description of Artificial Sequence: Synthetic oligonucleotide
ttcatcgctggtgctccgacaaaaaaaatgctgc

SEQ ID NO: 160585 - DNA, 33 bp, Artificial Sequence
  Description of Artificial Sequence: Synthetic oligonucleotide
tcatcgctggtgctccgacaaaaaaaatgctgc

SEQ ID NO: 160586 - DNA, 32 bp, Artificial Sequence
  Description of Artificial Sequence: Synthetic oligonucleotide
catcgctggtgctccgacaaaaaaaatgctgc

SEQ ID NO: 160587 - DNA, 33 bp, Artificial Sequence
  Description of Artificial Sequence: Synthetic oligonucleotide
atcgctggtgctccgacaaaaaaaatgctgctg

SEQ ID NO: 160588 - DNA, 32 bp, Artificial Sequence
  Description of Artificial Sequence: Synthetic oligonucleotide
tcgctggtgctccgacaaaaaaaatgctgctg

SEQ ID NO: 160589 - DNA, 31 bp, Artificial Sequence
  Description of Artificial Sequence: Synthetic oligonucleotide
cgctggtgctccgacaaaaaaaatgctgctg

SEQ ID NO: 160590 - DNA, 35 bp, Artificial Sequence
  Description of Artificial Sequence: Synthetic oligonucleotide
gctggtgctccgacaaaaaaaatgctgctgtaatg

SEQ ID NO: 160591 - DNA, 35 bp, Artificial Sequence
  Description of Artificial Sequence: Synthetic oligonucleotide
ctggtgctccgacaaaaaaaatgctgctgtaatgg

SEQ ID NO: 160592 - DNA, 36 bp, Artificial Sequence
  Description of Artificial Sequence: Synthetic oligonucleotide
tggtgctccgacaaaaaaaatgctgctgtaatggac

SEQ ID NO: 160593 - DNA, 35 bp, Artificial Sequence
  Description of Artificial Sequence: Synthetic oligonucleotide
ggtgctccgacaaaaaaaatgctgctgtaatggac

SEQ ID NO: 160594 - DNA, 35 bp, Artificial Sequence
  Description of Artificial Sequence: Synthetic oligonucleotide
gtgctccgacaaaaaaaatgctgctgtaatggacc

SEQ ID NO: 160595 - DNA, 37 bp, Artificial Sequence
  Description of Artificial Sequence: Synthetic oligonucleotide
tgctccgacaaaaaaaatgctgctgtaatggaccaag

SEQ ID NO: 160596 - DNA, 36 bp, Artificial Sequence
  Description of Artificial Sequence: Synthetic oligonucleotide
gctccgacaaaaaaaatgctgctgtaatggaccaag

SEQ ID NO: 160597 - DNA, 37 bp, Artificial Sequence
  Description of Artificial Sequence: Synthetic oligonucleotide
ctccgacaaaaaaaatgctgctgtaatggaccaagag

SEQ ID NO: 160598 - DNA, 37 bp, Artificial Sequence
  Description of Artificial Sequence: Synthetic oligonucleotide
tccgacaaaaaaaatgctgctgtaatggaccaagagc

SEQ ID NO: 160599 - DNA, 36 bp, Artificial Sequence
  Description of Artificial Sequence: Synthetic oligonucleotide
ccgacaaaaaaaatgctgctgtaatggaccaagagc

SEQ ID NO: 160600 - DNA, 36 bp, Artificial Sequence
  Description of Artificial Sequence: Synthetic oligonucleotide
cgacaaaaaaaatgctgctgtaatggaccaagagcc

SEQ ID NO: 160601 - DNA, 37 bp, Artificial Sequence
  Description of Artificial Sequence: Synthetic oligonucleotide
gacaaaaaaaatgctgctgtaatggaccaagagcctg

SEQ ID NO: 160602 - DNA, 29 bp, Artificial Sequence
  Description of Artificial Sequence: Synthetic oligonucleotide
agcctgcagggaacagaacagtgaacagc

SEQ ID NO: 160603 - DNA, 28 bp, Artificial Sequence
  Description of Artificial Sequence: Synthetic oligonucleotide
gcctgcagggaacagaacagtgaacagc

SEQ ID NO: 160604 - DNA, 28 bp, Artificial Sequence
  Description of Artificial Sequence: Synthetic oligonucleotide
cctgcagggaacagaacagtgaacagcg

SEQ ID NO: 160605 - DNA, 29 bp, Artificial Sequence
  Description of Artificial Sequence: Synthetic oligonucleotide
ctgcagggaacagaacagtgaacagcgag

SEQ ID NO: 160606 - DNA, 29 bp, Artificial Sequence
  Description of Artificial Sequence: Synthetic oligonucleotide
tgcagggaacagaacagtgaacagcgagg

SEQ ID NO: 160607 - DNA, 28 bp, Artificial Sequence
  Description of Artificial Sequence: Synthetic oligonucleotide
gcagggaacagaacagtgaacagcgagg

SEQ ID NO: 160608 - DNA, 31 bp, Artificial Sequence
  Description of Artificial Sequence: Synthetic oligonucleotide
cagggaacagaacagtgaacagcgaggattc

SEQ ID NO: 160609 - DNA, 32 bp, Artificial Sequence
  Description of Artificial Sequence: Synthetic oligonucleotide
agggaacagaacagtgaacagcgaggattctg

SEQ ID NO: 160610 - DNA, 31 bp, Artificial Sequence
  Description of Artificial Sequence: Synthetic oligonucleotide
gggaacagaacagtgaacagcgaggattctg

SEQ ID NO: 160611 - DNA, 33 bp, Artificial Sequence
  Description of Artificial Sequence: Synthetic oligonucleotide
ggaacagaacagtgaacagcgaggattctgatg

SEQ ID NO: 160612 - DNA, 35 bp, Artificial Sequence
  Description of Artificial Sequence: Synthetic oligonucleotide
gaacagaacagtgaacagcgaggattctgatgaac

SEQ ID NO: 160613 - DNA, 37 bp, Artificial Sequence
  Description of Artificial Sequence: Synthetic oligonucleotide
aacagaacagtgaacagcgaggattctgatgaacaag

SEQ ID NO: 160614 - DNA, 36 bp, Artificial Sequence
  Description of Artificial Sequence: Synthetic oligonucleotide
acagaacagtgaacagcgaggattctgatgaacaag

SEQ ID NO: 160615 - DNA, 35 bp, Artificial Sequence
  Description of Artificial Sequence: Synthetic oligonucleotide
cagaacagtgaacagcgaggattctgatgaacaag

SEQ ID NO: 160616 - DNA, 36 bp, Artificial Sequence
  Description of Artificial Sequence: Synthetic oligonucleotide
agaacagtgaacagcgaggattctgatgaacaagac

SEQ ID NO: 160617 - DNA, 35 bp, Artificial Sequence
  Description of Artificial Sequence: Synthetic oligonucleotide
gaacagtgaacagcgaggattctgatgaacaagac

SEQ ID NO: 160618 - DNA, 35 bp, Artificial Sequence
  Description of Artificial Sequence: Synthetic oligonucleotide
aacagtgaacagcgaggattctgatgaacaagacc

SEQ ID NO: 160619 - DNA, 34 bp, Artificial Sequence
  Description of Artificial Sequence: Synthetic oligonucleotide
acagtgaacagcgaggattctgatgaacaagacc

SEQ ID NO: 160620 - DNA, 33 bp, Artificial Sequence
  Description of Artificial Sequence: Synthetic oligonucleotide
cagtgaacagcgaggattctgatgaacaagacc

SEQ ID NO: 160621 - DNA, 35 bp, Artificial Sequence
  Description of Artificial Sequence: Synthetic oligonucleotide
agtgaacagcgaggattctgatgaacaagaccatc

SEQ ID NO: 160622 - DNA, 34 bp, Artificial Sequence
  Description of Artificial Sequence: Synthetic oligonucleotide
gtgaacagcgaggattctgatgaacaagaccatc

SEQ ID NO: 160623 - DNA, 35 bp, Artificial Sequence
  Description of Artificial Sequence: Synthetic oligonucleotide
tgaacagcgaggattctgatgaacaagaccatcag

SEQ ID NO: 160624 - DNA, 34 bp, Artificial Sequence
  Description of Artificial Sequence: Synthetic oligonucleotide
gaacagcgaggattctgatgaacaagaccatcag

SEQ ID NO: 160625 - DNA, 34 bp, Artificial Sequence
  Description of Artificial Sequence: Synthetic oligonucleotide
aacagcgaggattctgatgaacaagaccatcagg

SEQ ID NO: 160626 - DNA, 33 bp, Artificial Sequence
  Description of Artificial Sequence: Synthetic oligonucleotide
acagcgaggattctgatgaacaagaccatcagg

SEQ ID NO: 160627 - DNA, 32 bp, Artificial Sequence
  Description of Artificial Sequence: Synthetic oligonucleotide
cagcgaggattctgatgaacaagaccatcagg

SEQ ID NO: 160628 - DNA, 33 bp, Artificial Sequence
  Description of Artificial Sequence: Synthetic oligonucleotide
agcgaggattctgatgaacaagaccatcaggag

SEQ ID NO: 160629 - DNA, 32 bp, Artificial Sequence
  Description of Artificial Sequence: Synthetic oligonucleotide
gcgaggattctgatgaacaagaccatcaggag

SEQ ID NO: 160630 - DNA, 32 bp, Artificial Sequence
  Description of Artificial Sequence: Synthetic oligonucleotide
cgaggattctgatgaacaagaccatcaggagg

SEQ ID NO: 160631 - DNA, 33 bp, Artificial Sequence
  Description of Artificial Sequence: Synthetic oligonucleotide
gaggattctgatgaacaagaccatcaggaggtg

SEQ ID NO: 160632 - DNA, 34 bp, Artificial Sequence
  Description of Artificial Sequence: Synthetic oligonucleotide
aggattctgatgaacaagaccatcaggaggtgtc

SEQ ID NO: 160633 - DNA, 33 bp, Artificial Sequence
  Description of Artificial Sequence: Synthetic oligonucleotide
ggattctgatgaacaagaccatcaggaggtgtc

SEQ ID NO: 160634 - DNA, 36 bp, Artificial Sequence
  Description of Artificial Sequence: Synthetic oligonucleotide
gattctgatgaacaagaccatcaggaggtgtcatac

SEQ ID NO: 160635 - DNA, 36 bp, Artificial Sequence
  Description of Artificial Sequence: Synthetic oligonucleotide
attctgatgaacaagaccatcaggaggtgtcatacg

SEQ ID NO: 160636 - DNA, 35 bp, Artificial Sequence
  Description of Artificial Sequence: Synthetic oligonucleotide
ttctgatgaacaagaccatcaggaggtgtcatacg

SEQ ID NO: 160637 - DNA, 34 bp, Artificial Sequence
  Description of Artificial Sequence: Synthetic oligonucleotide
tctgatgaacaagaccatcaggaggtgtcatacg

SEQ ID NO: 160638 - DNA, 33 bp, Artificial Sequence
  Description of Artificial Sequence: Synthetic oligonucleotide
ctgatgaacaagaccatcaggaggtgtcatacg

SEQ ID NO: 160639 - DNA, 33 bp, Artificial Sequence
  Description of Artificial Sequence: Synthetic oligonucleotide
tgatgaacaagaccatcaggaggtgtcatacgc

SEQ ID NO: 160640 - DNA, 32 bp, Artificial Sequence
  Description of Artificial Sequence: Synthetic oligonucleotide
gatgaacaagaccatcaggaggtgtcatacgc

SEQ ID NO: 160641 - DNA, 31 bp, Artificial Sequence
  Description of Artificial Sequence: Synthetic oligonucleotide
caaggccaacttctccatcagtcgcatgaag

SEQ ID NO: 160642 - DNA, 31 bp, Artificial Sequence
  Description of Artificial Sequence: Synthetic oligonucleotide
aaggccaacttctccatcagtcgcatgaagc

SEQ ID NO: 160643 - DNA, 30 bp, Artificial Sequence
  Description of Artificial Sequence: Synthetic oligonucleotide
aggccaacttctccatcagtcgcatgaagc

SEQ ID NO: 160644 - DNA, 29 bp, Artificial Sequence
  Description of Artificial Sequence: Synthetic oligonucleotide
ggccaacttctccatcagtcgcatgaagc

SEQ ID NO: 160645 - DNA, 31 bp, Artificial Sequence
  Description of Artificial Sequence: Synthetic oligonucleotide
gccaacttctccatcagtcgcatgaagcaag

SEQ ID NO: 160646 - DNA, 32 bp, Artificial Sequence
  Description of Artificial Sequence: Synthetic oligonucleotide
ccaacttctccatcagtcgcatgaagcaagac

SEQ ID NO: 160647 - DNA, 32 bp, Artificial Sequence
  Description of Artificial Sequence: Synthetic oligonucleotide
caacttctccatcagtcgcatgaagcaagacc

SEQ ID NO: 160648 - DNA, 33 bp, Artificial Sequence
  Description of Artificial Sequence: Synthetic oligonucleotide
aacttctccatcagtcgcatgaagcaagacctg

SEQ ID NO: 160649 - DNA, 32 bp, Artificial Sequence
  Description of Artificial Sequence: Synthetic oligonucleotide
acttctccatcagtcgcatgaagcaagacctg

SEQ ID NO: 160650 - DNA, 31 bp, Artificial Sequence
  Description of Artificial Sequence: Synthetic oligonucleotide
cttctccatcagtcgcatgaagcaagacctg

SEQ ID NO: 160651 - DNA, 31 bp, Artificial Sequence
  Description of Artificial Sequence: Synthetic oligonucleotide
ttctccatcagtcgcatgaagcaagacctgg

SEQ ID NO: 160652 - DNA, 30 bp, Artificial Sequence
  Description of Artificial Sequence: Synthetic oligonucleotide
tctccatcagtcgcatgaagcaagacctgg

SEQ ID NO: 160653 - DNA, 29 bp, Artificial Sequence
  Description of Artificial Sequence: Synthetic oligonucleotide
ctccatcagtcgcatgaagcaagacctgg

SEQ ID NO: 160654 - DNA, 29 bp, Artificial Sequence
  Description of Artificial Sequence: Synthetic oligonucleotide
tccatcagtcgcatgaagcaagacctggc

SEQ ID NO: 160655 - DNA, 28 bp, Artificial Sequence
  Description of Artificial Sequence: Synthetic oligonucleotide
ccatcagtcgcatgaagcaagacctggc

SEQ ID NO: 160656 - DNA, 29 bp, Artificial Sequence
  Description of Artificial Sequence: Synthetic oligonucleotide
catcagtcgcatgaagcaagacctggcag

SEQ ID NO: 160657 - DNA, 29 bp, Artificial Sequence
  Description of Artificial Sequence: Synthetic oligonucleotide
atcagtcgcatgaagcaagacctggcagg

SEQ ID NO: 160658 - DNA, 28 bp, Artificial Sequence
  Description of Artificial Sequence: Synthetic oligonucleotide
tcagtcgcatgaagcaagacctggcagg

SEQ ID NO: 160659 - DNA, 27 bp, Artificial Sequence
  Description of Artificial Sequence: Synthetic oligonucleotide
cagtcgcatgaagcaagacctggcagg

SEQ ID NO: 160660 - DNA, 27 bp, Artificial Sequence
  Description of Artificial Sequence: Synthetic oligonucleotide
agtcgcatgaagcaagacctggcaggg

SEQ ID NO: 160661 - DNA, 27 bp, Artificial Sequence
  Description of Artificial Sequence: Synthetic oligonucleotide
gtcgcatgaagcaagacctggcaggga

SEQ ID NO: 160662 - DNA, 27 bp, Artificial Sequence
  Description of Artificial Sequence: Synthetic oligonucleotide
tcgcatgaagcaagacctggcagggac

SEQ ID NO: 160663 - DNA, 26 bp, Artificial Sequence
  Description of Artificial Sequence: Synthetic oligonucleotide
cgcatgaagcaagacctggcagggac

SEQ ID NO: 160664 - DNA, 27 bp, Artificial Sequence
  Description of Artificial Sequence: Synthetic oligonucleotide
gcatgaagcaagacctggcagggacct

SEQ ID NO: 160665 - DNA, 28 bp, Artificial Sequence
  Description of Artificial Sequence: Synthetic oligonucleotide
catgaagcaagacctggcagggacctac

SEQ ID NO: 160666 - DNA, 29 bp, Artificial Sequence
  Description of Artificial Sequence: Synthetic oligonucleotide
atgaagcaagacctggcagggacctacag

SEQ ID NO: 160667 - DNA, 28 bp, Artificial Sequence
  Description of Artificial Sequence: Synthetic oligonucleotide
tgaagcaagacctggcagggacctacag

SEQ ID NO: 160668 - DNA, 27 bp, Artificial Sequence
  Description of Artificial Sequence: Synthetic oligonucleotide
gaagcaagacctggcagggacctacag

SEQ ID NO: 160669 - DNA, 29 bp, Artificial Sequence
  Description of Artificial Sequence: Synthetic oligonucleotide
aagcaagacctggcagggacctacagatg

SEQ ID NO: 160670 - DNA, 28 bp, Artificial Sequence
  Description of Artificial Sequence: Synthetic oligonucleotide
agcaagacctggcagggacctacagatg

SEQ ID NO: 160671 - DNA, 26 bp, Artificial Sequence
  Description of Artificial Sequence: Synthetic oligonucleotide
aactttcctctgggccctgccaccca

SEQ ID NO: 160672 - DNA, 30 bp, Artificial Sequence
  Description of Artificial Sequence: Synthetic oligonucleotide
gacactttgcgcctcattggagaacaccac

SEQ ID NO: 160673 - DNA, 30 bp, Artificial Sequence
  Description of Artificial Sequence: Synthetic oligonucleotide
acactttgcgcctcattggagaacaccacg

SEQ ID NO: 160674 - DNA, 29 bp, Artificial Sequence
  Description of Artificial Sequence: Synthetic oligonucleotide
cactttgcgcctcattggagaacaccacg

SEQ ID NO: 160675 - DNA, 31 bp, Artificial Sequence
  Description of Artificial Sequence: Synthetic oligonucleotide
actttgcgcctcattggagaacaccacgatg

SEQ ID NO: 160676 - DNA, 30 bp, Artificial Sequence
  Description of Artificial Sequence: Synthetic oligonucleotide
ctttgcgcctcattggagaacaccacgatg

SEQ ID NO: 160677 - DNA, 30 bp, Artificial Sequence
  Description of Artificial Sequence: Synthetic oligonucleotide
tttgcgcctcattggagaacaccacgatgg

SEQ ID NO: 160678 - DNA, 29 bp, Artificial Sequence
  Description of Artificial Sequence: Synthetic oligonucleotide
ttgcgcctcattggagaacaccacgatgg

SEQ ID NO: 160679 - DNA, 28 bp, Artificial Sequence
  Description of Artificial Sequence: Synthetic oligonucleotide
tgcgcctcattggagaacaccacgatgg

SEQ ID NO: 160680 - DNA, 27 bp, Artificial Sequence
  Description of Artificial Sequence: Synthetic oligonucleotide
gcgcctcattggagaacaccacgatgg

SEQ ID NO: 160681 - DNA, 27 bp, Artificial Sequence
  Description of Artificial Sequence: Synthetic oligonucleotide
cgcctcattggagaacaccacgatggg

SEQ ID NO: 160682 - DNA, 27 bp, Artificial Sequence
  Description of Artificial Sequence: Synthetic oligonucleotide
gcctcattggagaacaccacgatgggg

SEQ ID NO: 160683 - DNA, 28 bp, Artificial Sequence
  Description of Artificial Sequence: Synthetic oligonucleotide
cctcattggagaacaccacgatggggtc

SEQ ID NO: 160684 - DNA, 29 bp, Artificial Sequence
  Description of Artificial Sequence: Synthetic oligonucleotide
ctcattggagaacaccacgatggggtctc

SEQ ID NO: 160685 - DNA, 29 bp, Artificial Sequence
  Description of Artificial Sequence: Synthetic oligonucleotide
tcattggagaacaccacgatggggtctcc

SEQ ID NO: 160686 - DNA, 28 bp, Artificial Sequence
  Description of Artificial Sequence: Synthetic oligonucleotide
cattggagaacaccacgatggggtctcc

SEQ ID NO: 160687 - DNA, 30 bp, Artificial Sequence
  Description of Artificial Sequence: Synthetic oligonucleotide
attggagaacaccacgatggggtctccaag

SEQ ID NO: 160688 - DNA, 29 bp, Artificial Sequence
  Description of Artificial Sequence: Synthetic oligonucleotide
ttggagaacaccacgatggggtctccaag

SEQ ID NO: 160689 - DNA, 28 bp, Artificial Sequence
  Description of Artificial Sequence: Synthetic oligonucleotide
tggagaacaccacgatggggtctccaag

SEQ ID NO: 160690 - DNA, 27 bp, Artificial Sequence
  Description of Artificial Sequence: Synthetic oligonucleotide
ggagaacaccacgatggggtctccaag

SEQ ID NO: 160691 - DNA, 27 bp, Artificial Sequence
  Description of Artificial Sequence: Synthetic oligonucleotide
gagaacaccacgatggggtctccaagg

SEQ ID NO: 160692 - DNA, 27 bp, Artificial Sequence
  Description of Artificial Sequence: Synthetic oligonucleotide
agaacaccacgatggggtctccaaggc

SEQ ID NO: 160693 - DNA, 26 bp, Artificial Sequence
  Description of Artificial Sequence: Synthetic oligonucleotide
gaacaccacgatggggtctccaaggc

SEQ ID NO: 160694 - DNA, 27 bp, Artificial Sequence
  Description of Artificial Sequence: Synthetic oligonucleotide
aacaccacgatggggtctccaaggcca

SEQ ID NO: 160695 - DNA, 27 bp, Artificial Sequence
  Description of Artificial Sequence: Synthetic oligonucleotide
acaccacgatggggtctccaaggccaa

SEQ ID NO: 160696 - DNA, 26 bp, Artificial Sequence
  Description of Artificial Sequence: Synthetic oligonucleotide
caccacgatggggtctccaaggccaa

SEQ ID NO: 160697 - DNA, 27 bp, Artificial Sequence
  Description of Artificial Sequence: Synthetic oligonucleotide
accacgatggggtctccaaggccaact

SEQ ID NO: 160698 - DNA, 27 bp, Artificial Sequence
  Description of Artificial Sequence: Synthetic oligonucleotide
ccacgatggggtctccaaggccaactt

SEQ ID NO: 160699 - DNA, 27 bp, Artificial Sequence
  Description of Artificial Sequence: Synthetic oligonucleotide
cacgatggggtctccaaggccaacttc

SEQ ID NO: 160700 - DNA, 28 bp, Artificial Sequence
  Description of Artificial Sequence: Synthetic oligonucleotide
acgatggggtctccaaggccaacttctc

SEQ ID NO: 160701 - DNA, 27 bp, Artificial Sequence
  Description of Artificial Sequence: Synthetic oligonucleotide
cgatggggtctccaaggccaacttctc

SEQ ID NO: 160702 - DNA, 29 bp, Artificial Sequence
  Description of Artificial Sequence: Synthetic oligonucleotide
ctccaaaaccggtaaccccagacacctac

SEQ ID NO: 160703 - DNA, 31 bp, Artificial Sequence
  Description of Artificial Sequence: Synthetic oligonucleotide
tccaaaaccggtaaccccagacacctacatg

SEQ ID NO: 160704 - DNA, 30 bp, Artificial Sequence
  Description of Artificial Sequence: Synthetic oligonucleotide
ccaaaaccggtaaccccagacacctacatg

SEQ ID NO: 160705 - DNA, 32 bp, Artificial Sequence
  Description of Artificial Sequence: Synthetic oligonucleotide
caaaaccggtaaccccagacacctacatgttc

SEQ ID NO: 160706 - DNA, 33 bp, Artificial Sequence
  Description of Artificial Sequence: Synthetic oligonucleotide
aaaaccggtaaccccagacacctacatgttctg

SEQ ID NO: 160707 - DNA, 31 bp, Artificial Sequence
  Description of Artificial Sequence: Synthetic oligonucleotide
ccacatgagggagtccacagaaaaccttcac

SEQ ID NO: 160708 - DNA, 32 bp, Artificial Sequence
  Description of Artificial Sequence: Synthetic oligonucleotide
cacatgagggagtccacagaaaaccttcactc

SEQ ID NO: 160709 - DNA, 32 bp, Artificial Sequence
  Description of Artificial Sequence: Synthetic oligonucleotide
acatgagggagtccacagaaaaccttcactcc

SEQ ID NO: 160710 - DNA, 31 bp, Artificial Sequence
  Description of Artificial Sequence: Synthetic oligonucleotide
catgagggagtccacagaaaaccttcactcc

SEQ ID NO: 160711 - DNA, 32 bp, Artificial Sequence
  Description of Artificial Sequence: Synthetic oligonucleotide
atgagggagtccacagaaaaccttcactcctg

SEQ ID NO: 160712 - DNA, 31 bp, Artificial Sequence
  Description of Artificial Sequence: Synthetic oligonucleotide
tgagggagtccacagaaaaccttcactcctg

SEQ ID NO: 160713 - DNA, 30 bp, Artificial Sequence
  Description of Artificial Sequence: Synthetic oligonucleotide
gagggagtccacagaaaaccttcactcctg

SEQ ID NO: 160714 - DNA, 30 bp, Artificial Sequence
  Description of Artificial Sequence: Synthetic oligonucleotide
agggagtccacagaaaaccttcactcctgg

SEQ ID NO: 160715 - DNA, 29 bp, Artificial Sequence
  Description of Artificial Sequence: Synthetic oligonucleotide
gggagtccacagaaaaccttcactcctgg

SEQ ID NO: 160716 - DNA, 29 bp, Artificial Sequence
  Description of Artificial Sequence: Synthetic oligonucleotide
ggagtccacagaaaaccttcactcctggc

SEQ ID NO: 160717 - DNA, 29 bp, Artificial Sequence
  Description of Artificial Sequence: Synthetic oligonucleotide
gagtccacagaaaaccttcactcctggcc

SEQ ID NO: 160718 - DNA, 29 bp, Artificial Sequence
  Description of Artificial Sequence: Synthetic oligonucleotide
agtccacagaaaaccttcactcctggccc

SEQ ID NO: 160719 - DNA, 28 bp, Artificial Sequence
  Description of Artificial Sequence: Synthetic oligonucleotide
gtccacagaaaaccttcactcctggccc

SEQ ID NO: 160720 - DNA, 29 bp, Artificial Sequence
  Description of Artificial Sequence: Synthetic oligonucleotide
tccacagaaaaccttcactcctggcccac

SEQ ID NO: 160721 - DNA, 28 bp, Artificial Sequence
  Description of Artificial Sequence: Synthetic oligonucleotide
ccacagaaaaccttcactcctggcccac

SEQ ID NO: 160722 - DNA, 28 bp, Artificial Sequence
  Description of Artificial Sequence: Synthetic oligonucleotide
cacagaaaaccttcactcctggcccacc

SEQ ID NO: 160723 - DNA, 28 bp, Artificial Sequence
  Description of Artificial Sequence: Synthetic oligonucleotide
acagaaaaccttcactcctggcccaccc

SEQ ID NO: 160724 - DNA, 27 bp, Artificial Sequence
  Description of Artificial Sequence: Synthetic oligonucleotide
cagaaaaccttcactcctggcccaccc

SEQ ID NO: 160725 - DNA, 28 bp, Artificial Sequence
  Description of Artificial Sequence: Synthetic oligonucleotide
agaaaaccttcactcctggcccacccag

SEQ ID NO: 160726 - DNA, 27 bp, Artificial Sequence
  Description of Artificial Sequence: Synthetic oligonucleotide
gaaaaccttcactcctggcccacccag

SEQ ID NO: 160727 - DNA, 27 bp, Artificial Sequence
  Description of Artificial Sequence: Synthetic oligonucleotide
aaaaccttcactcctggcccacccagg

SEQ ID NO: 160728 - DNA, 27 bp, Artificial Sequence
  Description of Artificial Sequence: Synthetic oligonucleotide
aaaccttcactcctggcccacccaggt

SEQ ID NO: 160729 - DNA, 26 bp, Artificial Sequence
  Description of Artificial Sequence: Synthetic oligonucleotide
aaccttcactcctggcccacccaggt

SEQ ID NO: 160730 - DNA, 25 bp, Artificial Sequence
  Description of Artificial Sequence: Synthetic oligonucleotide
accttcactcctggcccacccaggt

SEQ ID NO: 160731 - DNA, 24 bp, Artificial Sequence
  Description of Artificial Sequence: Synthetic oligonucleotide
ccttcactcctggcccacccaggt

SEQ ID NO: 160732 - DNA, 24 bp, Artificial Sequence
  Description of Artificial Sequence: Synthetic oligonucleotide
cttcactcctggcccacccaggtc

SEQ ID NO: 160733 - DNA, 24 bp, Artificial Sequence
  Description of Artificial Sequence: Synthetic oligonucleotide
ttcactcctggcccacccaggtcg

SEQ ID NO: 160734 - DNA, 23 bp, Artificial Sequence
  Description of Artificial Sequence: Synthetic oligonucleotide
tcactcctggcccacccaggtcg

SEQ ID NO: 160735 - DNA, 22 bp, Artificial Sequence
  Description of Artificial Sequence: Synthetic oligonucleotide
cactcctggcccacccaggtcg

SEQ ID NO: 160736 - DNA, 22 bp, Artificial Sequence
  Description of Artificial Sequence: Synthetic oligonucleotide
actcctggcccacccaggtcgc

SEQ ID NO: 160737 - DNA, 32 bp, Artificial Sequence
  Description of Artificial Sequence: Synthetic oligonucleotide
cgaaaccggtaaccccagacacctacatattc

SEQ ID NO: 160738 - DNA, 33 bp, Artificial Sequence
  Description of Artificial Sequence: Synthetic oligonucleotide
gaaaccggtaaccccagacacctacatattctg

SEQ ID NO: 160739 - DNA, 36 bp, Artificial Sequence
  Description of Artificial Sequence: Synthetic oligonucleotide
aaaccggtaaccccagacacctacatattctgattg

SEQ ID NO: 160740 - DNA, 35 bp, Artificial Sequence
  Description of Artificial Sequence: Synthetic oligonucleotide
aaccggtaaccccagacacctacatattctgattg

SEQ ID NO: 160741 - DNA, 34 bp, Artificial Sequence
  Description of Artificial Sequence: Synthetic oligonucleotide
accggtaaccccagacacctacatattctgattg

SEQ ID NO: 160742 - DNA, 33 bp, Artificial Sequence
  Description of Artificial Sequence: Synthetic oligonucleotide
ccggtaaccccagacacctacatattctgattg

SEQ ID NO: 160743 - DNA, 33 bp, Artificial Sequence
  Description of Artificial Sequence: Synthetic oligonucleotide
cggtaaccccagacacctacatattctgattgg

SEQ ID NO: 160744 - DNA, 33 bp, Artificial Sequence
  Description of Artificial Sequence: Synthetic oligonucleotide
ggtaaccccagacacctacatattctgattggg

SEQ ID NO: 160745 - DNA, 34 bp, Artificial Sequence
  Description of Artificial Sequence: Synthetic oligonucleotide
gtaaccccagacacctacatattctgattgggac

SEQ ID NO: 160746 - DNA, 34 bp, Artificial Sequence
  Description of Artificial Sequence: Synthetic oligonucleotide
taaccccagacacctacatattctgattgggacc

SEQ ID NO: 160747 - DNA, 33 bp, Artificial Sequence
  Description of Artificial Sequence: Synthetic oligonucleotide
aaccccagacacctacatattctgattgggacc

SEQ ID NO: 160748 - DNA, 32 bp, Artificial Sequence
  Description of Artificial Sequence: Synthetic oligonucleotide
accccagacacctacatattctgattgggacc

SEQ ID NO: 160749 - DNA, 31 bp, Artificial Sequence
  Description of Artificial Sequence: Synthetic oligonucleotide
ccccagacacctacatattctgattgggacc

SEQ ID NO: 160750 - DNA, 32 bp, Artificial Sequence
  Description of Artificial Sequence: Synthetic oligonucleotide
cccagacacctacatattctgattgggacctc

SEQ ID NO: 160751 - DNA, 33 bp, Artificial Sequence
  Description of Artificial Sequence: Synthetic oligonucleotide
ccagacacctacatattctgattgggacctcag

SEQ ID NO: 160752 - DNA, 34 bp, Artificial Sequence
  Description of Artificial Sequence: Synthetic oligonucleotide
cagacacctacatattctgattgggacctcagtg

SEQ ID NO: 160753 - DNA, 34 bp, Artificial Sequence
  Description of Artificial Sequence: Synthetic oligonucleotide
agacacctacatattctgattgggacctcagtgg

SEQ ID NO: 160754 - DNA, 33 bp, Artificial Sequence
  Description of Artificial Sequence: Synthetic oligonucleotide
gacacctacatattctgattgggacctcagtgg

SEQ ID NO: 160755 - DNA, 34 bp, Artificial Sequence
  Description of Artificial Sequence: Synthetic oligonucleotide
acacctacatattctgattgggacctcagtggtc

SEQ ID NO: 160756 - DNA, 33 bp, Artificial Sequence
  Description of Artificial Sequence: Synthetic oligonucleotide
cacctacatattctgattgggacctcagtggtc

SEQ ID NO: 160757 - DNA, 38 bp, Artificial Sequence
  Description of Artificial Sequence: Synthetic oligonucleotide
acctacatattctgattgggacctcagtggtcaaaatc

SEQ ID NO: 160758 - DNA, 37 bp, Artificial Sequence
  Description of Artificial Sequence: Synthetic oligonucleotide
cctacatattctgattgggacctcagtggtcaaaatc

SEQ ID NO: 160759 - DNA, 37 bp, Artificial Sequence
  Description of Artificial Sequence: Synthetic oligonucleotide
ctacatattctgattgggacctcagtggtcaaaatcc

SEQ ID NO: 160760 - DNA, 37 bp, Artificial Sequence
  Description of Artificial Sequence: Synthetic oligonucleotide
tacatattctgattgggacctcagtggtcaaaatccc

SEQ ID NO: 160761 - DNA, 36 bp, Artificial Sequence
  Description of Artificial Sequence: Synthetic oligonucleotide
acatattctgattgggacctcagtggtcaaaatccc

SEQ ID NO: 160762 - DNA, 35 bp, Artificial Sequence
  Description of Artificial Sequence: Synthetic oligonucleotide
catattctgattgggacctcagtggtcaaaatccc

SEQ ID NO: 160763 - DNA, 38 bp, Artificial Sequence
  Description of Artificial Sequence: Synthetic oligonucleotide
atattctgattgggacctcagtggtcaaaatccctttc

SEQ ID NO: 160764 - DNA, 37 bp, Artificial Sequence
  Description of Artificial Sequence: Synthetic oligonucleotide
tattctgattgggacctcagtggtcaaaatccctttc

SEQ ID NO: 160765 - DNA, 36 bp, Artificial Sequence
  Description of Artificial Sequence: Synthetic oligonucleotide
attctgattgggacctcagtggtcaaaatccctttc

SEQ ID NO: 160766 - DNA, 29 bp, Artificial Sequence
  Description of Artificial Sequence: Synthetic oligonucleotide
agcacttccttctgcacagagaggggaag

SEQ ID NO: 160767 - DNA, 28 bp, Artificial Sequence
  Description of Artificial Sequence: Synthetic oligonucleotide
gcacttccttctgcacagagaggggaag

SEQ ID NO: 160768 - DNA, 33 bp, Artificial Sequence
  Description of Artificial Sequence: Synthetic oligonucleotide
cacttccttctgcacagagaggggaagtataag

SEQ ID NO: 160769 - DNA, 33 bp, Artificial Sequence
  Description of Artificial Sequence: Synthetic oligonucleotide
acttccttctgcacagagaggggaagtataagg

SEQ ID NO: 160770 - DNA, 32 bp, Artificial Sequence
  Description of Artificial Sequence: Synthetic oligonucleotide
cttccttctgcacagagaggggaagtataagg

SEQ ID NO: 160771 - DNA, 33 bp, Artificial Sequence
  Description of Artificial Sequence: Synthetic oligonucleotide
ttccttctgcacagagaggggaagtataaggac

SEQ ID NO: 160772 - DNA, 32 bp, Artificial Sequence
  Description of Artificial Sequence: Synthetic oligonucleotide
tccttctgcacagagaggggaagtataaggac

SEQ ID NO: 160773 - DNA, 31 bp, Artificial Sequence
  Description of Artificial Sequence: Synthetic oligonucleotide
ccttctgcacagagaggggaagtataaggac

SEQ ID NO: 160774 - DNA, 32 bp, Artificial Sequence
  Description of Artificial Sequence: Synthetic oligonucleotide
cttctgcacagagaggggaagtataaggacac

SEQ ID NO: 160775 - DNA, 35 bp, Artificial Sequence
  Description of Artificial Sequence: Synthetic oligonucleotide
ttctgcacagagaggggaagtataaggacactttg

SEQ ID NO: 160776 - DNA, 34 bp, Artificial Sequence
  Description of Artificial Sequence: Synthetic oligonucleotide
tctgcacagagaggggaagtataaggacactttg

SEQ ID NO: 160777 - DNA, 33 bp, Artificial Sequence
  Description of Artificial Sequence: Synthetic oligonucleotide
ctgcacagagaggggaagtataaggacactttg

SEQ ID NO: 160778 - DNA, 33 bp, Artificial Sequence
  Description of Artificial Sequence: Synthetic oligonucleotide
tgcacagagaggggaagtataaggacactttgc

SEQ ID NO: 160779 - DNA, 32 bp, Artificial Sequence
  Description of Artificial Sequence: Synthetic oligonucleotide
gcacagagaggggaagtataaggacactttgc

SEQ ID NO: 160780 - DNA, 33 bp, Artificial Sequence
  Description of Artificial Sequence: Synthetic oligonucleotide
cacagagaggggaagtataaggacactttgcac

SEQ ID NO: 160781 - DNA, 33 bp, Artificial Sequence
  Description of Artificial Sequence: Synthetic oligonucleotide
acagagaggggaagtataaggacactttgcacc

SEQ ID NO: 160782 - DNA, 32 bp, Artificial Sequence
  Description of Artificial Sequence: Synthetic oligonucleotide
cagagaggggaagtataaggacactttgcacc

SEQ ID NO: 160783 - DNA, 33 bp, Artificial Sequence
  Description of Artificial Sequence: Synthetic oligonucleotide
agagaggggaagtataaggacactttgcacctc

SEQ ID NO: 160784 - DNA, 32 bp, Artificial Sequence
  Description of Artificial Sequence: Synthetic oligonucleotide
gagaggggaagtataaggacactttgcacctc

SEQ ID NO: 160785 - DNA, 35 bp, Artificial Sequence
  Description of Artificial Sequence: Synthetic oligonucleotide
agaggggaagtataaggacactttgcacctcattg

SEQ ID NO: 160786 - DNA, 34 bp, Artificial Sequence
  Description of Artificial Sequence: Synthetic oligonucleotide
gaggggaagtataaggacactttgcacctcattg

SEQ ID NO: 160787 - DNA, 34 bp, Artificial Sequence
  Description of Artificial Sequence: Synthetic oligonucleotide
aggggaagtataaggacactttgcacctcattgg

SEQ ID NO: 160788 - DNA, 33 bp, Artificial Sequence
  Description of Artificial Sequence: Synthetic oligonucleotide
ggggaagtataaggacactttgcacctcattgg

SEQ ID NO: 160789 - DNA, 34 bp, Artificial Sequence
  Description of Artificial Sequence: Synthetic oligonucleotide
gggaagtataaggacactttgcacctcattggag

SEQ ID NO: 160790 - DNA, 35 bp, Artificial Sequence
  Description of Artificial Sequence: Synthetic oligonucleotide
ggaagtataaggacactttgcacctcattggagag

SEQ ID NO: 160791 - DNA, 35 bp, Artificial Sequence
  Description of Artificial Sequence: Synthetic oligonucleotide
gaagtataaggacactttgcacctcattggagagc

SEQ ID NO: 160792 - DNA, 36 bp, Artificial Sequence
  Description of Artificial Sequence: Synthetic oligonucleotide
aagtataaggacactttgcacctcattggagagcac

SEQ ID NO: 160793 - DNA, 35 bp, Artificial Sequence
  Description of Artificial Sequence: Synthetic oligonucleotide
agtataaggacactttgcacctcattggagagcac

SEQ ID NO: 160794 - DNA, 34 bp, Artificial Sequence
  Description of Artificial Sequence: Synthetic oligonucleotide
gtataaggacactttgcacctcattggagagcac

SEQ ID NO: 160795 - DNA, 34 bp, Artificial Sequence
  Description of Artificial Sequence: Synthetic oligonucleotide
tataaggacactttgcacctcattggagagcacc

SEQ ID NO: 160796 - DNA, 33 bp, Artificial Sequence
  Description of Artificial Sequence: Synthetic oligonucleotide
ataaggacactttgcacctcattggagagcacc

SEQ ID NO: 160797 - DNA, 22 bp, Artificial Sequence
  Description of Artificial Sequence: Synthetic oligonucleotide
cccagccgggccccacggtttt

SEQ ID NO: 160798 - DNA, 22 bp, Artificial Sequence
  Description of Artificial Sequence: Synthetic oligonucleotide
ccagccgggccccacggttttg

SEQ ID NO: 160799 - DNA, 22 bp, Artificial Sequence
  Description of Artificial Sequence: Synthetic oligonucleotide
cagccgggccccacggttttgg

SEQ ID NO: 160800 - DNA, 23 bp, Artificial Sequence
  Description of Artificial Sequence: Synthetic oligonucleotide
agccgggccccacggttttggca

SEQ ID NO: 160801 - DNA, 22 bp, Artificial Sequence
  Description of Artificial Sequence: Synthetic oligonucleotide
gccgggccccacggttttggca

SEQ ID NO: 160802 - DNA, 22 bp, Artificial Sequence
  Description of Artificial Sequence: Synthetic oligonucleotide
ccgggccccacggttttggcag

SEQ ID NO: 160803 - DNA, 23 bp, Artificial Sequence
  Description of Artificial Sequence: Synthetic oligonucleotide
cgggccccacggttttggcagga

SEQ ID NO: 160804 - DNA, 24 bp, Artificial Sequence
  Description of Artificial Sequence: Synthetic oligonucleotide
gggccccacggttttggcaggaga

SEQ ID NO: 160805 - DNA, 25 bp, Artificial Sequence
  Description of Artificial Sequence: Synthetic oligonucleotide
ggccccacggttttggcaggagaga

SEQ ID NO: 160806 - DNA, 25 bp, Artificial Sequence
  Description of Artificial Sequence: Synthetic oligonucleotide
gccccacggttttggcaggagagag

SEQ ID NO: 160807 - DNA, 25 bp, Artificial Sequence
  Description of Artificial Sequence: Synthetic oligonucleotide
ccccacggttttggcaggagagagc

SEQ ID NO: 160808 - DNA, 26 bp, Artificial Sequence
  Description of Artificial Sequence: Synthetic oligonucleotide
cccacggttttggcaggagagagcgt

SEQ ID NO: 160809 - DNA, 27 bp, Artificial Sequence
  Description of Artificial Sequence: Synthetic oligonucleotide
ccacggttttggcaggagagagcgtga

SEQ ID NO: 160810 - DNA, 27 bp, Artificial Sequence
  Description of Artificial Sequence: Synthetic oligonucleotide
cacggttttggcaggagagagcgtgac

SEQ ID NO: 160811 - DNA, 27 bp, Artificial Sequence
  Description of Artificial Sequence: Synthetic oligonucleotide
acggttttggcaggagagagcgtgacc

SEQ ID NO: 160812 - DNA, 27 bp, Artificial Sequence
  Description of Artificial Sequence: Synthetic oligonucleotide
cggttttggcaggagagagcgtgacct

SEQ ID NO: 160813 - DNA, 28 bp, Artificial Sequence
  Description of Artificial Sequence: Synthetic oligonucleotide
ggttttggcaggagagagcgtgaccttg

SEQ ID NO: 160814 - DNA, 29 bp, Artificial Sequence
  Description of Artificial Sequence: Synthetic oligonucleotide
gttttggcaggagagagcgtgaccttgtc

SEQ ID NO: 160815 - DNA, 29 bp, Artificial Sequence
  Description of Artificial Sequence: Synthetic oligonucleotide
ttttggcaggagagagcgtgaccttgtcc

SEQ ID NO: 160816 - DNA, 28 bp, Artificial Sequence
  Description of Artificial Sequence: Synthetic oligonucleotide
tttggcaggagagagcgtgaccttgtcc

SEQ ID NO: 160817 - DNA, 27 bp, Artificial Sequence
  Description of Artificial Sequence: Synthetic oligonucleotide
ttggcaggagagagcgtgaccttgtcc

SEQ ID NO: 160818 - DNA, 29 bp, Artificial Sequence
  Description of Artificial Sequence: Synthetic oligonucleotide
caaaaccggtaaccccagacacctgcatg

SEQ ID NO: 160819 - DNA, 31 bp, Artificial Sequence
  Description of Artificial Sequence: Synthetic oligonucleotide
aaaaccggtaaccccagacacctgcatgttc

SEQ ID NO: 160820 - DNA, 35 bp, Artificial Sequence
  Description of Artificial Sequence: Synthetic oligonucleotide
tgcatgttctgattgggacctcagtggtcaaaatc

SEQ ID NO: 160821 - DNA, 34 bp, Artificial Sequence
  Description of Artificial Sequence: Synthetic oligonucleotide
gcatgttctgattgggacctcagtggtcaaaatc

SEQ ID NO: 160822 - DNA, 38 bp, Artificial Sequence
  Description of Artificial Sequence: Synthetic oligonucleotide
ctccaacaaaaaaaatgctgctgtaatggaccaagagc

SEQ ID NO: 160823 - DNA, 38 bp, Artificial Sequence
  Description of Artificial Sequence: Synthetic oligonucleotide
tccaacaaaaaaaatgctgctgtaatggaccaagagcc

SEQ ID NO: 160824 - DNA, 37 bp, Artificial Sequence
  Description of Artificial Sequence: Synthetic oligonucleotide
ccaacaaaaaaaatgctgctgtaatggaccaagagcc

SEQ ID NO: 160825 - DNA, 25 bp, Artificial Sequence
  Description of Artificial Sequence: Synthetic oligonucleotide
atctatccagggagggggaggccca

SEQ ID NO: 160826 - DNA, 24 bp, Artificial Sequence
  Description of Artificial Sequence: Synthetic oligonucleotide
tctatccagggagggggaggccca

SEQ ID NO: 160827 - DNA, 23 bp, Artificial Sequence
  Description of Artificial Sequence: Synthetic oligonucleotide
ctatccagggagggggaggccca

SEQ ID NO: 160828 - DNA, 23 bp, Artificial Sequence
  Description of Artificial Sequence: Synthetic oligonucleotide
tatccagggagggggaggcccac

SEQ ID NO: 160829 - DNA, 22 bp, Artificial Sequence
  Description of Artificial Sequence: Synthetic oligonucleotide
atccagggagggggaggcccac

SEQ ID NO: 160830 - DNA, 21 bp, Artificial Sequence
  Description of Artificial Sequence: Synthetic oligonucleotide
tccagggagggggaggcccac

SEQ ID NO: 160831 - DNA, 20 bp, Artificial Sequence
  Description of Artificial Sequence: Synthetic oligonucleotide
ccagggagggggaggcccac

SEQ ID NO: 160832 - DNA, 22 bp, Artificial Sequence
  Description of Artificial Sequence: Synthetic oligonucleotide
cagggagggggaggcccacgaa

SEQ ID NO: 160833 - DNA, 22 bp, Artificial Sequence
  Description of Artificial Sequence: Synthetic oligonucleotide
agggagggggaggcccacgaac

SEQ ID NO: 160834 - DNA, 21 bp, Artificial Sequence
  Description of Artificial Sequence: Synthetic oligonucleotide
gggagggggaggcccacgaac

SEQ ID NO: 160835 - DNA, 23 bp, Artificial Sequence
  Description of Artificial Sequence: Synthetic oligonucleotide
ggagggggaggcccacgaacgta

SEQ ID NO: 160836 - DNA, 23 bp, Artificial Sequence
  Description of Artificial Sequence: Synthetic oligonucleotide
gagggggaggcccacgaacgtag

SEQ ID NO: 160837 - DNA, 25 bp, Artificial Sequence
  Description of Artificial Sequence: Synthetic oligonucleotide
agggggaggcccacgaacgtaggtt

SEQ ID NO: 160838 - DNA, 24 bp, Artificial Sequence
  Description of Artificial Sequence: Synthetic oligonucleotide
gggggaggcccacgaacgtaggtt

SEQ ID NO: 160839 - DNA, 25 bp, Artificial Sequence
  Description of Artificial Sequence: Synthetic oligonucleotide
ggggaggcccacgaacgtaggttct

SEQ ID NO: 160840 - DNA, 26 bp, Artificial Sequence
  Description of Artificial Sequence: Synthetic oligonucleotide
gggaggcccacgaacgtaggttctct

SEQ ID NO: 160841 - DNA, 26 bp, Artificial Sequence
  Description of Artificial Sequence: Synthetic oligonucleotide
ggaggcccacgaacgtaggttctctg

SEQ ID NO: 160842 - DNA, 27 bp, Artificial Sequence
  Description of Artificial Sequence: Synthetic oligonucleotide
gaggcccacgaacgtaggttctctgca

SEQ ID NO: 160843 - DNA, 27 bp, Artificial Sequence
  Description of Artificial Sequence: Synthetic oligonucleotide
aggcccacgaacgtaggttctctgcag

SEQ ID NO: 160844 - DNA, 26 bp, Artificial Sequence
  Description of Artificial Sequence: Synthetic oligonucleotide
ggcccacgaacgtaggttctctgcag

SEQ ID NO: 160845 - DNA, 26 bp, Artificial Sequence
  Description of Artificial Sequence: Synthetic oligonucleotide
gcccacgaacgtaggttctctgcagg

SEQ ID NO: 160846 - DNA, 26 bp, Artificial Sequence
  Description of Artificial Sequence: Synthetic oligonucleotide
cccacgaacgtaggttctctgcaggg

SEQ ID NO: 160847 - DNA, 26 bp, Artificial Sequence
  Description of Artificial Sequence: Synthetic oligonucleotide
ccacgaacgtaggttctctgcagggc

SEQ ID NO: 160848 - DNA, 26 bp, Artificial Sequence
  Description of Artificial Sequence: Synthetic oligonucleotide
cacgaacgtaggttctctgcagggcc

SEQ ID NO: 160849 - DNA, 27 bp, Artificial Sequence
  Description of Artificial Sequence: Synthetic oligonucleotide
acgaacgtaggttctctgcagggccca

SEQ ID NO: 160850 - DNA, 27 bp, Artificial Sequence
  Description of Artificial Sequence: Synthetic oligonucleotide
cgaacgtaggttctctgcagggcccaa

SEQ ID NO: 160851 - DNA, 26 bp, Artificial Sequence
  Description of Artificial Sequence: Synthetic oligonucleotide
ttgggttcttcttgctgcagggggcc

SEQ ID NO: 160852 - DNA, 25 bp, Artificial Sequence
  Description of Artificial Sequence: Synthetic oligonucleotide
tgggttcttcttgctgcagggggcc

SEQ ID NO: 160853 - DNA, 24 bp, Artificial Sequence
  Description of Artificial Sequence: Synthetic oligonucleotide
gggttcttcttgctgcagggggcc

SEQ ID NO: 160854 - DNA, 24 bp, Artificial Sequence
  Description of Artificial Sequence: Synthetic oligonucleotide
ggttcttcttgctgcagggggccg

SEQ ID NO: 160855 - DNA, 24 bp, Artificial Sequence
  Description of Artificial Sequence: Synthetic oligonucleotide
gttcttcttgctgcagggggccgg

SEQ ID NO: 160856 - DNA, 24 bp, Artificial Sequence
  Description of Artificial Sequence: Synthetic oligonucleotide
ttcttcttgctgcagggggccggg

SEQ ID NO: 160857 - DNA, 23 bp, Artificial Sequence
  Description of Artificial Sequence: Synthetic oligonucleotide
tcttcttgctgcagggggccggg

SEQ ID NO: 160858 - DNA, 22 bp, Artificial Sequence
  Description of Artificial Sequence: Synthetic oligonucleotide
cttcttgctgcagggggccggg

SEQ ID NO: 160859 - DNA, 22 bp, Artificial Sequence
  Description of Artificial Sequence: Synthetic oligonucleotide
ttcttgctgcagggggccgggc

SEQ ID NO: 160860 - DNA, 21 bp, Artificial Sequence
  Description of Artificial Sequence: Synthetic oligonucleotide
tcttgctgcagggggccgggc

SEQ ID NO: 160861 - DNA, 20 bp, Artificial Sequence
  Description of Artificial Sequence: Synthetic oligonucleotide
cttgctgcagggggccgggc

SEQ ID NO: 160862 - DNA, 21 bp, Artificial Sequence
  Description of Artificial Sequence: Synthetic oligonucleotide
ttgctgcagggggccgggcca

SEQ ID NO: 160863 - DNA, 20 bp, Artificial Sequence
  Description of Artificial Sequence: Synthetic oligonucleotide
tgctgcagggggccgggcca

SEQ ID NO: 160864 - DNA, 20 bp, Artificial Sequence
  Description of Artificial Sequence: Synthetic oligonucleotide
gctgcagggggccgggccat

SEQ ID NO: 160865 - DNA, 21 bp, Artificial Sequence
  Description of Artificial Sequence: Synthetic oligonucleotide
ctgcagggggccgggccacat

SEQ ID NO: 160866 - DNA, 22 bp, Artificial Sequence
  Description of Artificial Sequence: Synthetic oligonucleotide
tgcagggggccgggccacatga

SEQ ID NO: 160867 - DNA, 21 bp, Artificial Sequence
  Description of Artificial Sequence: Synthetic oligonucleotide
gcagggggccgggccacatga

SEQ ID NO: 160868 - DNA, 21 bp, Artificial Sequence
  Description of Artificial Sequence: Synthetic oligonucleotide
cagggggccgggccacatgag

SEQ ID NO: 160869 - DNA, 21 bp, Artificial Sequence
  Description of Artificial Sequence: Synthetic oligonucleotide
agggggccgggccacatgagg

SEQ ID NO: 160870 - DNA, 20 bp, Artificial Sequence
  Description of Artificial Sequence: Synthetic oligonucleotide
gggggccgggccacatgagg

SEQ ID NO: 160871 - DNA, 21 bp, Artificial Sequence
  Description of Artificial Sequence: Synthetic oligonucleotide
ggggccgggccacatgaggga

SEQ ID NO: 160872 - DNA, 22 bp, Artificial Sequence
  Description of Artificial Sequence: Synthetic oligonucleotide
gggccgggccacatgagggagt

SEQ ID NO: 160873 - DNA, 22 bp, Artificial Sequence
  Description of Artificial Sequence: Synthetic oligonucleotide
ggccgggccacatgagggagtc

SEQ ID NO: 160874 - DNA, 23 bp, Artificial Sequence
  Description of Artificial Sequence: Synthetic oligonucleotide
gccgggccacatgagggagtcca

SEQ ID NO: 160875 - DNA, 24 bp, Artificial Sequence
  Description of Artificial Sequence: Synthetic oligonucleotide
ccgggccacatgagggagtccaca

SEQ ID NO: 160876 - DNA, 27 bp, Artificial Sequence
  Description of Artificial Sequence: Synthetic oligonucleotide
cgggccacatgagggagtccacagaaa

SEQ ID NO: 160877 - DNA, 28 bp, Artificial Sequence
  Description of Artificial Sequence: Synthetic oligonucleotide
gggccacatgagggagtccacagaaaac

SEQ ID NO: 160878 - DNA, 31 bp, Artificial Sequence
  Description of Artificial Sequence: Synthetic oligonucleotide
ccactgaaccaagctccaaaaccggtaactc

SEQ ID NO: 160879 - DNA, 31 bp, Artificial Sequence
  Description of Artificial Sequence: Synthetic oligonucleotide
cactgaaccaagctccaaaaccggtaactcc

SEQ ID NO: 160880 - DNA, 32 bp, Artificial Sequence
  Description of Artificial Sequence: Synthetic oligonucleotide
actgaaccaagctccaaaaccggtaactccag

SEQ ID NO: 160881 - DNA, 31 bp, Artificial Sequence
  Description of Artificial Sequence: Synthetic oligonucleotide
ctgaaccaagctccaaaaccggtaactccag

SEQ ID NO: 160882 - DNA, 34 bp, Artificial Sequence
  Description of Artificial Sequence: Synthetic oligonucleotide
tgaaccaagctccaaaaccggtaactccagatac

SEQ ID NO: 160883 - DNA, 33 bp, Artificial Sequence
  Description of Artificial Sequence: Synthetic oligonucleotide
gaaccaagctccaaaaccggtaactccagatac

SEQ ID NO: 160884 - DNA, 33 bp, Artificial Sequence
  Description of Artificial Sequence: Synthetic oligonucleotide
aaccaagctccaaaaccggtaactccagatacc

SEQ ID NO: 160885 - DNA, 32 bp, Artificial Sequence
  Description of Artificial Sequence: Synthetic oligonucleotide
accaagctccaaaaccggtaactccagatacc

SEQ ID NO: 160886 - DNA, 31 bp, Artificial Sequence
  Description of Artificial Sequence: Synthetic oligonucleotide
ccaagctccaaaaccggtaactccagatacc

SEQ ID NO: 160887 - DNA, 32 bp, Artificial Sequence
  Description of Artificial Sequence: Synthetic oligonucleotide
caagctccaaaaccggtaactccagatacctg

SEQ ID NO: 160888 - DNA, 32 bp, Artificial Sequence
  Description of Artificial Sequence: Synthetic oligonucleotide
aagctccaaaaccggtaactccagatacctgc

SEQ ID NO: 160889 - DNA, 31 bp, Artificial Sequence
  Description of Artificial Sequence: Synthetic oligonucleotide
agctccaaaaccggtaactccagatacctgc

SEQ ID NO: 160890 - DNA, 30 bp, Artificial Sequence
  Description of Artificial Sequence: Synthetic oligonucleotide
gctccaaaaccggtaactccagatacctgc

SEQ ID NO: 160891 - DNA, 31 bp, Artificial Sequence
  Description of Artificial Sequence: Synthetic oligonucleotide
ctccaaaaccggtaactccagatacctgcac

SEQ ID NO: 160892 - DNA, 31 bp, Artificial Sequence
  Description of Artificial Sequence: Synthetic oligonucleotide
tccaaaaccggtaactccagatacctgcacg

SEQ ID NO: 160893 - DNA, 30 bp, Artificial Sequence
  Description of Artificial Sequence: Synthetic oligonucleotide
ccaaaaccggtaactccagatacctgcacg

SEQ ID NO: 160894 - DNA, 30 bp, Artificial Sequence
  Description of Artificial Sequence: Synthetic oligonucleotide
caaaaccggtaactccagatacctgcacgc

SEQ ID NO: 160895 - DNA, 31 bp, Artificial Sequence
  Description of Artificial Sequence: Synthetic oligonucleotide
aaaaccggtaactccagatacctgcacgctc

SEQ ID NO: 160896 - DNA, 30 bp, Artificial Sequence
  Description of Artificial Sequence: Synthetic oligonucleotide
aaaccggtaactccagatacctgcacgctc

SEQ ID NO: 160897 - DNA, 29 bp, Artificial Sequence
  Description of Artificial Sequence: Synthetic oligonucleotide
aaccggtaactccagatacctgcacgctc

SEQ ID NO: 160898 - DNA, 28 bp, Artificial Sequence
  Description of Artificial Sequence: Synthetic oligonucleotide
accggtaactccagatacctgcacgctc

SEQ ID NO: 160899 - DNA, 27 bp, Artificial Sequence
  Description of Artificial Sequence: Synthetic oligonucleotide
ccggtaactccagatacctgcacgctc

SEQ ID NO: 160900 - DNA, 28 bp, Artificial Sequence
  Description of Artificial Sequence: Synthetic oligonucleotide
cggtaactccagatacctgcacgctctg

SEQ ID NO: 160901 - DNA, 31 bp, Artificial Sequence
  Description of Artificial Sequence: Synthetic oligonucleotide
ggtaactccagatacctgcacgctctgattg

SEQ ID NO: 160902 - DNA, 31 bp, Artificial Sequence
  Description of Artificial Sequence: Synthetic oligonucleotide
gtaactccagatacctgcacgctctgattgg

SEQ ID NO: 160903 - DNA, 31 bp, Artificial Sequence
  Description of Artificial Sequence: Synthetic oligonucleotide
taactccagatacctgcacgctctgattggg

SEQ ID NO: 160904 - DNA, 30 bp, Artificial Sequence
  Description of Artificial Sequence: Synthetic oligonucleotide
aactccagatacctgcacgctctgattggg

SEQ ID NO: 160905 - DNA, 29 bp, Artificial Sequence
  Description of Artificial Sequence: Synthetic oligonucleotide
actccagatacctgcacgctctgattggg

SEQ ID NO: 160906 - DNA, 28 bp, Artificial Sequence
  Description of Artificial Sequence: Synthetic oligonucleotide
ctccagatacctgcacgctctgattggg

SEQ ID NO: 160907 - DNA, 29 bp, Artificial Sequence
  Description of Artificial Sequence: Synthetic oligonucleotide
tccagatacctgcacgctctgattgggac

SEQ ID NO: 160908 - DNA, 28 bp, Artificial Sequence
  Description of Artificial Sequence: Synthetic oligonucleotide
ccagatacctgcacgctctgattgggac

SEQ ID NO: 160909 - DNA, 28 bp, Artificial Sequence
  Description of Artificial Sequence: Synthetic oligonucleotide
cagatacctgcacgctctgattgggacc

SEQ ID NO: 160910 - DNA, 29 bp, Artificial Sequence
  Description of Artificial Sequence: Synthetic oligonucleotide
agatacctgcacgctctgattgggacctc

SEQ ID NO: 160911 - DNA, 28 bp, Artificial Sequence
  Description of Artificial Sequence: Synthetic oligonucleotide
gatacctgcacgctctgattgggacctc

SEQ ID NO: 160912 - DNA, 29 bp, Artificial Sequence
  Description of Artificial Sequence: Synthetic oligonucleotide
atacctgcacgctctgattgggacctcag

SEQ ID NO: 160913 - DNA, 28 bp, Artificial Sequence
  Description of Artificial Sequence: Synthetic oligonucleotide
tacctgcacgctctgattgggacctcag

SEQ ID NO: 160914 - DNA, 27 bp, Artificial Sequence
  Description of Artificial Sequence: Synthetic oligonucleotide
acctgcacgctctgattgggacctcag

SEQ ID NO: 160915 - DNA, 27 bp, Artificial Sequence
  Description of Artificial Sequence: Synthetic oligonucleotide
cctgcacgctctgattgggacctcagt

SEQ ID NO: 160916 - DNA, 27 bp, Artificial Sequence
  Description of Artificial Sequence: Synthetic oligonucleotide
ctgcacgctctgattgggacctcagtg

SEQ ID NO: 160917 - DNA, 27 bp, Artificial Sequence
  Description of Artificial Sequence: Synthetic oligonucleotide
tgcacgctctgattgggacctcagtgg

SEQ ID NO: 160918 - DNA, 27 bp, Artificial Sequence
  Description of Artificial Sequence: Synthetic oligonucleotide
gcacgctctgattgggacctcagtggt

SEQ ID NO: 160919 - DNA, 27 bp, Artificial Sequence
  Description of Artificial Sequence: Synthetic oligonucleotide
cacgctctgattgggacctcagtggtc

SEQ ID NO: 160920 - DNA, 29 bp, Artificial Sequence
  Description of Artificial Sequence: Synthetic oligonucleotide
acgctctgattgggacctcagtggtcatc

SEQ ID NO: 160921 - DNA, 28 bp, Artificial Sequence
  Description of Artificial Sequence: Synthetic oligonucleotide
cgctctgattgggacctcagtggtcatc

SEQ ID NO: 160922 - DNA, 30 bp, Artificial Sequence
  Description of Artificial Sequence: Synthetic oligonucleotide
gctctgattgggacctcagtggtcatcatc

SEQ ID NO: 160923 - DNA, 30 bp, Artificial Sequence
  Description of Artificial Sequence: Synthetic oligonucleotide
ctctgattgggacctcagtggtcatcatcc

SEQ ID NO: 160924 - DNA, 30 bp, Artificial Sequence
  Description of Artificial Sequence: Synthetic oligonucleotide
tctgattgggacctcagtggtcatcatccc

SEQ ID NO: 160925 - DNA, 29 bp, Artificial Sequence
  Description of Artificial Sequence: Synthetic oligonucleotide
ctgattgggacctcagtggtcatcatccc

SEQ ID NO: 160926 - DNA, 29 bp, Artificial Sequence
  Description of Artificial Sequence: Synthetic oligonucleotide
tgattgggacctcagtggtcatcatcccc

SEQ ID NO: 160927 - DNA, 28 bp, Artificial Sequence
  Description of Artificial Sequence: Synthetic oligonucleotide
gattgggacctcagtggtcatcatcccc

SEQ ID NO: 160928 - DNA, 31 bp, Artificial Sequence
  Description of Artificial Sequence: Synthetic oligonucleotide
attgggacctcagtggtcatcatcccctttg

SEQ ID NO: 160929 - DNA, 30 bp, Artificial Sequence
  Description of Artificial Sequence: Synthetic oligonucleotide
ttgggacctcagtggtcatcatcccctttg

SEQ ID NO: 160930 - DNA, 29 bp, Artificial Sequence
  Description of Artificial Sequence: Synthetic oligonucleotide
tgggacctcagtggtcatcatcccctttg

SEQ ID NO: 160931 - DNA, 28 bp, Artificial Sequence
  Description of Artificial Sequence: Synthetic oligonucleotide
gggacctcagtggtcatcatcccctttg

SEQ ID NO: 160932 - DNA, 28 bp, Artificial Sequence
  Description of Artificial Sequence: Synthetic oligonucleotide
ggacctcagtggtcatcatcccctttgc

SEQ ID NO: 160933 - DNA, 31 bp, Artificial Sequence
  Description of Artificial Sequence: Synthetic oligonucleotide
gacctcagtggtcatcatcccctttgctatc

SEQ ID NO: 160934 - DNA, 31 bp, Artificial Sequence
  Description of Artificial Sequence: Synthetic oligonucleotide
acctcagtggtcatcatcccctttgctatcc

SEQ ID NO: 160935 - DNA, 30 bp, Artificial Sequence
  Description of Artificial Sequence: Synthetic oligonucleotide
cctcagtggtcatcatcccctttgctatcc

SEQ ID NO: 160936 - DNA, 31 bp, Artificial Sequence
  Description of Artificial Sequence: Synthetic oligonucleotide
ctcagtggtcatcatcccctttgctatcctc

SEQ ID NO: 160937 - DNA, 31 bp, Artificial Sequence
  Description of Artificial Sequence: Synthetic oligonucleotide
tcagtggtcatcatcccctttgctatcctcc

SEQ ID NO: 160938 - DNA, 30 bp, Artificial Sequence
  Description of Artificial Sequence: Synthetic oligonucleotide
cagtggtcatcatcccctttgctatcctcc

SEQ ID NO: 160939 - DNA, 31 bp, Artificial Sequence
  Description of Artificial Sequence: Synthetic oligonucleotide
agtggtcatcatcccctttgctatcctcctc

SEQ ID NO: 160940 - DNA, 30 bp, Artificial Sequence
  Description of Artificial Sequence: Synthetic oligonucleotide
gtggtcatcatcccctttgctatcctcctc

SEQ ID NO: 160941 - DNA, 32 bp, Artificial Sequence
  Description of Artificial Sequence: Synthetic oligonucleotide
tggtcatcatcccctttgctatcctcctcttc

SEQ ID NO: 160942 - DNA, 31 bp, Artificial Sequence
  Description of Artificial Sequence: Synthetic oligonucleotide
ggtcatcatcccctttgctatcctcctcttc

SEQ ID NO: 160943 - DNA, 34 bp, Artificial Sequence
  Description of Artificial Sequence: Synthetic oligonucleotide
gtcatcatcccctttgctatcctcctcttctttc

SEQ ID NO: 160944 - DNA, 35 bp, Artificial Sequence
  Description of Artificial Sequence: Synthetic oligonucleotide
tcatcatcccctttgctatcctcctcttctttctc

SEQ ID NO: 160945 - DNA, 34 bp, Artificial Sequence
  Description of Artificial Sequence: Synthetic oligonucleotide
catcatcccctttgctatcctcctcttctttctc

SEQ ID NO: 160946 - DNA, 34 bp, Artificial Sequence
  Description of Artificial Sequence: Synthetic oligonucleotide
atcatcccctttgctatcctcctcttctttctcc

SEQ ID NO: 160947 - DNA, 33 bp, Artificial Sequence
  Description of Artificial Sequence: Synthetic oligonucleotide
tcatcccctttgctatcctcctcttctttctcc

SEQ ID NO: 160948 - DNA, 32 bp, Artificial Sequence
  Description of Artificial Sequence: Synthetic oligonucleotide
catcccctttgctatcctcctcttctttctcc

SEQ ID NO: 160949 - DNA, 34 bp, Artificial Sequence
  Description of Artificial Sequence: Synthetic oligonucleotide
atcccctttgctatcctcctcttctttctccttc

SEQ ID NO: 160950 - DNA, 33 bp, Artificial Sequence
  Description of Artificial Sequence: Synthetic oligonucleotide
tcccctttgctatcctcctcttctttctccttc

SEQ ID NO: 160951 - DNA, 32 bp, Artificial Sequence
  Description of Artificial Sequence: Synthetic oligonucleotide
cccctttgctatcctcctcttctttctccttc

SEQ ID NO: 160952 - DNA, 34 bp, Artificial Sequence
  Description of Artificial Sequence: Synthetic oligonucleotide
ccctttgctatcctcctcttctttctccttcatc

SEQ ID NO: 160953 - DNA, 34 bp, Artificial Sequence
  Description of Artificial Sequence: Synthetic oligonucleotide
cctttgctatcctcctcttctttctccttcatcg

SEQ ID NO: 160954 - DNA, 34 bp, Artificial Sequence
  Description of Artificial Sequence: Synthetic oligonucleotide
ctttgctatcctcctcttctttctccttcatcgc

SEQ ID NO: 160955 - DNA, 35 bp, Artificial Sequence
  Description of Artificial Sequence: Synthetic oligonucleotide
tttgctatcctcctcttctttctccttcatcgctg

SEQ ID NO: 160956 - DNA, 34 bp, Artificial Sequence
  Description of Artificial Sequence: Synthetic oligonucleotide
ttgctatcctcctcttctttctccttcatcgctg

SEQ ID NO: 160957 - DNA, 33 bp, Artificial Sequence
  Description of Artificial Sequence: Synthetic oligonucleotide
tgctatcctcctcttctttctccttcatcgctg

SEQ ID NO: 160958 - DNA, 32 bp, Artificial Sequence
  Description of Artificial Sequence: Synthetic oligonucleotide
gctatcctcctcttctttctccttcatcgctg

SEQ ID NO: 160959 - DNA, 32 bp, Artificial Sequence
  Description of Artificial Sequence: Synthetic oligonucleotide
ctatcctcctcttctttctccttcatcgctgg

SEQ ID NO: 160960 - DNA, 33 bp, Artificial Sequence
  Description of Artificial Sequence: Synthetic oligonucleotide
tatcctcctcttctttctccttcatcgctggtg

SEQ ID NO: 160961 - DNA, 31 bp, Artificial Sequence
  Description of Artificial Sequence: Synthetic oligonucleotide
ctcctcttctttctccttcatcgctggtgtg

SEQ ID NO: 160962 - DNA, 31 bp, Artificial Sequence
  Description of Artificial Sequence: Synthetic oligonucleotide
tcctcttctttctccttcatcgctggtgtgc

SEQ ID NO: 160963 - DNA, 30 bp, Artificial Sequence
  Description of Artificial Sequence: Synthetic oligonucleotide
cctcttctttctccttcatcgctggtgtgc

SEQ ID NO: 160964 - DNA, 30 bp, Artificial Sequence
  Description of Artificial Sequence: Synthetic oligonucleotide
ctcttctttctccttcatcgctggtgtgcc

SEQ ID NO: 160965 - DNA, 32 bp, Artificial Sequence
  Description of Artificial Sequence: Synthetic oligonucleotide
tcttctttctccttcatcgctggtgtgccaac

SEQ ID NO: 160966 - DNA, 31 bp, Artificial Sequence
  Description of Artificial Sequence: Synthetic oligonucleotide
cttctttctccttcatcgctggtgtgccaac

SEQ ID NO: 160967 - DNA, 40 bp, Artificial Sequence
  Description of Artificial Sequence: Synthetic oligonucleotide
ttctttctccttcatcgctggtgtgccaacaaaaaaaatg

SEQ ID NO: 160968 - DNA, 39 bp, Artificial Sequence
  Description of Artificial Sequence: Synthetic oligonucleotide
tctttctccttcatcgctggtgtgccaacaaaaaaaatg

SEQ ID NO: 160969 - DNA, 38 bp, Artificial Sequence
  Description of Artificial Sequence: Synthetic oligonucleotide
ctttctccttcatcgctggtgtgccaacaaaaaaaatg

SEQ ID NO: 160970 - DNA, 38 bp, Artificial Sequence
  Description of Artificial Sequence: Synthetic oligonucleotide
tttctccttcatcgctggtgtgccaacaaaaaaaatgc

SEQ ID NO: 160971 - DNA, 37 bp, Artificial Sequence
  Description of Artificial Sequence: Synthetic oligonucleotide
ttctccttcatcgctggtgtgccaacaaaaaaaatgc

SEQ ID NO: 160972 - DNA, 36 bp, Artificial Sequence
  Description of Artificial Sequence: Synthetic oligonucleotide
tctccttcatcgctggtgtgccaacaaaaaaaatgc

SEQ ID NO: 160973 - DNA, 35 bp, Artificial Sequence
  Description of Artificial Sequence: Synthetic oligonucleotide
ctccttcatcgctggtgtgccaacaaaaaaaatgc

SEQ ID NO: 160974 - DNA, 36 bp, Artificial Sequence
  Description of Artificial Sequence: Synthetic oligonucleotide
tccttcatcgctggtgtgccaacaaaaaaaatgctg

SEQ ID NO: 160975 - DNA, 35 bp, Artificial Sequence
  Description of Artificial Sequence: Synthetic oligonucleotide
ccttcatcgctggtgtgccaacaaaaaaaatgctg

SEQ ID NO: 160976 - DNA, 35 bp, Artificial Sequence
  Description of Artificial Sequence: Synthetic oligonucleotide
cttcatcgctggtgtgccaacaaaaaaaatgctgc

SEQ ID NO: 160977 - DNA, 36 bp, Artificial Sequence
  Description of Artificial Sequence: Synthetic oligonucleotide
ttcatcgctggtgtgccaacaaaaaaaatgctgctg

SEQ ID NO: 160978 - DNA, 35 bp, Artificial Sequence
  Description of Artificial Sequence: Synthetic oligonucleotide
tcatcgctggtgtgccaacaaaaaaaatgctgctg

SEQ ID NO: 160979 - DNA, 34 bp, Artificial Sequence
  Description of Artificial Sequence: Synthetic oligonucleotide
catcgctggtgtgccaacaaaaaaaatgctgctg

SEQ ID NO: 160980 - DNA, 38 bp, Artificial Sequence
  Description of Artificial Sequence: Synthetic oligonucleotide
atcgctggtgtgccaacaaaaaaaatgctgctgtaatg

SEQ ID NO: 160981 - DNA, 37 bp, Artificial Sequence
  Description of Artificial Sequence: Synthetic oligonucleotide
tcgctggtgtgccaacaaaaaaaatgctgctgtaatg

SEQ ID NO: 160982 - DNA, 36 bp, Artificial Sequence
  Description of Artificial Sequence: Synthetic oligonucleotide
cgctggtgtgccaacaaaaaaaatgctgctgtaatg

SEQ ID NO: 160983 - DNA, 36 bp, Artificial Sequence
  Description of Artificial Sequence: Synthetic oligonucleotide
gctggtgtgccaacaaaaaaaatgctgctgtaatgg

SEQ ID NO: 160984 - DNA, 37 bp, Artificial Sequence
  Description of Artificial Sequence: Synthetic oligonucleotide
ctggtgtgccaacaaaaaaaatgctgctgtaatggac

SEQ ID NO: 160985 - DNA, 37 bp, Artificial Sequence
  Description of Artificial Sequence: Synthetic oligonucleotide
tggtgtgccaacaaaaaaaatgctgctgtaatggacc

SEQ ID NO: 160986 - DNA, 36 bp, Artificial Sequence
  Description of Artificial Sequence: Synthetic oligonucleotide
ggtgtgccaacaaaaaaaatgctgctgtaatggacc

SEQ ID NO: 160987 - DNA, 38 bp, Artificial Sequence
  Description of Artificial Sequence: Synthetic oligonucleotide
gtgtgccaacaaaaaaaatgctgctgtaatggaccaag

SEQ ID NO: 160988 - DNA, 39 bp, Artificial Sequence
  Description of Artificial Sequence: Synthetic oligonucleotide
tgtgccaacaaaaaaaatgctgctgtaatggaccaagag

SEQ ID NO: 160989 - DNA, 38 bp, Artificial Sequence
  Description of Artificial Sequence: Synthetic oligonucleotide
gtgccaacaaaaaaaatgctgctgtaatggaccaagag

SEQ ID NO: 160990 - DNA, 38 bp, Artificial Sequence
  Description of Artificial Sequence: Synthetic oligonucleotide
tgccaacaaaaaaaatgctgctgtaatggaccaagagc

SEQ ID NO: 160991 - DNA, 37 bp, Artificial Sequence
  Description of Artificial Sequence: Synthetic oligonucleotide
gccaacaaaaaaaatgctgctgtaatggaccaagagc

SEQ ID NO: 160992 - DNA, 33 bp, Artificial Sequence
  Description of Artificial Sequence: Synthetic oligonucleotide
cacgttctgattgggacctcagtggtcaaaatc

SEQ ID NO: 160993 - DNA, 33 bp, Artificial Sequence
  Description of Artificial Sequence: Synthetic oligonucleotide
acgttctgattgggacctcagtggtcaaaatcc

SEQ ID NO: 160994 - DNA, 32 bp, Artificial Sequence
  Description of Artificial Sequence: Synthetic oligonucleotide
cgttctgattgggacctcagtggtcaaaatcc

SEQ ID NO: 160995 - DNA, 30 bp, Artificial Sequence
  Description of Artificial Sequence: Synthetic oligonucleotide
tccaaaaccggtaaccccagacacctacac

SEQ ID NO: 160996 - DNA, 29 bp, Artificial Sequence
  Description of Artificial Sequence: Synthetic oligonucleotide
ccaaaaccggtaaccccagacacctacac

SEQ ID NO: 160997 - DNA, 29 bp, Artificial Sequence
  Description of Artificial Sequence: Synthetic oligonucleotide
caaaaccggtaaccccagacacctacacg

SEQ ID NO: 160998 - DNA, 31 bp, Artificial Sequence
  Description of Artificial Sequence: Synthetic oligonucleotide
aaaaccggtaaccccagacacctacacgttc

SEQ ID NO: 160999 - DNA, 30 bp, Artificial Sequence
  Description of Artificial Sequence: Synthetic oligonucleotide
aaaccggtaaccccagacacctacacgttc

SEQ ID NO: 161000 - DNA, 29 bp, Artificial Sequence
  Description of Artificial Sequence: Synthetic oligonucleotide
aaccggtaaccccagacacctacacgttc

SEQ ID NO: 161001 - DNA, 28 bp, Artificial Sequence
  Description of Artificial Sequence: Synthetic oligonucleotide
accggtaaccccagacacctacacgttc

SEQ ID NO: 161002 - DNA, 27 bp, Artificial Sequence
  Description of Artificial Sequence: Synthetic oligonucleotide
ccggtaaccccagacacctacacgttc

SEQ ID NO: 161003 - DNA, 28 bp, Artificial Sequence
  Description of Artificial Sequence: Synthetic oligonucleotide
cggtaaccccagacacctacacgttctg

SEQ ID NO: 161004 - DNA, 31 bp, Artificial Sequence
  Description of Artificial Sequence: Synthetic oligonucleotide
ggtaaccccagacacctacacgttctgattg

SEQ ID NO: 161005 - DNA, 31 bp, Artificial Sequence
  Description of Artificial Sequence: Synthetic oligonucleotide
gtaaccccagacacctacacgttctgattgg

SEQ ID NO: 161006 - DNA, 31 bp, Artificial Sequence
  Description of Artificial Sequence: Synthetic oligonucleotide
taaccccagacacctacacgttctgattggg

SEQ ID NO: 161007 - DNA, 30 bp, Artificial Sequence
  Description of Artificial Sequence: Synthetic oligonucleotide
aaccccagacacctacacgttctgattggg

SEQ ID NO: 161008 - DNA, 29 bp, Artificial Sequence
  Description of Artificial Sequence: Synthetic oligonucleotide
accccagacacctacacgttctgattggg

SEQ ID NO: 161009 - DNA, 28 bp, Artificial Sequence
  Description of Artificial Sequence: Synthetic oligonucleotide
ccccagacacctacacgttctgattggg

SEQ ID NO: 161010 - DNA, 29 bp, Artificial Sequence
  Description of Artificial Sequence: Synthetic oligonucleotide
cccagacacctacacgttctgattgggac

SEQ ID NO: 161011 - DNA, 29 bp, Artificial Sequence
  Description of Artificial Sequence: Synthetic oligonucleotide
ccagacacctacacgttctgattgggacc

SEQ ID NO: 161012 - DNA, 30 bp, Artificial Sequence
  Description of Artificial Sequence: Synthetic oligonucleotide
cagacacctacacgttctgattgggacctc

SEQ ID NO: 161013 - DNA, 31 bp, Artificial Sequence
  Description of Artificial Sequence: Synthetic oligonucleotide
agacacctacacgttctgattgggacctcag

SEQ ID NO: 161014 - DNA, 30 bp, Artificial Sequence
  Description of Artificial Sequence: Synthetic oligonucleotide
gacacctacacgttctgattgggacctcag

SEQ ID NO: 161015 - DNA, 31 bp, Artificial Sequence
  Description of Artificial Sequence: Synthetic oligonucleotide
acacctacacgttctgattgggacctcagtg

SEQ ID NO: 161016 - DNA, 30 bp, Artificial Sequence
  Description of Artificial Sequence: Synthetic oligonucleotide
cacctacacgttctgattgggacctcagtg

SEQ ID NO: 161017 - DNA, 30 bp, Artificial Sequence
  Description of Artificial Sequence: Synthetic oligonucleotide
acctacacgttctgattgggacctcagtgg

SEQ ID NO: 161018 - DNA, 29 bp, Artificial Sequence
  Description of Artificial Sequence: Synthetic oligonucleotide
cctacacgttctgattgggacctcagtgg

SEQ ID NO: 161019 - DNA, 30 bp, Artificial Sequence
  Description of Artificial Sequence: Synthetic oligonucleotide
ctacacgttctgattgggacctcagtggtc

SEQ ID NO: 161020 - DNA, 33 bp, Artificial Sequence
  Description of Artificial Sequence: Synthetic oligonucleotide
tacacgttctgattgggacctcagtggtcaaac

SEQ ID NO: 161021 - DNA, 32 bp, Artificial Sequence
  Description of Artificial Sequence: Synthetic oligonucleotide
acacgttctgattgggacctcagtggtcaaac

SEQ ID NO: 161022 - DNA, 31 bp, Artificial Sequence
  Description of Artificial Sequence: Synthetic oligonucleotide
cacgttctgattgggacctcagtggtcaaac

SEQ ID NO: 161023 - DNA, 32 bp, Artificial Sequence
  Description of Artificial Sequence: Synthetic oligonucleotide
acgttctgattgggacctcagtggtcaaactc

SEQ ID NO: 161024 - DNA, 31 bp, Artificial Sequence
  Description of Artificial Sequence: Synthetic oligonucleotide
cgttctgattgggacctcagtggtcaaactc

SEQ ID NO: 161025 - DNA, 31 bp, Artificial Sequence
  Description of Artificial Sequence: Synthetic oligonucleotide
gttctgattgggacctcagtggtcaaactcc

SEQ ID NO: 161026 - DNA, 31 bp, Artificial Sequence
  Description of Artificial Sequence: Synthetic oligonucleotide
ttctgattgggacctcagtggtcaaactccc

SEQ ID NO: 161027 - DNA, 30 bp, Artificial Sequence
  Description of Artificial Sequence: Synthetic oligonucleotide
tctgattgggacctcagtggtcaaactccc

SEQ ID NO: 161028 - DNA, 29 bp, Artificial Sequence
  Description of Artificial Sequence: Synthetic oligonucleotide
ctgattgggacctcagtggtcaaactccc

SEQ ID NO: 161029 - DNA, 32 bp, Artificial Sequence
  Description of Artificial Sequence: Synthetic oligonucleotide
tgattgggacctcagtggtcaaactccctttc

SEQ ID NO: 161030 - DNA, 31 bp, Artificial Sequence
  Description of Artificial Sequence: Synthetic oligonucleotide
gattgggacctcagtggtcaaactccctttc

SEQ ID NO: 161031 - DNA, 32 bp, Artificial Sequence
  Description of Artificial Sequence: Synthetic oligonucleotide
attgggacctcagtggtcaaactccctttcac

SEQ ID NO: 161032 - DNA, 31 bp, Artificial Sequence
  Description of Artificial Sequence: Synthetic oligonucleotide
ttgggacctcagtggtcaaactccctttcac

SEQ ID NO: 161033 - DNA, 30 bp, Artificial Sequence
  Description of Artificial Sequence: Synthetic oligonucleotide
tgggacctcagtggtcaaactccctttcac

SEQ ID NO: 161034 - DNA, 29 bp, Artificial Sequence
  Description of Artificial Sequence: Synthetic oligonucleotide
gggacctcagtggtcaaactccctttcac

SEQ ID NO: 161035 - DNA, 29 bp, Artificial Sequence
  Description of Artificial Sequence: Synthetic oligonucleotide
ggacctcagtggtcaaactccctttcacc

SEQ ID NO: 161036 - DNA, 31 bp, Artificial Sequence
  Description of Artificial Sequence: Synthetic oligonucleotide
gacctcagtggtcaaactccctttcaccatc

SEQ ID NO: 161037 - DNA, 31 bp, Artificial Sequence
  Description of Artificial Sequence: Synthetic oligonucleotide
acctcagtggtcaaactccctttcaccatcc

SEQ ID NO: 161038 - DNA, 30 bp, Artificial Sequence
  Description of Artificial Sequence: Synthetic oligonucleotide
cctcagtggtcaaactccctttcaccatcc

SEQ ID NO: 161039 - DNA, 31 bp, Artificial Sequence
  Description of Artificial Sequence: Synthetic oligonucleotide
ctcagtggtcaaactccctttcaccatcctc

SEQ ID NO: 161040 - DNA, 31 bp, Artificial Sequence
  Description of Artificial Sequence: Synthetic oligonucleotide
tcagtggtcaaactccctttcaccatcctcc

SEQ ID NO: 161041 - DNA, 30 bp, Artificial Sequence
  Description of Artificial Sequence: Synthetic oligonucleotide
cagtggtcaaactccctttcaccatcctcc

SEQ ID NO: 161042 - DNA, 31 bp, Artificial Sequence
  Description of Artificial Sequence: Synthetic oligonucleotide
agtggtcaaactccctttcaccatcctcctc

SEQ ID NO: 161043 - DNA, 30 bp, Artificial Sequence
  Description of Artificial Sequence: Synthetic oligonucleotide
gtggtcaaactccctttcaccatcctcctc

SEQ ID NO: 161044 - DNA, 32 bp, Artificial Sequence
  Description of Artificial Sequence: Synthetic oligonucleotide
tggtcaaactccctttcaccatcctcctcttc

SEQ ID NO: 161045 - DNA, 31 bp, Artificial Sequence
  Description of Artificial Sequence: Synthetic oligonucleotide
ggtcaaactccctttcaccatcctcctcttc

SEQ ID NO: 161046 - DNA, 34 bp, Artificial Sequence
  Description of Artificial Sequence: Synthetic oligonucleotide
gtcaaactccctttcaccatcctcctcttctttc

SEQ ID NO: 161047 - DNA, 35 bp, Artificial Sequence
  Description of Artificial Sequence: Synthetic oligonucleotide
tcaaactccctttcaccatcctcctcttctttctc

SEQ ID NO: 161048 - DNA, 34 bp, Artificial Sequence
  Description of Artificial Sequence: Synthetic oligonucleotide
caaactccctttcaccatcctcctcttctttctc

SEQ ID NO: 161049 - DNA, 34 bp, Artificial Sequence
  Description of Artificial Sequence: Synthetic oligonucleotide
aaactccctttcaccatcctcctcttctttctcc

SEQ ID NO: 161050 - DNA, 33 bp, Artificial Sequence
  Description of Artificial Sequence: Synthetic oligonucleotide
aactccctttcaccatcctcctcttctttctcc

SEQ ID NO: 161051 - DNA, 32 bp, Artificial Sequence
  Description of Artificial Sequence: Synthetic oligonucleotide
actccctttcaccatcctcctcttctttctcc

SEQ ID NO: 161052 - DNA, 31 bp, Artificial Sequence
  Description of Artificial Sequence: Synthetic oligonucleotide
ctccctttcaccatcctcctcttctttctcc

SEQ ID NO: 161053 - DNA, 35 bp, Artificial Sequence
  Description of Artificial Sequence: Synthetic oligonucleotide
cttcatcgctggtgctccgacaaaaaaaatgcatc

SEQ ID NO: 161054 - DNA, 36 bp, Artificial Sequence
  Description of Artificial Sequence: Synthetic oligonucleotide
ttcatcgctggtgctccgacaaaaaaaatgcatctg

SEQ ID NO: 161055 - DNA, 35 bp, Artificial Sequence
  Description of Artificial Sequence: Synthetic oligonucleotide
tcatcgctggtgctccgacaaaaaaaatgcatctg

SEQ ID NO: 161056 - DNA, 34 bp, Artificial Sequence
  Description of Artificial Sequence: Synthetic oligonucleotide
catcgctggtgctccgacaaaaaaaatgcatctg

SEQ ID NO: 161057 - DNA, 38 bp, Artificial Sequence
  Description of Artificial Sequence: Synthetic oligonucleotide
atcgctggtgctccgacaaaaaaaatgcatctgtaatg

SEQ ID NO: 161058 - DNA, 37 bp, Artificial Sequence
  Description of Artificial Sequence: Synthetic oligonucleotide
tcgctggtgctccgacaaaaaaaatgcatctgtaatg

SEQ ID NO: 161059 - DNA, 36 bp, Artificial Sequence
  Description of Artificial Sequence: Synthetic oligonucleotide
cgctggtgctccgacaaaaaaaatgcatctgtaatg

SEQ ID NO: 161060 - DNA, 36 bp, Artificial Sequence
  Description of Artificial Sequence: Synthetic oligonucleotide
gctggtgctccgacaaaaaaaatgcatctgtaatgg

SEQ ID NO: 161061 - DNA, 37 bp, Artificial Sequence
  Description of Artificial Sequence: Synthetic oligonucleotide
ctggtgctccgacaaaaaaaatgcatctgtaatggac

SEQ ID NO: 161062 - DNA, 37 bp, Artificial Sequence
  Description of Artificial Sequence: Synthetic oligonucleotide
tggtgctccgacaaaaaaaatgcatctgtaatggacc

SEQ ID NO: 161063 - DNA, 36 bp, Artificial Sequence
  Description of Artificial Sequence: Synthetic oligonucleotide
ggtgctccgacaaaaaaaatgcatctgtaatggacc

SEQ ID NO: 161064 - DNA, 38 bp, Artificial Sequence
  Description of Artificial Sequence: Synthetic oligonucleotide
gtgctccgacaaaaaaaatgcatctgtaatggaccaag

SEQ ID NO: 161065 - DNA, 38 bp, Artificial Sequence
  Description of Artificial Sequence: Synthetic oligonucleotide
tgctccgacaaaaaaaatgcatctgtaatggaccaagg

SEQ ID NO: 161066 - DNA, 37 bp, Artificial Sequence
  Description of Artificial Sequence: Synthetic oligonucleotide
gctccgacaaaaaaaatgcatctgtaatggaccaagg

SEQ ID NO: 161067 - DNA, 37 bp, Artificial Sequence
  Description of Artificial Sequence: Synthetic oligonucleotide
ctccgacaaaaaaaatgcatctgtaatggaccaaggg

SEQ ID NO: 161068 - DNA, 37 bp, Artificial Sequence
  Description of Artificial Sequence: Synthetic oligonucleotide
tccgacaaaaaaaatgcatctgtaatggaccaagggc

SEQ ID NO: 161069 - DNA, 36 bp, Artificial Sequence
  Description of Artificial Sequence: Synthetic oligonucleotide
ccgacaaaaaaaatgcatctgtaatggaccaagggc

SEQ ID NO: 161070 - DNA, 36 bp, Artificial Sequence
  Description of Artificial Sequence: Synthetic oligonucleotide
cgacaaaaaaaatgcatctgtaatggaccaagggcc

SEQ ID NO: 161071 - DNA, 37 bp, Artificial Sequence
  Description of Artificial Sequence: Synthetic oligonucleotide
gacaaaaaaaatgcatctgtaatggaccaagggcctg

SEQ ID NO: 161072 - DNA, 37 bp, Artificial Sequence
  Description of Artificial Sequence: Synthetic oligonucleotide
acaaaaaaaatgcatctgtaatggaccaagggcctgc

SEQ ID NO: 161073 - DNA, 36 bp, Artificial Sequence
  Description of Artificial Sequence: Synthetic oligonucleotide
caaaaaaaatgcatctgtaatggaccaagggcctgc

SEQ ID NO: 161074 - DNA, 36 bp, Artificial Sequence
  Description of Artificial Sequence: Synthetic oligonucleotide
aaaaaaaatgcatctgtaatggaccaagggcctgcg

SEQ ID NO: 161075 - DNA, 35 bp, Artificial Sequence
  Description of Artificial Sequence: Synthetic oligonucleotide
aaaaaaatgcatctgtaatggaccaagggcctgcg

SEQ ID NO: 161076 - DNA, 34 bp, Artificial Sequence
  Description of Artificial Sequence: Synthetic oligonucleotide
aaaaaatgcatctgtaatggaccaagggcctgcg

SEQ ID NO: 161077 - DNA, 33 bp, Artificial Sequence
  Description of Artificial Sequence: Synthetic oligonucleotide
aaaaatgcatctgtaatggaccaagggcctgcg

SEQ ID NO: 161078 - DNA, 32 bp, Artificial Sequence
  Description of Artificial Sequence: Synthetic oligonucleotide
aaaatgcatctgtaatggaccaagggcctgcg

SEQ ID NO: 161079 - DNA, 31 bp, Artificial Sequence
  Description of Artificial Sequence: Synthetic oligonucleotide
aaatgcatctgtaatggaccaagggcctgcg

SEQ ID NO: 161080 - DNA, 30 bp, Artificial Sequence
  Description of Artificial Sequence: Synthetic oligonucleotide
aatgcatctgtaatggaccaagggcctgcg

SEQ ID NO: 161081 - DNA, 29 bp, Artificial Sequence
  Description of Artificial Sequence: Synthetic oligonucleotide
atgcatctgtaatggaccaagggcctgcg

SEQ ID NO: 161082 - DNA, 28 bp, Artificial Sequence
  Description of Artificial Sequence: Synthetic oligonucleotide
tgcatctgtaatggaccaagggcctgcg

SEQ ID NO: 161083 - DNA, 27 bp, Artificial Sequence
  Description of Artificial Sequence: Synthetic oligonucleotide
gcatctgtaatggaccaagggcctgcg

SEQ ID NO: 161084 - DNA, 27 bp, Artificial Sequence
  Description of Artificial Sequence: Synthetic oligonucleotide
catctgtaatggaccaagggcctgcgg

SEQ ID NO: 161085 - DNA, 27 bp, Artificial Sequence
  Description of Artificial Sequence: Synthetic oligonucleotide
atctgtaatggaccaagggcctgcggg

SEQ ID NO: 161086 - DNA, 26 bp, Artificial Sequence
  Description of Artificial Sequence: Synthetic oligonucleotide
tctgtaatggaccaagggcctgcggg

SEQ ID NO: 161087 - DNA, 25 bp, Artificial Sequence
  Description of Artificial Sequence: Synthetic oligonucleotide
ctgtaatggaccaagggcctgcggg

SEQ ID NO: 161088 - DNA, 27 bp, Artificial Sequence
  Description of Artificial Sequence: Synthetic oligonucleotide
tgtaatggaccaagggcctgcggggaa

SEQ ID NO: 161089 - DNA, 26 bp, Artificial Sequence
  Description of Artificial Sequence: Synthetic oligonucleotide
gtaatggaccaagggcctgcggggaa

SEQ ID NO: 161090 - DNA, 27 bp, Artificial Sequence
  Description of Artificial Sequence: Synthetic oligonucleotide
taatggaccaagggcctgcggggaaca

SEQ ID NO: 161091 - DNA, 26 bp, Artificial Sequence
  Description of Artificial Sequence: Synthetic oligonucleotide
aatggaccaagggcctgcggggaaca

SEQ ID NO: 161092 - DNA, 25 bp, Artificial Sequence
  Description of Artificial Sequence: Synthetic oligonucleotide
atggaccaagggcctgcggggaaca

SEQ ID NO: 161093 - DNA, 24 bp, Artificial Sequence
  Description of Artificial Sequence: Synthetic oligonucleotide
tggaccaagggcctgcggggaaca

SEQ ID NO: 161094 - DNA, 23 bp, Artificial Sequence
  Description of Artificial Sequence: Synthetic oligonucleotide
ggaccaagggcctgcggggaaca

SEQ ID NO: 161095 - DNA, 25 bp, Artificial Sequence
  Description of Artificial Sequence: Synthetic oligonucleotide
gaccaagggcctgcggggaacagaa

SEQ ID NO: 161096 - DNA, 26 bp, Artificial Sequence
  Description of Artificial Sequence: Synthetic oligonucleotide
accaagggcctgcggggaacagaaca

SEQ ID NO: 161097 - DNA, 25 bp, Artificial Sequence
  Description of Artificial Sequence: Synthetic oligonucleotide
ccaagggcctgcggggaacagaaca

SEQ ID NO: 161098 - DNA, 26 bp, Artificial Sequence
  Description of Artificial Sequence: Synthetic oligonucleotide
caagggcctgcggggaacagaacagt

SEQ ID NO: 161099 - DNA, 27 bp, Artificial Sequence
  Description of Artificial Sequence: Synthetic oligonucleotide
aagggcctgcggggaacagaacagtga

SEQ ID NO: 161100 - DNA, 27 bp, Artificial Sequence
  Description of Artificial Sequence: Synthetic oligonucleotide
agggcctgcggggaacagaacagtgaa

SEQ ID NO: 161101 - DNA, 26 bp, Artificial Sequence
  Description of Artificial Sequence: Synthetic oligonucleotide
gggcctgcggggaacagaacagtgaa

SEQ ID NO: 161102 - DNA, 27 bp, Artificial Sequence
  Description of Artificial Sequence: Synthetic oligonucleotide
ggcctgcggggaacagaacagtgaaca

SEQ ID NO: 161103 - DNA, 27 bp, Artificial Sequence
  Description of Artificial Sequence: Synthetic oligonucleotide
gcctgcggggaacagaacagtgaacag

SEQ ID NO: 161104 - DNA, 27 bp, Artificial Sequence
  Description of Artificial Sequence: Synthetic oligonucleotide
cctgcggggaacagaacagtgaacagg

SEQ ID NO: 161105 - DNA, 27 bp, Artificial Sequence
  Description of Artificial Sequence: Synthetic oligonucleotide
ctgcggggaacagaacagtgaacaggg

SEQ ID NO: 161106 - DNA, 28 bp, Artificial Sequence
  Description of Artificial Sequence: Synthetic oligonucleotide
tgcggggaacagaacagtgaacagggag

SEQ ID NO: 161107 - DNA, 27 bp, Artificial Sequence
  Description of Artificial Sequence: Synthetic oligonucleotide
gcggggaacagaacagtgaacagggag

SEQ ID NO: 161108 - DNA, 27 bp, Artificial Sequence
  Description of Artificial Sequence: Synthetic oligonucleotide
cggggaacagaacagtgaacagggagg

SEQ ID NO: 161109 - DNA, 30 bp, Artificial Sequence
  Description of Artificial Sequence: Synthetic oligonucleotide
ggggaacagaacagtgaacagggaggattc

SEQ ID NO: 161110 - DNA, 31 bp, Artificial Sequence
  Description of Artificial Sequence: Synthetic oligonucleotide
gggaacagaacagtgaacagggaggattctg

SEQ ID NO: 161111 - DNA, 33 bp, Artificial Sequence
  Description of Artificial Sequence: Synthetic oligonucleotide
ggaacagaacagtgaacagggaggattctgatg

SEQ ID NO: 161112 - DNA, 35 bp, Artificial Sequence
  Description of Artificial Sequence: Synthetic oligonucleotide
gaacagaacagtgaacagggaggattctgatgaac

SEQ ID NO: 161113 - DNA, 36 bp, Artificial Sequence
  Description of Artificial Sequence: Synthetic oligonucleotide
aacagaacagtgaacagggaggattctgatgaacag

SEQ ID NO: 161114 - DNA, 35 bp, Artificial Sequence
  Description of Artificial Sequence: Synthetic oligonucleotide
acagaacagtgaacagggaggattctgatgaacag

SEQ ID NO: 161115 - DNA, 34 bp, Artificial Sequence
  Description of Artificial Sequence: Synthetic oligonucleotide
cagaacagtgaacagggaggattctgatgaacag

SEQ ID NO: 161116 - DNA, 34 bp, Artificial Sequence
  Description of Artificial Sequence: Synthetic oligonucleotide
agaacagtgaacagggaggattctgatgaacagg

SEQ ID NO: 161117 - DNA, 33 bp, Artificial Sequence
  Description of Artificial Sequence: Synthetic oligonucleotide
gaacagtgaacagggaggattctgatgaacagg

SEQ ID NO: 161118 - DNA, 34 bp, Artificial Sequence
  Description of Artificial Sequence: Synthetic oligonucleotide
aacagtgaacagggaggattctgatgaacaggac

SEQ ID NO: 161119 - DNA, 33 bp, Artificial Sequence
  Description of Artificial Sequence: Synthetic oligonucleotide
acagtgaacagggaggattctgatgaacaggac

SEQ ID NO: 161120 - DNA, 32 bp, Artificial Sequence
  Description of Artificial Sequence: Synthetic oligonucleotide
cagtgaacagggaggattctgatgaacaggac

SEQ ID NO: 161121 - DNA, 32 bp, Artificial Sequence
  Description of Artificial Sequence: Synthetic oligonucleotide
agtgaacagggaggattctgatgaacaggacc

SEQ ID NO: 161122 - DNA, 31 bp, Artificial Sequence
  Description of Artificial Sequence: Synthetic oligonucleotide
gtgaacagggaggattctgatgaacaggacc

SEQ ID NO: 161123 - DNA, 33 bp, Artificial Sequence
  Description of Artificial Sequence: Synthetic oligonucleotide
tgaacagggaggattctgatgaacaggaccatc

SEQ ID NO: 161124 - DNA, 32 bp, Artificial Sequence
  Description of Artificial Sequence: Synthetic oligonucleotide
gaacagggaggattctgatgaacaggaccatc

SEQ ID NO: 161125 - DNA, 33 bp, Artificial Sequence
  Description of Artificial Sequence: Synthetic oligonucleotide
aacagggaggattctgatgaacaggaccatcag

SEQ ID NO: 161126 - DNA, 32 bp, Artificial Sequence
  Description of Artificial Sequence: Synthetic oligonucleotide
acagggaggattctgatgaacaggaccatcag

SEQ ID NO: 161127 - DNA, 31 bp, Artificial Sequence
  Description of Artificial Sequence: Synthetic oligonucleotide
cagggaggattctgatgaacaggaccatcag

SEQ ID NO: 161128 - DNA, 31 bp, Artificial Sequence
  Description of Artificial Sequence: Synthetic oligonucleotide
agggaggattctgatgaacaggaccatcagg

SEQ ID NO: 161129 - DNA, 30 bp, Artificial Sequence
  Description of Artificial Sequence: Synthetic oligonucleotide
gggaggattctgatgaacaggaccatcagg

SEQ ID NO: 161130 - DNA, 31 bp, Artificial Sequence
  Description of Artificial Sequence: Synthetic oligonucleotide
ggaggattctgatgaacaggaccatcaggag

SEQ ID NO: 161131 - DNA, 31 bp, Artificial Sequence
  Description of Artificial Sequence: Synthetic oligonucleotide
gaggattctgatgaacaggaccatcaggagg

SEQ ID NO: 161132 - DNA, 32 bp, Artificial Sequence
  Description of Artificial Sequence: Synthetic oligonucleotide
aggattctgatgaacaggaccatcaggaggtg

SEQ ID NO: 161133 - DNA, 31 bp, Artificial Sequence
  Description of Artificial Sequence: Synthetic oligonucleotide
ggattctgatgaacaggaccatcaggaggtg

SEQ ID NO: 161134 - DNA, 32 bp, Artificial Sequence
  Description of Artificial Sequence: Synthetic oligonucleotide
gattctgatgaacaggaccatcaggaggtgtc

SEQ ID NO: 161135 - DNA, 35 bp, Artificial Sequence
  Description of Artificial Sequence: Synthetic oligonucleotide
attctgatgaacaggaccatcaggaggtgtcatac

SEQ ID NO: 161136 - DNA, 34 bp, Artificial Sequence
  Description of Artificial Sequence: Synthetic oligonucleotide
ttctgatgaacaggaccatcaggaggtgtcatac

SEQ ID NO: 161137 - DNA, 33 bp, Artificial Sequence
  Description of Artificial Sequence: Synthetic oligonucleotide
tctgatgaacaggaccatcaggaggtgtcatac

SEQ ID NO: 161138 - DNA, 32 bp, Artificial Sequence
  Description of Artificial Sequence: Synthetic oligonucleotide
ctgatgaacaggaccatcaggaggtgtcatac

SEQ ID NO: 161139 - DNA, 32 bp, Artificial Sequence
  Description of Artificial Sequence: Synthetic oligonucleotide
tgatgaacaggaccatcaggaggtgtcatacg

SEQ ID NO: 161140 - DNA, 31 bp, Artificial Sequence
  Description of Artificial Sequence: Synthetic oligonucleotide
gatgaacaggaccatcaggaggtgtcatacg

SEQ ID NO: 161141 - DNA, 31 bp, Artificial Sequence
  Description of Artificial Sequence: Synthetic oligonucleotide
atgaacaggaccatcaggaggtgtcatacgc

SEQ ID NO: 161142 - DNA, 30 bp, Artificial Sequence
  Description of Artificial Sequence: Synthetic oligonucleotide
tgaacaggaccatcaggaggtgtcatacgc

SEQ ID NO: 161143 - DNA, 29 bp, Artificial Sequence
  Description of Artificial Sequence: Synthetic oligonucleotide
gaacaggaccatcaggaggtgtcatacgc

SEQ ID NO: 161144 - DNA, 31 bp, Artificial Sequence
  Description of Artificial Sequence: Synthetic oligonucleotide
atgtcgctcatggtcatcagcatggcatgtg

SEQ ID NO: 161145 - DNA, 30 bp, Artificial Sequence
  Description of Artificial Sequence: Synthetic oligonucleotide
tgtcgctcatggtcatcagcatggcatgtg

SEQ ID NO: 161146 - DNA, 29 bp, Artificial Sequence
  Description of Artificial Sequence: Synthetic oligonucleotide
gtcgctcatggtcatcagcatggcatgtg

SEQ ID NO: 161147 - DNA, 31 bp, Artificial Sequence
  Description of Artificial Sequence: Synthetic oligonucleotide
tcgctcatggtcatcagcatggcatgtgttg

SEQ ID NO: 161148 - DNA, 30 bp, Artificial Sequence
  Description of Artificial Sequence: Synthetic oligonucleotide
cgctcatggtcatcagcatggcatgtgttg

SEQ ID NO: 161149 - DNA, 30 bp, Artificial Sequence
  Description of Artificial Sequence: Synthetic oligonucleotide
gctcatggtcatcagcatggcatgtgttgg

SEQ ID NO: 161150 - DNA, 30 bp, Artificial Sequence
  Description of Artificial Sequence: Synthetic oligonucleotide
ctcatggtcatcagcatggcatgtgttggg

SEQ ID NO: 161151 - DNA, 32 bp, Artificial Sequence
  Description of Artificial Sequence: Synthetic oligonucleotide
tcatggtcatcagcatggcatgtgttgggttc

SEQ ID NO: 161152 - DNA, 31 bp, Artificial Sequence
  Description of Artificial Sequence: Synthetic oligonucleotide
catggtcatcagcatggcatgtgttgggttc

SEQ ID NO: 161153 - DNA, 33 bp, Artificial Sequence
  Description of Artificial Sequence: Synthetic oligonucleotide
atggtcatcagcatggcatgtgttgggttcttc

SEQ ID NO: 161154 - DNA, 32 bp, Artificial Sequence
  Description of Artificial Sequence: Synthetic oligonucleotide
tggtcatcagcatggcatgtgttgggttcttc

SEQ ID NO: 161155 - DNA, 31 bp, Artificial Sequence
  Description of Artificial Sequence: Synthetic oligonucleotide
ggtcatcagcatggcatgtgttgggttcttc

SEQ ID NO: 161156 - DNA, 32 bp, Artificial Sequence
  Description of Artificial Sequence: Synthetic oligonucleotide
gtcatcagcatggcatgtgttgggttcttctg

SEQ ID NO: 161157 - DNA, 32 bp, Artificial Sequence
  Description of Artificial Sequence: Synthetic oligonucleotide
tcatcagcatggcatgtgttgggttcttctgg

SEQ ID NO: 161158 - DNA, 31 bp, Artificial Sequence
  Description of Artificial Sequence: Synthetic oligonucleotide
catcagcatggcatgtgttgggttcttctgg

SEQ ID NO: 161159 - DNA, 31 bp, Artificial Sequence
  Description of Artificial Sequence: Synthetic oligonucleotide
atcagcatggcatgtgttgggttcttctggc

SEQ ID NO: 161160 - DNA, 30 bp, Artificial Sequence
  Description of Artificial Sequence: Synthetic oligonucleotide
tcagcatggcatgtgttgggttcttctggc

SEQ ID NO: 161161 - DNA, 29 bp, Artificial Sequence
  Description of Artificial Sequence: Synthetic oligonucleotide
cagcatggcatgtgttgggttcttctggc

SEQ ID NO: 161162 - DNA, 30 bp, Artificial Sequence
  Description of Artificial Sequence: Synthetic oligonucleotide
agcatggcatgtgttgggttcttctggctg

SEQ ID NO: 161163 - DNA, 29 bp, Artificial Sequence
  Description of Artificial Sequence: Synthetic oligonucleotide
gcatggcatgtgttgggttcttctggctg

SEQ ID NO: 161164 - DNA, 29 bp, Artificial Sequence
  Description of Artificial Sequence: Synthetic oligonucleotide
catggcatgtgttgggttcttctggctgc

SEQ ID NO: 161165 - DNA, 30 bp, Artificial Sequence
  Description of Artificial Sequence: Synthetic oligonucleotide
atggcatgtgttgggttcttctggctgcag

SEQ ID NO: 161166 - DNA, 29 bp, Artificial Sequence
  Description of Artificial Sequence: Synthetic oligonucleotide
tggcatgtgttgggttcttctggctgcag

SEQ ID NO: 161167 - DNA, 28 bp, Artificial Sequence
  Description of Artificial Sequence: Synthetic oligonucleotide
ggcatgtgttgggttcttctggctgcag

SEQ ID NO: 161168 - DNA, 28 bp, Artificial Sequence
  Description of Artificial Sequence: Synthetic oligonucleotide
gcatgtgttgggttcttctggctgcagg

SEQ ID NO: 161169 - DNA, 28 bp, Artificial Sequence
  Description of Artificial Sequence: Synthetic oligonucleotide
catgtgttgggttcttctggctgcaggg

SEQ ID NO: 161170 - DNA, 28 bp, Artificial Sequence
  Description of Artificial Sequence: Synthetic oligonucleotide
atgtgttgggttcttctggctgcagggg

SEQ ID NO: 161171 - DNA, 27 bp, Artificial Sequence
  Description of Artificial Sequence: Synthetic oligonucleotide
tgtgttgggttcttctggctgcagggg

SEQ ID NO: 161172 - DNA, 26 bp, Artificial Sequence
  Description of Artificial Sequence: Synthetic oligonucleotide
gtgttgggttcttctggctgcagggg

SEQ ID NO: 161173 - DNA, 26 bp, Artificial Sequence
  Description of Artificial Sequence: Synthetic oligonucleotide
tgttgggttcttctggctgcaggggg

SEQ ID NO: 161174 - DNA, 25 bp, Artificial Sequence
  Description of Artificial Sequence: Synthetic oligonucleotide
gttgggttcttctggctgcaggggg

SEQ ID NO: 161175 - DNA, 25 bp, Artificial Sequence
  Description of Artificial Sequence: Synthetic oligonucleotide
ttgggttcttctggctgcagggggc

SEQ ID NO: 161176 - DNA, 24 bp, Artificial Sequence
  Description of Artificial Sequence: Synthetic oligonucleotide
tgggttcttctggctgcagggggc

SEQ ID NO: 161177 - DNA, 23 bp, Artificial Sequence
  Description of Artificial Sequence: Synthetic oligonucleotide
gggttcttctggctgcagggggc

SEQ ID NO: 161178 - DNA, 24 bp, Artificial Sequence
  Description of Artificial Sequence: Synthetic oligonucleotide
ggttcttctggctgcagggggcct

SEQ ID NO: 161179 - DNA, 24 bp, Artificial Sequence
  Description of Artificial Sequence: Synthetic oligonucleotide
gttcttctggctgcagggggcctg

SEQ ID NO: 161180 - DNA, 24 bp, Artificial Sequence
  Description of Artificial Sequence: Synthetic oligonucleotide
ttcttctggctgcagggggcctgg

SEQ ID NO: 161181 - DNA, 23 bp, Artificial Sequence
  Description of Artificial Sequence: Synthetic oligonucleotide
tcttctggctgcagggggcctgg

SEQ ID NO: 161182 - DNA, 22 bp, Artificial Sequence
  Description of Artificial Sequence: Synthetic oligonucleotide
cttctggctgcagggggcctgg

SEQ ID NO: 161183 - DNA, 22 bp, Artificial Sequence
  Description of Artificial Sequence: Synthetic oligonucleotide
ttctggctgcagggggcctggc

SEQ ID NO: 161184 - DNA, 21 bp, Artificial Sequence
  Description of Artificial Sequence: Synthetic oligonucleotide
tctggctgcagggggcctggc

SEQ ID NO: 161185 - DNA, 20 bp, Artificial Sequence
  Description of Artificial Sequence: Synthetic oligonucleotide
ctggctgcagggggcctggc

SEQ ID NO: 161186 - DNA, 21 bp, Artificial Sequence
  Description of Artificial Sequence: Synthetic oligonucleotide
tggctgcagggggcctggcca

SEQ ID NO: 161187 - DNA, 20 bp, Artificial Sequence
  Description of Artificial Sequence: Synthetic oligonucleotide
ggctgcagggggcctggcca

SEQ ID NO: 161188 - DNA, 25 bp, Artificial Sequence
  Description of Artificial Sequence: Synthetic oligonucleotide
agggggcctggccacatgagggatt

SEQ ID NO: 161189 - DNA, 24 bp, Artificial Sequence
  Description of Artificial Sequence: Synthetic oligonucleotide
gggggcctggccacatgagggatt

SEQ ID NO: 161190 - DNA, 24 bp, Artificial Sequence
  Description of Artificial Sequence: Synthetic oligonucleotide
ggggcctggccacatgagggattc

SEQ ID NO: 161191 - DNA, 24 bp, Artificial Sequence
  Description of Artificial Sequence: Synthetic oligonucleotide
gggcctggccacatgagggattcc

SEQ ID NO: 161192 - DNA, 24 bp, Artificial Sequence
  Description of Artificial Sequence: Synthetic oligonucleotide
ggcctggccacatgagggattccg

SEQ ID NO: 161193 - DNA, 25 bp, Artificial Sequence
  Description of Artificial Sequence: Synthetic oligonucleotide
gcctggccacatgagggattccgca

SEQ ID NO: 161194 - DNA, 27 bp, Artificial Sequence
  Description of Artificial Sequence: Synthetic oligonucleotide
cctggccacatgagggattccgcagaa

SEQ ID NO: 161195 - DNA, 29 bp, Artificial Sequence
  Description of Artificial Sequence: Synthetic oligonucleotide
ctggccacatgagggattccgcagaaaac

SEQ ID NO: 161196 - DNA, 29 bp, Artificial Sequence
  Description of Artificial Sequence: Synthetic oligonucleotide
tggccacatgagggattccgcagaaaacc

SEQ ID NO: 161197 - DNA, 28 bp, Artificial Sequence
  Description of Artificial Sequence: Synthetic oligonucleotide
ggccacatgagggattccgcagaaaacc

SEQ ID NO: 161198 - DNA, 30 bp, Artificial Sequence
  Description of Artificial Sequence: Synthetic oligonucleotide
gccacatgagggattccgcagaaaaccttc

SEQ ID NO: 161199 - DNA, 30 bp, Artificial Sequence
  Description of Artificial Sequence: Synthetic oligonucleotide
ccacatgagggattccgcagaaaaccttcc

SEQ ID NO: 161200 - DNA, 30 bp, Artificial Sequence
  Description of Artificial Sequence: Synthetic oligonucleotide
cacatgagggattccgcagaaaaccttccc

SEQ ID NO: 161201 - DNA, 31 bp, Artificial Sequence
  Description of Artificial Sequence: Synthetic oligonucleotide
acatgagggattccgcagaaaaccttccctc

SEQ ID NO: 161202 - DNA, 30 bp, Artificial Sequence
  Description of Artificial Sequence: Synthetic oligonucleotide
catgagggattccgcagaaaaccttccctc

SEQ ID NO: 161203 - DNA, 30 bp, Artificial Sequence
  Description of Artificial Sequence: Synthetic oligonucleotide
atgagggattccgcagaaaaccttccctcc

SEQ ID NO: 161204 - DNA, 29 bp, Artificial Sequence
  Description of Artificial Sequence: Synthetic oligonucleotide
tgagggattccgcagaaaaccttccctcc

SEQ ID NO: 161205 - DNA, 28 bp, Artificial Sequence
  Description of Artificial Sequence: Synthetic oligonucleotide
gagggattccgcagaaaaccttccctcc

SEQ ID NO: 161206 - DNA, 29 bp, Artificial Sequence
  Description of Artificial Sequence: Synthetic oligonucleotide
agggattccgcagaaaaccttccctcctg

SEQ ID NO: 161207 - DNA, 28 bp, Artificial Sequence
  Description of Artificial Sequence: Synthetic oligonucleotide
gggattccgcagaaaaccttccctcctg

SEQ ID NO: 161208 - DNA, 28 bp, Artificial Sequence
  Description of Artificial Sequence: Synthetic oligonucleotide
ggattccgcagaaaaccttccctcctgg

SEQ ID NO: 161209 - DNA, 28 bp, Artificial Sequence
  Description of Artificial Sequence: Synthetic oligonucleotide
gattccgcagaaaaccttccctcctggc

SEQ ID NO: 161210 - DNA, 28 bp, Artificial Sequence
  Description of Artificial Sequence: Synthetic oligonucleotide
attccgcagaaaaccttccctcctggcc

SEQ ID NO: 161211 - DNA, 27 bp, Artificial Sequence
  Description of Artificial Sequence: Synthetic oligonucleotide
ttccgcagaaaaccttccctcctggcc

SEQ ID NO: 161212 - DNA, 26 bp, Artificial Sequence
  Description of Artificial Sequence: Synthetic oligonucleotide
tccgcagaaaaccttccctcctggcc

SEQ ID NO: 161213 - DNA, 25 bp, Artificial Sequence
  Description of Artificial Sequence: Synthetic oligonucleotide
ccgcagaaaaccttccctcctggcc

SEQ ID NO: 161214 - DNA, 26 bp, Artificial Sequence
  Description of Artificial Sequence: Synthetic oligonucleotide
cgcagaaaaccttccctcctggccca

SEQ ID NO: 161215 - DNA, 26 bp, Artificial Sequence
  Description of Artificial Sequence: Synthetic oligonucleotide
gcagaaaaccttccctcctggcccac

SEQ ID NO: 161216 - DNA, 37 bp, Artificial Sequence
  Description of Artificial Sequence: Synthetic oligonucleotide
agtcatcctgcaatgttggtcagatgtcatgtttgag

SEQ ID NO: 161217 - DNA, 36 bp, Artificial Sequence
  Description of Artificial Sequence: Synthetic oligonucleotide
gtcatcctgcaatgttggtcagatgtcatgtttgag

SEQ ID NO: 161218 - DNA, 36 bp, Artificial Sequence
  Description of Artificial Sequence: Synthetic oligonucleotide
tcatcctgcaatgttggtcagatgtcatgtttgagc

SEQ ID NO: 161219 - DNA, 35 bp, Artificial Sequence
  Description of Artificial Sequence: Synthetic oligonucleotide
catcctgcaatgttggtcagatgtcatgtttgagc

SEQ ID NO: 161220 - DNA, 36 bp, Artificial Sequence
  Description of Artificial Sequence: Synthetic oligonucleotide
atcctgcaatgttggtcagatgtcatgtttgagcac

SEQ ID NO: 161221 - DNA, 35 bp, Artificial Sequence
  Description of Artificial Sequence: Synthetic oligonucleotide
tcctgcaatgttggtcagatgtcatgtttgagcac

SEQ ID NO: 161222 - DNA, 34 bp, Artificial Sequence
  Description of Artificial Sequence: Synthetic oligonucleotide
cctgcaatgttggtcagatgtcatgtttgagcac

SEQ ID NO: 161223 - DNA, 36 bp, Artificial Sequence
  Description of Artificial Sequence: Synthetic oligonucleotide
ctgcaatgttggtcagatgtcatgtttgagcacttc

SEQ ID NO: 161224 - DNA, 36 bp, Artificial Sequence
  Description of Artificial Sequence: Synthetic oligonucleotide
tgcaatgttggtcagatgtcatgtttgagcacttcc

SEQ ID NO: 161225 - DNA, 35 bp, Artificial Sequence
  Description of Artificial Sequence: Synthetic oligonucleotide
gcaatgttggtcagatgtcatgtttgagcacttcc

SEQ ID NO: 161226 - DNA, 37 bp, Artificial Sequence
  Description of Artificial Sequence: Synthetic oligonucleotide
caatgttggtcagatgtcatgtttgagcacttccttc

SEQ ID NO: 161227 - DNA, 38 bp, Artificial Sequence
  Description of Artificial Sequence: Synthetic oligonucleotide
aatgttggtcagatgtcatgtttgagcacttccttctg

SEQ ID NO: 161228 - DNA, 37 bp, Artificial Sequence
  Description of Artificial Sequence: Synthetic oligonucleotide
atgttggtcagatgtcatgtttgagcacttccttctg

SEQ ID NO: 161229 - DNA, 36 bp, Artificial Sequence
  Description of Artificial Sequence: Synthetic oligonucleotide
tgttggtcagatgtcatgtttgagcacttccttctg

SEQ ID NO: 161230 - DNA, 35 bp, Artificial Sequence
  Description of Artificial Sequence: Synthetic oligonucleotide
gttggtcagatgtcatgtttgagcacttccttctg

SEQ ID NO: 161231 - DNA, 35 bp, Artificial Sequence
  Description of Artificial Sequence: Synthetic oligonucleotide
ttggtcagatgtcatgtttgagcacttccttctgc

SEQ ID NO: 161232 - DNA, 34 bp, Artificial Sequence
  Description of Artificial Sequence: Synthetic oligonucleotide
tggtcagatgtcatgtttgagcacttccttctgc

SEQ ID NO: 161233 - DNA, 33 bp, Artificial Sequence
  Description of Artificial Sequence: Synthetic oligonucleotide
ggtcagatgtcatgtttgagcacttccttctgc

SEQ ID NO: 161234 - DNA, 34 bp, Artificial Sequence
  Description of Artificial Sequence: Synthetic oligonucleotide
gtcagatgtcatgtttgagcacttccttctgcac

SEQ ID NO: 161235 - DNA, 35 bp, Artificial Sequence
  Description of Artificial Sequence: Synthetic oligonucleotide
tcagatgtcatgtttgagcacttccttctgcacag

SEQ ID NO: 161236 - DNA, 34 bp, Artificial Sequence
  Description of Artificial Sequence: Synthetic oligonucleotide
cagatgtcatgtttgagcacttccttctgcacag

SEQ ID NO: 161237 - DNA, 35 bp, Artificial Sequence
  Description of Artificial Sequence: Synthetic oligonucleotide
agatgtcatgtttgagcacttccttctgcacagag

SEQ ID NO: 161238 - DNA, 34 bp, Artificial Sequence
  Description of Artificial Sequence: Synthetic oligonucleotide
gatgtcatgtttgagcacttccttctgcacagag

SEQ ID NO: 161239 - DNA, 35 bp, Artificial Sequence
  Description of Artificial Sequence: Synthetic oligonucleotide
atgtcatgtttgagcacttccttctgcacagagag

SEQ ID NO: 161240 - DNA, 34 bp, Artificial Sequence
  Description of Artificial Sequence: Synthetic oligonucleotide
tgtcatgtttgagcacttccttctgcacagagag

SEQ ID NO: 161241 - DNA, 33 bp, Artificial Sequence
  Description of Artificial Sequence: Synthetic oligonucleotide
gtcatgtttgagcacttccttctgcacagagag

SEQ ID NO: 161242 - DNA, 33 bp, Artificial Sequence
  Description of Artificial Sequence: Synthetic oligonucleotide
tcatgtttgagcacttccttctgcacagagagg

SEQ ID NO: 161243 - DNA, 32 bp, Artificial Sequence
  Description of Artificial Sequence: Synthetic oligonucleotide
catgtttgagcacttccttctgcacagagagg

SEQ ID NO: 161244 - DNA, 32 bp, Artificial Sequence
  Description of Artificial Sequence: Synthetic oligonucleotide
atgtttgagcacttccttctgcacagagaggg

SEQ ID NO: 161245 - DNA, 31 bp, Artificial Sequence
  Description of Artificial Sequence: Synthetic oligonucleotide
tgtttgagcacttccttctgcacagagaggg

SEQ ID NO: 161246 - DNA, 27 bp, Artificial Sequence
  Description of Artificial Sequence: Synthetic oligonucleotide
cacttccttctgcacagagaggggacg

SEQ ID NO: 161247 - DNA, 32 bp, Artificial Sequence
  Description of Artificial Sequence: Synthetic oligonucleotide
acttccttctgcacagagaggggacgtttaac

SEQ ID NO: 161248 - DNA, 31 bp, Artificial Sequence
  Description of Artificial Sequence: Synthetic oligonucleotide
cttccttctgcacagagaggggacgtttaac

SEQ ID NO: 161249 - DNA, 31 bp, Artificial Sequence
  Description of Artificial Sequence: Synthetic oligonucleotide
ttccttctgcacagagaggggacgtttaacg

SEQ ID NO: 161250 - DNA, 30 bp, Artificial Sequence
  Description of Artificial Sequence: Synthetic oligonucleotide
tccttctgcacagagaggggacgtttaacg

SEQ ID NO: 161251 - DNA, 29 bp, Artificial Sequence
  Description of Artificial Sequence: Synthetic oligonucleotide
ccttctgcacagagaggggacgtttaacg

SEQ ID NO: 161252 - DNA, 30 bp, Artificial Sequence
  Description of Artificial Sequence: Synthetic oligonucleotide
cttctgcacagagaggggacgtttaacgac

SEQ ID NO: 161253 - DNA, 31 bp, Artificial Sequence
  Description of Artificial Sequence: Synthetic oligonucleotide
ttctgcacagagaggggacgtttaacgacac

SEQ ID NO: 161254 - DNA, 30 bp, Artificial Sequence
  Description of Artificial Sequence: Synthetic oligonucleotide
tctgcacagagaggggacgtttaacgacac

SEQ ID NO: 161255 - DNA, 29 bp, Artificial Sequence
  Description of Artificial Sequence: Synthetic oligonucleotide
ctgcacagagaggggacgtttaacgacac

SEQ ID NO: 161256 - DNA, 32 bp, Artificial Sequence
  Description of Artificial Sequence: Synthetic oligonucleotide
tgcacagagaggggacgtttaacgacactttg

SEQ ID NO: 161257 - DNA, 31 bp, Artificial Sequence
  Description of Artificial Sequence: Synthetic oligonucleotide
gcacagagaggggacgtttaacgacactttg

SEQ ID NO: 161258 - DNA, 31 bp, Artificial Sequence
  Description of Artificial Sequence: Synthetic oligonucleotide
cacagagaggggacgtttaacgacactttgc

SEQ ID NO: 161259 - DNA, 31 bp, Artificial Sequence
  Description of Artificial Sequence: Synthetic oligonucleotide
acagagaggggacgtttaacgacactttgcg

SEQ ID NO: 161260 - DNA, 30 bp, Artificial Sequence
  Description of Artificial Sequence: Synthetic oligonucleotide
cagagaggggacgtttaacgacactttgcg

SEQ ID NO: 161261 - DNA, 30 bp, Artificial Sequence
  Description of Artificial Sequence: Synthetic oligonucleotide
agagaggggacgtttaacgacactttgcgc

SEQ ID NO: 161262 - DNA, 29 bp, Artificial Sequence
  Description of Artificial Sequence: Synthetic oligonucleotide
gagaggggacgtttaacgacactttgcgc

SEQ ID NO: 161263 - DNA, 29 bp, Artificial Sequence
  Description of Artificial Sequence: Synthetic oligonucleotide
agaggggacgtttaacgacactttgcgcc

SEQ ID NO: 161264 - DNA, 28 bp, Artificial Sequence
  Description of Artificial Sequence: Synthetic oligonucleotide
gaggggacgtttaacgacactttgcgcc

SEQ ID NO: 161265 - DNA, 29 bp, Artificial Sequence
  Description of Artificial Sequence: Synthetic oligonucleotide
aggggacgtttaacgacactttgcgcctc

SEQ ID NO: 161266 - DNA, 28 bp, Artificial Sequence
  Description of Artificial Sequence: Synthetic oligonucleotide
ggggacgtttaacgacactttgcgcctc

SEQ ID NO: 161267 - DNA, 31 bp, Artificial Sequence
  Description of Artificial Sequence: Synthetic oligonucleotide
gggacgtttaacgacactttgcgcctcattg

SEQ ID NO: 161268 - DNA, 31 bp, Artificial Sequence
  Description of Artificial Sequence: Synthetic oligonucleotide
ggacgtttaacgacactttgcgcctcattgg

SEQ ID NO: 161269 - DNA, 32 bp, Artificial Sequence
  Description of Artificial Sequence: Synthetic oligonucleotide
gacgtttaacgacactttgcgcctcattggag

SEQ ID NO: 161270 - DNA, 33 bp, Artificial Sequence
  Description of Artificial Sequence: Synthetic oligonucleotide
acgtttaacgacactttgcgcctcattggagag

SEQ ID NO: 161271 - DNA, 32 bp, Artificial Sequence
  Description of Artificial Sequence: Synthetic oligonucleotide
cgtttaacgacactttgcgcctcattggagag

SEQ ID NO: 161272 - DNA, 32 bp, Artificial Sequence
  Description of Artificial Sequence: Synthetic oligonucleotide
gtttaacgacactttgcgcctcattggagagc

SEQ ID NO: 161273 - DNA, 33 bp, Artificial Sequence
  Description of Artificial Sequence: Synthetic oligonucleotide
tttaacgacactttgcgcctcattggagagcac

SEQ ID NO: 161274 - DNA, 32 bp, Artificial Sequence
  Description of Artificial Sequence: Synthetic oligonucleotide
ttaacgacactttgcgcctcattggagagcac

SEQ ID NO: 161275 - DNA, 31 bp, Artificial Sequence
  Description of Artificial Sequence: Synthetic oligonucleotide
taacgacactttgcgcctcattggagagcac

SEQ ID NO: 161276 - DNA, 30 bp, Artificial Sequence
  Description of Artificial Sequence: Synthetic oligonucleotide
aacgacactttgcgcctcattggagagcac

SEQ ID NO: 161277 - DNA, 29 bp, Artificial Sequence
  Description of Artificial Sequence: Synthetic oligonucleotide
acgacactttgcgcctcattggagagcac

SEQ ID NO: 161278 - DNA, 28 bp, Artificial Sequence
  Description of Artificial Sequence: Synthetic oligonucleotide
cgacactttgcgcctcattggagagcac

SEQ ID NO: 161279 - DNA, 31 bp, Artificial Sequence
  Description of Artificial Sequence: Synthetic oligonucleotide
gacactttgcgcctcattggagagcacattg

SEQ ID NO: 161280 - DNA, 33 bp, Artificial Sequence
  Description of Artificial Sequence: Synthetic oligonucleotide
acactttgcgcctcattggagagcacattgatg

SEQ ID NO: 161281 - DNA, 32 bp, Artificial Sequence
  Description of Artificial Sequence: Synthetic oligonucleotide
cactttgcgcctcattggagagcacattgatg

SEQ ID NO: 161282 - DNA, 32 bp, Artificial Sequence
  Description of Artificial Sequence: Synthetic oligonucleotide
actttgcgcctcattggagagcacattgatgg

SEQ ID NO: 161283 - DNA, 31 bp, Artificial Sequence
  Description of Artificial Sequence: Synthetic oligonucleotide
ctttgcgcctcattggagagcacattgatgg

SEQ ID NO: 161284 - DNA, 31 bp, Artificial Sequence
  Description of Artificial Sequence: Synthetic oligonucleotide
tttgcgcctcattggagagcacattgatggg

SEQ ID NO: 161285 - DNA, 30 bp, Artificial Sequence
  Description of Artificial Sequence: Synthetic oligonucleotide
ttgcgcctcattggagagcacattgatggg

SEQ ID NO: 161286 - DNA, 29 bp, Artificial Sequence
  Description of Artificial Sequence: Synthetic oligonucleotide
tgcgcctcattggagagcacattgatggg

SEQ ID NO: 161287 - DNA, 28 bp, Artificial Sequence
  Description of Artificial Sequence: Synthetic oligonucleotide
gcgcctcattggagagcacattgatggg

SEQ ID NO: 161288 - DNA, 28 bp, Artificial Sequence
  Description of Artificial Sequence: Synthetic oligonucleotide
cgcctcattggagagcacattgatgggg

SEQ ID NO: 161289 - DNA, 29 bp, Artificial Sequence
  Description of Artificial Sequence: Synthetic oligonucleotide
gcctcattggagagcacattgatggggtc

SEQ ID NO: 161290 - DNA, 30 bp, Artificial Sequence
  Description of Artificial Sequence: Synthetic oligonucleotide
cctcattggagagcacattgatggggtctc

SEQ ID NO: 161291 - DNA, 30 bp, Artificial Sequence
  Description of Artificial Sequence: Synthetic oligonucleotide
ctcattggagagcacattgatggggtctcc

SEQ ID NO: 161292 - DNA, 32 bp, Artificial Sequence
  Description of Artificial Sequence: Synthetic oligonucleotide
tcattggagagcacattgatggggtctccaag

SEQ ID NO: 161293 - DNA, 31 bp, Artificial Sequence
  Description of Artificial Sequence: Synthetic oligonucleotide
cattggagagcacattgatggggtctccaag

SEQ ID NO: 161294 - DNA, 31 bp, Artificial Sequence
  Description of Artificial Sequence: Synthetic oligonucleotide
attggagagcacattgatggggtctccaagg

SEQ ID NO: 161295 - DNA, 30 bp, Artificial Sequence
  Description of Artificial Sequence: Synthetic oligonucleotide
ttggagagcacattgatggggtctccaagg

SEQ ID NO: 161296 - DNA, 29 bp, Artificial Sequence
  Description of Artificial Sequence: Synthetic oligonucleotide
tggagagcacattgatggggtctccaagg

SEQ ID NO: 161297 - DNA, 28 bp, Artificial Sequence
  Description of Artificial Sequence: Synthetic oligonucleotide
ggagagcacattgatggggtctccaagg

SEQ ID NO: 161298 - DNA, 28 bp, Artificial Sequence
  Description of Artificial Sequence: Synthetic oligonucleotide
gagagcacattgatggggtctccaaggc

SEQ ID NO: 161299 - DNA, 28 bp, Artificial Sequence
  Description of Artificial Sequence: Synthetic oligonucleotide
agagcacattgatggggtctccaaggcc

SEQ ID NO: 161300 - DNA, 27 bp, Artificial Sequence
  Description of Artificial Sequence: Synthetic oligonucleotide
gagcacattgatggggtctccaaggcc

SEQ ID NO: 161301 - DNA, 29 bp, Artificial Sequence
  Description of Artificial Sequence: Synthetic oligonucleotide
agcacattgatggggtctccaaggccaac

SEQ ID NO: 161302 - DNA, 28 bp, Artificial Sequence
  Description of Artificial Sequence: Synthetic oligonucleotide
gcacattgatggggtctccaaggccaac

SEQ ID NO: 161303 - DNA, 30 bp, Artificial Sequence
  Description of Artificial Sequence: Synthetic oligonucleotide
cacattgatggggtctccaaggccaacttc

SEQ ID NO: 161304 - DNA, 31 bp, Artificial Sequence
  Description of Artificial Sequence: Synthetic oligonucleotide
acattgatggggtctccaaggccaacttctc

SEQ ID NO: 161305 - DNA, 30 bp, Artificial Sequence
  Description of Artificial Sequence: Synthetic oligonucleotide
cattgatggggtctccaaggccaacttctc

SEQ ID NO: 161306 - DNA, 30 bp, Artificial Sequence
  Description of Artificial Sequence: Synthetic oligonucleotide
attgatggggtctccaaggccaacttctcc

SEQ ID NO: 161307 - DNA, 29 bp, Artificial Sequence
  Description of Artificial Sequence: Synthetic oligonucleotide
ttgatggggtctccaaggccaacttctcc

SEQ ID NO: 161308 - DNA, 28 bp, Artificial Sequence
  Description of Artificial Sequence: Synthetic oligonucleotide
tctccaaggccaacttctccatcggtcg

SEQ ID NO: 161309 - DNA, 27 bp, Artificial Sequence
  Description of Artificial Sequence: Synthetic oligonucleotide
ctccaaggccaacttctccatcggtcg

SEQ ID NO: 161310 - DNA, 27 bp, Artificial Sequence
  Description of Artificial Sequence: Synthetic oligonucleotide
tccaaggccaacttctccatcggtcgc

SEQ ID NO: 161311 - DNA, 27 bp, Artificial Sequence
  Description of Artificial Sequence: Synthetic oligonucleotide
ccaaggccaacttctccatcggtcgca

SEQ ID NO: 161312 - DNA, 28 bp, Artificial Sequence
  Description of Artificial Sequence: Synthetic oligonucleotide
caaggccaacttctccatcggtcgcatg

SEQ ID NO: 161313 - DNA, 29 bp, Artificial Sequence
  Description of Artificial Sequence: Synthetic oligonucleotide
aaggccaacttctccatcggtcgcatgag

SEQ ID NO: 161314 - DNA, 28 bp, Artificial Sequence
  Description of Artificial Sequence: Synthetic oligonucleotide
aggccaacttctccatcggtcgcatgag

SEQ ID NO: 161315 - DNA, 27 bp, Artificial Sequence
  Description of Artificial Sequence: Synthetic oligonucleotide
ggccaacttctccatcggtcgcatgag

SEQ ID NO: 161316 - DNA, 27 bp, Artificial Sequence
  Description of Artificial Sequence: Synthetic oligonucleotide
gccaacttctccatcggtcgcatgagg

SEQ ID NO: 161317 - DNA, 27 bp, Artificial Sequence
  Description of Artificial Sequence: Synthetic oligonucleotide
ccaacttctccatcggtcgcatgaggc

SEQ ID NO: 161318 - DNA, 29 bp, Artificial Sequence
  Description of Artificial Sequence: Synthetic oligonucleotide
caacttctccatcggtcgcatgaggcaag

SEQ ID NO: 161319 - DNA, 30 bp, Artificial Sequence
  Description of Artificial Sequence: Synthetic oligonucleotide
aacttctccatcggtcgcatgaggcaagac

SEQ ID NO: 161320 - DNA, 29 bp, Artificial Sequence
  Description of Artificial Sequence: Synthetic oligonucleotide
acttctccatcggtcgcatgaggcaagac

SEQ ID NO: 161321 - DNA, 28 bp, Artificial Sequence
  Description of Artificial Sequence: Synthetic oligonucleotide
cttctccatcggtcgcatgaggcaagac

SEQ ID NO: 161322 - DNA, 28 bp, Artificial Sequence
  Description of Artificial Sequence: Synthetic oligonucleotide
ttctccatcggtcgcatgaggcaagacc

SEQ ID NO: 161323 - DNA, 27 bp, Artificial Sequence
  Description of Artificial Sequence: Synthetic oligonucleotide
tctccatcggtcgcatgaggcaagacc

SEQ ID NO: 161324 - DNA, 27 bp, Artificial Sequence
  Description of Artificial Sequence: Synthetic oligonucleotide
ctccatcggtcgcatgaggcaagacct

SEQ ID NO: 161325 - DNA, 27 bp, Artificial Sequence
  Description of Artificial Sequence: Synthetic oligonucleotide
tccatcggtcgcatgaggcaagacctg

SEQ ID NO: 161326 - DNA, 26 bp, Artificial Sequence
  Description of Artificial Sequence: Synthetic oligonucleotide
ccatcggtcgcatgaggcaagacctg

SEQ ID NO: 161327 - DNA, 26 bp, Artificial Sequence
  Description of Artificial Sequence: Synthetic oligonucleotide
catcggtcgcatgaggcaagacctgg

SEQ ID NO: 161328 - DNA, 27 bp, Artificial Sequence
  Description of Artificial Sequence: Synthetic oligonucleotide
atcggtcgcatgaggcaagacctggca

SEQ ID NO: 161329 - DNA, 26 bp, Artificial Sequence
  Description of Artificial Sequence: Synthetic oligonucleotide
tcggtcgcatgaggcaagacctggca

SEQ ID NO: 161330 - DNA, 25 bp, Artificial Sequence
  Description of Artificial Sequence: Synthetic oligonucleotide
cggtcgcatgaggcaagacctggca

SEQ ID NO: 161331 - DNA, 25 bp, Artificial Sequence
  Description of Artificial Sequence: Synthetic oligonucleotide
ggtcgcatgaggcaagacctggcag

SEQ ID NO: 161332 - DNA, 30 bp, Artificial Sequence
  Description of Artificial Sequence: Synthetic oligonucleotide
cagggacctacagatgctacggttctgttc

SEQ ID NO: 161333 - DNA, 30 bp, Artificial Sequence
  Description of Artificial Sequence: Synthetic oligonucleotide
agggacctacagatgctacggttctgttcc

SEQ ID NO: 161334 - DNA, 29 bp, Artificial Sequence
  Description of Artificial Sequence: Synthetic oligonucleotide
gggacctacagatgctacggttctgttcc

SEQ ID NO: 161335 - DNA, 30 bp, Artificial Sequence
  Description of Artificial Sequence: Synthetic oligonucleotide
ggacctacagatgctacggttctgttcctc

SEQ ID NO: 161336 - DNA, 31 bp, Artificial Sequence
  Description of Artificial Sequence: Synthetic oligonucleotide
gacctacagatgctacggttctgttcctcac

SEQ ID NO: 161337 - DNA, 32 bp, Artificial Sequence
  Description of Artificial Sequence: Synthetic oligonucleotide
acctacagatgctacggttctgttcctcactc

SEQ ID NO: 161338 - DNA, 31 bp, Artificial Sequence
  Description of Artificial Sequence: Synthetic oligonucleotide
cctacagatgctacggttctgttcctcactc

SEQ ID NO: 161339 - DNA, 31 bp, Artificial Sequence
  Description of Artificial Sequence: Synthetic oligonucleotide
ctacagatgctacggttctgttcctcactcc

SEQ ID NO: 161340 - DNA, 31 bp, Artificial Sequence
  Description of Artificial Sequence: Synthetic oligonucleotide
tacagatgctacggttctgttcctcactccc

SEQ ID NO: 161341 - DNA, 30 bp, Artificial Sequence
  Description of Artificial Sequence: Synthetic oligonucleotide
acagatgctacggttctgttcctcactccc

SEQ ID NO: 161342 - DNA, 29 bp, Artificial Sequence
  Description of Artificial Sequence: Synthetic oligonucleotide
cagatgctacggttctgttcctcactccc

SEQ ID NO: 161343 - DNA, 29 bp, Artificial Sequence
  Description of Artificial Sequence: Synthetic oligonucleotide
agatgctacggttctgttcctcactcccc

SEQ ID NO: 161344 - DNA, 28 bp, Artificial Sequence
  Description of Artificial Sequence: Synthetic oligonucleotide
gatgctacggttctgttcctcactcccc

SEQ ID NO: 161345 - DNA, 28 bp, Artificial Sequence
  Description of Artificial Sequence: Synthetic oligonucleotide
atgctacggttctgttcctcactccccc

SEQ ID NO: 161346 - DNA, 27 bp, Artificial Sequence
  Description of Artificial Sequence: Synthetic oligonucleotide
tgctacggttctgttcctcactccccc

SEQ ID NO: 161347 - DNA, 27 bp, Artificial Sequence
  Description of Artificial Sequence: Synthetic oligonucleotide
gctacggttctgttcctcactccccct

SEQ ID NO: 161348 - DNA, 29 bp, Artificial Sequence
  Description of Artificial Sequence: Synthetic oligonucleotide
ctacggttctgttcctcactccccctatc

SEQ ID NO: 161349 - DNA, 30 bp, Artificial Sequence
  Description of Artificial Sequence: Synthetic oligonucleotide
tacggttctgttcctcactccccctatcag

SEQ ID NO: 161350 - DNA, 29 bp, Artificial Sequence
  Description of Artificial Sequence: Synthetic oligonucleotide
acggttctgttcctcactccccctatcag

SEQ ID NO: 161351 - DNA, 28 bp, Artificial Sequence
  Description of Artificial Sequence: Synthetic oligonucleotide
cggttctgttcctcactccccctatcag

SEQ ID NO: 161352 - DNA, 32 bp, Artificial Sequence
  Description of Artificial Sequence: Synthetic oligonucleotide
ggttctgttcctcactccccctatcagttttc

SEQ ID NO: 161353 - DNA, 33 bp, Artificial Sequence
  Description of Artificial Sequence: Synthetic oligonucleotide
gttctgttcctcactccccctatcagttttcag

SEQ ID NO: 161354 - DNA, 33 bp, Artificial Sequence
  Description of Artificial Sequence: Synthetic oligonucleotide
ttctgttcctcactccccctatcagttttcagc

SEQ ID NO: 161355 - DNA, 32 bp, Artificial Sequence
  Description of Artificial Sequence: Synthetic oligonucleotide
tctgttcctcactccccctatcagttttcagc

SEQ ID NO: 161356 - DNA, 31 bp, Artificial Sequence
  Description of Artificial Sequence: Synthetic oligonucleotide
ctgttcctcactccccctatcagttttcagc

SEQ ID NO: 161357 - DNA, 32 bp, Artificial Sequence
  Description of Artificial Sequence: Synthetic oligonucleotide
tgttcctcactccccctatcagttttcagctc

SEQ ID NO: 161358 - DNA, 31 bp, Artificial Sequence
  Description of Artificial Sequence: Synthetic oligonucleotide
gttcctcactccccctatcagttttcagctc

SEQ ID NO: 161359 - DNA, 31 bp, Artificial Sequence
  Description of Artificial Sequence: Synthetic oligonucleotide
ttcctcactccccctatcagttttcagctcc

SEQ ID NO: 161360 - DNA, 30 bp, Artificial Sequence
  Description of Artificial Sequence: Synthetic oligonucleotide
tcctcactccccctatcagttttcagctcc

SEQ ID NO: 161361 - DNA, 29 bp, Artificial Sequence
  Description of Artificial Sequence: Synthetic oligonucleotide
cctcactccccctatcagttttcagctcc

SEQ ID NO: 161362 - DNA, 29 bp, Artificial Sequence
  Description of Artificial Sequence: Synthetic oligonucleotide
ctcactccccctatcagttttcagctccc

SEQ ID NO: 161363 - DNA, 30 bp, Artificial Sequence
  Description of Artificial Sequence: Synthetic oligonucleotide
tcactccccctatcagttttcagctcccag

SEQ ID NO: 161364 - DNA, 29 bp, Artificial Sequence
  Description of Artificial Sequence: Synthetic oligonucleotide
cactccccctatcagttttcagctcccag

SEQ ID NO: 161365 - DNA, 30 bp, Artificial Sequence
  Description of Artificial Sequence: Synthetic oligonucleotide
actccccctatcagttttcagctcccagtg

SEQ ID NO: 161366 - DNA, 29 bp, Artificial Sequence
  Description of Artificial Sequence: Synthetic oligonucleotide
ctccccctatcagttttcagctcccagtg

SEQ ID NO: 161367 - DNA, 30 bp, Artificial Sequence
  Description of Artificial Sequence: Synthetic oligonucleotide
tccccctatcagttttcagctcccagtgac

SEQ ID NO: 161368 - DNA, 29 bp, Artificial Sequence
  Description of Artificial Sequence: Synthetic oligonucleotide
ccccctatcagttttcagctcccagtgac

SEQ ID NO: 161369 - DNA, 29 bp, Artificial Sequence
  Description of Artificial Sequence: Synthetic oligonucleotide
cccctatcagttttcagctcccagtgacc

SEQ ID NO: 161370 - DNA, 29 bp, Artificial Sequence
  Description of Artificial Sequence: Synthetic oligonucleotide
ccctatcagttttcagctcccagtgaccc

SEQ ID NO: 161371 - DNA, 30 bp, Artificial Sequence
  Description of Artificial Sequence: Synthetic oligonucleotide
cctatcagttttcagctcccagtgaccctc

SEQ ID NO: 161372 - DNA, 31 bp, Artificial Sequence
  Description of Artificial Sequence: Synthetic oligonucleotide
ctatcagttttcagctcccagtgaccctctg

SEQ ID NO: 161373 - DNA, 31 bp, Artificial Sequence
  Description of Artificial Sequence: Synthetic oligonucleotide
tatcagttttcagctcccagtgaccctctgg

SEQ ID NO: 161374 - DNA, 30 bp, Artificial Sequence
  Description of Artificial Sequence: Synthetic oligonucleotide
atcagttttcagctcccagtgaccctctgg

SEQ ID NO: 161375 - DNA, 29 bp, Artificial Sequence
  Description of Artificial Sequence: Synthetic oligonucleotide
tcagttttcagctcccagtgaccctctgg

SEQ ID NO: 161376 - DNA, 28 bp, Artificial Sequence
  Description of Artificial Sequence: Synthetic oligonucleotide
cagttttcagctcccagtgaccctctgg

SEQ ID NO: 161377 - DNA, 29 bp, Artificial Sequence
  Description of Artificial Sequence: Synthetic oligonucleotide
agttttcagctcccagtgaccctctggac

SEQ ID NO: 161378 - DNA, 28 bp, Artificial Sequence
  Description of Artificial Sequence: Synthetic oligonucleotide
gttttcagctcccagtgaccctctggac

SEQ ID NO: 161379 - DNA, 30 bp, Artificial Sequence
  Description of Artificial Sequence: Synthetic oligonucleotide
ttttcagctcccagtgaccctctggacatc

SEQ ID NO: 161380 - DNA, 29 bp, Artificial Sequence
  Description of Artificial Sequence: Synthetic oligonucleotide
tttcagctcccagtgaccctctggacatc

SEQ ID NO: 161381 - DNA, 28 bp, Artificial Sequence
  Description of Artificial Sequence: Synthetic oligonucleotide
ttcagctcccagtgaccctctggacatc

SEQ ID NO: 161382 - DNA, 28 bp, Artificial Sequence
  Description of Artificial Sequence: Synthetic oligonucleotide
ccagtgaccctctggacatcgtgatcac

SEQ ID NO: 161383 - DNA, 29 bp, Artificial Sequence
  Description of Artificial Sequence: Synthetic oligonucleotide
cagtgaccctctggacatcgtgatcacag

SEQ ID NO: 161384 - DNA, 29 bp, Artificial Sequence
  Description of Artificial Sequence: Synthetic oligonucleotide
agtgaccctctggacatcgtgatcacagg

SEQ ID NO: 161385 - DNA, 28 bp, Artificial Sequence
  Description of Artificial Sequence: Synthetic oligonucleotide
gtgaccctctggacatcgtgatcacagg

SEQ ID NO: 161386 - DNA, 29 bp, Artificial Sequence
  Description of Artificial Sequence: Synthetic oligonucleotide
tgaccctctggacatcgtgatcacaggtc

SEQ ID NO: 161387 - DNA, 28 bp, Artificial Sequence
  Description of Artificial Sequence: Synthetic oligonucleotide
gaccctctggacatcgtgatcacaggtc

SEQ ID NO: 161388 - DNA, 33 bp, Artificial Sequence
  Description of Artificial Sequence: Synthetic oligonucleotide
accctctggacatcgtgatcacaggtctatatg

SEQ ID NO: 161389 - DNA, 32 bp, Artificial Sequence
  Description of Artificial Sequence: Synthetic oligonucleotide
ccctctggacatcgtgatcacaggtctatatg

SEQ ID NO: 161390 - DNA, 33 bp, Artificial Sequence
  Description of Artificial Sequence: Synthetic oligonucleotide
cctctggacatcgtgatcacaggtctatatgag

SEQ ID NO: 161391 - DNA, 36 bp, Artificial Sequence
  Description of Artificial Sequence: Synthetic oligonucleotide
ctctggacatcgtgatcacaggtctatatgagaaac

SEQ ID NO: 161392 - DNA, 36 bp, Artificial Sequence
  Description of Artificial Sequence: Synthetic oligonucleotide
tctggacatcgtgatcacaggtctatatgagaaacc

SEQ ID NO: 161393 - DNA, 35 bp, Artificial Sequence
  Description of Artificial Sequence: Synthetic oligonucleotide
ctggacatcgtgatcacaggtctatatgagaaacc

SEQ ID NO: 161394 - DNA, 37 bp, Artificial Sequence
  Description of Artificial Sequence: Synthetic oligonucleotide
tggacatcgtgatcacaggtctatatgagaaaccttc

SEQ ID NO: 161395 - DNA, 36 bp, Artificial Sequence
  Description of Artificial Sequence: Synthetic oligonucleotide
ggacatcgtgatcacaggtctatatgagaaaccttc

SEQ ID NO: 161396 - DNA, 37 bp, Artificial Sequence
  Description of Artificial Sequence: Synthetic oligonucleotide
gacatcgtgatcacaggtctatatgagaaaccttctc

SEQ ID NO: 161397 - DNA, 38 bp, Artificial Sequence
  Description of Artificial Sequence: Synthetic oligonucleotide
acatcgtgatcacaggtctatatgagaaaccttctctc

SEQ ID NO: 161398 - DNA, 37 bp, Artificial Sequence
  Description of Artificial Sequence: Synthetic oligonucleotide
catcgtgatcacaggtctatatgagaaaccttctctc

SEQ ID NO: 161399 - DNA, 38 bp, Artificial Sequence
  Description of Artificial Sequence: Synthetic oligonucleotide
atcgtgatcacaggtctatatgagaaaccttctctctc

SEQ ID NO: 161400 - DNA, 37 bp, Artificial Sequence
  Description of Artificial Sequence: Synthetic oligonucleotide
tcgtgatcacaggtctatatgagaaaccttctctctc

SEQ ID NO: 161401 - DNA, 36 bp, Artificial Sequence
  Description of Artificial Sequence: Synthetic oligonucleotide
cgtgatcacaggtctatatgagaaaccttctctctc

SEQ ID NO: 161402 - DNA, 37 bp, Artificial Sequence
  Description of Artificial Sequence: Synthetic oligonucleotide
gtgatcacaggtctatatgagaaaccttctctctcag

SEQ ID NO: 161403 - DNA, 37 bp, Artificial Sequence
  Description of Artificial Sequence: Synthetic oligonucleotide
tgatcacaggtctatatgagaaaccttctctctcagc

SEQ ID NO: 161404 - DNA, 36 bp, Artificial Sequence
  Description of Artificial Sequence: Synthetic oligonucleotide
gatcacaggtctatatgagaaaccttctctctcagc

SEQ ID NO: 161405 - DNA, 27 bp, Artificial Sequence
  Description of Artificial Sequence: Synthetic oligonucleotide
agagcgtgaccttgtcctgcagctcct

SEQ ID NO: 161406 - DNA, 26 bp, Artificial Sequence
  Description of Artificial Sequence: Synthetic oligonucleotide
gagcgtgaccttgtcctgcagctcct

SEQ ID NO: 161407 - DNA, 26 bp, Artificial Sequence
  Description of Artificial Sequence: Synthetic oligonucleotide
agcgtgaccttgtcctgcagctcctg

SEQ ID NO: 161408 - DNA, 25 bp, Artificial Sequence
  Description of Artificial Sequence: Synthetic oligonucleotide
gcgtgaccttgtcctgcagctcctg

SEQ ID NO: 161409 - DNA, 26 bp, Artificial Sequence
  Description of Artificial Sequence: Synthetic oligonucleotide
cgtgaccttgtcctgcagctcctgga

SEQ ID NO: 161410 - DNA, 33 bp, Artificial Sequence
  Description of Artificial Sequence: Synthetic oligonucleotide
ctggagctcctatgacatgtaccatctatccac

SEQ ID NO: 161411 - DNA, 33 bp, Artificial Sequence
  Description of Artificial Sequence: Synthetic oligonucleotide
tggagctcctatgacatgtaccatctatccacg

SEQ ID NO: 161412 - DNA, 26 bp, Artificial Sequence
  Description of Artificial Sequence: Synthetic oligonucleotide
actttcctctgggccctgccacccaa

SEQ ID NO: 161413 - DNA, 25 bp, Artificial Sequence
  Description of Artificial Sequence: Synthetic oligonucleotide
ctttcctctgggccctgccacccaa

SEQ ID NO: 161414 - DNA, 25 bp, Artificial Sequence
  Description of Artificial Sequence: Synthetic oligonucleotide
tttcctctgggccctgccacccaag

SEQ ID NO: 161415 - DNA, 24 bp, Artificial Sequence
  Description of Artificial Sequence: Synthetic oligonucleotide
ttcctctgggccctgccacccaag

SEQ ID NO: 161416 - DNA, 23 bp, Artificial Sequence
  Description of Artificial Sequence: Synthetic oligonucleotide
tcctctgggccctgccacccaag

SEQ ID NO: 161417 - DNA, 22 bp, Artificial Sequence
  Description of Artificial Sequence: Synthetic oligonucleotide
cctctgggccctgccacccaag

SEQ ID NO: 161418 - DNA, 23 bp, Artificial Sequence
  Description of Artificial Sequence: Synthetic oligonucleotide
ctctgggccctgccacccaagga

SEQ ID NO: 161419 - DNA, 23 bp, Artificial Sequence
  Description of Artificial Sequence: Synthetic oligonucleotide
tctgggccctgccacccaaggag

SEQ ID NO: 161420 - DNA, 22 bp, Artificial Sequence
  Description of Artificial Sequence: Synthetic oligonucleotide
ctgggccctgccacccaaggag

SEQ ID NO: 161421 - DNA, 24 bp, Artificial Sequence
  Description of Artificial Sequence: Synthetic oligonucleotide
tgggccctgccacccaaggaggaa

SEQ ID NO: 161422 - DNA, 23 bp, Artificial Sequence
  Description of Artificial Sequence: Synthetic oligonucleotide
gggccctgccacccaaggaggaa

SEQ ID NO: 161423 - DNA, 23 bp, Artificial Sequence
  Description of Artificial Sequence: Synthetic oligonucleotide
ggccctgccacccaaggaggaac

SEQ ID NO: 161424 - DNA, 25 bp, Artificial Sequence
  Description of Artificial Sequence: Synthetic oligonucleotide
gccctgccacccaaggaggaaccta

SEQ ID NO: 161425 - DNA, 26 bp, Artificial Sequence
  Description of Artificial Sequence: Synthetic oligonucleotide
ccctgccacccaaggaggaacctaca

SEQ ID NO: 161426 - DNA, 27 bp, Artificial Sequence
  Description of Artificial Sequence: Synthetic oligonucleotide
cctgccacccaaggaggaacctacaga

SEQ ID NO: 161427 - DNA, 28 bp, Artificial Sequence
  Description of Artificial Sequence: Synthetic oligonucleotide
ctgccacccaaggaggaacctacagatg

SEQ ID NO: 161428 - DNA, 28 bp, Artificial Sequence
  Description of Artificial Sequence: Synthetic oligonucleotide
tgccacccaaggaggaacctacagatgc

SEQ ID NO: 161429 - DNA, 27 bp, Artificial Sequence
  Description of Artificial Sequence: Synthetic oligonucleotide
gccacccaaggaggaacctacagatgc

SEQ ID NO: 161430 - DNA, 29 bp, Artificial Sequence
  Description of Artificial Sequence: Synthetic oligonucleotide
ccacccaaggaggaacctacagatgcttc

SEQ ID NO: 161431 - DNA, 29 bp, Artificial Sequence
  Description of Artificial Sequence: Synthetic oligonucleotide
cacccaaggaggaacctacagatgcttcg

SEQ ID NO: 161432 - DNA, 29 bp, Artificial Sequence
  Description of Artificial Sequence: Synthetic oligonucleotide
acccaaggaggaacctacagatgcttcgg

SEQ ID NO: 161433 - DNA, 28 bp, Artificial Sequence
  Description of Artificial Sequence: Synthetic oligonucleotide
cccaaggaggaacctacagatgcttcgg

SEQ ID NO: 161434 - DNA, 28 bp, Artificial Sequence
  Description of Artificial Sequence: Synthetic oligonucleotide
ccaaggaggaacctacagatgcttcggc

SEQ ID NO: 161435 - DNA, 29 bp, Artificial Sequence
  Description of Artificial Sequence: Synthetic oligonucleotide
caaggaggaacctacagatgcttcggctc

SEQ ID NO: 161436 - DNA, 32 bp, Artificial Sequence
  Description of Artificial Sequence: Synthetic oligonucleotide
aaggaggaacctacagatgcttcggctctttc

SEQ ID NO: 161437 - DNA, 31 bp, Artificial Sequence
  Description of Artificial Sequence: Synthetic oligonucleotide
aggaggaacctacagatgcttcggctctttc

SEQ ID NO: 161438 - DNA, 32 bp, Artificial Sequence
  Description of Artificial Sequence: Synthetic oligonucleotide
aggaacctacagatgcttcggctctttccatg

SEQ ID NO: 161439 - DNA, 31 bp, Artificial Sequence
  Description of Artificial Sequence: Synthetic oligonucleotide
ggaacctacagatgcttcggctctttccatg

SEQ ID NO: 161440 - DNA, 32 bp, Artificial Sequence
  Description of Artificial Sequence: Synthetic oligonucleotide
gaacctacagatgcttcggctctttccatgac

SEQ ID NO: 161441 - DNA, 33 bp, Artificial Sequence
  Description of Artificial Sequence: Synthetic oligonucleotide
aacctacagatgcttcggctctttccatgactc

SEQ ID NO: 161442 - DNA, 30 bp, Artificial Sequence
  Description of Artificial Sequence: Synthetic oligonucleotide
agatgcttcggctctttccatgactctccc

SEQ ID NO: 161443 - DNA, 29 bp, Artificial Sequence
  Description of Artificial Sequence: Synthetic oligonucleotide
gatgcttcggctctttccatgactctccc

SEQ ID NO: 161444 - DNA, 31 bp, Artificial Sequence
  Description of Artificial Sequence: Synthetic oligonucleotide
atgcttcggctctttccatgactctccctac

SEQ ID NO: 161445 - DNA, 30 bp, Artificial Sequence
  Description of Artificial Sequence: Synthetic oligonucleotide
tgcttcggctctttccatgactctccctac

SEQ ID NO: 161446 - DNA, 29 bp, Artificial Sequence
  Description of Artificial Sequence: Synthetic oligonucleotide
gcttcggctctttccatgactctccctac

SEQ ID NO: 161447 - DNA, 29 bp, Artificial Sequence
  Description of Artificial Sequence: Synthetic oligonucleotide
cttcggctctttccatgactctccctacg

SEQ ID NO: 161448 - DNA, 30 bp, Artificial Sequence
  Description of Artificial Sequence: Synthetic oligonucleotide
ttcggctctttccatgactctccctacgag

SEQ ID NO: 161449 - DNA, 29 bp, Artificial Sequence
  Description of Artificial Sequence: Synthetic oligonucleotide
tcggctctttccatgactctccctacgag

SEQ ID NO: 161450 - DNA, 28 bp, Artificial Sequence
  Description of Artificial Sequence: Synthetic oligonucleotide
cggctctttccatgactctccctacgag

SEQ ID NO: 161451 - DNA, 29 bp, Artificial Sequence
  Description of Artificial Sequence: Synthetic oligonucleotide
ggctctttccatgactctccctacgagtg

SEQ ID NO: 161452 - DNA, 29 bp, Artificial Sequence
  Description of Artificial Sequence: Synthetic oligonucleotide
gctctttccatgactctccctacgagtgg

SEQ ID NO: 161453 - DNA, 30 bp, Artificial Sequence
  Description of Artificial Sequence: Synthetic oligonucleotide
ctctttccatgactctccctacgagtggtc

SEQ ID NO: 161454 - DNA, 33 bp, Artificial Sequence
  Description of Artificial Sequence: Synthetic oligonucleotide
tctttccatgactctccctacgagtggtcaaag

SEQ ID NO: 161455 - DNA, 32 bp, Artificial Sequence
  Description of Artificial Sequence: Synthetic oligonucleotide
ctttccatgactctccctacgagtggtcaaag

SEQ ID NO: 161456 - DNA, 33 bp, Artificial Sequence
  Description of Artificial Sequence: Synthetic oligonucleotide
tttccatgactctccctacgagtggtcaaagtc

SEQ ID NO: 161457 - DNA, 32 bp, Artificial Sequence
  Description of Artificial Sequence: Synthetic oligonucleotide
ttccatgactctccctacgagtggtcaaagtc

SEQ ID NO: 161458 - DNA, 31 bp, Artificial Sequence
  Description of Artificial Sequence: Synthetic oligonucleotide
tccatgactctccctacgagtggtcaaagtc

SEQ ID NO: 161459 - DNA, 30 bp, Artificial Sequence
  Description of Artificial Sequence: Synthetic oligonucleotide
ccatgactctccctacgagtggtcaaagtc

SEQ ID NO: 161460 - DNA, 32 bp, Artificial Sequence
  Description of Artificial Sequence: Synthetic oligonucleotide
catgactctccctacgagtggtcaaagtcaag

SEQ ID NO: 161461 - DNA, 33 bp, Artificial Sequence
  Description of Artificial Sequence: Synthetic oligonucleotide
atgactctccctacgagtggtcaaagtcaagtg

SEQ ID NO: 161462 - DNA, 32 bp, Artificial Sequence
  Description of Artificial Sequence: Synthetic oligonucleotide
tgactctccctacgagtggtcaaagtcaagtg

SEQ ID NO: 161463 - DNA, 31 bp, Artificial Sequence
  Description of Artificial Sequence: Synthetic oligonucleotide
gactctccctacgagtggtcaaagtcaagtg

SEQ ID NO: 161464 - DNA, 32 bp, Artificial Sequence
  Description of Artificial Sequence: Synthetic oligonucleotide
actctccctacgagtggtcaaagtcaagtgac

SEQ ID NO: 161465 - DNA, 31 bp, Artificial Sequence
  Description of Artificial Sequence: Synthetic oligonucleotide
ctctccctacgagtggtcaaagtcaagtgac

SEQ ID NO: 161466 - DNA, 31 bp, Artificial Sequence
  Description of Artificial Sequence: Synthetic oligonucleotide
tctccctacgagtggtcaaagtcaagtgacc

SEQ ID NO: 161467 - DNA, 30 bp, Artificial Sequence
  Description of Artificial Sequence: Synthetic oligonucleotide
ctccctacgagtggtcaaagtcaagtgacc

SEQ ID NO: 161468 - DNA, 30 bp, Artificial Sequence
  Description of Artificial Sequence: Synthetic oligonucleotide
tccctacgagtggtcaaagtcaagtgaccc

SEQ ID NO: 161469 - DNA, 29 bp, Artificial Sequence
  Description of Artificial Sequence: Synthetic oligonucleotide
ccctacgagtggtcaaagtcaagtgaccc

SEQ ID NO: 161470 - DNA, 30 bp, Artificial Sequence
  Description of Artificial Sequence: Synthetic oligonucleotide
cctacgagtggtcaaagtcaagtgacccac

SEQ ID NO: 161471 - DNA, 31 bp, Artificial Sequence
  Description of Artificial Sequence: Synthetic oligonucleotide
ctacgagtggtcaaagtcaagtgacccactg

SEQ ID NO: 161472 - DNA, 32 bp, Artificial Sequence
  Description of Artificial Sequence: Synthetic oligonucleotide
ggaacagaacagtgaacagggaggattctgac

SEQ ID NO: 161473 - DNA, 32 bp, Artificial Sequence
  Description of Artificial Sequence: Synthetic oligonucleotide
gaacagaacagtgaacagggaggattctgacg

SEQ ID NO: 161474 - DNA, 34 bp, Artificial Sequence
  Description of Artificial Sequence: Synthetic oligonucleotide
aacagaacagtgaacagggaggattctgacgaac

SEQ ID NO: 161475 - DNA, 33 bp, Artificial Sequence
  Description of Artificial Sequence: Synthetic oligonucleotide
acagaacagtgaacagggaggattctgacgaac

SEQ ID NO: 161476 - DNA, 32 bp, Artificial Sequence
  Description of Artificial Sequence: Synthetic oligonucleotide
cagaacagtgaacagggaggattctgacgaac

SEQ ID NO: 161477 - DNA, 33 bp, Artificial Sequence
  Description of Artificial Sequence: Synthetic oligonucleotide
agaacagtgaacagggaggattctgacgaacag

SEQ ID NO: 161478 - DNA, 32 bp, Artificial Sequence
  Description of Artificial Sequence: Synthetic oligonucleotide
gaacagtgaacagggaggattctgacgaacag

SEQ ID NO: 161479 - DNA, 32 bp, Artificial Sequence
  Description of Artificial Sequence: Synthetic oligonucleotide
aacagtgaacagggaggattctgacgaacagg

SEQ ID NO: 161480 - DNA, 31 bp, Artificial Sequence
  Description of Artificial Sequence: Synthetic oligonucleotide
acagtgaacagggaggattctgacgaacagg

SEQ ID NO: 161481 - DNA, 30 bp, Artificial Sequence
  Description of Artificial Sequence: Synthetic oligonucleotide
cagtgaacagggaggattctgacgaacagg

SEQ ID NO: 161482 - DNA, 31 bp, Artificial Sequence
  Description of Artificial Sequence: Synthetic oligonucleotide
agtgaacagggaggattctgacgaacaggac

SEQ ID NO: 161483 - DNA, 30 bp, Artificial Sequence
  Description of Artificial Sequence: Synthetic oligonucleotide
gtgaacagggaggattctgacgaacaggac

SEQ ID NO: 161484 - DNA, 30 bp, Artificial Sequence
  Description of Artificial Sequence: Synthetic oligonucleotide
tgaacagggaggattctgacgaacaggacc

SEQ ID NO: 161485 - DNA, 29 bp, Artificial Sequence
  Description of Artificial Sequence: Synthetic oligonucleotide
gaacagggaggattctgacgaacaggacc

SEQ ID NO: 161486 - DNA, 31 bp, Artificial Sequence
  Description of Artificial Sequence: Synthetic oligonucleotide
aacagggaggattctgacgaacaggaccatc

SEQ ID NO: 161487 - DNA, 30 bp, Artificial Sequence
  Description of Artificial Sequence: Synthetic oligonucleotide
acagggaggattctgacgaacaggaccatc

SEQ ID NO: 161488 - DNA, 29 bp, Artificial Sequence
  Description of Artificial Sequence: Synthetic oligonucleotide
cagggaggattctgacgaacaggaccatc

SEQ ID NO: 161489 - DNA, 30 bp, Artificial Sequence
  Description of Artificial Sequence: Synthetic oligonucleotide
agggaggattctgacgaacaggaccatcag

SEQ ID NO: 161490 - DNA, 29 bp, Artificial Sequence
  Description of Artificial Sequence: Synthetic oligonucleotide
gggaggattctgacgaacaggaccatcag

SEQ ID NO: 161491 - DNA, 29 bp, Artificial Sequence
  Description of Artificial Sequence: Synthetic oligonucleotide
ggaggattctgacgaacaggaccatcagg

SEQ ID NO: 161492 - DNA, 30 bp, Artificial Sequence
  Description of Artificial Sequence: Synthetic oligonucleotide
gaggattctgacgaacaggaccatcaggag

SEQ ID NO: 161493 - DNA, 30 bp, Artificial Sequence
  Description of Artificial Sequence: Synthetic oligonucleotide
aggattctgacgaacaggaccatcaggagg

SEQ ID NO: 161494 - DNA, 29 bp, Artificial Sequence
  Description of Artificial Sequence: Synthetic oligonucleotide
ggattctgacgaacaggaccatcaggagg

SEQ ID NO: 161495 - DNA, 30 bp, Artificial Sequence
  Description of Artificial Sequence: Synthetic oligonucleotide
gattctgacgaacaggaccatcaggaggtg

SEQ ID NO: 161496 - DNA, 31 bp, Artificial Sequence
  Description of Artificial Sequence: Synthetic oligonucleotide
attctgacgaacaggaccatcaggaggtgtc

SEQ ID NO: 161497 - DNA, 30 bp, Artificial Sequence
  Description of Artificial Sequence: Synthetic oligonucleotide
ttctgacgaacaggaccatcaggaggtgtc

SEQ ID NO: 161498 - DNA, 29 bp, Artificial Sequence
  Description of Artificial Sequence: Synthetic oligonucleotide
tctgacgaacaggaccatcaggaggtgtc

SEQ ID NO: 161499 - DNA, 28 bp, Artificial Sequence
  Description of Artificial Sequence: Synthetic oligonucleotide
ctgacgaacaggaccatcaggaggtgtc

SEQ ID NO: 161500 - DNA, 31 bp, Artificial Sequence
  Description of Artificial Sequence: Synthetic oligonucleotide
tgacgaacaggaccatcaggaggtgtcatac

SEQ ID NO: 161501 - DNA, 30 bp, Artificial Sequence
  Description of Artificial Sequence: Synthetic oligonucleotide
gacgaacaggaccatcaggaggtgtcatac

SEQ ID NO: 161502 - DNA, 30 bp, Artificial Sequence
  Description of Artificial Sequence: Synthetic oligonucleotide
acgaacaggaccatcaggaggtgtcatacg

SEQ ID NO: 161503 - DNA, 29 bp, Artificial Sequence
  Description of Artificial Sequence: Synthetic oligonucleotide
cgaacaggaccatcaggaggtgtcatacg

SEQ ID NO: 161504 - DNA, 25 bp, Artificial Sequence
  Description of Artificial Sequence: Synthetic oligonucleotide
accaagggcctgcggggaacagaac

SEQ ID NO: 161505 - DNA, 24 bp, Artificial Sequence
  Description of Artificial Sequence: Synthetic oligonucleotide
ccaagggcctgcggggaacagaac

SEQ ID NO: 161506 - DNA, 24 bp, Artificial Sequence
  Description of Artificial Sequence: Synthetic oligonucleotide
caagggcctgcggggaacagaacg

SEQ ID NO: 161507 - DNA, 25 bp, Artificial Sequence
  Description of Artificial Sequence: Synthetic oligonucleotide
aagggcctgcggggaacagaacggt

SEQ ID NO: 161508 - DNA, 24 bp, Artificial Sequence
  Description of Artificial Sequence: Synthetic oligonucleotide
agggcctgcggggaacagaacggt

SEQ ID NO: 161509 - DNA, 23 bp, Artificial Sequence
  Description of Artificial Sequence: Synthetic oligonucleotide
gggcctgcggggaacagaacggt

SEQ ID NO: 161510 - DNA, 25 bp, Artificial Sequence
  Description of Artificial Sequence: Synthetic oligonucleotide
ggcctgcggggaacagaacggtgaa

SEQ ID NO: 161511 - DNA, 26 bp, Artificial Sequence
  Description of Artificial Sequence: Synthetic oligonucleotide
gcctgcggggaacagaacggtgaaca

SEQ ID NO: 161512 - DNA, 26 bp, Artificial Sequence
  Description of Artificial Sequence: Synthetic oligonucleotide
cctgcggggaacagaacggtgaacag

SEQ ID NO: 161513 - DNA, 26 bp, Artificial Sequence
  Description of Artificial Sequence: Synthetic oligonucleotide
ctgcggggaacagaacggtgaacagg

SEQ ID NO: 161514 - DNA, 27 bp, Artificial Sequence
  Description of Artificial Sequence: Synthetic oligonucleotide
tgcggggaacagaacggtgaacaggga

SEQ ID NO: 161515 - DNA, 26 bp, Artificial Sequence
  Description of Artificial Sequence: Synthetic oligonucleotide
gcggggaacagaacggtgaacaggga

SEQ ID NO: 161516 - DNA, 26 bp, Artificial Sequence
  Description of Artificial Sequence: Synthetic oligonucleotide
cggggaacagaacggtgaacagggag

SEQ ID NO: 161517 - DNA, 27 bp, Artificial Sequence
  Description of Artificial Sequence: Synthetic oligonucleotide
ggggaacagaacggtgaacagggagga

SEQ ID NO: 161518 - DNA, 29 bp, Artificial Sequence
  Description of Artificial Sequence: Synthetic oligonucleotide
gggaacagaacggtgaacagggaggattc

SEQ ID NO: 161519 - DNA, 30 bp, Artificial Sequence
  Description of Artificial Sequence: Synthetic oligonucleotide
ggaacagaacggtgaacagggaggattctg

SEQ ID NO: 161520 - DNA, 32 bp, Artificial Sequence
  Description of Artificial Sequence: Synthetic oligonucleotide
gaacagaacggtgaacagggaggattctgatg

SEQ ID NO: 161521 - DNA, 34 bp, Artificial Sequence
  Description of Artificial Sequence: Synthetic oligonucleotide
aacagaacggtgaacagggaggattctgatgaac

SEQ ID NO: 161522 - DNA, 33 bp, Artificial Sequence
  Description of Artificial Sequence: Synthetic oligonucleotide
acagaacggtgaacagggaggattctgatgaac

SEQ ID NO: 161523 - DNA, 32 bp, Artificial Sequence
  Description of Artificial Sequence: Synthetic oligonucleotide
cagaacggtgaacagggaggattctgatgaac

SEQ ID NO: 161524 - DNA, 33 bp, Artificial Sequence
  Description of Artificial Sequence: Synthetic oligonucleotide
agaacggtgaacagggaggattctgatgaacag

SEQ ID NO: 161525 - DNA, 32 bp, Artificial Sequence
  Description of Artificial Sequence: Synthetic oligonucleotide
gaacggtgaacagggaggattctgatgaacag

SEQ ID NO: 161526 - DNA, 32 bp, Artificial Sequence
  Description of Artificial Sequence: Synthetic oligonucleotide
aacggtgaacagggaggattctgatgaacagg

SEQ ID NO: 161527 - DNA, 31 bp, Artificial Sequence
  Description of Artificial Sequence: Synthetic oligonucleotide
acggtgaacagggaggattctgatgaacagg

SEQ ID NO: 161528 - DNA, 30 bp, Artificial Sequence
  Description of Artificial Sequence: Synthetic oligonucleotide
cggtgaacagggaggattctgatgaacagg

SEQ ID NO: 161529 - DNA, 31 bp, Artificial Sequence
  Description of Artificial Sequence: Synthetic oligonucleotide
ggtgaacagggaggattctgatgaacaggac

SEQ ID NO: 161530 - DNA, 29 bp, Artificial Sequence
  Description of Artificial Sequence: Synthetic oligonucleotide
taggttctctgcagggcccaaggtcaatg

SEQ ID NO: 161531 - DNA, 28 bp, Artificial Sequence
  Description of Artificial Sequence: Synthetic oligonucleotide
aggttctctgcagggcccaaggtcaatg

SEQ ID NO: 161532 - DNA, 27 bp, Artificial Sequence
  Description of Artificial Sequence: Synthetic oligonucleotide
ggttctctgcagggcccaaggtcaatg

SEQ ID NO: 161533 - DNA, 27 bp, Artificial Sequence
  Description of Artificial Sequence: Synthetic oligonucleotide
gttctctgcagggcccaaggtcaatgg

SEQ ID NO: 161534 - DNA, 29 bp, Artificial Sequence
  Description of Artificial Sequence: Synthetic oligonucleotide
ttctctgcagggcccaaggtcaatggaac

SEQ ID NO: 161535 - DNA, 28 bp, Artificial Sequence
  Description of Artificial Sequence: Synthetic oligonucleotide
tctctgcagggcccaaggtcaatggaac

SEQ ID NO: 161536 - DNA, 27 bp, Artificial Sequence
  Description of Artificial Sequence: Synthetic oligonucleotide
ctctgcagggcccaaggtcaatggaac

SEQ ID NO: 161537 - DNA, 30 bp, Artificial Sequence
  Description of Artificial Sequence: Synthetic oligonucleotide
tctgcagggcccaaggtcaatggaacattc

SEQ ID NO: 161538 - DNA, 29 bp, Artificial Sequence
  Description of Artificial Sequence: Synthetic oligonucleotide
ctgcagggcccaaggtcaatggaacattc

SEQ ID NO: 161539 - DNA, 29 bp, Artificial Sequence
  Description of Artificial Sequence: Synthetic oligonucleotide
tgcagggcccaaggtcaatggaacattcc

SEQ ID NO: 161540 - DNA, 28 bp, Artificial Sequence
  Description of Artificial Sequence: Synthetic oligonucleotide
gcagggcccaaggtcaatggaacattcc

SEQ ID NO: 161541 - DNA, 29 bp, Artificial Sequence
  Description of Artificial Sequence: Synthetic oligonucleotide
cagggcccaaggtcaatggaacattccag

SEQ ID NO: 161542 - DNA, 29 bp, Artificial Sequence
  Description of Artificial Sequence: Synthetic oligonucleotide
agggcccaaggtcaatggaacattccagg

SEQ ID NO: 161543 - DNA, 28 bp, Artificial Sequence
  Description of Artificial Sequence: Synthetic oligonucleotide
gggcccaaggtcaatggaacattccagg

SEQ ID NO: 161544 - DNA, 28 bp, Artificial Sequence
  Description of Artificial Sequence: Synthetic oligonucleotide
ggcccaaggtcaatggaacattccaggc

SEQ ID NO: 161545 - DNA, 28 bp, Artificial Sequence
  Description of Artificial Sequence: Synthetic oligonucleotide
gcccaaggtcaatggaacattccaggcc

SEQ ID NO: 161546 - DNA, 28 bp, Artificial Sequence
  Description of Artificial Sequence: Synthetic oligonucleotide
cccaaggtcaatggaacattccaggccg

SEQ ID NO: 161547 - DNA, 29 bp, Artificial Sequence
  Description of Artificial Sequence: Synthetic oligonucleotide
ccaaggtcaatggaacattccaggccgac

SEQ ID NO: 161548 - DNA, 32 bp, Artificial Sequence
  Description of Artificial Sequence: Synthetic oligonucleotide
caaggtcaatggaacattccaggccgactttc

SEQ ID NO: 161549 - DNA, 32 bp, Artificial Sequence
  Description of Artificial Sequence: Synthetic oligonucleotide
aaggtcaatggaacattccaggccgactttcc

SEQ ID NO: 161550 - DNA, 31 bp, Artificial Sequence
  Description of Artificial Sequence: Synthetic oligonucleotide
aggtcaatggaacattccaggccgactttcc

SEQ ID NO: 161551 - DNA, 30 bp, Artificial Sequence
  Description of Artificial Sequence: Synthetic oligonucleotide
ggtcaatggaacattccaggccgactttcc

SEQ ID NO: 161552 - DNA, 31 bp, Artificial Sequence
  Description of Artificial Sequence: Synthetic oligonucleotide
gtcaatggaacattccaggccgactttcctc

SEQ ID NO: 161553 - DNA, 32 bp, Artificial Sequence
  Description of Artificial Sequence: Synthetic oligonucleotide
tcaatggaacattccaggccgactttcctctg

SEQ ID NO: 161554 - DNA, 31 bp, Artificial Sequence
  Description of Artificial Sequence: Synthetic oligonucleotide
caatggaacattccaggccgactttcctctg

SEQ ID NO: 161555 - DNA, 31 bp, Artificial Sequence
  Description of Artificial Sequence: Synthetic oligonucleotide
aatggaacattccaggccgactttcctctgg

SEQ ID NO: 161556 - DNA, 30 bp, Artificial Sequence
  Description of Artificial Sequence: Synthetic oligonucleotide
atggaacattccaggccgactttcctctgg

SEQ ID NO: 161557 - DNA, 29 bp, Artificial Sequence
  Description of Artificial Sequence: Synthetic oligonucleotide
tggaacattccaggccgactttcctctgg

SEQ ID NO: 161558 - DNA, 30 bp, Artificial Sequence
  Description of Artificial Sequence: Synthetic oligonucleotide
ccacccaaggaggaacctacagatgctttg

SEQ ID NO: 161559 - DNA, 30 bp, Artificial Sequence
  Description of Artificial Sequence: Synthetic oligonucleotide
cacccaaggaggaacctacagatgctttgg

SEQ ID NO: 161560 - DNA, 30 bp, Artificial Sequence
  Description of Artificial Sequence: Synthetic oligonucleotide
acccaaggaggaacctacagatgctttggc

SEQ ID NO: 161561 - DNA, 29 bp, Artificial Sequence
  Description of Artificial Sequence: Synthetic oligonucleotide
cccaaggaggaacctacagatgctttggc

SEQ ID NO: 161562 - DNA, 30 bp, Artificial Sequence
  Description of Artificial Sequence: Synthetic oligonucleotide
ccaaggaggaacctacagatgctttggctc

SEQ ID NO: 161563 - DNA, 33 bp, Artificial Sequence
  Description of Artificial Sequence: Synthetic oligonucleotide
caaggaggaacctacagatgctttggctctttc

SEQ ID NO: 161564 - DNA, 33 bp, Artificial Sequence
  Description of Artificial Sequence: Synthetic oligonucleotide
aaggaggaacctacagatgctttggctctttcc

SEQ ID NO: 161565 - DNA, 32 bp, Artificial Sequence
  Description of Artificial Sequence: Synthetic oligonucleotide
aggaggaacctacagatgctttggctctttcc

SEQ ID NO: 161566 - DNA, 31 bp, Artificial Sequence
  Description of Artificial Sequence: Synthetic oligonucleotide
ggaggaacctacagatgctttggctctttcc

SEQ ID NO: 161567 - DNA, 33 bp, Artificial Sequence
  Description of Artificial Sequence: Synthetic oligonucleotide
gaggaacctacagatgctttggctctttccatg

SEQ ID NO: 161568 - DNA, 34 bp, Artificial Sequence
  Description of Artificial Sequence: Synthetic oligonucleotide
aggaacctacagatgctttggctctttccatgac

SEQ ID NO: 161569 - DNA, 33 bp, Artificial Sequence
  Description of Artificial Sequence: Synthetic oligonucleotide
ggaacctacagatgctttggctctttccatgac

SEQ ID NO: 161570 - DNA, 34 bp, Artificial Sequence
  Description of Artificial Sequence: Synthetic oligonucleotide
gaacctacagatgctttggctctttccatgactc

SEQ ID NO: 161571 - DNA, 35 bp, Artificial Sequence
  Description of Artificial Sequence: Synthetic oligonucleotide
aacctacagatgctttggctctttccatgactctc

SEQ ID NO: 161572 - DNA, 34 bp, Artificial Sequence
  Description of Artificial Sequence: Synthetic oligonucleotide
acctacagatgctttggctctttccatgactctc

SEQ ID NO: 161573 - DNA, 33 bp, Artificial Sequence
  Description of Artificial Sequence: Synthetic oligonucleotide
cctacagatgctttggctctttccatgactctc

SEQ ID NO: 161574 - DNA, 33 bp, Artificial Sequence
  Description of Artificial Sequence: Synthetic oligonucleotide
ctacagatgctttggctctttccatgactctcc

SEQ ID NO: 161575 - DNA, 33 bp, Artificial Sequence
  Description of Artificial Sequence: Synthetic oligonucleotide
tacagatgctttggctctttccatgactctccc

SEQ ID NO: 161576 - DNA, 32 bp, Artificial Sequence
  Description of Artificial Sequence: Synthetic oligonucleotide
acagatgctttggctctttccatgactctccc

SEQ ID NO: 161577 - DNA, 31 bp, Artificial Sequence
  Description of Artificial Sequence: Synthetic oligonucleotide
cagatgctttggctctttccatgactctccc

SEQ ID NO: 161578 - DNA, 33 bp, Artificial Sequence
  Description of Artificial Sequence: Synthetic oligonucleotide
agatgctttggctctttccatgactctccctac

SEQ ID NO: 161579 - DNA, 32 bp, Artificial Sequence
  Description of Artificial Sequence: Synthetic oligonucleotide
gatgctttggctctttccatgactctccctac

SEQ ID NO: 161580 - DNA, 32 bp, Artificial Sequence
  Description of Artificial Sequence: Synthetic oligonucleotide
atgctttggctctttccatgactctccctacg

SEQ ID NO: 161581 - DNA, 31 bp, Artificial Sequence
  Description of Artificial Sequence: Synthetic oligonucleotide
tgctttggctctttccatgactctccctacg

SEQ ID NO: 161582 - DNA, 30 bp, Artificial Sequence
  Description of Artificial Sequence: Synthetic oligonucleotide
gctttggctctttccatgactctccctacg

SEQ ID NO: 161583 - DNA, 31 bp, Artificial Sequence
  Description of Artificial Sequence: Synthetic oligonucleotide
ctttggctctttccatgactctccctacgag

SEQ ID NO: 161584 - DNA, 32 bp, Artificial Sequence
  Description of Artificial Sequence: Synthetic oligonucleotide
tttggctctttccatgactctccctacgagtg

SEQ ID NO: 161585 - DNA, 31 bp, Artificial Sequence
  Description of Artificial Sequence: Synthetic oligonucleotide
ttggctctttccatgactctccctacgagtg

SEQ ID NO: 161586 - DNA, 30 bp, Artificial Sequence
  Description of Artificial Sequence: Synthetic oligonucleotide
tggctctttccatgactctccctacgagtg

SEQ ID NO: 161587 - DNA, 37 bp, Artificial Sequence
  Description of Artificial Sequence: Synthetic oligonucleotide
aaaaaaaatgcatctgtaatggaccaagggcctgcag

SEQ ID NO: 161588 - DNA, 36 bp, Artificial Sequence
  Description of Artificial Sequence: Synthetic oligonucleotide
aaaaaaatgcatctgtaatggaccaagggcctgcag

SEQ ID NO: 161589 - DNA, 35 bp, Artificial Sequence
  Description of Artificial Sequence: Synthetic oligonucleotide
aaaaaatgcatctgtaatggaccaagggcctgcag

SEQ ID NO: 161590 - DNA, 34 bp, Artificial Sequence
  Description of Artificial Sequence: Synthetic oligonucleotide
aaaaatgcatctgtaatggaccaagggcctgcag

SEQ ID NO: 161591 - DNA, 33 bp, Artificial Sequence
  Description of Artificial Sequence: Synthetic oligonucleotide
aaaatgcatctgtaatggaccaagggcctgcag

SEQ ID NO: 161592 - DNA, 32 bp, Artificial Sequence
  Description of Artificial Sequence: Synthetic oligonucleotide
aaatgcatctgtaatggaccaagggcctgcag

SEQ ID NO: 161593 - DNA, 31 bp, Artificial Sequence
  Description of Artificial Sequence: Synthetic oligonucleotide
aatgcatctgtaatggaccaagggcctgcag

SEQ ID NO: 161594 - DNA, 30 bp, Artificial Sequence
  Description of Artificial Sequence: Synthetic oligonucleotide
atgcatctgtaatggaccaagggcctgcag

SEQ ID NO: 161595 - DNA, 29 bp, Artificial Sequence
  Description of Artificial Sequence: Synthetic oligonucleotide
tgcatctgtaatggaccaagggcctgcag

SEQ ID NO: 161596 - DNA, 28 bp, Artificial Sequence
  Description of Artificial Sequence: Synthetic oligonucleotide
gcatctgtaatggaccaagggcctgcag

SEQ ID NO: 161597 - DNA, 28 bp, Artificial Sequence
  Description of Artificial Sequence: Synthetic oligonucleotide
catctgtaatggaccaagggcctgcagg

SEQ ID NO: 161598 - DNA, 28 bp, Artificial Sequence
  Description of Artificial Sequence: Synthetic oligonucleotide
atctgtaatggaccaagggcctgcaggg

SEQ ID NO: 161599 - DNA, 27 bp, Artificial Sequence
  Description of Artificial Sequence: Synthetic oligonucleotide
tctgtaatggaccaagggcctgcaggg

SEQ ID NO: 161600 - DNA, 27 bp, Artificial Sequence
  Description of Artificial Sequence: Synthetic oligonucleotide
ctgtaatggaccaagggcctgcaggga

SEQ ID NO: 161601 - DNA, 28 bp, Artificial Sequence
  Description of Artificial Sequence: Synthetic oligonucleotide
tgtaatggaccaagggcctgcagggaac

SEQ ID NO: 161602 - DNA, 27 bp, Artificial Sequence
  Description of Artificial Sequence: Synthetic oligonucleotide
gtaatggaccaagggcctgcagggaac

SEQ ID NO: 161603 - DNA, 28 bp, Artificial Sequence
  Description of Artificial Sequence: Synthetic oligonucleotide
taatggaccaagggcctgcagggaacag

SEQ ID NO: 161604 - DNA, 27 bp, Artificial Sequence
  Description of Artificial Sequence: Synthetic oligonucleotide
aatggaccaagggcctgcagggaacag

SEQ ID NO: 161605 - DNA, 27 bp, Artificial Sequence
  Description of Artificial Sequence: Synthetic oligonucleotide
atggaccaagggcctgcagggaacaga

SEQ ID NO: 161606 - DNA, 27 bp, Artificial Sequence
  Description of Artificial Sequence: Synthetic oligonucleotide
tggaccaagggcctgcagggaacagaa

SEQ ID NO: 161607 - DNA, 26 bp, Artificial Sequence
  Description of Artificial Sequence: Synthetic oligonucleotide
ggaccaagggcctgcagggaacagaa

SEQ ID NO: 161608 - DNA, 27 bp, Artificial Sequence
  Description of Artificial Sequence: Synthetic oligonucleotide
gaccaagggcctgcagggaacagaaca

SEQ ID NO: 161609 - DNA, 27 bp, Artificial Sequence
  Description of Artificial Sequence: Synthetic oligonucleotide
accaagggcctgcagggaacagaacag

SEQ ID NO: 161610 - DNA, 27 bp, Artificial Sequence
  Description of Artificial Sequence: Synthetic oligonucleotide
ccaagggcctgcagggaacagaacagt

SEQ ID NO: 161611 - DNA, 27 bp, Artificial Sequence
  Description of Artificial Sequence: Synthetic oligonucleotide
caagggcctgcagggaacagaacagtg

SEQ ID NO: 161612 - DNA, 29 bp, Artificial Sequence
  Description of Artificial Sequence: Synthetic oligonucleotide
aagggcctgcagggaacagaacagtgaac

SEQ ID NO: 161613 - DNA, 28 bp, Artificial Sequence
  Description of Artificial Sequence: Synthetic oligonucleotide
agggcctgcagggaacagaacagtgaac

SEQ ID NO: 161614 - DNA, 27 bp, Artificial Sequence
  Description of Artificial Sequence: Synthetic oligonucleotide
gggcctgcagggaacagaacagtgaac

SEQ ID NO: 161615 - DNA, 28 bp, Artificial Sequence
  Description of Artificial Sequence: Synthetic oligonucleotide
ggcctgcagggaacagaacagtgaacag

SEQ ID NO: 161616 - DNA, 31 bp, Artificial Sequence
  Description of Artificial Sequence: Synthetic oligonucleotide
cagggaacagaacagtgaacagggaggattc

SEQ ID NO: 161617 - DNA, 32 bp, Artificial Sequence
  Description of Artificial Sequence: Synthetic oligonucleotide
agggaacagaacagtgaacagggaggattctg

SEQ ID NO: 161618 - DNA, 37 bp, Artificial Sequence
  Description of Artificial Sequence: Synthetic oligonucleotide
tccttcatcgctggtgctccaacaaaaaaaatgcatc

SEQ ID NO: 161619 - DNA, 36 bp, Artificial Sequence
  Description of Artificial Sequence: Synthetic oligonucleotide
ccttcatcgctggtgctccaacaaaaaaaatgcatc

SEQ ID NO: 161620 - DNA, 37 bp, Artificial Sequence
  Description of Artificial Sequence: Synthetic oligonucleotide
cttcatcgctggtgctccaacaaaaaaaatgcatctg

SEQ ID NO: 161621 - DNA, 41 bp, Artificial Sequence
  Description of Artificial Sequence: Synthetic oligonucleotide
ttcatcgctggtgctccaacaaaaaaaatgcatctgtaatg

SEQ ID NO: 161622 - DNA, 40 bp, Artificial Sequence
  Description of Artificial Sequence: Synthetic oligonucleotide
tcatcgctggtgctccaacaaaaaaaatgcatctgtaatg

SEQ ID NO: 161623 - DNA, 39 bp, Artificial Sequence
  Description of Artificial Sequence: Synthetic oligonucleotide
catcgctggtgctccaacaaaaaaaatgcatctgtaatg

SEQ ID NO: 161624 - DNA, 39 bp, Artificial Sequence
  Description of Artificial Sequence: Synthetic oligonucleotide
atcgctggtgctccaacaaaaaaaatgcatctgtaatgg

SEQ ID NO: 161625 - DNA, 38 bp, Artificial Sequence
  Description of Artificial Sequence: Synthetic oligonucleotide
tcgctggtgctccaacaaaaaaaatgcatctgtaatgg

SEQ ID NO: 161626 - DNA, 37 bp, Artificial Sequence
  Description of Artificial Sequence: Synthetic oligonucleotide
cgctggtgctccaacaaaaaaaatgcatctgtaatgg

SEQ ID NO: 161627 - DNA, 38 bp, Artificial Sequence
  Description of Artificial Sequence: Synthetic oligonucleotide
gctggtgctccaacaaaaaaaatgcatctgtaatggac

SEQ ID NO: 161628 - DNA, 38 bp, Artificial Sequence
  Description of Artificial Sequence: Synthetic oligonucleotide
ctggtgctccaacaaaaaaaatgcatctgtaatggacc

SEQ ID NO: 161629 - DNA, 40 bp, Artificial Sequence
  Description of Artificial Sequence: Synthetic oligonucleotide
tggtgctccaacaaaaaaaatgcatctgtaatggaccaag

SEQ ID NO: 161630 - DNA, 39 bp, Artificial Sequence
  Description of Artificial Sequence: Synthetic oligonucleotide
ggtgctccaacaaaaaaaatgcatctgtaatggaccaag

SEQ ID NO: 161631 - DNA, 39 bp, Artificial Sequence
  Description of Artificial Sequence: Synthetic oligonucleotide
gtgctccaacaaaaaaaatgcatctgtaatggaccaagg

SEQ ID NO: 161632 - DNA, 39 bp, Artificial Sequence
  Description of Artificial Sequence: Synthetic oligonucleotide
tgctccaacaaaaaaaatgcatctgtaatggaccaaggg

SEQ ID NO: 161633 - DNA, 38 bp, Artificial Sequence
  Description of Artificial Sequence: Synthetic oligonucleotide
gctccaacaaaaaaaatgcatctgtaatggaccaaggg

SEQ ID NO: 161634 - DNA, 38 bp, Artificial Sequence
  Description of Artificial Sequence: Synthetic oligonucleotide
ctccaacaaaaaaaatgcatctgtaatggaccaagggc

SEQ ID NO: 161635 - DNA, 38 bp, Artificial Sequence
  Description of Artificial Sequence: Synthetic oligonucleotide
tccaacaaaaaaaatgcatctgtaatggaccaagggcc

SEQ ID NO: 161636 - DNA, 37 bp, Artificial Sequence
  Description of Artificial Sequence: Synthetic oligonucleotide
ccaacaaaaaaaatgcatctgtaatggaccaagggcc

SEQ ID NO: 161637 - DNA, 38 bp, Artificial Sequence
  Description of Artificial Sequence: Synthetic oligonucleotide
caacaaaaaaaatgcatctgtaatggaccaagggcctg

SEQ ID NO: 161638 - DNA, 38 bp, Artificial Sequence
  Description of Artificial Sequence: Synthetic oligonucleotide
aacaaaaaaaatgcatctgtaatggaccaagggcctgc

SEQ ID NO: 161639 - DNA, 27 bp, Artificial Sequence
  Description of Artificial Sequence: Synthetic oligonucleotide
gcaggagagagcgtgaccttgtcctga

SEQ ID NO: 161640 - DNA, 28 bp, Artificial Sequence
  Description of Artificial Sequence: Synthetic oligonucleotide
caggagagagcgtgaccttgtcctgaag

SEQ ID NO: 161641 - DNA, 28 bp, Artificial Sequence
  Description of Artificial Sequence: Synthetic oligonucleotide
aggagagagcgtgaccttgtcctgaagc

SEQ ID NO: 161642 - DNA, 27 bp, Artificial Sequence
  Description of Artificial Sequence: Synthetic oligonucleotide
ggagagagcgtgaccttgtcctgaagc

SEQ ID NO: 161643 - DNA, 28 bp, Artificial Sequence
  Description of Artificial Sequence: Synthetic oligonucleotide
gagagagcgtgaccttgtcctgaagctc

SEQ ID NO: 161644 - DNA, 28 bp, Artificial Sequence
  Description of Artificial Sequence: Synthetic oligonucleotide
agagagcgtgaccttgtcctgaagctcc

SEQ ID NO: 161645 - DNA, 27 bp, Artificial Sequence
  Description of Artificial Sequence: Synthetic oligonucleotide
gagagcgtgaccttgtcctgaagctcc

SEQ ID NO: 161646 - DNA, 28 bp, Artificial Sequence
  Description of Artificial Sequence: Synthetic oligonucleotide
agagcgtgaccttgtcctgaagctcctg

SEQ ID NO: 161647 - DNA, 27 bp, Artificial Sequence
  Description of Artificial Sequence: Synthetic oligonucleotide
gagcgtgaccttgtcctgaagctcctg

SEQ ID NO: 161648 - DNA, 27 bp, Artificial Sequence
  Description of Artificial Sequence: Synthetic oligonucleotide
agcgtgaccttgtcctgaagctcctgg

SEQ ID NO: 161649 - DNA, 27 bp, Artificial Sequence
  Description of Artificial Sequence: Synthetic oligonucleotide
gcgtgaccttgtcctgaagctcctgga

SEQ ID NO: 161650 - DNA, 27 bp, Artificial Sequence
  Description of Artificial Sequence: Synthetic oligonucleotide
cgtgaccttgtcctgaagctcctggag

SEQ ID NO: 161651 - DNA, 27 bp, Artificial Sequence
  Description of Artificial Sequence: Synthetic oligonucleotide
gtgaccttgtcctgaagctcctggagc

SEQ ID NO: 161652 - DNA, 28 bp, Artificial Sequence
  Description of Artificial Sequence: Synthetic oligonucleotide
tgaccttgtcctgaagctcctggagctc

SEQ ID NO: 161653 - DNA, 27 bp, Artificial Sequence
  Description of Artificial Sequence: Synthetic oligonucleotide
gaccttgtcctgaagctcctggagctc

SEQ ID NO: 161654 - DNA, 27 bp, Artificial Sequence
  Description of Artificial Sequence: Synthetic oligonucleotide
accttgtcctgaagctcctggagctcc

SEQ ID NO: 161655 - DNA, 27 bp, Artificial Sequence
  Description of Artificial Sequence: Synthetic oligonucleotide
ccttgtcctgaagctcctggagctcct

SEQ ID NO: 161656 - DNA, 29 bp, Artificial Sequence
  Description of Artificial Sequence: Synthetic oligonucleotide
cttgtcctgaagctcctggagctcctatg

SEQ ID NO: 161657 - DNA, 30 bp, Artificial Sequence
  Description of Artificial Sequence: Synthetic oligonucleotide
ttgtcctgaagctcctggagctcctatgac

SEQ ID NO: 161658 - DNA, 29 bp, Artificial Sequence
  Description of Artificial Sequence: Synthetic oligonucleotide
tgtcctgaagctcctggagctcctatgac

SEQ ID NO: 161659 - DNA, 28 bp, Artificial Sequence
  Description of Artificial Sequence: Synthetic oligonucleotide
gtcctgaagctcctggagctcctatgac

SEQ ID NO: 161660 - DNA, 30 bp, Artificial Sequence
  Description of Artificial Sequence: Synthetic oligonucleotide
tcctgaagctcctggagctcctatgacatg

SEQ ID NO: 161661 - DNA, 29 bp, Artificial Sequence
  Description of Artificial Sequence: Synthetic oligonucleotide
cctgaagctcctggagctcctatgacatg

SEQ ID NO: 161662 - DNA, 31 bp, Artificial Sequence
  Description of Artificial Sequence: Synthetic oligonucleotide
ctgaagctcctggagctcctatgacatgtac

SEQ ID NO: 161663 - DNA, 31 bp, Artificial Sequence
  Description of Artificial Sequence: Synthetic oligonucleotide
tgaagctcctggagctcctatgacatgtacc

SEQ ID NO: 161664 - DNA, 30 bp, Artificial Sequence
  Description of Artificial Sequence: Synthetic oligonucleotide
gaagctcctggagctcctatgacatgtacc

SEQ ID NO: 161665 - DNA, 32 bp, Artificial Sequence
  Description of Artificial Sequence: Synthetic oligonucleotide
aagctcctggagctcctatgacatgtaccatc

SEQ ID NO: 161666 - DNA, 31 bp, Artificial Sequence
  Description of Artificial Sequence: Synthetic oligonucleotide
atgtcgctcatggtcatcatcatggcgtgtg

SEQ ID NO: 161667 - DNA, 30 bp, Artificial Sequence
  Description of Artificial Sequence: Synthetic oligonucleotide
tgtcgctcatggtcatcatcatggcgtgtg

SEQ ID NO: 161668 - DNA, 29 bp, Artificial Sequence
  Description of Artificial Sequence: Synthetic oligonucleotide
gtcgctcatggtcatcatcatggcgtgtg

SEQ ID NO: 161669 - DNA, 31 bp, Artificial Sequence
  Description of Artificial Sequence: Synthetic oligonucleotide
tcgctcatggtcatcatcatggcgtgtgttg

SEQ ID NO: 161670 - DNA, 30 bp, Artificial Sequence
  Description of Artificial Sequence: Synthetic oligonucleotide
cgctcatggtcatcatcatggcgtgtgttg

SEQ ID NO: 161671 - DNA, 30 bp, Artificial Sequence
  Description of Artificial Sequence: Synthetic oligonucleotide
gctcatggtcatcatcatggcgtgtgttgg

SEQ ID NO: 161672 - DNA, 30 bp, Artificial Sequence
  Description of Artificial Sequence: Synthetic oligonucleotide
ctcatggtcatcatcatggcgtgtgttggg

SEQ ID NO: 161673 - DNA, 32 bp, Artificial Sequence
  Description of Artificial Sequence: Synthetic oligonucleotide
tcatggtcatcatcatggcgtgtgttgggttc

SEQ ID NO: 161674 - DNA, 31 bp, Artificial Sequence
  Description of Artificial Sequence: Synthetic oligonucleotide
catggtcatcatcatggcgtgtgttgggttc

SEQ ID NO: 161675 - DNA, 33 bp, Artificial Sequence
  Description of Artificial Sequence: Synthetic oligonucleotide
atggtcatcatcatggcgtgtgttgggttcttc

SEQ ID NO: 161676 - DNA, 32 bp, Artificial Sequence
  Description of Artificial Sequence: Synthetic oligonucleotide
tggtcatcatcatggcgtgtgttgggttcttc

SEQ ID NO: 161677 - DNA, 31 bp, Artificial Sequence
  Description of Artificial Sequence: Synthetic oligonucleotide
ggtcatcatcatggcgtgtgttgggttcttc

SEQ ID NO: 161678 - DNA, 33 bp, Artificial Sequence
  Description of Artificial Sequence: Synthetic oligonucleotide
gtcatcatcatggcgtgtgttgggttcttcttg

SEQ ID NO: 161679 - DNA, 33 bp, Artificial Sequence
  Description of Artificial Sequence: Synthetic oligonucleotide
tcatcatcatggcgtgtgttgggttcttcttgc

SEQ ID NO: 161680 - DNA, 32 bp, Artificial Sequence
  Description of Artificial Sequence: Synthetic oligonucleotide
catcatcatggcgtgtgttgggttcttcttgc

SEQ ID NO: 161681 - DNA, 33 bp, Artificial Sequence
  Description of Artificial Sequence: Synthetic oligonucleotide
atcatcatggcgtgtgttgggttcttcttgctg

SEQ ID NO: 161682 - DNA, 32 bp, Artificial Sequence
  Description of Artificial Sequence: Synthetic oligonucleotide
tcatcatggcgtgtgttgggttcttcttgctg

SEQ ID NO: 161683 - DNA, 31 bp, Artificial Sequence
  Description of Artificial Sequence: Synthetic oligonucleotide
catcatggcgtgtgttgggttcttcttgctg

SEQ ID NO: 161684 - DNA, 31 bp, Artificial Sequence
  Description of Artificial Sequence: Synthetic oligonucleotide
atcatggcgtgtgttgggttcttcttgctgc

SEQ ID NO: 161685 - DNA, 30 bp, Artificial Sequence
  Description of Artificial Sequence: Synthetic oligonucleotide
tcatggcgtgtgttgggttcttcttgctgc

SEQ ID NO: 161686 - DNA, 23 bp, Artificial Sequence
  Description of Artificial Sequence: Synthetic oligonucleotide
ttgctgcagggggcctggccaca

SEQ ID NO: 161687 - DNA, 22 bp, Artificial Sequence
  Description of Artificial Sequence: Synthetic oligonucleotide
tgctgcagggggcctggccaca

SEQ ID NO: 161688 - DNA, 21 bp, Artificial Sequence
  Description of Artificial Sequence: Synthetic oligonucleotide
gctgcagggggcctggccaca

SEQ ID NO: 161689 - DNA, 21 bp, Artificial Sequence
  Description of Artificial Sequence: Synthetic oligonucleotide
ctgcagggggcctggccacag

SEQ ID NO: 161690 - DNA, 22 bp, Artificial Sequence
  Description of Artificial Sequence: Synthetic oligonucleotide
tgcagggggcctggccacagga

SEQ ID NO: 161691 - DNA, 21 bp, Artificial Sequence
  Description of Artificial Sequence: Synthetic oligonucleotide
gcagggggcctggccacagga

SEQ ID NO: 161692 - DNA, 21 bp, Artificial Sequence
  Description of Artificial Sequence: Synthetic oligonucleotide
cagggggcctggccacaggag

SEQ ID NO: 161693 - DNA, 21 bp, Artificial Sequence
  Description of Artificial Sequence: Synthetic oligonucleotide
agggggcctggccacaggagg

SEQ ID NO: 161694 - DNA, 20 bp, Artificial Sequence
  Description of Artificial Sequence: Synthetic oligonucleotide
gggggcctggccacaggagg

SEQ ID NO: 161695 - DNA, 21 bp, Artificial Sequence
  Description of Artificial Sequence: Synthetic oligonucleotide
ggggcctggccacaggaggga

SEQ ID NO: 161696 - DNA, 22 bp, Artificial Sequence
  Description of Artificial Sequence: Synthetic oligonucleotide
gggcctggccacaggagggagt

SEQ ID NO: 161697 - DNA, 22 bp, Artificial Sequence
  Description of Artificial Sequence: Synthetic oligonucleotide
ggcctggccacaggagggagtc

SEQ ID NO: 161698 - DNA, 23 bp, Artificial Sequence
  Description of Artificial Sequence: Synthetic oligonucleotide
gcctggccacaggagggagtcca

SEQ ID NO: 161699 - DNA, 24 bp, Artificial Sequence
  Description of Artificial Sequence: Synthetic oligonucleotide
cctggccacaggagggagtccaca

SEQ ID NO: 161700 - DNA, 27 bp, Artificial Sequence
  Description of Artificial Sequence: Synthetic oligonucleotide
ctggccacaggagggagtccacagaaa

SEQ ID NO: 161701 - DNA, 28 bp, Artificial Sequence
  Description of Artificial Sequence: Synthetic oligonucleotide
tggccacaggagggagtccacagaaaac

SEQ ID NO: 161702 - DNA, 27 bp, Artificial Sequence
  Description of Artificial Sequence: Synthetic oligonucleotide
ggccacaggagggagtccacagaaaac

SEQ ID NO: 161703 - DNA, 27 bp, Artificial Sequence
  Description of Artificial Sequence: Synthetic oligonucleotide
gccacaggagggagtccacagaaaacc

SEQ ID NO: 161704 - DNA, 29 bp, Artificial Sequence
  Description of Artificial Sequence: Synthetic oligonucleotide
ccacaggagggagtccacagaaaaccttc

SEQ ID NO: 161705 - DNA, 29 bp, Artificial Sequence
  Description of Artificial Sequence: Synthetic oligonucleotide
cacaggagggagtccacagaaaaccttcc

SEQ ID NO: 161706 - DNA, 31 bp, Artificial Sequence
  Description of Artificial Sequence: Synthetic oligonucleotide
acaggagggagtccacagaaaaccttccttc

SEQ ID NO: 161707 - DNA, 30 bp, Artificial Sequence
  Description of Artificial Sequence: Synthetic oligonucleotide
caggagggagtccacagaaaaccttccttc

SEQ ID NO: 161708 - DNA, 30 bp, Artificial Sequence
  Description of Artificial Sequence: Synthetic oligonucleotide
aggagggagtccacagaaaaccttccttcc

SEQ ID NO: 161709 - DNA, 29 bp, Artificial Sequence
  Description of Artificial Sequence: Synthetic oligonucleotide
ggagggagtccacagaaaaccttccttcc

SEQ ID NO: 161710 - DNA, 30 bp, Artificial Sequence
  Description of Artificial Sequence: Synthetic oligonucleotide
gagggagtccacagaaaaccttccttcctg

SEQ ID NO: 161711 - DNA, 30 bp, Artificial Sequence
  Description of Artificial Sequence: Synthetic oligonucleotide
agggagtccacagaaaaccttccttcctgg

SEQ ID NO: 161712 - DNA, 29 bp, Artificial Sequence
  Description of Artificial Sequence: Synthetic oligonucleotide
gggagtccacagaaaaccttccttcctgg

SEQ ID NO: 161713 - DNA, 29 bp, Artificial Sequence
  Description of Artificial Sequence: Synthetic oligonucleotide
ggagtccacagaaaaccttccttcctggc

SEQ ID NO: 161714 - DNA, 29 bp, Artificial Sequence
  Description of Artificial Sequence: Synthetic oligonucleotide
gagtccacagaaaaccttccttcctggcc

SEQ ID NO: 161715 - DNA, 29 bp, Artificial Sequence
  Description of Artificial Sequence: Synthetic oligonucleotide
agtccacagaaaaccttccttcctggccc

SEQ ID NO: 161716 - DNA, 28 bp, Artificial Sequence
  Description of Artificial Sequence: Synthetic oligonucleotide
gtccacagaaaaccttccttcctggccc

SEQ ID NO: 161717 - DNA, 29 bp, Artificial Sequence
  Description of Artificial Sequence: Synthetic oligonucleotide
tccacagaaaaccttccttcctggccctc

SEQ ID NO: 161718 - DNA, 28 bp, Artificial Sequence
  Description of Artificial Sequence: Synthetic oligonucleotide
ccacagaaaaccttccttcctggccctc

SEQ ID NO: 161719 - DNA, 28 bp, Artificial Sequence
  Description of Artificial Sequence: Synthetic oligonucleotide
cacagaaaaccttccttcctggccctcc

SEQ ID NO: 161720 - DNA, 28 bp, Artificial Sequence
  Description of Artificial Sequence: Synthetic oligonucleotide
acagaaaaccttccttcctggccctccc

SEQ ID NO: 161721 - DNA, 27 bp, Artificial Sequence
  Description of Artificial Sequence: Synthetic oligonucleotide
cagaaaaccttccttcctggccctccc

SEQ ID NO: 161722 - DNA, 28 bp, Artificial Sequence
  Description of Artificial Sequence: Synthetic oligonucleotide
agaaaaccttccttcctggccctcccag

SEQ ID NO: 161723 - DNA, 27 bp, Artificial Sequence
  Description of Artificial Sequence: Synthetic oligonucleotide
gaaaaccttccttcctggccctcccag

SEQ ID NO: 161724 - DNA, 27 bp, Artificial Sequence
  Description of Artificial Sequence: Synthetic oligonucleotide
aaaaccttccttcctggccctcccagg

SEQ ID NO: 161725 - DNA, 27 bp, Artificial Sequence
  Description of Artificial Sequence: Synthetic oligonucleotide
aaaccttccttcctggccctcccaggt

SEQ ID NO: 161726 - DNA, 26 bp, Artificial Sequence
  Description of Artificial Sequence: Synthetic oligonucleotide
aaccttccttcctggccctcccaggt

SEQ ID NO: 161727 - DNA, 25 bp, Artificial Sequence
  Description of Artificial Sequence: Synthetic oligonucleotide
accttccttcctggccctcccaggt

SEQ ID NO: 161728 - DNA, 24 bp, Artificial Sequence
  Description of Artificial Sequence: Synthetic oligonucleotide
ccttccttcctggccctcccaggt

SEQ ID NO: 161729 - DNA, 25 bp, Artificial Sequence
  Description of Artificial Sequence: Synthetic oligonucleotide
cttccttcctggccctcccaggtca

SEQ ID NO: 161730 - DNA, 25 bp, Artificial Sequence
  Description of Artificial Sequence: Synthetic oligonucleotide
ttccttcctggccctcccaggtcac

SEQ ID NO: 161731 - DNA, 24 bp, Artificial Sequence
  Description of Artificial Sequence: Synthetic oligonucleotide
tccttcctggccctcccaggtcac

SEQ ID NO: 161732 - DNA, 23 bp, Artificial Sequence
  Description of Artificial Sequence: Synthetic oligonucleotide
ccttcctggccctcccaggtcac

SEQ ID NO: 161733 - DNA, 24 bp, Artificial Sequence
  Description of Artificial Sequence: Synthetic oligonucleotide
cttcctggccctcccaggtcacct

SEQ ID NO: 161734 - DNA, 24 bp, Artificial Sequence
  Description of Artificial Sequence: Synthetic oligonucleotide
ttcctggccctcccaggtcacctg

SEQ ID NO: 161735 - DNA, 23 bp, Artificial Sequence
  Description of Artificial Sequence: Synthetic oligonucleotide
tcctggccctcccaggtcacctg

SEQ ID NO: 161736 - DNA, 22 bp, Artificial Sequence
  Description of Artificial Sequence: Synthetic oligonucleotide
cctggccctcccaggtcacctg

SEQ ID NO: 161737 - DNA, 23 bp, Artificial Sequence
  Description of Artificial Sequence: Synthetic oligonucleotide
ctggccctcccaggtcacctggt

SEQ ID NO: 161738 - DNA, 27 bp, Artificial Sequence
  Description of Artificial Sequence: Synthetic oligonucleotide
tggccctcccaggtcacctggtgaaat

SEQ ID NO: 161739 - DNA, 26 bp, Artificial Sequence
  Description of Artificial Sequence: Synthetic oligonucleotide
ggccctcccaggtcacctggtgaaat

SEQ ID NO: 161740 - DNA, 27 bp, Artificial Sequence
  Description of Artificial Sequence: Synthetic oligonucleotide
gccctcccaggtcacctggtgaaatca

SEQ ID NO: 161741 - DNA, 27 bp, Artificial Sequence
  Description of Artificial Sequence: Synthetic oligonucleotide
ccctcccaggtcacctggtgaaatcag

SEQ ID NO: 161742 - DNA, 29 bp, Artificial Sequence
  Description of Artificial Sequence: Synthetic oligonucleotide
cctcccaggtcacctggtgaaatcagaag

SEQ ID NO: 161743 - DNA, 30 bp, Artificial Sequence
  Description of Artificial Sequence: Synthetic oligonucleotide
ctcccaggtcacctggtgaaatcagaagag

SEQ ID NO: 161744 - DNA, 31 bp, Artificial Sequence
  Description of Artificial Sequence: Synthetic oligonucleotide
tcccaggtcacctggtgaaatcagaagagac

SEQ ID NO: 161745 - DNA, 30 bp, Artificial Sequence
  Description of Artificial Sequence: Synthetic oligonucleotide
cccaggtcacctggtgaaatcagaagagac

SEQ ID NO: 161746 - DNA, 31 bp, Artificial Sequence
  Description of Artificial Sequence: Synthetic oligonucleotide
ccaggtcacctggtgaaatcagaagagacag

SEQ ID NO: 161747 - DNA, 32 bp, Artificial Sequence
  Description of Artificial Sequence: Synthetic oligonucleotide
caggtcacctggtgaaatcagaagagacagtc

SEQ ID NO: 161748 - DNA, 34 bp, Artificial Sequence
  Description of Artificial Sequence: Synthetic oligonucleotide
aggtcacctggtgaaatcagaagagacagtcatc

SEQ ID NO: 161749 - DNA, 33 bp, Artificial Sequence
  Description of Artificial Sequence: Synthetic oligonucleotide
ggtcacctggtgaaatcagaagagacagtcatc

SEQ ID NO: 161750 - DNA, 33 bp, Artificial Sequence
  Description of Artificial Sequence: Synthetic oligonucleotide
gtcacctggtgaaatcagaagagacagtcatcc

SEQ ID NO: 161751 - DNA, 34 bp, Artificial Sequence
  Description of Artificial Sequence: Synthetic oligonucleotide
tcacctggtgaaatcagaagagacagtcatcctg

SEQ ID NO: 161752 - DNA, 33 bp, Artificial Sequence
  Description of Artificial Sequence: Synthetic oligonucleotide
cacctggtgaaatcagaagagacagtcatcctg

SEQ ID NO: 161753 - DNA, 33 bp, Artificial Sequence
  Description of Artificial Sequence: Synthetic oligonucleotide
acctggtgaaatcagaagagacagtcatcctgc

SEQ ID NO: 161754 - DNA, 36 bp, Artificial Sequence
  Description of Artificial Sequence: Synthetic oligonucleotide
aaatcagaagagacagtcatcctgcaatgttggtcg

SEQ ID NO: 161755 - DNA, 35 bp, Artificial Sequence
  Description of Artificial Sequence: Synthetic oligonucleotide
aatcagaagagacagtcatcctgcaatgttggtcg

SEQ ID NO: 161756 - DNA, 34 bp, Artificial Sequence
  Description of Artificial Sequence: Synthetic oligonucleotide
atcagaagagacagtcatcctgcaatgttggtcg

SEQ ID NO: 161757 - DNA, 33 bp, Artificial Sequence
  Description of Artificial Sequence: Synthetic oligonucleotide
tcagaagagacagtcatcctgcaatgttggtcg

SEQ ID NO: 161758 - DNA, 32 bp, Artificial Sequence
  Description of Artificial Sequence: Synthetic oligonucleotide
cagaagagacagtcatcctgcaatgttggtcg

SEQ ID NO: 161759 - DNA, 32 bp, Artificial Sequence
  Description of Artificial Sequence: Synthetic oligonucleotide
agaagagacagtcatcctgcaatgttggtcgg

SEQ ID NO: 161760 - DNA, 31 bp, Artificial Sequence
  Description of Artificial Sequence: Synthetic oligonucleotide
gaagagacagtcatcctgcaatgttggtcgg

SEQ ID NO: 161761 - DNA, 33 bp, Artificial Sequence
  Description of Artificial Sequence: Synthetic oligonucleotide
aagagacagtcatcctgcaatgttggtcggatg

SEQ ID NO: 161762 - DNA, 32 bp, Artificial Sequence
  Description of Artificial Sequence: Synthetic oligonucleotide
agagacagtcatcctgcaatgttggtcggatg

SEQ ID NO: 161763 - DNA, 31 bp, Artificial Sequence
  Description of Artificial Sequence: Synthetic oligonucleotide
gagacagtcatcctgcaatgttggtcggatg

SEQ ID NO: 161764 - DNA, 32 bp, Artificial Sequence
  Description of Artificial Sequence: Synthetic oligonucleotide
agacagtcatcctgcaatgttggtcggatgtc

SEQ ID NO: 161765 - DNA, 31 bp, Artificial Sequence
  Description of Artificial Sequence: Synthetic oligonucleotide
gacagtcatcctgcaatgttggtcggatgtc

SEQ ID NO: 161766 - DNA, 33 bp, Artificial Sequence
  Description of Artificial Sequence: Synthetic oligonucleotide
acagtcatcctgcaatgttggtcggatgtcatg

SEQ ID NO: 161767 - DNA, 32 bp, Artificial Sequence
  Description of Artificial Sequence: Synthetic oligonucleotide
cagtcatcctgcaatgttggtcggatgtcatg

SEQ ID NO: 161768 - DNA, 35 bp, Artificial Sequence
  Description of Artificial Sequence: Synthetic oligonucleotide
agtcatcctgcaatgttggtcggatgtcatgtttg

SEQ ID NO: 161769 - DNA, 34 bp, Artificial Sequence
  Description of Artificial Sequence: Synthetic oligonucleotide
gtcatcctgcaatgttggtcggatgtcatgtttg

SEQ ID NO: 161770 - DNA, 35 bp, Artificial Sequence
  Description of Artificial Sequence: Synthetic oligonucleotide
tcatcctgcaatgttggtcggatgtcatgtttgag

SEQ ID NO: 161771 - DNA, 34 bp, Artificial Sequence
  Description of Artificial Sequence: Synthetic oligonucleotide
catcctgcaatgttggtcggatgtcatgtttgag

SEQ ID NO: 161772 - DNA, 34 bp, Artificial Sequence
  Description of Artificial Sequence: Synthetic oligonucleotide
atcctgcaatgttggtcggatgtcatgtttgagc

SEQ ID NO: 161773 - DNA, 33 bp, Artificial Sequence
  Description of Artificial Sequence: Synthetic oligonucleotide
tcctgcaatgttggtcggatgtcatgtttgagc

SEQ ID NO: 161774 - DNA, 32 bp, Artificial Sequence
  Description of Artificial Sequence: Synthetic oligonucleotide
cctgcaatgttggtcggatgtcatgtttgagc

SEQ ID NO: 161775 - DNA, 33 bp, Artificial Sequence
  Description of Artificial Sequence: Synthetic oligonucleotide
ctgcaatgttggtcggatgtcatgtttgagcac

SEQ ID NO: 161776 - DNA, 35 bp, Artificial Sequence
  Description of Artificial Sequence: Synthetic oligonucleotide
tgcaatgttggtcggatgtcatgtttgagcacttc

SEQ ID NO: 161777 - DNA, 34 bp, Artificial Sequence
  Description of Artificial Sequence: Synthetic oligonucleotide
gcaatgttggtcggatgtcatgtttgagcacttc

SEQ ID NO: 161778 - DNA, 34 bp, Artificial Sequence
  Description of Artificial Sequence: Synthetic oligonucleotide
caatgttggtcggatgtcatgtttgagcacttcc

SEQ ID NO: 161779 - DNA, 36 bp, Artificial Sequence
  Description of Artificial Sequence: Synthetic oligonucleotide
aatgttggtcggatgtcatgtttgagcacttccttc

SEQ ID NO: 161780 - DNA, 35 bp, Artificial Sequence
  Description of Artificial Sequence: Synthetic oligonucleotide
atgttggtcggatgtcatgtttgagcacttccttc

SEQ ID NO: 161781 - DNA, 34 bp, Artificial Sequence
  Description of Artificial Sequence: Synthetic oligonucleotide
tgttggtcggatgtcatgtttgagcacttccttc

SEQ ID NO: 161782 - DNA, 33 bp, Artificial Sequence
  Description of Artificial Sequence: Synthetic oligonucleotide
gttggtcggatgtcatgtttgagcacttccttc

SEQ ID NO: 161783 - DNA, 34 bp, Artificial Sequence
  Description of Artificial Sequence: Synthetic oligonucleotide
ttggtcggatgtcatgtttgagcacttccttctg

SEQ ID NO: 161784 - DNA, 33 bp, Artificial Sequence
  Description of Artificial Sequence: Synthetic oligonucleotide
tggtcggatgtcatgtttgagcacttccttctg

SEQ ID NO: 161785 - DNA, 32 bp, Artificial Sequence
  Description of Artificial Sequence: Synthetic oligonucleotide
ggtcggatgtcatgtttgagcacttccttctg

SEQ ID NO: 161786 - DNA, 32 bp, Artificial Sequence
  Description of Artificial Sequence: Synthetic oligonucleotide
gtcggatgtcatgtttgagcacttccttctgc

SEQ ID NO: 161787 - DNA, 33 bp, Artificial Sequence
  Description of Artificial Sequence: Synthetic oligonucleotide
tcggatgtcatgtttgagcacttccttctgcac

SEQ ID NO: 161788 - DNA, 32 bp, Artificial Sequence
  Description of Artificial Sequence: Synthetic oligonucleotide
cggatgtcatgtttgagcacttccttctgcac

SEQ ID NO: 161789 - DNA, 33 bp, Artificial Sequence
  Description of Artificial Sequence: Synthetic oligonucleotide
ggatgtcatgtttgagcacttccttctgcacag

SEQ ID NO: 161790 - DNA, 33 bp, Artificial Sequence
  Description of Artificial Sequence: Synthetic oligonucleotide
cacttccttctgcacagagaggggaagtttaac

SEQ ID NO: 161791 - DNA, 35 bp, Artificial Sequence
  Description of Artificial Sequence: Synthetic oligonucleotide
acttccttctgcacagagaggggaagtttaacaac

SEQ ID NO: 161792 - DNA, 34 bp, Artificial Sequence
  Description of Artificial Sequence: Synthetic oligonucleotide
cttccttctgcacagagaggggaagtttaacaac

SEQ ID NO: 161793 - DNA, 35 bp, Artificial Sequence
  Description of Artificial Sequence: Synthetic oligonucleotide
ttccttctgcacagagaggggaagtttaacaacac

SEQ ID NO: 161794 - DNA, 34 bp, Artificial Sequence
  Description of Artificial Sequence: Synthetic oligonucleotide
tccttctgcacagagaggggaagtttaacaacac

SEQ ID NO: 161795 - DNA, 33 bp, Artificial Sequence
  Description of Artificial Sequence: Synthetic oligonucleotide
ccttctgcacagagaggggaagtttaacaacac

SEQ ID NO: 161796 - DNA, 36 bp, Artificial Sequence
  Description of Artificial Sequence: Synthetic oligonucleotide
cttctgcacagagaggggaagtttaacaacactttg

SEQ ID NO: 161797 - DNA, 36 bp, Artificial Sequence
  Description of Artificial Sequence: Synthetic oligonucleotide
ttctgcacagagaggggaagtttaacaacactttgc

SEQ ID NO: 161798 - DNA, 35 bp, Artificial Sequence
  Description of Artificial Sequence: Synthetic oligonucleotide
tctgcacagagaggggaagtttaacaacactttgc

SEQ ID NO: 161799 - DNA, 34 bp, Artificial Sequence
  Description of Artificial Sequence: Synthetic oligonucleotide
ctgcacagagaggggaagtttaacaacactttgc

SEQ ID NO: 161800 - DNA, 35 bp, Artificial Sequence
  Description of Artificial Sequence: Synthetic oligonucleotide
tgcacagagaggggaagtttaacaacactttgcac

SEQ ID NO: 161801 - DNA, 34 bp, Artificial Sequence
  Description of Artificial Sequence: Synthetic oligonucleotide
gcacagagaggggaagtttaacaacactttgcac

SEQ ID NO: 161802 - DNA, 34 bp, Artificial Sequence
  Description of Artificial Sequence: Synthetic oligonucleotide
cacagagaggggaagtttaacaacactttgcacc

SEQ ID NO: 161803 - DNA, 35 bp, Artificial Sequence
  Description of Artificial Sequence: Synthetic oligonucleotide
acagagaggggaagtttaacaacactttgcacctc

SEQ ID NO: 161804 - DNA, 34 bp, Artificial Sequence
  Description of Artificial Sequence: Synthetic oligonucleotide
cagagaggggaagtttaacaacactttgcacctc

SEQ ID NO: 161805 - DNA, 37 bp, Artificial Sequence
  Description of Artificial Sequence: Synthetic oligonucleotide
agagaggggaagtttaacaacactttgcacctcattg

SEQ ID NO: 161806 - DNA, 36 bp, Artificial Sequence
  Description of Artificial Sequence: Synthetic oligonucleotide
gagaggggaagtttaacaacactttgcacctcattg

SEQ ID NO: 161807 - DNA, 36 bp, Artificial Sequence
  Description of Artificial Sequence: Synthetic oligonucleotide
agaggggaagtttaacaacactttgcacctcattgg

SEQ ID NO: 161808 - DNA, 35 bp, Artificial Sequence
  Description of Artificial Sequence: Synthetic oligonucleotide
gaggggaagtttaacaacactttgcacctcattgg

SEQ ID NO: 161809 - DNA, 36 bp, Artificial Sequence
  Description of Artificial Sequence: Synthetic oligonucleotide
aggggaagtttaacaacactttgcacctcattggag

SEQ ID NO: 161810 - DNA, 35 bp, Artificial Sequence
  Description of Artificial Sequence: Synthetic oligonucleotide
ggggaagtttaacaacactttgcacctcattggag

SEQ ID NO: 161811 - DNA, 36 bp, Artificial Sequence
  Description of Artificial Sequence: Synthetic oligonucleotide
gggaagtttaacaacactttgcacctcattggagag

SEQ ID NO: 161812 - DNA, 36 bp, Artificial Sequence
  Description of Artificial Sequence: Synthetic oligonucleotide
ggaagtttaacaacactttgcacctcattggagagc

SEQ ID NO: 161813 - DNA, 37 bp, Artificial Sequence
  Description of Artificial Sequence: Synthetic oligonucleotide
gaagtttaacaacactttgcacctcattggagagcac

SEQ ID NO: 161814 - DNA, 37 bp, Artificial Sequence
  Description of Artificial Sequence: Synthetic oligonucleotide
aagtttaacaacactttgcacctcattggagagcacc

SEQ ID NO: 161815 - DNA, 36 bp, Artificial Sequence
  Description of Artificial Sequence: Synthetic oligonucleotide
agtttaacaacactttgcacctcattggagagcacc

SEQ ID NO: 161816 - DNA, 35 bp, Artificial Sequence
  Description of Artificial Sequence: Synthetic oligonucleotide
gtttaacaacactttgcacctcattggagagcacc

SEQ ID NO: 161817 - DNA, 37 bp, Artificial Sequence
  Description of Artificial Sequence: Synthetic oligonucleotide
tttaacaacactttgcacctcattggagagcaccatg

SEQ ID NO: 161818 - DNA, 36 bp, Artificial Sequence
  Description of Artificial Sequence: Synthetic oligonucleotide
ttaacaacactttgcacctcattggagagcaccatg

SEQ ID NO: 161819 - DNA, 35 bp, Artificial Sequence
  Description of Artificial Sequence: Synthetic oligonucleotide
taacaacactttgcacctcattggagagcaccatg

SEQ ID NO: 161820 - DNA, 34 bp, Artificial Sequence
  Description of Artificial Sequence: Synthetic oligonucleotide
aacaacactttgcacctcattggagagcaccatg

SEQ ID NO: 161821 - DNA, 33 bp, Artificial Sequence
  Description of Artificial Sequence: Synthetic oligonucleotide
acaacactttgcacctcattggagagcaccatg

SEQ ID NO: 161822 - DNA, 32 bp, Artificial Sequence
  Description of Artificial Sequence: Synthetic oligonucleotide
caacactttgcacctcattggagagcaccatg

SEQ ID NO: 161823 - DNA, 34 bp, Artificial Sequence
  Description of Artificial Sequence: Synthetic oligonucleotide
aacactttgcacctcattggagagcaccatgatg

SEQ ID NO: 161824 - DNA, 33 bp, Artificial Sequence
  Description of Artificial Sequence: Synthetic oligonucleotide
atgatggggtttccaaggccaacttctccattg

SEQ ID NO: 161825 - DNA, 32 bp, Artificial Sequence
  Description of Artificial Sequence: Synthetic oligonucleotide
tgatggggtttccaaggccaacttctccattg

SEQ ID NO: 161826 - DNA, 31 bp, Artificial Sequence
  Description of Artificial Sequence: Synthetic oligonucleotide
gatggggtttccaaggccaacttctccattg

SEQ ID NO: 161827 - DNA, 31 bp, Artificial Sequence
  Description of Artificial Sequence: Synthetic oligonucleotide
atggggtttccaaggccaacttctccattgg

SEQ ID NO: 161828 - DNA, 30 bp, Artificial Sequence
  Description of Artificial Sequence: Synthetic oligonucleotide
tggggtttccaaggccaacttctccattgg

SEQ ID NO: 161829 - DNA, 29 bp, Artificial Sequence
  Description of Artificial Sequence: Synthetic oligonucleotide
ggggtttccaaggccaacttctccattgg

SEQ ID NO: 161830 - DNA, 30 bp, Artificial Sequence
  Description of Artificial Sequence: Synthetic oligonucleotide
gggtttccaaggccaacttctccattggtc

SEQ ID NO: 161831 - DNA, 30 bp, Artificial Sequence
  Description of Artificial Sequence: Synthetic oligonucleotide
ggtttccaaggccaacttctccattggtcc

SEQ ID NO: 161832 - DNA, 30 bp, Artificial Sequence
  Description of Artificial Sequence: Synthetic oligonucleotide
gtttccaaggccaacttctccattggtccc

SEQ ID NO: 161833 - DNA, 32 bp, Artificial Sequence
  Description of Artificial Sequence: Synthetic oligonucleotide
tttccaaggccaacttctccattggtcccatg

SEQ ID NO: 161834 - DNA, 31 bp, Artificial Sequence
  Description of Artificial Sequence: Synthetic oligonucleotide
ttccaaggccaacttctccattggtcccatg

SEQ ID NO: 161835 - DNA, 29 bp, Artificial Sequence
  Description of Artificial Sequence: Synthetic oligonucleotide
gccaacttctccattggtcccatgatgcc

SEQ ID NO: 161836 - DNA, 30 bp, Artificial Sequence
  Description of Artificial Sequence: Synthetic oligonucleotide
ccaacttctccattggtcccatgatgcctg

SEQ ID NO: 161837 - DNA, 31 bp, Artificial Sequence
  Description of Artificial Sequence: Synthetic oligonucleotide
caacttctccattggtcccatgatgcctgtc

SEQ ID NO: 161838 - DNA, 31 bp, Artificial Sequence
  Description of Artificial Sequence: Synthetic oligonucleotide
aacttctccattggtcccatgatgcctgtcc

SEQ ID NO: 161839 - DNA, 30 bp, Artificial Sequence
  Description of Artificial Sequence: Synthetic oligonucleotide
acttctccattggtcccatgatgcctgtcc

SEQ ID NO: 161840 - DNA, 29 bp, Artificial Sequence
  Description of Artificial Sequence: Synthetic oligonucleotide
cttctccattggtcccatgatgcctgtcc

SEQ ID NO: 161841 - DNA, 31 bp, Artificial Sequence
  Description of Artificial Sequence: Synthetic oligonucleotide
ttctccattggtcccatgatgcctgtccttg

SEQ ID NO: 161842 - DNA, 30 bp, Artificial Sequence
  Description of Artificial Sequence: Synthetic oligonucleotide
tctccattggtcccatgatgcctgtccttg

SEQ ID NO: 161843 - DNA, 29 bp, Artificial Sequence
  Description of Artificial Sequence: Synthetic oligonucleotide
ctccattggtcccatgatgcctgtccttg

SEQ ID NO: 161844 - DNA, 29 bp, Artificial Sequence
  Description of Artificial Sequence: Synthetic oligonucleotide
tccattggtcccatgatgcctgtccttgc

SEQ ID NO: 161845 - DNA, 28 bp, Artificial Sequence
  Description of Artificial Sequence: Synthetic oligonucleotide
ccattggtcccatgatgcctgtccttgc

SEQ ID NO: 161846 - DNA, 29 bp, Artificial Sequence
  Description of Artificial Sequence: Synthetic oligonucleotide
cattggtcccatgatgcctgtccttgcag

SEQ ID NO: 161847 - DNA, 29 bp, Artificial Sequence
  Description of Artificial Sequence: Synthetic oligonucleotide
attggtcccatgatgcctgtccttgcagg

SEQ ID NO: 161848 - DNA, 28 bp, Artificial Sequence
  Description of Artificial Sequence: Synthetic oligonucleotide
ttggtcccatgatgcctgtccttgcagg

SEQ ID NO: 161849 - DNA, 27 bp, Artificial Sequence
  Description of Artificial Sequence: Synthetic oligonucleotide
tggtcccatgatgcctgtccttgcagg

SEQ ID NO: 161850 - DNA, 27 bp, Artificial Sequence
  Description of Artificial Sequence: Synthetic oligonucleotide
ggtcccatgatgcctgtccttgcagga

SEQ ID NO: 161851 - DNA, 28 bp, Artificial Sequence
  Description of Artificial Sequence: Synthetic oligonucleotide
gtcccatgatgcctgtccttgcaggaac

SEQ ID NO: 161852 - DNA, 28 bp, Artificial Sequence
  Description of Artificial Sequence: Synthetic oligonucleotide
tcccatgatgcctgtccttgcaggaacc

SEQ ID NO: 161853 - DNA, 27 bp, Artificial Sequence
  Description of Artificial Sequence: Synthetic oligonucleotide
cccatgatgcctgtccttgcaggaacc

SEQ ID NO: 161854 - DNA, 29 bp, Artificial Sequence
  Description of Artificial Sequence: Synthetic oligonucleotide
ccatgatgcctgtccttgcaggaacctac

SEQ ID NO: 161855 - DNA, 30 bp, Artificial Sequence
  Description of Artificial Sequence: Synthetic oligonucleotide
catgatgcctgtccttgcaggaacctacag

SEQ ID NO: 161856 - DNA, 32 bp, Artificial Sequence
  Description of Artificial Sequence: Synthetic oligonucleotide
atgatgcctgtccttgcaggaacctacagatg

SEQ ID NO: 161857 - DNA, 31 bp, Artificial Sequence
  Description of Artificial Sequence: Synthetic oligonucleotide
tgatgcctgtccttgcaggaacctacagatg

SEQ ID NO: 161858 - DNA, 30 bp, Artificial Sequence
  Description of Artificial Sequence: Synthetic oligonucleotide
gatgcctgtccttgcaggaacctacagatg

SEQ ID NO: 161859 - DNA, 30 bp, Artificial Sequence
  Description of Artificial Sequence: Synthetic oligonucleotide
atgcctgtccttgcaggaacctacagatgc

SEQ ID NO: 161860 - DNA, 29 bp, Artificial Sequence
  Description of Artificial Sequence: Synthetic oligonucleotide
tgcctgtccttgcaggaacctacagatgc

SEQ ID NO: 161861 - DNA, 28 bp, Artificial Sequence
  Description of Artificial Sequence: Synthetic oligonucleotide
gcctgtccttgcaggaacctacagatgc

SEQ ID NO: 161862 - DNA, 30 bp, Artificial Sequence
  Description of Artificial Sequence: Synthetic oligonucleotide
cctgtccttgcaggaacctacagatgctac

SEQ ID NO: 161863 - DNA, 30 bp, Artificial Sequence
  Description of Artificial Sequence: Synthetic oligonucleotide
ctgtccttgcaggaacctacagatgctacg

SEQ ID NO: 161864 - DNA, 30 bp, Artificial Sequence
  Description of Artificial Sequence: Synthetic oligonucleotide
tgtccttgcaggaacctacagatgctacgg

SEQ ID NO: 161865 - DNA, 29 bp, Artificial Sequence
  Description of Artificial Sequence: Synthetic oligonucleotide
gtccttgcaggaacctacagatgctacgg

SEQ ID NO: 161866 - DNA, 31 bp, Artificial Sequence
  Description of Artificial Sequence: Synthetic oligonucleotide
tccttgcaggaacctacagatgctacggttc

SEQ ID NO: 161867 - DNA, 33 bp, Artificial Sequence
  Description of Artificial Sequence: Synthetic oligonucleotide
ttgcaggaacctacagatgctacggttctgttc

SEQ ID NO: 161868 - DNA, 32 bp, Artificial Sequence
  Description of Artificial Sequence: Synthetic oligonucleotide
tgcaggaacctacagatgctacggttctgttc

SEQ ID NO: 161869 - DNA, 31 bp, Artificial Sequence
  Description of Artificial Sequence: Synthetic oligonucleotide
gcaggaacctacagatgctacggttctgttc

SEQ ID NO: 161870 - DNA, 31 bp, Artificial Sequence
  Description of Artificial Sequence: Synthetic oligonucleotide
caggaacctacagatgctacggttctgttcc

SEQ ID NO: 161871 - DNA, 32 bp, Artificial Sequence
  Description of Artificial Sequence: Synthetic oligonucleotide
aggaacctacagatgctacggttctgttcctc

SEQ ID NO: 161872 - DNA, 31 bp, Artificial Sequence
  Description of Artificial Sequence: Synthetic oligonucleotide
ggaacctacagatgctacggttctgttcctc

SEQ ID NO: 161873 - DNA, 32 bp, Artificial Sequence
  Description of Artificial Sequence: Synthetic oligonucleotide
gaacctacagatgctacggttctgttcctcac

SEQ ID NO: 161874 - DNA, 33 bp, Artificial Sequence
  Description of Artificial Sequence: Synthetic oligonucleotide
aacctacagatgctacggttctgttcctcactc

SEQ ID NO: 161875 - DNA, 30 bp, Artificial Sequence
  Description of Artificial Sequence: Synthetic oligonucleotide
ggttctgttcctcactccccctatcagttg

SEQ ID NO: 161876 - DNA, 31 bp, Artificial Sequence
  Description of Artificial Sequence: Synthetic oligonucleotide
gttctgttcctcactccccctatcagttgtc

SEQ ID NO: 161877 - DNA, 32 bp, Artificial Sequence
  Description of Artificial Sequence: Synthetic oligonucleotide
ttctgttcctcactccccctatcagttgtcag

SEQ ID NO: 161878 - DNA, 31 bp, Artificial Sequence
  Description of Artificial Sequence: Synthetic oligonucleotide
tctgttcctcactccccctatcagttgtcag

SEQ ID NO: 161879 - DNA, 30 bp, Artificial Sequence
  Description of Artificial Sequence: Synthetic oligonucleotide
ctgttcctcactccccctatcagttgtcag

SEQ ID NO: 161880 - DNA, 30 bp, Artificial Sequence
  Description of Artificial Sequence: Synthetic oligonucleotide
tgttcctcactccccctatcagttgtcagc

SEQ ID NO: 161881 - DNA, 29 bp, Artificial Sequence
  Description of Artificial Sequence: Synthetic oligonucleotide
gttcctcactccccctatcagttgtcagc

SEQ ID NO: 161882 - DNA, 30 bp, Artificial Sequence
  Description of Artificial Sequence: Synthetic oligonucleotide
ttcctcactccccctatcagttgtcagctc

SEQ ID NO: 161883 - DNA, 29 bp, Artificial Sequence
  Description of Artificial Sequence: Synthetic oligonucleotide
tcctcactccccctatcagttgtcagctc

SEQ ID NO: 161884 - DNA, 28 bp, Artificial Sequence
  Description of Artificial Sequence: Synthetic oligonucleotide
cctcactccccctatcagttgtcagctc

SEQ ID NO: 161885 - DNA, 27 bp, Artificial Sequence
  Description of Artificial Sequence: Synthetic oligonucleotide
tcagctcccagtgaccctctggacatg

SEQ ID NO: 161886 - DNA, 26 bp, Artificial Sequence
  Description of Artificial Sequence: Synthetic oligonucleotide
cagctcccagtgaccctctggacatg

SEQ ID NO: 161887 - DNA, 27 bp, Artificial Sequence
  Description of Artificial Sequence: Synthetic oligonucleotide
agctcccagtgaccctctggacatggt

SEQ ID NO: 161888 - DNA, 26 bp, Artificial Sequence
  Description of Artificial Sequence: Synthetic oligonucleotide
gctcccagtgaccctctggacatggt

SEQ ID NO: 161889 - DNA, 27 bp, Artificial Sequence
  Description of Artificial Sequence: Synthetic oligonucleotide
ctcccagtgaccctctggacatggtga

SEQ ID NO: 161890 - DNA, 28 bp, Artificial Sequence
  Description of Artificial Sequence: Synthetic oligonucleotide
tcccagtgaccctctggacatggtgatc

SEQ ID NO: 161891 - DNA, 27 bp, Artificial Sequence
  Description of Artificial Sequence: Synthetic oligonucleotide
cccagtgaccctctggacatggtgatc

SEQ ID NO: 161892 - DNA, 30 bp, Artificial Sequence
  Description of Artificial Sequence: Synthetic oligonucleotide
ccagtgaccctctggacatggtgatcatag

SEQ ID NO: 161893 - DNA, 30 bp, Artificial Sequence
  Description of Artificial Sequence: Synthetic oligonucleotide
cagtgaccctctggacatggtgatcatagg

SEQ ID NO: 161894 - DNA, 31 bp, Artificial Sequence
  Description of Artificial Sequence: Synthetic oligonucleotide
agtgaccctctggacatggtgatcataggtc

SEQ ID NO: 161895 - DNA, 30 bp, Artificial Sequence
  Description of Artificial Sequence: Synthetic oligonucleotide
gtgaccctctggacatggtgatcataggtc

SEQ ID NO: 161896 - DNA, 35 bp, Artificial Sequence
  Description of Artificial Sequence: Synthetic oligonucleotide
tgaccctctggacatggtgatcataggtctatatg

SEQ ID NO: 161897 - DNA, 34 bp, Artificial Sequence
  Description of Artificial Sequence: Synthetic oligonucleotide
gaccctctggacatggtgatcataggtctatatg

SEQ ID NO: 161898 - DNA, 35 bp, Artificial Sequence
  Description of Artificial Sequence: Synthetic oligonucleotide
accctctggacatggtgatcataggtctatatgag

SEQ ID NO: 161899 - DNA, 34 bp, Artificial Sequence
  Description of Artificial Sequence: Synthetic oligonucleotide
ccctctggacatggtgatcataggtctatatgag

SEQ ID NO: 161900 - DNA, 37 bp, Artificial Sequence
  Description of Artificial Sequence: Synthetic oligonucleotide
cctctggacatggtgatcataggtctatatgagaaac

SEQ ID NO: 161901 - DNA, 37 bp, Artificial Sequence
  Description of Artificial Sequence: Synthetic oligonucleotide
ctctggacatggtgatcataggtctatatgagaaacc

SEQ ID NO: 161902 - DNA, 39 bp, Artificial Sequence
  Description of Artificial Sequence: Synthetic oligonucleotide
tctggacatggtgatcataggtctatatgagaaaccttc

SEQ ID NO: 161903 - DNA, 38 bp, Artificial Sequence
  Description of Artificial Sequence: Synthetic oligonucleotide
ctggacatggtgatcataggtctatatgagaaaccttc

SEQ ID NO: 161904 - DNA, 39 bp, Artificial Sequence
  Description of Artificial Sequence: Synthetic oligonucleotide
tggacatggtgatcataggtctatatgagaaaccttctc

SEQ ID NO: 161905 - DNA, 38 bp, Artificial Sequence
  Description of Artificial Sequence: Synthetic oligonucleotide
ggacatggtgatcataggtctatatgagaaaccttctc

SEQ ID NO: 161906 - DNA, 39 bp, Artificial Sequence
  Description of Artificial Sequence: Synthetic oligonucleotide
gacatggtgatcataggtctatatgagaaaccttctctc

SEQ ID NO: 161907 - DNA, 40 bp, Artificial Sequence
  Description of Artificial Sequence: Synthetic oligonucleotide
acatggtgatcataggtctatatgagaaaccttctctctc

SEQ ID NO: 161908 - DNA, 39 bp, Artificial Sequence
  Description of Artificial Sequence: Synthetic oligonucleotide
catggtgatcataggtctatatgagaaaccttctctctc

SEQ ID NO: 161909 - DNA, 40 bp, Artificial Sequence
  Description of Artificial Sequence: Synthetic oligonucleotide
atggtgatcataggtctatatgagaaaccttctctctcag

SEQ ID NO: 161910 - DNA, 39 bp, Artificial Sequence
  Description of Artificial Sequence: Synthetic oligonucleotide
tggtgatcataggtctatatgagaaaccttctctctcag

SEQ ID NO: 161911 - DNA, 38 bp, Artificial Sequence
  Description of Artificial Sequence: Synthetic oligonucleotide
ggtgatcataggtctatatgagaaaccttctctctcag

SEQ ID NO: 161912 - DNA, 21 bp, Artificial Sequence
  Description of Artificial Sequence: Synthetic oligonucleotide
ccagccgggccccacggttca

SEQ ID NO: 161913 - DNA, 21 bp, Artificial Sequence
  Description of Artificial Sequence: Synthetic oligonucleotide
cagccgggccccacggttcag

SEQ ID NO: 161914 - DNA, 21 bp, Artificial Sequence
  Description of Artificial Sequence: Synthetic oligonucleotide
agccgggccccacggttcagg

SEQ ID NO: 161915 - DNA, 20 bp, Artificial Sequence
  Description of Artificial Sequence: Synthetic oligonucleotide
gccgggccccacggttcagg

SEQ ID NO: 161916 - DNA, 21 bp, Artificial Sequence
  Description of Artificial Sequence: Synthetic oligonucleotide
ccgggccccacggttcaggca

SEQ ID NO: 161917 - DNA, 21 bp, Artificial Sequence
  Description of Artificial Sequence: Synthetic oligonucleotide
cgggccccacggttcaggcag

SEQ ID NO: 161918 - DNA, 22 bp, Artificial Sequence
  Description of Artificial Sequence: Synthetic oligonucleotide
gggccccacggttcaggcagga

SEQ ID NO: 161919 - DNA, 23 bp, Artificial Sequence
  Description of Artificial Sequence: Synthetic oligonucleotide
ggccccacggttcaggcaggaga

SEQ ID NO: 161920 - DNA, 26 bp, Artificial Sequence
  Description of Artificial Sequence: Synthetic oligonucleotide
gccccacggttcaggcaggagagaat

SEQ ID NO: 161921 - DNA, 27 bp, Artificial Sequence
  Description of Artificial Sequence: Synthetic oligonucleotide
ccccacggttcaggcaggagagaatgt

SEQ ID NO: 161922 - DNA, 27 bp, Artificial Sequence
  Description of Artificial Sequence: Synthetic oligonucleotide
cccacggttcaggcaggagagaatgtg

SEQ ID NO: 161923 - DNA, 28 bp, Artificial Sequence
  Description of Artificial Sequence: Synthetic oligonucleotide
ccacggttcaggcaggagagaatgtgac

SEQ ID NO: 161924 - DNA, 28 bp, Artificial Sequence
  Description of Artificial Sequence: Synthetic oligonucleotide
cacggttcaggcaggagagaatgtgacc

SEQ ID NO: 161925 - DNA, 30 bp, Artificial Sequence
  Description of Artificial Sequence: Synthetic oligonucleotide
acggttcaggcaggagagaatgtgaccttg

SEQ ID NO: 161926 - DNA, 29 bp, Artificial Sequence
  Description of Artificial Sequence: Synthetic oligonucleotide
cggttcaggcaggagagaatgtgaccttg

SEQ ID NO: 161927 - DNA, 30 bp, Artificial Sequence
  Description of Artificial Sequence: Synthetic oligonucleotide
ggttcaggcaggagagaatgtgaccttgtc

SEQ ID NO: 161928 - DNA, 30 bp, Artificial Sequence
  Description of Artificial Sequence: Synthetic oligonucleotide
gttcaggcaggagagaatgtgaccttgtcc

SEQ ID NO: 161929 - DNA, 31 bp, Artificial Sequence
  Description of Artificial Sequence: Synthetic oligonucleotide
ttcaggcaggagagaatgtgaccttgtcctg

SEQ ID NO: 161930 - DNA, 30 bp, Artificial Sequence
  Description of Artificial Sequence: Synthetic oligonucleotide
tcaggcaggagagaatgtgaccttgtcctg

SEQ ID NO: 161931 - DNA, 29 bp, Artificial Sequence
  Description of Artificial Sequence: Synthetic oligonucleotide
caggcaggagagaatgtgaccttgtcctg

SEQ ID NO: 161932 - DNA, 29 bp, Artificial Sequence
  Description of Artificial Sequence: Synthetic oligonucleotide
aggcaggagagaatgtgaccttgtcctgc

SEQ ID NO: 161933 - DNA, 26 bp, Artificial Sequence
  Description of Artificial Sequence: Synthetic oligonucleotide
gcccatgaacgtaggctccctgcagt

SEQ ID NO: 161934 - DNA, 26 bp, Artificial Sequence
  Description of Artificial Sequence: Synthetic oligonucleotide
cccatgaacgtaggctccctgcagtg

SEQ ID NO: 161935 - DNA, 26 bp, Artificial Sequence
  Description of Artificial Sequence: Synthetic oligonucleotide
ccatgaacgtaggctccctgcagtgc

SEQ ID NO: 161936 - DNA, 26 bp, Artificial Sequence
  Description of Artificial Sequence: Synthetic oligonucleotide
catgaacgtaggctccctgcagtgcg

SEQ ID NO: 161937 - DNA, 27 bp, Artificial Sequence
  Description of Artificial Sequence: Synthetic oligonucleotide
atgaacgtaggctccctgcagtgcgca

SEQ ID NO: 161938 - DNA, 26 bp, Artificial Sequence
  Description of Artificial Sequence: Synthetic oligonucleotide
tgaacgtaggctccctgcagtgcgca

SEQ ID NO: 161939 - DNA, 25 bp, Artificial Sequence
  Description of Artificial Sequence: Synthetic oligonucleotide
gaacgtaggctccctgcagtgcgca

SEQ ID NO: 161940 - DNA, 25 bp, Artificial Sequence
  Description of Artificial Sequence: Synthetic oligonucleotide
aacgtaggctccctgcagtgcgcag

SEQ ID NO: 161941 - DNA, 24 bp, Artificial Sequence
  Description of Artificial Sequence: Synthetic oligonucleotide
acgtaggctccctgcagtgcgcag

SEQ ID NO: 161942 - DNA, 23 bp, Artificial Sequence
  Description of Artificial Sequence: Synthetic oligonucleotide
cgtaggctccctgcagtgcgcag

SEQ ID NO: 161943 - DNA, 25 bp, Artificial Sequence
  Description of Artificial Sequence: Synthetic oligonucleotide
gtaggctccctgcagtgcgcagcat

SEQ ID NO: 161944 - DNA, 27 bp, Artificial Sequence
  Description of Artificial Sequence: Synthetic oligonucleotide
taggctccctgcagtgcgcagcatcaa

SEQ ID NO: 161945 - DNA, 26 bp, Artificial Sequence
  Description of Artificial Sequence: Synthetic oligonucleotide
aggctccctgcagtgcgcagcatcaa

SEQ ID NO: 161946 - DNA, 25 bp, Artificial Sequence
  Description of Artificial Sequence: Synthetic oligonucleotide
ggctccctgcagtgcgcagcatcaa

SEQ ID NO: 161947 - DNA, 25 bp, Artificial Sequence
  Description of Artificial Sequence: Synthetic oligonucleotide
gctccctgcagtgcgcagcatcaac

SEQ ID NO: 161948 - DNA, 25 bp, Artificial Sequence
  Description of Artificial Sequence: Synthetic oligonucleotide
ctccctgcagtgcgcagcatcaacg

SEQ ID NO: 161949 - DNA, 27 bp, Artificial Sequence
  Description of Artificial Sequence: Synthetic oligonucleotide
tccctgcagtgcgcagcatcaacggaa

SEQ ID NO: 161950 - DNA, 26 bp, Artificial Sequence
  Description of Artificial Sequence: Synthetic oligonucleotide
ccctgcagtgcgcagcatcaacggaa

SEQ ID NO: 161951 - DNA, 27 bp, Artificial Sequence
  Description of Artificial Sequence: Synthetic oligonucleotide
cctgcagtgcgcagcatcaacggaaca

SEQ ID NO: 161952 - DNA, 29 bp, Artificial Sequence
  Description of Artificial Sequence: Synthetic oligonucleotide
ctgcagtgcgcagcatcaacggaacattc

SEQ ID NO: 161953 - DNA, 29 bp, Artificial Sequence
  Description of Artificial Sequence: Synthetic oligonucleotide
tgcagtgcgcagcatcaacggaacattcc

SEQ ID NO: 161954 - DNA, 28 bp, Artificial Sequence
  Description of Artificial Sequence: Synthetic oligonucleotide
gcagtgcgcagcatcaacggaacattcc

SEQ ID NO: 161955 - DNA, 29 bp, Artificial Sequence
  Description of Artificial Sequence: Synthetic oligonucleotide
cagtgcgcagcatcaacggaacattccag

SEQ ID NO: 161956 - DNA, 29 bp, Artificial Sequence
  Description of Artificial Sequence: Synthetic oligonucleotide
agtgcgcagcatcaacggaacattccagg

SEQ ID NO: 161957 - DNA, 28 bp, Artificial Sequence
  Description of Artificial Sequence: Synthetic oligonucleotide
gtgcgcagcatcaacggaacattccagg

SEQ ID NO: 161958 - DNA, 28 bp, Artificial Sequence
  Description of Artificial Sequence: Synthetic oligonucleotide
tgcgcagcatcaacggaacattccaggc

SEQ ID NO: 161959 - DNA, 27 bp, Artificial Sequence
  Description of Artificial Sequence: Synthetic oligonucleotide
gcgcagcatcaacggaacattccaggc

SEQ ID NO: 161960 - DNA, 27 bp, Artificial Sequence
  Description of Artificial Sequence: Synthetic oligonucleotide
cgcagcatcaacggaacattccaggcc

SEQ ID NO: 161961 - DNA, 27 bp, Artificial Sequence
  Description of Artificial Sequence: Synthetic oligonucleotide
gcagcatcaacggaacattccaggccg

SEQ ID NO: 161962 - DNA, 28 bp, Artificial Sequence
  Description of Artificial Sequence: Synthetic oligonucleotide
cagcatcaacggaacattccaggccgac

SEQ ID NO: 161963 - DNA, 31 bp, Artificial Sequence
  Description of Artificial Sequence: Synthetic oligonucleotide
agcatcaacggaacattccaggccgactttc

SEQ ID NO: 161964 - DNA, 30 bp, Artificial Sequence
  Description of Artificial Sequence: Synthetic oligonucleotide
gcatcaacggaacattccaggccgactttc

SEQ ID NO: 161965 - DNA, 30 bp, Artificial Sequence
  Description of Artificial Sequence: Synthetic oligonucleotide
catcaacggaacattccaggccgactttcc

SEQ ID NO: 161966 - DNA, 31 bp, Artificial Sequence
  Description of Artificial Sequence: Synthetic oligonucleotide
atcaacggaacattccaggccgactttcctc

SEQ ID NO: 161967 - DNA, 29 bp, Artificial Sequence
  Description of Artificial Sequence: Synthetic oligonucleotide
ctacagatgcttcggctctttccgtgacg

SEQ ID NO: 161968 - DNA, 29 bp, Artificial Sequence
  Description of Artificial Sequence: Synthetic oligonucleotide
tacagatgcttcggctctttccgtgacgc

SEQ ID NO: 161969 - DNA, 28 bp, Artificial Sequence
  Description of Artificial Sequence: Synthetic oligonucleotide
acagatgcttcggctctttccgtgacgc

SEQ ID NO: 161970 - DNA, 27 bp, Artificial Sequence
  Description of Artificial Sequence: Synthetic oligonucleotide
cagatgcttcggctctttccgtgacgc

SEQ ID NO: 161971 - DNA, 28 bp, Artificial Sequence
  Description of Artificial Sequence: Synthetic oligonucleotide
agatgcttcggctctttccgtgacgctc

SEQ ID NO: 161972 - DNA, 27 bp, Artificial Sequence
  Description of Artificial Sequence: Synthetic oligonucleotide
gatgcttcggctctttccgtgacgctc

SEQ ID NO: 161973 - DNA, 27 bp, Artificial Sequence
  Description of Artificial Sequence: Synthetic oligonucleotide
atgcttcggctctttccgtgacgctcc

SEQ ID NO: 161974 - DNA, 26 bp, Artificial Sequence
  Description of Artificial Sequence: Synthetic oligonucleotide
tgcttcggctctttccgtgacgctcc

SEQ ID NO: 161975 - DNA, 25 bp, Artificial Sequence
  Description of Artificial Sequence: Synthetic oligonucleotide
gcttcggctctttccgtgacgctcc

SEQ ID NO: 161976 - DNA, 27 bp, Artificial Sequence
  Description of Artificial Sequence: Synthetic oligonucleotide
cttcggctctttccgtgacgctcccta

SEQ ID NO: 161977 - DNA, 27 bp, Artificial Sequence
  Description of Artificial Sequence: Synthetic oligonucleotide
ttcggctctttccgtgacgctccctac

SEQ ID NO: 161978 - DNA, 26 bp, Artificial Sequence
  Description of Artificial Sequence: Synthetic oligonucleotide
tcggctctttccgtgacgctccctac

SEQ ID NO: 161979 - DNA, 25 bp, Artificial Sequence
  Description of Artificial Sequence: Synthetic oligonucleotide
cggctctttccgtgacgctccctac

SEQ ID NO: 161980 - DNA, 26 bp, Artificial Sequence
  Description of Artificial Sequence: Synthetic oligonucleotide
ggctctttccgtgacgctccctacga

SEQ ID NO: 161981 - DNA, 27 bp, Artificial Sequence
  Description of Artificial Sequence: Synthetic oligonucleotide
gctctttccgtgacgctccctacgagt

SEQ ID NO: 161982 - DNA, 27 bp, Artificial Sequence
  Description of Artificial Sequence: Synthetic oligonucleotide
ctctttccgtgacgctccctacgagtg

SEQ ID NO: 161983 - DNA, 27 bp, Artificial Sequence
  Description of Artificial Sequence: Synthetic oligonucleotide
tctttccgtgacgctccctacgagtgg

SEQ ID NO: 161984 - DNA, 27 bp, Artificial Sequence
  Description of Artificial Sequence: Synthetic oligonucleotide
ctttccgtgacgctccctacgagtggt

SEQ ID NO: 161985 - DNA, 27 bp, Artificial Sequence
  Description of Artificial Sequence: Synthetic oligonucleotide
tttccgtgacgctccctacgagtggtc

SEQ ID NO: 161986 - DNA, 27 bp, Artificial Sequence
  Description of Artificial Sequence: Synthetic oligonucleotide
ttccgtgacgctccctacgagtggtca

SEQ ID NO: 161987 - DNA, 27 bp, Artificial Sequence
  Description of Artificial Sequence: Synthetic oligonucleotide
tccgtgacgctccctacgagtggtcaa

SEQ ID NO: 161988 - DNA, 27 bp, Artificial Sequence
  Description of Artificial Sequence: Synthetic oligonucleotide
ccgtgacgctccctacgagtggtcaaa

SEQ ID NO: 161989 - DNA, 27 bp, Artificial Sequence
  Description of Artificial Sequence: Synthetic oligonucleotide
cgtgacgctccctacgagtggtcaaac

SEQ ID NO: 161990 - DNA, 28 bp, Artificial Sequence
  Description of Artificial Sequence: Synthetic oligonucleotide
gtgacgctccctacgagtggtcaaactc

SEQ ID NO: 161991 - DNA, 28 bp, Artificial Sequence
  Description of Artificial Sequence: Synthetic oligonucleotide
tgacgctccctacgagtggtcaaactcg

SEQ ID NO: 161992 - DNA, 27 bp, Artificial Sequence
  Description of Artificial Sequence: Synthetic oligonucleotide
gacgctccctacgagtggtcaaactcg

SEQ ID NO: 161993 - DNA, 28 bp, Artificial Sequence
  Description of Artificial Sequence: Synthetic oligonucleotide
acgctccctacgagtggtcaaactcgag

SEQ ID NO: 161994 - DNA, 27 bp, Artificial Sequence
  Description of Artificial Sequence: Synthetic oligonucleotide
cgctccctacgagtggtcaaactcgag

SEQ ID NO: 161995 - DNA, 28 bp, Artificial Sequence
  Description of Artificial Sequence: Synthetic oligonucleotide
gctccctacgagtggtcaaactcgagtg

SEQ ID NO: 161996 - DNA, 30 bp, Artificial Sequence
  Description of Artificial Sequence: Synthetic oligonucleotide
ctccctacgagtggtcaaactcgagtgatc

SEQ ID NO: 161997 - DNA, 30 bp, Artificial Sequence
  Description of Artificial Sequence: Synthetic oligonucleotide
tccctacgagtggtcaaactcgagtgatcc

SEQ ID NO: 161998 - DNA, 29 bp, Artificial Sequence
  Description of Artificial Sequence: Synthetic oligonucleotide
ccctacgagtggtcaaactcgagtgatcc

SEQ ID NO: 161999 - DNA, 30 bp, Artificial Sequence
  Description of Artificial Sequence: Synthetic oligonucleotide
cctacgagtggtcaaactcgagtgatccac

SEQ ID NO: 162000 - DNA, 31 bp, Artificial Sequence
  Description of Artificial Sequence: Synthetic oligonucleotide
ctacgagtggtcaaactcgagtgatccactg

SEQ ID NO: 162001 - DNA, 31 bp, Artificial Sequence
  Description of Artificial Sequence: Synthetic oligonucleotide
tacgagtggtcaaactcgagtgatccactgc

SEQ ID NO: 162002 - DNA, 30 bp, Artificial Sequence
  Description of Artificial Sequence: Synthetic oligonucleotide
acgagtggtcaaactcgagtgatccactgc

SEQ ID NO: 162003 - DNA, 29 bp, Artificial Sequence
  Description of Artificial Sequence: Synthetic oligonucleotide
cgagtggtcaaactcgagtgatccactgc

SEQ ID NO: 162004 - DNA, 31 bp, Artificial Sequence
  Description of Artificial Sequence: Synthetic oligonucleotide
gagtggtcaaactcgagtgatccactgcttg

SEQ ID NO: 162005 - DNA, 34 bp, Artificial Sequence
  Description of Artificial Sequence: Synthetic oligonucleotide
agtggtcaaactcgagtgatccactgcttgtttc

SEQ ID NO: 162006 - DNA, 33 bp, Artificial Sequence
  Description of Artificial Sequence: Synthetic oligonucleotide
gtggtcaaactcgagtgatccactgcttgtttc

SEQ ID NO: 162007 - DNA, 33 bp, Artificial Sequence
  Description of Artificial Sequence: Synthetic oligonucleotide
tggtcaaactcgagtgatccactgcttgtttcc

SEQ ID NO: 162008 - DNA, 32 bp, Artificial Sequence
  Description of Artificial Sequence: Synthetic oligonucleotide
ggtcaaactcgagtgatccactgcttgtttcc

SEQ ID NO: 162009 - DNA, 32 bp, Artificial Sequence
  Description of Artificial Sequence: Synthetic oligonucleotide
gtcaaactcgagtgatccactgcttgtttccg

SEQ ID NO: 162010 - DNA, 33 bp, Artificial Sequence
  Description of Artificial Sequence: Synthetic oligonucleotide
tcaaactcgagtgatccactgcttgtttccgtc

SEQ ID NO: 162011 - DNA, 32 bp, Artificial Sequence
  Description of Artificial Sequence: Synthetic oligonucleotide
caaactcgagtgatccactgcttgtttccgtc

SEQ ID NO: 162012 - DNA, 33 bp, Artificial Sequence
  Description of Artificial Sequence: Synthetic oligonucleotide
aaactcgagtgatccactgcttgtttccgtcac

SEQ ID NO: 162013 - DNA, 32 bp, Artificial Sequence
  Description of Artificial Sequence: Synthetic oligonucleotide
aactcgagtgatccactgcttgtttccgtcac

SEQ ID NO: 162014 - DNA, 31 bp, Artificial Sequence
  Description of Artificial Sequence: Synthetic oligonucleotide
actcgagtgatccactgcttgtttccgtcac

SEQ ID NO: 162015 - DNA, 30 bp, Artificial Sequence
  Description of Artificial Sequence: Synthetic oligonucleotide
ctcgagtgatccactgcttgtttccgtcac

SEQ ID NO: 162016 - DNA, 31 bp, Artificial Sequence
  Description of Artificial Sequence: Synthetic oligonucleotide
tcgagtgatccactgcttgtttccgtcacag

SEQ ID NO: 162017 - DNA, 30 bp, Artificial Sequence
  Description of Artificial Sequence: Synthetic oligonucleotide
cgagtgatccactgcttgtttccgtcacag

SEQ ID NO: 162018 - DNA, 30 bp, Artificial Sequence
  Description of Artificial Sequence: Synthetic oligonucleotide
gagtgatccactgcttgtttccgtcacagg

SEQ ID NO: 162019 - DNA, 33 bp, Artificial Sequence
  Description of Artificial Sequence: Synthetic oligonucleotide
agtgatccactgcttgtttccgtcacaggaaac

SEQ ID NO: 162020 - DNA, 32 bp, Artificial Sequence
  Description of Artificial Sequence: Synthetic oligonucleotide
gtgatccactgcttgtttccgtcacaggaaac

SEQ ID NO: 162021 - DNA, 32 bp, Artificial Sequence
  Description of Artificial Sequence: Synthetic oligonucleotide
tgatccactgcttgtttccgtcacaggaaacc

SEQ ID NO: 162022 - DNA, 31 bp, Artificial Sequence
  Description of Artificial Sequence: Synthetic oligonucleotide
gatccactgcttgtttccgtcacaggaaacc

SEQ ID NO: 162023 - DNA, 31 bp, Artificial Sequence
  Description of Artificial Sequence: Synthetic oligonucleotide
atccactgcttgtttccgtcacaggaaaccc

SEQ ID NO: 162024 - DNA, 30 bp, Artificial Sequence
  Description of Artificial Sequence: Synthetic oligonucleotide
tccactgcttgtttccgtcacaggaaaccc

SEQ ID NO: 162025 - DNA, 29 bp, Artificial Sequence
  Description of Artificial Sequence: Synthetic oligonucleotide
ccactgcttgtttccgtcacaggaaaccc

SEQ ID NO: 162026 - DNA, 31 bp, Artificial Sequence
  Description of Artificial Sequence: Synthetic oligonucleotide
cactgcttgtttccgtcacaggaaacccttc

SEQ ID NO: 162027 - DNA, 36 bp, Artificial Sequence
  Description of Artificial Sequence: Synthetic oligonucleotide
actgcttgtttccgtcacaggaaacccttcaaatag

SEQ ID NO: 162028 - DNA, 35 bp, Artificial Sequence
  Description of Artificial Sequence: Synthetic oligonucleotide
ctgcttgtttccgtcacaggaaacccttcaaatag

SEQ ID NO: 162029 - DNA, 37 bp, Artificial Sequence
  Description of Artificial Sequence: Synthetic oligonucleotide
tgcttgtttccgtcacaggaaacccttcaaatagttg

SEQ ID NO: 162030 - DNA, 36 bp, Artificial Sequence
  Description of Artificial Sequence: Synthetic oligonucleotide
gcttgtttccgtcacaggaaacccttcaaatagttg

SEQ ID NO: 162031 - DNA, 36 bp, Artificial Sequence
  Description of Artificial Sequence: Synthetic oligonucleotide
cttgtttccgtcacaggaaacccttcaaatagttgg

SEQ ID NO: 162032 - DNA, 36 bp, Artificial Sequence
  Description of Artificial Sequence: Synthetic oligonucleotide
ttgtttccgtcacaggaaacccttcaaatagttggc

SEQ ID NO: 162033 - DNA, 35 bp, Artificial Sequence
  Description of Artificial Sequence: Synthetic oligonucleotide
tgtttccgtcacaggaaacccttcaaatagttggc

SEQ ID NO: 162034 - DNA, 34 bp, Artificial Sequence
  Description of Artificial Sequence: Synthetic oligonucleotide
gtttccgtcacaggaaacccttcaaatagttggc

SEQ ID NO: 162035 - DNA, 34 bp, Artificial Sequence
  Description of Artificial Sequence: Synthetic oligonucleotide
tttccgtcacaggaaacccttcaaatagttggcc

SEQ ID NO: 162036 - DNA, 33 bp, Artificial Sequence
  Description of Artificial Sequence: Synthetic oligonucleotide
ttccgtcacaggaaacccttcaaatagttggcc

SEQ ID NO: 162037 - DNA, 32 bp, Artificial Sequence
  Description of Artificial Sequence: Synthetic oligonucleotide
tccgtcacaggaaacccttcaaatagttggcc

SEQ ID NO: 162038 - DNA, 31 bp, Artificial Sequence
  Description of Artificial Sequence: Synthetic oligonucleotide
ccgtcacaggaaacccttcaaatagttggcc

SEQ ID NO: 162039 - DNA, 33 bp, Artificial Sequence
  Description of Artificial Sequence: Synthetic oligonucleotide
cgtcacaggaaacccttcaaatagttggccttc

SEQ ID NO: 162040 - DNA, 24 bp, Artificial Sequence
  Description of Artificial Sequence: Synthetic oligonucleotide
gagggggaggcccatgaacgtagg

SEQ ID NO: 162041 - DNA, 25 bp, Artificial Sequence
  Description of Artificial Sequence: Synthetic oligonucleotide
agggggaggcccatgaacgtaggct

SEQ ID NO: 162042 - DNA, 24 bp, Artificial Sequence
  Description of Artificial Sequence: Synthetic oligonucleotide
gggggaggcccatgaacgtaggct

SEQ ID NO: 162043 - DNA, 28 bp, Artificial Sequence
  Description of Artificial Sequence: Synthetic oligonucleotide
cgcagcatcaacggaacattccaggctg

SEQ ID NO: 162044 - DNA, 29 bp, Artificial Sequence
  Description of Artificial Sequence: Synthetic oligonucleotide
gcagcatcaacggaacattccaggctgac

SEQ ID NO: 162045 - DNA, 32 bp, Artificial Sequence
  Description of Artificial Sequence: Synthetic oligonucleotide
cagcatcaacggaacattccaggctgactttc

SEQ ID NO: 162046 - DNA, 32 bp, Artificial Sequence
  Description of Artificial Sequence: Synthetic oligonucleotide
agcatcaacggaacattccaggctgactttcc

SEQ ID NO: 162047 - DNA, 31 bp, Artificial Sequence
  Description of Artificial Sequence: Synthetic oligonucleotide
gcatcaacggaacattccaggctgactttcc

SEQ ID NO: 162048 - DNA, 32 bp, Artificial Sequence
  Description of Artificial Sequence: Synthetic oligonucleotide
catcaacggaacattccaggctgactttcctc

SEQ ID NO: 162049 - DNA, 33 bp, Artificial Sequence
  Description of Artificial Sequence: Synthetic oligonucleotide
atcaacggaacattccaggctgactttcctctg

SEQ ID NO: 162050 - DNA, 35 bp, Artificial Sequence
  Description of Artificial Sequence: Synthetic oligonucleotide
gaggattctgatgaacaagaccatcaggaggtatc

SEQ ID NO: 162051 - DNA, 38 bp, Artificial Sequence
  Description of Artificial Sequence: Synthetic oligonucleotide
aggattctgatgaacaagaccatcaggaggtatcatac

SEQ ID NO: 162052 - DNA, 37 bp, Artificial Sequence
  Description of Artificial Sequence: Synthetic oligonucleotide
ggattctgatgaacaagaccatcaggaggtatcatac

SEQ ID NO: 162053 - DNA, 37 bp, Artificial Sequence
  Description of Artificial Sequence: Synthetic oligonucleotide
gattctgatgaacaagaccatcaggaggtatcatacg

SEQ ID NO: 162054 - DNA, 37 bp, Artificial Sequence
  Description of Artificial Sequence: Synthetic oligonucleotide
attctgatgaacaagaccatcaggaggtatcatacgc

SEQ ID NO: 162055 - DNA, 36 bp, Artificial Sequence
  Description of Artificial Sequence: Synthetic oligonucleotide
ttctgatgaacaagaccatcaggaggtatcatacgc

SEQ ID NO: 162056 - DNA, 35 bp, Artificial Sequence
  Description of Artificial Sequence: Synthetic oligonucleotide
tctgatgaacaagaccatcaggaggtatcatacgc

SEQ ID NO: 162057 - DNA, 34 bp, Artificial Sequence
  Description of Artificial Sequence: Synthetic oligonucleotide
ctgatgaacaagaccatcaggaggtatcatacgc

SEQ ID NO: 162058 - DNA, 31 bp, Artificial Sequence
  Description of Artificial Sequence: Synthetic oligonucleotide
agagaatgtgaccttgtcctgcagctccatc

SEQ ID NO: 162059 - DNA, 30 bp, Artificial Sequence
  Description of Artificial Sequence: Synthetic oligonucleotide
gagaatgtgaccttgtcctgcagctccatc

SEQ ID NO: 162060 - DNA, 33 bp, Artificial Sequence
  Description of Artificial Sequence: Synthetic oligonucleotide
agaatgtgaccttgtcctgcagctccatctatc

SEQ ID NO: 162061 - DNA, 32 bp, Artificial Sequence
  Description of Artificial Sequence: Synthetic oligonucleotide
gaatgtgaccttgtcctgcagctccatctatc

SEQ ID NO: 162062 - DNA, 32 bp, Artificial Sequence
  Description of Artificial Sequence: Synthetic oligonucleotide
aatgtgaccttgtcctgcagctccatctatcc

SEQ ID NO: 162063 - DNA, 31 bp, Artificial Sequence
  Description of Artificial Sequence: Synthetic oligonucleotide
atgtgaccttgtcctgcagctccatctatcc

SEQ ID NO: 162064 - DNA, 30 bp, Artificial Sequence
  Description of Artificial Sequence: Synthetic oligonucleotide
tgtgaccttgtcctgcagctccatctatcc

SEQ ID NO: 162065 - DNA, 29 bp, Artificial Sequence
  Description of Artificial Sequence: Synthetic oligonucleotide
gtgaccttgtcctgcagctccatctatcc

SEQ ID NO: 162066 - DNA, 30 bp, Artificial Sequence
  Description of Artificial Sequence: Synthetic oligonucleotide
tgaccttgtcctgcagctccatctatccag

SEQ ID NO: 162067 - DNA, 29 bp, Artificial Sequence
  Description of Artificial Sequence: Synthetic oligonucleotide
gaccttgtcctgcagctccatctatccag

SEQ ID NO: 162068 - DNA, 29 bp, Artificial Sequence
  Description of Artificial Sequence: Synthetic oligonucleotide
accttgtcctgcagctccatctatccagg

SEQ ID NO: 162069 - DNA, 28 bp, Artificial Sequence
  Description of Artificial Sequence: Synthetic oligonucleotide
ccttgtcctgcagctccatctatccagg

SEQ ID NO: 162070 - DNA, 28 bp, Artificial Sequence
  Description of Artificial Sequence: Synthetic oligonucleotide
cttgtcctgcagctccatctatccaggg

SEQ ID NO: 162071 - DNA, 30 bp, Artificial Sequence
  Description of Artificial Sequence: Synthetic oligonucleotide
ttgtcctgcagctccatctatccagggaag

SEQ ID NO: 162072 - DNA, 29 bp, Artificial Sequence
  Description of Artificial Sequence: Synthetic oligonucleotide
tgtcctgcagctccatctatccagggaag

SEQ ID NO: 162073 - DNA, 28 bp, Artificial Sequence
  Description of Artificial Sequence: Synthetic oligonucleotide
gtcctgcagctccatctatccagggaag

SEQ ID NO: 162074 - DNA, 28 bp, Artificial Sequence
  Description of Artificial Sequence: Synthetic oligonucleotide
tcctgcagctccatctatccagggaagg

SEQ ID NO: 162075 - DNA, 27 bp, Artificial Sequence
  Description of Artificial Sequence: Synthetic oligonucleotide
cctgcagctccatctatccagggaagg

SEQ ID NO: 162076 - DNA, 27 bp, Artificial Sequence
  Description of Artificial Sequence: Synthetic oligonucleotide
ctgcagctccatctatccagggaaggg

SEQ ID NO: 162077 - DNA, 27 bp, Artificial Sequence
  Description of Artificial Sequence: Synthetic oligonucleotide
tgcagctccatctatccagggaagggg

SEQ ID NO: 162078 - DNA, 27 bp, Artificial Sequence
  Description of Artificial Sequence: Synthetic oligonucleotide
gcagctccatctatccagggaagggga

SEQ ID NO: 162079 - DNA, 27 bp, Artificial Sequence
  Description of Artificial Sequence: Synthetic oligonucleotide
cagctccatctatccagggaaggggag

SEQ ID NO: 162080 - DNA, 27 bp, Artificial Sequence
  Description of Artificial Sequence: Synthetic oligonucleotide
agctccatctatccagggaaggggagg

SEQ ID NO: 162081 - DNA, 26 bp, Artificial Sequence
  Description of Artificial Sequence: Synthetic oligonucleotide
gctccatctatccagggaaggggagg

SEQ ID NO: 162082 - DNA, 26 bp, Artificial Sequence
  Description of Artificial Sequence: Synthetic oligonucleotide
ctccatctatccagggaaggggaggc

SEQ ID NO: 162083 - DNA, 26 bp, Artificial Sequence
  Description of Artificial Sequence: Synthetic oligonucleotide
tccatctatccagggaaggggaggcc

SEQ ID NO: 162084 - DNA, 31 bp, Artificial Sequence
  Description of Artificial Sequence: Synthetic oligonucleotide
ctgtccttgcaggaacctacagatgctacag

SEQ ID NO: 162085 - DNA, 33 bp, Artificial Sequence
  Description of Artificial Sequence: Synthetic oligonucleotide
tgtccttgcaggaacctacagatgctacagttc

SEQ ID NO: 162086 - DNA, 32 bp, Artificial Sequence
  Description of Artificial Sequence: Synthetic oligonucleotide
gtccttgcaggaacctacagatgctacagttc

SEQ ID NO: 162087 - DNA, 33 bp, Artificial Sequence
  Description of Artificial Sequence: Synthetic oligonucleotide
tccttgcaggaacctacagatgctacagttctg

SEQ ID NO: 162088 - DNA, 32 bp, Artificial Sequence
  Description of Artificial Sequence: Synthetic oligonucleotide
ccttgcaggaacctacagatgctacagttctg

SEQ ID NO: 162089 - DNA, 34 bp, Artificial Sequence
  Description of Artificial Sequence: Synthetic oligonucleotide
cttgcaggaacctacagatgctacagttctgttc

SEQ ID NO: 162090 - DNA, 34 bp, Artificial Sequence
  Description of Artificial Sequence: Synthetic oligonucleotide
ttgcaggaacctacagatgctacagttctgttcc

SEQ ID NO: 162091 - DNA, 33 bp, Artificial Sequence
  Description of Artificial Sequence: Synthetic oligonucleotide
tgcaggaacctacagatgctacagttctgttcc

SEQ ID NO: 162092 - DNA, 32 bp, Artificial Sequence
  Description of Artificial Sequence: Synthetic oligonucleotide
gcaggaacctacagatgctacagttctgttcc

SEQ ID NO: 162093 - DNA, 33 bp, Artificial Sequence
  Description of Artificial Sequence: Synthetic oligonucleotide
caggaacctacagatgctacagttctgttcctc

SEQ ID NO: 162094 - DNA, 34 bp, Artificial Sequence
  Description of Artificial Sequence: Synthetic oligonucleotide
aggaacctacagatgctacagttctgttcctcac

SEQ ID NO: 162095 - DNA, 33 bp, Artificial Sequence
  Description of Artificial Sequence: Synthetic oligonucleotide
ggaacctacagatgctacagttctgttcctcac

SEQ ID NO: 162096 - DNA, 34 bp, Artificial Sequence
  Description of Artificial Sequence: Synthetic oligonucleotide
gaacctacagatgctacagttctgttcctcactc

SEQ ID NO: 162097 - DNA, 34 bp, Artificial Sequence
  Description of Artificial Sequence: Synthetic oligonucleotide
aacctacagatgctacagttctgttcctcactcc

SEQ ID NO: 162098 - DNA, 33 bp, Artificial Sequence
  Description of Artificial Sequence: Synthetic oligonucleotide
acctacagatgctacagttctgttcctcactcc

SEQ ID NO: 162099 - DNA, 32 bp, Artificial Sequence
  Description of Artificial Sequence: Synthetic oligonucleotide
cctacagatgctacagttctgttcctcactcc

SEQ ID NO: 162100 - DNA, 32 bp, Artificial Sequence
  Description of Artificial Sequence: Synthetic oligonucleotide
ctacagatgctacagttctgttcctcactccc

SEQ ID NO: 162101 - DNA, 32 bp, Artificial Sequence
  Description of Artificial Sequence: Synthetic oligonucleotide
tacagatgctacagttctgttcctcactcccc

SEQ ID NO: 162102 - DNA, 31 bp, Artificial Sequence
  Description of Artificial Sequence: Synthetic oligonucleotide
acagatgctacagttctgttcctcactcccc

SEQ ID NO: 162103 - DNA, 30 bp, Artificial Sequence
  Description of Artificial Sequence: Synthetic oligonucleotide
cagatgctacagttctgttcctcactcccc

SEQ ID NO: 162104 - DNA, 30 bp, Artificial Sequence
  Description of Artificial Sequence: Synthetic oligonucleotide
agatgctacagttctgttcctcactccccc

SEQ ID NO: 162105 - DNA, 29 bp, Artificial Sequence
  Description of Artificial Sequence: Synthetic oligonucleotide
gatgctacagttctgttcctcactccccc

SEQ ID NO: 162106 - DNA, 32 bp, Artificial Sequence
  Description of Artificial Sequence: Synthetic oligonucleotide
atgctacagttctgttcctcactccccctatc

SEQ ID NO: 162107 - DNA, 31 bp, Artificial Sequence
  Description of Artificial Sequence: Synthetic oligonucleotide
tgctacagttctgttcctcactccccctatc

SEQ ID NO: 162108 - DNA, 30 bp, Artificial Sequence
  Description of Artificial Sequence: Synthetic oligonucleotide
gctacagttctgttcctcactccccctatc

SEQ ID NO: 162109 - DNA, 31 bp, Artificial Sequence
  Description of Artificial Sequence: Synthetic oligonucleotide
ctacagttctgttcctcactccccctatcag

SEQ ID NO: 162110 - DNA, 33 bp, Artificial Sequence
  Description of Artificial Sequence: Synthetic oligonucleotide
tacagttctgttcctcactccccctatcagttg

SEQ ID NO: 162111 - DNA, 32 bp, Artificial Sequence
  Description of Artificial Sequence: Synthetic oligonucleotide
acagttctgttcctcactccccctatcagttg

SEQ ID NO: 162112 - DNA, 31 bp, Artificial Sequence
  Description of Artificial Sequence: Synthetic oligonucleotide
cagttctgttcctcactccccctatcagttg

SEQ ID NO: 162113 - DNA, 32 bp, Artificial Sequence
  Description of Artificial Sequence: Synthetic oligonucleotide
agttctgttcctcactccccctatcagttgtc

SEQ ID NO: 162114 - DNA, 28 bp, Artificial Sequence
  Description of Artificial Sequence: Synthetic oligonucleotide
ccacggttcaggcaggagagaatgtgtc

SEQ ID NO: 162115 - DNA, 28 bp, Artificial Sequence
  Description of Artificial Sequence: Synthetic oligonucleotide
cacggttcaggcaggagagaatgtgtcc

SEQ ID NO: 162116 - DNA, 30 bp, Artificial Sequence
  Description of Artificial Sequence: Synthetic oligonucleotide
acggttcaggcaggagagaatgtgtccttg

SEQ ID NO: 162117 - DNA, 29 bp, Artificial Sequence
  Description of Artificial Sequence: Synthetic oligonucleotide
cggttcaggcaggagagaatgtgtccttg

SEQ ID NO: 162118 - DNA, 30 bp, Artificial Sequence
  Description of Artificial Sequence: Synthetic oligonucleotide
ggttcaggcaggagagaatgtgtccttgtc

SEQ ID NO: 162119 - DNA, 30 bp, Artificial Sequence
  Description of Artificial Sequence: Synthetic oligonucleotide
gttcaggcaggagagaatgtgtccttgtcc

SEQ ID NO: 162120 - DNA, 31 bp, Artificial Sequence
  Description of Artificial Sequence: Synthetic oligonucleotide
ttcaggcaggagagaatgtgtccttgtcctg

SEQ ID NO: 162121 - DNA, 30 bp, Artificial Sequence
  Description of Artificial Sequence: Synthetic oligonucleotide
tcaggcaggagagaatgtgtccttgtcctg

SEQ ID NO: 162122 - DNA, 29 bp, Artificial Sequence
  Description of Artificial Sequence: Synthetic oligonucleotide
caggcaggagagaatgtgtccttgtcctg

SEQ ID NO: 162123 - DNA, 29 bp, Artificial Sequence
  Description of Artificial Sequence: Synthetic oligonucleotide
aggcaggagagaatgtgtccttgtcctgc

SEQ ID NO: 162124 - DNA, 28 bp, Artificial Sequence
  Description of Artificial Sequence: Synthetic oligonucleotide
ggcaggagagaatgtgtccttgtcctgc

SEQ ID NO: 162125 - DNA, 29 bp, Artificial Sequence
  Description of Artificial Sequence: Synthetic oligonucleotide
gcaggagagaatgtgtccttgtcctgcag

SEQ ID NO: 162126 - DNA, 29 bp, Artificial Sequence
  Description of Artificial Sequence: Synthetic oligonucleotide
caggagagaatgtgtccttgtcctgcagc

SEQ ID NO: 162127 - DNA, 30 bp, Artificial Sequence
  Description of Artificial Sequence: Synthetic oligonucleotide
aggagagaatgtgtccttgtcctgcagctc

SEQ ID NO: 162128 - DNA, 29 bp, Artificial Sequence
  Description of Artificial Sequence: Synthetic oligonucleotide
ggagagaatgtgtccttgtcctgcagctc

SEQ ID NO: 162129 - DNA, 29 bp, Artificial Sequence
  Description of Artificial Sequence: Synthetic oligonucleotide
gagagaatgtgtccttgtcctgcagctcc

SEQ ID NO: 162130 - DNA, 31 bp, Artificial Sequence
  Description of Artificial Sequence: Synthetic oligonucleotide
agagaatgtgtccttgtcctgcagctccatc

SEQ ID NO: 162131 - DNA, 30 bp, Artificial Sequence
  Description of Artificial Sequence: Synthetic oligonucleotide
gagaatgtgtccttgtcctgcagctccatc

SEQ ID NO: 162132 - DNA, 33 bp, Artificial Sequence
  Description of Artificial Sequence: Synthetic oligonucleotide
agaatgtgtccttgtcctgcagctccatctatc

SEQ ID NO: 162133 - DNA, 32 bp, Artificial Sequence
  Description of Artificial Sequence: Synthetic oligonucleotide
gaatgtgtccttgtcctgcagctccatctatc

SEQ ID NO: 162134 - DNA, 32 bp, Artificial Sequence
  Description of Artificial Sequence: Synthetic oligonucleotide
aatgtgtccttgtcctgcagctccatctatcc

SEQ ID NO: 162135 - DNA, 31 bp, Artificial Sequence
  Description of Artificial Sequence: Synthetic oligonucleotide
atgtgtccttgtcctgcagctccatctatcc

SEQ ID NO: 162136 - DNA, 30 bp, Artificial Sequence
  Description of Artificial Sequence: Synthetic oligonucleotide
tgtgtccttgtcctgcagctccatctatcc

SEQ ID NO: 162137 - DNA, 29 bp, Artificial Sequence
  Description of Artificial Sequence: Synthetic oligonucleotide
gtgtccttgtcctgcagctccatctatcc

SEQ ID NO: 162138 - DNA, 30 bp, Artificial Sequence
  Description of Artificial Sequence: Synthetic oligonucleotide
tgtccttgtcctgcagctccatctatccag

SEQ ID NO: 162139 - DNA, 29 bp, Artificial Sequence
  Description of Artificial Sequence: Synthetic oligonucleotide
gtccttgtcctgcagctccatctatccag

SEQ ID NO: 162140 - DNA, 29 bp, Artificial Sequence
  Description of Artificial Sequence: Synthetic oligonucleotide
tccttgtcctgcagctccatctatccagg

SEQ ID NO: 162141 - DNA, 29 bp, Artificial Sequence
  Description of Artificial Sequence: Synthetic oligonucleotide
ttgtcctgcagctccatctatccagggag

SEQ ID NO: 162142 - DNA, 28 bp, Artificial Sequence
  Description of Artificial Sequence: Synthetic oligonucleotide
tgtcctgcagctccatctatccagggag

SEQ ID NO: 162143 - DNA, 27 bp, Artificial Sequence
  Description of Artificial Sequence: Synthetic oligonucleotide
gtcctgcagctccatctatccagggag

SEQ ID NO: 162144 - DNA, 27 bp, Artificial Sequence
  Description of Artificial Sequence: Synthetic oligonucleotide
tcctgcagctccatctatccagggagg

SEQ ID NO: 162145 - DNA, 26 bp, Artificial Sequence
  Description of Artificial Sequence: Synthetic oligonucleotide
cctgcagctccatctatccagggagg

SEQ ID NO: 162146 - DNA, 26 bp, Artificial Sequence
  Description of Artificial Sequence: Synthetic oligonucleotide
ctgcagctccatctatccagggaggg

SEQ ID NO: 162147 - DNA, 26 bp, Artificial Sequence
  Description of Artificial Sequence: Synthetic oligonucleotide
tgcagctccatctatccagggagggg

SEQ ID NO: 162148 - DNA, 25 bp, Artificial Sequence
  Description of Artificial Sequence: Synthetic oligonucleotide
gcagctccatctatccagggagggg

SEQ ID NO: 162149 - DNA, 26 bp, Artificial Sequence
  Description of Artificial Sequence: Synthetic oligonucleotide
cagctccatctatccagggaggggga

SEQ ID NO: 162150 - DNA, 26 bp, Artificial Sequence
  Description of Artificial Sequence: Synthetic oligonucleotide
agctccatctatccagggagggggag

SEQ ID NO: 162151 - DNA, 25 bp, Artificial Sequence
  Description of Artificial Sequence: Synthetic oligonucleotide
gctccatctatccagggagggggag

SEQ ID NO: 162152 - DNA, 25 bp, Artificial Sequence
  Description of Artificial Sequence: Synthetic oligonucleotide
ctccatctatccagggagggggagg

SEQ ID NO: 162153 - DNA, 25 bp, Artificial Sequence
  Description of Artificial Sequence: Synthetic oligonucleotide
tccatctatccagggagggggaggc

SEQ ID NO: 162154 - DNA, 25 bp, Artificial Sequence
  Description of Artificial Sequence: Synthetic oligonucleotide
taggctccctgcagtgcgcagcatc

SEQ ID NO: 162155 - DNA, 24 bp, Artificial Sequence
  Description of Artificial Sequence: Synthetic oligonucleotide
aggctccctgcagtgcgcagcatc

SEQ ID NO: 162156 - DNA, 23 bp, Artificial Sequence
  Description of Artificial Sequence: Synthetic oligonucleotide
ggctccctgcagtgcgcagcatc

SEQ ID NO: 162157 - DNA, 24 bp, Artificial Sequence
  Description of Artificial Sequence: Synthetic oligonucleotide
gctccctgcagtgcgcagcatcca

SEQ ID NO: 162158 - DNA, 24 bp, Artificial Sequence
  Description of Artificial Sequence: Synthetic oligonucleotide
ctccctgcagtgcgcagcatccac

SEQ ID NO: 162159 - DNA, 24 bp, Artificial Sequence
  Description of Artificial Sequence: Synthetic oligonucleotide
tccctgcagtgcgcagcatccacg

SEQ ID NO: 162160 - DNA, 23 bp, Artificial Sequence
  Description of Artificial Sequence: Synthetic oligonucleotide
ccctgcagtgcgcagcatccacg

SEQ ID NO: 162161 - DNA, 25 bp, Artificial Sequence
  Description of Artificial Sequence: Synthetic oligonucleotide
cctgcagtgcgcagcatccacggaa

SEQ ID NO: 162162 - DNA, 27 bp, Artificial Sequence
  Description of Artificial Sequence: Synthetic oligonucleotide
ctgcagtgcgcagcatccacggaacat

SEQ ID NO: 162163 - DNA, 28 bp, Artificial Sequence
  Description of Artificial Sequence: Synthetic oligonucleotide
tgcagtgcgcagcatccacggaacattc

SEQ ID NO: 162164 - DNA, 27 bp, Artificial Sequence
  Description of Artificial Sequence: Synthetic oligonucleotide
gcagtgcgcagcatccacggaacattc

SEQ ID NO: 162165 - DNA, 27 bp, Artificial Sequence
  Description of Artificial Sequence: Synthetic oligonucleotide
cagtgcgcagcatccacggaacattcc

SEQ ID NO: 162166 - DNA, 28 bp, Artificial Sequence
  Description of Artificial Sequence: Synthetic oligonucleotide
agtgcgcagcatccacggaacattccag

SEQ ID NO: 162167 - DNA, 27 bp, Artificial Sequence
  Description of Artificial Sequence: Synthetic oligonucleotide
gtgcgcagcatccacggaacattccag

SEQ ID NO: 162168 - DNA, 27 bp, Artificial Sequence
  Description of Artificial Sequence: Synthetic oligonucleotide
tgcgcagcatccacggaacattccagg

SEQ ID NO: 162169 - DNA, 26 bp, Artificial Sequence
  Description of Artificial Sequence: Synthetic oligonucleotide
gcgcagcatccacggaacattccagg

SEQ ID NO: 162170 - DNA, 26 bp, Artificial Sequence
  Description of Artificial Sequence: Synthetic oligonucleotide
cgcagcatccacggaacattccaggc

SEQ ID NO: 162171 - DNA, 26 bp, Artificial Sequence
  Description of Artificial Sequence: Synthetic oligonucleotide
gcagcatccacggaacattccaggcc

SEQ ID NO: 162172 - DNA, 27 bp, Artificial Sequence
  Description of Artificial Sequence: Synthetic oligonucleotide
cagcatccacggaacattccaggccga

SEQ ID NO: 162173 - DNA, 27 bp, Artificial Sequence
  Description of Artificial Sequence: Synthetic oligonucleotide
agcatccacggaacattccaggccgac

SEQ ID NO: 162174 - DNA, 27 bp, Artificial Sequence
  Description of Artificial Sequence: Synthetic oligonucleotide
gcatccacggaacattccaggccgact

SEQ ID NO: 162175 - DNA, 29 bp, Artificial Sequence
  Description of Artificial Sequence: Synthetic oligonucleotide
catccacggaacattccaggccgactttc

SEQ ID NO: 162176 - DNA, 29 bp, Artificial Sequence
  Description of Artificial Sequence: Synthetic oligonucleotide
atccacggaacattccaggccgactttcc

SEQ ID NO: 162177 - DNA, 28 bp, Artificial Sequence
  Description of Artificial Sequence: Synthetic oligonucleotide
tccacggaacattccaggccgactttcc

SEQ ID NO: 162178 - DNA, 27 bp, Artificial Sequence
  Description of Artificial Sequence: Synthetic oligonucleotide
ccacggaacattccaggccgactttcc

SEQ ID NO: 162179 - DNA, 28 bp, Artificial Sequence
  Description of Artificial Sequence: Synthetic oligonucleotide
cacggaacattccaggccgactttcctc

SEQ ID NO: 162180 - DNA, 31 bp, Artificial Sequence
  Description of Artificial Sequence: Synthetic oligonucleotide
cacttccttctgcacagagaggggaagtttg

SEQ ID NO: 162181 - DNA, 32 bp, Artificial Sequence
  Description of Artificial Sequence: Synthetic oligonucleotide
acttccttctgcacagagaggggaagtttgac

SEQ ID NO: 162182 - DNA, 31 bp, Artificial Sequence
  Description of Artificial Sequence: Synthetic oligonucleotide
cttccttctgcacagagaggggaagtttgac

SEQ ID NO: 162183 - DNA, 33 bp, Artificial Sequence
  Description of Artificial Sequence: Synthetic oligonucleotide
ttccttctgcacagagaggggaagtttgacaac

SEQ ID NO: 162184 - DNA, 32 bp, Artificial Sequence
  Description of Artificial Sequence: Synthetic oligonucleotide
tccttctgcacagagaggggaagtttgacaac

SEQ ID NO: 162185 - DNA, 31 bp, Artificial Sequence
  Description of Artificial Sequence: Synthetic oligonucleotide
ccttctgcacagagaggggaagtttgacaac

SEQ ID NO: 162186 - DNA, 32 bp, Artificial Sequence
  Description of Artificial Sequence: Synthetic oligonucleotide
cttctgcacagagaggggaagtttgacaacac

SEQ ID NO: 162187 - DNA, 35 bp, Artificial Sequence
  Description of Artificial Sequence: Synthetic oligonucleotide
ttctgcacagagaggggaagtttgacaacactttg

SEQ ID NO: 162188 - DNA, 34 bp, Artificial Sequence
  Description of Artificial Sequence: Synthetic oligonucleotide
tctgcacagagaggggaagtttgacaacactttg

SEQ ID NO: 162189 - DNA, 33 bp, Artificial Sequence
  Description of Artificial Sequence: Synthetic oligonucleotide
ctgcacagagaggggaagtttgacaacactttg

SEQ ID NO: 162190 - DNA, 33 bp, Artificial Sequence
  Description of Artificial Sequence: Synthetic oligonucleotide
tgcacagagaggggaagtttgacaacactttgc

SEQ ID NO: 162191 - DNA, 32 bp, Artificial Sequence
  Description of Artificial Sequence: Synthetic oligonucleotide
gcacagagaggggaagtttgacaacactttgc

SEQ ID NO: 162192 - DNA, 33 bp, Artificial Sequence
  Description of Artificial Sequence: Synthetic oligonucleotide
cacagagaggggaagtttgacaacactttgcac

SEQ ID NO: 162193 - DNA, 33 bp, Artificial Sequence
  Description of Artificial Sequence: Synthetic oligonucleotide
acagagaggggaagtttgacaacactttgcacc

SEQ ID NO: 162194 - DNA, 32 bp, Artificial Sequence
  Description of Artificial Sequence: Synthetic oligonucleotide
cagagaggggaagtttgacaacactttgcacc

SEQ ID NO: 162195 - DNA, 33 bp, Artificial Sequence
  Description of Artificial Sequence: Synthetic oligonucleotide
agagaggggaagtttgacaacactttgcacctc

SEQ ID NO: 162196 - DNA, 32 bp, Artificial Sequence
  Description of Artificial Sequence: Synthetic oligonucleotide
gagaggggaagtttgacaacactttgcacctc

SEQ ID NO: 162197 - DNA, 35 bp, Artificial Sequence
  Description of Artificial Sequence: Synthetic oligonucleotide
agaggggaagtttgacaacactttgcacctcattg

SEQ ID NO: 162198 - DNA, 34 bp, Artificial Sequence
  Description of Artificial Sequence: Synthetic oligonucleotide
gaggggaagtttgacaacactttgcacctcattg

SEQ ID NO: 162199 - DNA, 34 bp, Artificial Sequence
  Description of Artificial Sequence: Synthetic oligonucleotide
aggggaagtttgacaacactttgcacctcattgg

SEQ ID NO: 162200 - DNA, 33 bp, Artificial Sequence
  Description of Artificial Sequence: Synthetic oligonucleotide
ggggaagtttgacaacactttgcacctcattgg

SEQ ID NO: 162201 - DNA, 34 bp, Artificial Sequence
  Description of Artificial Sequence: Synthetic oligonucleotide
gggaagtttgacaacactttgcacctcattggag

SEQ ID NO: 162202 - DNA, 35 bp, Artificial Sequence
  Description of Artificial Sequence: Synthetic oligonucleotide
ggaagtttgacaacactttgcacctcattggagag

SEQ ID NO: 162203 - DNA, 35 bp, Artificial Sequence
  Description of Artificial Sequence: Synthetic oligonucleotide
gaagtttgacaacactttgcacctcattggagagc

SEQ ID NO: 162204 - DNA, 36 bp, Artificial Sequence
  Description of Artificial Sequence: Synthetic oligonucleotide
aagtttgacaacactttgcacctcattggagagcac

SEQ ID NO: 162205 - DNA, 35 bp, Artificial Sequence
  Description of Artificial Sequence: Synthetic oligonucleotide
agtttgacaacactttgcacctcattggagagcac

SEQ ID NO: 162206 - DNA, 34 bp, Artificial Sequence
  Description of Artificial Sequence: Synthetic oligonucleotide
gtttgacaacactttgcacctcattggagagcac

SEQ ID NO: 162207 - DNA, 34 bp, Artificial Sequence
  Description of Artificial Sequence: Synthetic oligonucleotide
tttgacaacactttgcacctcattggagagcacc

SEQ ID NO: 162208 - DNA, 33 bp, Artificial Sequence
  Description of Artificial Sequence: Synthetic oligonucleotide
ttgacaacactttgcacctcattggagagcacc

SEQ ID NO: 162209 - DNA, 32 bp, Artificial Sequence
  Description of Artificial Sequence: Synthetic oligonucleotide
tgacaacactttgcacctcattggagagcacc

SEQ ID NO: 162210 - DNA, 31 bp, Artificial Sequence
  Description of Artificial Sequence: Synthetic oligonucleotide
gacaacactttgcacctcattggagagcacc

SEQ ID NO: 162211 - DNA, 39 bp, Artificial Sequence
  Description of Artificial Sequence: Synthetic oligonucleotide
tgatcataggtctatatgagaaaccttctctctcagcac

SEQ ID NO: 162212 - DNA, 38 bp, Artificial Sequence
  Description of Artificial Sequence: Synthetic oligonucleotide
gatcataggtctatatgagaaaccttctctctcagcac

SEQ ID NO: 162213 - DNA, 39 bp, Artificial Sequence
  Description of Artificial Sequence: Synthetic oligonucleotide
atcataggtctatatgagaaaccttctctctcagcacag

SEQ ID NO: 162214 - DNA, 38 bp, Artificial Sequence
  Description of Artificial Sequence: Synthetic oligonucleotide
tcataggtctatatgagaaaccttctctctcagcacag

SEQ ID NO: 162215 - DNA, 37 bp, Artificial Sequence
  Description of Artificial Sequence: Synthetic oligonucleotide
cataggtctatatgagaaaccttctctctcagcacag

SEQ ID NO: 162216 - DNA, 37 bp, Artificial Sequence
  Description of Artificial Sequence: Synthetic oligonucleotide
ataggtctatatgagaaaccttctctctcagcacagc

SEQ ID NO: 162217 - DNA, 36 bp, Artificial Sequence
  Description of Artificial Sequence: Synthetic oligonucleotide
taggtctatatgagaaaccttctctctcagcacagc

SEQ ID NO: 162218 - DNA, 35 bp, Artificial Sequence
  Description of Artificial Sequence: Synthetic oligonucleotide
aggtctatatgagaaaccttctctctcagcacagc

SEQ ID NO: 162219 - DNA, 34 bp, Artificial Sequence
  Description of Artificial Sequence: Synthetic oligonucleotide
ggtctatatgagaaaccttctctctcagcacagc

SEQ ID NO: 162220 - DNA, 34 bp, Artificial Sequence
  Description of Artificial Sequence: Synthetic oligonucleotide
gtctatatgagaaaccttctctctcagcacagcc

SEQ ID NO: 162221 - DNA, 34 bp, Artificial Sequence
  Description of Artificial Sequence: Synthetic oligonucleotide
tctatatgagaaaccttctctctcagcacagccg

SEQ ID NO: 162222 - DNA, 33 bp, Artificial Sequence
  Description of Artificial Sequence: Synthetic oligonucleotide
ctatatgagaaaccttctctctcagcacagccg

SEQ ID NO: 162223 - DNA, 33 bp, Artificial Sequence
  Description of Artificial Sequence: Synthetic oligonucleotide
tatatgagaaaccttctctctcagcacagccgg

SEQ ID NO: 162224 - DNA, 32 bp, Artificial Sequence
  Description of Artificial Sequence: Synthetic oligonucleotide
atatgagaaaccttctctctcagcacagccgg

SEQ ID NO: 162225 - DNA, 31 bp, Artificial Sequence
  Description of Artificial Sequence: Synthetic oligonucleotide
tatgagaaaccttctctctcagcacagccgg

SEQ ID NO: 162226 - DNA, 30 bp, Artificial Sequence
  Description of Artificial Sequence: Synthetic oligonucleotide
atgagaaaccttctctctcagcacagccgg

SEQ ID NO: 162227 - DNA, 29 bp, Artificial Sequence
  Description of Artificial Sequence: Synthetic oligonucleotide
tgagaaaccttctctctcagcacagccgg

SEQ ID NO: 162228 - DNA, 28 bp, Artificial Sequence
  Description of Artificial Sequence: Synthetic oligonucleotide
gagaaaccttctctctcagcacagccgg

SEQ ID NO: 162229 - DNA, 28 bp, Artificial Sequence
  Description of Artificial Sequence: Synthetic oligonucleotide
agaaaccttctctctcagcacagccggg

SEQ ID NO: 162230 - DNA, 27 bp, Artificial Sequence
  Description of Artificial Sequence: Synthetic oligonucleotide
gaaaccttctctctcagcacagccggg

SEQ ID NO: 162231 - DNA, 27 bp, Artificial Sequence
  Description of Artificial Sequence: Synthetic oligonucleotide
aaaccttctctctcagcacagccgggc

SEQ ID NO: 162232 - DNA, 26 bp, Artificial Sequence
  Description of Artificial Sequence: Synthetic oligonucleotide
aaccttctctctcagcacagccgggc

SEQ ID NO: 162233 - DNA, 25 bp, Artificial Sequence
  Description of Artificial Sequence: Synthetic oligonucleotide
accttctctctcagcacagccgggc

SEQ ID NO: 162234 - DNA, 24 bp, Artificial Sequence
  Description of Artificial Sequence: Synthetic oligonucleotide
ccttctctctcagcacagccgggc

SEQ ID NO: 162235 - DNA, 24 bp, Artificial Sequence
  Description of Artificial Sequence: Synthetic oligonucleotide
cttctctctcagcacagccgggcc

SEQ ID NO: 162236 - DNA, 24 bp, Artificial Sequence
  Description of Artificial Sequence: Synthetic oligonucleotide
ttctctctcagcacagccgggccc

SEQ ID NO: 162237 - DNA, 23 bp, Artificial Sequence
  Description of Artificial Sequence: Synthetic oligonucleotide
tctctctcagcacagccgggccc

SEQ ID NO: 162238 - DNA, 22 bp, Artificial Sequence
  Description of Artificial Sequence: Synthetic oligonucleotide
ctctctcagcacagccgggccc

SEQ ID NO: 162239 - DNA, 23 bp, Artificial Sequence
  Description of Artificial Sequence: Synthetic oligonucleotide
tctctcagcacagccgggcccca

SEQ ID NO: 162240 - DNA, 22 bp, Artificial Sequence
  Description of Artificial Sequence: Synthetic oligonucleotide
ctctcagcacagccgggcccca

SEQ ID NO: 162241 - DNA, 22 bp, Artificial Sequence
  Description of Artificial Sequence: Synthetic oligonucleotide
tctcagcacagccgggccccac

SEQ ID NO: 162242 - DNA, 21 bp, Artificial Sequence
  Description of Artificial Sequence: Synthetic oligonucleotide
ctcagcacagccgggccccac

SEQ ID NO: 162243 - DNA, 21 bp, Artificial Sequence
  Description of Artificial Sequence: Synthetic oligonucleotide
tcagcacagccgggccccacg

SEQ ID NO: 162244 - DNA, 20 bp, Artificial Sequence
  Description of Artificial Sequence: Synthetic oligonucleotide
cagcacagccgggccccacg

SEQ ID NO: 162245 - DNA, 22 bp, Artificial Sequence
  Description of Artificial Sequence: Synthetic oligonucleotide
agcacagccgggccccacggtt

SEQ ID NO: 162246 - DNA, 21 bp, Artificial Sequence
  Description of Artificial Sequence: Synthetic oligonucleotide
gcacagccgggccccacggtt

SEQ ID NO: 162247 - DNA, 22 bp, Artificial Sequence
  Description of Artificial Sequence: Synthetic oligonucleotide
cacagccgggccccacggttca

SEQ ID NO: 162248 - DNA, 22 bp, Artificial Sequence
  Description of Artificial Sequence: Synthetic oligonucleotide
acagccgggccccacggttcag

SEQ ID NO: 162249 - DNA, 32 bp, Artificial Sequence
  Description of Artificial Sequence: Synthetic oligonucleotide
catcaacggaacattccaggccgactttcttc

SEQ ID NO: 162250 - DNA, 33 bp, Artificial Sequence
  Description of Artificial Sequence: Synthetic oligonucleotide
atcaacggaacattccaggccgactttcttctg

SEQ ID NO: 162251 - DNA, 32 bp, Artificial Sequence
  Description of Artificial Sequence: Synthetic oligonucleotide
tcaacggaacattccaggccgactttcttctg

SEQ ID NO: 162252 - DNA, 31 bp, Artificial Sequence
  Description of Artificial Sequence: Synthetic oligonucleotide
caacggaacattccaggccgactttcttctg

SEQ ID NO: 162253 - DNA, 31 bp, Artificial Sequence
  Description of Artificial Sequence: Synthetic oligonucleotide
aacggaacattccaggccgactttcttctgg

SEQ ID NO: 162254 - DNA, 30 bp, Artificial Sequence
  Description of Artificial Sequence: Synthetic oligonucleotide
acggaacattccaggccgactttcttctgg

SEQ ID NO: 162255 - DNA, 29 bp, Artificial Sequence
  Description of Artificial Sequence: Synthetic oligonucleotide
cggaacattccaggccgactttcttctgg

SEQ ID NO: 162256 - DNA, 29 bp, Artificial Sequence
  Description of Artificial Sequence: Synthetic oligonucleotide
ggaacattccaggccgactttcttctggg

SEQ ID NO: 162257 - DNA, 29 bp, Artificial Sequence
  Description of Artificial Sequence: Synthetic oligonucleotide
gaacattccaggccgactttcttctgggc

SEQ ID NO: 162258 - DNA, 29 bp, Artificial Sequence
  Description of Artificial Sequence: Synthetic oligonucleotide
aacattccaggccgactttcttctgggcc

SEQ ID NO: 162259 - DNA, 28 bp, Artificial Sequence
  Description of Artificial Sequence: Synthetic oligonucleotide
acattccaggccgactttcttctgggcc

SEQ ID NO: 162260 - DNA, 27 bp, Artificial Sequence
  Description of Artificial Sequence: Synthetic oligonucleotide
cattccaggccgactttcttctgggcc

SEQ ID NO: 162261 - DNA, 27 bp, Artificial Sequence
  Description of Artificial Sequence: Synthetic oligonucleotide
attccaggccgactttcttctgggccc

SEQ ID NO: 162262 - DNA, 27 bp, Artificial Sequence
  Description of Artificial Sequence: Synthetic oligonucleotide
ttccaggccgactttcttctgggccct

SEQ ID NO: 162263 - DNA, 26 bp, Artificial Sequence
  Description of Artificial Sequence: Synthetic oligonucleotide
tccaggccgactttcttctgggccct

SEQ ID NO: 162264 - DNA, 25 bp, Artificial Sequence
  Description of Artificial Sequence: Synthetic oligonucleotide
ccaggccgactttcttctgggccct

SEQ ID NO: 162265 - DNA, 25 bp, Artificial Sequence
  Description of Artificial Sequence: Synthetic oligonucleotide
caggccgactttcttctgggccctg

SEQ ID NO: 162266 - DNA, 25 bp, Artificial Sequence
  Description of Artificial Sequence: Synthetic oligonucleotide
aggccgactttcttctgggccctgc

SEQ ID NO: 162267 - DNA, 24 bp, Artificial Sequence
  Description of Artificial Sequence: Synthetic oligonucleotide
ggccgactttcttctgggccctgc

SEQ ID NO: 162268 - DNA, 25 bp, Artificial Sequence
  Description of Artificial Sequence: Synthetic oligonucleotide
gccgactttcttctgggccctgcca

SEQ ID NO: 162269 - DNA, 25 bp, Artificial Sequence
  Description of Artificial Sequence: Synthetic oligonucleotide
ccgactttcttctgggccctgccac

SEQ ID NO: 162270 - DNA, 25 bp, Artificial Sequence
  Description of Artificial Sequence: Synthetic oligonucleotide
cgactttcttctgggccctgccacc

SEQ ID NO: 162271 - DNA, 26 bp, Artificial Sequence
  Description of Artificial Sequence: Synthetic oligonucleotide
gactttcttctgggccctgccaccca

SEQ ID NO: 162272 - DNA, 26 bp, Artificial Sequence
  Description of Artificial Sequence: Synthetic oligonucleotide
actttcttctgggccctgccacccac

SEQ ID NO: 162273 - DNA, 25 bp, Artificial Sequence
  Description of Artificial Sequence: Synthetic oligonucleotide
ctttcttctgggccctgccacccac

SEQ ID NO: 162274 - DNA, 25 bp, Artificial Sequence
  Description of Artificial Sequence: Synthetic oligonucleotide
tttcttctgggccctgccacccacg

SEQ ID NO: 162275 - DNA, 24 bp, Artificial Sequence
  Description of Artificial Sequence: Synthetic oligonucleotide
ttcttctgggccctgccacccacg

SEQ ID NO: 162276 - DNA, 23 bp, Artificial Sequence
  Description of Artificial Sequence: Synthetic oligonucleotide
tcttctgggccctgccacccacg

SEQ ID NO: 162277 - DNA, 22 bp, Artificial Sequence
  Description of Artificial Sequence: Synthetic oligonucleotide
cttctgggccctgccacccacg

SEQ ID NO: 162278 - DNA, 23 bp, Artificial Sequence
  Description of Artificial Sequence: Synthetic oligonucleotide
ttctgggccctgccacccacgga

SEQ ID NO: 162279 - DNA, 28 bp, Artificial Sequence
  Description of Artificial Sequence: Synthetic oligonucleotide
acccacggagggacctacagatgctttg

SEQ ID NO: 162280 - DNA, 27 bp, Artificial Sequence
  Description of Artificial Sequence: Synthetic oligonucleotide
cccacggagggacctacagatgctttg

SEQ ID NO: 162281 - DNA, 27 bp, Artificial Sequence
  Description of Artificial Sequence: Synthetic oligonucleotide
ccacggagggacctacagatgctttgg

SEQ ID NO: 162282 - DNA, 27 bp, Artificial Sequence
  Description of Artificial Sequence: Synthetic oligonucleotide
cacggagggacctacagatgctttggc

SEQ ID NO: 162283 - DNA, 28 bp, Artificial Sequence
  Description of Artificial Sequence: Synthetic oligonucleotide
acggagggacctacagatgctttggctc

SEQ ID NO: 162284 - DNA, 27 bp, Artificial Sequence
  Description of Artificial Sequence: Synthetic oligonucleotide
cggagggacctacagatgctttggctc

SEQ ID NO: 162285 - DNA, 30 bp, Artificial Sequence
  Description of Artificial Sequence: Synthetic oligonucleotide
ggagggacctacagatgctttggctctttc

SEQ ID NO: 162286 - DNA, 30 bp, Artificial Sequence
  Description of Artificial Sequence: Synthetic oligonucleotide
gagggacctacagatgctttggctctttcc

SEQ ID NO: 162287 - DNA, 30 bp, Artificial Sequence
  Description of Artificial Sequence: Synthetic oligonucleotide
agggacctacagatgctttggctctttccg

SEQ ID NO: 162288 - DNA, 29 bp, Artificial Sequence
  Description of Artificial Sequence: Synthetic oligonucleotide
gggacctacagatgctttggctctttccg

SEQ ID NO: 162289 - DNA, 30 bp, Artificial Sequence
  Description of Artificial Sequence: Synthetic oligonucleotide
ggacctacagatgctttggctctttccgtg

SEQ ID NO: 162290 - DNA, 31 bp, Artificial Sequence
  Description of Artificial Sequence: Synthetic oligonucleotide
gacctacagatgctttggctctttccgtgac

SEQ ID NO: 162291 - DNA, 31 bp, Artificial Sequence
  Description of Artificial Sequence: Synthetic oligonucleotide
acctacagatgctttggctctttccgtgacg

SEQ ID NO: 162292 - DNA, 30 bp, Artificial Sequence
  Description of Artificial Sequence: Synthetic oligonucleotide
cctacagatgctttggctctttccgtgacg

SEQ ID NO: 162293 - DNA, 30 bp, Artificial Sequence
  Description of Artificial Sequence: Synthetic oligonucleotide
ctacagatgctttggctctttccgtgacgc

SEQ ID NO: 162294 - DNA, 31 bp, Artificial Sequence
  Description of Artificial Sequence: Synthetic oligonucleotide
tacagatgctttggctctttccgtgacgctc

SEQ ID NO: 162295 - DNA, 30 bp, Artificial Sequence
  Description of Artificial Sequence: Synthetic oligonucleotide
acagatgctttggctctttccgtgacgctc

SEQ ID NO: 162296 - DNA, 29 bp, Artificial Sequence
  Description of Artificial Sequence: Synthetic oligonucleotide
cagatgctttggctctttccgtgacgctc

SEQ ID NO: 162297 - DNA, 29 bp, Artificial Sequence
  Description of Artificial Sequence: Synthetic oligonucleotide
agatgctttggctctttccgtgacgctcc

SEQ ID NO: 162298 - DNA, 28 bp, Artificial Sequence
  Description of Artificial Sequence: Synthetic oligonucleotide
gatgctttggctctttccgtgacgctcc

SEQ ID NO: 162299 - DNA, 28 bp, Artificial Sequence
  Description of Artificial Sequence: Synthetic oligonucleotide
atgctttggctctttccgtgacgctccc

SEQ ID NO: 162300 - DNA, 27 bp, Artificial Sequence
  Description of Artificial Sequence: Synthetic oligonucleotide
tgctttggctctttccgtgacgctccc

SEQ ID NO: 162301 - DNA, 27 bp, Artificial Sequence
  Description of Artificial Sequence: Synthetic oligonucleotide
gctttggctctttccgtgacgctccct

SEQ ID NO: 162302 - DNA, 28 bp, Artificial Sequence
  Description of Artificial Sequence: Synthetic oligonucleotide
ctttggctctttccgtgacgctccctac

SEQ ID NO: 162303 - DNA, 28 bp, Artificial Sequence
  Description of Artificial Sequence: Synthetic oligonucleotide
tttggctctttccgtgacgctccctacg

SEQ ID NO: 162304 - DNA, 27 bp, Artificial Sequence
  Description of Artificial Sequence: Synthetic oligonucleotide
ttggctctttccgtgacgctccctacg

SEQ ID NO: 162305 - DNA, 27 bp, Artificial Sequence
  Description of Artificial Sequence: Synthetic oligonucleotide
tggctctttccgtgacgctccctacga

SEQ ID NO: 162306 - DNA, 23 bp, Artificial Sequence
  Description of Artificial Sequence: Synthetic oligonucleotide
agggggcctggccacaggaggaa

SEQ ID NO: 162307 - DNA, 22 bp, Artificial Sequence
  Description of Artificial Sequence: Synthetic oligonucleotide
gggggcctggccacaggaggaa

SEQ ID NO: 162308 - DNA, 23 bp, Artificial Sequence
  Description of Artificial Sequence: Synthetic oligonucleotide
ggggcctggccacaggaggaagt

SEQ ID NO: 162309 - DNA, 23 bp, Artificial Sequence
  Description of Artificial Sequence: Synthetic oligonucleotide
gggcctggccacaggaggaagtc

SEQ ID NO: 162310 - DNA, 24 bp, Artificial Sequence
  Description of Artificial Sequence: Synthetic oligonucleotide
ggcctggccacaggaggaagtcca

SEQ ID NO: 162311 - DNA, 25 bp, Artificial Sequence
  Description of Artificial Sequence: Synthetic oligonucleotide
gcctggccacaggaggaagtccaca

SEQ ID NO: 162312 - DNA, 27 bp, Artificial Sequence
  Description of Artificial Sequence: Synthetic oligonucleotide
cctggccacaggaggaagtccacagaa

SEQ ID NO: 162313 - DNA, 29 bp, Artificial Sequence
  Description of Artificial Sequence: Synthetic oligonucleotide
ctggccacaggaggaagtccacagaaaac

SEQ ID NO: 162314 - DNA, 29 bp, Artificial Sequence
  Description of Artificial Sequence: Synthetic oligonucleotide
tggccacaggaggaagtccacagaaaacc

SEQ ID NO: 162315 - DNA, 28 bp, Artificial Sequence
  Description of Artificial Sequence: Synthetic oligonucleotide
ggccacaggaggaagtccacagaaaacc

SEQ ID NO: 162316 - DNA, 30 bp, Artificial Sequence
  Description of Artificial Sequence: Synthetic oligonucleotide
gccacaggaggaagtccacagaaaaccttc

SEQ ID NO: 162317 - DNA, 30 bp, Artificial Sequence
  Description of Artificial Sequence: Synthetic oligonucleotide
ccacaggaggaagtccacagaaaaccttcc

SEQ ID NO: 162318 - DNA, 32 bp, Artificial Sequence
  Description of Artificial Sequence: Synthetic oligonucleotide
cacaggaggaagtccacagaaaaccttccttc

SEQ ID NO: 162319 - DNA, 32 bp, Artificial Sequence
  Description of Artificial Sequence: Synthetic oligonucleotide
acaggaggaagtccacagaaaaccttccttcc

SEQ ID NO: 162320 - DNA, 31 bp, Artificial Sequence
  Description of Artificial Sequence: Synthetic oligonucleotide
caggaggaagtccacagaaaaccttccttcc

SEQ ID NO: 162321 - DNA, 32 bp, Artificial Sequence
  Description of Artificial Sequence: Synthetic oligonucleotide
aggaggaagtccacagaaaaccttccttcctg

SEQ ID NO: 162322 - DNA, 31 bp, Artificial Sequence
  Description of Artificial Sequence: Synthetic oligonucleotide
ggaggaagtccacagaaaaccttccttcctg

SEQ ID NO: 162323 - DNA, 31 bp, Artificial Sequence
  Description of Artificial Sequence: Synthetic oligonucleotide
gaggaagtccacagaaaaccttccttcctgg

SEQ ID NO: 162324 - DNA, 31 bp, Artificial Sequence
  Description of Artificial Sequence: Synthetic oligonucleotide
aggaagtccacagaaaaccttccttcctggc

SEQ ID NO: 162325 - DNA, 30 bp, Artificial Sequence
  Description of Artificial Sequence: Synthetic oligonucleotide
ggaagtccacagaaaaccttccttcctggc

SEQ ID NO: 162326 - DNA, 30 bp, Artificial Sequence
  Description of Artificial Sequence: Synthetic oligonucleotide
gaagtccacagaaaaccttccttcctggcc

SEQ ID NO: 162327 - DNA, 30 bp, Artificial Sequence
  Description of Artificial Sequence: Synthetic oligonucleotide
aagtccacagaaaaccttccttcctggccc

SEQ ID NO: 162328 - DNA, 31 bp, Artificial Sequence
  Description of Artificial Sequence: Synthetic oligonucleotide
tccattggtcccatgatgcctgtccttgaag

SEQ ID NO: 162329 - DNA, 30 bp, Artificial Sequence
  Description of Artificial Sequence: Synthetic oligonucleotide
ccattggtcccatgatgcctgtccttgaag

SEQ ID NO: 162330 - DNA, 30 bp, Artificial Sequence
  Description of Artificial Sequence: Synthetic oligonucleotide
cattggtcccatgatgcctgtccttgaagg

SEQ ID NO: 162331 - DNA, 32 bp, Artificial Sequence
  Description of Artificial Sequence: Synthetic oligonucleotide
attggtcccatgatgcctgtccttgaaggaac

SEQ ID NO: 162332 - DNA, 31 bp, Artificial Sequence
  Description of Artificial Sequence: Synthetic oligonucleotide
ttggtcccatgatgcctgtccttgaaggaac

SEQ ID NO: 162333 - DNA, 30 bp, Artificial Sequence
  Description of Artificial Sequence: Synthetic oligonucleotide
tggtcccatgatgcctgtccttgaaggaac

SEQ ID NO: 162334 - DNA, 29 bp, Artificial Sequence
  Description of Artificial Sequence: Synthetic oligonucleotide
ggtcccatgatgcctgtccttgaaggaac

SEQ ID NO: 162335 - DNA, 29 bp, Artificial Sequence
  Description of Artificial Sequence: Synthetic oligonucleotide
gtcccatgatgcctgtccttgaaggaacc

SEQ ID NO: 162336 - DNA, 31 bp, Artificial Sequence
  Description of Artificial Sequence: Synthetic oligonucleotide
tcccatgatgcctgtccttgaaggaacctac

SEQ ID NO: 162337 - DNA, 30 bp, Artificial Sequence
  Description of Artificial Sequence: Synthetic oligonucleotide
cccatgatgcctgtccttgaaggaacctac

SEQ ID NO: 162338 - DNA, 31 bp, Artificial Sequence
  Description of Artificial Sequence: Synthetic oligonucleotide
ccatgatgcctgtccttgaaggaacctacag

SEQ ID NO: 162339 - DNA, 33 bp, Artificial Sequence
  Description of Artificial Sequence: Synthetic oligonucleotide
catgatgcctgtccttgaaggaacctacagatg

SEQ ID NO: 162340 - DNA, 33 bp, Artificial Sequence
  Description of Artificial Sequence: Synthetic oligonucleotide
atgatgcctgtccttgaaggaacctacagatgc

SEQ ID NO: 162341 - DNA, 32 bp, Artificial Sequence
  Description of Artificial Sequence: Synthetic oligonucleotide
tgatgcctgtccttgaaggaacctacagatgc

SEQ ID NO: 162342 - DNA, 31 bp, Artificial Sequence
  Description of Artificial Sequence: Synthetic oligonucleotide
gatgcctgtccttgaaggaacctacagatgc

SEQ ID NO: 162343 - DNA, 33 bp, Artificial Sequence
  Description of Artificial Sequence: Synthetic oligonucleotide
atgcctgtccttgaaggaacctacagatgctac

SEQ ID NO: 162344 - DNA, 32 bp, Artificial Sequence
  Description of Artificial Sequence: Synthetic oligonucleotide
tgcctgtccttgaaggaacctacagatgctac

SEQ ID NO: 162345 - DNA, 31 bp, Artificial Sequence
  Description of Artificial Sequence: Synthetic oligonucleotide
gcctgtccttgaaggaacctacagatgctac

SEQ ID NO: 162346 - DNA, 31 bp, Artificial Sequence
  Description of Artificial Sequence: Synthetic oligonucleotide
cctgtccttgaaggaacctacagatgctacg

SEQ ID NO: 162347 - DNA, 31 bp, Artificial Sequence
  Description of Artificial Sequence: Synthetic oligonucleotide
ctgtccttgaaggaacctacagatgctacgg

SEQ ID NO: 162348 - DNA, 33 bp, Artificial Sequence
  Description of Artificial Sequence: Synthetic oligonucleotide
tgtccttgaaggaacctacagatgctacggttc

SEQ ID NO: 162349 - DNA, 32 bp, Artificial Sequence
  Description of Artificial Sequence: Synthetic oligonucleotide
gtccttgaaggaacctacagatgctacggttc

SEQ ID NO: 162350 - DNA, 33 bp, Artificial Sequence
  Description of Artificial Sequence: Synthetic oligonucleotide
tccttgaaggaacctacagatgctacggttctg

SEQ ID NO: 162351 - DNA, 32 bp, Artificial Sequence
  Description of Artificial Sequence: Synthetic oligonucleotide
ccttgaaggaacctacagatgctacggttctg

SEQ ID NO: 162352 - DNA, 34 bp, Artificial Sequence
  Description of Artificial Sequence: Synthetic oligonucleotide
cttgaaggaacctacagatgctacggttctgttc

SEQ ID NO: 162353 - DNA, 34 bp, Artificial Sequence
  Description of Artificial Sequence: Synthetic oligonucleotide
ttgaaggaacctacagatgctacggttctgttcc

SEQ ID NO: 162354 - DNA, 33 bp, Artificial Sequence
  Description of Artificial Sequence: Synthetic oligonucleotide
tgaaggaacctacagatgctacggttctgttcc

SEQ ID NO: 162355 - DNA, 32 bp, Artificial Sequence
  Description of Artificial Sequence: Synthetic oligonucleotide
gaaggaacctacagatgctacggttctgttcc

SEQ ID NO: 162356 - DNA, 33 bp, Artificial Sequence
  Description of Artificial Sequence: Synthetic oligonucleotide
aaggaacctacagatgctacggttctgttcctc

SEQ ID NO: 162357 - DNA, 21 bp, Artificial Sequence
  Description of Artificial Sequence: Synthetic oligonucleotide
gggcctggccacaggagggag

SEQ ID NO: 162358 - DNA, 21 bp, Artificial Sequence
  Description of Artificial Sequence: Synthetic oligonucleotide
ggcctggccacaggagggagc

SEQ ID NO: 162359 - DNA, 21 bp, Artificial Sequence
  Description of Artificial Sequence: Synthetic oligonucleotide
gcctggccacaggagggagcc

SEQ ID NO: 162360 - DNA, 22 bp, Artificial Sequence
  Description of Artificial Sequence: Synthetic oligonucleotide
cctggccacaggagggagccca

SEQ ID NO: 162361 - DNA, 23 bp, Artificial Sequence
  Description of Artificial Sequence: Synthetic oligonucleotide
ctggccacaggagggagcccaca

SEQ ID NO: 162362 - DNA, 27 bp, Artificial Sequence
  Description of Artificial Sequence: Synthetic oligonucleotide
tggccacaggagggagcccacagaaaa

SEQ ID NO: 162363 - DNA, 26 bp, Artificial Sequence
  Description of Artificial Sequence: Synthetic oligonucleotide
ggccacaggagggagcccacagaaaa

SEQ ID NO: 162364 - DNA, 26 bp, Artificial Sequence
  Description of Artificial Sequence: Synthetic oligonucleotide
gccacaggagggagcccacagaaaac

SEQ ID NO: 162365 - DNA, 27 bp, Artificial Sequence
  Description of Artificial Sequence: Synthetic oligonucleotide
ccacaggagggagcccacagaaaacct

SEQ ID NO: 162366 - DNA, 28 bp, Artificial Sequence
  Description of Artificial Sequence: Synthetic oligonucleotide
cacaggagggagcccacagaaaaccttc

SEQ ID NO: 162367 - DNA, 28 bp, Artificial Sequence
  Description of Artificial Sequence: Synthetic oligonucleotide
acaggagggagcccacagaaaaccttcc

SEQ ID NO: 162368 - DNA, 27 bp, Artificial Sequence
  Description of Artificial Sequence: Synthetic oligonucleotide
caggagggagcccacagaaaaccttcc

SEQ ID NO: 162369 - DNA, 29 bp, Artificial Sequence
  Description of Artificial Sequence: Synthetic oligonucleotide
aggagggagcccacagaaaaccttccttc

SEQ ID NO: 162370 - DNA, 28 bp, Artificial Sequence
  Description of Artificial Sequence: Synthetic oligonucleotide
ggagggagcccacagaaaaccttccttc

SEQ ID NO: 162371 - DNA, 28 bp, Artificial Sequence
  Description of Artificial Sequence: Synthetic oligonucleotide
gagggagcccacagaaaaccttccttcc

SEQ ID NO: 162372 - DNA, 29 bp, Artificial Sequence
  Description of Artificial Sequence: Synthetic oligonucleotide
agggagcccacagaaaaccttccttcctg

SEQ ID NO: 162373 - DNA, 28 bp, Artificial Sequence
  Description of Artificial Sequence: Synthetic oligonucleotide
gggagcccacagaaaaccttccttcctg

SEQ ID NO: 162374 - DNA, 28 bp, Artificial Sequence
  Description of Artificial Sequence: Synthetic oligonucleotide
ggagcccacagaaaaccttccttcctgg

SEQ ID NO: 162375 - DNA, 28 bp, Artificial Sequence
  Description of Artificial Sequence: Synthetic oligonucleotide
gagcccacagaaaaccttccttcctggc

SEQ ID NO: 162376 - DNA, 28 bp, Artificial Sequence
  Description of Artificial Sequence: Synthetic oligonucleotide
agcccacagaaaaccttccttcctggcc

SEQ ID NO: 162377 - DNA, 27 bp, Artificial Sequence
  Description of Artificial Sequence: Synthetic oligonucleotide
gcccacagaaaaccttccttcctggcc

SEQ ID NO: 162378 - DNA, 27 bp, Artificial Sequence
  Description of Artificial Sequence: Synthetic oligonucleotide
cccacagaaaaccttccttcctggccc

SEQ ID NO: 162379 - DNA, 27 bp, Artificial Sequence
  Description of Artificial Sequence: Synthetic oligonucleotide
tcggctctttccgtgacgctccctaca

SEQ ID NO: 162380 - DNA, 27 bp, Artificial Sequence
  Description of Artificial Sequence: Synthetic oligonucleotide
cggctctttccgtgacgctccctacaa

SEQ ID NO: 162381 - DNA, 27 bp, Artificial Sequence
  Description of Artificial Sequence: Synthetic oligonucleotide
ggctctttccgtgacgctccctacaag

SEQ ID NO: 162382 - DNA, 28 bp, Artificial Sequence
  Description of Artificial Sequence: Synthetic oligonucleotide
gctctttccgtgacgctccctacaagtg

SEQ ID NO: 162383 - DNA, 28 bp, Artificial Sequence
  Description of Artificial Sequence: Synthetic oligonucleotide
ctctttccgtgacgctccctacaagtgg

SEQ ID NO: 162384 - DNA, 29 bp, Artificial Sequence
  Description of Artificial Sequence: Synthetic oligonucleotide
tctttccgtgacgctccctacaagtggtc

SEQ ID NO: 162385 - DNA, 28 bp, Artificial Sequence
  Description of Artificial Sequence: Synthetic oligonucleotide
ctttccgtgacgctccctacaagtggtc

SEQ ID NO: 162386 - DNA, 31 bp, Artificial Sequence
  Description of Artificial Sequence: Synthetic oligonucleotide
tttccgtgacgctccctacaagtggtcaaac

SEQ ID NO: 162387 - DNA, 30 bp, Artificial Sequence
  Description of Artificial Sequence: Synthetic oligonucleotide
ttccgtgacgctccctacaagtggtcaaac

SEQ ID NO: 162388 - DNA, 29 bp, Artificial Sequence
  Description of Artificial Sequence: Synthetic oligonucleotide
tccgtgacgctccctacaagtggtcaaac

SEQ ID NO: 162389 - DNA, 28 bp, Artificial Sequence
  Description of Artificial Sequence: Synthetic oligonucleotide
ccgtgacgctccctacaagtggtcaaac

SEQ ID NO: 162390 - DNA, 29 bp, Artificial Sequence
  Description of Artificial Sequence: Synthetic oligonucleotide
cgtgacgctccctacaagtggtcaaactc

SEQ ID NO: 162391 - DNA, 29 bp, Artificial Sequence
  Description of Artificial Sequence: Synthetic oligonucleotide
gtgacgctccctacaagtggtcaaactcg

SEQ ID NO: 162392 - DNA, 30 bp, Artificial Sequence
  Description of Artificial Sequence: Synthetic oligonucleotide
tgacgctccctacaagtggtcaaactcgag

SEQ ID NO: 162393 - DNA, 29 bp, Artificial Sequence
  Description of Artificial Sequence: Synthetic oligonucleotide
gacgctccctacaagtggtcaaactcgag

SEQ ID NO: 162394 - DNA, 30 bp, Artificial Sequence
  Description of Artificial Sequence: Synthetic oligonucleotide
acgctccctacaagtggtcaaactcgagtg

SEQ ID NO: 162395 - DNA, 29 bp, Artificial Sequence
  Description of Artificial Sequence: Synthetic oligonucleotide
cgctccctacaagtggtcaaactcgagtg

SEQ ID NO: 162396 - DNA, 31 bp, Artificial Sequence
  Description of Artificial Sequence: Synthetic oligonucleotide
gctccctacaagtggtcaaactcgagtgatc

SEQ ID NO: 162397 - DNA, 31 bp, Artificial Sequence
  Description of Artificial Sequence: Synthetic oligonucleotide
ctccctacaagtggtcaaactcgagtgatcc

SEQ ID NO: 162398 - DNA, 32 bp, Artificial Sequence
  Description of Artificial Sequence: Synthetic oligonucleotide
tccctacaagtggtcaaactcgagtgatccac

SEQ ID NO: 162399 - DNA, 31 bp, Artificial Sequence
  Description of Artificial Sequence: Synthetic oligonucleotide
ccctacaagtggtcaaactcgagtgatccac

SEQ ID NO: 162400 - DNA, 32 bp, Artificial Sequence
  Description of Artificial Sequence: Synthetic oligonucleotide
cctacaagtggtcaaactcgagtgatccactg

SEQ ID NO: 162401 - DNA, 32 bp, Artificial Sequence
  Description of Artificial Sequence: Synthetic oligonucleotide
ctacaagtggtcaaactcgagtgatccactgc

SEQ ID NO: 162402 - DNA, 34 bp, Artificial Sequence
  Description of Artificial Sequence: Synthetic oligonucleotide
tacaagtggtcaaactcgagtgatccactgcttg

SEQ ID NO: 162403 - DNA, 33 bp, Artificial Sequence
  Description of Artificial Sequence: Synthetic oligonucleotide
acaagtggtcaaactcgagtgatccactgcttg

SEQ ID NO: 162404 - DNA, 32 bp, Artificial Sequence
  Description of Artificial Sequence: Synthetic oligonucleotide
caagtggtcaaactcgagtgatccactgcttg

SEQ ID NO: 162405 - DNA, 35 bp, Artificial Sequence
  Description of Artificial Sequence: Synthetic oligonucleotide
aagtggtcaaactcgagtgatccactgcttgtttc

SEQ ID NO: 162406 - DNA, 32 bp, Artificial Sequence
  Description of Artificial Sequence: Synthetic oligonucleotide
ttctccattggtcccatgatgcctgtcctttc

SEQ ID NO: 162407 - DNA, 31 bp, Artificial Sequence
  Description of Artificial Sequence: Synthetic oligonucleotide
tctccattggtcccatgatgcctgtcctttc

SEQ ID NO: 162408 - DNA, 30 bp, Artificial Sequence
  Description of Artificial Sequence: Synthetic oligonucleotide
ctccattggtcccatgatgcctgtcctttc

SEQ ID NO: 162409 - DNA, 31 bp, Artificial Sequence
  Description of Artificial Sequence: Synthetic oligonucleotide
tccattggtcccatgatgcctgtcctttcag

SEQ ID NO: 162410 - DNA, 30 bp, Artificial Sequence
  Description of Artificial Sequence: Synthetic oligonucleotide
ccattggtcccatgatgcctgtcctttcag

SEQ ID NO: 162411 - DNA, 30 bp, Artificial Sequence
  Description of Artificial Sequence: Synthetic oligonucleotide
cattggtcccatgatgcctgtcctttcagg

SEQ ID NO: 162412 - DNA, 32 bp, Artificial Sequence
  Description of Artificial Sequence: Synthetic oligonucleotide
attggtcccatgatgcctgtcctttcaggaac

SEQ ID NO: 162413 - DNA, 31 bp, Artificial Sequence
  Description of Artificial Sequence: Synthetic oligonucleotide
ttggtcccatgatgcctgtcctttcaggaac

SEQ ID NO: 162414 - DNA, 30 bp, Artificial Sequence
  Description of Artificial Sequence: Synthetic oligonucleotide
tggtcccatgatgcctgtcctttcaggaac

SEQ ID NO: 162415 - DNA, 29 bp, Artificial Sequence
  Description of Artificial Sequence: Synthetic oligonucleotide
ggtcccatgatgcctgtcctttcaggaac

SEQ ID NO: 162416 - DNA, 29 bp, Artificial Sequence
  Description of Artificial Sequence: Synthetic oligonucleotide
gtcccatgatgcctgtcctttcaggaacc

SEQ ID NO: 162417 - DNA, 31 bp, Artificial Sequence
  Description of Artificial Sequence: Synthetic oligonucleotide
tcccatgatgcctgtcctttcaggaacctac

SEQ ID NO: 162418 - DNA, 30 bp, Artificial Sequence
  Description of Artificial Sequence: Synthetic oligonucleotide
cccatgatgcctgtcctttcaggaacctac

SEQ ID NO: 162419 - DNA, 31 bp, Artificial Sequence
  Description of Artificial Sequence: Synthetic oligonucleotide
ccatgatgcctgtcctttcaggaacctacag

SEQ ID NO: 162420 - DNA, 33 bp, Artificial Sequence
  Description of Artificial Sequence: Synthetic oligonucleotide
catgatgcctgtcctttcaggaacctacagatg

SEQ ID NO: 162421 - DNA, 33 bp, Artificial Sequence
  Description of Artificial Sequence: Synthetic oligonucleotide
atgatgcctgtcctttcaggaacctacagatgc

SEQ ID NO: 162422 - DNA, 32 bp, Artificial Sequence
  Description of Artificial Sequence: Synthetic oligonucleotide
tgatgcctgtcctttcaggaacctacagatgc

SEQ ID NO: 162423 - DNA, 31 bp, Artificial Sequence
  Description of Artificial Sequence: Synthetic oligonucleotide
gatgcctgtcctttcaggaacctacagatgc

SEQ ID NO: 162424 - DNA, 33 bp, Artificial Sequence
  Description of Artificial Sequence: Synthetic oligonucleotide
atgcctgtcctttcaggaacctacagatgctac

SEQ ID NO: 162425 - DNA, 32 bp, Artificial Sequence
  Description of Artificial Sequence: Synthetic oligonucleotide
tgcctgtcctttcaggaacctacagatgctac

SEQ ID NO: 162426 - DNA, 31 bp, Artificial Sequence
  Description of Artificial Sequence: Synthetic oligonucleotide
gcctgtcctttcaggaacctacagatgctac

SEQ ID NO: 162427 - DNA, 31 bp, Artificial Sequence
  Description of Artificial Sequence: Synthetic oligonucleotide
cctgtcctttcaggaacctacagatgctacg

SEQ ID NO: 162428 - DNA, 31 bp, Artificial Sequence
  Description of Artificial Sequence: Synthetic oligonucleotide
ctgtcctttcaggaacctacagatgctacgg

SEQ ID NO: 162429 - DNA, 33 bp, Artificial Sequence
  Description of Artificial Sequence: Synthetic oligonucleotide
tgtcctttcaggaacctacagatgctacggttc

SEQ ID NO: 162430 - DNA, 32 bp, Artificial Sequence
  Description of Artificial Sequence: Synthetic oligonucleotide
gtcctttcaggaacctacagatgctacggttc

SEQ ID NO: 162431 - DNA, 33 bp, Artificial Sequence
  Description of Artificial Sequence: Synthetic oligonucleotide
tcctttcaggaacctacagatgctacggttctg

SEQ ID NO: 162432 - DNA, 32 bp, Artificial Sequence
  Description of Artificial Sequence: Synthetic oligonucleotide
cctttcaggaacctacagatgctacggttctg

SEQ ID NO: 162433 - DNA, 34 bp, Artificial Sequence
  Description of Artificial Sequence: Synthetic oligonucleotide
ctttcaggaacctacagatgctacggttctgttc

SEQ ID NO: 162434 - DNA, 34 bp, Artificial Sequence
  Description of Artificial Sequence: Synthetic oligonucleotide
tttcaggaacctacagatgctacggttctgttcc

SEQ ID NO: 162435 - DNA, 33 bp, Artificial Sequence
  Description of Artificial Sequence: Synthetic oligonucleotide
ttcaggaacctacagatgctacggttctgttcc

SEQ ID NO: 162436 - DNA, 32 bp, Artificial Sequence
  Description of Artificial Sequence: Synthetic oligonucleotide
tcaggaacctacagatgctacggttctgttcc

SEQ ID NO: 162437 - DNA, 31 bp, Artificial Sequence
  Description of Artificial Sequence: Synthetic oligonucleotide
atgttgctcatggtcatcagcatggcgtgtg

SEQ ID NO: 162438 - DNA, 30 bp, Artificial Sequence
  Description of Artificial Sequence: Synthetic oligonucleotide
tgttgctcatggtcatcagcatggcgtgtg

SEQ ID NO: 162439 - DNA, 29 bp, Artificial Sequence
  Description of Artificial Sequence: Synthetic oligonucleotide
gttgctcatggtcatcagcatggcgtgtg

SEQ ID NO: 162440 - DNA, 31 bp, Artificial Sequence
  Description of Artificial Sequence: Synthetic oligonucleotide
ttgctcatggtcatcagcatggcgtgtgttg

SEQ ID NO: 162441 - DNA, 30 bp, Artificial Sequence
  Description of Artificial Sequence: Synthetic oligonucleotide
tgctcatggtcatcagcatggcgtgtgttg

SEQ ID NO: 162442 - DNA, 29 bp, Artificial Sequence
  Description of Artificial Sequence: Synthetic oligonucleotide
ctcatggtcatcagcatggcgtgtgttgc

SEQ ID NO: 162443 - DNA, 29 bp, Artificial Sequence
  Description of Artificial Sequence: Synthetic oligonucleotide
tcatggtcatcagcatggcgtgtgttgcg

SEQ ID NO: 162444 - DNA, 28 bp, Artificial Sequence
  Description of Artificial Sequence: Synthetic oligonucleotide
catggtcatcagcatggcgtgtgttgcg

SEQ ID NO: 162445 - DNA, 30 bp, Artificial Sequence
  Description of Artificial Sequence: Synthetic oligonucleotide
atggtcatcagcatggcgtgtgttgcgttc

SEQ ID NO: 162446 - DNA, 29 bp, Artificial Sequence
  Description of Artificial Sequence: Synthetic oligonucleotide
tggtcatcagcatggcgtgtgttgcgttc

SEQ ID NO: 162447 - DNA, 28 bp, Artificial Sequence
  Description of Artificial Sequence: Synthetic oligonucleotide
ggtcatcagcatggcgtgtgttgcgttc

SEQ ID NO: 162448 - DNA, 30 bp, Artificial Sequence
  Description of Artificial Sequence: Synthetic oligonucleotide
gtcatcagcatggcgtgtgttgcgttcttc

SEQ ID NO: 162449 - DNA, 32 bp, Artificial Sequence
  Description of Artificial Sequence: Synthetic oligonucleotide
tcatcagcatggcgtgtgttgcgttcttcttg

SEQ ID NO: 162450 - DNA, 31 bp, Artificial Sequence
  Description of Artificial Sequence: Synthetic oligonucleotide
catcagcatggcgtgtgttgcgttcttcttg

SEQ ID NO: 162451 - DNA, 31 bp, Artificial Sequence
  Description of Artificial Sequence: Synthetic oligonucleotide
atcagcatggcgtgtgttgcgttcttcttgc

SEQ ID NO: 162452 - DNA, 30 bp, Artificial Sequence
  Description of Artificial Sequence: Synthetic oligonucleotide
tcagcatggcgtgtgttgcgttcttcttgc

SEQ ID NO: 162453 - DNA, 29 bp, Artificial Sequence
  Description of Artificial Sequence: Synthetic oligonucleotide
cagcatggcgtgtgttgcgttcttcttgc

SEQ ID NO: 162454 - DNA, 30 bp, Artificial Sequence
  Description of Artificial Sequence: Synthetic oligonucleotide
agcatggcgtgtgttgcgttcttcttgctg

SEQ ID NO: 162455 - DNA, 29 bp, Artificial Sequence
  Description of Artificial Sequence: Synthetic oligonucleotide
gcatggcgtgtgttgcgttcttcttgctg

SEQ ID NO: 162456 - DNA, 29 bp, Artificial Sequence
  Description of Artificial Sequence: Synthetic oligonucleotide
catggcgtgtgttgcgttcttcttgctgc

SEQ ID NO: 162457 - DNA, 30 bp, Artificial Sequence
  Description of Artificial Sequence: Synthetic oligonucleotide
atggcgtgtgttgcgttcttcttgctgcag

SEQ ID NO: 162458 - DNA, 29 bp, Artificial Sequence
  Description of Artificial Sequence: Synthetic oligonucleotide
tggcgtgtgttgcgttcttcttgctgcag

SEQ ID NO: 162459 - DNA, 28 bp, Artificial Sequence
  Description of Artificial Sequence: Synthetic oligonucleotide
ggcgtgtgttgcgttcttcttgctgcag

SEQ ID NO: 162460 - DNA, 28 bp, Artificial Sequence
  Description of Artificial Sequence: Synthetic oligonucleotide
gcgtgtgttgcgttcttcttgctgcagg

SEQ ID NO: 162461 - DNA, 28 bp, Artificial Sequence
  Description of Artificial Sequence: Synthetic oligonucleotide
cgtgtgttgcgttcttcttgctgcaggg

SEQ ID NO: 162462 - DNA, 28 bp, Artificial Sequence
  Description of Artificial Sequence: Synthetic oligonucleotide
gtgtgttgcgttcttcttgctgcagggg

SEQ ID NO: 162463 - DNA, 28 bp, Artificial Sequence
  Description of Artificial Sequence: Synthetic oligonucleotide
tgtgttgcgttcttcttgctgcaggggg

SEQ ID NO: 162464 - DNA, 27 bp, Artificial Sequence
  Description of Artificial Sequence: Synthetic oligonucleotide
gtgttgcgttcttcttgctgcaggggg

SEQ ID NO: 162465 - DNA, 27 bp, Artificial Sequence
  Description of Artificial Sequence: Synthetic oligonucleotide
tgttgcgttcttcttgctgcagggggc

SEQ ID NO: 162466 - DNA, 26 bp, Artificial Sequence
  Description of Artificial Sequence: Synthetic oligonucleotide
gttgcgttcttcttgctgcagggggc

SEQ ID NO: 162467 - DNA, 27 bp, Artificial Sequence
  Description of Artificial Sequence: Synthetic oligonucleotide
ttgcgttcttcttgctgcagggggcct

SEQ ID NO: 162468 - DNA, 26 bp, Artificial Sequence
  Description of Artificial Sequence: Synthetic oligonucleotide
tgcgttcttcttgctgcagggggcct

SEQ ID NO: 162469 - DNA, 25 bp, Artificial Sequence
  Description of Artificial Sequence: Synthetic oligonucleotide
gcgttcttcttgctgcagggggcct

SEQ ID NO: 162470 - DNA, 25 bp, Artificial Sequence
  Description of Artificial Sequence: Synthetic oligonucleotide
cgttcttcttgctgcagggggcctg

SEQ ID NO: 162471 - DNA, 31 bp, Artificial Sequence
  Description of Artificial Sequence: Synthetic oligonucleotide
ttccttctgcacagagaggggacgtttaacc

SEQ ID NO: 162472 - DNA, 30 bp, Artificial Sequence
  Description of Artificial Sequence: Synthetic oligonucleotide
tccttctgcacagagaggggacgtttaacc

SEQ ID NO: 162473 - DNA, 29 bp, Artificial Sequence
  Description of Artificial Sequence: Synthetic oligonucleotide
ccttctgcacagagaggggacgtttaacc

SEQ ID NO: 162474 - DNA, 30 bp, Artificial Sequence
  Description of Artificial Sequence: Synthetic oligonucleotide
cttctgcacagagaggggacgtttaaccac

SEQ ID NO: 162475 - DNA, 31 bp, Artificial Sequence
  Description of Artificial Sequence: Synthetic oligonucleotide
ttctgcacagagaggggacgtttaaccacac

SEQ ID NO: 162476 - DNA, 30 bp, Artificial Sequence
  Description of Artificial Sequence: Synthetic oligonucleotide
tctgcacagagaggggacgtttaaccacac

SEQ ID NO: 162477 - DNA, 29 bp, Artificial Sequence
  Description of Artificial Sequence: Synthetic oligonucleotide
ctgcacagagaggggacgtttaaccacac

SEQ ID NO: 162478 - DNA, 32 bp, Artificial Sequence
  Description of Artificial Sequence: Synthetic oligonucleotide
tgcacagagaggggacgtttaaccacactttg

SEQ ID NO: 162479 - DNA, 31 bp, Artificial Sequence
  Description of Artificial Sequence: Synthetic oligonucleotide
gcacagagaggggacgtttaaccacactttg

SEQ ID NO: 162480 - DNA, 31 bp, Artificial Sequence
  Description of Artificial Sequence: Synthetic oligonucleotide
cacagagaggggacgtttaaccacactttgc

SEQ ID NO: 162481 - DNA, 31 bp, Artificial Sequence
  Description of Artificial Sequence: Synthetic oligonucleotide
acagagaggggacgtttaaccacactttgcg

SEQ ID NO: 162482 - DNA, 30 bp, Artificial Sequence
  Description of Artificial Sequence: Synthetic oligonucleotide
cagagaggggacgtttaaccacactttgcg

SEQ ID NO: 162483 - DNA, 30 bp, Artificial Sequence
  Description of Artificial Sequence: Synthetic oligonucleotide
agagaggggacgtttaaccacactttgcgc

SEQ ID NO: 162484 - DNA, 29 bp, Artificial Sequence
  Description of Artificial Sequence: Synthetic oligonucleotide
gagaggggacgtttaaccacactttgcgc

SEQ ID NO: 162485 - DNA, 29 bp, Artificial Sequence
  Description of Artificial Sequence: Synthetic oligonucleotide
agaggggacgtttaaccacactttgcgcc

SEQ ID NO: 162486 - DNA, 28 bp, Artificial Sequence
  Description of Artificial Sequence: Synthetic oligonucleotide
gaggggacgtttaaccacactttgcgcc

SEQ ID NO: 162487 - DNA, 29 bp, Artificial Sequence
  Description of Artificial Sequence: Synthetic oligonucleotide
aggggacgtttaaccacactttgcgcctc

SEQ ID NO: 162488 - DNA, 28 bp, Artificial Sequence
  Description of Artificial Sequence: Synthetic oligonucleotide
ggggacgtttaaccacactttgcgcctc

SEQ ID NO: 162489 - DNA, 31 bp, Artificial Sequence
  Description of Artificial Sequence: Synthetic oligonucleotide
gggacgtttaaccacactttgcgcctcattg

SEQ ID NO: 162490 - DNA, 31 bp, Artificial Sequence
  Description of Artificial Sequence: Synthetic oligonucleotide
ggacgtttaaccacactttgcgcctcattgg

SEQ ID NO: 162491 - DNA, 32 bp, Artificial Sequence
  Description of Artificial Sequence: Synthetic oligonucleotide
gacgtttaaccacactttgcgcctcattggag

SEQ ID NO: 162492 - DNA, 33 bp, Artificial Sequence
  Description of Artificial Sequence: Synthetic oligonucleotide
acgtttaaccacactttgcgcctcattggagag

SEQ ID NO: 162493 - DNA, 32 bp, Artificial Sequence
  Description of Artificial Sequence: Synthetic oligonucleotide
cgtttaaccacactttgcgcctcattggagag

SEQ ID NO: 162494 - DNA, 32 bp, Artificial Sequence
  Description of Artificial Sequence: Synthetic oligonucleotide
gtttaaccacactttgcgcctcattggagagc

SEQ ID NO: 162495 - DNA, 33 bp, Artificial Sequence
  Description of Artificial Sequence: Synthetic oligonucleotide
tttaaccacactttgcgcctcattggagagcac

SEQ ID NO: 162496 - DNA, 32 bp, Artificial Sequence
  Description of Artificial Sequence: Synthetic oligonucleotide
ttaaccacactttgcgcctcattggagagcac

SEQ ID NO: 162497 - DNA, 31 bp, Artificial Sequence
  Description of Artificial Sequence: Synthetic oligonucleotide
taaccacactttgcgcctcattggagagcac

SEQ ID NO: 162498 - DNA, 30 bp, Artificial Sequence
  Description of Artificial Sequence: Synthetic oligonucleotide
aaccacactttgcgcctcattggagagcac

SEQ ID NO: 162499 - DNA, 29 bp, Artificial Sequence
  Description of Artificial Sequence: Synthetic oligonucleotide
accacactttgcgcctcattggagagcac

SEQ ID NO: 162500 - DNA, 28 bp, Artificial Sequence
  Description of Artificial Sequence: Synthetic oligonucleotide
ccacactttgcgcctcattggagagcac

SEQ ID NO: 162501 - DNA, 31 bp, Artificial Sequence
  Description of Artificial Sequence: Synthetic oligonucleotide
cacactttgcgcctcattggagagcacattg

SEQ ID NO: 162502 - DNA, 28 bp, Artificial Sequence
  Description of Artificial Sequence: Synthetic oligonucleotide
gagagcacattgatggggtctccaaggg

SEQ ID NO: 162503 - DNA, 28 bp, Artificial Sequence
  Description of Artificial Sequence: Synthetic oligonucleotide
agagcacattgatggggtctccaagggc

SEQ ID NO: 162504 - DNA, 27 bp, Artificial Sequence
  Description of Artificial Sequence: Synthetic oligonucleotide
gagcacattgatggggtctccaagggc

SEQ ID NO: 162505 - DNA, 29 bp, Artificial Sequence
  Description of Artificial Sequence: Synthetic oligonucleotide
agcacattgatggggtctccaagggcaac

SEQ ID NO: 162506 - DNA, 28 bp, Artificial Sequence
  Description of Artificial Sequence: Synthetic oligonucleotide
gcacattgatggggtctccaagggcaac

SEQ ID NO: 162507 - DNA, 30 bp, Artificial Sequence
  Description of Artificial Sequence: Synthetic oligonucleotide
cacattgatggggtctccaagggcaacttc

SEQ ID NO: 162508 - DNA, 31 bp, Artificial Sequence
  Description of Artificial Sequence: Synthetic oligonucleotide
acattgatggggtctccaagggcaacttctc

SEQ ID NO: 162509 - DNA, 30 bp, Artificial Sequence
  Description of Artificial Sequence: Synthetic oligonucleotide
cattgatggggtctccaagggcaacttctc

SEQ ID NO: 162510 - DNA, 30 bp, Artificial Sequence
  Description of Artificial Sequence: Synthetic oligonucleotide
attgatggggtctccaagggcaacttctcc

SEQ ID NO: 162511 - DNA, 29 bp, Artificial Sequence
  Description of Artificial Sequence: Synthetic oligonucleotide
ttgatggggtctccaagggcaacttctcc

SEQ ID NO: 162512 - DNA, 28 bp, Artificial Sequence
  Description of Artificial Sequence: Synthetic oligonucleotide
tgatggggtctccaagggcaacttctcc

SEQ ID NO: 162513 - DNA, 27 bp, Artificial Sequence
  Description of Artificial Sequence: Synthetic oligonucleotide
gatggggtctccaagggcaacttctcc

SEQ ID NO: 162514 - DNA, 29 bp, Artificial Sequence
  Description of Artificial Sequence: Synthetic oligonucleotide
atggggtctccaagggcaacttctccatc

SEQ ID NO: 162515 - DNA, 28 bp, Artificial Sequence
  Description of Artificial Sequence: Synthetic oligonucleotide
tggggtctccaagggcaacttctccatc

SEQ ID NO: 162516 - DNA, 27 bp, Artificial Sequence
  Description of Artificial Sequence: Synthetic oligonucleotide
ggggtctccaagggcaacttctccatc

SEQ ID NO: 162517 - DNA, 27 bp, Artificial Sequence
  Description of Artificial Sequence: Synthetic oligonucleotide
gggtctccaagggcaacttctccatcg

SEQ ID NO: 162518 - DNA, 27 bp, Artificial Sequence
  Description of Artificial Sequence: Synthetic oligonucleotide
ggtctccaagggcaacttctccatcgg

SEQ ID NO: 162519 - DNA, 28 bp, Artificial Sequence
  Description of Artificial Sequence: Synthetic oligonucleotide
gtctccaagggcaacttctccatcggtc

SEQ ID NO: 162520 - DNA, 28 bp, Artificial Sequence
  Description of Artificial Sequence: Synthetic oligonucleotide
tctccaagggcaacttctccatcggtcg

SEQ ID NO: 162521 - DNA, 27 bp, Artificial Sequence
  Description of Artificial Sequence: Synthetic oligonucleotide
ctccaagggcaacttctccatcggtcg

SEQ ID NO: 162522 - DNA, 27 bp, Artificial Sequence
  Description of Artificial Sequence: Synthetic oligonucleotide
tccaagggcaacttctccatcggtcgc

SEQ ID NO: 162523 - DNA, 27 bp, Artificial Sequence
  Description of Artificial Sequence: Synthetic oligonucleotide
ccaagggcaacttctccatcggtcgca

SEQ ID NO: 162524 - DNA, 28 bp, Artificial Sequence
  Description of Artificial Sequence: Synthetic oligonucleotide
caagggcaacttctccatcggtcgcatg

SEQ ID NO: 162525 - DNA, 29 bp, Artificial Sequence
  Description of Artificial Sequence: Synthetic oligonucleotide
aagggcaacttctccatcggtcgcatgac

SEQ ID NO: 162526 - DNA, 28 bp, Artificial Sequence
  Description of Artificial Sequence: Synthetic oligonucleotide
agggcaacttctccatcggtcgcatgac

SEQ ID NO: 162527 - DNA, 27 bp, Artificial Sequence
  Description of Artificial Sequence: Synthetic oligonucleotide
gggcaacttctccatcggtcgcatgac

SEQ ID NO: 162528 - DNA, 28 bp, Artificial Sequence
  Description of Artificial Sequence: Synthetic oligonucleotide
ggcaacttctccatcggtcgcatgacac

SEQ ID NO: 162529 - DNA, 30 bp, Artificial Sequence
  Description of Artificial Sequence: Synthetic oligonucleotide
gcaacttctccatcggtcgcatgacacaag

SEQ ID NO: 162530 - DNA, 31 bp, Artificial Sequence
  Description of Artificial Sequence: Synthetic oligonucleotide
caacttctccatcggtcgcatgacacaagac

SEQ ID NO: 162531 - DNA, 31 bp, Artificial Sequence
  Description of Artificial Sequence: Synthetic oligonucleotide
aacttctccatcggtcgcatgacacaagacc

SEQ ID NO: 162532 - DNA, 30 bp, Artificial Sequence
  Description of Artificial Sequence: Synthetic oligonucleotide
acttctccatcggtcgcatgacacaagacc

SEQ ID NO: 162533 - DNA, 29 bp, Artificial Sequence
  Description of Artificial Sequence: Synthetic oligonucleotide
cttctccatcggtcgcatgacacaagacc

SEQ ID NO: 162534 - DNA, 30 bp, Artificial Sequence
  Description of Artificial Sequence: Synthetic oligonucleotide
ttctccatcggtcgcatgacacaagacctg

SEQ ID NO: 162535 - DNA, 29 bp, Artificial Sequence
  Description of Artificial Sequence: Synthetic oligonucleotide
tctccatcggtcgcatgacacaagacctg

SEQ ID NO: 162536 - DNA, 28 bp, Artificial Sequence
  Description of Artificial Sequence: Synthetic oligonucleotide
ctccatcggtcgcatgacacaagacctg

SEQ ID NO: 162537 - DNA, 28 bp, Artificial Sequence
  Description of Artificial Sequence: Synthetic oligonucleotide
tccatcggtcgcatgacacaagacctgg

SEQ ID NO: 162538 - DNA, 27 bp, Artificial Sequence
  Description of Artificial Sequence: Synthetic oligonucleotide
ccatcggtcgcatgacacaagacctgg

SEQ ID NO: 162539 - DNA, 27 bp, Artificial Sequence
  Description of Artificial Sequence: Synthetic oligonucleotide
catcggtcgcatgacacaagacctggc

SEQ ID NO: 162540 - DNA, 28 bp, Artificial Sequence
  Description of Artificial Sequence: Synthetic oligonucleotide
atcggtcgcatgacacaagacctggcag

SEQ ID NO: 162541 - DNA, 27 bp, Artificial Sequence
  Description of Artificial Sequence: Synthetic oligonucleotide
tcggtcgcatgacacaagacctggcag

SEQ ID NO: 162542 - DNA, 26 bp, Artificial Sequence
  Description of Artificial Sequence: Synthetic oligonucleotide
cggtcgcatgacacaagacctggcag

SEQ ID NO: 162543 - DNA, 26 bp, Artificial Sequence
  Description of Artificial Sequence: Synthetic oligonucleotide
ggtcgcatgacacaagacctggcagg

SEQ ID NO: 162544 - DNA, 27 bp, Artificial Sequence
  Description of Artificial Sequence: Synthetic oligonucleotide
gtcgcatgacacaagacctggcaggga

SEQ ID NO: 162545 - DNA, 27 bp, Artificial Sequence
  Description of Artificial Sequence: Synthetic oligonucleotide
tcgcatgacacaagacctggcagggac

SEQ ID NO: 162546 - DNA, 26 bp, Artificial Sequence
  Description of Artificial Sequence: Synthetic oligonucleotide
cgcatgacacaagacctggcagggac

SEQ ID NO: 162547 - DNA, 27 bp, Artificial Sequence
  Description of Artificial Sequence: Synthetic oligonucleotide
gcatgacacaagacctggcagggacct

SEQ ID NO: 162548 - DNA, 28 bp, Artificial Sequence
  Description of Artificial Sequence: Synthetic oligonucleotide
catgacacaagacctggcagggacctac

SEQ ID NO: 162549 - DNA, 29 bp, Artificial Sequence
  Description of Artificial Sequence: Synthetic oligonucleotide
atgacacaagacctggcagggacctacag

SEQ ID NO: 162550 - DNA, 28 bp, Artificial Sequence
  Description of Artificial Sequence: Synthetic oligonucleotide
tgacacaagacctggcagggacctacag

SEQ ID NO: 162551 - DNA, 27 bp, Artificial Sequence
  Description of Artificial Sequence: Synthetic oligonucleotide
gacacaagacctggcagggacctacag

SEQ ID NO: 162552 - DNA, 29 bp, Artificial Sequence
  Description of Artificial Sequence: Synthetic oligonucleotide
acacaagacctggcagggacctacagatg

SEQ ID NO: 162553 - DNA, 28 bp, Artificial Sequence
  Description of Artificial Sequence: Synthetic oligonucleotide
cacaagacctggcagggacctacagatg

SEQ ID NO: 162554 - DNA, 28 bp, Artificial Sequence
  Description of Artificial Sequence: Synthetic oligonucleotide
acaagacctggcagggacctacagatgc

SEQ ID NO: 162555 - DNA, 31 bp, Artificial Sequence
  Description of Artificial Sequence: Synthetic oligonucleotide
tgttactcactccccctatcagttgtcagcg

SEQ ID NO: 162556 - DNA, 30 bp, Artificial Sequence
  Description of Artificial Sequence: Synthetic oligonucleotide
gttactcactccccctatcagttgtcagcg

SEQ ID NO: 162557 - DNA, 30 bp, Artificial Sequence
  Description of Artificial Sequence: Synthetic oligonucleotide
ttactcactccccctatcagttgtcagcgc

SEQ ID NO: 162558 - DNA, 29 bp, Artificial Sequence
  Description of Artificial Sequence: Synthetic oligonucleotide
tactcactccccctatcagttgtcagcgc

SEQ ID NO: 162559 - DNA, 28 bp, Artificial Sequence
  Description of Artificial Sequence: Synthetic oligonucleotide
actcactccccctatcagttgtcagcgc

SEQ ID NO: 162560 - DNA, 27 bp, Artificial Sequence
  Description of Artificial Sequence: Synthetic oligonucleotide
ctcactccccctatcagttgtcagcgc

SEQ ID NO: 162561 - DNA, 27 bp, Artificial Sequence
  Description of Artificial Sequence: Synthetic oligonucleotide
tcactccccctatcagttgtcagcgcc

SEQ ID NO: 162562 - DNA, 26 bp, Artificial Sequence
  Description of Artificial Sequence: Synthetic oligonucleotide
cactccccctatcagttgtcagcgcc

SEQ ID NO: 162563 - DNA, 27 bp, Artificial Sequence
  Description of Artificial Sequence: Synthetic oligonucleotide
actccccctatcagttgtcagcgccca

SEQ ID NO: 162564 - DNA, 26 bp, Artificial Sequence
  Description of Artificial Sequence: Synthetic oligonucleotide
ctccccctatcagttgtcagcgccca

SEQ ID NO: 162565 - DNA, 27 bp, Artificial Sequence
  Description of Artificial Sequence: Synthetic oligonucleotide
tccccctatcagttgtcagcgcccagt

SEQ ID NO: 162566 - DNA, 26 bp, Artificial Sequence
  Description of Artificial Sequence: Synthetic oligonucleotide
ccccctatcagttgtcagcgcccagt

SEQ ID NO: 162567 - DNA, 27 bp, Artificial Sequence
  Description of Artificial Sequence: Synthetic oligonucleotide
cccctatcagttgtcagcgcccagtga

SEQ ID NO: 162568 - DNA, 27 bp, Artificial Sequence
  Description of Artificial Sequence: Synthetic oligonucleotide
ccctatcagttgtcagcgcccagtgac

SEQ ID NO: 162569 - DNA, 27 bp, Artificial Sequence
  Description of Artificial Sequence: Synthetic oligonucleotide
cctatcagttgtcagcgcccagtgacc

SEQ ID NO: 162570 - DNA, 27 bp, Artificial Sequence
  Description of Artificial Sequence: Synthetic oligonucleotide
ctatcagttgtcagcgcccagtgaccc

SEQ ID NO: 162571 - DNA, 28 bp, Artificial Sequence
  Description of Artificial Sequence: Synthetic oligonucleotide
tatcagttgtcagcgcccagtgaccctc

SEQ ID NO: 162572 - DNA, 27 bp, Artificial Sequence
  Description of Artificial Sequence: Synthetic oligonucleotide
atcagttgtcagcgcccagtgaccctc

SEQ ID NO: 162573 - DNA, 27 bp, Artificial Sequence
  Description of Artificial Sequence: Synthetic oligonucleotide
tcagttgtcagcgcccagtgaccctct

SEQ ID NO: 162574 - DNA, 26 bp, Artificial Sequence
  Description of Artificial Sequence: Synthetic oligonucleotide
cagttgtcagcgcccagtgaccctct

SEQ ID NO: 162575 - DNA, 26 bp, Artificial Sequence
  Description of Artificial Sequence: Synthetic oligonucleotide
agttgtcagcgcccagtgaccctctg

SEQ ID NO: 162576 - DNA, 25 bp, Artificial Sequence
  Description of Artificial Sequence: Synthetic oligonucleotide
gttgtcagcgcccagtgaccctctg

SEQ ID NO: 162577 - DNA, 26 bp, Artificial Sequence
  Description of Artificial Sequence: Synthetic oligonucleotide
ttgtcagcgcccagtgaccctctgga

SEQ ID NO: 162578 - DNA, 25 bp, Artificial Sequence
  Description of Artificial Sequence: Synthetic oligonucleotide
tgtcagcgcccagtgaccctctgga

SEQ ID NO: 162579 - DNA, 24 bp, Artificial Sequence
  Description of Artificial Sequence: Synthetic oligonucleotide
gtcagcgcccagtgaccctctgga

SEQ ID NO: 162580 - DNA, 26 bp, Artificial Sequence
  Description of Artificial Sequence: Synthetic oligonucleotide
tcagcgcccagtgaccctctggacat

SEQ ID NO: 162581 - DNA, 25 bp, Artificial Sequence
  Description of Artificial Sequence: Synthetic oligonucleotide
cagcgcccagtgaccctctggacat

SEQ ID NO: 162582 - DNA, 25 bp, Artificial Sequence
  Description of Artificial Sequence: Synthetic oligonucleotide
agcgcccagtgaccctctggacatc

SEQ ID NO: 162583 - DNA, 24 bp, Artificial Sequence
  Description of Artificial Sequence: Synthetic oligonucleotide
gcgcccagtgaccctctggacatc

SEQ ID NO: 162584 - DNA, 25 bp, Artificial Sequence
  Description of Artificial Sequence: Synthetic oligonucleotide
cgcccagtgaccctctggacatcgt

SEQ ID NO: 162585 - DNA, 27 bp, Artificial Sequence
  Description of Artificial Sequence: Synthetic oligonucleotide
gcccagtgaccctctggacatcgtgat

SEQ ID NO: 162586 - DNA, 37 bp, Artificial Sequence
  Description of Artificial Sequence: Synthetic oligonucleotide
atcgtgatcacaggtctatatgagaaaccttctctcc

SEQ ID NO: 162587 - DNA, 36 bp, Artificial Sequence
  Description of Artificial Sequence: Synthetic oligonucleotide
tcgtgatcacaggtctatatgagaaaccttctctcc

SEQ ID NO: 162588 - DNA, 35 bp, Artificial Sequence
  Description of Artificial Sequence: Synthetic oligonucleotide
cgtgatcacaggtctatatgagaaaccttctctcc

SEQ ID NO: 162589 - DNA, 35 bp, Artificial Sequence
  Description of Artificial Sequence: Synthetic oligonucleotide
gtgatcacaggtctatatgagaaaccttctctccc

SEQ ID NO: 162590 - DNA, 36 bp, Artificial Sequence
  Description of Artificial Sequence: Synthetic oligonucleotide
tgatcacaggtctatatgagaaaccttctctcccag

SEQ ID NO: 162591 - DNA, 35 bp, Artificial Sequence
  Description of Artificial Sequence: Synthetic oligonucleotide
gatcacaggtctatatgagaaaccttctctcccag

SEQ ID NO: 162592 - DNA, 35 bp, Artificial Sequence
  Description of Artificial Sequence: Synthetic oligonucleotide
atcacaggtctatatgagaaaccttctctcccagc

SEQ ID NO: 162593 - DNA, 34 bp, Artificial Sequence
  Description of Artificial Sequence: Synthetic oligonucleotide
tcacaggtctatatgagaaaccttctctcccagc

SEQ ID NO: 162594 - DNA, 33 bp, Artificial Sequence
  Description of Artificial Sequence: Synthetic oligonucleotide
cacaggtctatatgagaaaccttctctcccagc

SEQ ID NO: 162595 - DNA, 33 bp, Artificial Sequence
  Description of Artificial Sequence: Synthetic oligonucleotide
acaggtctatatgagaaaccttctctcccagcc

SEQ ID NO: 162596 - DNA, 32 bp, Artificial Sequence
  Description of Artificial Sequence: Synthetic oligonucleotide
caggtctatatgagaaaccttctctcccagcc

SEQ ID NO: 162597 - DNA, 32 bp, Artificial Sequence
  Description of Artificial Sequence: Synthetic oligonucleotide
aggtctatatgagaaaccttctctcccagccc

SEQ ID NO: 162598 - DNA, 31 bp, Artificial Sequence
  Description of Artificial Sequence: Synthetic oligonucleotide
ggtctatatgagaaaccttctctcccagccc

SEQ ID NO: 162599 - DNA, 32 bp, Artificial Sequence
  Description of Artificial Sequence: Synthetic oligonucleotide
gtctatatgagaaaccttctctcccagcccag

SEQ ID NO: 162600 - DNA, 32 bp, Artificial Sequence
  Description of Artificial Sequence: Synthetic oligonucleotide
tctatatgagaaaccttctctcccagcccagc

SEQ ID NO: 162601 - DNA, 31 bp, Artificial Sequence
  Description of Artificial Sequence: Synthetic oligonucleotide
ctatatgagaaaccttctctcccagcccagc

SEQ ID NO: 162602 - DNA, 31 bp, Artificial Sequence
  Description of Artificial Sequence: Synthetic oligonucleotide
tatatgagaaaccttctctcccagcccagcc

SEQ ID NO: 162603 - DNA, 30 bp, Artificial Sequence
  Description of Artificial Sequence: Synthetic oligonucleotide
atatgagaaaccttctctcccagcccagcc

SEQ ID NO: 162604 - DNA, 29 bp, Artificial Sequence
  Description of Artificial Sequence: Synthetic oligonucleotide
tatgagaaaccttctctcccagcccagcc

SEQ ID NO: 162605 - DNA, 28 bp, Artificial Sequence
  Description of Artificial Sequence: Synthetic oligonucleotide
atgagaaaccttctctcccagcccagcc

SEQ ID NO: 162606 - DNA, 27 bp, Artificial Sequence
  Description of Artificial Sequence: Synthetic oligonucleotide
tgagaaaccttctctcccagcccagcc

SEQ ID NO: 162607 - DNA, 26 bp, Artificial Sequence
  Description of Artificial Sequence: Synthetic oligonucleotide
gagaaaccttctctcccagcccagcc

SEQ ID NO: 162608 - DNA, 26 bp, Artificial Sequence
  Description of Artificial Sequence: Synthetic oligonucleotide
agaaaccttctctcccagcccagccg

SEQ ID NO: 162609 - DNA, 25 bp, Artificial Sequence
  Description of Artificial Sequence: Synthetic oligonucleotide
gaaaccttctctcccagcccagccg

SEQ ID NO: 162610 - DNA, 25 bp, Artificial Sequence
  Description of Artificial Sequence: Synthetic oligonucleotide
aaaccttctctcccagcccagccgg

SEQ ID NO: 162611 - DNA, 24 bp, Artificial Sequence
  Description of Artificial Sequence: Synthetic oligonucleotide
aaccttctctcccagcccagccgg

SEQ ID NO: 162612 - DNA, 23 bp, Artificial Sequence
  Description of Artificial Sequence: Synthetic oligonucleotide
accttctctcccagcccagccgg

SEQ ID NO: 162613 - DNA, 22 bp, Artificial Sequence
  Description of Artificial Sequence: Synthetic oligonucleotide
ccttctctcccagcccagccgg

SEQ ID NO: 162614 - DNA, 22 bp, Artificial Sequence
  Description of Artificial Sequence: Synthetic oligonucleotide
cttctctcccagcccagccggg

SEQ ID NO: 162615 - DNA, 22 bp, Artificial Sequence
  Description of Artificial Sequence: Synthetic oligonucleotide
ttctctcccagcccagccgggc

SEQ ID NO: 162616 - DNA, 21 bp, Artificial Sequence
  Description of Artificial Sequence: Synthetic oligonucleotide
tctctcccagcccagccgggc

SEQ ID NO: 162617 - DNA, 20 bp, Artificial Sequence
  Description of Artificial Sequence: Synthetic oligonucleotide
ctctcccagcccagccgggc

SEQ ID NO: 162618 - DNA, 20 bp, Artificial Sequence
  Description of Artificial Sequence: Synthetic oligonucleotide
tctcccagcccagccgggcc

SEQ ID NO: 162619 - DNA, 20 bp, Artificial Sequence
  Description of Artificial Sequence: Synthetic oligonucleotide
ctcccagcccagccgggcct

SEQ ID NO: 162620 - DNA, 20 bp, Artificial Sequence
  Description of Artificial Sequence: Synthetic oligonucleotide
tcccagcccagccgggccct

SEQ ID NO: 162621 - DNA, 20 bp, Artificial Sequence
  Description of Artificial Sequence: Synthetic oligonucleotide
cccagcccagccgggccctt

SEQ ID NO: 162622 - DNA, 20 bp, Artificial Sequence
  Description of Artificial Sequence: Synthetic oligonucleotide
ccagcccagccgggccccat

SEQ ID NO: 162623 - DNA, 25 bp, Artificial Sequence
  Description of Artificial Sequence: Synthetic oligonucleotide
ctccctgcagggcccaaggtcaaca

SEQ ID NO: 162624 - DNA, 27 bp, Artificial Sequence
  Description of Artificial Sequence: Synthetic oligonucleotide
tccctgcagggcccaaggtcaacagaa

SEQ ID NO: 162625 - DNA, 26 bp, Artificial Sequence
  Description of Artificial Sequence: Synthetic oligonucleotide
ccctgcagggcccaaggtcaacagaa

SEQ ID NO: 162626 - DNA, 27 bp, Artificial Sequence
  Description of Artificial Sequence: Synthetic oligonucleotide
cctgcagggcccaaggtcaacagaaca

SEQ ID NO: 162627 - DNA, 28 bp, Artificial Sequence
  Description of Artificial Sequence: Synthetic oligonucleotide
gcccaaggtcaacagaacattccaggcc

SEQ ID NO: 162628 - DNA, 28 bp, Artificial Sequence
  Description of Artificial Sequence: Synthetic oligonucleotide
cccaaggtcaacagaacattccaggccg

SEQ ID NO: 162629 - DNA, 29 bp, Artificial Sequence
  Description of Artificial Sequence: Synthetic oligonucleotide
ccaaggtcaacagaacattccaggccgac

SEQ ID NO: 162630 - DNA, 30 bp, Artificial Sequence
  Description of Artificial Sequence: Synthetic oligonucleotide
caaggtcaacagaacattccaggccgactc

SEQ ID NO: 162631 - DNA, 31 bp, Artificial Sequence
  Description of Artificial Sequence: Synthetic oligonucleotide
aaggtcaacagaacattccaggccgactctc

SEQ ID NO: 162632 - DNA, 30 bp, Artificial Sequence
  Description of Artificial Sequence: Synthetic oligonucleotide
aggtcaacagaacattccaggccgactctc

SEQ ID NO: 162633 - DNA, 29 bp, Artificial Sequence
  Description of Artificial Sequence: Synthetic oligonucleotide
ggtcaacagaacattccaggccgactctc

SEQ ID NO: 162634 - DNA, 29 bp, Artificial Sequence
  Description of Artificial Sequence: Synthetic oligonucleotide
gtcaacagaacattccaggccgactctcc

SEQ ID NO: 162635 - DNA, 30 bp, Artificial Sequence
  Description of Artificial Sequence: Synthetic oligonucleotide
tcaacagaacattccaggccgactctcctc

SEQ ID NO: 162636 - DNA, 29 bp, Artificial Sequence
  Description of Artificial Sequence: Synthetic oligonucleotide
caacagaacattccaggccgactctcctc

SEQ ID NO: 162637 - DNA, 30 bp, Artificial Sequence
  Description of Artificial Sequence: Synthetic oligonucleotide
aacagaacattccaggccgactctcctctg

SEQ ID NO: 162638 - DNA, 29 bp, Artificial Sequence
  Description of Artificial Sequence: Synthetic oligonucleotide
acagaacattccaggccgactctcctctg

SEQ ID NO: 162639 - DNA, 28 bp, Artificial Sequence
  Description of Artificial Sequence: Synthetic oligonucleotide
cagaacattccaggccgactctcctctg

SEQ ID NO: 162640 - DNA, 28 bp, Artificial Sequence
  Description of Artificial Sequence: Synthetic oligonucleotide
agaacattccaggccgactctcctctgg

SEQ ID NO: 162641 - DNA, 27 bp, Artificial Sequence
  Description of Artificial Sequence: Synthetic oligonucleotide
gaacattccaggccgactctcctctgg

SEQ ID NO: 162642 - DNA, 28 bp, Artificial Sequence
  Description of Artificial Sequence: Synthetic oligonucleotide
aacattccaggccgactctcctctggac

SEQ ID NO: 162643 - DNA, 27 bp, Artificial Sequence
  Description of Artificial Sequence: Synthetic oligonucleotide
acattccaggccgactctcctctggac

SEQ ID NO: 162644 - DNA, 26 bp, Artificial Sequence
  Description of Artificial Sequence: Synthetic oligonucleotide
cattccaggccgactctcctctggac

SEQ ID NO: 162645 - DNA, 26 bp, Artificial Sequence
  Description of Artificial Sequence: Synthetic oligonucleotide
attccaggccgactctcctctggacc

SEQ ID NO: 162646 - DNA, 25 bp, Artificial Sequence
  Description of Artificial Sequence: Synthetic oligonucleotide
ttccaggccgactctcctctggacc

SEQ ID NO: 162647 - DNA, 24 bp, Artificial Sequence
  Description of Artificial Sequence: Synthetic oligonucleotide
tccaggccgactctcctctggacc

SEQ ID NO: 162648 - DNA, 23 bp, Artificial Sequence
  Description of Artificial Sequence: Synthetic oligonucleotide
ccaggccgactctcctctggacc

SEQ ID NO: 162649 - DNA, 24 bp, Artificial Sequence
  Description of Artificial Sequence: Synthetic oligonucleotide
caggccgactctcctctggaccct

SEQ ID NO: 162650 - DNA, 24 bp, Artificial Sequence
  Description of Artificial Sequence: Synthetic oligonucleotide
aggccgactctcctctggaccctg

SEQ ID NO: 162651 - DNA, 23 bp, Artificial Sequence
  Description of Artificial Sequence: Synthetic oligonucleotide
ggccgactctcctctggaccctg

SEQ ID NO: 162652 - DNA, 23 bp, Artificial Sequence
  Description of Artificial Sequence: Synthetic oligonucleotide
gccgactctcctctggaccctgc

SEQ ID NO: 162653 - DNA, 24 bp, Artificial Sequence
  Description of Artificial Sequence: Synthetic oligonucleotide
ccgactctcctctggaccctgcca

SEQ ID NO: 162654 - DNA, 24 bp, Artificial Sequence
  Description of Artificial Sequence: Synthetic oligonucleotide
cgactctcctctggaccctgccac

SEQ ID NO: 162655 - DNA, 24 bp, Artificial Sequence
  Description of Artificial Sequence: Synthetic oligonucleotide
gactctcctctggaccctgccacc

SEQ ID NO: 162656 - DNA, 25 bp, Artificial Sequence
  Description of Artificial Sequence: Synthetic oligonucleotide
actctcctctggaccctgccaccca

SEQ ID NO: 162657 - DNA, 24 bp, Artificial Sequence
  Description of Artificial Sequence: Synthetic oligonucleotide
ctctcctctggaccctgccaccca

SEQ ID NO: 162658 - DNA, 24 bp, Artificial Sequence
  Description of Artificial Sequence: Synthetic oligonucleotide
tctcctctggaccctgccacccac

SEQ ID NO: 162659 - DNA, 23 bp, Artificial Sequence
  Description of Artificial Sequence: Synthetic oligonucleotide
ctcctctggaccctgccacccac

SEQ ID NO: 162660 - DNA, 22 bp, Artificial Sequence
  Description of Artificial Sequence: Synthetic oligonucleotide
tggaccctgccacccacggagg

SEQ ID NO: 162661 - DNA, 21 bp, Artificial Sequence
  Description of Artificial Sequence: Synthetic oligonucleotide
ggaccctgccacccacggagg

SEQ ID NO: 162662 - DNA, 21 bp, Artificial Sequence
  Description of Artificial Sequence: Synthetic oligonucleotide
gaccctgccacccacggaggg

SEQ ID NO: 162663 - DNA, 21 bp, Artificial Sequence
  Description of Artificial Sequence: Synthetic oligonucleotide
accctgccacccacggagggg

SEQ ID NO: 162664 - DNA, 20 bp, Artificial Sequence
  Description of Artificial Sequence: Synthetic oligonucleotide
ccctgccacccacggagggg

SEQ ID NO: 162665 - DNA, 20 bp, Artificial Sequence
  Description of Artificial Sequence: Synthetic oligonucleotide
cctgccacccacggaggggc

SEQ ID NO: 162666 - DNA, 22 bp, Artificial Sequence
  Description of Artificial Sequence: Synthetic oligonucleotide
ctgccacccacggaggggccta

SEQ ID NO: 162667 - DNA, 23 bp, Artificial Sequence
  Description of Artificial Sequence: Synthetic oligonucleotide
tgccacccacggaggggcctaca

SEQ ID NO: 162668 - DNA, 22 bp, Artificial Sequence
  Description of Artificial Sequence: Synthetic oligonucleotide
gccacccacggaggggcctaca

SEQ ID NO: 162669 - DNA, 24 bp, Artificial Sequence
  Description of Artificial Sequence: Synthetic oligonucleotide
ccacccacggaggggcctacagat

SEQ ID NO: 162670 - DNA, 24 bp, Artificial Sequence
  Description of Artificial Sequence: Synthetic oligonucleotide
cacccacggaggggcctacagatg

SEQ ID NO: 162671 - DNA, 26 bp, Artificial Sequence
  Description of Artificial Sequence: Synthetic oligonucleotide
acccacggaggggcctacagatgctt

SEQ ID NO: 162672 - DNA, 25 bp, Artificial Sequence
  Description of Artificial Sequence: Synthetic oligonucleotide
cccacggaggggcctacagatgctt

SEQ ID NO: 162673 - DNA, 25 bp, Artificial Sequence
  Description of Artificial Sequence: Synthetic oligonucleotide
ccacggaggggcctacagatgcttc

SEQ ID NO: 162674 - DNA, 25 bp, Artificial Sequence
  Description of Artificial Sequence: Synthetic oligonucleotide
cacggaggggcctacagatgcttcg

SEQ ID NO: 162675 - DNA, 25 bp, Artificial Sequence
  Description of Artificial Sequence: Synthetic oligonucleotide
acggaggggcctacagatgcttcgg

SEQ ID NO: 162676 - DNA, 24 bp, Artificial Sequence
  Description of Artificial Sequence: Synthetic oligonucleotide
cggaggggcctacagatgcttcgg

SEQ ID NO: 162677 - DNA, 25 bp, Artificial Sequence
  Description of Artificial Sequence: Synthetic oligonucleotide
ggaggggcctacagatgcttcggct

SEQ ID NO: 162678 - DNA, 27 bp, Artificial Sequence
  Description of Artificial Sequence: Synthetic oligonucleotide
gaggggcctacagatgcttcggctctt

SEQ ID NO: 162679 - DNA, 28 bp, Artificial Sequence
  Description of Artificial Sequence: Synthetic oligonucleotide
aggggcctacagatgcttcggctctttc

SEQ ID NO: 162680 - DNA, 27 bp, Artificial Sequence
  Description of Artificial Sequence: Synthetic oligonucleotide
ggggcctacagatgcttcggctctttc

SEQ ID NO: 162681 - DNA, 27 bp, Artificial Sequence
  Description of Artificial Sequence: Synthetic oligonucleotide
gggcctacagatgcttcggctctttcc

SEQ ID NO: 162682 - DNA, 27 bp, Artificial Sequence
  Description of Artificial Sequence: Synthetic oligonucleotide
ggcctacagatgcttcggctctttccg

SEQ ID NO: 162683 - DNA, 28 bp, Artificial Sequence
  Description of Artificial Sequence: Synthetic oligonucleotide
gcctacagatgcttcggctctttccgtg

SEQ ID NO: 162684 - DNA, 38 bp, Artificial Sequence
  Description of Artificial Sequence: Synthetic oligonucleotide
ccactgcttgtttctgtcacaggaaactcttcaaatag

SEQ ID NO: 162685 - DNA, 40 bp, Artificial Sequence
  Description of Artificial Sequence: Synthetic oligonucleotide
cactgcttgtttctgtcacaggaaactcttcaaatagttg

SEQ ID NO: 162686 - DNA, 40 bp, Artificial Sequence
  Description of Artificial Sequence: Synthetic oligonucleotide
actgcttgtttctgtcacaggaaactcttcaaatagttgg

SEQ ID NO: 162687 - DNA, 39 bp, Artificial Sequence
  Description of Artificial Sequence: Synthetic oligonucleotide
ctgcttgtttctgtcacaggaaactcttcaaatagttgg

SEQ ID NO: 162688 - DNA, 39 bp, Artificial Sequence
  Description of Artificial Sequence: Synthetic oligonucleotide
tgcttgtttctgtcacaggaaactcttcaaatagttggc

SEQ ID NO: 162689 - DNA, 38 bp, Artificial Sequence
  Description of Artificial Sequence: Synthetic oligonucleotide
gcttgtttctgtcacaggaaactcttcaaatagttggc

SEQ ID NO: 162690 - DNA, 38 bp, Artificial Sequence
  Description of Artificial Sequence: Synthetic oligonucleotide
cttgtttctgtcacaggaaactcttcaaatagttggcc

SEQ ID NO: 162691 - DNA, 40 bp, Artificial Sequence
  Description of Artificial Sequence: Synthetic oligonucleotide
ttgtttctgtcacaggaaactcttcaaatagttggccttc

SEQ ID NO: 162692 - DNA, 39 bp, Artificial Sequence
  Description of Artificial Sequence: Synthetic oligonucleotide
tgtttctgtcacaggaaactcttcaaatagttggccttc

SEQ ID NO: 162693 - DNA, 38 bp, Artificial Sequence
  Description of Artificial Sequence: Synthetic oligonucleotide
gtttctgtcacaggaaactcttcaaatagttggccttc

SEQ ID NO: 162694 - DNA, 39 bp, Artificial Sequence
  Description of Artificial Sequence: Synthetic oligonucleotide
tttctgtcacaggaaactcttcaaatagttggccttcac

SEQ ID NO: 162695 - DNA, 38 bp, Artificial Sequence
  Description of Artificial Sequence: Synthetic oligonucleotide
ttctgtcacaggaaactcttcaaatagttggccttcac

SEQ ID NO: 162696 - DNA, 37 bp, Artificial Sequence
  Description of Artificial Sequence: Synthetic oligonucleotide
tctgtcacaggaaactcttcaaatagttggccttcac

SEQ ID NO: 162697 - DNA, 36 bp, Artificial Sequence
  Description of Artificial Sequence: Synthetic oligonucleotide
ctgtcacaggaaactcttcaaatagttggccttcac

SEQ ID NO: 162698 - DNA, 36 bp, Artificial Sequence
  Description of Artificial Sequence: Synthetic oligonucleotide
tgtcacaggaaactcttcaaatagttggccttcacc

SEQ ID NO: 162699 - DNA, 35 bp, Artificial Sequence
  Description of Artificial Sequence: Synthetic oligonucleotide
gtcacaggaaactcttcaaatagttggccttcacc

SEQ ID NO: 162700 - DNA, 35 bp, Artificial Sequence
  Description of Artificial Sequence: Synthetic oligonucleotide
tcacaggaaactcttcaaatagttggccttcaccc

SEQ ID NO: 162701 - DNA, 34 bp, Artificial Sequence
  Description of Artificial Sequence: Synthetic oligonucleotide
cacaggaaactcttcaaatagttggccttcaccc

SEQ ID NO: 162702 - DNA, 35 bp, Artificial Sequence
  Description of Artificial Sequence: Synthetic oligonucleotide
acaggaaactcttcaaatagttggccttcacccac

SEQ ID NO: 162703 - DNA, 34 bp, Artificial Sequence
  Description of Artificial Sequence: Synthetic oligonucleotide
caggaaactcttcaaatagttggccttcacccac

SEQ ID NO: 162704 - DNA, 35 bp, Artificial Sequence
  Description of Artificial Sequence: Synthetic oligonucleotide
aggaaactcttcaaatagttggccttcacccactg

SEQ ID NO: 162705 - DNA, 34 bp, Artificial Sequence
  Description of Artificial Sequence: Synthetic oligonucleotide
ggaaactcttcaaatagttggccttcacccactg

SEQ ID NO: 162706 - DNA, 36 bp, Artificial Sequence
  Description of Artificial Sequence: Synthetic oligonucleotide
gaaactcttcaaatagttggccttcacccactgaac

SEQ ID NO: 162707 - DNA, 36 bp, Artificial Sequence
  Description of Artificial Sequence: Synthetic oligonucleotide
aaactcttcaaatagttggccttcacccactgaacc

SEQ ID NO: 162708 - DNA, 35 bp, Artificial Sequence
  Description of Artificial Sequence: Synthetic oligonucleotide
aactcttcaaatagttggccttcacccactgaacc

SEQ ID NO: 162709 - DNA, 34 bp, Artificial Sequence
  Description of Artificial Sequence: Synthetic oligonucleotide
actcttcaaatagttggccttcacccactgaacc

SEQ ID NO: 162710 - DNA, 33 bp, Artificial Sequence
  Description of Artificial Sequence: Synthetic oligonucleotide
ctcttcaaatagttggccttcacccactgaacc

SEQ ID NO: 162711 - DNA, 35 bp, Artificial Sequence
  Description of Artificial Sequence: Synthetic oligonucleotide
tcttcaaatagttggccttcacccactgaaccaag

SEQ ID NO: 162712 - DNA, 28 bp, Artificial Sequence
  Description of Artificial Sequence: Synthetic oligonucleotide
cgaaaccggtaaccccagacacctacac

SEQ ID NO: 162713 - DNA, 28 bp, Artificial Sequence
  Description of Artificial Sequence: Synthetic oligonucleotide
gaaaccggtaaccccagacacctacacg

SEQ ID NO: 162714 - DNA, 32 bp, Artificial Sequence
  Description of Artificial Sequence: Synthetic oligonucleotide
caaggtcaacagaacattccaggccgactttc

SEQ ID NO: 162715 - DNA, 32 bp, Artificial Sequence
  Description of Artificial Sequence: Synthetic oligonucleotide
aaggtcaacagaacattccaggccgactttcc

SEQ ID NO: 162716 - DNA, 31 bp, Artificial Sequence
  Description of Artificial Sequence: Synthetic oligonucleotide
aggtcaacagaacattccaggccgactttcc

SEQ ID NO: 162717 - DNA, 30 bp, Artificial Sequence
  Description of Artificial Sequence: Synthetic oligonucleotide
ggtcaacagaacattccaggccgactttcc

SEQ ID NO: 162718 - DNA, 31 bp, Artificial Sequence
  Description of Artificial Sequence: Synthetic oligonucleotide
gtcaacagaacattccaggccgactttcctc

SEQ ID NO: 162719 - DNA, 32 bp, Artificial Sequence
  Description of Artificial Sequence: Synthetic oligonucleotide
tcaacagaacattccaggccgactttcctctg

SEQ ID NO: 162720 - DNA, 31 bp, Artificial Sequence
  Description of Artificial Sequence: Synthetic oligonucleotide
caacagaacattccaggccgactttcctctg

SEQ ID NO: 162721 - DNA, 31 bp, Artificial Sequence
  Description of Artificial Sequence: Synthetic oligonucleotide
aacagaacattccaggccgactttcctctgg

SEQ ID NO: 162722 - DNA, 30 bp, Artificial Sequence
  Description of Artificial Sequence: Synthetic oligonucleotide
acagaacattccaggccgactttcctctgg

SEQ ID NO: 162723 - DNA, 29 bp, Artificial Sequence
  Description of Artificial Sequence: Synthetic oligonucleotide
cagaacattccaggccgactttcctctgg

SEQ ID NO: 162724 - DNA, 30 bp, Artificial Sequence
  Description of Artificial Sequence: Synthetic oligonucleotide
agaacattccaggccgactttcctctggac

SEQ ID NO: 162725 - DNA, 22 bp, Artificial Sequence
  Description of Artificial Sequence: Synthetic oligonucleotide
gaccctgccacccacggaggga

SEQ ID NO: 162726 - DNA, 22 bp, Artificial Sequence
  Description of Artificial Sequence: Synthetic oligonucleotide
accctgccacccacggagggac

SEQ ID NO: 162727 - DNA, 31 bp, Artificial Sequence
  Description of Artificial Sequence: Synthetic oligonucleotide
atgtcactcatggtcatcagcatggcgtgtg

SEQ ID NO: 162728 - DNA, 30 bp, Artificial Sequence
  Description of Artificial Sequence: Synthetic oligonucleotide
tgtcactcatggtcatcagcatggcgtgtg

SEQ ID NO: 162729 - DNA, 29 bp, Artificial Sequence
  Description of Artificial Sequence: Synthetic oligonucleotide
gtcactcatggtcatcagcatggcgtgtg

SEQ ID NO: 162730 - DNA, 31 bp, Artificial Sequence
  Description of Artificial Sequence: Synthetic oligonucleotide
tcactcatggtcatcagcatggcgtgtgttg

SEQ ID NO: 162731 - DNA, 30 bp, Artificial Sequence
  Description of Artificial Sequence: Synthetic oligonucleotide
cactcatggtcatcagcatggcgtgtgttg

SEQ ID NO: 162732 - DNA, 30 bp, Artificial Sequence
  Description of Artificial Sequence: Synthetic oligonucleotide
actcatggtcatcagcatggcgtgtgttgc

SEQ ID NO: 162733 - DNA, 29 bp, Artificial Sequence
  Description of Artificial Sequence: Synthetic oligonucleotide
atgtcgctcatggtcatcagcaaggcgtg

SEQ ID NO: 162734 - DNA, 28 bp, Artificial Sequence
  Description of Artificial Sequence: Synthetic oligonucleotide
tgtcgctcatggtcatcagcaaggcgtg

SEQ ID NO: 162735 - DNA, 27 bp, Artificial Sequence
  Description of Artificial Sequence: Synthetic oligonucleotide
gtcgctcatggtcatcagcaaggcgtg

SEQ ID NO: 162736 - DNA, 28 bp, Artificial Sequence
  Description of Artificial Sequence: Synthetic oligonucleotide
tcgctcatggtcatcagcaaggcgtgtg

SEQ ID NO: 162737 - DNA, 27 bp, Artificial Sequence
  Description of Artificial Sequence: Synthetic oligonucleotide
cgctcatggtcatcagcaaggcgtgtg

SEQ ID NO: 162738 - DNA, 29 bp, Artificial Sequence
  Description of Artificial Sequence: Synthetic oligonucleotide
gctcatggtcatcagcaaggcgtgtgttg

SEQ ID NO: 162739 - DNA, 29 bp, Artificial Sequence
  Description of Artificial Sequence: Synthetic oligonucleotide
ctcatggtcatcagcaaggcgtgtgttgc

SEQ ID NO: 162740 - DNA, 29 bp, Artificial Sequence
  Description of Artificial Sequence: Synthetic oligonucleotide
tcatggtcatcagcaaggcgtgtgttgcg

SEQ ID NO: 162741 - DNA, 28 bp, Artificial Sequence
  Description of Artificial Sequence: Synthetic oligonucleotide
catggtcatcagcaaggcgtgtgttgcg

SEQ ID NO: 162742 - DNA, 30 bp, Artificial Sequence
  Description of Artificial Sequence: Synthetic oligonucleotide
atggtcatcagcaaggcgtgtgttgcgttc

SEQ ID NO: 162743 - DNA, 29 bp, Artificial Sequence
  Description of Artificial Sequence: Synthetic oligonucleotide
tggtcatcagcaaggcgtgtgttgcgttc

SEQ ID NO: 162744 - DNA, 28 bp, Artificial Sequence
  Description of Artificial Sequence: Synthetic oligonucleotide
ggtcatcagcaaggcgtgtgttgcgttc

SEQ ID NO: 162745 - DNA, 30 bp, Artificial Sequence
  Description of Artificial Sequence: Synthetic oligonucleotide
gtcatcagcaaggcgtgtgttgcgttcttc

SEQ ID NO: 162746 - DNA, 32 bp, Artificial Sequence
  Description of Artificial Sequence: Synthetic oligonucleotide
tcatcagcaaggcgtgtgttgcgttcttcttg

SEQ ID NO: 162747 - DNA, 31 bp, Artificial Sequence
  Description of Artificial Sequence: Synthetic oligonucleotide
catcagcaaggcgtgtgttgcgttcttcttg

SEQ ID NO: 162748 - DNA, 31 bp, Artificial Sequence
  Description of Artificial Sequence: Synthetic oligonucleotide
atcagcaaggcgtgtgttgcgttcttcttgc

SEQ ID NO: 162749 - DNA, 30 bp, Artificial Sequence
  Description of Artificial Sequence: Synthetic oligonucleotide
tcagcaaggcgtgtgttgcgttcttcttgc

SEQ ID NO: 162750 - DNA, 29 bp, Artificial Sequence
  Description of Artificial Sequence: Synthetic oligonucleotide
cagcaaggcgtgtgttgcgttcttcttgc

SEQ ID NO: 162751 - DNA, 30 bp, Artificial Sequence
  Description of Artificial Sequence: Synthetic oligonucleotide
agcaaggcgtgtgttgcgttcttcttgctg

SEQ ID NO: 162752 - DNA, 29 bp, Artificial Sequence
  Description of Artificial Sequence: Synthetic oligonucleotide
gcaaggcgtgtgttgcgttcttcttgctg

SEQ ID NO: 162753 - DNA, 29 bp, Artificial Sequence
  Description of Artificial Sequence: Synthetic oligonucleotide
caaggcgtgtgttgcgttcttcttgctgc

SEQ ID NO: 162754 - DNA, 30 bp, Artificial Sequence
  Description of Artificial Sequence: Synthetic oligonucleotide
aaggcgtgtgttgcgttcttcttgctgcag

SEQ ID NO: 162755 - DNA, 29 bp, Artificial Sequence
  Description of Artificial Sequence: Synthetic oligonucleotide
aggcgtgtgttgcgttcttcttgctgcag

SEQ ID NO: 162756 - DNA, 28 bp, Artificial Sequence
  Description of Artificial Sequence: Synthetic oligonucleotide
accaaggtcaacggaacattccaggccg

SEQ ID NO: 162757 - DNA, 37 bp, Artificial Sequence
  Description of Artificial Sequence: Synthetic oligonucleotide
aacagaacagtgaacagggaggattctgatgaacaag

SEQ ID NO: 162758 - DNA, 36 bp, Artificial Sequence
  Description of Artificial Sequence: Synthetic oligonucleotide
acagaacagtgaacagggaggattctgatgaacaag

SEQ ID NO: 162759 - DNA, 35 bp, Artificial Sequence
  Description of Artificial Sequence: Synthetic oligonucleotide
cagaacagtgaacagggaggattctgatgaacaag

SEQ ID NO: 162760 - DNA, 36 bp, Artificial Sequence
  Description of Artificial Sequence: Synthetic oligonucleotide
agaacagtgaacagggaggattctgatgaacaagac

SEQ ID NO: 162761 - DNA, 35 bp, Artificial Sequence
  Description of Artificial Sequence: Synthetic oligonucleotide
gaacagtgaacagggaggattctgatgaacaagac

SEQ ID NO: 162762 - DNA, 35 bp, Artificial Sequence
  Description of Artificial Sequence: Synthetic oligonucleotide
aacagtgaacagggaggattctgatgaacaagacc

SEQ ID NO: 162763 - DNA, 34 bp, Artificial Sequence
  Description of Artificial Sequence: Synthetic oligonucleotide
acagtgaacagggaggattctgatgaacaagacc

SEQ ID NO: 162764 - DNA, 33 bp, Artificial Sequence
  Description of Artificial Sequence: Synthetic oligonucleotide
cagtgaacagggaggattctgatgaacaagacc

SEQ ID NO: 162765 - DNA, 35 bp, Artificial Sequence
  Description of Artificial Sequence: Synthetic oligonucleotide
agtgaacagggaggattctgatgaacaagaccatc

SEQ ID NO: 162766 - DNA, 34 bp, Artificial Sequence
  Description of Artificial Sequence: Synthetic oligonucleotide
gtgaacagggaggattctgatgaacaagaccatc

SEQ ID NO: 162767 - DNA, 35 bp, Artificial Sequence
  Description of Artificial Sequence: Synthetic oligonucleotide
tgaacagggaggattctgatgaacaagaccatcag

SEQ ID NO: 162768 - DNA, 34 bp, Artificial Sequence
  Description of Artificial Sequence: Synthetic oligonucleotide
gaacagggaggattctgatgaacaagaccatcag

SEQ ID NO: 162769 - DNA, 34 bp, Artificial Sequence
  Description of Artificial Sequence: Synthetic oligonucleotide
aacagggaggattctgatgaacaagaccatcagg

SEQ ID NO: 162770 - DNA, 33 bp, Artificial Sequence
  Description of Artificial Sequence: Synthetic oligonucleotide
acagggaggattctgatgaacaagaccatcagg

SEQ ID NO: 162771 - DNA, 32 bp, Artificial Sequence
  Description of Artificial Sequence: Synthetic oligonucleotide
cagggaggattctgatgaacaagaccatcagg

SEQ ID NO: 162772 - DNA, 33 bp, Artificial Sequence
  Description of Artificial Sequence: Synthetic oligonucleotide
agggaggattctgatgaacaagaccatcaggag

SEQ ID NO: 162773 - DNA, 32 bp, Artificial Sequence
  Description of Artificial Sequence: Synthetic oligonucleotide
gggaggattctgatgaacaagaccatcaggag

SEQ ID NO: 162774 - DNA, 32 bp, Artificial Sequence
  Description of Artificial Sequence: Synthetic oligonucleotide
ggaggattctgatgaacaagaccatcaggagg

SEQ ID NO: 162775 - DNA, 22 bp, Artificial Sequence
  Description of Artificial Sequence: Synthetic oligonucleotide
ttgctgcagggggcctggccac

SEQ ID NO: 162776 - DNA, 21 bp, Artificial Sequence
  Description of Artificial Sequence: Synthetic oligonucleotide
tgctgcagggggcctggccac

SEQ ID NO: 162777 - DNA, 20 bp, Artificial Sequence
  Description of Artificial Sequence: Synthetic oligonucleotide
gctgcagggggcctggccac

SEQ ID NO: 162778 - DNA, 21 bp, Artificial Sequence
  Description of Artificial Sequence: Synthetic oligonucleotide
ctgcagggggcctggccacgt

SEQ ID NO: 162779 - DNA, 22 bp, Artificial Sequence
  Description of Artificial Sequence: Synthetic oligonucleotide
tgcagggggcctggccacgtga

SEQ ID NO: 162780 - DNA, 21 bp, Artificial Sequence
  Description of Artificial Sequence: Synthetic oligonucleotide
gcagggggcctggccacgtga

SEQ ID NO: 162781 - DNA, 21 bp, Artificial Sequence
  Description of Artificial Sequence: Synthetic oligonucleotide
cagggggcctggccacgtgag

SEQ ID NO: 162782 - DNA, 21 bp, Artificial Sequence
  Description of Artificial Sequence: Synthetic oligonucleotide
agggggcctggccacgtgagg

SEQ ID NO: 162783 - DNA, 20 bp, Artificial Sequence
  Description of Artificial Sequence: Synthetic oligonucleotide
gggggcctggccacgtgagg

SEQ ID NO: 162784 - DNA, 23 bp, Artificial Sequence
  Description of Artificial Sequence: Synthetic oligonucleotide
ggggcctggccacgtgagggatt

SEQ ID NO: 162785 - DNA, 23 bp, Artificial Sequence
  Description of Artificial Sequence: Synthetic oligonucleotide
gggcctggccacgtgagggattc

SEQ ID NO: 162786 - DNA, 23 bp, Artificial Sequence
  Description of Artificial Sequence: Synthetic oligonucleotide
ggcctggccacgtgagggattcc

SEQ ID NO: 162787 - DNA, 23 bp, Artificial Sequence
  Description of Artificial Sequence: Synthetic oligonucleotide
gcctggccacgtgagggattccg

SEQ ID NO: 162788 - DNA, 24 bp, Artificial Sequence
  Description of Artificial Sequence: Synthetic oligonucleotide
cctggccacgtgagggattccgca

SEQ ID NO: 162789 - DNA, 27 bp, Artificial Sequence
  Description of Artificial Sequence: Synthetic oligonucleotide
ctggccacgtgagggattccgcagaaa

SEQ ID NO: 162790 - DNA, 28 bp, Artificial Sequence
  Description of Artificial Sequence: Synthetic oligonucleotide
tggccacgtgagggattccgcagaaaac

SEQ ID NO: 162791 - DNA, 27 bp, Artificial Sequence
  Description of Artificial Sequence: Synthetic oligonucleotide
ggccacgtgagggattccgcagaaaac

SEQ ID NO: 162792 - DNA, 27 bp, Artificial Sequence
  Description of Artificial Sequence: Synthetic oligonucleotide
gccacgtgagggattccgcagaaaacc

SEQ ID NO: 162793 - DNA, 29 bp, Artificial Sequence
  Description of Artificial Sequence: Synthetic oligonucleotide
ccacgtgagggattccgcagaaaaccttc

SEQ ID NO: 162794 - DNA, 29 bp, Artificial Sequence
  Description of Artificial Sequence: Synthetic oligonucleotide
cacgtgagggattccgcagaaaaccttcc

SEQ ID NO: 162795 - DNA, 29 bp, Artificial Sequence
  Description of Artificial Sequence: Synthetic oligonucleotide
acgtgagggattccgcagaaaaccttccc

SEQ ID NO: 162796 - DNA, 28 bp, Artificial Sequence
  Description of Artificial Sequence: Synthetic oligonucleotide
cgtgagggattccgcagaaaaccttccc

SEQ ID NO: 162797 - DNA, 29 bp, Artificial Sequence
  Description of Artificial Sequence: Synthetic oligonucleotide
gtgagggattccgcagaaaaccttccctc

SEQ ID NO: 162798 - DNA, 34 bp, Artificial Sequence
  Description of Artificial Sequence: Synthetic oligonucleotide
ctacatgttctgattgggacctcagtggtcaaac

SEQ ID NO: 162799 - DNA, 35 bp, Artificial Sequence
  Description of Artificial Sequence: Synthetic oligonucleotide
tacatgttctgattgggacctcagtggtcaaactc

SEQ ID NO: 162800 - DNA, 34 bp, Artificial Sequence
  Description of Artificial Sequence: Synthetic oligonucleotide
acatgttctgattgggacctcagtggtcaaactc

SEQ ID NO: 162801 - DNA, 33 bp, Artificial Sequence
  Description of Artificial Sequence: Synthetic oligonucleotide
catgttctgattgggacctcagtggtcaaactc

SEQ ID NO: 162802 - DNA, 33 bp, Artificial Sequence
  Description of Artificial Sequence: Synthetic oligonucleotide
atgttctgattgggacctcagtggtcaaactcc

SEQ ID NO: 162803 - DNA, 32 bp, Artificial Sequence
  Description of Artificial Sequence: Synthetic oligonucleotide
tgttctgattgggacctcagtggtcaaactcc

SEQ ID NO: 162804 - DNA, 29 bp, Artificial Sequence
  Description of Artificial Sequence: Synthetic oligonucleotide
gagggacctacacatgcttcggctctttc

SEQ ID NO: 162805 - DNA, 29 bp, Artificial Sequence
  Description of Artificial Sequence: Synthetic oligonucleotide
agggacctacacatgcttcggctctttcc

SEQ ID NO: 162806 - DNA, 28 bp, Artificial Sequence
  Description of Artificial Sequence: Synthetic oligonucleotide
gggacctacacatgcttcggctctttcc

SEQ ID NO: 162807 - DNA, 28 bp, Artificial Sequence
  Description of Artificial Sequence: Synthetic oligonucleotide
ggacctacacatgcttcggctctttccg

SEQ ID NO: 162808 - DNA, 29 bp, Artificial Sequence
  Description of Artificial Sequence: Synthetic oligonucleotide
gacctacacatgcttcggctctttccgtg

SEQ ID NO: 162809 - DNA, 30 bp, Artificial Sequence
  Description of Artificial Sequence: Synthetic oligonucleotide
acctacacatgcttcggctctttccgtgac

SEQ ID NO: 162810 - DNA, 29 bp, Artificial Sequence
  Description of Artificial Sequence: Synthetic oligonucleotide
cctacacatgcttcggctctttccgtgac

SEQ ID NO: 162811 - DNA, 30 bp, Artificial Sequence
  Description of Artificial Sequence: Synthetic oligonucleotide
ctacacatgcttcggctctttccgtgactc

SEQ ID NO: 162812 - DNA, 31 bp, Artificial Sequence
  Description of Artificial Sequence: Synthetic oligonucleotide
tacacatgcttcggctctttccgtgactctc

SEQ ID NO: 162813 - DNA, 30 bp, Artificial Sequence
  Description of Artificial Sequence: Synthetic oligonucleotide
acacatgcttcggctctttccgtgactctc

SEQ ID NO: 162814 - DNA, 29 bp, Artificial Sequence
  Description of Artificial Sequence: Synthetic oligonucleotide
cacatgcttcggctctttccgtgactctc

SEQ ID NO: 162815 - DNA, 29 bp, Artificial Sequence
  Description of Artificial Sequence: Synthetic oligonucleotide
acatgcttcggctctttccgtgactctcc

SEQ ID NO: 162816 - DNA, 28 bp, Artificial Sequence
  Description of Artificial Sequence: Synthetic oligonucleotide
catgcttcggctctttccgtgactctcc

SEQ ID NO: 162817 - DNA, 29 bp, Artificial Sequence
  Description of Artificial Sequence: Synthetic oligonucleotide
ttctggcaggagagagcgtgaccttgttc

SEQ ID NO: 162818 - DNA, 28 bp, Artificial Sequence
  Description of Artificial Sequence: Synthetic oligonucleotide
tctggcaggagagagcgtgaccttgttc

SEQ ID NO: 162819 - DNA, 27 bp, Artificial Sequence
  Description of Artificial Sequence: Synthetic oligonucleotide
ctggcaggagagagcgtgaccttgttc

SEQ ID NO: 162820 - DNA, 28 bp, Artificial Sequence
  Description of Artificial Sequence: Synthetic oligonucleotide
tggcaggagagagcgtgaccttgttctg

SEQ ID NO: 162821 - DNA, 27 bp, Artificial Sequence
  Description of Artificial Sequence: Synthetic oligonucleotide
ggcaggagagagcgtgaccttgttctg

SEQ ID NO: 162822 - DNA, 27 bp, Artificial Sequence
  Description of Artificial Sequence: Synthetic oligonucleotide
gcaggagagagcgtgaccttgttctgc

SEQ ID NO: 162823 - DNA, 28 bp, Artificial Sequence
  Description of Artificial Sequence: Synthetic oligonucleotide
caggagagagcgtgaccttgttctgcag

SEQ ID NO: 162824 - DNA, 28 bp, Artificial Sequence
  Description of Artificial Sequence: Synthetic oligonucleotide
aggagagagcgtgaccttgttctgcagc

SEQ ID NO: 162825 - DNA, 27 bp, Artificial Sequence
  Description of Artificial Sequence: Synthetic oligonucleotide
ggagagagcgtgaccttgttctgcagc

SEQ ID NO: 162826 - DNA, 28 bp, Artificial Sequence
  Description of Artificial Sequence: Synthetic oligonucleotide
gagagagcgtgaccttgttctgcagctc

SEQ ID NO: 162827 - DNA, 28 bp, Artificial Sequence
  Description of Artificial Sequence: Synthetic oligonucleotide
agagagcgtgaccttgttctgcagctcc

SEQ ID NO: 162828 - DNA, 27 bp, Artificial Sequence
  Description of Artificial Sequence: Synthetic oligonucleotide
gagagcgtgaccttgttctgcagctcc

SEQ ID NO: 162829 - DNA, 27 bp, Artificial Sequence
  Description of Artificial Sequence: Synthetic oligonucleotide
agagcgtgaccttgttctgcagctccc

SEQ ID NO: 162830 - DNA, 26 bp, Artificial Sequence
  Description of Artificial Sequence: Synthetic oligonucleotide
gagcgtgaccttgttctgcagctccc

SEQ ID NO: 162831 - DNA, 26 bp, Artificial Sequence
  Description of Artificial Sequence: Synthetic oligonucleotide
agcgtgaccttgttctgcagctcccg

SEQ ID NO: 162832 - DNA, 25 bp, Artificial Sequence
  Description of Artificial Sequence: Synthetic oligonucleotide
gcgtgaccttgttctgcagctcccg

SEQ ID NO: 162833 - DNA, 26 bp, Artificial Sequence
  Description of Artificial Sequence: Synthetic oligonucleotide
cgtgaccttgttctgcagctcccgga

SEQ ID NO: 162834 - DNA, 26 bp, Artificial Sequence
  Description of Artificial Sequence: Synthetic oligonucleotide
gtgaccttgttctgcagctcccggag

SEQ ID NO: 162835 - DNA, 27 bp, Artificial Sequence
  Description of Artificial Sequence: Synthetic oligonucleotide
tgaccttgttctgcagctcccggagct

SEQ ID NO: 162836 - DNA, 26 bp, Artificial Sequence
  Description of Artificial Sequence: Synthetic oligonucleotide
gaccttgttctgcagctcccggagct

SEQ ID NO: 162837 - DNA, 26 bp, Artificial Sequence
  Description of Artificial Sequence: Synthetic oligonucleotide
accttgttctgcagctcccggagctc

SEQ ID NO: 162838 - DNA, 25 bp, Artificial Sequence
  Description of Artificial Sequence: Synthetic oligonucleotide
ccttgttctgcagctcccggagctc

SEQ ID NO: 162839 - DNA, 27 bp, Artificial Sequence
  Description of Artificial Sequence: Synthetic oligonucleotide
cttgttctgcagctcccggagctccta

SEQ ID NO: 162840 - DNA, 28 bp, Artificial Sequence
  Description of Artificial Sequence: Synthetic oligonucleotide
ttgttctgcagctcccggagctcctatg

SEQ ID NO: 162841 - DNA, 27 bp, Artificial Sequence
  Description of Artificial Sequence: Synthetic oligonucleotide
tgttctgcagctcccggagctcctatg

SEQ ID NO: 162842 - DNA, 27 bp, Artificial Sequence
  Description of Artificial Sequence: Synthetic oligonucleotide
gttctgcagctcccggagctcctatga

SEQ ID NO: 162843 - DNA, 27 bp, Artificial Sequence
  Description of Artificial Sequence: Synthetic oligonucleotide
ttctgcagctcccggagctcctatgac

SEQ ID NO: 162844 - DNA, 27 bp, Artificial Sequence
  Description of Artificial Sequence: Synthetic oligonucleotide
tctgcagctcccggagctcctatgaca

SEQ ID NO: 162845 - DNA, 27 bp, Artificial Sequence
  Description of Artificial Sequence: Synthetic oligonucleotide
gtcgtcagcatggcgtgtgttgggttg

SEQ ID NO: 162846 - DNA, 29 bp, Artificial Sequence
  Description of Artificial Sequence: Synthetic oligonucleotide
tcgtcagcatggcgtgtgttgggttgttc

SEQ ID NO: 162847 - DNA, 28 bp, Artificial Sequence
  Description of Artificial Sequence: Synthetic oligonucleotide
cgtcagcatggcgtgtgttgggttgttc

SEQ ID NO: 162848 - DNA, 30 bp, Artificial Sequence
  Description of Artificial Sequence: Synthetic oligonucleotide
gtcagcatggcgtgtgttgggttgttcttg

SEQ ID NO: 162849 - DNA, 30 bp, Artificial Sequence
  Description of Artificial Sequence: Synthetic oligonucleotide
tcagcatggcgtgtgttgggttgttcttgg

SEQ ID NO: 162850 - DNA, 29 bp, Artificial Sequence
  Description of Artificial Sequence: Synthetic oligonucleotide
cagcatggcgtgtgttgggttgttcttgg

SEQ ID NO: 162851 - DNA, 30 bp, Artificial Sequence
  Description of Artificial Sequence: Synthetic oligonucleotide
agcatggcgtgtgttgggttgttcttggtc

SEQ ID NO: 162852 - DNA, 29 bp, Artificial Sequence
  Description of Artificial Sequence: Synthetic oligonucleotide
gcatggcgtgtgttgggttgttcttggtc

SEQ ID NO: 162853 - DNA, 29 bp, Artificial Sequence
  Description of Artificial Sequence: Synthetic oligonucleotide
catggcgtgtgttgggttgttcttggtcc

SEQ ID NO: 162854 - DNA, 30 bp, Artificial Sequence
  Description of Artificial Sequence: Synthetic oligonucleotide
atggcgtgtgttgggttgttcttggtccag

SEQ ID NO: 162855 - DNA, 29 bp, Artificial Sequence
  Description of Artificial Sequence: Synthetic oligonucleotide
tggcgtgtgttgggttgttcttggtccag

SEQ ID NO: 162856 - DNA, 28 bp, Artificial Sequence
  Description of Artificial Sequence: Synthetic oligonucleotide
ggcgtgtgttgggttgttcttggtccag

SEQ ID NO: 162857 - DNA, 29 bp, Artificial Sequence
  Description of Artificial Sequence: Synthetic oligonucleotide
gcgtgtgttgggttgttcttggtccagag

SEQ ID NO: 162858 - DNA, 29 bp, Artificial Sequence
  Description of Artificial Sequence: Synthetic oligonucleotide
cgtgtgttgggttgttcttggtccagagg

SEQ ID NO: 162859 - DNA, 29 bp, Artificial Sequence
  Description of Artificial Sequence: Synthetic oligonucleotide
gtgtgttgggttgttcttggtccagaggg

SEQ ID NO: 162860 - DNA, 29 bp, Artificial Sequence
  Description of Artificial Sequence: Synthetic oligonucleotide
tgtgttgggttgttcttggtccagagggc

SEQ ID NO: 162861 - DNA, 28 bp, Artificial Sequence
  Description of Artificial Sequence: Synthetic oligonucleotide
gtgttgggttgttcttggtccagagggc

SEQ ID NO: 162862 - DNA, 28 bp, Artificial Sequence
  Description of Artificial Sequence: Synthetic oligonucleotide
tgttgggttgttcttggtccagagggcc

SEQ ID NO: 162863 - DNA, 27 bp, Artificial Sequence
  Description of Artificial Sequence: Synthetic oligonucleotide
gttgggttgttcttggtccagagggcc

SEQ ID NO: 162864 - DNA, 27 bp, Artificial Sequence
  Description of Artificial Sequence: Synthetic oligonucleotide
ttgggttgttcttggtccagagggccg

SEQ ID NO: 162865 - DNA, 26 bp, Artificial Sequence
  Description of Artificial Sequence: Synthetic oligonucleotide
tgggttgttcttggtccagagggccg

SEQ ID NO: 162866 - DNA, 25 bp, Artificial Sequence
  Description of Artificial Sequence: Synthetic oligonucleotide
gggttgttcttggtccagagggccg

SEQ ID NO: 162867 - DNA, 26 bp, Artificial Sequence
  Description of Artificial Sequence: Synthetic oligonucleotide
ggttgttcttggtccagagggccggt

SEQ ID NO: 162868 - DNA, 26 bp, Artificial Sequence
  Description of Artificial Sequence: Synthetic oligonucleotide
gttgttcttggtccagagggccggtc

SEQ ID NO: 162869 - DNA, 27 bp, Artificial Sequence
  Description of Artificial Sequence: Synthetic oligonucleotide
ttgttcttggtccagagggccggtcca

SEQ ID NO: 162870 - DNA, 26 bp, Artificial Sequence
  Description of Artificial Sequence: Synthetic oligonucleotide
tgttcttggtccagagggccggtcca

SEQ ID NO: 162871 - DNA, 25 bp, Artificial Sequence
  Description of Artificial Sequence: Synthetic oligonucleotide
gttcttggtccagagggccggtcca

SEQ ID NO: 162872 - DNA, 26 bp, Artificial Sequence
  Description of Artificial Sequence: Synthetic oligonucleotide
ttcttggtccagagggccggtccaca

SEQ ID NO: 162873 - DNA, 25 bp, Artificial Sequence
  Description of Artificial Sequence: Synthetic oligonucleotide
tcttggtccagagggccggtccaca

SEQ ID NO: 162874 - DNA, 24 bp, Artificial Sequence
  Description of Artificial Sequence: Synthetic oligonucleotide
cttggtccagagggccggtccaca

SEQ ID NO: 162875 - DNA, 26 bp, Artificial Sequence
  Description of Artificial Sequence: Synthetic oligonucleotide
ttggtccagagggccggtccacacat

SEQ ID NO: 162876 - DNA, 25 bp, Artificial Sequence
  Description of Artificial Sequence: Synthetic oligonucleotide
tggtccagagggccggtccacacat

SEQ ID NO: 162877 - DNA, 24 bp, Artificial Sequence
  Description of Artificial Sequence: Synthetic oligonucleotide
ggtccagagggccggtccacacat

SEQ ID NO: 162878 - DNA, 24 bp, Artificial Sequence
  Description of Artificial Sequence: Synthetic oligonucleotide
gtccagagggccggtccacacatg

SEQ ID NO: 162879 - DNA, 24 bp, Artificial Sequence
  Description of Artificial Sequence: Synthetic oligonucleotide
tccagagggccggtccacacatgg

SEQ ID NO: 162880 - DNA, 23 bp, Artificial Sequence
  Description of Artificial Sequence: Synthetic oligonucleotide
ccagagggccggtccacacatgg

SEQ ID NO: 162881 - DNA, 24 bp, Artificial Sequence
  Description of Artificial Sequence: Synthetic oligonucleotide
cagagggccggtccacacatgggt

SEQ ID NO: 162882 - DNA, 24 bp, Artificial Sequence
  Description of Artificial Sequence: Synthetic oligonucleotide
agagggccggtccacacatgggtg

SEQ ID NO: 162883 - DNA, 23 bp, Artificial Sequence
  Description of Artificial Sequence: Synthetic oligonucleotide
gagggccggtccacacatgggtg

SEQ ID NO: 162884 - DNA, 24 bp, Artificial Sequence
  Description of Artificial Sequence: Synthetic oligonucleotide
agggccggtccacacatgggtggt

SEQ ID NO: 162885 - DNA, 23 bp, Artificial Sequence
  Description of Artificial Sequence: Synthetic oligonucleotide
gggccggtccacacatgggtggt

SEQ ID NO: 162886 - DNA, 24 bp, Artificial Sequence
  Description of Artificial Sequence: Synthetic oligonucleotide
ggccggtccacacatgggtggtca

SEQ ID NO: 162887 - DNA, 24 bp, Artificial Sequence
  Description of Artificial Sequence: Synthetic oligonucleotide
gccggtccacacatgggtggtcag

SEQ ID NO: 162888 - DNA, 25 bp, Artificial Sequence
  Description of Artificial Sequence: Synthetic oligonucleotide
ccggtccacacatgggtggtcagga

SEQ ID NO: 162889 - DNA, 27 bp, Artificial Sequence
  Description of Artificial Sequence: Synthetic oligonucleotide
cggtccacacatgggtggtcaggacaa

SEQ ID NO: 162890 - DNA, 28 bp, Artificial Sequence
  Description of Artificial Sequence: Synthetic oligonucleotide
ggtccacacatgggtggtcaggacaaac

SEQ ID NO: 162891 - DNA, 28 bp, Artificial Sequence
  Description of Artificial Sequence: Synthetic oligonucleotide
gtccacacatgggtggtcaggacaaacc

SEQ ID NO: 162892 - DNA, 28 bp, Artificial Sequence
  Description of Artificial Sequence: Synthetic oligonucleotide
tccacacatgggtggtcaggacaaaccc

SEQ ID NO: 162893 - DNA, 27 bp, Artificial Sequence
  Description of Artificial Sequence: Synthetic oligonucleotide
ccacacatgggtggtcaggacaaaccc

SEQ ID NO: 162894 - DNA, 29 bp, Artificial Sequence
  Description of Artificial Sequence: Synthetic oligonucleotide
cacacatgggtggtcaggacaaacccttc

SEQ ID NO: 162895 - DNA, 29 bp, Artificial Sequence
  Description of Artificial Sequence: Synthetic oligonucleotide
acacatgggtggtcaggacaaacccttcc

SEQ ID NO: 162896 - DNA, 28 bp, Artificial Sequence
  Description of Artificial Sequence: Synthetic oligonucleotide
cacatgggtggtcaggacaaacccttcc

SEQ ID NO: 162897 - DNA, 29 bp, Artificial Sequence
  Description of Artificial Sequence: Synthetic oligonucleotide
acatgggtggtcaggacaaacccttcctg

SEQ ID NO: 162898 - DNA, 28 bp, Artificial Sequence
  Description of Artificial Sequence: Synthetic oligonucleotide
catgggtggtcaggacaaacccttcctg

SEQ ID NO: 162899 - DNA, 29 bp, Artificial Sequence
  Description of Artificial Sequence: Synthetic oligonucleotide
atgggtggtcaggacaaacccttcctgtc

SEQ ID NO: 162900 - DNA, 28 bp, Artificial Sequence
  Description of Artificial Sequence: Synthetic oligonucleotide
tgggtggtcaggacaaacccttcctgtc

SEQ ID NO: 162901 - DNA, 27 bp, Artificial Sequence
  Description of Artificial Sequence: Synthetic oligonucleotide
gggtggtcaggacaaacccttcctgtc

SEQ ID NO: 162902 - DNA, 28 bp, Artificial Sequence
  Description of Artificial Sequence: Synthetic oligonucleotide
ggtggtcaggacaaacccttcctgtctg

SEQ ID NO: 162903 - DNA, 28 bp, Artificial Sequence
  Description of Artificial Sequence: Synthetic oligonucleotide
gtggtcaggacaaacccttcctgtctgc

SEQ ID NO: 162904 - DNA, 28 bp, Artificial Sequence
  Description of Artificial Sequence: Synthetic oligonucleotide
tggtcaggacaaacccttcctgtctgcc

SEQ ID NO: 162905 - DNA, 27 bp, Artificial Sequence
  Description of Artificial Sequence: Synthetic oligonucleotide
ggtcaggacaaacccttcctgtctgcc

SEQ ID NO: 162906 - DNA, 28 bp, Artificial Sequence
  Description of Artificial Sequence: Synthetic oligonucleotide
gtcaggacaaacccttcctgtctgcctg

SEQ ID NO: 162907 - DNA, 28 bp, Artificial Sequence
  Description of Artificial Sequence: Synthetic oligonucleotide
tcaggacaaacccttcctgtctgcctgg

SEQ ID NO: 162908 - DNA, 27 bp, Artificial Sequence
  Description of Artificial Sequence: Synthetic oligonucleotide
caggacaaacccttcctgtctgcctgg

SEQ ID NO: 162909 - DNA, 27 bp, Artificial Sequence
  Description of Artificial Sequence: Synthetic oligonucleotide
aggacaaacccttcctgtctgcctggc

SEQ ID NO: 162910 - DNA, 26 bp, Artificial Sequence
  Description of Artificial Sequence: Synthetic oligonucleotide
ggacaaacccttcctgtctgcctggc

SEQ ID NO: 162911 - DNA, 26 bp, Artificial Sequence
  Description of Artificial Sequence: Synthetic oligonucleotide
gacaaacccttcctgtctgcctggcc

SEQ ID NO: 162912 - DNA, 27 bp, Artificial Sequence
  Description of Artificial Sequence: Synthetic oligonucleotide
acaaacccttcctgtctgcctggccca

SEQ ID NO: 162913 - DNA, 26 bp, Artificial Sequence
  Description of Artificial Sequence: Synthetic oligonucleotide
caaacccttcctgtctgcctggccca

SEQ ID NO: 162914 - DNA, 26 bp, Artificial Sequence
  Description of Artificial Sequence: Synthetic oligonucleotide
aaacccttcctgtctgcctggcccag

SEQ ID NO: 162915 - DNA, 25 bp, Artificial Sequence
  Description of Artificial Sequence: Synthetic oligonucleotide
aacccttcctgtctgcctggcccag

SEQ ID NO: 162916 - DNA, 24 bp, Artificial Sequence
  Description of Artificial Sequence: Synthetic oligonucleotide
acccttcctgtctgcctggcccag

SEQ ID NO: 162917 - DNA, 23 bp, Artificial Sequence
  Description of Artificial Sequence: Synthetic oligonucleotide
cccttcctgtctgcctggcccag

SEQ ID NO: 162918 - DNA, 23 bp, Artificial Sequence
  Description of Artificial Sequence: Synthetic oligonucleotide
ccttcctgtctgcctggcccagc

SEQ ID NO: 162919 - DNA, 23 bp, Artificial Sequence
  Description of Artificial Sequence: Synthetic oligonucleotide
cttcctgtctgcctggcccagcg

SEQ ID NO: 162920 - DNA, 24 bp, Artificial Sequence
  Description of Artificial Sequence: Synthetic oligonucleotide
ttcctgtctgcctggcccagcgct

SEQ ID NO: 162921 - DNA, 23 bp, Artificial Sequence
  Description of Artificial Sequence: Synthetic oligonucleotide
tcctgtctgcctggcccagcgct

SEQ ID NO: 162922 - DNA, 22 bp, Artificial Sequence
  Description of Artificial Sequence: Synthetic oligonucleotide
cctgtctgcctggcccagcgct

SEQ ID NO: 162923 - DNA, 24 bp, Artificial Sequence
  Description of Artificial Sequence: Synthetic oligonucleotide
cgctgtggtgcctcgaggaggaca

SEQ ID NO: 162924 - DNA, 24 bp, Artificial Sequence
  Description of Artificial Sequence: Synthetic oligonucleotide
gctgtggtgcctcgaggaggacac

SEQ ID NO: 162925 - DNA, 25 bp, Artificial Sequence
  Description of Artificial Sequence: Synthetic oligonucleotide
ctgtggtgcctcgaggaggacacgt

SEQ ID NO: 162926 - DNA, 26 bp, Artificial Sequence
  Description of Artificial Sequence: Synthetic oligonucleotide
tgtggtgcctcgaggaggacacgtga

SEQ ID NO: 162927 - DNA, 25 bp, Artificial Sequence
  Description of Artificial Sequence: Synthetic oligonucleotide
gtggtgcctcgaggaggacacgtga

SEQ ID NO: 162928 - DNA, 26 bp, Artificial Sequence
  Description of Artificial Sequence: Synthetic oligonucleotide
tggtgcctcgaggaggacacgtgact

SEQ ID NO: 162929 - DNA, 25 bp, Artificial Sequence
  Description of Artificial Sequence: Synthetic oligonucleotide
ggtgcctcgaggaggacacgtgact

SEQ ID NO: 162930 - DNA, 27 bp, Artificial Sequence
  Description of Artificial Sequence: Synthetic oligonucleotide
gtgcctcgaggaggacacgtgactctt

SEQ ID NO: 162931 - DNA, 27 bp, Artificial Sequence
  Description of Artificial Sequence: Synthetic oligonucleotide
tgcctcgaggaggacacgtgactcttc

SEQ ID NO: 162932 - DNA, 26 bp, Artificial Sequence
  Description of Artificial Sequence: Synthetic oligonucleotide
gcctcgaggaggacacgtgactcttc

SEQ ID NO: 162933 - DNA, 26 bp, Artificial Sequence
  Description of Artificial Sequence: Synthetic oligonucleotide
cctcgaggaggacacgtgactcttcg

SEQ ID NO: 162934 - DNA, 27 bp, Artificial Sequence
  Description of Artificial Sequence: Synthetic oligonucleotide
ctcgaggaggacacgtgactcttcggt

SEQ ID NO: 162935 - DNA, 27 bp, Artificial Sequence
  Description of Artificial Sequence: Synthetic oligonucleotide
tcgaggaggacacgtgactcttcggtg

SEQ ID NO: 162936 - DNA, 27 bp, Artificial Sequence
  Description of Artificial Sequence: Synthetic oligonucleotide
cgaggaggacacgtgactcttcggtgt

SEQ ID NO: 162937 - DNA, 27 bp, Artificial Sequence
  Description of Artificial Sequence: Synthetic oligonucleotide
gaggaggacacgtgactcttcggtgtc

SEQ ID NO: 162938 - DNA, 33 bp, Artificial Sequence
  Description of Artificial Sequence: Synthetic oligonucleotide
acacgtgactcttcggtgtcactatcgtcatag

SEQ ID NO: 162939 - DNA, 32 bp, Artificial Sequence
  Description of Artificial Sequence: Synthetic oligonucleotide
cacgtgactcttcggtgtcactatcgtcatag

SEQ ID NO: 162940 - DNA, 32 bp, Artificial Sequence
  Description of Artificial Sequence: Synthetic oligonucleotide
acgtgactcttcggtgtcactatcgtcatagg

SEQ ID NO: 162941 - DNA, 31 bp, Artificial Sequence
  Description of Artificial Sequence: Synthetic oligonucleotide
cgtgactcttcggtgtcactatcgtcatagg

SEQ ID NO: 162942 - DNA, 36 bp, Artificial Sequence
  Description of Artificial Sequence: Synthetic oligonucleotide
gtgactcttcggtgtcactatcgtcataggtttaac

SEQ ID NO: 162943 - DNA, 41 bp, Artificial Sequence
  Description of Artificial Sequence: Synthetic oligonucleotide
tgactcttcggtgtcactatcgtcataggtttaacaatttc

SEQ ID NO: 162944 - DNA, 40 bp, Artificial Sequence
  Description of Artificial Sequence: Synthetic oligonucleotide
gactcttcggtgtcactatcgtcataggtttaacaatttc

SEQ ID NO: 162945 - DNA, 42 bp, Artificial Sequence
  Description of Artificial Sequence: Synthetic oligonucleotide
actcttcggtgtcactatcgtcataggtttaacaatttcatg

SEQ ID NO: 162946 - DNA, 41 bp, Artificial Sequence
  Description of Artificial Sequence: Synthetic oligonucleotide
ctcttcggtgtcactatcgtcataggtttaacaatttcatg

SEQ ID NO: 162947 - DNA, 41 bp, Artificial Sequence
  Description of Artificial Sequence: Synthetic oligonucleotide
tcttcggtgtcactatcgtcataggtttaacaatttcatgc

SEQ ID NO: 162948 - DNA, 40 bp, Artificial Sequence
  Description of Artificial Sequence: Synthetic oligonucleotide
cttcggtgtcactatcgtcataggtttaacaatttcatgc

SEQ ID NO: 162949 - DNA, 44 bp, Artificial Sequence
  Description of Artificial Sequence: Synthetic oligonucleotide
ttcggtgtcactatcgtcataggtttaacaatttcatgctatac

SEQ ID NO: 162950 - DNA, 43 bp, Artificial Sequence
  Description of Artificial Sequence: Synthetic oligonucleotide
tcggtgtcactatcgtcataggtttaacaatttcatgctatac

SEQ ID NO: 162951 - DNA, 42 bp, Artificial Sequence
  Description of Artificial Sequence: Synthetic oligonucleotide
cggtgtcactatcgtcataggtttaacaatttcatgctatac

SEQ ID NO: 162952 - DNA, 45 bp, Artificial Sequence
  Description of Artificial Sequence: Synthetic oligonucleotide
ggtgtcactatcgtcataggtttaacaatttcatgctatacaaag

SEQ ID NO: 162953 - DNA, 47 bp, Artificial Sequence
  Description of Artificial Sequence: Synthetic oligonucleotide
gtgtcactatcgtcataggtttaacaatttcatgctatacaaagaag

SEQ ID NO: 162954 - DNA, 48 bp, Artificial Sequence
  Description of Artificial Sequence: Synthetic oligonucleotide
tgtcactatcgtcataggtttaacaatttcatgctatacaaagaagac

SEQ ID NO: 162955 - DNA, 47 bp, Artificial Sequence
  Description of Artificial Sequence: Synthetic oligonucleotide
gtcactatcgtcataggtttaacaatttcatgctatacaaagaagac

SEQ ID NO: 162956 - DNA, 48 bp, Artificial Sequence
  Description of Artificial Sequence: Synthetic oligonucleotide
tcactatcgtcataggtttaacaatttcatgctatacaaagaagacag

SEQ ID NO: 162957 - DNA, 47 bp, Artificial Sequence
  Description of Artificial Sequence: Synthetic oligonucleotide
cactatcgtcataggtttaacaatttcatgctatacaaagaagacag

SEQ ID NO: 162958 - DNA, 50 bp, Artificial Sequence
  Description of Artificial Sequence: Synthetic oligonucleotide
actatcgtcataggtttaacaatttcatgctatacaaagaagacagaatc

SEQ ID NO: 162959 - DNA, 49 bp, Artificial Sequence
  Description of Artificial Sequence: Synthetic oligonucleotide
ctatcgtcataggtttaacaatttcatgctatacaaagaagacagaatc

SEQ ID NO: 162960 - DNA, 49 bp, Artificial Sequence
  Description of Artificial Sequence: Synthetic oligonucleotide
tatcgtcataggtttaacaatttcatgctatacaaagaagacagaatcc

SEQ ID NO: 162961 - DNA, 48 bp, Artificial Sequence
  Description of Artificial Sequence: Synthetic oligonucleotide
atcgtcataggtttaacaatttcatgctatacaaagaagacagaatcc

SEQ ID NO: 162962 - DNA, 47 bp, Artificial Sequence
  Description of Artificial Sequence: Synthetic oligonucleotide
tcgtcataggtttaacaatttcatgctatacaaagaagacagaatcc

SEQ ID NO: 162963 - DNA, 46 bp, Artificial Sequence
  Description of Artificial Sequence: Synthetic oligonucleotide
cgtcataggtttaacaatttcatgctatacaaagaagacagaatcc

SEQ ID NO: 162964 - DNA, 47 bp, Artificial Sequence
  Description of Artificial Sequence: Synthetic oligonucleotide
gtcataggtttaacaatttcatgctatacaaagaagacagaatccac

SEQ ID NO: 162965 - DNA, 50 bp, Artificial Sequence
  Description of Artificial Sequence: Synthetic oligonucleotide
tcataggtttaacaatttcatgctatacaaagaagacagaatccacattc

SEQ ID NO: 162966 - DNA, 49 bp, Artificial Sequence
  Description of Artificial Sequence: Synthetic oligonucleotide
cataggtttaacaatttcatgctatacaaagaagacagaatccacattc

SEQ ID NO: 162967 - DNA, 49 bp, Artificial Sequence
  Description of Artificial Sequence: Synthetic oligonucleotide
ataggtttaacaatttcatgctatacaaagaagacagaatccacattcc

SEQ ID NO: 162968 - DNA, 48 bp, Artificial Sequence
  Description of Artificial Sequence: Synthetic oligonucleotide
taggtttaacaatttcatgctatacaaagaagacagaatccacattcc

SEQ ID NO: 162969 - DNA, 47 bp, Artificial Sequence
  Description of Artificial Sequence: Synthetic oligonucleotide
aggtttaacaatttcatgctatacaaagaagacagaatccacattcc

SEQ ID NO: 162970 - DNA, 46 bp, Artificial Sequence
  Description of Artificial Sequence: Synthetic oligonucleotide
ggtttaacaatttcatgctatacaaagaagacagaatccacattcc

SEQ ID NO: 162971 - DNA, 46 bp, Artificial Sequence
  Description of Artificial Sequence: Synthetic oligonucleotide
gtttaacaatttcatgctatacaaagaagacagaatccacattccc

SEQ ID NO: 162972 - DNA, 48 bp, Artificial Sequence
  Description of Artificial Sequence: Synthetic oligonucleotide
tttaacaatttcatgctatacaaagaagacagaatccacattcccatc

SEQ ID NO: 162973 - DNA, 47 bp, Artificial Sequence
  Description of Artificial Sequence: Synthetic oligonucleotide
ttaacaatttcatgctatacaaagaagacagaatccacattcccatc

SEQ ID NO: 162974 - DNA, 46 bp, Artificial Sequence
  Description of Artificial Sequence: Synthetic oligonucleotide
taacaatttcatgctatacaaagaagacagaatccacattcccatc

SEQ ID NO: 162975 - DNA, 45 bp, Artificial Sequence
  Description of Artificial Sequence: Synthetic oligonucleotide
aacaatttcatgctatacaaagaagacagaatccacattcccatc

SEQ ID NO: 162976 - DNA, 44 bp, Artificial Sequence
  Description of Artificial Sequence: Synthetic oligonucleotide
acaatttcatgctatacaaagaagacagaatccacattcccatc

SEQ ID NO: 162977 - DNA, 43 bp, Artificial Sequence
  Description of Artificial Sequence: Synthetic oligonucleotide
caatttcatgctatacaaagaagacagaatccacattcccatc

SEQ ID NO: 162978 - DNA, 45 bp, Artificial Sequence
  Description of Artificial Sequence: Synthetic oligonucleotide
aatttcatgctatacaaagaagacagaatccacattcccatcttc

SEQ ID NO: 162979 - DNA, 44 bp, Artificial Sequence
  Description of Artificial Sequence: Synthetic oligonucleotide
atttcatgctatacaaagaagacagaatccacattcccatcttc

SEQ ID NO: 162980 - DNA, 43 bp, Artificial Sequence
  Description of Artificial Sequence: Synthetic oligonucleotide
tttcatgctatacaaagaagacagaatccacattcccatcttc

SEQ ID NO: 162981 - DNA, 42 bp, Artificial Sequence
  Description of Artificial Sequence: Synthetic oligonucleotide
ttcatgctatacaaagaagacagaatccacattcccatcttc

SEQ ID NO: 162982 - DNA, 41 bp, Artificial Sequence
  Description of Artificial Sequence: Synthetic oligonucleotide
tcatgctatacaaagaagacagaatccacattcccatcttc

SEQ ID NO: 162983 - DNA, 40 bp, Artificial Sequence
  Description of Artificial Sequence: Synthetic oligonucleotide
catgctatacaaagaagacagaatccacattcccatcttc

SEQ ID NO: 162984 - DNA, 40 bp, Artificial Sequence
  Description of Artificial Sequence: Synthetic oligonucleotide
atgctatacaaagaagacagaatccacattcccatcttcc

SEQ ID NO: 162985 - DNA, 39 bp, Artificial Sequence
  Description of Artificial Sequence: Synthetic oligonucleotide
tgctatacaaagaagacagaatccacattcccatcttcc

SEQ ID NO: 162986 - DNA, 38 bp, Artificial Sequence
  Description of Artificial Sequence: Synthetic oligonucleotide
gctatacaaagaagacagaatccacattcccatcttcc

SEQ ID NO: 162987 - DNA, 40 bp, Artificial Sequence
  Description of Artificial Sequence: Synthetic oligonucleotide
ctatacaaagaagacagaatccacattcccatcttccatg

SEQ ID NO: 162988 - DNA, 40 bp, Artificial Sequence
  Description of Artificial Sequence: Synthetic oligonucleotide
tatacaaagaagacagaatccacattcccatcttccatgg

SEQ ID NO: 162989 - DNA, 39 bp, Artificial Sequence
  Description of Artificial Sequence: Synthetic oligonucleotide
atacaaagaagacagaatccacattcccatcttccatgg

SEQ ID NO: 162990 - DNA, 38 bp, Artificial Sequence
  Description of Artificial Sequence: Synthetic oligonucleotide
tacaaagaagacagaatccacattcccatcttccatgg

SEQ ID NO: 162991 - DNA, 37 bp, Artificial Sequence
  Description of Artificial Sequence: Synthetic oligonucleotide
acaaagaagacagaatccacattcccatcttccatgg

SEQ ID NO: 162992 - DNA, 36 bp, Artificial Sequence
  Description of Artificial Sequence: Synthetic oligonucleotide
caaagaagacagaatccacattcccatcttccatgg

SEQ ID NO: 162993 - DNA, 36 bp, Artificial Sequence
  Description of Artificial Sequence: Synthetic oligonucleotide
aaagaagacagaatccacattcccatcttccatggc

SEQ ID NO: 162994 - DNA, 35 bp, Artificial Sequence
  Description of Artificial Sequence: Synthetic oligonucleotide
aagaagacagaatccacattcccatcttccatggc

SEQ ID NO: 162995 - DNA, 34 bp, Artificial Sequence
  Description of Artificial Sequence: Synthetic oligonucleotide
agaagacagaatccacattcccatcttccatggc

SEQ ID NO: 162996 - DNA, 33 bp, Artificial Sequence
  Description of Artificial Sequence: Synthetic oligonucleotide
gaagacagaatccacattcccatcttccatggc

SEQ ID NO: 162997 - DNA, 34 bp, Artificial Sequence
  Description of Artificial Sequence: Synthetic oligonucleotide
aagacagaatccacattcccatcttccatggcag

SEQ ID NO: 162998 - DNA, 33 bp, Artificial Sequence
  Description of Artificial Sequence: Synthetic oligonucleotide
agacagaatccacattcccatcttccatggcag

SEQ ID NO: 162999 - DNA, 32 bp, Artificial Sequence
  Description of Artificial Sequence: Synthetic oligonucleotide
gacagaatccacattcccatcttccatggcag

SEQ ID NO: 163000 - DNA, 38 bp, Artificial Sequence
  Description of Artificial Sequence: Synthetic oligonucleotide
acagaatccacattcccatcttccatggcagaatattc

SEQ ID NO: 163001 - DNA, 37 bp, Artificial Sequence
  Description of Artificial Sequence: Synthetic oligonucleotide
cagaatccacattcccatcttccatggcagaatattc

SEQ ID NO: 163002 - DNA, 37 bp, Artificial Sequence
  Description of Artificial Sequence: Synthetic oligonucleotide
agaatccacattcccatcttccatggcagaatattcc

SEQ ID NO: 163003 - DNA, 36 bp, Artificial Sequence
  Description of Artificial Sequence: Synthetic oligonucleotide
gaatccacattcccatcttccatggcagaatattcc

SEQ ID NO: 163004 - DNA, 37 bp, Artificial Sequence
  Description of Artificial Sequence: Synthetic oligonucleotide
aatccacattcccatcttccatggcagaatattccag

SEQ ID NO: 163005 - DNA, 36 bp, Artificial Sequence
  Description of Artificial Sequence: Synthetic oligonucleotide
atccacattcccatcttccatggcagaatattccag

SEQ ID NO: 163006 - DNA, 35 bp, Artificial Sequence
  Description of Artificial Sequence: Synthetic oligonucleotide
tccacattcccatcttccatggcagaatattccag

SEQ ID NO: 163007 - DNA, 34 bp, Artificial Sequence
  Description of Artificial Sequence: Synthetic oligonucleotide
ccacattcccatcttccatggcagaatattccag

SEQ ID NO: 163008 - DNA, 34 bp, Artificial Sequence
  Description of Artificial Sequence: Synthetic oligonucleotide
cacattcccatcttccatggcagaatattccagg

SEQ ID NO: 163009 - DNA, 35 bp, Artificial Sequence
  Description of Artificial Sequence: Synthetic oligonucleotide
acattcccatcttccatggcagaatattccaggag

SEQ ID NO: 163010 - DNA, 34 bp, Artificial Sequence
  Description of Artificial Sequence: Synthetic oligonucleotide
cattcccatcttccatggcagaatattccaggag

SEQ ID NO: 163011 - DNA, 35 bp, Artificial Sequence
  Description of Artificial Sequence: Synthetic oligonucleotide
attcccatcttccatggcagaatattccaggagag

SEQ ID NO: 163012 - DNA, 34 bp, Artificial Sequence
  Description of Artificial Sequence: Synthetic oligonucleotide
ttcccatcttccatggcagaatattccaggagag

SEQ ID NO: 163013 - DNA, 33 bp, Artificial Sequence
  Description of Artificial Sequence: Synthetic oligonucleotide
tcccatcttccatggcagaatattccaggagag

SEQ ID NO: 163014 - DNA, 32 bp, Artificial Sequence
  Description of Artificial Sequence: Synthetic oligonucleotide
cccatcttccatggcagaatattccaggagag

SEQ ID NO: 163015 - DNA, 32 bp, Artificial Sequence
  Description of Artificial Sequence: Synthetic oligonucleotide
ccatcttccatggcagaatattccaggagagc

SEQ ID NO: 163016 - DNA, 34 bp, Artificial Sequence
  Description of Artificial Sequence: Synthetic oligonucleotide
catcttccatggcagaatattccaggagagcttc

SEQ ID NO: 163017 - DNA, 36 bp, Artificial Sequence
  Description of Artificial Sequence: Synthetic oligonucleotide
atcttccatggcagaatattccaggagagcttcaac

SEQ ID NO: 163018 - DNA, 35 bp, Artificial Sequence
  Description of Artificial Sequence: Synthetic oligonucleotide
tcttccatggcagaatattccaggagagcttcaac

SEQ ID NO: 163019 - DNA, 34 bp, Artificial Sequence
  Description of Artificial Sequence: Synthetic oligonucleotide
cttccatggcagaatattccaggagagcttcaac

SEQ ID NO: 163020 - DNA, 36 bp, Artificial Sequence
  Description of Artificial Sequence: Synthetic oligonucleotide
ttccatggcagaatattccaggagagcttcaacatg

SEQ ID NO: 163021 - DNA, 35 bp, Artificial Sequence
  Description of Artificial Sequence: Synthetic oligonucleotide
tccatggcagaatattccaggagagcttcaacatg

SEQ ID NO: 163022 - DNA, 34 bp, Artificial Sequence
  Description of Artificial Sequence: Synthetic oligonucleotide
ccatggcagaatattccaggagagcttcaacatg

SEQ ID NO: 163023 - DNA, 35 bp, Artificial Sequence
  Description of Artificial Sequence: Synthetic oligonucleotide
catggcagaatattccaggagagcttcaacatgag

SEQ ID NO: 163024 - DNA, 35 bp, Artificial Sequence
  Description of Artificial Sequence: Synthetic oligonucleotide
atggcagaatattccaggagagcttcaacatgagc

SEQ ID NO: 163025 - DNA, 34 bp, Artificial Sequence
  Description of Artificial Sequence: Synthetic oligonucleotide
tggcagaatattccaggagagcttcaacatgagc

SEQ ID NO: 163026 - DNA, 33 bp, Artificial Sequence
  Description of Artificial Sequence: Synthetic oligonucleotide
ggcagaatattccaggagagcttcaacatgagc

SEQ ID NO: 163027 - DNA, 33 bp, Artificial Sequence
  Description of Artificial Sequence: Synthetic oligonucleotide
gcagaatattccaggagagcttcaacatgagcc

SEQ ID NO: 163028 - DNA, 33 bp, Artificial Sequence
  Description of Artificial Sequence: Synthetic oligonucleotide
cagaatattccaggagagcttcaacatgagccc

SEQ ID NO: 163029 - DNA, 34 bp, Artificial Sequence
  Description of Artificial Sequence: Synthetic oligonucleotide
agaatattccaggagagcttcaacatgagccctg

SEQ ID NO: 163030 - DNA, 33 bp, Artificial Sequence
  Description of Artificial Sequence: Synthetic oligonucleotide
gaatattccaggagagcttcaacatgagccctg

SEQ ID NO: 163031 - DNA, 34 bp, Artificial Sequence
  Description of Artificial Sequence: Synthetic oligonucleotide
aatattccaggagagcttcaacatgagccctgtg

SEQ ID NO: 163032 - DNA, 33 bp, Artificial Sequence
  Description of Artificial Sequence: Synthetic oligonucleotide
atattccaggagagcttcaacatgagccctgtg

SEQ ID NO: 163033 - DNA, 32 bp, Artificial Sequence
  Description of Artificial Sequence: Synthetic oligonucleotide
tattccaggagagcttcaacatgagccctgtg

SEQ ID NO: 163034 - DNA, 31 bp, Artificial Sequence
  Description of Artificial Sequence: Synthetic oligonucleotide
attccaggagagcttcaacatgagccctgtg

SEQ ID NO: 163035 - DNA, 30 bp, Artificial Sequence
  Description of Artificial Sequence: Synthetic oligonucleotide
ttccaggagagcttcaacatgagccctgtg

SEQ ID NO: 163036 - DNA, 29 bp, Artificial Sequence
  Description of Artificial Sequence: Synthetic oligonucleotide
tccaggagagcttcaacatgagccctgtg

SEQ ID NO: 163037 - DNA, 28 bp, Artificial Sequence
  Description of Artificial Sequence: Synthetic oligonucleotide
ccaggagagcttcaacatgagccctgtg

SEQ ID NO: 163038 - DNA, 29 bp, Artificial Sequence
  Description of Artificial Sequence: Synthetic oligonucleotide
caggagagcttcaacatgagccctgtgac

SEQ ID NO: 163039 - DNA, 29 bp, Artificial Sequence
  Description of Artificial Sequence: Synthetic oligonucleotide
aggagagcttcaacatgagccctgtgacc

SEQ ID NO: 163040 - DNA, 28 bp, Artificial Sequence
  Description of Artificial Sequence: Synthetic oligonucleotide
ggagagcttcaacatgagccctgtgacc

SEQ ID NO: 163041 - DNA, 29 bp, Artificial Sequence
  Description of Artificial Sequence: Synthetic oligonucleotide
gagagcttcaacatgagccctgtgaccac

SEQ ID NO: 163042 - DNA, 30 bp, Artificial Sequence
  Description of Artificial Sequence: Synthetic oligonucleotide
agagcttcaacatgagccctgtgaccacag

SEQ ID NO: 163043 - DNA, 29 bp, Artificial Sequence
  Description of Artificial Sequence: Synthetic oligonucleotide
gagcttcaacatgagccctgtgaccacag

SEQ ID NO: 163044 - DNA, 29 bp, Artificial Sequence
  Description of Artificial Sequence: Synthetic oligonucleotide
agcttcaacatgagccctgtgaccacagc

SEQ ID NO: 163045 - DNA, 28 bp, Artificial Sequence
  Description of Artificial Sequence: Synthetic oligonucleotide
gcttcaacatgagccctgtgaccacagc

SEQ ID NO: 163046 - DNA, 29 bp, Artificial Sequence
  Description of Artificial Sequence: Synthetic oligonucleotide
cttcaacatgagccctgtgaccacagcac

SEQ ID NO: 163047 - DNA, 31 bp, Artificial Sequence
  Description of Artificial Sequence: Synthetic oligonucleotide
ttcaacatgagccctgtgaccacagcacatg

SEQ ID NO: 163048 - DNA, 30 bp, Artificial Sequence
  Description of Artificial Sequence: Synthetic oligonucleotide
tcaacatgagccctgtgaccacagcacatg

SEQ ID NO: 163049 - DNA, 29 bp, Artificial Sequence
  Description of Artificial Sequence: Synthetic oligonucleotide
caacatgagccctgtgaccacagcacatg

SEQ ID NO: 163050 - DNA, 29 bp, Artificial Sequence
  Description of Artificial Sequence: Synthetic oligonucleotide
aacatgagccctgtgaccacagcacatgc

SEQ ID NO: 163051 - DNA, 28 bp, Artificial Sequence
  Description of Artificial Sequence: Synthetic oligonucleotide
acatgagccctgtgaccacagcacatgc

SEQ ID NO: 163052 - DNA, 27 bp, Artificial Sequence
  Description of Artificial Sequence: Synthetic oligonucleotide
catgagccctgtgaccacagcacatgc

SEQ ID NO: 163053 - DNA, 28 bp, Artificial Sequence
  Description of Artificial Sequence: Synthetic oligonucleotide
atgagccctgtgaccacagcacatgcag

SEQ ID NO: 163054 - DNA, 27 bp, Artificial Sequence
  Description of Artificial Sequence: Synthetic oligonucleotide
tgagccctgtgaccacagcacatgcag

SEQ ID NO: 163055 - DNA, 26 bp, Artificial Sequence
  Description of Artificial Sequence: Synthetic oligonucleotide
gagccctgtgaccacagcacatgcag

SEQ ID NO: 163056 - DNA, 26 bp, Artificial Sequence
  Description of Artificial Sequence: Synthetic oligonucleotide
agccctgtgaccacagcacatgcagg

SEQ ID NO: 163057 - DNA, 25 bp, Artificial Sequence
  Description of Artificial Sequence: Synthetic oligonucleotide
gccctgtgaccacagcacatgcagg

SEQ ID NO: 163058 - DNA, 27 bp, Artificial Sequence
  Description of Artificial Sequence: Synthetic oligonucleotide
ccctgtgaccacagcacatgcagggaa

SEQ ID NO: 163059 - DNA, 27 bp, Artificial Sequence
  Description of Artificial Sequence: Synthetic oligonucleotide
cctgtgaccacagcacatgcagggaac

SEQ ID NO: 163060 - DNA, 29 bp, Artificial Sequence
  Description of Artificial Sequence: Synthetic oligonucleotide
ctgtgaccacagcacatgcagggaactac

SEQ ID NO: 163061 - DNA, 30 bp, Artificial Sequence
  Description of Artificial Sequence: Synthetic oligonucleotide
tgtgaccacagcacatgcagggaactacac

SEQ ID NO: 163062 - DNA, 29 bp, Artificial Sequence
  Description of Artificial Sequence: Synthetic oligonucleotide
gtgaccacagcacatgcagggaactacac

SEQ ID NO: 163063 - DNA, 31 bp, Artificial Sequence
  Description of Artificial Sequence: Synthetic oligonucleotide
tgaccacagcacatgcagggaactacacatg

SEQ ID NO: 163064 - DNA, 30 bp, Artificial Sequence
  Description of Artificial Sequence: Synthetic oligonucleotide
gaccacagcacatgcagggaactacacatg

SEQ ID NO: 163065 - DNA, 31 bp, Artificial Sequence
  Description of Artificial Sequence: Synthetic oligonucleotide
accacagcacatgcagggaactacacatgtc

SEQ ID NO: 163066 - DNA, 30 bp, Artificial Sequence
  Description of Artificial Sequence: Synthetic oligonucleotide
ccacagcacatgcagggaactacacatgtc

SEQ ID NO: 163067 - DNA, 30 bp, Artificial Sequence
  Description of Artificial Sequence: Synthetic oligonucleotide
cacagcacatgcagggaactacacatgtcg

SEQ ID NO: 163068 - DNA, 30 bp, Artificial Sequence
  Description of Artificial Sequence: Synthetic oligonucleotide
acagcacatgcagggaactacacatgtcgg

SEQ ID NO: 163069 - DNA, 29 bp, Artificial Sequence
  Description of Artificial Sequence: Synthetic oligonucleotide
cagcacatgcagggaactacacatgtcgg

SEQ ID NO: 163070 - DNA, 29 bp, Artificial Sequence
  Description of Artificial Sequence: Synthetic oligonucleotide
agcacatgcagggaactacacatgtcggg

SEQ ID NO: 163071 - DNA, 28 bp, Artificial Sequence
  Description of Artificial Sequence: Synthetic oligonucleotide
gcacatgcagggaactacacatgtcggg

SEQ ID NO: 163072 - DNA, 28 bp, Artificial Sequence
  Description of Artificial Sequence: Synthetic oligonucleotide
cacatgcagggaactacacatgtcgggg

SEQ ID NO: 163073 - DNA, 30 bp, Artificial Sequence
  Description of Artificial Sequence: Synthetic oligonucleotide
acatgcagggaactacacatgtcggggttc

SEQ ID NO: 163074 - DNA, 29 bp, Artificial Sequence
  Description of Artificial Sequence: Synthetic oligonucleotide
catgcagggaactacacatgtcggggttc

SEQ ID NO: 163075 - DNA, 30 bp, Artificial Sequence
  Description of Artificial Sequence: Synthetic oligonucleotide
atgcagggaactacacatgtcggggttcac

SEQ ID NO: 163076 - DNA, 29 bp, Artificial Sequence
  Description of Artificial Sequence: Synthetic oligonucleotide
tgcagggaactacacatgtcggggttcac

SEQ ID NO: 163077 - DNA, 28 bp, Artificial Sequence
  Description of Artificial Sequence: Synthetic oligonucleotide
gcagggaactacacatgtcggggttcac

SEQ ID NO: 163078 - DNA, 29 bp, Artificial Sequence
  Description of Artificial Sequence: Synthetic oligonucleotide
cagggaactacacatgtcggggttcacac

SEQ ID NO: 163079 - DNA, 29 bp, Artificial Sequence
  Description of Artificial Sequence: Synthetic oligonucleotide
agggaactacacatgtcggggttcacacc

SEQ ID NO: 163080 - DNA, 28 bp, Artificial Sequence
  Description of Artificial Sequence: Synthetic oligonucleotide
gggaactacacatgtcggggttcacacc

SEQ ID NO: 163081 - DNA, 28 bp, Artificial Sequence
  Description of Artificial Sequence: Synthetic oligonucleotide
ggaactacacatgtcggggttcacaccc

SEQ ID NO: 163082 - DNA, 29 bp, Artificial Sequence
  Description of Artificial Sequence: Synthetic oligonucleotide
gaactacacatgtcggggttcacacccac

SEQ ID NO: 163083 - DNA, 30 bp, Artificial Sequence
  Description of Artificial Sequence: Synthetic oligonucleotide
aactacacatgtcggggttcacacccacac

SEQ ID NO: 163084 - DNA, 29 bp, Artificial Sequence
  Description of Artificial Sequence: Synthetic oligonucleotide
actacacatgtcggggttcacacccacac

SEQ ID NO: 163085 - DNA, 28 bp, Artificial Sequence
  Description of Artificial Sequence: Synthetic oligonucleotide
ctacacatgtcggggttcacacccacac

SEQ ID NO: 163086 - DNA, 29 bp, Artificial Sequence
  Description of Artificial Sequence: Synthetic oligonucleotide
tacacatgtcggggttcacacccacactc

SEQ ID NO: 163087 - DNA, 28 bp, Artificial Sequence
  Description of Artificial Sequence: Synthetic oligonucleotide
acacatgtcggggttcacacccacactc

SEQ ID NO: 163088 - DNA, 27 bp, Artificial Sequence
  Description of Artificial Sequence: Synthetic oligonucleotide
cacatgtcggggttcacacccacactc

SEQ ID NO: 163089 - DNA, 27 bp, Artificial Sequence
  Description of Artificial Sequence: Synthetic oligonucleotide
acatgtcggggttcacacccacactcc

SEQ ID NO: 163090 - DNA, 26 bp, Artificial Sequence
  Description of Artificial Sequence: Synthetic oligonucleotide
catgtcggggttcacacccacactcc

SEQ ID NO: 163091 - DNA, 25 bp, Artificial Sequence
  Description of Artificial Sequence: Synthetic oligonucleotide
gggttcacacccacactcccccact

SEQ ID NO: 163092 - DNA, 25 bp, Artificial Sequence
  Description of Artificial Sequence: Synthetic oligonucleotide
ggttcacacccacactcccccactg

SEQ ID NO: 163093 - DNA, 25 bp, Artificial Sequence
  Description of Artificial Sequence: Synthetic oligonucleotide
gttcacacccacactcccccactgg

SEQ ID NO: 163094 - DNA, 26 bp, Artificial Sequence
  Description of Artificial Sequence: Synthetic oligonucleotide
ttcacacccacactcccccactgggt

SEQ ID NO: 163095 - DNA, 25 bp, Artificial Sequence
  Description of Artificial Sequence: Synthetic oligonucleotide
tcacacccacactcccccactgggt

SEQ ID NO: 163096 - DNA, 24 bp, Artificial Sequence
  Description of Artificial Sequence: Synthetic oligonucleotide
cacacccacactcccccactgggt

SEQ ID NO: 163097 - DNA, 24 bp, Artificial Sequence
  Description of Artificial Sequence: Synthetic oligonucleotide
acacccacactcccccactgggtg

SEQ ID NO: 163098 - DNA, 23 bp, Artificial Sequence
  Description of Artificial Sequence: Synthetic oligonucleotide
cacccacactcccccactgggtg

SEQ ID NO: 163099 - DNA, 24 bp, Artificial Sequence
  Description of Artificial Sequence: Synthetic oligonucleotide
acccacactcccccactgggtggt

SEQ ID NO: 163100 - DNA, 23 bp, Artificial Sequence
  Description of Artificial Sequence: Synthetic oligonucleotide
cccacactcccccactgggtggt

SEQ ID NO: 163101 - DNA, 23 bp, Artificial Sequence
  Description of Artificial Sequence: Synthetic oligonucleotide
ccacactcccccactgggtggtc

SEQ ID NO: 163102 - DNA, 23 bp, Artificial Sequence
  Description of Artificial Sequence: Synthetic oligonucleotide
cacactcccccactgggtggtcg

SEQ ID NO: 163103 - DNA, 23 bp, Artificial Sequence
  Description of Artificial Sequence: Synthetic oligonucleotide
acactcccccactgggtggtcgg

SEQ ID NO: 163104 - DNA, 22 bp, Artificial Sequence
  Description of Artificial Sequence: Synthetic oligonucleotide
cactcccccactgggtggtcgg

SEQ ID NO: 163105 - DNA, 23 bp, Artificial Sequence
  Description of Artificial Sequence: Synthetic oligonucleotide
actcccccactgggtggtcggca

SEQ ID NO: 163106 - DNA, 22 bp, Artificial Sequence
  Description of Artificial Sequence: Synthetic oligonucleotide
ctcccccactgggtggtcggca

SEQ ID NO: 163107 - DNA, 22 bp, Artificial Sequence
  Description of Artificial Sequence: Synthetic oligonucleotide
tcccccactgggtggtcggcac

SEQ ID NO: 163108 - DNA, 21 bp, Artificial Sequence
  Description of Artificial Sequence: Synthetic oligonucleotide
cccccactgggtggtcggcac

SEQ ID NO: 163109 - DNA, 21 bp, Artificial Sequence
  Description of Artificial Sequence: Synthetic oligonucleotide
ccccactgggtggtcggcacc

SEQ ID NO: 163110 - DNA, 22 bp, Artificial Sequence
  Description of Artificial Sequence: Synthetic oligonucleotide
cccactgggtggtcggcaccca

SEQ ID NO: 163111 - DNA, 22 bp, Artificial Sequence
  Description of Artificial Sequence: Synthetic oligonucleotide
ccactgggtggtcggcacccag

SEQ ID NO: 163112 - DNA, 24 bp, Artificial Sequence
  Description of Artificial Sequence: Synthetic oligonucleotide
cactgggtggtcggcacccagcaa

SEQ ID NO: 163113 - DNA, 24 bp, Artificial Sequence
  Description of Artificial Sequence: Synthetic oligonucleotide
actgggtggtcggcacccagcaac

SEQ ID NO: 163114 - DNA, 23 bp, Artificial Sequence
  Description of Artificial Sequence: Synthetic oligonucleotide
ctgggtggtcggcacccagcaac

SEQ ID NO: 163115 - DNA, 23 bp, Artificial Sequence
  Description of Artificial Sequence: Synthetic oligonucleotide
tggtcggcacccagcaaccccgt

SEQ ID NO: 163116 - DNA, 22 bp, Artificial Sequence
  Description of Artificial Sequence: Synthetic oligonucleotide
ggtcggcacccagcaaccccgt

SEQ ID NO: 163117 - DNA, 22 bp, Artificial Sequence
  Description of Artificial Sequence: Synthetic oligonucleotide
gtcggcacccagcaaccccgtg

SEQ ID NO: 163118 - DNA, 23 bp, Artificial Sequence
  Description of Artificial Sequence: Synthetic oligonucleotide
tcggcacccagcaaccccgtggt

SEQ ID NO: 163119 - DNA, 22 bp, Artificial Sequence
  Description of Artificial Sequence: Synthetic oligonucleotide
cggcacccagcaaccccgtggt

SEQ ID NO: 163120 - DNA, 24 bp, Artificial Sequence
  Description of Artificial Sequence: Synthetic oligonucleotide
ggcacccagcaaccccgtggtgat

SEQ ID NO: 163121 - DNA, 26 bp, Artificial Sequence
  Description of Artificial Sequence: Synthetic oligonucleotide
gcacccagcaaccccgtggtgatcat

SEQ ID NO: 163122 - DNA, 26 bp, Artificial Sequence
  Description of Artificial Sequence: Synthetic oligonucleotide
cacccagcaaccccgtggtgatcatg

SEQ ID NO: 163123 - DNA, 27 bp, Artificial Sequence
  Description of Artificial Sequence: Synthetic oligonucleotide
acccagcaaccccgtggtgatcatggt

SEQ ID NO: 163124 - DNA, 26 bp, Artificial Sequence
  Description of Artificial Sequence: Synthetic oligonucleotide
cccagcaaccccgtggtgatcatggt

SEQ ID NO: 163125 - DNA, 27 bp, Artificial Sequence
  Description of Artificial Sequence: Synthetic oligonucleotide
ccagcaaccccgtggtgatcatggtca

SEQ ID NO: 163126 - DNA, 27 bp, Artificial Sequence
  Description of Artificial Sequence: Synthetic oligonucleotide
cagcaaccccgtggtgatcatggtcac

SEQ ID NO: 163127 - DNA, 28 bp, Artificial Sequence
  Description of Artificial Sequence: Synthetic oligonucleotide
agcaaccccgtggtgatcatggtcacag

SEQ ID NO: 163128 - DNA, 27 bp, Artificial Sequence
  Description of Artificial Sequence: Synthetic oligonucleotide
gcaaccccgtggtgatcatggtcacag

SEQ ID NO: 163129 - DNA, 27 bp, Artificial Sequence
  Description of Artificial Sequence: Synthetic oligonucleotide
caaccccgtggtgatcatggtcacagg

SEQ ID NO: 163130 - DNA, 30 bp, Artificial Sequence
  Description of Artificial Sequence: Synthetic oligonucleotide
aaccccgtggtgatcatggtcacaggaaac

SEQ ID NO: 163131 - DNA, 29 bp, Artificial Sequence
  Description of Artificial Sequence: Synthetic oligonucleotide
accccgtggtgatcatggtcacaggaaac

SEQ ID NO: 163132 - DNA, 28 bp, Artificial Sequence
  Description of Artificial Sequence: Synthetic oligonucleotide
ccccgtggtgatcatggtcacaggaaac

SEQ ID NO: 163133 - DNA, 28 bp, Artificial Sequence
  Description of Artificial Sequence: Synthetic oligonucleotide
cccgtggtgatcatggtcacaggaaacc

SEQ ID NO: 163134 - DNA, 29 bp, Artificial Sequence
  Description of Artificial Sequence: Synthetic oligonucleotide
ccgtggtgatcatggtcacaggaaaccac

SEQ ID NO: 163135 - DNA, 30 bp, Artificial Sequence
  Description of Artificial Sequence: Synthetic oligonucleotide
cgtggtgatcatggtcacaggaaaccacag

SEQ ID NO: 163136 - DNA, 34 bp, Artificial Sequence
  Description of Artificial Sequence: Synthetic oligonucleotide
gtggtgatcatggtcacaggaaaccacagaaaac

SEQ ID NO: 163137 - DNA, 34 bp, Artificial Sequence
  Description of Artificial Sequence: Synthetic oligonucleotide
tggtgatcatggtcacaggaaaccacagaaaacc

SEQ ID NO: 163138 - DNA, 33 bp, Artificial Sequence
  Description of Artificial Sequence: Synthetic oligonucleotide
ggtgatcatggtcacaggaaaccacagaaaacc

SEQ ID NO: 163139 - DNA, 35 bp, Artificial Sequence
  Description of Artificial Sequence: Synthetic oligonucleotide
gtgatcatggtcacaggaaaccacagaaaaccttc

SEQ ID NO: 163140 - DNA, 35 bp, Artificial Sequence
  Description of Artificial Sequence: Synthetic oligonucleotide
tgatcatggtcacaggaaaccacagaaaaccttcc

SEQ ID NO: 163141 - DNA, 34 bp, Artificial Sequence
  Description of Artificial Sequence: Synthetic oligonucleotide
gatcatggtcacaggaaaccacagaaaaccttcc

SEQ ID NO: 163142 - DNA, 34 bp, Artificial Sequence
  Description of Artificial Sequence: Synthetic oligonucleotide
atcatggtcacaggaaaccacagaaaaccttccc

SEQ ID NO: 163143 - DNA, 33 bp, Artificial Sequence
  Description of Artificial Sequence: Synthetic oligonucleotide
tcatggtcacaggaaaccacagaaaaccttccc

SEQ ID NO: 163144 - DNA, 32 bp, Artificial Sequence
  Description of Artificial Sequence: Synthetic oligonucleotide
catggtcacaggaaaccacagaaaaccttccc

SEQ ID NO: 163145 - DNA, 33 bp, Artificial Sequence
  Description of Artificial Sequence: Synthetic oligonucleotide
atggtcacaggaaaccacagaaaaccttccctc

SEQ ID NO: 163146 - DNA, 32 bp, Artificial Sequence
  Description of Artificial Sequence: Synthetic oligonucleotide
tggtcacaggaaaccacagaaaaccttccctc

SEQ ID NO: 163147 - DNA, 31 bp, Artificial Sequence
  Description of Artificial Sequence: Synthetic oligonucleotide
ggtcacaggaaaccacagaaaaccttccctc

SEQ ID NO: 163148 - DNA, 31 bp, Artificial Sequence
  Description of Artificial Sequence: Synthetic oligonucleotide
gtcacaggaaaccacagaaaaccttccctcc

SEQ ID NO: 163149 - DNA, 32 bp, Artificial Sequence
  Description of Artificial Sequence: Synthetic oligonucleotide
tcacaggaaaccacagaaaaccttccctcctg

SEQ ID NO: 163150 - DNA, 31 bp, Artificial Sequence
  Description of Artificial Sequence: Synthetic oligonucleotide
cacaggaaaccacagaaaaccttccctcctg

SEQ ID NO: 163151 - DNA, 31 bp, Artificial Sequence
  Description of Artificial Sequence: Synthetic oligonucleotide
acaggaaaccacagaaaaccttccctcctgg

SEQ ID NO: 163152 - DNA, 30 bp, Artificial Sequence
  Description of Artificial Sequence: Synthetic oligonucleotide
caggaaaccacagaaaaccttccctcctgg

SEQ ID NO: 163153 - DNA, 30 bp, Artificial Sequence
  Description of Artificial Sequence: Synthetic oligonucleotide
aggaaaccacagaaaaccttccctcctggc

SEQ ID NO: 163154 - DNA, 29 bp, Artificial Sequence
  Description of Artificial Sequence: Synthetic oligonucleotide
ggaaaccacagaaaaccttccctcctggc

SEQ ID NO: 163155 - DNA, 29 bp, Artificial Sequence
  Description of Artificial Sequence: Synthetic oligonucleotide
gaaaccacagaaaaccttccctcctggcc

SEQ ID NO: 163156 - DNA, 29 bp, Artificial Sequence
  Description of Artificial Sequence: Synthetic oligonucleotide
aaaccacagaaaaccttccctcctggccc

SEQ ID NO: 163157 - DNA, 28 bp, Artificial Sequence
  Description of Artificial Sequence: Synthetic oligonucleotide
aaccacagaaaaccttccctcctggccc

SEQ ID NO: 163158 - DNA, 27 bp, Artificial Sequence
  Description of Artificial Sequence: Synthetic oligonucleotide
accacagaaaaccttccctcctggccc

SEQ ID NO: 163159 - DNA, 26 bp, Artificial Sequence
  Description of Artificial Sequence: Synthetic oligonucleotide
ccacccaggtcccctggtgaaatcag

SEQ ID NO: 163160 - DNA, 27 bp, Artificial Sequence
  Description of Artificial Sequence: Synthetic oligonucleotide
cacccaggtcccctggtgaaatcagga

SEQ ID NO: 163161 - DNA, 27 bp, Artificial Sequence
  Description of Artificial Sequence: Synthetic oligonucleotide
acccaggtcccctggtgaaatcaggag

SEQ ID NO: 163162 - DNA, 27 bp, Artificial Sequence
  Description of Artificial Sequence: Synthetic oligonucleotide
cccaggtcccctggtgaaatcaggaga

SEQ ID NO: 163163 - DNA, 27 bp, Artificial Sequence
  Description of Artificial Sequence: Synthetic oligonucleotide
ccaggtcccctggtgaaatcaggagag

SEQ ID NO: 163164 - DNA, 28 bp, Artificial Sequence
  Description of Artificial Sequence: Synthetic oligonucleotide
caggtcccctggtgaaatcaggagagag

SEQ ID NO: 163165 - DNA, 29 bp, Artificial Sequence
  Description of Artificial Sequence: Synthetic oligonucleotide
aggtcccctggtgaaatcaggagagagag

SEQ ID NO: 163166 - DNA, 28 bp, Artificial Sequence
  Description of Artificial Sequence: Synthetic oligonucleotide
ggtcccctggtgaaatcaggagagagag

SEQ ID NO: 163167 - DNA, 29 bp, Artificial Sequence
  Description of Artificial Sequence: Synthetic oligonucleotide
gtcccctggtgaaatcaggagagagagtc

SEQ ID NO: 163168 - DNA, 31 bp, Artificial Sequence
  Description of Artificial Sequence: Synthetic oligonucleotide
tcccctggtgaaatcaggagagagagtcatc

SEQ ID NO: 163169 - DNA, 30 bp, Artificial Sequence
  Description of Artificial Sequence: Synthetic oligonucleotide
cccctggtgaaatcaggagagagagtcatc

SEQ ID NO: 163170 - DNA, 30 bp, Artificial Sequence
  Description of Artificial Sequence: Synthetic oligonucleotide
ccctggtgaaatcaggagagagagtcatcc

SEQ ID NO: 163171 - DNA, 31 bp, Artificial Sequence
  Description of Artificial Sequence: Synthetic oligonucleotide
cctggtgaaatcaggagagagagtcatcctg

SEQ ID NO: 163172 - DNA, 31 bp, Artificial Sequence
  Description of Artificial Sequence: Synthetic oligonucleotide
ctggtgaaatcaggagagagagtcatcctgc

SEQ ID NO: 163173 - DNA, 34 bp, Artificial Sequence
  Description of Artificial Sequence: Synthetic oligonucleotide
tggtgaaatcaggagagagagtcatcctgcaatg

SEQ ID NO: 163174 - DNA, 33 bp, Artificial Sequence
  Description of Artificial Sequence: Synthetic oligonucleotide
ggtgaaatcaggagagagagtcatcctgcaatg

SEQ ID NO: 163175 - DNA, 35 bp, Artificial Sequence
  Description of Artificial Sequence: Synthetic oligonucleotide
gtgaaatcaggagagagagtcatcctgcaatgttg

SEQ ID NO: 163176 - DNA, 35 bp, Artificial Sequence
  Description of Artificial Sequence: Synthetic oligonucleotide
tgaaatcaggagagagagtcatcctgcaatgttgg

SEQ ID NO: 163177 - DNA, 34 bp, Artificial Sequence
  Description of Artificial Sequence: Synthetic oligonucleotide
gaaatcaggagagagagtcatcctgcaatgttgg

SEQ ID NO: 163178 - DNA, 35 bp, Artificial Sequence
  Description of Artificial Sequence: Synthetic oligonucleotide
aaatcaggagagagagtcatcctgcaatgttggtc

SEQ ID NO: 163179 - DNA, 34 bp, Artificial Sequence
  Description of Artificial Sequence: Synthetic oligonucleotide
aatcaggagagagagtcatcctgcaatgttggtc

SEQ ID NO: 163180 - DNA, 33 bp, Artificial Sequence
  Description of Artificial Sequence: Synthetic oligonucleotide
atcaggagagagagtcatcctgcaatgttggtc

SEQ ID NO: 163181 - DNA, 32 bp, Artificial Sequence
  Description of Artificial Sequence: Synthetic oligonucleotide
tcaggagagagagtcatcctgcaatgttggtc

SEQ ID NO: 163182 - DNA, 31 bp, Artificial Sequence
  Description of Artificial Sequence: Synthetic oligonucleotide
caggagagagagtcatcctgcaatgttggtc

SEQ ID NO: 163183 - DNA, 32 bp, Artificial Sequence
  Description of Artificial Sequence: Synthetic oligonucleotide
aggagagagagtcatcctgcaatgttggtcag

SEQ ID NO: 163184 - DNA, 31 bp, Artificial Sequence
  Description of Artificial Sequence: Synthetic oligonucleotide
ggagagagagtcatcctgcaatgttggtcag

SEQ ID NO: 163185 - DNA, 35 bp, Artificial Sequence
  Description of Artificial Sequence: Synthetic oligonucleotide
gagagagagtcatcctgcaatgttggtcagatatc

SEQ ID NO: 163186 - DNA, 37 bp, Artificial Sequence
  Description of Artificial Sequence: Synthetic oligonucleotide
agagagagtcatcctgcaatgttggtcagatatcatg

SEQ ID NO: 163187 - DNA, 36 bp, Artificial Sequence
  Description of Artificial Sequence: Synthetic oligonucleotide
gagagagtcatcctgcaatgttggtcagatatcatg

SEQ ID NO: 163188 - DNA, 39 bp, Artificial Sequence
  Description of Artificial Sequence: Synthetic oligonucleotide
agagagtcatcctgcaatgttggtcagatatcatgtttg

SEQ ID NO: 163189 - DNA, 38 bp, Artificial Sequence
  Description of Artificial Sequence: Synthetic oligonucleotide
gagagtcatcctgcaatgttggtcagatatcatgtttg

SEQ ID NO: 163190 - DNA, 39 bp, Artificial Sequence
  Description of Artificial Sequence: Synthetic oligonucleotide
agagtcatcctgcaatgttggtcagatatcatgtttgag

SEQ ID NO: 163191 - DNA, 38 bp, Artificial Sequence
  Description of Artificial Sequence: Synthetic oligonucleotide
gagtcatcctgcaatgttggtcagatatcatgtttgag

SEQ ID NO: 163192 - DNA, 38 bp, Artificial Sequence
  Description of Artificial Sequence: Synthetic oligonucleotide
agtcatcctgcaatgttggtcagatatcatgtttgagc

SEQ ID NO: 163193 - DNA, 37 bp, Artificial Sequence
  Description of Artificial Sequence: Synthetic oligonucleotide
gtcatcctgcaatgttggtcagatatcatgtttgagc

SEQ ID NO: 163194 - DNA, 38 bp, Artificial Sequence
  Description of Artificial Sequence: Synthetic oligonucleotide
tcatcctgcaatgttggtcagatatcatgtttgagcac

SEQ ID NO: 163195 - DNA, 37 bp, Artificial Sequence
  Description of Artificial Sequence: Synthetic oligonucleotide
catcctgcaatgttggtcagatatcatgtttgagcac

SEQ ID NO: 163196 - DNA, 39 bp, Artificial Sequence
  Description of Artificial Sequence: Synthetic oligonucleotide
atcctgcaatgttggtcagatatcatgtttgagcacttc

SEQ ID NO: 163197 - DNA, 38 bp, Artificial Sequence
  Description of Artificial Sequence: Synthetic oligonucleotide
tcctgcaatgttggtcagatatcatgtttgagcacttc

SEQ ID NO: 163198 - DNA, 37 bp, Artificial Sequence
  Description of Artificial Sequence: Synthetic oligonucleotide
cctgcaatgttggtcagatatcatgtttgagcacttc

SEQ ID NO: 163199 - DNA, 40 bp, Artificial Sequence
  Description of Artificial Sequence: Synthetic oligonucleotide
ctgcaatgttggtcagatatcatgtttgagcacttctttc

SEQ ID NO: 163200 - DNA, 41 bp, Artificial Sequence
  Description of Artificial Sequence: Synthetic oligonucleotide
tgcaatgttggtcagatatcatgtttgagcacttctttctg

SEQ ID NO: 163201 - DNA, 40 bp, Artificial Sequence
  Description of Artificial Sequence: Synthetic oligonucleotide
gcaatgttggtcagatatcatgtttgagcacttctttctg

SEQ ID NO: 163202 - DNA, 40 bp, Artificial Sequence
  Description of Artificial Sequence: Synthetic oligonucleotide
caatgttggtcagatatcatgtttgagcacttctttctgc

SEQ ID NO: 163203 - DNA, 41 bp, Artificial Sequence
  Description of Artificial Sequence: Synthetic oligonucleotide
aatgttggtcagatatcatgtttgagcacttctttctgcac

SEQ ID NO: 163204 - DNA, 40 bp, Artificial Sequence
  Description of Artificial Sequence: Synthetic oligonucleotide
atgttggtcagatatcatgtttgagcacttctttctgcac

SEQ ID NO: 163205 - DNA, 39 bp, Artificial Sequence
  Description of Artificial Sequence: Synthetic oligonucleotide
tgttggtcagatatcatgtttgagcacttctttctgcac

SEQ ID NO: 163206 - DNA, 38 bp, Artificial Sequence
  Description of Artificial Sequence: Synthetic oligonucleotide
gttggtcagatatcatgtttgagcacttctttctgcac

SEQ ID NO: 163207 - DNA, 41 bp, Artificial Sequence
  Description of Artificial Sequence: Synthetic oligonucleotide
ttggtcagatatcatgtttgagcacttctttctgcacaaag

SEQ ID NO: 163208 - DNA, 40 bp, Artificial Sequence
  Description of Artificial Sequence: Synthetic oligonucleotide
tggtcagatatcatgtttgagcacttctttctgcacaaag

SEQ ID NO: 163209 - DNA, 39 bp, Artificial Sequence
  Description of Artificial Sequence: Synthetic oligonucleotide
ggtcagatatcatgtttgagcacttctttctgcacaaag

SEQ ID NO: 163210 - DNA, 40 bp, Artificial Sequence
  Description of Artificial Sequence: Synthetic oligonucleotide
gtcagatatcatgtttgagcacttctttctgcacaaagag

SEQ ID NO: 163211 - DNA, 40 bp, Artificial Sequence
  Description of Artificial Sequence: Synthetic oligonucleotide
tcagatatcatgtttgagcacttctttctgcacaaagagg

SEQ ID NO: 163212 - DNA, 39 bp, Artificial Sequence
  Description of Artificial Sequence: Synthetic oligonucleotide
cagatatcatgtttgagcacttctttctgcacaaagagg

SEQ ID NO: 163213 - DNA, 39 bp, Artificial Sequence
  Description of Artificial Sequence: Synthetic oligonucleotide
agatatcatgtttgagcacttctttctgcacaaagaggg

SEQ ID NO: 163214 - DNA, 38 bp, Artificial Sequence
  Description of Artificial Sequence: Synthetic oligonucleotide
gatatcatgtttgagcacttctttctgcacaaagaggg

SEQ ID NO: 163215 - DNA, 38 bp, Artificial Sequence
  Description of Artificial Sequence: Synthetic oligonucleotide
atatcatgtttgagcacttctttctgcacaaagagggg

SEQ ID NO: 163216 - DNA, 37 bp, Artificial Sequence
  Description of Artificial Sequence: Synthetic oligonucleotide
tatcatgtttgagcacttctttctgcacaaagagggg

SEQ ID NO: 163217 - DNA, 36 bp, Artificial Sequence
  Description of Artificial Sequence: Synthetic oligonucleotide
atcatgtttgagcacttctttctgcacaaagagggg

SEQ ID NO: 163218 - DNA, 35 bp, Artificial Sequence
  Description of Artificial Sequence: Synthetic oligonucleotide
tcatgtttgagcacttctttctgcacaaagagggg

SEQ ID NO: 163219 - DNA, 34 bp, Artificial Sequence
  Description of Artificial Sequence: Synthetic oligonucleotide
catgtttgagcacttctttctgcacaaagagggg

SEQ ID NO: 163220 - DNA, 36 bp, Artificial Sequence
  Description of Artificial Sequence: Synthetic oligonucleotide
atgtttgagcacttctttctgcacaaagaggggatc

SEQ ID NO: 163221 - DNA, 35 bp, Artificial Sequence
  Description of Artificial Sequence: Synthetic oligonucleotide
tgtttgagcacttctttctgcacaaagaggggatc

SEQ ID NO: 163222 - DNA, 34 bp, Artificial Sequence
  Description of Artificial Sequence: Synthetic oligonucleotide
gtttgagcacttctttctgcacaaagaggggatc

SEQ ID NO: 163223 - DNA, 35 bp, Artificial Sequence
  Description of Artificial Sequence: Synthetic oligonucleotide
tttgagcacttctttctgcacaaagaggggatctc

SEQ ID NO: 163224 - DNA, 34 bp, Artificial Sequence
  Description of Artificial Sequence: Synthetic oligonucleotide
ttgagcacttctttctgcacaaagaggggatctc

SEQ ID NO: 163225 - DNA, 33 bp, Artificial Sequence
  Description of Artificial Sequence: Synthetic oligonucleotide
tgagcacttctttctgcacaaagaggggatctc

SEQ ID NO: 163226 - DNA, 32 bp, Artificial Sequence
  Description of Artificial Sequence: Synthetic oligonucleotide
gagcacttctttctgcacaaagaggggatctc

SEQ ID NO: 163227 - DNA, 35 bp, Artificial Sequence
  Description of Artificial Sequence: Synthetic oligonucleotide
agcacttctttctgcacaaagaggggatctctaag

SEQ ID NO: 163228 - DNA, 34 bp, Artificial Sequence
  Description of Artificial Sequence: Synthetic oligonucleotide
gcacttctttctgcacaaagaggggatctctaag

SEQ ID NO: 163229 - DNA, 34 bp, Artificial Sequence
  Description of Artificial Sequence: Synthetic oligonucleotide
cacttctttctgcacaaagaggggatctctaagg

SEQ ID NO: 163230 - DNA, 35 bp, Artificial Sequence
  Description of Artificial Sequence: Synthetic oligonucleotide
acttctttctgcacaaagaggggatctctaaggac

SEQ ID NO: 163231 - DNA, 34 bp, Artificial Sequence
  Description of Artificial Sequence: Synthetic oligonucleotide
cttctttctgcacaaagaggggatctctaaggac

SEQ ID NO: 163232 - DNA, 34 bp, Artificial Sequence
  Description of Artificial Sequence: Synthetic oligonucleotide
ttctttctgcacaaagaggggatctctaaggacc

SEQ ID NO: 163233 - DNA, 33 bp, Artificial Sequence
  Description of Artificial Sequence: Synthetic oligonucleotide
tctttctgcacaaagaggggatctctaaggacc

SEQ ID NO: 163234 - DNA, 32 bp, Artificial Sequence
  Description of Artificial Sequence: Synthetic oligonucleotide
ctttctgcacaaagaggggatctctaaggacc

SEQ ID NO: 163235 - DNA, 32 bp, Artificial Sequence
  Description of Artificial Sequence: Synthetic oligonucleotide
tttctgcacaaagaggggatctctaaggaccc

SEQ ID NO: 163236 - DNA, 31 bp, Artificial Sequence
  Description of Artificial Sequence: Synthetic oligonucleotide
ttctgcacaaagaggggatctctaaggaccc

SEQ ID NO: 163237 - DNA, 30 bp, Artificial Sequence
  Description of Artificial Sequence: Synthetic oligonucleotide
tctgcacaaagaggggatctctaaggaccc

SEQ ID NO: 163238 - DNA, 29 bp, Artificial Sequence
  Description of Artificial Sequence: Synthetic oligonucleotide
ctgcacaaagaggggatctctaaggaccc

SEQ ID NO: 163239 - DNA, 29 bp, Artificial Sequence
  Description of Artificial Sequence: Synthetic oligonucleotide
tgcacaaagaggggatctctaaggacccc

SEQ ID NO: 163240 - DNA, 28 bp, Artificial Sequence
  Description of Artificial Sequence: Synthetic oligonucleotide
gcacaaagaggggatctctaaggacccc

SEQ ID NO: 163241 - DNA, 29 bp, Artificial Sequence
  Description of Artificial Sequence: Synthetic oligonucleotide
cacaaagaggggatctctaaggacccctc

SEQ ID NO: 163242 - DNA, 30 bp, Artificial Sequence
  Description of Artificial Sequence: Synthetic oligonucleotide
acaaagaggggatctctaaggacccctcac

SEQ ID NO: 163243 - DNA, 29 bp, Artificial Sequence
  Description of Artificial Sequence: Synthetic oligonucleotide
caaagaggggatctctaaggacccctcac

SEQ ID NO: 163244 - DNA, 29 bp, Artificial Sequence
  Description of Artificial Sequence: Synthetic oligonucleotide
aaagaggggatctctaaggacccctcacg

SEQ ID NO: 163245 - DNA, 28 bp, Artificial Sequence
  Description of Artificial Sequence: Synthetic oligonucleotide
aagaggggatctctaaggacccctcacg

SEQ ID NO: 163246 - DNA, 27 bp, Artificial Sequence
  Description of Artificial Sequence: Synthetic oligonucleotide
agaggggatctctaaggacccctcacg

SEQ ID NO: 163247 - DNA, 26 bp, Artificial Sequence
  Description of Artificial Sequence: Synthetic oligonucleotide
gaggggatctctaaggacccctcacg

SEQ ID NO: 163248 - DNA, 26 bp, Artificial Sequence
  Description of Artificial Sequence: Synthetic oligonucleotide
aggggatctctaaggacccctcacgc

SEQ ID NO: 163249 - DNA, 25 bp, Artificial Sequence
  Description of Artificial Sequence: Synthetic oligonucleotide
ggggatctctaaggacccctcacgc

SEQ ID NO: 163250 - DNA, 26 bp, Artificial Sequence
  Description of Artificial Sequence: Synthetic oligonucleotide
gggatctctaaggacccctcacgcct

SEQ ID NO: 163251 - DNA, 26 bp, Artificial Sequence
  Description of Artificial Sequence: Synthetic oligonucleotide
ggatctctaaggacccctcacgcctc

SEQ ID NO: 163252 - DNA, 27 bp, Artificial Sequence
  Description of Artificial Sequence: Synthetic oligonucleotide
gatctctaaggacccctcacgcctcgt

SEQ ID NO: 163253 - DNA, 28 bp, Artificial Sequence
  Description of Artificial Sequence: Synthetic oligonucleotide
atctctaaggacccctcacgcctcgttg

SEQ ID NO: 163254 - DNA, 27 bp, Artificial Sequence
  Description of Artificial Sequence: Synthetic oligonucleotide
tctctaaggacccctcacgcctcgttg

SEQ ID NO: 163255 - DNA, 26 bp, Artificial Sequence
  Description of Artificial Sequence: Synthetic oligonucleotide
ctctaaggacccctcacgcctcgttg

SEQ ID NO: 163256 - DNA, 27 bp, Artificial Sequence
  Description of Artificial Sequence: Synthetic oligonucleotide
tctaaggacccctcacgcctcgttgga

SEQ ID NO: 163257 - DNA, 26 bp, Artificial Sequence
  Description of Artificial Sequence: Synthetic oligonucleotide
ctaaggacccctcacgcctcgttgga

SEQ ID NO: 163258 - DNA, 27 bp, Artificial Sequence
  Description of Artificial Sequence: Synthetic oligonucleotide
taaggacccctcacgcctcgttggaca

SEQ ID NO: 163259 - DNA, 26 bp, Artificial Sequence
  Description of Artificial Sequence: Synthetic oligonucleotide
aaggacccctcacgcctcgttggaca

SEQ ID NO: 163260 - DNA, 25 bp, Artificial Sequence
  Description of Artificial Sequence: Synthetic oligonucleotide
aggacccctcacgcctcgttggaca

SEQ ID NO: 163261 - DNA, 24 bp, Artificial Sequence
  Description of Artificial Sequence: Synthetic oligonucleotide
ggacccctcacgcctcgttggaca

SEQ ID NO: 163262 - DNA, 26 bp, Artificial Sequence
  Description of Artificial Sequence: Synthetic oligonucleotide
gacccctcacgcctcgttggacagat

SEQ ID NO: 163263 - DNA, 26 bp, Artificial Sequence
  Description of Artificial Sequence: Synthetic oligonucleotide
acccctcacgcctcgttggacagatc

SEQ ID NO: 163264 - DNA, 25 bp, Artificial Sequence
  Description of Artificial Sequence: Synthetic oligonucleotide
cccctcacgcctcgttggacagatc

SEQ ID NO: 163265 - DNA, 27 bp, Artificial Sequence
  Description of Artificial Sequence: Synthetic oligonucleotide
ccctcacgcctcgttggacagatccat

SEQ ID NO: 163266 - DNA, 27 bp, Artificial Sequence
  Description of Artificial Sequence: Synthetic oligonucleotide
cctcacgcctcgttggacagatccatg

SEQ ID NO: 163267 - DNA, 29 bp, Artificial Sequence
  Description of Artificial Sequence: Synthetic oligonucleotide
ctcacgcctcgttggacagatccatgatg

SEQ ID NO: 163268 - DNA, 29 bp, Artificial Sequence
  Description of Artificial Sequence: Synthetic oligonucleotide
tcacgcctcgttggacagatccatgatgg

SEQ ID NO: 163269 - DNA, 28 bp, Artificial Sequence
  Description of Artificial Sequence: Synthetic oligonucleotide
cacgcctcgttggacagatccatgatgg

SEQ ID NO: 163270 - DNA, 28 bp, Artificial Sequence
  Description of Artificial Sequence: Synthetic oligonucleotide
acgcctcgttggacagatccatgatggg

SEQ ID NO: 163271 - DNA, 27 bp, Artificial Sequence
  Description of Artificial Sequence: Synthetic oligonucleotide
cgcctcgttggacagatccatgatggg

SEQ ID NO: 163272 - DNA, 27 bp, Artificial Sequence
  Description of Artificial Sequence: Synthetic oligonucleotide
gcctcgttggacagatccatgatgggg

SEQ ID NO: 163273 - DNA, 28 bp, Artificial Sequence
  Description of Artificial Sequence: Synthetic oligonucleotide
cctcgttggacagatccatgatggggtc

SEQ ID NO: 163274 - DNA, 29 bp, Artificial Sequence
  Description of Artificial Sequence: Synthetic oligonucleotide
ctcgttggacagatccatgatggggtctc

SEQ ID NO: 163275 - DNA, 29 bp, Artificial Sequence
  Description of Artificial Sequence: Synthetic oligonucleotide
tcgttggacagatccatgatggggtctcc

SEQ ID NO: 163276 - DNA, 28 bp, Artificial Sequence
  Description of Artificial Sequence: Synthetic oligonucleotide
cgttggacagatccatgatggggtctcc

SEQ ID NO: 163277 - DNA, 30 bp, Artificial Sequence
  Description of Artificial Sequence: Synthetic oligonucleotide
gttggacagatccatgatggggtctccaag

SEQ ID NO: 163278 - DNA, 30 bp, Artificial Sequence
  Description of Artificial Sequence: Synthetic oligonucleotide
ttggacagatccatgatggggtctccaagg

SEQ ID NO: 163279 - DNA, 29 bp, Artificial Sequence
  Description of Artificial Sequence: Synthetic oligonucleotide
tggacagatccatgatggggtctccaagg

SEQ ID NO: 163280 - DNA, 28 bp, Artificial Sequence
  Description of Artificial Sequence: Synthetic oligonucleotide
ggacagatccatgatggggtctccaagg

SEQ ID NO: 163281 - DNA, 28 bp, Artificial Sequence
  Description of Artificial Sequence: Synthetic oligonucleotide
gacagatccatgatggggtctccaaggc

SEQ ID NO: 163282 - DNA, 28 bp, Artificial Sequence
  Description of Artificial Sequence: Synthetic oligonucleotide
acagatccatgatggggtctccaaggcc

SEQ ID NO: 163283 - DNA, 27 bp, Artificial Sequence
  Description of Artificial Sequence: Synthetic oligonucleotide
cagatccatgatggggtctccaaggcc

SEQ ID NO: 163284 - DNA, 32 bp, Artificial Sequence
  Description of Artificial Sequence: Synthetic oligonucleotide
agatccatgatggggtctccaaggccaatttc

SEQ ID NO: 163285 - DNA, 31 bp, Artificial Sequence
  Description of Artificial Sequence: Synthetic oligonucleotide
gatccatgatggggtctccaaggccaatttc

SEQ ID NO: 163286 - DNA, 32 bp, Artificial Sequence
  Description of Artificial Sequence: Synthetic oligonucleotide
atccatgatggggtctccaaggccaatttctc

SEQ ID NO: 163287 - DNA, 31 bp, Artificial Sequence
  Description of Artificial Sequence: Synthetic oligonucleotide
tccatgatggggtctccaaggccaatttctc

SEQ ID NO: 163288 - DNA, 30 bp, Artificial Sequence
  Description of Artificial Sequence: Synthetic oligonucleotide
ccatgatggggtctccaaggccaatttctc

SEQ ID NO: 163289 - DNA, 30 bp, Artificial Sequence
  Description of Artificial Sequence: Synthetic oligonucleotide
catgatggggtctccaaggccaatttctcc

SEQ ID NO: 163290 - DNA, 32 bp, Artificial Sequence
  Description of Artificial Sequence: Synthetic oligonucleotide
atgatggggtctccaaggccaatttctccatc

SEQ ID NO: 163291 - DNA, 31 bp, Artificial Sequence
  Description of Artificial Sequence: Synthetic oligonucleotide
tgatggggtctccaaggccaatttctccatc

SEQ ID NO: 163292 - DNA, 30 bp, Artificial Sequence
  Description of Artificial Sequence: Synthetic oligonucleotide
gatggggtctccaaggccaatttctccatc

SEQ ID NO: 163293 - DNA, 30 bp, Artificial Sequence
  Description of Artificial Sequence: Synthetic oligonucleotide
atggggtctccaaggccaatttctccatcg

SEQ ID NO: 163294 - DNA, 29 bp, Artificial Sequence
  Description of Artificial Sequence: Synthetic oligonucleotide
tggggtctccaaggccaatttctccatcg

SEQ ID NO: 163295 - DNA, 28 bp, Artificial Sequence
  Description of Artificial Sequence: Synthetic oligonucleotide
ggggtctccaaggccaatttctccatcg

SEQ ID NO: 163296 - DNA, 28 bp, Artificial Sequence
  Description of Artificial Sequence: Synthetic oligonucleotide
gggtctccaaggccaatttctccatcgg

SEQ ID NO: 163297 - DNA, 29 bp, Artificial Sequence
  Description of Artificial Sequence: Synthetic oligonucleotide
ggtctccaaggccaatttctccatcggtc

SEQ ID NO: 163298 - DNA, 29 bp, Artificial Sequence
  Description of Artificial Sequence: Synthetic oligonucleotide
gtctccaaggccaatttctccatcggtcc

SEQ ID NO: 163299 - DNA, 29 bp, Artificial Sequence
  Description of Artificial Sequence: Synthetic oligonucleotide
tctccaaggccaatttctccatcggtccc

SEQ ID NO: 163300 - DNA, 28 bp, Artificial Sequence
  Description of Artificial Sequence: Synthetic oligonucleotide
ctccaaggccaatttctccatcggtccc

SEQ ID NO: 163301 - DNA, 30 bp, Artificial Sequence
  Description of Artificial Sequence: Synthetic oligonucleotide
tccaaggccaatttctccatcggtcccatg

SEQ ID NO: 163302 - DNA, 29 bp, Artificial Sequence
  Description of Artificial Sequence: Synthetic oligonucleotide
ccaaggccaatttctccatcggtcccatg

SEQ ID NO: 163303 - DNA, 31 bp, Artificial Sequence
  Description of Artificial Sequence: Synthetic oligonucleotide
caaggccaatttctccatcggtcccatgatg

SEQ ID NO: 163304 - DNA, 31 bp, Artificial Sequence
  Description of Artificial Sequence: Synthetic oligonucleotide
aaggccaatttctccatcggtcccatgatgc

SEQ ID NO: 163305 - DNA, 30 bp, Artificial Sequence
  Description of Artificial Sequence: Synthetic oligonucleotide
aggccaatttctccatcggtcccatgatgc

SEQ ID NO: 163306 - DNA, 29 bp, Artificial Sequence
  Description of Artificial Sequence: Synthetic oligonucleotide
ggccaatttctccatcggtcccatgatgc

SEQ ID NO: 163307 - DNA, 31 bp, Artificial Sequence
  Description of Artificial Sequence: Synthetic oligonucleotide
gccaatttctccatcggtcccatgatgcttg

SEQ ID NO: 163308 - DNA, 31 bp, Artificial Sequence
  Description of Artificial Sequence: Synthetic oligonucleotide
ccaatttctccatcggtcccatgatgcttgc

SEQ ID NO: 163309 - DNA, 31 bp, Artificial Sequence
  Description of Artificial Sequence: Synthetic oligonucleotide
caatttctccatcggtcccatgatgcttgcc

SEQ ID NO: 163310 - DNA, 31 bp, Artificial Sequence
  Description of Artificial Sequence: Synthetic oligonucleotide
aatttctccatcggtcccatgatgcttgccc

SEQ ID NO: 163311 - DNA, 30 bp, Artificial Sequence
  Description of Artificial Sequence: Synthetic oligonucleotide
atttctccatcggtcccatgatgcttgccc

SEQ ID NO: 163312 - DNA, 29 bp, Artificial Sequence
  Description of Artificial Sequence: Synthetic oligonucleotide
tttctccatcggtcccatgatgcttgccc

SEQ ID NO: 163313 - DNA, 28 bp, Artificial Sequence
  Description of Artificial Sequence: Synthetic oligonucleotide
ttctccatcggtcccatgatgcttgccc

SEQ ID NO: 163314 - DNA, 27 bp, Artificial Sequence
  Description of Artificial Sequence: Synthetic oligonucleotide
tctccatcggtcccatgatgcttgccc

SEQ ID NO: 163315 - DNA, 27 bp, Artificial Sequence
  Description of Artificial Sequence: Synthetic oligonucleotide
ctccatcggtcccatgatgcttgccct

SEQ ID NO: 163316 - DNA, 28 bp, Artificial Sequence
  Description of Artificial Sequence: Synthetic oligonucleotide
tccatcggtcccatgatgcttgcccttg

SEQ ID NO: 163317 - DNA, 27 bp, Artificial Sequence
  Description of Artificial Sequence: Synthetic oligonucleotide
ccatcggtcccatgatgcttgcccttg

SEQ ID NO: 163318 - DNA, 27 bp, Artificial Sequence
  Description of Artificial Sequence: Synthetic oligonucleotide
catcggtcccatgatgcttgcccttgc

SEQ ID NO: 163319 - DNA, 28 bp, Artificial Sequence
  Description of Artificial Sequence: Synthetic oligonucleotide
atcggtcccatgatgcttgcccttgcag

SEQ ID NO: 163320 - DNA, 27 bp, Artificial Sequence
  Description of Artificial Sequence: Synthetic oligonucleotide
tcggtcccatgatgcttgcccttgcag

SEQ ID NO: 163321 - DNA, 26 bp, Artificial Sequence
  Description of Artificial Sequence: Synthetic oligonucleotide
cggtcccatgatgcttgcccttgcag

SEQ ID NO: 163322 - DNA, 26 bp, Artificial Sequence
  Description of Artificial Sequence: Synthetic oligonucleotide
ggtcccatgatgcttgcccttgcagg

SEQ ID NO: 163323 - DNA, 27 bp, Artificial Sequence
  Description of Artificial Sequence: Synthetic oligonucleotide
gtcccatgatgcttgcccttgcaggga

SEQ ID NO: 163324 - DNA, 27 bp, Artificial Sequence
  Description of Artificial Sequence: Synthetic oligonucleotide
tcccatgatgcttgcccttgcagggac

SEQ ID NO: 163325 - DNA, 26 bp, Artificial Sequence
  Description of Artificial Sequence: Synthetic oligonucleotide
cccatgatgcttgcccttgcagggac

SEQ ID NO: 163326 - DNA, 27 bp, Artificial Sequence
  Description of Artificial Sequence: Synthetic oligonucleotide
ccatgatgcttgcccttgcagggacct

SEQ ID NO: 163327 - DNA, 28 bp, Artificial Sequence
  Description of Artificial Sequence: Synthetic oligonucleotide
catgatgcttgcccttgcagggacctac

SEQ ID NO: 163328 - DNA, 29 bp, Artificial Sequence
  Description of Artificial Sequence: Synthetic oligonucleotide
atgatgcttgcccttgcagggacctacag

SEQ ID NO: 163329 - DNA, 28 bp, Artificial Sequence
  Description of Artificial Sequence: Synthetic oligonucleotide
tgatgcttgcccttgcagggacctacag

SEQ ID NO: 163330 - DNA, 27 bp, Artificial Sequence
  Description of Artificial Sequence: Synthetic oligonucleotide
gatgcttgcccttgcagggacctacag

SEQ ID NO: 163331 - DNA, 29 bp, Artificial Sequence
  Description of Artificial Sequence: Synthetic oligonucleotide
atgcttgcccttgcagggacctacagatg

SEQ ID NO: 163332 - DNA, 28 bp, Artificial Sequence
  Description of Artificial Sequence: Synthetic oligonucleotide
tgcttgcccttgcagggacctacagatg

SEQ ID NO: 163333 - DNA, 27 bp, Artificial Sequence
  Description of Artificial Sequence: Synthetic oligonucleotide
gcttgcccttgcagggacctacagatg

SEQ ID NO: 163334 - DNA, 27 bp, Artificial Sequence
  Description of Artificial Sequence: Synthetic oligonucleotide
cttgcccttgcagggacctacagatgc

SEQ ID NO: 163335 - DNA, 29 bp, Artificial Sequence
  Description of Artificial Sequence: Synthetic oligonucleotide
ttgcccttgcagggacctacagatgctac

SEQ ID NO: 163336 - DNA, 28 bp, Artificial Sequence
  Description of Artificial Sequence: Synthetic oligonucleotide
tgcccttgcagggacctacagatgctac

SEQ ID NO: 163337 - DNA, 27 bp, Artificial Sequence
  Description of Artificial Sequence: Synthetic oligonucleotide
gcccttgcagggacctacagatgctac

SEQ ID NO: 163338 - DNA, 27 bp, Artificial Sequence
  Description of Artificial Sequence: Synthetic oligonucleotide
cccttgcagggacctacagatgctacg

SEQ ID NO: 163339 - DNA, 33 bp, Artificial Sequence
  Description of Artificial Sequence: Synthetic oligonucleotide
gacctacagatgctacggttctgttactcacac

SEQ ID NO: 163340 - DNA, 33 bp, Artificial Sequence
  Description of Artificial Sequence: Synthetic oligonucleotide
acctacagatgctacggttctgttactcacacc

SEQ ID NO: 163341 - DNA, 32 bp, Artificial Sequence
  Description of Artificial Sequence: Synthetic oligonucleotide
cctacagatgctacggttctgttactcacacc

SEQ ID NO: 163342 - DNA, 32 bp, Artificial Sequence
  Description of Artificial Sequence: Synthetic oligonucleotide
ctacagatgctacggttctgttactcacaccc

SEQ ID NO: 163343 - DNA, 32 bp, Artificial Sequence
  Description of Artificial Sequence: Synthetic oligonucleotide
tacagatgctacggttctgttactcacacccc

SEQ ID NO: 163344 - DNA, 31 bp, Artificial Sequence
  Description of Artificial Sequence: Synthetic oligonucleotide
acagatgctacggttctgttactcacacccc

SEQ ID NO: 163345 - DNA, 30 bp, Artificial Sequence
  Description of Artificial Sequence: Synthetic oligonucleotide
cagatgctacggttctgttactcacacccc

SEQ ID NO: 163346 - DNA, 30 bp, Artificial Sequence
  Description of Artificial Sequence: Synthetic oligonucleotide
agatgctacggttctgttactcacaccccc

SEQ ID NO: 163347 - DNA, 29 bp, Artificial Sequence
  Description of Artificial Sequence: Synthetic oligonucleotide
gatgctacggttctgttactcacaccccc

SEQ ID NO: 163348 - DNA, 32 bp, Artificial Sequence
  Description of Artificial Sequence: Synthetic oligonucleotide
atgctacggttctgttactcacaccccctatc

SEQ ID NO: 163349 - DNA, 31 bp, Artificial Sequence
  Description of Artificial Sequence: Synthetic oligonucleotide
tgctacggttctgttactcacaccccctatc

SEQ ID NO: 163350 - DNA, 30 bp, Artificial Sequence
  Description of Artificial Sequence: Synthetic oligonucleotide
gctacggttctgttactcacaccccctatc

SEQ ID NO: 163351 - DNA, 31 bp, Artificial Sequence
  Description of Artificial Sequence: Synthetic oligonucleotide
ctacggttctgttactcacaccccctatcag

SEQ ID NO: 163352 - DNA, 33 bp, Artificial Sequence
  Description of Artificial Sequence: Synthetic oligonucleotide
tacggttctgttactcacaccccctatcagttg

SEQ ID NO: 163353 - DNA, 32 bp, Artificial Sequence
  Description of Artificial Sequence: Synthetic oligonucleotide
acggttctgttactcacaccccctatcagttg

SEQ ID NO: 163354 - DNA, 31 bp, Artificial Sequence
  Description of Artificial Sequence: Synthetic oligonucleotide
cggttctgttactcacaccccctatcagttg

SEQ ID NO: 163355 - DNA, 32 bp, Artificial Sequence
  Description of Artificial Sequence: Synthetic oligonucleotide
ggttctgttactcacaccccctatcagttgtc

SEQ ID NO: 163356 - DNA, 33 bp, Artificial Sequence
  Description of Artificial Sequence: Synthetic oligonucleotide
gttctgttactcacaccccctatcagttgtcag

SEQ ID NO: 163357 - DNA, 33 bp, Artificial Sequence
  Description of Artificial Sequence: Synthetic oligonucleotide
ttctgttactcacaccccctatcagttgtcagc

SEQ ID NO: 163358 - DNA, 32 bp, Artificial Sequence
  Description of Artificial Sequence: Synthetic oligonucleotide
tctgttactcacaccccctatcagttgtcagc

SEQ ID NO: 163359 - DNA, 31 bp, Artificial Sequence
  Description of Artificial Sequence: Synthetic oligonucleotide
ctgttactcacaccccctatcagttgtcagc

SEQ ID NO: 163360 - DNA, 32 bp, Artificial Sequence
  Description of Artificial Sequence: Synthetic oligonucleotide
tgttactcacaccccctatcagttgtcagctc

SEQ ID NO: 163361 - DNA, 31 bp, Artificial Sequence
  Description of Artificial Sequence: Synthetic oligonucleotide
gttactcacaccccctatcagttgtcagctc

SEQ ID NO: 163362 - DNA, 31 bp, Artificial Sequence
  Description of Artificial Sequence: Synthetic oligonucleotide
ttactcacaccccctatcagttgtcagctcc

SEQ ID NO: 163363 - DNA, 30 bp, Artificial Sequence
  Description of Artificial Sequence: Synthetic oligonucleotide
tactcacaccccctatcagttgtcagctcc

SEQ ID NO: 163364 - DNA, 29 bp, Artificial Sequence
  Description of Artificial Sequence: Synthetic oligonucleotide
actcacaccccctatcagttgtcagctcc

SEQ ID NO: 163365 - DNA, 28 bp, Artificial Sequence
  Description of Artificial Sequence: Synthetic oligonucleotide
ctcacaccccctatcagttgtcagctcc

SEQ ID NO: 163366 - DNA, 28 bp, Artificial Sequence
  Description of Artificial Sequence: Synthetic oligonucleotide
tcacaccccctatcagttgtcagctccc

SEQ ID NO: 163367 - DNA, 27 bp, Artificial Sequence
  Description of Artificial Sequence: Synthetic oligonucleotide
cacaccccctatcagttgtcagctccc

SEQ ID NO: 163368 - DNA, 28 bp, Artificial Sequence
  Description of Artificial Sequence: Synthetic oligonucleotide
acaccccctatcagttgtcagctcccag

SEQ ID NO: 163369 - DNA, 27 bp, Artificial Sequence
  Description of Artificial Sequence: Synthetic oligonucleotide
caccccctatcagttgtcagctcccag

SEQ ID NO: 163370 - DNA, 28 bp, Artificial Sequence
  Description of Artificial Sequence: Synthetic oligonucleotide
accccctatcagttgtcagctcccagtg

SEQ ID NO: 163371 - DNA, 29 bp, Artificial Sequence
  Description of Artificial Sequence: Synthetic oligonucleotide
cccctatcagttgtcagctcccagtgatc

SEQ ID NO: 163372 - DNA, 29 bp, Artificial Sequence
  Description of Artificial Sequence: Synthetic oligonucleotide
ccctatcagttgtcagctcccagtgatcc

SEQ ID NO: 163373 - DNA, 29 bp, Artificial Sequence
  Description of Artificial Sequence: Synthetic oligonucleotide
cctatcagttgtcagctcccagtgatccc

SEQ ID NO: 163374 - DNA, 29 bp, Artificial Sequence
  Description of Artificial Sequence: Synthetic oligonucleotide
ctatcagttgtcagctcccagtgatcccc

SEQ ID NO: 163375 - DNA, 30 bp, Artificial Sequence
  Description of Artificial Sequence: Synthetic oligonucleotide
tatcagttgtcagctcccagtgatcccctg

SEQ ID NO: 163376 - DNA, 29 bp, Artificial Sequence
  Description of Artificial Sequence: Synthetic oligonucleotide
atcagttgtcagctcccagtgatcccctg

SEQ ID NO: 163377 - DNA, 28 bp, Artificial Sequence
  Description of Artificial Sequence: Synthetic oligonucleotide
tcagttgtcagctcccagtgatcccctg

SEQ ID NO: 163378 - DNA, 27 bp, Artificial Sequence
  Description of Artificial Sequence: Synthetic oligonucleotide
cagttgtcagctcccagtgatcccctg

SEQ ID NO: 163379 - DNA, 27 bp, Artificial Sequence
  Description of Artificial Sequence: Synthetic oligonucleotide
agttgtcagctcccagtgatcccctgg

SEQ ID NO: 163380 - DNA, 27 bp, Artificial Sequence
  Description of Artificial Sequence: Synthetic oligonucleotide
gttgtcagctcccagtgatcccctgga

SEQ ID NO: 163381 - DNA, 27 bp, Artificial Sequence
  Description of Artificial Sequence: Synthetic oligonucleotide
ttgtcagctcccagtgatcccctggac

SEQ ID NO: 163382 - DNA, 27 bp, Artificial Sequence
  Description of Artificial Sequence: Synthetic oligonucleotide
tgtcagctcccagtgatcccctggaca

SEQ ID NO: 163383 - DNA, 27 bp, Artificial Sequence
  Description of Artificial Sequence: Synthetic oligonucleotide
gtcagctcccagtgatcccctggacat

SEQ ID NO: 163384 - DNA, 27 bp, Artificial Sequence
  Description of Artificial Sequence: Synthetic oligonucleotide
tcagctcccagtgatcccctggacatc

SEQ ID NO: 163385 - DNA, 26 bp, Artificial Sequence
  Description of Artificial Sequence: Synthetic oligonucleotide
cagctcccagtgatcccctggacatc

SEQ ID NO: 163386 - DNA, 27 bp, Artificial Sequence
  Description of Artificial Sequence: Synthetic oligonucleotide
agctcccagtgatcccctggacatcgt

SEQ ID NO: 163387 - DNA, 26 bp, Artificial Sequence
  Description of Artificial Sequence: Synthetic oligonucleotide
gctcccagtgatcccctggacatcgt

SEQ ID NO: 163388 - DNA, 26 bp, Artificial Sequence
  Description of Artificial Sequence: Synthetic oligonucleotide
ctcccagtgatcccctggacatcgtg

SEQ ID NO: 163389 - DNA, 27 bp, Artificial Sequence
  Description of Artificial Sequence: Synthetic oligonucleotide
tcccagtgatcccctggacatcgtggt

SEQ ID NO: 163390 - DNA, 26 bp, Artificial Sequence
  Description of Artificial Sequence: Synthetic oligonucleotide
cccagtgatcccctggacatcgtggt

SEQ ID NO: 163391 - DNA, 27 bp, Artificial Sequence
  Description of Artificial Sequence: Synthetic oligonucleotide
ccagtgatcccctggacatcgtggtca

SEQ ID NO: 163392 - DNA, 27 bp, Artificial Sequence
  Description of Artificial Sequence: Synthetic oligonucleotide
cagtgatcccctggacatcgtggtcac

SEQ ID NO: 163393 - DNA, 28 bp, Artificial Sequence
  Description of Artificial Sequence: Synthetic oligonucleotide
agtgatcccctggacatcgtggtcacag

SEQ ID NO: 163394 - DNA, 27 bp, Artificial Sequence
  Description of Artificial Sequence: Synthetic oligonucleotide
gtgatcccctggacatcgtggtcacag

SEQ ID NO: 163395 - DNA, 27 bp, Artificial Sequence
  Description of Artificial Sequence: Synthetic oligonucleotide
tgatcccctggacatcgtggtcacagg

SEQ ID NO: 163396 - DNA, 27 bp, Artificial Sequence
  Description of Artificial Sequence: Synthetic oligonucleotide
gatcccctggacatcgtggtcacaggt

SEQ ID NO: 163397 - DNA, 27 bp, Artificial Sequence
  Description of Artificial Sequence: Synthetic oligonucleotide
atcccctggacatcgtggtcacaggtc

SEQ ID NO: 163398 - DNA, 26 bp, Artificial Sequence
  Description of Artificial Sequence: Synthetic oligonucleotide
tcccctggacatcgtggtcacaggtc

SEQ ID NO: 163399 - DNA, 25 bp, Artificial Sequence
  Description of Artificial Sequence: Synthetic oligonucleotide
cccctggacatcgtggtcacaggtc

SEQ ID NO: 163400 - DNA, 27 bp, Artificial Sequence
  Description of Artificial Sequence: Synthetic oligonucleotide
ccctggacatcgtggtcacaggtccat

SEQ ID NO: 163401 - DNA, 29 bp, Artificial Sequence
  Description of Artificial Sequence: Synthetic oligonucleotide
cctggacatcgtggtcacaggtccatatg

SEQ ID NO: 163402 - DNA, 30 bp, Artificial Sequence
  Description of Artificial Sequence: Synthetic oligonucleotide
ctggacatcgtggtcacaggtccatatgag

SEQ ID NO: 163403 - DNA, 33 bp, Artificial Sequence
  Description of Artificial Sequence: Synthetic oligonucleotide
tggacatcgtggtcacaggtccatatgagaaac

SEQ ID NO: 163404 - DNA, 32 bp, Artificial Sequence
  Description of Artificial Sequence: Synthetic oligonucleotide
ggacatcgtggtcacaggtccatatgagaaac

SEQ ID NO: 163405 - DNA, 32 bp, Artificial Sequence
  Description of Artificial Sequence: Synthetic oligonucleotide
gacatcgtggtcacaggtccatatgagaaacc

SEQ ID NO: 163406 - DNA, 34 bp, Artificial Sequence
  Description of Artificial Sequence: Synthetic oligonucleotide
acatcgtggtcacaggtccatatgagaaaccttc

SEQ ID NO: 163407 - DNA, 33 bp, Artificial Sequence
  Description of Artificial Sequence: Synthetic oligonucleotide
catcgtggtcacaggtccatatgagaaaccttc

SEQ ID NO: 163408 - DNA, 34 bp, Artificial Sequence
  Description of Artificial Sequence: Synthetic oligonucleotide
atcgtggtcacaggtccatatgagaaaccttctc

SEQ ID NO: 163409 - DNA, 33 bp, Artificial Sequence
  Description of Artificial Sequence: Synthetic oligonucleotide
tcgtggtcacaggtccatatgagaaaccttctc

SEQ ID NO: 163410 - DNA, 32 bp, Artificial Sequence
  Description of Artificial Sequence: Synthetic oligonucleotide
cgtggtcacaggtccatatgagaaaccttctc

SEQ ID NO: 163411 - DNA, 33 bp, Artificial Sequence
  Description of Artificial Sequence: Synthetic oligonucleotide
gtggtcacaggtccatatgagaaaccttctctc

SEQ ID NO: 163412 - DNA, 34 bp, Artificial Sequence
  Description of Artificial Sequence: Synthetic oligonucleotide
tggtcacaggtccatatgagaaaccttctctctc

SEQ ID NO: 163413 - DNA, 33 bp, Artificial Sequence
  Description of Artificial Sequence: Synthetic oligonucleotide
ggtcacaggtccatatgagaaaccttctctctc

SEQ ID NO: 163414 - DNA, 34 bp, Artificial Sequence
  Description of Artificial Sequence: Synthetic oligonucleotide
gtcacaggtccatatgagaaaccttctctctcag

SEQ ID NO: 163415 - DNA, 34 bp, Artificial Sequence
  Description of Artificial Sequence: Synthetic oligonucleotide
tcacaggtccatatgagaaaccttctctctcagc

SEQ ID NO: 163416 - DNA, 33 bp, Artificial Sequence
  Description of Artificial Sequence: Synthetic oligonucleotide
cacaggtccatatgagaaaccttctctctcagc

SEQ ID NO: 163417 - DNA, 33 bp, Artificial Sequence
  Description of Artificial Sequence: Synthetic oligonucleotide
acaggtccatatgagaaaccttctctctcagcc

SEQ ID NO: 163418 - DNA, 32 bp, Artificial Sequence
  Description of Artificial Sequence: Synthetic oligonucleotide
caggtccatatgagaaaccttctctctcagcc

SEQ ID NO: 163419 - DNA, 32 bp, Artificial Sequence
  Description of Artificial Sequence: Synthetic oligonucleotide
aggtccatatgagaaaccttctctctcagccc

SEQ ID NO: 163420 - DNA, 31 bp, Artificial Sequence
  Description of Artificial Sequence: Synthetic oligonucleotide
ggtccatatgagaaaccttctctctcagccc

SEQ ID NO: 163421 - DNA, 32 bp, Artificial Sequence
  Description of Artificial Sequence: Synthetic oligonucleotide
gtccatatgagaaaccttctctctcagcccag

SEQ ID NO: 163422 - DNA, 32 bp, Artificial Sequence
  Description of Artificial Sequence: Synthetic oligonucleotide
tccatatgagaaaccttctctctcagcccagc

SEQ ID NO: 163423 - DNA, 31 bp, Artificial Sequence
  Description of Artificial Sequence: Synthetic oligonucleotide
ccatatgagaaaccttctctctcagcccagc

SEQ ID NO: 163424 - DNA, 31 bp, Artificial Sequence
  Description of Artificial Sequence: Synthetic oligonucleotide
catatgagaaaccttctctctcagcccagcc

SEQ ID NO: 163425 - DNA, 22 bp, Artificial Sequence
  Description of Artificial Sequence: Synthetic oligonucleotide
tctcagcccagccgggccccaa

SEQ ID NO: 163426 - DNA, 21 bp, Artificial Sequence
  Description of Artificial Sequence: Synthetic oligonucleotide
ctcagcccagccgggccccaa

SEQ ID NO: 163427 - DNA, 21 bp, Artificial Sequence
  Description of Artificial Sequence: Synthetic oligonucleotide
tcagcccagccgggccccaag

SEQ ID NO: 163428 - DNA, 20 bp, Artificial Sequence
  Description of Artificial Sequence: Synthetic oligonucleotide
cagcccagccgggccccaag

SEQ ID NO: 163429 - DNA, 22 bp, Artificial Sequence
  Description of Artificial Sequence: Synthetic oligonucleotide
agcccagccgggccccaaggtt

SEQ ID NO: 163430 - DNA, 21 bp, Artificial Sequence
  Description of Artificial Sequence: Synthetic oligonucleotide
gcccagccgggccccaaggtt

SEQ ID NO: 163431 - DNA, 22 bp, Artificial Sequence
  Description of Artificial Sequence: Synthetic oligonucleotide
cccagccgggccccaaggttca

SEQ ID NO: 163432 - DNA, 22 bp, Artificial Sequence
  Description of Artificial Sequence: Synthetic oligonucleotide
ccagccgggccccaaggttcag

SEQ ID NO: 163433 - DNA, 22 bp, Artificial Sequence
  Description of Artificial Sequence: Synthetic oligonucleotide
cagccgggccccaaggttcagg

SEQ ID NO: 163434 - DNA, 23 bp, Artificial Sequence
  Description of Artificial Sequence: Synthetic oligonucleotide
agccgggccccaaggttcaggca

SEQ ID NO: 163435 - DNA, 22 bp, Artificial Sequence
  Description of Artificial Sequence: Synthetic oligonucleotide
gccgggccccaaggttcaggca

SEQ ID NO: 163436 - DNA, 22 bp, Artificial Sequence
  Description of Artificial Sequence: Synthetic oligonucleotide
ccgggccccaaggttcaggcag

SEQ ID NO: 163437 - DNA, 23 bp, Artificial Sequence
  Description of Artificial Sequence: Synthetic oligonucleotide
cgggccccaaggttcaggcagga

SEQ ID NO: 163438 - DNA, 24 bp, Artificial Sequence
  Description of Artificial Sequence: Synthetic oligonucleotide
gggccccaaggttcaggcaggaga

SEQ ID NO: 163439 - DNA, 25 bp, Artificial Sequence
  Description of Artificial Sequence: Synthetic oligonucleotide
ggccccaaggttcaggcaggagaga

SEQ ID NO: 163440 - DNA, 25 bp, Artificial Sequence
  Description of Artificial Sequence: Synthetic oligonucleotide
gccccaaggttcaggcaggagagag

SEQ ID NO: 163441 - DNA, 25 bp, Artificial Sequence
  Description of Artificial Sequence: Synthetic oligonucleotide
ccccaaggttcaggcaggagagagc

SEQ ID NO: 163442 - DNA, 26 bp, Artificial Sequence
  Description of Artificial Sequence: Synthetic oligonucleotide
cccaaggttcaggcaggagagagcgt

SEQ ID NO: 163443 - DNA, 27 bp, Artificial Sequence
  Description of Artificial Sequence: Synthetic oligonucleotide
ccaaggttcaggcaggagagagcgtga

SEQ ID NO: 163444 - DNA, 27 bp, Artificial Sequence
  Description of Artificial Sequence: Synthetic oligonucleotide
caaggttcaggcaggagagagcgtgac

SEQ ID NO: 163445 - DNA, 27 bp, Artificial Sequence
  Description of Artificial Sequence: Synthetic oligonucleotide
aaggttcaggcaggagagagcgtgacc

SEQ ID NO: 163446 - DNA, 27 bp, Artificial Sequence
  Description of Artificial Sequence: Synthetic oligonucleotide
aggttcaggcaggagagagcgtgacct

SEQ ID NO: 163447 - DNA, 27 bp, Artificial Sequence
  Description of Artificial Sequence: Synthetic oligonucleotide
ggttcaggcaggagagagcgtgacctt

SEQ ID NO: 163448 - DNA, 27 bp, Artificial Sequence
  Description of Artificial Sequence: Synthetic oligonucleotide
gttcaggcaggagagagcgtgaccttg

SEQ ID NO: 163449 - DNA, 28 bp, Artificial Sequence
  Description of Artificial Sequence: Synthetic oligonucleotide
ttcaggcaggagagagcgtgaccttgtc

SEQ ID NO: 163450 - DNA, 27 bp, Artificial Sequence
  Description of Artificial Sequence: Synthetic oligonucleotide
tcaggcaggagagagcgtgaccttgtc

SEQ ID NO: 163451 - DNA, 26 bp, Artificial Sequence
  Description of Artificial Sequence: Synthetic oligonucleotide
caggcaggagagagcgtgaccttgtc

SEQ ID NO: 163452 - DNA, 27 bp, Artificial Sequence
  Description of Artificial Sequence: Synthetic oligonucleotide
aggcaggagagagcgtgaccttgtcct

SEQ ID NO: 163453 - DNA, 27 bp, Artificial Sequence
  Description of Artificial Sequence: Synthetic oligonucleotide
gcaggagagagcgtgaccttgtcctgt

SEQ ID NO: 163454 - DNA, 28 bp, Artificial Sequence
  Description of Artificial Sequence: Synthetic oligonucleotide
caggagagagcgtgaccttgtcctgtag

SEQ ID NO: 163455 - DNA, 28 bp, Artificial Sequence
  Description of Artificial Sequence: Synthetic oligonucleotide
aggagagagcgtgaccttgtcctgtagc

SEQ ID NO: 163456 - DNA, 27 bp, Artificial Sequence
  Description of Artificial Sequence: Synthetic oligonucleotide
ggagagagcgtgaccttgtcctgtagc

SEQ ID NO: 163457 - DNA, 28 bp, Artificial Sequence
  Description of Artificial Sequence: Synthetic oligonucleotide
gagagagcgtgaccttgtcctgtagctc

SEQ ID NO: 163458 - DNA, 28 bp, Artificial Sequence
  Description of Artificial Sequence: Synthetic oligonucleotide
agagagcgtgaccttgtcctgtagctcc

SEQ ID NO: 163459 - DNA, 27 bp, Artificial Sequence
  Description of Artificial Sequence: Synthetic oligonucleotide
gagagcgtgaccttgtcctgtagctcc

SEQ ID NO: 163460 - DNA, 27 bp, Artificial Sequence
  Description of Artificial Sequence: Synthetic oligonucleotide
agagcgtgaccttgtcctgtagctccc

SEQ ID NO: 163461 - DNA, 26 bp, Artificial Sequence
  Description of Artificial Sequence: Synthetic oligonucleotide
gagcgtgaccttgtcctgtagctccc

SEQ ID NO: 163462 - DNA, 26 bp, Artificial Sequence
  Description of Artificial Sequence: Synthetic oligonucleotide
agcgtgaccttgtcctgtagctcccg

SEQ ID NO: 163463 - DNA, 25 bp, Artificial Sequence
  Description of Artificial Sequence: Synthetic oligonucleotide
gcgtgaccttgtcctgtagctcccg

SEQ ID NO: 163464 - DNA, 26 bp, Artificial Sequence
  Description of Artificial Sequence: Synthetic oligonucleotide
cgtgaccttgtcctgtagctcccgga

SEQ ID NO: 163465 - DNA, 26 bp, Artificial Sequence
  Description of Artificial Sequence: Synthetic oligonucleotide
gtgaccttgtcctgtagctcccggag

SEQ ID NO: 163466 - DNA, 27 bp, Artificial Sequence
  Description of Artificial Sequence: Synthetic oligonucleotide
tgaccttgtcctgtagctcccggagct

SEQ ID NO: 163467 - DNA, 26 bp, Artificial Sequence
  Description of Artificial Sequence: Synthetic oligonucleotide
gaccttgtcctgtagctcccggagct

SEQ ID NO: 163468 - DNA, 26 bp, Artificial Sequence
  Description of Artificial Sequence: Synthetic oligonucleotide
accttgtcctgtagctcccggagctc

SEQ ID NO: 163469 - DNA, 25 bp, Artificial Sequence
  Description of Artificial Sequence: Synthetic oligonucleotide
ccttgtcctgtagctcccggagctc

SEQ ID NO: 163470 - DNA, 27 bp, Artificial Sequence
  Description of Artificial Sequence: Synthetic oligonucleotide
cttgtcctgtagctcccggagctccta

SEQ ID NO: 163471 - DNA, 28 bp, Artificial Sequence
  Description of Artificial Sequence: Synthetic oligonucleotide
ttgtcctgtagctcccggagctcctatg

SEQ ID NO: 163472 - DNA, 27 bp, Artificial Sequence
  Description of Artificial Sequence: Synthetic oligonucleotide
tgtcctgtagctcccggagctcctatg

SEQ ID NO: 163473 - DNA, 27 bp, Artificial Sequence
  Description of Artificial Sequence: Synthetic oligonucleotide
gtcctgtagctcccggagctcctatga

SEQ ID NO: 163474 - DNA, 27 bp, Artificial Sequence
  Description of Artificial Sequence: Synthetic oligonucleotide
tcctgtagctcccggagctcctatgac

SEQ ID NO: 163475 - DNA, 27 bp, Artificial Sequence
  Description of Artificial Sequence: Synthetic oligonucleotide
cctgtagctcccggagctcctatgaca

SEQ ID NO: 163476 - DNA, 28 bp, Artificial Sequence
  Description of Artificial Sequence: Synthetic oligonucleotide
ctgtagctcccggagctcctatgacatg

SEQ ID NO: 163477 - DNA, 30 bp, Artificial Sequence
  Description of Artificial Sequence: Synthetic oligonucleotide
tgtagctcccggagctcctatgacatgtac

SEQ ID NO: 163478 - DNA, 29 bp, Artificial Sequence
  Description of Artificial Sequence: Synthetic oligonucleotide
gtagctcccggagctcctatgacatgtac

SEQ ID NO: 163479 - DNA, 29 bp, Artificial Sequence
  Description of Artificial Sequence: Synthetic oligonucleotide
tagctcccggagctcctatgacatgtacc

SEQ ID NO: 163480 - DNA, 28 bp, Artificial Sequence
  Description of Artificial Sequence: Synthetic oligonucleotide
acatgtaccatctatccagggagggggg

SEQ ID NO: 163481 - DNA, 27 bp, Artificial Sequence
  Description of Artificial Sequence: Synthetic oligonucleotide
catgtaccatctatccagggagggggg

SEQ ID NO: 163482 - DNA, 28 bp, Artificial Sequence
  Description of Artificial Sequence: Synthetic oligonucleotide
atgtaccatctatccagggaggggggag

SEQ ID NO: 163483 - DNA, 27 bp, Artificial Sequence
  Description of Artificial Sequence: Synthetic oligonucleotide
tgtaccatctatccagggaggggggag

SEQ ID NO: 163484 - DNA, 26 bp, Artificial Sequence
  Description of Artificial Sequence: Synthetic oligonucleotide
gtaccatctatccagggaggggggag

SEQ ID NO: 163485 - DNA, 26 bp, Artificial Sequence
  Description of Artificial Sequence: Synthetic oligonucleotide
taccatctatccagggaggggggagc

SEQ ID NO: 163486 - DNA, 25 bp, Artificial Sequence
  Description of Artificial Sequence: Synthetic oligonucleotide
accatctatccagggaggggggagc

SEQ ID NO: 163487 - DNA, 24 bp, Artificial Sequence
  Description of Artificial Sequence: Synthetic oligonucleotide
ccatctatccagggaggggggagc

SEQ ID NO: 163488 - DNA, 24 bp, Artificial Sequence
  Description of Artificial Sequence: Synthetic oligonucleotide
catctatccagggaggggggagcc

SEQ ID NO: 163489 - DNA, 26 bp, Artificial Sequence
  Description of Artificial Sequence: Synthetic oligonucleotide
atctatccagggaggggggagcccat

SEQ ID NO: 163490 - DNA, 25 bp, Artificial Sequence
  Description of Artificial Sequence: Synthetic oligonucleotide
tctatccagggaggggggagcccat

SEQ ID NO: 163491 - DNA, 24 bp, Artificial Sequence
  Description of Artificial Sequence: Synthetic oligonucleotide
ctatccagggaggggggagcccat

SEQ ID NO: 163492 - DNA, 26 bp, Artificial Sequence
  Description of Artificial Sequence: Synthetic oligonucleotide
tatccagggaggggggagcccatgaa

SEQ ID NO: 163493 - DNA, 25 bp, Artificial Sequence
  Description of Artificial Sequence: Synthetic oligonucleotide
atccagggaggggggagcccatgaa

SEQ ID NO: 163494 - DNA, 24 bp, Artificial Sequence
  Description of Artificial Sequence: Synthetic oligonucleotide
tccagggaggggggagcccatgaa

SEQ ID NO: 163495 - DNA, 23 bp, Artificial Sequence
  Description of Artificial Sequence: Synthetic oligonucleotide
ccagggaggggggagcccatgaa

SEQ ID NO: 163496 - DNA, 23 bp, Artificial Sequence
  Description of Artificial Sequence: Synthetic oligonucleotide
cagggaggggggagcccatgaac

SEQ ID NO: 163497 - DNA, 25 bp, Artificial Sequence
  Description of Artificial Sequence: Synthetic oligonucleotide
agggaggggggagcccatgaacgta

SEQ ID NO: 163498 - DNA, 24 bp, Artificial Sequence
  Description of Artificial Sequence: Synthetic oligonucleotide
gggaggggggagcccatgaacgta

SEQ ID NO: 163499 - DNA, 24 bp, Artificial Sequence
  Description of Artificial Sequence: Synthetic oligonucleotide
ggaggggggagcccatgaacgtag

SEQ ID NO: 163500 - DNA, 24 bp, Artificial Sequence
  Description of Artificial Sequence: Synthetic oligonucleotide
gaggggggagcccatgaacgtagg

SEQ ID NO: 163501 - DNA, 25 bp, Artificial Sequence
  Description of Artificial Sequence: Synthetic oligonucleotide
aggggggagcccatgaacgtaggct

SEQ ID NO: 163502 - DNA, 24 bp, Artificial Sequence
  Description of Artificial Sequence: Synthetic oligonucleotide
ggggggagcccatgaacgtaggct

SEQ ID NO: 163503 - DNA, 24 bp, Artificial Sequence
  Description of Artificial Sequence: Synthetic oligonucleotide
gggggagcccatgaacgtaggctc

SEQ ID NO: 163504 - DNA, 24 bp, Artificial Sequence
  Description of Artificial Sequence: Synthetic oligonucleotide
ggggagcccatgaacgtaggctcc

SEQ ID NO: 163505 - DNA, 25 bp, Artificial Sequence
  Description of Artificial Sequence: Synthetic oligonucleotide
gggagcccatgaacgtaggctccct

SEQ ID NO: 163506 - DNA, 25 bp, Artificial Sequence
  Description of Artificial Sequence: Synthetic oligonucleotide
ggagcccatgaacgtaggctccctg

SEQ ID NO: 163507 - DNA, 26 bp, Artificial Sequence
  Description of Artificial Sequence: Synthetic oligonucleotide
gagcccatgaacgtaggctccctgca

SEQ ID NO: 163508 - DNA, 27 bp, Artificial Sequence
  Description of Artificial Sequence: Synthetic oligonucleotide
agcccatgaacgtaggctccctgcagt

SEQ ID NO: 163509 - DNA, 27 bp, Artificial Sequence
  Description of Artificial Sequence: Synthetic oligonucleotide
tgaacgtaggctccctgcagtgcgcaa

SEQ ID NO: 163510 - DNA, 26 bp, Artificial Sequence
  Description of Artificial Sequence: Synthetic oligonucleotide
gaacgtaggctccctgcagtgcgcaa

SEQ ID NO: 163511 - DNA, 26 bp, Artificial Sequence
  Description of Artificial Sequence: Synthetic oligonucleotide
aacgtaggctccctgcagtgcgcaag

SEQ ID NO: 163512 - DNA, 25 bp, Artificial Sequence
  Description of Artificial Sequence: Synthetic oligonucleotide
acgtaggctccctgcagtgcgcaag

SEQ ID NO: 163513 - DNA, 24 bp, Artificial Sequence
  Description of Artificial Sequence: Synthetic oligonucleotide
cgtaggctccctgcagtgcgcaag

SEQ ID NO: 163514 - DNA, 25 bp, Artificial Sequence
  Description of Artificial Sequence: Synthetic oligonucleotide
gtaggctccctgcagtgcgcaaggt

SEQ ID NO: 163515 - DNA, 27 bp, Artificial Sequence
  Description of Artificial Sequence: Synthetic oligonucleotide
taggctccctgcagtgcgcaaggtcaa

SEQ ID NO: 163516 - DNA, 26 bp, Artificial Sequence
  Description of Artificial Sequence: Synthetic oligonucleotide
aggctccctgcagtgcgcaaggtcaa

SEQ ID NO: 163517 - DNA, 25 bp, Artificial Sequence
  Description of Artificial Sequence: Synthetic oligonucleotide
ggctccctgcagtgcgcaaggtcaa

SEQ ID NO: 163518 - DNA, 26 bp, Artificial Sequence
  Description of Artificial Sequence: Synthetic oligonucleotide
gctccctgcagtgcgcaaggtcaaca

SEQ ID NO: 163519 - DNA, 27 bp, Artificial Sequence
  Description of Artificial Sequence: Synthetic oligonucleotide
ctccctgcagtgcgcaaggtcaacaga

SEQ ID NO: 163520 - DNA, 28 bp, Artificial Sequence
  Description of Artificial Sequence: Synthetic oligonucleotide
tccctgcagtgcgcaaggtcaacagaac

SEQ ID NO: 163521 - DNA, 27 bp, Artificial Sequence
  Description of Artificial Sequence: Synthetic oligonucleotide
ccctgcagtgcgcaaggtcaacagaac

SEQ ID NO: 163522 - DNA, 30 bp, Artificial Sequence
  Description of Artificial Sequence: Synthetic oligonucleotide
cctgcagtgcgcaaggtcaacagaacattc

SEQ ID NO: 163523 - DNA, 30 bp, Artificial Sequence
  Description of Artificial Sequence: Synthetic oligonucleotide
ctgcagtgcgcaaggtcaacagaacattcc

SEQ ID NO: 163524 - DNA, 31 bp, Artificial Sequence
  Description of Artificial Sequence: Synthetic oligonucleotide
tgcagtgcgcaaggtcaacagaacattccag

SEQ ID NO: 163525 - DNA, 30 bp, Artificial Sequence
  Description of Artificial Sequence: Synthetic oligonucleotide
gcagtgcgcaaggtcaacagaacattccag

SEQ ID NO: 163526 - DNA, 30 bp, Artificial Sequence
  Description of Artificial Sequence: Synthetic oligonucleotide
cagtgcgcaaggtcaacagaacattccagg

SEQ ID NO: 163527 - DNA, 30 bp, Artificial Sequence
  Description of Artificial Sequence: Synthetic oligonucleotide
agtgcgcaaggtcaacagaacattccaggc

SEQ ID NO: 163528 - DNA, 29 bp, Artificial Sequence
  Description of Artificial Sequence: Synthetic oligonucleotide
gtgcgcaaggtcaacagaacattccaggc

SEQ ID NO: 163529 - DNA, 30 bp, Artificial Sequence
  Description of Artificial Sequence: Synthetic oligonucleotide
tgcgcaaggtcaacagaacattccaggcag

SEQ ID NO: 163530 - DNA, 29 bp, Artificial Sequence
  Description of Artificial Sequence: Synthetic oligonucleotide
gcgcaaggtcaacagaacattccaggcag

SEQ ID NO: 163531 - DNA, 33 bp, Artificial Sequence
  Description of Artificial Sequence: Synthetic oligonucleotide
cgcaaggtcaacagaacattccaggcagatttc

SEQ ID NO: 163532 - DNA, 33 bp, Artificial Sequence
  Description of Artificial Sequence: Synthetic oligonucleotide
gcaaggtcaacagaacattccaggcagatttcc

SEQ ID NO: 163533 - DNA, 33 bp, Artificial Sequence
  Description of Artificial Sequence: Synthetic oligonucleotide
caaggtcaacagaacattccaggcagatttccc

SEQ ID NO: 163534 - DNA, 34 bp, Artificial Sequence
  Description of Artificial Sequence: Synthetic oligonucleotide
aaggtcaacagaacattccaggcagatttccctc

SEQ ID NO: 163535 - DNA, 33 bp, Artificial Sequence
  Description of Artificial Sequence: Synthetic oligonucleotide
aggtcaacagaacattccaggcagatttccctc

SEQ ID NO: 163536 - DNA, 32 bp, Artificial Sequence
  Description of Artificial Sequence: Synthetic oligonucleotide
ggtcaacagaacattccaggcagatttccctc

SEQ ID NO: 163537 - DNA, 33 bp, Artificial Sequence
  Description of Artificial Sequence: Synthetic oligonucleotide
gtcaacagaacattccaggcagatttccctctg

SEQ ID NO: 163538 - DNA, 33 bp, Artificial Sequence
  Description of Artificial Sequence: Synthetic oligonucleotide
tcaacagaacattccaggcagatttccctctgg

SEQ ID NO: 163539 - DNA, 32 bp, Artificial Sequence
  Description of Artificial Sequence: Synthetic oligonucleotide
caacagaacattccaggcagatttccctctgg

SEQ ID NO: 163540 - DNA, 32 bp, Artificial Sequence
  Description of Artificial Sequence: Synthetic oligonucleotide
aacagaacattccaggcagatttccctctggg

SEQ ID NO: 163541 - DNA, 31 bp, Artificial Sequence
  Description of Artificial Sequence: Synthetic oligonucleotide
acagaacattccaggcagatttccctctggg

SEQ ID NO: 163542 - DNA, 30 bp, Artificial Sequence
  Description of Artificial Sequence: Synthetic oligonucleotide
cagaacattccaggcagatttccctctggg

SEQ ID NO: 163543 - DNA, 30 bp, Artificial Sequence
  Description of Artificial Sequence: Synthetic oligonucleotide
agaacattccaggcagatttccctctgggc

SEQ ID NO: 163544 - DNA, 29 bp, Artificial Sequence
  Description of Artificial Sequence: Synthetic oligonucleotide
gaacattccaggcagatttccctctgggc

SEQ ID NO: 163545 - DNA, 29 bp, Artificial Sequence
  Description of Artificial Sequence: Synthetic oligonucleotide
aacattccaggcagatttccctctgggcc

SEQ ID NO: 163546 - DNA, 28 bp, Artificial Sequence
  Description of Artificial Sequence: Synthetic oligonucleotide
acattccaggcagatttccctctgggcc

SEQ ID NO: 163547 - DNA, 27 bp, Artificial Sequence
  Description of Artificial Sequence: Synthetic oligonucleotide
cattccaggcagatttccctctgggcc

SEQ ID NO: 163548 - DNA, 27 bp, Artificial Sequence
  Description of Artificial Sequence: Synthetic oligonucleotide
attccaggcagatttccctctgggccc

SEQ ID NO: 163549 - DNA, 27 bp, Artificial Sequence
  Description of Artificial Sequence: Synthetic oligonucleotide
ttccaggcagatttccctctgggccct

SEQ ID NO: 163550 - DNA, 26 bp, Artificial Sequence
  Description of Artificial Sequence: Synthetic oligonucleotide
tccaggcagatttccctctgggccct

SEQ ID NO: 163551 - DNA, 25 bp, Artificial Sequence
  Description of Artificial Sequence: Synthetic oligonucleotide
ccaggcagatttccctctgggccct

SEQ ID NO: 163552 - DNA, 25 bp, Artificial Sequence
  Description of Artificial Sequence: Synthetic oligonucleotide
caggcagatttccctctgggccctg

SEQ ID NO: 163553 - DNA, 25 bp, Artificial Sequence
  Description of Artificial Sequence: Synthetic oligonucleotide
aggcagatttccctctgggccctgc

SEQ ID NO: 163554 - DNA, 24 bp, Artificial Sequence
  Description of Artificial Sequence: Synthetic oligonucleotide
ggcagatttccctctgggccctgc

SEQ ID NO: 163555 - DNA, 25 bp, Artificial Sequence
  Description of Artificial Sequence: Synthetic oligonucleotide
gcagatttccctctgggccctgcca

SEQ ID NO: 163556 - DNA, 25 bp, Artificial Sequence
  Description of Artificial Sequence: Synthetic oligonucleotide
cagatttccctctgggccctgccac

SEQ ID NO: 163557 - DNA, 25 bp, Artificial Sequence
  Description of Artificial Sequence: Synthetic oligonucleotide
agatttccctctgggccctgccacc

SEQ ID NO: 163558 - DNA, 24 bp, Artificial Sequence
  Description of Artificial Sequence: Synthetic oligonucleotide
gatttccctctgggccctgccacc

SEQ ID NO: 163559 - DNA, 25 bp, Artificial Sequence
  Description of Artificial Sequence: Synthetic oligonucleotide
atttccctctgggccctgccaccca

SEQ ID NO: 163560 - DNA, 24 bp, Artificial Sequence
  Description of Artificial Sequence: Synthetic oligonucleotide
tttccctctgggccctgccaccca

SEQ ID NO: 163561 - DNA, 23 bp, Artificial Sequence
  Description of Artificial Sequence: Synthetic oligonucleotide
ttccctctgggccctgccaccca

SEQ ID NO: 163562 - DNA, 22 bp, Artificial Sequence
  Description of Artificial Sequence: Synthetic oligonucleotide
tccctctgggccctgccaccca

SEQ ID NO: 163563 - DNA, 21 bp, Artificial Sequence
  Description of Artificial Sequence: Synthetic oligonucleotide
ccctctgggccctgccaccca

SEQ ID NO: 163564 - DNA, 29 bp, Artificial Sequence
  Description of Artificial Sequence: Synthetic oligonucleotide
gacctacagatgcttcggctctttccgtc

SEQ ID NO: 163565 - DNA, 30 bp, Artificial Sequence
  Description of Artificial Sequence: Synthetic oligonucleotide
acctacagatgcttcggctctttccgtcac

SEQ ID NO: 163566 - DNA, 29 bp, Artificial Sequence
  Description of Artificial Sequence: Synthetic oligonucleotide
cctacagatgcttcggctctttccgtcac

SEQ ID NO: 163567 - DNA, 30 bp, Artificial Sequence
  Description of Artificial Sequence: Synthetic oligonucleotide
ctacagatgcttcggctctttccgtcactc

SEQ ID NO: 163568 - DNA, 31 bp, Artificial Sequence
  Description of Artificial Sequence: Synthetic oligonucleotide
tacagatgcttcggctctttccgtcactctc

SEQ ID NO: 163569 - DNA, 30 bp, Artificial Sequence
  Description of Artificial Sequence: Synthetic oligonucleotide
acagatgcttcggctctttccgtcactctc

SEQ ID NO: 163570 - DNA, 29 bp, Artificial Sequence
  Description of Artificial Sequence: Synthetic oligonucleotide
cagatgcttcggctctttccgtcactctc

SEQ ID NO: 163571 - DNA, 29 bp, Artificial Sequence
  Description of Artificial Sequence: Synthetic oligonucleotide
agatgcttcggctctttccgtcactctcc

SEQ ID NO: 163572 - DNA, 28 bp, Artificial Sequence
  Description of Artificial Sequence: Synthetic oligonucleotide
gatgcttcggctctttccgtcactctcc

SEQ ID NO: 163573 - DNA, 28 bp, Artificial Sequence
  Description of Artificial Sequence: Synthetic oligonucleotide
atgcttcggctctttccgtcactctccc

SEQ ID NO: 163574 - DNA, 27 bp, Artificial Sequence
  Description of Artificial Sequence: Synthetic oligonucleotide
tgcttcggctctttccgtcactctccc

SEQ ID NO: 163575 - DNA, 27 bp, Artificial Sequence
  Description of Artificial Sequence: Synthetic oligonucleotide
gcttcggctctttccgtcactctccct

SEQ ID NO: 163576 - DNA, 28 bp, Artificial Sequence
  Description of Artificial Sequence: Synthetic oligonucleotide
cttcggctctttccgtcactctccctac

SEQ ID NO: 163577 - DNA, 28 bp, Artificial Sequence
  Description of Artificial Sequence: Synthetic oligonucleotide
ttcggctctttccgtcactctccctacg

SEQ ID NO: 163578 - DNA, 27 bp, Artificial Sequence
  Description of Artificial Sequence: Synthetic oligonucleotide
tcggctctttccgtcactctccctacg

SEQ ID NO: 163579 - DNA, 27 bp, Artificial Sequence
  Description of Artificial Sequence: Synthetic oligonucleotide
cggctctttccgtcactctccctacga

SEQ ID NO: 163580 - DNA, 27 bp, Artificial Sequence
  Description of Artificial Sequence: Synthetic oligonucleotide
ggctctttccgtcactctccctacgag

SEQ ID NO: 163581 - DNA, 28 bp, Artificial Sequence
  Description of Artificial Sequence: Synthetic oligonucleotide
gctctttccgtcactctccctacgagtg

SEQ ID NO: 163582 - DNA, 28 bp, Artificial Sequence
  Description of Artificial Sequence: Synthetic oligonucleotide
ctctttccgtcactctccctacgagtgg

SEQ ID NO: 163583 - DNA, 29 bp, Artificial Sequence
  Description of Artificial Sequence: Synthetic oligonucleotide
tctttccgtcactctccctacgagtggtc

SEQ ID NO: 163584 - DNA, 28 bp, Artificial Sequence
  Description of Artificial Sequence: Synthetic oligonucleotide
ctttccgtcactctccctacgagtggtc

SEQ ID NO: 163585 - DNA, 29 bp, Artificial Sequence
  Description of Artificial Sequence: Synthetic oligonucleotide
tttccgtcactctccctacgagtggtcag

SEQ ID NO: 163586 - DNA, 28 bp, Artificial Sequence
  Description of Artificial Sequence: Synthetic oligonucleotide
ttccgtcactctccctacgagtggtcag

SEQ ID NO: 163587 - DNA, 27 bp, Artificial Sequence
  Description of Artificial Sequence: Synthetic oligonucleotide
tccgtcactctccctacgagtggtcag

SEQ ID NO: 163588 - DNA, 27 bp, Artificial Sequence
  Description of Artificial Sequence: Synthetic oligonucleotide
ccgtcactctccctacgagtggtcaga

SEQ ID NO: 163589 - DNA, 27 bp, Artificial Sequence
  Description of Artificial Sequence: Synthetic oligonucleotide
cgtcactctccctacgagtggtcagac

SEQ ID NO: 163590 - DNA, 27 bp, Artificial Sequence
  Description of Artificial Sequence: Synthetic oligonucleotide
gtcactctccctacgagtggtcagacc

SEQ ID NO: 163591 - DNA, 27 bp, Artificial Sequence
  Description of Artificial Sequence: Synthetic oligonucleotide
tcactctccctacgagtggtcagaccc

SEQ ID NO: 163592 - DNA, 26 bp, Artificial Sequence
  Description of Artificial Sequence: Synthetic oligonucleotide
cactctccctacgagtggtcagaccc

SEQ ID NO: 163593 - DNA, 27 bp, Artificial Sequence
  Description of Artificial Sequence: Synthetic oligonucleotide
actctccctacgagtggtcagacccga

SEQ ID NO: 163594 - DNA, 26 bp, Artificial Sequence
  Description of Artificial Sequence: Synthetic oligonucleotide
ctctccctacgagtggtcagacccga

SEQ ID NO: 163595 - DNA, 34 bp, Artificial Sequence
  Description of Artificial Sequence: Synthetic oligonucleotide
cactgcttgtttctgtcacaggaaacccttcaag

SEQ ID NO: 163596 - DNA, 36 bp, Artificial Sequence
  Description of Artificial Sequence: Synthetic oligonucleotide
actgcttgtttctgtcacaggaaacccttcaagtag

SEQ ID NO: 163597 - DNA, 35 bp, Artificial Sequence
  Description of Artificial Sequence: Synthetic oligonucleotide
ctgcttgtttctgtcacaggaaacccttcaagtag

SEQ ID NO: 163598 - DNA, 37 bp, Artificial Sequence
  Description of Artificial Sequence: Synthetic oligonucleotide
tgcttgtttctgtcacaggaaacccttcaagtagttg

SEQ ID NO: 163599 - DNA, 36 bp, Artificial Sequence
  Description of Artificial Sequence: Synthetic oligonucleotide
gcttgtttctgtcacaggaaacccttcaagtagttg

SEQ ID NO: 163600 - DNA, 36 bp, Artificial Sequence
  Description of Artificial Sequence: Synthetic oligonucleotide
cttgtttctgtcacaggaaacccttcaagtagttgg

SEQ ID NO: 163601 - DNA, 36 bp, Artificial Sequence
  Description of Artificial Sequence: Synthetic oligonucleotide
ttgtttctgtcacaggaaacccttcaagtagttggc

SEQ ID NO: 163602 - DNA, 35 bp, Artificial Sequence
  Description of Artificial Sequence: Synthetic oligonucleotide
tgtttctgtcacaggaaacccttcaagtagttggc

SEQ ID NO: 163603 - DNA, 34 bp, Artificial Sequence
  Description of Artificial Sequence: Synthetic oligonucleotide
gtttctgtcacaggaaacccttcaagtagttggc

SEQ ID NO: 163604 - DNA, 34 bp, Artificial Sequence
  Description of Artificial Sequence: Synthetic oligonucleotide
tttctgtcacaggaaacccttcaagtagttggcc

SEQ ID NO: 163605 - DNA, 33 bp, Artificial Sequence
  Description of Artificial Sequence: Synthetic oligonucleotide
ttctgtcacaggaaacccttcaagtagttggcc

SEQ ID NO: 163606 - DNA, 32 bp, Artificial Sequence
  Description of Artificial Sequence: Synthetic oligonucleotide
tctgtcacaggaaacccttcaagtagttggcc

SEQ ID NO: 163607 - DNA, 31 bp, Artificial Sequence
  Description of Artificial Sequence: Synthetic oligonucleotide
ctgtcacaggaaacccttcaagtagttggcc

SEQ ID NO: 163608 - DNA, 33 bp, Artificial Sequence
  Description of Artificial Sequence: Synthetic oligonucleotide
tgtcacaggaaacccttcaagtagttggccttc

SEQ ID NO: 163609 - DNA, 32 bp, Artificial Sequence
  Description of Artificial Sequence: Synthetic oligonucleotide
gtcacaggaaacccttcaagtagttggccttc

SEQ ID NO: 163610 - DNA, 33 bp, Artificial Sequence
  Description of Artificial Sequence: Synthetic oligonucleotide
tcacaggaaacccttcaagtagttggccttcac

SEQ ID NO: 163611 - DNA, 32 bp, Artificial Sequence
  Description of Artificial Sequence: Synthetic oligonucleotide
cacaggaaacccttcaagtagttggccttcac

SEQ ID NO: 163612 - DNA, 32 bp, Artificial Sequence
  Description of Artificial Sequence: Synthetic oligonucleotide
acaggaaacccttcaagtagttggccttcacc

SEQ ID NO: 163613 - DNA, 31 bp, Artificial Sequence
  Description of Artificial Sequence: Synthetic oligonucleotide
caggaaacccttcaagtagttggccttcacc

SEQ ID NO: 163614 - DNA, 31 bp, Artificial Sequence
  Description of Artificial Sequence: Synthetic oligonucleotide
aggaaacccttcaagtagttggccttcaccc

SEQ ID NO: 163615 - DNA, 30 bp, Artificial Sequence
  Description of Artificial Sequence: Synthetic oligonucleotide
ggaaacccttcaagtagttggccttcaccc

SEQ ID NO: 163616 - DNA, 31 bp, Artificial Sequence
  Description of Artificial Sequence: Synthetic oligonucleotide
gaaacccttcaagtagttggccttcacccac

SEQ ID NO: 163617 - DNA, 32 bp, Artificial Sequence
  Description of Artificial Sequence: Synthetic oligonucleotide
aaacccttcaagtagttggccttcacccacag

SEQ ID NO: 163618 - DNA, 31 bp, Artificial Sequence
  Description of Artificial Sequence: Synthetic oligonucleotide
aacccttcaagtagttggccttcacccacag

SEQ ID NO: 163619 - DNA, 30 bp, Artificial Sequence
  Description of Artificial Sequence: Synthetic oligonucleotide
acccttcaagtagttggccttcacccacag

SEQ ID NO: 163620 - DNA, 29 bp, Artificial Sequence
  Description of Artificial Sequence: Synthetic oligonucleotide
cccttcaagtagttggccttcacccacag

SEQ ID NO: 163621 - DNA, 31 bp, Artificial Sequence
  Description of Artificial Sequence: Synthetic oligonucleotide
ccttcaagtagttggccttcacccacagaac

SEQ ID NO: 163622 - DNA, 31 bp, Artificial Sequence
  Description of Artificial Sequence: Synthetic oligonucleotide
cttcaagtagttggccttcacccacagaacc

SEQ ID NO: 163623 - DNA, 33 bp, Artificial Sequence
  Description of Artificial Sequence: Synthetic oligonucleotide
ttcaagtagttggccttcacccacagaaccaag

SEQ ID NO: 163624 - DNA, 32 bp, Artificial Sequence
  Description of Artificial Sequence: Synthetic oligonucleotide
tcaagtagttggccttcacccacagaaccaag

SEQ ID NO: 163625 - DNA, 31 bp, Artificial Sequence
  Description of Artificial Sequence: Synthetic oligonucleotide
caagtagttggccttcacccacagaaccaag

SEQ ID NO: 163626 - DNA, 31 bp, Artificial Sequence
  Description of Artificial Sequence: Synthetic oligonucleotide
aagtagttggccttcacccacagaaccaagc

SEQ ID NO: 163627 - DNA, 30 bp, Artificial Sequence
  Description of Artificial Sequence: Synthetic oligonucleotide
tagttggccttcacccacagaaccaagctc

SEQ ID NO: 163628 - DNA, 29 bp, Artificial Sequence
  Description of Artificial Sequence: Synthetic oligonucleotide
agttggccttcacccacagaaccaagctc

SEQ ID NO: 163629 - DNA, 28 bp, Artificial Sequence
  Description of Artificial Sequence: Synthetic oligonucleotide
gttggccttcacccacagaaccaagctc

SEQ ID NO: 163630 - DNA, 28 bp, Artificial Sequence
  Description of Artificial Sequence: Synthetic oligonucleotide
ttggccttcacccacagaaccaagctcc

SEQ ID NO: 163631 - DNA, 27 bp, Artificial Sequence
  Description of Artificial Sequence: Synthetic oligonucleotide
tggccttcacccacagaaccaagctcc

SEQ ID NO: 163632 - DNA, 27 bp, Artificial Sequence
  Description of Artificial Sequence: Synthetic oligonucleotide
ggccttcacccacagaaccaagctcca

SEQ ID NO: 163633 - DNA, 30 bp, Artificial Sequence
  Description of Artificial Sequence: Synthetic oligonucleotide
gccttcacccacagaaccaagctccaaatc

SEQ ID NO: 163634 - DNA, 31 bp, Artificial Sequence
  Description of Artificial Sequence: Synthetic oligonucleotide
ccttcacccacagaaccaagctccaaatctg

SEQ ID NO: 163635 - DNA, 31 bp, Artificial Sequence
  Description of Artificial Sequence: Synthetic oligonucleotide
cttcacccacagaaccaagctccaaatctgg

SEQ ID NO: 163636 - DNA, 34 bp, Artificial Sequence
  Description of Artificial Sequence: Synthetic oligonucleotide
ttcacccacagaaccaagctccaaatctggtaac

SEQ ID NO: 163637 - DNA, 33 bp, Artificial Sequence
  Description of Artificial Sequence: Synthetic oligonucleotide
tcacccacagaaccaagctccaaatctggtaac

SEQ ID NO: 163638 - DNA, 32 bp, Artificial Sequence
  Description of Artificial Sequence: Synthetic oligonucleotide
cacccacagaaccaagctccaaatctggtaac

SEQ ID NO: 163639 - DNA, 32 bp, Artificial Sequence
  Description of Artificial Sequence: Synthetic oligonucleotide
acccacagaaccaagctccaaatctggtaacc

SEQ ID NO: 163640 - DNA, 31 bp, Artificial Sequence
  Description of Artificial Sequence: Synthetic oligonucleotide
cccacagaaccaagctccaaatctggtaacc

SEQ ID NO: 163641 - DNA, 31 bp, Artificial Sequence
  Description of Artificial Sequence: Synthetic oligonucleotide
ccacagaaccaagctccaaatctggtaaccc

SEQ ID NO: 163642 - DNA, 31 bp, Artificial Sequence
  Description of Artificial Sequence: Synthetic oligonucleotide
cacagaaccaagctccaaatctggtaacccc

SEQ ID NO: 163643 - DNA, 32 bp, Artificial Sequence
  Description of Artificial Sequence: Synthetic oligonucleotide
acagaaccaagctccaaatctggtaaccccag

SEQ ID NO: 163644 - DNA, 31 bp, Artificial Sequence
  Description of Artificial Sequence: Synthetic oligonucleotide
cagaaccaagctccaaatctggtaaccccag

SEQ ID NO: 163645 - DNA, 32 bp, Artificial Sequence
  Description of Artificial Sequence: Synthetic oligonucleotide
agaaccaagctccaaatctggtaaccccagac

SEQ ID NO: 163646 - DNA, 31 bp, Artificial Sequence
  Description of Artificial Sequence: Synthetic oligonucleotide
gaaccaagctccaaatctggtaaccccagac

SEQ ID NO: 163647 - DNA, 32 bp, Artificial Sequence
  Description of Artificial Sequence: Synthetic oligonucleotide
aaccaagctccaaatctggtaaccccagacac

SEQ ID NO: 163648 - DNA, 31 bp, Artificial Sequence
  Description of Artificial Sequence: Synthetic oligonucleotide
accaagctccaaatctggtaaccccagacac

SEQ ID NO: 163649 - DNA, 30 bp, Artificial Sequence
  Description of Artificial Sequence: Synthetic oligonucleotide
ccaagctccaaatctggtaaccccagacac

SEQ ID NO: 163650 - DNA, 30 bp, Artificial Sequence
  Description of Artificial Sequence: Synthetic oligonucleotide
caagctccaaatctggtaaccccagacacc

SEQ ID NO: 163651 - DNA, 31 bp, Artificial Sequence
  Description of Artificial Sequence: Synthetic oligonucleotide
aagctccaaatctggtaaccccagacacctg

SEQ ID NO: 163652 - DNA, 30 bp, Artificial Sequence
  Description of Artificial Sequence: Synthetic oligonucleotide
agctccaaatctggtaaccccagacacctg

SEQ ID NO: 163653 - DNA, 29 bp, Artificial Sequence
  Description of Artificial Sequence: Synthetic oligonucleotide
gctccaaatctggtaaccccagacacctg

SEQ ID NO: 163654 - DNA, 29 bp, Artificial Sequence
  Description of Artificial Sequence: Synthetic oligonucleotide
ctccaaatctggtaaccccagacacctgc

SEQ ID NO: 163655 - DNA, 30 bp, Artificial Sequence
  Description of Artificial Sequence: Synthetic oligonucleotide
tccaaatctggtaaccccagacacctgcac

SEQ ID NO: 163656 - DNA, 29 bp, Artificial Sequence
  Description of Artificial Sequence: Synthetic oligonucleotide
ccaaatctggtaaccccagacacctgcac

SEQ ID NO: 163657 - DNA, 32 bp, Artificial Sequence
  Description of Artificial Sequence: Synthetic oligonucleotide
caaatctggtaaccccagacacctgcacattc

SEQ ID NO: 163658 - DNA, 33 bp, Artificial Sequence
  Description of Artificial Sequence: Synthetic oligonucleotide
aaatctggtaaccccagacacctgcacattctg

SEQ ID NO: 163659 - DNA, 32 bp, Artificial Sequence
  Description of Artificial Sequence: Synthetic oligonucleotide
aatctggtaaccccagacacctgcacattctg

SEQ ID NO: 163660 - DNA, 31 bp, Artificial Sequence
  Description of Artificial Sequence: Synthetic oligonucleotide
atctggtaaccccagacacctgcacattctg

SEQ ID NO: 163661 - DNA, 30 bp, Artificial Sequence
  Description of Artificial Sequence: Synthetic oligonucleotide
tctggtaaccccagacacctgcacattctg

SEQ ID NO: 163662 - DNA, 29 bp, Artificial Sequence
  Description of Artificial Sequence: Synthetic oligonucleotide
ctggtaaccccagacacctgcacattctg

SEQ ID NO: 163663 - DNA, 32 bp, Artificial Sequence
  Description of Artificial Sequence: Synthetic oligonucleotide
tggtaaccccagacacctgcacattctgattg

SEQ ID NO: 163664 - DNA, 35 bp, Artificial Sequence
  Description of Artificial Sequence: Synthetic oligonucleotide
tcttcatcctcctcctcttctttctccttcatctc

SEQ ID NO: 163665 - DNA, 34 bp, Artificial Sequence
  Description of Artificial Sequence: Synthetic oligonucleotide
cttcatcctcctcctcttctttctccttcatctc

SEQ ID NO: 163666 - DNA, 35 bp, Artificial Sequence
  Description of Artificial Sequence: Synthetic oligonucleotide
ttcatcctcctcctcttctttctccttcatctctg

SEQ ID NO: 163667 - DNA, 34 bp, Artificial Sequence
  Description of Artificial Sequence: Synthetic oligonucleotide
tcatcctcctcctcttctttctccttcatctctg

SEQ ID NO: 163668 - DNA, 33 bp, Artificial Sequence
  Description of Artificial Sequence: Synthetic oligonucleotide
catcctcctcctcttctttctccttcatctctg

SEQ ID NO: 163669 - DNA, 33 bp, Artificial Sequence
  Description of Artificial Sequence: Synthetic oligonucleotide
atcctcctcctcttctttctccttcatctctgg

SEQ ID NO: 163670 - DNA, 32 bp, Artificial Sequence
  Description of Artificial Sequence: Synthetic oligonucleotide
tcctcctcctcttctttctccttcatctctgg

SEQ ID NO: 163671 - DNA, 31 bp, Artificial Sequence
  Description of Artificial Sequence: Synthetic oligonucleotide
cctcctcctcttctttctccttcatctctgg

SEQ ID NO: 163672 - DNA, 32 bp, Artificial Sequence
  Description of Artificial Sequence: Synthetic oligonucleotide
ctcctcctcttctttctccttcatctctggtg

SEQ ID NO: 163673 - DNA, 32 bp, Artificial Sequence
  Description of Artificial Sequence: Synthetic oligonucleotide
tcctcctcttctttctccttcatctctggtgc

SEQ ID NO: 163674 - DNA, 31 bp, Artificial Sequence
  Description of Artificial Sequence: Synthetic oligonucleotide
cctcctcttctttctccttcatctctggtgc

SEQ ID NO: 163675 - DNA, 32 bp, Artificial Sequence
  Description of Artificial Sequence: Synthetic oligonucleotide
ctcctcttctttctccttcatctctggtgctc

SEQ ID NO: 163676 - DNA, 32 bp, Artificial Sequence
  Description of Artificial Sequence: Synthetic oligonucleotide
tcctcttctttctccttcatctctggtgctcc

SEQ ID NO: 163677 - DNA, 31 bp, Artificial Sequence
  Description of Artificial Sequence: Synthetic oligonucleotide
cctcttctttctccttcatctctggtgctcc

SEQ ID NO: 163678 - DNA, 33 bp, Artificial Sequence
  Description of Artificial Sequence: Synthetic oligonucleotide
ctcttctttctccttcatctctggtgctccaac

SEQ ID NO: 163679 - DNA, 42 bp, Artificial Sequence
  Description of Artificial Sequence: Synthetic oligonucleotide
tcttctttctccttcatctctggtgctccaacaaaaaaaatg

SEQ ID NO: 163680 - DNA, 41 bp, Artificial Sequence
  Description of Artificial Sequence: Synthetic oligonucleotide
cttctttctccttcatctctggtgctccaacaaaaaaaatg

SEQ ID NO: 163681 - DNA, 41 bp, Artificial Sequence
  Description of Artificial Sequence: Synthetic oligonucleotide
ttctttctccttcatctctggtgctccaacaaaaaaaatgc

SEQ ID NO: 163682 - DNA, 40 bp, Artificial Sequence
  Description of Artificial Sequence: Synthetic oligonucleotide
tctttctccttcatctctggtgctccaacaaaaaaaatgc

SEQ ID NO: 163683 - DNA, 39 bp, Artificial Sequence
  Description of Artificial Sequence: Synthetic oligonucleotide
ctttctccttcatctctggtgctccaacaaaaaaaatgc

SEQ ID NO: 163684 - DNA, 40 bp, Artificial Sequence
  Description of Artificial Sequence: Synthetic oligonucleotide
tttctccttcatctctggtgctccaacaaaaaaaatgctg

SEQ ID NO: 163685 - DNA, 39 bp, Artificial Sequence
  Description of Artificial Sequence: Synthetic oligonucleotide
ttctccttcatctctggtgctccaacaaaaaaaatgctg

SEQ ID NO: 163686 - DNA, 38 bp, Artificial Sequence
  Description of Artificial Sequence: Synthetic oligonucleotide
tctccttcatctctggtgctccaacaaaaaaaatgctg

SEQ ID NO: 163687 - DNA, 37 bp, Artificial Sequence
  Description of Artificial Sequence: Synthetic oligonucleotide
ctccttcatctctggtgctccaacaaaaaaaatgctg

SEQ ID NO: 163688 - DNA, 37 bp, Artificial Sequence
  Description of Artificial Sequence: Synthetic oligonucleotide
tccttcatctctggtgctccaacaaaaaaaatgctgc

SEQ ID NO: 163689 - DNA, 36 bp, Artificial Sequence
  Description of Artificial Sequence: Synthetic oligonucleotide
ccttcatctctggtgctccaacaaaaaaaatgctgc

SEQ ID NO: 163690 - DNA, 37 bp, Artificial Sequence
  Description of Artificial Sequence: Synthetic oligonucleotide
cttcatctctggtgctccaacaaaaaaaatgctgctg

SEQ ID NO: 163691 - DNA, 41 bp, Artificial Sequence
  Description of Artificial Sequence: Synthetic oligonucleotide
ttcatctctggtgctccaacaaaaaaaatgctgctgtaatg

SEQ ID NO: 163692 - DNA, 40 bp, Artificial Sequence
  Description of Artificial Sequence: Synthetic oligonucleotide
tcatctctggtgctccaacaaaaaaaatgctgctgtaatg

SEQ ID NO: 163693 - DNA, 39 bp, Artificial Sequence
  Description of Artificial Sequence: Synthetic oligonucleotide
catctctggtgctccaacaaaaaaaatgctgctgtaatg

SEQ ID NO: 163694 - DNA, 39 bp, Artificial Sequence
  Description of Artificial Sequence: Synthetic oligonucleotide
atctctggtgctccaacaaaaaaaatgctgctgtaatgg

SEQ ID NO: 163695 - DNA, 38 bp, Artificial Sequence
  Description of Artificial Sequence: Synthetic oligonucleotide
tctctggtgctccaacaaaaaaaatgctgctgtaatgg

SEQ ID NO: 163696 - DNA, 37 bp, Artificial Sequence
  Description of Artificial Sequence: Synthetic oligonucleotide
ctctggtgctccaacaaaaaaaatgctgctgtaatgg

SEQ ID NO: 163697 - DNA, 38 bp, Artificial Sequence
  Description of Artificial Sequence: Synthetic oligonucleotide
tctggtgctccaacaaaaaaaatgctgctgtaatggac

SEQ ID NO: 163698 - DNA, 27 bp, Artificial Sequence
  Description of Artificial Sequence: Synthetic oligonucleotide
caagagcctgcagggaacagaacagcc

SEQ ID NO: 163699 - DNA, 29 bp, Artificial Sequence
  Description of Artificial Sequence: Synthetic oligonucleotide
aagagcctgcagggaacagaacagccaac

SEQ ID NO: 163700 - DNA, 28 bp, Artificial Sequence
  Description of Artificial Sequence: Synthetic oligonucleotide
agagcctgcagggaacagaacagccaac

SEQ ID NO: 163701 - DNA, 27 bp, Artificial Sequence
  Description of Artificial Sequence: Synthetic oligonucleotide
gagcctgcagggaacagaacagccaac

SEQ ID NO: 163702 - DNA, 28 bp, Artificial Sequence
  Description of Artificial Sequence: Synthetic oligonucleotide
agcctgcagggaacagaacagccaacag

SEQ ID NO: 163703 - DNA, 27 bp, Artificial Sequence
  Description of Artificial Sequence: Synthetic oligonucleotide
gcctgcagggaacagaacagccaacag

SEQ ID NO: 163704 - DNA, 27 bp, Artificial Sequence
  Description of Artificial Sequence: Synthetic oligonucleotide
cctgcagggaacagaacagccaacagc

SEQ ID NO: 163705 - DNA, 27 bp, Artificial Sequence
  Description of Artificial Sequence: Synthetic oligonucleotide
ctgcagggaacagaacagccaacagcg

SEQ ID NO: 163706 - DNA, 28 bp, Artificial Sequence
  Description of Artificial Sequence: Synthetic oligonucleotide
tgcagggaacagaacagccaacagcgag

SEQ ID NO: 163707 - DNA, 27 bp, Artificial Sequence
  Description of Artificial Sequence: Synthetic oligonucleotide
gcagggaacagaacagccaacagcgag

SEQ ID NO: 163708 - DNA, 27 bp, Artificial Sequence
  Description of Artificial Sequence: Synthetic oligonucleotide
cagggaacagaacagccaacagcgagg

SEQ ID NO: 163709 - DNA, 28 bp, Artificial Sequence
  Description of Artificial Sequence: Synthetic oligonucleotide
agggaacagaacagccaacagcgaggac

SEQ ID NO: 163710 - DNA, 27 bp, Artificial Sequence
  Description of Artificial Sequence: Synthetic oligonucleotide
gggaacagaacagccaacagcgaggac

SEQ ID NO: 163711 - DNA, 28 bp, Artificial Sequence
  Description of Artificial Sequence: Synthetic oligonucleotide
ggaacagaacagccaacagcgaggactc

SEQ ID NO: 163712 - DNA, 29 bp, Artificial Sequence
  Description of Artificial Sequence: Synthetic oligonucleotide
gaacagaacagccaacagcgaggactctg

SEQ ID NO: 163713 - DNA, 31 bp, Artificial Sequence
  Description of Artificial Sequence: Synthetic oligonucleotide
aacagaacagccaacagcgaggactctgatg

SEQ ID NO: 163714 - DNA, 30 bp, Artificial Sequence
  Description of Artificial Sequence: Synthetic oligonucleotide
acagaacagccaacagcgaggactctgatg

SEQ ID NO: 163715 - DNA, 29 bp, Artificial Sequence
  Description of Artificial Sequence: Synthetic oligonucleotide
cagaacagccaacagcgaggactctgatg

SEQ ID NO: 163716 - DNA, 31 bp, Artificial Sequence
  Description of Artificial Sequence: Synthetic oligonucleotide
agaacagccaacagcgaggactctgatgaac

SEQ ID NO: 163717 - DNA, 30 bp, Artificial Sequence
  Description of Artificial Sequence: Synthetic oligonucleotide
gaacagccaacagcgaggactctgatgaac

SEQ ID NO: 163718 - DNA, 32 bp, Artificial Sequence
  Description of Artificial Sequence: Synthetic oligonucleotide
aacagccaacagcgaggactctgatgaacaag

SEQ ID NO: 163719 - DNA, 31 bp, Artificial Sequence
  Description of Artificial Sequence: Synthetic oligonucleotide
acagccaacagcgaggactctgatgaacaag

SEQ ID NO: 163720 - DNA, 30 bp, Artificial Sequence
  Description of Artificial Sequence: Synthetic oligonucleotide
cagccaacagcgaggactctgatgaacaag

SEQ ID NO: 163721 - DNA, 31 bp, Artificial Sequence
  Description of Artificial Sequence: Synthetic oligonucleotide
agccaacagcgaggactctgatgaacaagac

SEQ ID NO: 163722 - DNA, 30 bp, Artificial Sequence
  Description of Artificial Sequence: Synthetic oligonucleotide
gccaacagcgaggactctgatgaacaagac

SEQ ID NO: 163723 - DNA, 30 bp, Artificial Sequence
  Description of Artificial Sequence: Synthetic oligonucleotide
ccaacagcgaggactctgatgaacaagacc

SEQ ID NO: 163724 - DNA, 30 bp, Artificial Sequence
  Description of Artificial Sequence: Synthetic oligonucleotide
caacagcgaggactctgatgaacaagaccc

SEQ ID NO: 163725 - DNA, 31 bp, Artificial Sequence
  Description of Artificial Sequence: Synthetic oligonucleotide
aacagcgaggactctgatgaacaagaccctg

SEQ ID NO: 163726 - DNA, 30 bp, Artificial Sequence
  Description of Artificial Sequence: Synthetic oligonucleotide
acagcgaggactctgatgaacaagaccctg

SEQ ID NO: 163727 - DNA, 29 bp, Artificial Sequence
  Description of Artificial Sequence: Synthetic oligonucleotide
cagcgaggactctgatgaacaagaccctg

SEQ ID NO: 163728 - DNA, 30 bp, Artificial Sequence
  Description of Artificial Sequence: Synthetic oligonucleotide
agcgaggactctgatgaacaagaccctgag

SEQ ID NO: 163729 - DNA, 29 bp, Artificial Sequence
  Description of Artificial Sequence: Synthetic oligonucleotide
gcgaggactctgatgaacaagaccctgag

SEQ ID NO: 163730 - DNA, 29 bp, Artificial Sequence
  Description of Artificial Sequence: Synthetic oligonucleotide
cgaggactctgatgaacaagaccctgagg

SEQ ID NO: 163731 - DNA, 30 bp, Artificial Sequence
  Description of Artificial Sequence: Synthetic oligonucleotide
aggtgacatacgcacagttggatcactgcg

SEQ ID NO: 163732 - DNA, 29 bp, Artificial Sequence
  Description of Artificial Sequence: Synthetic oligonucleotide
ggtgacatacgcacagttggatcactgcg

SEQ ID NO: 163733 - DNA, 33 bp, Artificial Sequence
  Description of Artificial Sequence: Synthetic oligonucleotide
gtgacatacgcacagttggatcactgcgttttc

SEQ ID NO: 163734 - DNA, 34 bp, Artificial Sequence
  Description of Artificial Sequence: Synthetic oligonucleotide
tgacatacgcacagttggatcactgcgttttcac

SEQ ID NO: 163735 - DNA, 33 bp, Artificial Sequence
  Description of Artificial Sequence: Synthetic oligonucleotide
gacatacgcacagttggatcactgcgttttcac

SEQ ID NO: 163736 - DNA, 34 bp, Artificial Sequence
  Description of Artificial Sequence: Synthetic oligonucleotide
acatacgcacagttggatcactgcgttttcacac

SEQ ID NO: 163737 - DNA, 33 bp, Artificial Sequence
  Description of Artificial Sequence: Synthetic oligonucleotide
catacgcacagttggatcactgcgttttcacac

SEQ ID NO: 163738 - DNA, 34 bp, Artificial Sequence
  Description of Artificial Sequence: Synthetic oligonucleotide
atacgcacagttggatcactgcgttttcacacag

SEQ ID NO: 163739 - DNA, 33 bp, Artificial Sequence
  Description of Artificial Sequence: Synthetic oligonucleotide
tacgcacagttggatcactgcgttttcacacag

SEQ ID NO: 163740 - DNA, 32 bp, Artificial Sequence
  Description of Artificial Sequence: Synthetic oligonucleotide
acgcacagttggatcactgcgttttcacacag

SEQ ID NO: 163741 - DNA, 31 bp, Artificial Sequence
  Description of Artificial Sequence: Synthetic oligonucleotide
cgcacagttggatcactgcgttttcacacag

SEQ ID NO: 163742 - DNA, 32 bp, Artificial Sequence
  Description of Artificial Sequence: Synthetic oligonucleotide
gcacagttggatcactgcgttttcacacagag

SEQ ID NO: 163743 - DNA, 38 bp, Artificial Sequence
  Description of Artificial Sequence: Synthetic oligonucleotide
cacagttggatcactgcgttttcacacagagaaaaatc

SEQ ID NO: 163744 - DNA, 27 bp, Artificial Sequence
  Description of Artificial Sequence: Synthetic oligonucleotide
cttctcagaggcccaagacacccccta

SEQ ID NO: 163745 - DNA, 27 bp, Artificial Sequence
  Description of Artificial Sequence: Synthetic oligonucleotide
ttctcagaggcccaagacaccccctac

SEQ ID NO: 163746 - DNA, 27 bp, Artificial Sequence
  Description of Artificial Sequence: Synthetic oligonucleotide
tctcagaggcccaagacaccccctaca

SEQ ID NO: 163747 - DNA, 26 bp, Artificial Sequence
  Description of Artificial Sequence: Synthetic oligonucleotide
ctcagaggcccaagacaccccctaca

SEQ ID NO: 163748 - DNA, 27 bp, Artificial Sequence
  Description of Artificial Sequence: Synthetic oligonucleotide
tcagaggcccaagacaccccctacaga

SEQ ID NO: 163749 - DNA, 27 bp, Artificial Sequence
  Description of Artificial Sequence: Synthetic oligonucleotide
cagaggcccaagacaccccctacagat

SEQ ID NO: 163750 - DNA, 28 bp, Artificial Sequence
  Description of Artificial Sequence: Synthetic oligonucleotide
agaggcccaagacaccccctacagatac

SEQ ID NO: 163751 - DNA, 27 bp, Artificial Sequence
  Description of Artificial Sequence: Synthetic oligonucleotide
gaggcccaagacaccccctacagatac

SEQ ID NO: 163752 - DNA, 27 bp, Artificial Sequence
  Description of Artificial Sequence: Synthetic oligonucleotide
aggcccaagacaccccctacagatacc

SEQ ID NO: 163753 - DNA, 27 bp, Artificial Sequence
  Description of Artificial Sequence: Synthetic oligonucleotide
ggcccaagacaccccctacagatacca

SEQ ID NO: 163754 - DNA, 28 bp, Artificial Sequence
  Description of Artificial Sequence: Synthetic oligonucleotide
gcccaagacaccccctacagataccatc

SEQ ID NO: 163755 - DNA, 30 bp, Artificial Sequence
  Description of Artificial Sequence: Synthetic oligonucleotide
cccaagacaccccctacagataccatcttg

SEQ ID NO: 163756 - DNA, 32 bp, Artificial Sequence
  Description of Artificial Sequence: Synthetic oligonucleotide
ccaagacaccccctacagataccatcttgtac

SEQ ID NO: 163757 - DNA, 33 bp, Artificial Sequence
  Description of Artificial Sequence: Synthetic oligonucleotide
caagacaccccctacagataccatcttgtacac

SEQ ID NO: 163758 - DNA, 33 bp, Artificial Sequence
  Description of Artificial Sequence: Synthetic oligonucleotide
aagacaccccctacagataccatcttgtacacg

SEQ ID NO: 163759 - DNA, 32 bp, Artificial Sequence
  Description of Artificial Sequence: Synthetic oligonucleotide
agacaccccctacagataccatcttgtacacg

SEQ ID NO: 163760 - DNA, 31 bp, Artificial Sequence
  Description of Artificial Sequence: Synthetic oligonucleotide
gacaccccctacagataccatcttgtacacg

SEQ ID NO: 163761 - DNA, 31 bp, Artificial Sequence
  Description of Artificial Sequence: Synthetic oligonucleotide
acaccccctacagataccatcttgtacacgg

SEQ ID NO: 163762 - DNA, 30 bp, Artificial Sequence
  Description of Artificial Sequence: Synthetic oligonucleotide
caccccctacagataccatcttgtacacgg

SEQ ID NO: 163763 - DNA, 32 bp, Artificial Sequence
  Description of Artificial Sequence: Synthetic oligonucleotide
accccctacagataccatcttgtacacggaac

SEQ ID NO: 163764 - DNA, 31 bp, Artificial Sequence
  Description of Artificial Sequence: Synthetic oligonucleotide
ccccctacagataccatcttgtacacggaac

SEQ ID NO: 163765 - DNA, 33 bp, Artificial Sequence
  Description of Artificial Sequence: Synthetic oligonucleotide
cccctacagataccatcttgtacacggaacttc

SEQ ID NO: 163766 - DNA, 33 bp, Artificial Sequence
  Description of Artificial Sequence: Synthetic oligonucleotide
ccctacagataccatcttgtacacggaacttcc

SEQ ID NO: 163767 - DNA, 37 bp, Artificial Sequence
  Description of Artificial Sequence: Synthetic oligonucleotide
cctacagataccatcttgtacacggaacttccaaatg

SEQ ID NO: 163768 - DNA, 37 bp, Artificial Sequence
  Description of Artificial Sequence: Synthetic oligonucleotide
ctacagataccatcttgtacacggaacttccaaatgc

SEQ ID NO: 163769 - DNA, 40 bp, Artificial Sequence
  Description of Artificial Sequence: Synthetic oligonucleotide
tacagataccatcttgtacacggaacttccaaatgctaag

SEQ ID NO: 163770 - DNA, 39 bp, Artificial Sequence
  Description of Artificial Sequence: Synthetic oligonucleotide
acagataccatcttgtacacggaacttccaaatgctaag

SEQ ID NO: 163771 - DNA, 38 bp, Artificial Sequence
  Description of Artificial Sequence: Synthetic oligonucleotide
cagataccatcttgtacacggaacttccaaatgctaag

SEQ ID NO: 163772 - DNA, 38 bp, Artificial Sequence
  Description of Artificial Sequence: Synthetic oligonucleotide
agataccatcttgtacacggaacttccaaatgctaagc

SEQ ID NO: 163773 - DNA, 37 bp, Artificial Sequence
  Description of Artificial Sequence: Synthetic oligonucleotide
gataccatcttgtacacggaacttccaaatgctaagc

SEQ ID NO: 163774 - DNA, 37 bp, Artificial Sequence
  Description of Artificial Sequence: Synthetic oligonucleotide
ataccatcttgtacacggaacttccaaatgctaagcc

SEQ ID NO: 163775 - DNA, 36 bp, Artificial Sequence
  Description of Artificial Sequence: Synthetic oligonucleotide
taccatcttgtacacggaacttccaaatgctaagcc

SEQ ID NO: 163776 - DNA, 35 bp, Artificial Sequence
  Description of Artificial Sequence: Synthetic oligonucleotide
accatcttgtacacggaacttccaaatgctaagcc

SEQ ID NO: 163777 - DNA, 34 bp, Artificial Sequence
  Description of Artificial Sequence: Synthetic oligonucleotide
ccatcttgtacacggaacttccaaatgctaagcc

SEQ ID NO: 163778 - DNA, 34 bp, Artificial Sequence
  Description of Artificial Sequence: Synthetic oligonucleotide
catcttgtacacggaacttccaaatgctaagccc

SEQ ID NO: 163779 - DNA, 35 bp, Artificial Sequence
  Description of Artificial Sequence: Synthetic oligonucleotide
atcttgtacacggaacttccaaatgctaagcccag

SEQ ID NO: 163780 - DNA, 34 bp, Artificial Sequence
  Description of Artificial Sequence: Synthetic oligonucleotide
tcttgtacacggaacttccaaatgctaagcccag

SEQ ID NO: 163781 - DNA, 33 bp, Artificial Sequence
  Description of Artificial Sequence: Synthetic oligonucleotide
cttgtacacggaacttccaaatgctaagcccag

SEQ ID NO: 163782 - DNA, 35 bp, Artificial Sequence
  Description of Artificial Sequence: Synthetic oligonucleotide
ttgtacacggaacttccaaatgctaagcccagatc

SEQ ID NO: 163783 - DNA, 34 bp, Artificial Sequence
  Description of Artificial Sequence: Synthetic oligonucleotide
tgtacacggaacttccaaatgctaagcccagatc

SEQ ID NO: 163784 - DNA, 33 bp, Artificial Sequence
  Description of Artificial Sequence: Synthetic oligonucleotide
gtacacggaacttccaaatgctaagcccagatc

SEQ ID NO: 163785 - DNA, 33 bp, Artificial Sequence
  Description of Artificial Sequence: Synthetic oligonucleotide
tacacggaacttccaaatgctaagcccagatcc

SEQ ID NO: 163786 - DNA, 32 bp, Artificial Sequence
  Description of Artificial Sequence: Synthetic oligonucleotide
acacggaacttccaaatgctaagcccagatcc

SEQ ID NO: 163787 - DNA, 31 bp, Artificial Sequence
  Description of Artificial Sequence: Synthetic oligonucleotide
cacggaacttccaaatgctaagcccagatcc

SEQ ID NO: 163788 - DNA, 34 bp, Artificial Sequence
  Description of Artificial Sequence: Synthetic oligonucleotide
acggaacttccaaatgctaagcccagatccaaag

SEQ ID NO: 163789 - DNA, 33 bp, Artificial Sequence
  Description of Artificial Sequence: Synthetic oligonucleotide
cggaacttccaaatgctaagcccagatccaaag

SEQ ID NO: 163790 - DNA, 35 bp, Artificial Sequence
  Description of Artificial Sequence: Synthetic oligonucleotide
ggaacttccaaatgctaagcccagatccaaagttg

SEQ ID NO: 163791 - DNA, 36 bp, Artificial Sequence
  Description of Artificial Sequence: Synthetic oligonucleotide
gaacttccaaatgctaagcccagatccaaagttgtc

SEQ ID NO: 163792 - DNA, 37 bp, Artificial Sequence
  Description of Artificial Sequence: Synthetic oligonucleotide
aacttccaaatgctaagcccagatccaaagttgtctc

SEQ ID NO: 163793 - DNA, 36 bp, Artificial Sequence
  Description of Artificial Sequence: Synthetic oligonucleotide
acttccaaatgctaagcccagatccaaagttgtctc

SEQ ID NO: 163794 - DNA, 35 bp, Artificial Sequence
  Description of Artificial Sequence: Synthetic oligonucleotide
cttccaaatgctaagcccagatccaaagttgtctc

SEQ ID NO: 163795 - DNA, 35 bp, Artificial Sequence
  Description of Artificial Sequence: Synthetic oligonucleotide
ttccaaatgctaagcccagatccaaagttgtctcc

SEQ ID NO: 163796 - DNA, 34 bp, Artificial Sequence
  Description of Artificial Sequence: Synthetic oligonucleotide
tccaaatgctaagcccagatccaaagttgtctcc

SEQ ID NO: 163797 - DNA, 33 bp, Artificial Sequence
  Description of Artificial Sequence: Synthetic oligonucleotide
ccaaatgctaagcccagatccaaagttgtctcc

SEQ ID NO: 163798 - DNA, 34 bp, Artificial Sequence
  Description of Artificial Sequence: Synthetic oligonucleotide
caaatgctaagcccagatccaaagttgtctcctg

SEQ ID NO: 163799 - DNA, 34 bp, Artificial Sequence
  Description of Artificial Sequence: Synthetic oligonucleotide
aaatgctaagcccagatccaaagttgtctcctgc

SEQ ID NO: 163800 - DNA, 33 bp, Artificial Sequence
  Description of Artificial Sequence: Synthetic oligonucleotide
aatgctaagcccagatccaaagttgtctcctgc

SEQ ID NO: 163801 - DNA, 32 bp, Artificial Sequence
  Description of Artificial Sequence: Synthetic oligonucleotide
atgctaagcccagatccaaagttgtctcctgc

SEQ ID NO: 163802 - DNA, 31 bp, Artificial Sequence
  Description of Artificial Sequence: Synthetic oligonucleotide
tgctaagcccagatccaaagttgtctcctgc

SEQ ID NO: 163803 - DNA, 30 bp, Artificial Sequence
  Description of Artificial Sequence: Synthetic oligonucleotide
gctaagcccagatccaaagttgtctcctgc

SEQ ID NO: 163804 - DNA, 30 bp, Artificial Sequence
  Description of Artificial Sequence: Synthetic oligonucleotide
ctaagcccagatccaaagttgtctcctgcc

SEQ ID NO: 163805 - DNA, 30 bp, Artificial Sequence
  Description of Artificial Sequence: Synthetic oligonucleotide
taagcccagatccaaagttgtctcctgccc

SEQ ID NO: 163806 - DNA, 29 bp, Artificial Sequence
  Description of Artificial Sequence: Synthetic oligonucleotide
aagcccagatccaaagttgtctcctgccc

SEQ ID NO: 163807 - DNA, 27 bp, Artificial Sequence
  Description of Artificial Sequence: Synthetic oligonucleotide
agtgatcccctggacatcgtggtcacg

SEQ ID NO: 163808 - DNA, 26 bp, Artificial Sequence
  Description of Artificial Sequence: Synthetic oligonucleotide
gtgatcccctggacatcgtggtcacg

SEQ ID NO: 163809 - DNA, 26 bp, Artificial Sequence
  Description of Artificial Sequence: Synthetic oligonucleotide
tgatcccctggacatcgtggtcacgg

SEQ ID NO: 163810 - DNA, 25 bp, Artificial Sequence
  Description of Artificial Sequence: Synthetic oligonucleotide
gatcccctggacatcgtggtcacgg

SEQ ID NO: 163811 - DNA, 26 bp, Artificial Sequence
  Description of Artificial Sequence: Synthetic oligonucleotide
atcccctggacatcgtggtcacgggt

SEQ ID NO: 163812 - DNA, 25 bp, Artificial Sequence
  Description of Artificial Sequence: Synthetic oligonucleotide
tcccctggacatcgtggtcacgggt

SEQ ID NO: 163813 - DNA, 24 bp, Artificial Sequence
  Description of Artificial Sequence: Synthetic oligonucleotide
cccctggacatcgtggtcacgggt

SEQ ID NO: 163814 - DNA, 24 bp, Artificial Sequence
  Description of Artificial Sequence: Synthetic oligonucleotide
ccctggacatcgtggtcacgggtc

SEQ ID NO: 163815 - DNA, 27 bp, Artificial Sequence
  Description of Artificial Sequence: Synthetic oligonucleotide
cctggacatcgtggtcacgggtccata

SEQ ID NO: 163816 - DNA, 28 bp, Artificial Sequence
  Description of Artificial Sequence: Synthetic oligonucleotide
ctggacatcgtggtcacgggtccatatg

SEQ ID NO: 163817 - DNA, 29 bp, Artificial Sequence
  Description of Artificial Sequence: Synthetic oligonucleotide
tggacatcgtggtcacgggtccatatgag

SEQ ID NO: 163818 - DNA, 28 bp, Artificial Sequence
  Description of Artificial Sequence: Synthetic oligonucleotide
ggacatcgtggtcacgggtccatatgag

SEQ ID NO: 163819 - DNA, 31 bp, Artificial Sequence
  Description of Artificial Sequence: Synthetic oligonucleotide
gacatcgtggtcacgggtccatatgagaaac

SEQ ID NO: 163820 - DNA, 31 bp, Artificial Sequence
  Description of Artificial Sequence: Synthetic oligonucleotide
acatcgtggtcacgggtccatatgagaaacc

SEQ ID NO: 163821 - DNA, 30 bp, Artificial Sequence
  Description of Artificial Sequence: Synthetic oligonucleotide
catcgtggtcacgggtccatatgagaaacc

SEQ ID NO: 163822 - DNA, 32 bp, Artificial Sequence
  Description of Artificial Sequence: Synthetic oligonucleotide
atcgtggtcacgggtccatatgagaaaccttc

SEQ ID NO: 163823 - DNA, 31 bp, Artificial Sequence
  Description of Artificial Sequence: Synthetic oligonucleotide
tcgtggtcacgggtccatatgagaaaccttc

SEQ ID NO: 163824 - DNA, 30 bp, Artificial Sequence
  Description of Artificial Sequence: Synthetic oligonucleotide
cgtggtcacgggtccatatgagaaaccttc

SEQ ID NO: 163825 - DNA, 31 bp, Artificial Sequence
  Description of Artificial Sequence: Synthetic oligonucleotide
gtggtcacgggtccatatgagaaaccttctc

SEQ ID NO: 163826 - DNA, 32 bp, Artificial Sequence
  Description of Artificial Sequence: Synthetic oligonucleotide
tggtcacgggtccatatgagaaaccttctctc

SEQ ID NO: 163827 - DNA, 31 bp, Artificial Sequence
  Description of Artificial Sequence: Synthetic oligonucleotide
ggtcacgggtccatatgagaaaccttctctc

SEQ ID NO: 163828 - DNA, 32 bp, Artificial Sequence
  Description of Artificial Sequence: Synthetic oligonucleotide
gtcacgggtccatatgagaaaccttctctctc

SEQ ID NO: 163829 - DNA, 33 bp, Artificial Sequence
  Description of Artificial Sequence: Synthetic oligonucleotide
tcacgggtccatatgagaaaccttctctctcag

SEQ ID NO: 163830 - DNA, 32 bp, Artificial Sequence
  Description of Artificial Sequence: Synthetic oligonucleotide
cacgggtccatatgagaaaccttctctctcag

SEQ ID NO: 163831 - DNA, 32 bp, Artificial Sequence
  Description of Artificial Sequence: Synthetic oligonucleotide
acgggtccatatgagaaaccttctctctcagc

SEQ ID NO: 163832 - DNA, 31 bp, Artificial Sequence
  Description of Artificial Sequence: Synthetic oligonucleotide
cgggtccatatgagaaaccttctctctcagc

SEQ ID NO: 163833 - DNA, 31 bp, Artificial Sequence
  Description of Artificial Sequence: Synthetic oligonucleotide
gggtccatatgagaaaccttctctctcagcc

SEQ ID NO: 163834 - DNA, 37 bp, Artificial Sequence
  Description of Artificial Sequence: Synthetic oligonucleotide
gtgctccaacaaaaaaaatgctgctgtaatggaccag

SEQ ID NO: 163835 - DNA, 37 bp, Artificial Sequence
  Description of Artificial Sequence: Synthetic oligonucleotide
tgctccaacaaaaaaaatgctgctgtaatggaccagg

SEQ ID NO: 163836 - DNA, 36 bp, Artificial Sequence
  Description of Artificial Sequence: Synthetic oligonucleotide
gctccaacaaaaaaaatgctgctgtaatggaccagg

SEQ ID NO: 163837 - DNA, 37 bp, Artificial Sequence
  Description of Artificial Sequence: Synthetic oligonucleotide
ctccaacaaaaaaaatgctgctgtaatggaccaggag

SEQ ID NO: 163838 - DNA, 37 bp, Artificial Sequence
  Description of Artificial Sequence: Synthetic oligonucleotide
tccaacaaaaaaaatgctgctgtaatggaccaggagc

SEQ ID NO: 163839 - DNA, 36 bp, Artificial Sequence
  Description of Artificial Sequence: Synthetic oligonucleotide
ccaacaaaaaaaatgctgctgtaatggaccaggagc

SEQ ID NO: 163840 - DNA, 36 bp, Artificial Sequence
  Description of Artificial Sequence: Synthetic oligonucleotide
caacaaaaaaaatgctgctgtaatggaccaggagcc

SEQ ID NO: 163841 - DNA, 37 bp, Artificial Sequence
  Description of Artificial Sequence: Synthetic oligonucleotide
aacaaaaaaaatgctgctgtaatggaccaggagcctg

SEQ ID NO: 163842 - DNA, 36 bp, Artificial Sequence
  Description of Artificial Sequence: Synthetic oligonucleotide
acaaaaaaaatgctgctgtaatggaccaggagcctg

SEQ ID NO: 163843 - DNA, 35 bp, Artificial Sequence
  Description of Artificial Sequence: Synthetic oligonucleotide
caaaaaaaatgctgctgtaatggaccaggagcctg

SEQ ID NO: 163844 - DNA, 35 bp, Artificial Sequence
  Description of Artificial Sequence: Synthetic oligonucleotide
aaaaaaaatgctgctgtaatggaccaggagcctgc

SEQ ID NO: 163845 - DNA, 34 bp, Artificial Sequence
  Description of Artificial Sequence: Synthetic oligonucleotide
aaaaaaatgctgctgtaatggaccaggagcctgc

SEQ ID NO: 163846 - DNA, 33 bp, Artificial Sequence
  Description of Artificial Sequence: Synthetic oligonucleotide
aaaaaatgctgctgtaatggaccaggagcctgc

SEQ ID NO: 163847 - DNA, 32 bp, Artificial Sequence
  Description of Artificial Sequence: Synthetic oligonucleotide
aaaaatgctgctgtaatggaccaggagcctgc

SEQ ID NO: 163848 - DNA, 31 bp, Artificial Sequence
  Description of Artificial Sequence: Synthetic oligonucleotide
aaaatgctgctgtaatggaccaggagcctgc

SEQ ID NO: 163849 - DNA, 30 bp, Artificial Sequence
  Description of Artificial Sequence: Synthetic oligonucleotide
aaatgctgctgtaatggaccaggagcctgc

SEQ ID NO: 163850 - DNA, 29 bp, Artificial Sequence
  Description of Artificial Sequence: Synthetic oligonucleotide
aatgctgctgtaatggaccaggagcctgc

SEQ ID NO: 163851 - DNA, 28 bp, Artificial Sequence
  Description of Artificial Sequence: Synthetic oligonucleotide
atgctgctgtaatggaccaggagcctgc

SEQ ID NO: 163852 - DNA, 27 bp, Artificial Sequence
  Description of Artificial Sequence: Synthetic oligonucleotide
tgctgctgtaatggaccaggagcctgc

SEQ ID NO: 163853 - DNA, 27 bp, Artificial Sequence
  Description of Artificial Sequence: Synthetic oligonucleotide
gctgctgtaatggaccaggagcctgca

SEQ ID NO: 163854 - DNA, 27 bp, Artificial Sequence
  Description of Artificial Sequence: Synthetic oligonucleotide
ctgctgtaatggaccaggagcctgcag

SEQ ID NO: 163855 - DNA, 27 bp, Artificial Sequence
  Description of Artificial Sequence: Synthetic oligonucleotide
tgctgtaatggaccaggagcctgcagg

SEQ ID NO: 163856 - DNA, 26 bp, Artificial Sequence
  Description of Artificial Sequence: Synthetic oligonucleotide
gctgtaatggaccaggagcctgcagg

SEQ ID NO: 163857 - DNA, 27 bp, Artificial Sequence
  Description of Artificial Sequence: Synthetic oligonucleotide
ctgtaatggaccaggagcctgcaggga

SEQ ID NO: 163858 - DNA, 28 bp, Artificial Sequence
  Description of Artificial Sequence: Synthetic oligonucleotide
tgtaatggaccaggagcctgcagggaac

SEQ ID NO: 163859 - DNA, 27 bp, Artificial Sequence
  Description of Artificial Sequence: Synthetic oligonucleotide
gtaatggaccaggagcctgcagggaac

SEQ ID NO: 163860 - DNA, 28 bp, Artificial Sequence
  Description of Artificial Sequence: Synthetic oligonucleotide
taatggaccaggagcctgcagggaacag

SEQ ID NO: 163861 - DNA, 27 bp, Artificial Sequence
  Description of Artificial Sequence: Synthetic oligonucleotide
aatggaccaggagcctgcagggaacag

SEQ ID NO: 163862 - DNA, 27 bp, Artificial Sequence
  Description of Artificial Sequence: Synthetic oligonucleotide
atggaccaggagcctgcagggaacaga

SEQ ID NO: 163863 - DNA, 27 bp, Artificial Sequence
  Description of Artificial Sequence: Synthetic oligonucleotide
tggaccaggagcctgcagggaacagaa

SEQ ID NO: 163864 - DNA, 26 bp, Artificial Sequence
  Description of Artificial Sequence: Synthetic oligonucleotide
ggaccaggagcctgcagggaacagaa

SEQ ID NO: 163865 - DNA, 27 bp, Artificial Sequence
  Description of Artificial Sequence: Synthetic oligonucleotide
gaccaggagcctgcagggaacagaaca

SEQ ID NO: 163866 - DNA, 27 bp, Artificial Sequence
  Description of Artificial Sequence: Synthetic oligonucleotide
accaggagcctgcagggaacagaacag

SEQ ID NO: 163867 - DNA, 26 bp, Artificial Sequence
  Description of Artificial Sequence: Synthetic oligonucleotide
ccaggagcctgcagggaacagaacag

SEQ ID NO: 163868 - DNA, 26 bp, Artificial Sequence
  Description of Artificial Sequence: Synthetic oligonucleotide
caggagcctgcagggaacagaacagc

SEQ ID NO: 163869 - DNA, 27 bp, Artificial Sequence
  Description of Artificial Sequence: Synthetic oligonucleotide
aggagcctgcagggaacagaacagcca

SEQ ID NO: 163870 - DNA, 27 bp, Artificial Sequence
  Description of Artificial Sequence: Synthetic oligonucleotide
ggagcctgcagggaacagaacagccaa

SEQ ID NO: 163871 - DNA, 29 bp, Artificial Sequence
  Description of Artificial Sequence: Synthetic oligonucleotide
atgttgctcatggtcgtcagcatggcgtg

SEQ ID NO: 163872 - DNA, 28 bp, Artificial Sequence
  Description of Artificial Sequence: Synthetic oligonucleotide
tgttgctcatggtcgtcagcatggcgtg

SEQ ID NO: 163873 - DNA, 27 bp, Artificial Sequence
  Description of Artificial Sequence: Synthetic oligonucleotide
gttgctcatggtcgtcagcatggcgtg

SEQ ID NO: 163874 - DNA, 28 bp, Artificial Sequence
  Description of Artificial Sequence: Synthetic oligonucleotide
ttgctcatggtcgtcagcatggcgtgtg

SEQ ID NO: 163875 - DNA, 27 bp, Artificial Sequence
  Description of Artificial Sequence: Synthetic oligonucleotide
tgctcatggtcgtcagcatggcgtgtg

SEQ ID NO: 163876 - DNA, 30 bp, Artificial Sequence
  Description of Artificial Sequence: Synthetic oligonucleotide
tcagcatggcgtgtgttgggttcttcttgg

SEQ ID NO: 163877 - DNA, 29 bp, Artificial Sequence
  Description of Artificial Sequence: Synthetic oligonucleotide
cagcatggcgtgtgttgggttcttcttgg

SEQ ID NO: 163878 - DNA, 30 bp, Artificial Sequence
  Description of Artificial Sequence: Synthetic oligonucleotide
agcatggcgtgtgttgggttcttcttggtc

SEQ ID NO: 163879 - DNA, 29 bp, Artificial Sequence
  Description of Artificial Sequence: Synthetic oligonucleotide
gcatggcgtgtgttgggttcttcttggtc

SEQ ID NO: 163880 - DNA, 29 bp, Artificial Sequence
  Description of Artificial Sequence: Synthetic oligonucleotide
catggcgtgtgttgggttcttcttggtcc

SEQ ID NO: 163881 - DNA, 30 bp, Artificial Sequence
  Description of Artificial Sequence: Synthetic oligonucleotide
atggcgtgtgttgggttcttcttggtccag

SEQ ID NO: 163882 - DNA, 29 bp, Artificial Sequence
  Description of Artificial Sequence: Synthetic oligonucleotide
tggcgtgtgttgggttcttcttggtccag

SEQ ID NO: 163883 - DNA, 28 bp, Artificial Sequence
  Description of Artificial Sequence: Synthetic oligonucleotide
ggcgtgtgttgggttcttcttggtccag

SEQ ID NO: 163884 - DNA, 29 bp, Artificial Sequence
  Description of Artificial Sequence: Synthetic oligonucleotide
gcgtgtgttgggttcttcttggtccagag

SEQ ID NO: 163885 - DNA, 29 bp, Artificial Sequence
  Description of Artificial Sequence: Synthetic oligonucleotide
cgtgtgttgggttcttcttggtccagagg

SEQ ID NO: 163886 - DNA, 29 bp, Artificial Sequence
  Description of Artificial Sequence: Synthetic oligonucleotide
gtgtgttgggttcttcttggtccagaggg

SEQ ID NO: 163887 - DNA, 29 bp, Artificial Sequence
  Description of Artificial Sequence: Synthetic oligonucleotide
tgtgttgggttcttcttggtccagagggc

SEQ ID NO: 163888 - DNA, 28 bp, Artificial Sequence
  Description of Artificial Sequence: Synthetic oligonucleotide
gtgttgggttcttcttggtccagagggc

SEQ ID NO: 163889 - DNA, 28 bp, Artificial Sequence
  Description of Artificial Sequence: Synthetic oligonucleotide
tgttgggttcttcttggtccagagggcc

SEQ ID NO: 163890 - DNA, 27 bp, Artificial Sequence
  Description of Artificial Sequence: Synthetic oligonucleotide
gttgggttcttcttggtccagagggcc

SEQ ID NO: 163891 - DNA, 27 bp, Artificial Sequence
  Description of Artificial Sequence: Synthetic oligonucleotide
ttgggttcttcttggtccagagggccg

SEQ ID NO: 163892 - DNA, 26 bp, Artificial Sequence
  Description of Artificial Sequence: Synthetic oligonucleotide
tgggttcttcttggtccagagggccg

SEQ ID NO: 163893 - DNA, 25 bp, Artificial Sequence
  Description of Artificial Sequence: Synthetic oligonucleotide
gggttcttcttggtccagagggccg

SEQ ID NO: 163894 - DNA, 26 bp, Artificial Sequence
  Description of Artificial Sequence: Synthetic oligonucleotide
ggttcttcttggtccagagggccggt

SEQ ID NO: 163895 - DNA, 26 bp, Artificial Sequence
  Description of Artificial Sequence: Synthetic oligonucleotide
gttcttcttggtccagagggccggtc

SEQ ID NO: 163896 - DNA, 27 bp, Artificial Sequence
  Description of Artificial Sequence: Synthetic oligonucleotide
ttcttcttggtccagagggccggtcca

SEQ ID NO: 163897 - DNA, 26 bp, Artificial Sequence
  Description of Artificial Sequence: Synthetic oligonucleotide
tcttcttggtccagagggccggtcca

SEQ ID NO: 163898 - DNA, 25 bp, Artificial Sequence
  Description of Artificial Sequence: Synthetic oligonucleotide
cttcttggtccagagggccggtcca

SEQ ID NO: 163899 - DNA, 24 bp, Artificial Sequence
  Description of Artificial Sequence: Synthetic oligonucleotide
ttggtccagagggccggtccacac

SEQ ID NO: 163900 - DNA, 23 bp, Artificial Sequence
  Description of Artificial Sequence: Synthetic oligonucleotide
tggtccagagggccggtccacac

SEQ ID NO: 163901 - DNA, 22 bp, Artificial Sequence
  Description of Artificial Sequence: Synthetic oligonucleotide
ggtccagagggccggtccacac

SEQ ID NO: 163902 - DNA, 23 bp, Artificial Sequence
  Description of Artificial Sequence: Synthetic oligonucleotide
gtccagagggccggtccacacgt

SEQ ID NO: 163903 - DNA, 23 bp, Artificial Sequence
  Description of Artificial Sequence: Synthetic oligonucleotide
tccagagggccggtccacacgtg

SEQ ID NO: 163904 - DNA, 22 bp, Artificial Sequence
  Description of Artificial Sequence: Synthetic oligonucleotide
ccagagggccggtccacacgtg

SEQ ID NO: 163905 - DNA, 22 bp, Artificial Sequence
  Description of Artificial Sequence: Synthetic oligonucleotide
cagagggccggtccacacgtgg

SEQ ID NO: 163906 - DNA, 23 bp, Artificial Sequence
  Description of Artificial Sequence: Synthetic oligonucleotide
agagggccggtccacacgtgggt

SEQ ID NO: 163907 - DNA, 22 bp, Artificial Sequence
  Description of Artificial Sequence: Synthetic oligonucleotide
gagggccggtccacacgtgggt

SEQ ID NO: 163908 - DNA, 22 bp, Artificial Sequence
  Description of Artificial Sequence: Synthetic oligonucleotide
agggccggtccacacgtgggtg

SEQ ID NO: 163909 - DNA, 21 bp, Artificial Sequence
  Description of Artificial Sequence: Synthetic oligonucleotide
gggccggtccacacgtgggtg

SEQ ID NO: 163910 - DNA, 22 bp, Artificial Sequence
  Description of Artificial Sequence: Synthetic oligonucleotide
ggccggtccacacgtgggtggt

SEQ ID NO: 163911 - DNA, 23 bp, Artificial Sequence
  Description of Artificial Sequence: Synthetic oligonucleotide
gccggtccacacgtgggtggtca

SEQ ID NO: 163912 - DNA, 23 bp, Artificial Sequence
  Description of Artificial Sequence: Synthetic oligonucleotide
ccggtccacacgtgggtggtcag

SEQ ID NO: 163913 - DNA, 24 bp, Artificial Sequence
  Description of Artificial Sequence: Synthetic oligonucleotide
cggtccacacgtgggtggtcagga

SEQ ID NO: 163914 - DNA, 26 bp, Artificial Sequence
  Description of Artificial Sequence: Synthetic oligonucleotide
ggtccacacgtgggtggtcaggacaa

SEQ ID NO: 163915 - DNA, 26 bp, Artificial Sequence
  Description of Artificial Sequence: Synthetic oligonucleotide
gtccacacgtgggtggtcaggacaag

SEQ ID NO: 163916 - DNA, 26 bp, Artificial Sequence
  Description of Artificial Sequence: Synthetic oligonucleotide
tccacacgtgggtggtcaggacaagc

SEQ ID NO: 163917 - DNA, 25 bp, Artificial Sequence
  Description of Artificial Sequence: Synthetic oligonucleotide
ccacacgtgggtggtcaggacaagc

SEQ ID NO: 163918 - DNA, 26 bp, Artificial Sequence
  Description of Artificial Sequence: Synthetic oligonucleotide
acgtgggtggtcaggacaagcccttc

SEQ ID NO: 163919 - DNA, 25 bp, Artificial Sequence
  Description of Artificial Sequence: Synthetic oligonucleotide
cgtgggtggtcaggacaagcccttc

SEQ ID NO: 163920 - DNA, 26 bp, Artificial Sequence
  Description of Artificial Sequence: Synthetic oligonucleotide
gtgggtggtcaggacaagcccttcct

SEQ ID NO: 163921 - DNA, 27 bp, Artificial Sequence
  Description of Artificial Sequence: Synthetic oligonucleotide
tgggtggtcaggacaagcccttcctgt

SEQ ID NO: 163922 - DNA, 26 bp, Artificial Sequence
  Description of Artificial Sequence: Synthetic oligonucleotide
gggtggtcaggacaagcccttcctgt

SEQ ID NO: 163923 - DNA, 27 bp, Artificial Sequence
  Description of Artificial Sequence: Synthetic oligonucleotide
ggtggtcaggacaagcccttcctgtct

SEQ ID NO: 163924 - DNA, 27 bp, Artificial Sequence
  Description of Artificial Sequence: Synthetic oligonucleotide
gtggtcaggacaagcccttcctgtctg

SEQ ID NO: 163925 - DNA, 27 bp, Artificial Sequence
  Description of Artificial Sequence: Synthetic oligonucleotide
tggtcaggacaagcccttcctgtctgc

SEQ ID NO: 163926 - DNA, 26 bp, Artificial Sequence
  Description of Artificial Sequence: Synthetic oligonucleotide
ggtcaggacaagcccttcctgtctgc

SEQ ID NO: 163927 - DNA, 27 bp, Artificial Sequence
  Description of Artificial Sequence: Synthetic oligonucleotide
gtcaggacaagcccttcctgtctgcct

SEQ ID NO: 163928 - DNA, 27 bp, Artificial Sequence
  Description of Artificial Sequence: Synthetic oligonucleotide
tcaggacaagcccttcctgtctgcctg

SEQ ID NO: 163929 - DNA, 26 bp, Artificial Sequence
  Description of Artificial Sequence: Synthetic oligonucleotide
caggacaagcccttcctgtctgcctg

SEQ ID NO: 163930 - DNA, 26 bp, Artificial Sequence
  Description of Artificial Sequence: Synthetic oligonucleotide
aggacaagcccttcctgtctgcctgg

SEQ ID NO: 163931 - DNA, 25 bp, Artificial Sequence
  Description of Artificial Sequence: Synthetic oligonucleotide
ggacaagcccttcctgtctgcctgg

SEQ ID NO: 163932 - DNA, 25 bp, Artificial Sequence
  Description of Artificial Sequence: Synthetic oligonucleotide
gacaagcccttcctgtctgcctggc

SEQ ID NO: 163933 - DNA, 25 bp, Artificial Sequence
  Description of Artificial Sequence: Synthetic oligonucleotide
acaagcccttcctgtctgcctggcc

SEQ ID NO: 163934 - DNA, 24 bp, Artificial Sequence
  Description of Artificial Sequence: Synthetic oligonucleotide
caagcccttcctgtctgcctggcc

SEQ ID NO: 163935 - DNA, 25 bp, Artificial Sequence
  Description of Artificial Sequence: Synthetic oligonucleotide
aagcccttcctgtctgcctggccca

SEQ ID NO: 163936 - DNA, 24 bp, Artificial Sequence
  Description of Artificial Sequence: Synthetic oligonucleotide
agcccttcctgtctgcctggccca

SEQ ID NO: 163937 - DNA, 23 bp, Artificial Sequence
  Description of Artificial Sequence: Synthetic oligonucleotide
gcccttcctgtctgcctggccca

SEQ ID NO: 163938 - DNA, 47 bp, Artificial Sequence
  Description of Artificial Sequence: Synthetic oligonucleotide
tcataggtttaacaatttcatgctatacaaagaagacagaatccacg

SEQ ID NO: 163939 - DNA, 46 bp, Artificial Sequence
  Description of Artificial Sequence: Synthetic oligonucleotide
cataggtttaacaatttcatgctatacaaagaagacagaatccacg

SEQ ID NO: 163940 - DNA, 48 bp, Artificial Sequence
  Description of Artificial Sequence: Synthetic oligonucleotide
ataggtttaacaatttcatgctatacaaagaagacagaatccacgttc

SEQ ID NO: 163941 - DNA, 47 bp, Artificial Sequence
  Description of Artificial Sequence: Synthetic oligonucleotide
taggtttaacaatttcatgctatacaaagaagacagaatccacgttc

SEQ ID NO: 163942 - DNA, 46 bp, Artificial Sequence
  Description of Artificial Sequence: Synthetic oligonucleotide
aggtttaacaatttcatgctatacaaagaagacagaatccacgttc

SEQ ID NO: 163943 - DNA, 45 bp, Artificial Sequence
  Description of Artificial Sequence: Synthetic oligonucleotide
ggtttaacaatttcatgctatacaaagaagacagaatccacgttc

SEQ ID NO: 163944 - DNA, 45 bp, Artificial Sequence
  Description of Artificial Sequence: Synthetic oligonucleotide
gtttaacaatttcatgctatacaaagaagacagaatccacgttcc

SEQ ID NO: 163945 - DNA, 45 bp, Artificial Sequence
  Description of Artificial Sequence: Synthetic oligonucleotide
tttaacaatttcatgctatacaaagaagacagaatccacgttccc

SEQ ID NO: 163946 - DNA, 44 bp, Artificial Sequence
  Description of Artificial Sequence: Synthetic oligonucleotide
ttaacaatttcatgctatacaaagaagacagaatccacgttccc

SEQ ID NO: 163947 - DNA, 43 bp, Artificial Sequence
  Description of Artificial Sequence: Synthetic oligonucleotide
taacaatttcatgctatacaaagaagacagaatccacgttccc

SEQ ID NO: 163948 - DNA, 42 bp, Artificial Sequence
  Description of Artificial Sequence: Synthetic oligonucleotide
aacaatttcatgctatacaaagaagacagaatccacgttccc

SEQ ID NO: 163949 - DNA, 41 bp, Artificial Sequence
  Description of Artificial Sequence: Synthetic oligonucleotide
acaatttcatgctatacaaagaagacagaatccacgttccc

SEQ ID NO: 163950 - DNA, 40 bp, Artificial Sequence
  Description of Artificial Sequence: Synthetic oligonucleotide
caatttcatgctatacaaagaagacagaatccacgttccc

SEQ ID NO: 163951 - DNA, 42 bp, Artificial Sequence
  Description of Artificial Sequence: Synthetic oligonucleotide
aatttcatgctatacaaagaagacagaatccacgttcccatc

SEQ ID NO: 163952 - DNA, 41 bp, Artificial Sequence
  Description of Artificial Sequence: Synthetic oligonucleotide
atttcatgctatacaaagaagacagaatccacgttcccatc

SEQ ID NO: 163953 - DNA, 40 bp, Artificial Sequence
  Description of Artificial Sequence: Synthetic oligonucleotide
tttcatgctatacaaagaagacagaatccacgttcccatc

SEQ ID NO: 163954 - DNA, 39 bp, Artificial Sequence
  Description of Artificial Sequence: Synthetic oligonucleotide
ttcatgctatacaaagaagacagaatccacgttcccatc

SEQ ID NO: 163955 - DNA, 38 bp, Artificial Sequence
  Description of Artificial Sequence: Synthetic oligonucleotide
tcatgctatacaaagaagacagaatccacgttcccatc

SEQ ID NO: 163956 - DNA, 37 bp, Artificial Sequence
  Description of Artificial Sequence: Synthetic oligonucleotide
catgctatacaaagaagacagaatccacgttcccatc

SEQ ID NO: 163957 - DNA, 39 bp, Artificial Sequence
  Description of Artificial Sequence: Synthetic oligonucleotide
atgctatacaaagaagacagaatccacgttcccatcttc

SEQ ID NO: 163958 - DNA, 38 bp, Artificial Sequence
  Description of Artificial Sequence: Synthetic oligonucleotide
tgctatacaaagaagacagaatccacgttcccatcttc

SEQ ID NO: 163959 - DNA, 37 bp, Artificial Sequence
  Description of Artificial Sequence: Synthetic oligonucleotide
gctatacaaagaagacagaatccacgttcccatcttc

SEQ ID NO: 163960 - DNA, 37 bp, Artificial Sequence
  Description of Artificial Sequence: Synthetic oligonucleotide
ctatacaaagaagacagaatccacgttcccatcttcc

SEQ ID NO: 163961 - DNA, 39 bp, Artificial Sequence
  Description of Artificial Sequence: Synthetic oligonucleotide
tatacaaagaagacagaatccacgttcccatcttccatg

SEQ ID NO: 163962 - DNA, 38 bp, Artificial Sequence
  Description of Artificial Sequence: Synthetic oligonucleotide
atacaaagaagacagaatccacgttcccatcttccatg

SEQ ID NO: 163963 - DNA, 37 bp, Artificial Sequence
  Description of Artificial Sequence: Synthetic oligonucleotide
tacaaagaagacagaatccacgttcccatcttccatg

SEQ ID NO: 163964 - DNA, 36 bp, Artificial Sequence
  Description of Artificial Sequence: Synthetic oligonucleotide
acaaagaagacagaatccacgttcccatcttccatg

SEQ ID NO: 163965 - DNA, 35 bp, Artificial Sequence
  Description of Artificial Sequence: Synthetic oligonucleotide
caaagaagacagaatccacgttcccatcttccatg

SEQ ID NO: 163966 - DNA, 35 bp, Artificial Sequence
  Description of Artificial Sequence: Synthetic oligonucleotide
aaagaagacagaatccacgttcccatcttccatgg

SEQ ID NO: 163967 - DNA, 34 bp, Artificial Sequence
  Description of Artificial Sequence: Synthetic oligonucleotide
aagaagacagaatccacgttcccatcttccatgg

SEQ ID NO: 163968 - DNA, 33 bp, Artificial Sequence
  Description of Artificial Sequence: Synthetic oligonucleotide
agaagacagaatccacgttcccatcttccatgg

SEQ ID NO: 163969 - DNA, 32 bp, Artificial Sequence
  Description of Artificial Sequence: Synthetic oligonucleotide
gaagacagaatccacgttcccatcttccatgg

SEQ ID NO: 163970 - DNA, 32 bp, Artificial Sequence
  Description of Artificial Sequence: Synthetic oligonucleotide
aagacagaatccacgttcccatcttccatggc

SEQ ID NO: 163971 - DNA, 31 bp, Artificial Sequence
  Description of Artificial Sequence: Synthetic oligonucleotide
agacagaatccacgttcccatcttccatggc

SEQ ID NO: 163972 - DNA, 30 bp, Artificial Sequence
  Description of Artificial Sequence: Synthetic oligonucleotide
gacagaatccacgttcccatcttccatggc

SEQ ID NO: 163973 - DNA, 31 bp, Artificial Sequence
  Description of Artificial Sequence: Synthetic oligonucleotide
acagaatccacgttcccatcttccatggcag

SEQ ID NO: 163974 - DNA, 30 bp, Artificial Sequence
  Description of Artificial Sequence: Synthetic oligonucleotide
cagaatccacgttcccatcttccatggcag

SEQ ID NO: 163975 - DNA, 36 bp, Artificial Sequence
  Description of Artificial Sequence: Synthetic oligonucleotide
agaatccacgttcccatcttccatggcagattattc

SEQ ID NO: 163976 - DNA, 35 bp, Artificial Sequence
  Description of Artificial Sequence: Synthetic oligonucleotide
gaatccacgttcccatcttccatggcagattattc

SEQ ID NO: 163977 - DNA, 35 bp, Artificial Sequence
  Description of Artificial Sequence: Synthetic oligonucleotide
aatccacgttcccatcttccatggcagattattcc

SEQ ID NO: 163978 - DNA, 34 bp, Artificial Sequence
  Description of Artificial Sequence: Synthetic oligonucleotide
atccacgttcccatcttccatggcagattattcc

SEQ ID NO: 163979 - DNA, 33 bp, Artificial Sequence
  Description of Artificial Sequence: Synthetic oligonucleotide
tccacgttcccatcttccatggcagattattcc

SEQ ID NO: 163980 - DNA, 32 bp, Artificial Sequence
  Description of Artificial Sequence: Synthetic oligonucleotide
ccacgttcccatcttccatggcagattattcc

SEQ ID NO: 163981 - DNA, 33 bp, Artificial Sequence
  Description of Artificial Sequence: Synthetic oligonucleotide
cacgttcccatcttccatggcagattattccag

SEQ ID NO: 163982 - DNA, 33 bp, Artificial Sequence
  Description of Artificial Sequence: Synthetic oligonucleotide
acgttcccatcttccatggcagattattccagg

SEQ ID NO: 163983 - DNA, 32 bp, Artificial Sequence
  Description of Artificial Sequence: Synthetic oligonucleotide
cgttcccatcttccatggcagattattccagg

SEQ ID NO: 163984 - DNA, 33 bp, Artificial Sequence
  Description of Artificial Sequence: Synthetic oligonucleotide
gttcccatcttccatggcagattattccaggag

SEQ ID NO: 163985 - DNA, 34 bp, Artificial Sequence
  Description of Artificial Sequence: Synthetic oligonucleotide
ttcccatcttccatggcagattattccaggagag

SEQ ID NO: 163986 - DNA, 33 bp, Artificial Sequence
  Description of Artificial Sequence: Synthetic oligonucleotide
tcccatcttccatggcagattattccaggagag

SEQ ID NO: 163987 - DNA, 32 bp, Artificial Sequence
  Description of Artificial Sequence: Synthetic oligonucleotide
cccatcttccatggcagattattccaggagag

SEQ ID NO: 163988 - DNA, 32 bp, Artificial Sequence
  Description of Artificial Sequence: Synthetic oligonucleotide
ccatcttccatggcagattattccaggagagc

SEQ ID NO: 163989 - DNA, 34 bp, Artificial Sequence
  Description of Artificial Sequence: Synthetic oligonucleotide
catcttccatggcagattattccaggagagcttc

SEQ ID NO: 163990 - DNA, 36 bp, Artificial Sequence
  Description of Artificial Sequence: Synthetic oligonucleotide
atcttccatggcagattattccaggagagcttcaac

SEQ ID NO: 163991 - DNA, 35 bp, Artificial Sequence
  Description of Artificial Sequence: Synthetic oligonucleotide
tcttccatggcagattattccaggagagcttcaac

SEQ ID NO: 163992 - DNA, 34 bp, Artificial Sequence
  Description of Artificial Sequence: Synthetic oligonucleotide
cttccatggcagattattccaggagagcttcaac

SEQ ID NO: 163993 - DNA, 36 bp, Artificial Sequence
  Description of Artificial Sequence: Synthetic oligonucleotide
ttccatggcagattattccaggagagcttcaacatg

SEQ ID NO: 163994 - DNA, 35 bp, Artificial Sequence
  Description of Artificial Sequence: Synthetic oligonucleotide
tccatggcagattattccaggagagcttcaacatg

SEQ ID NO: 163995 - DNA, 34 bp, Artificial Sequence
  Description of Artificial Sequence: Synthetic oligonucleotide
ccatggcagattattccaggagagcttcaacatg

SEQ ID NO: 163996 - DNA, 35 bp, Artificial Sequence
  Description of Artificial Sequence: Synthetic oligonucleotide
catggcagattattccaggagagcttcaacatgag

SEQ ID NO: 163997 - DNA, 35 bp, Artificial Sequence
  Description of Artificial Sequence: Synthetic oligonucleotide
atggcagattattccaggagagcttcaacatgagc

SEQ ID NO: 163998 - DNA, 34 bp, Artificial Sequence
  Description of Artificial Sequence: Synthetic oligonucleotide
tggcagattattccaggagagcttcaacatgagc

SEQ ID NO: 163999 - DNA, 33 bp, Artificial Sequence
  Description of Artificial Sequence: Synthetic oligonucleotide
ggcagattattccaggagagcttcaacatgagc

SEQ ID NO: 164000 - DNA, 33 bp, Artificial Sequence
  Description of Artificial Sequence: Synthetic oligonucleotide
gcagattattccaggagagcttcaacatgagcc

SEQ ID NO: 164001 - DNA, 33 bp, Artificial Sequence
  Description of Artificial Sequence: Synthetic oligonucleotide
cagattattccaggagagcttcaacatgagccc

SEQ ID NO: 164002 - DNA, 34 bp, Artificial Sequence
  Description of Artificial Sequence: Synthetic oligonucleotide
agattattccaggagagcttcaacatgagccctg

SEQ ID NO: 164003 - DNA, 33 bp, Artificial Sequence
  Description of Artificial Sequence: Synthetic oligonucleotide
gattattccaggagagcttcaacatgagccctg

SEQ ID NO: 164004 - DNA, 34 bp, Artificial Sequence
  Description of Artificial Sequence: Synthetic oligonucleotide
attattccaggagagcttcaacatgagccctgtg

SEQ ID NO: 164005 - DNA, 33 bp, Artificial Sequence
  Description of Artificial Sequence: Synthetic oligonucleotide
ttattccaggagagcttcaacatgagccctgtg

SEQ ID NO: 164006 - DNA, 32 bp, Artificial Sequence
  Description of Artificial Sequence: Synthetic oligonucleotide
ctcctatgacatgtaccatctatccagggagc

SEQ ID NO: 164007 - DNA, 32 bp, Artificial Sequence
  Description of Artificial Sequence: Synthetic oligonucleotide
tcctatgacatgtaccatctatccagggagcg

SEQ ID NO: 164008 - DNA, 31 bp, Artificial Sequence
  Description of Artificial Sequence: Synthetic oligonucleotide
cctatgacatgtaccatctatccagggagcg

SEQ ID NO: 164009 - DNA, 31 bp, Artificial Sequence
  Description of Artificial Sequence: Synthetic oligonucleotide
ctatgacatgtaccatctatccagggagcgg

SEQ ID NO: 164010 - DNA, 31 bp, Artificial Sequence
  Description of Artificial Sequence: Synthetic oligonucleotide
tatgacatgtaccatctatccagggagcggg

SEQ ID NO: 164011 - DNA, 30 bp, Artificial Sequence
  Description of Artificial Sequence: Synthetic oligonucleotide
atgacatgtaccatctatccagggagcggg

SEQ ID NO: 164012 - DNA, 29 bp, Artificial Sequence
  Description of Artificial Sequence: Synthetic oligonucleotide
tgacatgtaccatctatccagggagcggg

SEQ ID NO: 164013 - DNA, 28 bp, Artificial Sequence
  Description of Artificial Sequence: Synthetic oligonucleotide
gacatgtaccatctatccagggagcggg

SEQ ID NO: 164014 - DNA, 28 bp, Artificial Sequence
  Description of Artificial Sequence: Synthetic oligonucleotide
acatgtaccatctatccagggagcgggg

SEQ ID NO: 164015 - DNA, 27 bp, Artificial Sequence
  Description of Artificial Sequence: Synthetic oligonucleotide
catgtaccatctatccagggagcgggg

SEQ ID NO: 164016 - DNA, 28 bp, Artificial Sequence
  Description of Artificial Sequence: Synthetic oligonucleotide
atgtaccatctatccagggagcggggag

SEQ ID NO: 164017 - DNA, 27 bp, Artificial Sequence
  Description of Artificial Sequence: Synthetic oligonucleotide
tgtaccatctatccagggagcggggag

SEQ ID NO: 164018 - DNA, 26 bp, Artificial Sequence
  Description of Artificial Sequence: Synthetic oligonucleotide
gtaccatctatccagggagcggggag

SEQ ID NO: 164019 - DNA, 26 bp, Artificial Sequence
  Description of Artificial Sequence: Synthetic oligonucleotide
taccatctatccagggagcggggagc

SEQ ID NO: 164020 - DNA, 25 bp, Artificial Sequence
  Description of Artificial Sequence: Synthetic oligonucleotide
accatctatccagggagcggggagc

SEQ ID NO: 164021 - DNA, 24 bp, Artificial Sequence
  Description of Artificial Sequence: Synthetic oligonucleotide
ccatctatccagggagcggggagc

SEQ ID NO: 164022 - DNA, 24 bp, Artificial Sequence
  Description of Artificial Sequence: Synthetic oligonucleotide
catctatccagggagcggggagcc

SEQ ID NO: 164023 - DNA, 26 bp, Artificial Sequence
  Description of Artificial Sequence: Synthetic oligonucleotide
atctatccagggagcggggagcccat

SEQ ID NO: 164024 - DNA, 25 bp, Artificial Sequence
  Description of Artificial Sequence: Synthetic oligonucleotide
tctatccagggagcggggagcccat

SEQ ID NO: 164025 - DNA, 24 bp, Artificial Sequence
  Description of Artificial Sequence: Synthetic oligonucleotide
ctatccagggagcggggagcccat

SEQ ID NO: 164026 - DNA, 26 bp, Artificial Sequence
  Description of Artificial Sequence: Synthetic oligonucleotide
tatccagggagcggggagcccatgaa

SEQ ID NO: 164027 - DNA, 25 bp, Artificial Sequence
  Description of Artificial Sequence: Synthetic oligonucleotide
atccagggagcggggagcccatgaa

SEQ ID NO: 164028 - DNA, 24 bp, Artificial Sequence
  Description of Artificial Sequence: Synthetic oligonucleotide
tccagggagcggggagcccatgaa

SEQ ID NO: 164029 - DNA, 23 bp, Artificial Sequence
  Description of Artificial Sequence: Synthetic oligonucleotide
ccagggagcggggagcccatgaa

SEQ ID NO: 164030 - DNA, 23 bp, Artificial Sequence
  Description of Artificial Sequence: Synthetic oligonucleotide
cagggagcggggagcccatgaac

SEQ ID NO: 164031 - DNA, 25 bp, Artificial Sequence
  Description of Artificial Sequence: Synthetic oligonucleotide
agggagcggggagcccatgaacgta

SEQ ID NO: 164032 - DNA, 24 bp, Artificial Sequence
  Description of Artificial Sequence: Synthetic oligonucleotide
gggagcggggagcccatgaacgta

SEQ ID NO: 164033 - DNA, 24 bp, Artificial Sequence
  Description of Artificial Sequence: Synthetic oligonucleotide
ggagcggggagcccatgaacgtag

SEQ ID NO: 164034 - DNA, 24 bp, Artificial Sequence
  Description of Artificial Sequence: Synthetic oligonucleotide
gagcggggagcccatgaacgtagg

SEQ ID NO: 164035 - DNA, 25 bp, Artificial Sequence
  Description of Artificial Sequence: Synthetic oligonucleotide
agcggggagcccatgaacgtaggct

SEQ ID NO: 164036 - DNA, 24 bp, Artificial Sequence
  Description of Artificial Sequence: Synthetic oligonucleotide
gcggggagcccatgaacgtaggct

SEQ ID NO: 164037 - DNA, 24 bp, Artificial Sequence
  Description of Artificial Sequence: Synthetic oligonucleotide
cggggagcccatgaacgtaggctc

SEQ ID NO: 164038 - DNA, 32 bp, Artificial Sequence
  Description of Artificial Sequence: Synthetic oligonucleotide
aggacacgtgactcttcggtgtcactatcatc

SEQ ID NO: 164039 - DNA, 31 bp, Artificial Sequence
  Description of Artificial Sequence: Synthetic oligonucleotide
ggacacgtgactcttcggtgtcactatcatc

SEQ ID NO: 164040 - DNA, 34 bp, Artificial Sequence
  Description of Artificial Sequence: Synthetic oligonucleotide
gacacgtgactcttcggtgtcactatcatcatag

SEQ ID NO: 164041 - DNA, 34 bp, Artificial Sequence
  Description of Artificial Sequence: Synthetic oligonucleotide
acacgtgactcttcggtgtcactatcatcatagg

SEQ ID NO: 164042 - DNA, 33 bp, Artificial Sequence
  Description of Artificial Sequence: Synthetic oligonucleotide
cacgtgactcttcggtgtcactatcatcatagg

SEQ ID NO: 164043 - DNA, 38 bp, Artificial Sequence
  Description of Artificial Sequence: Synthetic oligonucleotide
acgtgactcttcggtgtcactatcatcataggtttaac

SEQ ID NO: 164044 - DNA, 37 bp, Artificial Sequence
  Description of Artificial Sequence: Synthetic oligonucleotide
cgtgactcttcggtgtcactatcatcataggtttaac

SEQ ID NO: 164045 - DNA, 42 bp, Artificial Sequence
  Description of Artificial Sequence: Synthetic oligonucleotide
gtgactcttcggtgtcactatcatcataggtttaacaatttc

SEQ ID NO: 164046 - DNA, 44 bp, Artificial Sequence
  Description of Artificial Sequence: Synthetic oligonucleotide
tgactcttcggtgtcactatcatcataggtttaacaatttcatg

SEQ ID NO: 164047 - DNA, 43 bp, Artificial Sequence
  Description of Artificial Sequence: Synthetic oligonucleotide
gactcttcggtgtcactatcatcataggtttaacaatttcatg

SEQ ID NO: 164048 - DNA, 43 bp, Artificial Sequence
  Description of Artificial Sequence: Synthetic oligonucleotide
actcttcggtgtcactatcatcataggtttaacaatttcatgc

SEQ ID NO: 164049 - DNA, 42 bp, Artificial Sequence
  Description of Artificial Sequence: Synthetic oligonucleotide
ctcttcggtgtcactatcatcataggtttaacaatttcatgc

SEQ ID NO: 164050 - DNA, 46 bp, Artificial Sequence
  Description of Artificial Sequence: Synthetic oligonucleotide
tcttcggtgtcactatcatcataggtttaacaatttcatgctatac

SEQ ID NO: 164051 - DNA, 45 bp, Artificial Sequence
  Description of Artificial Sequence: Synthetic oligonucleotide
cttcggtgtcactatcatcataggtttaacaatttcatgctatac

SEQ ID NO: 164052 - DNA, 48 bp, Artificial Sequence
  Description of Artificial Sequence: Synthetic oligonucleotide
ttcggtgtcactatcatcataggtttaacaatttcatgctatacaaag

SEQ ID NO: 164053 - DNA, 47 bp, Artificial Sequence
  Description of Artificial Sequence: Synthetic oligonucleotide
tcggtgtcactatcatcataggtttaacaatttcatgctatacaaag

SEQ ID NO: 164054 - DNA, 46 bp, Artificial Sequence
  Description of Artificial Sequence: Synthetic oligonucleotide
cggtgtcactatcatcataggtttaacaatttcatgctatacaaag

SEQ ID NO: 164055 - DNA, 48 bp, Artificial Sequence
  Description of Artificial Sequence: Synthetic oligonucleotide
ggtgtcactatcatcataggtttaacaatttcatgctatacaaagaag

SEQ ID NO: 164056 - DNA, 49 bp, Artificial Sequence
  Description of Artificial Sequence: Synthetic oligonucleotide
gtgtcactatcatcataggtttaacaatttcatgctatacaaagaagac

SEQ ID NO: 164057 - DNA, 49 bp, Artificial Sequence
  Description of Artificial Sequence: Synthetic oligonucleotide
tgtcactatcatcataggtttaacaatttcatgctatacaaagaagacg

SEQ ID NO: 164058 - DNA, 48 bp, Artificial Sequence
  Description of Artificial Sequence: Synthetic oligonucleotide
gtcactatcatcataggtttaacaatttcatgctatacaaagaagacg

SEQ ID NO: 164059 - DNA, 48 bp, Artificial Sequence
  Description of Artificial Sequence: Synthetic oligonucleotide
tcactatcatcataggtttaacaatttcatgctatacaaagaagacgg

SEQ ID NO: 164060 - DNA, 47 bp, Artificial Sequence
  Description of Artificial Sequence: Synthetic oligonucleotide
cactatcatcataggtttaacaatttcatgctatacaaagaagacgg

SEQ ID NO: 164061 - DNA, 50 bp, Artificial Sequence
  Description of Artificial Sequence: Synthetic oligonucleotide
actatcatcataggtttaacaatttcatgctatacaaagaagacggaatc

SEQ ID NO: 164062 - DNA, 49 bp, Artificial Sequence
  Description of Artificial Sequence: Synthetic oligonucleotide
ctatcatcataggtttaacaatttcatgctatacaaagaagacggaatc

SEQ ID NO: 164063 - DNA, 49 bp, Artificial Sequence
  Description of Artificial Sequence: Synthetic oligonucleotide
tatcatcataggtttaacaatttcatgctatacaaagaagacggaatcc

SEQ ID NO: 164064 - DNA, 48 bp, Artificial Sequence
  Description of Artificial Sequence: Synthetic oligonucleotide
atcatcataggtttaacaatttcatgctatacaaagaagacggaatcc

SEQ ID NO: 164065 - DNA, 47 bp, Artificial Sequence
  Description of Artificial Sequence: Synthetic oligonucleotide
tcatcataggtttaacaatttcatgctatacaaagaagacggaatcc

SEQ ID NO: 164066 - DNA, 46 bp, Artificial Sequence
  Description of Artificial Sequence: Synthetic oligonucleotide
catcataggtttaacaatttcatgctatacaaagaagacggaatcc

SEQ ID NO: 164067 - DNA, 47 bp, Artificial Sequence
  Description of Artificial Sequence: Synthetic oligonucleotide
atcataggtttaacaatttcatgctatacaaagaagacggaatccac

SEQ ID NO: 164068 - DNA, 46 bp, Artificial Sequence
  Description of Artificial Sequence: Synthetic oligonucleotide
tcataggtttaacaatttcatgctatacaaagaagacggaatccac

SEQ ID NO: 164069 - DNA, 45 bp, Artificial Sequence
  Description of Artificial Sequence: Synthetic oligonucleotide
cataggtttaacaatttcatgctatacaaagaagacggaatccac

SEQ ID NO: 164070 - DNA, 48 bp, Artificial Sequence
  Description of Artificial Sequence: Synthetic oligonucleotide
ataggtttaacaatttcatgctatacaaagaagacggaatccacattc

SEQ ID NO: 164071 - DNA, 47 bp, Artificial Sequence
  Description of Artificial Sequence: Synthetic oligonucleotide
taggtttaacaatttcatgctatacaaagaagacggaatccacattc

SEQ ID NO: 164072 - DNA, 46 bp, Artificial Sequence
  Description of Artificial Sequence: Synthetic oligonucleotide
aggtttaacaatttcatgctatacaaagaagacggaatccacattc

SEQ ID NO: 164073 - DNA, 45 bp, Artificial Sequence
  Description of Artificial Sequence: Synthetic oligonucleotide
ggtttaacaatttcatgctatacaaagaagacggaatccacattc

SEQ ID NO: 164074 - DNA, 45 bp, Artificial Sequence
  Description of Artificial Sequence: Synthetic oligonucleotide
gtttaacaatttcatgctatacaaagaagacggaatccacattcc

SEQ ID NO: 164075 - DNA, 45 bp, Artificial Sequence
  Description of Artificial Sequence: Synthetic oligonucleotide
tttaacaatttcatgctatacaaagaagacggaatccacattccc

SEQ ID NO: 164076 - DNA, 44 bp, Artificial Sequence
  Description of Artificial Sequence: Synthetic oligonucleotide
ttaacaatttcatgctatacaaagaagacggaatccacattccc

SEQ ID NO: 164077 - DNA, 43 bp, Artificial Sequence
  Description of Artificial Sequence: Synthetic oligonucleotide
taacaatttcatgctatacaaagaagacggaatccacattccc

SEQ ID NO: 164078 - DNA, 42 bp, Artificial Sequence
  Description of Artificial Sequence: Synthetic oligonucleotide
aacaatttcatgctatacaaagaagacggaatccacattccc

SEQ ID NO: 164079 - DNA, 41 bp, Artificial Sequence
  Description of Artificial Sequence: Synthetic oligonucleotide
acaatttcatgctatacaaagaagacggaatccacattccc

SEQ ID NO: 164080 - DNA, 40 bp, Artificial Sequence
  Description of Artificial Sequence: Synthetic oligonucleotide
caatttcatgctatacaaagaagacggaatccacattccc

SEQ ID NO: 164081 - DNA, 42 bp, Artificial Sequence
  Description of Artificial Sequence: Synthetic oligonucleotide
aatttcatgctatacaaagaagacggaatccacattcccatc

SEQ ID NO: 164082 - DNA, 41 bp, Artificial Sequence
  Description of Artificial Sequence: Synthetic oligonucleotide
atttcatgctatacaaagaagacggaatccacattcccatc

SEQ ID NO: 164083 - DNA, 40 bp, Artificial Sequence
  Description of Artificial Sequence: Synthetic oligonucleotide
tttcatgctatacaaagaagacggaatccacattcccatc

SEQ ID NO: 164084 - DNA, 39 bp, Artificial Sequence
  Description of Artificial Sequence: Synthetic oligonucleotide
ttcatgctatacaaagaagacggaatccacattcccatc

SEQ ID NO: 164085 - DNA, 38 bp, Artificial Sequence
  Description of Artificial Sequence: Synthetic oligonucleotide
tcatgctatacaaagaagacggaatccacattcccatc

SEQ ID NO: 164086 - DNA, 37 bp, Artificial Sequence
  Description of Artificial Sequence: Synthetic oligonucleotide
catgctatacaaagaagacggaatccacattcccatc

SEQ ID NO: 164087 - DNA, 39 bp, Artificial Sequence
  Description of Artificial Sequence: Synthetic oligonucleotide
atgctatacaaagaagacggaatccacattcccatcttc

SEQ ID NO: 164088 - DNA, 38 bp, Artificial Sequence
  Description of Artificial Sequence: Synthetic oligonucleotide
tgctatacaaagaagacggaatccacattcccatcttc

SEQ ID NO: 164089 - DNA, 37 bp, Artificial Sequence
  Description of Artificial Sequence: Synthetic oligonucleotide
gctatacaaagaagacggaatccacattcccatcttc

SEQ ID NO: 164090 - DNA, 37 bp, Artificial Sequence
  Description of Artificial Sequence: Synthetic oligonucleotide
ctatacaaagaagacggaatccacattcccatcttcc

SEQ ID NO: 164091 - DNA, 39 bp, Artificial Sequence
  Description of Artificial Sequence: Synthetic oligonucleotide
tatacaaagaagacggaatccacattcccatcttccatg

SEQ ID NO: 164092 - DNA, 38 bp, Artificial Sequence
  Description of Artificial Sequence: Synthetic oligonucleotide
atacaaagaagacggaatccacattcccatcttccatg

SEQ ID NO: 164093 - DNA, 37 bp, Artificial Sequence
  Description of Artificial Sequence: Synthetic oligonucleotide
tacaaagaagacggaatccacattcccatcttccatg

SEQ ID NO: 164094 - DNA, 36 bp, Artificial Sequence
  Description of Artificial Sequence: Synthetic oligonucleotide
acaaagaagacggaatccacattcccatcttccatg

SEQ ID NO: 164095 - DNA, 35 bp, Artificial Sequence
  Description of Artificial Sequence: Synthetic oligonucleotide
caaagaagacggaatccacattcccatcttccatg

SEQ ID NO: 164096 - DNA, 35 bp, Artificial Sequence
  Description of Artificial Sequence: Synthetic oligonucleotide
aaagaagacggaatccacattcccatcttccatgg

SEQ ID NO: 164097 - DNA, 34 bp, Artificial Sequence
  Description of Artificial Sequence: Synthetic oligonucleotide
aagaagacggaatccacattcccatcttccatgg

SEQ ID NO: 164098 - DNA, 33 bp, Artificial Sequence
  Description of Artificial Sequence: Synthetic oligonucleotide
agaagacggaatccacattcccatcttccatgg

SEQ ID NO: 164099 - DNA, 32 bp, Artificial Sequence
  Description of Artificial Sequence: Synthetic oligonucleotide
gaagacggaatccacattcccatcttccatgg

SEQ ID NO: 164100 - DNA, 32 bp, Artificial Sequence
  Description of Artificial Sequence: Synthetic oligonucleotide
aagacggaatccacattcccatcttccatggc

SEQ ID NO: 164101 - DNA, 31 bp, Artificial Sequence
  Description of Artificial Sequence: Synthetic oligonucleotide
agacggaatccacattcccatcttccatggc

SEQ ID NO: 164102 - DNA, 30 bp, Artificial Sequence
  Description of Artificial Sequence: Synthetic oligonucleotide
gacggaatccacattcccatcttccatggc

SEQ ID NO: 164103 - DNA, 31 bp, Artificial Sequence
  Description of Artificial Sequence: Synthetic oligonucleotide
acggaatccacattcccatcttccatggcag

SEQ ID NO: 164104 - DNA, 30 bp, Artificial Sequence
  Description of Artificial Sequence: Synthetic oligonucleotide
cggaatccacattcccatcttccatggcag

SEQ ID NO: 164105 - DNA, 36 bp, Artificial Sequence
  Description of Artificial Sequence: Synthetic oligonucleotide
ggaatccacattcccatcttccatggcagaatattc

SEQ ID NO: 164106 - DNA, 25 bp, Artificial Sequence
  Description of Artificial Sequence: Synthetic oligonucleotide
acccacactcccccactgggtggtt

SEQ ID NO: 164107 - DNA, 24 bp, Artificial Sequence
  Description of Artificial Sequence: Synthetic oligonucleotide
cccacactcccccactgggtggtt

SEQ ID NO: 164108 - DNA, 24 bp, Artificial Sequence
  Description of Artificial Sequence: Synthetic oligonucleotide
ccacactcccccactgggtggttg

SEQ ID NO: 164109 - DNA, 24 bp, Artificial Sequence
  Description of Artificial Sequence: Synthetic oligonucleotide
cacactcccccactgggtggttgg

SEQ ID NO: 164110 - DNA, 25 bp, Artificial Sequence
  Description of Artificial Sequence: Synthetic oligonucleotide
acactcccccactgggtggttggca

SEQ ID NO: 164111 - DNA, 24 bp, Artificial Sequence
  Description of Artificial Sequence: Synthetic oligonucleotide
cactcccccactgggtggttggca

SEQ ID NO: 164112 - DNA, 24 bp, Artificial Sequence
  Description of Artificial Sequence: Synthetic oligonucleotide
actcccccactgggtggttggcac

SEQ ID NO: 164113 - DNA, 23 bp, Artificial Sequence
  Description of Artificial Sequence: Synthetic oligonucleotide
ctcccccactgggtggttggcac

SEQ ID NO: 164114 - DNA, 23 bp, Artificial Sequence
  Description of Artificial Sequence: Synthetic oligonucleotide
tcccccactgggtggttggcacc

SEQ ID NO: 164115 - DNA, 22 bp, Artificial Sequence
  Description of Artificial Sequence: Synthetic oligonucleotide
cccccactgggtggttggcacc

SEQ ID NO: 164116 - DNA, 23 bp, Artificial Sequence
  Description of Artificial Sequence: Synthetic oligonucleotide
ccccactgggtggttggcaccca

SEQ ID NO: 164117 - DNA, 23 bp, Artificial Sequence
  Description of Artificial Sequence: Synthetic oligonucleotide
cccactgggtggttggcacccag

SEQ ID NO: 164118 - DNA, 25 bp, Artificial Sequence
  Description of Artificial Sequence: Synthetic oligonucleotide
ccactgggtggttggcacccagcaa

SEQ ID NO: 164119 - DNA, 25 bp, Artificial Sequence
  Description of Artificial Sequence: Synthetic oligonucleotide
cactgggtggttggcacccagcaac

SEQ ID NO: 164120 - DNA, 25 bp, Artificial Sequence
  Description of Artificial Sequence: Synthetic oligonucleotide
actgggtggttggcacccagcaacc

SEQ ID NO: 164121 - DNA, 24 bp, Artificial Sequence
  Description of Artificial Sequence: Synthetic oligonucleotide
ctgggtggttggcacccagcaacc

SEQ ID NO: 164122 - DNA, 24 bp, Artificial Sequence
  Description of Artificial Sequence: Synthetic oligonucleotide
tgggtggttggcacccagcaaccc

SEQ ID NO: 164123 - DNA, 23 bp, Artificial Sequence
  Description of Artificial Sequence: Synthetic oligonucleotide
gggtggttggcacccagcaaccc

SEQ ID NO: 164124 - DNA, 23 bp, Artificial Sequence
  Description of Artificial Sequence: Synthetic oligonucleotide
ggtggttggcacccagcaacccc

SEQ ID NO: 164125 - DNA, 24 bp, Artificial Sequence
  Description of Artificial Sequence: Synthetic oligonucleotide
gtggttggcacccagcaaccccgt

SEQ ID NO: 164126 - DNA, 24 bp, Artificial Sequence
  Description of Artificial Sequence: Synthetic oligonucleotide
tggttggcacccagcaaccccgtg

SEQ ID NO: 164127 - DNA, 23 bp, Artificial Sequence
  Description of Artificial Sequence: Synthetic oligonucleotide
ggttggcacccagcaaccccgtg

SEQ ID NO: 164128 - DNA, 24 bp, Artificial Sequence
  Description of Artificial Sequence: Synthetic oligonucleotide
gttggcacccagcaaccccgtggt

SEQ ID NO: 164129 - DNA, 26 bp, Artificial Sequence
  Description of Artificial Sequence: Synthetic oligonucleotide
ttggcacccagcaaccccgtggtgat

SEQ ID NO: 164130 - DNA, 25 bp, Artificial Sequence
  Description of Artificial Sequence: Synthetic oligonucleotide
tggcacccagcaaccccgtggtgat

SEQ ID NO: 164131 - DNA, 33 bp, Artificial Sequence
  Description of Artificial Sequence: Synthetic oligonucleotide
ctacagatgctacggttctgttactcacacctc

SEQ ID NO: 164132 - DNA, 33 bp, Artificial Sequence
  Description of Artificial Sequence: Synthetic oligonucleotide
tacagatgctacggttctgttactcacacctcc

SEQ ID NO: 164133 - DNA, 32 bp, Artificial Sequence
  Description of Artificial Sequence: Synthetic oligonucleotide
acagatgctacggttctgttactcacacctcc

SEQ ID NO: 164134 - DNA, 31 bp, Artificial Sequence
  Description of Artificial Sequence: Synthetic oligonucleotide
cagatgctacggttctgttactcacacctcc

SEQ ID NO: 164135 - DNA, 34 bp, Artificial Sequence
  Description of Artificial Sequence: Synthetic oligonucleotide
agatgctacggttctgttactcacacctcctatc

SEQ ID NO: 164136 - DNA, 33 bp, Artificial Sequence
  Description of Artificial Sequence: Synthetic oligonucleotide
gatgctacggttctgttactcacacctcctatc

SEQ ID NO: 164137 - DNA, 34 bp, Artificial Sequence
  Description of Artificial Sequence: Synthetic oligonucleotide
atgctacggttctgttactcacacctcctatcag

SEQ ID NO: 164138 - DNA, 33 bp, Artificial Sequence
  Description of Artificial Sequence: Synthetic oligonucleotide
tgctacggttctgttactcacacctcctatcag

SEQ ID NO: 164139 - DNA, 32 bp, Artificial Sequence
  Description of Artificial Sequence: Synthetic oligonucleotide
gctacggttctgttactcacacctcctatcag

SEQ ID NO: 164140 - DNA, 34 bp, Artificial Sequence
  Description of Artificial Sequence: Synthetic oligonucleotide
ctacggttctgttactcacacctcctatcagttg

SEQ ID NO: 164141 - DNA, 35 bp, Artificial Sequence
  Description of Artificial Sequence: Synthetic oligonucleotide
tacggttctgttactcacacctcctatcagttgtc

SEQ ID NO: 164142 - DNA, 34 bp, Artificial Sequence
  Description of Artificial Sequence: Synthetic oligonucleotide
acggttctgttactcacacctcctatcagttgtc

SEQ ID NO: 164143 - DNA, 33 bp, Artificial Sequence
  Description of Artificial Sequence: Synthetic oligonucleotide
cggttctgttactcacacctcctatcagttgtc

SEQ ID NO: 164144 - DNA, 34 bp, Artificial Sequence
  Description of Artificial Sequence: Synthetic oligonucleotide
ggttctgttactcacacctcctatcagttgtcag

SEQ ID NO: 164145 - DNA, 34 bp, Artificial Sequence
  Description of Artificial Sequence: Synthetic oligonucleotide
gttctgttactcacacctcctatcagttgtcagc

SEQ ID NO: 164146 - DNA, 35 bp, Artificial Sequence
  Description of Artificial Sequence: Synthetic oligonucleotide
ttctgttactcacacctcctatcagttgtcagctc

SEQ ID NO: 164147 - DNA, 34 bp, Artificial Sequence
  Description of Artificial Sequence: Synthetic oligonucleotide
tctgttactcacacctcctatcagttgtcagctc

SEQ ID NO: 164148 - DNA, 33 bp, Artificial Sequence
  Description of Artificial Sequence: Synthetic oligonucleotide
ctgttactcacacctcctatcagttgtcagctc

SEQ ID NO: 164149 - DNA, 33 bp, Artificial Sequence
  Description of Artificial Sequence: Synthetic oligonucleotide
tgttactcacacctcctatcagttgtcagctcc

SEQ ID NO: 164150 - DNA, 32 bp, Artificial Sequence
  Description of Artificial Sequence: Synthetic oligonucleotide
gttactcacacctcctatcagttgtcagctcc

SEQ ID NO: 164151 - DNA, 32 bp, Artificial Sequence
  Description of Artificial Sequence: Synthetic oligonucleotide
ttactcacacctcctatcagttgtcagctccc

SEQ ID NO: 164152 - DNA, 31 bp, Artificial Sequence
  Description of Artificial Sequence: Synthetic oligonucleotide
tactcacacctcctatcagttgtcagctccc

SEQ ID NO: 164153 - DNA, 30 bp, Artificial Sequence
  Description of Artificial Sequence: Synthetic oligonucleotide
actcacacctcctatcagttgtcagctccc

SEQ ID NO: 164154 - DNA, 29 bp, Artificial Sequence
  Description of Artificial Sequence: Synthetic oligonucleotide
ctcacacctcctatcagttgtcagctccc

SEQ ID NO: 164155 - DNA, 30 bp, Artificial Sequence
  Description of Artificial Sequence: Synthetic oligonucleotide
tcacacctcctatcagttgtcagctcccag

SEQ ID NO: 164156 - DNA, 29 bp, Artificial Sequence
  Description of Artificial Sequence: Synthetic oligonucleotide
cacacctcctatcagttgtcagctcccag

SEQ ID NO: 164157 - DNA, 30 bp, Artificial Sequence
  Description of Artificial Sequence: Synthetic oligonucleotide
acacctcctatcagttgtcagctcccagtg

SEQ ID NO: 164158 - DNA, 29 bp, Artificial Sequence
  Description of Artificial Sequence: Synthetic oligonucleotide
cacctcctatcagttgtcagctcccagtg

SEQ ID NO: 164159 - DNA, 31 bp, Artificial Sequence
  Description of Artificial Sequence: Synthetic oligonucleotide
acctcctatcagttgtcagctcccagtgatc

SEQ ID NO: 164160 - DNA, 30 bp, Artificial Sequence
  Description of Artificial Sequence: Synthetic oligonucleotide
cctcctatcagttgtcagctcccagtgatc

SEQ ID NO: 164161 - DNA, 30 bp, Artificial Sequence
  Description of Artificial Sequence: Synthetic oligonucleotide
ctcctatcagttgtcagctcccagtgatcc

SEQ ID NO: 164162 - DNA, 30 bp, Artificial Sequence
  Description of Artificial Sequence: Synthetic oligonucleotide
tcctatcagttgtcagctcccagtgatccc

SEQ ID NO: 164163 - DNA, 30 bp, Artificial Sequence
  Description of Artificial Sequence: Synthetic oligonucleotide
ggacctacagatgctttggctctttccgtc

SEQ ID NO: 164164 - DNA, 31 bp, Artificial Sequence
  Description of Artificial Sequence: Synthetic oligonucleotide
gacctacagatgctttggctctttccgtcac

SEQ ID NO: 164165 - DNA, 32 bp, Artificial Sequence
  Description of Artificial Sequence: Synthetic oligonucleotide
acctacagatgctttggctctttccgtcactc

SEQ ID NO: 164166 - DNA, 31 bp, Artificial Sequence
  Description of Artificial Sequence: Synthetic oligonucleotide
cctacagatgctttggctctttccgtcactc

SEQ ID NO: 164167 - DNA, 32 bp, Artificial Sequence
  Description of Artificial Sequence: Synthetic oligonucleotide
ctacagatgctttggctctttccgtcactctc

SEQ ID NO: 164168 - DNA, 32 bp, Artificial Sequence
  Description of Artificial Sequence: Synthetic oligonucleotide
tacagatgctttggctctttccgtcactctcc

SEQ ID NO: 164169 - DNA, 31 bp, Artificial Sequence
  Description of Artificial Sequence: Synthetic oligonucleotide
acagatgctttggctctttccgtcactctcc

SEQ ID NO: 164170 - DNA, 30 bp, Artificial Sequence
  Description of Artificial Sequence: Synthetic oligonucleotide
cagatgctttggctctttccgtcactctcc

SEQ ID NO: 164171 - DNA, 30 bp, Artificial Sequence
  Description of Artificial Sequence: Synthetic oligonucleotide
agatgctttggctctttccgtcactctccc

SEQ ID NO: 164172 - DNA, 29 bp, Artificial Sequence
  Description of Artificial Sequence: Synthetic oligonucleotide
gatgctttggctctttccgtcactctccc

SEQ ID NO: 164173 - DNA, 31 bp, Artificial Sequence
  Description of Artificial Sequence: Synthetic oligonucleotide
atgctttggctctttccgtcactctccctac

SEQ ID NO: 164174 - DNA, 30 bp, Artificial Sequence
  Description of Artificial Sequence: Synthetic oligonucleotide
tgctttggctctttccgtcactctccctac

SEQ ID NO: 164175 - DNA, 29 bp, Artificial Sequence
  Description of Artificial Sequence: Synthetic oligonucleotide
gctttggctctttccgtcactctccctac

SEQ ID NO: 164176 - DNA, 29 bp, Artificial Sequence
  Description of Artificial Sequence: Synthetic oligonucleotide
ctttggctctttccgtcactctccctacg

SEQ ID NO: 164177 - DNA, 30 bp, Artificial Sequence
  Description of Artificial Sequence: Synthetic oligonucleotide
tttggctctttccgtcactctccctacgag

SEQ ID NO: 164178 - DNA, 29 bp, Artificial Sequence
  Description of Artificial Sequence: Synthetic oligonucleotide
ttggctctttccgtcactctccctacgag

SEQ ID NO: 164179 - DNA, 28 bp, Artificial Sequence
  Description of Artificial Sequence: Synthetic oligonucleotide
tggctctttccgtcactctccctacgag

SEQ ID NO: 164180 - DNA, 29 bp, Artificial Sequence
  Description of Artificial Sequence: Synthetic oligonucleotide
gctctttccgtcactctccctacgagttg

SEQ ID NO: 164181 - DNA, 30 bp, Artificial Sequence
  Description of Artificial Sequence: Synthetic oligonucleotide
ctctttccgtcactctccctacgagttgtc

SEQ ID NO: 164182 - DNA, 31 bp, Artificial Sequence
  Description of Artificial Sequence: Synthetic oligonucleotide
tctttccgtcactctccctacgagttgtcag

SEQ ID NO: 164183 - DNA, 30 bp, Artificial Sequence
  Description of Artificial Sequence: Synthetic oligonucleotide
ctttccgtcactctccctacgagttgtcag

SEQ ID NO: 164184 - DNA, 31 bp, Artificial Sequence
  Description of Artificial Sequence: Synthetic oligonucleotide
tttccgtcactctccctacgagttgtcagac

SEQ ID NO: 164185 - DNA, 30 bp, Artificial Sequence
  Description of Artificial Sequence: Synthetic oligonucleotide
ttccgtcactctccctacgagttgtcagac

SEQ ID NO: 164186 - DNA, 29 bp, Artificial Sequence
  Description of Artificial Sequence: Synthetic oligonucleotide
tccgtcactctccctacgagttgtcagac

SEQ ID NO: 164187 - DNA, 28 bp, Artificial Sequence
  Description of Artificial Sequence: Synthetic oligonucleotide
ccgtcactctccctacgagttgtcagac

SEQ ID NO: 164188 - DNA, 28 bp, Artificial Sequence
  Description of Artificial Sequence: Synthetic oligonucleotide
cgtcactctccctacgagttgtcagacc

SEQ ID NO: 164189 - DNA, 28 bp, Artificial Sequence
  Description of Artificial Sequence: Synthetic oligonucleotide
gtcactctccctacgagttgtcagaccc

SEQ ID NO: 164190 - DNA, 28 bp, Artificial Sequence
  Description of Artificial Sequence: Synthetic oligonucleotide
tcactctccctacgagttgtcagacccg

SEQ ID NO: 164191 - DNA, 27 bp, Artificial Sequence
  Description of Artificial Sequence: Synthetic oligonucleotide
cactctccctacgagttgtcagacccg

SEQ ID NO: 164192 - DNA, 28 bp, Artificial Sequence
  Description of Artificial Sequence: Synthetic oligonucleotide
actctccctacgagttgtcagacccgag

SEQ ID NO: 164193 - DNA, 27 bp, Artificial Sequence
  Description of Artificial Sequence: Synthetic oligonucleotide
ctctccctacgagttgtcagacccgag

SEQ ID NO: 164194 - DNA, 28 bp, Artificial Sequence
  Description of Artificial Sequence: Synthetic oligonucleotide
tctccctacgagttgtcagacccgagtg

SEQ ID NO: 164195 - DNA, 27 bp, Artificial Sequence
  Description of Artificial Sequence: Synthetic oligonucleotide
ctccctacgagttgtcagacccgagtg

SEQ ID NO: 164196 - DNA, 28 bp, Artificial Sequence
  Description of Artificial Sequence: Synthetic oligonucleotide
tccctacgagttgtcagacccgagtgac

SEQ ID NO: 164197 - DNA, 27 bp, Artificial Sequence
  Description of Artificial Sequence: Synthetic oligonucleotide
ccctacgagttgtcagacccgagtgac

SEQ ID NO: 164198 - DNA, 27 bp, Artificial Sequence
  Description of Artificial Sequence: Synthetic oligonucleotide
cctacgagttgtcagacccgagtgacc

SEQ ID NO: 164199 - DNA, 27 bp, Artificial Sequence
  Description of Artificial Sequence: Synthetic oligonucleotide
ctacgagttgtcagacccgagtgaccc

SEQ ID NO: 164200 - DNA, 28 bp, Artificial Sequence
  Description of Artificial Sequence: Synthetic oligonucleotide
tacgagttgtcagacccgagtgacccac

SEQ ID NO: 164201 - DNA, 27 bp, Artificial Sequence
  Description of Artificial Sequence: Synthetic oligonucleotide
acgagttgtcagacccgagtgacccac

SEQ ID NO: 164202 - DNA, 27 bp, Artificial Sequence
  Description of Artificial Sequence: Synthetic oligonucleotide
cgagttgtcagacccgagtgacccact

SEQ ID NO: 164203 - DNA, 27 bp, Artificial Sequence
  Description of Artificial Sequence: Synthetic oligonucleotide
gagttgtcagacccgagtgacccactg

SEQ ID NO: 164204 - DNA, 27 bp, Artificial Sequence
  Description of Artificial Sequence: Synthetic oligonucleotide
agttgtcagacccgagtgacccactgc

SEQ ID NO: 164205 - DNA, 27 bp, Artificial Sequence
  Description of Artificial Sequence: Synthetic oligonucleotide
gttgtcagacccgagtgacccactgct

SEQ ID NO: 164206 - DNA, 28 bp, Artificial Sequence
  Description of Artificial Sequence: Synthetic oligonucleotide
ttgtcagacccgagtgacccactgcttg

SEQ ID NO: 164207 - DNA, 27 bp, Artificial Sequence
  Description of Artificial Sequence: Synthetic oligonucleotide
tgtcagacccgagtgacccactgcttg

SEQ ID NO: 164208 - DNA, 31 bp, Artificial Sequence
  Description of Artificial Sequence: Synthetic oligonucleotide
tccaaatctggtaaccccagacacctgcatg

SEQ ID NO: 164209 - DNA, 30 bp, Artificial Sequence
  Description of Artificial Sequence: Synthetic oligonucleotide
ccaaatctggtaaccccagacacctgcatg

SEQ ID NO: 164210 - DNA, 32 bp, Artificial Sequence
  Description of Artificial Sequence: Synthetic oligonucleotide
caaatctggtaaccccagacacctgcatgttc

SEQ ID NO: 164211 - DNA, 33 bp, Artificial Sequence
  Description of Artificial Sequence: Synthetic oligonucleotide
aaatctggtaaccccagacacctgcatgttctc

SEQ ID NO: 164212 - DNA, 32 bp, Artificial Sequence
  Description of Artificial Sequence: Synthetic oligonucleotide
aatctggtaaccccagacacctgcatgttctc

SEQ ID NO: 164213 - DNA, 31 bp, Artificial Sequence
  Description of Artificial Sequence: Synthetic oligonucleotide
atctggtaaccccagacacctgcatgttctc

SEQ ID NO: 164214 - DNA, 30 bp, Artificial Sequence
  Description of Artificial Sequence: Synthetic oligonucleotide
tctggtaaccccagacacctgcatgttctc

SEQ ID NO: 164215 - DNA, 29 bp, Artificial Sequence
  Description of Artificial Sequence: Synthetic oligonucleotide
ctggtaaccccagacacctgcatgttctc

SEQ ID NO: 164216 - DNA, 32 bp, Artificial Sequence
  Description of Artificial Sequence: Synthetic oligonucleotide
tggtaaccccagacacctgcatgttctcattg

SEQ ID NO: 164217 - DNA, 31 bp, Artificial Sequence
  Description of Artificial Sequence: Synthetic oligonucleotide
ggtaaccccagacacctgcatgttctcattg

SEQ ID NO: 164218 - DNA, 31 bp, Artificial Sequence
  Description of Artificial Sequence: Synthetic oligonucleotide
gtaaccccagacacctgcatgttctcattgg

SEQ ID NO: 164219 - DNA, 31 bp, Artificial Sequence
  Description of Artificial Sequence: Synthetic oligonucleotide
taaccccagacacctgcatgttctcattggg

SEQ ID NO: 164220 - DNA, 30 bp, Artificial Sequence
  Description of Artificial Sequence: Synthetic oligonucleotide
aaccccagacacctgcatgttctcattggg

SEQ ID NO: 164221 - DNA, 29 bp, Artificial Sequence
  Description of Artificial Sequence: Synthetic oligonucleotide
accccagacacctgcatgttctcattggg

SEQ ID NO: 164222 - DNA, 28 bp, Artificial Sequence
  Description of Artificial Sequence: Synthetic oligonucleotide
ccccagacacctgcatgttctcattggg

SEQ ID NO: 164223 - DNA, 29 bp, Artificial Sequence
  Description of Artificial Sequence: Synthetic oligonucleotide
cccagacacctgcatgttctcattgggac

SEQ ID NO: 164224 - DNA, 29 bp, Artificial Sequence
  Description of Artificial Sequence: Synthetic oligonucleotide
ccagacacctgcatgttctcattgggacc

SEQ ID NO: 164225 - DNA, 30 bp, Artificial Sequence
  Description of Artificial Sequence: Synthetic oligonucleotide
cagacacctgcatgttctcattgggacctc

SEQ ID NO: 164226 - DNA, 31 bp, Artificial Sequence
  Description of Artificial Sequence: Synthetic oligonucleotide
agacacctgcatgttctcattgggacctcag

SEQ ID NO: 164227 - DNA, 30 bp, Artificial Sequence
  Description of Artificial Sequence: Synthetic oligonucleotide
gacacctgcatgttctcattgggacctcag

SEQ ID NO: 164228 - DNA, 31 bp, Artificial Sequence
  Description of Artificial Sequence: Synthetic oligonucleotide
acacctgcatgttctcattgggacctcagtg

SEQ ID NO: 164229 - DNA, 30 bp, Artificial Sequence
  Description of Artificial Sequence: Synthetic oligonucleotide
cacctgcatgttctcattgggacctcagtg

SEQ ID NO: 164230 - DNA, 30 bp, Artificial Sequence
  Description of Artificial Sequence: Synthetic oligonucleotide
acctgcatgttctcattgggacctcagtgg

SEQ ID NO: 164231 - DNA, 29 bp, Artificial Sequence
  Description of Artificial Sequence: Synthetic oligonucleotide
cctgcatgttctcattgggacctcagtgg

SEQ ID NO: 164232 - DNA, 30 bp, Artificial Sequence
  Description of Artificial Sequence: Synthetic oligonucleotide
ctgcatgttctcattgggacctcagtggtc

SEQ ID NO: 164233 - DNA, 32 bp, Artificial Sequence
  Description of Artificial Sequence: Synthetic oligonucleotide
tgcatgttctcattgggacctcagtggtcatc

SEQ ID NO: 164234 - DNA, 31 bp, Artificial Sequence
  Description of Artificial Sequence: Synthetic oligonucleotide
gcatgttctcattgggacctcagtggtcatc

SEQ ID NO: 164235 - DNA, 33 bp, Artificial Sequence
  Description of Artificial Sequence: Synthetic oligonucleotide
catgttctcattgggacctcagtggtcatcatc

SEQ ID NO: 164236 - DNA, 33 bp, Artificial Sequence
  Description of Artificial Sequence: Synthetic oligonucleotide
atgttctcattgggacctcagtggtcatcatcc

SEQ ID NO: 164237 - DNA, 32 bp, Artificial Sequence
  Description of Artificial Sequence: Synthetic oligonucleotide
tgttctcattgggacctcagtggtcatcatcc

SEQ ID NO: 164238 - DNA, 31 bp, Artificial Sequence
  Description of Artificial Sequence: Synthetic oligonucleotide
gttctcattgggacctcagtggtcatcatcc

SEQ ID NO: 164239 - DNA, 32 bp, Artificial Sequence
  Description of Artificial Sequence: Synthetic oligonucleotide
ttctcattgggacctcagtggtcatcatcctc

SEQ ID NO: 164240 - DNA, 31 bp, Artificial Sequence
  Description of Artificial Sequence: Synthetic oligonucleotide
tctcattgggacctcagtggtcatcatcctc

SEQ ID NO: 164241 - DNA, 30 bp, Artificial Sequence
  Description of Artificial Sequence: Synthetic oligonucleotide
ctcattgggacctcagtggtcatcatcctc

SEQ ID NO: 164242 - DNA, 32 bp, Artificial Sequence
  Description of Artificial Sequence: Synthetic oligonucleotide
tcattgggacctcagtggtcatcatcctcttc

SEQ ID NO: 164243 - DNA, 31 bp, Artificial Sequence
  Description of Artificial Sequence: Synthetic oligonucleotide
cattgggacctcagtggtcatcatcctcttc

SEQ ID NO: 164244 - DNA, 33 bp, Artificial Sequence
  Description of Artificial Sequence: Synthetic oligonucleotide
ctcctcctcttctttctccttcatctctggtac

SEQ ID NO: 164245 - DNA, 34 bp, Artificial Sequence
  Description of Artificial Sequence: Synthetic oligonucleotide
tcctcctcttctttctccttcatctctggtactc

SEQ ID NO: 164246 - DNA, 33 bp, Artificial Sequence
  Description of Artificial Sequence: Synthetic oligonucleotide
cctcctcttctttctccttcatctctggtactc

SEQ ID NO: 164247 - DNA, 33 bp, Artificial Sequence
  Description of Artificial Sequence: Synthetic oligonucleotide
ctcctcttctttctccttcatctctggtactcc

SEQ ID NO: 164248 - DNA, 35 bp, Artificial Sequence
  Description of Artificial Sequence: Synthetic oligonucleotide
tcctcttctttctccttcatctctggtactccaac

SEQ ID NO: 164249 - DNA, 34 bp, Artificial Sequence
  Description of Artificial Sequence: Synthetic oligonucleotide
cctcttctttctccttcatctctggtactccaac

SEQ ID NO: 164250 - DNA, 43 bp, Artificial Sequence
  Description of Artificial Sequence: Synthetic oligonucleotide
ctcttctttctccttcatctctggtactccaacaaaaaaaatg

SEQ ID NO: 164251 - DNA, 43 bp, Artificial Sequence
  Description of Artificial Sequence: Synthetic oligonucleotide
tcttctttctccttcatctctggtactccaacaaaaaaaatgc

SEQ ID NO: 164252 - DNA, 42 bp, Artificial Sequence
  Description of Artificial Sequence: Synthetic oligonucleotide
cttctttctccttcatctctggtactccaacaaaaaaaatgc

SEQ ID NO: 164253 - DNA, 43 bp, Artificial Sequence
  Description of Artificial Sequence: Synthetic oligonucleotide
ttctttctccttcatctctggtactccaacaaaaaaaatgctg

SEQ ID NO: 164254 - DNA, 42 bp, Artificial Sequence
  Description of Artificial Sequence: Synthetic oligonucleotide
tctttctccttcatctctggtactccaacaaaaaaaatgctg

SEQ ID NO: 164255 - DNA, 41 bp, Artificial Sequence
  Description of Artificial Sequence: Synthetic oligonucleotide
ctttctccttcatctctggtactccaacaaaaaaaatgctg

SEQ ID NO: 164256 - DNA, 41 bp, Artificial Sequence
  Description of Artificial Sequence: Synthetic oligonucleotide
tttctccttcatctctggtactccaacaaaaaaaatgctgc

SEQ ID NO: 164257 - DNA, 40 bp, Artificial Sequence
  Description of Artificial Sequence: Synthetic oligonucleotide
ttctccttcatctctggtactccaacaaaaaaaatgctgc

SEQ ID NO: 164258 - DNA, 39 bp, Artificial Sequence
  Description of Artificial Sequence: Synthetic oligonucleotide
tctccttcatctctggtactccaacaaaaaaaatgctgc

SEQ ID NO: 164259 - DNA, 38 bp, Artificial Sequence
  Description of Artificial Sequence: Synthetic oligonucleotide
ctccttcatctctggtactccaacaaaaaaaatgctgc

SEQ ID NO: 164260 - DNA, 39 bp, Artificial Sequence
  Description of Artificial Sequence: Synthetic oligonucleotide
tccttcatctctggtactccaacaaaaaaaatgctgctg

SEQ ID NO: 164261 - DNA, 38 bp, Artificial Sequence
  Description of Artificial Sequence: Synthetic oligonucleotide
ccttcatctctggtactccaacaaaaaaaatgctgctg

SEQ ID NO: 164262 - DNA, 42 bp, Artificial Sequence
  Description of Artificial Sequence: Synthetic oligonucleotide
cttcatctctggtactccaacaaaaaaaatgctgctgtaatg

SEQ ID NO: 164263 - DNA, 42 bp, Artificial Sequence
  Description of Artificial Sequence: Synthetic oligonucleotide
ttcatctctggtactccaacaaaaaaaatgctgctgtaatgg

SEQ ID NO: 164264 - DNA, 41 bp, Artificial Sequence
  Description of Artificial Sequence: Synthetic oligonucleotide
tcatctctggtactccaacaaaaaaaatgctgctgtaatgg

SEQ ID NO: 164265 - DNA, 40 bp, Artificial Sequence
  Description of Artificial Sequence: Synthetic oligonucleotide
catctctggtactccaacaaaaaaaatgctgctgtaatgg

SEQ ID NO: 164266 - DNA, 41 bp, Artificial Sequence
  Description of Artificial Sequence: Synthetic oligonucleotide
atctctggtactccaacaaaaaaaatgctgctgtaatggac

SEQ ID NO: 164267 - DNA, 40 bp, Artificial Sequence
  Description of Artificial Sequence: Synthetic oligonucleotide
tctctggtactccaacaaaaaaaatgctgctgtaatggac

SEQ ID NO: 164268 - DNA, 39 bp, Artificial Sequence
  Description of Artificial Sequence: Synthetic oligonucleotide
ctctggtactccaacaaaaaaaatgctgctgtaatggac

SEQ ID NO: 164269 - DNA, 39 bp, Artificial Sequence
  Description of Artificial Sequence: Synthetic oligonucleotide
tctggtactccaacaaaaaaaatgctgctgtaatggacc

SEQ ID NO: 164270 - DNA, 38 bp, Artificial Sequence
  Description of Artificial Sequence: Synthetic oligonucleotide
ctggtactccaacaaaaaaaatgctgctgtaatggacc

SEQ ID NO: 164271 - DNA, 40 bp, Artificial Sequence
  Description of Artificial Sequence: Synthetic oligonucleotide
tggtactccaacaaaaaaaatgctgctgtaatggaccaag

SEQ ID NO: 164272 - DNA, 39 bp, Artificial Sequence
  Description of Artificial Sequence: Synthetic oligonucleotide
ggtactccaacaaaaaaaatgctgctgtaatggaccaag

SEQ ID NO: 164273 - DNA, 40 bp, Artificial Sequence
  Description of Artificial Sequence: Synthetic oligonucleotide
gtactccaacaaaaaaaatgctgctgtaatggaccaagag

SEQ ID NO: 164274 - DNA, 40 bp, Artificial Sequence
  Description of Artificial Sequence: Synthetic oligonucleotide
tactccaacaaaaaaaatgctgctgtaatggaccaagagc

SEQ ID NO: 164275 - DNA, 39 bp, Artificial Sequence
  Description of Artificial Sequence: Synthetic oligonucleotide
actccaacaaaaaaaatgctgctgtaatggaccaagagc

SEQ ID NO: 164276 - DNA, 31 bp, Artificial Sequence
  Description of Artificial Sequence: Synthetic oligonucleotide
aacagcgaggactctgatgaacaagaccctc

SEQ ID NO: 164277 - DNA, 30 bp, Artificial Sequence
  Description of Artificial Sequence: Synthetic oligonucleotide
acagcgaggactctgatgaacaagaccctc

SEQ ID NO: 164278 - DNA, 29 bp, Artificial Sequence
  Description of Artificial Sequence: Synthetic oligonucleotide
cagcgaggactctgatgaacaagaccctc

SEQ ID NO: 164279 - DNA, 30 bp, Artificial Sequence
  Description of Artificial Sequence: Synthetic oligonucleotide
agggaacagaacagccaacagcgaggattc

SEQ ID NO: 164280 - DNA, 29 bp, Artificial Sequence
  Description of Artificial Sequence: Synthetic oligonucleotide
gggaacagaacagccaacagcgaggattc

SEQ ID NO: 164281 - DNA, 30 bp, Artificial Sequence
  Description of Artificial Sequence: Synthetic oligonucleotide
ggaacagaacagccaacagcgaggattctg

SEQ ID NO: 164282 - DNA, 32 bp, Artificial Sequence
  Description of Artificial Sequence: Synthetic oligonucleotide
gaacagaacagccaacagcgaggattctgatg

SEQ ID NO: 164283 - DNA, 34 bp, Artificial Sequence
  Description of Artificial Sequence: Synthetic oligonucleotide
aacagaacagccaacagcgaggattctgatgaac

SEQ ID NO: 164284 - DNA, 33 bp, Artificial Sequence
  Description of Artificial Sequence: Synthetic oligonucleotide
acagaacagccaacagcgaggattctgatgaac

SEQ ID NO: 164285 - DNA, 32 bp, Artificial Sequence
  Description of Artificial Sequence: Synthetic oligonucleotide
cagaacagccaacagcgaggattctgatgaac

SEQ ID NO: 164286 - DNA, 34 bp, Artificial Sequence
  Description of Artificial Sequence: Synthetic oligonucleotide
agaacagccaacagcgaggattctgatgaacaag

SEQ ID NO: 164287 - DNA, 33 bp, Artificial Sequence
  Description of Artificial Sequence: Synthetic oligonucleotide
gaacagccaacagcgaggattctgatgaacaag

SEQ ID NO: 164288 - DNA, 34 bp, Artificial Sequence
  Description of Artificial Sequence: Synthetic oligonucleotide
aacagccaacagcgaggattctgatgaacaagac

SEQ ID NO: 164289 - DNA, 33 bp, Artificial Sequence
  Description of Artificial Sequence: Synthetic oligonucleotide
acagccaacagcgaggattctgatgaacaagac

SEQ ID NO: 164290 - DNA, 32 bp, Artificial Sequence
  Description of Artificial Sequence: Synthetic oligonucleotide
cagccaacagcgaggattctgatgaacaagac

SEQ ID NO: 164291 - DNA, 32 bp, Artificial Sequence
  Description of Artificial Sequence: Synthetic oligonucleotide
agccaacagcgaggattctgatgaacaagacc

SEQ ID NO: 164292 - DNA, 31 bp, Artificial Sequence
  Description of Artificial Sequence: Synthetic oligonucleotide
gccaacagcgaggattctgatgaacaagacc

SEQ ID NO: 164293 - DNA, 31 bp, Artificial Sequence
  Description of Artificial Sequence: Synthetic oligonucleotide
ccaacagcgaggattctgatgaacaagaccc

SEQ ID NO: 164294 - DNA, 32 bp, Artificial Sequence
  Description of Artificial Sequence: Synthetic oligonucleotide
caacagcgaggattctgatgaacaagaccctc

SEQ ID NO: 164295 - DNA, 33 bp, Artificial Sequence
  Description of Artificial Sequence: Synthetic oligonucleotide
aacagcgaggattctgatgaacaagaccctcag

SEQ ID NO: 164296 - DNA, 32 bp, Artificial Sequence
  Description of Artificial Sequence: Synthetic oligonucleotide
acagcgaggattctgatgaacaagaccctcag

SEQ ID NO: 164297 - DNA, 31 bp, Artificial Sequence
  Description of Artificial Sequence: Synthetic oligonucleotide
cagcgaggattctgatgaacaagaccctcag

SEQ ID NO: 164298 - DNA, 31 bp, Artificial Sequence
  Description of Artificial Sequence: Synthetic oligonucleotide
agcgaggattctgatgaacaagaccctcagg

SEQ ID NO: 164299 - DNA, 30 bp, Artificial Sequence
  Description of Artificial Sequence: Synthetic oligonucleotide
gcgaggattctgatgaacaagaccctcagg

SEQ ID NO: 164300 - DNA, 31 bp, Artificial Sequence
  Description of Artificial Sequence: Synthetic oligonucleotide
cgaggattctgatgaacaagaccctcaggag

SEQ ID NO: 164301 - DNA, 31 bp, Artificial Sequence
  Description of Artificial Sequence: Synthetic oligonucleotide
gaggattctgatgaacaagaccctcaggagg

SEQ ID NO: 164302 - DNA, 32 bp, Artificial Sequence
  Description of Artificial Sequence: Synthetic oligonucleotide
aggattctgatgaacaagaccctcaggaggtg

SEQ ID NO: 164303 - DNA, 31 bp, Artificial Sequence
  Description of Artificial Sequence: Synthetic oligonucleotide
ggattctgatgaacaagaccctcaggaggtg

SEQ ID NO: 164304 - DNA, 32 bp, Artificial Sequence
  Description of Artificial Sequence: Synthetic oligonucleotide
gattctgatgaacaagaccctcaggaggtgac

SEQ ID NO: 164305 - DNA, 35 bp, Artificial Sequence
  Description of Artificial Sequence: Synthetic oligonucleotide
attctgatgaacaagaccctcaggaggtgacatac

SEQ ID NO: 164306 - DNA, 34 bp, Artificial Sequence
  Description of Artificial Sequence: Synthetic oligonucleotide
ttctgatgaacaagaccctcaggaggtgacatac

SEQ ID NO: 164307 - DNA, 34 bp, Artificial Sequence
  Description of Artificial Sequence: Synthetic oligonucleotide
ttctgttactcacacctcctatcagttgtcagcc

SEQ ID NO: 164308 - DNA, 33 bp, Artificial Sequence
  Description of Artificial Sequence: Synthetic oligonucleotide
tctgttactcacacctcctatcagttgtcagcc

SEQ ID NO: 164309 - DNA, 32 bp, Artificial Sequence
  Description of Artificial Sequence: Synthetic oligonucleotide
ctgttactcacacctcctatcagttgtcagcc

SEQ ID NO: 164310 - DNA, 32 bp, Artificial Sequence
  Description of Artificial Sequence: Synthetic oligonucleotide
tgttactcacacctcctatcagttgtcagccc

SEQ ID NO: 164311 - DNA, 31 bp, Artificial Sequence
  Description of Artificial Sequence: Synthetic oligonucleotide
gttactcacacctcctatcagttgtcagccc

SEQ ID NO: 164312 - DNA, 31 bp, Artificial Sequence
  Description of Artificial Sequence: Synthetic oligonucleotide
ttactcacacctcctatcagttgtcagcccc

SEQ ID NO: 164313 - DNA, 30 bp, Artificial Sequence
  Description of Artificial Sequence: Synthetic oligonucleotide
tactcacacctcctatcagttgtcagcccc

SEQ ID NO: 164314 - DNA, 29 bp, Artificial Sequence
  Description of Artificial Sequence: Synthetic oligonucleotide
actcacacctcctatcagttgtcagcccc

SEQ ID NO: 164315 - DNA, 28 bp, Artificial Sequence
  Description of Artificial Sequence: Synthetic oligonucleotide
ctcacacctcctatcagttgtcagcccc

SEQ ID NO: 164316 - DNA, 28 bp, Artificial Sequence
  Description of Artificial Sequence: Synthetic oligonucleotide
tcacacctcctatcagttgtcagccccc

SEQ ID NO: 164317 - DNA, 27 bp, Artificial Sequence
  Description of Artificial Sequence: Synthetic oligonucleotide
cacacctcctatcagttgtcagccccc

SEQ ID NO: 164318 - DNA, 28 bp, Artificial Sequence
  Description of Artificial Sequence: Synthetic oligonucleotide
acacctcctatcagttgtcagcccccag

SEQ ID NO: 164319 - DNA, 27 bp, Artificial Sequence
  Description of Artificial Sequence: Synthetic oligonucleotide
cacctcctatcagttgtcagcccccag

SEQ ID NO: 164320 - DNA, 28 bp, Artificial Sequence
  Description of Artificial Sequence: Synthetic oligonucleotide
acctcctatcagttgtcagcccccagtg

SEQ ID NO: 164321 - DNA, 27 bp, Artificial Sequence
  Description of Artificial Sequence: Synthetic oligonucleotide
cctcctatcagttgtcagcccccagtg

SEQ ID NO: 164322 - DNA, 29 bp, Artificial Sequence
  Description of Artificial Sequence: Synthetic oligonucleotide
ctcctatcagttgtcagcccccagtgatc

SEQ ID NO: 164323 - DNA, 29 bp, Artificial Sequence
  Description of Artificial Sequence: Synthetic oligonucleotide
tcctatcagttgtcagcccccagtgatcc

SEQ ID NO: 164324 - DNA, 28 bp, Artificial Sequence
  Description of Artificial Sequence: Synthetic oligonucleotide
cctatcagttgtcagcccccagtgatcc

SEQ ID NO: 164325 - DNA, 28 bp, Artificial Sequence
  Description of Artificial Sequence: Synthetic oligonucleotide
ctatcagttgtcagcccccagtgatccc

SEQ ID NO: 164326 - DNA, 28 bp, Artificial Sequence
  Description of Artificial Sequence: Synthetic oligonucleotide
tatcagttgtcagcccccagtgatcccc

SEQ ID NO: 164327 - DNA, 27 bp, Artificial Sequence
  Description of Artificial Sequence: Synthetic oligonucleotide
atcagttgtcagcccccagtgatcccc

SEQ ID NO: 164328 - DNA, 27 bp, Artificial Sequence
  Description of Artificial Sequence: Synthetic oligonucleotide
tcagttgtcagcccccagtgatcccct

SEQ ID NO: 164329 - DNA, 26 bp, Artificial Sequence
  Description of Artificial Sequence: Synthetic oligonucleotide
cagttgtcagcccccagtgatcccct

SEQ ID NO: 164330 - DNA, 26 bp, Artificial Sequence
  Description of Artificial Sequence: Synthetic oligonucleotide
agttgtcagcccccagtgatcccctg

SEQ ID NO: 164331 - DNA, 25 bp, Artificial Sequence
  Description of Artificial Sequence: Synthetic oligonucleotide
gttgtcagcccccagtgatcccctg

SEQ ID NO: 164332 - DNA, 26 bp, Artificial Sequence
  Description of Artificial Sequence: Synthetic oligonucleotide
ttgtcagcccccagtgatcccctgga

SEQ ID NO: 164333 - DNA, 25 bp, Artificial Sequence
  Description of Artificial Sequence: Synthetic oligonucleotide
tgtcagcccccagtgatcccctgga

SEQ ID NO: 164334 - DNA, 24 bp, Artificial Sequence
  Description of Artificial Sequence: Synthetic oligonucleotide
gtcagcccccagtgatcccctgga

SEQ ID NO: 164335 - DNA, 26 bp, Artificial Sequence
  Description of Artificial Sequence: Synthetic oligonucleotide
tcagcccccagtgatcccctggacat

SEQ ID NO: 164336 - DNA, 25 bp, Artificial Sequence
  Description of Artificial Sequence: Synthetic oligonucleotide
cagcccccagtgatcccctggacat

SEQ ID NO: 164337 - DNA, 25 bp, Artificial Sequence
  Description of Artificial Sequence: Synthetic oligonucleotide
agcccccagtgatcccctggacatc

SEQ ID NO: 164338 - DNA, 24 bp, Artificial Sequence
  Description of Artificial Sequence: Synthetic oligonucleotide
gcccccagtgatcccctggacatc

SEQ ID NO: 164339 - DNA, 25 bp, Artificial Sequence
  Description of Artificial Sequence: Synthetic oligonucleotide
cccccagtgatcccctggacatcgt

SEQ ID NO: 164340 - DNA, 25 bp, Artificial Sequence
  Description of Artificial Sequence: Synthetic oligonucleotide
ccccagtgatcccctggacatcgtg

SEQ ID NO: 164341 - DNA, 27 bp, Artificial Sequence
  Description of Artificial Sequence: Synthetic oligonucleotide
ggtccacacatgggtggtcaggacaag

SEQ ID NO: 164342 - DNA, 27 bp, Artificial Sequence
  Description of Artificial Sequence: Synthetic oligonucleotide
gtccacacatgggtggtcaggacaagc

SEQ ID NO: 164343 - DNA, 27 bp, Artificial Sequence
  Description of Artificial Sequence: Synthetic oligonucleotide
tccacacatgggtggtcaggacaagcc

SEQ ID NO: 164344 - DNA, 26 bp, Artificial Sequence
  Description of Artificial Sequence: Synthetic oligonucleotide
ccacacatgggtggtcaggacaagcc

SEQ ID NO: 164345 - DNA, 27 bp, Artificial Sequence
  Description of Artificial Sequence: Synthetic oligonucleotide
cacacatgggtggtcaggacaagccct

SEQ ID NO: 164346 - DNA, 28 bp, Artificial Sequence
  Description of Artificial Sequence: Synthetic oligonucleotide
acacatgggtggtcaggacaagcccttc

SEQ ID NO: 164347 - DNA, 27 bp, Artificial Sequence
  Description of Artificial Sequence: Synthetic oligonucleotide
cacatgggtggtcaggacaagcccttc

SEQ ID NO: 164348 - DNA, 27 bp, Artificial Sequence
  Description of Artificial Sequence: Synthetic oligonucleotide
acatgggtggtcaggacaagcccttcc

SEQ ID NO: 164349 - DNA, 27 bp, Artificial Sequence
  Description of Artificial Sequence: Synthetic oligonucleotide
catgggtggtcaggacaagcccttcct

SEQ ID NO: 164350 - DNA, 27 bp, Artificial Sequence
  Description of Artificial Sequence: Synthetic oligonucleotide
atgggtggtcaggacaagcccttcctg

SEQ ID NO: 164351 - DNA, 33 bp, Artificial Sequence
  Description of Artificial Sequence: Synthetic oligonucleotide
atgatggggtctccaaggccaatttctccattg

SEQ ID NO: 164352 - DNA, 32 bp, Artificial Sequence
  Description of Artificial Sequence: Synthetic oligonucleotide
tgatggggtctccaaggccaatttctccattg

SEQ ID NO: 164353 - DNA, 31 bp, Artificial Sequence
  Description of Artificial Sequence: Synthetic oligonucleotide
gatggggtctccaaggccaatttctccattg

SEQ ID NO: 164354 - DNA, 31 bp, Artificial Sequence
  Description of Artificial Sequence: Synthetic oligonucleotide
atggggtctccaaggccaatttctccattgg

SEQ ID NO: 164355 - DNA, 30 bp, Artificial Sequence
  Description of Artificial Sequence: Synthetic oligonucleotide
tggggtctccaaggccaatttctccattgg

SEQ ID NO: 164356 - DNA, 29 bp, Artificial Sequence
  Description of Artificial Sequence: Synthetic oligonucleotide
ggggtctccaaggccaatttctccattgg

SEQ ID NO: 164357 - DNA, 30 bp, Artificial Sequence
  Description of Artificial Sequence: Synthetic oligonucleotide
gggtctccaaggccaatttctccattggtc

SEQ ID NO: 164358 - DNA, 30 bp, Artificial Sequence
  Description of Artificial Sequence: Synthetic oligonucleotide
ggtctccaaggccaatttctccattggtcc

SEQ ID NO: 164359 - DNA, 30 bp, Artificial Sequence
  Description of Artificial Sequence: Synthetic oligonucleotide
gtctccaaggccaatttctccattggtccc

SEQ ID NO: 164360 - DNA, 32 bp, Artificial Sequence
  Description of Artificial Sequence: Synthetic oligonucleotide
tctccaaggccaatttctccattggtcccatg

SEQ ID NO: 164361 - DNA, 31 bp, Artificial Sequence
  Description of Artificial Sequence: Synthetic oligonucleotide
ctccaaggccaatttctccattggtcccatg

SEQ ID NO: 164362 - DNA, 33 bp, Artificial Sequence
  Description of Artificial Sequence: Synthetic oligonucleotide
tccaaggccaatttctccattggtcccatgatg

SEQ ID NO: 164363 - DNA, 32 bp, Artificial Sequence
  Description of Artificial Sequence: Synthetic oligonucleotide
ccaaggccaatttctccattggtcccatgatg

SEQ ID NO: 164364 - DNA, 32 bp, Artificial Sequence
  Description of Artificial Sequence: Synthetic oligonucleotide
caaggccaatttctccattggtcccatgatgc

SEQ ID NO: 164365 - DNA, 34 bp, Artificial Sequence
  Description of Artificial Sequence: Synthetic oligonucleotide
aaggccaatttctccattggtcccatgatgcttg

SEQ ID NO: 164366 - DNA, 33 bp, Artificial Sequence
  Description of Artificial Sequence: Synthetic oligonucleotide
aggccaatttctccattggtcccatgatgcttg

SEQ ID NO: 164367 - DNA, 32 bp, Artificial Sequence
  Description of Artificial Sequence: Synthetic oligonucleotide
ggccaatttctccattggtcccatgatgcttg

SEQ ID NO: 164368 - DNA, 32 bp, Artificial Sequence
  Description of Artificial Sequence: Synthetic oligonucleotide
gccaatttctccattggtcccatgatgcttgc

SEQ ID NO: 164369 - DNA, 32 bp, Artificial Sequence
  Description of Artificial Sequence: Synthetic oligonucleotide
ccaatttctccattggtcccatgatgcttgcc

SEQ ID NO: 164370 - DNA, 32 bp, Artificial Sequence
  Description of Artificial Sequence: Synthetic oligonucleotide
caatttctccattggtcccatgatgcttgccc

SEQ ID NO: 164371 - DNA, 34 bp, Artificial Sequence
  Description of Artificial Sequence: Synthetic oligonucleotide
aatttctccattggtcccatgatgcttgcccttg

SEQ ID NO: 164372 - DNA, 33 bp, Artificial Sequence
  Description of Artificial Sequence: Synthetic oligonucleotide
atttctccattggtcccatgatgcttgcccttg

SEQ ID NO: 164373 - DNA, 32 bp, Artificial Sequence
  Description of Artificial Sequence: Synthetic oligonucleotide
tttctccattggtcccatgatgcttgcccttg

SEQ ID NO: 164374 - DNA, 31 bp, Artificial Sequence
  Description of Artificial Sequence: Synthetic oligonucleotide
ttctccattggtcccatgatgcttgcccttg

SEQ ID NO: 164375 - DNA, 30 bp, Artificial Sequence
  Description of Artificial Sequence: Synthetic oligonucleotide
tctccattggtcccatgatgcttgcccttg

SEQ ID NO: 164376 - DNA, 29 bp, Artificial Sequence
  Description of Artificial Sequence: Synthetic oligonucleotide
ctccattggtcccatgatgcttgcccttg

SEQ ID NO: 164377 - DNA, 29 bp, Artificial Sequence
  Description of Artificial Sequence: Synthetic oligonucleotide
tccattggtcccatgatgcttgcccttgc

SEQ ID NO: 164378 - DNA, 28 bp, Artificial Sequence
  Description of Artificial Sequence: Synthetic oligonucleotide
ccattggtcccatgatgcttgcccttgc

SEQ ID NO: 164379 - DNA, 29 bp, Artificial Sequence
  Description of Artificial Sequence: Synthetic oligonucleotide
cattggtcccatgatgcttgcccttgcag

SEQ ID NO: 164380 - DNA, 29 bp, Artificial Sequence
  Description of Artificial Sequence: Synthetic oligonucleotide
attggtcccatgatgcttgcccttgcagg

SEQ ID NO: 164381 - DNA, 28 bp, Artificial Sequence
  Description of Artificial Sequence: Synthetic oligonucleotide
ttggtcccatgatgcttgcccttgcagg

SEQ ID NO: 164382 - DNA, 27 bp, Artificial Sequence
  Description of Artificial Sequence: Synthetic oligonucleotide
tggtcccatgatgcttgcccttgcagg

SEQ ID NO: 164383 - DNA, 30 bp, Artificial Sequence
  Description of Artificial Sequence: Synthetic oligonucleotide
agggacctacagatgcttcggctctttctg

SEQ ID NO: 164384 - DNA, 29 bp, Artificial Sequence
  Description of Artificial Sequence: Synthetic oligonucleotide
gggacctacagatgcttcggctctttctg

SEQ ID NO: 164385 - DNA, 30 bp, Artificial Sequence
  Description of Artificial Sequence: Synthetic oligonucleotide
ggacctacagatgcttcggctctttctgtc

SEQ ID NO: 164386 - DNA, 31 bp, Artificial Sequence
  Description of Artificial Sequence: Synthetic oligonucleotide
gacctacagatgcttcggctctttctgtcac

SEQ ID NO: 164387 - DNA, 32 bp, Artificial Sequence
  Description of Artificial Sequence: Synthetic oligonucleotide
acctacagatgcttcggctctttctgtcactc

SEQ ID NO: 164388 - DNA, 31 bp, Artificial Sequence
  Description of Artificial Sequence: Synthetic oligonucleotide
cctacagatgcttcggctctttctgtcactc

SEQ ID NO: 164389 - DNA, 32 bp, Artificial Sequence
  Description of Artificial Sequence: Synthetic oligonucleotide
ctacagatgcttcggctctttctgtcactctc

SEQ ID NO: 164390 - DNA, 32 bp, Artificial Sequence
  Description of Artificial Sequence: Synthetic oligonucleotide
tacagatgcttcggctctttctgtcactctcc

SEQ ID NO: 164391 - DNA, 31 bp, Artificial Sequence
  Description of Artificial Sequence: Synthetic oligonucleotide
acagatgcttcggctctttctgtcactctcc

SEQ ID NO: 164392 - DNA, 30 bp, Artificial Sequence
  Description of Artificial Sequence: Synthetic oligonucleotide
cagatgcttcggctctttctgtcactctcc

SEQ ID NO: 164393 - DNA, 30 bp, Artificial Sequence
  Description of Artificial Sequence: Synthetic oligonucleotide
agatgcttcggctctttctgtcactctccc

SEQ ID NO: 164394 - DNA, 29 bp, Artificial Sequence
  Description of Artificial Sequence: Synthetic oligonucleotide
gatgcttcggctctttctgtcactctccc

SEQ ID NO: 164395 - DNA, 31 bp, Artificial Sequence
  Description of Artificial Sequence: Synthetic oligonucleotide
atgcttcggctctttctgtcactctccctac

SEQ ID NO: 164396 - DNA, 30 bp, Artificial Sequence
  Description of Artificial Sequence: Synthetic oligonucleotide
tgcttcggctctttctgtcactctccctac

SEQ ID NO: 164397 - DNA, 29 bp, Artificial Sequence
  Description of Artificial Sequence: Synthetic oligonucleotide
gcttcggctctttctgtcactctccctac

SEQ ID NO: 164398 - DNA, 29 bp, Artificial Sequence
  Description of Artificial Sequence: Synthetic oligonucleotide
cttcggctctttctgtcactctccctacg

SEQ ID NO: 164399 - DNA, 30 bp, Artificial Sequence
  Description of Artificial Sequence: Synthetic oligonucleotide
ttcggctctttctgtcactctccctacgag

SEQ ID NO: 164400 - DNA, 29 bp, Artificial Sequence
  Description of Artificial Sequence: Synthetic oligonucleotide
tcggctctttctgtcactctccctacgag

SEQ ID NO: 164401 - DNA, 28 bp, Artificial Sequence
  Description of Artificial Sequence: Synthetic oligonucleotide
cggctctttctgtcactctccctacgag

SEQ ID NO: 164402 - DNA, 30 bp, Artificial Sequence
  Description of Artificial Sequence: Synthetic oligonucleotide
ggctctttctgtcactctccctacgagttg

SEQ ID NO: 164403 - DNA, 31 bp, Artificial Sequence
  Description of Artificial Sequence: Synthetic oligonucleotide
gctctttctgtcactctccctacgagttgtc

SEQ ID NO: 164404 - DNA, 32 bp, Artificial Sequence
  Description of Artificial Sequence: Synthetic oligonucleotide
ctctttctgtcactctccctacgagttgtcag

SEQ ID NO: 164405 - DNA, 33 bp, Artificial Sequence
  Description of Artificial Sequence: Synthetic oligonucleotide
tctttctgtcactctccctacgagttgtcagac

SEQ ID NO: 164406 - DNA, 32 bp, Artificial Sequence
  Description of Artificial Sequence: Synthetic oligonucleotide
ctttctgtcactctccctacgagttgtcagac

SEQ ID NO: 164407 - DNA, 32 bp, Artificial Sequence
  Description of Artificial Sequence: Synthetic oligonucleotide
tttctgtcactctccctacgagttgtcagacc

SEQ ID NO: 164408 - DNA, 31 bp, Artificial Sequence
  Description of Artificial Sequence: Synthetic oligonucleotide
ttctgtcactctccctacgagttgtcagacc

SEQ ID NO: 164409 - DNA, 30 bp, Artificial Sequence
  Description of Artificial Sequence: Synthetic oligonucleotide
tctgtcactctccctacgagttgtcagacc

SEQ ID NO: 164410 - DNA, 29 bp, Artificial Sequence
  Description of Artificial Sequence: Synthetic oligonucleotide
ctgtcactctccctacgagttgtcagacc

SEQ ID NO: 164411 - DNA, 29 bp, Artificial Sequence
  Description of Artificial Sequence: Synthetic oligonucleotide
tgtcactctccctacgagttgtcagaccc

SEQ ID NO: 164412 - DNA, 29 bp, Artificial Sequence
  Description of Artificial Sequence: Synthetic oligonucleotide
caaatctggtaaccccagacacctgcacg

SEQ ID NO: 164413 - DNA, 31 bp, Artificial Sequence
  Description of Artificial Sequence: Synthetic oligonucleotide
aaatctggtaaccccagacacctgcacgttc

SEQ ID NO: 164414 - DNA, 30 bp, Artificial Sequence
  Description of Artificial Sequence: Synthetic oligonucleotide
aatctggtaaccccagacacctgcacgttc

SEQ ID NO: 164415 - DNA, 29 bp, Artificial Sequence
  Description of Artificial Sequence: Synthetic oligonucleotide
atctggtaaccccagacacctgcacgttc

SEQ ID NO: 164416 - DNA, 28 bp, Artificial Sequence
  Description of Artificial Sequence: Synthetic oligonucleotide
tctggtaaccccagacacctgcacgttc

SEQ ID NO: 164417 - DNA, 27 bp, Artificial Sequence
  Description of Artificial Sequence: Synthetic oligonucleotide
ctggtaaccccagacacctgcacgttc

SEQ ID NO: 164418 - DNA, 28 bp, Artificial Sequence
  Description of Artificial Sequence: Synthetic oligonucleotide
tggtaaccccagacacctgcacgttctg

SEQ ID NO: 164419 - DNA, 36 bp, Artificial Sequence
  Description of Artificial Sequence: Synthetic oligonucleotide
atatgcacagttggatcactgcgttttcacacagag

SEQ ID NO: 164420 - DNA, 35 bp, Artificial Sequence
  Description of Artificial Sequence: Synthetic oligonucleotide
tatgcacagttggatcactgcgttttcacacagag

SEQ ID NO: 164421 - DNA, 34 bp, Artificial Sequence
  Description of Artificial Sequence: Synthetic oligonucleotide
atgcacagttggatcactgcgttttcacacagag

SEQ ID NO: 164422 - DNA, 33 bp, Artificial Sequence
  Description of Artificial Sequence: Synthetic oligonucleotide
tgcacagttggatcactgcgttttcacacagag

SEQ ID NO: 164423 - DNA, 50 bp, Artificial Sequence
  Description of Artificial Sequence: Synthetic oligonucleotide
tgtcactatcatcataggtttaacaatttcatgctatacaaagaagacag

SEQ ID NO: 164424 - DNA, 49 bp, Artificial Sequence
  Description of Artificial Sequence: Synthetic oligonucleotide
gtcactatcatcataggtttaacaatttcatgctatacaaagaagacag

SEQ ID NO: 164425 - DNA, 52 bp, Artificial Sequence
  Description of Artificial Sequence: Synthetic oligonucleotide
tcactatcatcataggtttaacaatttcatgctatacaaagaagacagaatc

SEQ ID NO: 164426 - DNA, 51 bp, Artificial Sequence
  Description of Artificial Sequence: Synthetic oligonucleotide
cactatcatcataggtttaacaatttcatgctatacaaagaagacagaatc

SEQ ID NO: 164427 - DNA, 51 bp, Artificial Sequence
  Description of Artificial Sequence: Synthetic oligonucleotide
actatcatcataggtttaacaatttcatgctatacaaagaagacagaatcc

SEQ ID NO: 164428 - DNA, 50 bp, Artificial Sequence
  Description of Artificial Sequence: Synthetic oligonucleotide
ctatcatcataggtttaacaatttcatgctatacaaagaagacagaatcc

SEQ ID NO: 164429 - DNA, 51 bp, Artificial Sequence
  Description of Artificial Sequence: Synthetic oligonucleotide
tatcatcataggtttaacaatttcatgctatacaaagaagacagaatccac

SEQ ID NO: 164430 - DNA, 50 bp, Artificial Sequence
  Description of Artificial Sequence: Synthetic oligonucleotide
atcatcataggtttaacaatttcatgctatacaaagaagacagaatccac

SEQ ID NO: 164431 - DNA, 49 bp, Artificial Sequence
  Description of Artificial Sequence: Synthetic oligonucleotide
tcatcataggtttaacaatttcatgctatacaaagaagacagaatccac

SEQ ID NO: 164432 - DNA, 48 bp, Artificial Sequence
  Description of Artificial Sequence: Synthetic oligonucleotide
catcataggtttaacaatttcatgctatacaaagaagacagaatccac

SEQ ID NO: 164433 - DNA, 48 bp, Artificial Sequence
  Description of Artificial Sequence: Synthetic oligonucleotide
atcataggtttaacaatttcatgctatacaaagaagacagaatccacg

SEQ ID NO: 164434 - DNA, 21 bp, Artificial Sequence
  Description of Artificial Sequence: Synthetic oligonucleotide
gcccagcgctgtggtgcctcg

SEQ ID NO: 164435 - DNA, 21 bp, Artificial Sequence
  Description of Artificial Sequence: Synthetic oligonucleotide
cccagcgctgtggtgcctcgc

SEQ ID NO: 164436 - DNA, 21 bp, Artificial Sequence
  Description of Artificial Sequence: Synthetic oligonucleotide
ccagcgctgtggtgcctcgcg

SEQ ID NO: 164437 - DNA, 22 bp, Artificial Sequence
  Description of Artificial Sequence: Synthetic oligonucleotide
cagcgctgtggtgcctcgcgga

SEQ ID NO: 164438 - DNA, 22 bp, Artificial Sequence
  Description of Artificial Sequence: Synthetic oligonucleotide
agcgctgtggtgcctcgcggag

SEQ ID NO: 164439 - DNA, 21 bp, Artificial Sequence
  Description of Artificial Sequence: Synthetic oligonucleotide
gcgctgtggtgcctcgcggag

SEQ ID NO: 164440 - DNA, 22 bp, Artificial Sequence
  Description of Artificial Sequence: Synthetic oligonucleotide
cgctgtggtgcctcgcggagga

SEQ ID NO: 164441 - DNA, 23 bp, Artificial Sequence
  Description of Artificial Sequence: Synthetic oligonucleotide
gctgtggtgcctcgcggaggaca

SEQ ID NO: 164442 - DNA, 23 bp, Artificial Sequence
  Description of Artificial Sequence: Synthetic oligonucleotide
ctgtggtgcctcgcggaggacac

SEQ ID NO: 164443 - DNA, 24 bp, Artificial Sequence
  Description of Artificial Sequence: Synthetic oligonucleotide
tgtggtgcctcgcggaggacacgt

SEQ ID NO: 164444 - DNA, 23 bp, Artificial Sequence
  Description of Artificial Sequence: Synthetic oligonucleotide
gtggtgcctcgcggaggacacgt

SEQ ID NO: 164445 - DNA, 24 bp, Artificial Sequence
  Description of Artificial Sequence: Synthetic oligonucleotide
tggtgcctcgcggaggacacgtga

SEQ ID NO: 164446 - DNA, 23 bp, Artificial Sequence
  Description of Artificial Sequence: Synthetic oligonucleotide
ggtgcctcgcggaggacacgtga

SEQ ID NO: 164447 - DNA, 24 bp, Artificial Sequence
  Description of Artificial Sequence: Synthetic oligonucleotide
gtgcctcgcggaggacacgtgact

SEQ ID NO: 164448 - DNA, 26 bp, Artificial Sequence
  Description of Artificial Sequence: Synthetic oligonucleotide
tgcctcgcggaggacacgtgactctt

SEQ ID NO: 164449 - DNA, 25 bp, Artificial Sequence
  Description of Artificial Sequence: Synthetic oligonucleotide
gcctcgcggaggacacgtgactctt

SEQ ID NO: 164450 - DNA, 25 bp, Artificial Sequence
  Description of Artificial Sequence: Synthetic oligonucleotide
cctcgcggaggacacgtgactcttc

SEQ ID NO: 164451 - DNA, 25 bp, Artificial Sequence
  Description of Artificial Sequence: Synthetic oligonucleotide
ctcgcggaggacacgtgactcttcg

SEQ ID NO: 164452 - DNA, 26 bp, Artificial Sequence
  Description of Artificial Sequence: Synthetic oligonucleotide
tcgcggaggacacgtgactcttcggt

SEQ ID NO: 164453 - DNA, 25 bp, Artificial Sequence
  Description of Artificial Sequence: Synthetic oligonucleotide
cgcggaggacacgtgactcttcggt

SEQ ID NO: 164454 - DNA, 26 bp, Artificial Sequence
  Description of Artificial Sequence: Synthetic oligonucleotide
gcggaggacacgtgactcttcggtgt

SEQ ID NO: 164455 - DNA, 27 bp, Artificial Sequence
  Description of Artificial Sequence: Synthetic oligonucleotide
cggaggacacgtgactcttcggtgtca

SEQ ID NO: 164456 - DNA, 36 bp, Artificial Sequence
  Description of Artificial Sequence: Synthetic oligonucleotide
agaatccacgttcccatcttccatggcagaatattc

SEQ ID NO: 164457 - DNA, 35 bp, Artificial Sequence
  Description of Artificial Sequence: Synthetic oligonucleotide
gaatccacgttcccatcttccatggcagaatattc

SEQ ID NO: 164458 - DNA, 35 bp, Artificial Sequence
  Description of Artificial Sequence: Synthetic oligonucleotide
aatccacgttcccatcttccatggcagaatattcc

SEQ ID NO: 164459 - DNA, 34 bp, Artificial Sequence
  Description of Artificial Sequence: Synthetic oligonucleotide
atccacgttcccatcttccatggcagaatattcc

SEQ ID NO: 164460 - DNA, 33 bp, Artificial Sequence
  Description of Artificial Sequence: Synthetic oligonucleotide
tccacgttcccatcttccatggcagaatattcc

SEQ ID NO: 164461 - DNA, 32 bp, Artificial Sequence
  Description of Artificial Sequence: Synthetic oligonucleotide
ccacgttcccatcttccatggcagaatattcc

SEQ ID NO: 164462 - DNA, 33 bp, Artificial Sequence
  Description of Artificial Sequence: Synthetic oligonucleotide
cacgttcccatcttccatggcagaatattccag

SEQ ID NO: 164463 - DNA, 33 bp, Artificial Sequence
  Description of Artificial Sequence: Synthetic oligonucleotide
acgttcccatcttccatggcagaatattccagg

SEQ ID NO: 164464 - DNA, 32 bp, Artificial Sequence
  Description of Artificial Sequence: Synthetic oligonucleotide
cgttcccatcttccatggcagaatattccagg

SEQ ID NO: 164465 - DNA, 33 bp, Artificial Sequence
  Description of Artificial Sequence: Synthetic oligonucleotide
gttcccatcttccatggcagaatattccaggag

SEQ ID NO: 164466 - DNA, 33 bp, Artificial Sequence
  Description of Artificial Sequence: Synthetic oligonucleotide
ttcccatcttccatggcagaatattccaggagg

SEQ ID NO: 164467 - DNA, 32 bp, Artificial Sequence
  Description of Artificial Sequence: Synthetic oligonucleotide
tcccatcttccatggcagaatattccaggagg

SEQ ID NO: 164468 - DNA, 31 bp, Artificial Sequence
  Description of Artificial Sequence: Synthetic oligonucleotide
cccatcttccatggcagaatattccaggagg

SEQ ID NO: 164469 - DNA, 31 bp, Artificial Sequence
  Description of Artificial Sequence: Synthetic oligonucleotide
ccatcttccatggcagaatattccaggaggg

SEQ ID NO: 164470 - DNA, 31 bp, Artificial Sequence
  Description of Artificial Sequence: Synthetic oligonucleotide
catcttccatggcagaatattccaggagggc

SEQ ID NO: 164471 - DNA, 33 bp, Artificial Sequence
  Description of Artificial Sequence: Synthetic oligonucleotide
atcttccatggcagaatattccaggagggcttc

SEQ ID NO: 164472 - DNA, 32 bp, Artificial Sequence
  Description of Artificial Sequence: Synthetic oligonucleotide
tcttccatggcagaatattccaggagggcttc

SEQ ID NO: 164473 - DNA, 31 bp, Artificial Sequence
  Description of Artificial Sequence: Synthetic oligonucleotide
cttccatggcagaatattccaggagggcttc

SEQ ID NO: 164474 - DNA, 33 bp, Artificial Sequence
  Description of Artificial Sequence: Synthetic oligonucleotide
ttccatggcagaatattccaggagggcttcaac

SEQ ID NO: 164475 - DNA, 32 bp, Artificial Sequence
  Description of Artificial Sequence: Synthetic oligonucleotide
tccatggcagaatattccaggagggcttcaac

SEQ ID NO: 164476 - DNA, 31 bp, Artificial Sequence
  Description of Artificial Sequence: Synthetic oligonucleotide
ccatggcagaatattccaggagggcttcaac

SEQ ID NO: 164477 - DNA, 33 bp, Artificial Sequence
  Description of Artificial Sequence: Synthetic oligonucleotide
catggcagaatattccaggagggcttcaacatg

SEQ ID NO: 164478 - DNA, 34 bp, Artificial Sequence
  Description of Artificial Sequence: Synthetic oligonucleotide
atggcagaatattccaggagggcttcaacatgag

SEQ ID NO: 164479 - DNA, 33 bp, Artificial Sequence
  Description of Artificial Sequence: Synthetic oligonucleotide
tggcagaatattccaggagggcttcaacatgag

SEQ ID NO: 164480 - DNA, 32 bp, Artificial Sequence
  Description of Artificial Sequence: Synthetic oligonucleotide
ggcagaatattccaggagggcttcaacatgag

SEQ ID NO: 164481 - DNA, 32 bp, Artificial Sequence
  Description of Artificial Sequence: Synthetic oligonucleotide
gcagaatattccaggagggcttcaacatgagc

SEQ ID NO: 164482 - DNA, 32 bp, Artificial Sequence
  Description of Artificial Sequence: Synthetic oligonucleotide
cagaatattccaggagggcttcaacatgagcc

SEQ ID NO: 164483 - DNA, 32 bp, Artificial Sequence
  Description of Artificial Sequence: Synthetic oligonucleotide
agaatattccaggagggcttcaacatgagccc

SEQ ID NO: 164484 - DNA, 31 bp, Artificial Sequence
  Description of Artificial Sequence: Synthetic oligonucleotide
gaatattccaggagggcttcaacatgagccc

SEQ ID NO: 164485 - DNA, 32 bp, Artificial Sequence
  Description of Artificial Sequence: Synthetic oligonucleotide
aatattccaggagggcttcaacatgagccctg

SEQ ID NO: 164486 - DNA, 31 bp, Artificial Sequence
  Description of Artificial Sequence: Synthetic oligonucleotide
atattccaggagggcttcaacatgagccctg

SEQ ID NO: 164487 - DNA, 30 bp, Artificial Sequence
  Description of Artificial Sequence: Synthetic oligonucleotide
tattccaggagggcttcaacatgagccctg

SEQ ID NO: 164488 - DNA, 29 bp, Artificial Sequence
  Description of Artificial Sequence: Synthetic oligonucleotide
attccaggagggcttcaacatgagccctg

SEQ ID NO: 164489 - DNA, 28 bp, Artificial Sequence
  Description of Artificial Sequence: Synthetic oligonucleotide
ttccaggagggcttcaacatgagccctg

SEQ ID NO: 164490 - DNA, 27 bp, Artificial Sequence
  Description of Artificial Sequence: Synthetic oligonucleotide
tccaggagggcttcaacatgagccctg

SEQ ID NO: 164491 - DNA, 27 bp, Artificial Sequence
  Description of Artificial Sequence: Synthetic oligonucleotide
ccaggagggcttcaacatgagccctgt

SEQ ID NO: 164492 - DNA, 27 bp, Artificial Sequence
  Description of Artificial Sequence: Synthetic oligonucleotide
caggagggcttcaacatgagccctgtg

SEQ ID NO: 164493 - DNA, 28 bp, Artificial Sequence
  Description of Artificial Sequence: Synthetic oligonucleotide
aggagggcttcaacatgagccctgtgac

SEQ ID NO: 164494 - DNA, 27 bp, Artificial Sequence
  Description of Artificial Sequence: Synthetic oligonucleotide
ggagggcttcaacatgagccctgtgac

SEQ ID NO: 164495 - DNA, 27 bp, Artificial Sequence
  Description of Artificial Sequence: Synthetic oligonucleotide
gagggcttcaacatgagccctgtgacc

SEQ ID NO: 164496 - DNA, 28 bp, Artificial Sequence
  Description of Artificial Sequence: Synthetic oligonucleotide
agggcttcaacatgagccctgtgaccac

SEQ ID NO: 164497 - DNA, 27 bp, Artificial Sequence
  Description of Artificial Sequence: Synthetic oligonucleotide
gggcttcaacatgagccctgtgaccac

SEQ ID NO: 164498 - DNA, 28 bp, Artificial Sequence
  Description of Artificial Sequence: Synthetic oligonucleotide
ggcttcaacatgagccctgtgaccacag

SEQ ID NO: 164499 - DNA, 24 bp, Artificial Sequence
  Description of Artificial Sequence: Synthetic oligonucleotide
gtggtcggcacccagcaaccccat

SEQ ID NO: 164500 - DNA, 24 bp, Artificial Sequence
  Description of Artificial Sequence: Synthetic oligonucleotide
tggtcggcacccagcaaccccatg

SEQ ID NO: 164501 - DNA, 23 bp, Artificial Sequence
  Description of Artificial Sequence: Synthetic oligonucleotide
ggtcggcacccagcaaccccatg

SEQ ID NO: 164502 - DNA, 24 bp, Artificial Sequence
  Description of Artificial Sequence: Synthetic oligonucleotide
gtcggcacccagcaaccccatggt

SEQ ID NO: 164503 - DNA, 26 bp, Artificial Sequence
  Description of Artificial Sequence: Synthetic oligonucleotide
tcggcacccagcaaccccatggtgat

SEQ ID NO: 164504 - DNA, 25 bp, Artificial Sequence
  Description of Artificial Sequence: Synthetic oligonucleotide
cggcacccagcaaccccatggtgat

SEQ ID NO: 164505 - DNA, 27 bp, Artificial Sequence
  Description of Artificial Sequence: Synthetic oligonucleotide
ggcacccagcaaccccatggtgatcat

SEQ ID NO: 164506 - DNA, 27 bp, Artificial Sequence
  Description of Artificial Sequence: Synthetic oligonucleotide
gcacccagcaaccccatggtgatcatg

SEQ ID NO: 164507 - DNA, 27 bp, Artificial Sequence
  Description of Artificial Sequence: Synthetic oligonucleotide
cacccagcaaccccatggtgatcatgg

SEQ ID NO: 164508 - DNA, 28 bp, Artificial Sequence
  Description of Artificial Sequence: Synthetic oligonucleotide
acccagcaaccccatggtgatcatggtc

SEQ ID NO: 164509 - DNA, 27 bp, Artificial Sequence
  Description of Artificial Sequence: Synthetic oligonucleotide
cccagcaaccccatggtgatcatggtc

SEQ ID NO: 164510 - DNA, 28 bp, Artificial Sequence
  Description of Artificial Sequence: Synthetic oligonucleotide
ccagcaaccccatggtgatcatggtcac

SEQ ID NO: 164511 - DNA, 29 bp, Artificial Sequence
  Description of Artificial Sequence: Synthetic oligonucleotide
cagcaaccccatggtgatcatggtcacag

SEQ ID NO: 164512 - DNA, 29 bp, Artificial Sequence
  Description of Artificial Sequence: Synthetic oligonucleotide
agcaaccccatggtgatcatggtcacagg

SEQ ID NO: 164513 - DNA, 28 bp, Artificial Sequence
  Description of Artificial Sequence: Synthetic oligonucleotide
gcaaccccatggtgatcatggtcacagg

SEQ ID NO: 164514 - DNA, 31 bp, Artificial Sequence
  Description of Artificial Sequence: Synthetic oligonucleotide
caaccccatggtgatcatggtcacaggaaac

SEQ ID NO: 164515 - DNA, 31 bp, Artificial Sequence
  Description of Artificial Sequence: Synthetic oligonucleotide
aaccccatggtgatcatggtcacaggaaacc

SEQ ID NO: 164516 - DNA, 30 bp, Artificial Sequence
  Description of Artificial Sequence: Synthetic oligonucleotide
accccatggtgatcatggtcacaggaaacc

SEQ ID NO: 164517 - DNA, 29 bp, Artificial Sequence
  Description of Artificial Sequence: Synthetic oligonucleotide
ccccatggtgatcatggtcacaggaaacc

SEQ ID NO: 164518 - DNA, 30 bp, Artificial Sequence
  Description of Artificial Sequence: Synthetic oligonucleotide
cccatggtgatcatggtcacaggaaaccac

SEQ ID NO: 164519 - DNA, 31 bp, Artificial Sequence
  Description of Artificial Sequence: Synthetic oligonucleotide
ccatggtgatcatggtcacaggaaaccacag

SEQ ID NO: 164520 - DNA, 35 bp, Artificial Sequence
  Description of Artificial Sequence: Synthetic oligonucleotide
catggtgatcatggtcacaggaaaccacagaaaac

SEQ ID NO: 164521 - DNA, 35 bp, Artificial Sequence
  Description of Artificial Sequence: Synthetic oligonucleotide
atggtgatcatggtcacaggaaaccacagaaaacc

SEQ ID NO: 164522 - DNA, 27 bp, Artificial Sequence
  Description of Artificial Sequence: Synthetic oligonucleotide
cccatgatgcttgcccttgcagggact

SEQ ID NO: 164523 - DNA, 29 bp, Artificial Sequence
  Description of Artificial Sequence: Synthetic oligonucleotide
ccatgatgcttgcccttgcagggacttac

SEQ ID NO: 164524 - DNA, 30 bp, Artificial Sequence
  Description of Artificial Sequence: Synthetic oligonucleotide
catgatgcttgcccttgcagggacttacag

SEQ ID NO: 164525 - DNA, 32 bp, Artificial Sequence
  Description of Artificial Sequence: Synthetic oligonucleotide
atgatgcttgcccttgcagggacttacagatg

SEQ ID NO: 164526 - DNA, 31 bp, Artificial Sequence
  Description of Artificial Sequence: Synthetic oligonucleotide
tgatgcttgcccttgcagggacttacagatg

SEQ ID NO: 164527 - DNA, 30 bp, Artificial Sequence
  Description of Artificial Sequence: Synthetic oligonucleotide
gatgcttgcccttgcagggacttacagatg

SEQ ID NO: 164528 - DNA, 30 bp, Artificial Sequence
  Description of Artificial Sequence: Synthetic oligonucleotide
atgcttgcccttgcagggacttacagatgc

SEQ ID NO: 164529 - DNA, 29 bp, Artificial Sequence
  Description of Artificial Sequence: Synthetic oligonucleotide
tgcttgcccttgcagggacttacagatgc

SEQ ID NO: 164530 - DNA, 28 bp, Artificial Sequence
  Description of Artificial Sequence: Synthetic oligonucleotide
gcttgcccttgcagggacttacagatgc

SEQ ID NO: 164531 - DNA, 30 bp, Artificial Sequence
  Description of Artificial Sequence: Synthetic oligonucleotide
cttgcccttgcagggacttacagatgctac

SEQ ID NO: 164532 - DNA, 30 bp, Artificial Sequence
  Description of Artificial Sequence: Synthetic oligonucleotide
ttgcccttgcagggacttacagatgctacg

SEQ ID NO: 164533 - DNA, 29 bp, Artificial Sequence
  Description of Artificial Sequence: Synthetic oligonucleotide
tgcccttgcagggacttacagatgctacg

SEQ ID NO: 164534 - DNA, 28 bp, Artificial Sequence
  Description of Artificial Sequence: Synthetic oligonucleotide
gcccttgcagggacttacagatgctacg

SEQ ID NO: 164535 - DNA, 28 bp, Artificial Sequence
  Description of Artificial Sequence: Synthetic oligonucleotide
cccttgcagggacttacagatgctacgg

SEQ ID NO: 164536 - DNA, 30 bp, Artificial Sequence
  Description of Artificial Sequence: Synthetic oligonucleotide
ccttgcagggacttacagatgctacggttc

SEQ ID NO: 164537 - DNA, 31 bp, Artificial Sequence
  Description of Artificial Sequence: Synthetic oligonucleotide
cttgcagggacttacagatgctacggttctg

SEQ ID NO: 164538 - DNA, 34 bp, Artificial Sequence
  Description of Artificial Sequence: Synthetic oligonucleotide
ttgcagggacttacagatgctacggttctgttac

SEQ ID NO: 164539 - DNA, 33 bp, Artificial Sequence
  Description of Artificial Sequence: Synthetic oligonucleotide
tgcagggacttacagatgctacggttctgttac

SEQ ID NO: 164540 - DNA, 32 bp, Artificial Sequence
  Description of Artificial Sequence: Synthetic oligonucleotide
gcagggacttacagatgctacggttctgttac

SEQ ID NO: 164541 - DNA, 33 bp, Artificial Sequence
  Description of Artificial Sequence: Synthetic oligonucleotide
cagggacttacagatgctacggttctgttactc

SEQ ID NO: 164542 - DNA, 34 bp, Artificial Sequence
  Description of Artificial Sequence: Synthetic oligonucleotide
agggacttacagatgctacggttctgttactcac

SEQ ID NO: 164543 - DNA, 33 bp, Artificial Sequence
  Description of Artificial Sequence: Synthetic oligonucleotide
gggacttacagatgctacggttctgttactcac

SEQ ID NO: 164544 - DNA, 34 bp, Artificial Sequence
  Description of Artificial Sequence: Synthetic oligonucleotide
ggacttacagatgctacggttctgttactcacac

SEQ ID NO: 164545 - DNA, 34 bp, Artificial Sequence
  Description of Artificial Sequence: Synthetic oligonucleotide
gacttacagatgctacggttctgttactcacacc

SEQ ID NO: 164546 - DNA, 34 bp, Artificial Sequence
  Description of Artificial Sequence: Synthetic oligonucleotide
acttacagatgctacggttctgttactcacaccc

SEQ ID NO: 164547 - DNA, 33 bp, Artificial Sequence
  Description of Artificial Sequence: Synthetic oligonucleotide
cttacagatgctacggttctgttactcacaccc

SEQ ID NO: 164548 - DNA, 33 bp, Artificial Sequence
  Description of Artificial Sequence: Synthetic oligonucleotide
ttacagatgctacggttctgttactcacacccc

SEQ ID NO: 164549 - DNA, 25 bp, Artificial Sequence
  Description of Artificial Sequence: Synthetic oligonucleotide
cttctcagaggcccaagacaccccc

SEQ ID NO: 164550 - DNA, 30 bp, Artificial Sequence
  Description of Artificial Sequence: Synthetic oligonucleotide
gacacgtgactcttcggtgtcactgtcatc

SEQ ID NO: 164551 - DNA, 33 bp, Artificial Sequence
  Description of Artificial Sequence: Synthetic oligonucleotide
acacgtgactcttcggtgtcactgtcatcatag

SEQ ID NO: 164552 - DNA, 32 bp, Artificial Sequence
  Description of Artificial Sequence: Synthetic oligonucleotide
cacgtgactcttcggtgtcactgtcatcatag

SEQ ID NO: 164553 - DNA, 32 bp, Artificial Sequence
  Description of Artificial Sequence: Synthetic oligonucleotide
acgtgactcttcggtgtcactgtcatcatagg

SEQ ID NO: 164554 - DNA, 31 bp, Artificial Sequence
  Description of Artificial Sequence: Synthetic oligonucleotide
cgtgactcttcggtgtcactgtcatcatagg

SEQ ID NO: 164555 - DNA, 36 bp, Artificial Sequence
  Description of Artificial Sequence: Synthetic oligonucleotide
gtgactcttcggtgtcactgtcatcataggtttaac

SEQ ID NO: 164556 - DNA, 41 bp, Artificial Sequence
  Description of Artificial Sequence: Synthetic oligonucleotide
tgactcttcggtgtcactgtcatcataggtttaacaatttc

SEQ ID NO: 164557 - DNA, 40 bp, Artificial Sequence
  Description of Artificial Sequence: Synthetic oligonucleotide
gactcttcggtgtcactgtcatcataggtttaacaatttc

SEQ ID NO: 164558 - DNA, 42 bp, Artificial Sequence
  Description of Artificial Sequence: Synthetic oligonucleotide
actcttcggtgtcactgtcatcataggtttaacaatttcatg

SEQ ID NO: 164559 - DNA, 41 bp, Artificial Sequence
  Description of Artificial Sequence: Synthetic oligonucleotide
ctcttcggtgtcactgtcatcataggtttaacaatttcatg

SEQ ID NO: 164560 - DNA, 41 bp, Artificial Sequence
  Description of Artificial Sequence: Synthetic oligonucleotide
tcttcggtgtcactgtcatcataggtttaacaatttcatgc

SEQ ID NO: 164561 - DNA, 40 bp, Artificial Sequence
  Description of Artificial Sequence: Synthetic oligonucleotide
cttcggtgtcactgtcatcataggtttaacaatttcatgc

SEQ ID NO: 164562 - DNA, 44 bp, Artificial Sequence
  Description of Artificial Sequence: Synthetic oligonucleotide
ttcggtgtcactgtcatcataggtttaacaatttcatgctatac

SEQ ID NO: 164563 - DNA, 43 bp, Artificial Sequence
  Description of Artificial Sequence: Synthetic oligonucleotide
tcggtgtcactgtcatcataggtttaacaatttcatgctatac

SEQ ID NO: 164564 - DNA, 42 bp, Artificial Sequence
  Description of Artificial Sequence: Synthetic oligonucleotide
cggtgtcactgtcatcataggtttaacaatttcatgctatac

SEQ ID NO: 164565 - DNA, 45 bp, Artificial Sequence
  Description of Artificial Sequence: Synthetic oligonucleotide
ggtgtcactgtcatcataggtttaacaatttcatgctatacaaag

SEQ ID NO: 164566 - DNA, 47 bp, Artificial Sequence
  Description of Artificial Sequence: Synthetic oligonucleotide
gtgtcactgtcatcataggtttaacaatttcatgctatacaaagaag

SEQ ID NO: 164567 - DNA, 48 bp, Artificial Sequence
  Description of Artificial Sequence: Synthetic oligonucleotide
tgtcactgtcatcataggtttaacaatttcatgctatacaaagaagac

SEQ ID NO: 164568 - DNA, 47 bp, Artificial Sequence
  Description of Artificial Sequence: Synthetic oligonucleotide
gtcactgtcatcataggtttaacaatttcatgctatacaaagaagac

SEQ ID NO: 164569 - DNA, 47 bp, Artificial Sequence
  Description of Artificial Sequence: Synthetic oligonucleotide
tcactgtcatcataggtttaacaatttcatgctatacaaagaagacg

SEQ ID NO: 164570 - DNA, 46 bp, Artificial Sequence
  Description of Artificial Sequence: Synthetic oligonucleotide
cactgtcatcataggtttaacaatttcatgctatacaaagaagacg

SEQ ID NO: 164571 - DNA, 46 bp, Artificial Sequence
  Description of Artificial Sequence: Synthetic oligonucleotide
actgtcatcataggtttaacaatttcatgctatacaaagaagacgg

SEQ ID NO: 164572 - DNA, 45 bp, Artificial Sequence
  Description of Artificial Sequence: Synthetic oligonucleotide
ctgtcatcataggtttaacaatttcatgctatacaaagaagacgg

SEQ ID NO: 164573 - DNA, 48 bp, Artificial Sequence
  Description of Artificial Sequence: Synthetic oligonucleotide
tgtcatcataggtttaacaatttcatgctatacaaagaagacggaatc

SEQ ID NO: 164574 - DNA, 47 bp, Artificial Sequence
  Description of Artificial Sequence: Synthetic oligonucleotide
gtcatcataggtttaacaatttcatgctatacaaagaagacggaatc

SEQ ID NO: 164575 - DNA, 31 bp, Artificial Sequence
  Description of Artificial Sequence: Synthetic oligonucleotide
acaaagaggggatctctaaggacccctcaag

SEQ ID NO: 164576 - DNA, 30 bp, Artificial Sequence
  Description of Artificial Sequence: Synthetic oligonucleotide
caaagaggggatctctaaggacccctcaag

SEQ ID NO: 164577 - DNA, 30 bp, Artificial Sequence
  Description of Artificial Sequence: Synthetic oligonucleotide
aaagaggggatctctaaggacccctcaagc

SEQ ID NO: 164578 - DNA, 29 bp, Artificial Sequence
  Description of Artificial Sequence: Synthetic oligonucleotide
aagaggggatctctaaggacccctcaagc

SEQ ID NO: 164579 - DNA, 28 bp, Artificial Sequence
  Description of Artificial Sequence: Synthetic oligonucleotide
agaggggatctctaaggacccctcaagc

SEQ ID NO: 164580 - DNA, 27 bp, Artificial Sequence
  Description of Artificial Sequence: Synthetic oligonucleotide
gaggggatctctaaggacccctcaagc

SEQ ID NO: 164581 - DNA, 27 bp, Artificial Sequence
  Description of Artificial Sequence: Synthetic oligonucleotide
aggggatctctaaggacccctcaagcc

SEQ ID NO: 164582 - DNA, 27 bp, Artificial Sequence
  Description of Artificial Sequence: Synthetic oligonucleotide
ggggatctctaaggacccctcaagcct

SEQ ID NO: 164583 - DNA, 27 bp, Artificial Sequence
  Description of Artificial Sequence: Synthetic oligonucleotide
gggatctctaaggacccctcaagcctc

SEQ ID NO: 164584 - DNA, 27 bp, Artificial Sequence
  Description of Artificial Sequence: Synthetic oligonucleotide
ggatctctaaggacccctcaagcctcg

SEQ ID NO: 164585 - DNA, 29 bp, Artificial Sequence
  Description of Artificial Sequence: Synthetic oligonucleotide
gatctctaaggacccctcaagcctcgttg

SEQ ID NO: 164586 - DNA, 29 bp, Artificial Sequence
  Description of Artificial Sequence: Synthetic oligonucleotide
atctctaaggacccctcaagcctcgttgg

SEQ ID NO: 164587 - DNA, 28 bp, Artificial Sequence
  Description of Artificial Sequence: Synthetic oligonucleotide
tctctaaggacccctcaagcctcgttgg

SEQ ID NO: 164588 - DNA, 27 bp, Artificial Sequence
  Description of Artificial Sequence: Synthetic oligonucleotide
ctctaaggacccctcaagcctcgttgg

SEQ ID NO: 164589 - DNA, 28 bp, Artificial Sequence
  Description of Artificial Sequence: Synthetic oligonucleotide
tctaaggacccctcaagcctcgttggac

SEQ ID NO: 164590 - DNA, 27 bp, Artificial Sequence
  Description of Artificial Sequence: Synthetic oligonucleotide
ctaaggacccctcaagcctcgttggac

SEQ ID NO: 164591 - DNA, 28 bp, Artificial Sequence
  Description of Artificial Sequence: Synthetic oligonucleotide
taaggacccctcaagcctcgttggacag

SEQ ID NO: 164592 - DNA, 27 bp, Artificial Sequence
  Description of Artificial Sequence: Synthetic oligonucleotide
aaggacccctcaagcctcgttggacag

SEQ ID NO: 164593 - DNA, 27 bp, Artificial Sequence
  Description of Artificial Sequence: Synthetic oligonucleotide
aggacccctcaagcctcgttggacaga

SEQ ID NO: 164594 - DNA, 27 bp, Artificial Sequence
  Description of Artificial Sequence: Synthetic oligonucleotide
ggacccctcaagcctcgttggacagat

SEQ ID NO: 164595 - DNA, 27 bp, Artificial Sequence
  Description of Artificial Sequence: Synthetic oligonucleotide
gacccctcaagcctcgttggacagatc

SEQ ID NO: 164596 - DNA, 27 bp, Artificial Sequence
  Description of Artificial Sequence: Synthetic oligonucleotide
acccctcaagcctcgttggacagatcc

SEQ ID NO: 164597 - DNA, 27 bp, Artificial Sequence
  Description of Artificial Sequence: Synthetic oligonucleotide
cccctcaagcctcgttggacagatcca

SEQ ID NO: 164598 - DNA, 28 bp, Artificial Sequence
  Description of Artificial Sequence: Synthetic oligonucleotide
ccctcaagcctcgttggacagatccatg

SEQ ID NO: 164599 - DNA, 30 bp, Artificial Sequence
  Description of Artificial Sequence: Synthetic oligonucleotide
cctcaagcctcgttggacagatccatgatg

SEQ ID NO: 164600 - DNA, 30 bp, Artificial Sequence
  Description of Artificial Sequence: Synthetic oligonucleotide
ctcaagcctcgttggacagatccatgatgg

SEQ ID NO: 164601 - DNA, 30 bp, Artificial Sequence
  Description of Artificial Sequence: Synthetic oligonucleotide
tcaagcctcgttggacagatccatgatggg

SEQ ID NO: 164602 - DNA, 29 bp, Artificial Sequence
  Description of Artificial Sequence: Synthetic oligonucleotide
caagcctcgttggacagatccatgatggg

SEQ ID NO: 164603 - DNA, 29 bp, Artificial Sequence
  Description of Artificial Sequence: Synthetic oligonucleotide
aagcctcgttggacagatccatgatgggg

SEQ ID NO: 164604 - DNA, 28 bp, Artificial Sequence
  Description of Artificial Sequence: Synthetic oligonucleotide
agcctcgttggacagatccatgatgggg

SEQ ID NO: 164605 - DNA, 27 bp, Artificial Sequence
  Description of Artificial Sequence: Synthetic oligonucleotide
ccaggtcccctggtgaaatcaggagac

SEQ ID NO: 164606 - DNA, 28 bp, Artificial Sequence
  Description of Artificial Sequence: Synthetic oligonucleotide
caggtcccctggtgaaatcaggagacag

SEQ ID NO: 164607 - DNA, 29 bp, Artificial Sequence
  Description of Artificial Sequence: Synthetic oligonucleotide
aggtcccctggtgaaatcaggagacagag

SEQ ID NO: 164608 - DNA, 28 bp, Artificial Sequence
  Description of Artificial Sequence: Synthetic oligonucleotide
ggtcccctggtgaaatcaggagacagag

SEQ ID NO: 164609 - DNA, 29 bp, Artificial Sequence
  Description of Artificial Sequence: Synthetic oligonucleotide
gtcccctggtgaaatcaggagacagagtc

SEQ ID NO: 164610 - DNA, 31 bp, Artificial Sequence
  Description of Artificial Sequence: Synthetic oligonucleotide
tcccctggtgaaatcaggagacagagtcatc

SEQ ID NO: 164611 - DNA, 30 bp, Artificial Sequence
  Description of Artificial Sequence: Synthetic oligonucleotide
cccctggtgaaatcaggagacagagtcatc

SEQ ID NO: 164612 - DNA, 30 bp, Artificial Sequence
  Description of Artificial Sequence: Synthetic oligonucleotide
ccctggtgaaatcaggagacagagtcatcc

SEQ ID NO: 164613 - DNA, 31 bp, Artificial Sequence
  Description of Artificial Sequence: Synthetic oligonucleotide
cctggtgaaatcaggagacagagtcatcctg

SEQ ID NO: 164614 - DNA, 31 bp, Artificial Sequence
  Description of Artificial Sequence: Synthetic oligonucleotide
ctggtgaaatcaggagacagagtcatcctgc

SEQ ID NO: 164615 - DNA, 34 bp, Artificial Sequence
  Description of Artificial Sequence: Synthetic oligonucleotide
tggtgaaatcaggagacagagtcatcctgcaatg

SEQ ID NO: 164616 - DNA, 33 bp, Artificial Sequence
  Description of Artificial Sequence: Synthetic oligonucleotide
ggtgaaatcaggagacagagtcatcctgcaatg

SEQ ID NO: 164617 - DNA, 35 bp, Artificial Sequence
  Description of Artificial Sequence: Synthetic oligonucleotide
gtgaaatcaggagacagagtcatcctgcaatgttg

SEQ ID NO: 164618 - DNA, 35 bp, Artificial Sequence
  Description of Artificial Sequence: Synthetic oligonucleotide
tgaaatcaggagacagagtcatcctgcaatgttgg

SEQ ID NO: 164619 - DNA, 34 bp, Artificial Sequence
  Description of Artificial Sequence: Synthetic oligonucleotide
gaaatcaggagacagagtcatcctgcaatgttgg

SEQ ID NO: 164620 - DNA, 35 bp, Artificial Sequence
  Description of Artificial Sequence: Synthetic oligonucleotide
aaatcaggagacagagtcatcctgcaatgttggtc

SEQ ID NO: 164621 - DNA, 34 bp, Artificial Sequence
  Description of Artificial Sequence: Synthetic oligonucleotide
aatcaggagacagagtcatcctgcaatgttggtc

SEQ ID NO: 164622 - DNA, 33 bp, Artificial Sequence
  Description of Artificial Sequence: Synthetic oligonucleotide
atcaggagacagagtcatcctgcaatgttggtc

SEQ ID NO: 164623 - DNA, 32 bp, Artificial Sequence
  Description of Artificial Sequence: Synthetic oligonucleotide
tcaggagacagagtcatcctgcaatgttggtc

SEQ ID NO: 164624 - DNA, 31 bp, Artificial Sequence
  Description of Artificial Sequence: Synthetic oligonucleotide
caggagacagagtcatcctgcaatgttggtc

SEQ ID NO: 164625 - DNA, 32 bp, Artificial Sequence
  Description of Artificial Sequence: Synthetic oligonucleotide
aggagacagagtcatcctgcaatgttggtcag

SEQ ID NO: 164626 - DNA, 31 bp, Artificial Sequence
  Description of Artificial Sequence: Synthetic oligonucleotide
ggagacagagtcatcctgcaatgttggtcag

SEQ ID NO: 164627 - DNA, 35 bp, Artificial Sequence
  Description of Artificial Sequence: Synthetic oligonucleotide
gagacagagtcatcctgcaatgttggtcagatatc

SEQ ID NO: 164628 - DNA, 37 bp, Artificial Sequence
  Description of Artificial Sequence: Synthetic oligonucleotide
agacagagtcatcctgcaatgttggtcagatatcatg

SEQ ID NO: 164629 - DNA, 36 bp, Artificial Sequence
  Description of Artificial Sequence: Synthetic oligonucleotide
gacagagtcatcctgcaatgttggtcagatatcatg

SEQ ID NO: 164630 - DNA, 39 bp, Artificial Sequence
  Description of Artificial Sequence: Synthetic oligonucleotide
acagagtcatcctgcaatgttggtcagatatcatgtttg

SEQ ID NO: 164631 - DNA, 38 bp, Artificial Sequence
  Description of Artificial Sequence: Synthetic oligonucleotide
cagagtcatcctgcaatgttggtcagatatcatgtttg

SEQ ID NO: 164632 - DNA, 29 bp, Artificial Sequence
  Description of Artificial Sequence: Synthetic oligonucleotide
ggctctttctgtcactctccctacgagtg

SEQ ID NO: 164633 - DNA, 29 bp, Artificial Sequence
  Description of Artificial Sequence: Synthetic oligonucleotide
gctctttctgtcactctccctacgagtgg

SEQ ID NO: 164634 - DNA, 30 bp, Artificial Sequence
  Description of Artificial Sequence: Synthetic oligonucleotide
ctctttctgtcactctccctacgagtggtc

SEQ ID NO: 164635 - DNA, 31 bp, Artificial Sequence
  Description of Artificial Sequence: Synthetic oligonucleotide
tctttctgtcactctccctacgagtggtcag

SEQ ID NO: 164636 - DNA, 30 bp, Artificial Sequence
  Description of Artificial Sequence: Synthetic oligonucleotide
ctttctgtcactctccctacgagtggtcag

SEQ ID NO: 164637 - DNA, 31 bp, Artificial Sequence
  Description of Artificial Sequence: Synthetic oligonucleotide
tttctgtcactctccctacgagtggtcagac

SEQ ID NO: 164638 - DNA, 30 bp, Artificial Sequence
  Description of Artificial Sequence: Synthetic oligonucleotide
ttctgtcactctccctacgagtggtcagac

SEQ ID NO: 164639 - DNA, 29 bp, Artificial Sequence
  Description of Artificial Sequence: Synthetic oligonucleotide
tctgtcactctccctacgagtggtcagac

SEQ ID NO: 164640 - DNA, 28 bp, Artificial Sequence
  Description of Artificial Sequence: Synthetic oligonucleotide
ctgtcactctccctacgagtggtcagac

SEQ ID NO: 164641 - DNA, 28 bp, Artificial Sequence
  Description of Artificial Sequence: Synthetic oligonucleotide
tgtcactctccctacgagtggtcagacc

SEQ ID NO: 164642 - DNA, 22 bp, Artificial Sequence
  Description of Artificial Sequence: Synthetic oligonucleotide
gccggtccacacgtgggtggtc

SEQ ID NO: 164643 - DNA, 22 bp, Artificial Sequence
  Description of Artificial Sequence: Synthetic oligonucleotide
ccggtccacacgtgggtggtcg

SEQ ID NO: 164644 - DNA, 22 bp, Artificial Sequence
  Description of Artificial Sequence: Synthetic oligonucleotide
cggtccacacgtgggtggtcgg

SEQ ID NO: 164645 - DNA, 23 bp, Artificial Sequence
  Description of Artificial Sequence: Synthetic oligonucleotide
ggtccacacgtgggtggtcggga

SEQ ID NO: 164646 - DNA, 25 bp, Artificial Sequence
  Description of Artificial Sequence: Synthetic oligonucleotide
gtccacacgtgggtggtcgggacaa

SEQ ID NO: 164647 - DNA, 25 bp, Artificial Sequence
  Description of Artificial Sequence: Synthetic oligonucleotide
tccacacgtgggtggtcgggacaag

SEQ ID NO: 164648 - DNA, 24 bp, Artificial Sequence
  Description of Artificial Sequence: Synthetic oligonucleotide
ccacacgtgggtggtcgggacaag

SEQ ID NO: 164649 - DNA, 24 bp, Artificial Sequence
  Description of Artificial Sequence: Synthetic oligonucleotide
cacacgtgggtggtcgggacaagc

SEQ ID NO: 164650 - DNA, 24 bp, Artificial Sequence
  Description of Artificial Sequence: Synthetic oligonucleotide
acacgtgggtggtcgggacaagcc

SEQ ID NO: 164651 - DNA, 23 bp, Artificial Sequence
  Description of Artificial Sequence: Synthetic oligonucleotide
cacgtgggtggtcgggacaagcc

SEQ ID NO: 164652 - DNA, 25 bp, Artificial Sequence
  Description of Artificial Sequence: Synthetic oligonucleotide
acgtgggtggtcgggacaagccctt

SEQ ID NO: 164653 - DNA, 24 bp, Artificial Sequence
  Description of Artificial Sequence: Synthetic oligonucleotide
cgtgggtggtcgggacaagccctt

SEQ ID NO: 164654 - DNA, 24 bp, Artificial Sequence
  Description of Artificial Sequence: Synthetic oligonucleotide
gtgggtggtcgggacaagcccttc

SEQ ID NO: 164655 - DNA, 25 bp, Artificial Sequence
  Description of Artificial Sequence: Synthetic oligonucleotide
tgggtggtcgggacaagcccttcct

SEQ ID NO: 164656 - DNA, 24 bp, Artificial Sequence
  Description of Artificial Sequence: Synthetic oligonucleotide
gggtggtcgggacaagcccttcct

SEQ ID NO: 164657 - DNA, 25 bp, Artificial Sequence
  Description of Artificial Sequence: Synthetic oligonucleotide
ggtggtcgggacaagcccttcctgt

SEQ ID NO: 164658 - DNA, 26 bp, Artificial Sequence
  Description of Artificial Sequence: Synthetic oligonucleotide
gtggtcgggacaagcccttcctgtct

SEQ ID NO: 164659 - DNA, 26 bp, Artificial Sequence
  Description of Artificial Sequence: Synthetic oligonucleotide
tggtcgggacaagcccttcctgtctg

SEQ ID NO: 164660 - DNA, 25 bp, Artificial Sequence
  Description of Artificial Sequence: Synthetic oligonucleotide
ggtcgggacaagcccttcctgtctg

SEQ ID NO: 164661 - DNA, 25 bp, Artificial Sequence
  Description of Artificial Sequence: Synthetic oligonucleotide
gtcgggacaagcccttcctgtctgc

SEQ ID NO: 164662 - DNA, 26 bp, Artificial Sequence
  Description of Artificial Sequence: Synthetic oligonucleotide
tcgggacaagcccttcctgtctgcct

SEQ ID NO: 164663 - DNA, 25 bp, Artificial Sequence
  Description of Artificial Sequence: Synthetic oligonucleotide
cgggacaagcccttcctgtctgcct

SEQ ID NO: 164664 - DNA, 25 bp, Artificial Sequence
  Description of Artificial Sequence: Synthetic oligonucleotide
gggacaagcccttcctgtctgcctg

SEQ ID NO: 164665 - DNA, 26 bp, Artificial Sequence
  Description of Artificial Sequence: Synthetic oligonucleotide
taaggacccctcacgcctcgttggac

SEQ ID NO: 164666 - DNA, 25 bp, Artificial Sequence
  Description of Artificial Sequence: Synthetic oligonucleotide
aaggacccctcacgcctcgttggac

SEQ ID NO: 164667 - DNA, 24 bp, Artificial Sequence
  Description of Artificial Sequence: Synthetic oligonucleotide
aggacccctcacgcctcgttggac

SEQ ID NO: 164668 - DNA, 23 bp, Artificial Sequence
  Description of Artificial Sequence: Synthetic oligonucleotide
ggacccctcacgcctcgttggac

SEQ ID NO: 164669 - DNA, 25 bp, Artificial Sequence
  Description of Artificial Sequence: Synthetic oligonucleotide
gacccctcacgcctcgttggacgat

SEQ ID NO: 164670 - DNA, 25 bp, Artificial Sequence
  Description of Artificial Sequence: Synthetic oligonucleotide
acccctcacgcctcgttggacgatc

SEQ ID NO: 164671 - DNA, 24 bp, Artificial Sequence
  Description of Artificial Sequence: Synthetic oligonucleotide
cccctcacgcctcgttggacgatc

SEQ ID NO: 164672 - DNA, 26 bp, Artificial Sequence
  Description of Artificial Sequence: Synthetic oligonucleotide
ccctcacgcctcgttggacgatccat

SEQ ID NO: 164673 - DNA, 27 bp, Artificial Sequence
  Description of Artificial Sequence: Synthetic oligonucleotide
cctcacgcctcgttggacgatccatga

SEQ ID NO: 164674 - DNA, 28 bp, Artificial Sequence
  Description of Artificial Sequence: Synthetic oligonucleotide
ctcacgcctcgttggacgatccatgatg

SEQ ID NO: 164675 - DNA, 28 bp, Artificial Sequence
  Description of Artificial Sequence: Synthetic oligonucleotide
tcacgcctcgttggacgatccatgatgg

SEQ ID NO: 164676 - DNA, 27 bp, Artificial Sequence
  Description of Artificial Sequence: Synthetic oligonucleotide
cacgcctcgttggacgatccatgatgg

SEQ ID NO: 164677 - DNA, 27 bp, Artificial Sequence
  Description of Artificial Sequence: Synthetic oligonucleotide
acgcctcgttggacgatccatgatggg

SEQ ID NO: 164678 - DNA, 26 bp, Artificial Sequence
  Description of Artificial Sequence: Synthetic oligonucleotide
cgcctcgttggacgatccatgatggg

SEQ ID NO: 164679 - DNA, 27 bp, Artificial Sequence
  Description of Artificial Sequence: Synthetic oligonucleotide
gcctcgttggacgatccatgatggggt

SEQ ID NO: 164680 - DNA, 27 bp, Artificial Sequence
  Description of Artificial Sequence: Synthetic oligonucleotide
cctcgttggacgatccatgatggggtc

SEQ ID NO: 164681 - DNA, 28 bp, Artificial Sequence
  Description of Artificial Sequence: Synthetic oligonucleotide
ctcgttggacgatccatgatggggtctc

SEQ ID NO: 164682 - DNA, 28 bp, Artificial Sequence
  Description of Artificial Sequence: Synthetic oligonucleotide
tcgttggacgatccatgatggggtctcc

SEQ ID NO: 164683 - DNA, 27 bp, Artificial Sequence
  Description of Artificial Sequence: Synthetic oligonucleotide
cgttggacgatccatgatggggtctcc

SEQ ID NO: 164684 - DNA, 29 bp, Artificial Sequence
  Description of Artificial Sequence: Synthetic oligonucleotide
gttggacgatccatgatggggtctccaag

SEQ ID NO: 164685 - DNA, 29 bp, Artificial Sequence
  Description of Artificial Sequence: Synthetic oligonucleotide
ttggacgatccatgatggggtctccaagg

SEQ ID NO: 164686 - DNA, 28 bp, Artificial Sequence
  Description of Artificial Sequence: Synthetic oligonucleotide
tggacgatccatgatggggtctccaagg

SEQ ID NO: 164687 - DNA, 27 bp, Artificial Sequence
  Description of Artificial Sequence: Synthetic oligonucleotide
ggacgatccatgatggggtctccaagg

SEQ ID NO: 164688 - DNA, 27 bp, Artificial Sequence
  Description of Artificial Sequence: Synthetic oligonucleotide
gacgatccatgatggggtctccaaggc

SEQ ID NO: 164689 - DNA, 27 bp, Artificial Sequence
  Description of Artificial Sequence: Synthetic oligonucleotide
acgatccatgatggggtctccaaggcc

SEQ ID NO: 164690 - DNA, 27 bp, Artificial Sequence
  Description of Artificial Sequence: Synthetic oligonucleotide
cgatccatgatggggtctccaaggcca

SEQ ID NO: 164691 - DNA, 38 bp, Artificial Sequence
  Description of Artificial Sequence: Synthetic oligonucleotide
tacagataccatcttgtacacggaacttccaaatgctg

SEQ ID NO: 164692 - DNA, 37 bp, Artificial Sequence
  Description of Artificial Sequence: Synthetic oligonucleotide
acagataccatcttgtacacggaacttccaaatgctg

SEQ ID NO: 164693 - DNA, 36 bp, Artificial Sequence
  Description of Artificial Sequence: Synthetic oligonucleotide
cagataccatcttgtacacggaacttccaaatgctg

SEQ ID NO: 164694 - DNA, 37 bp, Artificial Sequence
  Description of Artificial Sequence: Synthetic oligonucleotide
agataccatcttgtacacggaacttccaaatgctgag

SEQ ID NO: 164695 - DNA, 36 bp, Artificial Sequence
  Description of Artificial Sequence: Synthetic oligonucleotide
gataccatcttgtacacggaacttccaaatgctgag

SEQ ID NO: 164696 - DNA, 36 bp, Artificial Sequence
  Description of Artificial Sequence: Synthetic oligonucleotide
ataccatcttgtacacggaacttccaaatgctgagc

SEQ ID NO: 164697 - DNA, 35 bp, Artificial Sequence
  Description of Artificial Sequence: Synthetic oligonucleotide
taccatcttgtacacggaacttccaaatgctgagc

SEQ ID NO: 164698 - DNA, 34 bp, Artificial Sequence
  Description of Artificial Sequence: Synthetic oligonucleotide
accatcttgtacacggaacttccaaatgctgagc

SEQ ID NO: 164699 - DNA, 33 bp, Artificial Sequence
  Description of Artificial Sequence: Synthetic oligonucleotide
ccatcttgtacacggaacttccaaatgctgagc

SEQ ID NO: 164700 - DNA, 33 bp, Artificial Sequence
  Description of Artificial Sequence: Synthetic oligonucleotide
catcttgtacacggaacttccaaatgctgagcc

SEQ ID NO: 164701 - DNA, 33 bp, Artificial Sequence
  Description of Artificial Sequence: Synthetic oligonucleotide
atcttgtacacggaacttccaaatgctgagccc

SEQ ID NO: 164702 - DNA, 32 bp, Artificial Sequence
  Description of Artificial Sequence: Synthetic oligonucleotide
tcttgtacacggaacttccaaatgctgagccc

SEQ ID NO: 164703 - DNA, 31 bp, Artificial Sequence
  Description of Artificial Sequence: Synthetic oligonucleotide
cttgtacacggaacttccaaatgctgagccc

SEQ ID NO: 164704 - DNA, 32 bp, Artificial Sequence
  Description of Artificial Sequence: Synthetic oligonucleotide
ttgtacacggaacttccaaatgctgagcccag

SEQ ID NO: 164705 - DNA, 27 bp, Artificial Sequence
  Description of Artificial Sequence: Synthetic oligonucleotide
agggaacagaacagccaacagcgaggc

SEQ ID NO: 164706 - DNA, 26 bp, Artificial Sequence
  Description of Artificial Sequence: Synthetic oligonucleotide
gggaacagaacagccaacagcgaggc

SEQ ID NO: 164707 - DNA, 27 bp, Artificial Sequence
  Description of Artificial Sequence: Synthetic oligonucleotide
ggaacagaacagccaacagcgaggcct

SEQ ID NO: 164708 - DNA, 27 bp, Artificial Sequence
  Description of Artificial Sequence: Synthetic oligonucleotide
gaacagaacagccaacagcgaggcctc

SEQ ID NO: 164709 - DNA, 28 bp, Artificial Sequence
  Description of Artificial Sequence: Synthetic oligonucleotide
aacagaacagccaacagcgaggcctctg

SEQ ID NO: 164710 - DNA, 27 bp, Artificial Sequence
  Description of Artificial Sequence: Synthetic oligonucleotide
acagaacagccaacagcgaggcctctg

SEQ ID NO: 164711 - DNA, 27 bp, Artificial Sequence
  Description of Artificial Sequence: Synthetic oligonucleotide
cagaacagccaacagcgaggcctctga

SEQ ID NO: 164712 - DNA, 28 bp, Artificial Sequence
  Description of Artificial Sequence: Synthetic oligonucleotide
agaacagccaacagcgaggcctctgatg

SEQ ID NO: 164713 - DNA, 27 bp, Artificial Sequence
  Description of Artificial Sequence: Synthetic oligonucleotide
gaacagccaacagcgaggcctctgatg

SEQ ID NO: 164714 - DNA, 29 bp, Artificial Sequence
  Description of Artificial Sequence: Synthetic oligonucleotide
aacagccaacagcgaggcctctgatgaac

SEQ ID NO: 164715 - DNA, 28 bp, Artificial Sequence
  Description of Artificial Sequence: Synthetic oligonucleotide
acagccaacagcgaggcctctgatgaac

SEQ ID NO: 164716 - DNA, 27 bp, Artificial Sequence
  Description of Artificial Sequence: Synthetic oligonucleotide
cagccaacagcgaggcctctgatgaac

SEQ ID NO: 164717 - DNA, 29 bp, Artificial Sequence
  Description of Artificial Sequence: Synthetic oligonucleotide
agccaacagcgaggcctctgatgaacaag

SEQ ID NO: 164718 - DNA, 28 bp, Artificial Sequence
  Description of Artificial Sequence: Synthetic oligonucleotide
gccaacagcgaggcctctgatgaacaag

SEQ ID NO: 164719 - DNA, 29 bp, Artificial Sequence
  Description of Artificial Sequence: Synthetic oligonucleotide
ccaacagcgaggcctctgatgaacaagac

SEQ ID NO: 164720 - DNA, 29 bp, Artificial Sequence
  Description of Artificial Sequence: Synthetic oligonucleotide
caacagcgaggcctctgatgaacaagacc

SEQ ID NO: 164721 - DNA, 29 bp, Artificial Sequence
  Description of Artificial Sequence: Synthetic oligonucleotide
aacagcgaggcctctgatgaacaagaccc

SEQ ID NO: 164722 - DNA, 28 bp, Artificial Sequence
  Description of Artificial Sequence: Synthetic oligonucleotide
acagcgaggcctctgatgaacaagaccc

SEQ ID NO: 164723 - DNA, 27 bp, Artificial Sequence
  Description of Artificial Sequence: Synthetic oligonucleotide
cagcgaggcctctgatgaacaagaccc

SEQ ID NO: 164724 - DNA, 28 bp, Artificial Sequence
  Description of Artificial Sequence: Synthetic oligonucleotide
agcgaggcctctgatgaacaagaccctg

SEQ ID NO: 164725 - DNA, 27 bp, Artificial Sequence
  Description of Artificial Sequence: Synthetic oligonucleotide
gcgaggcctctgatgaacaagaccctg

SEQ ID NO: 164726 - DNA, 28 bp, Artificial Sequence
  Description of Artificial Sequence: Synthetic oligonucleotide
cgaggcctctgatgaacaagaccctgag

SEQ ID NO: 164727 - DNA, 28 bp, Artificial Sequence
  Description of Artificial Sequence: Synthetic oligonucleotide
gaggcctctgatgaacaagaccctgagg

SEQ ID NO: 164728 - DNA, 29 bp, Artificial Sequence
  Description of Artificial Sequence: Synthetic oligonucleotide
aggcctctgatgaacaagaccctgaggag

SEQ ID NO: 164729 - DNA, 28 bp, Artificial Sequence
  Description of Artificial Sequence: Synthetic oligonucleotide
ggcctctgatgaacaagaccctgaggag

SEQ ID NO: 164730 - DNA, 28 bp, Artificial Sequence
  Description of Artificial Sequence: Synthetic oligonucleotide
gcctctgatgaacaagaccctgaggagg

SEQ ID NO: 164731 - DNA, 29 bp, Artificial Sequence
  Description of Artificial Sequence: Synthetic oligonucleotide
cctctgatgaacaagaccctgaggaggtg

SEQ ID NO: 164732 - DNA, 32 bp, Artificial Sequence
  Description of Artificial Sequence: Synthetic oligonucleotide
accacagcacatgcagggaactacacatgttg

SEQ ID NO: 164733 - DNA, 31 bp, Artificial Sequence
  Description of Artificial Sequence: Synthetic oligonucleotide
ccacagcacatgcagggaactacacatgttg

SEQ ID NO: 164734 - DNA, 31 bp, Artificial Sequence
  Description of Artificial Sequence: Synthetic oligonucleotide
cacagcacatgcagggaactacacatgttgg

SEQ ID NO: 164735 - DNA, 31 bp, Artificial Sequence
  Description of Artificial Sequence: Synthetic oligonucleotide
acagcacatgcagggaactacacatgttggg

SEQ ID NO: 164736 - DNA, 30 bp, Artificial Sequence
  Description of Artificial Sequence: Synthetic oligonucleotide
cagcacatgcagggaactacacatgttggg

SEQ ID NO: 164737 - DNA, 30 bp, Artificial Sequence
  Description of Artificial Sequence: Synthetic oligonucleotide
agcacatgcagggaactacacatgttgggg

SEQ ID NO: 164738 - DNA, 29 bp, Artificial Sequence
  Description of Artificial Sequence: Synthetic oligonucleotide
gcacatgcagggaactacacatgttgggg

SEQ ID NO: 164739 - DNA, 31 bp, Artificial Sequence
  Description of Artificial Sequence: Synthetic oligonucleotide
cacatgcagggaactacacatgttggggttc

SEQ ID NO: 164740 - DNA, 32 bp, Artificial Sequence
  Description of Artificial Sequence: Synthetic oligonucleotide
acatgcagggaactacacatgttggggttcac

SEQ ID NO: 164741 - DNA, 31 bp, Artificial Sequence
  Description of Artificial Sequence: Synthetic oligonucleotide
catgcagggaactacacatgttggggttcac

SEQ ID NO: 164742 - DNA, 32 bp, Artificial Sequence
  Description of Artificial Sequence: Synthetic oligonucleotide
atgcagggaactacacatgttggggttcacac

SEQ ID NO: 164743 - DNA, 31 bp, Artificial Sequence
  Description of Artificial Sequence: Synthetic oligonucleotide
tgcagggaactacacatgttggggttcacac

SEQ ID NO: 164744 - DNA, 30 bp, Artificial Sequence
  Description of Artificial Sequence: Synthetic oligonucleotide
gcagggaactacacatgttggggttcacac

SEQ ID NO: 164745 - DNA, 30 bp, Artificial Sequence
  Description of Artificial Sequence: Synthetic oligonucleotide
cagggaactacacatgttggggttcacacc

SEQ ID NO: 164746 - DNA, 30 bp, Artificial Sequence
  Description of Artificial Sequence: Synthetic oligonucleotide
agggaactacacatgttggggttcacaccc

SEQ ID NO: 164747 - DNA, 29 bp, Artificial Sequence
  Description of Artificial Sequence: Synthetic oligonucleotide
gggaactacacatgttggggttcacaccc

SEQ ID NO: 164748 - DNA, 30 bp, Artificial Sequence
  Description of Artificial Sequence: Synthetic oligonucleotide
ggaactacacatgttggggttcacacccac

SEQ ID NO: 164749 - DNA, 31 bp, Artificial Sequence
  Description of Artificial Sequence: Synthetic oligonucleotide
gaactacacatgttggggttcacacccacac

SEQ ID NO: 164750 - DNA, 32 bp, Artificial Sequence
  Description of Artificial Sequence: Synthetic oligonucleotide
aactacacatgttggggttcacacccacactc

SEQ ID NO: 164751 - DNA, 31 bp, Artificial Sequence
  Description of Artificial Sequence: Synthetic oligonucleotide
actacacatgttggggttcacacccacactc

SEQ ID NO: 164752 - DNA, 30 bp, Artificial Sequence
  Description of Artificial Sequence: Synthetic oligonucleotide
ctacacatgttggggttcacacccacactc

SEQ ID NO: 164753 - DNA, 30 bp, Artificial Sequence
  Description of Artificial Sequence: Synthetic oligonucleotide
tacacatgttggggttcacacccacactcc

SEQ ID NO: 164754 - DNA, 29 bp, Artificial Sequence
  Description of Artificial Sequence: Synthetic oligonucleotide
acacatgttggggttcacacccacactcc

SEQ ID NO: 164755 - DNA, 28 bp, Artificial Sequence
  Description of Artificial Sequence: Synthetic oligonucleotide
cacatgttggggttcacacccacactcc

SEQ ID NO: 164756 - DNA, 28 bp, Artificial Sequence
  Description of Artificial Sequence: Synthetic oligonucleotide
acatgttggggttcacacccacactccc

SEQ ID NO: 164757 - DNA, 27 bp, Artificial Sequence
  Description of Artificial Sequence: Synthetic oligonucleotide
catgttggggttcacacccacactccc

SEQ ID NO: 164758 - DNA, 27 bp, Artificial Sequence
  Description of Artificial Sequence: Synthetic oligonucleotide
atgttggggttcacacccacactcccc

SEQ ID NO: 164759 - DNA, 26 bp, Artificial Sequence
  Description of Artificial Sequence: Synthetic oligonucleotide
tgttggggttcacacccacactcccc

SEQ ID NO: 164760 - DNA, 25 bp, Artificial Sequence
  Description of Artificial Sequence: Synthetic oligonucleotide
gttggggttcacacccacactcccc

SEQ ID NO: 164761 - DNA, 26 bp, Artificial Sequence
  Description of Artificial Sequence: Synthetic oligonucleotide
ttggggttcacacccacactccccca

SEQ ID NO: 164762 - DNA, 25 bp, Artificial Sequence
  Description of Artificial Sequence: Synthetic oligonucleotide
tggggttcacacccacactccccca

SEQ ID NO: 164763 - DNA, 32 bp, Artificial Sequence
  Description of Artificial Sequence: Synthetic oligonucleotide
ctgcagtgcgcaaggtcaacagaacattcaag

SEQ ID NO: 164764 - DNA, 32 bp, Artificial Sequence
  Description of Artificial Sequence: Synthetic oligonucleotide
tgcagtgcgcaaggtcaacagaacattcaagg

SEQ ID NO: 164765 - DNA, 31 bp, Artificial Sequence
  Description of Artificial Sequence: Synthetic oligonucleotide
gcagtgcgcaaggtcaacagaacattcaagg

SEQ ID NO: 164766 - DNA, 31 bp, Artificial Sequence
  Description of Artificial Sequence: Synthetic oligonucleotide
cagtgcgcaaggtcaacagaacattcaaggc

SEQ ID NO: 164767 - DNA, 32 bp, Artificial Sequence
  Description of Artificial Sequence: Synthetic oligonucleotide
agtgcgcaaggtcaacagaacattcaaggcag

SEQ ID NO: 164768 - DNA, 31 bp, Artificial Sequence
  Description of Artificial Sequence: Synthetic oligonucleotide
gtgcgcaaggtcaacagaacattcaaggcag

SEQ ID NO: 164769 - DNA, 35 bp, Artificial Sequence
  Description of Artificial Sequence: Synthetic oligonucleotide
tgcgcaaggtcaacagaacattcaaggcagatttc

SEQ ID NO: 164770 - DNA, 34 bp, Artificial Sequence
  Description of Artificial Sequence: Synthetic oligonucleotide
gcgcaaggtcaacagaacattcaaggcagatttc

SEQ ID NO: 164771 - DNA, 34 bp, Artificial Sequence
  Description of Artificial Sequence: Synthetic oligonucleotide
cgcaaggtcaacagaacattcaaggcagatttcc

SEQ ID NO: 164772 - DNA, 34 bp, Artificial Sequence
  Description of Artificial Sequence: Synthetic oligonucleotide
gcaaggtcaacagaacattcaaggcagatttccc

SEQ ID NO: 164773 - DNA, 35 bp, Artificial Sequence
  Description of Artificial Sequence: Synthetic oligonucleotide
caaggtcaacagaacattcaaggcagatttccctc

SEQ ID NO: 164774 - DNA, 36 bp, Artificial Sequence
  Description of Artificial Sequence: Synthetic oligonucleotide
aaggtcaacagaacattcaaggcagatttccctctg

SEQ ID NO: 164775 - DNA, 35 bp, Artificial Sequence
  Description of Artificial Sequence: Synthetic oligonucleotide
aggtcaacagaacattcaaggcagatttccctctg

SEQ ID NO: 164776 - DNA, 34 bp, Artificial Sequence
  Description of Artificial Sequence: Synthetic oligonucleotide
ggtcaacagaacattcaaggcagatttccctctg

SEQ ID NO: 164777 - DNA, 34 bp, Artificial Sequence
  Description of Artificial Sequence: Synthetic oligonucleotide
gtcaacagaacattcaaggcagatttccctctgg

SEQ ID NO: 164778 - DNA, 34 bp, Artificial Sequence
  Description of Artificial Sequence: Synthetic oligonucleotide
tcaacagaacattcaaggcagatttccctctggg

SEQ ID NO: 164779 - DNA, 33 bp, Artificial Sequence
  Description of Artificial Sequence: Synthetic oligonucleotide
caacagaacattcaaggcagatttccctctggg

SEQ ID NO: 164780 - DNA, 33 bp, Artificial Sequence
  Description of Artificial Sequence: Synthetic oligonucleotide
aacagaacattcaaggcagatttccctctgggc

SEQ ID NO: 164781 - DNA, 32 bp, Artificial Sequence
  Description of Artificial Sequence: Synthetic oligonucleotide
acagaacattcaaggcagatttccctctgggc

SEQ ID NO: 164782 - DNA, 31 bp, Artificial Sequence
  Description of Artificial Sequence: Synthetic oligonucleotide
cagaacattcaaggcagatttccctctgggc

SEQ ID NO: 164783 - DNA, 31 bp, Artificial Sequence
  Description of Artificial Sequence: Synthetic oligonucleotide
agaacattcaaggcagatttccctctgggcc

SEQ ID NO: 164784 - DNA, 30 bp, Artificial Sequence
  Description of Artificial Sequence: Synthetic oligonucleotide
gaacattcaaggcagatttccctctgggcc

SEQ ID NO: 164785 - DNA, 30 bp, Artificial Sequence
  Description of Artificial Sequence: Synthetic oligonucleotide
aacattcaaggcagatttccctctgggccc

SEQ ID NO: 164786 - DNA, 29 bp, Artificial Sequence
  Description of Artificial Sequence: Synthetic oligonucleotide
acattcaaggcagatttccctctgggccc

SEQ ID NO: 164787 - DNA, 28 bp, Artificial Sequence
  Description of Artificial Sequence: Synthetic oligonucleotide
cattcaaggcagatttccctctgggccc

SEQ ID NO: 164788 - DNA, 29 bp, Artificial Sequence
  Description of Artificial Sequence: Synthetic oligonucleotide
attcaaggcagatttccctctgggccctg

SEQ ID NO: 164789 - DNA, 28 bp, Artificial Sequence
  Description of Artificial Sequence: Synthetic oligonucleotide
ttcaaggcagatttccctctgggccctg

SEQ ID NO: 164790 - DNA, 27 bp, Artificial Sequence
  Description of Artificial Sequence: Synthetic oligonucleotide
tcaaggcagatttccctctgggccctg

SEQ ID NO: 164791 - DNA, 26 bp, Artificial Sequence
  Description of Artificial Sequence: Synthetic oligonucleotide
caaggcagatttccctctgggccctg

SEQ ID NO: 164792 - DNA, 26 bp, Artificial Sequence
  Description of Artificial Sequence: Synthetic oligonucleotide
aaggcagatttccctctgggccctgc

SEQ ID NO: 164793 - DNA, 30 bp, Artificial Sequence
  Description of Artificial Sequence: Synthetic oligonucleotide
agggaactacacatgtcggggttcacacac

SEQ ID NO: 164794 - DNA, 29 bp, Artificial Sequence
  Description of Artificial Sequence: Synthetic oligonucleotide
gggaactacacatgtcggggttcacacac

SEQ ID NO: 164795 - DNA, 30 bp, Artificial Sequence
  Description of Artificial Sequence: Synthetic oligonucleotide
ggaactacacatgtcggggttcacacacac

SEQ ID NO: 164796 - DNA, 31 bp, Artificial Sequence
  Description of Artificial Sequence: Synthetic oligonucleotide
gaactacacatgtcggggttcacacacacac

SEQ ID NO: 164797 - DNA, 32 bp, Artificial Sequence
  Description of Artificial Sequence: Synthetic oligonucleotide
aactacacatgtcggggttcacacacacactc

SEQ ID NO: 164798 - DNA, 31 bp, Artificial Sequence
  Description of Artificial Sequence: Synthetic oligonucleotide
actacacatgtcggggttcacacacacactc

SEQ ID NO: 164799 - DNA, 30 bp, Artificial Sequence
  Description of Artificial Sequence: Synthetic oligonucleotide
ctacacatgtcggggttcacacacacactc

SEQ ID NO: 164800 - DNA, 30 bp, Artificial Sequence
  Description of Artificial Sequence: Synthetic oligonucleotide
tacacatgtcggggttcacacacacactcc

SEQ ID NO: 164801 - DNA, 29 bp, Artificial Sequence
  Description of Artificial Sequence: Synthetic oligonucleotide
acacatgtcggggttcacacacacactcc

SEQ ID NO: 164802 - DNA, 28 bp, Artificial Sequence
  Description of Artificial Sequence: Synthetic oligonucleotide
cacatgtcggggttcacacacacactcc

SEQ ID NO: 164803 - DNA, 28 bp, Artificial Sequence
  Description of Artificial Sequence: Synthetic oligonucleotide
acatgtcggggttcacacacacactccc

SEQ ID NO: 164804 - DNA, 27 bp, Artificial Sequence
  Description of Artificial Sequence: Synthetic oligonucleotide
catgtcggggttcacacacacactccc

SEQ ID NO: 164805 - DNA, 27 bp, Artificial Sequence
  Description of Artificial Sequence: Synthetic oligonucleotide
atgtcggggttcacacacacactcccc

SEQ ID NO: 164806 - DNA, 26 bp, Artificial Sequence
  Description of Artificial Sequence: Synthetic oligonucleotide
tgtcggggttcacacacacactcccc

SEQ ID NO: 164807 - DNA, 25 bp, Artificial Sequence
  Description of Artificial Sequence: Synthetic oligonucleotide
gtcggggttcacacacacactcccc

SEQ ID NO: 164808 - DNA, 26 bp, Artificial Sequence
  Description of Artificial Sequence: Synthetic oligonucleotide
tcggggttcacacacacactccccca

SEQ ID NO: 164809 - DNA, 25 bp, Artificial Sequence
  Description of Artificial Sequence: Synthetic oligonucleotide
cggggttcacacacacactccccca

SEQ ID NO: 164810 - DNA, 26 bp, Artificial Sequence
  Description of Artificial Sequence: Synthetic oligonucleotide
ggggttcacacacacactcccccact

SEQ ID NO: 164811 - DNA, 26 bp, Artificial Sequence
  Description of Artificial Sequence: Synthetic oligonucleotide
gggttcacacacacactcccccactg

SEQ ID NO: 164812 - DNA, 26 bp, Artificial Sequence
  Description of Artificial Sequence: Synthetic oligonucleotide
ggttcacacacacactcccccactgg

SEQ ID NO: 164813 - DNA, 27 bp, Artificial Sequence
  Description of Artificial Sequence: Synthetic oligonucleotide
gttcacacacacactcccccactgggt

SEQ ID NO: 164814 - DNA, 27 bp, Artificial Sequence
  Description of Artificial Sequence: Synthetic oligonucleotide
ttcacacacacactcccccactgggtg

SEQ ID NO: 164815 - DNA, 26 bp, Artificial Sequence
  Description of Artificial Sequence: Synthetic oligonucleotide
tcacacacacactcccccactgggtg

SEQ ID NO: 164816 - DNA, 25 bp, Artificial Sequence
  Description of Artificial Sequence: Synthetic oligonucleotide
cacacacacactcccccactgggtg

SEQ ID NO: 164817 - DNA, 26 bp, Artificial Sequence
  Description of Artificial Sequence: Synthetic oligonucleotide
acacacacactcccccactgggtggt

SEQ ID NO: 164818 - DNA, 25 bp, Artificial Sequence
  Description of Artificial Sequence: Synthetic oligonucleotide
cacacacactcccccactgggtggt

SEQ ID NO: 164819 - DNA, 25 bp, Artificial Sequence
  Description of Artificial Sequence: Synthetic oligonucleotide
acacacactcccccactgggtggtc

SEQ ID NO: 164820 - DNA, 24 bp, Artificial Sequence
  Description of Artificial Sequence: Synthetic oligonucleotide
cacacactcccccactgggtggtc

SEQ ID NO: 164821 - DNA, 24 bp, Artificial Sequence
  Description of Artificial Sequence: Synthetic oligonucleotide
acacactcccccactgggtggtcg

SEQ ID NO: 164822 - DNA, 24 bp, Artificial Sequence
  Description of Artificial Sequence: Synthetic oligonucleotide
ccacactcccccactgggtggtca

SEQ ID NO: 164823 - DNA, 24 bp, Artificial Sequence
  Description of Artificial Sequence: Synthetic oligonucleotide
cacactcccccactgggtggtcag

SEQ ID NO: 164824 - DNA, 25 bp, Artificial Sequence
  Description of Artificial Sequence: Synthetic oligonucleotide
acactcccccactgggtggtcagca

SEQ ID NO: 164825 - DNA, 24 bp, Artificial Sequence
  Description of Artificial Sequence: Synthetic oligonucleotide
cactcccccactgggtggtcagca

SEQ ID NO: 164826 - DNA, 24 bp, Artificial Sequence
  Description of Artificial Sequence: Synthetic oligonucleotide
actcccccactgggtggtcagcac

SEQ ID NO: 164827 - DNA, 23 bp, Artificial Sequence
  Description of Artificial Sequence: Synthetic oligonucleotide
ctcccccactgggtggtcagcac

SEQ ID NO: 164828 - DNA, 23 bp, Artificial Sequence
  Description of Artificial Sequence: Synthetic oligonucleotide
tcccccactgggtggtcagcacc

SEQ ID NO: 164829 - DNA, 22 bp, Artificial Sequence
  Description of Artificial Sequence: Synthetic oligonucleotide
cccccactgggtggtcagcacc

SEQ ID NO: 164830 - DNA, 23 bp, Artificial Sequence
  Description of Artificial Sequence: Synthetic oligonucleotide
ccccactgggtggtcagcaccca

SEQ ID NO: 164831 - DNA, 23 bp, Artificial Sequence
  Description of Artificial Sequence: Synthetic oligonucleotide
cccactgggtggtcagcacccag

SEQ ID NO: 164832 - DNA, 25 bp, Artificial Sequence
  Description of Artificial Sequence: Synthetic oligonucleotide
ccactgggtggtcagcacccagcaa

SEQ ID NO: 164833 - DNA, 25 bp, Artificial Sequence
  Description of Artificial Sequence: Synthetic oligonucleotide
cactgggtggtcagcacccagcaac

SEQ ID NO: 164834 - DNA, 25 bp, Artificial Sequence
  Description of Artificial Sequence: Synthetic oligonucleotide
actgggtggtcagcacccagcaacc

SEQ ID NO: 164835 - DNA, 24 bp, Artificial Sequence
  Description of Artificial Sequence: Synthetic oligonucleotide
ctgggtggtcagcacccagcaacc

SEQ ID NO: 164836 - DNA, 24 bp, Artificial Sequence
  Description of Artificial Sequence: Synthetic oligonucleotide
tgggtggtcagcacccagcaaccc

SEQ ID NO: 164837 - DNA, 23 bp, Artificial Sequence
  Description of Artificial Sequence: Synthetic oligonucleotide
gggtggtcagcacccagcaaccc

SEQ ID NO: 164838 - DNA, 23 bp, Artificial Sequence
  Description of Artificial Sequence: Synthetic oligonucleotide
ggtggtcagcacccagcaacccc

SEQ ID NO: 164839 - DNA, 24 bp, Artificial Sequence
  Description of Artificial Sequence: Synthetic oligonucleotide
gtggtcagcacccagcaaccccgt

SEQ ID NO: 164840 - DNA, 24 bp, Artificial Sequence
  Description of Artificial Sequence: Synthetic oligonucleotide
tggtcagcacccagcaaccccgtg

SEQ ID NO: 164841 - DNA, 23 bp, Artificial Sequence
  Description of Artificial Sequence: Synthetic oligonucleotide
ggtcagcacccagcaaccccgtg

SEQ ID NO: 164842 - DNA, 24 bp, Artificial Sequence
  Description of Artificial Sequence: Synthetic oligonucleotide
gtcagcacccagcaaccccgtggt

SEQ ID NO: 164843 - DNA, 26 bp, Artificial Sequence
  Description of Artificial Sequence: Synthetic oligonucleotide
tcagcacccagcaaccccgtggtgat

SEQ ID NO: 164844 - DNA, 25 bp, Artificial Sequence
  Description of Artificial Sequence: Synthetic oligonucleotide
cagcacccagcaaccccgtggtgat

SEQ ID NO: 164845 - DNA, 27 bp, Artificial Sequence
  Description of Artificial Sequence: Synthetic oligonucleotide
agcacccagcaaccccgtggtgatcat

SEQ ID NO: 164846 - DNA, 26 bp, Artificial Sequence
  Description of Artificial Sequence: Synthetic oligonucleotide
gatctctaaggacccctcacgcctcg

SEQ ID NO: 164847 - DNA, 27 bp, Artificial Sequence
  Description of Artificial Sequence: Synthetic oligonucleotide
atctctaaggacccctcacgcctcgct

SEQ ID NO: 164848 - DNA, 26 bp, Artificial Sequence
  Description of Artificial Sequence: Synthetic oligonucleotide
tctctaaggacccctcacgcctcgct

SEQ ID NO: 164849 - DNA, 25 bp, Artificial Sequence
  Description of Artificial Sequence: Synthetic oligonucleotide
ctctaaggacccctcacgcctcgct

SEQ ID NO: 164850 - DNA, 25 bp, Artificial Sequence
  Description of Artificial Sequence: Synthetic oligonucleotide
tctaaggacccctcacgcctcgctg

SEQ ID NO: 164851 - DNA, 24 bp, Artificial Sequence
  Description of Artificial Sequence: Synthetic oligonucleotide
ctaaggacccctcacgcctcgctg

SEQ ID NO: 164852 - DNA, 25 bp, Artificial Sequence
  Description of Artificial Sequence: Synthetic oligonucleotide
taaggacccctcacgcctcgctgga

SEQ ID NO: 164853 - DNA, 24 bp, Artificial Sequence
  Description of Artificial Sequence: Synthetic oligonucleotide
aaggacccctcacgcctcgctgga

SEQ ID NO: 164854 - DNA, 23 bp, Artificial Sequence
  Description of Artificial Sequence: Synthetic oligonucleotide
aggacccctcacgcctcgctgga

SEQ ID NO: 164855 - DNA, 22 bp, Artificial Sequence
  Description of Artificial Sequence: Synthetic oligonucleotide
ggacccctcacgcctcgctgga

SEQ ID NO: 164856 - DNA, 23 bp, Artificial Sequence
  Description of Artificial Sequence: Synthetic oligonucleotide
gacccctcacgcctcgctggaca

SEQ ID NO: 164857 - DNA, 25 bp, Artificial Sequence
  Description of Artificial Sequence: Synthetic oligonucleotide
acccctcacgcctcgctggacagat

SEQ ID NO: 164858 - DNA, 24 bp, Artificial Sequence
  Description of Artificial Sequence: Synthetic oligonucleotide
cccctcacgcctcgctggacagat

SEQ ID NO: 164859 - DNA, 24 bp, Artificial Sequence
  Description of Artificial Sequence: Synthetic oligonucleotide
ccctcacgcctcgctggacagatc

SEQ ID NO: 164860 - DNA, 26 bp, Artificial Sequence
  Description of Artificial Sequence: Synthetic oligonucleotide
cctcacgcctcgctggacagatccat

SEQ ID NO: 164861 - DNA, 27 bp, Artificial Sequence
  Description of Artificial Sequence: Synthetic oligonucleotide
ctcacgcctcgctggacagatccatga

SEQ ID NO: 164862 - DNA, 28 bp, Artificial Sequence
  Description of Artificial Sequence: Synthetic oligonucleotide
tcacgcctcgctggacagatccatgatg

SEQ ID NO: 164863 - DNA, 27 bp, Artificial Sequence
  Description of Artificial Sequence: Synthetic oligonucleotide
cacgcctcgctggacagatccatgatg

SEQ ID NO: 164864 - DNA, 27 bp, Artificial Sequence
  Description of Artificial Sequence: Synthetic oligonucleotide
acgcctcgctggacagatccatgatgg

SEQ ID NO: 164865 - DNA, 26 bp, Artificial Sequence
  Description of Artificial Sequence: Synthetic oligonucleotide
cgcctcgctggacagatccatgatgg

SEQ ID NO: 164866 - DNA, 26 bp, Artificial Sequence
  Description of Artificial Sequence: Synthetic oligonucleotide
gcctcgctggacagatccatgatggg

SEQ ID NO: 164867 - DNA, 27 bp, Artificial Sequence
  Description of Artificial Sequence: Synthetic oligonucleotide
cctcgctggacagatccatgatggggt

SEQ ID NO: 164868 - DNA, 27 bp, Artificial Sequence
  Description of Artificial Sequence: Synthetic oligonucleotide
ctcgctggacagatccatgatggggtc

SEQ ID NO: 164869 - DNA, 28 bp, Artificial Sequence
  Description of Artificial Sequence: Synthetic oligonucleotide
tcgctggacagatccatgatggggtctc

SEQ ID NO: 164870 - DNA, 27 bp, Artificial Sequence
  Description of Artificial Sequence: Synthetic oligonucleotide
cgctggacagatccatgatggggtctc

SEQ ID NO: 164871 - DNA, 27 bp, Artificial Sequence
  Description of Artificial Sequence: Synthetic oligonucleotide
gctggacagatccatgatggggtctcc

SEQ ID NO: 164872 - DNA, 29 bp, Artificial Sequence
  Description of Artificial Sequence: Synthetic oligonucleotide
ctggacagatccatgatggggtctccaag

SEQ ID NO: 164873 - DNA, 33 bp, Artificial Sequence
  Description of Artificial Sequence: Synthetic oligonucleotide
agcacttctttctgcacaaagaggggatctctg

SEQ ID NO: 164874 - DNA, 32 bp, Artificial Sequence
  Description of Artificial Sequence: Synthetic oligonucleotide
gcacttctttctgcacaaagaggggatctctg

SEQ ID NO: 164875 - DNA, 33 bp, Artificial Sequence
  Description of Artificial Sequence: Synthetic oligonucleotide
cacttctttctgcacaaagaggggatctctgag

SEQ ID NO: 164876 - DNA, 33 bp, Artificial Sequence
  Description of Artificial Sequence: Synthetic oligonucleotide
acttctttctgcacaaagaggggatctctgagg

SEQ ID NO: 164877 - DNA, 32 bp, Artificial Sequence
  Description of Artificial Sequence: Synthetic oligonucleotide
cttctttctgcacaaagaggggatctctgagg

SEQ ID NO: 164878 - DNA, 33 bp, Artificial Sequence
  Description of Artificial Sequence: Synthetic oligonucleotide
ttctttctgcacaaagaggggatctctgaggac

SEQ ID NO: 164879 - DNA, 32 bp, Artificial Sequence
  Description of Artificial Sequence: Synthetic oligonucleotide
tctttctgcacaaagaggggatctctgaggac

SEQ ID NO: 164880 - DNA, 31 bp, Artificial Sequence
  Description of Artificial Sequence: Synthetic oligonucleotide
ctttctgcacaaagaggggatctctgaggac

SEQ ID NO: 164881 - DNA, 31 bp, Artificial Sequence
  Description of Artificial Sequence: Synthetic oligonucleotide
tttctgcacaaagaggggatctctgaggacc

SEQ ID NO: 164882 - DNA, 30 bp, Artificial Sequence
  Description of Artificial Sequence: Synthetic oligonucleotide
ttctgcacaaagaggggatctctgaggacc

SEQ ID NO: 164883 - DNA, 29 bp, Artificial Sequence
  Description of Artificial Sequence: Synthetic oligonucleotide
tctgcacaaagaggggatctctgaggacc

SEQ ID NO: 164884 - DNA, 28 bp, Artificial Sequence
  Description of Artificial Sequence: Synthetic oligonucleotide
ctgcacaaagaggggatctctgaggacc

SEQ ID NO: 164885 - DNA, 28 bp, Artificial Sequence
  Description of Artificial Sequence: Synthetic oligonucleotide
tgcacaaagaggggatctctgaggaccc

SEQ ID NO: 164886 - DNA, 27 bp, Artificial Sequence
  Description of Artificial Sequence: Synthetic oligonucleotide
gcacaaagaggggatctctgaggaccc

SEQ ID NO: 164887 - DNA, 27 bp, Artificial Sequence
  Description of Artificial Sequence: Synthetic oligonucleotide
cacaaagaggggatctctgaggacccc

SEQ ID NO: 164888 - DNA, 28 bp, Artificial Sequence
  Description of Artificial Sequence: Synthetic oligonucleotide
acaaagaggggatctctgaggacccctc

SEQ ID NO: 164889 - DNA, 27 bp, Artificial Sequence
  Description of Artificial Sequence: Synthetic oligonucleotide
caaagaggggatctctgaggacccctc

SEQ ID NO: 164890 - DNA, 28 bp, Artificial Sequence
  Description of Artificial Sequence: Synthetic oligonucleotide
aaagaggggatctctgaggacccctcac

SEQ ID NO: 164891 - DNA, 27 bp, Artificial Sequence
  Description of Artificial Sequence: Synthetic oligonucleotide
aagaggggatctctgaggacccctcac

SEQ ID NO: 164892 - DNA, 26 bp, Artificial Sequence
  Description of Artificial Sequence: Synthetic oligonucleotide
agaggggatctctgaggacccctcac

SEQ ID NO: 164893 - DNA, 25 bp, Artificial Sequence
  Description of Artificial Sequence: Synthetic oligonucleotide
gaggggatctctgaggacccctcac

SEQ ID NO: 164894 - DNA, 25 bp, Artificial Sequence
  Description of Artificial Sequence: Synthetic oligonucleotide
aggggatctctgaggacccctcacg

SEQ ID NO: 164895 - DNA, 24 bp, Artificial Sequence
  Description of Artificial Sequence: Synthetic oligonucleotide
ggggatctctgaggacccctcacg

SEQ ID NO: 164896 - DNA, 24 bp, Artificial Sequence
  Description of Artificial Sequence: Synthetic oligonucleotide
gggatctctgaggacccctcacgc

SEQ ID NO: 164897 - DNA, 25 bp, Artificial Sequence
  Description of Artificial Sequence: Synthetic oligonucleotide
ggatctctgaggacccctcacgcct

SEQ ID NO: 164898 - DNA, 25 bp, Artificial Sequence
  Description of Artificial Sequence: Synthetic oligonucleotide
gatctctgaggacccctcacgcctc

SEQ ID NO: 164899 - DNA, 27 bp, Artificial Sequence
  Description of Artificial Sequence: Synthetic oligonucleotide
atctctgaggacccctcacgcctcgtt

SEQ ID NO: 164900 - DNA, 26 bp, Artificial Sequence
  Description of Artificial Sequence: Synthetic oligonucleotide
tctctgaggacccctcacgcctcgtt

SEQ ID NO: 164901 - DNA, 25 bp, Artificial Sequence
  Description of Artificial Sequence: Synthetic oligonucleotide
ctctgaggacccctcacgcctcgtt

SEQ ID NO: 164902 - DNA, 25 bp, Artificial Sequence
  Description of Artificial Sequence: Synthetic oligonucleotide
tctgaggacccctcacgcctcgttg

SEQ ID NO: 164903 - DNA, 24 bp, Artificial Sequence
  Description of Artificial Sequence: Synthetic oligonucleotide
ctgaggacccctcacgcctcgttg

SEQ ID NO: 164904 - DNA, 25 bp, Artificial Sequence
  Description of Artificial Sequence: Synthetic oligonucleotide
tgaggacccctcacgcctcgttgga

SEQ ID NO: 164905 - DNA, 24 bp, Artificial Sequence
  Description of Artificial Sequence: Synthetic oligonucleotide
gaggacccctcacgcctcgttgga

SEQ ID NO: 164906 - DNA, 34 bp, Artificial Sequence
  Description of Artificial Sequence: Synthetic oligonucleotide
agctcctatgacatgtaccatctatccagggatg

SEQ ID NO: 164907 - DNA, 33 bp, Artificial Sequence
  Description of Artificial Sequence: Synthetic oligonucleotide
gctcctatgacatgtaccatctatccagggatg

SEQ ID NO: 164908 - DNA, 33 bp, Artificial Sequence
  Description of Artificial Sequence: Synthetic oligonucleotide
ctcctatgacatgtaccatctatccagggatgg

SEQ ID NO: 164909 - DNA, 33 bp, Artificial Sequence
  Description of Artificial Sequence: Synthetic oligonucleotide
tcctatgacatgtaccatctatccagggatggg

SEQ ID NO: 164910 - DNA, 32 bp, Artificial Sequence
  Description of Artificial Sequence: Synthetic oligonucleotide
cctatgacatgtaccatctatccagggatggg

SEQ ID NO: 164911 - DNA, 32 bp, Artificial Sequence
  Description of Artificial Sequence: Synthetic oligonucleotide
ctatgacatgtaccatctatccagggatgggg

SEQ ID NO: 164912 - DNA, 32 bp, Artificial Sequence
  Description of Artificial Sequence: Synthetic oligonucleotide
tatgacatgtaccatctatccagggatggggg

SEQ ID NO: 164913 - DNA, 31 bp, Artificial Sequence
  Description of Artificial Sequence: Synthetic oligonucleotide
atgacatgtaccatctatccagggatggggg

SEQ ID NO: 164914 - DNA, 30 bp, Artificial Sequence
  Description of Artificial Sequence: Synthetic oligonucleotide
tgacatgtaccatctatccagggatggggg

SEQ ID NO: 164915 - DNA, 29 bp, Artificial Sequence
  Description of Artificial Sequence: Synthetic oligonucleotide
gacatgtaccatctatccagggatggggg

SEQ ID NO: 164916 - DNA, 30 bp, Artificial Sequence
  Description of Artificial Sequence: Synthetic oligonucleotide
acatgtaccatctatccagggatgggggag

SEQ ID NO: 164917 - DNA, 29 bp, Artificial Sequence
  Description of Artificial Sequence: Synthetic oligonucleotide
catgtaccatctatccagggatgggggag

SEQ ID NO: 164918 - DNA, 29 bp, Artificial Sequence
  Description of Artificial Sequence: Synthetic oligonucleotide
atgtaccatctatccagggatgggggagc

SEQ ID NO: 164919 - DNA, 28 bp, Artificial Sequence
  Description of Artificial Sequence: Synthetic oligonucleotide
tgtaccatctatccagggatgggggagc

SEQ ID NO: 164920 - DNA, 27 bp, Artificial Sequence
  Description of Artificial Sequence: Synthetic oligonucleotide
gtaccatctatccagggatgggggagc

SEQ ID NO: 164921 - DNA, 27 bp, Artificial Sequence
  Description of Artificial Sequence: Synthetic oligonucleotide
taccatctatccagggatgggggagcc

SEQ ID NO: 164922 - DNA, 26 bp, Artificial Sequence
  Description of Artificial Sequence: Synthetic oligonucleotide
accatctatccagggatgggggagcc

SEQ ID NO: 164923 - DNA, 25 bp, Artificial Sequence
  Description of Artificial Sequence: Synthetic oligonucleotide
ccatctatccagggatgggggagcc

SEQ ID NO: 164924 - DNA, 27 bp, Artificial Sequence
  Description of Artificial Sequence: Synthetic oligonucleotide
catctatccagggatgggggagcccat

SEQ ID NO: 164925 - DNA, 27 bp, Artificial Sequence
  Description of Artificial Sequence: Synthetic oligonucleotide
atctatccagggatgggggagcccatg

SEQ ID NO: 164926 - DNA, 27 bp, Artificial Sequence
  Description of Artificial Sequence: Synthetic oligonucleotide
tctatccagggatgggggagcccatga

SEQ ID NO: 164927 - DNA, 27 bp, Artificial Sequence
  Description of Artificial Sequence: Synthetic oligonucleotide
ctatccagggatgggggagcccatgaa

SEQ ID NO: 164928 - DNA, 27 bp, Artificial Sequence
  Description of Artificial Sequence: Synthetic oligonucleotide
tatccagggatgggggagcccatgaac

SEQ ID NO: 164929 - DNA, 26 bp, Artificial Sequence
  Description of Artificial Sequence: Synthetic oligonucleotide
atccagggatgggggagcccatgaac

SEQ ID NO: 164930 - DNA, 25 bp, Artificial Sequence
  Description of Artificial Sequence: Synthetic oligonucleotide
tccagggatgggggagcccatgaac

SEQ ID NO: 164931 - DNA, 24 bp, Artificial Sequence
  Description of Artificial Sequence: Synthetic oligonucleotide
ccagggatgggggagcccatgaac

SEQ ID NO: 164932 - DNA, 26 bp, Artificial Sequence
  Description of Artificial Sequence: Synthetic oligonucleotide
cagggatgggggagcccatgaacgta

SEQ ID NO: 164933 - DNA, 26 bp, Artificial Sequence
  Description of Artificial Sequence: Synthetic oligonucleotide
agggatgggggagcccatgaacgtag

SEQ ID NO: 164934 - DNA, 25 bp, Artificial Sequence
  Description of Artificial Sequence: Synthetic oligonucleotide
gggatgggggagcccatgaacgtag

SEQ ID NO: 164935 - DNA, 25 bp, Artificial Sequence
  Description of Artificial Sequence: Synthetic oligonucleotide
ggatgggggagcccatgaacgtagg

SEQ ID NO: 164936 - DNA, 26 bp, Artificial Sequence
  Description of Artificial Sequence: Synthetic oligonucleotide
gatgggggagcccatgaacgtaggct

SEQ ID NO: 164937 - DNA, 26 bp, Artificial Sequence
  Description of Artificial Sequence: Synthetic oligonucleotide
atgggggagcccatgaacgtaggctc

SEQ ID NO: 164938 - DNA, 25 bp, Artificial Sequence
  Description of Artificial Sequence: Synthetic oligonucleotide
tgggggagcccatgaacgtaggctc

SEQ ID NO: 164939 - DNA, 31 bp, Artificial Sequence
  Description of Artificial Sequence: Synthetic oligonucleotide
gacacgtgactcttcggtgtcactatcatcg

SEQ ID NO: 164940 - DNA, 33 bp, Artificial Sequence
  Description of Artificial Sequence: Synthetic oligonucleotide
acacgtgactcttcggtgtcactatcatcgtag

SEQ ID NO: 164941 - DNA, 32 bp, Artificial Sequence
  Description of Artificial Sequence: Synthetic oligonucleotide
cacgtgactcttcggtgtcactatcatcgtag

SEQ ID NO: 164942 - DNA, 32 bp, Artificial Sequence
  Description of Artificial Sequence: Synthetic oligonucleotide
acgtgactcttcggtgtcactatcatcgtagg

SEQ ID NO: 164943 - DNA, 31 bp, Artificial Sequence
  Description of Artificial Sequence: Synthetic oligonucleotide
cgtgactcttcggtgtcactatcatcgtagg

SEQ ID NO: 164944 - DNA, 36 bp, Artificial Sequence
  Description of Artificial Sequence: Synthetic oligonucleotide
gtgactcttcggtgtcactatcatcgtaggtttaac

SEQ ID NO: 164945 - DNA, 41 bp, Artificial Sequence
  Description of Artificial Sequence: Synthetic oligonucleotide
tgactcttcggtgtcactatcatcgtaggtttaacaatttc

SEQ ID NO: 164946 - DNA, 40 bp, Artificial Sequence
  Description of Artificial Sequence: Synthetic oligonucleotide
gactcttcggtgtcactatcatcgtaggtttaacaatttc

SEQ ID NO: 164947 - DNA, 42 bp, Artificial Sequence
  Description of Artificial Sequence: Synthetic oligonucleotide
actcttcggtgtcactatcatcgtaggtttaacaatttcatg

SEQ ID NO: 164948 - DNA, 41 bp, Artificial Sequence
  Description of Artificial Sequence: Synthetic oligonucleotide
ctcttcggtgtcactatcatcgtaggtttaacaatttcatg

SEQ ID NO: 164949 - DNA, 41 bp, Artificial Sequence
  Description of Artificial Sequence: Synthetic oligonucleotide
tcttcggtgtcactatcatcgtaggtttaacaatttcatgc

SEQ ID NO: 164950 - DNA, 40 bp, Artificial Sequence
  Description of Artificial Sequence: Synthetic oligonucleotide
cttcggtgtcactatcatcgtaggtttaacaatttcatgc

SEQ ID NO: 164951 - DNA, 44 bp, Artificial Sequence
  Description of Artificial Sequence: Synthetic oligonucleotide
ttcggtgtcactatcatcgtaggtttaacaatttcatgctatac

SEQ ID NO: 164952 - DNA, 43 bp, Artificial Sequence
  Description of Artificial Sequence: Synthetic oligonucleotide
tcggtgtcactatcatcgtaggtttaacaatttcatgctatac

SEQ ID NO: 164953 - DNA, 42 bp, Artificial Sequence
  Description of Artificial Sequence: Synthetic oligonucleotide
cggtgtcactatcatcgtaggtttaacaatttcatgctatac

SEQ ID NO: 164954 - DNA, 45 bp, Artificial Sequence
  Description of Artificial Sequence: Synthetic oligonucleotide
ggtgtcactatcatcgtaggtttaacaatttcatgctatacaaag

SEQ ID NO: 164955 - DNA, 47 bp, Artificial Sequence
  Description of Artificial Sequence: Synthetic oligonucleotide
gtgtcactatcatcgtaggtttaacaatttcatgctatacaaagaag

SEQ ID NO: 164956 - DNA, 48 bp, Artificial Sequence
  Description of Artificial Sequence: Synthetic oligonucleotide
tgtcactatcatcgtaggtttaacaatttcatgctatacaaagaagac

SEQ ID NO: 164957 - DNA, 47 bp, Artificial Sequence
  Description of Artificial Sequence: Synthetic oligonucleotide
gtcactatcatcgtaggtttaacaatttcatgctatacaaagaagac

SEQ ID NO: 164958 - DNA, 47 bp, Artificial Sequence
  Description of Artificial Sequence: Synthetic oligonucleotide
tcactatcatcgtaggtttaacaatttcatgctatacaaagaagacg

SEQ ID NO: 164959 - DNA, 46 bp, Artificial Sequence
  Description of Artificial Sequence: Synthetic oligonucleotide
cactatcatcgtaggtttaacaatttcatgctatacaaagaagacg

SEQ ID NO: 164960 - DNA, 46 bp, Artificial Sequence
  Description of Artificial Sequence: Synthetic oligonucleotide
actatcatcgtaggtttaacaatttcatgctatacaaagaagacgg

SEQ ID NO: 164961 - DNA, 45 bp, Artificial Sequence
  Description of Artificial Sequence: Synthetic oligonucleotide
ctatcatcgtaggtttaacaatttcatgctatacaaagaagacgg

SEQ ID NO: 164962 - DNA, 48 bp, Artificial Sequence
  Description of Artificial Sequence: Synthetic oligonucleotide
tatcatcgtaggtttaacaatttcatgctatacaaagaagacggaatc

SEQ ID NO: 164963 - DNA, 47 bp, Artificial Sequence
  Description of Artificial Sequence: Synthetic oligonucleotide
atcatcgtaggtttaacaatttcatgctatacaaagaagacggaatc

SEQ ID NO: 164964 - DNA, 46 bp, Artificial Sequence
  Description of Artificial Sequence: Synthetic oligonucleotide
tcatcgtaggtttaacaatttcatgctatacaaagaagacggaatc

SEQ ID NO: 164965 - DNA, 45 bp, Artificial Sequence
  Description of Artificial Sequence: Synthetic oligonucleotide
catcgtaggtttaacaatttcatgctatacaaagaagacggaatc

SEQ ID NO: 164966 - DNA, 45 bp, Artificial Sequence
  Description of Artificial Sequence: Synthetic oligonucleotide
atcgtaggtttaacaatttcatgctatacaaagaagacggaatcc

SEQ ID NO: 164967 - DNA, 44 bp, Artificial Sequence
  Description of Artificial Sequence: Synthetic oligonucleotide
tcgtaggtttaacaatttcatgctatacaaagaagacggaatcc

SEQ ID NO: 164968 - DNA, 43 bp, Artificial Sequence
  Description of Artificial Sequence: Synthetic oligonucleotide
cgtaggtttaacaatttcatgctatacaaagaagacggaatcc

SEQ ID NO: 164969 - DNA, 44 bp, Artificial Sequence
  Description of Artificial Sequence: Synthetic oligonucleotide
gtaggtttaacaatttcatgctatacaaagaagacggaatccac

SEQ ID NO: 164970 - DNA, 34 bp, Artificial Sequence
  Description of Artificial Sequence: Synthetic oligonucleotide
tggacatcgtggtcacaggtccatatgagaaaac

SEQ ID NO: 164971 - DNA, 33 bp, Artificial Sequence
  Description of Artificial Sequence: Synthetic oligonucleotide
ggacatcgtggtcacaggtccatatgagaaaac

SEQ ID NO: 164972 - DNA, 35 bp, Artificial Sequence
  Description of Artificial Sequence: Synthetic oligonucleotide
gacatcgtggtcacaggtccatatgagaaaacttc

SEQ ID NO: 164973 - DNA, 36 bp, Artificial Sequence
  Description of Artificial Sequence: Synthetic oligonucleotide
acatcgtggtcacaggtccatatgagaaaacttctc

SEQ ID NO: 164974 - DNA, 35 bp, Artificial Sequence
  Description of Artificial Sequence: Synthetic oligonucleotide
catcgtggtcacaggtccatatgagaaaacttctc

SEQ ID NO: 164975 - DNA, 36 bp, Artificial Sequence
  Description of Artificial Sequence: Synthetic oligonucleotide
atcgtggtcacaggtccatatgagaaaacttctctc

SEQ ID NO: 164976 - DNA, 35 bp, Artificial Sequence
  Description of Artificial Sequence: Synthetic oligonucleotide
tcgtggtcacaggtccatatgagaaaacttctctc

SEQ ID NO: 164977 - DNA, 34 bp, Artificial Sequence
  Description of Artificial Sequence: Synthetic oligonucleotide
cgtggtcacaggtccatatgagaaaacttctctc

SEQ ID NO: 164978 - DNA, 35 bp, Artificial Sequence
  Description of Artificial Sequence: Synthetic oligonucleotide
gtggtcacaggtccatatgagaaaacttctctctc

SEQ ID NO: 164979 - DNA, 36 bp, Artificial Sequence
  Description of Artificial Sequence: Synthetic oligonucleotide
tggtcacaggtccatatgagaaaacttctctctcag

SEQ ID NO: 164980 - DNA, 35 bp, Artificial Sequence
  Description of Artificial Sequence: Synthetic oligonucleotide
ggtcacaggtccatatgagaaaacttctctctcag

SEQ ID NO: 164981 - DNA, 35 bp, Artificial Sequence
  Description of Artificial Sequence: Synthetic oligonucleotide
gtcacaggtccatatgagaaaacttctctctcagc

SEQ ID NO: 164982 - DNA, 35 bp, Artificial Sequence
  Description of Artificial Sequence: Synthetic oligonucleotide
tcacaggtccatatgagaaaacttctctctcagcc

SEQ ID NO: 164983 - DNA, 34 bp, Artificial Sequence
  Description of Artificial Sequence: Synthetic oligonucleotide
cacaggtccatatgagaaaacttctctctcagcc

SEQ ID NO: 164984 - DNA, 34 bp, Artificial Sequence
  Description of Artificial Sequence: Synthetic oligonucleotide
acaggtccatatgagaaaacttctctctcagccc

SEQ ID NO: 164985 - DNA, 33 bp, Artificial Sequence
  Description of Artificial Sequence: Synthetic oligonucleotide
caggtccatatgagaaaacttctctctcagccc

SEQ ID NO: 164986 - DNA, 34 bp, Artificial Sequence
  Description of Artificial Sequence: Synthetic oligonucleotide
aggtccatatgagaaaacttctctctcagcccag

SEQ ID NO: 164987 - DNA, 33 bp, Artificial Sequence
  Description of Artificial Sequence: Synthetic oligonucleotide
ggtccatatgagaaaacttctctctcagcccag

SEQ ID NO: 164988 - DNA, 33 bp, Artificial Sequence
  Description of Artificial Sequence: Synthetic oligonucleotide
gtccatatgagaaaacttctctctcagcccagc

SEQ ID NO: 164989 - DNA, 33 bp, Artificial Sequence
  Description of Artificial Sequence: Synthetic oligonucleotide
tccatatgagaaaacttctctctcagcccagcc

SEQ ID NO: 164990 - DNA, 32 bp, Artificial Sequence
  Description of Artificial Sequence: Synthetic oligonucleotide
ccatatgagaaaacttctctctcagcccagcc

SEQ ID NO: 164991 - DNA, 32 bp, Artificial Sequence
  Description of Artificial Sequence: Synthetic oligonucleotide
catatgagaaaacttctctctcagcccagccg

SEQ ID NO: 164992 - DNA, 32 bp, Artificial Sequence
  Description of Artificial Sequence: Synthetic oligonucleotide
atatgagaaaacttctctctcagcccagccgg

SEQ ID NO: 164993 - DNA, 31 bp, Artificial Sequence
  Description of Artificial Sequence: Synthetic oligonucleotide
tatgagaaaacttctctctcagcccagccgg

SEQ ID NO: 164994 - DNA, 30 bp, Artificial Sequence
  Description of Artificial Sequence: Synthetic oligonucleotide
atgagaaaacttctctctcagcccagccgg

SEQ ID NO: 164995 - DNA, 29 bp, Artificial Sequence
  Description of Artificial Sequence: Synthetic oligonucleotide
tgagaaaacttctctctcagcccagccgg

SEQ ID NO: 164996 - DNA, 28 bp, Artificial Sequence
  Description of Artificial Sequence: Synthetic oligonucleotide
gagaaaacttctctctcagcccagccgg

SEQ ID NO: 164997 - DNA, 28 bp, Artificial Sequence
  Description of Artificial Sequence: Synthetic oligonucleotide
agaaaacttctctctcagcccagccggg

SEQ ID NO: 164998 - DNA, 27 bp, Artificial Sequence
  Description of Artificial Sequence: Synthetic oligonucleotide
gaaaacttctctctcagcccagccggg

SEQ ID NO: 164999 - DNA, 27 bp, Artificial Sequence
  Description of Artificial Sequence: Synthetic oligonucleotide
aaaacttctctctcagcccagccgggc

SEQ ID NO: 165000 - DNA, 26 bp, Artificial Sequence
  Description of Artificial Sequence: Synthetic oligonucleotide
aaacttctctctcagcccagccgggc

SEQ ID NO: 165001 - DNA, 25 bp, Artificial Sequence
  Description of Artificial Sequence: Synthetic oligonucleotide
aacttctctctcagcccagccgggc

SEQ ID NO: 165002 - DNA, 24 bp, Artificial Sequence
  Description of Artificial Sequence: Synthetic oligonucleotide
acttctctctcagcccagccgggc

SEQ ID NO: 165003 - DNA, 28 bp, Artificial Sequence
  Description of Artificial Sequence: Synthetic oligonucleotide
caggtcccctggtgaaatcaggagagac

SEQ ID NO: 165004 - DNA, 29 bp, Artificial Sequence
  Description of Artificial Sequence: Synthetic oligonucleotide
aggtcccctggtgaaatcaggagagacag

SEQ ID NO: 165005 - DNA, 28 bp, Artificial Sequence
  Description of Artificial Sequence: Synthetic oligonucleotide
ggtcccctggtgaaatcaggagagacag

SEQ ID NO: 165006 - DNA, 29 bp, Artificial Sequence
  Description of Artificial Sequence: Synthetic oligonucleotide
gtcccctggtgaaatcaggagagacagtc

SEQ ID NO: 165007 - DNA, 31 bp, Artificial Sequence
  Description of Artificial Sequence: Synthetic oligonucleotide
tcccctggtgaaatcaggagagacagtcatc

SEQ ID NO: 165008 - DNA, 30 bp, Artificial Sequence
  Description of Artificial Sequence: Synthetic oligonucleotide
cccctggtgaaatcaggagagacagtcatc

SEQ ID NO: 165009 - DNA, 30 bp, Artificial Sequence
  Description of Artificial Sequence: Synthetic oligonucleotide
ccctggtgaaatcaggagagacagtcatcc

SEQ ID NO: 165010 - DNA, 31 bp, Artificial Sequence
  Description of Artificial Sequence: Synthetic oligonucleotide
cctggtgaaatcaggagagacagtcatcctg

SEQ ID NO: 165011 - DNA, 31 bp, Artificial Sequence
  Description of Artificial Sequence: Synthetic oligonucleotide
ctggtgaaatcaggagagacagtcatcctgc

SEQ ID NO: 165012 - DNA, 34 bp, Artificial Sequence
  Description of Artificial Sequence: Synthetic oligonucleotide
tggtgaaatcaggagagacagtcatcctgcaatg

SEQ ID NO: 165013 - DNA, 33 bp, Artificial Sequence
  Description of Artificial Sequence: Synthetic oligonucleotide
ggtgaaatcaggagagacagtcatcctgcaatg

SEQ ID NO: 165014 - DNA, 35 bp, Artificial Sequence
  Description of Artificial Sequence: Synthetic oligonucleotide
gtgaaatcaggagagacagtcatcctgcaatgttg

SEQ ID NO: 165015 - DNA, 35 bp, Artificial Sequence
  Description of Artificial Sequence: Synthetic oligonucleotide
tgaaatcaggagagacagtcatcctgcaatgttgg

SEQ ID NO: 165016 - DNA, 34 bp, Artificial Sequence
  Description of Artificial Sequence: Synthetic oligonucleotide
gaaatcaggagagacagtcatcctgcaatgttgg

SEQ ID NO: 165017 - DNA, 35 bp, Artificial Sequence
  Description of Artificial Sequence: Synthetic oligonucleotide
aaatcaggagagacagtcatcctgcaatgttggtc

SEQ ID NO: 165018 - DNA, 34 bp, Artificial Sequence
  Description of Artificial Sequence: Synthetic oligonucleotide
aatcaggagagacagtcatcctgcaatgttggtc

SEQ ID NO: 165019 - DNA, 33 bp, Artificial Sequence
  Description of Artificial Sequence: Synthetic oligonucleotide
atcaggagagacagtcatcctgcaatgttggtc

SEQ ID NO: 165020 - DNA, 32 bp, Artificial Sequence
  Description of Artificial Sequence: Synthetic oligonucleotide
tcaggagagacagtcatcctgcaatgttggtc

SEQ ID NO: 165021 - DNA, 31 bp, Artificial Sequence
  Description of Artificial Sequence: Synthetic oligonucleotide
caggagagacagtcatcctgcaatgttggtc

SEQ ID NO: 165022 - DNA, 32 bp, Artificial Sequence
  Description of Artificial Sequence: Synthetic oligonucleotide
aggagagacagtcatcctgcaatgttggtcag

SEQ ID NO: 165023 - DNA, 31 bp, Artificial Sequence
  Description of Artificial Sequence: Synthetic oligonucleotide
ggagagacagtcatcctgcaatgttggtcag

SEQ ID NO: 165024 - DNA, 35 bp, Artificial Sequence
  Description of Artificial Sequence: Synthetic oligonucleotide
gagagacagtcatcctgcaatgttggtcagatatc

SEQ ID NO: 165025 - DNA, 37 bp, Artificial Sequence
  Description of Artificial Sequence: Synthetic oligonucleotide
agagacagtcatcctgcaatgttggtcagatatcatg

SEQ ID NO: 165026 - DNA, 36 bp, Artificial Sequence
  Description of Artificial Sequence: Synthetic oligonucleotide
gagacagtcatcctgcaatgttggtcagatatcatg

SEQ ID NO: 165027 - DNA, 39 bp, Artificial Sequence
  Description of Artificial Sequence: Synthetic oligonucleotide
agacagtcatcctgcaatgttggtcagatatcatgtttg

SEQ ID NO: 165028 - DNA, 38 bp, Artificial Sequence
  Description of Artificial Sequence: Synthetic oligonucleotide
gacagtcatcctgcaatgttggtcagatatcatgtttg

SEQ ID NO: 165029 - DNA, 39 bp, Artificial Sequence
  Description of Artificial Sequence: Synthetic oligonucleotide
acagtcatcctgcaatgttggtcagatatcatgtttgag

SEQ ID NO: 165030 - DNA, 38 bp, Artificial Sequence
  Description of Artificial Sequence: Synthetic oligonucleotide
cagtcatcctgcaatgttggtcagatatcatgtttgag

SEQ ID NO: 165031 - DNA, 28 bp, Artificial Sequence
  Description of Artificial Sequence: Synthetic oligonucleotide
cagggaactacacatgtcggggttcacg

SEQ ID NO: 165032 - DNA, 28 bp, Artificial Sequence
  Description of Artificial Sequence: Synthetic oligonucleotide
agggaactacacatgtcggggttcacgc

SEQ ID NO: 165033 - DNA, 27 bp, Artificial Sequence
  Description of Artificial Sequence: Synthetic oligonucleotide
gggaactacacatgtcggggttcacgc

SEQ ID NO: 165034 - DNA, 27 bp, Artificial Sequence
  Description of Artificial Sequence: Synthetic oligonucleotide
ggaactacacatgtcggggttcacgcc

SEQ ID NO: 165035 - DNA, 27 bp, Artificial Sequence
  Description of Artificial Sequence: Synthetic oligonucleotide
gaactacacatgtcggggttcacgccc

SEQ ID NO: 165036 - DNA, 28 bp, Artificial Sequence
  Description of Artificial Sequence: Synthetic oligonucleotide
aactacacatgtcggggttcacgcccac

SEQ ID NO: 165037 - DNA, 27 bp, Artificial Sequence
  Description of Artificial Sequence: Synthetic oligonucleotide
actacacatgtcggggttcacgcccac

SEQ ID NO: 165038 - DNA, 27 bp, Artificial Sequence
  Description of Artificial Sequence: Synthetic oligonucleotide
ctacacatgtcggggttcacgcccaca

SEQ ID NO: 165039 - DNA, 27 bp, Artificial Sequence
  Description of Artificial Sequence: Synthetic oligonucleotide
tacacatgtcggggttcacgcccacac

SEQ ID NO: 165040 - DNA, 27 bp, Artificial Sequence
  Description of Artificial Sequence: Synthetic oligonucleotide
acacatgtcggggttcacgcccacact

SEQ ID NO: 165041 - DNA, 26 bp, Artificial Sequence
  Description of Artificial Sequence: Synthetic oligonucleotide
cacatgtcggggttcacgcccacact

SEQ ID NO: 165042 - DNA, 26 bp, Artificial Sequence
  Description of Artificial Sequence: Synthetic oligonucleotide
acatgtcggggttcacgcccacactc

SEQ ID NO: 165043 - DNA, 25 bp, Artificial Sequence
  Description of Artificial Sequence: Synthetic oligonucleotide
catgtcggggttcacgcccacactc

SEQ ID NO: 165044 - DNA, 25 bp, Artificial Sequence
  Description of Artificial Sequence: Synthetic oligonucleotide
atgtcggggttcacgcccacactcc

SEQ ID NO: 165045 - DNA, 24 bp, Artificial Sequence
  Description of Artificial Sequence: Synthetic oligonucleotide
tgtcggggttcacgcccacactcc

SEQ ID NO: 165046 - DNA, 23 bp, Artificial Sequence
  Description of Artificial Sequence: Synthetic oligonucleotide
gtcggggttcacgcccacactcc

SEQ ID NO: 165047 - DNA, 23 bp, Artificial Sequence
  Description of Artificial Sequence: Synthetic oligonucleotide
tcggggttcacgcccacactccc

SEQ ID NO: 165048 - DNA, 22 bp, Artificial Sequence
  Description of Artificial Sequence: Synthetic oligonucleotide
cggggttcacgcccacactccc

SEQ ID NO: 165049 - DNA, 22 bp, Artificial Sequence
  Description of Artificial Sequence: Synthetic oligonucleotide
ggggttcacgcccacactcccc

SEQ ID NO: 165050 - DNA, 23 bp, Artificial Sequence
  Description of Artificial Sequence: Synthetic oligonucleotide
gggttcacgcccacactccccca

SEQ ID NO: 165051 - DNA, 24 bp, Artificial Sequence
  Description of Artificial Sequence: Synthetic oligonucleotide
ggttcacgcccacactcccccact

SEQ ID NO: 165052 - DNA, 24 bp, Artificial Sequence
  Description of Artificial Sequence: Synthetic oligonucleotide
gttcacgcccacactcccccactg

SEQ ID NO: 165053 - DNA, 24 bp, Artificial Sequence
  Description of Artificial Sequence: Synthetic oligonucleotide
ttcacgcccacactcccccactgg

SEQ ID NO: 165054 - DNA, 23 bp, Artificial Sequence
  Description of Artificial Sequence: Synthetic oligonucleotide
tcacgcccacactcccccactgg

SEQ ID NO: 165055 - DNA, 22 bp, Artificial Sequence
  Description of Artificial Sequence: Synthetic oligonucleotide
cacgcccacactcccccactgg

SEQ ID NO: 165056 - DNA, 23 bp, Artificial Sequence
  Description of Artificial Sequence: Synthetic oligonucleotide
acgcccacactcccccactgggt

SEQ ID NO: 165057 - DNA, 22 bp, Artificial Sequence
  Description of Artificial Sequence: Synthetic oligonucleotide
cgcccacactcccccactgggt

SEQ ID NO: 165058 - DNA, 22 bp, Artificial Sequence
  Description of Artificial Sequence: Synthetic oligonucleotide
gcccacactcccccactgggtg

SEQ ID NO: 165059 - DNA, 27 bp, Artificial Sequence
  Description of Artificial Sequence: Synthetic oligonucleotide
tcccctggacatcgtggtcacaggtct

SEQ ID NO: 165060 - DNA, 27 bp, Artificial Sequence
  Description of Artificial Sequence: Synthetic oligonucleotide
cccctggacatcgtggtcacaggtcta

SEQ ID NO: 165061 - DNA, 30 bp, Artificial Sequence
  Description of Artificial Sequence: Synthetic oligonucleotide
ccctggacatcgtggtcacaggtctatatg

SEQ ID NO: 165062 - DNA, 31 bp, Artificial Sequence
  Description of Artificial Sequence: Synthetic oligonucleotide
cctggacatcgtggtcacaggtctatatgag

SEQ ID NO: 165063 - DNA, 34 bp, Artificial Sequence
  Description of Artificial Sequence: Synthetic oligonucleotide
ctggacatcgtggtcacaggtctatatgagaaac

SEQ ID NO: 165064 - DNA, 34 bp, Artificial Sequence
  Description of Artificial Sequence: Synthetic oligonucleotide
tggacatcgtggtcacaggtctatatgagaaacc

SEQ ID NO: 165065 - DNA, 33 bp, Artificial Sequence
  Description of Artificial Sequence: Synthetic oligonucleotide
ggacatcgtggtcacaggtctatatgagaaacc

SEQ ID NO: 165066 - DNA, 35 bp, Artificial Sequence
  Description of Artificial Sequence: Synthetic oligonucleotide
gacatcgtggtcacaggtctatatgagaaaccttc

SEQ ID NO: 165067 - DNA, 36 bp, Artificial Sequence
  Description of Artificial Sequence: Synthetic oligonucleotide
acatcgtggtcacaggtctatatgagaaaccttctc

SEQ ID NO: 165068 - DNA, 35 bp, Artificial Sequence
  Description of Artificial Sequence: Synthetic oligonucleotide
catcgtggtcacaggtctatatgagaaaccttctc

SEQ ID NO: 165069 - DNA, 36 bp, Artificial Sequence
  Description of Artificial Sequence: Synthetic oligonucleotide
atcgtggtcacaggtctatatgagaaaccttctctc

SEQ ID NO: 165070 - DNA, 35 bp, Artificial Sequence
  Description of Artificial Sequence: Synthetic oligonucleotide
tcgtggtcacaggtctatatgagaaaccttctctc

SEQ ID NO: 165071 - DNA, 34 bp, Artificial Sequence
  Description of Artificial Sequence: Synthetic oligonucleotide
cgtggtcacaggtctatatgagaaaccttctctc

SEQ ID NO: 165072 - DNA, 35 bp, Artificial Sequence
  Description of Artificial Sequence: Synthetic oligonucleotide
gtggtcacaggtctatatgagaaaccttctctctc

SEQ ID NO: 165073 - DNA, 36 bp, Artificial Sequence
  Description of Artificial Sequence: Synthetic oligonucleotide
tggtcacaggtctatatgagaaaccttctctctcag

SEQ ID NO: 165074 - DNA, 35 bp, Artificial Sequence
  Description of Artificial Sequence: Synthetic oligonucleotide
ggtcacaggtctatatgagaaaccttctctctcag

SEQ ID NO: 165075 - DNA, 35 bp, Artificial Sequence
  Description of Artificial Sequence: Synthetic oligonucleotide
gtcacaggtctatatgagaaaccttctctctcagc

SEQ ID NO: 165076 - DNA, 26 bp, Artificial Sequence
  Description of Artificial Sequence: Synthetic oligonucleotide
agagggccggtccacacatgggtgat

SEQ ID NO: 165077 - DNA, 25 bp, Artificial Sequence
  Description of Artificial Sequence: Synthetic oligonucleotide
gagggccggtccacacatgggtgat

SEQ ID NO: 165078 - DNA, 26 bp, Artificial Sequence
  Description of Artificial Sequence: Synthetic oligonucleotide
agggccggtccacacatgggtgatca

SEQ ID NO: 165079 - DNA, 25 bp, Artificial Sequence
  Description of Artificial Sequence: Synthetic oligonucleotide
gggccggtccacacatgggtgatca

SEQ ID NO: 165080 - DNA, 25 bp, Artificial Sequence
  Description of Artificial Sequence: Synthetic oligonucleotide
ggccggtccacacatgggtgatcag

SEQ ID NO: 165081 - DNA, 26 bp, Artificial Sequence
  Description of Artificial Sequence: Synthetic oligonucleotide
gccggtccacacatgggtgatcagga

SEQ ID NO: 165082 - DNA, 27 bp, Artificial Sequence
  Description of Artificial Sequence: Synthetic oligonucleotide
ccggtccacacatgggtgatcaggaca

SEQ ID NO: 165083 - DNA, 29 bp, Artificial Sequence
  Description of Artificial Sequence: Synthetic oligonucleotide
cggtccacacatgggtgatcaggacaaac

SEQ ID NO: 165084 - DNA, 29 bp, Artificial Sequence
  Description of Artificial Sequence: Synthetic oligonucleotide
ggtccacacatgggtgatcaggacaaacc

SEQ ID NO: 165085 - DNA, 29 bp, Artificial Sequence
  Description of Artificial Sequence: Synthetic oligonucleotide
gtccacacatgggtgatcaggacaaaccc

SEQ ID NO: 165086 - DNA, 31 bp, Artificial Sequence
  Description of Artificial Sequence: Synthetic oligonucleotide
tccacacatgggtgatcaggacaaacccttc

SEQ ID NO: 165087 - DNA, 30 bp, Artificial Sequence
  Description of Artificial Sequence: Synthetic oligonucleotide
ccacacatgggtgatcaggacaaacccttc

SEQ ID NO: 165088 - DNA, 30 bp, Artificial Sequence
  Description of Artificial Sequence: Synthetic oligonucleotide
cacacatgggtgatcaggacaaacccttcc

SEQ ID NO: 165089 - DNA, 31 bp, Artificial Sequence
  Description of Artificial Sequence: Synthetic oligonucleotide
acacatgggtgatcaggacaaacccttcctg

SEQ ID NO: 165090 - DNA, 30 bp, Artificial Sequence
  Description of Artificial Sequence: Synthetic oligonucleotide
cacatgggtgatcaggacaaacccttcctg

SEQ ID NO: 165091 - DNA, 31 bp, Artificial Sequence
  Description of Artificial Sequence: Synthetic oligonucleotide
acatgggtgatcaggacaaacccttcctgtc

SEQ ID NO: 165092 - DNA, 30 bp, Artificial Sequence
  Description of Artificial Sequence: Synthetic oligonucleotide
catgggtgatcaggacaaacccttcctgtc

SEQ ID NO: 165093 - DNA, 31 bp, Artificial Sequence
  Description of Artificial Sequence: Synthetic oligonucleotide
atgggtgatcaggacaaacccttcctgtctg

SEQ ID NO: 165094 - DNA, 30 bp, Artificial Sequence
  Description of Artificial Sequence: Synthetic oligonucleotide
tgggtgatcaggacaaacccttcctgtctg

SEQ ID NO: 165095 - DNA, 29 bp, Artificial Sequence
  Description of Artificial Sequence: Synthetic oligonucleotide
gggtgatcaggacaaacccttcctgtctg

SEQ ID NO: 165096 - DNA, 29 bp, Artificial Sequence
  Description of Artificial Sequence: Synthetic oligonucleotide
ggtgatcaggacaaacccttcctgtctgc

SEQ ID NO: 165097 - DNA, 29 bp, Artificial Sequence
  Description of Artificial Sequence: Synthetic oligonucleotide
gtgatcaggacaaacccttcctgtctgcc

SEQ ID NO: 165098 - DNA, 30 bp, Artificial Sequence
  Description of Artificial Sequence: Synthetic oligonucleotide
tgatcaggacaaacccttcctgtctgcctg

SEQ ID NO: 165099 - DNA, 29 bp, Artificial Sequence
  Description of Artificial Sequence: Synthetic oligonucleotide
gatcaggacaaacccttcctgtctgcctg

SEQ ID NO: 165100 - DNA, 29 bp, Artificial Sequence
  Description of Artificial Sequence: Synthetic oligonucleotide
atcaggacaaacccttcctgtctgcctgg

SEQ ID NO: 165101 - DNA, 27 bp, Artificial Sequence
  Description of Artificial Sequence: Synthetic oligonucleotide
gagcgtgaccttgtcctgtagctccca

SEQ ID NO: 165102 - DNA, 27 bp, Artificial Sequence
  Description of Artificial Sequence: Synthetic oligonucleotide
agcgtgaccttgtcctgtagctcccag

SEQ ID NO: 165103 - DNA, 27 bp, Artificial Sequence
  Description of Artificial Sequence: Synthetic oligonucleotide
gcgtgaccttgtcctgtagctcccaga

SEQ ID NO: 165104 - DNA, 27 bp, Artificial Sequence
  Description of Artificial Sequence: Synthetic oligonucleotide
cgtgaccttgtcctgtagctcccagag

SEQ ID NO: 165105 - DNA, 27 bp, Artificial Sequence
  Description of Artificial Sequence: Synthetic oligonucleotide
gtgaccttgtcctgtagctcccagagc

SEQ ID NO: 165106 - DNA, 28 bp, Artificial Sequence
  Description of Artificial Sequence: Synthetic oligonucleotide
tgaccttgtcctgtagctcccagagctc

SEQ ID NO: 165107 - DNA, 27 bp, Artificial Sequence
  Description of Artificial Sequence: Synthetic oligonucleotide
gaccttgtcctgtagctcccagagctc

SEQ ID NO: 165108 - DNA, 27 bp, Artificial Sequence
  Description of Artificial Sequence: Synthetic oligonucleotide
accttgtcctgtagctcccagagctcc

SEQ ID NO: 165109 - DNA, 27 bp, Artificial Sequence
  Description of Artificial Sequence: Synthetic oligonucleotide
ccttgtcctgtagctcccagagctcct

SEQ ID NO: 165110 - DNA, 29 bp, Artificial Sequence
  Description of Artificial Sequence: Synthetic oligonucleotide
cttgtcctgtagctcccagagctcctatg

SEQ ID NO: 165111 - DNA, 30 bp, Artificial Sequence
  Description of Artificial Sequence: Synthetic oligonucleotide
ttgtcctgtagctcccagagctcctatgac

SEQ ID NO: 165112 - DNA, 29 bp, Artificial Sequence
  Description of Artificial Sequence: Synthetic oligonucleotide
tgtcctgtagctcccagagctcctatgac

SEQ ID NO: 165113 - DNA, 28 bp, Artificial Sequence
  Description of Artificial Sequence: Synthetic oligonucleotide
gtcctgtagctcccagagctcctatgac

SEQ ID NO: 165114 - DNA, 30 bp, Artificial Sequence
  Description of Artificial Sequence: Synthetic oligonucleotide
tcctgtagctcccagagctcctatgacatg

SEQ ID NO: 165115 - DNA, 29 bp, Artificial Sequence
  Description of Artificial Sequence: Synthetic oligonucleotide
cctgtagctcccagagctcctatgacatg

SEQ ID NO: 165116 - DNA, 31 bp, Artificial Sequence
  Description of Artificial Sequence: Synthetic oligonucleotide
ctgtagctcccagagctcctatgacatgtac

SEQ ID NO: 165117 - DNA, 31 bp, Artificial Sequence
  Description of Artificial Sequence: Synthetic oligonucleotide
tgtagctcccagagctcctatgacatgtacc

SEQ ID NO: 165118 - DNA, 30 bp, Artificial Sequence
  Description of Artificial Sequence: Synthetic oligonucleotide
gtagctcccagagctcctatgacatgtacc

SEQ ID NO: 165119 - DNA, 32 bp, Artificial Sequence
  Description of Artificial Sequence: Synthetic oligonucleotide
tagctcccagagctcctatgacatgtaccatc

SEQ ID NO: 165120 - DNA, 23 bp, Artificial Sequence
  Description of Artificial Sequence: Synthetic oligonucleotide
tctgcctggcccagcgctgtgct

SEQ ID NO: 165121 - DNA, 22 bp, Artificial Sequence
  Description of Artificial Sequence: Synthetic oligonucleotide
ctgcctggcccagcgctgtgct

SEQ ID NO: 165122 - DNA, 22 bp, Artificial Sequence
  Description of Artificial Sequence: Synthetic oligonucleotide
tgcctggcccagcgctgtgctg

SEQ ID NO: 165123 - DNA, 21 bp, Artificial Sequence
  Description of Artificial Sequence: Synthetic oligonucleotide
gcctggcccagcgctgtgctg

SEQ ID NO: 165124 - DNA, 21 bp, Artificial Sequence
  Description of Artificial Sequence: Synthetic oligonucleotide
cctggcccagcgctgtgctgc

SEQ ID NO: 165125 - DNA, 22 bp, Artificial Sequence
  Description of Artificial Sequence: Synthetic oligonucleotide
ctggcccagcgctgtgctgcct

SEQ ID NO: 165126 - DNA, 22 bp, Artificial Sequence
  Description of Artificial Sequence: Synthetic oligonucleotide
tggcccagcgctgtgctgcctc

SEQ ID NO: 165127 - DNA, 21 bp, Artificial Sequence
  Description of Artificial Sequence: Synthetic oligonucleotide
ggcccagcgctgtgctgcctc

SEQ ID NO: 165128 - DNA, 22 bp, Artificial Sequence
  Description of Artificial Sequence: Synthetic oligonucleotide
gcccagcgctgtgctgcctcga

SEQ ID NO: 165129 - DNA, 22 bp, Artificial Sequence
  Description of Artificial Sequence: Synthetic oligonucleotide
cccagcgctgtgctgcctcgag

SEQ ID NO: 165130 - DNA, 23 bp, Artificial Sequence
  Description of Artificial Sequence: Synthetic oligonucleotide
ccagcgctgtgctgcctcgagga

SEQ ID NO: 165131 - DNA, 23 bp, Artificial Sequence
  Description of Artificial Sequence: Synthetic oligonucleotide
cagcgctgtgctgcctcgaggag

SEQ ID NO: 165132 - DNA, 24 bp, Artificial Sequence
  Description of Artificial Sequence: Synthetic oligonucleotide
agcgctgtgctgcctcgaggagga

SEQ ID NO: 165133 - DNA, 23 bp, Artificial Sequence
  Description of Artificial Sequence: Synthetic oligonucleotide
gcgctgtgctgcctcgaggagga

SEQ ID NO: 165134 - DNA, 24 bp, Artificial Sequence
  Description of Artificial Sequence: Synthetic oligonucleotide
cgctgtgctgcctcgaggaggaca

SEQ ID NO: 165135 - DNA, 24 bp, Artificial Sequence
  Description of Artificial Sequence: Synthetic oligonucleotide
gctgtgctgcctcgaggaggacac

SEQ ID NO: 165136 - DNA, 25 bp, Artificial Sequence
  Description of Artificial Sequence: Synthetic oligonucleotide
ctgtgctgcctcgaggaggacacgt

SEQ ID NO: 165137 - DNA, 26 bp, Artificial Sequence
  Description of Artificial Sequence: Synthetic oligonucleotide
tgtgctgcctcgaggaggacacgtga

SEQ ID NO: 165138 - DNA, 25 bp, Artificial Sequence
  Description of Artificial Sequence: Synthetic oligonucleotide
gtgctgcctcgaggaggacacgtga

SEQ ID NO: 165139 - DNA, 26 bp, Artificial Sequence
  Description of Artificial Sequence: Synthetic oligonucleotide
tgctgcctcgaggaggacacgtgact

SEQ ID NO: 165140 - DNA, 25 bp, Artificial Sequence
  Description of Artificial Sequence: Synthetic oligonucleotide
gctgcctcgaggaggacacgtgact

SEQ ID NO: 165141 - DNA, 27 bp, Artificial Sequence
  Description of Artificial Sequence: Synthetic oligonucleotide
ctgcctcgaggaggacacgtgactctt

SEQ ID NO: 165142 - DNA, 41 bp, Artificial Sequence
  Description of Artificial Sequence: Synthetic oligonucleotide
tcagatatcatgtttgagcacttctttctgcacaaagagtg

SEQ ID NO: 165143 - DNA, 40 bp, Artificial Sequence
  Description of Artificial Sequence: Synthetic oligonucleotide
cagatatcatgtttgagcacttctttctgcacaaagagtg

SEQ ID NO: 165144 - DNA, 40 bp, Artificial Sequence
  Description of Artificial Sequence: Synthetic oligonucleotide
agatatcatgtttgagcacttctttctgcacaaagagtgg

SEQ ID NO: 165145 - DNA, 39 bp, Artificial Sequence
  Description of Artificial Sequence: Synthetic oligonucleotide
gatatcatgtttgagcacttctttctgcacaaagagtgg

SEQ ID NO: 165146 - DNA, 41 bp, Artificial Sequence
  Description of Artificial Sequence: Synthetic oligonucleotide
atatcatgtttgagcacttctttctgcacaaagagtggatc

SEQ ID NO: 165147 - DNA, 40 bp, Artificial Sequence
  Description of Artificial Sequence: Synthetic oligonucleotide
tatcatgtttgagcacttctttctgcacaaagagtggatc

SEQ ID NO: 165148 - DNA, 39 bp, Artificial Sequence
  Description of Artificial Sequence: Synthetic oligonucleotide
atcatgtttgagcacttctttctgcacaaagagtggatc

SEQ ID NO: 165149 - DNA, 38 bp, Artificial Sequence
  Description of Artificial Sequence: Synthetic oligonucleotide
tcatgtttgagcacttctttctgcacaaagagtggatc

SEQ ID NO: 165150 - DNA, 37 bp, Artificial Sequence
  Description of Artificial Sequence: Synthetic oligonucleotide
catgtttgagcacttctttctgcacaaagagtggatc

SEQ ID NO: 165151 - DNA, 38 bp, Artificial Sequence
  Description of Artificial Sequence: Synthetic oligonucleotide
atgtttgagcacttctttctgcacaaagagtggatctc

SEQ ID NO: 165152 - DNA, 37 bp, Artificial Sequence
  Description of Artificial Sequence: Synthetic oligonucleotide
tgtttgagcacttctttctgcacaaagagtggatctc

SEQ ID NO: 165153 - DNA, 36 bp, Artificial Sequence
  Description of Artificial Sequence: Synthetic oligonucleotide
gtttgagcacttctttctgcacaaagagtggatctc

SEQ ID NO: 165154 - DNA, 39 bp, Artificial Sequence
  Description of Artificial Sequence: Synthetic oligonucleotide
tttgagcacttctttctgcacaaagagtggatctctaag

SEQ ID NO: 165155 - DNA, 38 bp, Artificial Sequence
  Description of Artificial Sequence: Synthetic oligonucleotide
ttgagcacttctttctgcacaaagagtggatctctaag

SEQ ID NO: 165156 - DNA, 37 bp, Artificial Sequence
  Description of Artificial Sequence: Synthetic oligonucleotide
tgagcacttctttctgcacaaagagtggatctctaag

SEQ ID NO: 165157 - DNA, 36 bp, Artificial Sequence
  Description of Artificial Sequence: Synthetic oligonucleotide
gagcacttctttctgcacaaagagtggatctctaag

SEQ ID NO: 165158 - DNA, 36 bp, Artificial Sequence
  Description of Artificial Sequence: Synthetic oligonucleotide
agcacttctttctgcacaaagagtggatctctaagg

SEQ ID NO: 165159 - DNA, 35 bp, Artificial Sequence
  Description of Artificial Sequence: Synthetic oligonucleotide
gcacttctttctgcacaaagagtggatctctaagg

SEQ ID NO: 165160 - DNA, 36 bp, Artificial Sequence
  Description of Artificial Sequence: Synthetic oligonucleotide
cacttctttctgcacaaagagtggatctctaaggac

SEQ ID NO: 165161 - DNA, 36 bp, Artificial Sequence
  Description of Artificial Sequence: Synthetic oligonucleotide
acttctttctgcacaaagagtggatctctaaggacc

SEQ ID NO: 165162 - DNA, 35 bp, Artificial Sequence
  Description of Artificial Sequence: Synthetic oligonucleotide
cttctttctgcacaaagagtggatctctaaggacc

SEQ ID NO: 165163 - DNA, 35 bp, Artificial Sequence
  Description of Artificial Sequence: Synthetic oligonucleotide
ttctttctgcacaaagagtggatctctaaggaccc

SEQ ID NO: 165164 - DNA, 34 bp, Artificial Sequence
  Description of Artificial Sequence: Synthetic oligonucleotide
tctttctgcacaaagagtggatctctaaggaccc

SEQ ID NO: 165165 - DNA, 33 bp, Artificial Sequence
  Description of Artificial Sequence: Synthetic oligonucleotide
ctttctgcacaaagagtggatctctaaggaccc

SEQ ID NO: 165166 - DNA, 33 bp, Artificial Sequence
  Description of Artificial Sequence: Synthetic oligonucleotide
tttctgcacaaagagtggatctctaaggacccc

SEQ ID NO: 165167 - DNA, 32 bp, Artificial Sequence
  Description of Artificial Sequence: Synthetic oligonucleotide
ttctgcacaaagagtggatctctaaggacccc

SEQ ID NO: 165168 - DNA, 31 bp, Artificial Sequence
  Description of Artificial Sequence: Synthetic oligonucleotide
tctgcacaaagagtggatctctaaggacccc

SEQ ID NO: 165169 - DNA, 30 bp, Artificial Sequence
  Description of Artificial Sequence: Synthetic oligonucleotide
ctgcacaaagagtggatctctaaggacccc

SEQ ID NO: 165170 - DNA, 31 bp, Artificial Sequence
  Description of Artificial Sequence: Synthetic oligonucleotide
tgcacaaagagtggatctctaaggacccctc

SEQ ID NO: 165171 - DNA, 30 bp, Artificial Sequence
  Description of Artificial Sequence: Synthetic oligonucleotide
gcacaaagagtggatctctaaggacccctc

SEQ ID NO: 165172 - DNA, 31 bp, Artificial Sequence
  Description of Artificial Sequence: Synthetic oligonucleotide
cacaaagagtggatctctaaggacccctcac

SEQ ID NO: 165173 - DNA, 31 bp, Artificial Sequence
  Description of Artificial Sequence: Synthetic oligonucleotide
acaaagagtggatctctaaggacccctcacg

SEQ ID NO: 165174 - DNA, 30 bp, Artificial Sequence
  Description of Artificial Sequence: Synthetic oligonucleotide
caaagagtggatctctaaggacccctcacg

SEQ ID NO: 165175 - DNA, 30 bp, Artificial Sequence
  Description of Artificial Sequence: Synthetic oligonucleotide
aaagagtggatctctaaggacccctcacgc

SEQ ID NO: 165176 - DNA, 29 bp, Artificial Sequence
  Description of Artificial Sequence: Synthetic oligonucleotide
aagagtggatctctaaggacccctcacgc

SEQ ID NO: 165177 - DNA, 28 bp, Artificial Sequence
  Description of Artificial Sequence: Synthetic oligonucleotide
agagtggatctctaaggacccctcacgc

SEQ ID NO: 165178 - DNA, 27 bp, Artificial Sequence
  Description of Artificial Sequence: Synthetic oligonucleotide
gagtggatctctaaggacccctcacgc

SEQ ID NO: 165179 - DNA, 27 bp, Artificial Sequence
  Description of Artificial Sequence: Synthetic oligonucleotide
agtggatctctaaggacccctcacgcc

SEQ ID NO: 165180 - DNA, 27 bp, Artificial Sequence
  Description of Artificial Sequence: Synthetic oligonucleotide
gtggatctctaaggacccctcacgcct

SEQ ID NO: 165181 - DNA, 27 bp, Artificial Sequence
  Description of Artificial Sequence: Synthetic oligonucleotide
tggatctctaaggacccctcacgcctc

SEQ ID NO: 165182 - DNA, 30 bp, Artificial Sequence
  Description of Artificial Sequence: Synthetic oligonucleotide
ggtctccaaggccaatttctccatcggttc

SEQ ID NO: 165183 - DNA, 30 bp, Artificial Sequence
  Description of Artificial Sequence: Synthetic oligonucleotide
gtctccaaggccaatttctccatcggttcc

SEQ ID NO: 165184 - DNA, 32 bp, Artificial Sequence
  Description of Artificial Sequence: Synthetic oligonucleotide
tctccaaggccaatttctccatcggttccatg

SEQ ID NO: 165185 - DNA, 31 bp, Artificial Sequence
  Description of Artificial Sequence: Synthetic oligonucleotide
ctccaaggccaatttctccatcggttccatg

SEQ ID NO: 165186 - DNA, 33 bp, Artificial Sequence
  Description of Artificial Sequence: Synthetic oligonucleotide
tccaaggccaatttctccatcggttccatgatg

SEQ ID NO: 165187 - DNA, 32 bp, Artificial Sequence
  Description of Artificial Sequence: Synthetic oligonucleotide
ccaaggccaatttctccatcggttccatgatg

SEQ ID NO: 165188 - DNA, 32 bp, Artificial Sequence
  Description of Artificial Sequence: Synthetic oligonucleotide
caaggccaatttctccatcggttccatgatgc

SEQ ID NO: 165189 - DNA, 32 bp, Artificial Sequence
  Description of Artificial Sequence: Synthetic oligonucleotide
aaggccaatttctccatcggttccatgatgcg

SEQ ID NO: 165190 - DNA, 31 bp, Artificial Sequence
  Description of Artificial Sequence: Synthetic oligonucleotide
aggccaatttctccatcggttccatgatgcg

SEQ ID NO: 165191 - DNA, 30 bp, Artificial Sequence
  Description of Artificial Sequence: Synthetic oligonucleotide
ggccaatttctccatcggttccatgatgcg

SEQ ID NO: 165192 - DNA, 31 bp, Artificial Sequence
  Description of Artificial Sequence: Synthetic oligonucleotide
gccaatttctccatcggttccatgatgcgtg

SEQ ID NO: 165193 - DNA, 31 bp, Artificial Sequence
  Description of Artificial Sequence: Synthetic oligonucleotide
ccaatttctccatcggttccatgatgcgtgc

SEQ ID NO: 165194 - DNA, 31 bp, Artificial Sequence
  Description of Artificial Sequence: Synthetic oligonucleotide
caatttctccatcggttccatgatgcgtgcc

SEQ ID NO: 165195 - DNA, 31 bp, Artificial Sequence
  Description of Artificial Sequence: Synthetic oligonucleotide
aatttctccatcggttccatgatgcgtgccc

SEQ ID NO: 165196 - DNA, 30 bp, Artificial Sequence
  Description of Artificial Sequence: Synthetic oligonucleotide
atttctccatcggttccatgatgcgtgccc

SEQ ID NO: 165197 - DNA, 29 bp, Artificial Sequence
  Description of Artificial Sequence: Synthetic oligonucleotide
tttctccatcggttccatgatgcgtgccc

SEQ ID NO: 165198 - DNA, 28 bp, Artificial Sequence
  Description of Artificial Sequence: Synthetic oligonucleotide
ttctccatcggttccatgatgcgtgccc

SEQ ID NO: 165199 - DNA, 27 bp, Artificial Sequence
  Description of Artificial Sequence: Synthetic oligonucleotide
tctccatcggttccatgatgcgtgccc

SEQ ID NO: 165200 - DNA, 27 bp, Artificial Sequence
  Description of Artificial Sequence: Synthetic oligonucleotide
ctccatcggttccatgatgcgtgccct

SEQ ID NO: 165201 - DNA, 28 bp, Artificial Sequence
  Description of Artificial Sequence: Synthetic oligonucleotide
tccatcggttccatgatgcgtgcccttg

SEQ ID NO: 165202 - DNA, 27 bp, Artificial Sequence
  Description of Artificial Sequence: Synthetic oligonucleotide
ccatcggttccatgatgcgtgcccttg

SEQ ID NO: 165203 - DNA, 27 bp, Artificial Sequence
  Description of Artificial Sequence: Synthetic oligonucleotide
catcggttccatgatgcgtgcccttgc

SEQ ID NO: 165204 - DNA, 28 bp, Artificial Sequence
  Description of Artificial Sequence: Synthetic oligonucleotide
atcggttccatgatgcgtgcccttgcag

SEQ ID NO: 165205 - DNA, 27 bp, Artificial Sequence
  Description of Artificial Sequence: Synthetic oligonucleotide
tcggttccatgatgcgtgcccttgcag

SEQ ID NO: 165206 - DNA, 26 bp, Artificial Sequence
  Description of Artificial Sequence: Synthetic oligonucleotide
cggttccatgatgcgtgcccttgcag

SEQ ID NO: 165207 - DNA, 26 bp, Artificial Sequence
  Description of Artificial Sequence: Synthetic oligonucleotide
ggttccatgatgcgtgcccttgcagg

SEQ ID NO: 165208 - DNA, 27 bp, Artificial Sequence
  Description of Artificial Sequence: Synthetic oligonucleotide
gttccatgatgcgtgcccttgcaggga

SEQ ID NO: 165209 - DNA, 27 bp, Artificial Sequence
  Description of Artificial Sequence: Synthetic oligonucleotide
ttccatgatgcgtgcccttgcagggac

SEQ ID NO: 165210 - DNA, 26 bp, Artificial Sequence
  Description of Artificial Sequence: Synthetic oligonucleotide
tccatgatgcgtgcccttgcagggac

SEQ ID NO: 165211 - DNA, 25 bp, Artificial Sequence
  Description of Artificial Sequence: Synthetic oligonucleotide
ccatgatgcgtgcccttgcagggac

SEQ ID NO: 165212 - DNA, 27 bp, Artificial Sequence
  Description of Artificial Sequence: Synthetic oligonucleotide
catgatgcgtgcccttgcagggaccta

SEQ ID NO: 165213 - DNA, 27 bp, Artificial Sequence
  Description of Artificial Sequence: Synthetic oligonucleotide
atgatgcgtgcccttgcagggacctac

SEQ ID NO: 165214 - DNA, 27 bp, Artificial Sequence
  Description of Artificial Sequence: Synthetic oligonucleotide
tgatgcgtgcccttgcagggacctaca

SEQ ID NO: 165215 - DNA, 26 bp, Artificial Sequence
  Description of Artificial Sequence: Synthetic oligonucleotide
gatgcgtgcccttgcagggacctaca

SEQ ID NO: 165216 - DNA, 27 bp, Artificial Sequence
  Description of Artificial Sequence: Synthetic oligonucleotide
atgcgtgcccttgcagggacctacaga

SEQ ID NO: 165217 - DNA, 27 bp, Artificial Sequence
  Description of Artificial Sequence: Synthetic oligonucleotide
tgcgtgcccttgcagggacctacagat

SEQ ID NO: 165218 - DNA, 26 bp, Artificial Sequence
  Description of Artificial Sequence: Synthetic oligonucleotide
gcgtgcccttgcagggacctacagat

SEQ ID NO: 165219 - DNA, 26 bp, Artificial Sequence
  Description of Artificial Sequence: Synthetic oligonucleotide
cgtgcccttgcagggacctacagatg

SEQ ID NO: 165220 - DNA, 27 bp, Artificial Sequence
  Description of Artificial Sequence: Synthetic oligonucleotide
gtgcccttgcagggacctacagatgct

SEQ ID NO: 165221 - DNA, 27 bp, Artificial Sequence
  Description of Artificial Sequence: Synthetic oligonucleotide
cggtcccatgatgcttgcccttgcaga

SEQ ID NO: 165222 - DNA, 27 bp, Artificial Sequence
  Description of Artificial Sequence: Synthetic oligonucleotide
ggtcccatgatgcttgcccttgcagag

SEQ ID NO: 165223 - DNA, 28 bp, Artificial Sequence
  Description of Artificial Sequence: Synthetic oligonucleotide
gtcccatgatgcttgcccttgcagagac

SEQ ID NO: 165224 - DNA, 28 bp, Artificial Sequence
  Description of Artificial Sequence: Synthetic oligonucleotide
tcccatgatgcttgcccttgcagagacc

SEQ ID NO: 165225 - DNA, 27 bp, Artificial Sequence
  Description of Artificial Sequence: Synthetic oligonucleotide
cccatgatgcttgcccttgcagagacc

SEQ ID NO: 165226 - DNA, 29 bp, Artificial Sequence
  Description of Artificial Sequence: Synthetic oligonucleotide
ccatgatgcttgcccttgcagagacctac

SEQ ID NO: 165227 - DNA, 30 bp, Artificial Sequence
  Description of Artificial Sequence: Synthetic oligonucleotide
catgatgcttgcccttgcagagacctacag

SEQ ID NO: 165228 - DNA, 32 bp, Artificial Sequence
  Description of Artificial Sequence: Synthetic oligonucleotide
atgatgcttgcccttgcagagacctacagatg

SEQ ID NO: 165229 - DNA, 31 bp, Artificial Sequence
  Description of Artificial Sequence: Synthetic oligonucleotide
tgatgcttgcccttgcagagacctacagatg

SEQ ID NO: 165230 - DNA, 30 bp, Artificial Sequence
  Description of Artificial Sequence: Synthetic oligonucleotide
gatgcttgcccttgcagagacctacagatg

SEQ ID NO: 165231 - DNA, 30 bp, Artificial Sequence
  Description of Artificial Sequence: Synthetic oligonucleotide
atgcttgcccttgcagagacctacagatgc

SEQ ID NO: 165232 - DNA, 29 bp, Artificial Sequence
  Description of Artificial Sequence: Synthetic oligonucleotide
tgcttgcccttgcagagacctacagatgc

SEQ ID NO: 165233 - DNA, 28 bp, Artificial Sequence
  Description of Artificial Sequence: Synthetic oligonucleotide
gcttgcccttgcagagacctacagatgc

SEQ ID NO: 165234 - DNA, 30 bp, Artificial Sequence
  Description of Artificial Sequence: Synthetic oligonucleotide
cttgcccttgcagagacctacagatgctac

SEQ ID NO: 165235 - DNA, 30 bp, Artificial Sequence
  Description of Artificial Sequence: Synthetic oligonucleotide
ttgcccttgcagagacctacagatgctacg

SEQ ID NO: 165236 - DNA, 29 bp, Artificial Sequence
  Description of Artificial Sequence: Synthetic oligonucleotide
tgcccttgcagagacctacagatgctacg

SEQ ID NO: 165237 - DNA, 28 bp, Artificial Sequence
  Description of Artificial Sequence: Synthetic oligonucleotide
gcccttgcagagacctacagatgctacg

SEQ ID NO: 165238 - DNA, 28 bp, Artificial Sequence
  Description of Artificial Sequence: Synthetic oligonucleotide
cccttgcagagacctacagatgctacgg

SEQ ID NO: 165239 - DNA, 30 bp, Artificial Sequence
  Description of Artificial Sequence: Synthetic oligonucleotide
ccttgcagagacctacagatgctacggttc

SEQ ID NO: 165240 - DNA, 31 bp, Artificial Sequence
  Description of Artificial Sequence: Synthetic oligonucleotide
cttgcagagacctacagatgctacggttctg

SEQ ID NO: 165241 - DNA, 34 bp, Artificial Sequence
  Description of Artificial Sequence: Synthetic oligonucleotide
ttgcagagacctacagatgctacggttctgttac

SEQ ID NO: 165242 - DNA, 33 bp, Artificial Sequence
  Description of Artificial Sequence: Synthetic oligonucleotide
tgcagagacctacagatgctacggttctgttac

SEQ ID NO: 165243 - DNA, 32 bp, Artificial Sequence
  Description of Artificial Sequence: Synthetic oligonucleotide
gcagagacctacagatgctacggttctgttac

SEQ ID NO: 165244 - DNA, 33 bp, Artificial Sequence
  Description of Artificial Sequence: Synthetic oligonucleotide
cagagacctacagatgctacggttctgttactc

SEQ ID NO: 165245 - DNA, 34 bp, Artificial Sequence
  Description of Artificial Sequence: Synthetic oligonucleotide
agagacctacagatgctacggttctgttactcac

SEQ ID NO: 165246 - DNA, 33 bp, Artificial Sequence
  Description of Artificial Sequence: Synthetic oligonucleotide
gagacctacagatgctacggttctgttactcac

SEQ ID NO: 165247 - DNA, 34 bp, Artificial Sequence
  Description of Artificial Sequence: Synthetic oligonucleotide
agacctacagatgctacggttctgttactcacac

SEQ ID NO: 165248 - DNA, 31 bp, Artificial Sequence
  Description of Artificial Sequence: Synthetic oligonucleotide
acaaagaggggatctctaaggacccctcatg

SEQ ID NO: 165249 - DNA, 30 bp, Artificial Sequence
  Description of Artificial Sequence: Synthetic oligonucleotide
caaagaggggatctctaaggacccctcatg

SEQ ID NO: 165250 - DNA, 30 bp, Artificial Sequence
  Description of Artificial Sequence: Synthetic oligonucleotide
aaagaggggatctctaaggacccctcatgc

SEQ ID NO: 165251 - DNA, 29 bp, Artificial Sequence
  Description of Artificial Sequence: Synthetic oligonucleotide
aagaggggatctctaaggacccctcatgc

SEQ ID NO: 165252 - DNA, 28 bp, Artificial Sequence
  Description of Artificial Sequence: Synthetic oligonucleotide
agaggggatctctaaggacccctcatgc

SEQ ID NO: 165253 - DNA, 27 bp, Artificial Sequence
  Description of Artificial Sequence: Synthetic oligonucleotide
gaggggatctctaaggacccctcatgc

SEQ ID NO: 165254 - DNA, 27 bp, Artificial Sequence
  Description of Artificial Sequence: Synthetic oligonucleotide
aggggatctctaaggacccctcatgcc

SEQ ID NO: 165255 - DNA, 27 bp, Artificial Sequence
  Description of Artificial Sequence: Synthetic oligonucleotide
ggggatctctaaggacccctcatgcct

SEQ ID NO: 165256 - DNA, 27 bp, Artificial Sequence
  Description of Artificial Sequence: Synthetic oligonucleotide
gggatctctaaggacccctcatgcctc

SEQ ID NO: 165257 - DNA, 27 bp, Artificial Sequence
  Description of Artificial Sequence: Synthetic oligonucleotide
ggatctctaaggacccctcatgcctcg

SEQ ID NO: 165258 - DNA, 29 bp, Artificial Sequence
  Description of Artificial Sequence: Synthetic oligonucleotide
gatctctaaggacccctcatgcctcgttg

SEQ ID NO: 165259 - DNA, 29 bp, Artificial Sequence
  Description of Artificial Sequence: Synthetic oligonucleotide
atctctaaggacccctcatgcctcgttgg

SEQ ID NO: 165260 - DNA, 28 bp, Artificial Sequence
  Description of Artificial Sequence: Synthetic oligonucleotide
tctctaaggacccctcatgcctcgttgg

SEQ ID NO: 165261 - DNA, 27 bp, Artificial Sequence
  Description of Artificial Sequence: Synthetic oligonucleotide
ctctaaggacccctcatgcctcgttgg

SEQ ID NO: 165262 - DNA, 28 bp, Artificial Sequence
  Description of Artificial Sequence: Synthetic oligonucleotide
tctaaggacccctcatgcctcgttggac

SEQ ID NO: 165263 - DNA, 27 bp, Artificial Sequence
  Description of Artificial Sequence: Synthetic oligonucleotide
ctaaggacccctcatgcctcgttggac

SEQ ID NO: 165264 - DNA, 28 bp, Artificial Sequence
  Description of Artificial Sequence: Synthetic oligonucleotide
taaggacccctcatgcctcgttggacag

SEQ ID NO: 165265 - DNA, 27 bp, Artificial Sequence
  Description of Artificial Sequence: Synthetic oligonucleotide
aaggacccctcatgcctcgttggacag

SEQ ID NO: 165266 - DNA, 27 bp, Artificial Sequence
  Description of Artificial Sequence: Synthetic oligonucleotide
aggacccctcatgcctcgttggacaga

SEQ ID NO: 165267 - DNA, 27 bp, Artificial Sequence
  Description of Artificial Sequence: Synthetic oligonucleotide
ggacccctcatgcctcgttggacagat

SEQ ID NO: 165268 - DNA, 27 bp, Artificial Sequence
  Description of Artificial Sequence: Synthetic oligonucleotide
gacccctcatgcctcgttggacagatc

SEQ ID NO: 165269 - DNA, 27 bp, Artificial Sequence
  Description of Artificial Sequence: Synthetic oligonucleotide
acccctcatgcctcgttggacagatcc

SEQ ID NO: 165270 - DNA, 27 bp, Artificial Sequence
  Description of Artificial Sequence: Synthetic oligonucleotide
cccctcatgcctcgttggacagatcca

SEQ ID NO: 165271 - DNA, 28 bp, Artificial Sequence
  Description of Artificial Sequence: Synthetic oligonucleotide
ccctcatgcctcgttggacagatccatg

SEQ ID NO: 165272 - DNA, 30 bp, Artificial Sequence
  Description of Artificial Sequence: Synthetic oligonucleotide
cctcatgcctcgttggacagatccatgatg

SEQ ID NO: 165273 - DNA, 30 bp, Artificial Sequence
  Description of Artificial Sequence: Synthetic oligonucleotide
ctcatgcctcgttggacagatccatgatgg

SEQ ID NO: 165274 - DNA, 30 bp, Artificial Sequence
  Description of Artificial Sequence: Synthetic oligonucleotide
tcatgcctcgttggacagatccatgatggg

SEQ ID NO: 165275 - DNA, 29 bp, Artificial Sequence
  Description of Artificial Sequence: Synthetic oligonucleotide
catgcctcgttggacagatccatgatggg

SEQ ID NO: 165276 - DNA, 29 bp, Artificial Sequence
  Description of Artificial Sequence: Synthetic oligonucleotide
atgcctcgttggacagatccatgatgggg

SEQ ID NO: 165277 - DNA, 28 bp, Artificial Sequence
  Description of Artificial Sequence: Synthetic oligonucleotide
tgcctcgttggacagatccatgatgggg

SEQ ID NO: 165278 - DNA, 30 bp, Artificial Sequence
  Description of Artificial Sequence: Synthetic oligonucleotide
tcactctccctacgagttgtcagacccaag

SEQ ID NO: 165279 - DNA, 29 bp, Artificial Sequence
  Description of Artificial Sequence: Synthetic oligonucleotide
cactctccctacgagttgtcagacccaag

SEQ ID NO: 165280 - DNA, 30 bp, Artificial Sequence
  Description of Artificial Sequence: Synthetic oligonucleotide
actctccctacgagttgtcagacccaagtg

SEQ ID NO: 165281 - DNA, 29 bp, Artificial Sequence
  Description of Artificial Sequence: Synthetic oligonucleotide
ctctccctacgagttgtcagacccaagtg

SEQ ID NO: 165282 - DNA, 30 bp, Artificial Sequence
  Description of Artificial Sequence: Synthetic oligonucleotide
tctccctacgagttgtcagacccaagtgac

SEQ ID NO: 165283 - DNA, 29 bp, Artificial Sequence
  Description of Artificial Sequence: Synthetic oligonucleotide
ctccctacgagttgtcagacccaagtgac

SEQ ID NO: 165284 - DNA, 29 bp, Artificial Sequence
  Description of Artificial Sequence: Synthetic oligonucleotide
tccctacgagttgtcagacccaagtgacc

SEQ ID NO: 165285 - DNA, 28 bp, Artificial Sequence
  Description of Artificial Sequence: Synthetic oligonucleotide
ccctacgagttgtcagacccaagtgacc

SEQ ID NO: 165286 - DNA, 28 bp, Artificial Sequence
  Description of Artificial Sequence: Synthetic oligonucleotide
cctacgagttgtcagacccaagtgaccc

SEQ ID NO: 165287 - DNA, 29 bp, Artificial Sequence
  Description of Artificial Sequence: Synthetic oligonucleotide
ctacgagttgtcagacccaagtgacccac

SEQ ID NO: 165288 - DNA, 30 bp, Artificial Sequence
  Description of Artificial Sequence: Synthetic oligonucleotide
tacgagttgtcagacccaagtgacccactg

SEQ ID NO: 165289 - DNA, 29 bp, Artificial Sequence
  Description of Artificial Sequence: Synthetic oligonucleotide
acgagttgtcagacccaagtgacccactg

SEQ ID NO: 165290 - DNA, 28 bp, Artificial Sequence
  Description of Artificial Sequence: Synthetic oligonucleotide
cgagttgtcagacccaagtgacccactg

SEQ ID NO: 165291 - DNA, 28 bp, Artificial Sequence
  Description of Artificial Sequence: Synthetic oligonucleotide
gagttgtcagacccaagtgacccactgc

SEQ ID NO: 165292 - DNA, 30 bp, Artificial Sequence
  Description of Artificial Sequence: Synthetic oligonucleotide
agttgtcagacccaagtgacccactgcttg

SEQ ID NO: 165293 - DNA, 29 bp, Artificial Sequence
  Description of Artificial Sequence: Synthetic oligonucleotide
gttgtcagacccaagtgacccactgcttg

SEQ ID NO: 165294 - DNA, 32 bp, Artificial Sequence
  Description of Artificial Sequence: Synthetic oligonucleotide
ttgtcagacccaagtgacccactgcttgtttc

SEQ ID NO: 165295 - DNA, 31 bp, Artificial Sequence
  Description of Artificial Sequence: Synthetic oligonucleotide
tgtcagacccaagtgacccactgcttgtttc

SEQ ID NO: 165296 - DNA, 30 bp, Artificial Sequence
  Description of Artificial Sequence: Synthetic oligonucleotide
gtcagacccaagtgacccactgcttgtttc

SEQ ID NO: 165297 - DNA, 31 bp, Artificial Sequence
  Description of Artificial Sequence: Synthetic oligonucleotide
tcagacccaagtgacccactgcttgtttctg

SEQ ID NO: 165298 - DNA, 30 bp, Artificial Sequence
  Description of Artificial Sequence: Synthetic oligonucleotide
cagacccaagtgacccactgcttgtttctg

SEQ ID NO: 165299 - DNA, 31 bp, Artificial Sequence
  Description of Artificial Sequence: Synthetic oligonucleotide
agacccaagtgacccactgcttgtttctgtc

SEQ ID NO: 165300 - DNA, 30 bp, Artificial Sequence
  Description of Artificial Sequence: Synthetic oligonucleotide
gacccaagtgacccactgcttgtttctgtc

SEQ ID NO: 165301 - DNA, 31 bp, Artificial Sequence
  Description of Artificial Sequence: Synthetic oligonucleotide
acccaagtgacccactgcttgtttctgtcac

SEQ ID NO: 165302 - DNA, 30 bp, Artificial Sequence
  Description of Artificial Sequence: Synthetic oligonucleotide
cccaagtgacccactgcttgtttctgtcac

SEQ ID NO: 165303 - DNA, 31 bp, Artificial Sequence
  Description of Artificial Sequence: Synthetic oligonucleotide
ccaagtgacccactgcttgtttctgtcacag

SEQ ID NO: 165304 - DNA, 34 bp, Artificial Sequence
  Description of Artificial Sequence: Synthetic oligonucleotide
ttcacccacagaaccaagctccaaatctggtatc

SEQ ID NO: 165305 - DNA, 33 bp, Artificial Sequence
  Description of Artificial Sequence: Synthetic oligonucleotide
tcacccacagaaccaagctccaaatctggtatc

SEQ ID NO: 165306 - DNA, 32 bp, Artificial Sequence
  Description of Artificial Sequence: Synthetic oligonucleotide
cacccacagaaccaagctccaaatctggtatc

SEQ ID NO: 165307 - DNA, 33 bp, Artificial Sequence
  Description of Artificial Sequence: Synthetic oligonucleotide
acccacagaaccaagctccaaatctggtatctg

SEQ ID NO: 165308 - DNA, 32 bp, Artificial Sequence
  Description of Artificial Sequence: Synthetic oligonucleotide
cccacagaaccaagctccaaatctggtatctg

SEQ ID NO: 165309 - DNA, 32 bp, Artificial Sequence
  Description of Artificial Sequence: Synthetic oligonucleotide
ccacagaaccaagctccaaatctggtatctgc

SEQ ID NO: 165310 - DNA, 33 bp, Artificial Sequence
  Description of Artificial Sequence: Synthetic oligonucleotide
cacagaaccaagctccaaatctggtatctgcag

SEQ ID NO: 165311 - DNA, 34 bp, Artificial Sequence
  Description of Artificial Sequence: Synthetic oligonucleotide
acagaaccaagctccaaatctggtatctgcagac

SEQ ID NO: 165312 - DNA, 33 bp, Artificial Sequence
  Description of Artificial Sequence: Synthetic oligonucleotide
cagaaccaagctccaaatctggtatctgcagac

SEQ ID NO: 165313 - DNA, 34 bp, Artificial Sequence
  Description of Artificial Sequence: Synthetic oligonucleotide
agaaccaagctccaaatctggtatctgcagacac

SEQ ID NO: 165314 - DNA, 33 bp, Artificial Sequence
  Description of Artificial Sequence: Synthetic oligonucleotide
gaaccaagctccaaatctggtatctgcagacac

SEQ ID NO: 165315 - DNA, 33 bp, Artificial Sequence
  Description of Artificial Sequence: Synthetic oligonucleotide
aaccaagctccaaatctggtatctgcagacacc

SEQ ID NO: 165316 - DNA, 32 bp, Artificial Sequence
  Description of Artificial Sequence: Synthetic oligonucleotide
accaagctccaaatctggtatctgcagacacc

SEQ ID NO: 165317 - DNA, 31 bp, Artificial Sequence
  Description of Artificial Sequence: Synthetic oligonucleotide
ccaagctccaaatctggtatctgcagacacc

SEQ ID NO: 165318 - DNA, 32 bp, Artificial Sequence
  Description of Artificial Sequence: Synthetic oligonucleotide
caagctccaaatctggtatctgcagacacctg

SEQ ID NO: 165319 - DNA, 32 bp, Artificial Sequence
  Description of Artificial Sequence: Synthetic oligonucleotide
aagctccaaatctggtatctgcagacacctgc

SEQ ID NO: 165320 - DNA, 31 bp, Artificial Sequence
  Description of Artificial Sequence: Synthetic oligonucleotide
agctccaaatctggtatctgcagacacctgc

SEQ ID NO: 165321 - DNA, 30 bp, Artificial Sequence
  Description of Artificial Sequence: Synthetic oligonucleotide
gctccaaatctggtatctgcagacacctgc

SEQ ID NO: 165322 - DNA, 32 bp, Artificial Sequence
  Description of Artificial Sequence: Synthetic oligonucleotide
ctccaaatctggtatctgcagacacctgcatg

SEQ ID NO: 165323 - DNA, 34 bp, Artificial Sequence
  Description of Artificial Sequence: Synthetic oligonucleotide
tccaaatctggtatctgcagacacctgcatgttc

SEQ ID NO: 165324 - DNA, 33 bp, Artificial Sequence
  Description of Artificial Sequence: Synthetic oligonucleotide
ccaaatctggtatctgcagacacctgcatgttc

SEQ ID NO: 165325 - DNA, 34 bp, Artificial Sequence
  Description of Artificial Sequence: Synthetic oligonucleotide
caaatctggtatctgcagacacctgcatgttctg

SEQ ID NO: 165326 - DNA, 37 bp, Artificial Sequence
  Description of Artificial Sequence: Synthetic oligonucleotide
aaatctggtatctgcagacacctgcatgttctgattg

SEQ ID NO: 165327 - DNA, 36 bp, Artificial Sequence
  Description of Artificial Sequence: Synthetic oligonucleotide
aatctggtatctgcagacacctgcatgttctgattg

SEQ ID NO: 165328 - DNA, 35 bp, Artificial Sequence
  Description of Artificial Sequence: Synthetic oligonucleotide
atctggtatctgcagacacctgcatgttctgattg

SEQ ID NO: 165329 - DNA, 34 bp, Artificial Sequence
  Description of Artificial Sequence: Synthetic oligonucleotide
tctggtatctgcagacacctgcatgttctgattg

SEQ ID NO: 165330 - DNA, 33 bp, Artificial Sequence
  Description of Artificial Sequence: Synthetic oligonucleotide
ctggtatctgcagacacctgcatgttctgattg

SEQ ID NO: 165331 - DNA, 33 bp, Artificial Sequence
  Description of Artificial Sequence: Synthetic oligonucleotide
tggtatctgcagacacctgcatgttctgattgg

SEQ ID NO: 165332 - DNA, 32 bp, Artificial Sequence
  Description of Artificial Sequence: Synthetic oligonucleotide
ggtatctgcagacacctgcatgttctgattgg

SEQ ID NO: 165333 - DNA, 32 bp, Artificial Sequence
  Description of Artificial Sequence: Synthetic oligonucleotide
gtatctgcagacacctgcatgttctgattggg

SEQ ID NO: 165334 - DNA, 33 bp, Artificial Sequence
  Description of Artificial Sequence: Synthetic oligonucleotide
tatctgcagacacctgcatgttctgattgggac

SEQ ID NO: 165335 - DNA, 32 bp, Artificial Sequence
  Description of Artificial Sequence: Synthetic oligonucleotide
atctgcagacacctgcatgttctgattgggac

SEQ ID NO: 165336 - DNA, 31 bp, Artificial Sequence
  Description of Artificial Sequence: Synthetic oligonucleotide
tctgcagacacctgcatgttctgattgggac

SEQ ID NO: 165337 - DNA, 30 bp, Artificial Sequence
  Description of Artificial Sequence: Synthetic oligonucleotide
ctgcagacacctgcatgttctgattgggac

SEQ ID NO: 165338 - DNA, 30 bp, Artificial Sequence
  Description of Artificial Sequence: Synthetic oligonucleotide
tgcagacacctgcatgttctgattgggacc

SEQ ID NO: 165339 - DNA, 29 bp, Artificial Sequence
  Description of Artificial Sequence: Synthetic oligonucleotide
gcagacacctgcatgttctgattgggacc

SEQ ID NO: 165340 - DNA, 33 bp, Artificial Sequence
  Description of Artificial Sequence: Synthetic oligonucleotide
catgttctgattgggacctcagtggtcatcttc

SEQ ID NO: 165341 - DNA, 33 bp, Artificial Sequence
  Description of Artificial Sequence: Synthetic oligonucleotide
atgttctgattgggacctcagtggtcatcttcc

SEQ ID NO: 165342 - DNA, 32 bp, Artificial Sequence
  Description of Artificial Sequence: Synthetic oligonucleotide
tgttctgattgggacctcagtggtcatcttcc

SEQ ID NO: 165343 - DNA, 31 bp, Artificial Sequence
  Description of Artificial Sequence: Synthetic oligonucleotide
gttctgattgggacctcagtggtcatcttcc

SEQ ID NO: 165344 - DNA, 32 bp, Artificial Sequence
  Description of Artificial Sequence: Synthetic oligonucleotide
ttctgattgggacctcagtggtcatcttcctc

SEQ ID NO: 165345 - DNA, 31 bp, Artificial Sequence
  Description of Artificial Sequence: Synthetic oligonucleotide
tctgattgggacctcagtggtcatcttcctc

SEQ ID NO: 165346 - DNA, 30 bp, Artificial Sequence
  Description of Artificial Sequence: Synthetic oligonucleotide
ctgattgggacctcagtggtcatcttcctc

SEQ ID NO: 165347 - DNA, 32 bp, Artificial Sequence
  Description of Artificial Sequence: Synthetic oligonucleotide
tgattgggacctcagtggtcatcttcctcttc

SEQ ID NO: 165348 - DNA, 31 bp, Artificial Sequence
  Description of Artificial Sequence: Synthetic oligonucleotide
gattgggacctcagtggtcatcttcctcttc

SEQ ID NO: 165349 - DNA, 33 bp, Artificial Sequence
  Description of Artificial Sequence: Synthetic oligonucleotide
attgggacctcagtggtcatcttcctcttcatc

SEQ ID NO: 165350 - DNA, 32 bp, Artificial Sequence
  Description of Artificial Sequence: Synthetic oligonucleotide
ttgggacctcagtggtcatcttcctcttcatc

SEQ ID NO: 165351 - DNA, 31 bp, Artificial Sequence
  Description of Artificial Sequence: Synthetic oligonucleotide
tgggacctcagtggtcatcttcctcttcatc

SEQ ID NO: 165352 - DNA, 30 bp, Artificial Sequence
  Description of Artificial Sequence: Synthetic oligonucleotide
gggacctcagtggtcatcttcctcttcatc

SEQ ID NO: 165353 - DNA, 30 bp, Artificial Sequence
  Description of Artificial Sequence: Synthetic oligonucleotide
ggacctcagtggtcatcttcctcttcatcc

SEQ ID NO: 165354 - DNA, 31 bp, Artificial Sequence
  Description of Artificial Sequence: Synthetic oligonucleotide
gacctcagtggtcatcttcctcttcatcctc

SEQ ID NO: 165355 - DNA, 31 bp, Artificial Sequence
  Description of Artificial Sequence: Synthetic oligonucleotide
acctcagtggtcatcttcctcttcatcctcc

SEQ ID NO: 165356 - DNA, 30 bp, Artificial Sequence
  Description of Artificial Sequence: Synthetic oligonucleotide
cctcagtggtcatcttcctcttcatcctcc

SEQ ID NO: 165357 - DNA, 31 bp, Artificial Sequence
  Description of Artificial Sequence: Synthetic oligonucleotide
ctcagtggtcatcttcctcttcatcctcctc

SEQ ID NO: 165358 - DNA, 31 bp, Artificial Sequence
  Description of Artificial Sequence: Synthetic oligonucleotide
tcagtggtcatcttcctcttcatcctcctcc

SEQ ID NO: 165359 - DNA, 30 bp, Artificial Sequence
  Description of Artificial Sequence: Synthetic oligonucleotide
cagtggtcatcttcctcttcatcctcctcc

SEQ ID NO: 165360 - DNA, 31 bp, Artificial Sequence
  Description of Artificial Sequence: Synthetic oligonucleotide
agtggtcatcttcctcttcatcctcctcctc

SEQ ID NO: 165361 - DNA, 30 bp, Artificial Sequence
  Description of Artificial Sequence: Synthetic oligonucleotide
gtggtcatcttcctcttcatcctcctcctc

SEQ ID NO: 165362 - DNA, 32 bp, Artificial Sequence
  Description of Artificial Sequence: Synthetic oligonucleotide
tggtcatcttcctcttcatcctcctcctcttc

SEQ ID NO: 165363 - DNA, 31 bp, Artificial Sequence
  Description of Artificial Sequence: Synthetic oligonucleotide
ggtcatcttcctcttcatcctcctcctcttc

SEQ ID NO: 165364 - DNA, 34 bp, Artificial Sequence
  Description of Artificial Sequence: Synthetic oligonucleotide
gtcatcttcctcttcatcctcctcctcttctttc

SEQ ID NO: 165365 - DNA, 35 bp, Artificial Sequence
  Description of Artificial Sequence: Synthetic oligonucleotide
tcatcttcctcttcatcctcctcctcttctttctc

SEQ ID NO: 165366 - DNA, 34 bp, Artificial Sequence
  Description of Artificial Sequence: Synthetic oligonucleotide
catcttcctcttcatcctcctcctcttctttctc

SEQ ID NO: 165367 - DNA, 34 bp, Artificial Sequence
  Description of Artificial Sequence: Synthetic oligonucleotide
atcttcctcttcatcctcctcctcttctttctcc

SEQ ID NO: 165368 - DNA, 33 bp, Artificial Sequence
  Description of Artificial Sequence: Synthetic oligonucleotide
tcttcctcttcatcctcctcctcttctttctcc

SEQ ID NO: 165369 - DNA, 32 bp, Artificial Sequence
  Description of Artificial Sequence: Synthetic oligonucleotide
cttcctcttcatcctcctcctcttctttctcc

SEQ ID NO: 165370 - DNA, 37 bp, Artificial Sequence
  Description of Artificial Sequence: Synthetic oligonucleotide
ttcctcttcatcctcctcctcttctttctcctttatc

SEQ ID NO: 165371 - DNA, 36 bp, Artificial Sequence
  Description of Artificial Sequence: Synthetic oligonucleotide
tcctcttcatcctcctcctcttctttctcctttatc

SEQ ID NO: 165372 - DNA, 35 bp, Artificial Sequence
  Description of Artificial Sequence: Synthetic oligonucleotide
cctcttcatcctcctcctcttctttctcctttatc

SEQ ID NO: 165373 - DNA, 35 bp, Artificial Sequence
  Description of Artificial Sequence: Synthetic oligonucleotide
ctcttcatcctcctcctcttctttctcctttatcg

SEQ ID NO: 165374 - DNA, 35 bp, Artificial Sequence
  Description of Artificial Sequence: Synthetic oligonucleotide
tcttcatcctcctcctcttctttctcctttatcgc

SEQ ID NO: 165375 - DNA, 34 bp, Artificial Sequence
  Description of Artificial Sequence: Synthetic oligonucleotide
cttcatcctcctcctcttctttctcctttatcgc

SEQ ID NO: 165376 - DNA, 35 bp, Artificial Sequence
  Description of Artificial Sequence: Synthetic oligonucleotide
ttcatcctcctcctcttctttctcctttatcgctg

SEQ ID NO: 165377 - DNA, 34 bp, Artificial Sequence
  Description of Artificial Sequence: Synthetic oligonucleotide
tcatcctcctcctcttctttctcctttatcgctg

SEQ ID NO: 165378 - DNA, 33 bp, Artificial Sequence
  Description of Artificial Sequence: Synthetic oligonucleotide
catcctcctcctcttctttctcctttatcgctg

SEQ ID NO: 165379 - DNA, 33 bp, Artificial Sequence
  Description of Artificial Sequence: Synthetic oligonucleotide
atcctcctcctcttctttctcctttatcgctgg

SEQ ID NO: 165380 - DNA, 32 bp, Artificial Sequence
  Description of Artificial Sequence: Synthetic oligonucleotide
tcctcctcctcttctttctcctttatcgctgg

SEQ ID NO: 165381 - DNA, 31 bp, Artificial Sequence
  Description of Artificial Sequence: Synthetic oligonucleotide
cctcctcctcttctttctcctttatcgctgg

SEQ ID NO: 165382 - DNA, 32 bp, Artificial Sequence
  Description of Artificial Sequence: Synthetic oligonucleotide
ctcctcctcttctttctcctttatcgctggtg

SEQ ID NO: 165383 - DNA, 32 bp, Artificial Sequence
  Description of Artificial Sequence: Synthetic oligonucleotide
tcctcctcttctttctcctttatcgctggtgc

SEQ ID NO: 165384 - DNA, 31 bp, Artificial Sequence
  Description of Artificial Sequence: Synthetic oligonucleotide
cctcctcttctttctcctttatcgctggtgc

SEQ ID NO: 165385 - DNA, 32 bp, Artificial Sequence
  Description of Artificial Sequence: Synthetic oligonucleotide
ctcctcttctttctcctttatcgctggtgctc

SEQ ID NO: 165386 - DNA, 32 bp, Artificial Sequence
  Description of Artificial Sequence: Synthetic oligonucleotide
tcctcttctttctcctttatcgctggtgctcc

SEQ ID NO: 165387 - DNA, 31 bp, Artificial Sequence
  Description of Artificial Sequence: Synthetic oligonucleotide
cctcttctttctcctttatcgctggtgctcc

SEQ ID NO: 165388 - DNA, 33 bp, Artificial Sequence
  Description of Artificial Sequence: Synthetic oligonucleotide
ctcttctttctcctttatcgctggtgctccaac

SEQ ID NO: 165389 - DNA, 38 bp, Artificial Sequence
  Description of Artificial Sequence: Synthetic oligonucleotide
tcttctttctcctttatcgctggtgctccaacaaaaag

SEQ ID NO: 165390 - DNA, 37 bp, Artificial Sequence
  Description of Artificial Sequence: Synthetic oligonucleotide
cttctttctcctttatcgctggtgctccaacaaaaag

SEQ ID NO: 165391 - DNA, 40 bp, Artificial Sequence
  Description of Artificial Sequence: Synthetic oligonucleotide
ttctttctcctttatcgctggtgctccaacaaaaagaatg

SEQ ID NO: 165392 - DNA, 39 bp, Artificial Sequence
  Description of Artificial Sequence: Synthetic oligonucleotide
tctttctcctttatcgctggtgctccaacaaaaagaatg

SEQ ID NO: 165393 - DNA, 38 bp, Artificial Sequence
  Description of Artificial Sequence: Synthetic oligonucleotide
ctttctcctttatcgctggtgctccaacaaaaagaatg

SEQ ID NO: 165394 - DNA, 38 bp, Artificial Sequence
  Description of Artificial Sequence: Synthetic oligonucleotide
tttctcctttatcgctggtgctccaacaaaaagaatgc

SEQ ID NO: 165395 - DNA, 37 bp, Artificial Sequence
  Description of Artificial Sequence: Synthetic oligonucleotide
ttctcctttatcgctggtgctccaacaaaaagaatgc

SEQ ID NO: 165396 - DNA, 36 bp, Artificial Sequence
  Description of Artificial Sequence: Synthetic oligonucleotide
tctcctttatcgctggtgctccaacaaaaagaatgc

SEQ ID NO: 165397 - DNA, 35 bp, Artificial Sequence
  Description of Artificial Sequence: Synthetic oligonucleotide
ctcctttatcgctggtgctccaacaaaaagaatgc

SEQ ID NO: 165398 - DNA, 36 bp, Artificial Sequence
  Description of Artificial Sequence: Synthetic oligonucleotide
tcctttatcgctggtgctccaacaaaaagaatgctg

SEQ ID NO: 165399 - DNA, 35 bp, Artificial Sequence
  Description of Artificial Sequence: Synthetic oligonucleotide
cctttatcgctggtgctccaacaaaaagaatgctg

SEQ ID NO: 165400 - DNA, 35 bp, Artificial Sequence
  Description of Artificial Sequence: Synthetic oligonucleotide
ctttatcgctggtgctccaacaaaaagaatgctgc

SEQ ID NO: 165401 - DNA, 36 bp, Artificial Sequence
  Description of Artificial Sequence: Synthetic oligonucleotide
tttatcgctggtgctccaacaaaaagaatgctgctg

SEQ ID NO: 165402 - DNA, 35 bp, Artificial Sequence
  Description of Artificial Sequence: Synthetic oligonucleotide
ttatcgctggtgctccaacaaaaagaatgctgctg

SEQ ID NO: 165403 - DNA, 34 bp, Artificial Sequence
  Description of Artificial Sequence: Synthetic oligonucleotide
tatcgctggtgctccaacaaaaagaatgctgctg

SEQ ID NO: 165404 - DNA, 33 bp, Artificial Sequence
  Description of Artificial Sequence: Synthetic oligonucleotide
atcgctggtgctccaacaaaaagaatgctgctg

SEQ ID NO: 165405 - DNA, 32 bp, Artificial Sequence
  Description of Artificial Sequence: Synthetic oligonucleotide
tcgctggtgctccaacaaaaagaatgctgctg

SEQ ID NO: 165406 - DNA, 31 bp, Artificial Sequence
  Description of Artificial Sequence: Synthetic oligonucleotide
cgctggtgctccaacaaaaagaatgctgctg

SEQ ID NO: 165407 - DNA, 35 bp, Artificial Sequence
  Description of Artificial Sequence: Synthetic oligonucleotide
gctggtgctccaacaaaaagaatgctgctgtaatg

SEQ ID NO: 165408 - DNA, 35 bp, Artificial Sequence
  Description of Artificial Sequence: Synthetic oligonucleotide
ctggtgctccaacaaaaagaatgctgctgtaatgg

SEQ ID NO: 165409 - DNA, 36 bp, Artificial Sequence
  Description of Artificial Sequence: Synthetic oligonucleotide
tggtgctccaacaaaaagaatgctgctgtaatggac

SEQ ID NO: 165410 - DNA, 35 bp, Artificial Sequence
  Description of Artificial Sequence: Synthetic oligonucleotide
ggtgctccaacaaaaagaatgctgctgtaatggac

SEQ ID NO: 165411 - DNA, 35 bp, Artificial Sequence
  Description of Artificial Sequence: Synthetic oligonucleotide
gtgctccaacaaaaagaatgctgctgtaatggacc

SEQ ID NO: 165412 - DNA, 30 bp, Artificial Sequence
  Description of Artificial Sequence: Synthetic oligonucleotide
aatgctgctgtaatggaccaagagcctgcg

SEQ ID NO: 165413 - DNA, 29 bp, Artificial Sequence
  Description of Artificial Sequence: Synthetic oligonucleotide
atgctgctgtaatggaccaagagcctgcg

SEQ ID NO: 165414 - DNA, 28 bp, Artificial Sequence
  Description of Artificial Sequence: Synthetic oligonucleotide
tgctgctgtaatggaccaagagcctgcg

SEQ ID NO: 165415 - DNA, 27 bp, Artificial Sequence
  Description of Artificial Sequence: Synthetic oligonucleotide
gctgctgtaatggaccaagagcctgcg

SEQ ID NO: 165416 - DNA, 27 bp, Artificial Sequence
  Description of Artificial Sequence: Synthetic oligonucleotide
ctgctgtaatggaccaagagcctgcgg

SEQ ID NO: 165417 - DNA, 27 bp, Artificial Sequence
  Description of Artificial Sequence: Synthetic oligonucleotide
tgctgtaatggaccaagagcctgcggg

SEQ ID NO: 165418 - DNA, 26 bp, Artificial Sequence
  Description of Artificial Sequence: Synthetic oligonucleotide
gctgtaatggaccaagagcctgcggg

SEQ ID NO: 165419 - DNA, 26 bp, Artificial Sequence
  Description of Artificial Sequence: Synthetic oligonucleotide
ctgtaatggaccaagagcctgcgggg

SEQ ID NO: 165420 - DNA, 27 bp, Artificial Sequence
  Description of Artificial Sequence: Synthetic oligonucleotide
tgtaatggaccaagagcctgcggggga

SEQ ID NO: 165421 - DNA, 26 bp, Artificial Sequence
  Description of Artificial Sequence: Synthetic oligonucleotide
gtaatggaccaagagcctgcggggga

SEQ ID NO: 165422 - DNA, 27 bp, Artificial Sequence
  Description of Artificial Sequence: Synthetic oligonucleotide
taatggaccaagagcctgcgggggaca

SEQ ID NO: 165423 - DNA, 26 bp, Artificial Sequence
  Description of Artificial Sequence: Synthetic oligonucleotide
aatggaccaagagcctgcgggggaca

SEQ ID NO: 165424 - DNA, 25 bp, Artificial Sequence
  Description of Artificial Sequence: Synthetic oligonucleotide
atggaccaagagcctgcgggggaca

SEQ ID NO: 165425 - DNA, 24 bp, Artificial Sequence
  Description of Artificial Sequence: Synthetic oligonucleotide
tggaccaagagcctgcgggggaca

SEQ ID NO: 165426 - DNA, 23 bp, Artificial Sequence
  Description of Artificial Sequence: Synthetic oligonucleotide
ggaccaagagcctgcgggggaca

SEQ ID NO: 165427 - DNA, 25 bp, Artificial Sequence
  Description of Artificial Sequence: Synthetic oligonucleotide
gaccaagagcctgcgggggacagaa

SEQ ID NO: 165428 - DNA, 26 bp, Artificial Sequence
  Description of Artificial Sequence: Synthetic oligonucleotide
accaagagcctgcgggggacagaaca

SEQ ID NO: 165429 - DNA, 25 bp, Artificial Sequence
  Description of Artificial Sequence: Synthetic oligonucleotide
ccaagagcctgcgggggacagaaca

SEQ ID NO: 165430 - DNA, 26 bp, Artificial Sequence
  Description of Artificial Sequence: Synthetic oligonucleotide
caagagcctgcgggggacagaacagt

SEQ ID NO: 165431 - DNA, 27 bp, Artificial Sequence
  Description of Artificial Sequence: Synthetic oligonucleotide
aagagcctgcgggggacagaacagtga

SEQ ID NO: 165432 - DNA, 27 bp, Artificial Sequence
  Description of Artificial Sequence: Synthetic oligonucleotide
agagcctgcgggggacagaacagtgaa

SEQ ID NO: 165433 - DNA, 27 bp, Artificial Sequence
  Description of Artificial Sequence: Synthetic oligonucleotide
gagcctgcgggggacagaacagtgaat

SEQ ID NO: 165434 - DNA, 28 bp, Artificial Sequence
  Description of Artificial Sequence: Synthetic oligonucleotide
agcctgcgggggacagaacagtgaatag

SEQ ID NO: 165435 - DNA, 27 bp, Artificial Sequence
  Description of Artificial Sequence: Synthetic oligonucleotide
gcctgcgggggacagaacagtgaatag

SEQ ID NO: 165436 - DNA, 27 bp, Artificial Sequence
  Description of Artificial Sequence: Synthetic oligonucleotide
cctgcgggggacagaacagtgaatagg

SEQ ID NO: 165437 - DNA, 27 bp, Artificial Sequence
  Description of Artificial Sequence: Synthetic oligonucleotide
ctgcgggggacagaacagtgaataggc

SEQ ID NO: 165438 - DNA, 28 bp, Artificial Sequence
  Description of Artificial Sequence: Synthetic oligonucleotide
tgcgggggacagaacagtgaataggcag

SEQ ID NO: 165439 - DNA, 27 bp, Artificial Sequence
  Description of Artificial Sequence: Synthetic oligonucleotide
gcgggggacagaacagtgaataggcag

SEQ ID NO: 165440 - DNA, 27 bp, Artificial Sequence
  Description of Artificial Sequence: Synthetic oligonucleotide
cgggggacagaacagtgaataggcagg

SEQ ID NO: 165441 - DNA, 28 bp, Artificial Sequence
  Description of Artificial Sequence: Synthetic oligonucleotide
gggggacagaacagtgaataggcaggac

SEQ ID NO: 165442 - DNA, 29 bp, Artificial Sequence
  Description of Artificial Sequence: Synthetic oligonucleotide
ggggacagaacagtgaataggcaggactc

SEQ ID NO: 165443 - DNA, 30 bp, Artificial Sequence
  Description of Artificial Sequence: Synthetic oligonucleotide
gggacagaacagtgaataggcaggactctg

SEQ ID NO: 165444 - DNA, 32 bp, Artificial Sequence
  Description of Artificial Sequence: Synthetic oligonucleotide
ggacagaacagtgaataggcaggactctgatg

SEQ ID NO: 165445 - DNA, 34 bp, Artificial Sequence
  Description of Artificial Sequence: Synthetic oligonucleotide
gacagaacagtgaataggcaggactctgatgaac

SEQ ID NO: 165446 - DNA, 36 bp, Artificial Sequence
  Description of Artificial Sequence: Synthetic oligonucleotide
acagaacagtgaataggcaggactctgatgaacaag

SEQ ID NO: 165447 - DNA, 35 bp, Artificial Sequence
  Description of Artificial Sequence: Synthetic oligonucleotide
cagaacagtgaataggcaggactctgatgaacaag

SEQ ID NO: 165448 - DNA, 36 bp, Artificial Sequence
  Description of Artificial Sequence: Synthetic oligonucleotide
agaacagtgaataggcaggactctgatgaacaagac

SEQ ID NO: 165449 - DNA, 35 bp, Artificial Sequence
  Description of Artificial Sequence: Synthetic oligonucleotide
gaacagtgaataggcaggactctgatgaacaagac

SEQ ID NO: 165450 - DNA, 35 bp, Artificial Sequence
  Description of Artificial Sequence: Synthetic oligonucleotide
aacagtgaataggcaggactctgatgaacaagacc

SEQ ID NO: 165451 - DNA, 34 bp, Artificial Sequence
  Description of Artificial Sequence: Synthetic oligonucleotide
acagtgaataggcaggactctgatgaacaagacc

SEQ ID NO: 165452 - DNA, 33 bp, Artificial Sequence
  Description of Artificial Sequence: Synthetic oligonucleotide
cagtgaataggcaggactctgatgaacaagacc

SEQ ID NO: 165453 - DNA, 33 bp, Artificial Sequence
  Description of Artificial Sequence: Synthetic oligonucleotide
agtgaataggcaggactctgatgaacaagaccc

SEQ ID NO: 165454 - DNA, 32 bp, Artificial Sequence
  Description of Artificial Sequence: Synthetic oligonucleotide
gtgaataggcaggactctgatgaacaagaccc

SEQ ID NO: 165455 - DNA, 33 bp, Artificial Sequence
  Description of Artificial Sequence: Synthetic oligonucleotide
tgaataggcaggactctgatgaacaagaccctc

SEQ ID NO: 165456 - DNA, 32 bp, Artificial Sequence
  Description of Artificial Sequence: Synthetic oligonucleotide
gaataggcaggactctgatgaacaagaccctc

SEQ ID NO: 165457 - DNA, 33 bp, Artificial Sequence
  Description of Artificial Sequence: Synthetic oligonucleotide
aataggcaggactctgatgaacaagaccctcag

SEQ ID NO: 165458 - DNA, 32 bp, Artificial Sequence
  Description of Artificial Sequence: Synthetic oligonucleotide
ataggcaggactctgatgaacaagaccctcag

SEQ ID NO: 165459 - DNA, 31 bp, Artificial Sequence
  Description of Artificial Sequence: Synthetic oligonucleotide
taggcaggactctgatgaacaagaccctcag

SEQ ID NO: 165460 - DNA, 30 bp, Artificial Sequence
  Description of Artificial Sequence: Synthetic oligonucleotide
atgaacaagaccctcaggaggtgacgtacg

SEQ ID NO: 165461 - DNA, 29 bp, Artificial Sequence
  Description of Artificial Sequence: Synthetic oligonucleotide
tgaacaagaccctcaggaggtgacgtacg

SEQ ID NO: 165462 - DNA, 28 bp, Artificial Sequence
  Description of Artificial Sequence: Synthetic oligonucleotide
gaacaagaccctcaggaggtgacgtacg

SEQ ID NO: 165463 - DNA, 28 bp, Artificial Sequence
  Description of Artificial Sequence: Synthetic oligonucleotide
aacaagaccctcaggaggtgacgtacgc

SEQ ID NO: 165464 - DNA, 27 bp, Artificial Sequence
  Description of Artificial Sequence: Synthetic oligonucleotide
acaagaccctcaggaggtgacgtacgc

SEQ ID NO: 165465 - DNA, 27 bp, Artificial Sequence
  Description of Artificial Sequence: Synthetic oligonucleotide
caagaccctcaggaggtgacgtacgca

SEQ ID NO: 165466 - DNA, 27 bp, Artificial Sequence
  Description of Artificial Sequence: Synthetic oligonucleotide
aagaccctcaggaggtgacgtacgcac

SEQ ID NO: 165467 - DNA, 27 bp, Artificial Sequence
  Description of Artificial Sequence: Synthetic oligonucleotide
agaccctcaggaggtgacgtacgcaca

SEQ ID NO: 165468 - DNA, 26 bp, Artificial Sequence
  Description of Artificial Sequence: Synthetic oligonucleotide
gaccctcaggaggtgacgtacgcaca

SEQ ID NO: 165469 - DNA, 27 bp, Artificial Sequence
  Description of Artificial Sequence: Synthetic oligonucleotide
accctcaggaggtgacgtacgcacagt

SEQ ID NO: 165470 - DNA, 27 bp, Artificial Sequence
  Description of Artificial Sequence: Synthetic oligonucleotide
ccctcaggaggtgacgtacgcacagtt

SEQ ID NO: 165471 - DNA, 27 bp, Artificial Sequence
  Description of Artificial Sequence: Synthetic oligonucleotide
cctcaggaggtgacgtacgcacagttg

SEQ ID NO: 165472 - DNA, 27 bp, Artificial Sequence
  Description of Artificial Sequence: Synthetic oligonucleotide
ctcaggaggtgacgtacgcacagttgg

SEQ ID NO: 165473 - DNA, 29 bp, Artificial Sequence
  Description of Artificial Sequence: Synthetic oligonucleotide
tcaggaggtgacgtacgcacagttggatc

SEQ ID NO: 165474 - DNA, 28 bp, Artificial Sequence
  Description of Artificial Sequence: Synthetic oligonucleotide
caggaggtgacgtacgcacagttggatc

SEQ ID NO: 165475 - DNA, 29 bp, Artificial Sequence
  Description of Artificial Sequence: Synthetic oligonucleotide
aggaggtgacgtacgcacagttggatcac

SEQ ID NO: 165476 - DNA, 28 bp, Artificial Sequence
  Description of Artificial Sequence: Synthetic oligonucleotide
ggaggtgacgtacgcacagttggatcac

SEQ ID NO: 165477 - DNA, 29 bp, Artificial Sequence
  Description of Artificial Sequence: Synthetic oligonucleotide
gaggtgacgtacgcacagttggatcactg

SEQ ID NO: 165478 - DNA, 29 bp, Artificial Sequence
  Description of Artificial Sequence: Synthetic oligonucleotide
aggtgacgtacgcacagttggatcactgc

SEQ ID NO: 165479 - DNA, 28 bp, Artificial Sequence
  Description of Artificial Sequence: Synthetic oligonucleotide
ggtgacgtacgcacagttggatcactgc

SEQ ID NO: 165480 - DNA, 28 bp, Artificial Sequence
  Description of Artificial Sequence: Synthetic oligonucleotide
gtgacgtacgcacagttggatcactgcg

SEQ ID NO: 165481 - DNA, 32 bp, Artificial Sequence
  Description of Artificial Sequence: Synthetic oligonucleotide
tgacgtacgcacagttggatcactgcgttttc

SEQ ID NO: 165482 - DNA, 31 bp, Artificial Sequence
  Description of Artificial Sequence: Synthetic oligonucleotide
gacgtacgcacagttggatcactgcgttttc

SEQ ID NO: 165483 - DNA, 34 bp, Artificial Sequence
  Description of Artificial Sequence: Synthetic oligonucleotide
acgtacgcacagttggatcactgcgttttcatac

SEQ ID NO: 165484 - DNA, 33 bp, Artificial Sequence
  Description of Artificial Sequence: Synthetic oligonucleotide
cgtacgcacagttggatcactgcgttttcatac

SEQ ID NO: 165485 - DNA, 34 bp, Artificial Sequence
  Description of Artificial Sequence: Synthetic oligonucleotide
gtacgcacagttggatcactgcgttttcatacag

SEQ ID NO: 165486 - DNA, 35 bp, Artificial Sequence
  Description of Artificial Sequence: Synthetic oligonucleotide
tacgcacagttggatcactgcgttttcatacagag

SEQ ID NO: 165487 - DNA, 34 bp, Artificial Sequence
  Description of Artificial Sequence: Synthetic oligonucleotide
acgcacagttggatcactgcgttttcatacagag

SEQ ID NO: 165488 - DNA, 33 bp, Artificial Sequence
  Description of Artificial Sequence: Synthetic oligonucleotide
cgcacagttggatcactgcgttttcatacagag

SEQ ID NO: 165489 - DNA, 39 bp, Artificial Sequence
  Description of Artificial Sequence: Synthetic oligonucleotide
gcacagttggatcactgcgttttcatacagagaaaaatc

SEQ ID NO: 165490 - DNA, 40 bp, Artificial Sequence
  Description of Artificial Sequence: Synthetic oligonucleotide
cacagttggatcactgcgttttcatacagagaaaaatcag

SEQ ID NO: 165491 - DNA, 41 bp, Artificial Sequence
  Description of Artificial Sequence: Synthetic oligonucleotide
acagttggatcactgcgttttcatacagagaaaaatcagtc

SEQ ID NO: 165492 - DNA, 40 bp, Artificial Sequence
  Description of Artificial Sequence: Synthetic oligonucleotide
cagttggatcactgcgttttcatacagagaaaaatcagtc

SEQ ID NO: 165493 - DNA, 40 bp, Artificial Sequence
  Description of Artificial Sequence: Synthetic oligonucleotide
agttggatcactgcgttttcatacagagaaaaatcagtcg

SEQ ID NO: 165494 - DNA, 39 bp, Artificial Sequence
  Description of Artificial Sequence: Synthetic oligonucleotide
gttggatcactgcgttttcatacagagaaaaatcagtcg

SEQ ID NO: 165495 - DNA, 39 bp, Artificial Sequence
  Description of Artificial Sequence: Synthetic oligonucleotide
ttggatcactgcgttttcatacagagaaaaatcagtcgc

SEQ ID NO: 165496 - DNA, 38 bp, Artificial Sequence
  Description of Artificial Sequence: Synthetic oligonucleotide
tggatcactgcgttttcatacagagaaaaatcagtcgc

SEQ ID NO: 165497 - DNA, 37 bp, Artificial Sequence
  Description of Artificial Sequence: Synthetic oligonucleotide
ggatcactgcgttttcatacagagaaaaatcagtcgc

SEQ ID NO: 165498 - DNA, 37 bp, Artificial Sequence
  Description of Artificial Sequence: Synthetic oligonucleotide
gatcactgcgttttcatacagagaaaaatcagtcgcc

SEQ ID NO: 165499 - DNA, 37 bp, Artificial Sequence
  Description of Artificial Sequence: Synthetic oligonucleotide
atcactgcgttttcatacagagaaaaatcagtcgccc

SEQ ID NO: 165500 - DNA, 36 bp, Artificial Sequence
  Description of Artificial Sequence: Synthetic oligonucleotide
tcactgcgttttcatacagagaaaaatcagtcgccc

SEQ ID NO: 165501 - DNA, 35 bp, Artificial Sequence
  Description of Artificial Sequence: Synthetic oligonucleotide
cactgcgttttcatacagagaaaaatcagtcgccc

SEQ ID NO: 165502 - DNA, 37 bp, Artificial Sequence
  Description of Artificial Sequence: Synthetic oligonucleotide
actgcgttttcatacagagaaaaatcagtcgcccttc

SEQ ID NO: 165503 - DNA, 36 bp, Artificial Sequence
  Description of Artificial Sequence: Synthetic oligonucleotide
ctgcgttttcatacagagaaaaatcagtcgcccttc

SEQ ID NO: 165504 - DNA, 37 bp, Artificial Sequence
  Description of Artificial Sequence: Synthetic oligonucleotide
tgcgttttcatacagagaaaaatcagtcgcccttctc

SEQ ID NO: 165505 - DNA, 36 bp, Artificial Sequence
  Description of Artificial Sequence: Synthetic oligonucleotide
gcgttttcatacagagaaaaatcagtcgcccttctc

SEQ ID NO: 165506 - DNA, 37 bp, Artificial Sequence
  Description of Artificial Sequence: Synthetic oligonucleotide
cgttttcatacagagaaaaatcagtcgcccttctcag

SEQ ID NO: 165507 - DNA, 38 bp, Artificial Sequence
  Description of Artificial Sequence: Synthetic oligonucleotide
gttttcatacagagaaaaatcagtcgcccttctcagag

SEQ ID NO: 165508 - DNA, 38 bp, Artificial Sequence
  Description of Artificial Sequence: Synthetic oligonucleotide
ttttcatacagagaaaaatcagtcgcccttctcagagg

SEQ ID NO: 165509 - DNA, 37 bp, Artificial Sequence
  Description of Artificial Sequence: Synthetic oligonucleotide
tttcatacagagaaaaatcagtcgcccttctcagagg

SEQ ID NO: 165510 - DNA, 36 bp, Artificial Sequence
  Description of Artificial Sequence: Synthetic oligonucleotide
ttcatacagagaaaaatcagtcgcccttctcagagg

SEQ ID NO: 165511 - DNA, 35 bp, Artificial Sequence
  Description of Artificial Sequence: Synthetic oligonucleotide
tcatacagagaaaaatcagtcgcccttctcagagg

SEQ ID NO: 165512 - DNA, 34 bp, Artificial Sequence
  Description of Artificial Sequence: Synthetic oligonucleotide
catacagagaaaaatcagtcgcccttctcagagg

SEQ ID NO: 165513 - DNA, 34 bp, Artificial Sequence
  Description of Artificial Sequence: Synthetic oligonucleotide
atacagagaaaaatcagtcgcccttctcagaggc

SEQ ID NO: 165514 - DNA, 33 bp, Artificial Sequence
  Description of Artificial Sequence: Synthetic oligonucleotide
tacagagaaaaatcagtcgcccttctcagaggc

SEQ ID NO: 165515 - DNA, 32 bp, Artificial Sequence
  Description of Artificial Sequence: Synthetic oligonucleotide
acagagaaaaatcagtcgcccttctcagaggc

SEQ ID NO: 165516 - DNA, 31 bp, Artificial Sequence
  Description of Artificial Sequence: Synthetic oligonucleotide
cagagaaaaatcagtcgcccttctcagaggc

SEQ ID NO: 165517 - DNA, 31 bp, Artificial Sequence
  Description of Artificial Sequence: Synthetic oligonucleotide
agagaaaaatcagtcgcccttctcagaggcc

SEQ ID NO: 165518 - DNA, 30 bp, Artificial Sequence
  Description of Artificial Sequence: Synthetic oligonucleotide
gagaaaaatcagtcgcccttctcagaggcc

SEQ ID NO: 165519 - DNA, 30 bp, Artificial Sequence
  Description of Artificial Sequence: Synthetic oligonucleotide
agaaaaatcagtcgcccttctcagaggccc

SEQ ID NO: 165520 - DNA, 29 bp, Artificial Sequence
  Description of Artificial Sequence: Synthetic oligonucleotide
gaaaaatcagtcgcccttctcagaggccc

SEQ ID NO: 165521 - DNA, 31 bp, Artificial Sequence
  Description of Artificial Sequence: Synthetic oligonucleotide
aaaaatcagtcgcccttctcagaggcccaag

SEQ ID NO: 165522 - DNA, 30 bp, Artificial Sequence
  Description of Artificial Sequence: Synthetic oligonucleotide
aaaatcagtcgcccttctcagaggcccaag

SEQ ID NO: 165523 - DNA, 29 bp, Artificial Sequence
  Description of Artificial Sequence: Synthetic oligonucleotide
aaatcagtcgcccttctcagaggcccaag

SEQ ID NO: 165524 - DNA, 28 bp, Artificial Sequence
  Description of Artificial Sequence: Synthetic oligonucleotide
aatcagtcgcccttctcagaggcccaag

SEQ ID NO: 165525 - DNA, 27 bp, Artificial Sequence
  Description of Artificial Sequence: Synthetic oligonucleotide
atcagtcgcccttctcagaggcccaag

SEQ ID NO: 165526 - DNA, 27 bp, Artificial Sequence
  Description of Artificial Sequence: Synthetic oligonucleotide
tcagtcgcccttctcagaggcccaaga

SEQ ID NO: 165527 - DNA, 26 bp, Artificial Sequence
  Description of Artificial Sequence: Synthetic oligonucleotide
cagtcgcccttctcagaggcccaaga

SEQ ID NO: 165528 - DNA, 27 bp, Artificial Sequence
  Description of Artificial Sequence: Synthetic oligonucleotide
agtcgcccttctcagaggcccaagaca

SEQ ID NO: 165529 - DNA, 26 bp, Artificial Sequence
  Description of Artificial Sequence: Synthetic oligonucleotide
gtcgcccttctcagaggcccaagaca

SEQ ID NO: 165530 - DNA, 27 bp, Artificial Sequence
  Description of Artificial Sequence: Synthetic oligonucleotide
ccttctcagaggcccaagacaccccta

SEQ ID NO: 165531 - DNA, 28 bp, Artificial Sequence
  Description of Artificial Sequence: Synthetic oligonucleotide
cttctcagaggcccaagacacccctaac

SEQ ID NO: 165532 - DNA, 29 bp, Artificial Sequence
  Description of Artificial Sequence: Synthetic oligonucleotide
ttctcagaggcccaagacacccctaacag

SEQ ID NO: 165533 - DNA, 28 bp, Artificial Sequence
  Description of Artificial Sequence: Synthetic oligonucleotide
tctcagaggcccaagacacccctaacag

SEQ ID NO: 165534 - DNA, 27 bp, Artificial Sequence
  Description of Artificial Sequence: Synthetic oligonucleotide
ctcagaggcccaagacacccctaacag

SEQ ID NO: 165535 - DNA, 30 bp, Artificial Sequence
  Description of Artificial Sequence: Synthetic oligonucleotide
tcagaggcccaagacacccctaacagatac

SEQ ID NO: 165536 - DNA, 29 bp, Artificial Sequence
  Description of Artificial Sequence: Synthetic oligonucleotide
cagaggcccaagacacccctaacagatac

SEQ ID NO: 165537 - DNA, 29 bp, Artificial Sequence
  Description of Artificial Sequence: Synthetic oligonucleotide
agaggcccaagacacccctaacagatacc

SEQ ID NO: 165538 - DNA, 28 bp, Artificial Sequence
  Description of Artificial Sequence: Synthetic oligonucleotide
gaggcccaagacacccctaacagatacc

SEQ ID NO: 165539 - DNA, 29 bp, Artificial Sequence
  Description of Artificial Sequence: Synthetic oligonucleotide
aggcccaagacacccctaacagataccag

SEQ ID NO: 165540 - DNA, 28 bp, Artificial Sequence
  Description of Artificial Sequence: Synthetic oligonucleotide
ggcccaagacacccctaacagataccag

SEQ ID NO: 165541 - DNA, 28 bp, Artificial Sequence
  Description of Artificial Sequence: Synthetic oligonucleotide
gcccaagacacccctaacagataccagc

SEQ ID NO: 165542 - DNA, 28 bp, Artificial Sequence
  Description of Artificial Sequence: Synthetic oligonucleotide
cccaagacacccctaacagataccagcg

SEQ ID NO: 165543 - DNA, 29 bp, Artificial Sequence
  Description of Artificial Sequence: Synthetic oligonucleotide
ccaagacacccctaacagataccagcgtg

SEQ ID NO: 165544 - DNA, 31 bp, Artificial Sequence
  Description of Artificial Sequence: Synthetic oligonucleotide
caagacacccctaacagataccagcgtgtac

SEQ ID NO: 165545 - DNA, 32 bp, Artificial Sequence
  Description of Artificial Sequence: Synthetic oligonucleotide
aagacacccctaacagataccagcgtgtacac

SEQ ID NO: 165546 - DNA, 31 bp, Artificial Sequence
  Description of Artificial Sequence: Synthetic oligonucleotide
agacacccctaacagataccagcgtgtacac

SEQ ID NO: 165547 - DNA, 30 bp, Artificial Sequence
  Description of Artificial Sequence: Synthetic oligonucleotide
gacacccctaacagataccagcgtgtacac

SEQ ID NO: 165548 - DNA, 30 bp, Artificial Sequence
  Description of Artificial Sequence: Synthetic oligonucleotide
acacccctaacagataccagcgtgtacacg

SEQ ID NO: 165549 - DNA, 29 bp, Artificial Sequence
  Description of Artificial Sequence: Synthetic oligonucleotide
cacccctaacagataccagcgtgtacacg

SEQ ID NO: 165550 - DNA, 29 bp, Artificial Sequence
  Description of Artificial Sequence: Synthetic oligonucleotide
acccctaacagataccagcgtgtacacgg

SEQ ID NO: 165551 - DNA, 28 bp, Artificial Sequence
  Description of Artificial Sequence: Synthetic oligonucleotide
cccctaacagataccagcgtgtacacgg

SEQ ID NO: 165552 - DNA, 30 bp, Artificial Sequence
  Description of Artificial Sequence: Synthetic oligonucleotide
ccctaacagataccagcgtgtacacggaac

SEQ ID NO: 165553 - DNA, 32 bp, Artificial Sequence
  Description of Artificial Sequence: Synthetic oligonucleotide
cctaacagataccagcgtgtacacggaacttc

SEQ ID NO: 165554 - DNA, 32 bp, Artificial Sequence
  Description of Artificial Sequence: Synthetic oligonucleotide
ctaacagataccagcgtgtacacggaacttcc

SEQ ID NO: 165555 - DNA, 36 bp, Artificial Sequence
  Description of Artificial Sequence: Synthetic oligonucleotide
taacagataccagcgtgtacacggaacttccaaatg

SEQ ID NO: 165556 - DNA, 35 bp, Artificial Sequence
  Description of Artificial Sequence: Synthetic oligonucleotide
aacagataccagcgtgtacacggaacttccaaatg

SEQ ID NO: 165557 - DNA, 34 bp, Artificial Sequence
  Description of Artificial Sequence: Synthetic oligonucleotide
acagataccagcgtgtacacggaacttccaaatg

SEQ ID NO: 165558 - DNA, 33 bp, Artificial Sequence
  Description of Artificial Sequence: Synthetic oligonucleotide
cagataccagcgtgtacacggaacttccaaatg

SEQ ID NO: 165559 - DNA, 33 bp, Artificial Sequence
  Description of Artificial Sequence: Synthetic oligonucleotide
agataccagcgtgtacacggaacttccaaatgc

SEQ ID NO: 165560 - DNA, 32 bp, Artificial Sequence
  Description of Artificial Sequence: Synthetic oligonucleotide
gataccagcgtgtacacggaacttccaaatgc

SEQ ID NO: 165561 - DNA, 33 bp, Artificial Sequence
  Description of Artificial Sequence: Synthetic oligonucleotide
ataccagcgtgtacacggaacttccaaatgctg

SEQ ID NO: 165562 - DNA, 32 bp, Artificial Sequence
  Description of Artificial Sequence: Synthetic oligonucleotide
taccagcgtgtacacggaacttccaaatgctg

SEQ ID NO: 165563 - DNA, 31 bp, Artificial Sequence
  Description of Artificial Sequence: Synthetic oligonucleotide
accagcgtgtacacggaacttccaaatgctg

SEQ ID NO: 165564 - DNA, 30 bp, Artificial Sequence
  Description of Artificial Sequence: Synthetic oligonucleotide
ccagcgtgtacacggaacttccaaatgctg

SEQ ID NO: 165565 - DNA, 31 bp, Artificial Sequence
  Description of Artificial Sequence: Synthetic oligonucleotide
cagcgtgtacacggaacttccaaatgctgag

SEQ ID NO: 165566 - DNA, 31 bp, Artificial Sequence
  Description of Artificial Sequence: Synthetic oligonucleotide
agcgtgtacacggaacttccaaatgctgagc

SEQ ID NO: 165567 - DNA, 30 bp, Artificial Sequence
  Description of Artificial Sequence: Synthetic oligonucleotide
gcgtgtacacggaacttccaaatgctgagc

SEQ ID NO: 165568 - DNA, 28 bp, Artificial Sequence
  Description of Artificial Sequence: Synthetic oligonucleotide
cccagatccaaagttgtctcctgcccac

SEQ ID NO: 165569 - DNA, 28 bp, Artificial Sequence
  Description of Artificial Sequence: Synthetic oligonucleotide
ccagatccaaagttgtctcctgcccacg

SEQ ID NO: 165570 - DNA, 29 bp, Artificial Sequence
  Description of Artificial Sequence: Synthetic oligonucleotide
cagatccaaagttgtctcctgcccacgag

SEQ ID NO: 165571 - DNA, 29 bp, Artificial Sequence
  Description of Artificial Sequence: Synthetic oligonucleotide
agatccaaagttgtctcctgcccacgagc

SEQ ID NO: 165572 - DNA, 28 bp, Artificial Sequence
  Description of Artificial Sequence: Synthetic oligonucleotide
gatccaaagttgtctcctgcccacgagc

SEQ ID NO: 165573 - DNA, 29 bp, Artificial Sequence
  Description of Artificial Sequence: Synthetic oligonucleotide
atccaaagttgtctcctgcccacgagcac

SEQ ID NO: 165574 - DNA, 28 bp, Artificial Sequence
  Description of Artificial Sequence: Synthetic oligonucleotide
tccaaagttgtctcctgcccacgagcac

SEQ ID NO: 165575 - DNA, 27 bp, Artificial Sequence
  Description of Artificial Sequence: Synthetic oligonucleotide
ccaaagttgtctcctgcccacgagcac

SEQ ID NO: 165576 - DNA, 27 bp, Artificial Sequence
  Description of Artificial Sequence: Synthetic oligonucleotide
caaagttgtctcctgcccacgagcacc

SEQ ID NO: 165577 - DNA, 28 bp, Artificial Sequence
  Description of Artificial Sequence: Synthetic oligonucleotide
aaagttgtctcctgcccacgagcaccac

SEQ ID NO: 165578 - DNA, 27 bp, Artificial Sequence
  Description of Artificial Sequence: Synthetic oligonucleotide
aagttgtctcctgcccacgagcaccac

SEQ ID NO: 165579 - DNA, 27 bp, Artificial Sequence
  Description of Artificial Sequence: Synthetic oligonucleotide
agttgtctcctgcccacgagcaccaca

SEQ ID NO: 165580 - DNA, 26 bp, Artificial Sequence
  Description of Artificial Sequence: Synthetic oligonucleotide
gttgtctcctgcccacgagcaccaca

SEQ ID NO: 165581 - DNA, 27 bp, Artificial Sequence
  Description of Artificial Sequence: Synthetic oligonucleotide
ttgtctcctgcccacgagcaccacagt

SEQ ID NO: 165582 - DNA, 26 bp, Artificial Sequence
  Description of Artificial Sequence: Synthetic oligonucleotide
tgtctcctgcccacgagcaccacagt

SEQ ID NO: 165583 - DNA, 25 bp, Artificial Sequence
  Description of Artificial Sequence: Synthetic oligonucleotide
gtctcctgcccacgagcaccacagt

SEQ ID NO: 165584 - DNA, 26 bp, Artificial Sequence
  Description of Artificial Sequence: Synthetic oligonucleotide
tctcctgcccacgagcaccacagtca

SEQ ID NO: 165585 - DNA, 25 bp, Artificial Sequence
  Description of Artificial Sequence: Synthetic oligonucleotide
ctcctgcccacgagcaccacagtca

SEQ ID NO: 165586 - DNA, 25 bp, Artificial Sequence
  Description of Artificial Sequence: Synthetic oligonucleotide
tcctgcccacgagcaccacagtcag

SEQ ID NO: 165587 - DNA, 24 bp, Artificial Sequence
  Description of Artificial Sequence: Synthetic oligonucleotide
cctgcccacgagcaccacagtcag

SEQ ID NO: 165588 - DNA, 25 bp, Artificial Sequence
  Description of Artificial Sequence: Synthetic oligonucleotide
ctgcccacgagcaccacagtcaggt

SEQ ID NO: 165589 - DNA, 27 bp, Artificial Sequence
  Description of Artificial Sequence: Synthetic oligonucleotide
tgcccacgagcaccacagtcaggtctt

SEQ ID NO: 165590 - DNA, 26 bp, Artificial Sequence
  Description of Artificial Sequence: Synthetic oligonucleotide
gcccacgagcaccacagtcaggtctt

SEQ ID NO: 165591 - DNA, 27 bp, Artificial Sequence
  Description of Artificial Sequence: Synthetic oligonucleotide
cccacgagcaccacagtcaggtcttga

SEQ ID NO: 165592 - DNA, 27 bp, Artificial Sequence
  Description of Artificial Sequence: Synthetic oligonucleotide
ccacgagcaccacagtcaggtcttgag

SEQ ID NO: 165593 - DNA, 27 bp, Artificial Sequence
  Description of Artificial Sequence: Synthetic oligonucleotide
cacgagcaccacagtcaggtcttgagg

SEQ ID NO: 165594 - DNA, 27 bp, Artificial Sequence
  Description of Artificial Sequence: Synthetic oligonucleotide
acgagcaccacagtcaggtcttgaggg

SEQ ID NO: 165595 - DNA, 26 bp, Artificial Sequence
  Description of Artificial Sequence: Synthetic oligonucleotide
cgagcaccacagtcaggtcttgaggg

SEQ ID NO: 165596 - DNA, 26 bp, Artificial Sequence
  Description of Artificial Sequence: Synthetic oligonucleotide
gagcaccacagtcaggtcttgagggg

SEQ ID NO: 165597 - DNA, 27 bp, Artificial Sequence
  Description of Artificial Sequence: Synthetic oligonucleotide
agcaccacagtcaggtcttgagggggt

SEQ ID NO: 165598 - DNA, 27 bp, Artificial Sequence
  Description of Artificial Sequence: Synthetic oligonucleotide
gcaccacagtcaggtcttgagggggtt

SEQ ID NO: 165599 - DNA, 29 bp, Artificial Sequence
  Description of Artificial Sequence: Synthetic oligonucleotide
caccacagtcaggtcttgagggggttttc

SEQ ID NO: 165600 - DNA, 31 bp, Artificial Sequence
  Description of Artificial Sequence: Synthetic oligonucleotide
accacagtcaggtcttgagggggttttctag

SEQ ID NO: 165601 - DNA, 37 bp, Artificial Sequence
  Description of Artificial Sequence: Synthetic oligonucleotide
actgcgttttcatacagagaaaaatcagtcgcccttg

SEQ ID NO: 165602 - DNA, 36 bp, Artificial Sequence
  Description of Artificial Sequence: Synthetic oligonucleotide
ctgcgttttcatacagagaaaaatcagtcgcccttg

SEQ ID NO: 165603 - DNA, 37 bp, Artificial Sequence
  Description of Artificial Sequence: Synthetic oligonucleotide
tgcgttttcatacagagaaaaatcagtcgcccttgtc

SEQ ID NO: 165604 - DNA, 36 bp, Artificial Sequence
  Description of Artificial Sequence: Synthetic oligonucleotide
gcgttttcatacagagaaaaatcagtcgcccttgtc

SEQ ID NO: 165605 - DNA, 37 bp, Artificial Sequence
  Description of Artificial Sequence: Synthetic oligonucleotide
cgttttcatacagagaaaaatcagtcgcccttgtcag

SEQ ID NO: 165606 - DNA, 38 bp, Artificial Sequence
  Description of Artificial Sequence: Synthetic oligonucleotide
gttttcatacagagaaaaatcagtcgcccttgtcagag

SEQ ID NO: 165607 - DNA, 38 bp, Artificial Sequence
  Description of Artificial Sequence: Synthetic oligonucleotide
ttttcatacagagaaaaatcagtcgcccttgtcagagg

SEQ ID NO: 165608 - DNA, 37 bp, Artificial Sequence
  Description of Artificial Sequence: Synthetic oligonucleotide
tttcatacagagaaaaatcagtcgcccttgtcagagg

SEQ ID NO: 165609 - DNA, 36 bp, Artificial Sequence
  Description of Artificial Sequence: Synthetic oligonucleotide
ttcatacagagaaaaatcagtcgcccttgtcagagg

SEQ ID NO: 165610 - DNA, 35 bp, Artificial Sequence
  Description of Artificial Sequence: Synthetic oligonucleotide
tcatacagagaaaaatcagtcgcccttgtcagagg

SEQ ID NO: 165611 - DNA, 34 bp, Artificial Sequence
  Description of Artificial Sequence: Synthetic oligonucleotide
catacagagaaaaatcagtcgcccttgtcagagg

SEQ ID NO: 165612 - DNA, 34 bp, Artificial Sequence
  Description of Artificial Sequence: Synthetic oligonucleotide
atacagagaaaaatcagtcgcccttgtcagaggc

SEQ ID NO: 165613 - DNA, 33 bp, Artificial Sequence
  Description of Artificial Sequence: Synthetic oligonucleotide
tacagagaaaaatcagtcgcccttgtcagaggc

SEQ ID NO: 165614 - DNA, 32 bp, Artificial Sequence
  Description of Artificial Sequence: Synthetic oligonucleotide
acagagaaaaatcagtcgcccttgtcagaggc

SEQ ID NO: 165615 - DNA, 31 bp, Artificial Sequence
  Description of Artificial Sequence: Synthetic oligonucleotide
cagagaaaaatcagtcgcccttgtcagaggc

SEQ ID NO: 165616 - DNA, 31 bp, Artificial Sequence
  Description of Artificial Sequence: Synthetic oligonucleotide
agagaaaaatcagtcgcccttgtcagaggcc

SEQ ID NO: 165617 - DNA, 30 bp, Artificial Sequence
  Description of Artificial Sequence: Synthetic oligonucleotide
gagaaaaatcagtcgcccttgtcagaggcc

SEQ ID NO: 165618 - DNA, 30 bp, Artificial Sequence
  Description of Artificial Sequence: Synthetic oligonucleotide
agaaaaatcagtcgcccttgtcagaggccc

SEQ ID NO: 165619 - DNA, 29 bp, Artificial Sequence
  Description of Artificial Sequence: Synthetic oligonucleotide
gaaaaatcagtcgcccttgtcagaggccc

SEQ ID NO: 165620 - DNA, 31 bp, Artificial Sequence
  Description of Artificial Sequence: Synthetic oligonucleotide
aaaaatcagtcgcccttgtcagaggcccaag

SEQ ID NO: 165621 - DNA, 30 bp, Artificial Sequence
  Description of Artificial Sequence: Synthetic oligonucleotide
aaaatcagtcgcccttgtcagaggcccaag

SEQ ID NO: 165622 - DNA, 29 bp, Artificial Sequence
  Description of Artificial Sequence: Synthetic oligonucleotide
aaatcagtcgcccttgtcagaggcccaag

SEQ ID NO: 165623 - DNA, 28 bp, Artificial Sequence
  Description of Artificial Sequence: Synthetic oligonucleotide
aatcagtcgcccttgtcagaggcccaag

SEQ ID NO: 165624 - DNA, 27 bp, Artificial Sequence
  Description of Artificial Sequence: Synthetic oligonucleotide
atcagtcgcccttgtcagaggcccaag

SEQ ID NO: 165625 - DNA, 27 bp, Artificial Sequence
  Description of Artificial Sequence: Synthetic oligonucleotide
tcagtcgcccttgtcagaggcccaaga

SEQ ID NO: 165626 - DNA, 26 bp, Artificial Sequence
  Description of Artificial Sequence: Synthetic oligonucleotide
cagtcgcccttgtcagaggcccaaga

SEQ ID NO: 165627 - DNA, 27 bp, Artificial Sequence
  Description of Artificial Sequence: Synthetic oligonucleotide
agtcgcccttgtcagaggcccaagaca

SEQ ID NO: 165628 - DNA, 26 bp, Artificial Sequence
  Description of Artificial Sequence: Synthetic oligonucleotide
gtcgcccttgtcagaggcccaagaca

SEQ ID NO: 165629 - DNA, 26 bp, Artificial Sequence
  Description of Artificial Sequence: Synthetic oligonucleotide
tcgcccttgtcagaggcccaagacac

SEQ ID NO: 165630 - DNA, 25 bp, Artificial Sequence
  Description of Artificial Sequence: Synthetic oligonucleotide
cgcccttgtcagaggcccaagacac

SEQ ID NO: 165631 - DNA, 25 bp, Artificial Sequence
  Description of Artificial Sequence: Synthetic oligonucleotide
gcccttgtcagaggcccaagacacc

SEQ ID NO: 165632 - DNA, 25 bp, Artificial Sequence
  Description of Artificial Sequence: Synthetic oligonucleotide
cccttgtcagaggcccaagacaccc

SEQ ID NO: 165633 - DNA, 27 bp, Artificial Sequence
  Description of Artificial Sequence: Synthetic oligonucleotide
ccttgtcagaggcccaagacaccccta

SEQ ID NO: 165634 - DNA, 28 bp, Artificial Sequence
  Description of Artificial Sequence: Synthetic oligonucleotide
cttgtcagaggcccaagacacccctaac

SEQ ID NO: 165635 - DNA, 29 bp, Artificial Sequence
  Description of Artificial Sequence: Synthetic oligonucleotide
ttgtcagaggcccaagacacccctaacag

SEQ ID NO: 165636 - DNA, 28 bp, Artificial Sequence
  Description of Artificial Sequence: Synthetic oligonucleotide
tgtcagaggcccaagacacccctaacag

SEQ ID NO: 165637 - DNA, 27 bp, Artificial Sequence
  Description of Artificial Sequence: Synthetic oligonucleotide
gtcagaggcccaagacacccctaacag

SEQ ID NO: 165638 - DNA, 33 bp, Artificial Sequence
  Description of Artificial Sequence: Synthetic oligonucleotide
gtgacgtacgcacagttggatcactgcattttc

SEQ ID NO: 165639 - DNA, 36 bp, Artificial Sequence
  Description of Artificial Sequence: Synthetic oligonucleotide
tgacgtacgcacagttggatcactgcattttcatac

SEQ ID NO: 165640 - DNA, 35 bp, Artificial Sequence
  Description of Artificial Sequence: Synthetic oligonucleotide
gacgtacgcacagttggatcactgcattttcatac

SEQ ID NO: 165641 - DNA, 36 bp, Artificial Sequence
  Description of Artificial Sequence: Synthetic oligonucleotide
acgtacgcacagttggatcactgcattttcatacag

SEQ ID NO: 165642 - DNA, 35 bp, Artificial Sequence
  Description of Artificial Sequence: Synthetic oligonucleotide
cgtacgcacagttggatcactgcattttcatacag

SEQ ID NO: 165643 - DNA, 36 bp, Artificial Sequence
  Description of Artificial Sequence: Synthetic oligonucleotide
gtacgcacagttggatcactgcattttcatacagag

SEQ ID NO: 165644 - DNA, 42 bp, Artificial Sequence
  Description of Artificial Sequence: Synthetic oligonucleotide
tacgcacagttggatcactgcattttcatacagagaaaaatc

SEQ ID NO: 165645 - DNA, 41 bp, Artificial Sequence
  Description of Artificial Sequence: Synthetic oligonucleotide
acgcacagttggatcactgcattttcatacagagaaaaatc

SEQ ID NO: 165646 - DNA, 40 bp, Artificial Sequence
  Description of Artificial Sequence: Synthetic oligonucleotide
cgcacagttggatcactgcattttcatacagagaaaaatc

SEQ ID NO: 165647 - DNA, 41 bp, Artificial Sequence
  Description of Artificial Sequence: Synthetic oligonucleotide
gcacagttggatcactgcattttcatacagagaaaaatcag

SEQ ID NO: 165648 - DNA, 42 bp, Artificial Sequence
  Description of Artificial Sequence: Synthetic oligonucleotide
cacagttggatcactgcattttcatacagagaaaaatcagtc

SEQ ID NO: 165649 - DNA, 42 bp, Artificial Sequence
  Description of Artificial Sequence: Synthetic oligonucleotide
acagttggatcactgcattttcatacagagaaaaatcagtcg

SEQ ID NO: 165650 - DNA, 41 bp, Artificial Sequence
  Description of Artificial Sequence: Synthetic oligonucleotide
cagttggatcactgcattttcatacagagaaaaatcagtcg

SEQ ID NO: 165651 - DNA, 41 bp, Artificial Sequence
  Description of Artificial Sequence: Synthetic oligonucleotide
agttggatcactgcattttcatacagagaaaaatcagtcgc

SEQ ID NO: 165652 - DNA, 40 bp, Artificial Sequence
  Description of Artificial Sequence: Synthetic oligonucleotide
gttggatcactgcattttcatacagagaaaaatcagtcgc

SEQ ID NO: 165653 - DNA, 40 bp, Artificial Sequence
  Description of Artificial Sequence: Synthetic oligonucleotide
ttggatcactgcattttcatacagagaaaaatcagtcgcc

SEQ ID NO: 165654 - DNA, 39 bp, Artificial Sequence
  Description of Artificial Sequence: Synthetic oligonucleotide
tggatcactgcattttcatacagagaaaaatcagtcgcc

SEQ ID NO: 165655 - DNA, 38 bp, Artificial Sequence
  Description of Artificial Sequence: Synthetic oligonucleotide
ggatcactgcattttcatacagagaaaaatcagtcgcc

SEQ ID NO: 165656 - DNA, 38 bp, Artificial Sequence
  Description of Artificial Sequence: Synthetic oligonucleotide
gatcactgcattttcatacagagaaaaatcagtcgccc

SEQ ID NO: 165657 - DNA, 40 bp, Artificial Sequence
  Description of Artificial Sequence: Synthetic oligonucleotide
atcactgcattttcatacagagaaaaatcagtcgcccttc

SEQ ID NO: 165658 - DNA, 39 bp, Artificial Sequence
  Description of Artificial Sequence: Synthetic oligonucleotide
tcactgcattttcatacagagaaaaatcagtcgcccttc

SEQ ID NO: 165659 - DNA, 38 bp, Artificial Sequence
  Description of Artificial Sequence: Synthetic oligonucleotide
cactgcattttcatacagagaaaaatcagtcgcccttc

SEQ ID NO: 165660 - DNA, 39 bp, Artificial Sequence
  Description of Artificial Sequence: Synthetic oligonucleotide
actgcattttcatacagagaaaaatcagtcgcccttctc

SEQ ID NO: 165661 - DNA, 38 bp, Artificial Sequence
  Description of Artificial Sequence: Synthetic oligonucleotide
ctgcattttcatacagagaaaaatcagtcgcccttctc

SEQ ID NO: 165662 - DNA, 39 bp, Artificial Sequence
  Description of Artificial Sequence: Synthetic oligonucleotide
tgcattttcatacagagaaaaatcagtcgcccttctcag

SEQ ID NO: 165663 - DNA, 38 bp, Artificial Sequence
  Description of Artificial Sequence: Synthetic oligonucleotide
gcattttcatacagagaaaaatcagtcgcccttctcag

SEQ ID NO: 165664 - DNA, 39 bp, Artificial Sequence
  Description of Artificial Sequence: Synthetic oligonucleotide
cattttcatacagagaaaaatcagtcgcccttctcagag

SEQ ID NO: 165665 - DNA, 39 bp, Artificial Sequence
  Description of Artificial Sequence: Synthetic oligonucleotide
attttcatacagagaaaaatcagtcgcccttctcagagg

SEQ ID NO: 165666 - DNA, 26 bp, Artificial Sequence
  Description of Artificial Sequence: Synthetic oligonucleotide
gacccctcacgcctcgttggacagaa

SEQ ID NO: 165667 - DNA, 26 bp, Artificial Sequence
  Description of Artificial Sequence: Synthetic oligonucleotide
acccctcacgcctcgttggacagaac

SEQ ID NO: 165668 - DNA, 25 bp, Artificial Sequence
  Description of Artificial Sequence: Synthetic oligonucleotide
cccctcacgcctcgttggacagaac

SEQ ID NO: 165669 - DNA, 27 bp, Artificial Sequence
  Description of Artificial Sequence: Synthetic oligonucleotide
ccctcacgcctcgttggacagaaccat

SEQ ID NO: 165670 - DNA, 27 bp, Artificial Sequence
  Description of Artificial Sequence: Synthetic oligonucleotide
cctcacgcctcgttggacagaaccatg

SEQ ID NO: 165671 - DNA, 29 bp, Artificial Sequence
  Description of Artificial Sequence: Synthetic oligonucleotide
ctcacgcctcgttggacagaaccatgatg

SEQ ID NO: 165672 - DNA, 29 bp, Artificial Sequence
  Description of Artificial Sequence: Synthetic oligonucleotide
tcacgcctcgttggacagaaccatgatgg

SEQ ID NO: 165673 - DNA, 28 bp, Artificial Sequence
  Description of Artificial Sequence: Synthetic oligonucleotide
cacgcctcgttggacagaaccatgatgg

SEQ ID NO: 165674 - DNA, 28 bp, Artificial Sequence
  Description of Artificial Sequence: Synthetic oligonucleotide
acgcctcgttggacagaaccatgatggg

SEQ ID NO: 165675 - DNA, 27 bp, Artificial Sequence
  Description of Artificial Sequence: Synthetic oligonucleotide
cgcctcgttggacagaaccatgatggg

SEQ ID NO: 165676 - DNA, 27 bp, Artificial Sequence
  Description of Artificial Sequence: Synthetic oligonucleotide
gcctcgttggacagaaccatgatgggg

SEQ ID NO: 165677 - DNA, 28 bp, Artificial Sequence
  Description of Artificial Sequence: Synthetic oligonucleotide
cctcgttggacagaaccatgatggggtc

SEQ ID NO: 165678 - DNA, 29 bp, Artificial Sequence
  Description of Artificial Sequence: Synthetic oligonucleotide
ctcgttggacagaaccatgatggggtctc

SEQ ID NO: 165679 - DNA, 29 bp, Artificial Sequence
  Description of Artificial Sequence: Synthetic oligonucleotide
tcgttggacagaaccatgatggggtctcc

SEQ ID NO: 165680 - DNA, 28 bp, Artificial Sequence
  Description of Artificial Sequence: Synthetic oligonucleotide
cgttggacagaaccatgatggggtctcc

SEQ ID NO: 165681 - DNA, 30 bp, Artificial Sequence
  Description of Artificial Sequence: Synthetic oligonucleotide
gttggacagaaccatgatggggtctccaag

SEQ ID NO: 165682 - DNA, 30 bp, Artificial Sequence
  Description of Artificial Sequence: Synthetic oligonucleotide
ttggacagaaccatgatggggtctccaagg

SEQ ID NO: 165683 - DNA, 29 bp, Artificial Sequence
  Description of Artificial Sequence: Synthetic oligonucleotide
tggacagaaccatgatggggtctccaagg

SEQ ID NO: 165684 - DNA, 28 bp, Artificial Sequence
  Description of Artificial Sequence: Synthetic oligonucleotide
ggacagaaccatgatggggtctccaagg

SEQ ID NO: 165685 - DNA, 28 bp, Artificial Sequence
  Description of Artificial Sequence: Synthetic oligonucleotide
gacagaaccatgatggggtctccaaggc

SEQ ID NO: 165686 - DNA, 28 bp, Artificial Sequence
  Description of Artificial Sequence: Synthetic oligonucleotide
acagaaccatgatggggtctccaaggcc

SEQ ID NO: 165687 - DNA, 27 bp, Artificial Sequence
  Description of Artificial Sequence: Synthetic oligonucleotide
cagaaccatgatggggtctccaaggcc

SEQ ID NO: 165688 - DNA, 32 bp, Artificial Sequence
  Description of Artificial Sequence: Synthetic oligonucleotide
agaaccatgatggggtctccaaggccaatttc

SEQ ID NO: 165689 - DNA, 31 bp, Artificial Sequence
  Description of Artificial Sequence: Synthetic oligonucleotide
gaaccatgatggggtctccaaggccaatttc

SEQ ID NO: 165690 - DNA, 32 bp, Artificial Sequence
  Description of Artificial Sequence: Synthetic oligonucleotide
aaccatgatggggtctccaaggccaatttctc

SEQ ID NO: 165691 - DNA, 31 bp, Artificial Sequence
  Description of Artificial Sequence: Synthetic oligonucleotide
accatgatggggtctccaaggccaatttctc

SEQ ID NO: 165692 - DNA, 38 bp, Artificial Sequence
  Description of Artificial Sequence: Synthetic oligonucleotide
acagaatccacattcccatcttccatggcagattattc

SEQ ID NO: 165693 - DNA, 37 bp, Artificial Sequence
  Description of Artificial Sequence: Synthetic oligonucleotide
cagaatccacattcccatcttccatggcagattattc

SEQ ID NO: 165694 - DNA, 37 bp, Artificial Sequence
  Description of Artificial Sequence: Synthetic oligonucleotide
agaatccacattcccatcttccatggcagattattcc

SEQ ID NO: 165695 - DNA, 36 bp, Artificial Sequence
  Description of Artificial Sequence: Synthetic oligonucleotide
gaatccacattcccatcttccatggcagattattcc

SEQ ID NO: 165696 - DNA, 37 bp, Artificial Sequence
  Description of Artificial Sequence: Synthetic oligonucleotide
aatccacattcccatcttccatggcagattattccag

SEQ ID NO: 165697 - DNA, 36 bp, Artificial Sequence
  Description of Artificial Sequence: Synthetic oligonucleotide
atccacattcccatcttccatggcagattattccag

SEQ ID NO: 165698 - DNA, 35 bp, Artificial Sequence
  Description of Artificial Sequence: Synthetic oligonucleotide
tccacattcccatcttccatggcagattattccag

SEQ ID NO: 165699 - DNA, 34 bp, Artificial Sequence
  Description of Artificial Sequence: Synthetic oligonucleotide
ccacattcccatcttccatggcagattattccag

SEQ ID NO: 165700 - DNA, 34 bp, Artificial Sequence
  Description of Artificial Sequence: Synthetic oligonucleotide
cacattcccatcttccatggcagattattccagg

SEQ ID NO: 165701 - DNA, 35 bp, Artificial Sequence
  Description of Artificial Sequence: Synthetic oligonucleotide
acattcccatcttccatggcagattattccaggag

SEQ ID NO: 165702 - DNA, 34 bp, Artificial Sequence
  Description of Artificial Sequence: Synthetic oligonucleotide
cattcccatcttccatggcagattattccaggag

SEQ ID NO: 165703 - DNA, 35 bp, Artificial Sequence
  Description of Artificial Sequence: Synthetic oligonucleotide
attcccatcttccatggcagattattccaggagag

SEQ ID NO: 165704 - DNA, 35 bp, Artificial Sequence
  Description of Artificial Sequence: Synthetic oligonucleotide
catggcagattattccaggagagcttcaacatgac

SEQ ID NO: 165705 - DNA, 35 bp, Artificial Sequence
  Description of Artificial Sequence: Synthetic oligonucleotide
atggcagattattccaggagagcttcaacatgacc

SEQ ID NO: 165706 - DNA, 34 bp, Artificial Sequence
  Description of Artificial Sequence: Synthetic oligonucleotide
tggcagattattccaggagagcttcaacatgacc

SEQ ID NO: 165707 - DNA, 33 bp, Artificial Sequence
  Description of Artificial Sequence: Synthetic oligonucleotide
ggcagattattccaggagagcttcaacatgacc

SEQ ID NO: 165708 - DNA, 33 bp, Artificial Sequence
  Description of Artificial Sequence: Synthetic oligonucleotide
gcagattattccaggagagcttcaacatgaccc

SEQ ID NO: 165709 - DNA, 33 bp, Artificial Sequence
  Description of Artificial Sequence: Synthetic oligonucleotide
cagattattccaggagagcttcaacatgacccc

SEQ ID NO: 165710 - DNA, 34 bp, Artificial Sequence
  Description of Artificial Sequence: Synthetic oligonucleotide
agattattccaggagagcttcaacatgacccctg

SEQ ID NO: 165711 - DNA, 33 bp, Artificial Sequence
  Description of Artificial Sequence: Synthetic oligonucleotide
gattattccaggagagcttcaacatgacccctg

SEQ ID NO: 165712 - DNA, 34 bp, Artificial Sequence
  Description of Artificial Sequence: Synthetic oligonucleotide
attattccaggagagcttcaacatgacccctgtg

SEQ ID NO: 165713 - DNA, 33 bp, Artificial Sequence
  Description of Artificial Sequence: Synthetic oligonucleotide
ttattccaggagagcttcaacatgacccctgtg

SEQ ID NO: 165714 - DNA, 32 bp, Artificial Sequence
  Description of Artificial Sequence: Synthetic oligonucleotide
tattccaggagagcttcaacatgacccctgtg

SEQ ID NO: 165715 - DNA, 31 bp, Artificial Sequence
  Description of Artificial Sequence: Synthetic oligonucleotide
attccaggagagcttcaacatgacccctgtg

SEQ ID NO: 165716 - DNA, 30 bp, Artificial Sequence
  Description of Artificial Sequence: Synthetic oligonucleotide
ttccaggagagcttcaacatgacccctgtg

SEQ ID NO: 165717 - DNA, 29 bp, Artificial Sequence
  Description of Artificial Sequence: Synthetic oligonucleotide
tccaggagagcttcaacatgacccctgtg

SEQ ID NO: 165718 - DNA, 28 bp, Artificial Sequence
  Description of Artificial Sequence: Synthetic oligonucleotide
ccaggagagcttcaacatgacccctgtg

SEQ ID NO: 165719 - DNA, 29 bp, Artificial Sequence
  Description of Artificial Sequence: Synthetic oligonucleotide
caggagagcttcaacatgacccctgtgac

SEQ ID NO: 165720 - DNA, 29 bp, Artificial Sequence
  Description of Artificial Sequence: Synthetic oligonucleotide
aggagagcttcaacatgacccctgtgacc

SEQ ID NO: 165721 - DNA, 28 bp, Artificial Sequence
  Description of Artificial Sequence: Synthetic oligonucleotide
ggagagcttcaacatgacccctgtgacc

SEQ ID NO: 165722 - DNA, 29 bp, Artificial Sequence
  Description of Artificial Sequence: Synthetic oligonucleotide
gagagcttcaacatgacccctgtgaccac

SEQ ID NO: 165723 - DNA, 30 bp, Artificial Sequence
  Description of Artificial Sequence: Synthetic oligonucleotide
agagcttcaacatgacccctgtgaccacag

SEQ ID NO: 165724 - DNA, 29 bp, Artificial Sequence
  Description of Artificial Sequence: Synthetic oligonucleotide
gagcttcaacatgacccctgtgaccacag

SEQ ID NO: 165725 - DNA, 29 bp, Artificial Sequence
  Description of Artificial Sequence: Synthetic oligonucleotide
agcttcaacatgacccctgtgaccacagc

SEQ ID NO: 165726 - DNA, 28 bp, Artificial Sequence
  Description of Artificial Sequence: Synthetic oligonucleotide
gcttcaacatgacccctgtgaccacagc

SEQ ID NO: 165727 - DNA, 29 bp, Artificial Sequence
  Description of Artificial Sequence: Synthetic oligonucleotide
cttcaacatgacccctgtgaccacagcac

SEQ ID NO: 165728 - DNA, 31 bp, Artificial Sequence
  Description of Artificial Sequence: Synthetic oligonucleotide
ttcaacatgacccctgtgaccacagcacatg

SEQ ID NO: 165729 - DNA, 30 bp, Artificial Sequence
  Description of Artificial Sequence: Synthetic oligonucleotide
tcaacatgacccctgtgaccacagcacatg

SEQ ID NO: 165730 - DNA, 29 bp, Artificial Sequence
  Description of Artificial Sequence: Synthetic oligonucleotide
caacatgacccctgtgaccacagcacatg

SEQ ID NO: 165731 - DNA, 29 bp, Artificial Sequence
  Description of Artificial Sequence: Synthetic oligonucleotide
aacatgacccctgtgaccacagcacatgc

SEQ ID NO: 165732 - DNA, 28 bp, Artificial Sequence
  Description of Artificial Sequence: Synthetic oligonucleotide
acatgacccctgtgaccacagcacatgc

SEQ ID NO: 165733 - DNA, 27 bp, Artificial Sequence
  Description of Artificial Sequence: Synthetic oligonucleotide
catgacccctgtgaccacagcacatgc

SEQ ID NO: 165734 - DNA, 28 bp, Artificial Sequence
  Description of Artificial Sequence: Synthetic oligonucleotide
atgacccctgtgaccacagcacatgcag

SEQ ID NO: 165735 - DNA, 27 bp, Artificial Sequence
  Description of Artificial Sequence: Synthetic oligonucleotide
tgacccctgtgaccacagcacatgcag

SEQ ID NO: 165736 - DNA, 26 bp, Artificial Sequence
  Description of Artificial Sequence: Synthetic oligonucleotide
gacccctgtgaccacagcacatgcag

SEQ ID NO: 165737 - DNA, 26 bp, Artificial Sequence
  Description of Artificial Sequence: Synthetic oligonucleotide
acccctgtgaccacagcacatgcagg

SEQ ID NO: 165738 - DNA, 25 bp, Artificial Sequence
  Description of Artificial Sequence: Synthetic oligonucleotide
cccctgtgaccacagcacatgcagg

SEQ ID NO: 165739 - DNA, 39 bp, Artificial Sequence
  Description of Artificial Sequence: Synthetic oligonucleotide
tccttcatctctggtgctccaacaaaaaaaatgctgttg

SEQ ID NO: 165740 - DNA, 38 bp, Artificial Sequence
  Description of Artificial Sequence: Synthetic oligonucleotide
ccttcatctctggtgctccaacaaaaaaaatgctgttg

SEQ ID NO: 165741 - DNA, 42 bp, Artificial Sequence
  Description of Artificial Sequence: Synthetic oligonucleotide
cttcatctctggtgctccaacaaaaaaaatgctgttgtaatg

SEQ ID NO: 165742 - DNA, 42 bp, Artificial Sequence
  Description of Artificial Sequence: Synthetic oligonucleotide
ttcatctctggtgctccaacaaaaaaaatgctgttgtaatgg

SEQ ID NO: 165743 - DNA, 41 bp, Artificial Sequence
  Description of Artificial Sequence: Synthetic oligonucleotide
tcatctctggtgctccaacaaaaaaaatgctgttgtaatgg

SEQ ID NO: 165744 - DNA, 40 bp, Artificial Sequence
  Description of Artificial Sequence: Synthetic oligonucleotide
catctctggtgctccaacaaaaaaaatgctgttgtaatgg

SEQ ID NO: 165745 - DNA, 41 bp, Artificial Sequence
  Description of Artificial Sequence: Synthetic oligonucleotide
atctctggtgctccaacaaaaaaaatgctgttgtaatggac

SEQ ID NO: 165746 - DNA, 40 bp, Artificial Sequence
  Description of Artificial Sequence: Synthetic oligonucleotide
tctctggtgctccaacaaaaaaaatgctgttgtaatggac

SEQ ID NO: 165747 - DNA, 39 bp, Artificial Sequence
  Description of Artificial Sequence: Synthetic oligonucleotide
ctctggtgctccaacaaaaaaaatgctgttgtaatggac

SEQ ID NO: 165748 - DNA, 39 bp, Artificial Sequence
  Description of Artificial Sequence: Synthetic oligonucleotide
tctggtgctccaacaaaaaaaatgctgttgtaatggacc

SEQ ID NO: 165749 - DNA, 27 bp, Artificial Sequence
  Description of Artificial Sequence: Synthetic oligonucleotide
ggatctctaaggacccctcacgcctca

SEQ ID NO: 165750 - DNA, 29 bp, Artificial Sequence
  Description of Artificial Sequence: Synthetic oligonucleotide
gatctctaaggacccctcacgcctcattg

SEQ ID NO: 165751 - DNA, 29 bp, Artificial Sequence
  Description of Artificial Sequence: Synthetic oligonucleotide
atctctaaggacccctcacgcctcattgg

SEQ ID NO: 165752 - DNA, 28 bp, Artificial Sequence
  Description of Artificial Sequence: Synthetic oligonucleotide
tctctaaggacccctcacgcctcattgg

SEQ ID NO: 165753 - DNA, 27 bp, Artificial Sequence
  Description of Artificial Sequence: Synthetic oligonucleotide
ctctaaggacccctcacgcctcattgg

SEQ ID NO: 165754 - DNA, 28 bp, Artificial Sequence
  Description of Artificial Sequence: Synthetic oligonucleotide
tctaaggacccctcacgcctcattggac

SEQ ID NO: 165755 - DNA, 27 bp, Artificial Sequence
  Description of Artificial Sequence: Synthetic oligonucleotide
ctaaggacccctcacgcctcattggac

SEQ ID NO: 165756 - DNA, 28 bp, Artificial Sequence
  Description of Artificial Sequence: Synthetic oligonucleotide
taaggacccctcacgcctcattggacag

SEQ ID NO: 165757 - DNA, 27 bp, Artificial Sequence
  Description of Artificial Sequence: Synthetic oligonucleotide
aaggacccctcacgcctcattggacag

SEQ ID NO: 165758 - DNA, 27 bp, Artificial Sequence
  Description of Artificial Sequence: Synthetic oligonucleotide
aggacccctcacgcctcattggacaga

SEQ ID NO: 165759 - DNA, 27 bp, Artificial Sequence
  Description of Artificial Sequence: Synthetic oligonucleotide
ggacccctcacgcctcattggacagat

SEQ ID NO: 165760 - DNA, 27 bp, Artificial Sequence
  Description of Artificial Sequence: Synthetic oligonucleotide
gacccctcacgcctcattggacagatc

SEQ ID NO: 165761 - DNA, 27 bp, Artificial Sequence
  Description of Artificial Sequence: Synthetic oligonucleotide
acccctcacgcctcattggacagatcc

SEQ ID NO: 165762 - DNA, 27 bp, Artificial Sequence
  Description of Artificial Sequence: Synthetic oligonucleotide
cccctcacgcctcattggacagatcca

SEQ ID NO: 165763 - DNA, 28 bp, Artificial Sequence
  Description of Artificial Sequence: Synthetic oligonucleotide
ccctcacgcctcattggacagatccatg

SEQ ID NO: 165764 - DNA, 30 bp, Artificial Sequence
  Description of Artificial Sequence: Synthetic oligonucleotide
cctcacgcctcattggacagatccatgatg

SEQ ID NO: 165765 - DNA, 30 bp, Artificial Sequence
  Description of Artificial Sequence: Synthetic oligonucleotide
ctcacgcctcattggacagatccatgatgg

SEQ ID NO: 165766 - DNA, 30 bp, Artificial Sequence
  Description of Artificial Sequence: Synthetic oligonucleotide
tcacgcctcattggacagatccatgatggg

SEQ ID NO: 165767 - DNA, 29 bp, Artificial Sequence
  Description of Artificial Sequence: Synthetic oligonucleotide
cacgcctcattggacagatccatgatggg

SEQ ID NO: 165768 - DNA, 29 bp, Artificial Sequence
  Description of Artificial Sequence: Synthetic oligonucleotide
acgcctcattggacagatccatgatgggg

SEQ ID NO: 165769 - DNA, 28 bp, Artificial Sequence
  Description of Artificial Sequence: Synthetic oligonucleotide
cgcctcattggacagatccatgatgggg

SEQ ID NO: 165770 - DNA, 29 bp, Artificial Sequence
  Description of Artificial Sequence: Synthetic oligonucleotide
gcctcattggacagatccatgatggggtc

SEQ ID NO: 165771 - DNA, 30 bp, Artificial Sequence
  Description of Artificial Sequence: Synthetic oligonucleotide
cctcattggacagatccatgatggggtctc

SEQ ID NO: 165772 - DNA, 30 bp, Artificial Sequence
  Description of Artificial Sequence: Synthetic oligonucleotide
ctcattggacagatccatgatggggtctcc

SEQ ID NO: 165773 - DNA, 32 bp, Artificial Sequence
  Description of Artificial Sequence: Synthetic oligonucleotide
tcattggacagatccatgatggggtctccaag

SEQ ID NO: 165774 - DNA, 31 bp, Artificial Sequence
  Description of Artificial Sequence: Synthetic oligonucleotide
cattggacagatccatgatggggtctccaag

SEQ ID NO: 165775 - DNA, 31 bp, Artificial Sequence
  Description of Artificial Sequence: Synthetic oligonucleotide
attggacagatccatgatggggtctccaagg

SEQ ID NO: 165776 - DNA, 24 bp, Artificial Sequence
  Description of Artificial Sequence: Synthetic oligonucleotide
gctcacggtcgtcagcatggcgtg

SEQ ID NO: 165777 - DNA, 24 bp, Artificial Sequence
  Description of Artificial Sequence: Synthetic oligonucleotide
ctcacggtcgtcagcatggcgtgc

SEQ ID NO: 165778 - DNA, 26 bp, Artificial Sequence
  Description of Artificial Sequence: Synthetic oligonucleotide
tcacggtcgtcagcatggcgtgcgtt

SEQ ID NO: 165779 - DNA, 25 bp, Artificial Sequence
  Description of Artificial Sequence: Synthetic oligonucleotide
cacggtcgtcagcatggcgtgcgtt

SEQ ID NO: 165780 - DNA, 25 bp, Artificial Sequence
  Description of Artificial Sequence: Synthetic oligonucleotide
acggtcgtcagcatggcgtgcgttg

SEQ ID NO: 165781 - DNA, 24 bp, Artificial Sequence
  Description of Artificial Sequence: Synthetic oligonucleotide
cggtcgtcagcatggcgtgcgttg

SEQ ID NO: 165782 - DNA, 24 bp, Artificial Sequence
  Description of Artificial Sequence: Synthetic oligonucleotide
ggtcgtcagcatggcgtgcgttgg

SEQ ID NO: 165783 - DNA, 26 bp, Artificial Sequence
  Description of Artificial Sequence: Synthetic oligonucleotide
gtcgtcagcatggcgtgcgttgggtt

SEQ ID NO: 165784 - DNA, 27 bp, Artificial Sequence
  Description of Artificial Sequence: Synthetic oligonucleotide
tcgtcagcatggcgtgcgttgggttct

SEQ ID NO: 165785 - DNA, 27 bp, Artificial Sequence
  Description of Artificial Sequence: Synthetic oligonucleotide
cgtcagcatggcgtgcgttgggttctt

SEQ ID NO: 165786 - DNA, 27 bp, Artificial Sequence
  Description of Artificial Sequence: Synthetic oligonucleotide
gtcagcatggcgtgcgttgggttcttc

SEQ ID NO: 165787 - DNA, 29 bp, Artificial Sequence
  Description of Artificial Sequence: Synthetic oligonucleotide
tcagcatggcgtgcgttgggttcttcttg

SEQ ID NO: 165788 - DNA, 28 bp, Artificial Sequence
  Description of Artificial Sequence: Synthetic oligonucleotide
cagcatggcgtgcgttgggttcttcttg

SEQ ID NO: 165789 - DNA, 28 bp, Artificial Sequence
  Description of Artificial Sequence: Synthetic oligonucleotide
agcatggcgtgcgttgggttcttcttgc

SEQ ID NO: 165790 - DNA, 27 bp, Artificial Sequence
  Description of Artificial Sequence: Synthetic oligonucleotide
gcatggcgtgcgttgggttcttcttgc

SEQ ID NO: 165791 - DNA, 28 bp, Artificial Sequence
  Description of Artificial Sequence: Synthetic oligonucleotide
catggcgtgcgttgggttcttcttgctg

SEQ ID NO: 165792 - DNA, 28 bp, Artificial Sequence
  Description of Artificial Sequence: Synthetic oligonucleotide
atggcgtgcgttgggttcttcttgctgc

SEQ ID NO: 165793 - DNA, 27 bp, Artificial Sequence
  Description of Artificial Sequence: Synthetic oligonucleotide
tggcgtgcgttgggttcttcttgctgc

SEQ ID NO: 165794 - DNA, 27 bp, Artificial Sequence
  Description of Artificial Sequence: Synthetic oligonucleotide
ggcgtgcgttgggttcttcttgctgca

SEQ ID NO: 165795 - DNA, 27 bp, Artificial Sequence
  Description of Artificial Sequence: Synthetic oligonucleotide
gcgtgcgttgggttcttcttgctgcag

SEQ ID NO: 165796 - DNA, 27 bp, Artificial Sequence
  Description of Artificial Sequence: Synthetic oligonucleotide
cgtgcgttgggttcttcttgctgcagg

SEQ ID NO: 165797 - DNA, 27 bp, Artificial Sequence
  Description of Artificial Sequence: Synthetic oligonucleotide
gtgcgttgggttcttcttgctgcaggg

SEQ ID NO: 165798 - DNA, 27 bp, Artificial Sequence
  Description of Artificial Sequence: Synthetic oligonucleotide
tgcgttgggttcttcttgctgcagggg

SEQ ID NO: 165799 - DNA, 26 bp, Artificial Sequence
  Description of Artificial Sequence: Synthetic oligonucleotide
gcgttgggttcttcttgctgcagggg

SEQ ID NO: 165800 - DNA, 26 bp, Artificial Sequence
  Description of Artificial Sequence: Synthetic oligonucleotide
cgttgggttcttcttgctgcaggggg

SEQ ID NO: 165801 - DNA, 23 bp, Artificial Sequence
  Description of Artificial Sequence: Synthetic oligonucleotide
ttgctgcagggggcctggccact

SEQ ID NO: 165802 - DNA, 22 bp, Artificial Sequence
  Description of Artificial Sequence: Synthetic oligonucleotide
tgctgcagggggcctggccact

SEQ ID NO: 165803 - DNA, 21 bp, Artificial Sequence
  Description of Artificial Sequence: Synthetic oligonucleotide
gctgcagggggcctggccact

SEQ ID NO: 165804 - DNA, 23 bp, Artificial Sequence
  Description of Artificial Sequence: Synthetic oligonucleotide
ctgcagggggcctggccactcat

SEQ ID NO: 165805 - DNA, 23 bp, Artificial Sequence
  Description of Artificial Sequence: Synthetic oligonucleotide
tgcagggggcctggccactcatg

SEQ ID NO: 165806 - DNA, 22 bp, Artificial Sequence
  Description of Artificial Sequence: Synthetic oligonucleotide
gcagggggcctggccactcatg

SEQ ID NO: 165807 - DNA, 22 bp, Artificial Sequence
  Description of Artificial Sequence: Synthetic oligonucleotide
cagggggcctggccactcatgg

SEQ ID NO: 165808 - DNA, 23 bp, Artificial Sequence
  Description of Artificial Sequence: Synthetic oligonucleotide
agggggcctggccactcatgggt

SEQ ID NO: 165809 - DNA, 22 bp, Artificial Sequence
  Description of Artificial Sequence: Synthetic oligonucleotide
gggggcctggccactcatgggt

SEQ ID NO: 165810 - DNA, 22 bp, Artificial Sequence
  Description of Artificial Sequence: Synthetic oligonucleotide
ggggcctggccactcatgggtg

SEQ ID NO: 165811 - DNA, 23 bp, Artificial Sequence
  Description of Artificial Sequence: Synthetic oligonucleotide
gggcctggccactcatgggtggt

SEQ ID NO: 165812 - DNA, 24 bp, Artificial Sequence
  Description of Artificial Sequence: Synthetic oligonucleotide
ggcctggccactcatgggtggtca

SEQ ID NO: 165813 - DNA, 24 bp, Artificial Sequence
  Description of Artificial Sequence: Synthetic oligonucleotide
gcctggccactcatgggtggtcag

SEQ ID NO: 165814 - DNA, 25 bp, Artificial Sequence
  Description of Artificial Sequence: Synthetic oligonucleotide
cctggccactcatgggtggtcagga

SEQ ID NO: 165815 - DNA, 27 bp, Artificial Sequence
  Description of Artificial Sequence: Synthetic oligonucleotide
ctggccactcatgggtggtcaggacaa

SEQ ID NO: 165816 - DNA, 28 bp, Artificial Sequence
  Description of Artificial Sequence: Synthetic oligonucleotide
tggccactcatgggtggtcaggacaaac

SEQ ID NO: 165817 - DNA, 27 bp, Artificial Sequence
  Description of Artificial Sequence: Synthetic oligonucleotide
ggccactcatgggtggtcaggacaaac

SEQ ID NO: 165818 - DNA, 27 bp, Artificial Sequence
  Description of Artificial Sequence: Synthetic oligonucleotide
gccactcatgggtggtcaggacaaacc

SEQ ID NO: 165819 - DNA, 27 bp, Artificial Sequence
  Description of Artificial Sequence: Synthetic oligonucleotide
ccactcatgggtggtcaggacaaaccc

SEQ ID NO: 165820 - DNA, 29 bp, Artificial Sequence
  Description of Artificial Sequence: Synthetic oligonucleotide
cactcatgggtggtcaggacaaacccttc

SEQ ID NO: 165821 - DNA, 29 bp, Artificial Sequence
  Description of Artificial Sequence: Synthetic oligonucleotide
actcatgggtggtcaggacaaacccttcc

SEQ ID NO: 165822 - DNA, 28 bp, Artificial Sequence
  Description of Artificial Sequence: Synthetic oligonucleotide
ctcatgggtggtcaggacaaacccttcc

SEQ ID NO: 165823 - DNA, 29 bp, Artificial Sequence
  Description of Artificial Sequence: Synthetic oligonucleotide
tcatgggtggtcaggacaaacccttcctg

SEQ ID NO: 165824 - DNA, 27 bp, Artificial Sequence
  Description of Artificial Sequence: Synthetic oligonucleotide
gtcaggacaaacccttcctgtctgccc

SEQ ID NO: 165825 - DNA, 27 bp, Artificial Sequence
  Description of Artificial Sequence: Synthetic oligonucleotide
tcaggacaaacccttcctgtctgcccg

SEQ ID NO: 165826 - DNA, 26 bp, Artificial Sequence
  Description of Artificial Sequence: Synthetic oligonucleotide
caggacaaacccttcctgtctgcccg

SEQ ID NO: 165827 - DNA, 26 bp, Artificial Sequence
  Description of Artificial Sequence: Synthetic oligonucleotide
aggacaaacccttcctgtctgcccgg

SEQ ID NO: 165828 - DNA, 25 bp, Artificial Sequence
  Description of Artificial Sequence: Synthetic oligonucleotide
ggacaaacccttcctgtctgcccgg

SEQ ID NO: 165829 - DNA, 25 bp, Artificial Sequence
  Description of Artificial Sequence: Synthetic oligonucleotide
gacaaacccttcctgtctgcccggc

SEQ ID NO: 165830 - DNA, 25 bp, Artificial Sequence
  Description of Artificial Sequence: Synthetic oligonucleotide
acaaacccttcctgtctgcccggcc

SEQ ID NO: 165831 - DNA, 24 bp, Artificial Sequence
  Description of Artificial Sequence: Synthetic oligonucleotide
caaacccttcctgtctgcccggcc

SEQ ID NO: 165832 - DNA, 25 bp, Artificial Sequence
  Description of Artificial Sequence: Synthetic oligonucleotide
aaacccttcctgtctgcccggccca

SEQ ID NO: 165833 - DNA, 24 bp, Artificial Sequence
  Description of Artificial Sequence: Synthetic oligonucleotide
aacccttcctgtctgcccggccca

SEQ ID NO: 165834 - DNA, 23 bp, Artificial Sequence
  Description of Artificial Sequence: Synthetic oligonucleotide
acccttcctgtctgcccggccca

SEQ ID NO: 165835 - DNA, 22 bp, Artificial Sequence
  Description of Artificial Sequence: Synthetic oligonucleotide
cccttcctgtctgcccggccca

SEQ ID NO: 165836 - DNA, 22 bp, Artificial Sequence
  Description of Artificial Sequence: Synthetic oligonucleotide
ccttcctgtctgcccggcccag

SEQ ID NO: 165837 - DNA, 23 bp, Artificial Sequence
  Description of Artificial Sequence: Synthetic oligonucleotide
cttcctgtctgcccggcccagca

SEQ ID NO: 165838 - DNA, 24 bp, Artificial Sequence
  Description of Artificial Sequence: Synthetic oligonucleotide
ttcctgtctgcccggcccagcact

SEQ ID NO: 165839 - DNA, 23 bp, Artificial Sequence
  Description of Artificial Sequence: Synthetic oligonucleotide
tcctgtctgcccggcccagcact

SEQ ID NO: 165840 - DNA, 22 bp, Artificial Sequence
  Description of Artificial Sequence: Synthetic oligonucleotide
cctgtctgcccggcccagcact

SEQ ID NO: 165841 - DNA, 23 bp, Artificial Sequence
  Description of Artificial Sequence: Synthetic oligonucleotide
ctgtctgcccggcccagcactgt

SEQ ID NO: 165842 - DNA, 23 bp, Artificial Sequence
  Description of Artificial Sequence: Synthetic oligonucleotide
tgtctgcccggcccagcactgtg

SEQ ID NO: 165843 - DNA, 22 bp, Artificial Sequence
  Description of Artificial Sequence: Synthetic oligonucleotide
gtctgcccggcccagcactgtg

SEQ ID NO: 165844 - DNA, 23 bp, Artificial Sequence
  Description of Artificial Sequence: Synthetic oligonucleotide
tctgcccggcccagcactgtggt

SEQ ID NO: 165845 - DNA, 22 bp, Artificial Sequence
  Description of Artificial Sequence: Synthetic oligonucleotide
ctgcccggcccagcactgtggt

SEQ ID NO: 165846 - DNA, 22 bp, Artificial Sequence
  Description of Artificial Sequence: Synthetic oligonucleotide
tgcccggcccagcactgtggtg

SEQ ID NO: 165847 - DNA, 21 bp, Artificial Sequence
  Description of Artificial Sequence: Synthetic oligonucleotide
gcccggcccagcactgtggtg

SEQ ID NO: 165848 - DNA, 21 bp, Artificial Sequence
  Description of Artificial Sequence: Synthetic oligonucleotide
cccggcccagcactgtggtgc

SEQ ID NO: 165849 - DNA, 22 bp, Artificial Sequence
  Description of Artificial Sequence: Synthetic oligonucleotide
ccggcccagcactgtggtgcct

SEQ ID NO: 165850 - DNA, 22 bp, Artificial Sequence
  Description of Artificial Sequence: Synthetic oligonucleotide
cggcccagcactgtggtgcctc

SEQ ID NO: 165851 - DNA, 26 bp, Artificial Sequence
  Description of Artificial Sequence: Synthetic oligonucleotide
agcactgtggtgcctcgaggaggaca

SEQ ID NO: 165852 - DNA, 25 bp, Artificial Sequence
  Description of Artificial Sequence: Synthetic oligonucleotide
gcactgtggtgcctcgaggaggaca

SEQ ID NO: 165853 - DNA, 25 bp, Artificial Sequence
  Description of Artificial Sequence: Synthetic oligonucleotide
cactgtggtgcctcgaggaggacac

SEQ ID NO: 165854 - DNA, 26 bp, Artificial Sequence
  Description of Artificial Sequence: Synthetic oligonucleotide
actgtggtgcctcgaggaggacacgt

SEQ ID NO: 165855 - DNA, 25 bp, Artificial Sequence
  Description of Artificial Sequence: Synthetic oligonucleotide
tgtggtgcctcgaggaggacacgtg

SEQ ID NO: 165856 - DNA, 24 bp, Artificial Sequence
  Description of Artificial Sequence: Synthetic oligonucleotide
gtggtgcctcgaggaggacacgtg

SEQ ID NO: 165857 - DNA, 24 bp, Artificial Sequence
  Description of Artificial Sequence: Synthetic oligonucleotide
tggtgcctcgaggaggacacgtgg

SEQ ID NO: 165858 - DNA, 23 bp, Artificial Sequence
  Description of Artificial Sequence: Synthetic oligonucleotide
ggtgcctcgaggaggacacgtgg

SEQ ID NO: 165859 - DNA, 24 bp, Artificial Sequence
  Description of Artificial Sequence: Synthetic oligonucleotide
gtgcctcgaggaggacacgtggct

SEQ ID NO: 165860 - DNA, 26 bp, Artificial Sequence
  Description of Artificial Sequence: Synthetic oligonucleotide
tgcctcgaggaggacacgtggctctt

SEQ ID NO: 165861 - DNA, 25 bp, Artificial Sequence
  Description of Artificial Sequence: Synthetic oligonucleotide
gcctcgaggaggacacgtggctctt

SEQ ID NO: 165862 - DNA, 26 bp, Artificial Sequence
  Description of Artificial Sequence: Synthetic oligonucleotide
cctcgaggaggacacgtggctcttca

SEQ ID NO: 165863 - DNA, 27 bp, Artificial Sequence
  Description of Artificial Sequence: Synthetic oligonucleotide
ctcgaggaggacacgtggctcttcagt

SEQ ID NO: 165864 - DNA, 27 bp, Artificial Sequence
  Description of Artificial Sequence: Synthetic oligonucleotide
tcgaggaggacacgtggctcttcagtg

SEQ ID NO: 165865 - DNA, 27 bp, Artificial Sequence
  Description of Artificial Sequence: Synthetic oligonucleotide
cgaggaggacacgtggctcttcagtgt

SEQ ID NO: 165866 - DNA, 27 bp, Artificial Sequence
  Description of Artificial Sequence: Synthetic oligonucleotide
gaggaggacacgtggctcttcagtgtc

SEQ ID NO: 165867 - DNA, 28 bp, Artificial Sequence
  Description of Artificial Sequence: Synthetic oligonucleotide
aggaggacacgtggctcttcagtgtcac

SEQ ID NO: 165868 - DNA, 27 bp, Artificial Sequence
  Description of Artificial Sequence: Synthetic oligonucleotide
ggaggacacgtggctcttcagtgtcac

SEQ ID NO: 165869 - DNA, 30 bp, Artificial Sequence
  Description of Artificial Sequence: Synthetic oligonucleotide
gaggacacgtggctcttcagtgtcactatc

SEQ ID NO: 165870 - DNA, 30 bp, Artificial Sequence
  Description of Artificial Sequence: Synthetic oligonucleotide
aggacacgtggctcttcagtgtcactatcg

SEQ ID NO: 165871 - DNA, 29 bp, Artificial Sequence
  Description of Artificial Sequence: Synthetic oligonucleotide
ggacacgtggctcttcagtgtcactatcg

SEQ ID NO: 165872 - DNA, 30 bp, Artificial Sequence
  Description of Artificial Sequence: Synthetic oligonucleotide
gacacgtggctcttcagtgtcactatcgtc

SEQ ID NO: 165873 - DNA, 30 bp, Artificial Sequence
  Description of Artificial Sequence: Synthetic oligonucleotide
acacgtggctcttcagtgtcactatcgtcg

SEQ ID NO: 165874 - DNA, 29 bp, Artificial Sequence
  Description of Artificial Sequence: Synthetic oligonucleotide
cacgtggctcttcagtgtcactatcgtcg

SEQ ID NO: 165875 - DNA, 30 bp, Artificial Sequence
  Description of Artificial Sequence: Synthetic oligonucleotide
acgtggctcttcagtgtcactatcgtcgtg

SEQ ID NO: 165876 - DNA, 29 bp, Artificial Sequence
  Description of Artificial Sequence: Synthetic oligonucleotide
cgtggctcttcagtgtcactatcgtcgtg

SEQ ID NO: 165877 - DNA, 29 bp, Artificial Sequence
  Description of Artificial Sequence: Synthetic oligonucleotide
gtggctcttcagtgtcactatcgtcgtgg

SEQ ID NO: 165878 - DNA, 29 bp, Artificial Sequence
  Description of Artificial Sequence: Synthetic oligonucleotide
tggctcttcagtgtcactatcgtcgtggg

SEQ ID NO: 165879 - DNA, 28 bp, Artificial Sequence
  Description of Artificial Sequence: Synthetic oligonucleotide
ggctcttcagtgtcactatcgtcgtggg

SEQ ID NO: 165880 - DNA, 33 bp, Artificial Sequence
  Description of Artificial Sequence: Synthetic oligonucleotide
gctcttcagtgtcactatcgtcgtgggtttaac

SEQ ID NO: 165881 - DNA, 38 bp, Artificial Sequence
  Description of Artificial Sequence: Synthetic oligonucleotide
ctcttcagtgtcactatcgtcgtgggtttaacaatttc

SEQ ID NO: 165882 - DNA, 40 bp, Artificial Sequence
  Description of Artificial Sequence: Synthetic oligonucleotide
tcttcagtgtcactatcgtcgtgggtttaacaatttcatg

SEQ ID NO: 165883 - DNA, 39 bp, Artificial Sequence
  Description of Artificial Sequence: Synthetic oligonucleotide
cttcagtgtcactatcgtcgtgggtttaacaatttcatg

SEQ ID NO: 165884 - DNA, 39 bp, Artificial Sequence
  Description of Artificial Sequence: Synthetic oligonucleotide
ttcagtgtcactatcgtcgtgggtttaacaatttcatgc

SEQ ID NO: 165885 - DNA, 38 bp, Artificial Sequence
  Description of Artificial Sequence: Synthetic oligonucleotide
tcagtgtcactatcgtcgtgggtttaacaatttcatgc

SEQ ID NO: 165886 - DNA, 37 bp, Artificial Sequence
  Description of Artificial Sequence: Synthetic oligonucleotide
cagtgtcactatcgtcgtgggtttaacaatttcatgc

SEQ ID NO: 165887 - DNA, 38 bp, Artificial Sequence
  Description of Artificial Sequence: Synthetic oligonucleotide
agtgtcactatcgtcgtgggtttaacaatttcatgctg

SEQ ID NO: 165888 - DNA, 37 bp, Artificial Sequence
  Description of Artificial Sequence: Synthetic oligonucleotide
gtgtcactatcgtcgtgggtttaacaatttcatgctg

SEQ ID NO: 165889 - DNA, 39 bp, Artificial Sequence
  Description of Artificial Sequence: Synthetic oligonucleotide
tgtcactatcgtcgtgggtttaacaatttcatgctgtac

SEQ ID NO: 165890 - DNA, 38 bp, Artificial Sequence
  Description of Artificial Sequence: Synthetic oligonucleotide
gtcactatcgtcgtgggtttaacaatttcatgctgtac

SEQ ID NO: 165891 - DNA, 41 bp, Artificial Sequence
  Description of Artificial Sequence: Synthetic oligonucleotide
tcactatcgtcgtgggtttaacaatttcatgctgtacaaag

SEQ ID NO: 165892 - DNA, 40 bp, Artificial Sequence
  Description of Artificial Sequence: Synthetic oligonucleotide
cactatcgtcgtgggtttaacaatttcatgctgtacaaag

SEQ ID NO: 165893 - DNA, 42 bp, Artificial Sequence
  Description of Artificial Sequence: Synthetic oligonucleotide
actatcgtcgtgggtttaacaatttcatgctgtacaaagaag

SEQ ID NO: 165894 - DNA, 41 bp, Artificial Sequence
  Description of Artificial Sequence: Synthetic oligonucleotide
ctatcgtcgtgggtttaacaatttcatgctgtacaaagaag

SEQ ID NO: 165895 - DNA, 42 bp, Artificial Sequence
  Description of Artificial Sequence: Synthetic oligonucleotide
tatcgtcgtgggtttaacaatttcatgctgtacaaagaagac

SEQ ID NO: 165896 - DNA, 41 bp, Artificial Sequence
  Description of Artificial Sequence: Synthetic oligonucleotide
atcgtcgtgggtttaacaatttcatgctgtacaaagaagac

SEQ ID NO: 165897 - DNA, 40 bp, Artificial Sequence
  Description of Artificial Sequence: Synthetic oligonucleotide
tcgtcgtgggtttaacaatttcatgctgtacaaagaagac

SEQ ID NO: 165898 - DNA, 39 bp, Artificial Sequence
  Description of Artificial Sequence: Synthetic oligonucleotide
cgtcgtgggtttaacaatttcatgctgtacaaagaagac

SEQ ID NO: 165899 - DNA, 40 bp, Artificial Sequence
  Description of Artificial Sequence: Synthetic oligonucleotide
gtcgtgggtttaacaatttcatgctgtacaaagaagacag

SEQ ID NO: 165900 - DNA, 42 bp, Artificial Sequence
  Description of Artificial Sequence: Synthetic oligonucleotide
tcgtgggtttaacaatttcatgctgtacaaagaagacagaag

SEQ ID NO: 165901 - DNA, 41 bp, Artificial Sequence
  Description of Artificial Sequence: Synthetic oligonucleotide
cgtgggtttaacaatttcatgctgtacaaagaagacagaag

SEQ ID NO: 165902 - DNA, 41 bp, Artificial Sequence
  Description of Artificial Sequence: Synthetic oligonucleotide
gtgggtttaacaatttcatgctgtacaaagaagacagaagc

SEQ ID NO: 165903 - DNA, 41 bp, Artificial Sequence
  Description of Artificial Sequence: Synthetic oligonucleotide
tgggtttaacaatttcatgctgtacaaagaagacagaagcc

SEQ ID NO: 165904 - DNA, 40 bp, Artificial Sequence
  Description of Artificial Sequence: Synthetic oligonucleotide
gggtttaacaatttcatgctgtacaaagaagacagaagcc

SEQ ID NO: 165905 - DNA, 41 bp, Artificial Sequence
  Description of Artificial Sequence: Synthetic oligonucleotide
ggtttaacaatttcatgctgtacaaagaagacagaagccac

SEQ ID NO: 165906 - DNA, 41 bp, Artificial Sequence
  Description of Artificial Sequence: Synthetic oligonucleotide
gtttaacaatttcatgctgtacaaagaagacagaagccacg

SEQ ID NO: 165907 - DNA, 43 bp, Artificial Sequence
  Description of Artificial Sequence: Synthetic oligonucleotide
tttaacaatttcatgctgtacaaagaagacagaagccacgttc

SEQ ID NO: 165908 - DNA, 42 bp, Artificial Sequence
  Description of Artificial Sequence: Synthetic oligonucleotide
ttaacaatttcatgctgtacaaagaagacagaagccacgttc

SEQ ID NO: 165909 - DNA, 41 bp, Artificial Sequence
  Description of Artificial Sequence: Synthetic oligonucleotide
taacaatttcatgctgtacaaagaagacagaagccacgttc

SEQ ID NO: 165910 - DNA, 40 bp, Artificial Sequence
  Description of Artificial Sequence: Synthetic oligonucleotide
aacaatttcatgctgtacaaagaagacagaagccacgttc

SEQ ID NO: 165911 - DNA, 39 bp, Artificial Sequence
  Description of Artificial Sequence: Synthetic oligonucleotide
acaatttcatgctgtacaaagaagacagaagccacgttc

SEQ ID NO: 165912 - DNA, 38 bp, Artificial Sequence
  Description of Artificial Sequence: Synthetic oligonucleotide
caatttcatgctgtacaaagaagacagaagccacgttc

SEQ ID NO: 165913 - DNA, 38 bp, Artificial Sequence
  Description of Artificial Sequence: Synthetic oligonucleotide
aatttcatgctgtacaaagaagacagaagccacgttcc

SEQ ID NO: 165914 - DNA, 37 bp, Artificial Sequence
  Description of Artificial Sequence: Synthetic oligonucleotide
atttcatgctgtacaaagaagacagaagccacgttcc

SEQ ID NO: 165915 - DNA, 36 bp, Artificial Sequence
  Description of Artificial Sequence: Synthetic oligonucleotide
tttcatgctgtacaaagaagacagaagccacgttcc

SEQ ID NO: 165916 - DNA, 35 bp, Artificial Sequence
  Description of Artificial Sequence: Synthetic oligonucleotide
ttcatgctgtacaaagaagacagaagccacgttcc

SEQ ID NO: 165917 - DNA, 34 bp, Artificial Sequence
  Description of Artificial Sequence: Synthetic oligonucleotide
tcatgctgtacaaagaagacagaagccacgttcc

SEQ ID NO: 165918 - DNA, 33 bp, Artificial Sequence
  Description of Artificial Sequence: Synthetic oligonucleotide
catgctgtacaaagaagacagaagccacgttcc

SEQ ID NO: 165919 - DNA, 33 bp, Artificial Sequence
  Description of Artificial Sequence: Synthetic oligonucleotide
atgctgtacaaagaagacagaagccacgttccc

SEQ ID NO: 165920 - DNA, 32 bp, Artificial Sequence
  Description of Artificial Sequence: Synthetic oligonucleotide
tgctgtacaaagaagacagaagccacgttccc

SEQ ID NO: 165921 - DNA, 31 bp, Artificial Sequence
  Description of Artificial Sequence: Synthetic oligonucleotide
gctgtacaaagaagacagaagccacgttccc

SEQ ID NO: 165922 - DNA, 33 bp, Artificial Sequence
  Description of Artificial Sequence: Synthetic oligonucleotide
ctgtacaaagaagacagaagccacgttcccatc

SEQ ID NO: 165923 - DNA, 35 bp, Artificial Sequence
  Description of Artificial Sequence: Synthetic oligonucleotide
tgtacaaagaagacagaagccacgttcccatcttc

SEQ ID NO: 165924 - DNA, 34 bp, Artificial Sequence
  Description of Artificial Sequence: Synthetic oligonucleotide
gtacaaagaagacagaagccacgttcccatcttc

SEQ ID NO: 165925 - DNA, 34 bp, Artificial Sequence
  Description of Artificial Sequence: Synthetic oligonucleotide
tacaaagaagacagaagccacgttcccatcttcc

SEQ ID NO: 165926 - DNA, 33 bp, Artificial Sequence
  Description of Artificial Sequence: Synthetic oligonucleotide
acaaagaagacagaagccacgttcccatcttcc

SEQ ID NO: 165927 - DNA, 32 bp, Artificial Sequence
  Description of Artificial Sequence: Synthetic oligonucleotide
caaagaagacagaagccacgttcccatcttcc

SEQ ID NO: 165928 - DNA, 33 bp, Artificial Sequence
  Description of Artificial Sequence: Synthetic oligonucleotide
aaagaagacagaagccacgttcccatcttccac

SEQ ID NO: 165929 - DNA, 32 bp, Artificial Sequence
  Description of Artificial Sequence: Synthetic oligonucleotide
aagaagacagaagccacgttcccatcttccac

SEQ ID NO: 165930 - DNA, 31 bp, Artificial Sequence
  Description of Artificial Sequence: Synthetic oligonucleotide
agaagacagaagccacgttcccatcttccac

SEQ ID NO: 165931 - DNA, 30 bp, Artificial Sequence
  Description of Artificial Sequence: Synthetic oligonucleotide
gaagacagaagccacgttcccatcttccac

SEQ ID NO: 165932 - DNA, 30 bp, Artificial Sequence
  Description of Artificial Sequence: Synthetic oligonucleotide
aagacagaagccacgttcccatcttccacg

SEQ ID NO: 165933 - DNA, 29 bp, Artificial Sequence
  Description of Artificial Sequence: Synthetic oligonucleotide
agacagaagccacgttcccatcttccacg

SEQ ID NO: 165934 - DNA, 28 bp, Artificial Sequence
  Description of Artificial Sequence: Synthetic oligonucleotide
gacagaagccacgttcccatcttccacg

SEQ ID NO: 165935 - DNA, 28 bp, Artificial Sequence
  Description of Artificial Sequence: Synthetic oligonucleotide
acagaagccacgttcccatcttccacgg

SEQ ID NO: 165936 - DNA, 27 bp, Artificial Sequence
  Description of Artificial Sequence: Synthetic oligonucleotide
cagaagccacgttcccatcttccacgg

SEQ ID NO: 165937 - DNA, 27 bp, Artificial Sequence
  Description of Artificial Sequence: Synthetic oligonucleotide
agaagccacgttcccatcttccacggc

SEQ ID NO: 165938 - DNA, 27 bp, Artificial Sequence
  Description of Artificial Sequence: Synthetic oligonucleotide
gaagccacgttcccatcttccacggca

SEQ ID NO: 165939 - DNA, 27 bp, Artificial Sequence
  Description of Artificial Sequence: Synthetic oligonucleotide
aagccacgttcccatcttccacggcag

SEQ ID NO: 165940 - DNA, 27 bp, Artificial Sequence
  Description of Artificial Sequence: Synthetic oligonucleotide
agccacgttcccatcttccacggcaga

SEQ ID NO: 165941 - DNA, 27 bp, Artificial Sequence
  Description of Artificial Sequence: Synthetic oligonucleotide
gccacgttcccatcttccacggcagaa

SEQ ID NO: 165942 - DNA, 31 bp, Artificial Sequence
  Description of Artificial Sequence: Synthetic oligonucleotide
ccacgttcccatcttccacggcagaatattc

SEQ ID NO: 165943 - DNA, 31 bp, Artificial Sequence
  Description of Artificial Sequence: Synthetic oligonucleotide
cacgttcccatcttccacggcagaatattcc

SEQ ID NO: 165944 - DNA, 32 bp, Artificial Sequence
  Description of Artificial Sequence: Synthetic oligonucleotide
acgttcccatcttccacggcagaatattccag

SEQ ID NO: 165945 - DNA, 31 bp, Artificial Sequence
  Description of Artificial Sequence: Synthetic oligonucleotide
cgttcccatcttccacggcagaatattccag

SEQ ID NO: 165946 - DNA, 31 bp, Artificial Sequence
  Description of Artificial Sequence: Synthetic oligonucleotide
gttcccatcttccacggcagaatattccagg

SEQ ID NO: 165947 - DNA, 32 bp, Artificial Sequence
  Description of Artificial Sequence: Synthetic oligonucleotide
ttcccatcttccacggcagaatattccaggag

SEQ ID NO: 165948 - DNA, 31 bp, Artificial Sequence
  Description of Artificial Sequence: Synthetic oligonucleotide
tcccatcttccacggcagaatattccaggag

SEQ ID NO: 165949 - DNA, 30 bp, Artificial Sequence
  Description of Artificial Sequence: Synthetic oligonucleotide
cccatcttccacggcagaatattccaggag

SEQ ID NO: 165950 - DNA, 31 bp, Artificial Sequence
  Description of Artificial Sequence: Synthetic oligonucleotide
ccatcttccacggcagaatattccaggagag

SEQ ID NO: 165951 - DNA, 31 bp, Artificial Sequence
  Description of Artificial Sequence: Synthetic oligonucleotide
catcttccacggcagaatattccaggagagc

SEQ ID NO: 165952 - DNA, 33 bp, Artificial Sequence
  Description of Artificial Sequence: Synthetic oligonucleotide
atcttccacggcagaatattccaggagagcttc

SEQ ID NO: 165953 - DNA, 32 bp, Artificial Sequence
  Description of Artificial Sequence: Synthetic oligonucleotide
tcttccacggcagaatattccaggagagcttc

SEQ ID NO: 165954 - DNA, 31 bp, Artificial Sequence
  Description of Artificial Sequence: Synthetic oligonucleotide
cttccacggcagaatattccaggagagcttc

SEQ ID NO: 165955 - DNA, 33 bp, Artificial Sequence
  Description of Artificial Sequence: Synthetic oligonucleotide
ttccacggcagaatattccaggagagcttcatc

SEQ ID NO: 165956 - DNA, 32 bp, Artificial Sequence
  Description of Artificial Sequence: Synthetic oligonucleotide
tccacggcagaatattccaggagagcttcatc

SEQ ID NO: 165957 - DNA, 31 bp, Artificial Sequence
  Description of Artificial Sequence: Synthetic oligonucleotide
ccacggcagaatattccaggagagcttcatc

SEQ ID NO: 165958 - DNA, 33 bp, Artificial Sequence
  Description of Artificial Sequence: Synthetic oligonucleotide
cacggcagaatattccaggagagcttcatcatg

SEQ ID NO: 165959 - DNA, 33 bp, Artificial Sequence
  Description of Artificial Sequence: Synthetic oligonucleotide
acggcagaatattccaggagagcttcatcatgg

SEQ ID NO: 165960 - DNA, 32 bp, Artificial Sequence
  Description of Artificial Sequence: Synthetic oligonucleotide
cggcagaatattccaggagagcttcatcatgg

SEQ ID NO: 165961 - DNA, 32 bp, Artificial Sequence
  Description of Artificial Sequence: Synthetic oligonucleotide
ggcagaatattccaggagagcttcatcatggg

SEQ ID NO: 165962 - DNA, 32 bp, Artificial Sequence
  Description of Artificial Sequence: Synthetic oligonucleotide
gcagaatattccaggagagcttcatcatgggc

SEQ ID NO: 165963 - DNA, 32 bp, Artificial Sequence
  Description of Artificial Sequence: Synthetic oligonucleotide
cagaatattccaggagagcttcatcatgggcc

SEQ ID NO: 165964 - DNA, 32 bp, Artificial Sequence
  Description of Artificial Sequence: Synthetic oligonucleotide
agaatattccaggagagcttcatcatgggccc

SEQ ID NO: 165965 - DNA, 31 bp, Artificial Sequence
  Description of Artificial Sequence: Synthetic oligonucleotide
gaatattccaggagagcttcatcatgggccc

SEQ ID NO: 165966 - DNA, 32 bp, Artificial Sequence
  Description of Artificial Sequence: Synthetic oligonucleotide
aatattccaggagagcttcatcatgggccctg

SEQ ID NO: 165967 - DNA, 31 bp, Artificial Sequence
  Description of Artificial Sequence: Synthetic oligonucleotide
atattccaggagagcttcatcatgggccctg

SEQ ID NO: 165968 - DNA, 30 bp, Artificial Sequence
  Description of Artificial Sequence: Synthetic oligonucleotide
tattccaggagagcttcatcatgggccctg

SEQ ID NO: 165969 - DNA, 29 bp, Artificial Sequence
  Description of Artificial Sequence: Synthetic oligonucleotide
attccaggagagcttcatcatgggccctg

SEQ ID NO: 165970 - DNA, 28 bp, Artificial Sequence
  Description of Artificial Sequence: Synthetic oligonucleotide
ttccaggagagcttcatcatgggccctg

SEQ ID NO: 165971 - DNA, 27 bp, Artificial Sequence
  Description of Artificial Sequence: Synthetic oligonucleotide
tccaggagagcttcatcatgggccctg

SEQ ID NO: 165972 - DNA, 27 bp, Artificial Sequence
  Description of Artificial Sequence: Synthetic oligonucleotide
ccaggagagcttcatcatgggccctgt

SEQ ID NO: 165973 - DNA, 27 bp, Artificial Sequence
  Description of Artificial Sequence: Synthetic oligonucleotide
caggagagcttcatcatgggccctgtg

SEQ ID NO: 165974 - DNA, 28 bp, Artificial Sequence
  Description of Artificial Sequence: Synthetic oligonucleotide
aggagagcttcatcatgggccctgtgac

SEQ ID NO: 165975 - DNA, 27 bp, Artificial Sequence
  Description of Artificial Sequence: Synthetic oligonucleotide
ggagagcttcatcatgggccctgtgac

SEQ ID NO: 165976 - DNA, 27 bp, Artificial Sequence
  Description of Artificial Sequence: Synthetic oligonucleotide
gagagcttcatcatgggccctgtgacc

SEQ ID NO: 165977 - DNA, 27 bp, Artificial Sequence
  Description of Artificial Sequence: Synthetic oligonucleotide
agagcttcatcatgggccctgtgaccc

SEQ ID NO: 165978 - DNA, 26 bp, Artificial Sequence
  Description of Artificial Sequence: Synthetic oligonucleotide
gagcttcatcatgggccctgtgaccc

SEQ ID NO: 165979 - DNA, 27 bp, Artificial Sequence
  Description of Artificial Sequence: Synthetic oligonucleotide
agcttcatcatgggccctgtgacccca

SEQ ID NO: 165980 - DNA, 26 bp, Artificial Sequence
  Description of Artificial Sequence: Synthetic oligonucleotide
gcttcatcatgggccctgtgacccca

SEQ ID NO: 165981 - DNA, 26 bp, Artificial Sequence
  Description of Artificial Sequence: Synthetic oligonucleotide
cttcatcatgggccctgtgaccccag

SEQ ID NO: 165982 - DNA, 27 bp, Artificial Sequence
  Description of Artificial Sequence: Synthetic oligonucleotide
ttcatcatgggccctgtgaccccagca

SEQ ID NO: 165983 - DNA, 26 bp, Artificial Sequence
  Description of Artificial Sequence: Synthetic oligonucleotide
tcatcatgggccctgtgaccccagca

SEQ ID NO: 165984 - DNA, 25 bp, Artificial Sequence
  Description of Artificial Sequence: Synthetic oligonucleotide
catcatgggccctgtgaccccagca

SEQ ID NO: 165985 - DNA, 27 bp, Artificial Sequence
  Description of Artificial Sequence: Synthetic oligonucleotide
atcatgggccctgtgaccccagcacat

SEQ ID NO: 165986 - DNA, 26 bp, Artificial Sequence
  Description of Artificial Sequence: Synthetic oligonucleotide
tcatgggccctgtgaccccagcacat

SEQ ID NO: 165987 - DNA, 25 bp, Artificial Sequence
  Description of Artificial Sequence: Synthetic oligonucleotide
catgggccctgtgaccccagcacat

SEQ ID NO: 165988 - DNA, 25 bp, Artificial Sequence
  Description of Artificial Sequence: Synthetic oligonucleotide
atgggccctgtgaccccagcacatg

SEQ ID NO: 165989 - DNA, 24 bp, Artificial Sequence
  Description of Artificial Sequence: Synthetic oligonucleotide
tgggccctgtgaccccagcacatg

SEQ ID NO: 165990 - DNA, 23 bp, Artificial Sequence
  Description of Artificial Sequence: Synthetic oligonucleotide
gggccctgtgaccccagcacatg

SEQ ID NO: 165991 - DNA, 24 bp, Artificial Sequence
  Description of Artificial Sequence: Synthetic oligonucleotide
ggccctgtgaccccagcacatgca

SEQ ID NO: 165992 - DNA, 24 bp, Artificial Sequence
  Description of Artificial Sequence: Synthetic oligonucleotide
gccctgtgaccccagcacatgcag

SEQ ID NO: 165993 - DNA, 24 bp, Artificial Sequence
  Description of Artificial Sequence: Synthetic oligonucleotide
ccctgtgaccccagcacatgcagg

SEQ ID NO: 165994 - DNA, 25 bp, Artificial Sequence
  Description of Artificial Sequence: Synthetic oligonucleotide
cctgtgaccccagcacatgcaggga

SEQ ID NO: 165995 - DNA, 25 bp, Artificial Sequence
  Description of Artificial Sequence: Synthetic oligonucleotide
ctgtgaccccagcacatgcagggac

SEQ ID NO: 165996 - DNA, 27 bp, Artificial Sequence
  Description of Artificial Sequence: Synthetic oligonucleotide
tgtgaccccagcacatgcagggaccta

SEQ ID NO: 165997 - DNA, 26 bp, Artificial Sequence
  Description of Artificial Sequence: Synthetic oligonucleotide
gtgaccccagcacatgcagggaccta

SEQ ID NO: 165998 - DNA, 27 bp, Artificial Sequence
  Description of Artificial Sequence: Synthetic oligonucleotide
tgaccccagcacatgcagggacctaca

SEQ ID NO: 165999 - DNA, 26 bp, Artificial Sequence
  Description of Artificial Sequence: Synthetic oligonucleotide
gaccccagcacatgcagggacctaca

SEQ ID NO: 166000 - DNA, 27 bp, Artificial Sequence
  Description of Artificial Sequence: Synthetic oligonucleotide
accccagcacatgcagggacctacaga

SEQ ID NO: 166001 - DNA, 27 bp, Artificial Sequence
  Description of Artificial Sequence: Synthetic oligonucleotide
ccccagcacatgcagggacctacagat

SEQ ID NO: 166002 - DNA, 27 bp, Artificial Sequence
  Description of Artificial Sequence: Synthetic oligonucleotide
cccagcacatgcagggacctacagatg

SEQ ID NO: 166003 - DNA, 28 bp, Artificial Sequence
  Description of Artificial Sequence: Synthetic oligonucleotide
ccagcacatgcagggacctacagatgtc

SEQ ID NO: 166004 - DNA, 28 bp, Artificial Sequence
  Description of Artificial Sequence: Synthetic oligonucleotide
cagcacatgcagggacctacagatgtcg

SEQ ID NO: 166005 - DNA, 28 bp, Artificial Sequence
  Description of Artificial Sequence: Synthetic oligonucleotide
agcacatgcagggacctacagatgtcgg

SEQ ID NO: 166006 - DNA, 27 bp, Artificial Sequence
  Description of Artificial Sequence: Synthetic oligonucleotide
gcacatgcagggacctacagatgtcgg

SEQ ID NO: 166007 - DNA, 27 bp, Artificial Sequence
  Description of Artificial Sequence: Synthetic oligonucleotide
cacatgcagggacctacagatgtcggg

SEQ ID NO: 166008 - DNA, 27 bp, Artificial Sequence
  Description of Artificial Sequence: Synthetic oligonucleotide
acatgcagggacctacagatgtcgggg

SEQ ID NO: 166009 - DNA, 27 bp, Artificial Sequence
  Description of Artificial Sequence: Synthetic oligonucleotide
catgcagggacctacagatgtcggggt

SEQ ID NO: 166010 - DNA, 28 bp, Artificial Sequence
  Description of Artificial Sequence: Synthetic oligonucleotide
atgcagggacctacagatgtcggggttc

SEQ ID NO: 166011 - DNA, 27 bp, Artificial Sequence
  Description of Artificial Sequence: Synthetic oligonucleotide
tgcagggacctacagatgtcggggttc

SEQ ID NO: 166012 - DNA, 27 bp, Artificial Sequence
  Description of Artificial Sequence: Synthetic oligonucleotide
agggacctacagatgtcggggttcacg

SEQ ID NO: 166013 - DNA, 26 bp, Artificial Sequence
  Description of Artificial Sequence: Synthetic oligonucleotide
gggacctacagatgtcggggttcacg

SEQ ID NO: 166014 - DNA, 26 bp, Artificial Sequence
  Description of Artificial Sequence: Synthetic oligonucleotide
ggacctacagatgtcggggttcacgc

SEQ ID NO: 166015 - DNA, 26 bp, Artificial Sequence
  Description of Artificial Sequence: Synthetic oligonucleotide
gacctacagatgtcggggttcacgcc

SEQ ID NO: 166016 - DNA, 27 bp, Artificial Sequence
  Description of Artificial Sequence: Synthetic oligonucleotide
acctacagatgtcggggttcacgccca

SEQ ID NO: 166017 - DNA, 26 bp, Artificial Sequence
  Description of Artificial Sequence: Synthetic oligonucleotide
cctacagatgtcggggttcacgccca

SEQ ID NO: 166018 - DNA, 27 bp, Artificial Sequence
  Description of Artificial Sequence: Synthetic oligonucleotide
ctacagatgtcggggttcacgcccaca

SEQ ID NO: 166019 - DNA, 27 bp, Artificial Sequence
  Description of Artificial Sequence: Synthetic oligonucleotide
tacagatgtcggggttcacgcccacac

SEQ ID NO: 166020 - DNA, 27 bp, Artificial Sequence
  Description of Artificial Sequence: Synthetic oligonucleotide
acagatgtcggggttcacgcccacact

SEQ ID NO: 166021 - DNA, 26 bp, Artificial Sequence
  Description of Artificial Sequence: Synthetic oligonucleotide
cagatgtcggggttcacgcccacact

SEQ ID NO: 166022 - DNA, 26 bp, Artificial Sequence
  Description of Artificial Sequence: Synthetic oligonucleotide
agatgtcggggttcacgcccacactc

SEQ ID NO: 166023 - DNA, 25 bp, Artificial Sequence
  Description of Artificial Sequence: Synthetic oligonucleotide
gatgtcggggttcacgcccacactc

SEQ ID NO: 166024 - DNA, 24 bp, Artificial Sequence
  Description of Artificial Sequence: Synthetic oligonucleotide
tcggggttcacgcccacactccct

SEQ ID NO: 166025 - DNA, 23 bp, Artificial Sequence
  Description of Artificial Sequence: Synthetic oligonucleotide
cggggttcacgcccacactccct

SEQ ID NO: 166026 - DNA, 24 bp, Artificial Sequence
  Description of Artificial Sequence: Synthetic oligonucleotide
ggggttcacgcccacactccctca

SEQ ID NO: 166027 - DNA, 25 bp, Artificial Sequence
  Description of Artificial Sequence: Synthetic oligonucleotide
gggttcacgcccacactccctcact

SEQ ID NO: 166028 - DNA, 25 bp, Artificial Sequence
  Description of Artificial Sequence: Synthetic oligonucleotide
ggttcacgcccacactccctcactg

SEQ ID NO: 166029 - DNA, 25 bp, Artificial Sequence
  Description of Artificial Sequence: Synthetic oligonucleotide
gttcacgcccacactccctcactgg

SEQ ID NO: 166030 - DNA, 26 bp, Artificial Sequence
  Description of Artificial Sequence: Synthetic oligonucleotide
ttcacgcccacactccctcactgggt

SEQ ID NO: 166031 - DNA, 25 bp, Artificial Sequence
  Description of Artificial Sequence: Synthetic oligonucleotide
tcacgcccacactccctcactgggt

SEQ ID NO: 166032 - DNA, 24 bp, Artificial Sequence
  Description of Artificial Sequence: Synthetic oligonucleotide
cacgcccacactccctcactgggt

SEQ ID NO: 166033 - DNA, 24 bp, Artificial Sequence
  Description of Artificial Sequence: Synthetic oligonucleotide
acgcccacactccctcactgggtg

SEQ ID NO: 166034 - DNA, 23 bp, Artificial Sequence
  Description of Artificial Sequence: Synthetic oligonucleotide
cgcccacactccctcactgggtg

SEQ ID NO: 166035 - DNA, 24 bp, Artificial Sequence
  Description of Artificial Sequence: Synthetic oligonucleotide
gcccacactccctcactgggtggt

SEQ ID NO: 166036 - DNA, 24 bp, Artificial Sequence
  Description of Artificial Sequence: Synthetic oligonucleotide
cccacactccctcactgggtggtc

SEQ ID NO: 166037 - DNA, 24 bp, Artificial Sequence
  Description of Artificial Sequence: Synthetic oligonucleotide
ccacactccctcactgggtggtcg

SEQ ID NO: 166038 - DNA, 24 bp, Artificial Sequence
  Description of Artificial Sequence: Synthetic oligonucleotide
cacactccctcactgggtggtcgg

SEQ ID NO: 166039 - DNA, 25 bp, Artificial Sequence
  Description of Artificial Sequence: Synthetic oligonucleotide
acactccctcactgggtggtcggca

SEQ ID NO: 166040 - DNA, 24 bp, Artificial Sequence
  Description of Artificial Sequence: Synthetic oligonucleotide
cactccctcactgggtggtcggca

SEQ ID NO: 166041 - DNA, 24 bp, Artificial Sequence
  Description of Artificial Sequence: Synthetic oligonucleotide
actccctcactgggtggtcggcac

SEQ ID NO: 166042 - DNA, 23 bp, Artificial Sequence
  Description of Artificial Sequence: Synthetic oligonucleotide
ctccctcactgggtggtcggcac

SEQ ID NO: 166043 - DNA, 23 bp, Artificial Sequence
  Description of Artificial Sequence: Synthetic oligonucleotide
tccctcactgggtggtcggcacc

SEQ ID NO: 166044 - DNA, 22 bp, Artificial Sequence
  Description of Artificial Sequence: Synthetic oligonucleotide
ccctcactgggtggtcggcacc

SEQ ID NO: 166045 - DNA, 23 bp, Artificial Sequence
  Description of Artificial Sequence: Synthetic oligonucleotide
cctcactgggtggtcggcaccca

SEQ ID NO: 166046 - DNA, 23 bp, Artificial Sequence
  Description of Artificial Sequence: Synthetic oligonucleotide
ctcactgggtggtcggcacccag

SEQ ID NO: 166047 - DNA, 25 bp, Artificial Sequence
  Description of Artificial Sequence: Synthetic oligonucleotide
tcactgggtggtcggcacccagcaa

SEQ ID NO: 166048 - DNA, 30 bp, Artificial Sequence
  Description of Artificial Sequence: Synthetic oligonucleotide
aaccccctggtgatcatggtcacaggaaac

SEQ ID NO: 166049 - DNA, 29 bp, Artificial Sequence
  Description of Artificial Sequence: Synthetic oligonucleotide
accccctggtgatcatggtcacaggaaac

SEQ ID NO: 166050 - DNA, 28 bp, Artificial Sequence
  Description of Artificial Sequence: Synthetic oligonucleotide
ccccctggtgatcatggtcacaggaaac

SEQ ID NO: 166051 - DNA, 28 bp, Artificial Sequence
  Description of Artificial Sequence: Synthetic oligonucleotide
cccctggtgatcatggtcacaggaaacc

SEQ ID NO: 166052 - DNA, 29 bp, Artificial Sequence
  Description of Artificial Sequence: Synthetic oligonucleotide
ccctggtgatcatggtcacaggaaaccac

SEQ ID NO: 166053 - DNA, 30 bp, Artificial Sequence
  Description of Artificial Sequence: Synthetic oligonucleotide
cctggtgatcatggtcacaggaaaccacag

SEQ ID NO: 166054 - DNA, 34 bp, Artificial Sequence
  Description of Artificial Sequence: Synthetic oligonucleotide
ctggtgatcatggtcacaggaaaccacagaaaac

SEQ ID NO: 166055 - DNA, 22 bp, Artificial Sequence
  Description of Artificial Sequence: Synthetic oligonucleotide
cttccctcctggcccacccagg

SEQ ID NO: 166056 - DNA, 22 bp, Artificial Sequence
  Description of Artificial Sequence: Synthetic oligonucleotide
ttccctcctggcccacccaggg

SEQ ID NO: 166057 - DNA, 21 bp, Artificial Sequence
  Description of Artificial Sequence: Synthetic oligonucleotide
tccctcctggcccacccaggg

SEQ ID NO: 166058 - DNA, 20 bp, Artificial Sequence
  Description of Artificial Sequence: Synthetic oligonucleotide
ccctcctggcccacccaggg

SEQ ID NO: 166059 - DNA, 20 bp, Artificial Sequence
  Description of Artificial Sequence: Synthetic oligonucleotide
cctcctggcccacccagggc

SEQ ID NO: 166060 - DNA, 20 bp, Artificial Sequence
  Description of Artificial Sequence: Synthetic oligonucleotide
ctcctggcccacccagggcc

SEQ ID NO: 166061 - DNA, 20 bp, Artificial Sequence
  Description of Artificial Sequence: Synthetic oligonucleotide
tcctggcccacccagggccc

SEQ ID NO: 166062 - DNA, 20 bp, Artificial Sequence
  Description of Artificial Sequence: Synthetic oligonucleotide
cctggcccacccagggccct

SEQ ID NO: 166063 - DNA, 20 bp, Artificial Sequence
  Description of Artificial Sequence: Synthetic oligonucleotide
ctggcccacccagggcccct

SEQ ID NO: 166064 - DNA, 20 bp, Artificial Sequence
  Description of Artificial Sequence: Synthetic oligonucleotide
tggcccacccagggcccctg

SEQ ID NO: 166065 - DNA, 20 bp, Artificial Sequence
  Description of Artificial Sequence: Synthetic oligonucleotide
ggcccacccagggcccctgt

SEQ ID NO: 166066 - DNA, 20 bp, Artificial Sequence
  Description of Artificial Sequence: Synthetic oligonucleotide
gcccacccagggcccctgct

SEQ ID NO: 166067 - DNA, 24 bp, Artificial Sequence
  Description of Artificial Sequence: Synthetic oligonucleotide
cccacccagggcccctgctgaaat

SEQ ID NO: 166068 - DNA, 25 bp, Artificial Sequence
  Description of Artificial Sequence: Synthetic oligonucleotide
ccacccagggcccctgctgaaatca

SEQ ID NO: 166069 - DNA, 25 bp, Artificial Sequence
  Description of Artificial Sequence: Synthetic oligonucleotide
cacccagggcccctgctgaaatcag

SEQ ID NO: 166070 - DNA, 26 bp, Artificial Sequence
  Description of Artificial Sequence: Synthetic oligonucleotide
acccagggcccctgctgaaatcagga

SEQ ID NO: 166071 - DNA, 25 bp, Artificial Sequence
  Description of Artificial Sequence: Synthetic oligonucleotide
cccagggcccctgctgaaatcagga

SEQ ID NO: 166072 - DNA, 26 bp, Artificial Sequence
  Description of Artificial Sequence: Synthetic oligonucleotide
ccagggcccctgctgaaatcaggaga

SEQ ID NO: 166073 - DNA, 27 bp, Artificial Sequence
  Description of Artificial Sequence: Synthetic oligonucleotide
cagggcccctgctgaaatcaggagaga

SEQ ID NO: 166074 - DNA, 27 bp, Artificial Sequence
  Description of Artificial Sequence: Synthetic oligonucleotide
agggcccctgctgaaatcaggagagac

SEQ ID NO: 166075 - DNA, 27 bp, Artificial Sequence
  Description of Artificial Sequence: Synthetic oligonucleotide
gggcccctgctgaaatcaggagagaca

SEQ ID NO: 166076 - DNA, 27 bp, Artificial Sequence
  Description of Artificial Sequence: Synthetic oligonucleotide
ggcccctgctgaaatcaggagagacag

SEQ ID NO: 166077 - DNA, 28 bp, Artificial Sequence
  Description of Artificial Sequence: Synthetic oligonucleotide
gcccctgctgaaatcaggagagacagtc

SEQ ID NO: 166078 - DNA, 30 bp, Artificial Sequence
  Description of Artificial Sequence: Synthetic oligonucleotide
cccctgctgaaatcaggagagacagtcatc

SEQ ID NO: 166079 - DNA, 30 bp, Artificial Sequence
  Description of Artificial Sequence: Synthetic oligonucleotide
ccctgctgaaatcaggagagacagtcatcc

SEQ ID NO: 166080 - DNA, 31 bp, Artificial Sequence
  Description of Artificial Sequence: Synthetic oligonucleotide
cctgctgaaatcaggagagacagtcatcctg

SEQ ID NO: 166081 - DNA, 31 bp, Artificial Sequence
  Description of Artificial Sequence: Synthetic oligonucleotide
ctgctgaaatcaggagagacagtcatcctgc

SEQ ID NO: 166082 - DNA, 34 bp, Artificial Sequence
  Description of Artificial Sequence: Synthetic oligonucleotide
tgctgaaatcaggagagacagtcatcctgcaatg

SEQ ID NO: 166083 - DNA, 33 bp, Artificial Sequence
  Description of Artificial Sequence: Synthetic oligonucleotide
gctgaaatcaggagagacagtcatcctgcaatg

SEQ ID NO: 166084 - DNA, 35 bp, Artificial Sequence
  Description of Artificial Sequence: Synthetic oligonucleotide
ctgaaatcaggagagacagtcatcctgcaatgttg

SEQ ID NO: 166085 - DNA, 33 bp, Artificial Sequence
  Description of Artificial Sequence: Synthetic oligonucleotide
gagagacagtcatcctgcaatgttggtcagatg

SEQ ID NO: 166086 - DNA, 39 bp, Artificial Sequence
  Description of Artificial Sequence: Synthetic oligonucleotide
tgcaatgttggtcagatgtcatgtttgagcacttctttc

SEQ ID NO: 166087 - DNA, 38 bp, Artificial Sequence
  Description of Artificial Sequence: Synthetic oligonucleotide
gcaatgttggtcagatgtcatgtttgagcacttctttc

SEQ ID NO: 166088 - DNA, 39 bp, Artificial Sequence
  Description of Artificial Sequence: Synthetic oligonucleotide
caatgttggtcagatgtcatgtttgagcacttctttctg

SEQ ID NO: 166089 - DNA, 39 bp, Artificial Sequence
  Description of Artificial Sequence: Synthetic oligonucleotide
aatgttggtcagatgtcatgtttgagcacttctttctgc

SEQ ID NO: 166090 - DNA, 38 bp, Artificial Sequence
  Description of Artificial Sequence: Synthetic oligonucleotide
atgttggtcagatgtcatgtttgagcacttctttctgc

SEQ ID NO: 166091 - DNA, 37 bp, Artificial Sequence
  Description of Artificial Sequence: Synthetic oligonucleotide
tgttggtcagatgtcatgtttgagcacttctttctgc

SEQ ID NO: 166092 - DNA, 36 bp, Artificial Sequence
  Description of Artificial Sequence: Synthetic oligonucleotide
gttggtcagatgtcatgtttgagcacttctttctgc

SEQ ID NO: 166093 - DNA, 37 bp, Artificial Sequence
  Description of Artificial Sequence: Synthetic oligonucleotide
ttggtcagatgtcatgtttgagcacttctttctgcac

SEQ ID NO: 166094 - DNA, 36 bp, Artificial Sequence
  Description of Artificial Sequence: Synthetic oligonucleotide
tggtcagatgtcatgtttgagcacttctttctgcac

SEQ ID NO: 166095 - DNA, 35 bp, Artificial Sequence
  Description of Artificial Sequence: Synthetic oligonucleotide
ggtcagatgtcatgtttgagcacttctttctgcac

SEQ ID NO: 166096 - DNA, 36 bp, Artificial Sequence
  Description of Artificial Sequence: Synthetic oligonucleotide
gtcagatgtcatgtttgagcacttctttctgcacag

SEQ ID NO: 166097 - DNA, 37 bp, Artificial Sequence
  Description of Artificial Sequence: Synthetic oligonucleotide
tcagatgtcatgtttgagcacttctttctgcacagag

SEQ ID NO: 166098 - DNA, 36 bp, Artificial Sequence
  Description of Artificial Sequence: Synthetic oligonucleotide
cagatgtcatgtttgagcacttctttctgcacagag

SEQ ID NO: 166099 - DNA, 37 bp, Artificial Sequence
  Description of Artificial Sequence: Synthetic oligonucleotide
agatgtcatgtttgagcacttctttctgcacagagag

SEQ ID NO: 166100 - DNA, 36 bp, Artificial Sequence
  Description of Artificial Sequence: Synthetic oligonucleotide
gatgtcatgtttgagcacttctttctgcacagagag

SEQ ID NO: 166101 - DNA, 36 bp, Artificial Sequence
  Description of Artificial Sequence: Synthetic oligonucleotide
atgtcatgtttgagcacttctttctgcacagagagg

SEQ ID NO: 166102 - DNA, 35 bp, Artificial Sequence
  Description of Artificial Sequence: Synthetic oligonucleotide
tgtcatgtttgagcacttctttctgcacagagagg

SEQ ID NO: 166103 - DNA, 34 bp, Artificial Sequence
  Description of Artificial Sequence: Synthetic oligonucleotide
gtcatgtttgagcacttctttctgcacagagagg

SEQ ID NO: 166104 - DNA, 34 bp, Artificial Sequence
  Description of Artificial Sequence: Synthetic oligonucleotide
tcatgtttgagcacttctttctgcacagagaggg

SEQ ID NO: 166105 - DNA, 33 bp, Artificial Sequence
  Description of Artificial Sequence: Synthetic oligonucleotide
catgtttgagcacttctttctgcacagagaggg

SEQ ID NO: 166106 - DNA, 33 bp, Artificial Sequence
  Description of Artificial Sequence: Synthetic oligonucleotide
atgtttgagcacttctttctgcacagagagggg

SEQ ID NO: 166107 - DNA, 32 bp, Artificial Sequence
  Description of Artificial Sequence: Synthetic oligonucleotide
tgtttgagcacttctttctgcacagagagggg

SEQ ID NO: 166108 - DNA, 31 bp, Artificial Sequence
  Description of Artificial Sequence: Synthetic oligonucleotide
gtttgagcacttctttctgcacagagagggg

SEQ ID NO: 166109 - DNA, 33 bp, Artificial Sequence
  Description of Artificial Sequence: Synthetic oligonucleotide
tttgagcacttctttctgcacagagaggggatc

SEQ ID NO: 166110 - DNA, 32 bp, Artificial Sequence
  Description of Artificial Sequence: Synthetic oligonucleotide
ttgagcacttctttctgcacagagaggggatc

SEQ ID NO: 166111 - DNA, 31 bp, Artificial Sequence
  Description of Artificial Sequence: Synthetic oligonucleotide
tgagcacttctttctgcacagagaggggatc

SEQ ID NO: 166112 - DNA, 30 bp, Artificial Sequence
  Description of Artificial Sequence: Synthetic oligonucleotide
gagcacttctttctgcacagagaggggatc

SEQ ID NO: 166113 - DNA, 31 bp, Artificial Sequence
  Description of Artificial Sequence: Synthetic oligonucleotide
agcacttctttctgcacagagaggggatctc

SEQ ID NO: 166114 - DNA, 30 bp, Artificial Sequence
  Description of Artificial Sequence: Synthetic oligonucleotide
gcacttctttctgcacagagaggggatctc

SEQ ID NO: 166115 - DNA, 31 bp, Artificial Sequence
  Description of Artificial Sequence: Synthetic oligonucleotide
cacttctttctgcacagagaggggatctctg

SEQ ID NO: 166116 - DNA, 32 bp, Artificial Sequence
  Description of Artificial Sequence: Synthetic oligonucleotide
acttctttctgcacagagaggggatctctgag

SEQ ID NO: 166117 - DNA, 31 bp, Artificial Sequence
  Description of Artificial Sequence: Synthetic oligonucleotide
cttctttctgcacagagaggggatctctgag

SEQ ID NO: 166118 - DNA, 31 bp, Artificial Sequence
  Description of Artificial Sequence: Synthetic oligonucleotide
ttctttctgcacagagaggggatctctgagg

SEQ ID NO: 166119 - DNA, 30 bp, Artificial Sequence
  Description of Artificial Sequence: Synthetic oligonucleotide
tctttctgcacagagaggggatctctgagg

SEQ ID NO: 166120 - DNA, 29 bp, Artificial Sequence
  Description of Artificial Sequence: Synthetic oligonucleotide
ctttctgcacagagaggggatctctgagg

SEQ ID NO: 166121 - DNA, 30 bp, Artificial Sequence
  Description of Artificial Sequence: Synthetic oligonucleotide
tttctgcacagagaggggatctctgaggac

SEQ ID NO: 166122 - DNA, 29 bp, Artificial Sequence
  Description of Artificial Sequence: Synthetic oligonucleotide
ttctgcacagagaggggatctctgaggac

SEQ ID NO: 166123 - DNA, 28 bp, Artificial Sequence
  Description of Artificial Sequence: Synthetic oligonucleotide
tctgcacagagaggggatctctgaggac

SEQ ID NO: 166124 - DNA, 27 bp, Artificial Sequence
  Description of Artificial Sequence: Synthetic oligonucleotide
ctgcacagagaggggatctctgaggac

SEQ ID NO: 166125 - DNA, 27 bp, Artificial Sequence
  Description of Artificial Sequence: Synthetic oligonucleotide
tgcacagagaggggatctctgaggacc

SEQ ID NO: 166126 - DNA, 26 bp, Artificial Sequence
  Description of Artificial Sequence: Synthetic oligonucleotide
gcacagagaggggatctctgaggacc

SEQ ID NO: 166127 - DNA, 26 bp, Artificial Sequence
  Description of Artificial Sequence: Synthetic oligonucleotide
cacagagaggggatctctgaggaccc

SEQ ID NO: 166128 - DNA, 27 bp, Artificial Sequence
  Description of Artificial Sequence: Synthetic oligonucleotide
acagagaggggatctctgaggacccct

SEQ ID NO: 166129 - DNA, 26 bp, Artificial Sequence
  Description of Artificial Sequence: Synthetic oligonucleotide
cagagaggggatctctgaggacccct

SEQ ID NO: 166130 - DNA, 27 bp, Artificial Sequence
  Description of Artificial Sequence: Synthetic oligonucleotide
agagaggggatctctgaggacccctca

SEQ ID NO: 166131 - DNA, 26 bp, Artificial Sequence
  Description of Artificial Sequence: Synthetic oligonucleotide
gagaggggatctctgaggacccctca

SEQ ID NO: 166132 - DNA, 29 bp, Artificial Sequence
  Description of Artificial Sequence: Synthetic oligonucleotide
agatccatgatggggtctccaaggccaac

SEQ ID NO: 166133 - DNA, 28 bp, Artificial Sequence
  Description of Artificial Sequence: Synthetic oligonucleotide
gatccatgatggggtctccaaggccaac

SEQ ID NO: 166134 - DNA, 30 bp, Artificial Sequence
  Description of Artificial Sequence: Synthetic oligonucleotide
atccatgatggggtctccaaggccaacttc

SEQ ID NO: 166135 - DNA, 29 bp, Artificial Sequence
  Description of Artificial Sequence: Synthetic oligonucleotide
tccatgatggggtctccaaggccaacttc

SEQ ID NO: 166136 - DNA, 27 bp, Artificial Sequence
  Description of Artificial Sequence: Synthetic oligonucleotide
ccaaggccaacttctccatcggtccct

SEQ ID NO: 166137 - DNA, 28 bp, Artificial Sequence
  Description of Artificial Sequence: Synthetic oligonucleotide
caaggccaacttctccatcggtcccttg

SEQ ID NO: 166138 - DNA, 30 bp, Artificial Sequence
  Description of Artificial Sequence: Synthetic oligonucleotide
aaggccaacttctccatcggtcccttgatg

SEQ ID NO: 166139 - DNA, 29 bp, Artificial Sequence
  Description of Artificial Sequence: Synthetic oligonucleotide
aggccaacttctccatcggtcccttgatg

SEQ ID NO: 166140 - DNA, 28 bp, Artificial Sequence
  Description of Artificial Sequence: Synthetic oligonucleotide
ggccaacttctccatcggtcccttgatg

SEQ ID NO: 166141 - DNA, 28 bp, Artificial Sequence
  Description of Artificial Sequence: Synthetic oligonucleotide
gccaacttctccatcggtcccttgatgc

SEQ ID NO: 166142 - DNA, 28 bp, Artificial Sequence
  Description of Artificial Sequence: Synthetic oligonucleotide
ccaacttctccatcggtcccttgatgcc

SEQ ID NO: 166143 - DNA, 29 bp, Artificial Sequence
  Description of Artificial Sequence: Synthetic oligonucleotide
caacttctccatcggtcccttgatgcctg

SEQ ID NO: 166144 - DNA, 30 bp, Artificial Sequence
  Description of Artificial Sequence: Synthetic oligonucleotide
aacttctccatcggtcccttgatgcctgtc

SEQ ID NO: 166145 - DNA, 29 bp, Artificial Sequence
  Description of Artificial Sequence: Synthetic oligonucleotide
acttctccatcggtcccttgatgcctgtc

SEQ ID NO: 166146 - DNA, 28 bp, Artificial Sequence
  Description of Artificial Sequence: Synthetic oligonucleotide
cttctccatcggtcccttgatgcctgtc

SEQ ID NO: 166147 - DNA, 28 bp, Artificial Sequence
  Description of Artificial Sequence: Synthetic oligonucleotide
ttctccatcggtcccttgatgcctgtcc

SEQ ID NO: 166148 - DNA, 27 bp, Artificial Sequence
  Description of Artificial Sequence: Synthetic oligonucleotide
tctccatcggtcccttgatgcctgtcc

SEQ ID NO: 166149 - DNA, 27 bp, Artificial Sequence
  Description of Artificial Sequence: Synthetic oligonucleotide
ctccatcggtcccttgatgcctgtcct

SEQ ID NO: 166150 - DNA, 28 bp, Artificial Sequence
  Description of Artificial Sequence: Synthetic oligonucleotide
tccatcggtcccttgatgcctgtccttg

SEQ ID NO: 166151 - DNA, 27 bp, Artificial Sequence
  Description of Artificial Sequence: Synthetic oligonucleotide
ccatcggtcccttgatgcctgtccttg

SEQ ID NO: 166152 - DNA, 27 bp, Artificial Sequence
  Description of Artificial Sequence: Synthetic oligonucleotide
catcggtcccttgatgcctgtccttgc

SEQ ID NO: 166153 - DNA, 28 bp, Artificial Sequence
  Description of Artificial Sequence: Synthetic oligonucleotide
atcggtcccttgatgcctgtccttgcag

SEQ ID NO: 166154 - DNA, 27 bp, Artificial Sequence
  Description of Artificial Sequence: Synthetic oligonucleotide
tcggtcccttgatgcctgtccttgcag

SEQ ID NO: 166155 - DNA, 26 bp, Artificial Sequence
  Description of Artificial Sequence: Synthetic oligonucleotide
cggtcccttgatgcctgtccttgcag

SEQ ID NO: 166156 - DNA, 27 bp, Artificial Sequence
  Description of Artificial Sequence: Synthetic oligonucleotide
ggtcccttgatgcctgtccttgcagga

SEQ ID NO: 166157 - DNA, 28 bp, Artificial Sequence
  Description of Artificial Sequence: Synthetic oligonucleotide
gtcccttgatgcctgtccttgcaggaac

SEQ ID NO: 166158 - DNA, 28 bp, Artificial Sequence
  Description of Artificial Sequence: Synthetic oligonucleotide
tcccttgatgcctgtccttgcaggaacc

SEQ ID NO: 166159 - DNA, 27 bp, Artificial Sequence
  Description of Artificial Sequence: Synthetic oligonucleotide
cccttgatgcctgtccttgcaggaacc

SEQ ID NO: 166160 - DNA, 29 bp, Artificial Sequence
  Description of Artificial Sequence: Synthetic oligonucleotide
ccttgatgcctgtccttgcaggaacctac

SEQ ID NO: 166161 - DNA, 30 bp, Artificial Sequence
  Description of Artificial Sequence: Synthetic oligonucleotide
cttgatgcctgtccttgcaggaacctacag

SEQ ID NO: 166162 - DNA, 32 bp, Artificial Sequence
  Description of Artificial Sequence: Synthetic oligonucleotide
ttgatgcctgtccttgcaggaacctacagatg

SEQ ID NO: 166163 - DNA, 34 bp, Artificial Sequence
  Description of Artificial Sequence: Synthetic oligonucleotide
atgcctgtccttgcaggaacctacagatgttatg

SEQ ID NO: 166164 - DNA, 33 bp, Artificial Sequence
  Description of Artificial Sequence: Synthetic oligonucleotide
tgcctgtccttgcaggaacctacagatgttatg

SEQ ID NO: 166165 - DNA, 32 bp, Artificial Sequence
  Description of Artificial Sequence: Synthetic oligonucleotide
gcctgtccttgcaggaacctacagatgttatg

SEQ ID NO: 166166 - DNA, 32 bp, Artificial Sequence
  Description of Artificial Sequence: Synthetic oligonucleotide
cctgtccttgcaggaacctacagatgttatgg

SEQ ID NO: 166167 - DNA, 34 bp, Artificial Sequence
  Description of Artificial Sequence: Synthetic oligonucleotide
ctgtccttgcaggaacctacagatgttatggttc

SEQ ID NO: 166168 - DNA, 35 bp, Artificial Sequence
  Description of Artificial Sequence: Synthetic oligonucleotide
tgtccttgcaggaacctacagatgttatggttctg

SEQ ID NO: 166169 - DNA, 34 bp, Artificial Sequence
  Description of Artificial Sequence: Synthetic oligonucleotide
gtccttgcaggaacctacagatgttatggttctg

SEQ ID NO: 166170 - DNA, 36 bp, Artificial Sequence
  Description of Artificial Sequence: Synthetic oligonucleotide
tccttgcaggaacctacagatgttatggttctgttc

SEQ ID NO: 166171 - DNA, 35 bp, Artificial Sequence
  Description of Artificial Sequence: Synthetic oligonucleotide
ccttgcaggaacctacagatgttatggttctgttc

SEQ ID NO: 166172 - DNA, 35 bp, Artificial Sequence
  Description of Artificial Sequence: Synthetic oligonucleotide
cttgcaggaacctacagatgttatggttctgttcc

SEQ ID NO: 166173 - DNA, 36 bp, Artificial Sequence
  Description of Artificial Sequence: Synthetic oligonucleotide
ttgcaggaacctacagatgttatggttctgttcctc

SEQ ID NO: 166174 - DNA, 35 bp, Artificial Sequence
  Description of Artificial Sequence: Synthetic oligonucleotide
tgcaggaacctacagatgttatggttctgttcctc

SEQ ID NO: 166175 - DNA, 34 bp, Artificial Sequence
  Description of Artificial Sequence: Synthetic oligonucleotide
gcaggaacctacagatgttatggttctgttcctc

SEQ ID NO: 166176 - DNA, 35 bp, Artificial Sequence
  Description of Artificial Sequence: Synthetic oligonucleotide
caggaacctacagatgttatggttctgttcctcac

SEQ ID NO: 166177 - DNA, 36 bp, Artificial Sequence
  Description of Artificial Sequence: Synthetic oligonucleotide
aggaacctacagatgttatggttctgttcctcactc

SEQ ID NO: 166178 - DNA, 35 bp, Artificial Sequence
  Description of Artificial Sequence: Synthetic oligonucleotide
ggaacctacagatgttatggttctgttcctcactc

SEQ ID NO: 166179 - DNA, 35 bp, Artificial Sequence
  Description of Artificial Sequence: Synthetic oligonucleotide
gaacctacagatgttatggttctgttcctcactcc

SEQ ID NO: 166180 - DNA, 35 bp, Artificial Sequence
  Description of Artificial Sequence: Synthetic oligonucleotide
aacctacagatgttatggttctgttcctcactccc

SEQ ID NO: 166181 - DNA, 34 bp, Artificial Sequence
  Description of Artificial Sequence: Synthetic oligonucleotide
acctacagatgttatggttctgttcctcactccc

SEQ ID NO: 166182 - DNA, 33 bp, Artificial Sequence
  Description of Artificial Sequence: Synthetic oligonucleotide
cctacagatgttatggttctgttcctcactccc

SEQ ID NO: 166183 - DNA, 33 bp, Artificial Sequence
  Description of Artificial Sequence: Synthetic oligonucleotide
ctacagatgttatggttctgttcctcactcccc

SEQ ID NO: 166184 - DNA, 33 bp, Artificial Sequence
  Description of Artificial Sequence: Synthetic oligonucleotide
tacagatgttatggttctgttcctcactccccc

SEQ ID NO: 166185 - DNA, 32 bp, Artificial Sequence
  Description of Artificial Sequence: Synthetic oligonucleotide
acagatgttatggttctgttcctcactccccc

SEQ ID NO: 166186 - DNA, 31 bp, Artificial Sequence
  Description of Artificial Sequence: Synthetic oligonucleotide
cagatgttatggttctgttcctcactccccc

SEQ ID NO: 166187 - DNA, 34 bp, Artificial Sequence
  Description of Artificial Sequence: Synthetic oligonucleotide
agatgttatggttctgttcctcactccccctatc

SEQ ID NO: 166188 - DNA, 33 bp, Artificial Sequence
  Description of Artificial Sequence: Synthetic oligonucleotide
gatgttatggttctgttcctcactccccctatc

SEQ ID NO: 166189 - DNA, 34 bp, Artificial Sequence
  Description of Artificial Sequence: Synthetic oligonucleotide
atgttatggttctgttcctcactccccctatcag

SEQ ID NO: 166190 - DNA, 33 bp, Artificial Sequence
  Description of Artificial Sequence: Synthetic oligonucleotide
tgttatggttctgttcctcactccccctatcag

SEQ ID NO: 166191 - DNA, 32 bp, Artificial Sequence
  Description of Artificial Sequence: Synthetic oligonucleotide
gttatggttctgttcctcactccccctatcag

SEQ ID NO: 166192 - DNA, 34 bp, Artificial Sequence
  Description of Artificial Sequence: Synthetic oligonucleotide
ttatggttctgttcctcactccccctatcagttg

SEQ ID NO: 166193 - DNA, 33 bp, Artificial Sequence
  Description of Artificial Sequence: Synthetic oligonucleotide
tatggttctgttcctcactccccctatcagttg

SEQ ID NO: 166194 - DNA, 32 bp, Artificial Sequence
  Description of Artificial Sequence: Synthetic oligonucleotide
atggttctgttcctcactccccctatcagttg

SEQ ID NO: 166195 - DNA, 31 bp, Artificial Sequence
  Description of Artificial Sequence: Synthetic oligonucleotide
tggttctgttcctcactccccctatcagttg

SEQ ID NO: 166196 - DNA, 28 bp, Artificial Sequence
  Description of Artificial Sequence: Synthetic oligonucleotide
ctatcagttgtcagctcccagtgacccc

SEQ ID NO: 166197 - DNA, 28 bp, Artificial Sequence
  Description of Artificial Sequence: Synthetic oligonucleotide
tatcagttgtcagctcccagtgaccccc

SEQ ID NO: 166198 - DNA, 27 bp, Artificial Sequence
  Description of Artificial Sequence: Synthetic oligonucleotide
atcagttgtcagctcccagtgaccccc

SEQ ID NO: 166199 - DNA, 27 bp, Artificial Sequence
  Description of Artificial Sequence: Synthetic oligonucleotide
tcagttgtcagctcccagtgaccccct

SEQ ID NO: 166200 - DNA, 26 bp, Artificial Sequence
  Description of Artificial Sequence: Synthetic oligonucleotide
cagttgtcagctcccagtgaccccct

SEQ ID NO: 166201 - DNA, 26 bp, Artificial Sequence
  Description of Artificial Sequence: Synthetic oligonucleotide
agttgtcagctcccagtgaccccctg

SEQ ID NO: 166202 - DNA, 25 bp, Artificial Sequence
  Description of Artificial Sequence: Synthetic oligonucleotide
gttgtcagctcccagtgaccccctg

SEQ ID NO: 166203 - DNA, 26 bp, Artificial Sequence
  Description of Artificial Sequence: Synthetic oligonucleotide
ttgtcagctcccagtgaccccctgga

SEQ ID NO: 166204 - DNA, 25 bp, Artificial Sequence
  Description of Artificial Sequence: Synthetic oligonucleotide
tgtcagctcccagtgaccccctgga

SEQ ID NO: 166205 - DNA, 24 bp, Artificial Sequence
  Description of Artificial Sequence: Synthetic oligonucleotide
gtcagctcccagtgaccccctgga

SEQ ID NO: 166206 - DNA, 26 bp, Artificial Sequence
  Description of Artificial Sequence: Synthetic oligonucleotide
tcagctcccagtgaccccctggacat

SEQ ID NO: 166207 - DNA, 25 bp, Artificial Sequence
  Description of Artificial Sequence: Synthetic oligonucleotide
cagctcccagtgaccccctggacat

SEQ ID NO: 166208 - DNA, 25 bp, Artificial Sequence
  Description of Artificial Sequence: Synthetic oligonucleotide
agctcccagtgaccccctggacatc

SEQ ID NO: 166209 - DNA, 24 bp, Artificial Sequence
  Description of Artificial Sequence: Synthetic oligonucleotide
gctcccagtgaccccctggacatc

SEQ ID NO: 166210 - DNA, 25 bp, Artificial Sequence
  Description of Artificial Sequence: Synthetic oligonucleotide
ctcccagtgaccccctggacatcgt

SEQ ID NO: 166211 - DNA, 27 bp, Artificial Sequence
  Description of Artificial Sequence: Synthetic oligonucleotide
tcccagtgaccccctggacatcgtgat

SEQ ID NO: 166212 - DNA, 26 bp, Artificial Sequence
  Description of Artificial Sequence: Synthetic oligonucleotide
cccagtgaccccctggacatcgtgat

SEQ ID NO: 166213 - DNA, 27 bp, Artificial Sequence
  Description of Artificial Sequence: Synthetic oligonucleotide
ccagtgaccccctggacatcgtgatca

SEQ ID NO: 166214 - DNA, 27 bp, Artificial Sequence
  Description of Artificial Sequence: Synthetic oligonucleotide
cagtgaccccctggacatcgtgatcac

SEQ ID NO: 166215 - DNA, 28 bp, Artificial Sequence
  Description of Artificial Sequence: Synthetic oligonucleotide
agtgaccccctggacatcgtgatcacag

SEQ ID NO: 166216 - DNA, 27 bp, Artificial Sequence
  Description of Artificial Sequence: Synthetic oligonucleotide
gtgaccccctggacatcgtgatcacag

SEQ ID NO: 166217 - DNA, 27 bp, Artificial Sequence
  Description of Artificial Sequence: Synthetic oligonucleotide
tgaccccctggacatcgtgatcacagg

SEQ ID NO: 166218 - DNA, 27 bp, Artificial Sequence
  Description of Artificial Sequence: Synthetic oligonucleotide
gaccccctggacatcgtgatcacaggt

SEQ ID NO: 166219 - DNA, 27 bp, Artificial Sequence
  Description of Artificial Sequence: Synthetic oligonucleotide
accccctggacatcgtgatcacaggtc

SEQ ID NO: 166220 - DNA, 27 bp, Artificial Sequence
  Description of Artificial Sequence: Synthetic oligonucleotide
ccccctggacatcgtgatcacaggtct

SEQ ID NO: 166221 - DNA, 31 bp, Artificial Sequence
  Description of Artificial Sequence: Synthetic oligonucleotide
cccctggacatcgtgatcacaggtctatatg

SEQ ID NO: 166222 - DNA, 32 bp, Artificial Sequence
  Description of Artificial Sequence: Synthetic oligonucleotide
ccctggacatcgtgatcacaggtctatatgag

SEQ ID NO: 166223 - DNA, 35 bp, Artificial Sequence
  Description of Artificial Sequence: Synthetic oligonucleotide
cctggacatcgtgatcacaggtctatatgagaaac

SEQ ID NO: 166224 - DNA, 25 bp, Artificial Sequence
  Description of Artificial Sequence: Synthetic oligonucleotide
gccccacggttcaggcaggagagaa

SEQ ID NO: 166225 - DNA, 25 bp, Artificial Sequence
  Description of Artificial Sequence: Synthetic oligonucleotide
ccccacggttcaggcaggagagaac

SEQ ID NO: 166226 - DNA, 26 bp, Artificial Sequence
  Description of Artificial Sequence: Synthetic oligonucleotide
cccacggttcaggcaggagagaacgt

SEQ ID NO: 166227 - DNA, 27 bp, Artificial Sequence
  Description of Artificial Sequence: Synthetic oligonucleotide
ccacggttcaggcaggagagaacgtga

SEQ ID NO: 166228 - DNA, 27 bp, Artificial Sequence
  Description of Artificial Sequence: Synthetic oligonucleotide
cacggttcaggcaggagagaacgtgac

SEQ ID NO: 166229 - DNA, 27 bp, Artificial Sequence
  Description of Artificial Sequence: Synthetic oligonucleotide
acggttcaggcaggagagaacgtgacc

SEQ ID NO: 166230 - DNA, 27 bp, Artificial Sequence
  Description of Artificial Sequence: Synthetic oligonucleotide
cggttcaggcaggagagaacgtgacct

SEQ ID NO: 166231 - DNA, 28 bp, Artificial Sequence
  Description of Artificial Sequence: Synthetic oligonucleotide
ggttcaggcaggagagaacgtgaccttg

SEQ ID NO: 166232 - DNA, 29 bp, Artificial Sequence
  Description of Artificial Sequence: Synthetic oligonucleotide
gttcaggcaggagagaacgtgaccttgtc

SEQ ID NO: 166233 - DNA, 29 bp, Artificial Sequence
  Description of Artificial Sequence: Synthetic oligonucleotide
ttcaggcaggagagaacgtgaccttgtcc

SEQ ID NO: 166234 - DNA, 28 bp, Artificial Sequence
  Description of Artificial Sequence: Synthetic oligonucleotide
tcaggcaggagagaacgtgaccttgtcc

SEQ ID NO: 166235 - DNA, 27 bp, Artificial Sequence
  Description of Artificial Sequence: Synthetic oligonucleotide
caggcaggagagaacgtgaccttgtcc

SEQ ID NO: 166236 - DNA, 28 bp, Artificial Sequence
  Description of Artificial Sequence: Synthetic oligonucleotide
aggcaggagagaacgtgaccttgtcctg

SEQ ID NO: 166237 - DNA, 27 bp, Artificial Sequence
  Description of Artificial Sequence: Synthetic oligonucleotide
ggcaggagagaacgtgaccttgtcctg

SEQ ID NO: 166238 - DNA, 29 bp, Artificial Sequence
  Description of Artificial Sequence: Synthetic oligonucleotide
gcaggagagaacgtgaccttgtcctgtag

SEQ ID NO: 166239 - DNA, 29 bp, Artificial Sequence
  Description of Artificial Sequence: Synthetic oligonucleotide
caggagagaacgtgaccttgtcctgtagc

SEQ ID NO: 166240 - DNA, 30 bp, Artificial Sequence
  Description of Artificial Sequence: Synthetic oligonucleotide
aggagagaacgtgaccttgtcctgtagctc

SEQ ID NO: 166241 - DNA, 29 bp, Artificial Sequence
  Description of Artificial Sequence: Synthetic oligonucleotide
ggagagaacgtgaccttgtcctgtagctc

SEQ ID NO: 166242 - DNA, 29 bp, Artificial Sequence
  Description of Artificial Sequence: Synthetic oligonucleotide
gagagaacgtgaccttgtcctgtagctcc

SEQ ID NO: 166243 - DNA, 30 bp, Artificial Sequence
  Description of Artificial Sequence: Synthetic oligonucleotide
agagaacgtgaccttgtcctgtagctcctg

SEQ ID NO: 166244 - DNA, 29 bp, Artificial Sequence
  Description of Artificial Sequence: Synthetic oligonucleotide
gagaacgtgaccttgtcctgtagctcctg

SEQ ID NO: 166245 - DNA, 29 bp, Artificial Sequence
  Description of Artificial Sequence: Synthetic oligonucleotide
agaacgtgaccttgtcctgtagctcctgg

SEQ ID NO: 166246 - DNA, 28 bp, Artificial Sequence
  Description of Artificial Sequence: Synthetic oligonucleotide
gaacgtgaccttgtcctgtagctcctgg

SEQ ID NO: 166247 - DNA, 29 bp, Artificial Sequence
  Description of Artificial Sequence: Synthetic oligonucleotide
aacgtgaccttgtcctgtagctcctggag

SEQ ID NO: 166248 - DNA, 28 bp, Artificial Sequence
  Description of Artificial Sequence: Synthetic oligonucleotide
acgtgaccttgtcctgtagctcctggag

SEQ ID NO: 166249 - DNA, 27 bp, Artificial Sequence
  Description of Artificial Sequence: Synthetic oligonucleotide
cgtgaccttgtcctgtagctcctggag

SEQ ID NO: 166250 - DNA, 27 bp, Artificial Sequence
  Description of Artificial Sequence: Synthetic oligonucleotide
gtgaccttgtcctgtagctcctggagc

SEQ ID NO: 166251 - DNA, 28 bp, Artificial Sequence
  Description of Artificial Sequence: Synthetic oligonucleotide
tgaccttgtcctgtagctcctggagctc

SEQ ID NO: 166252 - DNA, 27 bp, Artificial Sequence
  Description of Artificial Sequence: Synthetic oligonucleotide
gaccttgtcctgtagctcctggagctc

SEQ ID NO: 166253 - DNA, 27 bp, Artificial Sequence
  Description of Artificial Sequence: Synthetic oligonucleotide
accttgtcctgtagctcctggagctcc

SEQ ID NO: 166254 - DNA, 27 bp, Artificial Sequence
  Description of Artificial Sequence: Synthetic oligonucleotide
ccttgtcctgtagctcctggagctcct

SEQ ID NO: 166255 - DNA, 29 bp, Artificial Sequence
  Description of Artificial Sequence: Synthetic oligonucleotide
cttgtcctgtagctcctggagctcctatg

SEQ ID NO: 166256 - DNA, 30 bp, Artificial Sequence
  Description of Artificial Sequence: Synthetic oligonucleotide
ttgtcctgtagctcctggagctcctatgac

SEQ ID NO: 166257 - DNA, 29 bp, Artificial Sequence
  Description of Artificial Sequence: Synthetic oligonucleotide
tgtcctgtagctcctggagctcctatgac

SEQ ID NO: 166258 - DNA, 28 bp, Artificial Sequence
  Description of Artificial Sequence: Synthetic oligonucleotide
gtcctgtagctcctggagctcctatgac

SEQ ID NO: 166259 - DNA, 30 bp, Artificial Sequence
  Description of Artificial Sequence: Synthetic oligonucleotide
tcctgtagctcctggagctcctatgacatc

SEQ ID NO: 166260 - DNA, 29 bp, Artificial Sequence
  Description of Artificial Sequence: Synthetic oligonucleotide
cctgtagctcctggagctcctatgacatc

SEQ ID NO: 166261 - DNA, 31 bp, Artificial Sequence
  Description of Artificial Sequence: Synthetic oligonucleotide
ctgtagctcctggagctcctatgacatctac

SEQ ID NO: 166262 - DNA, 31 bp, Artificial Sequence
  Description of Artificial Sequence: Synthetic oligonucleotide
tgtagctcctggagctcctatgacatctacc

SEQ ID NO: 166263 - DNA, 30 bp, Artificial Sequence
  Description of Artificial Sequence: Synthetic oligonucleotide
gtagctcctggagctcctatgacatctacc

SEQ ID NO: 166264 - DNA, 32 bp, Artificial Sequence
  Description of Artificial Sequence: Synthetic oligonucleotide
tagctcctggagctcctatgacatctaccatc

SEQ ID NO: 166265 - DNA, 31 bp, Artificial Sequence
  Description of Artificial Sequence: Synthetic oligonucleotide
agctcctggagctcctatgacatctaccatc

SEQ ID NO: 166266 - DNA, 30 bp, Artificial Sequence
  Description of Artificial Sequence: Synthetic oligonucleotide
gctcctggagctcctatgacatctaccatc

SEQ ID NO: 166267 - DNA, 31 bp, Artificial Sequence
  Description of Artificial Sequence: Synthetic oligonucleotide
ctcctggagctcctatgacatctaccatctg

SEQ ID NO: 166268 - DNA, 32 bp, Artificial Sequence
  Description of Artificial Sequence: Synthetic oligonucleotide
tcctggagctcctatgacatctaccatctgtc

SEQ ID NO: 166269 - DNA, 31 bp, Artificial Sequence
  Description of Artificial Sequence: Synthetic oligonucleotide
cctggagctcctatgacatctaccatctgtc

SEQ ID NO: 166270 - DNA, 31 bp, Artificial Sequence
  Description of Artificial Sequence: Synthetic oligonucleotide
ctggagctcctatgacatctaccatctgtcc

SEQ ID NO: 166271 - DNA, 32 bp, Artificial Sequence
  Description of Artificial Sequence: Synthetic oligonucleotide
tggagctcctatgacatctaccatctgtccag

SEQ ID NO: 166272 - DNA, 31 bp, Artificial Sequence
  Description of Artificial Sequence: Synthetic oligonucleotide
ggagctcctatgacatctaccatctgtccag

SEQ ID NO: 166273 - DNA, 31 bp, Artificial Sequence
  Description of Artificial Sequence: Synthetic oligonucleotide
gagctcctatgacatctaccatctgtccagg

SEQ ID NO: 166274 - DNA, 31 bp, Artificial Sequence
  Description of Artificial Sequence: Synthetic oligonucleotide
agctcctatgacatctaccatctgtccaggg

SEQ ID NO: 166275 - DNA, 30 bp, Artificial Sequence
  Description of Artificial Sequence: Synthetic oligonucleotide
gctcctatgacatctaccatctgtccaggg

SEQ ID NO: 166276 - DNA, 32 bp, Artificial Sequence
  Description of Artificial Sequence: Synthetic oligonucleotide
ctcctatgacatctaccatctgtccagggaag

SEQ ID NO: 166277 - DNA, 32 bp, Artificial Sequence
  Description of Artificial Sequence: Synthetic oligonucleotide
tcctatgacatctaccatctgtccagggaagg

SEQ ID NO: 166278 - DNA, 31 bp, Artificial Sequence
  Description of Artificial Sequence: Synthetic oligonucleotide
cctatgacatctaccatctgtccagggaagg

SEQ ID NO: 166279 - DNA, 31 bp, Artificial Sequence
  Description of Artificial Sequence: Synthetic oligonucleotide
ctatgacatctaccatctgtccagggaaggg

SEQ ID NO: 166280 - DNA, 31 bp, Artificial Sequence
  Description of Artificial Sequence: Synthetic oligonucleotide
tatgacatctaccatctgtccagggaagggg

SEQ ID NO: 166281 - DNA, 30 bp, Artificial Sequence
  Description of Artificial Sequence: Synthetic oligonucleotide
atgacatctaccatctgtccagggaagggg

SEQ ID NO: 166282 - DNA, 29 bp, Artificial Sequence
  Description of Artificial Sequence: Synthetic oligonucleotide
tgacatctaccatctgtccagggaagggg

SEQ ID NO: 166283 - DNA, 28 bp, Artificial Sequence
  Description of Artificial Sequence: Synthetic oligonucleotide
gacatctaccatctgtccagggaagggg

SEQ ID NO: 166284 - DNA, 29 bp, Artificial Sequence
  Description of Artificial Sequence: Synthetic oligonucleotide
acatctaccatctgtccagggaaggggag

SEQ ID NO: 166285 - DNA, 28 bp, Artificial Sequence
  Description of Artificial Sequence: Synthetic oligonucleotide
catctaccatctgtccagggaaggggag

SEQ ID NO: 166286 - DNA, 28 bp, Artificial Sequence
  Description of Artificial Sequence: Synthetic oligonucleotide
atctaccatctgtccagggaaggggagg

SEQ ID NO: 166287 - DNA, 27 bp, Artificial Sequence
  Description of Artificial Sequence: Synthetic oligonucleotide
tctaccatctgtccagggaaggggagg

SEQ ID NO: 166288 - DNA, 26 bp, Artificial Sequence
  Description of Artificial Sequence: Synthetic oligonucleotide
ctaccatctgtccagggaaggggagg

SEQ ID NO: 166289 - DNA, 26 bp, Artificial Sequence
  Description of Artificial Sequence: Synthetic oligonucleotide
taccatctgtccagggaaggggaggc

SEQ ID NO: 166290 - DNA, 25 bp, Artificial Sequence
  Description of Artificial Sequence: Synthetic oligonucleotide
accatctgtccagggaaggggaggc

SEQ ID NO: 166291 - DNA, 24 bp, Artificial Sequence
  Description of Artificial Sequence: Synthetic oligonucleotide
ccatctgtccagggaaggggaggc

SEQ ID NO: 166292 - DNA, 24 bp, Artificial Sequence
  Description of Artificial Sequence: Synthetic oligonucleotide
catctgtccagggaaggggaggcc

SEQ ID NO: 166293 - DNA, 26 bp, Artificial Sequence
  Description of Artificial Sequence: Synthetic oligonucleotide
atctgtccagggaaggggaggcccat

SEQ ID NO: 166294 - DNA, 25 bp, Artificial Sequence
  Description of Artificial Sequence: Synthetic oligonucleotide
tctgtccagggaaggggaggcccat

SEQ ID NO: 166295 - DNA, 24 bp, Artificial Sequence
  Description of Artificial Sequence: Synthetic oligonucleotide
ctgtccagggaaggggaggcccat

SEQ ID NO: 166296 - DNA, 26 bp, Artificial Sequence
  Description of Artificial Sequence: Synthetic oligonucleotide
tgtccagggaaggggaggcccatgaa

SEQ ID NO: 166297 - DNA, 25 bp, Artificial Sequence
  Description of Artificial Sequence: Synthetic oligonucleotide
gtccagggaaggggaggcccatgaa

SEQ ID NO: 166298 - DNA, 25 bp, Artificial Sequence
  Description of Artificial Sequence: Synthetic oligonucleotide
ggaggcccatgaacgtaggctccgt

SEQ ID NO: 166299 - DNA, 25 bp, Artificial Sequence
  Description of Artificial Sequence: Synthetic oligonucleotide
gaggcccatgaacgtaggctccgtg

SEQ ID NO: 166300 - DNA, 26 bp, Artificial Sequence
  Description of Artificial Sequence: Synthetic oligonucleotide
aggcccatgaacgtaggctccgtgca

SEQ ID NO: 166301 - DNA, 25 bp, Artificial Sequence
  Description of Artificial Sequence: Synthetic oligonucleotide
ggcccatgaacgtaggctccgtgca

SEQ ID NO: 166302 - DNA, 26 bp, Artificial Sequence
  Description of Artificial Sequence: Synthetic oligonucleotide
gcccatgaacgtaggctccgtgcagt

SEQ ID NO: 166303 - DNA, 26 bp, Artificial Sequence
  Description of Artificial Sequence: Synthetic oligonucleotide
cccatgaacgtaggctccgtgcagtg

SEQ ID NO: 166304 - DNA, 26 bp, Artificial Sequence
  Description of Artificial Sequence: Synthetic oligonucleotide
ccatgaacgtaggctccgtgcagtgc

SEQ ID NO: 166305 - DNA, 26 bp, Artificial Sequence
  Description of Artificial Sequence: Synthetic oligonucleotide
catgaacgtaggctccgtgcagtgcc

SEQ ID NO: 166306 - DNA, 27 bp, Artificial Sequence
  Description of Artificial Sequence: Synthetic oligonucleotide
atgaacgtaggctccgtgcagtgccca

SEQ ID NO: 166307 - DNA, 27 bp, Artificial Sequence
  Description of Artificial Sequence: Synthetic oligonucleotide
tgaacgtaggctccgtgcagtgcccaa

SEQ ID NO: 166308 - DNA, 26 bp, Artificial Sequence
  Description of Artificial Sequence: Synthetic oligonucleotide
gaacgtaggctccgtgcagtgcccaa

SEQ ID NO: 166309 - DNA, 26 bp, Artificial Sequence
  Description of Artificial Sequence: Synthetic oligonucleotide
aacgtaggctccgtgcagtgcccaag

SEQ ID NO: 166310 - DNA, 25 bp, Artificial Sequence
  Description of Artificial Sequence: Synthetic oligonucleotide
acgtaggctccgtgcagtgcccaag

SEQ ID NO: 166311 - DNA, 24 bp, Artificial Sequence
  Description of Artificial Sequence: Synthetic oligonucleotide
cgtaggctccgtgcagtgcccaag

SEQ ID NO: 166312 - DNA, 25 bp, Artificial Sequence
  Description of Artificial Sequence: Synthetic oligonucleotide
gtaggctccgtgcagtgcccaaggt

SEQ ID NO: 166313 - DNA, 27 bp, Artificial Sequence
  Description of Artificial Sequence: Synthetic oligonucleotide
taggctccgtgcagtgcccaaggtcaa

SEQ ID NO: 166314 - DNA, 26 bp, Artificial Sequence
  Description of Artificial Sequence: Synthetic oligonucleotide
aggctccgtgcagtgcccaaggtcaa

SEQ ID NO: 166315 - DNA, 25 bp, Artificial Sequence
  Description of Artificial Sequence: Synthetic oligonucleotide
ggctccgtgcagtgcccaaggtcaa

SEQ ID NO: 166316 - DNA, 26 bp, Artificial Sequence
  Description of Artificial Sequence: Synthetic oligonucleotide
gctccgtgcagtgcccaaggtcaaca

SEQ ID NO: 166317 - DNA, 27 bp, Artificial Sequence
  Description of Artificial Sequence: Synthetic oligonucleotide
ctccgtgcagtgcccaaggtcaacaga

SEQ ID NO: 166318 - DNA, 28 bp, Artificial Sequence
  Description of Artificial Sequence: Synthetic oligonucleotide
tccgtgcagtgcccaaggtcaacagaac

SEQ ID NO: 166319 - DNA, 27 bp, Artificial Sequence
  Description of Artificial Sequence: Synthetic oligonucleotide
ccgtgcagtgcccaaggtcaacagaac

SEQ ID NO: 166320 - DNA, 30 bp, Artificial Sequence
  Description of Artificial Sequence: Synthetic oligonucleotide
cgtgcagtgcccaaggtcaacagaacattc

SEQ ID NO: 166321 - DNA, 30 bp, Artificial Sequence
  Description of Artificial Sequence: Synthetic oligonucleotide
gtgcagtgcccaaggtcaacagaacattcc

SEQ ID NO: 166322 - DNA, 31 bp, Artificial Sequence
  Description of Artificial Sequence: Synthetic oligonucleotide
tgcagtgcccaaggtcaacagaacattccag

SEQ ID NO: 166323 - DNA, 30 bp, Artificial Sequence
  Description of Artificial Sequence: Synthetic oligonucleotide
gcagtgcccaaggtcaacagaacattccag

SEQ ID NO: 166324 - DNA, 30 bp, Artificial Sequence
  Description of Artificial Sequence: Synthetic oligonucleotide
cagtgcccaaggtcaacagaacattccagg

SEQ ID NO: 166325 - DNA, 30 bp, Artificial Sequence
  Description of Artificial Sequence: Synthetic oligonucleotide
agtgcccaaggtcaacagaacattccaggc

SEQ ID NO: 166326 - DNA, 29 bp, Artificial Sequence
  Description of Artificial Sequence: Synthetic oligonucleotide
gtgcccaaggtcaacagaacattccaggc

SEQ ID NO: 166327 - DNA, 30 bp, Artificial Sequence
  Description of Artificial Sequence: Synthetic oligonucleotide
tgcccaaggtcaacagaacattccaggcag

SEQ ID NO: 166328 - DNA, 29 bp, Artificial Sequence
  Description of Artificial Sequence: Synthetic oligonucleotide
gcccaaggtcaacagaacattccaggcag

SEQ ID NO: 166329 - DNA, 30 bp, Artificial Sequence
  Description of Artificial Sequence: Synthetic oligonucleotide
cccaaggtcaacagaacattccaggcagac

SEQ ID NO: 166330 - DNA, 33 bp, Artificial Sequence
  Description of Artificial Sequence: Synthetic oligonucleotide
ccaaggtcaacagaacattccaggcagactttc

SEQ ID NO: 166331 - DNA, 33 bp, Artificial Sequence
  Description of Artificial Sequence: Synthetic oligonucleotide
caaggtcaacagaacattccaggcagactttcc

SEQ ID NO: 166332 - DNA, 34 bp, Artificial Sequence
  Description of Artificial Sequence: Synthetic oligonucleotide
aaggtcaacagaacattccaggcagactttcctc

SEQ ID NO: 166333 - DNA, 33 bp, Artificial Sequence
  Description of Artificial Sequence: Synthetic oligonucleotide
aggtcaacagaacattccaggcagactttcctc

SEQ ID NO: 166334 - DNA, 32 bp, Artificial Sequence
  Description of Artificial Sequence: Synthetic oligonucleotide
ggtcaacagaacattccaggcagactttcctc

SEQ ID NO: 166335 - DNA, 33 bp, Artificial Sequence
  Description of Artificial Sequence: Synthetic oligonucleotide
gtcaacagaacattccaggcagactttcctctg

SEQ ID NO: 166336 - DNA, 33 bp, Artificial Sequence
  Description of Artificial Sequence: Synthetic oligonucleotide
tcaacagaacattccaggcagactttcctctgg

SEQ ID NO: 166337 - DNA, 32 bp, Artificial Sequence
  Description of Artificial Sequence: Synthetic oligonucleotide
caacagaacattccaggcagactttcctctgg

SEQ ID NO: 166338 - DNA, 32 bp, Artificial Sequence
  Description of Artificial Sequence: Synthetic oligonucleotide
aacagaacattccaggcagactttcctctggg

SEQ ID NO: 166339 - DNA, 31 bp, Artificial Sequence
  Description of Artificial Sequence: Synthetic oligonucleotide
acagaacattccaggcagactttcctctggg

SEQ ID NO: 166340 - DNA, 30 bp, Artificial Sequence
  Description of Artificial Sequence: Synthetic oligonucleotide
cagaacattccaggcagactttcctctggg

SEQ ID NO: 166341 - DNA, 30 bp, Artificial Sequence
  Description of Artificial Sequence: Synthetic oligonucleotide
agaacattccaggcagactttcctctgggc

SEQ ID NO: 166342 - DNA, 29 bp, Artificial Sequence
  Description of Artificial Sequence: Synthetic oligonucleotide
gaacattccaggcagactttcctctgggc

SEQ ID NO: 166343 - DNA, 29 bp, Artificial Sequence
  Description of Artificial Sequence: Synthetic oligonucleotide
aacattccaggcagactttcctctgggcc

SEQ ID NO: 166344 - DNA, 28 bp, Artificial Sequence
  Description of Artificial Sequence: Synthetic oligonucleotide
acattccaggcagactttcctctgggcc

SEQ ID NO: 166345 - DNA, 27 bp, Artificial Sequence
  Description of Artificial Sequence: Synthetic oligonucleotide
cattccaggcagactttcctctgggcc

SEQ ID NO: 166346 - DNA, 27 bp, Artificial Sequence
  Description of Artificial Sequence: Synthetic oligonucleotide
attccaggcagactttcctctgggccc

SEQ ID NO: 166347 - DNA, 27 bp, Artificial Sequence
  Description of Artificial Sequence: Synthetic oligonucleotide
ttccaggcagactttcctctgggccct

SEQ ID NO: 166348 - DNA, 26 bp, Artificial Sequence
  Description of Artificial Sequence: Synthetic oligonucleotide
tccaggcagactttcctctgggccct

SEQ ID NO: 166349 - DNA, 25 bp, Artificial Sequence
  Description of Artificial Sequence: Synthetic oligonucleotide
ccaggcagactttcctctgggccct

SEQ ID NO: 166350 - DNA, 25 bp, Artificial Sequence
  Description of Artificial Sequence: Synthetic oligonucleotide
caggcagactttcctctgggccctg

SEQ ID NO: 166351 - DNA, 25 bp, Artificial Sequence
  Description of Artificial Sequence: Synthetic oligonucleotide
aggcagactttcctctgggccctgc

SEQ ID NO: 166352 - DNA, 24 bp, Artificial Sequence
  Description of Artificial Sequence: Synthetic oligonucleotide
ggcagactttcctctgggccctgc

SEQ ID NO: 166353 - DNA, 25 bp, Artificial Sequence
  Description of Artificial Sequence: Synthetic oligonucleotide
gcagactttcctctgggccctgcca

SEQ ID NO: 166354 - DNA, 25 bp, Artificial Sequence
  Description of Artificial Sequence: Synthetic oligonucleotide
cagactttcctctgggccctgccac

SEQ ID NO: 166355 - DNA, 25 bp, Artificial Sequence
  Description of Artificial Sequence: Synthetic oligonucleotide
agactttcctctgggccctgccacc

SEQ ID NO: 166356 - DNA, 29 bp, Artificial Sequence
  Description of Artificial Sequence: Synthetic oligonucleotide
acctacagatgcttcggctctttccgtgc

SEQ ID NO: 166357 - DNA, 28 bp, Artificial Sequence
  Description of Artificial Sequence: Synthetic oligonucleotide
cctacagatgcttcggctctttccgtgc

SEQ ID NO: 166358 - DNA, 28 bp, Artificial Sequence
  Description of Artificial Sequence: Synthetic oligonucleotide
ctacagatgcttcggctctttccgtgcc

SEQ ID NO: 166359 - DNA, 28 bp, Artificial Sequence
  Description of Artificial Sequence: Synthetic oligonucleotide
tacagatgcttcggctctttccgtgccc

SEQ ID NO: 166360 - DNA, 27 bp, Artificial Sequence
  Description of Artificial Sequence: Synthetic oligonucleotide
acagatgcttcggctctttccgtgccc

SEQ ID NO: 166361 - DNA, 27 bp, Artificial Sequence
  Description of Artificial Sequence: Synthetic oligonucleotide
cagatgcttcggctctttccgtgccct

SEQ ID NO: 166362 - DNA, 27 bp, Artificial Sequence
  Description of Artificial Sequence: Synthetic oligonucleotide
agatgcttcggctctttccgtgccctg

SEQ ID NO: 166363 - DNA, 26 bp, Artificial Sequence
  Description of Artificial Sequence: Synthetic oligonucleotide
gatgcttcggctctttccgtgccctg

SEQ ID NO: 166364 - DNA, 26 bp, Artificial Sequence
  Description of Artificial Sequence: Synthetic oligonucleotide
atgcttcggctctttccgtgccctgc

SEQ ID NO: 166365 - DNA, 25 bp, Artificial Sequence
  Description of Artificial Sequence: Synthetic oligonucleotide
tgcttcggctctttccgtgccctgc

SEQ ID NO: 166366 - DNA, 24 bp, Artificial Sequence
  Description of Artificial Sequence: Synthetic oligonucleotide
gcttcggctctttccgtgccctgc

SEQ ID NO: 166367 - DNA, 24 bp, Artificial Sequence
  Description of Artificial Sequence: Synthetic oligonucleotide
cttcggctctttccgtgccctgcc

SEQ ID NO: 166368 - DNA, 25 bp, Artificial Sequence
  Description of Artificial Sequence: Synthetic oligonucleotide
ttcggctctttccgtgccctgccct

SEQ ID NO: 166369 - DNA, 24 bp, Artificial Sequence
  Description of Artificial Sequence: Synthetic oligonucleotide
tcggctctttccgtgccctgccct

SEQ ID NO: 166370 - DNA, 23 bp, Artificial Sequence
  Description of Artificial Sequence: Synthetic oligonucleotide
cggctctttccgtgccctgccct

SEQ ID NO: 166371 - DNA, 23 bp, Artificial Sequence
  Description of Artificial Sequence: Synthetic oligonucleotide
ggctctttccgtgccctgccctg

SEQ ID NO: 166372 - DNA, 23 bp, Artificial Sequence
  Description of Artificial Sequence: Synthetic oligonucleotide
gctctttccgtgccctgccctgc

SEQ ID NO: 166373 - DNA, 24 bp, Artificial Sequence
  Description of Artificial Sequence: Synthetic oligonucleotide
ctctttccgtgccctgccctgcgt

SEQ ID NO: 166374 - DNA, 25 bp, Artificial Sequence
  Description of Artificial Sequence: Synthetic oligonucleotide
tctttccgtgccctgccctgcgtgt

SEQ ID NO: 166375 - DNA, 24 bp, Artificial Sequence
  Description of Artificial Sequence: Synthetic oligonucleotide
ctttccgtgccctgccctgcgtgt

SEQ ID NO: 166376 - DNA, 24 bp, Artificial Sequence
  Description of Artificial Sequence: Synthetic oligonucleotide
tttccgtgccctgccctgcgtgtg

SEQ ID NO: 166377 - DNA, 23 bp, Artificial Sequence
  Description of Artificial Sequence: Synthetic oligonucleotide
ttccgtgccctgccctgcgtgtg

SEQ ID NO: 166378 - DNA, 22 bp, Artificial Sequence
  Description of Artificial Sequence: Synthetic oligonucleotide
tccgtgccctgccctgcgtgtg

SEQ ID NO: 166379 - DNA, 21 bp, Artificial Sequence
  Description of Artificial Sequence: Synthetic oligonucleotide
ccgtgccctgccctgcgtgtg

SEQ ID NO: 166380 - DNA, 22 bp, Artificial Sequence
  Description of Artificial Sequence: Synthetic oligonucleotide
cgtgccctgccctgcgtgtggt

SEQ ID NO: 166381 - DNA, 25 bp, Artificial Sequence
  Description of Artificial Sequence: Synthetic oligonucleotide
gtgccctgccctgcgtgtggtcaaa

SEQ ID NO: 166382 - DNA, 26 bp, Artificial Sequence
  Description of Artificial Sequence: Synthetic oligonucleotide
tgccctgccctgcgtgtggtcaaact

SEQ ID NO: 166383 - DNA, 25 bp, Artificial Sequence
  Description of Artificial Sequence: Synthetic oligonucleotide
gccctgccctgcgtgtggtcaaact

SEQ ID NO: 166384 - DNA, 27 bp, Artificial Sequence
  Description of Artificial Sequence: Synthetic oligonucleotide
ccctgccctgcgtgtggtcaaactcaa

SEQ ID NO: 166385 - DNA, 27 bp, Artificial Sequence
  Description of Artificial Sequence: Synthetic oligonucleotide
cctgccctgcgtgtggtcaaactcaag

SEQ ID NO: 166386 - DNA, 28 bp, Artificial Sequence
  Description of Artificial Sequence: Synthetic oligonucleotide
ctgccctgcgtgtggtcaaactcaagtg

SEQ ID NO: 166387 - DNA, 29 bp, Artificial Sequence
  Description of Artificial Sequence: Synthetic oligonucleotide
tgccctgcgtgtggtcaaactcaagtgac

SEQ ID NO: 166388 - DNA, 28 bp, Artificial Sequence
  Description of Artificial Sequence: Synthetic oligonucleotide
gccctgcgtgtggtcaaactcaagtgac

SEQ ID NO: 166389 - DNA, 28 bp, Artificial Sequence
  Description of Artificial Sequence: Synthetic oligonucleotide
ccctgcgtgtggtcaaactcaagtgacc

SEQ ID NO: 166390 - DNA, 28 bp, Artificial Sequence
  Description of Artificial Sequence: Synthetic oligonucleotide
cctgcgtgtggtcaaactcaagtgaccc

SEQ ID NO: 166391 - DNA, 29 bp, Artificial Sequence
  Description of Artificial Sequence: Synthetic oligonucleotide
ctgcgtgtggtcaaactcaagtgacccac

SEQ ID NO: 166392 - DNA, 30 bp, Artificial Sequence
  Description of Artificial Sequence: Synthetic oligonucleotide
tgcgtgtggtcaaactcaagtgacccactg

SEQ ID NO: 166393 - DNA, 29 bp, Artificial Sequence
  Description of Artificial Sequence: Synthetic oligonucleotide
gcgtgtggtcaaactcaagtgacccactg

SEQ ID NO: 166394 - DNA, 29 bp, Artificial Sequence
  Description of Artificial Sequence: Synthetic oligonucleotide
cgtgtggtcaaactcaagtgacccactgc

SEQ ID NO: 166395 - DNA, 31 bp, Artificial Sequence
  Description of Artificial Sequence: Synthetic oligonucleotide
gtgtggtcaaactcaagtgacccactgcttg

SEQ ID NO: 166396 - DNA, 34 bp, Artificial Sequence
  Description of Artificial Sequence: Synthetic oligonucleotide
tgtggtcaaactcaagtgacccactgcttgtttc

SEQ ID NO: 166397 - DNA, 33 bp, Artificial Sequence
  Description of Artificial Sequence: Synthetic oligonucleotide
gtggtcaaactcaagtgacccactgcttgtttc

SEQ ID NO: 166398 - DNA, 34 bp, Artificial Sequence
  Description of Artificial Sequence: Synthetic oligonucleotide
tggtcaaactcaagtgacccactgcttgtttctg

SEQ ID NO: 166399 - DNA, 33 bp, Artificial Sequence
  Description of Artificial Sequence: Synthetic oligonucleotide
ggtcaaactcaagtgacccactgcttgtttctg

SEQ ID NO: 166400 - DNA, 34 bp, Artificial Sequence
  Description of Artificial Sequence: Synthetic oligonucleotide
gtcaaactcaagtgacccactgcttgtttctgtc

SEQ ID NO: 166401 - DNA, 35 bp, Artificial Sequence
  Description of Artificial Sequence: Synthetic oligonucleotide
tcaaactcaagtgacccactgcttgtttctgtcac

SEQ ID NO: 166402 - DNA, 34 bp, Artificial Sequence
  Description of Artificial Sequence: Synthetic oligonucleotide
caaactcaagtgacccactgcttgtttctgtcac

SEQ ID NO: 166403 - DNA, 35 bp, Artificial Sequence
  Description of Artificial Sequence: Synthetic oligonucleotide
aaactcaagtgacccactgcttgtttctgtcacag

SEQ ID NO: 166404 - DNA, 34 bp, Artificial Sequence
  Description of Artificial Sequence: Synthetic oligonucleotide
aactcaagtgacccactgcttgtttctgtcacag

SEQ ID NO: 166405 - DNA, 33 bp, Artificial Sequence
  Description of Artificial Sequence: Synthetic oligonucleotide
actcaagtgacccactgcttgtttctgtcacag

SEQ ID NO: 166406 - DNA, 32 bp, Artificial Sequence
  Description of Artificial Sequence: Synthetic oligonucleotide
ctcaagtgacccactgcttgtttctgtcacag

SEQ ID NO: 166407 - DNA, 39 bp, Artificial Sequence
  Description of Artificial Sequence: Synthetic oligonucleotide
atcctgcaatgttggtcagatgtcatgtttgagcatttc

SEQ ID NO: 166408 - DNA, 38 bp, Artificial Sequence
  Description of Artificial Sequence: Synthetic oligonucleotide
tcctgcaatgttggtcagatgtcatgtttgagcatttc

SEQ ID NO: 166409 - DNA, 37 bp, Artificial Sequence
  Description of Artificial Sequence: Synthetic oligonucleotide
cctgcaatgttggtcagatgtcatgtttgagcatttc

SEQ ID NO: 166410 - DNA, 40 bp, Artificial Sequence
  Description of Artificial Sequence: Synthetic oligonucleotide
ctgcaatgttggtcagatgtcatgtttgagcatttctttc

SEQ ID NO: 166411 - DNA, 41 bp, Artificial Sequence
  Description of Artificial Sequence: Synthetic oligonucleotide
tgcaatgttggtcagatgtcatgtttgagcatttctttctg

SEQ ID NO: 166412 - DNA, 40 bp, Artificial Sequence
  Description of Artificial Sequence: Synthetic oligonucleotide
gcaatgttggtcagatgtcatgtttgagcatttctttctg

SEQ ID NO: 166413 - DNA, 40 bp, Artificial Sequence
  Description of Artificial Sequence: Synthetic oligonucleotide
caatgttggtcagatgtcatgtttgagcatttctttctgc

SEQ ID NO: 166414 - DNA, 41 bp, Artificial Sequence
  Description of Artificial Sequence: Synthetic oligonucleotide
aatgttggtcagatgtcatgtttgagcatttctttctgcac

SEQ ID NO: 166415 - DNA, 40 bp, Artificial Sequence
  Description of Artificial Sequence: Synthetic oligonucleotide
atgttggtcagatgtcatgtttgagcatttctttctgcac

SEQ ID NO: 166416 - DNA, 39 bp, Artificial Sequence
  Description of Artificial Sequence: Synthetic oligonucleotide
tgttggtcagatgtcatgtttgagcatttctttctgcac

SEQ ID NO: 166417 - DNA, 38 bp, Artificial Sequence
  Description of Artificial Sequence: Synthetic oligonucleotide
gttggtcagatgtcatgtttgagcatttctttctgcac

SEQ ID NO: 166418 - DNA, 39 bp, Artificial Sequence
  Description of Artificial Sequence: Synthetic oligonucleotide
ttggtcagatgtcatgtttgagcatttctttctgcacag

SEQ ID NO: 166419 - DNA, 38 bp, Artificial Sequence
  Description of Artificial Sequence: Synthetic oligonucleotide
tggtcagatgtcatgtttgagcatttctttctgcacag

SEQ ID NO: 166420 - DNA, 37 bp, Artificial Sequence
  Description of Artificial Sequence: Synthetic oligonucleotide
ggtcagatgtcatgtttgagcatttctttctgcacag

SEQ ID NO: 166421 - DNA, 38 bp, Artificial Sequence
  Description of Artificial Sequence: Synthetic oligonucleotide
gtcagatgtcatgtttgagcatttctttctgcacagag

SEQ ID NO: 166422 - DNA, 39 bp, Artificial Sequence
  Description of Artificial Sequence: Synthetic oligonucleotide
tcagatgtcatgtttgagcatttctttctgcacagagag

SEQ ID NO: 166423 - DNA, 38 bp, Artificial Sequence
  Description of Artificial Sequence: Synthetic oligonucleotide
cagatgtcatgtttgagcatttctttctgcacagagag

SEQ ID NO: 166424 - DNA, 38 bp, Artificial Sequence
  Description of Artificial Sequence: Synthetic oligonucleotide
agatgtcatgtttgagcatttctttctgcacagagagg

SEQ ID NO: 166425 - DNA, 37 bp, Artificial Sequence
  Description of Artificial Sequence: Synthetic oligonucleotide
gatgtcatgtttgagcatttctttctgcacagagagg

SEQ ID NO: 166426 - DNA, 37 bp, Artificial Sequence
  Description of Artificial Sequence: Synthetic oligonucleotide
atgtcatgtttgagcatttctttctgcacagagaggg

SEQ ID NO: 166427 - DNA, 36 bp, Artificial Sequence
  Description of Artificial Sequence: Synthetic oligonucleotide
tgtcatgtttgagcatttctttctgcacagagaggg

SEQ ID NO: 166428 - DNA, 35 bp, Artificial Sequence
  Description of Artificial Sequence: Synthetic oligonucleotide
gtcatgtttgagcatttctttctgcacagagaggg

SEQ ID NO: 166429 - DNA, 35 bp, Artificial Sequence
  Description of Artificial Sequence: Synthetic oligonucleotide
tcatgtttgagcatttctttctgcacagagagggg

SEQ ID NO: 166430 - DNA, 34 bp, Artificial Sequence
  Description of Artificial Sequence: Synthetic oligonucleotide
catgtttgagcatttctttctgcacagagagggg

SEQ ID NO: 166431 - DNA, 36 bp, Artificial Sequence
  Description of Artificial Sequence: Synthetic oligonucleotide
atgtttgagcatttctttctgcacagagaggggatc

SEQ ID NO: 166432 - DNA, 35 bp, Artificial Sequence
  Description of Artificial Sequence: Synthetic oligonucleotide
tgtttgagcatttctttctgcacagagaggggatc

SEQ ID NO: 166433 - DNA, 34 bp, Artificial Sequence
  Description of Artificial Sequence: Synthetic oligonucleotide
gtttgagcatttctttctgcacagagaggggatc

SEQ ID NO: 166434 - DNA, 35 bp, Artificial Sequence
  Description of Artificial Sequence: Synthetic oligonucleotide
tttgagcatttctttctgcacagagaggggatctc

SEQ ID NO: 166435 - DNA, 34 bp, Artificial Sequence
  Description of Artificial Sequence: Synthetic oligonucleotide
ttgagcatttctttctgcacagagaggggatctc

SEQ ID NO: 166436 - DNA, 33 bp, Artificial Sequence
  Description of Artificial Sequence: Synthetic oligonucleotide
tgagcatttctttctgcacagagaggggatctc

SEQ ID NO: 166437 - DNA, 32 bp, Artificial Sequence
  Description of Artificial Sequence: Synthetic oligonucleotide
gagcatttctttctgcacagagaggggatctc

SEQ ID NO: 166438 - DNA, 33 bp, Artificial Sequence
  Description of Artificial Sequence: Synthetic oligonucleotide
agcatttctttctgcacagagaggggatctctg

SEQ ID NO: 166439 - DNA, 32 bp, Artificial Sequence
  Description of Artificial Sequence: Synthetic oligonucleotide
gcatttctttctgcacagagaggggatctctg

SEQ ID NO: 166440 - DNA, 33 bp, Artificial Sequence
  Description of Artificial Sequence: Synthetic oligonucleotide
catttctttctgcacagagaggggatctctgag

SEQ ID NO: 166441 - DNA, 33 bp, Artificial Sequence
  Description of Artificial Sequence: Synthetic oligonucleotide
atttctttctgcacagagaggggatctctgagg

SEQ ID NO: 166442 - DNA, 32 bp, Artificial Sequence
  Description of Artificial Sequence: Synthetic oligonucleotide
tttctttctgcacagagaggggatctctgagg

SEQ ID NO: 166443 - DNA, 27 bp, Artificial Sequence
  Description of Artificial Sequence: Synthetic oligonucleotide
atgtcgctcactgtcgtcagcatggcg

SEQ ID NO: 166444 - DNA, 27 bp, Artificial Sequence
  Description of Artificial Sequence: Synthetic oligonucleotide
tgtcgctcactgtcgtcagcatggcgt

SEQ ID NO: 166445 - DNA, 26 bp, Artificial Sequence
  Description of Artificial Sequence: Synthetic oligonucleotide
gtcgctcactgtcgtcagcatggcgt

SEQ ID NO: 166446 - DNA, 26 bp, Artificial Sequence
  Description of Artificial Sequence: Synthetic oligonucleotide
tcgctcactgtcgtcagcatggcgtg

SEQ ID NO: 166447 - DNA, 25 bp, Artificial Sequence
  Description of Artificial Sequence: Synthetic oligonucleotide
cgctcactgtcgtcagcatggcgtg

SEQ ID NO: 166448 - DNA, 25 bp, Artificial Sequence
  Description of Artificial Sequence: Synthetic oligonucleotide
gctcactgtcgtcagcatggcgtgc

SEQ ID NO: 166449 - DNA, 27 bp, Artificial Sequence
  Description of Artificial Sequence: Synthetic oligonucleotide
ctcactgtcgtcagcatggcgtgcgtt

SEQ ID NO: 166450 - DNA, 27 bp, Artificial Sequence
  Description of Artificial Sequence: Synthetic oligonucleotide
tcactgtcgtcagcatggcgtgcgttg

SEQ ID NO: 166451 - DNA, 26 bp, Artificial Sequence
  Description of Artificial Sequence: Synthetic oligonucleotide
cactgtcgtcagcatggcgtgcgttg

SEQ ID NO: 166452 - DNA, 26 bp, Artificial Sequence
  Description of Artificial Sequence: Synthetic oligonucleotide
actgtcgtcagcatggcgtgcgttgg

SEQ ID NO: 166453 - DNA, 25 bp, Artificial Sequence
  Description of Artificial Sequence: Synthetic oligonucleotide
ctgtcgtcagcatggcgtgcgttgg

SEQ ID NO: 166454 - DNA, 27 bp, Artificial Sequence
  Description of Artificial Sequence: Synthetic oligonucleotide
tgtcgtcagcatggcgtgcgttgggtt

SEQ ID NO: 166455 - DNA, 38 bp, Artificial Sequence
  Description of Artificial Sequence: Synthetic oligonucleotide
agatgtcatgtttgagcacttctttctgcacagagatg

SEQ ID NO: 166456 - DNA, 37 bp, Artificial Sequence
  Description of Artificial Sequence: Synthetic oligonucleotide
gatgtcatgtttgagcacttctttctgcacagagatg

SEQ ID NO: 166457 - DNA, 37 bp, Artificial Sequence
  Description of Artificial Sequence: Synthetic oligonucleotide
atgtcatgtttgagcacttctttctgcacagagatgg

SEQ ID NO: 166458 - DNA, 36 bp, Artificial Sequence
  Description of Artificial Sequence: Synthetic oligonucleotide
tgtcatgtttgagcacttctttctgcacagagatgg

SEQ ID NO: 166459 - DNA, 35 bp, Artificial Sequence
  Description of Artificial Sequence: Synthetic oligonucleotide
gtcatgtttgagcacttctttctgcacagagatgg

SEQ ID NO: 166460 - DNA, 35 bp, Artificial Sequence
  Description of Artificial Sequence: Synthetic oligonucleotide
tcatgtttgagcacttctttctgcacagagatggg

SEQ ID NO: 166461 - DNA, 34 bp, Artificial Sequence
  Description of Artificial Sequence: Synthetic oligonucleotide
catgtttgagcacttctttctgcacagagatggg

SEQ ID NO: 166462 - DNA, 36 bp, Artificial Sequence
  Description of Artificial Sequence: Synthetic oligonucleotide
atgtttgagcacttctttctgcacagagatgggatc

SEQ ID NO: 166463 - DNA, 35 bp, Artificial Sequence
  Description of Artificial Sequence: Synthetic oligonucleotide
tgtttgagcacttctttctgcacagagatgggatc

SEQ ID NO: 166464 - DNA, 34 bp, Artificial Sequence
  Description of Artificial Sequence: Synthetic oligonucleotide
gtttgagcacttctttctgcacagagatgggatc

SEQ ID NO: 166465 - DNA, 35 bp, Artificial Sequence
  Description of Artificial Sequence: Synthetic oligonucleotide
tttgagcacttctttctgcacagagatgggatctc

SEQ ID NO: 166466 - DNA, 34 bp, Artificial Sequence
  Description of Artificial Sequence: Synthetic oligonucleotide
ttgagcacttctttctgcacagagatgggatctc

SEQ ID NO: 166467 - DNA, 33 bp, Artificial Sequence
  Description of Artificial Sequence: Synthetic oligonucleotide
tgagcacttctttctgcacagagatgggatctc

SEQ ID NO: 166468 - DNA, 32 bp, Artificial Sequence
  Description of Artificial Sequence: Synthetic oligonucleotide
gagcacttctttctgcacagagatgggatctc

SEQ ID NO: 166469 - DNA, 33 bp, Artificial Sequence
  Description of Artificial Sequence: Synthetic oligonucleotide
agcacttctttctgcacagagatgggatctctg

SEQ ID NO: 166470 - DNA, 32 bp, Artificial Sequence
  Description of Artificial Sequence: Synthetic oligonucleotide
gcacttctttctgcacagagatgggatctctg

SEQ ID NO: 166471 - DNA, 33 bp, Artificial Sequence
  Description of Artificial Sequence: Synthetic oligonucleotide
cacttctttctgcacagagatgggatctctgag

SEQ ID NO: 166472 - DNA, 33 bp, Artificial Sequence
  Description of Artificial Sequence: Synthetic oligonucleotide
acttctttctgcacagagatgggatctctgagg

SEQ ID NO: 166473 - DNA, 32 bp, Artificial Sequence
  Description of Artificial Sequence: Synthetic oligonucleotide
cttctttctgcacagagatgggatctctgagg

SEQ ID NO: 166474 - DNA, 33 bp, Artificial Sequence
  Description of Artificial Sequence: Synthetic oligonucleotide
ttctttctgcacagagatgggatctctgaggac

SEQ ID NO: 166475 - DNA, 32 bp, Artificial Sequence
  Description of Artificial Sequence: Synthetic oligonucleotide
tctttctgcacagagatgggatctctgaggac

SEQ ID NO: 166476 - DNA, 31 bp, Artificial Sequence
  Description of Artificial Sequence: Synthetic oligonucleotide
ctttctgcacagagatgggatctctgaggac

SEQ ID NO: 166477 - DNA, 31 bp, Artificial Sequence
  Description of Artificial Sequence: Synthetic oligonucleotide
tttctgcacagagatgggatctctgaggacc

SEQ ID NO: 166478 - DNA, 30 bp, Artificial Sequence
  Description of Artificial Sequence: Synthetic oligonucleotide
ttctgcacagagatgggatctctgaggacc

SEQ ID NO: 166479 - DNA, 29 bp, Artificial Sequence
  Description of Artificial Sequence: Synthetic oligonucleotide
tctgcacagagatgggatctctgaggacc

SEQ ID NO: 166480 - DNA, 28 bp, Artificial Sequence
  Description of Artificial Sequence: Synthetic oligonucleotide
ctgcacagagatgggatctctgaggacc

SEQ ID NO: 166481 - DNA, 28 bp, Artificial Sequence
  Description of Artificial Sequence: Synthetic oligonucleotide
tgcacagagatgggatctctgaggaccc

SEQ ID NO: 166482 - DNA, 27 bp, Artificial Sequence
  Description of Artificial Sequence: Synthetic oligonucleotide
gcacagagatgggatctctgaggaccc

SEQ ID NO: 166483 - DNA, 27 bp, Artificial Sequence
  Description of Artificial Sequence: Synthetic oligonucleotide
cacagagatgggatctctgaggacccc

SEQ ID NO: 166484 - DNA, 28 bp, Artificial Sequence
  Description of Artificial Sequence: Synthetic oligonucleotide
acagagatgggatctctgaggacccctc

SEQ ID NO: 166485 - DNA, 27 bp, Artificial Sequence
  Description of Artificial Sequence: Synthetic oligonucleotide
cagagatgggatctctgaggacccctc

SEQ ID NO: 166486 - DNA, 28 bp, Artificial Sequence
  Description of Artificial Sequence: Synthetic oligonucleotide
agagatgggatctctgaggacccctcac

SEQ ID NO: 166487 - DNA, 27 bp, Artificial Sequence
  Description of Artificial Sequence: Synthetic oligonucleotide
gagatgggatctctgaggacccctcac

SEQ ID NO: 166488 - DNA, 27 bp, Artificial Sequence
  Description of Artificial Sequence: Synthetic oligonucleotide
agatgggatctctgaggacccctcacg

SEQ ID NO: 166489 - DNA, 26 bp, Artificial Sequence
  Description of Artificial Sequence: Synthetic oligonucleotide
gatgggatctctgaggacccctcacg

SEQ ID NO: 166490 - DNA, 26 bp, Artificial Sequence
  Description of Artificial Sequence: Synthetic oligonucleotide
atgggatctctgaggacccctcacgc

SEQ ID NO: 166491 - DNA, 25 bp, Artificial Sequence
  Description of Artificial Sequence: Synthetic oligonucleotide
tgggatctctgaggacccctcacgc

SEQ ID NO: 166492 - DNA, 29 bp, Artificial Sequence
  Description of Artificial Sequence: Synthetic oligonucleotide
tacagatgtcggggttcacgcccacattc

SEQ ID NO: 166493 - DNA, 28 bp, Artificial Sequence
  Description of Artificial Sequence: Synthetic oligonucleotide
acagatgtcggggttcacgcccacattc

SEQ ID NO: 166494 - DNA, 27 bp, Artificial Sequence
  Description of Artificial Sequence: Synthetic oligonucleotide
cagatgtcggggttcacgcccacattc

SEQ ID NO: 166495 - DNA, 27 bp, Artificial Sequence
  Description of Artificial Sequence: Synthetic oligonucleotide
agatgtcggggttcacgcccacattcc

SEQ ID NO: 166496 - DNA, 26 bp, Artificial Sequence
  Description of Artificial Sequence: Synthetic oligonucleotide
gatgtcggggttcacgcccacattcc

SEQ ID NO: 166497 - DNA, 27 bp, Artificial Sequence
  Description of Artificial Sequence: Synthetic oligonucleotide
atgtcggggttcacgcccacattccct

SEQ ID NO: 166498 - DNA, 26 bp, Artificial Sequence
  Description of Artificial Sequence: Synthetic oligonucleotide
tgtcggggttcacgcccacattccct

SEQ ID NO: 166499 - DNA, 25 bp, Artificial Sequence
  Description of Artificial Sequence: Synthetic oligonucleotide
gtcggggttcacgcccacattccct

SEQ ID NO: 166500 - DNA, 26 bp, Artificial Sequence
  Description of Artificial Sequence: Synthetic oligonucleotide
tcggggttcacgcccacattccctca

SEQ ID NO: 166501 - DNA, 25 bp, Artificial Sequence
  Description of Artificial Sequence: Synthetic oligonucleotide
cggggttcacgcccacattccctca

SEQ ID NO: 166502 - DNA, 26 bp, Artificial Sequence
  Description of Artificial Sequence: Synthetic oligonucleotide
ggggttcacgcccacattccctcact

SEQ ID NO: 166503 - DNA, 26 bp, Artificial Sequence
  Description of Artificial Sequence: Synthetic oligonucleotide
gggttcacgcccacattccctcactg

SEQ ID NO: 166504 - DNA, 26 bp, Artificial Sequence
  Description of Artificial Sequence: Synthetic oligonucleotide
ggttcacgcccacattccctcactgg

SEQ ID NO: 166505 - DNA, 27 bp, Artificial Sequence
  Description of Artificial Sequence: Synthetic oligonucleotide
gttcacgcccacattccctcactgggt

SEQ ID NO: 166506 - DNA, 27 bp, Artificial Sequence
  Description of Artificial Sequence: Synthetic oligonucleotide
ttcacgcccacattccctcactgggtg

SEQ ID NO: 166507 - DNA, 26 bp, Artificial Sequence
  Description of Artificial Sequence: Synthetic oligonucleotide
tcacgcccacattccctcactgggtg

SEQ ID NO: 166508 - DNA, 25 bp, Artificial Sequence
  Description of Artificial Sequence: Synthetic oligonucleotide
cacgcccacattccctcactgggtg

SEQ ID NO: 166509 - DNA, 26 bp, Artificial Sequence
  Description of Artificial Sequence: Synthetic oligonucleotide
acgcccacattccctcactgggtggt

SEQ ID NO: 166510 - DNA, 25 bp, Artificial Sequence
  Description of Artificial Sequence: Synthetic oligonucleotide
cgcccacattccctcactgggtggt

SEQ ID NO: 166511 - DNA, 25 bp, Artificial Sequence
  Description of Artificial Sequence: Synthetic oligonucleotide
gcccacattccctcactgggtggtc

SEQ ID NO: 166512 - DNA, 25 bp, Artificial Sequence
  Description of Artificial Sequence: Synthetic oligonucleotide
cccacattccctcactgggtggtcg

SEQ ID NO: 166513 - DNA, 25 bp, Artificial Sequence
  Description of Artificial Sequence: Synthetic oligonucleotide
ccacattccctcactgggtggtcgg

SEQ ID NO: 166514 - DNA, 26 bp, Artificial Sequence
  Description of Artificial Sequence: Synthetic oligonucleotide
cacattccctcactgggtggtcggca

SEQ ID NO: 166515 - DNA, 26 bp, Artificial Sequence
  Description of Artificial Sequence: Synthetic oligonucleotide
acattccctcactgggtggtcggcac

SEQ ID NO: 166516 - DNA, 25 bp, Artificial Sequence
  Description of Artificial Sequence: Synthetic oligonucleotide
cattccctcactgggtggtcggcac

SEQ ID NO: 166517 - DNA, 25 bp, Artificial Sequence
  Description of Artificial Sequence: Synthetic oligonucleotide
attccctcactgggtggtcggcacc

SEQ ID NO: 166518 - DNA, 24 bp, Artificial Sequence
  Description of Artificial Sequence: Synthetic oligonucleotide
ttccctcactgggtggtcggcacc

SEQ ID NO: 166519 - DNA, 22 bp, Artificial Sequence
  Description of Artificial Sequence: Synthetic oligonucleotide
tgcccggcccagcactgtggtc

SEQ ID NO: 166520 - DNA, 21 bp, Artificial Sequence
  Description of Artificial Sequence: Synthetic oligonucleotide
gcccggcccagcactgtggtc

SEQ ID NO: 166521 - DNA, 21 bp, Artificial Sequence
  Description of Artificial Sequence: Synthetic oligonucleotide
cccggcccagcactgtggtcg

SEQ ID NO: 166522 - DNA, 22 bp, Artificial Sequence
  Description of Artificial Sequence: Synthetic oligonucleotide
ccggcccagcactgtggtcgct

SEQ ID NO: 166523 - DNA, 22 bp, Artificial Sequence
  Description of Artificial Sequence: Synthetic oligonucleotide
cggcccagcactgtggtcgctc

SEQ ID NO: 166524 - DNA, 23 bp, Artificial Sequence
  Description of Artificial Sequence: Synthetic oligonucleotide
ggcccagcactgtggtcgctcga

SEQ ID NO: 166525 - DNA, 23 bp, Artificial Sequence
  Description of Artificial Sequence: Synthetic oligonucleotide
gcccagcactgtggtcgctcgag

SEQ ID NO: 166526 - DNA, 24 bp, Artificial Sequence
  Description of Artificial Sequence: Synthetic oligonucleotide
cccagcactgtggtcgctcgagga

SEQ ID NO: 166527 - DNA, 24 bp, Artificial Sequence
  Description of Artificial Sequence: Synthetic oligonucleotide
ccagcactgtggtcgctcgaggag

SEQ ID NO: 166528 - DNA, 25 bp, Artificial Sequence
  Description of Artificial Sequence: Synthetic oligonucleotide
cagcactgtggtcgctcgaggagga

SEQ ID NO: 166529 - DNA, 26 bp, Artificial Sequence
  Description of Artificial Sequence: Synthetic oligonucleotide
agcactgtggtcgctcgaggaggaca

SEQ ID NO: 166530 - DNA, 25 bp, Artificial Sequence
  Description of Artificial Sequence: Synthetic oligonucleotide
gcactgtggtcgctcgaggaggaca

SEQ ID NO: 166531 - DNA, 25 bp, Artificial Sequence
  Description of Artificial Sequence: Synthetic oligonucleotide
cactgtggtcgctcgaggaggacac

SEQ ID NO: 166532 - DNA, 26 bp, Artificial Sequence
  Description of Artificial Sequence: Synthetic oligonucleotide
actgtggtcgctcgaggaggacacgt

SEQ ID NO: 166533 - DNA, 25 bp, Artificial Sequence
  Description of Artificial Sequence: Synthetic oligonucleotide
ctgtggtcgctcgaggaggacacgt

SEQ ID NO: 166534 - DNA, 25 bp, Artificial Sequence
  Description of Artificial Sequence: Synthetic oligonucleotide
tgtggtcgctcgaggaggacacgtg

SEQ ID NO: 166535 - DNA, 24 bp, Artificial Sequence
  Description of Artificial Sequence: Synthetic oligonucleotide
gtggtcgctcgaggaggacacgtg

SEQ ID NO: 166536 - DNA, 24 bp, Artificial Sequence
  Description of Artificial Sequence: Synthetic oligonucleotide
tggtcgctcgaggaggacacgtgg

SEQ ID NO: 166537 - DNA, 23 bp, Artificial Sequence
  Description of Artificial Sequence: Synthetic oligonucleotide
ggtcgctcgaggaggacacgtgg

SEQ ID NO: 166538 - DNA, 24 bp, Artificial Sequence
  Description of Artificial Sequence: Synthetic oligonucleotide
gtcgctcgaggaggacacgtggct

SEQ ID NO: 166539 - DNA, 26 bp, Artificial Sequence
  Description of Artificial Sequence: Synthetic oligonucleotide
tcgctcgaggaggacacgtggctctt

SEQ ID NO: 166540 - DNA, 25 bp, Artificial Sequence
  Description of Artificial Sequence: Synthetic oligonucleotide
cgctcgaggaggacacgtggctctt

SEQ ID NO: 166541 - DNA, 26 bp, Artificial Sequence
  Description of Artificial Sequence: Synthetic oligonucleotide
gctcgaggaggacacgtggctcttca

SEQ ID NO: 166542 - DNA, 27 bp, Artificial Sequence
  Description of Artificial Sequence: Synthetic oligonucleotide
agaggggatctctgaggacccctcaca

SEQ ID NO: 166543 - DNA, 26 bp, Artificial Sequence
  Description of Artificial Sequence: Synthetic oligonucleotide
gaggggatctctgaggacccctcaca

SEQ ID NO: 166544 - DNA, 26 bp, Artificial Sequence
  Description of Artificial Sequence: Synthetic oligonucleotide
aggggatctctgaggacccctcacac

SEQ ID NO: 166545 - DNA, 25 bp, Artificial Sequence
  Description of Artificial Sequence: Synthetic oligonucleotide
ggggatctctgaggacccctcacac

SEQ ID NO: 166546 - DNA, 26 bp, Artificial Sequence
  Description of Artificial Sequence: Synthetic oligonucleotide
gggatctctgaggacccctcacacct

SEQ ID NO: 166547 - DNA, 26 bp, Artificial Sequence
  Description of Artificial Sequence: Synthetic oligonucleotide
ggatctctgaggacccctcacacctc

SEQ ID NO: 166548 - DNA, 27 bp, Artificial Sequence
  Description of Artificial Sequence: Synthetic oligonucleotide
gatctctgaggacccctcacacctcgt

SEQ ID NO: 166549 - DNA, 28 bp, Artificial Sequence
  Description of Artificial Sequence: Synthetic oligonucleotide
atctctgaggacccctcacacctcgttg

SEQ ID NO: 166550 - DNA, 27 bp, Artificial Sequence
  Description of Artificial Sequence: Synthetic oligonucleotide
tctctgaggacccctcacacctcgttg

SEQ ID NO: 166551 - DNA, 26 bp, Artificial Sequence
  Description of Artificial Sequence: Synthetic oligonucleotide
ctctgaggacccctcacacctcgttg

SEQ ID NO: 166552 - DNA, 27 bp, Artificial Sequence
  Description of Artificial Sequence: Synthetic oligonucleotide
tctgaggacccctcacacctcgttgga

SEQ ID NO: 166553 - DNA, 26 bp, Artificial Sequence
  Description of Artificial Sequence: Synthetic oligonucleotide
ctgaggacccctcacacctcgttgga

SEQ ID NO: 166554 - DNA, 27 bp, Artificial Sequence
  Description of Artificial Sequence: Synthetic oligonucleotide
tgaggacccctcacacctcgttggaca

SEQ ID NO: 166555 - DNA, 26 bp, Artificial Sequence
  Description of Artificial Sequence: Synthetic oligonucleotide
gaggacccctcacacctcgttggaca

SEQ ID NO: 166556 - DNA, 27 bp, Artificial Sequence
  Description of Artificial Sequence: Synthetic oligonucleotide
aggacccctcacacctcgttggacaga

SEQ ID NO: 166557 - DNA, 27 bp, Artificial Sequence
  Description of Artificial Sequence: Synthetic oligonucleotide
ggacccctcacacctcgttggacagat

SEQ ID NO: 166558 - DNA, 27 bp, Artificial Sequence
  Description of Artificial Sequence: Synthetic oligonucleotide
gacccctcacacctcgttggacagatc

SEQ ID NO: 166559 - DNA, 27 bp, Artificial Sequence
  Description of Artificial Sequence: Synthetic oligonucleotide
acccctcacacctcgttggacagatcc

SEQ ID NO: 166560 - DNA, 27 bp, Artificial Sequence
  Description of Artificial Sequence: Synthetic oligonucleotide
cccctcacacctcgttggacagatcca

SEQ ID NO: 166561 - DNA, 28 bp, Artificial Sequence
  Description of Artificial Sequence: Synthetic oligonucleotide
ccctcacacctcgttggacagatccatg

SEQ ID NO: 166562 - DNA, 30 bp, Artificial Sequence
  Description of Artificial Sequence: Synthetic oligonucleotide
cctcacacctcgttggacagatccatgatg

SEQ ID NO: 166563 - DNA, 30 bp, Artificial Sequence
  Description of Artificial Sequence: Synthetic oligonucleotide
ctcacacctcgttggacagatccatgatgg

SEQ ID NO: 166564 - DNA, 30 bp, Artificial Sequence
  Description of Artificial Sequence: Synthetic oligonucleotide
tcacacctcgttggacagatccatgatggg

SEQ ID NO: 166565 - DNA, 29 bp, Artificial Sequence
  Description of Artificial Sequence: Synthetic oligonucleotide
cacacctcgttggacagatccatgatggg

SEQ ID NO: 166566 - DNA, 29 bp, Artificial Sequence
  Description of Artificial Sequence: Synthetic oligonucleotide
acacctcgttggacagatccatgatgggg

SEQ ID NO: 166567 - DNA, 28 bp, Artificial Sequence
  Description of Artificial Sequence: Synthetic oligonucleotide
cacctcgttggacagatccatgatgggg

SEQ ID NO: 166568 - DNA, 29 bp, Artificial Sequence
  Description of Artificial Sequence: Synthetic oligonucleotide
acctcgttggacagatccatgatggggtc

SEQ ID NO: 166569 - DNA, 37 bp, Artificial Sequence
  Description of Artificial Sequence: Synthetic oligonucleotide
gtgatcacaggtctatatgagaaaccttctctctcac

SEQ ID NO: 166570 - DNA, 37 bp, Artificial Sequence
  Description of Artificial Sequence: Synthetic oligonucleotide
tgatcacaggtctatatgagaaaccttctctctcacc

SEQ ID NO: 166571 - DNA, 36 bp, Artificial Sequence
  Description of Artificial Sequence: Synthetic oligonucleotide
gatcacaggtctatatgagaaaccttctctctcacc

SEQ ID NO: 166572 - DNA, 36 bp, Artificial Sequence
  Description of Artificial Sequence: Synthetic oligonucleotide
atcacaggtctatatgagaaaccttctctctcaccg

SEQ ID NO: 166573 - DNA, 35 bp, Artificial Sequence
  Description of Artificial Sequence: Synthetic oligonucleotide
tcacaggtctatatgagaaaccttctctctcaccg

SEQ ID NO: 166574 - DNA, 34 bp, Artificial Sequence
  Description of Artificial Sequence: Synthetic oligonucleotide
cacaggtctatatgagaaaccttctctctcaccg

SEQ ID NO: 166575 - DNA, 34 bp, Artificial Sequence
  Description of Artificial Sequence: Synthetic oligonucleotide
acaggtctatatgagaaaccttctctctcaccgc

SEQ ID NO: 166576 - DNA, 33 bp, Artificial Sequence
  Description of Artificial Sequence: Synthetic oligonucleotide
caggtctatatgagaaaccttctctctcaccgc

SEQ ID NO: 166577 - DNA, 34 bp, Artificial Sequence
  Description of Artificial Sequence: Synthetic oligonucleotide
aggtctatatgagaaaccttctctctcaccgcag

SEQ ID NO: 166578 - DNA, 33 bp, Artificial Sequence
  Description of Artificial Sequence: Synthetic oligonucleotide
ggtctatatgagaaaccttctctctcaccgcag

SEQ ID NO: 166579 - DNA, 33 bp, Artificial Sequence
  Description of Artificial Sequence: Synthetic oligonucleotide
gtctatatgagaaaccttctctctcaccgcagc

SEQ ID NO: 166580 - DNA, 33 bp, Artificial Sequence
  Description of Artificial Sequence: Synthetic oligonucleotide
tctatatgagaaaccttctctctcaccgcagcc

SEQ ID NO: 166581 - DNA, 32 bp, Artificial Sequence
  Description of Artificial Sequence: Synthetic oligonucleotide
ctatatgagaaaccttctctctcaccgcagcc

SEQ ID NO: 166582 - DNA, 32 bp, Artificial Sequence
  Description of Artificial Sequence: Synthetic oligonucleotide
tatatgagaaaccttctctctcaccgcagccg

SEQ ID NO: 166583 - DNA, 31 bp, Artificial Sequence
  Description of Artificial Sequence: Synthetic oligonucleotide
atatgagaaaccttctctctcaccgcagccg

SEQ ID NO: 166584 - DNA, 30 bp, Artificial Sequence
  Description of Artificial Sequence: Synthetic oligonucleotide
tatgagaaaccttctctctcaccgcagccg

SEQ ID NO: 166585 - DNA, 29 bp, Artificial Sequence
  Description of Artificial Sequence: Synthetic oligonucleotide
atgagaaaccttctctctcaccgcagccg

SEQ ID NO: 166586 - DNA, 28 bp, Artificial Sequence
  Description of Artificial Sequence: Synthetic oligonucleotide
tgagaaaccttctctctcaccgcagccg

SEQ ID NO: 166587 - DNA, 27 bp, Artificial Sequence
  Description of Artificial Sequence: Synthetic oligonucleotide
gagaaaccttctctctcaccgcagccg

SEQ ID NO: 166588 - DNA, 27 bp, Artificial Sequence
  Description of Artificial Sequence: Synthetic oligonucleotide
agaaaccttctctctcaccgcagccgg

SEQ ID NO: 166589 - DNA, 26 bp, Artificial Sequence
  Description of Artificial Sequence: Synthetic oligonucleotide
gaaaccttctctctcaccgcagccgg

SEQ ID NO: 166590 - DNA, 26 bp, Artificial Sequence
  Description of Artificial Sequence: Synthetic oligonucleotide
aaaccttctctctcaccgcagccggg

SEQ ID NO: 166591 - DNA, 25 bp, Artificial Sequence
  Description of Artificial Sequence: Synthetic oligonucleotide
aaccttctctctcaccgcagccggg

SEQ ID NO: 166592 - DNA, 24 bp, Artificial Sequence
  Description of Artificial Sequence: Synthetic oligonucleotide
accttctctctcaccgcagccggg

SEQ ID NO: 166593 - DNA, 23 bp, Artificial Sequence
  Description of Artificial Sequence: Synthetic oligonucleotide
ccttctctctcaccgcagccggg

SEQ ID NO: 166594 - DNA, 23 bp, Artificial Sequence
  Description of Artificial Sequence: Synthetic oligonucleotide
cttctctctcaccgcagccgggc

SEQ ID NO: 166595 - DNA, 23 bp, Artificial Sequence
  Description of Artificial Sequence: Synthetic oligonucleotide
ttctctctcaccgcagccgggcc

SEQ ID NO: 166596 - DNA, 22 bp, Artificial Sequence
  Description of Artificial Sequence: Synthetic oligonucleotide
tctctctcaccgcagccgggcc

SEQ ID NO: 166597 - DNA, 21 bp, Artificial Sequence
  Description of Artificial Sequence: Synthetic oligonucleotide
ctctctcaccgcagccgggcc

SEQ ID NO: 166598 - DNA, 21 bp, Artificial Sequence
  Description of Artificial Sequence: Synthetic oligonucleotide
tctctcaccgcagccgggccc

SEQ ID NO: 166599 - DNA, 20 bp, Artificial Sequence
  Description of Artificial Sequence: Synthetic oligonucleotide
ctctcaccgcagccgggccc

SEQ ID NO: 166600 - DNA, 21 bp, Artificial Sequence
  Description of Artificial Sequence: Synthetic oligonucleotide
tctcaccgcagccgggcccca

SEQ ID NO: 166601 - DNA, 20 bp, Artificial Sequence
  Description of Artificial Sequence: Synthetic oligonucleotide
ctcaccgcagccgggcccca

SEQ ID NO: 166602 - DNA, 20 bp, Artificial Sequence
  Description of Artificial Sequence: Synthetic oligonucleotide
tcaccgcagccgggccccac

SEQ ID NO: 166603 - DNA, 20 bp, Artificial Sequence
  Description of Artificial Sequence: Synthetic oligonucleotide
caccgcagccgggccccact

SEQ ID NO: 166604 - DNA, 20 bp, Artificial Sequence
  Description of Artificial Sequence: Synthetic oligonucleotide
accgcagccgggccccacgt

SEQ ID NO: 166605 - DNA, 20 bp, Artificial Sequence
  Description of Artificial Sequence: Synthetic oligonucleotide
ccgcagccgggccccacgtt

SEQ ID NO: 166606 - DNA, 20 bp, Artificial Sequence
  Description of Artificial Sequence: Synthetic oligonucleotide
cgcagccgggccccacggtt

SEQ ID NO: 166607 - DNA, 21 bp, Artificial Sequence
  Description of Artificial Sequence: Synthetic oligonucleotide
gcagccgggccccacggttca

SEQ ID NO: 166608 - DNA, 29 bp, Artificial Sequence
  Description of Artificial Sequence: Synthetic oligonucleotide
tcctgtagctcctggagctcctatgacac

SEQ ID NO: 166609 - DNA, 28 bp, Artificial Sequence
  Description of Artificial Sequence: Synthetic oligonucleotide
cctgtagctcctggagctcctatgacac

SEQ ID NO: 166610 - DNA, 28 bp, Artificial Sequence
  Description of Artificial Sequence: Synthetic oligonucleotide
ctgtagctcctggagctcctatgacacc

SEQ ID NO: 166611 - DNA, 30 bp, Artificial Sequence
  Description of Artificial Sequence: Synthetic oligonucleotide
tgtagctcctggagctcctatgacacctac

SEQ ID NO: 166612 - DNA, 29 bp, Artificial Sequence
  Description of Artificial Sequence: Synthetic oligonucleotide
gtagctcctggagctcctatgacacctac

SEQ ID NO: 166613 - DNA, 29 bp, Artificial Sequence
  Description of Artificial Sequence: Synthetic oligonucleotide
tagctcctggagctcctatgacacctacc

SEQ ID NO: 166614 - DNA, 28 bp, Artificial Sequence
  Description of Artificial Sequence: Synthetic oligonucleotide
agctcctggagctcctatgacacctacc

SEQ ID NO: 166615 - DNA, 27 bp, Artificial Sequence
  Description of Artificial Sequence: Synthetic oligonucleotide
gctcctggagctcctatgacacctacc

SEQ ID NO: 166616 - DNA, 29 bp, Artificial Sequence
  Description of Artificial Sequence: Synthetic oligonucleotide
ctcctggagctcctatgacacctaccatc

SEQ ID NO: 166617 - DNA, 30 bp, Artificial Sequence
  Description of Artificial Sequence: Synthetic oligonucleotide
tcctggagctcctatgacacctaccatctg

SEQ ID NO: 166618 - DNA, 29 bp, Artificial Sequence
  Description of Artificial Sequence: Synthetic oligonucleotide
cctggagctcctatgacacctaccatctg

SEQ ID NO: 166619 - DNA, 30 bp, Artificial Sequence
  Description of Artificial Sequence: Synthetic oligonucleotide
ctggagctcctatgacacctaccatctgtc

SEQ ID NO: 166620 - DNA, 30 bp, Artificial Sequence
  Description of Artificial Sequence: Synthetic oligonucleotide
tggagctcctatgacacctaccatctgtcc

SEQ ID NO: 166621 - DNA, 29 bp, Artificial Sequence
  Description of Artificial Sequence: Synthetic oligonucleotide
ggagctcctatgacacctaccatctgtcc

SEQ ID NO: 166622 - DNA, 30 bp, Artificial Sequence
  Description of Artificial Sequence: Synthetic oligonucleotide
gagctcctatgacacctaccatctgtccag

SEQ ID NO: 166623 - DNA, 30 bp, Artificial Sequence
  Description of Artificial Sequence: Synthetic oligonucleotide
agctcctatgacacctaccatctgtccagg

SEQ ID NO: 166624 - DNA, 29 bp, Artificial Sequence
  Description of Artificial Sequence: Synthetic oligonucleotide
gctcctatgacacctaccatctgtccagg

SEQ ID NO: 166625 - DNA, 29 bp, Artificial Sequence
  Description of Artificial Sequence: Synthetic oligonucleotide
ctcctatgacacctaccatctgtccaggg

SEQ ID NO: 166626 - DNA, 31 bp, Artificial Sequence
  Description of Artificial Sequence: Synthetic oligonucleotide
tcctatgacacctaccatctgtccagggaag

SEQ ID NO: 166627 - DNA, 30 bp, Artificial Sequence
  Description of Artificial Sequence: Synthetic oligonucleotide
cctatgacacctaccatctgtccagggaag

SEQ ID NO: 166628 - DNA, 30 bp, Artificial Sequence
  Description of Artificial Sequence: Synthetic oligonucleotide
ctatgacacctaccatctgtccagggaagg

SEQ ID NO: 166629 - DNA, 30 bp, Artificial Sequence
  Description of Artificial Sequence: Synthetic oligonucleotide
tatgacacctaccatctgtccagggaaggg

SEQ ID NO: 166630 - DNA, 29 bp, Artificial Sequence
  Description of Artificial Sequence: Synthetic oligonucleotide
atgacacctaccatctgtccagggaaggg

SEQ ID NO: 166631 - DNA, 28 bp, Artificial Sequence
  Description of Artificial Sequence: Synthetic oligonucleotide
tgacacctaccatctgtccagggaaggg

SEQ ID NO: 166632 - DNA, 27 bp, Artificial Sequence
  Description of Artificial Sequence: Synthetic oligonucleotide
gacacctaccatctgtccagggaaggg

SEQ ID NO: 166633 - DNA, 27 bp, Artificial Sequence
  Description of Artificial Sequence: Synthetic oligonucleotide
acacctaccatctgtccagggaagggg

SEQ ID NO: 166634 - DNA, 27 bp, Artificial Sequence
  Description of Artificial Sequence: Synthetic oligonucleotide
cacctaccatctgtccagggaagggga

SEQ ID NO: 166635 - DNA, 27 bp, Artificial Sequence
  Description of Artificial Sequence: Synthetic oligonucleotide
acctaccatctgtccagggaaggggag

SEQ ID NO: 166636 - DNA, 26 bp, Artificial Sequence
  Description of Artificial Sequence: Synthetic oligonucleotide
cctaccatctgtccagggaaggggag

SEQ ID NO: 166637 - DNA, 25 bp, Artificial Sequence
  Description of Artificial Sequence: Synthetic oligonucleotide
ccacactccctcactgggtggtcga

SEQ ID NO: 166638 - DNA, 26 bp, Artificial Sequence
  Description of Artificial Sequence: Synthetic oligonucleotide
cacactccctcactgggtggtcgaca

SEQ ID NO: 166639 - DNA, 26 bp, Artificial Sequence
  Description of Artificial Sequence: Synthetic oligonucleotide
acactccctcactgggtggtcgacac

SEQ ID NO: 166640 - DNA, 25 bp, Artificial Sequence
  Description of Artificial Sequence: Synthetic oligonucleotide
cactccctcactgggtggtcgacac

SEQ ID NO: 166641 - DNA, 25 bp, Artificial Sequence
  Description of Artificial Sequence: Synthetic oligonucleotide
actccctcactgggtggtcgacacc

SEQ ID NO: 166642 - DNA, 24 bp, Artificial Sequence
  Description of Artificial Sequence: Synthetic oligonucleotide
ctccctcactgggtggtcgacacc

SEQ ID NO: 166643 - DNA, 25 bp, Artificial Sequence
  Description of Artificial Sequence: Synthetic oligonucleotide
tccctcactgggtggtcgacaccca

SEQ ID NO: 166644 - DNA, 24 bp, Artificial Sequence
  Description of Artificial Sequence: Synthetic oligonucleotide
ccctcactgggtggtcgacaccca

SEQ ID NO: 166645 - DNA, 24 bp, Artificial Sequence
  Description of Artificial Sequence: Synthetic oligonucleotide
cctcactgggtggtcgacacccag

SEQ ID NO: 166646 - DNA, 26 bp, Artificial Sequence
  Description of Artificial Sequence: Synthetic oligonucleotide
ctcactgggtggtcgacacccagcaa

SEQ ID NO: 166647 - DNA, 26 bp, Artificial Sequence
  Description of Artificial Sequence: Synthetic oligonucleotide
tcactgggtggtcgacacccagcaac

SEQ ID NO: 166648 - DNA, 25 bp, Artificial Sequence
  Description of Artificial Sequence: Synthetic oligonucleotide
cactgggtggtcgacacccagcaac

SEQ ID NO: 166649 - DNA, 25 bp, Artificial Sequence
  Description of Artificial Sequence: Synthetic oligonucleotide
actgggtggtcgacacccagcaacc

SEQ ID NO: 166650 - DNA, 24 bp, Artificial Sequence
  Description of Artificial Sequence: Synthetic oligonucleotide
ctgggtggtcgacacccagcaacc

SEQ ID NO: 166651 - DNA, 24 bp, Artificial Sequence
  Description of Artificial Sequence: Synthetic oligonucleotide
tgggtggtcgacacccagcaaccc

SEQ ID NO: 166652 - DNA, 23 bp, Artificial Sequence
  Description of Artificial Sequence: Synthetic oligonucleotide
gggtggtcgacacccagcaaccc

SEQ ID NO: 166653 - DNA, 23 bp, Artificial Sequence
  Description of Artificial Sequence: Synthetic oligonucleotide
ggtggtcgacacccagcaacccc

SEQ ID NO: 166654 - DNA, 24 bp, Artificial Sequence
  Description of Artificial Sequence: Synthetic oligonucleotide
gtggtcgacacccagcaaccccct

SEQ ID NO: 166655 - DNA, 24 bp, Artificial Sequence
  Description of Artificial Sequence: Synthetic oligonucleotide
tggtcgacacccagcaaccccctg

SEQ ID NO: 166656 - DNA, 23 bp, Artificial Sequence
  Description of Artificial Sequence: Synthetic oligonucleotide
ggtcgacacccagcaaccccctg

SEQ ID NO: 166657 - DNA, 24 bp, Artificial Sequence
  Description of Artificial Sequence: Synthetic oligonucleotide
gtcgacacccagcaaccccctggt

SEQ ID NO: 166658 - DNA, 26 bp, Artificial Sequence
  Description of Artificial Sequence: Synthetic oligonucleotide
tcgacacccagcaaccccctggtgat

SEQ ID NO: 166659 - DNA, 25 bp, Artificial Sequence
  Description of Artificial Sequence: Synthetic oligonucleotide
cgacacccagcaaccccctggtgat

SEQ ID NO: 166660 - DNA, 27 bp, Artificial Sequence
  Description of Artificial Sequence: Synthetic oligonucleotide
gacacccagcaaccccctggtgatcat

SEQ ID NO: 166661 - DNA, 27 bp, Artificial Sequence
  Description of Artificial Sequence: Synthetic oligonucleotide
acacccagcaaccccctggtgatcatg

SEQ ID NO: 166662 - DNA, 32 bp, Artificial Sequence
  Description of Artificial Sequence: Synthetic oligonucleotide
actctgatgaacaagaccctcaggaggtgatg

SEQ ID NO: 166663 - DNA, 31 bp, Artificial Sequence
  Description of Artificial Sequence: Synthetic oligonucleotide
ctctgatgaacaagaccctcaggaggtgatg

SEQ ID NO: 166664 - DNA, 33 bp, Artificial Sequence
  Description of Artificial Sequence: Synthetic oligonucleotide
tctgatgaacaagaccctcaggaggtgatgtac

SEQ ID NO: 166665 - DNA, 32 bp, Artificial Sequence
  Description of Artificial Sequence: Synthetic oligonucleotide
ctgatgaacaagaccctcaggaggtgatgtac

SEQ ID NO: 166666 - DNA, 32 bp, Artificial Sequence
  Description of Artificial Sequence: Synthetic oligonucleotide
tgatgaacaagaccctcaggaggtgatgtacg

SEQ ID NO: 166667 - DNA, 31 bp, Artificial Sequence
  Description of Artificial Sequence: Synthetic oligonucleotide
gatgaacaagaccctcaggaggtgatgtacg

SEQ ID NO: 166668 - DNA, 31 bp, Artificial Sequence
  Description of Artificial Sequence: Synthetic oligonucleotide
atgaacaagaccctcaggaggtgatgtacgc

SEQ ID NO: 166669 - DNA, 30 bp, Artificial Sequence
  Description of Artificial Sequence: Synthetic oligonucleotide
tgaacaagaccctcaggaggtgatgtacgc

SEQ ID NO: 166670 - DNA, 29 bp, Artificial Sequence
  Description of Artificial Sequence: Synthetic oligonucleotide
gaacaagaccctcaggaggtgatgtacgc

SEQ ID NO: 166671 - DNA, 30 bp, Artificial Sequence
  Description of Artificial Sequence: Synthetic oligonucleotide
aacaagaccctcaggaggtgatgtacgcac

SEQ ID NO: 166672 - DNA, 29 bp, Artificial Sequence
  Description of Artificial Sequence: Synthetic oligonucleotide
acaagaccctcaggaggtgatgtacgcac

SEQ ID NO: 166673 - DNA, 28 bp, Artificial Sequence
  Description of Artificial Sequence: Synthetic oligonucleotide
caagaccctcaggaggtgatgtacgcac

SEQ ID NO: 166674 - DNA, 29 bp, Artificial Sequence
  Description of Artificial Sequence: Synthetic oligonucleotide
aagaccctcaggaggtgatgtacgcacag

SEQ ID NO: 166675 - DNA, 28 bp, Artificial Sequence
  Description of Artificial Sequence: Synthetic oligonucleotide
agaccctcaggaggtgatgtacgcacag

SEQ ID NO: 166676 - DNA, 27 bp, Artificial Sequence
  Description of Artificial Sequence: Synthetic oligonucleotide
gaccctcaggaggtgatgtacgcacag

SEQ ID NO: 166677 - DNA, 29 bp, Artificial Sequence
  Description of Artificial Sequence: Synthetic oligonucleotide
accctcaggaggtgatgtacgcacagttg

SEQ ID NO: 166678 - DNA, 28 bp, Artificial Sequence
  Description of Artificial Sequence: Synthetic oligonucleotide
ccctcaggaggtgatgtacgcacagttg

SEQ ID NO: 166679 - DNA, 28 bp, Artificial Sequence
  Description of Artificial Sequence: Synthetic oligonucleotide
cctcaggaggtgatgtacgcacagttgg

SEQ ID NO: 166680 - DNA, 30 bp, Artificial Sequence
  Description of Artificial Sequence: Synthetic oligonucleotide
ctcaggaggtgatgtacgcacagttggatc

SEQ ID NO: 166681 - DNA, 31 bp, Artificial Sequence
  Description of Artificial Sequence: Synthetic oligonucleotide
tcaggaggtgatgtacgcacagttggatcac

SEQ ID NO: 166682 - DNA, 30 bp, Artificial Sequence
  Description of Artificial Sequence: Synthetic oligonucleotide
caggaggtgatgtacgcacagttggatcac

SEQ ID NO: 166683 - DNA, 31 bp, Artificial Sequence
  Description of Artificial Sequence: Synthetic oligonucleotide
aggaggtgatgtacgcacagttggatcactg

SEQ ID NO: 166684 - DNA, 30 bp, Artificial Sequence
  Description of Artificial Sequence: Synthetic oligonucleotide
ggaggtgatgtacgcacagttggatcactg

SEQ ID NO: 166685 - DNA, 30 bp, Artificial Sequence
  Description of Artificial Sequence: Synthetic oligonucleotide
gaggtgatgtacgcacagttggatcactgc

SEQ ID NO: 166686 - DNA, 30 bp, Artificial Sequence
  Description of Artificial Sequence: Synthetic oligonucleotide
aggtgatgtacgcacagttggatcactgcg

SEQ ID NO: 166687 - DNA, 29 bp, Artificial Sequence
  Description of Artificial Sequence: Synthetic oligonucleotide
ggtgatgtacgcacagttggatcactgcg

SEQ ID NO: 166688 - DNA, 33 bp, Artificial Sequence
  Description of Artificial Sequence: Synthetic oligonucleotide
gtgatgtacgcacagttggatcactgcgttttc

SEQ ID NO: 166689 - DNA, 36 bp, Artificial Sequence
  Description of Artificial Sequence: Synthetic oligonucleotide
tgatgtacgcacagttggatcactgcgttttcatac

SEQ ID NO: 166690 - DNA, 35 bp, Artificial Sequence
  Description of Artificial Sequence: Synthetic oligonucleotide
gatgtacgcacagttggatcactgcgttttcatac

SEQ ID NO: 166691 - DNA, 36 bp, Artificial Sequence
  Description of Artificial Sequence: Synthetic oligonucleotide
atgtacgcacagttggatcactgcgttttcatacag

SEQ ID NO: 166692 - DNA, 35 bp, Artificial Sequence
  Description of Artificial Sequence: Synthetic oligonucleotide
tgtacgcacagttggatcactgcgttttcatacag

SEQ ID NO: 166693 - DNA, 24 bp, Artificial Sequence
  Description of Artificial Sequence: Synthetic oligonucleotide
cggcccagcactgtggtgcctcaa

SEQ ID NO: 166694 - DNA, 24 bp, Artificial Sequence
  Description of Artificial Sequence: Synthetic oligonucleotide
ggcccagcactgtggtgcctcaag

SEQ ID NO: 166695 - DNA, 25 bp, Artificial Sequence
  Description of Artificial Sequence: Synthetic oligonucleotide
gcccagcactgtggtgcctcaagga

SEQ ID NO: 166696 - DNA, 25 bp, Artificial Sequence
  Description of Artificial Sequence: Synthetic oligonucleotide
cccagcactgtggtgcctcaaggag

SEQ ID NO: 166697 - DNA, 26 bp, Artificial Sequence
  Description of Artificial Sequence: Synthetic oligonucleotide
ccagcactgtggtgcctcaaggagga

SEQ ID NO: 166698 - DNA, 27 bp, Artificial Sequence
  Description of Artificial Sequence: Synthetic oligonucleotide
cagcactgtggtgcctcaaggaggaca

SEQ ID NO: 166699 - DNA, 27 bp, Artificial Sequence
  Description of Artificial Sequence: Synthetic oligonucleotide
agcactgtggtgcctcaaggaggacac

SEQ ID NO: 166700 - DNA, 26 bp, Artificial Sequence
  Description of Artificial Sequence: Synthetic oligonucleotide
gcactgtggtgcctcaaggaggacac

SEQ ID NO: 166701 - DNA, 27 bp, Artificial Sequence
  Description of Artificial Sequence: Synthetic oligonucleotide
cactgtggtgcctcaaggaggacacgt

SEQ ID NO: 166702 - DNA, 27 bp, Artificial Sequence
  Description of Artificial Sequence: Synthetic oligonucleotide
actgtggtgcctcaaggaggacacgtg

SEQ ID NO: 166703 - DNA, 26 bp, Artificial Sequence
  Description of Artificial Sequence: Synthetic oligonucleotide
ctgtggtgcctcaaggaggacacgtg

SEQ ID NO: 166704 - DNA, 26 bp, Artificial Sequence
  Description of Artificial Sequence: Synthetic oligonucleotide
tgtggtgcctcaaggaggacacgtgg

SEQ ID NO: 166705 - DNA, 25 bp, Artificial Sequence
  Description of Artificial Sequence: Synthetic oligonucleotide
gtggtgcctcaaggaggacacgtgg

SEQ ID NO: 166706 - DNA, 26 bp, Artificial Sequence
  Description of Artificial Sequence: Synthetic oligonucleotide
tggtgcctcaaggaggacacgtggct

SEQ ID NO: 166707 - DNA, 25 bp, Artificial Sequence
  Description of Artificial Sequence: Synthetic oligonucleotide
ggtgcctcaaggaggacacgtggct

SEQ ID NO: 166708 - DNA, 27 bp, Artificial Sequence
  Description of Artificial Sequence: Synthetic oligonucleotide
gtgcctcaaggaggacacgtggctctt

SEQ ID NO: 166709 - DNA, 27 bp, Artificial Sequence
  Description of Artificial Sequence: Synthetic oligonucleotide
tgcctcaaggaggacacgtggctcttc

SEQ ID NO: 166710 - DNA, 27 bp, Artificial Sequence
  Description of Artificial Sequence: Synthetic oligonucleotide
gcctcaaggaggacacgtggctcttca

SEQ ID NO: 166711 - DNA, 27 bp, Artificial Sequence
  Description of Artificial Sequence: Synthetic oligonucleotide
cctcaaggaggacacgtggctcttcag

SEQ ID NO: 166712 - DNA, 28 bp, Artificial Sequence
  Description of Artificial Sequence: Synthetic oligonucleotide
ctcaaggaggacacgtggctcttcagtg

SEQ ID NO: 166713 - DNA, 29 bp, Artificial Sequence
  Description of Artificial Sequence: Synthetic oligonucleotide
tcaaggaggacacgtggctcttcagtgtc

SEQ ID NO: 166714 - DNA, 28 bp, Artificial Sequence
  Description of Artificial Sequence: Synthetic oligonucleotide
caaggaggacacgtggctcttcagtgtc

SEQ ID NO: 166715 - DNA, 29 bp, Artificial Sequence
  Description of Artificial Sequence: Synthetic oligonucleotide
aaggaggacacgtggctcttcagtgtcac

SEQ ID NO: 166716 - DNA, 23 bp, Artificial Sequence
  Description of Artificial Sequence: Synthetic oligonucleotide
ttccctcctggcccacccaggga

SEQ ID NO: 166717 - DNA, 22 bp, Artificial Sequence
  Description of Artificial Sequence: Synthetic oligonucleotide
tccctcctggcccacccaggga

SEQ ID NO: 166718 - DNA, 21 bp, Artificial Sequence
  Description of Artificial Sequence: Synthetic oligonucleotide
ccctcctggcccacccaggga

SEQ ID NO: 166719 - DNA, 21 bp, Artificial Sequence
  Description of Artificial Sequence: Synthetic oligonucleotide
cctcctggcccacccagggac

SEQ ID NO: 166720 - DNA, 21 bp, Artificial Sequence
  Description of Artificial Sequence: Synthetic oligonucleotide
ctcctggcccacccagggacc

SEQ ID NO: 166721 - DNA, 22 bp, Artificial Sequence
  Description of Artificial Sequence: Synthetic oligonucleotide
tcctggcccacccagggaccct

SEQ ID NO: 166722 - DNA, 21 bp, Artificial Sequence
  Description of Artificial Sequence: Synthetic oligonucleotide
cctggcccacccagggaccct

SEQ ID NO: 166723 - DNA, 21 bp, Artificial Sequence
  Description of Artificial Sequence: Synthetic oligonucleotide
ctggcccacccagggaccctg

SEQ ID NO: 166724 - DNA, 22 bp, Artificial Sequence
  Description of Artificial Sequence: Synthetic oligonucleotide
tggcccacccagggaccctgct

SEQ ID NO: 166725 - DNA, 21 bp, Artificial Sequence
  Description of Artificial Sequence: Synthetic oligonucleotide
ggcccacccagggaccctgct

SEQ ID NO: 166726 - DNA, 25 bp, Artificial Sequence
  Description of Artificial Sequence: Synthetic oligonucleotide
gcccacccagggaccctgctgaaat

SEQ ID NO: 166727 - DNA, 26 bp, Artificial Sequence
  Description of Artificial Sequence: Synthetic oligonucleotide
cccacccagggaccctgctgaaatca

SEQ ID NO: 166728 - DNA, 26 bp, Artificial Sequence
  Description of Artificial Sequence: Synthetic oligonucleotide
ccacccagggaccctgctgaaatcag

SEQ ID NO: 166729 - DNA, 27 bp, Artificial Sequence
  Description of Artificial Sequence: Synthetic oligonucleotide
cacccagggaccctgctgaaatcagga

SEQ ID NO: 166730 - DNA, 27 bp, Artificial Sequence
  Description of Artificial Sequence: Synthetic oligonucleotide
acccagggaccctgctgaaatcaggag

SEQ ID NO: 166731 - DNA, 27 bp, Artificial Sequence
  Description of Artificial Sequence: Synthetic oligonucleotide
cccagggaccctgctgaaatcaggaga

SEQ ID NO: 166732 - DNA, 27 bp, Artificial Sequence
  Description of Artificial Sequence: Synthetic oligonucleotide
ccagggaccctgctgaaatcaggagag

SEQ ID NO: 166733 - DNA, 28 bp, Artificial Sequence
  Description of Artificial Sequence: Synthetic oligonucleotide
cagggaccctgctgaaatcaggagagac

SEQ ID NO: 166734 - DNA, 29 bp, Artificial Sequence
  Description of Artificial Sequence: Synthetic oligonucleotide
agggaccctgctgaaatcaggagagacag

SEQ ID NO: 166735 - DNA, 28 bp, Artificial Sequence
  Description of Artificial Sequence: Synthetic oligonucleotide
gggaccctgctgaaatcaggagagacag

SEQ ID NO: 166736 - DNA, 29 bp, Artificial Sequence
  Description of Artificial Sequence: Synthetic oligonucleotide
ggaccctgctgaaatcaggagagacagtc

SEQ ID NO: 166737 - DNA, 31 bp, Artificial Sequence
  Description of Artificial Sequence: Synthetic oligonucleotide
gaccctgctgaaatcaggagagacagtcatc

SEQ ID NO: 166738 - DNA, 31 bp, Artificial Sequence
  Description of Artificial Sequence: Synthetic oligonucleotide
accctgctgaaatcaggagagacagtcatcc

SEQ ID NO: 166739 - DNA, 27 bp, Artificial Sequence
  Description of Artificial Sequence: Synthetic oligonucleotide
cccaagacacccccaacagataccagc

SEQ ID NO: 166740 - DNA, 27 bp, Artificial Sequence
  Description of Artificial Sequence: Synthetic oligonucleotide
ccaagacacccccaacagataccagcg

SEQ ID NO: 166741 - DNA, 28 bp, Artificial Sequence
  Description of Artificial Sequence: Synthetic oligonucleotide
caagacacccccaacagataccagcgtg

SEQ ID NO: 166742 - DNA, 30 bp, Artificial Sequence
  Description of Artificial Sequence: Synthetic oligonucleotide
aagacacccccaacagataccagcgtgtac

SEQ ID NO: 166743 - DNA, 29 bp, Artificial Sequence
  Description of Artificial Sequence: Synthetic oligonucleotide
agacacccccaacagataccagcgtgtac

SEQ ID NO: 166744 - DNA, 28 bp, Artificial Sequence
  Description of Artificial Sequence: Synthetic oligonucleotide
gacacccccaacagataccagcgtgtac

SEQ ID NO: 166745 - DNA, 29 bp, Artificial Sequence
  Description of Artificial Sequence: Synthetic oligonucleotide
acacccccaacagataccagcgtgtacac

SEQ ID NO: 166746 - DNA, 28 bp, Artificial Sequence
  Description of Artificial Sequence: Synthetic oligonucleotide
cacccccaacagataccagcgtgtacac

SEQ ID NO: 166747 - DNA, 28 bp, Artificial Sequence
  Description of Artificial Sequence: Synthetic oligonucleotide
acccccaacagataccagcgtgtacacg

SEQ ID NO: 166748 - DNA, 27 bp, Artificial Sequence
  Description of Artificial Sequence: Synthetic oligonucleotide
cccccaacagataccagcgtgtacacg

SEQ ID NO: 166749 - DNA, 27 bp, Artificial Sequence
  Description of Artificial Sequence: Synthetic oligonucleotide
ccccaacagataccagcgtgtacacgg

SEQ ID NO: 166750 - DNA, 29 bp, Artificial Sequence
  Description of Artificial Sequence: Synthetic oligonucleotide
cccaacagataccagcgtgtacacggaac

SEQ ID NO: 166751 - DNA, 31 bp, Artificial Sequence
  Description of Artificial Sequence: Synthetic oligonucleotide
ccaacagataccagcgtgtacacggaacttc

SEQ ID NO: 166752 - DNA, 31 bp, Artificial Sequence
  Description of Artificial Sequence: Synthetic oligonucleotide
caacagataccagcgtgtacacggaacttcc

SEQ ID NO: 166753 - DNA, 30 bp, Artificial Sequence
  Description of Artificial Sequence: Synthetic oligonucleotide
gacctacagatgcttcggctctttccatgc

SEQ ID NO: 166754 - DNA, 30 bp, Artificial Sequence
  Description of Artificial Sequence: Synthetic oligonucleotide
acctacagatgcttcggctctttccatgcc

SEQ ID NO: 166755 - DNA, 29 bp, Artificial Sequence
  Description of Artificial Sequence: Synthetic oligonucleotide
cctacagatgcttcggctctttccatgcc

SEQ ID NO: 166756 - DNA, 29 bp, Artificial Sequence
  Description of Artificial Sequence: Synthetic oligonucleotide
ctacagatgcttcggctctttccatgccc

SEQ ID NO: 166757 - DNA, 30 bp, Artificial Sequence
  Description of Artificial Sequence: Synthetic oligonucleotide
tacagatgcttcggctctttccatgccctg

SEQ ID NO: 166758 - DNA, 29 bp, Artificial Sequence
  Description of Artificial Sequence: Synthetic oligonucleotide
acagatgcttcggctctttccatgccctg

SEQ ID NO: 166759 - DNA, 28 bp, Artificial Sequence
  Description of Artificial Sequence: Synthetic oligonucleotide
cagatgcttcggctctttccatgccctg

SEQ ID NO: 166760 - DNA, 28 bp, Artificial Sequence
  Description of Artificial Sequence: Synthetic oligonucleotide
agatgcttcggctctttccatgccctgc

SEQ ID NO: 166761 - DNA, 27 bp, Artificial Sequence
  Description of Artificial Sequence: Synthetic oligonucleotide
gatgcttcggctctttccatgccctgc

SEQ ID NO: 166762 - DNA, 27 bp, Artificial Sequence
  Description of Artificial Sequence: Synthetic oligonucleotide
atgcttcggctctttccatgccctgcc

SEQ ID NO: 166763 - DNA, 26 bp, Artificial Sequence
  Description of Artificial Sequence: Synthetic oligonucleotide
tgcttcggctctttccatgccctgcc

SEQ ID NO: 166764 - DNA, 25 bp, Artificial Sequence
  Description of Artificial Sequence: Synthetic oligonucleotide
gcttcggctctttccatgccctgcc

SEQ ID NO: 166765 - DNA, 26 bp, Artificial Sequence
  Description of Artificial Sequence: Synthetic oligonucleotide
cttcggctctttccatgccctgccct

SEQ ID NO: 166766 - DNA, 26 bp, Artificial Sequence
  Description of Artificial Sequence: Synthetic oligonucleotide
ttcggctctttccatgccctgccctg

SEQ ID NO: 166767 - DNA, 25 bp, Artificial Sequence
  Description of Artificial Sequence: Synthetic oligonucleotide
tcggctctttccatgccctgccctg

SEQ ID NO: 166768 - DNA, 24 bp, Artificial Sequence
  Description of Artificial Sequence: Synthetic oligonucleotide
cggctctttccatgccctgccctg

SEQ ID NO: 166769 - DNA, 24 bp, Artificial Sequence
  Description of Artificial Sequence: Synthetic oligonucleotide
ggctctttccatgccctgccctgc

SEQ ID NO: 166770 - DNA, 25 bp, Artificial Sequence
  Description of Artificial Sequence: Synthetic oligonucleotide
gctctttccatgccctgccctgcgt

SEQ ID NO: 166771 - DNA, 26 bp, Artificial Sequence
  Description of Artificial Sequence: Synthetic oligonucleotide
ctctttccatgccctgccctgcgtgt

SEQ ID NO: 166772 - DNA, 26 bp, Artificial Sequence
  Description of Artificial Sequence: Synthetic oligonucleotide
tctttccatgccctgccctgcgtgtg

SEQ ID NO: 166773 - DNA, 25 bp, Artificial Sequence
  Description of Artificial Sequence: Synthetic oligonucleotide
ctttccatgccctgccctgcgtgtg

SEQ ID NO: 166774 - DNA, 26 bp, Artificial Sequence
  Description of Artificial Sequence: Synthetic oligonucleotide
tttccatgccctgccctgcgtgtggt

SEQ ID NO: 166775 - DNA, 25 bp, Artificial Sequence
  Description of Artificial Sequence: Synthetic oligonucleotide
ttccatgccctgccctgcgtgtggt

SEQ ID NO: 166776 - DNA, 24 bp, Artificial Sequence
  Description of Artificial Sequence: Synthetic oligonucleotide
tccatgccctgccctgcgtgtggt

SEQ ID NO: 166777 - DNA, 23 bp, Artificial Sequence
  Description of Artificial Sequence: Synthetic oligonucleotide
ccatgccctgccctgcgtgtggt

SEQ ID NO: 166778 - DNA, 26 bp, Artificial Sequence
  Description of Artificial Sequence: Synthetic oligonucleotide
catgccctgccctgcgtgtggtcaaa

SEQ ID NO: 166779 - DNA, 27 bp, Artificial Sequence
  Description of Artificial Sequence: Synthetic oligonucleotide
atgccctgccctgcgtgtggtcaaact

SEQ ID NO: 166780 - DNA, 26 bp, Artificial Sequence
  Description of Artificial Sequence: Synthetic oligonucleotide
ctgtggtgcctcgaggaggacatgtg

SEQ ID NO: 166781 - DNA, 26 bp, Artificial Sequence
  Description of Artificial Sequence: Synthetic oligonucleotide
tgtggtgcctcgaggaggacatgtgg

SEQ ID NO: 166782 - DNA, 25 bp, Artificial Sequence
  Description of Artificial Sequence: Synthetic oligonucleotide
gtggtgcctcgaggaggacatgtgg

SEQ ID NO: 166783 - DNA, 26 bp, Artificial Sequence
  Description of Artificial Sequence: Synthetic oligonucleotide
tggtgcctcgaggaggacatgtggct

SEQ ID NO: 166784 - DNA, 25 bp, Artificial Sequence
  Description of Artificial Sequence: Synthetic oligonucleotide
ggtgcctcgaggaggacatgtggct

SEQ ID NO: 166785 - DNA, 27 bp, Artificial Sequence
  Description of Artificial Sequence: Synthetic oligonucleotide
gtgcctcgaggaggacatgtggctctt

SEQ ID NO: 166786 - DNA, 27 bp, Artificial Sequence
  Description of Artificial Sequence: Synthetic oligonucleotide
tgcctcgaggaggacatgtggctcttc

SEQ ID NO: 166787 - DNA, 27 bp, Artificial Sequence
  Description of Artificial Sequence: Synthetic oligonucleotide
gcctcgaggaggacatgtggctcttca

SEQ ID NO: 166788 - DNA, 27 bp, Artificial Sequence
  Description of Artificial Sequence: Synthetic oligonucleotide
cctcgaggaggacatgtggctcttcag

SEQ ID NO: 166789 - DNA, 28 bp, Artificial Sequence
  Description of Artificial Sequence: Synthetic oligonucleotide
ctcgaggaggacatgtggctcttcagtg

SEQ ID NO: 166790 - DNA, 29 bp, Artificial Sequence
  Description of Artificial Sequence: Synthetic oligonucleotide
tcgaggaggacatgtggctcttcagtgtc

SEQ ID NO: 166791 - DNA, 28 bp, Artificial Sequence
  Description of Artificial Sequence: Synthetic oligonucleotide
cgaggaggacatgtggctcttcagtgtc

SEQ ID NO: 166792 - DNA, 29 bp, Artificial Sequence
  Description of Artificial Sequence: Synthetic oligonucleotide
gaggaggacatgtggctcttcagtgtcac

SEQ ID NO: 166793 - DNA, 32 bp, Artificial Sequence
  Description of Artificial Sequence: Synthetic oligonucleotide
aggaggacatgtggctcttcagtgtcactatc

SEQ ID NO: 166794 - DNA, 31 bp, Artificial Sequence
  Description of Artificial Sequence: Synthetic oligonucleotide
ggaggacatgtggctcttcagtgtcactatc

SEQ ID NO: 166795 - DNA, 31 bp, Artificial Sequence
  Description of Artificial Sequence: Synthetic oligonucleotide
gaggacatgtggctcttcagtgtcactatcg

SEQ ID NO: 166796 - DNA, 32 bp, Artificial Sequence
  Description of Artificial Sequence: Synthetic oligonucleotide
aggacatgtggctcttcagtgtcactatcgtc

SEQ ID NO: 166797 - DNA, 31 bp, Artificial Sequence
  Description of Artificial Sequence: Synthetic oligonucleotide
ggacatgtggctcttcagtgtcactatcgtc

SEQ ID NO: 166798 - DNA, 31 bp, Artificial Sequence
  Description of Artificial Sequence: Synthetic oligonucleotide
gacatgtggctcttcagtgtcactatcgtcg

SEQ ID NO: 166799 - DNA, 32 bp, Artificial Sequence
  Description of Artificial Sequence: Synthetic oligonucleotide
acatgtggctcttcagtgtcactatcgtcgtg

SEQ ID NO: 166800 - DNA, 31 bp, Artificial Sequence
  Description of Artificial Sequence: Synthetic oligonucleotide
catgtggctcttcagtgtcactatcgtcgtg

SEQ ID NO: 166801 - DNA, 31 bp, Artificial Sequence
  Description of Artificial Sequence: Synthetic oligonucleotide
atgtggctcttcagtgtcactatcgtcgtgg

SEQ ID NO: 166802 - DNA, 30 bp, Artificial Sequence
  Description of Artificial Sequence: Synthetic oligonucleotide
tgtggctcttcagtgtcactatcgtcgtgg

SEQ ID NO: 166803 - DNA, 24 bp, Artificial Sequence
  Description of Artificial Sequence: Synthetic oligonucleotide
ccttcctgtctgcctggcccagca

SEQ ID NO: 166804 - DNA, 25 bp, Artificial Sequence
  Description of Artificial Sequence: Synthetic oligonucleotide
cttcctgtctgcctggcccagcact

SEQ ID NO: 166805 - DNA, 26 bp, Artificial Sequence
  Description of Artificial Sequence: Synthetic oligonucleotide
ttcctgtctgcctggcccagcactgt

SEQ ID NO: 166806 - DNA, 25 bp, Artificial Sequence
  Description of Artificial Sequence: Synthetic oligonucleotide
tcctgtctgcctggcccagcactgt

SEQ ID NO: 166807 - DNA, 24 bp, Artificial Sequence
  Description of Artificial Sequence: Synthetic oligonucleotide
cctgtctgcctggcccagcactgt

SEQ ID NO: 166808 - DNA, 30 bp, Artificial Sequence
  Description of Artificial Sequence: Synthetic oligonucleotide
ggacctacagatgcttcggctctttctgtg

SEQ ID NO: 166809 - DNA, 30 bp, Artificial Sequence
  Description of Artificial Sequence: Synthetic oligonucleotide
gacctacagatgcttcggctctttctgtgc

SEQ ID NO: 166810 - DNA, 30 bp, Artificial Sequence
  Description of Artificial Sequence: Synthetic oligonucleotide
acctacagatgcttcggctctttctgtgcc

SEQ ID NO: 166811 - DNA, 29 bp, Artificial Sequence
  Description of Artificial Sequence: Synthetic oligonucleotide
cctacagatgcttcggctctttctgtgcc

SEQ ID NO: 166812 - DNA, 29 bp, Artificial Sequence
  Description of Artificial Sequence: Synthetic oligonucleotide
ctacagatgcttcggctctttctgtgccc

SEQ ID NO: 166813 - DNA, 30 bp, Artificial Sequence
  Description of Artificial Sequence: Synthetic oligonucleotide
tacagatgcttcggctctttctgtgccctg

SEQ ID NO: 166814 - DNA, 29 bp, Artificial Sequence
  Description of Artificial Sequence: Synthetic oligonucleotide
acagatgcttcggctctttctgtgccctg

SEQ ID NO: 166815 - DNA, 28 bp, Artificial Sequence
  Description of Artificial Sequence: Synthetic oligonucleotide
cagatgcttcggctctttctgtgccctg

SEQ ID NO: 166816 - DNA, 28 bp, Artificial Sequence
  Description of Artificial Sequence: Synthetic oligonucleotide
agatgcttcggctctttctgtgccctgc

SEQ ID NO: 166817 - DNA, 27 bp, Artificial Sequence
  Description of Artificial Sequence: Synthetic oligonucleotide
gatgcttcggctctttctgtgccctgc

SEQ ID NO: 166818 - DNA, 27 bp, Artificial Sequence
  Description of Artificial Sequence: Synthetic oligonucleotide
atgcttcggctctttctgtgccctgcc

SEQ ID NO: 166819 - DNA, 26 bp, Artificial Sequence
  Description of Artificial Sequence: Synthetic oligonucleotide
tgcttcggctctttctgtgccctgcc

SEQ ID NO: 166820 - DNA, 25 bp, Artificial Sequence
  Description of Artificial Sequence: Synthetic oligonucleotide
gcttcggctctttctgtgccctgcc

SEQ ID NO: 166821 - DNA, 26 bp, Artificial Sequence
  Description of Artificial Sequence: Synthetic oligonucleotide
cttcggctctttctgtgccctgccct

SEQ ID NO: 166822 - DNA, 26 bp, Artificial Sequence
  Description of Artificial Sequence: Synthetic oligonucleotide
ttcggctctttctgtgccctgccctg

SEQ ID NO: 166823 - DNA, 25 bp, Artificial Sequence
  Description of Artificial Sequence: Synthetic oligonucleotide
tcggctctttctgtgccctgccctg

SEQ ID NO: 166824 - DNA, 24 bp, Artificial Sequence
  Description of Artificial Sequence: Synthetic oligonucleotide
cggctctttctgtgccctgccctg

SEQ ID NO: 166825 - DNA, 24 bp, Artificial Sequence
  Description of Artificial Sequence: Synthetic oligonucleotide
ggctctttctgtgccctgccctgc

SEQ ID NO: 166826 - DNA, 25 bp, Artificial Sequence
  Description of Artificial Sequence: Synthetic oligonucleotide
gctctttctgtgccctgccctgcgt

SEQ ID NO: 166827 - DNA, 26 bp, Artificial Sequence
  Description of Artificial Sequence: Synthetic oligonucleotide
ctctttctgtgccctgccctgcgtgt

SEQ ID NO: 166828 - DNA, 26 bp, Artificial Sequence
  Description of Artificial Sequence: Synthetic oligonucleotide
tctttctgtgccctgccctgcgtgtg

SEQ ID NO: 166829 - DNA, 25 bp, Artificial Sequence
  Description of Artificial Sequence: Synthetic oligonucleotide
ctttctgtgccctgccctgcgtgtg

SEQ ID NO: 166830 - DNA, 26 bp, Artificial Sequence
  Description of Artificial Sequence: Synthetic oligonucleotide
tttctgtgccctgccctgcgtgtggt

SEQ ID NO: 166831 - DNA, 25 bp, Artificial Sequence
  Description of Artificial Sequence: Synthetic oligonucleotide
ttctgtgccctgccctgcgtgtggt

SEQ ID NO: 166832 - DNA, 24 bp, Artificial Sequence
  Description of Artificial Sequence: Synthetic oligonucleotide
tctgtgccctgccctgcgtgtggt

SEQ ID NO: 166833 - DNA, 23 bp, Artificial Sequence
  Description of Artificial Sequence: Synthetic oligonucleotide
ctgtgccctgccctgcgtgtggt

SEQ ID NO: 166834 - DNA, 26 bp, Artificial Sequence
  Description of Artificial Sequence: Synthetic oligonucleotide
tgtgccctgccctgcgtgtggtcaaa

SEQ ID NO: 166835 - DNA, 29 bp, Artificial Sequence
  Description of Artificial Sequence: Synthetic oligonucleotide
ctacagatgcttcggctctttccgtgacc

SEQ ID NO: 166836 - DNA, 30 bp, Artificial Sequence
  Description of Artificial Sequence: Synthetic oligonucleotide
tacagatgcttcggctctttccgtgacctg

SEQ ID NO: 166837 - DNA, 29 bp, Artificial Sequence
  Description of Artificial Sequence: Synthetic oligonucleotide
acagatgcttcggctctttccgtgacctg

SEQ ID NO: 166838 - DNA, 28 bp, Artificial Sequence
  Description of Artificial Sequence: Synthetic oligonucleotide
cagatgcttcggctctttccgtgacctg

SEQ ID NO: 166839 - DNA, 28 bp, Artificial Sequence
  Description of Artificial Sequence: Synthetic oligonucleotide
agatgcttcggctctttccgtgacctgc

SEQ ID NO: 166840 - DNA, 27 bp, Artificial Sequence
  Description of Artificial Sequence: Synthetic oligonucleotide
gatgcttcggctctttccgtgacctgc

SEQ ID NO: 166841 - DNA, 27 bp, Artificial Sequence
  Description of Artificial Sequence: Synthetic oligonucleotide
atgcttcggctctttccgtgacctgcc

SEQ ID NO: 166842 - DNA, 26 bp, Artificial Sequence
  Description of Artificial Sequence: Synthetic oligonucleotide
tgcttcggctctttccgtgacctgcc

SEQ ID NO: 166843 - DNA, 25 bp, Artificial Sequence
  Description of Artificial Sequence: Synthetic oligonucleotide
gcttcggctctttccgtgacctgcc

SEQ ID NO: 166844 - DNA, 26 bp, Artificial Sequence
  Description of Artificial Sequence: Synthetic oligonucleotide
cttcggctctttccgtgacctgccct

SEQ ID NO: 166845 - DNA, 26 bp, Artificial Sequence
  Description of Artificial Sequence: Synthetic oligonucleotide
ttcggctctttccgtgacctgccctg

SEQ ID NO: 166846 - DNA, 25 bp, Artificial Sequence
  Description of Artificial Sequence: Synthetic oligonucleotide
tcggctctttccgtgacctgccctg

SEQ ID NO: 166847 - DNA, 24 bp, Artificial Sequence
  Description of Artificial Sequence: Synthetic oligonucleotide
cggctctttccgtgacctgccctg

SEQ ID NO: 166848 - DNA, 24 bp, Artificial Sequence
  Description of Artificial Sequence: Synthetic oligonucleotide
ggctctttccgtgacctgccctgc

SEQ ID NO: 166849 - DNA, 25 bp, Artificial Sequence
  Description of Artificial Sequence: Synthetic oligonucleotide
gctctttccgtgacctgccctgcgt

SEQ ID NO: 166850 - DNA, 26 bp, Artificial Sequence
  Description of Artificial Sequence: Synthetic oligonucleotide
ctctttccgtgacctgccctgcgtgt

SEQ ID NO: 166851 - DNA, 26 bp, Artificial Sequence
  Description of Artificial Sequence: Synthetic oligonucleotide
tctttccgtgacctgccctgcgtgtg

SEQ ID NO: 166852 - DNA, 25 bp, Artificial Sequence
  Description of Artificial Sequence: Synthetic oligonucleotide
ctttccgtgacctgccctgcgtgtg

SEQ ID NO: 166853 - DNA, 26 bp, Artificial Sequence
  Description of Artificial Sequence: Synthetic oligonucleotide
tttccgtgacctgccctgcgtgtggt

SEQ ID NO: 166854 - DNA, 25 bp, Artificial Sequence
  Description of Artificial Sequence: Synthetic oligonucleotide
ttccgtgacctgccctgcgtgtggt

SEQ ID NO: 166855 - DNA, 24 bp, Artificial Sequence
  Description of Artificial Sequence: Synthetic oligonucleotide
tccgtgacctgccctgcgtgtggt

SEQ ID NO: 166856 - DNA, 23 bp, Artificial Sequence
  Description of Artificial Sequence: Synthetic oligonucleotide
ccgtgacctgccctgcgtgtggt

SEQ ID NO: 166857 - DNA, 26 bp, Artificial Sequence
  Description of Artificial Sequence: Synthetic oligonucleotide
cgtgacctgccctgcgtgtggtcaaa

SEQ ID NO: 166858 - DNA, 27 bp, Artificial Sequence
  Description of Artificial Sequence: Synthetic oligonucleotide
gtgacctgccctgcgtgtggtcaaact

SEQ ID NO: 166859 - DNA, 27 bp, Artificial Sequence
  Description of Artificial Sequence: Synthetic oligonucleotide
tgacctgccctgcgtgtggtcaaactc

SEQ ID NO: 166860 - DNA, 27 bp, Artificial Sequence
  Description of Artificial Sequence: Synthetic oligonucleotide
gacctgccctgcgtgtggtcaaactca

SEQ ID NO: 166861 - DNA, 28 bp, Artificial Sequence
  Description of Artificial Sequence: Synthetic oligonucleotide
acctgccctgcgtgtggtcaaactcaag

SEQ ID NO: 166862 - DNA, 31 bp, Artificial Sequence
  Description of Artificial Sequence: Synthetic oligonucleotide
aagacagaagccacgttcccatcttccacag

SEQ ID NO: 166863 - DNA, 30 bp, Artificial Sequence
  Description of Artificial Sequence: Synthetic oligonucleotide
agacagaagccacgttcccatcttccacag

SEQ ID NO: 166864 - DNA, 29 bp, Artificial Sequence
  Description of Artificial Sequence: Synthetic oligonucleotide
gacagaagccacgttcccatcttccacag

SEQ ID NO: 166865 - DNA, 29 bp, Artificial Sequence
  Description of Artificial Sequence: Synthetic oligonucleotide
acagaagccacgttcccatcttccacagc

SEQ ID NO: 166866 - DNA, 28 bp, Artificial Sequence
  Description of Artificial Sequence: Synthetic oligonucleotide
cagaagccacgttcccatcttccacagc

SEQ ID NO: 166867 - DNA, 29 bp, Artificial Sequence
  Description of Artificial Sequence: Synthetic oligonucleotide
agaagccacgttcccatcttccacagcag

SEQ ID NO: 166868 - DNA, 28 bp, Artificial Sequence
  Description of Artificial Sequence: Synthetic oligonucleotide
gaagccacgttcccatcttccacagcag

SEQ ID NO: 166869 - DNA, 34 bp, Artificial Sequence
  Description of Artificial Sequence: Synthetic oligonucleotide
aagccacgttcccatcttccacagcagaatattc

SEQ ID NO: 166870 - DNA, 33 bp, Artificial Sequence
  Description of Artificial Sequence: Synthetic oligonucleotide
agccacgttcccatcttccacagcagaatattc

SEQ ID NO: 166871 - DNA, 32 bp, Artificial Sequence
  Description of Artificial Sequence: Synthetic oligonucleotide
gccacgttcccatcttccacagcagaatattc

SEQ ID NO: 166872 - DNA, 32 bp, Artificial Sequence
  Description of Artificial Sequence: Synthetic oligonucleotide
ccacgttcccatcttccacagcagaatattcc

SEQ ID NO: 166873 - DNA, 33 bp, Artificial Sequence
  Description of Artificial Sequence: Synthetic oligonucleotide
cacgttcccatcttccacagcagaatattccag

SEQ ID NO: 166874 - DNA, 33 bp, Artificial Sequence
  Description of Artificial Sequence: Synthetic oligonucleotide
acgttcccatcttccacagcagaatattccagg

SEQ ID NO: 166875 - DNA, 32 bp, Artificial Sequence
  Description of Artificial Sequence: Synthetic oligonucleotide
cgttcccatcttccacagcagaatattccagg

SEQ ID NO: 166876 - DNA, 33 bp, Artificial Sequence
  Description of Artificial Sequence: Synthetic oligonucleotide
gttcccatcttccacagcagaatattccaggag

SEQ ID NO: 166877 - DNA, 34 bp, Artificial Sequence
  Description of Artificial Sequence: Synthetic oligonucleotide
ttcccatcttccacagcagaatattccaggagag

SEQ ID NO: 166878 - DNA, 33 bp, Artificial Sequence
  Description of Artificial Sequence: Synthetic oligonucleotide
tcccatcttccacagcagaatattccaggagag

SEQ ID NO: 166879 - DNA, 32 bp, Artificial Sequence
  Description of Artificial Sequence: Synthetic oligonucleotide
cccatcttccacagcagaatattccaggagag

SEQ ID NO: 166880 - DNA, 32 bp, Artificial Sequence
  Description of Artificial Sequence: Synthetic oligonucleotide
ccatcttccacagcagaatattccaggagagc

SEQ ID NO: 166881 - DNA, 34 bp, Artificial Sequence
  Description of Artificial Sequence: Synthetic oligonucleotide
catcttccacagcagaatattccaggagagcttc

SEQ ID NO: 166882 - DNA, 36 bp, Artificial Sequence
  Description of Artificial Sequence: Synthetic oligonucleotide
atcttccacagcagaatattccaggagagcttcatc

SEQ ID NO: 166883 - DNA, 35 bp, Artificial Sequence
  Description of Artificial Sequence: Synthetic oligonucleotide
tcttccacagcagaatattccaggagagcttcatc

SEQ ID NO: 166884 - DNA, 34 bp, Artificial Sequence
  Description of Artificial Sequence: Synthetic oligonucleotide
cttccacagcagaatattccaggagagcttcatc

SEQ ID NO: 166885 - DNA, 36 bp, Artificial Sequence
  Description of Artificial Sequence: Synthetic oligonucleotide
ttccacagcagaatattccaggagagcttcatcatg

SEQ ID NO: 166886 - DNA, 35 bp, Artificial Sequence
  Description of Artificial Sequence: Synthetic oligonucleotide
tccacagcagaatattccaggagagcttcatcatg

SEQ ID NO: 166887 - DNA, 34 bp, Artificial Sequence
  Description of Artificial Sequence: Synthetic oligonucleotide
ccacagcagaatattccaggagagcttcatcatg

SEQ ID NO: 166888 - DNA, 34 bp, Artificial Sequence
  Description of Artificial Sequence: Synthetic oligonucleotide
cacagcagaatattccaggagagcttcatcatgg

SEQ ID NO: 166889 - DNA, 34 bp, Artificial Sequence
  Description of Artificial Sequence: Synthetic oligonucleotide
acagcagaatattccaggagagcttcatcatggg

SEQ ID NO: 166890 - DNA, 33 bp, Artificial Sequence
  Description of Artificial Sequence: Synthetic oligonucleotide
cagcagaatattccaggagagcttcatcatggg

SEQ ID NO: 166891 - DNA, 33 bp, Artificial Sequence
  Description of Artificial Sequence: Synthetic oligonucleotide
agcagaatattccaggagagcttcatcatgggc

SEQ ID NO: 166892 - DNA, 24 bp, Artificial Sequence
  Description of Artificial Sequence: Synthetic oligonucleotide
ttcctgtctgcccggcccagcagt

SEQ ID NO: 166893 - DNA, 23 bp, Artificial Sequence
  Description of Artificial Sequence: Synthetic oligonucleotide
tcctgtctgcccggcccagcagt

SEQ ID NO: 166894 - DNA, 22 bp, Artificial Sequence
  Description of Artificial Sequence: Synthetic oligonucleotide
cctgtctgcccggcccagcagt

SEQ ID NO: 166895 - DNA, 23 bp, Artificial Sequence
  Description of Artificial Sequence: Synthetic oligonucleotide
ctgtctgcccggcccagcagtgt

SEQ ID NO: 166896 - DNA, 23 bp, Artificial Sequence
  Description of Artificial Sequence: Synthetic oligonucleotide
tgtctgcccggcccagcagtgtg

SEQ ID NO: 166897 - DNA, 22 bp, Artificial Sequence
  Description of Artificial Sequence: Synthetic oligonucleotide
gtctgcccggcccagcagtgtg

SEQ ID NO: 166898 - DNA, 23 bp, Artificial Sequence
  Description of Artificial Sequence: Synthetic oligonucleotide
tctgcccggcccagcagtgtggt

SEQ ID NO: 166899 - DNA, 22 bp, Artificial Sequence
  Description of Artificial Sequence: Synthetic oligonucleotide
ctgcccggcccagcagtgtggt

SEQ ID NO: 166900 - DNA, 22 bp, Artificial Sequence
  Description of Artificial Sequence: Synthetic oligonucleotide
tgcccggcccagcagtgtggtg

SEQ ID NO: 166901 - DNA, 21 bp, Artificial Sequence
  Description of Artificial Sequence: Synthetic oligonucleotide
gcccggcccagcagtgtggtg

SEQ ID NO: 166902 - DNA, 21 bp, Artificial Sequence
  Description of Artificial Sequence: Synthetic oligonucleotide
cccggcccagcagtgtggtgc

SEQ ID NO: 166903 - DNA, 22 bp, Artificial Sequence
  Description of Artificial Sequence: Synthetic oligonucleotide
ccggcccagcagtgtggtgcct

SEQ ID NO: 166904 - DNA, 22 bp, Artificial Sequence
  Description of Artificial Sequence: Synthetic oligonucleotide
cggcccagcagtgtggtgcctc

SEQ ID NO: 166905 - DNA, 23 bp, Artificial Sequence
  Description of Artificial Sequence: Synthetic oligonucleotide
ggcccagcagtgtggtgcctcga

SEQ ID NO: 166906 - DNA, 23 bp, Artificial Sequence
  Description of Artificial Sequence: Synthetic oligonucleotide
gcccagcagtgtggtgcctcgag

SEQ ID NO: 166907 - DNA, 24 bp, Artificial Sequence
  Description of Artificial Sequence: Synthetic oligonucleotide
cccagcagtgtggtgcctcgagga

SEQ ID NO: 166908 - DNA, 24 bp, Artificial Sequence
  Description of Artificial Sequence: Synthetic oligonucleotide
ccagcagtgtggtgcctcgaggag

SEQ ID NO: 166909 - DNA, 25 bp, Artificial Sequence
  Description of Artificial Sequence: Synthetic oligonucleotide
cagcagtgtggtgcctcgaggagga

SEQ ID NO: 166910 - DNA, 26 bp, Artificial Sequence
  Description of Artificial Sequence: Synthetic oligonucleotide
agcagtgtggtgcctcgaggaggaca

SEQ ID NO: 166911 - DNA, 25 bp, Artificial Sequence
  Description of Artificial Sequence: Synthetic oligonucleotide
gcagtgtggtgcctcgaggaggaca

SEQ ID NO: 166912 - DNA, 25 bp, Artificial Sequence
  Description of Artificial Sequence: Synthetic oligonucleotide
cagtgtggtgcctcgaggaggacac

SEQ ID NO: 166913 - DNA, 26 bp, Artificial Sequence
  Description of Artificial Sequence: Synthetic oligonucleotide
agtgtggtgcctcgaggaggacacgt

SEQ ID NO: 166914 - DNA, 25 bp, Artificial Sequence
  Description of Artificial Sequence: Synthetic oligonucleotide
gtgtggtgcctcgaggaggacacgt

SEQ ID NO: 166915 - DNA, 39 bp, Artificial Sequence
  Description of Artificial Sequence: Synthetic oligonucleotide
ttggtcagatatcatgtttgagcacttctttctgcacag

SEQ ID NO: 166916 - DNA, 38 bp, Artificial Sequence
  Description of Artificial Sequence: Synthetic oligonucleotide
tggtcagatatcatgtttgagcacttctttctgcacag

SEQ ID NO: 166917 - DNA, 37 bp, Artificial Sequence
  Description of Artificial Sequence: Synthetic oligonucleotide
ggtcagatatcatgtttgagcacttctttctgcacag

SEQ ID NO: 166918 - DNA, 38 bp, Artificial Sequence
  Description of Artificial Sequence: Synthetic oligonucleotide
gtcagatatcatgtttgagcacttctttctgcacagag

SEQ ID NO: 166919 - DNA, 39 bp, Artificial Sequence
  Description of Artificial Sequence: Synthetic oligonucleotide
tcagatatcatgtttgagcacttctttctgcacagagag

SEQ ID NO: 166920 - DNA, 38 bp, Artificial Sequence
  Description of Artificial Sequence: Synthetic oligonucleotide
cagatatcatgtttgagcacttctttctgcacagagag

SEQ ID NO: 166921 - DNA, 38 bp, Artificial Sequence
  Description of Artificial Sequence: Synthetic oligonucleotide
agatatcatgtttgagcacttctttctgcacagagagg

SEQ ID NO: 166922 - DNA, 37 bp, Artificial Sequence
  Description of Artificial Sequence: Synthetic oligonucleotide
gatatcatgtttgagcacttctttctgcacagagagg

SEQ ID NO: 166923 - DNA, 37 bp, Artificial Sequence
  Description of Artificial Sequence: Synthetic oligonucleotide
atatcatgtttgagcacttctttctgcacagagaggg

SEQ ID NO: 166924 - DNA, 36 bp, Artificial Sequence
  Description of Artificial Sequence: Synthetic oligonucleotide
tatcatgtttgagcacttctttctgcacagagaggg

SEQ ID NO: 166925 - DNA, 35 bp, Artificial Sequence
  Description of Artificial Sequence: Synthetic oligonucleotide
atcatgtttgagcacttctttctgcacagagaggg

SEQ ID NO: 166926 - DNA, 29 bp, Artificial Sequence
  Description of Artificial Sequence: Synthetic oligonucleotide
catggcgtgtgttgggttcttcttgctgg

SEQ ID NO: 166927 - DNA, 30 bp, Artificial Sequence
  Description of Artificial Sequence: Synthetic oligonucleotide
atggcgtgtgttgggttcttcttgctggag

SEQ ID NO: 166928 - DNA, 29 bp, Artificial Sequence
  Description of Artificial Sequence: Synthetic oligonucleotide
tggcgtgtgttgggttcttcttgctggag

SEQ ID NO: 166929 - DNA, 28 bp, Artificial Sequence
  Description of Artificial Sequence: Synthetic oligonucleotide
ggcgtgtgttgggttcttcttgctggag

SEQ ID NO: 166930 - DNA, 28 bp, Artificial Sequence
  Description of Artificial Sequence: Synthetic oligonucleotide
gcgtgtgttgggttcttcttgctggagg

SEQ ID NO: 166931 - DNA, 28 bp, Artificial Sequence
  Description of Artificial Sequence: Synthetic oligonucleotide
cgtgtgttgggttcttcttgctggaggg

SEQ ID NO: 166932 - DNA, 28 bp, Artificial Sequence
  Description of Artificial Sequence: Synthetic oligonucleotide
gtgtgttgggttcttcttgctggagggg

SEQ ID NO: 166933 - DNA, 28 bp, Artificial Sequence
  Description of Artificial Sequence: Synthetic oligonucleotide
tgtgttgggttcttcttgctggaggggc

SEQ ID NO: 166934 - DNA, 27 bp, Artificial Sequence
  Description of Artificial Sequence: Synthetic oligonucleotide
gtgttgggttcttcttgctggaggggc

SEQ ID NO: 166935 - DNA, 27 bp, Artificial Sequence
  Description of Artificial Sequence: Synthetic oligonucleotide
tgttgggttcttcttgctggaggggcc

SEQ ID NO: 166936 - DNA, 26 bp, Artificial Sequence
  Description of Artificial Sequence: Synthetic oligonucleotide
gttgggttcttcttgctggaggggcc

SEQ ID NO: 166937 - DNA, 27 bp, Artificial Sequence
  Description of Artificial Sequence: Synthetic oligonucleotide
ttgggttcttcttgctggaggggccct

SEQ ID NO: 166938 - DNA, 26 bp, Artificial Sequence
  Description of Artificial Sequence: Synthetic oligonucleotide
tgggttcttcttgctggaggggccct

SEQ ID NO: 166939 - DNA, 25 bp, Artificial Sequence
  Description of Artificial Sequence: Synthetic oligonucleotide
gggttcttcttgctggaggggccct

SEQ ID NO: 166940 - DNA, 25 bp, Artificial Sequence
  Description of Artificial Sequence: Synthetic oligonucleotide
ggttcttcttgctggaggggccctg

SEQ ID NO: 166941 - DNA, 25 bp, Artificial Sequence
  Description of Artificial Sequence: Synthetic oligonucleotide
gttcttcttgctggaggggccctgg

SEQ ID NO: 166942 - DNA, 25 bp, Artificial Sequence
  Description of Artificial Sequence: Synthetic oligonucleotide
ttcttcttgctggaggggccctggc

SEQ ID NO: 166943 - DNA, 24 bp, Artificial Sequence
  Description of Artificial Sequence: Synthetic oligonucleotide
tcttcttgctggaggggccctggc

SEQ ID NO: 166944 - DNA, 23 bp, Artificial Sequence
  Description of Artificial Sequence: Synthetic oligonucleotide
cttcttgctggaggggccctggc

SEQ ID NO: 166945 - DNA, 24 bp, Artificial Sequence
  Description of Artificial Sequence: Synthetic oligonucleotide
ttcttgctggaggggccctggcca

SEQ ID NO: 166946 - DNA, 23 bp, Artificial Sequence
  Description of Artificial Sequence: Synthetic oligonucleotide
tcttgctggaggggccctggcca

SEQ ID NO: 166947 - DNA, 22 bp, Artificial Sequence
  Description of Artificial Sequence: Synthetic oligonucleotide
cttgctggaggggccctggcca

SEQ ID NO: 166948 - DNA, 24 bp, Artificial Sequence
  Description of Artificial Sequence: Synthetic oligonucleotide
ttgctggaggggccctggccacat

SEQ ID NO: 166949 - DNA, 23 bp, Artificial Sequence
  Description of Artificial Sequence: Synthetic oligonucleotide
tgctggaggggccctggccacat

SEQ ID NO: 166950 - DNA, 22 bp, Artificial Sequence
  Description of Artificial Sequence: Synthetic oligonucleotide
gctggaggggccctggccacat

SEQ ID NO: 166951 - DNA, 23 bp, Artificial Sequence
  Description of Artificial Sequence: Synthetic oligonucleotide
ctggaggggccctggccacatgt

SEQ ID NO: 166952 - DNA, 23 bp, Artificial Sequence
  Description of Artificial Sequence: Synthetic oligonucleotide
tggaggggccctggccacatgtg

SEQ ID NO: 166953 - DNA, 22 bp, Artificial Sequence
  Description of Artificial Sequence: Synthetic oligonucleotide
ggaggggccctggccacatgtg

SEQ ID NO: 166954 - DNA, 22 bp, Artificial Sequence
  Description of Artificial Sequence: Synthetic oligonucleotide
gaggggccctggccacatgtgg

SEQ ID NO: 166955 - DNA, 23 bp, Artificial Sequence
  Description of Artificial Sequence: Synthetic oligonucleotide
aggggccctggccacatgtgggt

SEQ ID NO: 166956 - DNA, 22 bp, Artificial Sequence
  Description of Artificial Sequence: Synthetic oligonucleotide
ggggccctggccacatgtgggt

SEQ ID NO: 166957 - DNA, 22 bp, Artificial Sequence
  Description of Artificial Sequence: Synthetic oligonucleotide
gggccctggccacatgtgggtg

SEQ ID NO: 166958 - DNA, 23 bp, Artificial Sequence
  Description of Artificial Sequence: Synthetic oligonucleotide
ggccctggccacatgtgggtggt

SEQ ID NO: 166959 - DNA, 24 bp, Artificial Sequence
  Description of Artificial Sequence: Synthetic oligonucleotide
gccctggccacatgtgggtggtca

SEQ ID NO: 166960 - DNA, 24 bp, Artificial Sequence
  Description of Artificial Sequence: Synthetic oligonucleotide
ccctggccacatgtgggtggtcag

SEQ ID NO: 166961 - DNA, 25 bp, Artificial Sequence
  Description of Artificial Sequence: Synthetic oligonucleotide
cctggccacatgtgggtggtcagga

SEQ ID NO: 166962 - DNA, 27 bp, Artificial Sequence
  Description of Artificial Sequence: Synthetic oligonucleotide
ctggccacatgtgggtggtcaggacaa

SEQ ID NO: 166963 - DNA, 27 bp, Artificial Sequence
  Description of Artificial Sequence: Synthetic oligonucleotide
tggccacatgtgggtggtcaggacaag

SEQ ID NO: 166964 - DNA, 26 bp, Artificial Sequence
  Description of Artificial Sequence: Synthetic oligonucleotide
ggccacatgtgggtggtcaggacaag

SEQ ID NO: 166965 - DNA, 26 bp, Artificial Sequence
  Description of Artificial Sequence: Synthetic oligonucleotide
gccacatgtgggtggtcaggacaagc

SEQ ID NO: 166966 - DNA, 26 bp, Artificial Sequence
  Description of Artificial Sequence: Synthetic oligonucleotide
ccacatgtgggtggtcaggacaagcc

SEQ ID NO: 166967 - DNA, 27 bp, Artificial Sequence
  Description of Artificial Sequence: Synthetic oligonucleotide
cacatgtgggtggtcaggacaagccct

SEQ ID NO: 166968 - DNA, 28 bp, Artificial Sequence
  Description of Artificial Sequence: Synthetic oligonucleotide
acatgtgggtggtcaggacaagcccttc

SEQ ID NO: 166969 - DNA, 27 bp, Artificial Sequence
  Description of Artificial Sequence: Synthetic oligonucleotide
catgtgggtggtcaggacaagcccttc

SEQ ID NO: 166970 - DNA, 27 bp, Artificial Sequence
  Description of Artificial Sequence: Synthetic oligonucleotide
atgtgggtggtcaggacaagcccttcc

SEQ ID NO: 166971 - DNA, 27 bp, Artificial Sequence
  Description of Artificial Sequence: Synthetic oligonucleotide
tgtgggtggtcaggacaagcccttcct

SEQ ID NO: 166972 - DNA, 27 bp, Artificial Sequence
  Description of Artificial Sequence: Synthetic oligonucleotide
tgggtggtcaggacaagcccttcctct

SEQ ID NO: 166973 - DNA, 26 bp, Artificial Sequence
  Description of Artificial Sequence: Synthetic oligonucleotide
gggtggtcaggacaagcccttcctct

SEQ ID NO: 166974 - DNA, 27 bp, Artificial Sequence
  Description of Artificial Sequence: Synthetic oligonucleotide
ggtggtcaggacaagcccttcctctct

SEQ ID NO: 166975 - DNA, 27 bp, Artificial Sequence
  Description of Artificial Sequence: Synthetic oligonucleotide
gtggtcaggacaagcccttcctctctg

SEQ ID NO: 166976 - DNA, 27 bp, Artificial Sequence
  Description of Artificial Sequence: Synthetic oligonucleotide
tggtcaggacaagcccttcctctctgc

SEQ ID NO: 166977 - DNA, 26 bp, Artificial Sequence
  Description of Artificial Sequence: Synthetic oligonucleotide
ggtcaggacaagcccttcctctctgc

SEQ ID NO: 166978 - DNA, 27 bp, Artificial Sequence
  Description of Artificial Sequence: Synthetic oligonucleotide
gtcaggacaagcccttcctctctgcct

SEQ ID NO: 166979 - DNA, 27 bp, Artificial Sequence
  Description of Artificial Sequence: Synthetic oligonucleotide
tcaggacaagcccttcctctctgcctg

SEQ ID NO: 166980 - DNA, 26 bp, Artificial Sequence
  Description of Artificial Sequence: Synthetic oligonucleotide
caggacaagcccttcctctctgcctg

SEQ ID NO: 166981 - DNA, 26 bp, Artificial Sequence
  Description of Artificial Sequence: Synthetic oligonucleotide
aggacaagcccttcctctctgcctgg

SEQ ID NO: 166982 - DNA, 25 bp, Artificial Sequence
  Description of Artificial Sequence: Synthetic oligonucleotide
ggacaagcccttcctctctgcctgg

SEQ ID NO: 166983 - DNA, 25 bp, Artificial Sequence
  Description of Artificial Sequence: Synthetic oligonucleotide
gacaagcccttcctctctgcctggc

SEQ ID NO: 166984 - DNA, 25 bp, Artificial Sequence
  Description of Artificial Sequence: Synthetic oligonucleotide
acaagcccttcctctctgcctggcc

SEQ ID NO: 166985 - DNA, 24 bp, Artificial Sequence
  Description of Artificial Sequence: Synthetic oligonucleotide
caagcccttcctctctgcctggcc

SEQ ID NO: 166986 - DNA, 24 bp, Artificial Sequence
  Description of Artificial Sequence: Synthetic oligonucleotide
aagcccttcctctctgcctggccc

SEQ ID NO: 166987 - DNA, 23 bp, Artificial Sequence
  Description of Artificial Sequence: Synthetic oligonucleotide
agcccttcctctctgcctggccc

SEQ ID NO: 166988 - DNA, 22 bp, Artificial Sequence
  Description of Artificial Sequence: Synthetic oligonucleotide
gcccttcctctctgcctggccc

SEQ ID NO: 166989 - DNA, 22 bp, Artificial Sequence
  Description of Artificial Sequence: Synthetic oligonucleotide
cccttcctctctgcctggcccg

SEQ ID NO: 166990 - DNA, 22 bp, Artificial Sequence
  Description of Artificial Sequence: Synthetic oligonucleotide
ccttcctctctgcctggcccgg

SEQ ID NO: 166991 - DNA, 23 bp, Artificial Sequence
  Description of Artificial Sequence: Synthetic oligonucleotide
cttcctctctgcctggcccggca

SEQ ID NO: 166992 - DNA, 24 bp, Artificial Sequence
  Description of Artificial Sequence: Synthetic oligonucleotide
ttcctctctgcctggcccggcact

SEQ ID NO: 166993 - DNA, 23 bp, Artificial Sequence
  Description of Artificial Sequence: Synthetic oligonucleotide
tcctctctgcctggcccggcact

SEQ ID NO: 166994 - DNA, 22 bp, Artificial Sequence
  Description of Artificial Sequence: Synthetic oligonucleotide
cctctctgcctggcccggcact

SEQ ID NO: 166995 - DNA, 23 bp, Artificial Sequence
  Description of Artificial Sequence: Synthetic oligonucleotide
ctctctgcctggcccggcactgt

SEQ ID NO: 166996 - DNA, 23 bp, Artificial Sequence
  Description of Artificial Sequence: Synthetic oligonucleotide
tctctgcctggcccggcactgtg

SEQ ID NO: 166997 - DNA, 22 bp, Artificial Sequence
  Description of Artificial Sequence: Synthetic oligonucleotide
ctctgcctggcccggcactgtg

SEQ ID NO: 166998 - DNA, 23 bp, Artificial Sequence
  Description of Artificial Sequence: Synthetic oligonucleotide
tctgcctggcccggcactgtggt

SEQ ID NO: 166999 - DNA, 22 bp, Artificial Sequence
  Description of Artificial Sequence: Synthetic oligonucleotide
ctgcctggcccggcactgtggt

SEQ ID NO: 167000 - DNA, 23 bp, Artificial Sequence
  Description of Artificial Sequence: Synthetic oligonucleotide
tgcctggcccggcactgtggtgt

SEQ ID NO: 167001 - DNA, 22 bp, Artificial Sequence
  Description of Artificial Sequence: Synthetic oligonucleotide
gcctggcccggcactgtggtgt

SEQ ID NO: 167002 - DNA, 23 bp, Artificial Sequence
  Description of Artificial Sequence: Synthetic oligonucleotide
cctggcccggcactgtggtgtct

SEQ ID NO: 167003 - DNA, 25 bp, Artificial Sequence
  Description of Artificial Sequence: Synthetic oligonucleotide
ctggcccggcactgtggtgtctgaa

SEQ ID NO: 167004 - DNA, 25 bp, Artificial Sequence
  Description of Artificial Sequence: Synthetic oligonucleotide
tggcccggcactgtggtgtctgaag

SEQ ID NO: 167005 - DNA, 24 bp, Artificial Sequence
  Description of Artificial Sequence: Synthetic oligonucleotide
ggcccggcactgtggtgtctgaag

SEQ ID NO: 167006 - DNA, 25 bp, Artificial Sequence
  Description of Artificial Sequence: Synthetic oligonucleotide
gcccggcactgtggtgtctgaagga

SEQ ID NO: 167007 - DNA, 27 bp, Artificial Sequence
  Description of Artificial Sequence: Synthetic oligonucleotide
cccggcactgtggtgtctgaaggacaa

SEQ ID NO: 167008 - DNA, 27 bp, Artificial Sequence
  Description of Artificial Sequence: Synthetic oligonucleotide
ccggcactgtggtgtctgaaggacaac

SEQ ID NO: 167009 - DNA, 29 bp, Artificial Sequence
  Description of Artificial Sequence: Synthetic oligonucleotide
cggcactgtggtgtctgaaggacaacatg

SEQ ID NO: 167010 - DNA, 30 bp, Artificial Sequence
  Description of Artificial Sequence: Synthetic oligonucleotide
ggcactgtggtgtctgaaggacaacatgtg

SEQ ID NO: 167011 - DNA, 31 bp, Artificial Sequence
  Description of Artificial Sequence: Synthetic oligonucleotide
gcactgtggtgtctgaaggacaacatgtgac

SEQ ID NO: 167012 - DNA, 32 bp, Artificial Sequence
  Description of Artificial Sequence: Synthetic oligonucleotide
cactgtggtgtctgaaggacaacatgtgactc

SEQ ID NO: 167013 - DNA, 34 bp, Artificial Sequence
  Description of Artificial Sequence: Synthetic oligonucleotide
actgtggtgtctgaaggacaacatgtgactcttc

SEQ ID NO: 167014 - DNA, 33 bp, Artificial Sequence
  Description of Artificial Sequence: Synthetic oligonucleotide
ctgtggtgtctgaaggacaacatgtgactcttc

SEQ ID NO: 167015 - DNA, 34 bp, Artificial Sequence
  Description of Artificial Sequence: Synthetic oligonucleotide
tgtggtgtctgaaggacaacatgtgactcttcag

SEQ ID NO: 167016 - DNA, 33 bp, Artificial Sequence
  Description of Artificial Sequence: Synthetic oligonucleotide
gtggtgtctgaaggacaacatgtgactcttcag

SEQ ID NO: 167017 - DNA, 34 bp, Artificial Sequence
  Description of Artificial Sequence: Synthetic oligonucleotide
tggtgtctgaaggacaacatgtgactcttcagtg

SEQ ID NO: 167018 - DNA, 33 bp, Artificial Sequence
  Description of Artificial Sequence: Synthetic oligonucleotide
ggtgtctgaaggacaacatgtgactcttcagtg

SEQ ID NO: 167019 - DNA, 34 bp, Artificial Sequence
  Description of Artificial Sequence: Synthetic oligonucleotide
gtgtctgaaggacaacatgtgactcttcagtgtc

SEQ ID NO: 167020 - DNA, 34 bp, Artificial Sequence
  Description of Artificial Sequence: Synthetic oligonucleotide
tgtctgaaggacaacatgtgactcttcagtgtcg

SEQ ID NO: 167021 - DNA, 33 bp, Artificial Sequence
  Description of Artificial Sequence: Synthetic oligonucleotide
gtctgaaggacaacatgtgactcttcagtgtcg

SEQ ID NO: 167022 - DNA, 33 bp, Artificial Sequence
  Description of Artificial Sequence: Synthetic oligonucleotide
tctgaaggacaacatgtgactcttcagtgtcgc

SEQ ID NO: 167023 - DNA, 32 bp, Artificial Sequence
  Description of Artificial Sequence: Synthetic oligonucleotide
ctgaaggacaacatgtgactcttcagtgtcgc

SEQ ID NO: 167024 - DNA, 33 bp, Artificial Sequence
  Description of Artificial Sequence: Synthetic oligonucleotide
tgaaggacaacatgtgactcttcagtgtcgctc

SEQ ID NO: 167025 - DNA, 32 bp, Artificial Sequence
  Description of Artificial Sequence: Synthetic oligonucleotide
gaaggacaacatgtgactcttcagtgtcgctc

SEQ ID NO: 167026 - DNA, 33 bp, Artificial Sequence
  Description of Artificial Sequence: Synthetic oligonucleotide
aaggacaacatgtgactcttcagtgtcgctctc

SEQ ID NO: 167027 - DNA, 32 bp, Artificial Sequence
  Description of Artificial Sequence: Synthetic oligonucleotide
aggacaacatgtgactcttcagtgtcgctctc

SEQ ID NO: 167028 - DNA, 31 bp, Artificial Sequence
  Description of Artificial Sequence: Synthetic oligonucleotide
ggacaacatgtgactcttcagtgtcgctctc

SEQ ID NO: 167029 - DNA, 31 bp, Artificial Sequence
  Description of Artificial Sequence: Synthetic oligonucleotide
gacaacatgtgactcttcagtgtcgctctcg

SEQ ID NO: 167030 - DNA, 32 bp, Artificial Sequence
  Description of Artificial Sequence: Synthetic oligonucleotide
acaacatgtgactcttcagtgtcgctctcgtc

SEQ ID NO: 167031 - DNA, 31 bp, Artificial Sequence
  Description of Artificial Sequence: Synthetic oligonucleotide
caacatgtgactcttcagtgtcgctctcgtc

SEQ ID NO: 167032 - DNA, 33 bp, Artificial Sequence
  Description of Artificial Sequence: Synthetic oligonucleotide
aacatgtgactcttcagtgtcgctctcgtcttg

SEQ ID NO: 167033 - DNA, 32 bp, Artificial Sequence
  Description of Artificial Sequence: Synthetic oligonucleotide
acatgtgactcttcagtgtcgctctcgtcttg

SEQ ID NO: 167034 - DNA, 31 bp, Artificial Sequence
  Description of Artificial Sequence: Synthetic oligonucleotide
catgtgactcttcagtgtcgctctcgtcttg

SEQ ID NO: 167035 - DNA, 31 bp, Artificial Sequence
  Description of Artificial Sequence: Synthetic oligonucleotide
atgtgactcttcagtgtcgctctcgtcttgg

SEQ ID NO: 167036 - DNA, 30 bp, Artificial Sequence
  Description of Artificial Sequence: Synthetic oligonucleotide
tgtgactcttcagtgtcgctctcgtcttgg

SEQ ID NO: 167037 - DNA, 29 bp, Artificial Sequence
  Description of Artificial Sequence: Synthetic oligonucleotide
gtgactcttcagtgtcgctctcgtcttgg

SEQ ID NO: 167038 - DNA, 29 bp, Artificial Sequence
  Description of Artificial Sequence: Synthetic oligonucleotide
tgactcttcagtgtcgctctcgtcttggg

SEQ ID NO: 167039 - DNA, 28 bp, Artificial Sequence
  Description of Artificial Sequence: Synthetic oligonucleotide
gactcttcagtgtcgctctcgtcttggg

SEQ ID NO: 167040 - DNA, 33 bp, Artificial Sequence
  Description of Artificial Sequence: Synthetic oligonucleotide
actcttcagtgtcgctctcgtcttgggtttaac

SEQ ID NO: 167041 - DNA, 32 bp, Artificial Sequence
  Description of Artificial Sequence: Synthetic oligonucleotide
ctcttcagtgtcgctctcgtcttgggtttaac

SEQ ID NO: 167042 - DNA, 32 bp, Artificial Sequence
  Description of Artificial Sequence: Synthetic oligonucleotide
tcttcagtgtcgctctcgtcttgggtttaacg

SEQ ID NO: 167043 - DNA, 31 bp, Artificial Sequence
  Description of Artificial Sequence: Synthetic oligonucleotide
cttcagtgtcgctctcgtcttgggtttaacg

SEQ ID NO: 167044 - DNA, 35 bp, Artificial Sequence
  Description of Artificial Sequence: Synthetic oligonucleotide
ttcagtgtcgctctcgtcttgggtttaacgaattc

SEQ ID NO: 167045 - DNA, 34 bp, Artificial Sequence
  Description of Artificial Sequence: Synthetic oligonucleotide
tcagtgtcgctctcgtcttgggtttaacgaattc

SEQ ID NO: 167046 - DNA, 33 bp, Artificial Sequence
  Description of Artificial Sequence: Synthetic oligonucleotide
cagtgtcgctctcgtcttgggtttaacgaattc

SEQ ID NO: 167047 - DNA, 34 bp, Artificial Sequence
  Description of Artificial Sequence: Synthetic oligonucleotide
agtgtcgctctcgtcttgggtttaacgaattcag

SEQ ID NO: 167048 - DNA, 33 bp, Artificial Sequence
  Description of Artificial Sequence: Synthetic oligonucleotide
gtgtcgctctcgtcttgggtttaacgaattcag

SEQ ID NO: 167049 - DNA, 34 bp, Artificial Sequence
  Description of Artificial Sequence: Synthetic oligonucleotide
tgtcgctctcgtcttgggtttaacgaattcagtc

SEQ ID NO: 167050 - DNA, 33 bp, Artificial Sequence
  Description of Artificial Sequence: Synthetic oligonucleotide
gtcgctctcgtcttgggtttaacgaattcagtc

SEQ ID NO: 167051 - DNA, 34 bp, Artificial Sequence
  Description of Artificial Sequence: Synthetic oligonucleotide
tcgctctcgtcttgggtttaacgaattcagtctg

SEQ ID NO: 167052 - DNA, 33 bp, Artificial Sequence
  Description of Artificial Sequence: Synthetic oligonucleotide
cgctctcgtcttgggtttaacgaattcagtctg

SEQ ID NO: 167053 - DNA, 34 bp, Artificial Sequence
  Description of Artificial Sequence: Synthetic oligonucleotide
gctctcgtcttgggtttaacgaattcagtctgtc

SEQ ID NO: 167054 - DNA, 34 bp, Artificial Sequence
  Description of Artificial Sequence: Synthetic oligonucleotide
ctctcgtcttgggtttaacgaattcagtctgtcc

SEQ ID NO: 167055 - DNA, 37 bp, Artificial Sequence
  Description of Artificial Sequence: Synthetic oligonucleotide
tctcgtcttgggtttaacgaattcagtctgtccaaag

SEQ ID NO: 167056 - DNA, 36 bp, Artificial Sequence
  Description of Artificial Sequence: Synthetic oligonucleotide
ctcgtcttgggtttaacgaattcagtctgtccaaag

SEQ ID NO: 167057 - DNA, 38 bp, Artificial Sequence
  Description of Artificial Sequence: Synthetic oligonucleotide
tcgtcttgggtttaacgaattcagtctgtccaaagaag

SEQ ID NO: 167058 - DNA, 37 bp, Artificial Sequence
  Description of Artificial Sequence: Synthetic oligonucleotide
cgtcttgggtttaacgaattcagtctgtccaaagaag

SEQ ID NO: 167059 - DNA, 38 bp, Artificial Sequence
  Description of Artificial Sequence: Synthetic oligonucleotide
gtcttgggtttaacgaattcagtctgtccaaagaagac

SEQ ID NO: 167060 - DNA, 38 bp, Artificial Sequence
  Description of Artificial Sequence: Synthetic oligonucleotide
tcttgggtttaacgaattcagtctgtccaaagaagacg

SEQ ID NO: 167061 - DNA, 37 bp, Artificial Sequence
  Description of Artificial Sequence: Synthetic oligonucleotide
cttgggtttaacgaattcagtctgtccaaagaagacg

SEQ ID NO: 167062 - DNA, 37 bp, Artificial Sequence
  Description of Artificial Sequence: Synthetic oligonucleotide
ttgggtttaacgaattcagtctgtccaaagaagacgg

SEQ ID NO: 167063 - DNA, 36 bp, Artificial Sequence
  Description of Artificial Sequence: Synthetic oligonucleotide
tgggtttaacgaattcagtctgtccaaagaagacgg

SEQ ID NO: 167064 - DNA, 35 bp, Artificial Sequence
  Description of Artificial Sequence: Synthetic oligonucleotide
gggtttaacgaattcagtctgtccaaagaagacgg

SEQ ID NO: 167065 - DNA, 35 bp, Artificial Sequence
  Description of Artificial Sequence: Synthetic oligonucleotide
ggtttaacgaattcagtctgtccaaagaagacggg

SEQ ID NO: 167066 - DNA, 37 bp, Artificial Sequence
  Description of Artificial Sequence: Synthetic oligonucleotide
gtttaacgaattcagtctgtccaaagaagacgggatg

SEQ ID NO: 167067 - DNA, 37 bp, Artificial Sequence
  Description of Artificial Sequence: Synthetic oligonucleotide
tttaacgaattcagtctgtccaaagaagacgggatgc

SEQ ID NO: 167068 - DNA, 36 bp, Artificial Sequence
  Description of Artificial Sequence: Synthetic oligonucleotide
ttaacgaattcagtctgtccaaagaagacgggatgc

SEQ ID NO: 167069 - DNA, 35 bp, Artificial Sequence
  Description of Artificial Sequence: Synthetic oligonucleotide
taacgaattcagtctgtccaaagaagacgggatgc

SEQ ID NO: 167070 - DNA, 34 bp, Artificial Sequence
  Description of Artificial Sequence: Synthetic oligonucleotide
aacgaattcagtctgtccaaagaagacgggatgc

SEQ ID NO: 167071 - DNA, 33 bp, Artificial Sequence
  Description of Artificial Sequence: Synthetic oligonucleotide
acgaattcagtctgtccaaagaagacgggatgc

SEQ ID NO: 167072 - DNA, 32 bp, Artificial Sequence
  Description of Artificial Sequence: Synthetic oligonucleotide
cgaattcagtctgtccaaagaagacgggatgc

SEQ ID NO: 167073 - DNA, 32 bp, Artificial Sequence
  Description of Artificial Sequence: Synthetic oligonucleotide
gaattcagtctgtccaaagaagacgggatgcc

SEQ ID NO: 167074 - DNA, 33 bp, Artificial Sequence
  Description of Artificial Sequence: Synthetic oligonucleotide
aattcagtctgtccaaagaagacgggatgcctg

SEQ ID NO: 167075 - DNA, 32 bp, Artificial Sequence
  Description of Artificial Sequence: Synthetic oligonucleotide
attcagtctgtccaaagaagacgggatgcctg

SEQ ID NO: 167076 - DNA, 31 bp, Artificial Sequence
  Description of Artificial Sequence: Synthetic oligonucleotide
ttcagtctgtccaaagaagacgggatgcctg

SEQ ID NO: 167077 - DNA, 30 bp, Artificial Sequence
  Description of Artificial Sequence: Synthetic oligonucleotide
tcagtctgtccaaagaagacgggatgcctg

SEQ ID NO: 167078 - DNA, 29 bp, Artificial Sequence
  Description of Artificial Sequence: Synthetic oligonucleotide
cagtctgtccaaagaagacgggatgcctg

SEQ ID NO: 167079 - DNA, 30 bp, Artificial Sequence
  Description of Artificial Sequence: Synthetic oligonucleotide
agtctgtccaaagaagacgggatgcctgtc

SEQ ID NO: 167080 - DNA, 29 bp, Artificial Sequence
  Description of Artificial Sequence: Synthetic oligonucleotide
gtctgtccaaagaagacgggatgcctgtc

SEQ ID NO: 167081 - DNA, 29 bp, Artificial Sequence
  Description of Artificial Sequence: Synthetic oligonucleotide
tctgtccaaagaagacgggatgcctgtcc

SEQ ID NO: 167082 - DNA, 28 bp, Artificial Sequence
  Description of Artificial Sequence: Synthetic oligonucleotide
ctgtccaaagaagacgggatgcctgtcc

SEQ ID NO: 167083 - DNA, 28 bp, Artificial Sequence
  Description of Artificial Sequence: Synthetic oligonucleotide
tgtccaaagaagacgggatgcctgtccc

SEQ ID NO: 167084 - DNA, 27 bp, Artificial Sequence
  Description of Artificial Sequence: Synthetic oligonucleotide
gtccaaagaagacgggatgcctgtccc

SEQ ID NO: 167085 - DNA, 28 bp, Artificial Sequence
  Description of Artificial Sequence: Synthetic oligonucleotide
tccaaagaagacgggatgcctgtccctg

SEQ ID NO: 167086 - DNA, 27 bp, Artificial Sequence
  Description of Artificial Sequence: Synthetic oligonucleotide
ccaaagaagacgggatgcctgtccctg

SEQ ID NO: 167087 - DNA, 28 bp, Artificial Sequence
  Description of Artificial Sequence: Synthetic oligonucleotide
caaagaagacgggatgcctgtccctgag

SEQ ID NO: 167088 - DNA, 28 bp, Artificial Sequence
  Description of Artificial Sequence: Synthetic oligonucleotide
aaagaagacgggatgcctgtccctgagc

SEQ ID NO: 167089 - DNA, 27 bp, Artificial Sequence
  Description of Artificial Sequence: Synthetic oligonucleotide
aagaagacgggatgcctgtccctgagc

SEQ ID NO: 167090 - DNA, 27 bp, Artificial Sequence
  Description of Artificial Sequence: Synthetic oligonucleotide
agaagacgggatgcctgtccctgagct

SEQ ID NO: 167091 - DNA, 26 bp, Artificial Sequence
  Description of Artificial Sequence: Synthetic oligonucleotide
gaagacgggatgcctgtccctgagct

SEQ ID NO: 167092 - DNA, 27 bp, Artificial Sequence
  Description of Artificial Sequence: Synthetic oligonucleotide
aagacgggatgcctgtccctgagctct

SEQ ID NO: 167093 - DNA, 27 bp, Artificial Sequence
  Description of Artificial Sequence: Synthetic oligonucleotide
agacgggatgcctgtccctgagctcta

SEQ ID NO: 167094 - DNA, 26 bp, Artificial Sequence
  Description of Artificial Sequence: Synthetic oligonucleotide
gacgggatgcctgtccctgagctcta

SEQ ID NO: 167095 - DNA, 27 bp, Artificial Sequence
  Description of Artificial Sequence: Synthetic oligonucleotide
acgggatgcctgtccctgagctctaca

SEQ ID NO: 167096 - DNA, 27 bp, Artificial Sequence
  Description of Artificial Sequence: Synthetic oligonucleotide
cgggatgcctgtccctgagctctacaa

SEQ ID NO: 167097 - DNA, 27 bp, Artificial Sequence
  Description of Artificial Sequence: Synthetic oligonucleotide
gggatgcctgtccctgagctctacaac

SEQ ID NO: 167098 - DNA, 28 bp, Artificial Sequence
  Description of Artificial Sequence: Synthetic oligonucleotide
ggatgcctgtccctgagctctacaacag

SEQ ID NO: 167099 - DNA, 34 bp, Artificial Sequence
  Description of Artificial Sequence: Synthetic oligonucleotide
gatgcctgtccctgagctctacaacagaatattc

SEQ ID NO: 167100 - DNA, 34 bp, Artificial Sequence
  Description of Artificial Sequence: Synthetic oligonucleotide
atgcctgtccctgagctctacaacagaatattcc

SEQ ID NO: 167101 - DNA, 33 bp, Artificial Sequence
  Description of Artificial Sequence: Synthetic oligonucleotide
tgcctgtccctgagctctacaacagaatattcc

SEQ ID NO: 167102 - DNA, 32 bp, Artificial Sequence
  Description of Artificial Sequence: Synthetic oligonucleotide
gcctgtccctgagctctacaacagaatattcc

SEQ ID NO: 167103 - DNA, 32 bp, Artificial Sequence
  Description of Artificial Sequence: Synthetic oligonucleotide
cctgtccctgagctctacaacagaatattccg

SEQ ID NO: 167104 - DNA, 32 bp, Artificial Sequence
  Description of Artificial Sequence: Synthetic oligonucleotide
ctgtccctgagctctacaacagaatattccgg

SEQ ID NO: 167105 - DNA, 34 bp, Artificial Sequence
  Description of Artificial Sequence: Synthetic oligonucleotide
tgtccctgagctctacaacagaatattccggaac

SEQ ID NO: 167106 - DNA, 33 bp, Artificial Sequence
  Description of Artificial Sequence: Synthetic oligonucleotide
gtccctgagctctacaacagaatattccggaac

SEQ ID NO: 167107 - DNA, 34 bp, Artificial Sequence
  Description of Artificial Sequence: Synthetic oligonucleotide
tccctgagctctacaacagaatattccggaacag

SEQ ID NO: 167108 - DNA, 33 bp, Artificial Sequence
  Description of Artificial Sequence: Synthetic oligonucleotide
ccctgagctctacaacagaatattccggaacag

SEQ ID NO: 167109 - DNA, 33 bp, Artificial Sequence
  Description of Artificial Sequence: Synthetic oligonucleotide
cctgagctctacaacagaatattccggaacagc

SEQ ID NO: 167110 - DNA, 36 bp, Artificial Sequence
  Description of Artificial Sequence: Synthetic oligonucleotide
ctgagctctacaacagaatattccggaacagctttc

SEQ ID NO: 167111 - DNA, 37 bp, Artificial Sequence
  Description of Artificial Sequence: Synthetic oligonucleotide
tgagctctacaacagaatattccggaacagctttctc

SEQ ID NO: 167112 - DNA, 36 bp, Artificial Sequence
  Description of Artificial Sequence: Synthetic oligonucleotide
gagctctacaacagaatattccggaacagctttctc

SEQ ID NO: 167113 - DNA, 38 bp, Artificial Sequence
  Description of Artificial Sequence: Synthetic oligonucleotide
agctctacaacagaatattccggaacagctttctcatg

SEQ ID NO: 167114 - DNA, 37 bp, Artificial Sequence
  Description of Artificial Sequence: Synthetic oligonucleotide
gctctacaacagaatattccggaacagctttctcatg

SEQ ID NO: 167115 - DNA, 37 bp, Artificial Sequence
  Description of Artificial Sequence: Synthetic oligonucleotide
ctctacaacagaatattccggaacagctttctcatgg

SEQ ID NO: 167116 - DNA, 37 bp, Artificial Sequence
  Description of Artificial Sequence: Synthetic oligonucleotide
tctacaacagaatattccggaacagctttctcatggg

SEQ ID NO: 167117 - DNA, 36 bp, Artificial Sequence
  Description of Artificial Sequence: Synthetic oligonucleotide
ctacaacagaatattccggaacagctttctcatggg

SEQ ID NO: 167118 - DNA, 36 bp, Artificial Sequence
  Description of Artificial Sequence: Synthetic oligonucleotide
tacaacagaatattccggaacagctttctcatgggc

SEQ ID NO: 167119 - DNA, 35 bp, Artificial Sequence
  Description of Artificial Sequence: Synthetic oligonucleotide
acaacagaatattccggaacagctttctcatgggc

SEQ ID NO: 167120 - DNA, 34 bp, Artificial Sequence
  Description of Artificial Sequence: Synthetic oligonucleotide
caacagaatattccggaacagctttctcatgggc

SEQ ID NO: 167121 - DNA, 34 bp, Artificial Sequence
  Description of Artificial Sequence: Synthetic oligonucleotide
aacagaatattccggaacagctttctcatgggcc

SEQ ID NO: 167122 - DNA, 33 bp, Artificial Sequence
  Description of Artificial Sequence: Synthetic oligonucleotide
acagaatattccggaacagctttctcatgggcc

SEQ ID NO: 167123 - DNA, 32 bp, Artificial Sequence
  Description of Artificial Sequence: Synthetic oligonucleotide
cagaatattccggaacagctttctcatgggcc

SEQ ID NO: 167124 - DNA, 32 bp, Artificial Sequence
  Description of Artificial Sequence: Synthetic oligonucleotide
agaatattccggaacagctttctcatgggccc

SEQ ID NO: 167125 - DNA, 31 bp, Artificial Sequence
  Description of Artificial Sequence: Synthetic oligonucleotide
gaatattccggaacagctttctcatgggccc

SEQ ID NO: 167126 - DNA, 32 bp, Artificial Sequence
  Description of Artificial Sequence: Synthetic oligonucleotide
aatattccggaacagctttctcatgggccctg

SEQ ID NO: 167127 - DNA, 31 bp, Artificial Sequence
  Description of Artificial Sequence: Synthetic oligonucleotide
atattccggaacagctttctcatgggccctg

SEQ ID NO: 167128 - DNA, 30 bp, Artificial Sequence
  Description of Artificial Sequence: Synthetic oligonucleotide
tattccggaacagctttctcatgggccctg

SEQ ID NO: 167129 - DNA, 29 bp, Artificial Sequence
  Description of Artificial Sequence: Synthetic oligonucleotide
attccggaacagctttctcatgggccctg

SEQ ID NO: 167130 - DNA, 28 bp, Artificial Sequence
  Description of Artificial Sequence: Synthetic oligonucleotide
ttccggaacagctttctcatgggccctg

SEQ ID NO: 167131 - DNA, 27 bp, Artificial Sequence
  Description of Artificial Sequence: Synthetic oligonucleotide
tccggaacagctttctcatgggccctg

SEQ ID NO: 167132 - DNA, 27 bp, Artificial Sequence
  Description of Artificial Sequence: Synthetic oligonucleotide
ccggaacagctttctcatgggccctgt

SEQ ID NO: 167133 - DNA, 27 bp, Artificial Sequence
  Description of Artificial Sequence: Synthetic oligonucleotide
cggaacagctttctcatgggccctgtg

SEQ ID NO: 167134 - DNA, 28 bp, Artificial Sequence
  Description of Artificial Sequence: Synthetic oligonucleotide
ggaacagctttctcatgggccctgtgac

SEQ ID NO: 167135 - DNA, 28 bp, Artificial Sequence
  Description of Artificial Sequence: Synthetic oligonucleotide
gaacagctttctcatgggccctgtgacc

SEQ ID NO: 167136 - DNA, 28 bp, Artificial Sequence
  Description of Artificial Sequence: Synthetic oligonucleotide
aacagctttctcatgggccctgtgaccc

SEQ ID NO: 167137 - DNA, 27 bp, Artificial Sequence
  Description of Artificial Sequence: Synthetic oligonucleotide
acagctttctcatgggccctgtgaccc

SEQ ID NO: 167138 - DNA, 26 bp, Artificial Sequence
  Description of Artificial Sequence: Synthetic oligonucleotide
cagctttctcatgggccctgtgaccc

SEQ ID NO: 167139 - DNA, 27 bp, Artificial Sequence
  Description of Artificial Sequence: Synthetic oligonucleotide
agctttctcatgggccctgtgacccca

SEQ ID NO: 167140 - DNA, 26 bp, Artificial Sequence
  Description of Artificial Sequence: Synthetic oligonucleotide
gctttctcatgggccctgtgacccca

SEQ ID NO: 167141 - DNA, 26 bp, Artificial Sequence
  Description of Artificial Sequence: Synthetic oligonucleotide
ctttctcatgggccctgtgaccccag

SEQ ID NO: 167142 - DNA, 27 bp, Artificial Sequence
  Description of Artificial Sequence: Synthetic oligonucleotide
tttctcatgggccctgtgaccccagca

SEQ ID NO: 167143 - DNA, 26 bp, Artificial Sequence
  Description of Artificial Sequence: Synthetic oligonucleotide
ttctcatgggccctgtgaccccagca

SEQ ID NO: 167144 - DNA, 25 bp, Artificial Sequence
  Description of Artificial Sequence: Synthetic oligonucleotide
tctcatgggccctgtgaccccagca

SEQ ID NO: 167145 - DNA, 24 bp, Artificial Sequence
  Description of Artificial Sequence: Synthetic oligonucleotide
ctcatgggccctgtgaccccagca

SEQ ID NO: 167146 - DNA, 29 bp, Artificial Sequence
  Description of Artificial Sequence: Synthetic oligonucleotide
ccagcacatgcagggacctacagatgttg

SEQ ID NO: 167147 - DNA, 29 bp, Artificial Sequence
  Description of Artificial Sequence: Synthetic oligonucleotide
cagcacatgcagggacctacagatgttgc

SEQ ID NO: 167148 - DNA, 30 bp, Artificial Sequence
  Description of Artificial Sequence: Synthetic oligonucleotide
agcacatgcagggacctacagatgttgcag

SEQ ID NO: 167149 - DNA, 29 bp, Artificial Sequence
  Description of Artificial Sequence: Synthetic oligonucleotide
gcacatgcagggacctacagatgttgcag

SEQ ID NO: 167150 - DNA, 31 bp, Artificial Sequence
  Description of Artificial Sequence: Synthetic oligonucleotide
cacatgcagggacctacagatgttgcagttc

SEQ ID NO: 167151 - DNA, 32 bp, Artificial Sequence
  Description of Artificial Sequence: Synthetic oligonucleotide
acatgcagggacctacagatgttgcagttcac

SEQ ID NO: 167152 - DNA, 31 bp, Artificial Sequence
  Description of Artificial Sequence: Synthetic oligonucleotide
catgcagggacctacagatgttgcagttcac

SEQ ID NO: 167153 - DNA, 32 bp, Artificial Sequence
  Description of Artificial Sequence: Synthetic oligonucleotide
atgcagggacctacagatgttgcagttcacac

SEQ ID NO: 167154 - DNA, 31 bp, Artificial Sequence
  Description of Artificial Sequence: Synthetic oligonucleotide
tgcagggacctacagatgttgcagttcacac

SEQ ID NO: 167155 - DNA, 30 bp, Artificial Sequence
  Description of Artificial Sequence: Synthetic oligonucleotide
gcagggacctacagatgttgcagttcacac

SEQ ID NO: 167156 - DNA, 30 bp, Artificial Sequence
  Description of Artificial Sequence: Synthetic oligonucleotide
cagggacctacagatgttgcagttcacacc

SEQ ID NO: 167157 - DNA, 30 bp, Artificial Sequence
  Description of Artificial Sequence: Synthetic oligonucleotide
agggacctacagatgttgcagttcacaccc

SEQ ID NO: 167158 - DNA, 29 bp, Artificial Sequence
  Description of Artificial Sequence: Synthetic oligonucleotide
gggacctacagatgttgcagttcacaccc

SEQ ID NO: 167159 - DNA, 30 bp, Artificial Sequence
  Description of Artificial Sequence: Synthetic oligonucleotide
ggacctacagatgttgcagttcacacccac

SEQ ID NO: 167160 - DNA, 31 bp, Artificial Sequence
  Description of Artificial Sequence: Synthetic oligonucleotide
gacctacagatgttgcagttcacacccacac

SEQ ID NO: 167161 - DNA, 32 bp, Artificial Sequence
  Description of Artificial Sequence: Synthetic oligonucleotide
acctacagatgttgcagttcacacccacactc

SEQ ID NO: 167162 - DNA, 31 bp, Artificial Sequence
  Description of Artificial Sequence: Synthetic oligonucleotide
cctacagatgttgcagttcacacccacactc

SEQ ID NO: 167163 - DNA, 31 bp, Artificial Sequence
  Description of Artificial Sequence: Synthetic oligonucleotide
ctacagatgttgcagttcacacccacactcc

SEQ ID NO: 167164 - DNA, 31 bp, Artificial Sequence
  Description of Artificial Sequence: Synthetic oligonucleotide
tacagatgttgcagttcacacccacactccc

SEQ ID NO: 167165 - DNA, 30 bp, Artificial Sequence
  Description of Artificial Sequence: Synthetic oligonucleotide
acagatgttgcagttcacacccacactccc

SEQ ID NO: 167166 - DNA, 29 bp, Artificial Sequence
  Description of Artificial Sequence: Synthetic oligonucleotide
cagatgttgcagttcacacccacactccc

SEQ ID NO: 167167 - DNA, 29 bp, Artificial Sequence
  Description of Artificial Sequence: Synthetic oligonucleotide
agatgttgcagttcacacccacactcccc

SEQ ID NO: 167168 - DNA, 28 bp, Artificial Sequence
  Description of Artificial Sequence: Synthetic oligonucleotide
gatgttgcagttcacacccacactcccc

SEQ ID NO: 167169 - DNA, 28 bp, Artificial Sequence
  Description of Artificial Sequence: Synthetic oligonucleotide
atgttgcagttcacacccacactccccc

SEQ ID NO: 167170 - DNA, 27 bp, Artificial Sequence
  Description of Artificial Sequence: Synthetic oligonucleotide
tgttgcagttcacacccacactccccc

SEQ ID NO: 167171 - DNA, 27 bp, Artificial Sequence
  Description of Artificial Sequence: Synthetic oligonucleotide
gttgcagttcacacccacactccccca

SEQ ID NO: 167172 - DNA, 27 bp, Artificial Sequence
  Description of Artificial Sequence: Synthetic oligonucleotide
ttgcagttcacacccacactcccccac

SEQ ID NO: 167173 - DNA, 27 bp, Artificial Sequence
  Description of Artificial Sequence: Synthetic oligonucleotide
tgcagttcacacccacactcccccact

SEQ ID NO: 167174 - DNA, 26 bp, Artificial Sequence
  Description of Artificial Sequence: Synthetic oligonucleotide
gcagttcacacccacactcccccact

SEQ ID NO: 167175 - DNA, 26 bp, Artificial Sequence
  Description of Artificial Sequence: Synthetic oligonucleotide
cagttcacacccacactcccccactg

SEQ ID NO: 167176 - DNA, 26 bp, Artificial Sequence
  Description of Artificial Sequence: Synthetic oligonucleotide
agttcacacccacactcccccactgg

SEQ ID NO: 167177 - DNA, 23 bp, Artificial Sequence
  Description of Artificial Sequence: Synthetic oligonucleotide
ggtggtcggcacccagcaaccct

SEQ ID NO: 167178 - DNA, 24 bp, Artificial Sequence
  Description of Artificial Sequence: Synthetic oligonucleotide
gtggtcggcacccagcaaccctgt

SEQ ID NO: 167179 - DNA, 24 bp, Artificial Sequence
  Description of Artificial Sequence: Synthetic oligonucleotide
tggtcggcacccagcaaccctgtg

SEQ ID NO: 167180 - DNA, 23 bp, Artificial Sequence
  Description of Artificial Sequence: Synthetic oligonucleotide
ggtcggcacccagcaaccctgtg

SEQ ID NO: 167181 - DNA, 24 bp, Artificial Sequence
  Description of Artificial Sequence: Synthetic oligonucleotide
gtcggcacccagcaaccctgtggt

SEQ ID NO: 167182 - DNA, 26 bp, Artificial Sequence
  Description of Artificial Sequence: Synthetic oligonucleotide
tcggcacccagcaaccctgtggtgat

SEQ ID NO: 167183 - DNA, 25 bp, Artificial Sequence
  Description of Artificial Sequence: Synthetic oligonucleotide
cggcacccagcaaccctgtggtgat

SEQ ID NO: 167184 - DNA, 27 bp, Artificial Sequence
  Description of Artificial Sequence: Synthetic oligonucleotide
ggcacccagcaaccctgtggtgatcat

SEQ ID NO: 167185 - DNA, 27 bp, Artificial Sequence
  Description of Artificial Sequence: Synthetic oligonucleotide
gcacccagcaaccctgtggtgatcatg

SEQ ID NO: 167186 - DNA, 27 bp, Artificial Sequence
  Description of Artificial Sequence: Synthetic oligonucleotide
cacccagcaaccctgtggtgatcatgg

SEQ ID NO: 167187 - DNA, 28 bp, Artificial Sequence
  Description of Artificial Sequence: Synthetic oligonucleotide
acccagcaaccctgtggtgatcatggtc

SEQ ID NO: 167188 - DNA, 27 bp, Artificial Sequence
  Description of Artificial Sequence: Synthetic oligonucleotide
cccagcaaccctgtggtgatcatggtc

SEQ ID NO: 167189 - DNA, 28 bp, Artificial Sequence
  Description of Artificial Sequence: Synthetic oligonucleotide
ccagcaaccctgtggtgatcatggtcac

SEQ ID NO: 167190 - DNA, 29 bp, Artificial Sequence
  Description of Artificial Sequence: Synthetic oligonucleotide
cagcaaccctgtggtgatcatggtcacag

SEQ ID NO: 167191 - DNA, 29 bp, Artificial Sequence
  Description of Artificial Sequence: Synthetic oligonucleotide
agcaaccctgtggtgatcatggtcacagg

SEQ ID NO: 167192 - DNA, 28 bp, Artificial Sequence
  Description of Artificial Sequence: Synthetic oligonucleotide
gcaaccctgtggtgatcatggtcacagg

SEQ ID NO: 167193 - DNA, 29 bp, Artificial Sequence
  Description of Artificial Sequence: Synthetic oligonucleotide
caaccctgtggtgatcatggtcacaggag

SEQ ID NO: 167194 - DNA, 30 bp, Artificial Sequence
  Description of Artificial Sequence: Synthetic oligonucleotide
aaccctgtggtgatcatggtcacaggagtc

SEQ ID NO: 167195 - DNA, 29 bp, Artificial Sequence
  Description of Artificial Sequence: Synthetic oligonucleotide
accctgtggtgatcatggtcacaggagtc

SEQ ID NO: 167196 - DNA, 28 bp, Artificial Sequence
  Description of Artificial Sequence: Synthetic oligonucleotide
ccctgtggtgatcatggtcacaggagtc

SEQ ID NO: 167197 - DNA, 28 bp, Artificial Sequence
  Description of Artificial Sequence: Synthetic oligonucleotide
cctgtggtgatcatggtcacaggagtcc

SEQ ID NO: 167198 - DNA, 29 bp, Artificial Sequence
  Description of Artificial Sequence: Synthetic oligonucleotide
ctgtggtgatcatggtcacaggagtccac

SEQ ID NO: 167199 - DNA, 30 bp, Artificial Sequence
  Description of Artificial Sequence: Synthetic oligonucleotide
tgtggtgatcatggtcacaggagtccacag

SEQ ID NO: 167200 - DNA, 29 bp, Artificial Sequence
  Description of Artificial Sequence: Synthetic oligonucleotide
gtggtgatcatggtcacaggagtccacag

SEQ ID NO: 167201 - DNA, 33 bp, Artificial Sequence
  Description of Artificial Sequence: Synthetic oligonucleotide
tggtgatcatggtcacaggagtccacagaaaac

SEQ ID NO: 167202 - DNA, 32 bp, Artificial Sequence
  Description of Artificial Sequence: Synthetic oligonucleotide
ggtgatcatggtcacaggagtccacagaaaac

SEQ ID NO: 167203 - DNA, 32 bp, Artificial Sequence
  Description of Artificial Sequence: Synthetic oligonucleotide
gtgatcatggtcacaggagtccacagaaaacc

SEQ ID NO: 167204 - DNA, 34 bp, Artificial Sequence
  Description of Artificial Sequence: Synthetic oligonucleotide
tgatcatggtcacaggagtccacagaaaaccttc

SEQ ID NO: 167205 - DNA, 33 bp, Artificial Sequence
  Description of Artificial Sequence: Synthetic oligonucleotide
gatcatggtcacaggagtccacagaaaaccttc

SEQ ID NO: 167206 - DNA, 33 bp, Artificial Sequence
  Description of Artificial Sequence: Synthetic oligonucleotide
atcatggtcacaggagtccacagaaaaccttcc

SEQ ID NO: 167207 - DNA, 32 bp, Artificial Sequence
  Description of Artificial Sequence: Synthetic oligonucleotide
tcatggtcacaggagtccacagaaaaccttcc

SEQ ID NO: 167208 - DNA, 31 bp, Artificial Sequence
  Description of Artificial Sequence: Synthetic oligonucleotide
catggtcacaggagtccacagaaaaccttcc

SEQ ID NO: 167209 - DNA, 31 bp, Artificial Sequence
  Description of Artificial Sequence: Synthetic oligonucleotide
atggtcacaggagtccacagaaaaccttccc

SEQ ID NO: 167210 - DNA, 30 bp, Artificial Sequence
  Description of Artificial Sequence: Synthetic oligonucleotide
tggtcacaggagtccacagaaaaccttccc

SEQ ID NO: 167211 - DNA, 29 bp, Artificial Sequence
  Description of Artificial Sequence: Synthetic oligonucleotide
ggtcacaggagtccacagaaaaccttccc

SEQ ID NO: 167212 - DNA, 30 bp, Artificial Sequence
  Description of Artificial Sequence: Synthetic oligonucleotide
gtcacaggagtccacagaaaaccttccctc

SEQ ID NO: 167213 - DNA, 30 bp, Artificial Sequence
  Description of Artificial Sequence: Synthetic oligonucleotide
tcacaggagtccacagaaaaccttccctcc

SEQ ID NO: 167214 - DNA, 25 bp, Artificial Sequence
  Description of Artificial Sequence: Synthetic oligonucleotide
cccacccaggtcccctggtgaaatc

SEQ ID NO: 167215 - DNA, 25 bp, Artificial Sequence
  Description of Artificial Sequence: Synthetic oligonucleotide
ccacccaggtcccctggtgaaatcg

SEQ ID NO: 167216 - DNA, 25 bp, Artificial Sequence
  Description of Artificial Sequence: Synthetic oligonucleotide
cacccaggtcccctggtgaaatcgg

SEQ ID NO: 167217 - DNA, 26 bp, Artificial Sequence
  Description of Artificial Sequence: Synthetic oligonucleotide
acccaggtcccctggtgaaatcggga

SEQ ID NO: 167218 - DNA, 25 bp, Artificial Sequence
  Description of Artificial Sequence: Synthetic oligonucleotide
cccaggtcccctggtgaaatcggga

SEQ ID NO: 167219 - DNA, 26 bp, Artificial Sequence
  Description of Artificial Sequence: Synthetic oligonucleotide
ccaggtcccctggtgaaatcgggaga

SEQ ID NO: 167220 - DNA, 27 bp, Artificial Sequence
  Description of Artificial Sequence: Synthetic oligonucleotide
caggtcccctggtgaaatcgggagaga

SEQ ID NO: 167221 - DNA, 27 bp, Artificial Sequence
  Description of Artificial Sequence: Synthetic oligonucleotide
aggtcccctggtgaaatcgggagagac

SEQ ID NO: 167222 - DNA, 26 bp, Artificial Sequence
  Description of Artificial Sequence: Synthetic oligonucleotide
ggtcccctggtgaaatcgggagagac

SEQ ID NO: 167223 - DNA, 26 bp, Artificial Sequence
  Description of Artificial Sequence: Synthetic oligonucleotide
gtcccctggtgaaatcgggagagacg

SEQ ID NO: 167224 - DNA, 27 bp, Artificial Sequence
  Description of Artificial Sequence: Synthetic oligonucleotide
tcccctggtgaaatcgggagagacggt

SEQ ID NO: 167225 - DNA, 26 bp, Artificial Sequence
  Description of Artificial Sequence: Synthetic oligonucleotide
cccctggtgaaatcgggagagacggt

SEQ ID NO: 167226 - DNA, 27 bp, Artificial Sequence
  Description of Artificial Sequence: Synthetic oligonucleotide
ccctggtgaaatcgggagagacggtca

SEQ ID NO: 167227 - DNA, 28 bp, Artificial Sequence
  Description of Artificial Sequence: Synthetic oligonucleotide
cctggtgaaatcgggagagacggtcatc

SEQ ID NO: 167228 - DNA, 28 bp, Artificial Sequence
  Description of Artificial Sequence: Synthetic oligonucleotide
ctggtgaaatcgggagagacggtcatcc

SEQ ID NO: 167229 - DNA, 29 bp, Artificial Sequence
  Description of Artificial Sequence: Synthetic oligonucleotide
tggtgaaatcgggagagacggtcatcctg

SEQ ID NO: 167230 - DNA, 28 bp, Artificial Sequence
  Description of Artificial Sequence: Synthetic oligonucleotide
ggtgaaatcgggagagacggtcatcctg

SEQ ID NO: 167231 - DNA, 28 bp, Artificial Sequence
  Description of Artificial Sequence: Synthetic oligonucleotide
gtgaaatcgggagagacggtcatcctgc

SEQ ID NO: 167232 - DNA, 31 bp, Artificial Sequence
  Description of Artificial Sequence: Synthetic oligonucleotide
tgaaatcgggagagacggtcatcctgcaatg

SEQ ID NO: 167233 - DNA, 30 bp, Artificial Sequence
  Description of Artificial Sequence: Synthetic oligonucleotide
gaaatcgggagagacggtcatcctgcaatg

SEQ ID NO: 167234 - DNA, 32 bp, Artificial Sequence
  Description of Artificial Sequence: Synthetic oligonucleotide
aaatcgggagagacggtcatcctgcaatgttg

SEQ ID NO: 167235 - DNA, 31 bp, Artificial Sequence
  Description of Artificial Sequence: Synthetic oligonucleotide
aatcgggagagacggtcatcctgcaatgttg

SEQ ID NO: 167236 - DNA, 30 bp, Artificial Sequence
  Description of Artificial Sequence: Synthetic oligonucleotide
atcgggagagacggtcatcctgcaatgttg

SEQ ID NO: 167237 - DNA, 29 bp, Artificial Sequence
  Description of Artificial Sequence: Synthetic oligonucleotide
tcgggagagacggtcatcctgcaatgttg

SEQ ID NO: 167238 - DNA, 28 bp, Artificial Sequence
  Description of Artificial Sequence: Synthetic oligonucleotide
cgggagagacggtcatcctgcaatgttg

SEQ ID NO: 167239 - DNA, 28 bp, Artificial Sequence
  Description of Artificial Sequence: Synthetic oligonucleotide
gggagagacggtcatcctgcaatgttgg

SEQ ID NO: 167240 - DNA, 29 bp, Artificial Sequence
  Description of Artificial Sequence: Synthetic oligonucleotide
ggagagacggtcatcctgcaatgttggtc

SEQ ID NO: 167241 - DNA, 30 bp, Artificial Sequence
  Description of Artificial Sequence: Synthetic oligonucleotide
gagagacggtcatcctgcaatgttggtcag

SEQ ID NO: 167242 - DNA, 32 bp, Artificial Sequence
  Description of Artificial Sequence: Synthetic oligonucleotide
agagacggtcatcctgcaatgttggtcagatg

SEQ ID NO: 167243 - DNA, 31 bp, Artificial Sequence
  Description of Artificial Sequence: Synthetic oligonucleotide
gagacggtcatcctgcaatgttggtcagatg

SEQ ID NO: 167244 - DNA, 32 bp, Artificial Sequence
  Description of Artificial Sequence: Synthetic oligonucleotide
agacggtcatcctgcaatgttggtcagatgtc

SEQ ID NO: 167245 - DNA, 31 bp, Artificial Sequence
  Description of Artificial Sequence: Synthetic oligonucleotide
gacggtcatcctgcaatgttggtcagatgtc

SEQ ID NO: 167246 - DNA, 32 bp, Artificial Sequence
  Description of Artificial Sequence: Synthetic oligonucleotide
acggtcatcctgcaatgttggtcagatgtcag

SEQ ID NO: 167247 - DNA, 31 bp, Artificial Sequence
  Description of Artificial Sequence: Synthetic oligonucleotide
cggtcatcctgcaatgttggtcagatgtcag

SEQ ID NO: 167248 - DNA, 31 bp, Artificial Sequence
  Description of Artificial Sequence: Synthetic oligonucleotide
ggtcatcctgcaatgttggtcagatgtcagg

SEQ ID NO: 167249 - DNA, 32 bp, Artificial Sequence
  Description of Artificial Sequence: Synthetic oligonucleotide
ctgcaatgttggtcagatgtcaggtttgagcg

SEQ ID NO: 167250 - DNA, 32 bp, Artificial Sequence
  Description of Artificial Sequence: Synthetic oligonucleotide
tgcaatgttggtcagatgtcaggtttgagcgc

SEQ ID NO: 167251 - DNA, 31 bp, Artificial Sequence
  Description of Artificial Sequence: Synthetic oligonucleotide
gcaatgttggtcagatgtcaggtttgagcgc

SEQ ID NO: 167252 - DNA, 33 bp, Artificial Sequence
  Description of Artificial Sequence: Synthetic oligonucleotide
caatgttggtcagatgtcaggtttgagcgcttc

SEQ ID NO: 167253 - DNA, 33 bp, Artificial Sequence
  Description of Artificial Sequence: Synthetic oligonucleotide
aatgttggtcagatgtcaggtttgagcgcttcc

SEQ ID NO: 167254 - DNA, 32 bp, Artificial Sequence
  Description of Artificial Sequence: Synthetic oligonucleotide
atgttggtcagatgtcaggtttgagcgcttcc

SEQ ID NO: 167255 - DNA, 31 bp, Artificial Sequence
  Description of Artificial Sequence: Synthetic oligonucleotide
tgttggtcagatgtcaggtttgagcgcttcc

SEQ ID NO: 167256 - DNA, 30 bp, Artificial Sequence
  Description of Artificial Sequence: Synthetic oligonucleotide
gttggtcagatgtcaggtttgagcgcttcc

SEQ ID NO: 167257 - DNA, 32 bp, Artificial Sequence
  Description of Artificial Sequence: Synthetic oligonucleotide
ttggtcagatgtcaggtttgagcgcttccttc

SEQ ID NO: 167258 - DNA, 31 bp, Artificial Sequence
  Description of Artificial Sequence: Synthetic oligonucleotide
tggtcagatgtcaggtttgagcgcttccttc

SEQ ID NO: 167259 - DNA, 30 bp, Artificial Sequence
  Description of Artificial Sequence: Synthetic oligonucleotide
ggtcagatgtcaggtttgagcgcttccttc

SEQ ID NO: 167260 - DNA, 31 bp, Artificial Sequence
  Description of Artificial Sequence: Synthetic oligonucleotide
gtcagatgtcaggtttgagcgcttccttctg

SEQ ID NO: 167261 - DNA, 31 bp, Artificial Sequence
  Description of Artificial Sequence: Synthetic oligonucleotide
tcagatgtcaggtttgagcgcttccttctgc

SEQ ID NO: 167262 - DNA, 30 bp, Artificial Sequence
  Description of Artificial Sequence: Synthetic oligonucleotide
cagatgtcaggtttgagcgcttccttctgc

SEQ ID NO: 167263 - DNA, 31 bp, Artificial Sequence
  Description of Artificial Sequence: Synthetic oligonucleotide
agatgtcaggtttgagcgcttccttctgcac

SEQ ID NO: 167264 - DNA, 30 bp, Artificial Sequence
  Description of Artificial Sequence: Synthetic oligonucleotide
gatgtcaggtttgagcgcttccttctgcac

SEQ ID NO: 167265 - DNA, 31 bp, Artificial Sequence
  Description of Artificial Sequence: Synthetic oligonucleotide
atgtcaggtttgagcgcttccttctgcacag

SEQ ID NO: 167266 - DNA, 30 bp, Artificial Sequence
  Description of Artificial Sequence: Synthetic oligonucleotide
tgtcaggtttgagcgcttccttctgcacag

SEQ ID NO: 167267 - DNA, 29 bp, Artificial Sequence
  Description of Artificial Sequence: Synthetic oligonucleotide
gtcaggtttgagcgcttccttctgcacag

SEQ ID NO: 167268 - DNA, 30 bp, Artificial Sequence
  Description of Artificial Sequence: Synthetic oligonucleotide
tcaggtttgagcgcttccttctgcacagag

SEQ ID NO: 167269 - DNA, 29 bp, Artificial Sequence
  Description of Artificial Sequence: Synthetic oligonucleotide
caggtttgagcgcttccttctgcacagag

SEQ ID NO: 167270 - DNA, 30 bp, Artificial Sequence
  Description of Artificial Sequence: Synthetic oligonucleotide
aggtttgagcgcttccttctgcacagagag

SEQ ID NO: 167271 - DNA, 29 bp, Artificial Sequence
  Description of Artificial Sequence: Synthetic oligonucleotide
ggtttgagcgcttccttctgcacagagag

SEQ ID NO: 167272 - DNA, 29 bp, Artificial Sequence
  Description of Artificial Sequence: Synthetic oligonucleotide
gtttgagcgcttccttctgcacagagagg

SEQ ID NO: 167273 - DNA, 29 bp, Artificial Sequence
  Description of Artificial Sequence: Synthetic oligonucleotide
tttgagcgcttccttctgcacagagaggg

SEQ ID NO: 167274 - DNA, 28 bp, Artificial Sequence
  Description of Artificial Sequence: Synthetic oligonucleotide
ttgagcgcttccttctgcacagagaggg

SEQ ID NO: 167275 - DNA, 27 bp, Artificial Sequence
  Description of Artificial Sequence: Synthetic oligonucleotide
tgagcgcttccttctgcacagagaggg

SEQ ID NO: 167276 - DNA, 26 bp, Artificial Sequence
  Description of Artificial Sequence: Synthetic oligonucleotide
gagcgcttccttctgcacagagaggg

SEQ ID NO: 167277 - DNA, 27 bp, Artificial Sequence
  Description of Artificial Sequence: Synthetic oligonucleotide
agcgcttccttctgcacagagagggga

SEQ ID NO: 167278 - DNA, 27 bp, Artificial Sequence
  Description of Artificial Sequence: Synthetic oligonucleotide
gcgcttccttctgcacagagaggggat

SEQ ID NO: 167279 - DNA, 27 bp, Artificial Sequence
  Description of Artificial Sequence: Synthetic oligonucleotide
cgcttccttctgcacagagaggggatc

SEQ ID NO: 167280 - DNA, 28 bp, Artificial Sequence
  Description of Artificial Sequence: Synthetic oligonucleotide
gcttccttctgcacagagaggggatcac

SEQ ID NO: 167281 - DNA, 29 bp, Artificial Sequence
  Description of Artificial Sequence: Synthetic oligonucleotide
cttccttctgcacagagaggggatcactg

SEQ ID NO: 167282 - DNA, 30 bp, Artificial Sequence
  Description of Artificial Sequence: Synthetic oligonucleotide
ttccttctgcacagagaggggatcactgag

SEQ ID NO: 167283 - DNA, 29 bp, Artificial Sequence
  Description of Artificial Sequence: Synthetic oligonucleotide
tccttctgcacagagaggggatcactgag

SEQ ID NO: 167284 - DNA, 28 bp, Artificial Sequence
  Description of Artificial Sequence: Synthetic oligonucleotide
ccttctgcacagagaggggatcactgag

SEQ ID NO: 167285 - DNA, 28 bp, Artificial Sequence
  Description of Artificial Sequence: Synthetic oligonucleotide
cttctgcacagagaggggatcactgagg

SEQ ID NO: 167286 - DNA, 29 bp, Artificial Sequence
  Description of Artificial Sequence: Synthetic oligonucleotide
ttctgcacagagaggggatcactgaggac

SEQ ID NO: 167287 - DNA, 28 bp, Artificial Sequence
  Description of Artificial Sequence: Synthetic oligonucleotide
tctgcacagagaggggatcactgaggac

SEQ ID NO: 167288 - DNA, 27 bp, Artificial Sequence
  Description of Artificial Sequence: Synthetic oligonucleotide
ctgcacagagaggggatcactgaggac

SEQ ID NO: 167289 - DNA, 27 bp, Artificial Sequence
  Description of Artificial Sequence: Synthetic oligonucleotide
tgcacagagaggggatcactgaggacc

SEQ ID NO: 167290 - DNA, 26 bp, Artificial Sequence
  Description of Artificial Sequence: Synthetic oligonucleotide
gcacagagaggggatcactgaggacc

SEQ ID NO: 167291 - DNA, 26 bp, Artificial Sequence
  Description of Artificial Sequence: Synthetic oligonucleotide
cacagagaggggatcactgaggaccc

SEQ ID NO: 167292 - DNA, 27 bp, Artificial Sequence
  Description of Artificial Sequence: Synthetic oligonucleotide
acagagaggggatcactgaggacccct

SEQ ID NO: 167293 - DNA, 27 bp, Artificial Sequence
  Description of Artificial Sequence: Synthetic oligonucleotide
cagagaggggatcactgaggacccctt

SEQ ID NO: 167294 - DNA, 27 bp, Artificial Sequence
  Description of Artificial Sequence: Synthetic oligonucleotide
agagaggggatcactgaggaccccttg

SEQ ID NO: 167295 - DNA, 26 bp, Artificial Sequence
  Description of Artificial Sequence: Synthetic oligonucleotide
gagaggggatcactgaggaccccttg

SEQ ID NO: 167296 - DNA, 26 bp, Artificial Sequence
  Description of Artificial Sequence: Synthetic oligonucleotide
agaggggatcactgaggaccccttgc

SEQ ID NO: 167297 - DNA, 25 bp, Artificial Sequence
  Description of Artificial Sequence: Synthetic oligonucleotide
gaggggatcactgaggaccccttgc

SEQ ID NO: 167298 - DNA, 25 bp, Artificial Sequence
  Description of Artificial Sequence: Synthetic oligonucleotide
aggggatcactgaggaccccttgcg

SEQ ID NO: 167299 - DNA, 24 bp, Artificial Sequence
  Description of Artificial Sequence: Synthetic oligonucleotide
ggggatcactgaggaccccttgcg

SEQ ID NO: 167300 - DNA, 24 bp, Artificial Sequence
  Description of Artificial Sequence: Synthetic oligonucleotide
gggatcactgaggaccccttgcgc

SEQ ID NO: 167301 - DNA, 25 bp, Artificial Sequence
  Description of Artificial Sequence: Synthetic oligonucleotide
ggatcactgaggaccccttgcgcct

SEQ ID NO: 167302 - DNA, 27 bp, Artificial Sequence
  Description of Artificial Sequence: Synthetic oligonucleotide
gatcactgaggaccccttgcgcctcat

SEQ ID NO: 167303 - DNA, 28 bp, Artificial Sequence
  Description of Artificial Sequence: Synthetic oligonucleotide
atcactgaggaccccttgcgcctcattg

SEQ ID NO: 167304 - DNA, 27 bp, Artificial Sequence
  Description of Artificial Sequence: Synthetic oligonucleotide
tcactgaggaccccttgcgcctcattg

SEQ ID NO: 167305 - DNA, 26 bp, Artificial Sequence
  Description of Artificial Sequence: Synthetic oligonucleotide
cactgaggaccccttgcgcctcattg

SEQ ID NO: 167306 - DNA, 27 bp, Artificial Sequence
  Description of Artificial Sequence: Synthetic oligonucleotide
actgaggaccccttgcgcctcattgga

SEQ ID NO: 167307 - DNA, 26 bp, Artificial Sequence
  Description of Artificial Sequence: Synthetic oligonucleotide
ctgaggaccccttgcgcctcattgga

SEQ ID NO: 167308 - DNA, 27 bp, Artificial Sequence
  Description of Artificial Sequence: Synthetic oligonucleotide
tgaggaccccttgcgcctcattggaca

SEQ ID NO: 167309 - DNA, 26 bp, Artificial Sequence
  Description of Artificial Sequence: Synthetic oligonucleotide
gaggaccccttgcgcctcattggaca

SEQ ID NO: 167310 - DNA, 26 bp, Artificial Sequence
  Description of Artificial Sequence: Synthetic oligonucleotide
aggaccccttgcgcctcattggacag

SEQ ID NO: 167311 - DNA, 25 bp, Artificial Sequence
  Description of Artificial Sequence: Synthetic oligonucleotide
ggaccccttgcgcctcattggacag

SEQ ID NO: 167312 - DNA, 26 bp, Artificial Sequence
  Description of Artificial Sequence: Synthetic oligonucleotide
gaccccttgcgcctcattggacagct

SEQ ID NO: 167313 - DNA, 26 bp, Artificial Sequence
  Description of Artificial Sequence: Synthetic oligonucleotide
accccttgcgcctcattggacagctc

SEQ ID NO: 167314 - DNA, 25 bp, Artificial Sequence
  Description of Artificial Sequence: Synthetic oligonucleotide
ccccttgcgcctcattggacagctc

SEQ ID NO: 167315 - DNA, 26 bp, Artificial Sequence
  Description of Artificial Sequence: Synthetic oligonucleotide
cccttgcgcctcattggacagctcca

SEQ ID NO: 167316 - DNA, 26 bp, Artificial Sequence
  Description of Artificial Sequence: Synthetic oligonucleotide
ccttgcgcctcattggacagctccac

SEQ ID NO: 167317 - DNA, 27 bp, Artificial Sequence
  Description of Artificial Sequence: Synthetic oligonucleotide
cttgcgcctcattggacagctccacga

SEQ ID NO: 167318 - DNA, 28 bp, Artificial Sequence
  Description of Artificial Sequence: Synthetic oligonucleotide
ttgcgcctcattggacagctccacgatg

SEQ ID NO: 167319 - DNA, 27 bp, Artificial Sequence
  Description of Artificial Sequence: Synthetic oligonucleotide
tgcgcctcattggacagctccacgatg

SEQ ID NO: 167320 - DNA, 26 bp, Artificial Sequence
  Description of Artificial Sequence: Synthetic oligonucleotide
gcgcctcattggacagctccacgatg

SEQ ID NO: 167321 - DNA, 26 bp, Artificial Sequence
  Description of Artificial Sequence: Synthetic oligonucleotide
cgcctcattggacagctccacgatgc

SEQ ID NO: 167322 - DNA, 26 bp, Artificial Sequence
  Description of Artificial Sequence: Synthetic oligonucleotide
gcctcattggacagctccacgatgcg

SEQ ID NO: 167323 - DNA, 26 bp, Artificial Sequence
  Description of Artificial Sequence: Synthetic oligonucleotide
cctcattggacagctccacgatgcgg

SEQ ID NO: 167324 - DNA, 27 bp, Artificial Sequence
  Description of Artificial Sequence: Synthetic oligonucleotide
ctcattggacagctccacgatgcgggt

SEQ ID NO: 167325 - DNA, 28 bp, Artificial Sequence
  Description of Artificial Sequence: Synthetic oligonucleotide
tcattggacagctccacgatgcgggttc

SEQ ID NO: 167326 - DNA, 27 bp, Artificial Sequence
  Description of Artificial Sequence: Synthetic oligonucleotide
cattggacagctccacgatgcgggttc

SEQ ID NO: 167327 - DNA, 27 bp, Artificial Sequence
  Description of Artificial Sequence: Synthetic oligonucleotide
attggacagctccacgatgcgggttcc

SEQ ID NO: 167328 - DNA, 26 bp, Artificial Sequence
  Description of Artificial Sequence: Synthetic oligonucleotide
ttggacagctccacgatgcgggttcc

SEQ ID NO: 167329 - DNA, 25 bp, Artificial Sequence
  Description of Artificial Sequence: Synthetic oligonucleotide
tggacagctccacgatgcgggttcc

SEQ ID NO: 167330 - DNA, 24 bp, Artificial Sequence
  Description of Artificial Sequence: Synthetic oligonucleotide
ggacagctccacgatgcgggttcc

SEQ ID NO: 167331 - DNA, 25 bp, Artificial Sequence
  Description of Artificial Sequence: Synthetic oligonucleotide
gacagctccacgatgcgggttccca

SEQ ID NO: 167332 - DNA, 25 bp, Artificial Sequence
  Description of Artificial Sequence: Synthetic oligonucleotide
acagctccacgatgcgggttcccag

SEQ ID NO: 167333 - DNA, 24 bp, Artificial Sequence
  Description of Artificial Sequence: Synthetic oligonucleotide
cagctccacgatgcgggttcccag

SEQ ID NO: 167334 - DNA, 25 bp, Artificial Sequence
  Description of Artificial Sequence: Synthetic oligonucleotide
agctccacgatgcgggttcccaggt

SEQ ID NO: 167335 - DNA, 24 bp, Artificial Sequence
  Description of Artificial Sequence: Synthetic oligonucleotide
gctccacgatgcgggttcccaggt

SEQ ID NO: 167336 - DNA, 26 bp, Artificial Sequence
  Description of Artificial Sequence: Synthetic oligonucleotide
ctccacgatgcgggttcccaggtcaa

SEQ ID NO: 167337 - DNA, 27 bp, Artificial Sequence
  Description of Artificial Sequence: Synthetic oligonucleotide
tccacgatgcgggttcccaggtcaact

SEQ ID NO: 167338 - DNA, 27 bp, Artificial Sequence
  Description of Artificial Sequence: Synthetic oligonucleotide
ccacgatgcgggttcccaggtcaacta

SEQ ID NO: 167339 - DNA, 29 bp, Artificial Sequence
  Description of Artificial Sequence: Synthetic oligonucleotide
cacgatgcgggttcccaggtcaactattc

SEQ ID NO: 167340 - DNA, 29 bp, Artificial Sequence
  Description of Artificial Sequence: Synthetic oligonucleotide
acgatgcgggttcccaggtcaactattcc

SEQ ID NO: 167341 - DNA, 28 bp, Artificial Sequence
  Description of Artificial Sequence: Synthetic oligonucleotide
cgatgcgggttcccaggtcaactattcc

SEQ ID NO: 167342 - DNA, 30 bp, Artificial Sequence
  Description of Artificial Sequence: Synthetic oligonucleotide
gatgcgggttcccaggtcaactattccatg

SEQ ID NO: 167343 - DNA, 30 bp, Artificial Sequence
  Description of Artificial Sequence: Synthetic oligonucleotide
atgcgggttcccaggtcaactattccatgg

SEQ ID NO: 167344 - DNA, 29 bp, Artificial Sequence
  Description of Artificial Sequence: Synthetic oligonucleotide
tgcgggttcccaggtcaactattccatgg

SEQ ID NO: 167345 - DNA, 28 bp, Artificial Sequence
  Description of Artificial Sequence: Synthetic oligonucleotide
gcgggttcccaggtcaactattccatgg

SEQ ID NO: 167346 - DNA, 28 bp, Artificial Sequence
  Description of Artificial Sequence: Synthetic oligonucleotide
cgggttcccaggtcaactattccatggg

SEQ ID NO: 167347 - DNA, 29 bp, Artificial Sequence
  Description of Artificial Sequence: Synthetic oligonucleotide
gggttcccaggtcaactattccatgggtc

SEQ ID NO: 167348 - DNA, 29 bp, Artificial Sequence
  Description of Artificial Sequence: Synthetic oligonucleotide
ggttcccaggtcaactattccatgggtcc

SEQ ID NO: 167349 - DNA, 29 bp, Artificial Sequence
  Description of Artificial Sequence: Synthetic oligonucleotide
gttcccaggtcaactattccatgggtccc

SEQ ID NO: 167350 - DNA, 31 bp, Artificial Sequence
  Description of Artificial Sequence: Synthetic oligonucleotide
ttcccaggtcaactattccatgggtcccatg

SEQ ID NO: 167351 - DNA, 30 bp, Artificial Sequence
  Description of Artificial Sequence: Synthetic oligonucleotide
tcccaggtcaactattccatgggtcccatg

SEQ ID NO: 167352 - DNA, 29 bp, Artificial Sequence
  Description of Artificial Sequence: Synthetic oligonucleotide
cccaggtcaactattccatgggtcccatg

SEQ ID NO: 167353 - DNA, 30 bp, Artificial Sequence
  Description of Artificial Sequence: Synthetic oligonucleotide
ccaggtcaactattccatgggtcccatgac

SEQ ID NO: 167354 - DNA, 31 bp, Artificial Sequence
  Description of Artificial Sequence: Synthetic oligonucleotide
caggtcaactattccatgggtcccatgacac

SEQ ID NO: 167355 - DNA, 31 bp, Artificial Sequence
  Description of Artificial Sequence: Synthetic oligonucleotide
aggtcaactattccatgggtcccatgacacc

SEQ ID NO: 167356 - DNA, 30 bp, Artificial Sequence
  Description of Artificial Sequence: Synthetic oligonucleotide
ggtcaactattccatgggtcccatgacacc

SEQ ID NO: 167357 - DNA, 31 bp, Artificial Sequence
  Description of Artificial Sequence: Synthetic oligonucleotide
gtcaactattccatgggtcccatgacacctg

SEQ ID NO: 167358 - DNA, 31 bp, Artificial Sequence
  Description of Artificial Sequence: Synthetic oligonucleotide
tcaactattccatgggtcccatgacacctgc

SEQ ID NO: 167359 - DNA, 30 bp, Artificial Sequence
  Description of Artificial Sequence: Synthetic oligonucleotide
caactattccatgggtcccatgacacctgc

SEQ ID NO: 167360 - DNA, 30 bp, Artificial Sequence
  Description of Artificial Sequence: Synthetic oligonucleotide
aactattccatgggtcccatgacacctgcc

SEQ ID NO: 167361 - DNA, 29 bp, Artificial Sequence
  Description of Artificial Sequence: Synthetic oligonucleotide
actattccatgggtcccatgacacctgcc

SEQ ID NO: 167362 - DNA, 28 bp, Artificial Sequence
  Description of Artificial Sequence: Synthetic oligonucleotide
ctattccatgggtcccatgacacctgcc

SEQ ID NO: 167363 - DNA, 28 bp, Artificial Sequence
  Description of Artificial Sequence: Synthetic oligonucleotide
tattccatgggtcccatgacacctgccc

SEQ ID NO: 167364 - DNA, 27 bp, Artificial Sequence
  Description of Artificial Sequence: Synthetic oligonucleotide
attccatgggtcccatgacacctgccc

SEQ ID NO: 167365 - DNA, 27 bp, Artificial Sequence
  Description of Artificial Sequence: Synthetic oligonucleotide
ttccatgggtcccatgacacctgccct

SEQ ID NO: 167366 - DNA, 27 bp, Artificial Sequence
  Description of Artificial Sequence: Synthetic oligonucleotide
tccatgggtcccatgacacctgccctt

SEQ ID NO: 167367 - DNA, 26 bp, Artificial Sequence
  Description of Artificial Sequence: Synthetic oligonucleotide
ccatgggtcccatgacacctgccctt

SEQ ID NO: 167368 - DNA, 26 bp, Artificial Sequence
  Description of Artificial Sequence: Synthetic oligonucleotide
catgggtcccatgacacctgcccttg

SEQ ID NO: 167369 - DNA, 27 bp, Artificial Sequence
  Description of Artificial Sequence: Synthetic oligonucleotide
atgggtcccatgacacctgcccttgca

SEQ ID NO: 167370 - DNA, 26 bp, Artificial Sequence
  Description of Artificial Sequence: Synthetic oligonucleotide
tgggtcccatgacacctgcccttgca

SEQ ID NO: 167371 - DNA, 25 bp, Artificial Sequence
  Description of Artificial Sequence: Synthetic oligonucleotide
gggtcccatgacacctgcccttgca

SEQ ID NO: 167372 - DNA, 25 bp, Artificial Sequence
  Description of Artificial Sequence: Synthetic oligonucleotide
ggtcccatgacacctgcccttgcag

SEQ ID NO: 167373 - DNA, 25 bp, Artificial Sequence
  Description of Artificial Sequence: Synthetic oligonucleotide
gtcccatgacacctgcccttgcagg

SEQ ID NO: 167374 - DNA, 26 bp, Artificial Sequence
  Description of Artificial Sequence: Synthetic oligonucleotide
tcccatgacacctgcccttgcaggga

SEQ ID NO: 167375 - DNA, 25 bp, Artificial Sequence
  Description of Artificial Sequence: Synthetic oligonucleotide
cccatgacacctgcccttgcaggga

SEQ ID NO: 167376 - DNA, 25 bp, Artificial Sequence
  Description of Artificial Sequence: Synthetic oligonucleotide
ccatgacacctgcccttgcagggac

SEQ ID NO: 167377 - DNA, 27 bp, Artificial Sequence
  Description of Artificial Sequence: Synthetic oligonucleotide
catgacacctgcccttgcagggaccta

SEQ ID NO: 167378 - DNA, 27 bp, Artificial Sequence
  Description of Artificial Sequence: Synthetic oligonucleotide
atgacacctgcccttgcagggacctac

SEQ ID NO: 167379 - DNA, 27 bp, Artificial Sequence
  Description of Artificial Sequence: Synthetic oligonucleotide
tgacacctgcccttgcagggacctaca

SEQ ID NO: 167380 - DNA, 26 bp, Artificial Sequence
  Description of Artificial Sequence: Synthetic oligonucleotide
gacacctgcccttgcagggacctaca

SEQ ID NO: 167381 - DNA, 27 bp, Artificial Sequence
  Description of Artificial Sequence: Synthetic oligonucleotide
acacctgcccttgcagggacctacaga

SEQ ID NO: 167382 - DNA, 27 bp, Artificial Sequence
  Description of Artificial Sequence: Synthetic oligonucleotide
cacctgcccttgcagggacctacagat

SEQ ID NO: 167383 - DNA, 27 bp, Artificial Sequence
  Description of Artificial Sequence: Synthetic oligonucleotide
acctgcccttgcagggacctacagatg

SEQ ID NO: 167384 - DNA, 26 bp, Artificial Sequence
  Description of Artificial Sequence: Synthetic oligonucleotide
cctgcccttgcagggacctacagatg

SEQ ID NO: 167385 - DNA, 27 bp, Artificial Sequence
  Description of Artificial Sequence: Synthetic oligonucleotide
ctgcccttgcagggacctacagatgct

SEQ ID NO: 167386 - DNA, 29 bp, Artificial Sequence
  Description of Artificial Sequence: Synthetic oligonucleotide
tgcccttgcagggacctacagatgctttg

SEQ ID NO: 167387 - DNA, 28 bp, Artificial Sequence
  Description of Artificial Sequence: Synthetic oligonucleotide
gcccttgcagggacctacagatgctttg

SEQ ID NO: 167388 - DNA, 28 bp, Artificial Sequence
  Description of Artificial Sequence: Synthetic oligonucleotide
cccttgcagggacctacagatgctttgg

SEQ ID NO: 167389 - DNA, 30 bp, Artificial Sequence
  Description of Artificial Sequence: Synthetic oligonucleotide
ccttgcagggacctacagatgctttggttc

SEQ ID NO: 167390 - DNA, 31 bp, Artificial Sequence
  Description of Artificial Sequence: Synthetic oligonucleotide
cttgcagggacctacagatgctttggttctg

SEQ ID NO: 167391 - DNA, 32 bp, Artificial Sequence
  Description of Artificial Sequence: Synthetic oligonucleotide
ttgcagggacctacagatgctttggttctgtc

SEQ ID NO: 167392 - DNA, 31 bp, Artificial Sequence
  Description of Artificial Sequence: Synthetic oligonucleotide
tgcagggacctacagatgctttggttctgtc

SEQ ID NO: 167393 - DNA, 30 bp, Artificial Sequence
  Description of Artificial Sequence: Synthetic oligonucleotide
gcagggacctacagatgctttggttctgtc

SEQ ID NO: 167394 - DNA, 31 bp, Artificial Sequence
  Description of Artificial Sequence: Synthetic oligonucleotide
cagggacctacagatgctttggttctgtcac

SEQ ID NO: 167395 - DNA, 32 bp, Artificial Sequence
  Description of Artificial Sequence: Synthetic oligonucleotide
agggacctacagatgctttggttctgtcactc

SEQ ID NO: 167396 - DNA, 31 bp, Artificial Sequence
  Description of Artificial Sequence: Synthetic oligonucleotide
gggacctacagatgctttggttctgtcactc

SEQ ID NO: 167397 - DNA, 32 bp, Artificial Sequence
  Description of Artificial Sequence: Synthetic oligonucleotide
ggacctacagatgctttggttctgtcactcac

SEQ ID NO: 167398 - DNA, 35 bp, Artificial Sequence
  Description of Artificial Sequence: Synthetic oligonucleotide
gacctacagatgctttggttctgtcactcacttac

SEQ ID NO: 167399 - DNA, 35 bp, Artificial Sequence
  Description of Artificial Sequence: Synthetic oligonucleotide
acctacagatgctttggttctgtcactcacttacc

SEQ ID NO: 167400 - DNA, 34 bp, Artificial Sequence
  Description of Artificial Sequence: Synthetic oligonucleotide
cctacagatgctttggttctgtcactcacttacc

SEQ ID NO: 167401 - DNA, 34 bp, Artificial Sequence
  Description of Artificial Sequence: Synthetic oligonucleotide
ctacagatgctttggttctgtcactcacttaccc

SEQ ID NO: 167402 - DNA, 37 bp, Artificial Sequence
  Description of Artificial Sequence: Synthetic oligonucleotide
tacagatgctttggttctgtcactcacttaccctatg

SEQ ID NO: 167403 - DNA, 36 bp, Artificial Sequence
  Description of Artificial Sequence: Synthetic oligonucleotide
acagatgctttggttctgtcactcacttaccctatg

SEQ ID NO: 167404 - DNA, 35 bp, Artificial Sequence
  Description of Artificial Sequence: Synthetic oligonucleotide
cagatgctttggttctgtcactcacttaccctatg

SEQ ID NO: 167405 - DNA, 36 bp, Artificial Sequence
  Description of Artificial Sequence: Synthetic oligonucleotide
agatgctttggttctgtcactcacttaccctatgag

SEQ ID NO: 167406 - DNA, 35 bp, Artificial Sequence
  Description of Artificial Sequence: Synthetic oligonucleotide
gatgctttggttctgtcactcacttaccctatgag

SEQ ID NO: 167407 - DNA, 37 bp, Artificial Sequence
  Description of Artificial Sequence: Synthetic oligonucleotide
atgctttggttctgtcactcacttaccctatgagttg

SEQ ID NO: 167408 - DNA, 36 bp, Artificial Sequence
  Description of Artificial Sequence: Synthetic oligonucleotide
tgctttggttctgtcactcacttaccctatgagttg

SEQ ID NO: 167409 - DNA, 35 bp, Artificial Sequence
  Description of Artificial Sequence: Synthetic oligonucleotide
gctttggttctgtcactcacttaccctatgagttg

SEQ ID NO: 167410 - DNA, 36 bp, Artificial Sequence
  Description of Artificial Sequence: Synthetic oligonucleotide
ctttggttctgtcactcacttaccctatgagttgtc

SEQ ID NO: 167411 - DNA, 36 bp, Artificial Sequence
  Description of Artificial Sequence: Synthetic oligonucleotide
tttggttctgtcactcacttaccctatgagttgtcg

SEQ ID NO: 167412 - DNA, 35 bp, Artificial Sequence
  Description of Artificial Sequence: Synthetic oligonucleotide
ttggttctgtcactcacttaccctatgagttgtcg

SEQ ID NO: 167413 - DNA, 34 bp, Artificial Sequence
  Description of Artificial Sequence: Synthetic oligonucleotide
tggttctgtcactcacttaccctatgagttgtcg

SEQ ID NO: 167414 - DNA, 33 bp, Artificial Sequence
  Description of Artificial Sequence: Synthetic oligonucleotide
ggttctgtcactcacttaccctatgagttgtcg

SEQ ID NO: 167415 - DNA, 33 bp, Artificial Sequence
  Description of Artificial Sequence: Synthetic oligonucleotide
gttctgtcactcacttaccctatgagttgtcgg

SEQ ID NO: 167416 - DNA, 33 bp, Artificial Sequence
  Description of Artificial Sequence: Synthetic oligonucleotide
ttctgtcactcacttaccctatgagttgtcggc

SEQ ID NO: 167417 - DNA, 32 bp, Artificial Sequence
  Description of Artificial Sequence: Synthetic oligonucleotide
tctgtcactcacttaccctatgagttgtcggc

SEQ ID NO: 167418 - DNA, 31 bp, Artificial Sequence
  Description of Artificial Sequence: Synthetic oligonucleotide
ctgtcactcacttaccctatgagttgtcggc

SEQ ID NO: 167419 - DNA, 32 bp, Artificial Sequence
  Description of Artificial Sequence: Synthetic oligonucleotide
tgtcactcacttaccctatgagttgtcggctc

SEQ ID NO: 167420 - DNA, 31 bp, Artificial Sequence
  Description of Artificial Sequence: Synthetic oligonucleotide
gtcactcacttaccctatgagttgtcggctc

SEQ ID NO: 167421 - DNA, 31 bp, Artificial Sequence
  Description of Artificial Sequence: Synthetic oligonucleotide
tcactcacttaccctatgagttgtcggctcc

SEQ ID NO: 167422 - DNA, 30 bp, Artificial Sequence
  Description of Artificial Sequence: Synthetic oligonucleotide
cactcacttaccctatgagttgtcggctcc

SEQ ID NO: 167423 - DNA, 30 bp, Artificial Sequence
  Description of Artificial Sequence: Synthetic oligonucleotide
actcacttaccctatgagttgtcggctccc

SEQ ID NO: 167424 - DNA, 29 bp, Artificial Sequence
  Description of Artificial Sequence: Synthetic oligonucleotide
ctcacttaccctatgagttgtcggctccc

SEQ ID NO: 167425 - DNA, 30 bp, Artificial Sequence
  Description of Artificial Sequence: Synthetic oligonucleotide
tcacttaccctatgagttgtcggctcccag

SEQ ID NO: 167426 - DNA, 29 bp, Artificial Sequence
  Description of Artificial Sequence: Synthetic oligonucleotide
cacttaccctatgagttgtcggctcccag

SEQ ID NO: 167427 - DNA, 30 bp, Artificial Sequence
  Description of Artificial Sequence: Synthetic oligonucleotide
acttaccctatgagttgtcggctcccagtg

SEQ ID NO: 167428 - DNA, 29 bp, Artificial Sequence
  Description of Artificial Sequence: Synthetic oligonucleotide
cttaccctatgagttgtcggctcccagtg

SEQ ID NO: 167429 - DNA, 30 bp, Artificial Sequence
  Description of Artificial Sequence: Synthetic oligonucleotide
ttaccctatgagttgtcggctcccagtgac

SEQ ID NO: 167430 - DNA, 29 bp, Artificial Sequence
  Description of Artificial Sequence: Synthetic oligonucleotide
taccctatgagttgtcggctcccagtgac

SEQ ID NO: 167431 - DNA, 28 bp, Artificial Sequence
  Description of Artificial Sequence: Synthetic oligonucleotide
accctatgagttgtcggctcccagtgac

SEQ ID NO: 167432 - DNA, 27 bp, Artificial Sequence
  Description of Artificial Sequence: Synthetic oligonucleotide
ccctatgagttgtcggctcccagtgac

SEQ ID NO: 167433 - DNA, 27 bp, Artificial Sequence
  Description of Artificial Sequence: Synthetic oligonucleotide
cctatgagttgtcggctcccagtgacc

SEQ ID NO: 167434 - DNA, 27 bp, Artificial Sequence
  Description of Artificial Sequence: Synthetic oligonucleotide
ctatgagttgtcggctcccagtgaccc

SEQ ID NO: 167435 - DNA, 28 bp, Artificial Sequence
  Description of Artificial Sequence: Synthetic oligonucleotide
tatgagttgtcggctcccagtgaccctc

SEQ ID NO: 167436 - DNA, 27 bp, Artificial Sequence
  Description of Artificial Sequence: Synthetic oligonucleotide
atgagttgtcggctcccagtgaccctc

SEQ ID NO: 167437 - DNA, 27 bp, Artificial Sequence
  Description of Artificial Sequence: Synthetic oligonucleotide
tgagttgtcggctcccagtgaccctct

SEQ ID NO: 167438 - DNA, 26 bp, Artificial Sequence
  Description of Artificial Sequence: Synthetic oligonucleotide
gagttgtcggctcccagtgaccctct

SEQ ID NO: 167439 - DNA, 26 bp, Artificial Sequence
  Description of Artificial Sequence: Synthetic oligonucleotide
agttgtcggctcccagtgaccctctg

SEQ ID NO: 167440 - DNA, 25 bp, Artificial Sequence
  Description of Artificial Sequence: Synthetic oligonucleotide
gttgtcggctcccagtgaccctctg

SEQ ID NO: 167441 - DNA, 26 bp, Artificial Sequence
  Description of Artificial Sequence: Synthetic oligonucleotide
ttgtcggctcccagtgaccctctgga

SEQ ID NO: 167442 - DNA, 25 bp, Artificial Sequence
  Description of Artificial Sequence: Synthetic oligonucleotide
tgtcggctcccagtgaccctctgga

SEQ ID NO: 167443 - DNA, 24 bp, Artificial Sequence
  Description of Artificial Sequence: Synthetic oligonucleotide
gtcggctcccagtgaccctctgga

SEQ ID NO: 167444 - DNA, 26 bp, Artificial Sequence
  Description of Artificial Sequence: Synthetic oligonucleotide
tcggctcccagtgaccctctggacat

SEQ ID NO: 167445 - DNA, 25 bp, Artificial Sequence
  Description of Artificial Sequence: Synthetic oligonucleotide
cggctcccagtgaccctctggacat

SEQ ID NO: 167446 - DNA, 25 bp, Artificial Sequence
  Description of Artificial Sequence: Synthetic oligonucleotide
ggctcccagtgaccctctggacatc

SEQ ID NO: 167447 - DNA, 26 bp, Artificial Sequence
  Description of Artificial Sequence: Synthetic oligonucleotide
ctcccagtgaccctctggacatcgtg

SEQ ID NO: 167448 - DNA, 27 bp, Artificial Sequence
  Description of Artificial Sequence: Synthetic oligonucleotide
tcccagtgaccctctggacatcgtggt

SEQ ID NO: 167449 - DNA, 26 bp, Artificial Sequence
  Description of Artificial Sequence: Synthetic oligonucleotide
cccagtgaccctctggacatcgtggt

SEQ ID NO: 167450 - DNA, 26 bp, Artificial Sequence
  Description of Artificial Sequence: Synthetic oligonucleotide
ccagtgaccctctggacatcgtggtc

SEQ ID NO: 167451 - DNA, 27 bp, Artificial Sequence
  Description of Artificial Sequence: Synthetic oligonucleotide
cagtgaccctctggacatcgtggtcgt

SEQ ID NO: 167452 - DNA, 28 bp, Artificial Sequence
  Description of Artificial Sequence: Synthetic oligonucleotide
agtgaccctctggacatcgtggtcgtag

SEQ ID NO: 167453 - DNA, 27 bp, Artificial Sequence
  Description of Artificial Sequence: Synthetic oligonucleotide
gtgaccctctggacatcgtggtcgtag

SEQ ID NO: 167454 - DNA, 27 bp, Artificial Sequence
  Description of Artificial Sequence: Synthetic oligonucleotide
tgaccctctggacatcgtggtcgtagg

SEQ ID NO: 167455 - DNA, 27 bp, Artificial Sequence
  Description of Artificial Sequence: Synthetic oligonucleotide
gaccctctggacatcgtggtcgtaggt

SEQ ID NO: 167456 - DNA, 27 bp, Artificial Sequence
  Description of Artificial Sequence: Synthetic oligonucleotide
accctctggacatcgtggtcgtaggtc

SEQ ID NO: 167457 - DNA, 27 bp, Artificial Sequence
  Description of Artificial Sequence: Synthetic oligonucleotide
ccctctggacatcgtggtcgtaggtct

SEQ ID NO: 167458 - DNA, 31 bp, Artificial Sequence
  Description of Artificial Sequence: Synthetic oligonucleotide
cctctggacatcgtggtcgtaggtctatatg

SEQ ID NO: 167459 - DNA, 31 bp, Artificial Sequence
  Description of Artificial Sequence: Synthetic oligonucleotide
ctctggacatcgtggtcgtaggtctatatgg

SEQ ID NO: 167460 - DNA, 31 bp, Artificial Sequence
  Description of Artificial Sequence: Synthetic oligonucleotide
tctggacatcgtggtcgtaggtctatatggg

SEQ ID NO: 167461 - DNA, 30 bp, Artificial Sequence
  Description of Artificial Sequence: Synthetic oligonucleotide
ctggacatcgtggtcgtaggtctatatggg

SEQ ID NO: 167462 - DNA, 33 bp, Artificial Sequence
  Description of Artificial Sequence: Synthetic oligonucleotide
tggacatcgtggtcgtaggtctatatgggaaac

SEQ ID NO: 167463 - DNA, 32 bp, Artificial Sequence
  Description of Artificial Sequence: Synthetic oligonucleotide
ggacatcgtggtcgtaggtctatatgggaaac

SEQ ID NO: 167464 - DNA, 32 bp, Artificial Sequence
  Description of Artificial Sequence: Synthetic oligonucleotide
gacatcgtggtcgtaggtctatatgggaaacc

SEQ ID NO: 167465 - DNA, 34 bp, Artificial Sequence
  Description of Artificial Sequence: Synthetic oligonucleotide
acatcgtggtcgtaggtctatatgggaaaccttc

SEQ ID NO: 167466 - DNA, 33 bp, Artificial Sequence
  Description of Artificial Sequence: Synthetic oligonucleotide
catcgtggtcgtaggtctatatgggaaaccttc

SEQ ID NO: 167467 - DNA, 34 bp, Artificial Sequence
  Description of Artificial Sequence: Synthetic oligonucleotide
atcgtggtcgtaggtctatatgggaaaccttctc

SEQ ID NO: 167468 - DNA, 33 bp, Artificial Sequence
  Description of Artificial Sequence: Synthetic oligonucleotide
tcgtggtcgtaggtctatatgggaaaccttctc

SEQ ID NO: 167469 - DNA, 32 bp, Artificial Sequence
  Description of Artificial Sequence: Synthetic oligonucleotide
cgtggtcgtaggtctatatgggaaaccttctc

SEQ ID NO: 167470 - DNA, 33 bp, Artificial Sequence
  Description of Artificial Sequence: Synthetic oligonucleotide
gtggtcgtaggtctatatgggaaaccttctctc

SEQ ID NO: 167471 - DNA, 34 bp, Artificial Sequence
  Description of Artificial Sequence: Synthetic oligonucleotide
tggtcgtaggtctatatgggaaaccttctctctc

SEQ ID NO: 167472 - DNA, 33 bp, Artificial Sequence
  Description of Artificial Sequence: Synthetic oligonucleotide
ggtcgtaggtctatatgggaaaccttctctctc

SEQ ID NO: 167473 - DNA, 34 bp, Artificial Sequence
  Description of Artificial Sequence: Synthetic oligonucleotide
gtcgtaggtctatatgggaaaccttctctctcag

SEQ ID NO: 167474 - DNA, 34 bp, Artificial Sequence
  Description of Artificial Sequence: Synthetic oligonucleotide
tcgtaggtctatatgggaaaccttctctctcagc

SEQ ID NO: 167475 - DNA, 33 bp, Artificial Sequence
  Description of Artificial Sequence: Synthetic oligonucleotide
cgtaggtctatatgggaaaccttctctctcagc

SEQ ID NO: 167476 - DNA, 33 bp, Artificial Sequence
  Description of Artificial Sequence: Synthetic oligonucleotide
gtaggtctatatgggaaaccttctctctcagcc

SEQ ID NO: 167477 - DNA, 33 bp, Artificial Sequence
  Description of Artificial Sequence: Synthetic oligonucleotide
taggtctatatgggaaaccttctctctcagccc

SEQ ID NO: 167478 - DNA, 26 bp, Artificial Sequence
  Description of Artificial Sequence: Synthetic oligonucleotide
accttgtcctgcagctcccggagctt

SEQ ID NO: 167479 - DNA, 25 bp, Artificial Sequence
  Description of Artificial Sequence: Synthetic oligonucleotide
ccttgtcctgcagctcccggagctt

SEQ ID NO: 167480 - DNA, 27 bp, Artificial Sequence
  Description of Artificial Sequence: Synthetic oligonucleotide
cttgtcctgcagctcccggagcttgtt

SEQ ID NO: 167481 - DNA, 28 bp, Artificial Sequence
  Description of Artificial Sequence: Synthetic oligonucleotide
ttgtcctgcagctcccggagcttgtttg

SEQ ID NO: 167482 - DNA, 27 bp, Artificial Sequence
  Description of Artificial Sequence: Synthetic oligonucleotide
tgtcctgcagctcccggagcttgtttg

SEQ ID NO: 167483 - DNA, 27 bp, Artificial Sequence
  Description of Artificial Sequence: Synthetic oligonucleotide
gtcctgcagctcccggagcttgtttga

SEQ ID NO: 167484 - DNA, 27 bp, Artificial Sequence
  Description of Artificial Sequence: Synthetic oligonucleotide
tcctgcagctcccggagcttgtttgac

SEQ ID NO: 167485 - DNA, 27 bp, Artificial Sequence
  Description of Artificial Sequence: Synthetic oligonucleotide
cctgcagctcccggagcttgtttgaca

SEQ ID NO: 167486 - DNA, 31 bp, Artificial Sequence
  Description of Artificial Sequence: Synthetic oligonucleotide
ctgcagctcccggagcttgtttgacatttac

SEQ ID NO: 167487 - DNA, 31 bp, Artificial Sequence
  Description of Artificial Sequence: Synthetic oligonucleotide
tgcagctcccggagcttgtttgacatttacc

SEQ ID NO: 167488 - DNA, 30 bp, Artificial Sequence
  Description of Artificial Sequence: Synthetic oligonucleotide
gcagctcccggagcttgtttgacatttacc

SEQ ID NO: 167489 - DNA, 32 bp, Artificial Sequence
  Description of Artificial Sequence: Synthetic oligonucleotide
cagctcccggagcttgtttgacatttaccatc

SEQ ID NO: 167490 - DNA, 35 bp, Artificial Sequence
  Description of Artificial Sequence: Synthetic oligonucleotide
agctcccggagcttgtttgacatttaccatctatc

SEQ ID NO: 167491 - DNA, 34 bp, Artificial Sequence
  Description of Artificial Sequence: Synthetic oligonucleotide
gctcccggagcttgtttgacatttaccatctatc

SEQ ID NO: 167492 - DNA, 34 bp, Artificial Sequence
  Description of Artificial Sequence: Synthetic oligonucleotide
ctcccggagcttgtttgacatttaccatctatcc

SEQ ID NO: 167493 - DNA, 35 bp, Artificial Sequence
  Description of Artificial Sequence: Synthetic oligonucleotide
tcccggagcttgtttgacatttaccatctatccag

SEQ ID NO: 167494 - DNA, 34 bp, Artificial Sequence
  Description of Artificial Sequence: Synthetic oligonucleotide
cccggagcttgtttgacatttaccatctatccag

SEQ ID NO: 167495 - DNA, 34 bp, Artificial Sequence
  Description of Artificial Sequence: Synthetic oligonucleotide
ccggagcttgtttgacatttaccatctatccagg

SEQ ID NO: 167496 - DNA, 34 bp, Artificial Sequence
  Description of Artificial Sequence: Synthetic oligonucleotide
cggagcttgtttgacatttaccatctatccaggg

SEQ ID NO: 167497 - DNA, 35 bp, Artificial Sequence
  Description of Artificial Sequence: Synthetic oligonucleotide
ggagcttgtttgacatttaccatctatccagggag

SEQ ID NO: 167498 - DNA, 35 bp, Artificial Sequence
  Description of Artificial Sequence: Synthetic oligonucleotide
gagcttgtttgacatttaccatctatccagggagg

SEQ ID NO: 167499 - DNA, 35 bp, Artificial Sequence
  Description of Artificial Sequence: Synthetic oligonucleotide
agcttgtttgacatttaccatctatccagggaggc

SEQ ID NO: 167500 - DNA, 34 bp, Artificial Sequence
  Description of Artificial Sequence: Synthetic oligonucleotide
gcttgtttgacatttaccatctatccagggaggc

SEQ ID NO: 167501 - DNA, 35 bp, Artificial Sequence
  Description of Artificial Sequence: Synthetic oligonucleotide
cttgtttgacatttaccatctatccagggaggcag

SEQ ID NO: 167502 - DNA, 36 bp, Artificial Sequence
  Description of Artificial Sequence: Synthetic oligonucleotide
ttgtttgacatttaccatctatccagggaggcagag

SEQ ID NO: 167503 - DNA, 35 bp, Artificial Sequence
  Description of Artificial Sequence: Synthetic oligonucleotide
tgtttgacatttaccatctatccagggaggcagag

SEQ ID NO: 167504 - DNA, 34 bp, Artificial Sequence
  Description of Artificial Sequence: Synthetic oligonucleotide
gtttgacatttaccatctatccagggaggcagag

SEQ ID NO: 167505 - DNA, 34 bp, Artificial Sequence
  Description of Artificial Sequence: Synthetic oligonucleotide
tttgacatttaccatctatccagggaggcagagg

SEQ ID NO: 167506 - DNA, 33 bp, Artificial Sequence
  Description of Artificial Sequence: Synthetic oligonucleotide
ttgacatttaccatctatccagggaggcagagg

SEQ ID NO: 167507 - DNA, 32 bp, Artificial Sequence
  Description of Artificial Sequence: Synthetic oligonucleotide
tgacatttaccatctatccagggaggcagagg

SEQ ID NO: 167508 - DNA, 31 bp, Artificial Sequence
  Description of Artificial Sequence: Synthetic oligonucleotide
gacatttaccatctatccagggaggcagagg

SEQ ID NO: 167509 - DNA, 31 bp, Artificial Sequence
  Description of Artificial Sequence: Synthetic oligonucleotide
acatttaccatctatccagggaggcagaggc

SEQ ID NO: 167510 - DNA, 30 bp, Artificial Sequence
  Description of Artificial Sequence: Synthetic oligonucleotide
catttaccatctatccagggaggcagaggc

SEQ ID NO: 167511 - DNA, 30 bp, Artificial Sequence
  Description of Artificial Sequence: Synthetic oligonucleotide
atttaccatctatccagggaggcagaggcc

SEQ ID NO: 167512 - DNA, 29 bp, Artificial Sequence
  Description of Artificial Sequence: Synthetic oligonucleotide
tttaccatctatccagggaggcagaggcc

SEQ ID NO: 167513 - DNA, 28 bp, Artificial Sequence
  Description of Artificial Sequence: Synthetic oligonucleotide
ttaccatctatccagggaggcagaggcc

SEQ ID NO: 167514 - DNA, 27 bp, Artificial Sequence
  Description of Artificial Sequence: Synthetic oligonucleotide
taccatctatccagggaggcagaggcc

SEQ ID NO: 167515 - DNA, 26 bp, Artificial Sequence
  Description of Artificial Sequence: Synthetic oligonucleotide
accatctatccagggaggcagaggcc

SEQ ID NO: 167516 - DNA, 25 bp, Artificial Sequence
  Description of Artificial Sequence: Synthetic oligonucleotide
ccatctatccagggaggcagaggcc

SEQ ID NO: 167517 - DNA, 25 bp, Artificial Sequence
  Description of Artificial Sequence: Synthetic oligonucleotide
catctatccagggaggcagaggccg

SEQ ID NO: 167518 - DNA, 26 bp, Artificial Sequence
  Description of Artificial Sequence: Synthetic oligonucleotide
atctatccagggaggcagaggccggt

SEQ ID NO: 167519 - DNA, 25 bp, Artificial Sequence
  Description of Artificial Sequence: Synthetic oligonucleotide
tctatccagggaggcagaggccggt

SEQ ID NO: 167520 - DNA, 24 bp, Artificial Sequence
  Description of Artificial Sequence: Synthetic oligonucleotide
ctatccagggaggcagaggccggt

SEQ ID NO: 167521 - DNA, 26 bp, Artificial Sequence
  Description of Artificial Sequence: Synthetic oligonucleotide
tatccagggaggcagaggccggtgaa

SEQ ID NO: 167522 - DNA, 25 bp, Artificial Sequence
  Description of Artificial Sequence: Synthetic oligonucleotide
atccagggaggcagaggccggtgaa

SEQ ID NO: 167523 - DNA, 24 bp, Artificial Sequence
  Description of Artificial Sequence: Synthetic oligonucleotide
tccagggaggcagaggccggtgaa

SEQ ID NO: 167524 - DNA, 23 bp, Artificial Sequence
  Description of Artificial Sequence: Synthetic oligonucleotide
ccagggaggcagaggccggtgaa

SEQ ID NO: 167525 - DNA, 26 bp, Artificial Sequence
  Description of Artificial Sequence: Synthetic oligonucleotide
cagggaggcagaggccggtgaactta

SEQ ID NO: 167526 - DNA, 26 bp, Artificial Sequence
  Description of Artificial Sequence: Synthetic oligonucleotide
agggaggcagaggccggtgaacttag

SEQ ID NO: 167527 - DNA, 25 bp, Artificial Sequence
  Description of Artificial Sequence: Synthetic oligonucleotide
gggaggcagaggccggtgaacttag

SEQ ID NO: 167528 - DNA, 25 bp, Artificial Sequence
  Description of Artificial Sequence: Synthetic oligonucleotide
ggaggcagaggccggtgaacttagg

SEQ ID NO: 167529 - DNA, 26 bp, Artificial Sequence
  Description of Artificial Sequence: Synthetic oligonucleotide
gaggcagaggccggtgaacttaggct

SEQ ID NO: 167530 - DNA, 27 bp, Artificial Sequence
  Description of Artificial Sequence: Synthetic oligonucleotide
aggcagaggccggtgaacttaggctca

SEQ ID NO: 167531 - DNA, 26 bp, Artificial Sequence
  Description of Artificial Sequence: Synthetic oligonucleotide
ggcagaggccggtgaacttaggctca

SEQ ID NO: 167532 - DNA, 27 bp, Artificial Sequence
  Description of Artificial Sequence: Synthetic oligonucleotide
gcagaggccggtgaacttaggctcact

SEQ ID NO: 167533 - DNA, 27 bp, Artificial Sequence
  Description of Artificial Sequence: Synthetic oligonucleotide
cagaggccggtgaacttaggctcactg

SEQ ID NO: 167534 - DNA, 27 bp, Artificial Sequence
  Description of Artificial Sequence: Synthetic oligonucleotide
agaggccggtgaacttaggctcactgc

SEQ ID NO: 167535 - DNA, 26 bp, Artificial Sequence
  Description of Artificial Sequence: Synthetic oligonucleotide
gaggccggtgaacttaggctcactgc

SEQ ID NO: 167536 - DNA, 26 bp, Artificial Sequence
  Description of Artificial Sequence: Synthetic oligonucleotide
aggccggtgaacttaggctcactgcg

SEQ ID NO: 167537 - DNA, 25 bp, Artificial Sequence
  Description of Artificial Sequence: Synthetic oligonucleotide
ggccggtgaacttaggctcactgcg

SEQ ID NO: 167538 - DNA, 26 bp, Artificial Sequence
  Description of Artificial Sequence: Synthetic oligonucleotide
gccggtgaacttaggctcactgcggt

SEQ ID NO: 167539 - DNA, 26 bp, Artificial Sequence
  Description of Artificial Sequence: Synthetic oligonucleotide
ccggtgaacttaggctcactgcggtg

SEQ ID NO: 167540 - DNA, 27 bp, Artificial Sequence
  Description of Artificial Sequence: Synthetic oligonucleotide
cggtgaacttaggctcactgcggtgct

SEQ ID NO: 167541 - DNA, 27 bp, Artificial Sequence
  Description of Artificial Sequence: Synthetic oligonucleotide
ggtgaacttaggctcactgcggtgctg

SEQ ID NO: 167542 - DNA, 28 bp, Artificial Sequence
  Description of Artificial Sequence: Synthetic oligonucleotide
gtgaacttaggctcactgcggtgctgag

SEQ ID NO: 167543 - DNA, 28 bp, Artificial Sequence
  Description of Artificial Sequence: Synthetic oligonucleotide
tgaacttaggctcactgcggtgctgagg

SEQ ID NO: 167544 - DNA, 27 bp, Artificial Sequence
  Description of Artificial Sequence: Synthetic oligonucleotide
gaacttaggctcactgcggtgctgagg

SEQ ID NO: 167545 - DNA, 27 bp, Artificial Sequence
  Description of Artificial Sequence: Synthetic oligonucleotide
aacttaggctcactgcggtgctgaggg

SEQ ID NO: 167546 - DNA, 27 bp, Artificial Sequence
  Description of Artificial Sequence: Synthetic oligonucleotide
acttaggctcactgcggtgctgagggt

SEQ ID NO: 167547 - DNA, 26 bp, Artificial Sequence
  Description of Artificial Sequence: Synthetic oligonucleotide
cttaggctcactgcggtgctgagggt

SEQ ID NO: 167548 - DNA, 27 bp, Artificial Sequence
  Description of Artificial Sequence: Synthetic oligonucleotide
ttaggctcactgcggtgctgagggtca

SEQ ID NO: 167549 - DNA, 27 bp, Artificial Sequence
  Description of Artificial Sequence: Synthetic oligonucleotide
taggctcactgcggtgctgagggtcaa

SEQ ID NO: 167550 - DNA, 27 bp, Artificial Sequence
  Description of Artificial Sequence: Synthetic oligonucleotide
aggctcactgcggtgctgagggtcaat

SEQ ID NO: 167551 - DNA, 26 bp, Artificial Sequence
  Description of Artificial Sequence: Synthetic oligonucleotide
ggctcactgcggtgctgagggtcaat

SEQ ID NO: 167552 - DNA, 26 bp, Artificial Sequence
  Description of Artificial Sequence: Synthetic oligonucleotide
gctcactgcggtgctgagggtcaatg

SEQ ID NO: 167553 - DNA, 27 bp, Artificial Sequence
  Description of Artificial Sequence: Synthetic oligonucleotide
ctcactgcggtgctgagggtcaatgga

SEQ ID NO: 167554 - DNA, 28 bp, Artificial Sequence
  Description of Artificial Sequence: Synthetic oligonucleotide
tcactgcggtgctgagggtcaatggaac

SEQ ID NO: 167555 - DNA, 27 bp, Artificial Sequence
  Description of Artificial Sequence: Synthetic oligonucleotide
cactgcggtgctgagggtcaatggaac

SEQ ID NO: 167556 - DNA, 30 bp, Artificial Sequence
  Description of Artificial Sequence: Synthetic oligonucleotide
actgcggtgctgagggtcaatggaacattc

SEQ ID NO: 167557 - DNA, 29 bp, Artificial Sequence
  Description of Artificial Sequence: Synthetic oligonucleotide
ctgcggtgctgagggtcaatggaacattc

SEQ ID NO: 167558 - DNA, 29 bp, Artificial Sequence
  Description of Artificial Sequence: Synthetic oligonucleotide
tgcggtgctgagggtcaatggaacattcc

SEQ ID NO: 167559 - DNA, 28 bp, Artificial Sequence
  Description of Artificial Sequence: Synthetic oligonucleotide
gcggtgctgagggtcaatggaacattcc

SEQ ID NO: 167560 - DNA, 29 bp, Artificial Sequence
  Description of Artificial Sequence: Synthetic oligonucleotide
cggtgctgagggtcaatggaacattccag

SEQ ID NO: 167561 - DNA, 29 bp, Artificial Sequence
  Description of Artificial Sequence: Synthetic oligonucleotide
ggtgctgagggtcaatggaacattccagg

SEQ ID NO: 167562 - DNA, 29 bp, Artificial Sequence
  Description of Artificial Sequence: Synthetic oligonucleotide
gtgctgagggtcaatggaacattccaggc

SEQ ID NO: 167563 - DNA, 29 bp, Artificial Sequence
  Description of Artificial Sequence: Synthetic oligonucleotide
tgctgagggtcaatggaacattccaggcc

SEQ ID NO: 167564 - DNA, 28 bp, Artificial Sequence
  Description of Artificial Sequence: Synthetic oligonucleotide
gctgagggtcaatggaacattccaggcc

SEQ ID NO: 167565 - DNA, 30 bp, Artificial Sequence
  Description of Artificial Sequence: Synthetic oligonucleotide
ctgagggtcaatggaacattccaggccaac

SEQ ID NO: 167566 - DNA, 32 bp, Artificial Sequence
  Description of Artificial Sequence: Synthetic oligonucleotide
tgagggtcaatggaacattccaggccaacttc

SEQ ID NO: 167567 - DNA, 31 bp, Artificial Sequence
  Description of Artificial Sequence: Synthetic oligonucleotide
gagggtcaatggaacattccaggccaacttc

SEQ ID NO: 167568 - DNA, 31 bp, Artificial Sequence
  Description of Artificial Sequence: Synthetic oligonucleotide
agggtcaatggaacattccaggccaacttcc

SEQ ID NO: 167569 - DNA, 30 bp, Artificial Sequence
  Description of Artificial Sequence: Synthetic oligonucleotide
gggtcaatggaacattccaggccaacttcc

SEQ ID NO: 167570 - DNA, 30 bp, Artificial Sequence
  Description of Artificial Sequence: Synthetic oligonucleotide
ggtcaatggaacattccaggccaacttccc

SEQ ID NO: 167571 - DNA, 31 bp, Artificial Sequence
  Description of Artificial Sequence: Synthetic oligonucleotide
gtcaatggaacattccaggccaacttccctc

SEQ ID NO: 167572 - DNA, 32 bp, Artificial Sequence
  Description of Artificial Sequence: Synthetic oligonucleotide
tcaatggaacattccaggccaacttccctctg

SEQ ID NO: 167573 - DNA, 31 bp, Artificial Sequence
  Description of Artificial Sequence: Synthetic oligonucleotide
caatggaacattccaggccaacttccctctg

SEQ ID NO: 167574 - DNA, 31 bp, Artificial Sequence
  Description of Artificial Sequence: Synthetic oligonucleotide
aatggaacattccaggccaacttccctctgg

SEQ ID NO: 167575 - DNA, 30 bp, Artificial Sequence
  Description of Artificial Sequence: Synthetic oligonucleotide
atggaacattccaggccaacttccctctgg

SEQ ID NO: 167576 - DNA, 29 bp, Artificial Sequence
  Description of Artificial Sequence: Synthetic oligonucleotide
tggaacattccaggccaacttccctctgg

SEQ ID NO: 167577 - DNA, 28 bp, Artificial Sequence
  Description of Artificial Sequence: Synthetic oligonucleotide
ggaacattccaggccaacttccctctgg

SEQ ID NO: 167578 - DNA, 28 bp, Artificial Sequence
  Description of Artificial Sequence: Synthetic oligonucleotide
gaacattccaggccaacttccctctggg

SEQ ID NO: 167579 - DNA, 28 bp, Artificial Sequence
  Description of Artificial Sequence: Synthetic oligonucleotide
aacattccaggccaacttccctctgggc

SEQ ID NO: 167580 - DNA, 27 bp, Artificial Sequence
  Description of Artificial Sequence: Synthetic oligonucleotide
acattccaggccaacttccctctgggc

SEQ ID NO: 167581 - DNA, 26 bp, Artificial Sequence
  Description of Artificial Sequence: Synthetic oligonucleotide
cattccaggccaacttccctctgggc

SEQ ID NO: 167582 - DNA, 26 bp, Artificial Sequence
  Description of Artificial Sequence: Synthetic oligonucleotide
attccaggccaacttccctctgggcc

SEQ ID NO: 167583 - DNA, 25 bp, Artificial Sequence
  Description of Artificial Sequence: Synthetic oligonucleotide
ttccaggccaacttccctctgggcc

SEQ ID NO: 167584 - DNA, 24 bp, Artificial Sequence
  Description of Artificial Sequence: Synthetic oligonucleotide
tccaggccaacttccctctgggcc

SEQ ID NO: 167585 - DNA, 23 bp, Artificial Sequence
  Description of Artificial Sequence: Synthetic oligonucleotide
ccaggccaacttccctctgggcc

SEQ ID NO: 167586 - DNA, 24 bp, Artificial Sequence
  Description of Artificial Sequence: Synthetic oligonucleotide
caggccaacttccctctgggccct

SEQ ID NO: 167587 - DNA, 25 bp, Artificial Sequence
  Description of Artificial Sequence: Synthetic oligonucleotide
aggccaacttccctctgggccctgt

SEQ ID NO: 167588 - DNA, 24 bp, Artificial Sequence
  Description of Artificial Sequence: Synthetic oligonucleotide
ggccaacttccctctgggccctgt

SEQ ID NO: 167589 - DNA, 25 bp, Artificial Sequence
  Description of Artificial Sequence: Synthetic oligonucleotide
gccaacttccctctgggccctgtga

SEQ ID NO: 167590 - DNA, 25 bp, Artificial Sequence
  Description of Artificial Sequence: Synthetic oligonucleotide
ccaacttccctctgggccctgtgac

SEQ ID NO: 167591 - DNA, 25 bp, Artificial Sequence
  Description of Artificial Sequence: Synthetic oligonucleotide
caacttccctctgggccctgtgacc

SEQ ID NO: 167592 - DNA, 26 bp, Artificial Sequence
  Description of Artificial Sequence: Synthetic oligonucleotide
aacttccctctgggccctgtgaccca

SEQ ID NO: 167593 - DNA, 25 bp, Artificial Sequence
  Description of Artificial Sequence: Synthetic oligonucleotide
acttccctctgggccctgtgaccca

SEQ ID NO: 167594 - DNA, 24 bp, Artificial Sequence
  Description of Artificial Sequence: Synthetic oligonucleotide
cttccctctgggccctgtgaccca

SEQ ID NO: 167595 - DNA, 24 bp, Artificial Sequence
  Description of Artificial Sequence: Synthetic oligonucleotide
ttccctctgggccctgtgacccac

SEQ ID NO: 167596 - DNA, 23 bp, Artificial Sequence
  Description of Artificial Sequence: Synthetic oligonucleotide
tccctctgggccctgtgacccac

SEQ ID NO: 167597 - DNA, 22 bp, Artificial Sequence
  Description of Artificial Sequence: Synthetic oligonucleotide
ccctctgggccctgtgacccac

SEQ ID NO: 167598 - DNA, 22 bp, Artificial Sequence
  Description of Artificial Sequence: Synthetic oligonucleotide
cctctgggccctgtgacccacg

SEQ ID NO: 167599 - DNA, 23 bp, Artificial Sequence
  Description of Artificial Sequence: Synthetic oligonucleotide
ctctgggccctgtgacccacgga

SEQ ID NO: 167600 - DNA, 23 bp, Artificial Sequence
  Description of Artificial Sequence: Synthetic oligonucleotide
tctgggccctgtgacccacggag

SEQ ID NO: 167601 - DNA, 22 bp, Artificial Sequence
  Description of Artificial Sequence: Synthetic oligonucleotide
ctgggccctgtgacccacggag

SEQ ID NO: 167602 - DNA, 22 bp, Artificial Sequence
  Description of Artificial Sequence: Synthetic oligonucleotide
tgggccctgtgacccacggagg

SEQ ID NO: 167603 - DNA, 21 bp, Artificial Sequence
  Description of Artificial Sequence: Synthetic oligonucleotide
gggccctgtgacccacggagg

SEQ ID NO: 167604 - DNA, 23 bp, Artificial Sequence
  Description of Artificial Sequence: Synthetic oligonucleotide
ggccctgtgacccacggagggaa

SEQ ID NO: 167605 - DNA, 25 bp, Artificial Sequence
  Description of Artificial Sequence: Synthetic oligonucleotide
gccctgtgacccacggagggaacta

SEQ ID NO: 167606 - DNA, 26 bp, Artificial Sequence
  Description of Artificial Sequence: Synthetic oligonucleotide
ccctgtgacccacggagggaactaca

SEQ ID NO: 167607 - DNA, 27 bp, Artificial Sequence
  Description of Artificial Sequence: Synthetic oligonucleotide
cctgtgacccacggagggaactacaga

SEQ ID NO: 167608 - DNA, 28 bp, Artificial Sequence
  Description of Artificial Sequence: Synthetic oligonucleotide
ctgtgacccacggagggaactacagatg

SEQ ID NO: 167609 - DNA, 28 bp, Artificial Sequence
  Description of Artificial Sequence: Synthetic oligonucleotide
tgtgacccacggagggaactacagatgc

SEQ ID NO: 167610 - DNA, 27 bp, Artificial Sequence
  Description of Artificial Sequence: Synthetic oligonucleotide
gtgacccacggagggaactacagatgc

SEQ ID NO: 167611 - DNA, 29 bp, Artificial Sequence
  Description of Artificial Sequence: Synthetic oligonucleotide
tgacccacggagggaactacagatgcttc

SEQ ID NO: 167612 - DNA, 28 bp, Artificial Sequence
  Description of Artificial Sequence: Synthetic oligonucleotide
gacccacggagggaactacagatgcttc

SEQ ID NO: 167613 - DNA, 28 bp, Artificial Sequence
  Description of Artificial Sequence: Synthetic oligonucleotide
acccacggagggaactacagatgcttcg

SEQ ID NO: 167614 - DNA, 27 bp, Artificial Sequence
  Description of Artificial Sequence: Synthetic oligonucleotide
cccacggagggaactacagatgcttcg

SEQ ID NO: 167615 - DNA, 27 bp, Artificial Sequence
  Description of Artificial Sequence: Synthetic oligonucleotide
ccacggagggaactacagatgcttcgg

SEQ ID NO: 167616 - DNA, 27 bp, Artificial Sequence
  Description of Artificial Sequence: Synthetic oligonucleotide
cacggagggaactacagatgcttcggc

SEQ ID NO: 167617 - DNA, 28 bp, Artificial Sequence
  Description of Artificial Sequence: Synthetic oligonucleotide
acggagggaactacagatgcttcggctc

SEQ ID NO: 167618 - DNA, 27 bp, Artificial Sequence
  Description of Artificial Sequence: Synthetic oligonucleotide
cggagggaactacagatgcttcggctc

SEQ ID NO: 167619 - DNA, 30 bp, Artificial Sequence
  Description of Artificial Sequence: Synthetic oligonucleotide
ggagggaactacagatgcttcggctctttc

SEQ ID NO: 167620 - DNA, 30 bp, Artificial Sequence
  Description of Artificial Sequence: Synthetic oligonucleotide
gagggaactacagatgcttcggctctttcc

SEQ ID NO: 167621 - DNA, 30 bp, Artificial Sequence
  Description of Artificial Sequence: Synthetic oligonucleotide
agggaactacagatgcttcggctctttccg

SEQ ID NO: 167622 - DNA, 29 bp, Artificial Sequence
  Description of Artificial Sequence: Synthetic oligonucleotide
gggaactacagatgcttcggctctttccg

SEQ ID NO: 167623 - DNA, 30 bp, Artificial Sequence
  Description of Artificial Sequence: Synthetic oligonucleotide
ggaactacagatgcttcggctctttccgtg

SEQ ID NO: 167624 - DNA, 30 bp, Artificial Sequence
  Description of Artificial Sequence: Synthetic oligonucleotide
gaactacagatgcttcggctctttccgtgc

SEQ ID NO: 167625 - DNA, 30 bp, Artificial Sequence
  Description of Artificial Sequence: Synthetic oligonucleotide
aactacagatgcttcggctctttccgtgcc

SEQ ID NO: 167626 - DNA, 29 bp, Artificial Sequence
  Description of Artificial Sequence: Synthetic oligonucleotide
actacagatgcttcggctctttccgtgcc

SEQ ID NO: 167627 - DNA, 24 bp, Artificial Sequence
  Description of Artificial Sequence: Synthetic oligonucleotide
ttcggctctttccgtgccctgccc

SEQ ID NO: 167628 - DNA, 23 bp, Artificial Sequence
  Description of Artificial Sequence: Synthetic oligonucleotide
tcggctctttccgtgccctgccc

SEQ ID NO: 167629 - DNA, 22 bp, Artificial Sequence
  Description of Artificial Sequence: Synthetic oligonucleotide
cggctctttccgtgccctgccc

SEQ ID NO: 167630 - DNA, 23 bp, Artificial Sequence
  Description of Artificial Sequence: Synthetic oligonucleotide
ggctctttccgtgccctgcccca

SEQ ID NO: 167631 - DNA, 23 bp, Artificial Sequence
  Description of Artificial Sequence: Synthetic oligonucleotide
gctctttccgtgccctgccccac

SEQ ID NO: 167632 - DNA, 23 bp, Artificial Sequence
  Description of Artificial Sequence: Synthetic oligonucleotide
ctctttccgtgccctgccccacg

SEQ ID NO: 167633 - DNA, 23 bp, Artificial Sequence
  Description of Artificial Sequence: Synthetic oligonucleotide
tctttccgtgccctgccccacgc

SEQ ID NO: 167634 - DNA, 22 bp, Artificial Sequence
  Description of Artificial Sequence: Synthetic oligonucleotide
ctttccgtgccctgccccacgc

SEQ ID NO: 167635 - DNA, 23 bp, Artificial Sequence
  Description of Artificial Sequence: Synthetic oligonucleotide
tttccgtgccctgccccacgcgt

SEQ ID NO: 167636 - DNA, 22 bp, Artificial Sequence
  Description of Artificial Sequence: Synthetic oligonucleotide
ttccgtgccctgccccacgcgt

SEQ ID NO: 167637 - DNA, 21 bp, Artificial Sequence
  Description of Artificial Sequence: Synthetic oligonucleotide
tccgtgccctgccccacgcgt

SEQ ID NO: 167638 - DNA, 20 bp, Artificial Sequence
  Description of Artificial Sequence: Synthetic oligonucleotide
ccgtgccctgccccacgcgt

SEQ ID NO: 167639 - DNA, 20 bp, Artificial Sequence
  Description of Artificial Sequence: Synthetic oligonucleotide
cgtgccctgccccacgcgtg

SEQ ID NO: 167640 - DNA, 21 bp, Artificial Sequence
  Description of Artificial Sequence: Synthetic oligonucleotide
gtgccctgccccacgcgtggt

SEQ ID NO: 167641 - DNA, 22 bp, Artificial Sequence
  Description of Artificial Sequence: Synthetic oligonucleotide
tgccctgccccacgcgtggtca

SEQ ID NO: 167642 - DNA, 21 bp, Artificial Sequence
  Description of Artificial Sequence: Synthetic oligonucleotide
gccctgccccacgcgtggtca

SEQ ID NO: 167643 - DNA, 22 bp, Artificial Sequence
  Description of Artificial Sequence: Synthetic oligonucleotide
ccctgccccacgcgtggtcaga

SEQ ID NO: 167644 - DNA, 22 bp, Artificial Sequence
  Description of Artificial Sequence: Synthetic oligonucleotide
cctgccccacgcgtggtcagac

SEQ ID NO: 167645 - DNA, 22 bp, Artificial Sequence
  Description of Artificial Sequence: Synthetic oligonucleotide
ctgccccacgcgtggtcagacc

SEQ ID NO: 167646 - DNA, 22 bp, Artificial Sequence
  Description of Artificial Sequence: Synthetic oligonucleotide
tgccccacgcgtggtcagaccc

SEQ ID NO: 167647 - DNA, 21 bp, Artificial Sequence
  Description of Artificial Sequence: Synthetic oligonucleotide
gccccacgcgtggtcagaccc

SEQ ID NO: 167648 - DNA, 22 bp, Artificial Sequence
  Description of Artificial Sequence: Synthetic oligonucleotide
ccccacgcgtggtcagacccga

SEQ ID NO: 167649 - DNA, 23 bp, Artificial Sequence
  Description of Artificial Sequence: Synthetic oligonucleotide
cccacgcgtggtcagacccgagt

SEQ ID NO: 167650 - DNA, 24 bp, Artificial Sequence
  Description of Artificial Sequence: Synthetic oligonucleotide
ccacgcgtggtcagacccgagtga

SEQ ID NO: 167651 - DNA, 24 bp, Artificial Sequence
  Description of Artificial Sequence: Synthetic oligonucleotide
cacgcgtggtcagacccgagtgac

SEQ ID NO: 167652 - DNA, 24 bp, Artificial Sequence
  Description of Artificial Sequence: Synthetic oligonucleotide
acgcgtggtcagacccgagtgacc

SEQ ID NO: 167653 - DNA, 23 bp, Artificial Sequence
  Description of Artificial Sequence: Synthetic oligonucleotide
cgcgtggtcagacccgagtgacc

SEQ ID NO: 167654 - DNA, 24 bp, Artificial Sequence
  Description of Artificial Sequence: Synthetic oligonucleotide
gcgtggtcagacccgagtgaccca

SEQ ID NO: 167655 - DNA, 25 bp, Artificial Sequence
  Description of Artificial Sequence: Synthetic oligonucleotide
cgtggtcagacccgagtgacccact

SEQ ID NO: 167656 - DNA, 24 bp, Artificial Sequence
  Description of Artificial Sequence: Synthetic oligonucleotide
gtcagacccgagtgacccactgcc

SEQ ID NO: 167657 - DNA, 24 bp, Artificial Sequence
  Description of Artificial Sequence: Synthetic oligonucleotide
tcagacccgagtgacccactgccc

SEQ ID NO: 167658 - DNA, 23 bp, Artificial Sequence
  Description of Artificial Sequence: Synthetic oligonucleotide
cagacccgagtgacccactgccc

SEQ ID NO: 167659 - DNA, 26 bp, Artificial Sequence
  Description of Artificial Sequence: Synthetic oligonucleotide
agacccgagtgacccactgcccgttt

SEQ ID NO: 167660 - DNA, 25 bp, Artificial Sequence
  Description of Artificial Sequence: Synthetic oligonucleotide
gacccgagtgacccactgcccgttt

SEQ ID NO: 167661 - DNA, 26 bp, Artificial Sequence
  Description of Artificial Sequence: Synthetic oligonucleotide
acccgagtgacccactgcccgtttct

SEQ ID NO: 167662 - DNA, 25 bp, Artificial Sequence
  Description of Artificial Sequence: Synthetic oligonucleotide
cccgagtgacccactgcccgtttct

SEQ ID NO: 167663 - DNA, 26 bp, Artificial Sequence
  Description of Artificial Sequence: Synthetic oligonucleotide
ccgagtgacccactgcccgtttctgt

SEQ ID NO: 167664 - DNA, 27 bp, Artificial Sequence
  Description of Artificial Sequence: Synthetic oligonucleotide
cgagtgacccactgcccgtttctgtca

SEQ ID NO: 167665 - DNA, 27 bp, Artificial Sequence
  Description of Artificial Sequence: Synthetic oligonucleotide
gagtgacccactgcccgtttctgtcac

SEQ ID NO: 167666 - DNA, 28 bp, Artificial Sequence
  Description of Artificial Sequence: Synthetic oligonucleotide
agtgacccactgcccgtttctgtcacag

SEQ ID NO: 167667 - DNA, 27 bp, Artificial Sequence
  Description of Artificial Sequence: Synthetic oligonucleotide
gtgacccactgcccgtttctgtcacag

SEQ ID NO: 167668 - DNA, 27 bp, Artificial Sequence
  Description of Artificial Sequence: Synthetic oligonucleotide
tgacccactgcccgtttctgtcacagg

SEQ ID NO: 167669 - DNA, 27 bp, Artificial Sequence
  Description of Artificial Sequence: Synthetic oligonucleotide
gacccactgcccgtttctgtcacaggt

SEQ ID NO: 167670 - DNA, 29 bp, Artificial Sequence
  Description of Artificial Sequence: Synthetic oligonucleotide
acccactgcccgtttctgtcacaggtaac

SEQ ID NO: 167671 - DNA, 28 bp, Artificial Sequence
  Description of Artificial Sequence: Synthetic oligonucleotide
cccactgcccgtttctgtcacaggtaac

SEQ ID NO: 167672 - DNA, 29 bp, Artificial Sequence
  Description of Artificial Sequence: Synthetic oligonucleotide
ccactgcccgtttctgtcacaggtaactc

SEQ ID NO: 167673 - DNA, 29 bp, Artificial Sequence
  Description of Artificial Sequence: Synthetic oligonucleotide
cactgcccgtttctgtcacaggtaactcc

SEQ ID NO: 167674 - DNA, 30 bp, Artificial Sequence
  Description of Artificial Sequence: Synthetic oligonucleotide
actgcccgtttctgtcacaggtaactccag

SEQ ID NO: 167675 - DNA, 29 bp, Artificial Sequence
  Description of Artificial Sequence: Synthetic oligonucleotide
ctgcccgtttctgtcacaggtaactccag

SEQ ID NO: 167676 - DNA, 32 bp, Artificial Sequence
  Description of Artificial Sequence: Synthetic oligonucleotide
tgcccgtttctgtcacaggtaactccagaaac

SEQ ID NO: 167677 - DNA, 31 bp, Artificial Sequence
  Description of Artificial Sequence: Synthetic oligonucleotide
gcccgtttctgtcacaggtaactccagaaac

SEQ ID NO: 167678 - DNA, 31 bp, Artificial Sequence
  Description of Artificial Sequence: Synthetic oligonucleotide
cccgtttctgtcacaggtaactccagaaacc

SEQ ID NO: 167679 - DNA, 32 bp, Artificial Sequence
  Description of Artificial Sequence: Synthetic oligonucleotide
ccgtttctgtcacaggtaactccagaaacctg

SEQ ID NO: 167680 - DNA, 32 bp, Artificial Sequence
  Description of Artificial Sequence: Synthetic oligonucleotide
cgtttctgtcacaggtaactccagaaacctgc

SEQ ID NO: 167681 - DNA, 33 bp, Artificial Sequence
  Description of Artificial Sequence: Synthetic oligonucleotide
gtttctgtcacaggtaactccagaaacctgcac

SEQ ID NO: 167682 - DNA, 33 bp, Artificial Sequence
  Description of Artificial Sequence: Synthetic oligonucleotide
tttctgtcacaggtaactccagaaacctgcacg

SEQ ID NO: 167683 - DNA, 32 bp, Artificial Sequence
  Description of Artificial Sequence: Synthetic oligonucleotide
ttctgtcacaggtaactccagaaacctgcacg

SEQ ID NO: 167684 - DNA, 31 bp, Artificial Sequence
  Description of Artificial Sequence: Synthetic oligonucleotide
tctgtcacaggtaactccagaaacctgcacg

SEQ ID NO: 167685 - DNA, 30 bp, Artificial Sequence
  Description of Artificial Sequence: Synthetic oligonucleotide
ctgtcacaggtaactccagaaacctgcacg

SEQ ID NO: 167686 - DNA, 32 bp, Artificial Sequence
  Description of Artificial Sequence: Synthetic oligonucleotide
tgtcacaggtaactccagaaacctgcacgttc

SEQ ID NO: 167687 - DNA, 31 bp, Artificial Sequence
  Description of Artificial Sequence: Synthetic oligonucleotide
gtcacaggtaactccagaaacctgcacgttc

SEQ ID NO: 167688 - DNA, 32 bp, Artificial Sequence
  Description of Artificial Sequence: Synthetic oligonucleotide
tcacaggtaactccagaaacctgcacgttctg

SEQ ID NO: 167689 - DNA, 31 bp, Artificial Sequence
  Description of Artificial Sequence: Synthetic oligonucleotide
cacaggtaactccagaaacctgcacgttctg

SEQ ID NO: 167690 - DNA, 34 bp, Artificial Sequence
  Description of Artificial Sequence: Synthetic oligonucleotide
acaggtaactccagaaacctgcacgttctgattg

SEQ ID NO: 167691 - DNA, 33 bp, Artificial Sequence
  Description of Artificial Sequence: Synthetic oligonucleotide
caggtaactccagaaacctgcacgttctgattg

SEQ ID NO: 167692 - DNA, 33 bp, Artificial Sequence
  Description of Artificial Sequence: Synthetic oligonucleotide
aggtaactccagaaacctgcacgttctgattgg

SEQ ID NO: 167693 - DNA, 32 bp, Artificial Sequence
  Description of Artificial Sequence: Synthetic oligonucleotide
ggtaactccagaaacctgcacgttctgattgg

SEQ ID NO: 167694 - DNA, 32 bp, Artificial Sequence
  Description of Artificial Sequence: Synthetic oligonucleotide
gtaactccagaaacctgcacgttctgattggg

SEQ ID NO: 167695 - DNA, 33 bp, Artificial Sequence
  Description of Artificial Sequence: Synthetic oligonucleotide
taactccagaaacctgcacgttctgattgggac

SEQ ID NO: 167696 - DNA, 32 bp, Artificial Sequence
  Description of Artificial Sequence: Synthetic oligonucleotide
aactccagaaacctgcacgttctgattgggac

SEQ ID NO: 167697 - DNA, 31 bp, Artificial Sequence
  Description of Artificial Sequence: Synthetic oligonucleotide
actccagaaacctgcacgttctgattgggac

SEQ ID NO: 167698 - DNA, 30 bp, Artificial Sequence
  Description of Artificial Sequence: Synthetic oligonucleotide
ctccagaaacctgcacgttctgattgggac

SEQ ID NO: 167699 - DNA, 30 bp, Artificial Sequence
  Description of Artificial Sequence: Synthetic oligonucleotide
tccagaaacctgcacgttctgattgggacc

SEQ ID NO: 167700 - DNA, 29 bp, Artificial Sequence
  Description of Artificial Sequence: Synthetic oligonucleotide
ccagaaacctgcacgttctgattgggacc

SEQ ID NO: 167701 - DNA, 30 bp, Artificial Sequence
  Description of Artificial Sequence: Synthetic oligonucleotide
cagaaacctgcacgttctgattgggacctc

SEQ ID NO: 167702 - DNA, 31 bp, Artificial Sequence
  Description of Artificial Sequence: Synthetic oligonucleotide
agaaacctgcacgttctgattgggacctcag

SEQ ID NO: 167703 - DNA, 30 bp, Artificial Sequence
  Description of Artificial Sequence: Synthetic oligonucleotide
gaaacctgcacgttctgattgggacctcag

SEQ ID NO: 167704 - DNA, 31 bp, Artificial Sequence
  Description of Artificial Sequence: Synthetic oligonucleotide
aaacctgcacgttctgattgggacctcagtg

SEQ ID NO: 167705 - DNA, 30 bp, Artificial Sequence
  Description of Artificial Sequence: Synthetic oligonucleotide
aacctgcacgttctgattgggacctcagtg

SEQ ID NO: 167706 - DNA, 31 bp, Artificial Sequence
  Description of Artificial Sequence: Synthetic oligonucleotide
ttctgattgggacctcagtggtcatcatccc

SEQ ID NO: 167707 - DNA, 36 bp, Artificial Sequence
  Description of Artificial Sequence: Synthetic oligonucleotide
ttctttctccttcatcgctggtgtgccaacaaaaag

SEQ ID NO: 167708 - DNA, 35 bp, Artificial Sequence
  Description of Artificial Sequence: Synthetic oligonucleotide
tctttctccttcatcgctggtgtgccaacaaaaag

SEQ ID NO: 167709 - DNA, 34 bp, Artificial Sequence
  Description of Artificial Sequence: Synthetic oligonucleotide
ctttctccttcatcgctggtgtgccaacaaaaag

SEQ ID NO: 167710 - DNA, 37 bp, Artificial Sequence
  Description of Artificial Sequence: Synthetic oligonucleotide
tttctccttcatcgctggtgtgccaacaaaaagaatg

SEQ ID NO: 167711 - DNA, 36 bp, Artificial Sequence
  Description of Artificial Sequence: Synthetic oligonucleotide
ttctccttcatcgctggtgtgccaacaaaaagaatg

SEQ ID NO: 167712 - DNA, 35 bp, Artificial Sequence
  Description of Artificial Sequence: Synthetic oligonucleotide
tctccttcatcgctggtgtgccaacaaaaagaatg

SEQ ID NO: 167713 - DNA, 34 bp, Artificial Sequence
  Description of Artificial Sequence: Synthetic oligonucleotide
ctccttcatcgctggtgtgccaacaaaaagaatg

SEQ ID NO: 167714 - DNA, 34 bp, Artificial Sequence
  Description of Artificial Sequence: Synthetic oligonucleotide
tccttcatcgctggtgtgccaacaaaaagaatgc

SEQ ID NO: 167715 - DNA, 33 bp, Artificial Sequence
  Description of Artificial Sequence: Synthetic oligonucleotide
ccttcatcgctggtgtgccaacaaaaagaatgc

SEQ ID NO: 167716 - DNA, 34 bp, Artificial Sequence
  Description of Artificial Sequence: Synthetic oligonucleotide
cttcatcgctggtgtgccaacaaaaagaatgctg

SEQ ID NO: 167717 - DNA, 36 bp, Artificial Sequence
  Description of Artificial Sequence: Synthetic oligonucleotide
ttcatcgctggtgtgccaacaaaaagaatgctgttg

SEQ ID NO: 167718 - DNA, 35 bp, Artificial Sequence
  Description of Artificial Sequence: Synthetic oligonucleotide
tcatcgctggtgtgccaacaaaaagaatgctgttg

SEQ ID NO: 167719 - DNA, 34 bp, Artificial Sequence
  Description of Artificial Sequence: Synthetic oligonucleotide
catcgctggtgtgccaacaaaaagaatgctgttg

SEQ ID NO: 167720 - DNA, 38 bp, Artificial Sequence
  Description of Artificial Sequence: Synthetic oligonucleotide
atcgctggtgtgccaacaaaaagaatgctgttgtaatg

SEQ ID NO: 167721 - DNA, 37 bp, Artificial Sequence
  Description of Artificial Sequence: Synthetic oligonucleotide
tcgctggtgtgccaacaaaaagaatgctgttgtaatg

SEQ ID NO: 167722 - DNA, 36 bp, Artificial Sequence
  Description of Artificial Sequence: Synthetic oligonucleotide
cgctggtgtgccaacaaaaagaatgctgttgtaatg

SEQ ID NO: 167723 - DNA, 36 bp, Artificial Sequence
  Description of Artificial Sequence: Synthetic oligonucleotide
gctggtgtgccaacaaaaagaatgctgttgtaatgg

SEQ ID NO: 167724 - DNA, 37 bp, Artificial Sequence
  Description of Artificial Sequence: Synthetic oligonucleotide
ctggtgtgccaacaaaaagaatgctgttgtaatggac

SEQ ID NO: 167725 - DNA, 37 bp, Artificial Sequence
  Description of Artificial Sequence: Synthetic oligonucleotide
tggtgtgccaacaaaaagaatgctgttgtaatggacc

SEQ ID NO: 167726 - DNA, 36 bp, Artificial Sequence
  Description of Artificial Sequence: Synthetic oligonucleotide
ggtgtgccaacaaaaagaatgctgttgtaatggacc

SEQ ID NO: 167727 - DNA, 38 bp, Artificial Sequence
  Description of Artificial Sequence: Synthetic oligonucleotide
gtgtgccaacaaaaagaatgctgttgtaatggaccaag

SEQ ID NO: 167728 - DNA, 39 bp, Artificial Sequence
  Description of Artificial Sequence: Synthetic oligonucleotide
tgtgccaacaaaaagaatgctgttgtaatggaccaagag

SEQ ID NO: 167729 - DNA, 38 bp, Artificial Sequence
  Description of Artificial Sequence: Synthetic oligonucleotide
gtgccaacaaaaagaatgctgttgtaatggaccaagag

SEQ ID NO: 167730 - DNA, 38 bp, Artificial Sequence
  Description of Artificial Sequence: Synthetic oligonucleotide
tgccaacaaaaagaatgctgttgtaatggaccaagagc

SEQ ID NO: 167731 - DNA, 37 bp, Artificial Sequence
  Description of Artificial Sequence: Synthetic oligonucleotide
gccaacaaaaagaatgctgttgtaatggaccaagagc

SEQ ID NO: 167732 - DNA, 37 bp, Artificial Sequence
  Description of Artificial Sequence: Synthetic oligonucleotide
ccaacaaaaagaatgctgttgtaatggaccaagagcc

SEQ ID NO: 167733 - DNA, 38 bp, Artificial Sequence
  Description of Artificial Sequence: Synthetic oligonucleotide
caacaaaaagaatgctgttgtaatggaccaagagcctg

SEQ ID NO: 167734 - DNA, 38 bp, Artificial Sequence
  Description of Artificial Sequence: Synthetic oligonucleotide
aacaaaaagaatgctgttgtaatggaccaagagcctgc

SEQ ID NO: 167735 - DNA, 37 bp, Artificial Sequence
  Description of Artificial Sequence: Synthetic oligonucleotide
acaaaaagaatgctgttgtaatggaccaagagcctgc

SEQ ID NO: 167736 - DNA, 36 bp, Artificial Sequence
  Description of Artificial Sequence: Synthetic oligonucleotide
caaaaagaatgctgttgtaatggaccaagagcctgc

SEQ ID NO: 167737 - DNA, 37 bp, Artificial Sequence
  Description of Artificial Sequence: Synthetic oligonucleotide
aaaaagaatgctgttgtaatggaccaagagcctgcag

SEQ ID NO: 167738 - DNA, 36 bp, Artificial Sequence
  Description of Artificial Sequence: Synthetic oligonucleotide
aaaagaatgctgttgtaatggaccaagagcctgcag

SEQ ID NO: 167739 - DNA, 35 bp, Artificial Sequence
  Description of Artificial Sequence: Synthetic oligonucleotide
aaagaatgctgttgtaatggaccaagagcctgcag

SEQ ID NO: 167740 - DNA, 34 bp, Artificial Sequence
  Description of Artificial Sequence: Synthetic oligonucleotide
aagaatgctgttgtaatggaccaagagcctgcag

SEQ ID NO: 167741 - DNA, 33 bp, Artificial Sequence
  Description of Artificial Sequence: Synthetic oligonucleotide
agaatgctgttgtaatggaccaagagcctgcag

SEQ ID NO: 167742 - DNA, 32 bp, Artificial Sequence
  Description of Artificial Sequence: Synthetic oligonucleotide
gaatgctgttgtaatggaccaagagcctgcag

SEQ ID NO: 167743 - DNA, 37 bp, Artificial Sequence
  Description of Artificial Sequence: Synthetic oligonucleotide
gtgtgccaacaaaaagaatgctgttgtaatggaccag

SEQ ID NO: 167744 - DNA, 37 bp, Artificial Sequence
  Description of Artificial Sequence: Synthetic oligonucleotide
tgtgccaacaaaaagaatgctgttgtaatggaccagg

SEQ ID NO: 167745 - DNA, 36 bp, Artificial Sequence
  Description of Artificial Sequence: Synthetic oligonucleotide
gtgccaacaaaaagaatgctgttgtaatggaccagg

SEQ ID NO: 167746 - DNA, 37 bp, Artificial Sequence
  Description of Artificial Sequence: Synthetic oligonucleotide
tgccaacaaaaagaatgctgttgtaatggaccaggag

SEQ ID NO: 167747 - DNA, 36 bp, Artificial Sequence
  Description of Artificial Sequence: Synthetic oligonucleotide
gccaacaaaaagaatgctgttgtaatggaccaggag

SEQ ID NO: 167748 - DNA, 36 bp, Artificial Sequence
  Description of Artificial Sequence: Synthetic oligonucleotide
ccaacaaaaagaatgctgttgtaatggaccaggagc

SEQ ID NO: 167749 - DNA, 36 bp, Artificial Sequence
  Description of Artificial Sequence: Synthetic oligonucleotide
caacaaaaagaatgctgttgtaatggaccaggagcc

SEQ ID NO: 167750 - DNA, 37 bp, Artificial Sequence
  Description of Artificial Sequence: Synthetic oligonucleotide
aacaaaaagaatgctgttgtaatggaccaggagcctg

SEQ ID NO: 167751 - DNA, 36 bp, Artificial Sequence
  Description of Artificial Sequence: Synthetic oligonucleotide
acaaaaagaatgctgttgtaatggaccaggagcctg

SEQ ID NO: 167752 - DNA, 35 bp, Artificial Sequence
  Description of Artificial Sequence: Synthetic oligonucleotide
caaaaagaatgctgttgtaatggaccaggagcctg

SEQ ID NO: 167753 - DNA, 35 bp, Artificial Sequence
  Description of Artificial Sequence: Synthetic oligonucleotide
aaaaagaatgctgttgtaatggaccaggagcctgc

SEQ ID NO: 167754 - DNA, 34 bp, Artificial Sequence
  Description of Artificial Sequence: Synthetic oligonucleotide
aaaagaatgctgttgtaatggaccaggagcctgc

SEQ ID NO: 167755 - DNA, 33 bp, Artificial Sequence
  Description of Artificial Sequence: Synthetic oligonucleotide
aaagaatgctgttgtaatggaccaggagcctgc

SEQ ID NO: 167756 - DNA, 32 bp, Artificial Sequence
  Description of Artificial Sequence: Synthetic oligonucleotide
aagaatgctgttgtaatggaccaggagcctgc

SEQ ID NO: 167757 - DNA, 31 bp, Artificial Sequence
  Description of Artificial Sequence: Synthetic oligonucleotide
agaatgctgttgtaatggaccaggagcctgc

SEQ ID NO: 167758 - DNA, 30 bp, Artificial Sequence
  Description of Artificial Sequence: Synthetic oligonucleotide
gaatgctgttgtaatggaccaggagcctgc

SEQ ID NO: 167759 - DNA, 31 bp, Artificial Sequence
  Description of Artificial Sequence: Synthetic oligonucleotide
aatgctgttgtaatggaccaggagcctgcag

SEQ ID NO: 167760 - DNA, 30 bp, Artificial Sequence
  Description of Artificial Sequence: Synthetic oligonucleotide
atgctgttgtaatggaccaggagcctgcag

SEQ ID NO: 167761 - DNA, 29 bp, Artificial Sequence
  Description of Artificial Sequence: Synthetic oligonucleotide
tgctgttgtaatggaccaggagcctgcag

SEQ ID NO: 167762 - DNA, 28 bp, Artificial Sequence
  Description of Artificial Sequence: Synthetic oligonucleotide
gctgttgtaatggaccaggagcctgcag

SEQ ID NO: 167763 - DNA, 28 bp, Artificial Sequence
  Description of Artificial Sequence: Synthetic oligonucleotide
ctgttgtaatggaccaggagcctgcagg

SEQ ID NO: 167764 - DNA, 28 bp, Artificial Sequence
  Description of Artificial Sequence: Synthetic oligonucleotide
tgttgtaatggaccaggagcctgcaggg

SEQ ID NO: 167765 - DNA, 27 bp, Artificial Sequence
  Description of Artificial Sequence: Synthetic oligonucleotide
gttgtaatggaccaggagcctgcaggg

SEQ ID NO: 167766 - DNA, 29 bp, Artificial Sequence
  Description of Artificial Sequence: Synthetic oligonucleotide
ttgtaatggaccaggagcctgcagggaac

SEQ ID NO: 167767 - DNA, 27 bp, Artificial Sequence
  Description of Artificial Sequence: Synthetic oligonucleotide
ccaggagcctgcagggaacagaacagt

SEQ ID NO: 167768 - DNA, 27 bp, Artificial Sequence
  Description of Artificial Sequence: Synthetic oligonucleotide
caggagcctgcagggaacagaacagtg

SEQ ID NO: 167769 - DNA, 29 bp, Artificial Sequence
  Description of Artificial Sequence: Synthetic oligonucleotide
aggagcctgcagggaacagaacagtgaac

SEQ ID NO: 167770 - DNA, 28 bp, Artificial Sequence
  Description of Artificial Sequence: Synthetic oligonucleotide
ggagcctgcagggaacagaacagtgaac

SEQ ID NO: 167771 - DNA, 27 bp, Artificial Sequence
  Description of Artificial Sequence: Synthetic oligonucleotide
cccttgcgcctcattggacagctccat

SEQ ID NO: 167772 - DNA, 27 bp, Artificial Sequence
  Description of Artificial Sequence: Synthetic oligonucleotide
ccttgcgcctcattggacagctccatg

SEQ ID NO: 167773 - DNA, 29 bp, Artificial Sequence
  Description of Artificial Sequence: Synthetic oligonucleotide
cttgcgcctcattggacagctccatgatg

SEQ ID NO: 167774 - DNA, 29 bp, Artificial Sequence
  Description of Artificial Sequence: Synthetic oligonucleotide
ttgcgcctcattggacagctccatgatgc

SEQ ID NO: 167775 - DNA, 28 bp, Artificial Sequence
  Description of Artificial Sequence: Synthetic oligonucleotide
tgcgcctcattggacagctccatgatgc

SEQ ID NO: 167776 - DNA, 27 bp, Artificial Sequence
  Description of Artificial Sequence: Synthetic oligonucleotide
gcgcctcattggacagctccatgatgc

SEQ ID NO: 167777 - DNA, 27 bp, Artificial Sequence
  Description of Artificial Sequence: Synthetic oligonucleotide
cgcctcattggacagctccatgatgcg

SEQ ID NO: 167778 - DNA, 27 bp, Artificial Sequence
  Description of Artificial Sequence: Synthetic oligonucleotide
gcctcattggacagctccatgatgcgg

SEQ ID NO: 167779 - DNA, 27 bp, Artificial Sequence
  Description of Artificial Sequence: Synthetic oligonucleotide
cctcattggacagctccatgatgcggg

SEQ ID NO: 167780 - DNA, 29 bp, Artificial Sequence
  Description of Artificial Sequence: Synthetic oligonucleotide
ctcattggacagctccatgatgcgggttc

SEQ ID NO: 167781 - DNA, 29 bp, Artificial Sequence
  Description of Artificial Sequence: Synthetic oligonucleotide
tcattggacagctccatgatgcgggttcc

SEQ ID NO: 167782 - DNA, 28 bp, Artificial Sequence
  Description of Artificial Sequence: Synthetic oligonucleotide
cattggacagctccatgatgcgggttcc

SEQ ID NO: 167783 - DNA, 28 bp, Artificial Sequence
  Description of Artificial Sequence: Synthetic oligonucleotide
attggacagctccatgatgcgggttccc

SEQ ID NO: 167784 - DNA, 27 bp, Artificial Sequence
  Description of Artificial Sequence: Synthetic oligonucleotide
ttggacagctccatgatgcgggttccc

SEQ ID NO: 167785 - DNA, 27 bp, Artificial Sequence
  Description of Artificial Sequence: Synthetic oligonucleotide
tggacagctccatgatgcgggttccca

SEQ ID NO: 167786 - DNA, 26 bp, Artificial Sequence
  Description of Artificial Sequence: Synthetic oligonucleotide
ggacagctccatgatgcgggttccca

SEQ ID NO: 167787 - DNA, 26 bp, Artificial Sequence
  Description of Artificial Sequence: Synthetic oligonucleotide
gacagctccatgatgcgggttcccag

SEQ ID NO: 167788 - DNA, 27 bp, Artificial Sequence
  Description of Artificial Sequence: Synthetic oligonucleotide
acagctccatgatgcgggttcccaggt

SEQ ID NO: 167789 - DNA, 26 bp, Artificial Sequence
  Description of Artificial Sequence: Synthetic oligonucleotide
cagctccatgatgcgggttcccaggt

SEQ ID NO: 167790 - DNA, 27 bp, Artificial Sequence
  Description of Artificial Sequence: Synthetic oligonucleotide
agctccatgatgcgggttcccaggtca

SEQ ID NO: 167791 - DNA, 27 bp, Artificial Sequence
  Description of Artificial Sequence: Synthetic oligonucleotide
gctccatgatgcgggttcccaggtcaa

SEQ ID NO: 167792 - DNA, 27 bp, Artificial Sequence
  Description of Artificial Sequence: Synthetic oligonucleotide
ctccatgatgcgggttcccaggtcaac

SEQ ID NO: 167793 - DNA, 31 bp, Artificial Sequence
  Description of Artificial Sequence: Synthetic oligonucleotide
tccatgatgcgggttcccaggtcaactattc

SEQ ID NO: 167794 - DNA, 30 bp, Artificial Sequence
  Description of Artificial Sequence: Synthetic oligonucleotide
ccatgatgcgggttcccaggtcaactattc

SEQ ID NO: 167795 - DNA, 30 bp, Artificial Sequence
  Description of Artificial Sequence: Synthetic oligonucleotide
catgatgcgggttcccaggtcaactattcc

SEQ ID NO: 167796 - DNA, 32 bp, Artificial Sequence
  Description of Artificial Sequence: Synthetic oligonucleotide
atgatgcgggttcccaggtcaactattccatg

SEQ ID NO: 167797 - DNA, 31 bp, Artificial Sequence
  Description of Artificial Sequence: Synthetic oligonucleotide
tgatgcgggttcccaggtcaactattccatg

SEQ ID NO: 167798 - DNA, 25 bp, Artificial Sequence
  Description of Artificial Sequence: Synthetic oligonucleotide
gatcactgaggaccccttgcgcctc

SEQ ID NO: 167799 - DNA, 27 bp, Artificial Sequence
  Description of Artificial Sequence: Synthetic oligonucleotide
atcactgaggaccccttgcgcctcgtt

SEQ ID NO: 167800 - DNA, 26 bp, Artificial Sequence
  Description of Artificial Sequence: Synthetic oligonucleotide
tcactgaggaccccttgcgcctcgtt

SEQ ID NO: 167801 - DNA, 25 bp, Artificial Sequence
  Description of Artificial Sequence: Synthetic oligonucleotide
cactgaggaccccttgcgcctcgtt

SEQ ID NO: 167802 - DNA, 25 bp, Artificial Sequence
  Description of Artificial Sequence: Synthetic oligonucleotide
actgaggaccccttgcgcctcgttg

SEQ ID NO: 167803 - DNA, 24 bp, Artificial Sequence
  Description of Artificial Sequence: Synthetic oligonucleotide
ctgaggaccccttgcgcctcgttg

SEQ ID NO: 167804 - DNA, 25 bp, Artificial Sequence
  Description of Artificial Sequence: Synthetic oligonucleotide
tgaggaccccttgcgcctcgttgga

SEQ ID NO: 167805 - DNA, 24 bp, Artificial Sequence
  Description of Artificial Sequence: Synthetic oligonucleotide
gaggaccccttgcgcctcgttgga

SEQ ID NO: 167806 - DNA, 25 bp, Artificial Sequence
  Description of Artificial Sequence: Synthetic oligonucleotide
aggaccccttgcgcctcgttggaca

SEQ ID NO: 167807 - DNA, 24 bp, Artificial Sequence
  Description of Artificial Sequence: Synthetic oligonucleotide
ggaccccttgcgcctcgttggaca

SEQ ID NO: 167808 - DNA, 24 bp, Artificial Sequence
  Description of Artificial Sequence: Synthetic oligonucleotide
gaccccttgcgcctcgttggacag

SEQ ID NO: 167809 - DNA, 25 bp, Artificial Sequence
  Description of Artificial Sequence: Synthetic oligonucleotide
accccttgcgcctcgttggacagct

SEQ ID NO: 167810 - DNA, 24 bp, Artificial Sequence
  Description of Artificial Sequence: Synthetic oligonucleotide
ccccttgcgcctcgttggacagct

SEQ ID NO: 167811 - DNA, 24 bp, Artificial Sequence
  Description of Artificial Sequence: Synthetic oligonucleotide
cccttgcgcctcgttggacagctc

SEQ ID NO: 167812 - DNA, 25 bp, Artificial Sequence
  Description of Artificial Sequence: Synthetic oligonucleotide
ccttgcgcctcgttggacagctcca

SEQ ID NO: 167813 - DNA, 25 bp, Artificial Sequence
  Description of Artificial Sequence: Synthetic oligonucleotide
cttgcgcctcgttggacagctccac

SEQ ID NO: 167814 - DNA, 27 bp, Artificial Sequence
  Description of Artificial Sequence: Synthetic oligonucleotide
ttgcgcctcgttggacagctccacgat

SEQ ID NO: 167815 - DNA, 26 bp, Artificial Sequence
  Description of Artificial Sequence: Synthetic oligonucleotide
tgcgcctcgttggacagctccacgat

SEQ ID NO: 167816 - DNA, 25 bp, Artificial Sequence
  Description of Artificial Sequence: Synthetic oligonucleotide
gcgcctcgttggacagctccacgat

SEQ ID NO: 167817 - DNA, 25 bp, Artificial Sequence
  Description of Artificial Sequence: Synthetic oligonucleotide
cgcctcgttggacagctccacgatg

SEQ ID NO: 167818 - DNA, 25 bp, Artificial Sequence
  Description of Artificial Sequence: Synthetic oligonucleotide
gcctcgttggacagctccacgatgc

SEQ ID NO: 167819 - DNA, 25 bp, Artificial Sequence
  Description of Artificial Sequence: Synthetic oligonucleotide
cctcgttggacagctccacgatgcg

SEQ ID NO: 167820 - DNA, 25 bp, Artificial Sequence
  Description of Artificial Sequence: Synthetic oligonucleotide
ctcgttggacagctccacgatgcgg

SEQ ID NO: 167821 - DNA, 27 bp, Artificial Sequence
  Description of Artificial Sequence: Synthetic oligonucleotide
tcgttggacagctccacgatgcgggtt

SEQ ID NO: 167822 - DNA, 26 bp, Artificial Sequence
  Description of Artificial Sequence: Synthetic oligonucleotide
cgttggacagctccacgatgcgggtt

SEQ ID NO: 167823 - DNA, 26 bp, Artificial Sequence
  Description of Artificial Sequence: Synthetic oligonucleotide
gttggacagctccacgatgcgggttc

SEQ ID NO: 167824 - DNA, 30 bp, Artificial Sequence
  Description of Artificial Sequence: Synthetic oligonucleotide
tgcccgtttctgtcacaggtaactccagac

SEQ ID NO: 167825 - DNA, 29 bp, Artificial Sequence
  Description of Artificial Sequence: Synthetic oligonucleotide
gcccgtttctgtcacaggtaactccagac

SEQ ID NO: 167826 - DNA, 30 bp, Artificial Sequence
  Description of Artificial Sequence: Synthetic oligonucleotide
cccgtttctgtcacaggtaactccagacac

SEQ ID NO: 167827 - DNA, 30 bp, Artificial Sequence
  Description of Artificial Sequence: Synthetic oligonucleotide
ccgtttctgtcacaggtaactccagacacc

SEQ ID NO: 167828 - DNA, 31 bp, Artificial Sequence
  Description of Artificial Sequence: Synthetic oligonucleotide
cgtttctgtcacaggtaactccagacacctg

SEQ ID NO: 167829 - DNA, 31 bp, Artificial Sequence
  Description of Artificial Sequence: Synthetic oligonucleotide
gtttctgtcacaggtaactccagacacctgc

SEQ ID NO: 167830 - DNA, 32 bp, Artificial Sequence
  Description of Artificial Sequence: Synthetic oligonucleotide
tttctgtcacaggtaactccagacacctgcac

SEQ ID NO: 167831 - DNA, 31 bp, Artificial Sequence
  Description of Artificial Sequence: Synthetic oligonucleotide
ttctgtcacaggtaactccagacacctgcac

SEQ ID NO: 167832 - DNA, 30 bp, Artificial Sequence
  Description of Artificial Sequence: Synthetic oligonucleotide
tctgtcacaggtaactccagacacctgcac

SEQ ID NO: 167833 - DNA, 29 bp, Artificial Sequence
  Description of Artificial Sequence: Synthetic oligonucleotide
ctgtcacaggtaactccagacacctgcac

SEQ ID NO: 167834 - DNA, 29 bp, Artificial Sequence
  Description of Artificial Sequence: Synthetic oligonucleotide
tgtcacaggtaactccagacacctgcacg

SEQ ID NO: 167835 - DNA, 28 bp, Artificial Sequence
  Description of Artificial Sequence: Synthetic oligonucleotide
gtcacaggtaactccagacacctgcacg

SEQ ID NO: 167836 - DNA, 30 bp, Artificial Sequence
  Description of Artificial Sequence: Synthetic oligonucleotide
tcacaggtaactccagacacctgcacgttc

SEQ ID NO: 167837 - DNA, 29 bp, Artificial Sequence
  Description of Artificial Sequence: Synthetic oligonucleotide
cacaggtaactccagacacctgcacgttc

SEQ ID NO: 167838 - DNA, 30 bp, Artificial Sequence
  Description of Artificial Sequence: Synthetic oligonucleotide
acaggtaactccagacacctgcacgttctg

SEQ ID NO: 167839 - DNA, 29 bp, Artificial Sequence
  Description of Artificial Sequence: Synthetic oligonucleotide
caggtaactccagacacctgcacgttctg

SEQ ID NO: 167840 - DNA, 32 bp, Artificial Sequence
  Description of Artificial Sequence: Synthetic oligonucleotide
aggtaactccagacacctgcacgttctgattg

SEQ ID NO: 167841 - DNA, 31 bp, Artificial Sequence
  Description of Artificial Sequence: Synthetic oligonucleotide
ggtaactccagacacctgcacgttctgattg

SEQ ID NO: 167842 - DNA, 31 bp, Artificial Sequence
  Description of Artificial Sequence: Synthetic oligonucleotide
gtaactccagacacctgcacgttctgattgg

SEQ ID NO: 167843 - DNA, 31 bp, Artificial Sequence
  Description of Artificial Sequence: Synthetic oligonucleotide
taactccagacacctgcacgttctgattggg

SEQ ID NO: 167844 - DNA, 30 bp, Artificial Sequence
  Description of Artificial Sequence: Synthetic oligonucleotide
aactccagacacctgcacgttctgattggg

SEQ ID NO: 167845 - DNA, 29 bp, Artificial Sequence
  Description of Artificial Sequence: Synthetic oligonucleotide
actccagacacctgcacgttctgattggg

SEQ ID NO: 167846 - DNA, 28 bp, Artificial Sequence
  Description of Artificial Sequence: Synthetic oligonucleotide
ctccagacacctgcacgttctgattggg

SEQ ID NO: 167847 - DNA, 29 bp, Artificial Sequence
  Description of Artificial Sequence: Synthetic oligonucleotide
tccagacacctgcacgttctgattgggac

SEQ ID NO: 167848 - DNA, 34 bp, Artificial Sequence
  Description of Artificial Sequence: Synthetic oligonucleotide
actcttcagtgtcgctctcgtcttgggtttaatg

SEQ ID NO: 167849 - DNA, 33 bp, Artificial Sequence
  Description of Artificial Sequence: Synthetic oligonucleotide
ctcttcagtgtcgctctcgtcttgggtttaatg

SEQ ID NO: 167850 - DNA, 37 bp, Artificial Sequence
  Description of Artificial Sequence: Synthetic oligonucleotide
tcttcagtgtcgctctcgtcttgggtttaatgaattc

SEQ ID NO: 167851 - DNA, 36 bp, Artificial Sequence
  Description of Artificial Sequence: Synthetic oligonucleotide
cttcagtgtcgctctcgtcttgggtttaatgaattc

SEQ ID NO: 167852 - DNA, 37 bp, Artificial Sequence
  Description of Artificial Sequence: Synthetic oligonucleotide
ttcagtgtcgctctcgtcttgggtttaatgaattcag

SEQ ID NO: 167853 - DNA, 36 bp, Artificial Sequence
  Description of Artificial Sequence: Synthetic oligonucleotide
tcagtgtcgctctcgtcttgggtttaatgaattcag

SEQ ID NO: 167854 - DNA, 35 bp, Artificial Sequence
  Description of Artificial Sequence: Synthetic oligonucleotide
cagtgtcgctctcgtcttgggtttaatgaattcag

SEQ ID NO: 167855 - DNA, 36 bp, Artificial Sequence
  Description of Artificial Sequence: Synthetic oligonucleotide
agtgtcgctctcgtcttgggtttaatgaattcagtc

SEQ ID NO: 167856 - DNA, 35 bp, Artificial Sequence
  Description of Artificial Sequence: Synthetic oligonucleotide
gtgtcgctctcgtcttgggtttaatgaattcagtc

SEQ ID NO: 167857 - DNA, 36 bp, Artificial Sequence
  Description of Artificial Sequence: Synthetic oligonucleotide
tgtcgctctcgtcttgggtttaatgaattcagtctg

SEQ ID NO: 167858 - DNA, 35 bp, Artificial Sequence
  Description of Artificial Sequence: Synthetic oligonucleotide
gtcgctctcgtcttgggtttaatgaattcagtctg

SEQ ID NO: 167859 - DNA, 36 bp, Artificial Sequence
  Description of Artificial Sequence: Synthetic oligonucleotide
tcgctctcgtcttgggtttaatgaattcagtctgtc

SEQ ID NO: 167860 - DNA, 35 bp, Artificial Sequence
  Description of Artificial Sequence: Synthetic oligonucleotide
cgctctcgtcttgggtttaatgaattcagtctgtc

SEQ ID NO: 167861 - DNA, 35 bp, Artificial Sequence
  Description of Artificial Sequence: Synthetic oligonucleotide
gctctcgtcttgggtttaatgaattcagtctgtcc

SEQ ID NO: 167862 - DNA, 38 bp, Artificial Sequence
  Description of Artificial Sequence: Synthetic oligonucleotide
ctctcgtcttgggtttaatgaattcagtctgtccaaag

SEQ ID NO: 167863 - DNA, 40 bp, Artificial Sequence
  Description of Artificial Sequence: Synthetic oligonucleotide
tctcgtcttgggtttaatgaattcagtctgtccaaagaag

SEQ ID NO: 167864 - DNA, 39 bp, Artificial Sequence
  Description of Artificial Sequence: Synthetic oligonucleotide
ctcgtcttgggtttaatgaattcagtctgtccaaagaag

SEQ ID NO: 167865 - DNA, 40 bp, Artificial Sequence
  Description of Artificial Sequence: Synthetic oligonucleotide
tcgtcttgggtttaatgaattcagtctgtccaaagaagac

SEQ ID NO: 167866 - DNA, 39 bp, Artificial Sequence
  Description of Artificial Sequence: Synthetic oligonucleotide
cgtcttgggtttaatgaattcagtctgtccaaagaagac

SEQ ID NO: 167867 - DNA, 39 bp, Artificial Sequence
  Description of Artificial Sequence: Synthetic oligonucleotide
gtcttgggtttaatgaattcagtctgtccaaagaagacg

SEQ ID NO: 167868 - DNA, 39 bp, Artificial Sequence
  Description of Artificial Sequence: Synthetic oligonucleotide
tcttgggtttaatgaattcagtctgtccaaagaagacgg

SEQ ID NO: 167869 - DNA, 38 bp, Artificial Sequence
  Description of Artificial Sequence: Synthetic oligonucleotide
cttgggtttaatgaattcagtctgtccaaagaagacgg

SEQ ID NO: 167870 - DNA, 38 bp, Artificial Sequence
  Description of Artificial Sequence: Synthetic oligonucleotide
ttgggtttaatgaattcagtctgtccaaagaagacggg

SEQ ID NO: 167871 - DNA, 37 bp, Artificial Sequence
  Description of Artificial Sequence: Synthetic oligonucleotide
tgggtttaatgaattcagtctgtccaaagaagacggg

SEQ ID NO: 167872 - DNA, 36 bp, Artificial Sequence
  Description of Artificial Sequence: Synthetic oligonucleotide
gggtttaatgaattcagtctgtccaaagaagacggg

SEQ ID NO: 167873 - DNA, 38 bp, Artificial Sequence
  Description of Artificial Sequence: Synthetic oligonucleotide
ggtttaatgaattcagtctgtccaaagaagacgggatg

SEQ ID NO: 167874 - DNA, 38 bp, Artificial Sequence
  Description of Artificial Sequence: Synthetic oligonucleotide
gtttaatgaattcagtctgtccaaagaagacgggatgc

SEQ ID NO: 167875 - DNA, 38 bp, Artificial Sequence
  Description of Artificial Sequence: Synthetic oligonucleotide
tttaatgaattcagtctgtccaaagaagacgggatgcc

SEQ ID NO: 167876 - DNA, 37 bp, Artificial Sequence
  Description of Artificial Sequence: Synthetic oligonucleotide
ttaatgaattcagtctgtccaaagaagacgggatgcc

SEQ ID NO: 167877 - DNA, 36 bp, Artificial Sequence
  Description of Artificial Sequence: Synthetic oligonucleotide
taatgaattcagtctgtccaaagaagacgggatgcc

SEQ ID NO: 167878 - DNA, 35 bp, Artificial Sequence
  Description of Artificial Sequence: Synthetic oligonucleotide
aatgaattcagtctgtccaaagaagacgggatgcc

SEQ ID NO: 167879 - DNA, 34 bp, Artificial Sequence
  Description of Artificial Sequence: Synthetic oligonucleotide
atgaattcagtctgtccaaagaagacgggatgcc

SEQ ID NO: 167880 - DNA, 33 bp, Artificial Sequence
  Description of Artificial Sequence: Synthetic oligonucleotide
tgaattcagtctgtccaaagaagacgggatgcc

SEQ ID NO: 167881 - DNA, 28 bp, Artificial Sequence
  Description of Artificial Sequence: Synthetic oligonucleotide
aggtcccctggtgaaatcaggagagacg

SEQ ID NO: 167882 - DNA, 27 bp, Artificial Sequence
  Description of Artificial Sequence: Synthetic oligonucleotide
ggtcccctggtgaaatcaggagagacg

SEQ ID NO: 167883 - DNA, 27 bp, Artificial Sequence
  Description of Artificial Sequence: Synthetic oligonucleotide
gtcccctggtgaaatcaggagagacgg

SEQ ID NO: 167884 - DNA, 28 bp, Artificial Sequence
  Description of Artificial Sequence: Synthetic oligonucleotide
tcccctggtgaaatcaggagagacggtc

SEQ ID NO: 167885 - DNA, 27 bp, Artificial Sequence
  Description of Artificial Sequence: Synthetic oligonucleotide
cccctggtgaaatcaggagagacggtc

SEQ ID NO: 167886 - DNA, 29 bp, Artificial Sequence
  Description of Artificial Sequence: Synthetic oligonucleotide
ccctggtgaaatcaggagagacggtcatc

SEQ ID NO: 167887 - DNA, 29 bp, Artificial Sequence
  Description of Artificial Sequence: Synthetic oligonucleotide
cctggtgaaatcaggagagacggtcatcc

SEQ ID NO: 167888 - DNA, 30 bp, Artificial Sequence
  Description of Artificial Sequence: Synthetic oligonucleotide
ctggtgaaatcaggagagacggtcatcctg

SEQ ID NO: 167889 - DNA, 30 bp, Artificial Sequence
  Description of Artificial Sequence: Synthetic oligonucleotide
tggtgaaatcaggagagacggtcatcctgc

SEQ ID NO: 167890 - DNA, 29 bp, Artificial Sequence
  Description of Artificial Sequence: Synthetic oligonucleotide
ggtgaaatcaggagagacggtcatcctgc

SEQ ID NO: 167891 - DNA, 32 bp, Artificial Sequence
  Description of Artificial Sequence: Synthetic oligonucleotide
gtgaaatcaggagagacggtcatcctgcaatg

SEQ ID NO: 167892 - DNA, 34 bp, Artificial Sequence
  Description of Artificial Sequence: Synthetic oligonucleotide
tgaaatcaggagagacggtcatcctgcaatgttg

SEQ ID NO: 167893 - DNA, 33 bp, Artificial Sequence
  Description of Artificial Sequence: Synthetic oligonucleotide
gaaatcaggagagacggtcatcctgcaatgttg

SEQ ID NO: 167894 - DNA, 33 bp, Artificial Sequence
  Description of Artificial Sequence: Synthetic oligonucleotide
aaatcaggagagacggtcatcctgcaatgttgg

SEQ ID NO: 167895 - DNA, 32 bp, Artificial Sequence
  Description of Artificial Sequence: Synthetic oligonucleotide
aatcaggagagacggtcatcctgcaatgttgg

SEQ ID NO: 167896 - DNA, 31 bp, Artificial Sequence
  Description of Artificial Sequence: Synthetic oligonucleotide
atcaggagagacggtcatcctgcaatgttgg

SEQ ID NO: 167897 - DNA, 30 bp, Artificial Sequence
  Description of Artificial Sequence: Synthetic oligonucleotide
tcaggagagacggtcatcctgcaatgttgg

SEQ ID NO: 167898 - DNA, 29 bp, Artificial Sequence
  Description of Artificial Sequence: Synthetic oligonucleotide
caggagagacggtcatcctgcaatgttgg

SEQ ID NO: 167899 - DNA, 30 bp, Artificial Sequence
  Description of Artificial Sequence: Synthetic oligonucleotide
aggagagacggtcatcctgcaatgttggtc

SEQ ID NO: 167900 - DNA, 34 bp, Artificial Sequence
  Description of Artificial Sequence: Synthetic oligonucleotide
cttgtttgacatttaccatctatccagggaggcg

SEQ ID NO: 167901 - DNA, 34 bp, Artificial Sequence
  Description of Artificial Sequence: Synthetic oligonucleotide
ttgtttgacatttaccatctatccagggaggcgg

SEQ ID NO: 167902 - DNA, 33 bp, Artificial Sequence
  Description of Artificial Sequence: Synthetic oligonucleotide
tgtttgacatttaccatctatccagggaggcgg

SEQ ID NO: 167903 - DNA, 32 bp, Artificial Sequence
  Description of Artificial Sequence: Synthetic oligonucleotide
gtttgacatttaccatctatccagggaggcgg

SEQ ID NO: 167904 - DNA, 33 bp, Artificial Sequence
  Description of Artificial Sequence: Synthetic oligonucleotide
tttgacatttaccatctatccagggaggcggag

SEQ ID NO: 167905 - DNA, 32 bp, Artificial Sequence
  Description of Artificial Sequence: Synthetic oligonucleotide
ttgacatttaccatctatccagggaggcggag

SEQ ID NO: 167906 - DNA, 31 bp, Artificial Sequence
  Description of Artificial Sequence: Synthetic oligonucleotide
tgacatttaccatctatccagggaggcggag

SEQ ID NO: 167907 - DNA, 30 bp, Artificial Sequence
  Description of Artificial Sequence: Synthetic oligonucleotide
gacatttaccatctatccagggaggcggag

SEQ ID NO: 167908 - DNA, 30 bp, Artificial Sequence
  Description of Artificial Sequence: Synthetic oligonucleotide
acatttaccatctatccagggaggcggagg

SEQ ID NO: 167909 - DNA, 29 bp, Artificial Sequence
  Description of Artificial Sequence: Synthetic oligonucleotide
catttaccatctatccagggaggcggagg

SEQ ID NO: 167910 - DNA, 29 bp, Artificial Sequence
  Description of Artificial Sequence: Synthetic oligonucleotide
atttaccatctatccagggaggcggaggc

SEQ ID NO: 167911 - DNA, 28 bp, Artificial Sequence
  Description of Artificial Sequence: Synthetic oligonucleotide
tttaccatctatccagggaggcggaggc

SEQ ID NO: 167912 - DNA, 27 bp, Artificial Sequence
  Description of Artificial Sequence: Synthetic oligonucleotide
ttaccatctatccagggaggcggaggc

SEQ ID NO: 167913 - DNA, 26 bp, Artificial Sequence
  Description of Artificial Sequence: Synthetic oligonucleotide
taccatctatccagggaggcggaggc

SEQ ID NO: 167914 - DNA, 25 bp, Artificial Sequence
  Description of Artificial Sequence: Synthetic oligonucleotide
accatctatccagggaggcggaggc

SEQ ID NO: 167915 - DNA, 24 bp, Artificial Sequence
  Description of Artificial Sequence: Synthetic oligonucleotide
ccatctatccagggaggcggaggc

SEQ ID NO: 167916 - DNA, 24 bp, Artificial Sequence
  Description of Artificial Sequence: Synthetic oligonucleotide
catctatccagggaggcggaggcc

SEQ ID NO: 167917 - DNA, 24 bp, Artificial Sequence
  Description of Artificial Sequence: Synthetic oligonucleotide
atctatccagggaggcggaggccg

SEQ ID NO: 167918 - DNA, 23 bp, Artificial Sequence
  Description of Artificial Sequence: Synthetic oligonucleotide
tctatccagggaggcggaggccg

SEQ ID NO: 167919 - DNA, 22 bp, Artificial Sequence
  Description of Artificial Sequence: Synthetic oligonucleotide
ctatccagggaggcggaggccg

SEQ ID NO: 167920 - DNA, 23 bp, Artificial Sequence
  Description of Artificial Sequence: Synthetic oligonucleotide
tatccagggaggcggaggccggt

SEQ ID NO: 167921 - DNA, 22 bp, Artificial Sequence
  Description of Artificial Sequence: Synthetic oligonucleotide
atccagggaggcggaggccggt

SEQ ID NO: 167922 - DNA, 21 bp, Artificial Sequence
  Description of Artificial Sequence: Synthetic oligonucleotide
tccagggaggcggaggccggt

SEQ ID NO: 167923 - DNA, 20 bp, Artificial Sequence
  Description of Artificial Sequence: Synthetic oligonucleotide
ccagggaggcggaggccggt

SEQ ID NO: 167924 - DNA, 22 bp, Artificial Sequence
  Description of Artificial Sequence: Synthetic oligonucleotide
cagggaggcggaggccggtgaa

SEQ ID NO: 167925 - DNA, 25 bp, Artificial Sequence
  Description of Artificial Sequence: Synthetic oligonucleotide
agggaggcggaggccggtgaactta

SEQ ID NO: 167926 - DNA, 24 bp, Artificial Sequence
  Description of Artificial Sequence: Synthetic oligonucleotide
gggaggcggaggccggtgaactta

SEQ ID NO: 167927 - DNA, 24 bp, Artificial Sequence
  Description of Artificial Sequence: Synthetic oligonucleotide
ggaggcggaggccggtgaacttag

SEQ ID NO: 167928 - DNA, 24 bp, Artificial Sequence
  Description of Artificial Sequence: Synthetic oligonucleotide
gaggcggaggccggtgaacttagg

SEQ ID NO: 167929 - DNA, 25 bp, Artificial Sequence
  Description of Artificial Sequence: Synthetic oligonucleotide
aggcggaggccggtgaacttaggct

SEQ ID NO: 167930 - DNA, 24 bp, Artificial Sequence
  Description of Artificial Sequence: Synthetic oligonucleotide
ggcggaggccggtgaacttaggct

SEQ ID NO: 167931 - DNA, 25 bp, Artificial Sequence
  Description of Artificial Sequence: Synthetic oligonucleotide
gcggaggccggtgaacttaggctca

SEQ ID NO: 167932 - DNA, 26 bp, Artificial Sequence
  Description of Artificial Sequence: Synthetic oligonucleotide
cggaggccggtgaacttaggctcact

SEQ ID NO: 167933 - DNA, 26 bp, Artificial Sequence
  Description of Artificial Sequence: Synthetic oligonucleotide
ggaggccggtgaacttaggctcactg

SEQ ID NO: 167934 - DNA, 27 bp, Artificial Sequence
  Description of Artificial Sequence: Synthetic oligonucleotide
gaggccggtgaacttaggctcactgca

SEQ ID NO: 167935 - DNA, 27 bp, Artificial Sequence
  Description of Artificial Sequence: Synthetic oligonucleotide
aggccggtgaacttaggctcactgcag

SEQ ID NO: 167936 - DNA, 27 bp, Artificial Sequence
  Description of Artificial Sequence: Synthetic oligonucleotide
ggccggtgaacttaggctcactgcagt

SEQ ID NO: 167937 - DNA, 27 bp, Artificial Sequence
  Description of Artificial Sequence: Synthetic oligonucleotide
gccggtgaacttaggctcactgcagtg

SEQ ID NO: 167938 - DNA, 27 bp, Artificial Sequence
  Description of Artificial Sequence: Synthetic oligonucleotide
ccggtgaacttaggctcactgcagtgc

SEQ ID NO: 167939 - DNA, 28 bp, Artificial Sequence
  Description of Artificial Sequence: Synthetic oligonucleotide
cggtgaacttaggctcactgcagtgctg

SEQ ID NO: 167940 - DNA, 29 bp, Artificial Sequence
  Description of Artificial Sequence: Synthetic oligonucleotide
ggtgaacttaggctcactgcagtgctgag

SEQ ID NO: 167941 - DNA, 29 bp, Artificial Sequence
  Description of Artificial Sequence: Synthetic oligonucleotide
gtgaacttaggctcactgcagtgctgagg

SEQ ID NO: 167942 - DNA, 29 bp, Artificial Sequence
  Description of Artificial Sequence: Synthetic oligonucleotide
tgaacttaggctcactgcagtgctgaggg

SEQ ID NO: 167943 - DNA, 28 bp, Artificial Sequence
  Description of Artificial Sequence: Synthetic oligonucleotide
gaacttaggctcactgcagtgctgaggg

SEQ ID NO: 167944 - DNA, 29 bp, Artificial Sequence
  Description of Artificial Sequence: Synthetic oligonucleotide
aacttaggctcactgcagtgctgagggtc

SEQ ID NO: 167945 - DNA, 28 bp, Artificial Sequence
  Description of Artificial Sequence: Synthetic oligonucleotide
acttaggctcactgcagtgctgagggtc

SEQ ID NO: 167946 - DNA, 27 bp, Artificial Sequence
  Description of Artificial Sequence: Synthetic oligonucleotide
cttaggctcactgcagtgctgagggtc

SEQ ID NO: 167947 - DNA, 30 bp, Artificial Sequence
  Description of Artificial Sequence: Synthetic oligonucleotide
ttaggctcactgcagtgctgagggtcaatg

SEQ ID NO: 167948 - DNA, 29 bp, Artificial Sequence
  Description of Artificial Sequence: Synthetic oligonucleotide
taggctcactgcagtgctgagggtcaatg

SEQ ID NO: 167949 - DNA, 28 bp, Artificial Sequence
  Description of Artificial Sequence: Synthetic oligonucleotide
aggctcactgcagtgctgagggtcaatg

SEQ ID NO: 167950 - DNA, 27 bp, Artificial Sequence
  Description of Artificial Sequence: Synthetic oligonucleotide
ggctcactgcagtgctgagggtcaatg

SEQ ID NO: 167951 - DNA, 27 bp, Artificial Sequence
  Description of Artificial Sequence: Synthetic oligonucleotide
gctcactgcagtgctgagggtcaatgg

SEQ ID NO: 167952 - DNA, 29 bp, Artificial Sequence
  Description of Artificial Sequence: Synthetic oligonucleotide
ctcactgcagtgctgagggtcaatggaac

SEQ ID NO: 167953 - DNA, 32 bp, Artificial Sequence
  Description of Artificial Sequence: Synthetic oligonucleotide
tcactgcagtgctgagggtcaatggaacattc

SEQ ID NO: 167954 - DNA, 31 bp, Artificial Sequence
  Description of Artificial Sequence: Synthetic oligonucleotide
cactgcagtgctgagggtcaatggaacattc

SEQ ID NO: 167955 - DNA, 31 bp, Artificial Sequence
  Description of Artificial Sequence: Synthetic oligonucleotide
actgcagtgctgagggtcaatggaacattcc

SEQ ID NO: 167956 - DNA, 30 bp, Artificial Sequence
  Description of Artificial Sequence: Synthetic oligonucleotide
ctgcagtgctgagggtcaatggaacattcc

SEQ ID NO: 167957 - DNA, 31 bp, Artificial Sequence
  Description of Artificial Sequence: Synthetic oligonucleotide
tgcagtgctgagggtcaatggaacattccag

SEQ ID NO: 167958 - DNA, 30 bp, Artificial Sequence
  Description of Artificial Sequence: Synthetic oligonucleotide
gcagtgctgagggtcaatggaacattccag

SEQ ID NO: 167959 - DNA, 30 bp, Artificial Sequence
  Description of Artificial Sequence: Synthetic oligonucleotide
cagtgctgagggtcaatggaacattccagg

SEQ ID NO: 167960 - DNA, 30 bp, Artificial Sequence
  Description of Artificial Sequence: Synthetic oligonucleotide
agtgctgagggtcaatggaacattccaggc

SEQ ID NO: 167961 - DNA, 24 bp, Artificial Sequence
  Description of Artificial Sequence: Synthetic oligonucleotide
ggctctttccgtgccctgccccat

SEQ ID NO: 167962 - DNA, 24 bp, Artificial Sequence
  Description of Artificial Sequence: Synthetic oligonucleotide
gctctttccgtgccctgccccatg

SEQ ID NO: 167963 - DNA, 24 bp, Artificial Sequence
  Description of Artificial Sequence: Synthetic oligonucleotide
ctctttccgtgccctgccccatgc

SEQ ID NO: 167964 - DNA, 25 bp, Artificial Sequence
  Description of Artificial Sequence: Synthetic oligonucleotide
tctttccgtgccctgccccatgcgt

SEQ ID NO: 167965 - DNA, 24 bp, Artificial Sequence
  Description of Artificial Sequence: Synthetic oligonucleotide
ctttccgtgccctgccccatgcgt

SEQ ID NO: 167966 - DNA, 24 bp, Artificial Sequence
  Description of Artificial Sequence: Synthetic oligonucleotide
tttccgtgccctgccccatgcgtg

SEQ ID NO: 167967 - DNA, 23 bp, Artificial Sequence
  Description of Artificial Sequence: Synthetic oligonucleotide
ttccgtgccctgccccatgcgtg

SEQ ID NO: 167968 - DNA, 22 bp, Artificial Sequence
  Description of Artificial Sequence: Synthetic oligonucleotide
tccgtgccctgccccatgcgtg

SEQ ID NO: 167969 - DNA, 21 bp, Artificial Sequence
  Description of Artificial Sequence: Synthetic oligonucleotide
ccgtgccctgccccatgcgtg

SEQ ID NO: 167970 - DNA, 22 bp, Artificial Sequence
  Description of Artificial Sequence: Synthetic oligonucleotide
cgtgccctgccccatgcgtggt

SEQ ID NO: 167971 - DNA, 23 bp, Artificial Sequence
  Description of Artificial Sequence: Synthetic oligonucleotide
gtgccctgccccatgcgtggtca

SEQ ID NO: 167972 - DNA, 24 bp, Artificial Sequence
  Description of Artificial Sequence: Synthetic oligonucleotide
tgccctgccccatgcgtggtcaga

SEQ ID NO: 167973 - DNA, 23 bp, Artificial Sequence
  Description of Artificial Sequence: Synthetic oligonucleotide
gccctgccccatgcgtggtcaga

SEQ ID NO: 167974 - DNA, 23 bp, Artificial Sequence
  Description of Artificial Sequence: Synthetic oligonucleotide
ccctgccccatgcgtggtcagac

SEQ ID NO: 167975 - DNA, 23 bp, Artificial Sequence
  Description of Artificial Sequence: Synthetic oligonucleotide
cctgccccatgcgtggtcagacc

SEQ ID NO: 167976 - DNA, 23 bp, Artificial Sequence
  Description of Artificial Sequence: Synthetic oligonucleotide
ctgccccatgcgtggtcagaccc

SEQ ID NO: 167977 - DNA, 24 bp, Artificial Sequence
  Description of Artificial Sequence: Synthetic oligonucleotide
tgccccatgcgtggtcagacccga

SEQ ID NO: 167978 - DNA, 23 bp, Artificial Sequence
  Description of Artificial Sequence: Synthetic oligonucleotide
gccccatgcgtggtcagacccga

SEQ ID NO: 167979 - DNA, 24 bp, Artificial Sequence
  Description of Artificial Sequence: Synthetic oligonucleotide
ccccatgcgtggtcagacccgagt

SEQ ID NO: 167980 - DNA, 25 bp, Artificial Sequence
  Description of Artificial Sequence: Synthetic oligonucleotide
cccatgcgtggtcagacccgagtga

SEQ ID NO: 167981 - DNA, 25 bp, Artificial Sequence
  Description of Artificial Sequence: Synthetic oligonucleotide
ccatgcgtggtcagacccgagtgac

SEQ ID NO: 167982 - DNA, 25 bp, Artificial Sequence
  Description of Artificial Sequence: Synthetic oligonucleotide
catgcgtggtcagacccgagtgacc

SEQ ID NO: 167983 - DNA, 26 bp, Artificial Sequence
  Description of Artificial Sequence: Synthetic oligonucleotide
atgcgtggtcagacccgagtgaccca

SEQ ID NO: 167984 - DNA, 25 bp, Artificial Sequence
  Description of Artificial Sequence: Synthetic oligonucleotide
tgcgtggtcagacccgagtgaccca

SEQ ID NO: 167985 - DNA, 33 bp, Artificial Sequence
  Description of Artificial Sequence: Synthetic oligonucleotide
tttctgtcacaggtaactccagacacctgcatg

SEQ ID NO: 167986 - DNA, 32 bp, Artificial Sequence
  Description of Artificial Sequence: Synthetic oligonucleotide
ttctgtcacaggtaactccagacacctgcatg

SEQ ID NO: 167987 - DNA, 31 bp, Artificial Sequence
  Description of Artificial Sequence: Synthetic oligonucleotide
tctgtcacaggtaactccagacacctgcatg

SEQ ID NO: 167988 - DNA, 30 bp, Artificial Sequence
  Description of Artificial Sequence: Synthetic oligonucleotide
ctgtcacaggtaactccagacacctgcatg

SEQ ID NO: 167989 - DNA, 32 bp, Artificial Sequence
  Description of Artificial Sequence: Synthetic oligonucleotide
tgtcacaggtaactccagacacctgcatgttc

SEQ ID NO: 167990 - DNA, 31 bp, Artificial Sequence
  Description of Artificial Sequence: Synthetic oligonucleotide
gtcacaggtaactccagacacctgcatgttc

SEQ ID NO: 167991 - DNA, 32 bp, Artificial Sequence
  Description of Artificial Sequence: Synthetic oligonucleotide
tcacaggtaactccagacacctgcatgttctg

SEQ ID NO: 167992 - DNA, 31 bp, Artificial Sequence
  Description of Artificial Sequence: Synthetic oligonucleotide
cacaggtaactccagacacctgcatgttctg

SEQ ID NO: 167993 - DNA, 34 bp, Artificial Sequence
  Description of Artificial Sequence: Synthetic oligonucleotide
acaggtaactccagacacctgcatgttctgattg

SEQ ID NO: 167994 - DNA, 33 bp, Artificial Sequence
  Description of Artificial Sequence: Synthetic oligonucleotide
caggtaactccagacacctgcatgttctgattg

SEQ ID NO: 167995 - DNA, 33 bp, Artificial Sequence
  Description of Artificial Sequence: Synthetic oligonucleotide
aggtaactccagacacctgcatgttctgattgg

SEQ ID NO: 167996 - DNA, 32 bp, Artificial Sequence
  Description of Artificial Sequence: Synthetic oligonucleotide
ggtaactccagacacctgcatgttctgattgg

SEQ ID NO: 167997 - DNA, 32 bp, Artificial Sequence
  Description of Artificial Sequence: Synthetic oligonucleotide
gtaactccagacacctgcatgttctgattggg

SEQ ID NO: 167998 - DNA, 33 bp, Artificial Sequence
  Description of Artificial Sequence: Synthetic oligonucleotide
taactccagacacctgcatgttctgattgggac

SEQ ID NO: 167999 - DNA, 32 bp, Artificial Sequence
  Description of Artificial Sequence: Synthetic oligonucleotide
aactccagacacctgcatgttctgattgggac

SEQ ID NO: 168000 - DNA, 31 bp, Artificial Sequence
  Description of Artificial Sequence: Synthetic oligonucleotide
actccagacacctgcatgttctgattgggac

SEQ ID NO: 168001 - DNA, 30 bp, Artificial Sequence
  Description of Artificial Sequence: Synthetic oligonucleotide
ctccagacacctgcatgttctgattgggac

SEQ ID NO: 168002 - DNA, 30 bp, Artificial Sequence
  Description of Artificial Sequence: Synthetic oligonucleotide
tccagacacctgcatgttctgattgggacc

SEQ ID NO: 168003 - DNA, 37 bp, Artificial Sequence
  Description of Artificial Sequence: Synthetic oligonucleotide
tacaacagaatattccggaacagctttctcatgggtc

SEQ ID NO: 168004 - DNA, 36 bp, Artificial Sequence
  Description of Artificial Sequence: Synthetic oligonucleotide
acaacagaatattccggaacagctttctcatgggtc

SEQ ID NO: 168005 - DNA, 35 bp, Artificial Sequence
  Description of Artificial Sequence: Synthetic oligonucleotide
caacagaatattccggaacagctttctcatgggtc

SEQ ID NO: 168006 - DNA, 35 bp, Artificial Sequence
  Description of Artificial Sequence: Synthetic oligonucleotide
aacagaatattccggaacagctttctcatgggtcc

SEQ ID NO: 168007 - DNA, 34 bp, Artificial Sequence
  Description of Artificial Sequence: Synthetic oligonucleotide
acagaatattccggaacagctttctcatgggtcc

SEQ ID NO: 168008 - DNA, 33 bp, Artificial Sequence
  Description of Artificial Sequence: Synthetic oligonucleotide
cagaatattccggaacagctttctcatgggtcc

SEQ ID NO: 168009 - DNA, 34 bp, Artificial Sequence
  Description of Artificial Sequence: Synthetic oligonucleotide
agaatattccggaacagctttctcatgggtcctg

SEQ ID NO: 168010 - DNA, 33 bp, Artificial Sequence
  Description of Artificial Sequence: Synthetic oligonucleotide
gaatattccggaacagctttctcatgggtcctg

SEQ ID NO: 168011 - DNA, 34 bp, Artificial Sequence
  Description of Artificial Sequence: Synthetic oligonucleotide
aatattccggaacagctttctcatgggtcctgtg

SEQ ID NO: 168012 - DNA, 33 bp, Artificial Sequence
  Description of Artificial Sequence: Synthetic oligonucleotide
atattccggaacagctttctcatgggtcctgtg

SEQ ID NO: 168013 - DNA, 32 bp, Artificial Sequence
  Description of Artificial Sequence: Synthetic oligonucleotide
tattccggaacagctttctcatgggtcctgtg

SEQ ID NO: 168014 - DNA, 31 bp, Artificial Sequence
  Description of Artificial Sequence: Synthetic oligonucleotide
attccggaacagctttctcatgggtcctgtg

SEQ ID NO: 168015 - DNA, 30 bp, Artificial Sequence
  Description of Artificial Sequence: Synthetic oligonucleotide
ttccggaacagctttctcatgggtcctgtg

SEQ ID NO: 168016 - DNA, 29 bp, Artificial Sequence
  Description of Artificial Sequence: Synthetic oligonucleotide
tccggaacagctttctcatgggtcctgtg

SEQ ID NO: 168017 - DNA, 28 bp, Artificial Sequence
  Description of Artificial Sequence: Synthetic oligonucleotide
ccggaacagctttctcatgggtcctgtg

SEQ ID NO: 168018 - DNA, 29 bp, Artificial Sequence
  Description of Artificial Sequence: Synthetic oligonucleotide
cggaacagctttctcatgggtcctgtgac

SEQ ID NO: 168019 - DNA, 29 bp, Artificial Sequence
  Description of Artificial Sequence: Synthetic oligonucleotide
ggaacagctttctcatgggtcctgtgacc

SEQ ID NO: 168020 - DNA, 29 bp, Artificial Sequence
  Description of Artificial Sequence: Synthetic oligonucleotide
gaacagctttctcatgggtcctgtgaccc

SEQ ID NO: 168021 - DNA, 29 bp, Artificial Sequence
  Description of Artificial Sequence: Synthetic oligonucleotide
aacagctttctcatgggtcctgtgacccc

SEQ ID NO: 168022 - DNA, 28 bp, Artificial Sequence
  Description of Artificial Sequence: Synthetic oligonucleotide
acagctttctcatgggtcctgtgacccc

SEQ ID NO: 168023 - DNA, 27 bp, Artificial Sequence
  Description of Artificial Sequence: Synthetic oligonucleotide
cagctttctcatgggtcctgtgacccc

SEQ ID NO: 168024 - DNA, 28 bp, Artificial Sequence
  Description of Artificial Sequence: Synthetic oligonucleotide
agctttctcatgggtcctgtgaccccag

SEQ ID NO: 168025 - DNA, 27 bp, Artificial Sequence
  Description of Artificial Sequence: Synthetic oligonucleotide
gctttctcatgggtcctgtgaccccag

SEQ ID NO: 168026 - DNA, 27 bp, Artificial Sequence
  Description of Artificial Sequence: Synthetic oligonucleotide
ctttctcatgggtcctgtgaccccagc

SEQ ID NO: 168027 - DNA, 28 bp, Artificial Sequence
  Description of Artificial Sequence: Synthetic oligonucleotide
tttctcatgggtcctgtgaccccagcac

SEQ ID NO: 168028 - DNA, 27 bp, Artificial Sequence
  Description of Artificial Sequence: Synthetic oligonucleotide
ttctcatgggtcctgtgaccccagcac

SEQ ID NO: 168029 - DNA, 27 bp, Artificial Sequence
  Description of Artificial Sequence: Synthetic oligonucleotide
tctcatgggtcctgtgaccccagcaca

SEQ ID NO: 168030 - DNA, 27 bp, Artificial Sequence
  Description of Artificial Sequence: Synthetic oligonucleotide
ctcatgggtcctgtgaccccagcacat

SEQ ID NO: 168031 - DNA, 27 bp, Artificial Sequence
  Description of Artificial Sequence: Synthetic oligonucleotide
tcatgggtcctgtgaccccagcacatg

SEQ ID NO: 168032 - DNA, 26 bp, Artificial Sequence
  Description of Artificial Sequence: Synthetic oligonucleotide
catgggtcctgtgaccccagcacatg

SEQ ID NO: 168033 - DNA, 27 bp, Artificial Sequence
  Description of Artificial Sequence: Synthetic oligonucleotide
atgggtcctgtgaccccagcacatgca

SEQ ID NO: 168034 - DNA, 26 bp, Artificial Sequence
  Description of Artificial Sequence: Synthetic oligonucleotide
tgggtcctgtgaccccagcacatgca

SEQ ID NO: 168035 - DNA, 25 bp, Artificial Sequence
  Description of Artificial Sequence: Synthetic oligonucleotide
gggtcctgtgaccccagcacatgca

SEQ ID NO: 168036 - DNA, 25 bp, Artificial Sequence
  Description of Artificial Sequence: Synthetic oligonucleotide
ggtcctgtgaccccagcacatgcag

SEQ ID NO: 168037 - DNA, 25 bp, Artificial Sequence
  Description of Artificial Sequence: Synthetic oligonucleotide
gtcctgtgaccccagcacatgcagg

SEQ ID NO: 168038 - DNA, 26 bp, Artificial Sequence
  Description of Artificial Sequence: Synthetic oligonucleotide
tcctgtgaccccagcacatgcaggga

SEQ ID NO: 168039 - DNA, 21 bp, Artificial Sequence
  Description of Artificial Sequence: Synthetic oligonucleotide
tcagcccagccgggccccaca

SEQ ID NO: 168040 - DNA, 20 bp, Artificial Sequence
  Description of Artificial Sequence: Synthetic oligonucleotide
cagcccagccgggccccaca

SEQ ID NO: 168041 - DNA, 22 bp, Artificial Sequence
  Description of Artificial Sequence: Synthetic oligonucleotide
agcccagccgggccccacagtt

SEQ ID NO: 168042 - DNA, 21 bp, Artificial Sequence
  Description of Artificial Sequence: Synthetic oligonucleotide
gcccagccgggccccacagtt

SEQ ID NO: 168043 - DNA, 22 bp, Artificial Sequence
  Description of Artificial Sequence: Synthetic oligonucleotide
cccagccgggccccacagttca

SEQ ID NO: 168044 - DNA, 22 bp, Artificial Sequence
  Description of Artificial Sequence: Synthetic oligonucleotide
ccagccgggccccacagttcag

SEQ ID NO: 168045 - DNA, 22 bp, Artificial Sequence
  Description of Artificial Sequence: Synthetic oligonucleotide
cagccgggccccacagttcagg

SEQ ID NO: 168046 - DNA, 23 bp, Artificial Sequence
  Description of Artificial Sequence: Synthetic oligonucleotide
agccgggccccacagttcaggca

SEQ ID NO: 168047 - DNA, 22 bp, Artificial Sequence
  Description of Artificial Sequence: Synthetic oligonucleotide
gccgggccccacagttcaggca

SEQ ID NO: 168048 - DNA, 22 bp, Artificial Sequence
  Description of Artificial Sequence: Synthetic oligonucleotide
ccgggccccacagttcaggcag

SEQ ID NO: 168049 - DNA, 23 bp, Artificial Sequence
  Description of Artificial Sequence: Synthetic oligonucleotide
cgggccccacagttcaggcagga

SEQ ID NO: 168050 - DNA, 24 bp, Artificial Sequence
  Description of Artificial Sequence: Synthetic oligonucleotide
gggccccacagttcaggcaggaga

SEQ ID NO: 168051 - DNA, 27 bp, Artificial Sequence
  Description of Artificial Sequence: Synthetic oligonucleotide
ggccccacagttcaggcaggagagaat

SEQ ID NO: 168052 - DNA, 27 bp, Artificial Sequence
  Description of Artificial Sequence: Synthetic oligonucleotide
gccccacagttcaggcaggagagaatg

SEQ ID NO: 168053 - DNA, 28 bp, Artificial Sequence
  Description of Artificial Sequence: Synthetic oligonucleotide
ccccacagttcaggcaggagagaatgtg

SEQ ID NO: 168054 - DNA, 29 bp, Artificial Sequence
  Description of Artificial Sequence: Synthetic oligonucleotide
cccacagttcaggcaggagagaatgtgac

SEQ ID NO: 168055 - DNA, 29 bp, Artificial Sequence
  Description of Artificial Sequence: Synthetic oligonucleotide
ccacagttcaggcaggagagaatgtgacc

SEQ ID NO: 168056 - DNA, 31 bp, Artificial Sequence
  Description of Artificial Sequence: Synthetic oligonucleotide
cacagttcaggcaggagagaatgtgaccttg

SEQ ID NO: 168057 - DNA, 32 bp, Artificial Sequence
  Description of Artificial Sequence: Synthetic oligonucleotide
acagttcaggcaggagagaatgtgaccttgtc

SEQ ID NO: 168058 - DNA, 31 bp, Artificial Sequence
  Description of Artificial Sequence: Synthetic oligonucleotide
cagttcaggcaggagagaatgtgaccttgtc

SEQ ID NO: 168059 - DNA, 31 bp, Artificial Sequence
  Description of Artificial Sequence: Synthetic oligonucleotide
agttcaggcaggagagaatgtgaccttgtcc

SEQ ID NO: 168060 - DNA, 32 bp, Artificial Sequence
  Description of Artificial Sequence: Synthetic oligonucleotide
tgcccgtttctgtcacaggtaactccagatac

SEQ ID NO: 168061 - DNA, 31 bp, Artificial Sequence
  Description of Artificial Sequence: Synthetic oligonucleotide
gcccgtttctgtcacaggtaactccagatac

SEQ ID NO: 168062 - DNA, 31 bp, Artificial Sequence
  Description of Artificial Sequence: Synthetic oligonucleotide
cccgtttctgtcacaggtaactccagatacc

SEQ ID NO: 168063 - DNA, 32 bp, Artificial Sequence
  Description of Artificial Sequence: Synthetic oligonucleotide
ccgtttctgtcacaggtaactccagatacctg

SEQ ID NO: 168064 - DNA, 32 bp, Artificial Sequence
  Description of Artificial Sequence: Synthetic oligonucleotide
cgtttctgtcacaggtaactccagatacctgc

SEQ ID NO: 168065 - DNA, 33 bp, Artificial Sequence
  Description of Artificial Sequence: Synthetic oligonucleotide
gtttctgtcacaggtaactccagatacctgcac

SEQ ID NO: 168066 - DNA, 33 bp, Artificial Sequence
  Description of Artificial Sequence: Synthetic oligonucleotide
tttctgtcacaggtaactccagatacctgcacg

SEQ ID NO: 168067 - DNA, 32 bp, Artificial Sequence
  Description of Artificial Sequence: Synthetic oligonucleotide
ttctgtcacaggtaactccagatacctgcacg

SEQ ID NO: 168068 - DNA, 31 bp, Artificial Sequence
  Description of Artificial Sequence: Synthetic oligonucleotide
tctgtcacaggtaactccagatacctgcacg

SEQ ID NO: 168069 - DNA, 30 bp, Artificial Sequence
  Description of Artificial Sequence: Synthetic oligonucleotide
ctgtcacaggtaactccagatacctgcacg

SEQ ID NO: 168070 - DNA, 30 bp, Artificial Sequence
  Description of Artificial Sequence: Synthetic oligonucleotide
tgtcacaggtaactccagatacctgcacgc

SEQ ID NO: 168071 - DNA, 29 bp, Artificial Sequence
  Description of Artificial Sequence: Synthetic oligonucleotide
gtcacaggtaactccagatacctgcacgc

SEQ ID NO: 168072 - DNA, 30 bp, Artificial Sequence
  Description of Artificial Sequence: Synthetic oligonucleotide
tcacaggtaactccagatacctgcacgctc

SEQ ID NO: 168073 - DNA, 29 bp, Artificial Sequence
  Description of Artificial Sequence: Synthetic oligonucleotide
cacaggtaactccagatacctgcacgctc

SEQ ID NO: 168074 - DNA, 30 bp, Artificial Sequence
  Description of Artificial Sequence: Synthetic oligonucleotide
acaggtaactccagatacctgcacgctctg

SEQ ID NO: 168075 - DNA, 29 bp, Artificial Sequence
  Description of Artificial Sequence: Synthetic oligonucleotide
caggtaactccagatacctgcacgctctg

SEQ ID NO: 168076 - DNA, 32 bp, Artificial Sequence
  Description of Artificial Sequence: Synthetic oligonucleotide
aggtaactccagatacctgcacgctctgattg

SEQ ID NO: 168077 - DNA, 33 bp, Artificial Sequence
  Description of Artificial Sequence: Synthetic oligonucleotide
gacaacatgtgactcttcagtgtcgctctcatc

SEQ ID NO: 168078 - DNA, 35 bp, Artificial Sequence
  Description of Artificial Sequence: Synthetic oligonucleotide
acaacatgtgactcttcagtgtcgctctcatcttg

SEQ ID NO: 168079 - DNA, 34 bp, Artificial Sequence
  Description of Artificial Sequence: Synthetic oligonucleotide
caacatgtgactcttcagtgtcgctctcatcttg

SEQ ID NO: 168080 - DNA, 34 bp, Artificial Sequence
  Description of Artificial Sequence: Synthetic oligonucleotide
aacatgtgactcttcagtgtcgctctcatcttgg

SEQ ID NO: 168081 - DNA, 33 bp, Artificial Sequence
  Description of Artificial Sequence: Synthetic oligonucleotide
acatgtgactcttcagtgtcgctctcatcttgg

SEQ ID NO: 168082 - DNA, 32 bp, Artificial Sequence
  Description of Artificial Sequence: Synthetic oligonucleotide
catgtgactcttcagtgtcgctctcatcttgg

SEQ ID NO: 168083 - DNA, 32 bp, Artificial Sequence
  Description of Artificial Sequence: Synthetic oligonucleotide
atgtgactcttcagtgtcgctctcatcttggg

SEQ ID NO: 168084 - DNA, 31 bp, Artificial Sequence
  Description of Artificial Sequence: Synthetic oligonucleotide
tgtgactcttcagtgtcgctctcatcttggg

SEQ ID NO: 168085 - DNA, 30 bp, Artificial Sequence
  Description of Artificial Sequence: Synthetic oligonucleotide
gtgactcttcagtgtcgctctcatcttggg

SEQ ID NO: 168086 - DNA, 35 bp, Artificial Sequence
  Description of Artificial Sequence: Synthetic oligonucleotide
tgactcttcagtgtcgctctcatcttgggtttaac

SEQ ID NO: 168087 - DNA, 34 bp, Artificial Sequence
  Description of Artificial Sequence: Synthetic oligonucleotide
gactcttcagtgtcgctctcatcttgggtttaac

SEQ ID NO: 168088 - DNA, 34 bp, Artificial Sequence
  Description of Artificial Sequence: Synthetic oligonucleotide
actcttcagtgtcgctctcatcttgggtttaacg

SEQ ID NO: 168089 - DNA, 33 bp, Artificial Sequence
  Description of Artificial Sequence: Synthetic oligonucleotide
ctcttcagtgtcgctctcatcttgggtttaacg

SEQ ID NO: 168090 - DNA, 37 bp, Artificial Sequence
  Description of Artificial Sequence: Synthetic oligonucleotide
tcttcagtgtcgctctcatcttgggtttaacgaattc

SEQ ID NO: 168091 - DNA, 36 bp, Artificial Sequence
  Description of Artificial Sequence: Synthetic oligonucleotide
cttcagtgtcgctctcatcttgggtttaacgaattc

SEQ ID NO: 168092 - DNA, 37 bp, Artificial Sequence
  Description of Artificial Sequence: Synthetic oligonucleotide
ttcagtgtcgctctcatcttgggtttaacgaattcag

SEQ ID NO: 168093 - DNA, 36 bp, Artificial Sequence
  Description of Artificial Sequence: Synthetic oligonucleotide
tcagtgtcgctctcatcttgggtttaacgaattcag

SEQ ID NO: 168094 - DNA, 35 bp, Artificial Sequence
  Description of Artificial Sequence: Synthetic oligonucleotide
cagtgtcgctctcatcttgggtttaacgaattcag

SEQ ID NO: 168095 - DNA, 36 bp, Artificial Sequence
  Description of Artificial Sequence: Synthetic oligonucleotide
agtgtcgctctcatcttgggtttaacgaattcagtc

SEQ ID NO: 168096 - DNA, 35 bp, Artificial Sequence
  Description of Artificial Sequence: Synthetic oligonucleotide
gtgtcgctctcatcttgggtttaacgaattcagtc

SEQ ID NO: 168097 - DNA, 36 bp, Artificial Sequence
  Description of Artificial Sequence: Synthetic oligonucleotide
tgtcgctctcatcttgggtttaacgaattcagtctg

SEQ ID NO: 168098 - DNA, 35 bp, Artificial Sequence
  Description of Artificial Sequence: Synthetic oligonucleotide
gtcgctctcatcttgggtttaacgaattcagtctg

SEQ ID NO: 168099 - DNA, 36 bp, Artificial Sequence
  Description of Artificial Sequence: Synthetic oligonucleotide
tcgctctcatcttgggtttaacgaattcagtctgtc

SEQ ID NO: 168100 - DNA, 35 bp, Artificial Sequence
  Description of Artificial Sequence: Synthetic oligonucleotide
cgctctcatcttgggtttaacgaattcagtctgtc

SEQ ID NO: 168101 - DNA, 35 bp, Artificial Sequence
  Description of Artificial Sequence: Synthetic oligonucleotide
gctctcatcttgggtttaacgaattcagtctgtcc

SEQ ID NO: 168102 - DNA, 38 bp, Artificial Sequence
  Description of Artificial Sequence: Synthetic oligonucleotide
ctctcatcttgggtttaacgaattcagtctgtccaaag

SEQ ID NO: 168103 - DNA, 40 bp, Artificial Sequence
  Description of Artificial Sequence: Synthetic oligonucleotide
tctcatcttgggtttaacgaattcagtctgtccaaagaag

SEQ ID NO: 168104 - DNA, 39 bp, Artificial Sequence
  Description of Artificial Sequence: Synthetic oligonucleotide
ctcatcttgggtttaacgaattcagtctgtccaaagaag

SEQ ID NO: 168105 - DNA, 40 bp, Artificial Sequence
  Description of Artificial Sequence: Synthetic oligonucleotide
tcatcttgggtttaacgaattcagtctgtccaaagaagac

SEQ ID NO: 168106 - DNA, 39 bp, Artificial Sequence
  Description of Artificial Sequence: Synthetic oligonucleotide
catcttgggtttaacgaattcagtctgtccaaagaagac

SEQ ID NO: 168107 - DNA, 39 bp, Artificial Sequence
  Description of Artificial Sequence: Synthetic oligonucleotide
atcttgggtttaacgaattcagtctgtccaaagaagacg

SEQ ID NO: 168108 - DNA, 28 bp, Artificial Sequence
  Description of Artificial Sequence: Synthetic oligonucleotide
cagcaaccctgtggtgatcatggtcacg

SEQ ID NO: 168109 - DNA, 28 bp, Artificial Sequence
  Description of Artificial Sequence: Synthetic oligonucleotide
agcaaccctgtggtgatcatggtcacgg

SEQ ID NO: 168110 - DNA, 27 bp, Artificial Sequence
  Description of Artificial Sequence: Synthetic oligonucleotide
gcaaccctgtggtgatcatggtcacgg

SEQ ID NO: 168111 - DNA, 27 bp, Artificial Sequence
  Description of Artificial Sequence: Synthetic oligonucleotide
caaccctgtggtgatcatggtcacggg

SEQ ID NO: 168112 - DNA, 28 bp, Artificial Sequence
  Description of Artificial Sequence: Synthetic oligonucleotide
aaccctgtggtgatcatggtcacgggag

SEQ ID NO: 168113 - DNA, 27 bp, Artificial Sequence
  Description of Artificial Sequence: Synthetic oligonucleotide
accctgtggtgatcatggtcacgggag

SEQ ID NO: 168114 - DNA, 27 bp, Artificial Sequence
  Description of Artificial Sequence: Synthetic oligonucleotide
ccctgtggtgatcatggtcacgggagt

SEQ ID NO: 168115 - DNA, 27 bp, Artificial Sequence
  Description of Artificial Sequence: Synthetic oligonucleotide
cctgtggtgatcatggtcacgggagtc

SEQ ID NO: 168116 - DNA, 27 bp, Artificial Sequence
  Description of Artificial Sequence: Synthetic oligonucleotide
ctgtggtgatcatggtcacgggagtcc

SEQ ID NO: 168117 - DNA, 28 bp, Artificial Sequence
  Description of Artificial Sequence: Synthetic oligonucleotide
tgtggtgatcatggtcacgggagtccac

SEQ ID NO: 168118 - DNA, 27 bp, Artificial Sequence
  Description of Artificial Sequence: Synthetic oligonucleotide
gtggtgatcatggtcacgggagtccac

SEQ ID NO: 168119 - DNA, 28 bp, Artificial Sequence
  Description of Artificial Sequence: Synthetic oligonucleotide
tggtgatcatggtcacgggagtccacag

SEQ ID NO: 168120 - DNA, 27 bp, Artificial Sequence
  Description of Artificial Sequence: Synthetic oligonucleotide
ggtgatcatggtcacgggagtccacag

SEQ ID NO: 168121 - DNA, 31 bp, Artificial Sequence
  Description of Artificial Sequence: Synthetic oligonucleotide
gtgatcatggtcacgggagtccacagaaaac

SEQ ID NO: 168122 - DNA, 31 bp, Artificial Sequence
  Description of Artificial Sequence: Synthetic oligonucleotide
tgatcatggtcacgggagtccacagaaaacc

SEQ ID NO: 168123 - DNA, 30 bp, Artificial Sequence
  Description of Artificial Sequence: Synthetic oligonucleotide
gatcatggtcacgggagtccacagaaaacc

SEQ ID NO: 168124 - DNA, 32 bp, Artificial Sequence
  Description of Artificial Sequence: Synthetic oligonucleotide
atcatggtcacgggagtccacagaaaaccttc

SEQ ID NO: 168125 - DNA, 31 bp, Artificial Sequence
  Description of Artificial Sequence: Synthetic oligonucleotide
tcatggtcacgggagtccacagaaaaccttc

SEQ ID NO: 168126 - DNA, 30 bp, Artificial Sequence
  Description of Artificial Sequence: Synthetic oligonucleotide
catggtcacgggagtccacagaaaaccttc

SEQ ID NO: 168127 - DNA, 30 bp, Artificial Sequence
  Description of Artificial Sequence: Synthetic oligonucleotide
atggtcacgggagtccacagaaaaccttcc

SEQ ID NO: 168128 - DNA, 29 bp, Artificial Sequence
  Description of Artificial Sequence: Synthetic oligonucleotide
tggtcacgggagtccacagaaaaccttcc

SEQ ID NO: 168129 - DNA, 28 bp, Artificial Sequence
  Description of Artificial Sequence: Synthetic oligonucleotide
ggtcacgggagtccacagaaaaccttcc

SEQ ID NO: 168130 - DNA, 28 bp, Artificial Sequence
  Description of Artificial Sequence: Synthetic oligonucleotide
gtcacgggagtccacagaaaaccttccc

SEQ ID NO: 168131 - DNA, 29 bp, Artificial Sequence
  Description of Artificial Sequence: Synthetic oligonucleotide
tcacgggagtccacagaaaaccttccctc

SEQ ID NO: 168132 - DNA, 28 bp, Artificial Sequence
  Description of Artificial Sequence: Synthetic oligonucleotide
cacgggagtccacagaaaaccttccctc

SEQ ID NO: 168133 - DNA, 28 bp, Artificial Sequence
  Description of Artificial Sequence: Synthetic oligonucleotide
acgggagtccacagaaaaccttccctcc

SEQ ID NO: 168134 - DNA, 27 bp, Artificial Sequence
  Description of Artificial Sequence: Synthetic oligonucleotide
cgggagtccacagaaaaccttccctcc

SEQ ID NO: 168135 - DNA, 27 bp, Artificial Sequence
  Description of Artificial Sequence: Synthetic oligonucleotide
gaaaccttctctctcagcccagccgga

SEQ ID NO: 168136 - DNA, 27 bp, Artificial Sequence
  Description of Artificial Sequence: Synthetic oligonucleotide
aaaccttctctctcagcccagccggac

SEQ ID NO: 168137 - DNA, 26 bp, Artificial Sequence
  Description of Artificial Sequence: Synthetic oligonucleotide
aaccttctctctcagcccagccggac

SEQ ID NO: 168138 - DNA, 25 bp, Artificial Sequence
  Description of Artificial Sequence: Synthetic oligonucleotide
accttctctctcagcccagccggac

SEQ ID NO: 168139 - DNA, 24 bp, Artificial Sequence
  Description of Artificial Sequence: Synthetic oligonucleotide
ccttctctctcagcccagccggac

SEQ ID NO: 168140 - DNA, 24 bp, Artificial Sequence
  Description of Artificial Sequence: Synthetic oligonucleotide
cttctctctcagcccagccggacc

SEQ ID NO: 168141 - DNA, 24 bp, Artificial Sequence
  Description of Artificial Sequence: Synthetic oligonucleotide
ttctctctcagcccagccggaccc

SEQ ID NO: 168142 - DNA, 23 bp, Artificial Sequence
  Description of Artificial Sequence: Synthetic oligonucleotide
tctctctcagcccagccggaccc

SEQ ID NO: 168143 - DNA, 22 bp, Artificial Sequence
  Description of Artificial Sequence: Synthetic oligonucleotide
ctctctcagcccagccggaccc

SEQ ID NO: 168144 - DNA, 23 bp, Artificial Sequence
  Description of Artificial Sequence: Synthetic oligonucleotide
tctctcagcccagccggacccca

SEQ ID NO: 168145 - DNA, 22 bp, Artificial Sequence
  Description of Artificial Sequence: Synthetic oligonucleotide
ctctcagcccagccggacccca

SEQ ID NO: 168146 - DNA, 22 bp, Artificial Sequence
  Description of Artificial Sequence: Synthetic oligonucleotide
tctcagcccagccggaccccac

SEQ ID NO: 168147 - DNA, 21 bp, Artificial Sequence
  Description of Artificial Sequence: Synthetic oligonucleotide
ctcagcccagccggaccccac

SEQ ID NO: 168148 - DNA, 21 bp, Artificial Sequence
  Description of Artificial Sequence: Synthetic oligonucleotide
tcagcccagccggaccccacg

SEQ ID NO: 168149 - DNA, 20 bp, Artificial Sequence
  Description of Artificial Sequence: Synthetic oligonucleotide
cagcccagccggaccccacg

SEQ ID NO: 168150 - DNA, 22 bp, Artificial Sequence
  Description of Artificial Sequence: Synthetic oligonucleotide
agcccagccggaccccacggtt

SEQ ID NO: 168151 - DNA, 21 bp, Artificial Sequence
  Description of Artificial Sequence: Synthetic oligonucleotide
gcccagccggaccccacggtt

SEQ ID NO: 168152 - DNA, 22 bp, Artificial Sequence
  Description of Artificial Sequence: Synthetic oligonucleotide
cccagccggaccccacggttca

SEQ ID NO: 168153 - DNA, 22 bp, Artificial Sequence
  Description of Artificial Sequence: Synthetic oligonucleotide
ccagccggaccccacggttcag

SEQ ID NO: 168154 - DNA, 22 bp, Artificial Sequence
  Description of Artificial Sequence: Synthetic oligonucleotide
cagccggaccccacggttcagg

SEQ ID NO: 168155 - DNA, 23 bp, Artificial Sequence
  Description of Artificial Sequence: Synthetic oligonucleotide
agccggaccccacggttcaggca

SEQ ID NO: 168156 - DNA, 22 bp, Artificial Sequence
  Description of Artificial Sequence: Synthetic oligonucleotide
gccggaccccacggttcaggca

SEQ ID NO: 168157 - DNA, 22 bp, Artificial Sequence
  Description of Artificial Sequence: Synthetic oligonucleotide
ccggaccccacggttcaggcag

SEQ ID NO: 168158 - DNA, 23 bp, Artificial Sequence
  Description of Artificial Sequence: Synthetic oligonucleotide
cggaccccacggttcaggcagga

SEQ ID NO: 168159 - DNA, 24 bp, Artificial Sequence
  Description of Artificial Sequence: Synthetic oligonucleotide
ggaccccacggttcaggcaggaga

SEQ ID NO: 168160 - DNA, 27 bp, Artificial Sequence
  Description of Artificial Sequence: Synthetic oligonucleotide
gaccccacggttcaggcaggagagaat

SEQ ID NO: 168161 - DNA, 27 bp, Artificial Sequence
  Description of Artificial Sequence: Synthetic oligonucleotide
accccacggttcaggcaggagagaatg

SEQ ID NO: 168162 - DNA, 30 bp, Artificial Sequence
  Description of Artificial Sequence: Synthetic oligonucleotide
gagagaatgtgaccttgtcctgcagctctc

SEQ ID NO: 168163 - DNA, 30 bp, Artificial Sequence
  Description of Artificial Sequence: Synthetic oligonucleotide
agagaatgtgaccttgtcctgcagctctcg

SEQ ID NO: 168164 - DNA, 29 bp, Artificial Sequence
  Description of Artificial Sequence: Synthetic oligonucleotide
gagaatgtgaccttgtcctgcagctctcg

SEQ ID NO: 168165 - DNA, 29 bp, Artificial Sequence
  Description of Artificial Sequence: Synthetic oligonucleotide
agaatgtgaccttgtcctgcagctctcgg

SEQ ID NO: 168166 - DNA, 28 bp, Artificial Sequence
  Description of Artificial Sequence: Synthetic oligonucleotide
gaatgtgaccttgtcctgcagctctcgg

SEQ ID NO: 168167 - DNA, 29 bp, Artificial Sequence
  Description of Artificial Sequence: Synthetic oligonucleotide
aatgtgaccttgtcctgcagctctcggag

SEQ ID NO: 168168 - DNA, 28 bp, Artificial Sequence
  Description of Artificial Sequence: Synthetic oligonucleotide
atgtgaccttgtcctgcagctctcggag

SEQ ID NO: 168169 - DNA, 27 bp, Artificial Sequence
  Description of Artificial Sequence: Synthetic oligonucleotide
tgtgaccttgtcctgcagctctcggag

SEQ ID NO: 168170 - DNA, 26 bp, Artificial Sequence
  Description of Artificial Sequence: Synthetic oligonucleotide
gtgaccttgtcctgcagctctcggag

SEQ ID NO: 168171 - DNA, 27 bp, Artificial Sequence
  Description of Artificial Sequence: Synthetic oligonucleotide
tgaccttgtcctgcagctctcggagct

SEQ ID NO: 168172 - DNA, 27 bp, Artificial Sequence
  Description of Artificial Sequence: Synthetic oligonucleotide
gaccttgtcctgcagctctcggagctt

SEQ ID NO: 168173 - DNA, 27 bp, Artificial Sequence
  Description of Artificial Sequence: Synthetic oligonucleotide
accttgtcctgcagctctcggagcttg

SEQ ID NO: 168174 - DNA, 27 bp, Artificial Sequence
  Description of Artificial Sequence: Synthetic oligonucleotide
ccttgtcctgcagctctcggagcttgt

SEQ ID NO: 168175 - DNA, 29 bp, Artificial Sequence
  Description of Artificial Sequence: Synthetic oligonucleotide
cttgtcctgcagctctcggagcttgtttg

SEQ ID NO: 168176 - DNA, 30 bp, Artificial Sequence
  Description of Artificial Sequence: Synthetic oligonucleotide
ttgtcctgcagctctcggagcttgtttgac

SEQ ID NO: 168177 - DNA, 29 bp, Artificial Sequence
  Description of Artificial Sequence: Synthetic oligonucleotide
tgtcctgcagctctcggagcttgtttgac

SEQ ID NO: 168178 - DNA, 28 bp, Artificial Sequence
  Description of Artificial Sequence: Synthetic oligonucleotide
gtcctgcagctctcggagcttgtttgac

SEQ ID NO: 168179 - DNA, 33 bp, Artificial Sequence
  Description of Artificial Sequence: Synthetic oligonucleotide
tcctgcagctctcggagcttgtttgacatttac

SEQ ID NO: 168180 - DNA, 32 bp, Artificial Sequence
  Description of Artificial Sequence: Synthetic oligonucleotide
cctgcagctctcggagcttgtttgacatttac

SEQ ID NO: 168181 - DNA, 32 bp, Artificial Sequence
  Description of Artificial Sequence: Synthetic oligonucleotide
ctgcagctctcggagcttgtttgacatttacc

SEQ ID NO: 168182 - DNA, 34 bp, Artificial Sequence
  Description of Artificial Sequence: Synthetic oligonucleotide
tgcagctctcggagcttgtttgacatttaccatc

SEQ ID NO: 168183 - DNA, 33 bp, Artificial Sequence
  Description of Artificial Sequence: Synthetic oligonucleotide
gcagctctcggagcttgtttgacatttaccatc

SEQ ID NO: 168184 - DNA, 36 bp, Artificial Sequence
  Description of Artificial Sequence: Synthetic oligonucleotide
cagctctcggagcttgtttgacatttaccatctatc

SEQ ID NO: 168185 - DNA, 36 bp, Artificial Sequence
  Description of Artificial Sequence: Synthetic oligonucleotide
agctctcggagcttgtttgacatttaccatctatcc

SEQ ID NO: 168186 - DNA, 35 bp, Artificial Sequence
  Description of Artificial Sequence: Synthetic oligonucleotide
gctctcggagcttgtttgacatttaccatctatcc

SEQ ID NO: 168187 - DNA, 36 bp, Artificial Sequence
  Description of Artificial Sequence: Synthetic oligonucleotide
ctctcggagcttgtttgacatttaccatctatccag

SEQ ID NO: 168188 - DNA, 36 bp, Artificial Sequence
  Description of Artificial Sequence: Synthetic oligonucleotide
tctcggagcttgtttgacatttaccatctatccagg

SEQ ID NO: 168189 - DNA, 35 bp, Artificial Sequence
  Description of Artificial Sequence: Synthetic oligonucleotide
ctcggagcttgtttgacatttaccatctatccagg

SEQ ID NO: 168190 - DNA, 35 bp, Artificial Sequence
  Description of Artificial Sequence: Synthetic oligonucleotide
tcggagcttgtttgacatttaccatctatccaggg

SEQ ID NO: 168191 - DNA, 34 bp, Artificial Sequence
  Description of Artificial Sequence: Synthetic oligonucleotide
actcttcagtgtcgctctcgtcttgggtttaaag

SEQ ID NO: 168192 - DNA, 33 bp, Artificial Sequence
  Description of Artificial Sequence: Synthetic oligonucleotide
ctcttcagtgtcgctctcgtcttgggtttaaag

SEQ ID NO: 168193 - DNA, 37 bp, Artificial Sequence
  Description of Artificial Sequence: Synthetic oligonucleotide
tcttcagtgtcgctctcgtcttgggtttaaagaattc

SEQ ID NO: 168194 - DNA, 36 bp, Artificial Sequence
  Description of Artificial Sequence: Synthetic oligonucleotide
cttcagtgtcgctctcgtcttgggtttaaagaattc

SEQ ID NO: 168195 - DNA, 37 bp, Artificial Sequence
  Description of Artificial Sequence: Synthetic oligonucleotide
ttcagtgtcgctctcgtcttgggtttaaagaattcag

SEQ ID NO: 168196 - DNA, 36 bp, Artificial Sequence
  Description of Artificial Sequence: Synthetic oligonucleotide
tcagtgtcgctctcgtcttgggtttaaagaattcag

SEQ ID NO: 168197 - DNA, 35 bp, Artificial Sequence
  Description of Artificial Sequence: Synthetic oligonucleotide
cagtgtcgctctcgtcttgggtttaaagaattcag

SEQ ID NO: 168198 - DNA, 36 bp, Artificial Sequence
  Description of Artificial Sequence: Synthetic oligonucleotide
agtgtcgctctcgtcttgggtttaaagaattcagtc

SEQ ID NO: 168199 - DNA, 35 bp, Artificial Sequence
  Description of Artificial Sequence: Synthetic oligonucleotide
gtgtcgctctcgtcttgggtttaaagaattcagtc

SEQ ID NO: 168200 - DNA, 36 bp, Artificial Sequence
  Description of Artificial Sequence: Synthetic oligonucleotide
tgtcgctctcgtcttgggtttaaagaattcagtctg

SEQ ID NO: 168201 - DNA, 35 bp, Artificial Sequence
  Description of Artificial Sequence: Synthetic oligonucleotide
gtcgctctcgtcttgggtttaaagaattcagtctg

SEQ ID NO: 168202 - DNA, 36 bp, Artificial Sequence
  Description of Artificial Sequence: Synthetic oligonucleotide
tcgctctcgtcttgggtttaaagaattcagtctgtc

SEQ ID NO: 168203 - DNA, 35 bp, Artificial Sequence
  Description of Artificial Sequence: Synthetic oligonucleotide
cgctctcgtcttgggtttaaagaattcagtctgtc

SEQ ID NO: 168204 - DNA, 35 bp, Artificial Sequence
  Description of Artificial Sequence: Synthetic oligonucleotide
gctctcgtcttgggtttaaagaattcagtctgtcc

SEQ ID NO: 168205 - DNA, 38 bp, Artificial Sequence
  Description of Artificial Sequence: Synthetic oligonucleotide
ctctcgtcttgggtttaaagaattcagtctgtccaaag

SEQ ID NO: 168206 - DNA, 40 bp, Artificial Sequence
  Description of Artificial Sequence: Synthetic oligonucleotide
tctcgtcttgggtttaaagaattcagtctgtccaaagaag

SEQ ID NO: 168207 - DNA, 39 bp, Artificial Sequence
  Description of Artificial Sequence: Synthetic oligonucleotide
ctcgtcttgggtttaaagaattcagtctgtccaaagaag

SEQ ID NO: 168208 - DNA, 40 bp, Artificial Sequence
  Description of Artificial Sequence: Synthetic oligonucleotide
tcgtcttgggtttaaagaattcagtctgtccaaagaagac

SEQ ID NO: 168209 - DNA, 39 bp, Artificial Sequence
  Description of Artificial Sequence: Synthetic oligonucleotide
cgtcttgggtttaaagaattcagtctgtccaaagaagac

SEQ ID NO: 168210 - DNA, 39 bp, Artificial Sequence
  Description of Artificial Sequence: Synthetic oligonucleotide
gtcttgggtttaaagaattcagtctgtccaaagaagacg

SEQ ID NO: 168211 - DNA, 39 bp, Artificial Sequence
  Description of Artificial Sequence: Synthetic oligonucleotide
tcttgggtttaaagaattcagtctgtccaaagaagacgg

SEQ ID NO: 168212 - DNA, 38 bp, Artificial Sequence
  Description of Artificial Sequence: Synthetic oligonucleotide
cttgggtttaaagaattcagtctgtccaaagaagacgg

SEQ ID NO: 168213 - DNA, 38 bp, Artificial Sequence
  Description of Artificial Sequence: Synthetic oligonucleotide
ttgggtttaaagaattcagtctgtccaaagaagacggg

SEQ ID NO: 168214 - DNA, 37 bp, Artificial Sequence
  Description of Artificial Sequence: Synthetic oligonucleotide
tgggtttaaagaattcagtctgtccaaagaagacggg

SEQ ID NO: 168215 - DNA, 36 bp, Artificial Sequence
  Description of Artificial Sequence: Synthetic oligonucleotide
gggtttaaagaattcagtctgtccaaagaagacggg

SEQ ID NO: 168216 - DNA, 38 bp, Artificial Sequence
  Description of Artificial Sequence: Synthetic oligonucleotide
ggtttaaagaattcagtctgtccaaagaagacgggatg

SEQ ID NO: 168217 - DNA, 38 bp, Artificial Sequence
  Description of Artificial Sequence: Synthetic oligonucleotide
gtttaaagaattcagtctgtccaaagaagacgggatgc

SEQ ID NO: 168218 - DNA, 38 bp, Artificial Sequence
  Description of Artificial Sequence: Synthetic oligonucleotide
tttaaagaattcagtctgtccaaagaagacgggatgcc

SEQ ID NO: 168219 - DNA, 37 bp, Artificial Sequence
  Description of Artificial Sequence: Synthetic oligonucleotide
ttaaagaattcagtctgtccaaagaagacgggatgcc

SEQ ID NO: 168220 - DNA, 36 bp, Artificial Sequence
  Description of Artificial Sequence: Synthetic oligonucleotide
taaagaattcagtctgtccaaagaagacgggatgcc

SEQ ID NO: 168221 - DNA, 35 bp, Artificial Sequence
  Description of Artificial Sequence: Synthetic oligonucleotide
aaagaattcagtctgtccaaagaagacgggatgcc

SEQ ID NO: 168222 - DNA, 34 bp, Artificial Sequence
  Description of Artificial Sequence: Synthetic oligonucleotide
aagaattcagtctgtccaaagaagacgggatgcc

SEQ ID NO: 168223 - DNA, 33 bp, Artificial Sequence
  Description of Artificial Sequence: Synthetic oligonucleotide
agaattcagtctgtccaaagaagacgggatgcc

SEQ ID NO: 168224 - DNA, 35 bp, Artificial Sequence
  Description of Artificial Sequence: Synthetic oligonucleotide
ggtcatcctgcaatgttggtcagatgtcagttttg

SEQ ID NO: 168225 - DNA, 36 bp, Artificial Sequence
  Description of Artificial Sequence: Synthetic oligonucleotide
gtcatcctgcaatgttggtcagatgtcagttttgag

SEQ ID NO: 168226 - DNA, 36 bp, Artificial Sequence
  Description of Artificial Sequence: Synthetic oligonucleotide
tcatcctgcaatgttggtcagatgtcagttttgagc

SEQ ID NO: 168227 - DNA, 35 bp, Artificial Sequence
  Description of Artificial Sequence: Synthetic oligonucleotide
catcctgcaatgttggtcagatgtcagttttgagc

SEQ ID NO: 168228 - DNA, 35 bp, Artificial Sequence
  Description of Artificial Sequence: Synthetic oligonucleotide
atcctgcaatgttggtcagatgtcagttttgagcg

SEQ ID NO: 168229 - DNA, 34 bp, Artificial Sequence
  Description of Artificial Sequence: Synthetic oligonucleotide
tcctgcaatgttggtcagatgtcagttttgagcg

SEQ ID NO: 168230 - DNA, 33 bp, Artificial Sequence
  Description of Artificial Sequence: Synthetic oligonucleotide
cctgcaatgttggtcagatgtcagttttgagcg

SEQ ID NO: 168231 - DNA, 33 bp, Artificial Sequence
  Description of Artificial Sequence: Synthetic oligonucleotide
ctgcaatgttggtcagatgtcagttttgagcgc

SEQ ID NO: 168232 - DNA, 35 bp, Artificial Sequence
  Description of Artificial Sequence: Synthetic oligonucleotide
tgcaatgttggtcagatgtcagttttgagcgcttc

SEQ ID NO: 168233 - DNA, 34 bp, Artificial Sequence
  Description of Artificial Sequence: Synthetic oligonucleotide
gcaatgttggtcagatgtcagttttgagcgcttc

SEQ ID NO: 168234 - DNA, 34 bp, Artificial Sequence
  Description of Artificial Sequence: Synthetic oligonucleotide
caatgttggtcagatgtcagttttgagcgcttcc

SEQ ID NO: 168235 - DNA, 36 bp, Artificial Sequence
  Description of Artificial Sequence: Synthetic oligonucleotide
aatgttggtcagatgtcagttttgagcgcttccttc

SEQ ID NO: 168236 - DNA, 35 bp, Artificial Sequence
  Description of Artificial Sequence: Synthetic oligonucleotide
atgttggtcagatgtcagttttgagcgcttccttc

SEQ ID NO: 168237 - DNA, 34 bp, Artificial Sequence
  Description of Artificial Sequence: Synthetic oligonucleotide
tgttggtcagatgtcagttttgagcgcttccttc

SEQ ID NO: 168238 - DNA, 33 bp, Artificial Sequence
  Description of Artificial Sequence: Synthetic oligonucleotide
gttggtcagatgtcagttttgagcgcttccttc

SEQ ID NO: 168239 - DNA, 34 bp, Artificial Sequence
  Description of Artificial Sequence: Synthetic oligonucleotide
ttggtcagatgtcagttttgagcgcttccttctg

SEQ ID NO: 168240 - DNA, 33 bp, Artificial Sequence
  Description of Artificial Sequence: Synthetic oligonucleotide
tggtcagatgtcagttttgagcgcttccttctg

SEQ ID NO: 168241 - DNA, 32 bp, Artificial Sequence
  Description of Artificial Sequence: Synthetic oligonucleotide
ggtcagatgtcagttttgagcgcttccttctg

SEQ ID NO: 168242 - DNA, 32 bp, Artificial Sequence
  Description of Artificial Sequence: Synthetic oligonucleotide
gtcagatgtcagttttgagcgcttccttctgc

SEQ ID NO: 168243 - DNA, 33 bp, Artificial Sequence
  Description of Artificial Sequence: Synthetic oligonucleotide
tcagatgtcagttttgagcgcttccttctgcac

SEQ ID NO: 168244 - DNA, 32 bp, Artificial Sequence
  Description of Artificial Sequence: Synthetic oligonucleotide
cagatgtcagttttgagcgcttccttctgcac

SEQ ID NO: 168245 - DNA, 33 bp, Artificial Sequence
  Description of Artificial Sequence: Synthetic oligonucleotide
agatgtcagttttgagcgcttccttctgcacag

SEQ ID NO: 168246 - DNA, 32 bp, Artificial Sequence
  Description of Artificial Sequence: Synthetic oligonucleotide
gatgtcagttttgagcgcttccttctgcacag

SEQ ID NO: 168247 - DNA, 33 bp, Artificial Sequence
  Description of Artificial Sequence: Synthetic oligonucleotide
atgtcagttttgagcgcttccttctgcacagag

SEQ ID NO: 168248 - DNA, 32 bp, Artificial Sequence
  Description of Artificial Sequence: Synthetic oligonucleotide
tgtcagttttgagcgcttccttctgcacagag

SEQ ID NO: 168249 - DNA, 31 bp, Artificial Sequence
  Description of Artificial Sequence: Synthetic oligonucleotide
gtcagttttgagcgcttccttctgcacagag

SEQ ID NO: 168250 - DNA, 32 bp, Artificial Sequence
  Description of Artificial Sequence: Synthetic oligonucleotide
tcagttttgagcgcttccttctgcacagagag

SEQ ID NO: 168251 - DNA, 31 bp, Artificial Sequence
  Description of Artificial Sequence: Synthetic oligonucleotide
cagttttgagcgcttccttctgcacagagag

SEQ ID NO: 168252 - DNA, 31 bp, Artificial Sequence
  Description of Artificial Sequence: Synthetic oligonucleotide
agttttgagcgcttccttctgcacagagagg

SEQ ID NO: 168253 - DNA, 30 bp, Artificial Sequence
  Description of Artificial Sequence: Synthetic oligonucleotide
gttttgagcgcttccttctgcacagagagg

SEQ ID NO: 168254 - DNA, 30 bp, Artificial Sequence
  Description of Artificial Sequence: Synthetic oligonucleotide
ttttgagcgcttccttctgcacagagaggg

SEQ ID NO: 168255 - DNA, 37 bp, Artificial Sequence
  Description of Artificial Sequence: Synthetic oligonucleotide
tttggttctgtcactcacttaccctatgagttgtcag

SEQ ID NO: 168256 - DNA, 36 bp, Artificial Sequence
  Description of Artificial Sequence: Synthetic oligonucleotide
ttggttctgtcactcacttaccctatgagttgtcag

SEQ ID NO: 168257 - DNA, 35 bp, Artificial Sequence
  Description of Artificial Sequence: Synthetic oligonucleotide
tggttctgtcactcacttaccctatgagttgtcag

SEQ ID NO: 168258 - DNA, 34 bp, Artificial Sequence
  Description of Artificial Sequence: Synthetic oligonucleotide
ggttctgtcactcacttaccctatgagttgtcag

SEQ ID NO: 168259 - DNA, 34 bp, Artificial Sequence
  Description of Artificial Sequence: Synthetic oligonucleotide
gttctgtcactcacttaccctatgagttgtcagc

SEQ ID NO: 168260 - DNA, 35 bp, Artificial Sequence
  Description of Artificial Sequence: Synthetic oligonucleotide
ttctgtcactcacttaccctatgagttgtcagctc

SEQ ID NO: 168261 - DNA, 34 bp, Artificial Sequence
  Description of Artificial Sequence: Synthetic oligonucleotide
tctgtcactcacttaccctatgagttgtcagctc

SEQ ID NO: 168262 - DNA, 33 bp, Artificial Sequence
  Description of Artificial Sequence: Synthetic oligonucleotide
ctgtcactcacttaccctatgagttgtcagctc

SEQ ID NO: 168263 - DNA, 33 bp, Artificial Sequence
  Description of Artificial Sequence: Synthetic oligonucleotide
tgtcactcacttaccctatgagttgtcagctcc

SEQ ID NO: 168264 - DNA, 32 bp, Artificial Sequence
  Description of Artificial Sequence: Synthetic oligonucleotide
gtcactcacttaccctatgagttgtcagctcc

SEQ ID NO: 168265 - DNA, 32 bp, Artificial Sequence
  Description of Artificial Sequence: Synthetic oligonucleotide
tcactcacttaccctatgagttgtcagctccc

SEQ ID NO: 168266 - DNA, 31 bp, Artificial Sequence
  Description of Artificial Sequence: Synthetic oligonucleotide
cactcacttaccctatgagttgtcagctccc

SEQ ID NO: 168267 - DNA, 32 bp, Artificial Sequence
  Description of Artificial Sequence: Synthetic oligonucleotide
actcacttaccctatgagttgtcagctcccag

SEQ ID NO: 168268 - DNA, 31 bp, Artificial Sequence
  Description of Artificial Sequence: Synthetic oligonucleotide
ctcacttaccctatgagttgtcagctcccag

SEQ ID NO: 168269 - DNA, 32 bp, Artificial Sequence
  Description of Artificial Sequence: Synthetic oligonucleotide
tcacttaccctatgagttgtcagctcccagtg

SEQ ID NO: 168270 - DNA, 31 bp, Artificial Sequence
  Description of Artificial Sequence: Synthetic oligonucleotide
cacttaccctatgagttgtcagctcccagtg

SEQ ID NO: 168271 - DNA, 32 bp, Artificial Sequence
  Description of Artificial Sequence: Synthetic oligonucleotide
acttaccctatgagttgtcagctcccagtgac

SEQ ID NO: 168272 - DNA, 31 bp, Artificial Sequence
  Description of Artificial Sequence: Synthetic oligonucleotide
cttaccctatgagttgtcagctcccagtgac

SEQ ID NO: 168273 - DNA, 31 bp, Artificial Sequence
  Description of Artificial Sequence: Synthetic oligonucleotide
ttaccctatgagttgtcagctcccagtgacc

SEQ ID NO: 168274 - DNA, 30 bp, Artificial Sequence
  Description of Artificial Sequence: Synthetic oligonucleotide
taccctatgagttgtcagctcccagtgacc

SEQ ID NO: 168275 - DNA, 29 bp, Artificial Sequence
  Description of Artificial Sequence: Synthetic oligonucleotide
accctatgagttgtcagctcccagtgacc

SEQ ID NO: 168276 - DNA, 28 bp, Artificial Sequence
  Description of Artificial Sequence: Synthetic oligonucleotide
ccctatgagttgtcagctcccagtgacc

SEQ ID NO: 168277 - DNA, 28 bp, Artificial Sequence
  Description of Artificial Sequence: Synthetic oligonucleotide
cctatgagttgtcagctcccagtgaccc

SEQ ID NO: 168278 - DNA, 29 bp, Artificial Sequence
  Description of Artificial Sequence: Synthetic oligonucleotide
ctatgagttgtcagctcccagtgaccctc

SEQ ID NO: 168279 - DNA, 30 bp, Artificial Sequence
  Description of Artificial Sequence: Synthetic oligonucleotide
tatgagttgtcagctcccagtgaccctctg

SEQ ID NO: 168280 - DNA, 29 bp, Artificial Sequence
  Description of Artificial Sequence: Synthetic oligonucleotide
atgagttgtcagctcccagtgaccctctg

SEQ ID NO: 168281 - DNA, 28 bp, Artificial Sequence
  Description of Artificial Sequence: Synthetic oligonucleotide
tgagttgtcagctcccagtgaccctctg

SEQ ID NO: 168282 - DNA, 27 bp, Artificial Sequence
  Description of Artificial Sequence: Synthetic oligonucleotide
gagttgtcagctcccagtgaccctctg

SEQ ID NO: 168283 - DNA, 22 bp, Artificial Sequence
  Description of Artificial Sequence: Synthetic oligonucleotide
ggccctgtgacccacggaggga

SEQ ID NO: 168284 - DNA, 22 bp, Artificial Sequence
  Description of Artificial Sequence: Synthetic oligonucleotide
gccctgtgacccacggagggac

SEQ ID NO: 168285 - DNA, 24 bp, Artificial Sequence
  Description of Artificial Sequence: Synthetic oligonucleotide
ccctgtgacccacggagggaccta

SEQ ID NO: 168286 - DNA, 25 bp, Artificial Sequence
  Description of Artificial Sequence: Synthetic oligonucleotide
cctgtgacccacggagggacctaca

SEQ ID NO: 168287 - DNA, 27 bp, Artificial Sequence
  Description of Artificial Sequence: Synthetic oligonucleotide
ctgtgacccacggagggacctacagat

SEQ ID NO: 168288 - DNA, 27 bp, Artificial Sequence
  Description of Artificial Sequence: Synthetic oligonucleotide
tgtgacccacggagggacctacagatg

SEQ ID NO: 168289 - DNA, 26 bp, Artificial Sequence
  Description of Artificial Sequence: Synthetic oligonucleotide
gtgacccacggagggacctacagatg

SEQ ID NO: 168290 - DNA, 27 bp, Artificial Sequence
  Description of Artificial Sequence: Synthetic oligonucleotide
tgacccacggagggacctacagatgct

SEQ ID NO: 168291 - DNA, 27 bp, Artificial Sequence
  Description of Artificial Sequence: Synthetic oligonucleotide
gacccacggagggacctacagatgctt

SEQ ID NO: 168292 - DNA, 29 bp, Artificial Sequence
  Description of Artificial Sequence: Synthetic oligonucleotide
agcacttccttctgcacagagaggggatc

SEQ ID NO: 168293 - DNA, 28 bp, Artificial Sequence
  Description of Artificial Sequence: Synthetic oligonucleotide
gcacttccttctgcacagagaggggatc

SEQ ID NO: 168294 - DNA, 29 bp, Artificial Sequence
  Description of Artificial Sequence: Synthetic oligonucleotide
cacttccttctgcacagagaggggatcac

SEQ ID NO: 168295 - DNA, 30 bp, Artificial Sequence
  Description of Artificial Sequence: Synthetic oligonucleotide
acttccttctgcacagagaggggatcactg

SEQ ID NO: 168296 - DNA, 35 bp, Artificial Sequence
  Description of Artificial Sequence: Synthetic oligonucleotide
atgcctgtccctgagctctacaacagaatattctg

SEQ ID NO: 168297 - DNA, 34 bp, Artificial Sequence
  Description of Artificial Sequence: Synthetic oligonucleotide
tgcctgtccctgagctctacaacagaatattctg

SEQ ID NO: 168298 - DNA, 33 bp, Artificial Sequence
  Description of Artificial Sequence: Synthetic oligonucleotide
gcctgtccctgagctctacaacagaatattctg

SEQ ID NO: 168299 - DNA, 35 bp, Artificial Sequence
  Description of Artificial Sequence: Synthetic oligonucleotide
tccctgagctctacaacagaatattctggaacagc

SEQ ID NO: 168300 - DNA, 34 bp, Artificial Sequence
  Description of Artificial Sequence: Synthetic oligonucleotide
ccctgagctctacaacagaatattctggaacagc

SEQ ID NO: 168301 - DNA, 37 bp, Artificial Sequence
  Description of Artificial Sequence: Synthetic oligonucleotide
cctgagctctacaacagaatattctggaacagctttc

SEQ ID NO: 168302 - DNA, 38 bp, Artificial Sequence
  Description of Artificial Sequence: Synthetic oligonucleotide
ctgagctctacaacagaatattctggaacagctttctc

SEQ ID NO: 168303 - DNA, 40 bp, Artificial Sequence
  Description of Artificial Sequence: Synthetic oligonucleotide
tgagctctacaacagaatattctggaacagctttctcatg

SEQ ID NO: 168304 - DNA, 39 bp, Artificial Sequence
  Description of Artificial Sequence: Synthetic oligonucleotide
gagctctacaacagaatattctggaacagctttctcatg

SEQ ID NO: 168305 - DNA, 39 bp, Artificial Sequence
  Description of Artificial Sequence: Synthetic oligonucleotide
agctctacaacagaatattctggaacagctttctcatgg

SEQ ID NO: 168306 - DNA, 38 bp, Artificial Sequence
  Description of Artificial Sequence: Synthetic oligonucleotide
gctctacaacagaatattctggaacagctttctcatgg

SEQ ID NO: 168307 - DNA, 38 bp, Artificial Sequence
  Description of Artificial Sequence: Synthetic oligonucleotide
ctctacaacagaatattctggaacagctttctcatggg

SEQ ID NO: 168308 - DNA, 38 bp, Artificial Sequence
  Description of Artificial Sequence: Synthetic oligonucleotide
tctacaacagaatattctggaacagctttctcatgggc

SEQ ID NO: 168309 - DNA, 37 bp, Artificial Sequence
  Description of Artificial Sequence: Synthetic oligonucleotide
ctacaacagaatattctggaacagctttctcatgggc

SEQ ID NO: 168310 - DNA, 37 bp, Artificial Sequence
  Description of Artificial Sequence: Synthetic oligonucleotide
tacaacagaatattctggaacagctttctcatgggcc

SEQ ID NO: 168311 - DNA, 36 bp, Artificial Sequence
  Description of Artificial Sequence: Synthetic oligonucleotide
acaacagaatattctggaacagctttctcatgggcc

SEQ ID NO: 168312 - DNA, 35 bp, Artificial Sequence
  Description of Artificial Sequence: Synthetic oligonucleotide
caacagaatattctggaacagctttctcatgggcc

SEQ ID NO: 168313 - DNA, 35 bp, Artificial Sequence
  Description of Artificial Sequence: Synthetic oligonucleotide
aacagaatattctggaacagctttctcatgggccc

SEQ ID NO: 168314 - DNA, 34 bp, Artificial Sequence
  Description of Artificial Sequence: Synthetic oligonucleotide
acagaatattctggaacagctttctcatgggccc

SEQ ID NO: 168315 - DNA, 33 bp, Artificial Sequence
  Description of Artificial Sequence: Synthetic oligonucleotide
cagaatattctggaacagctttctcatgggccc

SEQ ID NO: 168316 - DNA, 34 bp, Artificial Sequence
  Description of Artificial Sequence: Synthetic oligonucleotide
agaatattctggaacagctttctcatgggccctg

SEQ ID NO: 168317 - DNA, 33 bp, Artificial Sequence
  Description of Artificial Sequence: Synthetic oligonucleotide
gaatattctggaacagctttctcatgggccctg

SEQ ID NO: 168318 - DNA, 34 bp, Artificial Sequence
  Description of Artificial Sequence: Synthetic oligonucleotide
aatattctggaacagctttctcatgggccctgtg

SEQ ID NO: 168319 - DNA, 33 bp, Artificial Sequence
  Description of Artificial Sequence: Synthetic oligonucleotide
atattctggaacagctttctcatgggccctgtg

SEQ ID NO: 168320 - DNA, 32 bp, Artificial Sequence
  Description of Artificial Sequence: Synthetic oligonucleotide
tattctggaacagctttctcatgggccctgtg

SEQ ID NO: 168321 - DNA, 31 bp, Artificial Sequence
  Description of Artificial Sequence: Synthetic oligonucleotide
attctggaacagctttctcatgggccctgtg

SEQ ID NO: 168322 - DNA, 30 bp, Artificial Sequence
  Description of Artificial Sequence: Synthetic oligonucleotide
ttctggaacagctttctcatgggccctgtg

SEQ ID NO: 168323 - DNA, 29 bp, Artificial Sequence
  Description of Artificial Sequence: Synthetic oligonucleotide
tctggaacagctttctcatgggccctgtg

SEQ ID NO: 168324 - DNA, 28 bp, Artificial Sequence
  Description of Artificial Sequence: Synthetic oligonucleotide
ctggaacagctttctcatgggccctgtg

SEQ ID NO: 168325 - DNA, 29 bp, Artificial Sequence
  Description of Artificial Sequence: Synthetic oligonucleotide
tggaacagctttctcatgggccctgtgac

SEQ ID NO: 168326 - DNA, 24 bp, Artificial Sequence
  Description of Artificial Sequence: Synthetic oligonucleotide
ctggaggggccctggccacatgta

SEQ ID NO: 168327 - DNA, 24 bp, Artificial Sequence
  Description of Artificial Sequence: Synthetic oligonucleotide
tggaggggccctggccacatgtag

SEQ ID NO: 168328 - DNA, 23 bp, Artificial Sequence
  Description of Artificial Sequence: Synthetic oligonucleotide
ggaggggccctggccacatgtag

SEQ ID NO: 168329 - DNA, 24 bp, Artificial Sequence
  Description of Artificial Sequence: Synthetic oligonucleotide
gaggggccctggccacatgtaggt

SEQ ID NO: 168330 - DNA, 24 bp, Artificial Sequence
  Description of Artificial Sequence: Synthetic oligonucleotide
aggggccctggccacatgtaggtg

SEQ ID NO: 168331 - DNA, 23 bp, Artificial Sequence
  Description of Artificial Sequence: Synthetic oligonucleotide
ggggccctggccacatgtaggtg

SEQ ID NO: 168332 - DNA, 24 bp, Artificial Sequence
  Description of Artificial Sequence: Synthetic oligonucleotide
gggccctggccacatgtaggtggt

SEQ ID NO: 168333 - DNA, 25 bp, Artificial Sequence
  Description of Artificial Sequence: Synthetic oligonucleotide
ggccctggccacatgtaggtggtca

SEQ ID NO: 168334 - DNA, 25 bp, Artificial Sequence
  Description of Artificial Sequence: Synthetic oligonucleotide
gccctggccacatgtaggtggtcag

SEQ ID NO: 168335 - DNA, 26 bp, Artificial Sequence
  Description of Artificial Sequence: Synthetic oligonucleotide
ccctggccacatgtaggtggtcagga

SEQ ID NO: 168336 - DNA, 27 bp, Artificial Sequence
  Description of Artificial Sequence: Synthetic oligonucleotide
cctggccacatgtaggtggtcaggaca

SEQ ID NO: 168337 - DNA, 28 bp, Artificial Sequence
  Description of Artificial Sequence: Synthetic oligonucleotide
ctggccacatgtaggtggtcaggacaag

SEQ ID NO: 168338 - DNA, 28 bp, Artificial Sequence
  Description of Artificial Sequence: Synthetic oligonucleotide
tggccacatgtaggtggtcaggacaagc

SEQ ID NO: 168339 - DNA, 27 bp, Artificial Sequence
  Description of Artificial Sequence: Synthetic oligonucleotide
ggccacatgtaggtggtcaggacaagc

SEQ ID NO: 168340 - DNA, 27 bp, Artificial Sequence
  Description of Artificial Sequence: Synthetic oligonucleotide
gccacatgtaggtggtcaggacaagcc

SEQ ID NO: 168341 - DNA, 27 bp, Artificial Sequence
  Description of Artificial Sequence: Synthetic oligonucleotide
ccacatgtaggtggtcaggacaagccc

SEQ ID NO: 168342 - DNA, 29 bp, Artificial Sequence
  Description of Artificial Sequence: Synthetic oligonucleotide
cacatgtaggtggtcaggacaagcccttc

SEQ ID NO: 168343 - DNA, 29 bp, Artificial Sequence
  Description of Artificial Sequence: Synthetic oligonucleotide
acatgtaggtggtcaggacaagcccttcc

SEQ ID NO: 168344 - DNA, 28 bp, Artificial Sequence
  Description of Artificial Sequence: Synthetic oligonucleotide
catgtaggtggtcaggacaagcccttcc

SEQ ID NO: 168345 - DNA, 29 bp, Artificial Sequence
  Description of Artificial Sequence: Synthetic oligonucleotide
atgtaggtggtcaggacaagcccttcctc

SEQ ID NO: 168346 - DNA, 28 bp, Artificial Sequence
  Description of Artificial Sequence: Synthetic oligonucleotide
tgtaggtggtcaggacaagcccttcctc

SEQ ID NO: 168347 - DNA, 27 bp, Artificial Sequence
  Description of Artificial Sequence: Synthetic oligonucleotide
gtaggtggtcaggacaagcccttcctc

SEQ ID NO: 168348 - DNA, 28 bp, Artificial Sequence
  Description of Artificial Sequence: Synthetic oligonucleotide
taggtggtcaggacaagcccttcctctc

SEQ ID NO: 168349 - DNA, 27 bp, Artificial Sequence
  Description of Artificial Sequence: Synthetic oligonucleotide
aggtggtcaggacaagcccttcctctc

SEQ ID NO: 168350 - DNA, 31 bp, Artificial Sequence
  Description of Artificial Sequence: Synthetic oligonucleotide
ctcctcttctttctccttcatcgctggtgtc

SEQ ID NO: 168351 - DNA, 31 bp, Artificial Sequence
  Description of Artificial Sequence: Synthetic oligonucleotide
tcctcttctttctccttcatcgctggtgtcc

SEQ ID NO: 168352 - DNA, 30 bp, Artificial Sequence
  Description of Artificial Sequence: Synthetic oligonucleotide
cctcttctttctccttcatcgctggtgtcc

SEQ ID NO: 168353 - DNA, 30 bp, Artificial Sequence
  Description of Artificial Sequence: Synthetic oligonucleotide
ctcttctttctccttcatcgctggtgtccc

SEQ ID NO: 168354 - DNA, 32 bp, Artificial Sequence
  Description of Artificial Sequence: Synthetic oligonucleotide
tcttctttctccttcatcgctggtgtcccaac

SEQ ID NO: 168355 - DNA, 31 bp, Artificial Sequence
  Description of Artificial Sequence: Synthetic oligonucleotide
cttctttctccttcatcgctggtgtcccaac

SEQ ID NO: 168356 - DNA, 36 bp, Artificial Sequence
  Description of Artificial Sequence: Synthetic oligonucleotide
ttctttctccttcatcgctggtgtcccaacaaaaag

SEQ ID NO: 168357 - DNA, 35 bp, Artificial Sequence
  Description of Artificial Sequence: Synthetic oligonucleotide
tctttctccttcatcgctggtgtcccaacaaaaag

SEQ ID NO: 168358 - DNA, 34 bp, Artificial Sequence
  Description of Artificial Sequence: Synthetic oligonucleotide
ctttctccttcatcgctggtgtcccaacaaaaag

SEQ ID NO: 168359 - DNA, 37 bp, Artificial Sequence
  Description of Artificial Sequence: Synthetic oligonucleotide
tttctccttcatcgctggtgtcccaacaaaaagaatg

SEQ ID NO: 168360 - DNA, 36 bp, Artificial Sequence
  Description of Artificial Sequence: Synthetic oligonucleotide
ttctccttcatcgctggtgtcccaacaaaaagaatg

SEQ ID NO: 168361 - DNA, 35 bp, Artificial Sequence
  Description of Artificial Sequence: Synthetic oligonucleotide
tctccttcatcgctggtgtcccaacaaaaagaatg

SEQ ID NO: 168362 - DNA, 34 bp, Artificial Sequence
  Description of Artificial Sequence: Synthetic oligonucleotide
ctccttcatcgctggtgtcccaacaaaaagaatg

SEQ ID NO: 168363 - DNA, 34 bp, Artificial Sequence
  Description of Artificial Sequence: Synthetic oligonucleotide
tccttcatcgctggtgtcccaacaaaaagaatgc

SEQ ID NO: 168364 - DNA, 33 bp, Artificial Sequence
  Description of Artificial Sequence: Synthetic oligonucleotide
ccttcatcgctggtgtcccaacaaaaagaatgc

SEQ ID NO: 168365 - DNA, 34 bp, Artificial Sequence
  Description of Artificial Sequence: Synthetic oligonucleotide
cttcatcgctggtgtcccaacaaaaagaatgctg

SEQ ID NO: 168366 - DNA, 36 bp, Artificial Sequence
  Description of Artificial Sequence: Synthetic oligonucleotide
ttcatcgctggtgtcccaacaaaaagaatgctgttg

SEQ ID NO: 168367 - DNA, 35 bp, Artificial Sequence
  Description of Artificial Sequence: Synthetic oligonucleotide
tcatcgctggtgtcccaacaaaaagaatgctgttg

SEQ ID NO: 168368 - DNA, 34 bp, Artificial Sequence
  Description of Artificial Sequence: Synthetic oligonucleotide
catcgctggtgtcccaacaaaaagaatgctgttg

SEQ ID NO: 168369 - DNA, 38 bp, Artificial Sequence
  Description of Artificial Sequence: Synthetic oligonucleotide
atcgctggtgtcccaacaaaaagaatgctgttgtaatg

SEQ ID NO: 168370 - DNA, 37 bp, Artificial Sequence
  Description of Artificial Sequence: Synthetic oligonucleotide
tcgctggtgtcccaacaaaaagaatgctgttgtaatg

SEQ ID NO: 168371 - DNA, 36 bp, Artificial Sequence
  Description of Artificial Sequence: Synthetic oligonucleotide
cgctggtgtcccaacaaaaagaatgctgttgtaatg

SEQ ID NO: 168372 - DNA, 36 bp, Artificial Sequence
  Description of Artificial Sequence: Synthetic oligonucleotide
gctggtgtcccaacaaaaagaatgctgttgtaatgg

SEQ ID NO: 168373 - DNA, 37 bp, Artificial Sequence
  Description of Artificial Sequence: Synthetic oligonucleotide
ctggtgtcccaacaaaaagaatgctgttgtaatggac

SEQ ID NO: 168374 - DNA, 37 bp, Artificial Sequence
  Description of Artificial Sequence: Synthetic oligonucleotide
tggtgtcccaacaaaaagaatgctgttgtaatggacc

SEQ ID NO: 168375 - DNA, 36 bp, Artificial Sequence
  Description of Artificial Sequence: Synthetic oligonucleotide
ggtgtcccaacaaaaagaatgctgttgtaatggacc

SEQ ID NO: 168376 - DNA, 38 bp, Artificial Sequence
  Description of Artificial Sequence: Synthetic oligonucleotide
gtgtcccaacaaaaagaatgctgttgtaatggaccaag

SEQ ID NO: 168377 - DNA, 39 bp, Artificial Sequence
  Description of Artificial Sequence: Synthetic oligonucleotide
tgtcccaacaaaaagaatgctgttgtaatggaccaagag

SEQ ID NO: 168378 - DNA, 38 bp, Artificial Sequence
  Description of Artificial Sequence: Synthetic oligonucleotide
gtcccaacaaaaagaatgctgttgtaatggaccaagag

SEQ ID NO: 168379 - DNA, 38 bp, Artificial Sequence
  Description of Artificial Sequence: Synthetic oligonucleotide
tcccaacaaaaagaatgctgttgtaatggaccaagagc

SEQ ID NO: 168380 - DNA, 37 bp, Artificial Sequence
  Description of Artificial Sequence: Synthetic oligonucleotide
cccaacaaaaagaatgctgttgtaatggaccaagagc

SEQ ID NO: 168381 - DNA, 34 bp, Artificial Sequence
  Description of Artificial Sequence: Synthetic oligonucleotide
aacagaacagtgaacagggaggactctgatgatc

SEQ ID NO: 168382 - DNA, 33 bp, Artificial Sequence
  Description of Artificial Sequence: Synthetic oligonucleotide
tctgatgatcaagaccctcaggaggtgacatac

SEQ ID NO: 168383 - DNA, 32 bp, Artificial Sequence
  Description of Artificial Sequence: Synthetic oligonucleotide
ctgatgatcaagaccctcaggaggtgacatac

SEQ ID NO: 168384 - DNA, 32 bp, Artificial Sequence
  Description of Artificial Sequence: Synthetic oligonucleotide
tgatgatcaagaccctcaggaggtgacatacg

SEQ ID NO: 168385 - DNA, 31 bp, Artificial Sequence
  Description of Artificial Sequence: Synthetic oligonucleotide
gatgatcaagaccctcaggaggtgacatacg

SEQ ID NO: 168386 - DNA, 31 bp, Artificial Sequence
  Description of Artificial Sequence: Synthetic oligonucleotide
atgatcaagaccctcaggaggtgacatacgc

SEQ ID NO: 168387 - DNA, 30 bp, Artificial Sequence
  Description of Artificial Sequence: Synthetic oligonucleotide
tgatcaagaccctcaggaggtgacatacgc

SEQ ID NO: 168388 - DNA, 29 bp, Artificial Sequence
  Description of Artificial Sequence: Synthetic oligonucleotide
gatcaagaccctcaggaggtgacatacgc

SEQ ID NO: 168389 - DNA, 30 bp, Artificial Sequence
  Description of Artificial Sequence: Synthetic oligonucleotide
atcaagaccctcaggaggtgacatacgcac

SEQ ID NO: 168390 - DNA, 29 bp, Artificial Sequence
  Description of Artificial Sequence: Synthetic oligonucleotide
tcaagaccctcaggaggtgacatacgcac

SEQ ID NO: 168391 - DNA, 30 bp, Artificial Sequence
  Description of Artificial Sequence: Synthetic oligonucleotide
tcacaggtaactccagacacctgcacgatc

SEQ ID NO: 168392 - DNA, 29 bp, Artificial Sequence
  Description of Artificial Sequence: Synthetic oligonucleotide
cacaggtaactccagacacctgcacgatc

SEQ ID NO: 168393 - DNA, 30 bp, Artificial Sequence
  Description of Artificial Sequence: Synthetic oligonucleotide
acaggtaactccagacacctgcacgatctg

SEQ ID NO: 168394 - DNA, 29 bp, Artificial Sequence
  Description of Artificial Sequence: Synthetic oligonucleotide
caggtaactccagacacctgcacgatctg

SEQ ID NO: 168395 - DNA, 32 bp, Artificial Sequence
  Description of Artificial Sequence: Synthetic oligonucleotide
aggtaactccagacacctgcacgatctgattg

SEQ ID NO: 168396 - DNA, 31 bp, Artificial Sequence
  Description of Artificial Sequence: Synthetic oligonucleotide
ggtaactccagacacctgcacgatctgattg

SEQ ID NO: 168397 - DNA, 31 bp, Artificial Sequence
  Description of Artificial Sequence: Synthetic oligonucleotide
gtaactccagacacctgcacgatctgattgg

SEQ ID NO: 168398 - DNA, 31 bp, Artificial Sequence
  Description of Artificial Sequence: Synthetic oligonucleotide
taactccagacacctgcacgatctgattggg

SEQ ID NO: 168399 - DNA, 30 bp, Artificial Sequence
  Description of Artificial Sequence: Synthetic oligonucleotide
aactccagacacctgcacgatctgattggg

SEQ ID NO: 168400 - DNA, 29 bp, Artificial Sequence
  Description of Artificial Sequence: Synthetic oligonucleotide
actccagacacctgcacgatctgattggg

SEQ ID NO: 168401 - DNA, 28 bp, Artificial Sequence
  Description of Artificial Sequence: Synthetic oligonucleotide
ctccagacacctgcacgatctgattggg

SEQ ID NO: 168402 - DNA, 29 bp, Artificial Sequence
  Description of Artificial Sequence: Synthetic oligonucleotide
tccagacacctgcacgatctgattgggac

SEQ ID NO: 168403 - DNA, 28 bp, Artificial Sequence
  Description of Artificial Sequence: Synthetic oligonucleotide
ccagacacctgcacgatctgattgggac

SEQ ID NO: 168404 - DNA, 28 bp, Artificial Sequence
  Description of Artificial Sequence: Synthetic oligonucleotide
cagacacctgcacgatctgattgggacc

SEQ ID NO: 168405 - DNA, 29 bp, Artificial Sequence
  Description of Artificial Sequence: Synthetic oligonucleotide
agacacctgcacgatctgattgggacctc

SEQ ID NO: 168406 - DNA, 28 bp, Artificial Sequence
  Description of Artificial Sequence: Synthetic oligonucleotide
gacacctgcacgatctgattgggacctc

SEQ ID NO: 168407 - DNA, 29 bp, Artificial Sequence
  Description of Artificial Sequence: Synthetic oligonucleotide
acacctgcacgatctgattgggacctcag

SEQ ID NO: 168408 - DNA, 28 bp, Artificial Sequence
  Description of Artificial Sequence: Synthetic oligonucleotide
cacctgcacgatctgattgggacctcag

SEQ ID NO: 168409 - DNA, 29 bp, Artificial Sequence
  Description of Artificial Sequence: Synthetic oligonucleotide
acctgcacgatctgattgggacctcagtg

SEQ ID NO: 168410 - DNA, 28 bp, Artificial Sequence
  Description of Artificial Sequence: Synthetic oligonucleotide
cctgcacgatctgattgggacctcagtg

SEQ ID NO: 168411 - DNA, 28 bp, Artificial Sequence
  Description of Artificial Sequence: Synthetic oligonucleotide
ctgcacgatctgattgggacctcagtgg

SEQ ID NO: 168412 - DNA, 29 bp, Artificial Sequence
  Description of Artificial Sequence: Synthetic oligonucleotide
tgcacgatctgattgggacctcagtggtc

SEQ ID NO: 168413 - DNA, 28 bp, Artificial Sequence
  Description of Artificial Sequence: Synthetic oligonucleotide
gcacgatctgattgggacctcagtggtc

SEQ ID NO: 168414 - DNA, 30 bp, Artificial Sequence
  Description of Artificial Sequence: Synthetic oligonucleotide
cacgatctgattgggacctcagtggtcatc

SEQ ID NO: 168415 - DNA, 32 bp, Artificial Sequence
  Description of Artificial Sequence: Synthetic oligonucleotide
acgatctgattgggacctcagtggtcatcatc

SEQ ID NO: 168416 - DNA, 31 bp, Artificial Sequence
  Description of Artificial Sequence: Synthetic oligonucleotide
cgatctgattgggacctcagtggtcatcatc

SEQ ID NO: 168417 - DNA, 31 bp, Artificial Sequence
  Description of Artificial Sequence: Synthetic oligonucleotide
gatctgattgggacctcagtggtcatcatcc

SEQ ID NO: 168418 - DNA, 31 bp, Artificial Sequence
  Description of Artificial Sequence: Synthetic oligonucleotide
atctgattgggacctcagtggtcatcatccc

SEQ ID NO: 168419 - DNA, 24 bp, Artificial Sequence
  Description of Artificial Sequence: Synthetic oligonucleotide
ttccctcctggcccacccaggtct

SEQ ID NO: 168420 - DNA, 23 bp, Artificial Sequence
  Description of Artificial Sequence: Synthetic oligonucleotide
tccctcctggcccacccaggtct

SEQ ID NO: 168421 - DNA, 22 bp, Artificial Sequence
  Description of Artificial Sequence: Synthetic oligonucleotide
ccctcctggcccacccaggtct

SEQ ID NO: 168422 - DNA, 22 bp, Artificial Sequence
  Description of Artificial Sequence: Synthetic oligonucleotide
cctcctggcccacccaggtctc

SEQ ID NO: 168423 - DNA, 23 bp, Artificial Sequence
  Description of Artificial Sequence: Synthetic oligonucleotide
ctcctggcccacccaggtctcct

SEQ ID NO: 168424 - DNA, 23 bp, Artificial Sequence
  Description of Artificial Sequence: Synthetic oligonucleotide
tcctggcccacccaggtctcctg

SEQ ID NO: 168425 - DNA, 22 bp, Artificial Sequence
  Description of Artificial Sequence: Synthetic oligonucleotide
cctggcccacccaggtctcctg

SEQ ID NO: 168426 - DNA, 23 bp, Artificial Sequence
  Description of Artificial Sequence: Synthetic oligonucleotide
ctggcccacccaggtctcctggt

SEQ ID NO: 168427 - DNA, 27 bp, Artificial Sequence
  Description of Artificial Sequence: Synthetic oligonucleotide
tggcccacccaggtctcctggtgaaat

SEQ ID NO: 168428 - DNA, 26 bp, Artificial Sequence
  Description of Artificial Sequence: Synthetic oligonucleotide
ggcccacccaggtctcctggtgaaat

SEQ ID NO: 168429 - DNA, 26 bp, Artificial Sequence
  Description of Artificial Sequence: Synthetic oligonucleotide
gcccacccaggtctcctggtgaaatc

SEQ ID NO: 168430 - DNA, 26 bp, Artificial Sequence
  Description of Artificial Sequence: Synthetic oligonucleotide
cccacccaggtctcctggtgaaatcg

SEQ ID NO: 168431 - DNA, 26 bp, Artificial Sequence
  Description of Artificial Sequence: Synthetic oligonucleotide
ccacccaggtctcctggtgaaatcgg

SEQ ID NO: 168432 - DNA, 27 bp, Artificial Sequence
  Description of Artificial Sequence: Synthetic oligonucleotide
cacccaggtctcctggtgaaatcggga

SEQ ID NO: 168433 - DNA, 27 bp, Artificial Sequence
  Description of Artificial Sequence: Synthetic oligonucleotide
acccaggtctcctggtgaaatcgggag

SEQ ID NO: 168434 - DNA, 27 bp, Artificial Sequence
  Description of Artificial Sequence: Synthetic oligonucleotide
cccaggtctcctggtgaaatcgggaga

SEQ ID NO: 168435 - DNA, 27 bp, Artificial Sequence
  Description of Artificial Sequence: Synthetic oligonucleotide
ccaggtctcctggtgaaatcgggagag

SEQ ID NO: 168436 - DNA, 28 bp, Artificial Sequence
  Description of Artificial Sequence: Synthetic oligonucleotide
caggtctcctggtgaaatcgggagagac

SEQ ID NO: 168437 - DNA, 28 bp, Artificial Sequence
  Description of Artificial Sequence: Synthetic oligonucleotide
aggtctcctggtgaaatcgggagagacg

SEQ ID NO: 168438 - DNA, 27 bp, Artificial Sequence
  Description of Artificial Sequence: Synthetic oligonucleotide
ggtctcctggtgaaatcgggagagacg

SEQ ID NO: 168439 - DNA, 27 bp, Artificial Sequence
  Description of Artificial Sequence: Synthetic oligonucleotide
gtctcctggtgaaatcgggagagacgg

SEQ ID NO: 168440 - DNA, 28 bp, Artificial Sequence
  Description of Artificial Sequence: Synthetic oligonucleotide
tctcctggtgaaatcgggagagacggtc

SEQ ID NO: 168441 - DNA, 27 bp, Artificial Sequence
  Description of Artificial Sequence: Synthetic oligonucleotide
ctcctggtgaaatcgggagagacggtc

SEQ ID NO: 168442 - DNA, 29 bp, Artificial Sequence
  Description of Artificial Sequence: Synthetic oligonucleotide
tcctggtgaaatcgggagagacggtcatc

SEQ ID NO: 168443 - DNA, 37 bp, Artificial Sequence
  Description of Artificial Sequence: Synthetic oligonucleotide
gtttaacgaattcagtctgtccaaagaagacgggaag

SEQ ID NO: 168444 - DNA, 37 bp, Artificial Sequence
  Description of Artificial Sequence: Synthetic oligonucleotide
tttaacgaattcagtctgtccaaagaagacgggaagc

SEQ ID NO: 168445 - DNA, 36 bp, Artificial Sequence
  Description of Artificial Sequence: Synthetic oligonucleotide
ttaacgaattcagtctgtccaaagaagacgggaagc

SEQ ID NO: 168446 - DNA, 35 bp, Artificial Sequence
  Description of Artificial Sequence: Synthetic oligonucleotide
taacgaattcagtctgtccaaagaagacgggaagc

SEQ ID NO: 168447 - DNA, 34 bp, Artificial Sequence
  Description of Artificial Sequence: Synthetic oligonucleotide
aacgaattcagtctgtccaaagaagacgggaagc

SEQ ID NO: 168448 - DNA, 33 bp, Artificial Sequence
  Description of Artificial Sequence: Synthetic oligonucleotide
acgaattcagtctgtccaaagaagacgggaagc

SEQ ID NO: 168449 - DNA, 32 bp, Artificial Sequence
  Description of Artificial Sequence: Synthetic oligonucleotide
cgaattcagtctgtccaaagaagacgggaagc

SEQ ID NO: 168450 - DNA, 32 bp, Artificial Sequence
  Description of Artificial Sequence: Synthetic oligonucleotide
gaattcagtctgtccaaagaagacgggaagcc

SEQ ID NO: 168451 - DNA, 33 bp, Artificial Sequence
  Description of Artificial Sequence: Synthetic oligonucleotide
aattcagtctgtccaaagaagacgggaagcctg

SEQ ID NO: 168452 - DNA, 32 bp, Artificial Sequence
  Description of Artificial Sequence: Synthetic oligonucleotide
attcagtctgtccaaagaagacgggaagcctg

SEQ ID NO: 168453 - DNA, 31 bp, Artificial Sequence
  Description of Artificial Sequence: Synthetic oligonucleotide
ttcagtctgtccaaagaagacgggaagcctg

SEQ ID NO: 168454 - DNA, 30 bp, Artificial Sequence
  Description of Artificial Sequence: Synthetic oligonucleotide
tcagtctgtccaaagaagacgggaagcctg

SEQ ID NO: 168455 - DNA, 29 bp, Artificial Sequence
  Description of Artificial Sequence: Synthetic oligonucleotide
cagtctgtccaaagaagacgggaagcctg

SEQ ID NO: 168456 - DNA, 30 bp, Artificial Sequence
  Description of Artificial Sequence: Synthetic oligonucleotide
agtctgtccaaagaagacgggaagcctgtc

SEQ ID NO: 168457 - DNA, 29 bp, Artificial Sequence
  Description of Artificial Sequence: Synthetic oligonucleotide
gtctgtccaaagaagacgggaagcctgtc

SEQ ID NO: 168458 - DNA, 29 bp, Artificial Sequence
  Description of Artificial Sequence: Synthetic oligonucleotide
tctgtccaaagaagacgggaagcctgtcc

SEQ ID NO: 168459 - DNA, 28 bp, Artificial Sequence
  Description of Artificial Sequence: Synthetic oligonucleotide
ctgtccaaagaagacgggaagcctgtcc

SEQ ID NO: 168460 - DNA, 28 bp, Artificial Sequence
  Description of Artificial Sequence: Synthetic oligonucleotide
tgtccaaagaagacgggaagcctgtccc

SEQ ID NO: 168461 - DNA, 27 bp, Artificial Sequence
  Description of Artificial Sequence: Synthetic oligonucleotide
gtccaaagaagacgggaagcctgtccc

SEQ ID NO: 168462 - DNA, 28 bp, Artificial Sequence
  Description of Artificial Sequence: Synthetic oligonucleotide
tccaaagaagacgggaagcctgtccctg

SEQ ID NO: 168463 - DNA, 27 bp, Artificial Sequence
  Description of Artificial Sequence: Synthetic oligonucleotide
ccaaagaagacgggaagcctgtccctg

SEQ ID NO: 168464 - DNA, 28 bp, Artificial Sequence
  Description of Artificial Sequence: Synthetic oligonucleotide
caaagaagacgggaagcctgtccctgag

SEQ ID NO: 168465 - DNA, 28 bp, Artificial Sequence
  Description of Artificial Sequence: Synthetic oligonucleotide
aaagaagacgggaagcctgtccctgagc

SEQ ID NO: 168466 - DNA, 27 bp, Artificial Sequence
  Description of Artificial Sequence: Synthetic oligonucleotide
aagaagacgggaagcctgtccctgagc

SEQ ID NO: 168467 - DNA, 27 bp, Artificial Sequence
  Description of Artificial Sequence: Synthetic oligonucleotide
agaagacgggaagcctgtccctgagct

SEQ ID NO: 168468 - DNA, 26 bp, Artificial Sequence
  Description of Artificial Sequence: Synthetic oligonucleotide
gaagacgggaagcctgtccctgagct

SEQ ID NO: 168469 - DNA, 27 bp, Artificial Sequence
  Description of Artificial Sequence: Synthetic oligonucleotide
aagacgggaagcctgtccctgagctct

SEQ ID NO: 168470 - DNA, 27 bp, Artificial Sequence
  Description of Artificial Sequence: Synthetic oligonucleotide
agacgggaagcctgtccctgagctcta

SEQ ID NO: 168471 - DNA, 26 bp, Artificial Sequence
  Description of Artificial Sequence: Synthetic oligonucleotide
gacgggaagcctgtccctgagctcta

SEQ ID NO: 168472 - DNA, 27 bp, Artificial Sequence
  Description of Artificial Sequence: Synthetic oligonucleotide
acgggaagcctgtccctgagctctaca

SEQ ID NO: 168473 - DNA, 27 bp, Artificial Sequence
  Description of Artificial Sequence: Synthetic oligonucleotide
cgggaagcctgtccctgagctctacaa

SEQ ID NO: 168474 - DNA, 27 bp, Artificial Sequence
  Description of Artificial Sequence: Synthetic oligonucleotide
gggaagcctgtccctgagctctacaac

SEQ ID NO: 168475 - DNA, 28 bp, Artificial Sequence
  Description of Artificial Sequence: Synthetic oligonucleotide
ggaagcctgtccctgagctctacaacag

SEQ ID NO: 168476 - DNA, 34 bp, Artificial Sequence
  Description of Artificial Sequence: Synthetic oligonucleotide
gaagcctgtccctgagctctacaacagaatattc

SEQ ID NO: 168477 - DNA, 34 bp, Artificial Sequence
  Description of Artificial Sequence: Synthetic oligonucleotide
aagcctgtccctgagctctacaacagaatattcc

SEQ ID NO: 168478 - DNA, 33 bp, Artificial Sequence
  Description of Artificial Sequence: Synthetic oligonucleotide
agcctgtccctgagctctacaacagaatattcc

SEQ ID NO: 168479 - DNA, 28 bp, Artificial Sequence
  Description of Artificial Sequence: Synthetic oligonucleotide
acatgagggtggtcaggacaagcccttc

SEQ ID NO: 168480 - DNA, 27 bp, Artificial Sequence
  Description of Artificial Sequence: Synthetic oligonucleotide
catgagggtggtcaggacaagcccttc

SEQ ID NO: 168481 - DNA, 27 bp, Artificial Sequence
  Description of Artificial Sequence: Synthetic oligonucleotide
atgagggtggtcaggacaagcccttcc

SEQ ID NO: 168482 - DNA, 27 bp, Artificial Sequence
  Description of Artificial Sequence: Synthetic oligonucleotide
tgagggtggtcaggacaagcccttcct

SEQ ID NO: 168483 - DNA, 26 bp, Artificial Sequence
  Description of Artificial Sequence: Synthetic oligonucleotide
gagggtggtcaggacaagcccttcct

SEQ ID NO: 168484 - DNA, 27 bp, Artificial Sequence
  Description of Artificial Sequence: Synthetic oligonucleotide
agggtggtcaggacaagcccttcctct

SEQ ID NO: 168485 - DNA, 25 bp, Artificial Sequence
  Description of Artificial Sequence: Synthetic oligonucleotide
aagcccttcctctctgcctggccca

SEQ ID NO: 168486 - DNA, 24 bp, Artificial Sequence
  Description of Artificial Sequence: Synthetic oligonucleotide
agcccttcctctctgcctggccca

SEQ ID NO: 168487 - DNA, 23 bp, Artificial Sequence
  Description of Artificial Sequence: Synthetic oligonucleotide
gcccttcctctctgcctggccca

SEQ ID NO: 168488 - DNA, 23 bp, Artificial Sequence
  Description of Artificial Sequence: Synthetic oligonucleotide
cccttcctctctgcctggcccag

SEQ ID NO: 168489 - DNA, 23 bp, Artificial Sequence
  Description of Artificial Sequence: Synthetic oligonucleotide
ccttcctctctgcctggcccagc

SEQ ID NO: 168490 - DNA, 23 bp, Artificial Sequence
  Description of Artificial Sequence: Synthetic oligonucleotide
cttcctctctgcctggcccagcc

SEQ ID NO: 168491 - DNA, 24 bp, Artificial Sequence
  Description of Artificial Sequence: Synthetic oligonucleotide
ttcctctctgcctggcccagccct

SEQ ID NO: 168492 - DNA, 23 bp, Artificial Sequence
  Description of Artificial Sequence: Synthetic oligonucleotide
tcctctctgcctggcccagccct

SEQ ID NO: 168493 - DNA, 22 bp, Artificial Sequence
  Description of Artificial Sequence: Synthetic oligonucleotide
cctctctgcctggcccagccct

SEQ ID NO: 168494 - DNA, 23 bp, Artificial Sequence
  Description of Artificial Sequence: Synthetic oligonucleotide
ctctctgcctggcccagccctgt

SEQ ID NO: 168495 - DNA, 23 bp, Artificial Sequence
  Description of Artificial Sequence: Synthetic oligonucleotide
tctctgcctggcccagccctgtg

SEQ ID NO: 168496 - DNA, 22 bp, Artificial Sequence
  Description of Artificial Sequence: Synthetic oligonucleotide
ctctgcctggcccagccctgtg

SEQ ID NO: 168497 - DNA, 23 bp, Artificial Sequence
  Description of Artificial Sequence: Synthetic oligonucleotide
tctgcctggcccagccctgtggt

SEQ ID NO: 168498 - DNA, 22 bp, Artificial Sequence
  Description of Artificial Sequence: Synthetic oligonucleotide
ctgcctggcccagccctgtggt

SEQ ID NO: 168499 - DNA, 23 bp, Artificial Sequence
  Description of Artificial Sequence: Synthetic oligonucleotide
tgcctggcccagccctgtggtgt

SEQ ID NO: 168500 - DNA, 22 bp, Artificial Sequence
  Description of Artificial Sequence: Synthetic oligonucleotide
gcctggcccagccctgtggtgt

SEQ ID NO: 168501 - DNA, 23 bp, Artificial Sequence
  Description of Artificial Sequence: Synthetic oligonucleotide
cctggcccagccctgtggtgtct

SEQ ID NO: 168502 - DNA, 25 bp, Artificial Sequence
  Description of Artificial Sequence: Synthetic oligonucleotide
ctggcccagccctgtggtgtctgaa

SEQ ID NO: 168503 - DNA, 25 bp, Artificial Sequence
  Description of Artificial Sequence: Synthetic oligonucleotide
tggcccagccctgtggtgtctgaag

SEQ ID NO: 168504 - DNA, 24 bp, Artificial Sequence
  Description of Artificial Sequence: Synthetic oligonucleotide
ggcccagccctgtggtgtctgaag

SEQ ID NO: 168505 - DNA, 25 bp, Artificial Sequence
  Description of Artificial Sequence: Synthetic oligonucleotide
gcccagccctgtggtgtctgaagga

SEQ ID NO: 168506 - DNA, 27 bp, Artificial Sequence
  Description of Artificial Sequence: Synthetic oligonucleotide
cccagccctgtggtgtctgaaggagaa

SEQ ID NO: 168507 - DNA, 27 bp, Artificial Sequence
  Description of Artificial Sequence: Synthetic oligonucleotide
ccagccctgtggtgtctgaaggagaac

SEQ ID NO: 168508 - DNA, 29 bp, Artificial Sequence
  Description of Artificial Sequence: Synthetic oligonucleotide
cagccctgtggtgtctgaaggagaacatg

SEQ ID NO: 168509 - DNA, 30 bp, Artificial Sequence
  Description of Artificial Sequence: Synthetic oligonucleotide
agccctgtggtgtctgaaggagaacatgtg

SEQ ID NO: 168510 - DNA, 29 bp, Artificial Sequence
  Description of Artificial Sequence: Synthetic oligonucleotide
gccctgtggtgtctgaaggagaacatgtg

SEQ ID NO: 168511 - DNA, 29 bp, Artificial Sequence
  Description of Artificial Sequence: Synthetic oligonucleotide
ccctgtggtgtctgaaggagaacatgtgg

SEQ ID NO: 168512 - DNA, 29 bp, Artificial Sequence
  Description of Artificial Sequence: Synthetic oligonucleotide
cctgtggtgtctgaaggagaacatgtggc

SEQ ID NO: 168513 - DNA, 30 bp, Artificial Sequence
  Description of Artificial Sequence: Synthetic oligonucleotide
ctgtggtgtctgaaggagaacatgtggctc

SEQ ID NO: 168514 - DNA, 32 bp, Artificial Sequence
  Description of Artificial Sequence: Synthetic oligonucleotide
tgtggtgtctgaaggagaacatgtggctcttc

SEQ ID NO: 168515 - DNA, 31 bp, Artificial Sequence
  Description of Artificial Sequence: Synthetic oligonucleotide
gtggtgtctgaaggagaacatgtggctcttc

SEQ ID NO: 168516 - DNA, 32 bp, Artificial Sequence
  Description of Artificial Sequence: Synthetic oligonucleotide
tggtgtctgaaggagaacatgtggctcttcag

SEQ ID NO: 168517 - DNA, 31 bp, Artificial Sequence
  Description of Artificial Sequence: Synthetic oligonucleotide
ggtgtctgaaggagaacatgtggctcttcag

SEQ ID NO: 168518 - DNA, 32 bp, Artificial Sequence
  Description of Artificial Sequence: Synthetic oligonucleotide
gtgtctgaaggagaacatgtggctcttcagtg

SEQ ID NO: 168519 - DNA, 33 bp, Artificial Sequence
  Description of Artificial Sequence: Synthetic oligonucleotide
tgtctgaaggagaacatgtggctcttcagtgtc

SEQ ID NO: 168520 - DNA, 32 bp, Artificial Sequence
  Description of Artificial Sequence: Synthetic oligonucleotide
gtctgaaggagaacatgtggctcttcagtgtc

SEQ ID NO: 168521 - DNA, 32 bp, Artificial Sequence
  Description of Artificial Sequence: Synthetic oligonucleotide
tctgaaggagaacatgtggctcttcagtgtcg

SEQ ID NO: 168522 - DNA, 31 bp, Artificial Sequence
  Description of Artificial Sequence: Synthetic oligonucleotide
ctgaaggagaacatgtggctcttcagtgtcg

SEQ ID NO: 168523 - DNA, 31 bp, Artificial Sequence
  Description of Artificial Sequence: Synthetic oligonucleotide
tgaaggagaacatgtggctcttcagtgtcgc

SEQ ID NO: 168524 - DNA, 30 bp, Artificial Sequence
  Description of Artificial Sequence: Synthetic oligonucleotide
gaaggagaacatgtggctcttcagtgtcgc

SEQ ID NO: 168525 - DNA, 31 bp, Artificial Sequence
  Description of Artificial Sequence: Synthetic oligonucleotide
aaggagaacatgtggctcttcagtgtcgctc

SEQ ID NO: 168526 - DNA, 30 bp, Artificial Sequence
  Description of Artificial Sequence: Synthetic oligonucleotide
aggagaacatgtggctcttcagtgtcgctc

SEQ ID NO: 168527 - DNA, 29 bp, Artificial Sequence
  Description of Artificial Sequence: Synthetic oligonucleotide
ggagaacatgtggctcttcagtgtcgctc

SEQ ID NO: 168528 - DNA, 30 bp, Artificial Sequence
  Description of Artificial Sequence: Synthetic oligonucleotide
gagaacatgtggctcttcagtgtcgctctc

SEQ ID NO: 168529 - DNA, 30 bp, Artificial Sequence
  Description of Artificial Sequence: Synthetic oligonucleotide
agaacatgtggctcttcagtgtcgctctcg

SEQ ID NO: 168530 - DNA, 29 bp, Artificial Sequence
  Description of Artificial Sequence: Synthetic oligonucleotide
gaacatgtggctcttcagtgtcgctctcg

SEQ ID NO: 168531 - DNA, 30 bp, Artificial Sequence
  Description of Artificial Sequence: Synthetic oligonucleotide
aacatgtggctcttcagtgtcgctctcgtc

SEQ ID NO: 168532 - DNA, 29 bp, Artificial Sequence
  Description of Artificial Sequence: Synthetic oligonucleotide
acatgtggctcttcagtgtcgctctcgtc

SEQ ID NO: 168533 - DNA, 28 bp, Artificial Sequence
  Description of Artificial Sequence: Synthetic oligonucleotide
catgtggctcttcagtgtcgctctcgtc

SEQ ID NO: 168534 - DNA, 30 bp, Artificial Sequence
  Description of Artificial Sequence: Synthetic oligonucleotide
atgtggctcttcagtgtcgctctcgtcttg

SEQ ID NO: 168535 - DNA, 29 bp, Artificial Sequence
  Description of Artificial Sequence: Synthetic oligonucleotide
tgtggctcttcagtgtcgctctcgtcttg

SEQ ID NO: 168536 - DNA, 28 bp, Artificial Sequence
  Description of Artificial Sequence: Synthetic oligonucleotide
gtggctcttcagtgtcgctctcgtcttg

SEQ ID NO: 168537 - DNA, 28 bp, Artificial Sequence
  Description of Artificial Sequence: Synthetic oligonucleotide
tggctcttcagtgtcgctctcgtcttgg

SEQ ID NO: 168538 - DNA, 27 bp, Artificial Sequence
  Description of Artificial Sequence: Synthetic oligonucleotide
ggctcttcagtgtcgctctcgtcttgg

SEQ ID NO: 168539 - DNA, 27 bp, Artificial Sequence
  Description of Artificial Sequence: Synthetic oligonucleotide
gctcttcagtgtcgctctcgtcttggg

SEQ ID NO: 168540 - DNA, 29 bp, Artificial Sequence
  Description of Artificial Sequence: Synthetic oligonucleotide
gatgcctgtccctgagctctacaacagag

SEQ ID NO: 168541 - DNA, 33 bp, Artificial Sequence
  Description of Artificial Sequence: Synthetic oligonucleotide
atgcctgtccctgagctctacaacagagtattc

SEQ ID NO: 168542 - DNA, 32 bp, Artificial Sequence
  Description of Artificial Sequence: Synthetic oligonucleotide
tgcctgtccctgagctctacaacagagtattc

SEQ ID NO: 168543 - DNA, 31 bp, Artificial Sequence
  Description of Artificial Sequence: Synthetic oligonucleotide
gcctgtccctgagctctacaacagagtattc

SEQ ID NO: 168544 - DNA, 31 bp, Artificial Sequence
  Description of Artificial Sequence: Synthetic oligonucleotide
cctgtccctgagctctacaacagagtattcc

SEQ ID NO: 168545 - DNA, 31 bp, Artificial Sequence
  Description of Artificial Sequence: Synthetic oligonucleotide
ctgtccctgagctctacaacagagtattccg

SEQ ID NO: 168546 - DNA, 34 bp, Artificial Sequence
  Description of Artificial Sequence: Synthetic oligonucleotide
tgtccctgagctctacaacagagtattccgaaac

SEQ ID NO: 168547 - DNA, 33 bp, Artificial Sequence
  Description of Artificial Sequence: Synthetic oligonucleotide
gtccctgagctctacaacagagtattccgaaac

SEQ ID NO: 168548 - DNA, 34 bp, Artificial Sequence
  Description of Artificial Sequence: Synthetic oligonucleotide
tccctgagctctacaacagagtattccgaaacac

SEQ ID NO: 168549 - DNA, 33 bp, Artificial Sequence
  Description of Artificial Sequence: Synthetic oligonucleotide
ccctgagctctacaacagagtattccgaaacac

SEQ ID NO: 168550 - DNA, 33 bp, Artificial Sequence
  Description of Artificial Sequence: Synthetic oligonucleotide
cctgagctctacaacagagtattccgaaacacc

SEQ ID NO: 168551 - DNA, 33 bp, Artificial Sequence
  Description of Artificial Sequence: Synthetic oligonucleotide
ctgagctctacaacagagtattccgaaacaccg

SEQ ID NO: 168552 - DNA, 37 bp, Artificial Sequence
  Description of Artificial Sequence: Synthetic oligonucleotide
tgagctctacaacagagtattccgaaacaccgttttc

SEQ ID NO: 168553 - DNA, 36 bp, Artificial Sequence
  Description of Artificial Sequence: Synthetic oligonucleotide
gagctctacaacagagtattccgaaacaccgttttc

SEQ ID NO: 168554 - DNA, 39 bp, Artificial Sequence
  Description of Artificial Sequence: Synthetic oligonucleotide
agctctacaacagagtattccgaaacaccgttttcatag

SEQ ID NO: 168555 - DNA, 38 bp, Artificial Sequence
  Description of Artificial Sequence: Synthetic oligonucleotide
gctctacaacagagtattccgaaacaccgttttcatag

SEQ ID NO: 168556 - DNA, 38 bp, Artificial Sequence
  Description of Artificial Sequence: Synthetic oligonucleotide
ctctacaacagagtattccgaaacaccgttttcatagg

SEQ ID NO: 168557 - DNA, 38 bp, Artificial Sequence
  Description of Artificial Sequence: Synthetic oligonucleotide
tctacaacagagtattccgaaacaccgttttcataggc

SEQ ID NO: 168558 - DNA, 37 bp, Artificial Sequence
  Description of Artificial Sequence: Synthetic oligonucleotide
ctacaacagagtattccgaaacaccgttttcataggc

SEQ ID NO: 168559 - DNA, 37 bp, Artificial Sequence
  Description of Artificial Sequence: Synthetic oligonucleotide
tacaacagagtattccgaaacaccgttttcataggcc
